United States Patent 7,250,496 (BIOINFORMATICALLY DETECTABLE GROUP OF NOVEL REGULATORY GENES AND USES THEREOF) - sequence listing, part 3

SEQ ID NO: 57821 - RNA, 21 nt, Human
ucuuugaaaaagucuuuacag

SEQ ID NO: 57822 - RNA, 21 nt, Human
ucuuuuuuucauauuuuccca

SEQ ID NO: 57823 - RNA, 22 nt, Human
ucuuuuuuucuguuuuacauga

SEQ ID NO: 57824 - RNA, 23 nt, Human
ugaaaaaugcuaauucaagaaaa

SEQ ID NO: 57825 - RNA, 20 nt, Human
ugaagaagaaucauagaaaa

SEQ ID NO: 57826 - RNA, 18 nt, Human
ugcagauauaaacaugcu

SEQ ID NO: 57827 - RNA, 18 nt, Human
ugccagcacacuccuucc

SEQ ID NO: 57828 - RNA, 18 nt, Human
ugccucucgcaaaacuug

SEQ ID NO: 57829 - RNA, 22 nt, Human
ugcuccuuucuucugaccucua

SEQ ID NO: 57830 - RNA, 21 nt, Human
uggaagcaggcagccuuucac

SEQ ID NO: 57831 - RNA, 22 nt, Human
uggaagggagacaauauuguuu

SEQ ID NO: 57832 - RNA, 22 nt, Human
uguauaauaucaaaggaaauau

SEQ ID NO: 57833 - RNA, 21 nt, Human
uguauguauacacaugcaagu

SEQ ID NO: 57834 - RNA, 20 nt, Human
uguauguauacacaugcagu

SEQ ID NO: 57835 - RNA, 26 nt, Human
ugucauaaccuuggacacuuacaggc

SEQ ID NO: 57836 - RNA, 21 nt, Human
ugucucuuuuaugagaggagg

SEQ ID NO: 57837 - RNA, 21 nt, Human
uguuugacucuuucccccuca

SEQ ID NO: 57838 - RNA, 21 nt, Human
uguuuguuugacucuuucccc

SEQ ID NO: 57839 - RNA, 22 nt, Human
uuaaaugaaaacaguugagaag

SEQ ID NO: 57840 - RNA, 25 nt, Human
uuauaauuauuuuauuuuuuauaga

SEQ ID NO: 57841 - RNA, 21 nt, Human
uucaagaaaggucaucaaaaa

SEQ ID NO: 57842 - RNA, 21 nt, Human
uucaccauucccuaaaauuua

SEQ ID NO: 57843 - RNA, 20 nt, Human
uucacucuuuuuuucuguuu

SEQ ID NO: 57844 - RNA, 23 nt, Human
uucuaaaaauauuuuuaaaauaa

SEQ ID NO: 57845 - RNA, 19 nt, Human
uugcuaccuugccaacaac

SEQ ID NO: 57846 - RNA, 18 nt, Human
uuguguguuuauuuuucc

SEQ ID NO: 57847 - RNA, 20 nt, Human
uuuaaaauaaugaaguuaca

SEQ ID NO: 57848 - RNA, 24 nt, Human
uuuagaaggagaggcuuaccugcu

SEQ ID NO: 57849 - RNA, 28 nt, Human
uuucccuuaaaugaaaacaguugagaaa

SEQ ID NO: 57850 - RNA, 26 nt, Human
uuugaaaaaugcuaauucaagaaagg

SEQ ID NO: 57851 - RNA, 19 nt, Human
uuugcagauauaaacaugc

SEQ ID NO: 57852 - RNA, 21 nt, Human
uuugcauagaaaccacaugaa

SEQ ID NO: 57853 - RNA, 28 nt, Human
uuuucccacuacaauuauuaaguggcua

SEQ ID NO: 57854 - RNA, 21 nt, Human
aagucuucucuuuccucuuuu

SEQ ID NO: 57855 - RNA, 20 nt, Human
accugguuuuuacugcugug

SEQ ID NO: 57856 - RNA, 20 nt, Human
acgcugccauggcugggucc

SEQ ID NO: 57857 - RNA, 19 nt, Human
agcuuuuacagagcagcuu

SEQ ID NO: 57858 - RNA, 20 nt, Human
agggcaaacacacguccaga

SEQ ID NO: 57859 - RNA, 21 nt, Human
caaacacacguccagaguccc

SEQ ID NO: 57860 - RNA, 25 nt, Human
caguaauaaaccagcaggguacccc

SEQ ID NO: 57861 - RNA, 19 nt, Human
caguccugcucacuuggga

SEQ ID NO: 57862 - RNA, 20 nt, Human
caguuccucagguggacugg

SEQ ID NO: 57863 - RNA, 21 nt, Human
ccagauccuacaguguuguuc

SEQ ID NO: 57864 - RNA, 25 nt, Human
cucuuuccucuuuuuccaguagcaa

SEQ ID NO: 57865 - RNA, 22 nt, Human
cugaaacgcagggcugcuacgc

SEQ ID NO: 57866 - RNA, 22 nt, Human
ggcugggaggagauaaacacca

SEQ ID NO: 57867 - RNA, 25 nt, Human
gggcaaacacacguccagagucccg

SEQ ID NO: 57868 - RNA, 24 nt, Human
uaaacugucagucugauucucagc

SEQ ID NO: 57869 - RNA, 29 nt, Human
ucaaugaaagucuucucuuuccucuuuuu

SEQ ID NO: 57870 - RNA, 18 nt, Human
ucacuugggagggcugug

SEQ ID NO: 57871 - RNA, 20 nt, Human
ucacuugggagggcuguguc

SEQ ID NO: 57872 - RNA, 21 nt, Human
uccagagucccgagcugcugc

SEQ ID NO: 57873 - RNA, 20 nt, Human
uccaggcaugcaguaaacug

SEQ ID NO: 57874 - RNA, 20 nt, Human
uccucagguggacugggaug

SEQ ID NO: 57875 - RNA, 21 nt, Human
ucuccaggcaugcaguaaacu

SEQ ID NO: 57876 - RNA, 27 nt, Human
ucucuuuccucuuuuuccaguagcaaa

SEQ ID NO: 57877 - RNA, 20 nt, Human
ucuugguugugacagcagcc

SEQ ID NO: 57878 - RNA, 27 nt, Human
ugagggcaaacacacguccagaguccc

SEQ ID NO: 57879 - RNA, 19 nt, Human
uggaagaggacacagugcg

SEQ ID NO: 57880 - RNA, 19 nt, Human
uggcuggguccgucaauga

SEQ ID NO: 57881 - RNA, 24 nt, Human
uggcuggguccgucaaugaaaguc

SEQ ID NO: 57882 - RNA, 18 nt, Human
ugguggaagaggacacag

SEQ ID NO: 57883 - RNA, 18 nt, Human
uguauaacauaaguguuc

SEQ ID NO: 57884 - RNA, 23 nt, Human
uguauuguauaacauaaguguuc

SEQ ID NO: 57885 - RNA, 22 nt, Human
uguucuguuuuccaguuauuua

SEQ ID NO: 57886 - RNA, 19 nt, Human
uuagcaaacuugagggcaa

SEQ ID NO: 57887 - RNA, 24 nt, Human
uuccaguagcaaaccugggguacc

SEQ ID NO: 57888 - RNA, 21 nt, Human
uucuugguugugacagcagcg

SEQ ID NO: 57889 - RNA, 24 nt, Human
uugguugugacagcagcgucugua

SEQ ID NO: 57890 - RNA, 19 nt, Human
uuuacagagcagcuuucac

SEQ ID NO: 57891 - RNA, 21 nt, Human
uuuacugcuguguucucucca

SEQ ID NO: 57892 - RNA, 19 nt, Human
uuugaaaauaguucgagac

SEQ ID NO: 57893 - RNA, 22 nt, Human
agacggaggggaguuggggggc

SEQ ID NO: 57894 - RNA, 20 nt, Human
agccucuggcacagcugcuc

SEQ ID NO: 57895 - RNA, 20 nt, Human
aggcgguggcacagugucuu

SEQ ID NO: 57896 - RNA, 20 nt, Human
agggagagaagaggggcgag

SEQ ID NO: 57897 - RNA, 19 nt, Human
agggggagggagagaagag

SEQ ID NO: 57898 - RNA, 20 nt, Human
agggggagggagagaagagg

SEQ ID NO: 57899 - RNA, 18 nt, Human
cagagcccuaggggcugu

SEQ ID NO: 57900 - RNA, 20 nt, Human
caggcagggagccccugaag

SEQ ID NO: 57901 - RNA, 19 nt, Human
caggcuugccugcagcugc

SEQ ID NO: 57902 - RNA, 21 nt, Human
cagugucuugcaucugggucc

SEQ ID NO: 57903 - RNA, 20 nt, Human
caucuggguccagguugucc

SEQ ID NO: 57904 - RNA, 19 nt, Human
ccccugaagggggagggag

SEQ ID NO: 57905 - RNA, 20 nt, Human
cccuaggggcugugccuggg

SEQ ID NO: 57906 - RNA, 21 nt, Human
cccucaggcagggagccccug

SEQ ID NO: 57907 - RNA, 23 nt, Human
cccugaagggggagggagagaag

SEQ ID NO: 57908 - RNA, 18 nt, Human
cuacaucagagggauggg

SEQ ID NO: 57909 - RNA, 25 nt, Human
cugaagaugugucaauggcgaggga

SEQ ID NO: 57910 - RNA, 22 nt, Human
cuggcucaggaagcccagggug

SEQ ID NO: 57911 - RNA, 24 nt, Human
cugggucaaggagggcuggcucag

SEQ ID NO: 57912 - RNA, 21 nt, Human
gaacacccuccaugucacaga

SEQ ID NO: 57913 - RNA, 24 nt, Human
gaagggggagggagagaagagggg

SEQ ID NO: 57914 - RNA, 19 nt, Human
gcccauucaagguacugug

SEQ ID NO: 57915 - RNA, 19 nt, Human
gccccugaagggggaggga

SEQ ID NO: 57916 - RNA, 21 nt, Human
gcgguggcacagugucuugca

SEQ ID NO: 57917 - RNA, 18 nt, Human
ggcucaggaagcccaggg

SEQ ID NO: 57918 - RNA, 24 nt, Human
ggggagggagagaagaggggcgag

SEQ ID NO: 57919 - RNA, 19 nt, Human
gggggagggagagaagagg

SEQ ID NO: 57920 - RNA, 19 nt, Human
gggugucagggaaggcggu

SEQ ID NO: 57921 - RNA, 20 nt, Human
ggucaaggagggcuggcuca

SEQ ID NO: 57922 - RNA, 24 nt, Human
uacaucagagggaugggccccgaa

SEQ ID NO: 57923 - RNA, 21 nt, Human
ucacagacggaggggaguugg

SEQ ID NO: 57924 - RNA, 21 nt, Human
uccagccucuggcacagcugc

SEQ ID NO: 57925 - RNA, 23 nt, Human
ucugcucagagcccuaggggcug

SEQ ID NO: 57926 - RNA, 21 nt, Human
ugccugggauguccugcugca

SEQ ID NO: 57927 - RNA, 22 nt, Human
ugccugggauguccugcugcag

SEQ ID NO: 57928 - RNA, 18 nt, Human
ugcucagagcccuagggg

SEQ ID NO: 57929 - RNA, 18 nt, Human
uggccaggcuugccugca

SEQ ID NO: 57930 - RNA, 20 nt, Human
uggccaggcuugccugcaga

SEQ ID NO: 57931 - RNA, 18 nt, Human
ugggauguccugcugcag

SEQ ID NO: 57932 - RNA, 20 nt, Human
ugggauguccugcugcagcc

SEQ ID NO: 57933 - RNA, 19 nt, Human
ugucagggaaggcgguggc

SEQ ID NO: 57934 - RNA, 18 nt, Human
uuuuuuuuuuuuuuuuug

SEQ ID NO: 57935 - RNA, 20 nt, Human
uuuuuuuuuuuuuuuuuggu

SEQ ID NO: 57936 - RNA, 19 nt, Human
uaccagauuauuagaccac

SEQ ID NO: 57937 - RNA, 23 nt, Human
uuaacuuggaaugagguuaaugu

SEQ ID NO: 57938 - RNA, 20 nt, Human
aaaaaaaccccaaaaccaaa

SEQ ID NO: 57939 - RNA, 20 nt, Human
aaaaaaaccccaaaaccaaa

SEQ ID NO: 57940 - RNA, 21 nt, Human
aaaaaccccaaaaccaaaacc

SEQ ID NO: 57941 - RNA, 21 nt, Human
aaaaaccccaaaaccaaaacc

SEQ ID NO: 57942 - RNA, 21 nt, Human
aaaaaccccaaaaccaaaacc

SEQ ID NO: 57943 - RNA, 21 nt, Human
aaaaaccccaaaaccaaaacc

SEQ ID NO: 57944 - RNA, 21 nt, Human
aaaaagcccucauucacuuuu

SEQ ID NO: 57945 - RNA, 21 nt, Human
aaaaagcccucauucacuuuu

SEQ ID NO: 57946 - RNA, 21 nt, Human
aaaaagcccucauucacuuuu

SEQ ID NO: 57947 - RNA, 21 nt, Human
aaaaagcccucauucacuuuu

SEQ ID NO: 57948 - RNA, 21 nt, Human
aaaacccauccccagccacaa

SEQ ID NO: 57949 - RNA, 21 nt, Human
aaaacccauccccagccacaa

SEQ ID NO: 57950 - RNA, 21 nt, Human
aaaacccauccccagccacaa

SEQ ID NO: 57951 - RNA, 22 nt, Human
aaagcagccccacccccggccg

SEQ ID NO: 57952 - RNA, 22 nt, Human
aaagcagccccacccccggccg

SEQ ID NO: 57953 - RNA, 18 nt, Human
aacagccucgagccuggc

SEQ ID NO: 57954 - RNA, 18 nt, Human
aacagccucgagccuggc

SEQ ID NO: 57955 - RNA, 20 nt, Human
aaccaaaacccauccccagc

SEQ ID NO: 57956 - RNA, 20 nt, Human
aaccaaaacccauccccagc

SEQ ID NO: 57957 - RNA, 20 nt, Human
aaccaaaacccauccccagc

SEQ ID NO: 57958 - RNA, 20 nt, Human
aaccaaaacccauccccagc

SEQ ID NO: 57959 - RNA, 22 nt, Human
aagcaaaagcagccccaccccc

SEQ ID NO: 57960 - RNA, 22 nt, Human
aagcaaaagcagccccaccccc

SEQ ID NO: 57961 - RNA, 20 nt, Human
aagcagccccacccccggcc

SEQ ID NO: 57962 - RNA, 20 nt, Human
aagcagccccacccccggcc

SEQ ID NO: 57963 - RNA, 22 nt, Human
aagcagccccacccccggccga

SEQ ID NO: 57964 - RNA, 22 nt, Human
aagcagccccacccccggccga

SEQ ID NO: 57965 - RNA, 24 nt, Human
aagcagcccgcccaagugcccuuc

SEQ ID NO: 57966 - RNA, 19 nt, Human
accagcccgguccucuggc

SEQ ID NO: 57967 - RNA, 22 nt, Human
accgaaucggucccagccgcgc

SEQ ID NO: 57968 - RNA, 22 nt, Human
accgaaucggucccagccgcgc

SEQ ID NO: 57969 - RNA, 25 nt, Human
acgcagccucggggaaagggaacgc

SEQ ID NO: 57970 - RNA, 25 nt, Human
acgcagccucggggaaagggaacgc

SEQ ID NO: 57971 - RNA, 18 nt, Human
acucccgcagagcggcgg

SEQ ID NO: 57972 - RNA, 22 nt, Human
agagacaacauaaaaaauucca

SEQ ID NO: 57973 - RNA, 23 nt, Human
agagacaacauaaaaaauuccaa

SEQ ID NO: 57974 - RNA, 21 nt, Human
agagagacaacauaaaaaauu

SEQ ID NO: 57975 - RNA, 21 nt, Human
agagagacaacauaaaaaauu

SEQ ID NO: 57976 - RNA, 22 nt, Human
agccacaaaaagcccucauuca

SEQ ID NO: 57977 - RNA, 22 nt, Human
agccacaaaaagcccucauuca

SEQ ID NO: 57978 - RNA, 22 nt, Human
agccacaaaaagcccucauuca

SEQ ID NO: 57979 - RNA, 22 nt, Human
agccacaaaaagcccucauuca

SEQ ID NO: 57980 - RNA, 20 nt, Human
agcccgcccaagugcccuuc

SEQ ID NO: 57981 - RNA, 22 nt, Human
agcccgcccaagugcccuucug

SEQ ID NO: 57982 - RNA, 23 nt, Human
aggaagcaaaagcagccccaccc

SEQ ID NO: 57983 - RNA, 23 nt, Human
aggaagcaaaagcagccccaccc

SEQ ID NO: 57984 - RNA, 18 nt, Human
aggagcagcuggggcugg

SEQ ID NO: 57985 - RNA, 23 nt, Human
aggagcugcgcugucaggcucug

SEQ ID NO: 57986 - RNA, 23 nt, Human
aggagcugcgcugucaggcucug

SEQ ID NO: 57987 - RNA, 24 nt, Human
aggcaggacagggaacagccucga

SEQ ID NO: 57988 - RNA, 24 nt, Human
aggcaggacagggaacagccucga

SEQ ID NO: 57989 - RNA, 21 nt, Human
aggccccgcggccaggacccu

SEQ ID NO: 57990 - RNA, 21 nt, Human
aggccccgcggccaggacccu

SEQ ID NO: 57991 - RNA, 24 nt, Human
aggcccggagcuagagcuuccucu

SEQ ID NO: 57992 - RNA, 24 nt, Human
aggcccggagcuagagcuuccucu

SEQ ID NO: 57993 - RNA, 20 nt, Human
aggccgccccggggccugcc

SEQ ID NO: 57994 - RNA, 20 nt, Human
aggccgccccggggccugcc

SEQ ID NO: 57995 - RNA, 31 nt, Human
aggcgaguggugugugugugugugugugugg

SEQ ID NO: 57996 - RNA, 21 nt, Human
aggggcugggcagaggggagg

SEQ ID NO: 57997 - RNA, 21 nt, Human
aggggcugggcagaggggagg

SEQ ID NO: 57998 - RNA, 24 nt, Human
aggugccaaagcggagucuggagc

SEQ ID NO: 57999 - RNA, 24 nt, Human
aggugccaaagcggagucuggagc

SEQ ID NO: 58000 - RNA, 23 nt, Human
agugugugggguucagggguugg

SEQ ID NO: 58001 - RNA, 20 nt, Human
aguuuucuuuuuuuuuuuuu

SEQ ID NO: 58002 - RNA, 22 nt, Human
aucagcugucauugcaagaggc

SEQ ID NO: 58003 - RNA, 22 nt, Human
aucagcugucauugcaagaggc

SEQ ID NO: 58004 - RNA, 22 nt, Human
aucagcugucauugcaagaggc

SEQ ID NO: 58005 - RNA, 19 nt, Human
auggcagaguguguggggu

SEQ ID NO: 58006 - RNA, 20 nt, Human
caaaaccaaaacccaucccc

SEQ ID NO: 58007 - RNA, 20 nt, Human
caaaaccaaaacccaucccc

SEQ ID NO: 58008 - RNA, 20 nt, Human
caaaaccaaaacccaucccc

SEQ ID NO: 58009 - RNA, 20 nt, Human
caaaaccaaaacccaucccc

SEQ ID NO: 58010 - RNA, 20 nt, Human
caaaacccauccccagccac

SEQ ID NO: 58011 - RNA, 20 nt, Human
caaaacccauccccagccac

SEQ ID NO: 58012 - RNA, 20 nt, Human
caaaacccauccccagccac

SEQ ID NO: 58013 - RNA, 20 nt, Human
caaaacccauccccagccac

SEQ ID NO: 58014 - RNA, 20 nt, Human
caaaagcagccccacccccc

SEQ ID NO: 58015 - RNA, 20 nt, Human
caaaagcagccccacccccc

SEQ ID NO: 58016 - RNA, 24 nt, Human
caauuuauccacagcuucagaagu

SEQ ID NO: 58017 - RNA, 24 nt, Human
caauuuauccacagcuucagaagu

SEQ ID NO: 58018 - RNA, 19 nt, Human
cacagcuccuucuccugca

SEQ ID NO: 58019 - RNA, 19 nt, Human
cacagcuccuucuccugca

SEQ ID NO: 58020 - RNA, 21 nt, Human
cacagcuccuucuccugcagc

SEQ ID NO: 58021 - RNA, 21 nt, Human
cacagcuccuucuccugcagc

SEQ ID NO: 58022 - RNA, 23 nt, Human
cacagcuccuucuccugcagccg

SEQ ID NO: 58023 - RNA, 23 nt, Human
cacagcuccuucuccugcagccg

SEQ ID NO: 58024 - RNA, 22 nt, Human
caccacggggggccugccucuc

SEQ ID NO: 58025 - RNA, 20 nt, Human
caccagcccgguccucuggc

SEQ ID NO: 58026 - RNA, 22 nt, Human
caccgaggcgaggaacugccag

SEQ ID NO: 58027 - RNA, 22 nt, Human
caccgaggcgaggaacugccag

SEQ ID NO: 58028 - RNA, 22 nt, Human
caccggccugucccccaacuga

SEQ ID NO: 58029 - RNA, 22 nt, Human
caccggccugucccccaacuga

SEQ ID NO: 58030 - RNA, 19 nt, Human
caccugcacccaggguccc

SEQ ID NO: 58031 - RNA, 19 nt, Human
caccugcacccaggguccc

SEQ ID NO: 58032 - RNA, 19 nt, Human
cacucccgcagagcggcgg

SEQ ID NO: 58033 - RNA, 19 nt, Human
cagccacaaaaagcccuca

SEQ ID NO: 58034 - RNA, 19 nt, Human
cagccacaaaaagcccuca

SEQ ID NO: 58035 - RNA, 19 nt, Human
cagccacaaaaagcccuca

SEQ ID NO: 58036 - RNA, 19 nt, Human
cagccacaaaaagcccuca

SEQ ID NO: 58037 - RNA, 18 nt, Human
cagccaccggccuguccc

SEQ ID NO: 58038 - RNA, 18 nt, Human
cagccaccggccuguccc

SEQ ID NO: 58039 - RNA, 20 nt, Human
cagccaccggccuguccccc

SEQ ID NO: 58040 - RNA, 18 nt, Human
cagccguccgggcucgcc

SEQ ID NO: 58041 - RNA, 18 nt, Human
cagccguccgggcucgcc

SEQ ID NO: 58042 - RNA, 21 nt, Human
cagcgaccugggagaggaagg

SEQ ID NO: 58043 - RNA, 21 nt, Human
cagcgaccugggagaggaagg

SEQ ID NO: 58044 - RNA, 19 nt, Human
cagcuccuccgacgcagcc

SEQ ID NO: 58045 - RNA, 19 nt, Human
cagcuccuccgacgcagcc

SEQ ID NO: 58046 - RNA, 22 nt, Human
cagcugucugucuccuuccugc

SEQ ID NO: 58047 - RNA, 22 nt, Human
cagcugucugucuccuuccugc

SEQ ID NO: 58048 - RNA, 18 nt, Human
caggccccgcggccaggg

SEQ ID NO: 58049 - RNA, 18 nt, Human
caggccccgcggccaggg

SEQ ID NO: 58050 - RNA, 21 nt, Human
cagggaacagccucgagccuu

SEQ ID NO: 58051 - RNA, 21 nt, Human
cagggaacagccucgagccuu

SEQ ID NO: 58052 - RNA, 22 nt, Human
cauugguucggcuggugaaggg

SEQ ID NO: 58053 - RNA, 20 nt, Human
ccaaaaccaaaacccauccc

SEQ ID NO: 58054 - RNA, 20 nt, Human
ccaaaaccaaaacccauccc

SEQ ID NO: 58055 - RNA, 20 nt, Human
ccaaaaccaaaacccauccc

SEQ ID NO: 58056 - RNA, 20 nt, Human
ccaaaaccaaaacccauccc

SEQ ID NO: 58057 - RNA, 22 nt, Human
ccaaaaccaaaacccaucccca

SEQ ID NO: 58058 - RNA, 22 nt, Human
ccaaaaccaaaacccaucccca

SEQ ID NO: 58059 - RNA, 22 nt, Human
ccaaaaccaaaacccaucccca

SEQ ID NO: 58060 - RNA, 22 nt, Human
ccaaaaccaaaacccaucccca

SEQ ID NO: 58061 - RNA, 24 nt, Human
ccaaaaccaaaacccauccccagc

SEQ ID NO: 58062 - RNA, 24 nt, Human
ccaaaaccaaaacccauccccagc

SEQ ID NO: 58063 - RNA, 24 nt, Human
ccaaaaccaaaacccauccccagc

SEQ ID NO: 58064 - RNA, 24 nt, Human
ccaaaaccaaaacccauccccagc

SEQ ID NO: 58065 - RNA, 20 nt, Human
ccacccccggccgacaaggc

SEQ ID NO: 58066 - RNA, 20 nt, Human
ccacccccggccgacaaggc

SEQ ID NO: 58067 - RNA, 24 nt, Human
ccaggacaccgaauggcccucucu

SEQ ID NO: 58068 - RNA, 28 nt, Human
cccaaaaccaaaacccauccccagccac

SEQ ID NO: 58069 - RNA, 28 nt, Human
cccaaaaccaaaacccauccccagccac

SEQ ID NO: 58070 - RNA, 28 nt, Human
cccaaaaccaaaacccauccccagccac

SEQ ID NO: 58071 - RNA, 28 nt, Human
cccaaaaccaaaacccauccccagccac

SEQ ID NO: 58072 - RNA, 20 nt, Human
cccaccacggggggccugcc

SEQ ID NO: 58073 - RNA, 19 nt, Human
cccagaggaaugugugcac

SEQ ID NO: 58074 - RNA, 19 nt, Human
cccagaggaaugugugcac

SEQ ID NO: 58075 - RNA, 19 nt, Human
cccagaggaaugugugcac

SEQ ID NO: 58076 - RNA, 19 nt, Human
cccagaggaaugugugcac

SEQ ID NO: 58077 - RNA, 21 nt, Human
cccagcagccaggcucugccc

SEQ ID NO: 58078 - RNA, 20 nt, Human
cccagccacaaaaagcccuc

SEQ ID NO: 58079 - RNA, 21 nt, Human
cccagccacaaaaagcccuca

SEQ ID NO: 58080 - RNA, 21 nt, Human
cccagccacaaaaagcccuca

SEQ ID NO: 58081 - RNA, 21 nt, Human
cccagccacaaaaagcccuca

SEQ ID NO: 58082 - RNA, 21 nt, Human
cccagccacaaaaagcccuca

SEQ ID NO: 58083 - RNA, 24 nt, Human
cccagccugcaggcugccuggacu

SEQ ID NO: 58084 - RNA, 24 nt, Human
cccagccugcaggcugccuggacu

SEQ ID NO: 58085 - RNA, 21 nt, Human
ccccaaaaccaaaacccaucc

SEQ ID NO: 58086 - RNA, 21 nt, Human
ccccaaaaccaaaacccaucc

SEQ ID NO: 58087 - RNA, 21 nt, Human
ccccaaaaccaaaacccaucc

SEQ ID NO: 58088 - RNA, 21 nt, Human
ccccaaaaccaaaacccaucc

SEQ ID NO: 58089 - RNA, 23 nt, Human
ccccaaaaccaaaacccaucccc

SEQ ID NO: 58090 - RNA, 23 nt, Human
ccccaaaaccaaaacccaucccc

SEQ ID NO: 58091 - RNA, 23 nt, Human
ccccaaaaccaaaacccaucccc

SEQ ID NO: 58092 - RNA, 23 nt, Human
ccccaaaaccaaaacccaucccc

SEQ ID NO: 58093 - RNA, 24 nt, Human
ccccaaaaccaaaacccaucccca

SEQ ID NO: 58094 - RNA, 24 nt, Human
ccccaaaaccaaaacccaucccca

SEQ ID NO: 58095 - RNA, 24 nt, Human
ccccaaaaccaaaacccaucccca

SEQ ID NO: 58096 - RNA, 24 nt, Human
ccccaaaaccaaaacccaucccca

SEQ ID NO: 58097 - RNA, 26 nt, Human
ccccagggaccccuugcauucccccu

SEQ ID NO: 58098 - RNA, 18 nt, Human
ccccccugccguggcccc

SEQ ID NO: 58099 - RNA, 18 nt, Human
ccccccugccguggcccc

SEQ ID NO: 58100 - RNA, 23 nt, Human
ccccggggccugccuggccgggg

SEQ ID NO: 58101 - RNA, 23 nt, Human
ccccggggccugccuggccgggg

SEQ ID NO: 58102 - RNA, 19 nt, Human
ccccugagucccccaggga

SEQ ID NO: 58103 - RNA, 20 nt, Human
ccccugagucccccagggac

SEQ ID NO: 58104 - RNA, 19 nt, Human
ccccuggcucgccucucca

SEQ ID NO: 58105 - RNA, 19 nt, Human
ccccuggcucgccucucca

SEQ ID NO: 58106 - RNA, 19 nt, Human
cccucucucuccccgcuuc

SEQ ID NO: 58107 - RNA, 19 nt, Human
cccucucucuccccgcuuc

SEQ ID NO: 58108 - RNA, 19 nt, Human
cccucucucuccccgcuuc

SEQ ID NO: 58109 - RNA, 19 nt, Human
cccucucucuccccgcuuc

SEQ ID NO: 58110 - RNA, 19 nt, Human
cccugagucccccagggac

SEQ ID NO: 58111 - RNA, 21 nt, Human
cccugagucccccagggaccc

SEQ ID NO: 58112 - RNA, 19 nt, Human
cccugggugguccugacuu

SEQ ID NO: 58113 - RNA, 19 nt, Human
cccugggugguccugacuu

SEQ ID NO: 58114 - RNA, 25 nt, Human
ccgacucuacucucaccggccaugc

SEQ ID NO: 58115 - RNA, 25 nt, Human
ccgacucuacucucaccggccaugc

SEQ ID NO: 58116 - RNA, 22 nt, Human
ccgggccgggguggccucuggc

SEQ ID NO: 58117 - RNA, 22 nt, Human
ccgggccgggguggccucuggc

SEQ ID NO: 58118 - RNA, 21 nt, Human
ccguccacaccgcggcuccag

SEQ ID NO: 58119 - RNA, 21 nt, Human
ccguccacaccgcggcuccag

SEQ ID NO: 58120 - RNA, 23 nt, Human
ccguggcccccgggaugggggag

SEQ ID NO: 58121 - RNA, 23 nt, Human
ccguggcccccgggaugggggag

SEQ ID NO: 58122 - RNA, 19 nt, Human
ccuacuccuuuccuuccuc

SEQ ID NO: 58123 - RNA, 19 nt, Human
ccuacuccuuuccuuccuc

SEQ ID NO: 58124 - RNA, 21 nt, Human
ccucccugauggcaccgaggc

SEQ ID NO: 58125 - RNA, 22 nt, Human
ccucccugauggcaccgaggcg

SEQ ID NO: 58126 - RNA, 25 nt, Human
ccucuggcagccagguccccggccc

SEQ ID NO: 58127 - RNA, 19 nt, Human
ccucugggcguccaggcuc

SEQ ID NO: 58128 - RNA, 19 nt, Human
ccucugggcguccaggcuc

SEQ ID NO: 58129 - RNA, 19 nt, Human
ccucuuucacugaaagaca

SEQ ID NO: 58130 - RNA, 27 nt, Human
ccugcccgccccucuaaaggaagcaaa

SEQ ID NO: 58131 - RNA, 27 nt, Human
ccugcccgccccucuaaaggaagcaaa

SEQ ID NO: 58132 - RNA, 19 nt, Human
ccuggcccugggggcgccc

SEQ ID NO: 58133 - RNA, 19 nt, Human
ccuggcccugggggcgccc

SEQ ID NO: 58134 - RNA, 19 nt, Human
ccugugugcauggcagagu

SEQ ID NO: 58135 - RNA, 19 nt, Human
ccugugugcauggcagagu

SEQ ID NO: 58136 - RNA, 19 nt, Human
cgagaggagccagcccugu

SEQ ID NO: 58137 - RNA, 19 nt, Human
cgagaggagccagcccugu

SEQ ID NO: 58138 - RNA, 19 nt, Human
cgagaggagccagcccugu

SEQ ID NO: 58139 - RNA, 21 nt, Human
cgagccuggcaccugcaccca

SEQ ID NO: 58140 - RNA, 21 nt, Human
cgcccaagugcccuucugccc

SEQ ID NO: 58141 - RNA, 19 nt, Human
cgccgaagggccuuggggg

SEQ ID NO: 58142 - RNA, 20 nt, Human
cggccccccugccguggccc

SEQ ID NO: 58143 - RNA, 22 nt, Human
cggccccccugccguggccccc

SEQ ID NO: 58144 - RNA, 21 nt, Human
cggccucugggcguccaggcu

SEQ ID NO: 58145 - RNA, 21 nt, Human
cggccucugggcguccaggcu

SEQ ID NO: 58146 - RNA, 21 nt, Human
cggcuggugaagggagaaugg

SEQ ID NO: 58147 - RNA, 21 nt, Human
cggcuggugaagggagaaugg

SEQ ID NO: 58148 - RNA, 21 nt, Human
cuacagucagucauucaugcc

SEQ ID NO: 58149 - RNA, 21 nt, Human
cuacagucagucauucaugcc

SEQ ID NO: 58150 - RNA, 21 nt, Human
cuacagucagucauucaugcc

SEQ ID NO: 58151 - RNA, 21 nt, Human
cuacagucagucauucaugcc

SEQ ID NO: 58152 - RNA, 21 nt, Human
cuccaggggcgagaggagcca

SEQ ID NO: 58153 - RNA, 21 nt, Human
cuccaggggcgagaggagcca

SEQ ID NO: 58154 - RNA, 18 nt, Human
cuccccgcuucuugcugc

SEQ ID NO: 58155 - RNA, 18 nt, Human
cuccccgcuucuugcugc

SEQ ID NO: 58156 - RNA, 18 nt, Human
cuccccgcuucuugcugc

SEQ ID NO: 58157 - RNA, 18 nt, Human
cuccccgcuucuugcugc

SEQ ID NO: 58158 - RNA, 21 nt, Human
cucccugcccgccccucuaaa

SEQ ID NO: 58159 - RNA, 21 nt, Human
cucccugcccgccccucuaaa

SEQ ID NO: 58160 - RNA, 19 nt, Human
cuccuucuccugcagccgc

SEQ ID NO: 58161 - RNA, 19 nt, Human
cuccuucuccugcagccgc

SEQ ID NO: 58162 - RNA, 23 nt, Human
cucgagccuggcaccugcaccca

SEQ ID NO: 58163 - RNA, 23 nt, Human
cucgagccuggcaccugcaccca

SEQ ID NO: 58164 - RNA, 22 nt, Human
cucuauggacaugcuggugcaa

SEQ ID NO: 58165 - RNA, 19 nt, Human
cucucccugcccgccccuc

SEQ ID NO: 58166 - RNA, 19 nt, Human
cucucccugcccgccccuc

SEQ ID NO: 58167 - RNA, 24 nt, Human
cucugggagacccugggugguccu

SEQ ID NO: 58168 - RNA, 24 nt, Human
cucugggagacccugggugguccu

SEQ ID NO: 58169 - RNA, 21 nt, Human
cugcacccaggguccccagcc

SEQ ID NO: 58170 - RNA, 21 nt, Human
cugcacccaggguccccagcc

SEQ ID NO: 58171 - RNA, 24 nt, Human
cuucuaagaccuggcagauacauu

SEQ ID NO: 58172 - RNA, 24 nt, Human
cuucuaagaccuggcagauacauu

SEQ ID NO: 58173 - RNA, 25 nt, Human
cuucucuauggacaugcuggugcaa

SEQ ID NO: 58174 - RNA, 18 nt, Human
cuuuuguguccugguucc

SEQ ID NO: 58175 - RNA, 18 nt, Human
cuuuuguguccugguucc

SEQ ID NO: 58176 - RNA, 18 nt, Human
cuuuuguguccugguucc

SEQ ID NO: 58177 - RNA, 18 nt, Human
cuuuuguguccugguucc

SEQ ID NO: 58178 - RNA, 23 nt, Human
gaacacggacuaugauauagugc

SEQ ID NO: 58179 - RNA, 23 nt, Human
gaacacggacuaugauauagugc

SEQ ID NO: 58180 - RNA, 21 nt, Human
gacagaugagguugggaaaaa

SEQ ID NO: 58181 - RNA, 21 nt, Human
gacagaugagguugggaaaaa

SEQ ID NO: 58182 - RNA, 21 nt, Human
gacagaugagguugggaaaaa

SEQ ID NO: 58183 - RNA, 21 nt, Human
gacagaugagguugggaaaaa

SEQ ID NO: 58184 - RNA, 19 nt, Human
gacccuuucagaugggguc

SEQ ID NO: 58185 - RNA, 19 nt, Human
gacccuuucagaugggguc

SEQ ID NO: 58186 - RNA, 18 nt, Human
gagaggagccagcccugu

SEQ ID NO: 58187 - RNA, 20 nt, Human
gagccuggcaccugcaccca

SEQ ID NO: 58188 - RNA, 20 nt, Human
gagcugcgggguccgcgggg

SEQ ID NO: 58189 - RNA, 20 nt, Human
gagcugcgggguccgcgggg

SEQ ID NO: 58190 - RNA, 21 nt, Human
gagcugcgggguccgcggggg

SEQ ID NO: 58191 - RNA, 21 nt, Human
gagcugcgggguccgcggggg

SEQ ID NO: 58192 - RNA, 18 nt, Human
gagcuuccucucccugcc

SEQ ID NO: 58193 - RNA, 18 nt, Human
gaggaggagcagcugggg

SEQ ID NO: 58194 - RNA, 20 nt, Human
gaggaggagcagcuggggcu

SEQ ID NO: 58195 - RNA, 23 nt, Human
gauucaguggaggcgaguggugu

SEQ ID NO: 58196 - RNA, 23 nt, Human
gauucaguggaggcgaguggugu

SEQ ID NO: 58197 - RNA, 18 nt, Human
gcccagcagccaggcucu

SEQ ID NO: 58198 - RNA, 18 nt, Human
gccccccugccguggccc

SEQ ID NO: 58199 - RNA, 21 nt, Human
gcccgcccaagugcccuucug

SEQ ID NO: 58200 - RNA, 26 nt, Human
gcccuacuccuuuccuuccucuuuca

SEQ ID NO: 58201 - RNA, 26 nt, Human
gcccuacuccuuuccuuccucuuuca

SEQ ID NO: 58202 - RNA, 18 nt, Human
gcccugucucucucuccu

SEQ ID NO: 58203 - RNA, 18 nt, Human
gcccugucucucucuccu

SEQ ID NO: 58204 - RNA, 19 nt, Human
gcccugucucucucuccug

SEQ ID NO: 58205 - RNA, 19 nt, Human
gcccugucucucucuccug

SEQ ID NO: 58206 - RNA, 21 nt, Human
gccuggccccggccucugggc

SEQ ID NO: 58207 - RNA, 21 nt, Human
gccuggccccggccucugggc

SEQ ID NO: 58208 - RNA, 19 nt, Human
gcgagaggagccagcccug

SEQ ID NO: 58209 - RNA, 19 nt, Human
gcgagaggagccagcccug

SEQ ID NO: 58210 - RNA, 22 nt, Human
ggaagcagggccccucuccgcu

SEQ ID NO: 58211 - RNA, 22 nt, Human
ggaagcagggccccucuccgcu

SEQ ID NO: 58212 - RNA, 19 nt, Human
ggaccccugagucccccag

SEQ ID NO: 58213 - RNA, 28 nt, Human
ggaccccugagucccccagggaccccuu

SEQ ID NO: 58214 - RNA, 21 nt, Human
ggagacccugggugguccuga

SEQ ID NO: 58215 - RNA, 21 nt, Human
ggagacccugggugguccuga

SEQ ID NO: 58216 - RNA, 19 nt, Human
ggagcgugcagccaugcca

SEQ ID NO: 58217 - RNA, 19 nt, Human
ggagcgugcagccaugcca

SEQ ID NO: 58218 - RNA, 21 nt, Human
ggagguauguggguuggggag

SEQ ID NO: 58219 - RNA, 21 nt, Human
ggagguauguggguuggggag

SEQ ID NO: 58220 - RNA, 21 nt, Human
ggccccccugccguggccccc

SEQ ID NO: 58221 - RNA, 21 nt, Human
ggcuggugaagggagaauggu

SEQ ID NO: 58222 - RNA, 21 nt, Human
ggcuggugaagggagaauggu

SEQ ID NO: 58223 - RNA, 21 nt, Human
gggcuugaggaggagcagcug

SEQ ID NO: 58224 - RNA, 19 nt, Human
ggggaggcacugaggcagg

SEQ ID NO: 58225 - RNA, 21 nt, Human
ggggcuacuggguuggcugca

SEQ ID NO: 58226 - RNA, 21 nt, Human
ggggcuacuggguuggcugca

SEQ ID NO: 58227 - RNA, 21 nt, Human
ggguggccucuggcggagacg

SEQ ID NO: 58228 - RNA, 21 nt, Human
ggguggccucuggcggagacg

SEQ ID NO: 58229 - RNA, 20 nt, Human
ggguuggggagggugggcag

SEQ ID NO: 58230 - RNA, 23 nt, Human
ggugugugugugugugugugugg

SEQ ID NO: 58231 - RNA, 19 nt, Human
guccaggcucuccgccucc

SEQ ID NO: 58232 - RNA, 19 nt, Human
guccaggcucuccgccucc

SEQ ID NO: 58233 - RNA, 23 nt, Human
gucccuaacacaaggaaccccga

SEQ ID NO: 58234 - RNA, 23 nt, Human
gucccuaacacaaggaaccccga

SEQ ID NO: 58235 - RNA, 18 nt, Human
gucucucacuguuuacuc

SEQ ID NO: 58236 - RNA, 22 nt, Human
gugcaauccugggucagccacc

SEQ ID NO: 58237 - RNA, 22 nt, Human
gugcaauccugggucagccacc

SEQ ID NO: 58238 - RNA, 18 nt, Human
guggagggggcuucugug

SEQ ID NO: 58239 - RNA, 18 nt, Human
guggagggggcuucugug

SEQ ID NO: 58240 - RNA, 19 nt, Human
guggguuggggaggguggg

SEQ ID NO: 58241 - RNA, 19 nt, Human
guggguuggggaggguggg

SEQ ID NO: 58242 - RNA, 18 nt, Human
guggugugugugugugug

SEQ ID NO: 58243 - RNA, 20 nt, Human
gugugugugugugugugugu

SEQ ID NO: 58244 - RNA, 20 nt, Human
gugugugugugugugugugu

SEQ ID NO: 58245 - RNA, 21 nt, Human
gugugugugugugugugugug

SEQ ID NO: 58246 - RNA, 24 nt, Human
uaaaaaaaaaaccccaaaaccaaa

SEQ ID NO: 58247 - RNA, 24 nt, Human
uaaaaaaaaaaccccaaaaccaaa

SEQ ID NO: 58248 - RNA, 24 nt, Human
uaaaaaaaaaaccccaaaaccaaa

SEQ ID NO: 58249 - RNA, 24 nt, Human
uaaaaaaaaaaccccaaaaccaaa

SEQ ID NO: 58250 - RNA, 21 nt, Human
uaaaggaagcaaaagcagccc

SEQ ID NO: 58251 - RNA, 21 nt, Human
uaaaggaagcaaaagcagccc

SEQ ID NO: 58252 - RNA, 19 nt, Human
uacagucagucauucaugc

SEQ ID NO: 58253 - RNA, 19 nt, Human
uacagucagucauucaugc

SEQ ID NO: 58254 - RNA, 19 nt, Human
uacagucagucauucaugc

SEQ ID NO: 58255 - RNA, 19 nt, Human
uacagucagucauucaugc

SEQ ID NO: 58256 - RNA, 21 nt, Human
uauacaucagaguaggguagg

SEQ ID NO: 58257 - RNA, 21 nt, Human
uauacaucagaguaggguagg

SEQ ID NO: 58258 - RNA, 19 nt, Human
uauccacagcuucagaagu

SEQ ID NO: 58259 - RNA, 19 nt, Human
uauccacagcuucagaagu

SEQ ID NO: 58260 - RNA, 21 nt, Human
ucaagguaauuucaaaacuuc

SEQ ID NO: 58261 - RNA, 21 nt, Human
ucaagguaauuucaaaacuuc

SEQ ID NO: 58262 - RNA, 18 nt, Human
ucacaguaaaaucugugu

SEQ ID NO: 58263 - RNA, 18 nt, Human
ucacaguaaaaucugugu

SEQ ID NO: 58264 - RNA, 22 nt, Human
ucaccgaaucggucccagccgc

SEQ ID NO: 58265 - RNA, 24 nt, Human
ucaccgaaucggucccagccgcgc

SEQ ID NO: 58266 - RNA, 24 nt, Human
ucaccgaaucggucccagccgcgc

SEQ ID NO: 58267 - RNA, 20 nt, Human
ucagaugggguccuggcucc

SEQ ID NO: 58268 - RNA, 20 nt, Human
ucagaugggguccuggcucc

SEQ ID NO: 58269 - RNA, 21 nt, Human
ucagccaccggccuguccccc

SEQ ID NO: 58270 - RNA, 21 nt, Human
ucaggcccggagcuagagcuu

SEQ ID NO: 58271 - RNA, 21 nt, Human
ucaggcccggagcuagagcuu

SEQ ID NO: 58272 - RNA, 25 nt, Human
uccacugggaccccugaguccccca

SEQ ID NO: 58273 - RNA, 20 nt, Human
uccccagccacaaaaagccc

SEQ ID NO: 58274 - RNA, 20 nt, Human
uccccagccacaaaaagccc

SEQ ID NO: 58275 - RNA, 20 nt, Human
uccccagccacaaaaagccc

SEQ ID NO: 58276 - RNA, 20 nt, Human
uccccagccacaaaaagccc

SEQ ID NO: 58277 - RNA, 19 nt, Human
uccccgcuucuugcugcuu

SEQ ID NO: 58278 - RNA, 19 nt, Human
uccccgcuucuugcugcuu

SEQ ID NO: 58279 - RNA, 19 nt, Human
uccccgcuucuugcugcuu

SEQ ID NO: 58280 - RNA, 19 nt, Human
uccccgcuucuugcugcuu

SEQ ID NO: 58281 - RNA, 22 nt, Human
ucccgcagagcggcggggcgga

SEQ ID NO: 58282 - RNA, 22 nt, Human
ucccgcagagcggcggggcgga

SEQ ID NO: 58283 - RNA, 21 nt, Human
ucccucucucuccccgcuucu

SEQ ID NO: 58284 - RNA, 21 nt, Human
ucccucucucuccccgcuucu

SEQ ID NO: 58285 - RNA, 21 nt, Human
ucccucucucuccccgcuucu

SEQ ID NO: 58286 - RNA, 21 nt, Human
ucccucucucuccccgcuucu

SEQ ID NO: 58287 - RNA, 22 nt, Human
uccucuggcagccagguccccg

SEQ ID NO: 58288 - RNA, 24 nt, Human
uccucuggcagccagguccccggc

SEQ ID NO: 58289 - RNA, 21 nt, Human
uccucuuucacugaaagacag

SEQ ID NO: 58290 - RNA, 23 nt, Human
ucggcuggugaagggagaaugga

SEQ ID NO: 58291 - RNA, 23 nt, Human
ucggcuggugaagggagaaugga

SEQ ID NO: 58292 - RNA, 18 nt, Human
ucuaggcaucguguggag

SEQ ID NO: 58293 - RNA, 21 nt, Human
ucucacuguuuacucucucug

SEQ ID NO: 58294 - RNA, 22 nt, Human
ucuccaagaggccacaggggcu

SEQ ID NO: 58295 - RNA, 22 nt, Human
ucuccaagaggccacaggggcu

SEQ ID NO: 58296 - RNA, 18 nt, Human
ucucucacuguuuacucu

SEQ ID NO: 58297 - RNA, 20 nt, Human
ucucuccuggcccugggggc

SEQ ID NO: 58298 - RNA, 20 nt, Human
ucucuccuggcccugggggc

SEQ ID NO: 58299 - RNA, 20 nt, Human
ucucugguuugcucucuugg

SEQ ID NO: 58300 - RNA, 22 nt, Human
ucucugguuugcucucuugguc

SEQ ID NO: 58301 - RNA, 21 nt, Human
ucuugcugcuuuuguguccug

SEQ ID NO: 58302 - RNA, 21 nt, Human
ucuugcugcuuuuguguccug

SEQ ID NO: 58303 - RNA, 21 nt, Human
ucuugcugcuuuuguguccug

SEQ ID NO: 58304 - RNA, 21 nt, Human
ucuugcugcuuuuguguccug

SEQ ID NO: 58305 - RNA, 23 nt, Human
ugaagcagcccgcccaagugccc

SEQ ID NO: 58306 - RNA, 20 nt, Human
ugacguggagggggcuucug

SEQ ID NO: 58307 - RNA, 21 nt, Human
ugacguggagggggcuucugu

SEQ ID NO: 58308 - RNA, 21 nt, Human
ugaggaggagcagcuggggcu

SEQ ID NO: 58309 - RNA, 24 nt, Human
ugauggcaccgaggcgaggaacug

SEQ ID NO: 58310 - RNA, 24 nt, Human
ugauggcaccgaggcgaggaacug

SEQ ID NO: 58311 - RNA, 21 nt, Human
ugcaauccugggucagccacc

SEQ ID NO: 58312 - RNA, 21 nt, Human
ugcaauccugggucagccacc

SEQ ID NO: 58313 - RNA, 22 nt, Human
ugcaauccugggucagccaccg

SEQ ID NO: 58314 - RNA, 22 nt, Human
ugcaauccugggucagccaccg

SEQ ID NO: 58315 - RNA, 21 nt, Human
ugccuggccgggggugcaccg

SEQ ID NO: 58316 - RNA, 21 nt, Human
ugccuggccgggggugcaccg

SEQ ID NO: 58317 - RNA, 18 nt, Human
uggaauggagguaugugg

SEQ ID NO: 58318 - RNA, 18 nt, Human
uggaauggagguaugugg

SEQ ID NO: 58319 - RNA, 25 nt, Human
uggagaccccaaacuccuccccuaa

SEQ ID NO: 58320 - RNA, 25 nt, Human
uggagaccccaaacuccuccccuaa

SEQ ID NO: 58321 - RNA, 20 nt, Human
uggaggccgggccggggugg

SEQ ID NO: 58322 - RNA, 20 nt, Human
uggaggccgggccggggugg

SEQ ID NO: 58323 - RNA, 23 nt, Human
uggcugcagcagcgaccugggag

SEQ ID NO: 58324 - RNA, 23 nt, Human
uggcugcagcagcgaccugggag

SEQ ID NO: 58325 - RNA, 24 nt, Human
ugggcagaggggaggcacugaggc

SEQ ID NO: 58326 - RNA, 24 nt, Human
ugggcagaggggaggcacugaggc

SEQ ID NO: 58327 - RNA, 20 nt, Human
ugggccaggacaccgaaugg

SEQ ID NO: 58328 - RNA, 22 nt, Human
uggggagggugggcagaugagg

SEQ ID NO: 58329 - RNA, 22 nt, Human
uggggagggugggcagaugagg

SEQ ID NO: 58330 - RNA, 21 nt, Human
ugggggaggauggaggggggc

SEQ ID NO: 58331 - RNA, 21 nt, Human
ugggggaggauggaggggggc

SEQ ID NO: 58332 - RNA, 21 nt, Human
uggguuggggagggugggcag

SEQ ID NO: 58333 - RNA, 26 nt, Human
uggugcaauccugggucagccaccgg

SEQ ID NO: 58334 - RNA, 26 nt, Human
uggugcaauccugggucagccaccgg

SEQ ID NO: 58335 - RNA, 22 nt, Human
uggugugugugugugugugugu

SEQ ID NO: 58336 - RNA, 22 nt, Human
uggugugugugugugugugugu

SEQ ID NO: 58337 - RNA, 19 nt, Human
ugguucggcuggugaaggg

SEQ ID NO: 58338 - RNA, 23 nt, Human
ugguuugcucucuuggucucuca

SEQ ID NO: 58339 - RNA, 23 nt, Human
ugugggaagcagggccccucucc

SEQ ID NO: 58340 - RNA, 23 nt, Human
ugugggaagcagggccccucucc

SEQ ID NO: 58341 - RNA, 20 nt, Human
ugugggguucagggguuggg

SEQ ID NO: 58342 - RNA, 24 nt, Human
ugugugcauggcagagagugugug

SEQ ID NO: 58343 - RNA, 24 nt, Human
ugugugcauggcagagagugugug

SEQ ID NO: 58344 - RNA, 22 nt, Human
ugugugcauggcagagugugug

SEQ ID NO: 58345 - RNA, 22 nt, Human
ugugugcauggcagagugugug

SEQ ID NO: 58346 - RNA, 18 nt, Human
uguguguguccugaaugu

SEQ ID NO: 58347 - RNA, 18 nt, Human
uguguguguccugaaugu

SEQ ID NO: 58348 - RNA, 21 nt, Human
uguguguguguguguguccug

SEQ ID NO: 58349 - RNA, 21 nt, Human
uguguguguguguguguccug

SEQ ID NO: 58350 - RNA, 18 nt, Human
ugugugugugugugugug

SEQ ID NO: 58351 - RNA, 18 nt, Human
ugugugugugugugugug

SEQ ID NO: 58352 - RNA, 18 nt, Human
ugugugugugugugugug

SEQ ID NO: 58353 - RNA, 18 nt, Human
ugugugugugugugugug

SEQ ID NO: 58354 - RNA, 18 nt, Human
ugugugugugugugugug

SEQ ID NO: 58355 - RNA, 18 nt, Human
ugugugugugugugugug

SEQ ID NO: 58356 - RNA, 18 nt, Human
ugugugugugugugugug

SEQ ID NO: 58357 - RNA, 18 nt, Human
ugugugugugugugugug

SEQ ID NO: 58358 - RNA, 18 nt, Human
ugugugugugugugugug

SEQ ID NO: 58359 - RNA, 18 nt, Human
ugugugugugugugugug

SEQ ID NO: 58360 - RNA, 21 nt, Human
ugugugugugugugugugugu

SEQ ID NO: 58361 - RNA, 21 nt, Human
ugugugugugugugugugugu

SEQ ID NO: 58362 - RNA, 21 nt, Human
ugugugugugugugugugugu

SEQ ID NO: 58363 - RNA, 21 nt, Human
ugugugugugugugugugugu

SEQ ID NO: 58364 - RNA, 21 nt, Human
ugugugugugugugugugugu

SEQ ID NO: 58365 - RNA, 21 nt, Human
ugugugugugugugugugugu

SEQ ID NO: 58366 - RNA, 21 nt, Human
ugugugugugugugugugugu

SEQ ID NO: 58367 - RNA, 21 nt, Human
ugugugugugugugugugugu

SEQ ID NO: 58368 - RNA, 21 nt, Human
ugugugugugugugugugugu

SEQ ID NO: 58369 - RNA, 21 nt, Human
ugugugugugugugugugugu

SEQ ID NO: 58370 - RNA, 21 nt, Human
ugugugugugugugugugugu

SEQ ID NO: 58371 - RNA, 21 nt, Human
ugugugugugugugugugugu

SEQ ID NO: 58372 - RNA, 21 nt, Human
ugugugugugugugugugugu

SEQ ID NO: 58373 - RNA, 21 nt, Human
ugugugugugugugugugugu

SEQ ID NO: 58374 - RNA, 21 nt, Human
ugugugugugugugugugugu

SEQ ID NO: 58375 - RNA, 21 nt, Human
ugugugugugugugugugugu

SEQ ID NO: 58376 - RNA, 22 nt, Human
ugugugugugugugugugugug

SEQ ID NO: 58377 - RNA, 22 nt, Human
ugugugugugugugugugugug

SEQ ID NO: 58378 - RNA, 22 nt, Human
ugugugugugugugugugugug

SEQ ID NO: 58379 - RNA, 22 nt, Human
ugugugugugugugugugugug

SEQ ID NO: 58380 - RNA, 22 nt, Human
ugugugugugugugugugugug

SEQ ID NO: 58381 - RNA, 19 nt, Human
uguuuucuaucccucucuc

SEQ ID NO: 58382 - RNA, 19 nt, Human
uguuuucuaucccucucuc

SEQ ID NO: 58383 - RNA, 19 nt, Human
uguuuucuaucccucucuc

SEQ ID NO: 58384 - RNA, 19 nt, Human
uguuuucuaucccucucuc

SEQ ID NO: 58385 - RNA, 18 nt, Human
uuacucucucugugggcc

SEQ ID NO: 58386 - RNA, 18 nt, Human
uucaagguaaugauuuuc

SEQ ID NO: 58387 - RNA, 18 nt, Human
uucaagguaaugauuuuc

SEQ ID NO: 58388 - RNA, 26 nt, Human
uuccucucccugcccgccccucuaaa

SEQ ID NO: 58389 - RNA, 26 nt, Human
uuccucucccugcccgccccucuaaa

SEQ ID NO: 58390 - RNA, 21 nt, Human
uuccugccuugacccagagcc

SEQ ID NO: 58391 - RNA, 21 nt, Human
uuccugccuugacccagagcc

SEQ ID NO: 58392 - RNA, 21 nt, Human
uucuaucccucucucuccccg

SEQ ID NO: 58393 - RNA, 21 nt, Human
uucuaucccucucucuccccg

SEQ ID NO: 58394 - RNA, 21 nt, Human
uucuaucccucucucuccccg

SEQ ID NO: 58395 - RNA, 21 nt, Human
uucuaucccucucucuccccg

SEQ ID NO: 58396 - RNA, 19 nt, Human
uugacccagagccuggccc

SEQ ID NO: 58397 - RNA, 19 nt, Human
uugacccagagccuggccc

SEQ ID NO: 58398 - RNA, 22 nt, Human
uuucuaucccucucucuccccg

SEQ ID NO: 58399 - RNA, 23 nt, Human
uuuuuuuuuuuuuucuuuccagg

SEQ ID NO: 58400 - RNA, 23 nt, Human
uuuuuuuuuuuuuucuuuccagg

SEQ ID NO: 58401 - RNA, 21 nt, Human
aaagaacaauggagguggccg

SEQ ID NO: 58402 - RNA, 24 nt, Human
aagaacaauggagguggccaguuc

SEQ ID NO: 58403 - RNA, 30 nt, Human
aagcugcauauugagugaauguguggugca

SEQ ID NO: 58404 - RNA, 18 nt, Human
aaggagcugcuggagauc

SEQ ID NO: 58405 - RNA, 20 nt, Human
agaacaauggagguggccag

SEQ ID NO: 58406 - RNA, 21 nt, Human
agcccucuucugugugauggc

SEQ ID NO: 58407 - RNA, 19 nt, Human
agcugcuggagaucgcgcu

SEQ ID NO: 58408 - RNA, 19 nt, Human
aguuaaagaggauggggga

SEQ ID NO: 58409 - RNA, 27 nt, Human
cacagacacaacaaaguauuggauaca

SEQ ID NO: 58410 - RNA, 22 nt, Human
cuacugaaacaggaagcugcau

SEQ ID NO: 58411 - RNA, 19 nt, Human
cuggaggucguccuggucu

SEQ ID NO: 58412 - RNA, 21 nt, Human
ggcagucccucacuuggccuc

SEQ ID NO: 58413 - RNA, 22 nt, Human
ggucacuccccuacugaaacag

SEQ ID NO: 58414 - RNA, 25 nt, Human
guuacaauaggcagugguuuuaauu

SEQ ID NO: 58415 - RNA, 18 nt, Human
uacagcauccaguaugaa

SEQ ID NO: 58416 - RNA, 18 nt, Human
uagcacagacacaacaaa

SEQ ID NO: 58417 - RNA, 19 nt, Human
uagcacagacacaacaaag

SEQ ID NO: 58418 - RNA, 19 nt, Human
ucaccacagcccucuucug

SEQ ID NO: 58419 - RNA, 21 nt, Human
ucaucugagcauuucagcuau

SEQ ID NO: 58420 - RNA, 23 nt, Human
ucaucugagcauuucagcuauau

SEQ ID NO: 58421 - RNA, 20 nt, Human
ucccagguuagcacagacac

SEQ ID NO: 58422 - RNA, 18 nt, Human
ugcagaagcaaagaacaa

SEQ ID NO: 58423 - RNA, 22 nt, Human
ugcagaagcaaagaacaaugga

SEQ ID NO: 58424 - RNA, 24 nt, Human
ugccgaaggagcugcuggagaucg

SEQ ID NO: 58425 - RNA, 18 nt, Human
ugccguauauuugcuaac

SEQ ID NO: 58426 - RNA, 19 nt, Human
ugcuucaaguccuccuugc

SEQ ID NO: 58427 - RNA, 21 nt, Human
uggaaggauuccuacauagug

SEQ ID NO: 58428 - RNA, 24 nt, Human
ugggcagucccucacuuggccucu

SEQ ID NO: 58429 - RNA, 21 nt, Human
ugugcagaagcaaagaacaau

SEQ ID NO: 58430 - RNA, 26 nt, Human
uuagcacagacacaacaaaguauugg

SEQ ID NO: 58431 - RNA, 18 nt, Human
uuaggucacuccccuacu

SEQ ID NO: 58432 - RNA, 18 nt, Human
uugaagaggucugcaggu

SEQ ID NO: 58433 - RNA, 23 nt, Human
aacauuuuauucuauuuuucugu

SEQ ID NO: 58434 - RNA, 20 nt, Human
aagaaucagugaagagucac

SEQ ID NO: 58435 - RNA, 23 nt, Human
aagagucacccccacccagaauc

SEQ ID NO: 58436 - RNA, 26 nt, Human
aaugcaaagaugcuggagaagcugaa

SEQ ID NO: 58437 - RNA, 20 nt, Human
acaaugcaaagaugcuggag

SEQ ID NO: 58438 - RNA, 18 nt, Human
acaguaauaauuuuacag

SEQ ID NO: 58439 - RNA, 19 nt, Human
acccugacaguuugggucc

SEQ ID NO: 58440 - RNA, 18 nt, Human
agaaagcuuugacuagaa

SEQ ID NO: 58441 - RNA, 24 nt, Human
agcaccauccaccucuaaagcggc

SEQ ID NO: 58442 - RNA, 26 nt, Human
agcauccccccacccccuaaagcaac

SEQ ID NO: 58443 - RNA, 24 nt, Human
aguauacuguaguguuugcaaaau

SEQ ID NO: 58444 - RNA, 19 nt, Human
auagcauccccccaccccc

SEQ ID NO: 58445 - RNA, 24 nt, Human
auagcauccccccacccccuaaag

SEQ ID NO: 58446 - RNA, 24 nt, Human
aucauuccaucuccuucugucccu

SEQ ID NO: 58447 - RNA, 21 nt, Human
auccucucaagcacacacggc

SEQ ID NO: 58448 - RNA, 25 nt, Human
auuccaaucacuagagagaaagcuu

SEQ ID NO: 58449 - RNA, 18 nt, Human
cacagaacuacagaauuc

SEQ ID NO: 58450 - RNA, 21 nt, Human
cagcgaacacacacacacuuc

SEQ ID NO: 58451 - RNA, 21 nt, Human
ccacccagaaucccucccucc

SEQ ID NO: 58452 - RNA, 18 nt, Human
ccacccccuaaagcaacu

SEQ ID NO: 58453 - RNA, 22 nt, Human
ccagaaucccucccuccucuuc

SEQ ID NO: 58454 - RNA, 18 nt, Human
ccauucuacuagcuaagg

SEQ ID NO: 58455 - RNA, 21 nt, Human
ccccacccagaaucccucccu

SEQ ID NO: 58456 - RNA, 23 nt, Human
cuacagaauuccucauuuuggga

SEQ ID NO: 58457 - RNA, 24 nt, Human
cuggaaggacacagugaugaaugu

SEQ ID NO: 58458 - RNA, 24 nt, Human
gcuuccuuguaaaaggugauaucc

SEQ ID NO: 58459 - RNA, 18 nt, Human
ggcaagaauuucuuccuu

SEQ ID NO: 58460 - RNA, 19 nt, Human
guauucugaagaaaaaaau

SEQ ID NO: 58461 - RNA, 20 nt, Human
gugcugccauucuacuagcu

SEQ ID NO: 58462 - RNA, 21 nt, Human
guuauuauuuacagcaaaacu

SEQ ID NO: 58463 - RNA, 19 nt, Human
guuuacagauaaaaucuuu

SEQ ID NO: 58464 - RNA, 22 nt, Human
uaaagcggcaagcauuuacccc

SEQ ID NO: 58465 - RNA, 24 nt, Human
uaaagcggcaagcauuuacccccu

SEQ ID NO: 58466 - RNA, 24 nt, Human
uaacagauagcauccccccacccc

SEQ ID NO: 58467 - RNA, 26 nt, Human
uaacagauagcauccccccacccccu

SEQ ID NO: 58468 - RNA, 18 nt, Human
uagcauccccccaccccc

SEQ ID NO: 58469 - RNA, 22 nt, Human
uagcauccccccacccccuaaa

SEQ ID NO: 58470 - RNA, 21 nt, Human
uaguauucugaagaaaaaaau

SEQ ID NO: 58471 - RNA, 22 nt, Human
uauucuguuuguguucuaagag

SEQ ID NO: 58472 - RNA, 18 nt, Human
ucaccaaaacccaaauaa

SEQ ID NO: 58473 - RNA, 21 nt, Human
ucccuucugauggcaagaauu

SEQ ID NO: 58474 - RNA, 22 nt, Human
ucuagacucaaaaccuggagau

SEQ ID NO: 58475 - RNA, 20 nt, Human
ugaaaaauuggcaauagcaa

SEQ ID NO: 58476 - RNA, 24 nt, Human
ugaaaaauuggcaauagcaacaaa

SEQ ID NO: 58477 - RNA, 21 nt, Human
ugacuagaagcaggaagauau

SEQ ID NO: 58478 - RNA, 27 nt, Human
ugacuagaagcaggaagauauucacaa

SEQ ID NO: 58479 - RNA, 18 nt, Human
ugauacacaugcaucaaa

SEQ ID NO: 58480 - RNA, 19 nt, Human
ugcacacgcgccaauccgg

SEQ ID NO: 58481 - RNA, 23 nt, Human
uggaaugguguuuugucagacuu

SEQ ID NO: 58482 - RNA, 22 nt, Human
uguaaaaggugauauccucagg

SEQ ID NO: 58483 - RNA, 20 nt, Human
uguaguguuugcaaaauugg

SEQ ID NO: 58484 - RNA, 22 nt, Human
uguuguagauuuaguaauuuua

SEQ ID NO: 58485 - RNA, 20 nt, Human
uguuuuaaaaaagaaacaaa

SEQ ID NO: 58486 - RNA, 20 nt, Human
uuaagcacuaacagauagca

SEQ ID NO: 58487 - RNA, 19 nt, Human
uuccaaauccuggaaggac

SEQ ID NO: 58488 - RNA, 24 nt, Human
uuuauacaguguuauuauuuacag

SEQ ID NO: 58489 - RNA, 25 nt, Human
uuuuuuuuuuuuggcccagggcguu

SEQ ID NO: 58490 - RNA, 26 nt, Human
uuuuuuuuuuuuuuuuuggcccaggg

SEQ ID NO: 58491 - RNA, 22 nt, Human
uuuuuuuuuuuuuuuuuuuggc

SEQ ID NO: 58492 - RNA, 28 nt, Human
uuuuuuuuuuuuuuuuuuuuuuuggggg

SEQ ID NO: 58493 - RNA, 26 nt, Human
aaaaaaaaaaucuagaucacugcuaa

SEQ ID NO: 58494 - RNA, 23 nt, Human
aaaccaaaccuuucuacgggaga

SEQ ID NO: 58495 - RNA, 26 nt, Human
aaacuaaaaugcaaaguuaggaugcu

SEQ ID NO: 58496 - RNA, 24 nt, Human
aaaguguugggauuacaggcauga

SEQ ID NO: 58497 - RNA, 24 nt, Human
aacaaaacaaaaaaaagggaacaa

SEQ ID NO: 58498 - RNA, 19 nt, Human
aacccugaaacaaagcaua

SEQ ID NO: 58499 - RNA, 20 nt, Human
aaccucugccucccaggauc

SEQ ID NO: 58500 - RNA, 21 nt, Human
aagaggccaccggggcuccau

SEQ ID NO: 58501 - RNA, 19 nt, Human
aagcaaaucaaaggaagcc

SEQ ID NO: 58502 - RNA, 19 nt, Human
aagcaugaaagucacacau

SEQ ID NO: 58503 - RNA, 21 nt, Human
aagcgauccuccugccucagc

SEQ ID NO: 58504 - RNA, 28 nt, Human
aagggaacaaaauacgaugggagaggga

SEQ ID NO: 58505 - RNA, 19 nt, Human
aaguagcugggacuacaga

SEQ ID NO: 58506 - RNA, 24 nt, Human
aagugauccacccuccuuggccuc

SEQ ID NO: 58507 - RNA, 21 nt, Human
aaguguugggauuacaggcau

SEQ ID NO: 58508 - RNA, 26 nt, Human
aaguguugggauuacaggcaugagcc

SEQ ID NO: 58509 - RNA, 25 nt, Human
acaaaacaaaaaaaagggaacaaaa

SEQ ID NO: 58510 - RNA, 26 nt, Human
acaaauccauaaacccugaaacaaag

SEQ ID NO: 58511 - RNA, 23 nt, Human
acagcacugaaaacgguagacac

SEQ ID NO: 58512 - RNA, 21 nt, Human
acagcuugcucagaucuagga

SEQ ID NO: 58513 - RNA, 18 nt, Human
acaggguuucgccauguu

SEQ ID NO: 58514 - RNA, 23 nt, Human
acaggguuucgccauguuggcca

SEQ ID NO: 58515 - RNA, 24 nt, Human
acaggguuucgccauguuggccag

SEQ ID NO: 58516 - RNA, 28 nt, Human
accccagaagcaugaaaguugagggguc

SEQ ID NO: 58517 - RNA, 21 nt, Human
acggccaugugacugggaagc

SEQ ID NO: 58518 - RNA, 24 nt, Human
acgggguuuugcucuguugcucag

SEQ ID NO: 58519 - RNA, 18 nt, Human
agacaggguuucgccaug

SEQ ID NO: 58520 - RNA, 18 nt, Human
agacaggguuucgccaug

SEQ ID NO: 58521 - RNA, 22 nt, Human
agaucaggaagggcauacccag

SEQ ID NO: 58522 - RNA, 24 nt, Human
agauuuuuuuuuaaucuucucaga

SEQ ID NO: 58523 - RNA, 18 nt, Human
agccacagcccauguaga

SEQ ID NO: 58524 - RNA, 20 nt, Human
aggaaaagccacucugagga

SEQ ID NO: 58525 - RNA, 23 nt, Human
aggagauuguccaggggaggagg

SEQ ID NO: 58526 - RNA, 21 nt, Human
aggcaugagccaccaugcccg

SEQ ID NO: 58527 - RNA, 25 nt, Human
agggaaaagcaagccuucaggaaaa

SEQ ID NO: 58528 - RNA, 22 nt, Human
aggggaggaggacacaacguca

SEQ ID NO: 58529 - RNA, 18 nt, Human
aguacauucucaauuacc

SEQ ID NO: 58530 - RNA, 25 nt, Human
aguagcugggacuacagaugcacac

SEQ ID NO: 58531 - RNA, 23 nt, Human
aguagcugggauuacagguaugu

SEQ ID NO: 58532 - RNA, 23 nt, Human
aguagcugggauuacagguaugu

SEQ ID NO: 58533 - RNA, 23 nt, Human
aguccaucccugcugcccuccca

SEQ ID NO: 58534 - RNA, 18 nt, Human
agugacccauuuauuccc

SEQ ID NO: 58535 - RNA, 24 nt, Human
agugauccacccuccuuggccucc

SEQ ID NO: 58536 - RNA, 20 nt, Human
agugcgauggcgcgaucucg

SEQ ID NO: 58537 - RNA, 24 nt, Human
agugcgauggcgcgaucucggcuc

SEQ ID NO: 58538 - RNA, 23 nt, Human
agugucauccugacugacugucc

SEQ ID NO: 58539 - RNA, 18 nt, Human
agugugagcauacccagu

SEQ ID NO: 58540 - RNA, 19 nt, Human
augcacaccacugugccca

SEQ ID NO: 58541 - RNA, 24 nt, Human
auuuuuauguuuuuaguagagaca

SEQ ID NO: 58542 - RNA, 27 nt, Human
caaaaaaaagggaacaaaauacgaugg

SEQ ID NO: 58543 - RNA, 21 nt, Human
caaaacaaaaaaaagggaaca

SEQ ID NO: 58544 - RNA, 26 nt, Human
caaacuccugaccuuaagugauccaa

SEQ ID NO: 58545 - RNA, 24 nt, Human
caaaguguugggauuacaggcaug

SEQ ID NO: 58546 - RNA, 22 nt, Human
caacaguaaagaccauucacua

SEQ ID NO: 58547 - RNA, 23 nt, Human
caaccaugucaguuugcugcccc

SEQ ID NO: 58548 - RNA, 20 nt, Human
caacgucaaccgugaggcag

SEQ ID NO: 58549 - RNA, 23 nt, Human
caagcaaauucuccugccucagc

SEQ ID NO: 58550 - RNA, 26 nt, Human
caagcucaaguccaucccugcugccc

SEQ ID NO: 58551 - RNA, 19 nt, Human
caaguccaucccugcugcc

SEQ ID NO: 58552 - RNA, 25 nt, Human
cacaacaaagaucugccgggaaaaa

SEQ ID NO: 58553 - RNA, 18 nt, Human
cacaccacugugcccagc

SEQ ID NO: 58554 - RNA, 26 nt, Human
cacaccccaucagcacuggguacccc

SEQ ID NO: 58555 - RNA, 21 nt, Human
cacuacaaccucugccuccca

SEQ ID NO: 58556 - RNA, 20 nt, Human
cagaucuaggagaacgcaga

SEQ ID NO: 58557 - RNA, 22 nt, Human
cagcacugaaaacgguagacac

SEQ ID NO: 58558 - RNA, 20 nt, Human
cagccuccugaguagcuggg

SEQ ID NO: 58559 - RNA, 20 nt, Human
cagcgugccacccgccuccu

SEQ ID NO: 58560 - RNA, 24 nt, Human
cagcugugucuuuuggguuuucgu

SEQ ID NO: 58561 - RNA, 20 nt, Human
caggaagggcauacccagua

SEQ ID NO: 58562 - RNA, 24 nt, Human
caggguuucgccauguuggccagg

SEQ ID NO: 58563 - RNA, 18 nt, Human
cauccugacugacugucc

SEQ ID NO: 58564 - RNA, 25 nt, Human
cauguccccacgugggcacacccca

SEQ ID NO: 58565 - RNA, 24 nt, Human
cauguuggccaggcuggucucaaa

SEQ ID NO: 58566 - RNA, 21 nt, Human
cauucaaccaugucaguuugc

SEQ ID NO: 58567 - RNA, 26 nt, Human
ccaaaacaaaacaaaaaaaagggaac

SEQ ID NO: 58568 - RNA, 23 nt, Human
ccaaaguguugggauuacaggca

SEQ ID NO: 58569 - RNA, 24 nt, Human
ccaaaguguugggauuacaggcau

SEQ ID NO: 58570 - RNA, 18 nt, Human
ccaccaugcccggccugc

SEQ ID NO: 58571 - RNA, 18 nt, Human
ccauaaacccugaaacaa

SEQ ID NO: 58572 - RNA, 19 nt, Human
ccauguuggccaggcuggu

SEQ ID NO: 58573 - RNA, 22 nt, Human
ccauguuggccaggcuggucuc

SEQ ID NO: 58574 - RNA, 24 nt, Human
cccaaaguguugggauuacaggca

SEQ ID NO: 58575 - RNA, 23 nt, Human
cccaaguagcugggacuacagau

SEQ ID NO: 58576 - RNA, 20 nt, Human
cccacacacaucugcugccg

SEQ ID NO: 58577 - RNA, 22 nt, Human
cccacacacaucugcugccgcg

SEQ ID NO: 58578 - RNA, 23 nt, Human
ccccacacacaucugcugccgcg

SEQ ID NO: 58579 - RNA, 19 nt, Human
ccccacgugggcacacccc

SEQ ID NO: 58580 - RNA, 21 nt, Human
cccucccacacaacaaagauu

SEQ ID NO: 58581 - RNA, 21 nt, Human
ccgcgaggggacucugcgggg

SEQ ID NO: 58582 - RNA, 21 nt, Human
ccgugggcugaccccacacac

SEQ ID NO: 58583 - RNA, 18 nt, Human
ccgugggcugaccccacc

SEQ ID NO: 58584 - RNA, 19 nt, Human
ccucccacacaacaaagau

SEQ ID NO: 58585 - RNA, 23 nt, Human
ccucccacacaacaaagaucugc

SEQ ID NO: 58586 - RNA, 24 nt, Human
ccugaccuuaagugauccacccuc

SEQ ID NO: 58587 - RNA, 22 nt, Human
ccugaguagcugggauuacagg

SEQ ID NO: 58588 - RNA, 23 nt, Human
ccugaguagcugggauuacaggu

SEQ ID NO: 58589 - RNA, 24 nt, Human
ccugaguagcugggauuacaggua

SEQ ID NO: 58590 - RNA, 23 nt, Human
ccugccucagccucccaaguagc

SEQ ID NO: 58591 - RNA, 23 nt, Human
ccugccucagccuccugaguagc

SEQ ID NO: 58592 - RNA, 24 nt, Human
ccugcugcccucccacacaacaaa

SEQ ID NO: 58593 - RNA, 21 nt, Human
cgacagaggccgcgggcggcg

SEQ ID NO: 58594 - RNA, 19 nt, Human
cgagggaaaagcaagccuu

SEQ ID NO: 58595 - RNA, 19 nt, Human
cgaugaagggggacaggag

SEQ ID NO: 58596 - RNA, 27 nt, Human
cgccauguuggccaggcuggucucaaa

SEQ ID NO: 58597 - RNA, 20 nt, Human
cggcggcggcggcuccuccu

SEQ ID NO: 58598 - RNA, 23 nt, Human
cggcggggccucgggcgcggcgg

SEQ ID NO: 58599 - RNA, 24 nt, Human
cucacuacaaccucugccucccag

SEQ ID NO: 58600 - RNA, 24 nt, Human
cucagccucccaaguagcugggac

SEQ ID NO: 58601 - RNA, 24 nt, Human
cucagccuccugaguagcugggau

SEQ ID NO: 58602 - RNA, 22 nt, Human
cucccacacaacaaagaucugc

SEQ ID NO: 58603 - RNA, 19 nt, Human
cucugcggggaggcgaggg

SEQ ID NO: 58604 - RNA, 19 nt, Human
cucuguugcucaggcugga

SEQ ID NO: 58605 - RNA, 21 nt, Human
cugaguagcugggauuacagg

SEQ ID NO: 58606 - RNA, 24 nt, Human
cugaguagcugggauuacagguau

SEQ ID NO: 58607 - RNA, 19 nt, Human
cugcagguauguugagcac

SEQ ID NO: 58608 - RNA, 23 nt, Human
cugccucagccucccaaguagcu

SEQ ID NO: 58609 - RNA, 23 nt, Human
cugccucagccuccugaguagcu

SEQ ID NO: 58610 - RNA, 21 nt, Human
cuggaugagacuuaaagcuuc

SEQ ID NO: 58611 - RNA, 20 nt, Human
cuguggccugcugugcaggg

SEQ ID NO: 58612 - RNA, 22 nt, Human
cuguggccugcugugcagggug

SEQ ID NO: 58613 - RNA, 20 nt, Human
cuuaagcgauccuccugccu

SEQ ID NO: 58614 - RNA, 24 nt, Human
cuugucacccaggcuggagugcga

SEQ ID NO: 58615 - RNA, 27 nt, Human
gaaaaaaccugcuuuccaaaacuuaga

SEQ ID NO: 58616 - RNA, 21 nt, Human
gaaauguauuauagccuaaaa

SEQ ID NO: 58617 - RNA, 20 nt, Human
gacaggagagucuguggccu

SEQ ID NO: 58618 - RNA, 21 nt, Human
gacaggagagucuguggccug

SEQ ID NO: 58619 - RNA, 24 nt, Human
gaccuuaagugauccacccuccuu

SEQ ID NO: 58620 - RNA, 18 nt, Human
gagcggggcgcgggccga

SEQ ID NO: 58621 - RNA, 19 nt, Human
gaguagcugggauuacagg

SEQ ID NO: 58622 - RNA, 18 nt, Human
gauuacaggcaugagcca

SEQ ID NO: 58623 - RNA, 21 nt, Human
gauuacaggcaugagccacca

SEQ ID NO: 58624 - RNA, 22 nt, Human
gauuacaggcaugagccaccau

SEQ ID NO: 58625 - RNA, 19 nt, Human
gauuacagguaugugcuac

SEQ ID NO: 58626 - RNA, 23 nt, Human
gccucccaggaucaagcaaauuc

SEQ ID NO: 58627 - RNA, 24 nt, Human
gcgauccuccugccucagccuccc

SEQ ID NO: 58628 - RNA, 19 nt, Human
gcgaugaagggggacagga

SEQ ID NO: 58629 - RNA, 20 nt, Human
gcucuguugcucaggcugga

SEQ ID NO: 58630 - RNA, 20 nt, Human
gcucuugucacccaggcugg

SEQ ID NO: 58631 - RNA, 21 nt, Human
gcucuugucacccaggcugga

SEQ ID NO: 58632 - RNA, 24 nt, Human
gcucuugucacccaggcuggagug

SEQ ID NO: 58633 - RNA, 21 nt, Human
gcugacagccacagcccaugu

SEQ ID NO: 58634 - RNA, 23 nt, Human
gcugcaguccuuugguuccaaga

SEQ ID NO: 58635 - RNA, 20 nt, Human
ggaaaagcaagccuucaggg

SEQ ID NO: 58636 - RNA, 18 nt, Human
ggaaaagccacucugagg

SEQ ID NO: 58637 - RNA, 24 nt, Human
ggacaggagagucuguggccuggu

SEQ ID NO: 58638 - RNA, 22 nt, Human
ggagauucuguccaucugucag

SEQ ID NO: 58639 - RNA, 24 nt, Human
ggauuacaggcaugagccaccaug

SEQ ID NO: 58640 - RNA, 20 nt, Human
ggccugccuuuuucuuucuc

SEQ ID NO: 58641 - RNA, 23 nt, Human
ggcuggucucaaacuccugaccu

SEQ ID NO: 58642 - RNA, 25 nt, Human
gggcugcagcgugccacccgccucc

SEQ ID NO: 58643 - RNA, 22 nt, Human
ggguuucgccauguuggccagg

SEQ ID NO: 58644 - RNA, 24 nt, Human
gugauccacccuccuuggccuccc

SEQ ID NO: 58645 - RNA, 18 nt, Human
guucacagcuaacauuau

SEQ ID NO: 58646 - RNA, 24 nt, Human
guuuugcucuguugcucaggcugg

SEQ ID NO: 58647 - RNA, 18 nt, Human
uaaaaugcaaaguuagga

SEQ ID NO: 58648 - RNA, 22 nt, Human
uaaacagaauguuagaucagga

SEQ ID NO: 58649 - RNA, 21 nt, Human
uaaacccugaaacaaagcaua

SEQ ID NO: 58650 - RNA, 24 nt, Human
uaaagagcacuuccuuaaaagcga

SEQ ID NO: 58651 - RNA, 27 nt, Human
uaagcgauccuccugccucagccuccc

SEQ ID NO: 58652 - RNA, 27 nt, Human
uaagcgauccuccugccucagccuccc

SEQ ID NO: 58653 - RNA, 24 nt, Human
uaauuuuuauguuuuuaguagaga

SEQ ID NO: 58654 - RNA, 23 nt, Human
uacaggcaugagccaccaugccc

SEQ ID NO: 58655 - RNA, 24 nt, Human
uacagguaugugcuaccaccccca

SEQ ID NO: 58656 - RNA, 26 nt, Human
uaccaaaacaaaacaaaaaaaaggga

SEQ ID NO: 58657 - RNA, 19 nt, Human
uacccuacagcaaccuggc

SEQ ID NO: 58658 - RNA, 22 nt, Human
uagagacaggguuucgccaugu

SEQ ID NO: 58659 - RNA, 24 nt, Human
uaguagagacaggguuucgccaug

SEQ ID NO: 58660 - RNA, 19 nt, Human
uauacugcacugcauggau

SEQ ID NO: 58661 - RNA, 23 nt, Human
uauagccuaaaauaaauuacaua

SEQ ID NO: 58662 - RNA, 21 nt, Human
uaugacuaaggauagcagaac

SEQ ID NO: 58663 - RNA, 21 nt, Human
uauucuuccauuguaggaucu

SEQ ID NO: 58664 - RNA, 18 nt, Human
ucacccaggcuggagugc

SEQ ID NO: 58665 - RNA, 18 nt, Human
ucacuacaaccucugccu

SEQ ID NO: 58666 - RNA, 19 nt, Human
ucacuacaaccucugccuc

SEQ ID NO: 58667 - RNA, 24 nt, Human
ucacuacaaccucugccucccagg

SEQ ID NO: 58668 - RNA, 19 nt, Human
ucacugcuaauguucagau

SEQ ID NO: 58669 - RNA, 22 nt, Human
ucagaucuaggagaacgcagag

SEQ ID NO: 58670 - RNA, 18 nt, Human
ucagccucccaaguagcu

SEQ ID NO: 58671 - RNA, 20 nt, Human
ucagccucccaaguagcugg

SEQ ID NO: 58672 - RNA, 20 nt, Human
ucagccuccugaguagcugg

SEQ ID NO: 58673 - RNA, 28 nt, Human
ucauuaccaaaacaaaacaaaaaaaagg

SEQ ID NO: 58674 - RNA, 21 nt, Human
uccacccuccuuggccuccca

SEQ ID NO: 58675 - RNA, 20 nt, Human
uccauaaacccugaaacaaa

SEQ ID NO: 58676 - RNA, 21 nt, Human
uccauaaacccugaaacaaag

SEQ ID NO: 58677 - RNA, 19 nt, Human
uccaucccugcugcccucc

SEQ ID NO: 58678 - RNA, 24 nt, Human
ucccaaaguguugggauuacaggc

SEQ ID NO: 58679 - RNA, 18 nt, Human
ucccaaguagcugggacu

SEQ ID NO: 58680 - RNA, 18 nt, Human
ucccacacaacaaagauc

SEQ ID NO: 58681 - RNA, 22 nt, Human
ucccaggaucaagcaaauucuc

SEQ ID NO: 58682 - RNA, 25 nt, Human
ucccaggaucaagcaaauucuccug

SEQ ID NO: 58683 - RNA, 27 nt, Human
uccuccugccucagccucccaaguagc

SEQ ID NO: 58684 - RNA, 24 nt, Human
uccugaguagcugggauuacaggu

SEQ ID NO: 58685 - RNA, 21 nt, Human
uccuuggccucccaaaguguu

SEQ ID NO: 58686 - RNA, 22 nt, Human
ucgccauguuggccaggcuggu

SEQ ID NO: 58687 - RNA, 24 nt, Human
ucgccauguuggccaggcuggucu

SEQ ID NO: 58688 - RNA, 24 nt, Human
ucuccugccucagccuccugagua

SEQ ID NO: 58689 - RNA, 19 nt, Human
ucugucagccugcugugga

SEQ ID NO: 58690 - RNA, 20 nt, Human
ucuguggccugcugugcagg

SEQ ID NO: 58691 - RNA, 22 nt, Human
ucuuucagucuaggaauucuga

SEQ ID NO: 58692 - RNA, 22 nt, Human
ugaaacugacaaaccuaugggc

SEQ ID NO: 58693 - RNA, 22 nt, Human
ugaaaugcuaucauucaaccau

SEQ ID NO: 58694 - RNA, 20 nt, Human
ugaauacaaauccauaaacc

SEQ ID NO: 58695 - RNA, 21 nt, Human
ugaauacaaauccauaaaccc

SEQ ID NO: 58696 - RNA, 23 nt, Human
ugaauacaaauccauaaacccug

SEQ ID NO: 58697 - RNA, 20 nt, Human
ugaccuuaagugauccaccc

SEQ ID NO: 58698 - RNA, 20 nt, Human
ugaccuuaagugauccaccc

SEQ ID NO: 58699 - RNA, 21 nt, Human
ugaccuuaagugauccacccu

SEQ ID NO: 58700 - RNA, 22 nt, Human
ugaccuuaagugauccacccuc

SEQ ID NO: 58701 - RNA, 27 nt, Human
ugacuaaaucaauuuagugaaccgugu

SEQ ID NO: 58702 - RNA, 22 nt, Human
ugacucgcucuaaugcgaccuu

SEQ ID NO: 58703 - RNA, 23 nt, Human
ugacucuaagcacacuuaauuuu

SEQ ID NO: 58704 - RNA, 18 nt, Human
ugagcacacaagcaauca

SEQ ID NO: 58705 - RNA, 18 nt, Human
ugaggcagcugugucuuc

SEQ ID NO: 58706 - RNA, 21 nt, Human
ugaggcagggguaugaaguca

SEQ ID NO: 58707 - RNA, 18 nt, Human
ugcaaaaacuuccaucug

SEQ ID NO: 58708 - RNA, 20 nt, Human
ugcaaaaacuuccaucuguu

SEQ ID NO: 58709 - RNA, 20 nt, Human
ugcaaaaacuuccaucuguu

SEQ ID NO: 58710 - RNA, 24 nt, Human
ugccucagccucccaaguagcugg

SEQ ID NO: 58711 - RNA, 24 nt, Human
ugccucagccuccugaguagcugg

SEQ ID NO: 58712 - RNA, 20 nt, Human
ugcuagagaauugacacgaa

SEQ ID NO: 58713 - RNA, 21 nt, Human
ugcuagagaauugacacgaaa

SEQ ID NO: 58714 - RNA, 24 nt, Human
ugcucuugucacccaggcuggagu

SEQ ID NO: 58715 - RNA, 24 nt, Human
ugcugccgcgaggggacucugcgg

SEQ ID NO: 58716 - RNA, 23 nt, Human
ugcuguggucacaggucuccguu

SEQ ID NO: 58717 - RNA, 24 nt, Human
uggagugcgauggcgcgaucucgg

SEQ ID NO: 58718 - RNA, 20 nt, Human
uggaguuuugcucuugucac

SEQ ID NO: 58719 - RNA, 24 nt, Human
uggccaggcuggucucaaacuccu

SEQ ID NO: 58720 - RNA, 24 nt, Human
uggcgcgaucucggcucacuacaa

SEQ ID NO: 58721 - RNA, 22 nt, Human
ugggacuacagaugcacaccac

SEQ ID NO: 58722 - RNA, 24 nt, Human
ugggacuacagaugcacaccacug

SEQ ID NO: 58723 - RNA, 18 nt, Human
ugggauuacaggcaugag

SEQ ID NO: 58724 - RNA, 22 nt, Human
ugggauuacaggcaugagccac

SEQ ID NO: 58725 - RNA, 23 nt, Human
ugggauuacaggcaugagccacc

SEQ ID NO: 58726 - RNA, 24 nt, Human
ugggauuacaggcaugagccacca

SEQ ID NO: 58727 - RNA, 25 nt, Human
ugggauuacaggcaugagccaccau

SEQ ID NO: 58728 - RNA, 22 nt, Human
ugggauuacagguaugugcuac

SEQ ID NO: 58729 - RNA, 24 nt, Human
ugggauuacagguaugugcuacca

SEQ ID NO: 58730 - RNA, 24 nt, Human
ugugcuuaagcgauccuccugccu

SEQ ID NO: 58731 - RNA, 23 nt, Human
uguucauugauacaauacguuuc

SEQ ID NO: 58732 - RNA, 21 nt, Human
uuaaaaaaguuagcucaugua

SEQ ID NO: 58733 - RNA, 25 nt, Human
uuaaaguaaaauuagaguaugaaac

SEQ ID NO: 58734 - RNA, 24 nt, Human
uuaguagagacaggguuucgccau

SEQ ID NO: 58735 - RNA, 27 nt, Human
uucaaaccaaaccuuucuacgggagau

SEQ ID NO: 58736 - RNA, 22 nt, Human
uugcucuguugcucaggcugga

SEQ ID NO: 58737 - RNA, 23 nt, Human
uugcucuugucacccaggcugga

SEQ ID NO: 58738 - RNA, 28 nt, Human
uuucauuaccaaaacaaaacaaaaaaaa

SEQ ID NO: 58739 - RNA, 24 nt, Human
uuucgccauguuggccaggcuggu

SEQ ID NO: 58740 - RNA, 24 nt, Human
uuugcucuugucacccaggcugga

SEQ ID NO: 58741 - RNA, 20 nt, Human
uuuguuuaaaaaaaaaaaaa

SEQ ID NO: 58742 - RNA, 23 nt, Human
uuuugcucuguugcucaggcugg

SEQ ID NO: 58743 - RNA, 24 nt, Human
uuuugcucuguugcucaggcugga

SEQ ID NO: 58744 - RNA, 24 nt, Human
uuuugcucuugucacccaggcugg

SEQ ID NO: 58745 - RNA, 22 nt, Human
uuuugugacaauuuaaaaaagu

SEQ ID NO: 58746 - RNA, 22 nt, Human
uuuuuaguagagacaggguuuc

SEQ ID NO: 58747 - RNA, 23 nt, Human
uuuuuaguagagacaggguuucg

SEQ ID NO: 58748 - RNA, 20 nt, Human
uuuuuauguuuuuaguagag

SEQ ID NO: 58749 - RNA, 18 nt, Human
aaaaaccaguaaauauug

SEQ ID NO: 58750 - RNA, 22 nt, Human
aauuuauaaguaaacaaaacua

SEQ ID NO: 58751 - RNA, 21 nt, Human
accagagcagaggaagcccca

SEQ ID NO: 58752 - RNA, 23 nt, Human
agagcagaggaagccccaauuuc

SEQ ID NO: 58753 - RNA, 25 nt, Human
agcacuugauacaaagacugaugau

SEQ ID NO: 58754 - RNA, 18 nt, Human
aggccuccaagcccgggc

SEQ ID NO: 58755 - RNA, 22 nt, Human
agugcaaggucucgcgaccacc

SEQ ID NO: 58756 - RNA, 25 nt, Human
auaagaacaauuuuuuucuagggau

SEQ ID NO: 58757 - RNA, 22 nt, Human
auaguuauaaaaagaguauuac

SEQ ID NO: 58758 - RNA, 21 nt, Human
caccagagcagaggaagcccc

SEQ ID NO: 58759 - RNA, 22 nt, Human
caccgacgacagcagacagcga

SEQ ID NO: 58760 - RNA, 23 nt, Human
cacuugauacaaagacugaugau

SEQ ID NO: 58761 - RNA, 18 nt, Human
cagcugugcccgaaaagu

SEQ ID NO: 58762 - RNA, 18 nt, Human
caguguguucuuggaauc

SEQ ID NO: 58763 - RNA, 23 nt, Human
ccaagaaguaaacaaaagggcaa

SEQ ID NO: 58764 - RNA, 24 nt, Human
ccaccgacgacagcagacagcgag

SEQ ID NO: 58765 - RNA, 18 nt, Human
cccagcgucccgagacag

SEQ ID NO: 58766 - RNA, 22 nt, Human
cucgcucauccgcggcgagcga

SEQ ID NO: 58767 - RNA, 23 nt, Human
cugaaaaugucaaauuacagcac

SEQ ID NO: 58768 - RNA, 22 nt, Human
gauaacuaucuguaccauaaaa

SEQ ID NO: 58769 - RNA, 21 nt, Human
gccgcgacgucacuuccgauu

SEQ ID NO: 58770 - RNA, 22 nt, Human
gcggcgagcggaucccgggcac

SEQ ID NO: 58771 - RNA, 23 nt, Human
ggccuccaagcccgggcuuguuu

SEQ ID NO: 58772 - RNA, 23 nt, Human
uaaaaaacguuccgcagcaaugc

SEQ ID NO: 58773 - RNA, 22 nt, Human
uaauucaacaauaagaacaauu

SEQ ID NO: 58774 - RNA, 21 nt, Human
uacacgagugaagaugacuag

SEQ ID NO: 58775 - RNA, 23 nt, Human
uagaauaauuucugaaaauguca

SEQ ID NO: 58776 - RNA, 21 nt, Human
uagcaaacccuauauaaagug

SEQ ID NO: 58777 - RNA, 24 nt, Human
ucaacaauaagaacaauuuuuuuc

SEQ ID NO: 58778 - RNA, 27 nt, Human
ucccagcgucccgagacaggagcccgc

SEQ ID NO: 58779 - RNA, 24 nt, Human
uccucuugguuuuguaagagcagu

SEQ ID NO: 58780 - RNA, 24 nt, Human
ucuuuuuuuugucccucucuccuu

SEQ ID NO: 58781 - RNA, 24 nt, Human
ugacuaggguagaauaauuucuga

SEQ ID NO: 58782 - RNA, 19 nt, Human
ugacuuaauacacgaguga

SEQ ID NO: 58783 - RNA, 24 nt, Human
ugcacuuuuuaauucaacaauaag

SEQ ID NO: 58784 - RNA, 19 nt, Human
uggaggggagacucuugca

SEQ ID NO: 58785 - RNA, 24 nt, Human
uguaguuucaauaacuaaaacauu

SEQ ID NO: 58786 - RNA, 24 nt, Human
ugucucccgcuggaggggagacuc

SEQ ID NO: 58787 - RNA, 24 nt, Human
uguguucuuggaaucuggauauuu

SEQ ID NO: 58788 - RNA, 18 nt, Human
uuaauacacgagugaaga

SEQ ID NO: 58789 - RNA, 23 nt, Human
uucccaucugaggccagcuucag

SEQ ID NO: 58790 - RNA, 19 nt, Human
uuuuuugucccucucuccu

SEQ ID NO: 58791 - RNA, 22 nt, Human
aaaaaacacagcuucuccugca

SEQ ID NO: 58792 - RNA, 22 nt, Human
aaaaaacacaguuuccccugca

SEQ ID NO: 58793 - RNA, 21 nt, Human
aaaacacuaucccuaucccaa

SEQ ID NO: 58794 - RNA, 19 nt, Human
aaacacagcuucuccugca

SEQ ID NO: 58795 - RNA, 24 nt, Human
aaacacaguuuccccugcaccucc

SEQ ID NO: 58796 - RNA, 20 nt, Human
aacacuccccccauacccca

SEQ ID NO: 58797 - RNA, 19 nt, Human
aacgagaaacgaacggcag

SEQ ID NO: 58798 - RNA, 20 nt, Human
aagagccccacguggacccc

SEQ ID NO: 58799 - RNA, 22 nt, Human
acacagcuucuccugcaccucu

SEQ ID NO: 58800 - RNA, 22 nt, Human
acccuaugggacacaggugaca

SEQ ID NO: 58801 - RNA, 19 nt, Human
acgcaguccacacaacagu

SEQ ID NO: 58802 - RNA, 19 nt, Human
acgccuggggcuucaucac

SEQ ID NO: 58803 - RNA, 20 nt, Human
agcugggaagggugcaggug

SEQ ID NO: 58804 - RNA, 18 nt, Human
aggaacacaggacaggac

SEQ ID NO: 58805 - RNA, 19 nt, Human
aggaacacaggacaggaca

SEQ ID NO: 58806 - RNA, 22 nt, Human
auggaaaaguauccugcccaca

SEQ ID NO: 58807 - RNA, 23 nt, Human
caaaacaucuuaggcaacgagaa

SEQ ID NO: 58808 - RNA, 22 nt, Human
caaauggaacuucuugucccuc

SEQ ID NO: 58809 - RNA, 19 nt, Human
cacgcaguccacacaacag

SEQ ID NO: 58810 - RNA, 20 nt, Human
cacguggacccccggucucc

SEQ ID NO: 58811 - RNA, 21 nt, Human
cagccgccuccugauggcacc

SEQ ID NO: 58812 - RNA, 18 nt, Human
cagcuuggauauuuccug

SEQ ID NO: 58813 - RNA, 21 nt, Human
caggacaagagccccacgugg

SEQ ID NO: 58814 - RNA, 23 nt, Human
caggacaagagccccacguggac

SEQ ID NO: 58815 - RNA, 18 nt, Human
caggacaggacaagagcc

SEQ ID NO: 58816 - RNA, 23 nt, Human
caggugagcagugcaucuacccc

SEQ ID NO: 58817 - RNA, 21 nt, Human
cagguuucaagcaacagcuga

SEQ ID NO: 58818 - RNA, 21 nt, Human
cauuuagagacuagacuaucc

SEQ ID NO: 58819 - RNA, 23 nt, Human
ccaaaucaccuaacaaaaaugag

SEQ ID NO: 58820 - RNA, 19 nt, Human
ccacaaggacucacccaag

SEQ ID NO: 58821 - RNA, 22 nt, Human
ccacacauacgccccgcaaagc

SEQ ID NO: 58822 - RNA, 19 nt, Human
ccagcgccgcggcggcugc

SEQ ID NO: 58823 - RNA, 25 nt, Human
ccaggccacgguacauguuugcacg

SEQ ID NO: 58824 - RNA, 26 nt, Human
ccaucauuuagagacuagacuaucca

SEQ ID NO: 58825 - RNA, 19 nt, Human
ccccauaccccaaaacacu

SEQ ID NO: 58826 - RNA, 21 nt, Human
ccccauaccccaaaacacuau

SEQ ID NO: 58827 - RNA, 24 nt, Human
cccuaucccaaaucaccuaacaaa

SEQ ID NO: 58828 - RNA, 23 nt, Human
cccucaagacuggugagcuccag

SEQ ID NO: 58829 - RNA, 18 nt, Human
cccugcaccucccucaag

SEQ ID NO: 58830 - RNA, 24 nt, Human
ccuaucccaaaucaccuaacaaaa

SEQ ID NO: 58831 - RNA, 21 nt, Human
ccucaggagagaguggaugcu

SEQ ID NO: 58832 - RNA, 18 nt, Human
ccugcaccucuuccccaa

SEQ ID NO: 58833 - RNA, 18 nt, Human
ccuggggccacaccccaa

SEQ ID NO: 58834 - RNA, 21 nt, Human
cgccucaguccccagcacuga

SEQ ID NO: 58835 - RNA, 19 nt, Human
cgguacauguuugcacgca

SEQ ID NO: 58836 - RNA, 27 nt, Human
cucaagacuggugagcuccagcaaccc

SEQ ID NO: 58837 - RNA, 22 nt, Human
cucagcgacccauuaggagcac

SEQ ID NO: 58838 - RNA, 19 nt, Human
gagaauuuuuuaaugacuc

SEQ ID NO: 58839 - RNA, 24 nt, Human
gccacaccccaaacugcugaggug

SEQ ID NO: 58840 - RNA, 22 nt, Human
gccgcggcggcugcccaggugc

SEQ ID NO: 58841 - RNA, 19 nt, Human
ggacaggacaagagcccca

SEQ ID NO: 58842 - RNA, 22 nt, Human
ggcucgccucaguccccagcac

SEQ ID NO: 58843 - RNA, 23 nt, Human
gggagaauuuuuuaaugacucuu

SEQ ID NO: 58844 - RNA, 23 nt, Human
gguacauuaauaucaaucucuau

SEQ ID NO: 58845 - RNA, 22 nt, Human
uaaaaaacacagcuucuccugc

SEQ ID NO: 58846 - RNA, 22 nt, Human
uaaaaaacacaguuuccccugc

SEQ ID NO: 58847 - RNA, 25 nt, Human
uaaaacaauuccauggaaacuuuaa

SEQ ID NO: 58848 - RNA, 23 nt, Human
uaccaugugggcacgugugugug

SEQ ID NO: 58849 - RNA, 22 nt, Human
uagguaagccacaacggggccc

SEQ ID NO: 58850 - RNA, 21 nt, Human
ucaccuaacaaaaaugagagc

SEQ ID NO: 58851 - RNA, 19 nt, Human
uccacacaacaguaaaggc

SEQ ID NO: 58852 - RNA, 20 nt, Human
uccauccccacgaggaacac

SEQ ID NO: 58853 - RNA, 21 nt, Human
uccauccccacgaggaacaca

SEQ ID NO: 58854 - RNA, 18 nt, Human
ucccaaaucaccuaacaa

SEQ ID NO: 58855 - RNA, 21 nt, Human
uccugcaccucuuccccaaga

SEQ ID NO: 58856 - RNA, 21 nt, Human
ucuuaggccuguggcucuaga

SEQ ID NO: 58857 - RNA, 21 nt, Human
ugagggggcucgccucagucc

SEQ ID NO: 58858 - RNA, 21 nt, Human
ugcaccucuuccccaagacug

SEQ ID NO: 58859 - RNA, 19 nt, Human
ugcacuccagcgaccugag

SEQ ID NO: 58860 - RNA, 19 nt, Human
ugcacuccagcgaccugag

SEQ ID NO: 58861 - RNA, 19 nt, Human
ugcacuccagcgaccugag

SEQ ID NO: 58862 - RNA, 20 nt, Human
ugccuagaucgaugauggag

SEQ ID NO: 58863 - RNA, 30 nt, Human
uggacccccggucuccgcaggcagccagga

SEQ ID NO: 58864 - RNA, 23 nt, Human
uggagcgggcaugugcaccugag

SEQ ID NO: 58865 - RNA, 22 nt, Human
ugggaagggugcaggugagcag

SEQ ID NO: 58866 - RNA, 18 nt, Human
ugggacacaggugacagu

SEQ ID NO: 58867 - RNA, 21 nt, Human
uuaacagguuucaagcaacag

SEQ ID NO: 58868 - RNA, 19 nt, Human
uucaagcaacagcugauaa

SEQ ID NO: 58869 - RNA, 23 nt, Human
uucaccuggaggggacacuccgg

SEQ ID NO: 58870 - RNA, 20 nt, Human
uuccccugcaccucccucaa

SEQ ID NO: 58871 - RNA, 22 nt, Human
uuccuuguugcauaaaacauug

SEQ ID NO: 58872 - RNA, 18 nt, Human
uugucccucacgcagucc

SEQ ID NO: 58873 - RNA, 18 nt, Human
aaacaaaaccagaaacaa

SEQ ID NO: 58874 - RNA, 22 nt, Human
aaacagaaauagaagcuauagg

SEQ ID NO: 58875 - RNA, 28 nt, Human
aaauaagaagcaaaaacagaagggaccc

SEQ ID NO: 58876 - RNA, 24 nt, Human
aacaauagaaggaccuugaaaaga

SEQ ID NO: 58877 - RNA, 20 nt, Human
aacagacucaaaacaacacu

SEQ ID NO: 58878 - RNA, 18 nt, Human
aacauaacacaaggacac

SEQ ID NO: 58879 - RNA, 19 nt, Human
aacauaacacaaggacaca

SEQ ID NO: 58880 - RNA, 18 nt, Human
aacuauauggcucaaagu

SEQ ID NO: 58881 - RNA, 21 nt, Human
aagaaaaaagggaauauguga

SEQ ID NO: 58882 - RNA, 23 nt, Human
aagcaaaaacagaaauagaagcu

SEQ ID NO: 58883 - RNA, 27 nt, Human
aagcaaaaacagaaauagaagggaccc

SEQ ID NO: 58884 - RNA, 20 nt, Human
acaaaacaauagaaggaccc

SEQ ID NO: 58885 - RNA, 20 nt, Human
acaaugaaauaguaagccac

SEQ ID NO: 58886 - RNA, 20 nt, Human
acagaaaaguccacauggug

SEQ ID NO: 58887 - RNA, 22 nt, Human
agaaaaaagggaauaugugaug

SEQ ID NO: 58888 - RNA, 19 nt, Human
agcaagucaugcacccccc

SEQ ID NO: 58889 - RNA, 21 nt, Human
agcaagucaugcaccccccau

SEQ ID NO: 58890 - RNA, 18 nt, Human
agcucucccgcgcugcag

SEQ ID NO: 58891 - RNA, 24 nt, Human
aggacacauacauagccaaagaca

SEQ ID NO: 58892 - RNA, 23 nt, Human
aggcgcugggguccgcgcgagcc

SEQ ID NO: 58893 - RNA, 21 nt, Human
auaguaagccacaccaaaggc

SEQ ID NO: 58894 - RNA, 22 nt, Human
aucgucccucagcacucugcug

SEQ ID NO: 58895 - RNA, 21 nt, Human
augcuaaucaggaugauggag

SEQ ID NO: 58896 - RNA, 23 nt, Human
caaacaaaaccagaaacaacaua

SEQ ID NO: 58897 - RNA, 21 nt, Human
caaacaaaggcucauacaaua

SEQ ID NO: 58898 - RNA, 18 nt, Human
caacauaacacaaggaca

SEQ ID NO: 58899 - RNA, 19 nt, Human
caacauaacacaaggacac

SEQ ID NO: 58900 - RNA, 24 nt, Human
caacauaacacaaggacacauaca

SEQ ID NO: 58901 - RNA, 20 nt, Human
caaugcuacacaagguuuga

SEQ ID NO: 58902 - RNA, 25 nt, Human
cacaaggacacauacauagccaaag

SEQ ID NO: 58903 - RNA, 22 nt, Human
cacccuuucuguuuuaagaagg

SEQ ID NO: 58904 - RNA, 23 nt, Human
cacuguacaacauaacacaagga

SEQ ID NO: 58905 - RNA, 18 nt, Human
cagcaagaaggguggggc

SEQ ID NO: 58906 - RNA, 18 nt, Human
caguaaaaaggaguaaca

SEQ ID NO: 58907 - RNA, 21 nt, Human
caucauguccaguaaaaagga

SEQ ID NO: 58908 - RNA, 24 nt, Human
caugcaccccccauuagaagccuc

SEQ ID NO: 58909 - RNA, 20 nt, Human
cauucugcuucuuccucacu

SEQ ID NO: 58910 - RNA, 21 nt, Human
ccaaagacauauucauuacag

SEQ ID NO: 58911 - RNA, 19 nt, Human
ccacccuuucuguuuuaag

SEQ ID NO: 58912 - RNA, 24 nt, Human
cccauagguucuuucaacaugaag

SEQ ID NO: 58913 - RNA, 19 nt, Human
ccccggacgccaccuggug

SEQ ID NO: 58914 - RNA, 24 nt, Human
ccccggacgccaccuggugcagcu

SEQ ID NO: 58915 - RNA, 20 nt, Human
cccgcgcugcagcucacagg

SEQ ID NO: 58916 - RNA, 22 nt, Human
cccuugucuuuaugaucaggag

SEQ ID NO: 58917 - RNA, 26 nt, Human
ccuuucuguuuuaagaaauauaaaga

SEQ ID NO: 58918 - RNA, 24 nt, Human
cgcgcugcagcucacaggcagcga

SEQ ID NO: 58919 - RNA, 23 nt, Human
cucaaacaaaggcucauacaaua

SEQ ID NO: 58920 - RNA, 20 nt, Human
cucaaccuaauauuuaagac

SEQ ID NO: 58921 - RNA, 25 nt, Human
gaaaaagugcucugcggaagcccug

SEQ ID NO: 58922 - RNA, 22 nt, Human
gacacauacauagccaaagaca

SEQ ID NO: 58923 - RNA, 20 nt, Human
gcuauagcauaauaacaucu

SEQ ID NO: 58924 - RNA, 18 nt, Human
gcucugcggaagcccugg

SEQ ID NO: 58925 - RNA, 22 nt, Human
ggaguaacaaauagaaaugagg

SEQ ID NO: 58926 - RNA, 20 nt, Human
gggaagacugaaaagacccc

SEQ ID NO: 58927 - RNA, 21 nt, Human
gggaagacugaaaagaccccu

SEQ ID NO: 58928 - RNA, 22 nt, Human
gggacagcaagaaggguggggc

SEQ ID NO: 58929 - RNA, 22 nt, Human
gggcaccuggggcgagagagcg

SEQ ID NO: 58930 - RNA, 27 nt, Human
ggggacagcaagaaggguggggccggu

SEQ ID NO: 58931 - RNA, 22 nt, Human
guaaauaauaacagacucaaaa

SEQ ID NO: 58932 - RNA, 24 nt, Human
guagacaucaaaagaaaaaaggga

SEQ ID NO: 58933 - RNA, 26 nt, Human
uaagagaaauaagaagcaaaaacaga

SEQ ID NO: 58934 - RNA, 24 nt, Human
uaauacuugugacuauuuucuaga

SEQ ID NO: 58935 - RNA, 20 nt, Human
uagaaaaguccaguguggug

SEQ ID NO: 58936 - RNA, 20 nt, Human
uagaaggaccuugaaaagau

SEQ ID NO: 58937 - RNA, 19 nt, Human
uagacaucaaaagaaaaaa

SEQ ID NO: 58938 - RNA, 20 nt, Human
uaguaagccacaccaaaggc

SEQ ID NO: 58939 - RNA, 18 nt, Human
uauugcuucuguauagug

SEQ ID NO: 58940 - RNA, 23 nt, Human
ucaaccuaauauuuaagacuauc

SEQ ID NO: 58941 - RNA, 19 nt, Human
ucagugaauguugacugag

SEQ ID NO: 58942 - RNA, 24 nt, Human
ucauuacagugaauaucuccuggg

SEQ ID NO: 58943 - RNA, 23 nt, Human
uccuggggguagugagggaauaa

SEQ ID NO: 58944 - RNA, 19 nt, Human
ucuauaguaaaauucgugc

SEQ ID NO: 58945 - RNA, 23 nt, Human
ucuuucaacaugaagcuuuccag

SEQ ID NO: 58946 - RNA, 24 nt, Human
ugacugagaucuauauugugccau

SEQ ID NO: 58947 - RNA, 19 nt, Human
ugaggagagggaagacuga

SEQ ID NO: 58948 - RNA, 23 nt, Human
ugagggaauaaacaugcuaauca

SEQ ID NO: 58949 - RNA, 23 nt, Human
ugcaaugcuacacaagguuugag

SEQ ID NO: 58950 - RNA, 20 nt, Human
ugcuaaucaggaugauggag

SEQ ID NO: 58951 - RNA, 18 nt, Human
uggaccaugaauguaaaa

SEQ ID NO: 58952 - RNA, 19 nt, Human
ugggugggugcacacaaug

SEQ ID NO: 58953 - RNA, 19 nt, Human
ugguagaaaauaugaauag

SEQ ID NO: 58954 - RNA, 21 nt, Human
uguccaguaaaaaggaguaac

SEQ ID NO: 58955 - RNA, 18 nt, Human
uguggugggugggugggu

SEQ ID NO: 58956 - RNA, 28 nt, Human
uguguaaauaauaacagacucaaaacaa

SEQ ID NO: 58957 - RNA, 23 nt, Human
uuagaaccagcaagucaugcacc

SEQ ID NO: 58958 - RNA, 24 nt, Human
uuagaagccucacugaaggucuga

SEQ ID NO: 58959 - RNA, 23 nt, Human
uuauaagagaaauaagaagcaaa

SEQ ID NO: 58960 - RNA, 22 nt, Human
aaacagucaaaucacaauaggg

SEQ ID NO: 58961 - RNA, 20 nt, Human
aaucaauaaaccccgaaccc

SEQ ID NO: 58962 - RNA, 23 nt, Human
aucccuccccccgcaacccccag

SEQ ID NO: 58963 - RNA, 20 nt, Human
auucaaucaauaaaccccga

SEQ ID NO: 58964 - RNA, 22 nt, Human
caaucagaaaaaaauaaguuuc

SEQ ID NO: 58965 - RNA, 28 nt, Human
cacccgccaucccuccccccgcaacccc

SEQ ID NO: 58966 - RNA, 19 nt, Human
cagggggcaggauuggagg

SEQ ID NO: 58967 - RNA, 20 nt, Human
cagggggcaggauuggaggg

SEQ ID NO: 58968 - RNA, 19 nt, Human
caguaaaaauaguauuuua

SEQ ID NO: 58969 - RNA, 24 nt, Human
caguacacucuuccccucucguuc

SEQ ID NO: 58970 - RNA, 22 nt, Human
cccacagcaacguuacaaucag

SEQ ID NO: 58971 - RNA, 23 nt, Human
cccacggccgcgcguuuuaggac

SEQ ID NO: 58972 - RNA, 22 nt, Human
ccccacccgccaucccuccccc

SEQ ID NO: 58973 - RNA, 23 nt, Human
ccccacccgccaucccucccccc

SEQ ID NO: 58974 - RNA, 24 nt, Human
ccccaguacacucuuccccucucg

SEQ ID NO: 58975 - RNA, 22 nt, Human
cccccacccgccaucccucccc

SEQ ID NO: 58976 - RNA, 23 nt, Human
cccccacccgccaucccuccccc

SEQ ID NO: 58977 - RNA, 23 nt, Human
cccccgcaacccccaguacacuc

SEQ ID NO: 58978 - RNA, 20 nt, Human
cccuccccccgcaaccccca

SEQ ID NO: 58979 - RNA, 18 nt, Human
cgcucucucucugcagag

SEQ ID NO: 58980 - RNA, 22 nt, Human
cggaauucaaucaauaaacccc

SEQ ID NO: 58981 - RNA, 20 nt, Human
cucuuccccucucguuccca

SEQ ID NO: 58982 - RNA, 21 nt, Human
cugcagaggcucccgcgccgg

SEQ ID NO: 58983 - RNA, 23 nt, Human
gaacccacggccgcgcguuuuag

SEQ ID NO: 58984 - RNA, 20 nt, Human
gcaggauuggaggggggggg

SEQ ID NO: 58985 - RNA, 19 nt, Human
ggaggggggggggagaggg

SEQ ID NO: 58986 - RNA, 23 nt, Human
ggggagaggggauauggguaaaa

SEQ ID NO: 58987 - RNA, 23 nt, Human
gggggggggagaggggauauggg

SEQ ID NO: 58988 - RNA, 28 nt, Human
ucagaaaaaaauaaguuucagggggcaa

SEQ ID NO: 58989 - RNA, 22 nt, Human
uccccccgcaacccccaguaca

SEQ ID NO: 58990 - RNA, 18 nt, Human
uggaggggggggggagag

SEQ ID NO: 58991 - RNA, 24 nt, Human
uggaggggggggggagaggggaua

SEQ ID NO: 58992 - RNA, 19 nt, Human
uggcaguaaaaauaguauu

SEQ ID NO: 58993 - RNA, 19 nt, Human
uuccccucucguucccaca

SEQ ID NO: 58994 - RNA, 18 nt, Human
uuggaggggggggggaga

SEQ ID NO: 58995 - RNA, 21 nt, Human
uuuuuuuuuuuuuaaagagug

SEQ ID NO: 58996 - RNA, 19 nt, Human
uuuuuuuuuuuuuuuuuaa

SEQ ID NO: 58997 - RNA, 20 nt, Human
acaggugccaugccaggccu

SEQ ID NO: 58998 - RNA, 19 nt, Human
agaacggagcagccccagg

SEQ ID NO: 58999 - RNA, 20 nt, Human
agagagaacgugggcuggag

SEQ ID NO: 59000 - RNA, 22 nt, Human
agagcuucugcucaucuggccc

SEQ ID NO: 59001 - RNA, 18 nt, Human
agaggguacagggcggcc

SEQ ID NO: 59002 - RNA, 18 nt, Human
aggcagagagaacguggg

SEQ ID NO: 59003 - RNA, 21 nt, Human
aggcggcucagggagccucag

SEQ ID NO: 59004 - RNA, 18 nt, Human
agggagccucaggccagg

SEQ ID NO: 59005 - RNA, 19 nt, Human
aggggcugggaggugcuca

SEQ ID NO: 59006 - RNA, 19 nt, Human
aucagccccagggcacugg

SEQ ID NO: 59007 - RNA, 22 nt, Human
cagagagaacgugggcuggaga

SEQ ID NO: 59008 - RNA, 23 nt, Human
cagccugggucaucaggaacuag

SEQ ID NO: 59009 - RNA, 20 nt, Human
cagggcacugggcgacaggu

SEQ ID NO: 59010 - RNA, 21 nt, Human
caucaggaacuagacuggcuc

SEQ ID NO: 59011 - RNA, 25 nt, Human
cccacaacaggcagacugaucaacg

SEQ ID NO: 59012 - RNA, 19 nt, Human
cccccagcaaggccguuca

SEQ ID NO: 59013 - RNA, 18 nt, Human
cccuguugauuccucaga

SEQ ID NO: 59014 - RNA, 20 nt, Human
ccucgggcuccaggaaugga

SEQ ID NO: 59015 - RNA, 18 nt, Human
cggcucagggagccucag

SEQ ID NO: 59016 - RNA, 26 nt, Human
cuagaaauccuuuauuuacauuuucu

SEQ ID NO: 59017 - RNA, 24 nt, Human
cuagggcgggguuggcaugagggg

SEQ ID NO: 59018 - RNA, 20 nt, Human
cucacaggcagagagaacgu

SEQ ID NO: 59019 - RNA, 20 nt, Human
cuuagaaaaaaauauacaga

SEQ ID NO: 59020 - RNA, 21 nt, Human
cuucccugagaucagccccag

SEQ ID NO: 59021 - RNA, 21 nt, Human
gccccagggcacugggcgaca

SEQ ID NO: 59022 - RNA, 19 nt, Human
gcucaucuggcccuggagc

SEQ ID NO: 59023 - RNA, 23 nt, Human
gcucaucuggcccuggagcuggg

SEQ ID NO: 59024 - RNA, 22 nt, Human
ggacacaugugggcaccuugca

SEQ ID NO: 59025 - RNA, 23 nt, Human
ggaggacacuggugccccuuaaa

SEQ ID NO: 59026 - RNA, 19 nt, Human
gggauggacacaugugggc

SEQ ID NO: 59027 - RNA, 21 nt, Human
gggcaggggcugggaggugcu

SEQ ID NO: 59028 - RNA, 26 nt, Human
gggguuggcaugaggggcaggggcug

SEQ ID NO: 59029 - RNA, 27 nt, Human
gggguuggcaugaggggcaggggcugg

SEQ ID NO: 59030 - RNA, 24 nt, Human
ggugaugguggggaggcggcucag

SEQ ID NO: 59031 - RNA, 24 nt, Human
uagaaauccuuuauuuacauuuuc

SEQ ID NO: 59032 - RNA, 20 nt, Human
uagggucuuuagggaaaggu

SEQ ID NO: 59033 - RNA, 19 nt, Human
ucaggccaggcagagaacg

SEQ ID NO: 59034 - RNA, 23 nt, Human
ucaucuagaaauccuuuauuuac

SEQ ID NO: 59035 - RNA, 20 nt, Human
uccuugaggggaggacacug

SEQ ID NO: 59036 - RNA, 22 nt, Human
ucuuagaaaaaaauauacagau

SEQ ID NO: 59037 - RNA, 18 nt, Human
uucccugagaucagcccc

SEQ ID NO: 59038 - RNA, 19 nt, Human
uucccugagaucagcccca

SEQ ID NO: 59039 - RNA, 18 nt, Human
aacauuuuuaaaaaaugg

SEQ ID NO: 59040 - RNA, 19 nt, Human
cauuuuauuuucagcuaca

SEQ ID NO: 59041 - RNA, 22 nt, Human
ggcuauauuuuucagcauguag

SEQ ID NO: 59042 - RNA, 26 nt, Human
uaaaaaugauuuaaaggcuauauuuu

SEQ ID NO: 59043 - RNA, 24 nt, Human
uagaacaacuuguauaggguuuua

SEQ ID NO: 59044 - RNA, 19 nt, Human
ugcaaagaacuaaagagaa

SEQ ID NO: 59045 - RNA, 23 nt, Human
uugaaaaagugucuuuaucucua

SEQ ID NO: 59046 - RNA, 22 nt, Human
agaaacagacauucuuuuggcc

SEQ ID NO: 59047 - RNA, 21 nt, Human
agggaugggguagaaaaggca

SEQ ID NO: 59048 - RNA, 20 nt, Human
agggguggaagacaggccua

SEQ ID NO: 59049 - RNA, 19 nt, Human
ccacggggacuccggacgc

SEQ ID NO: 59050 - RNA, 21 nt, Human
ccuagggcugggucccacucc

SEQ ID NO: 59051 - RNA, 19 nt, Human
cggcgccuggguucugccu

SEQ ID NO: 59052 - RNA, 21 nt, Human
cuagggcugggucccacuccc

SEQ ID NO: 59053 - RNA, 22 nt, Human
cugguguugccggcaggugggc

SEQ ID NO: 59054 - RNA, 24 nt, Human
gacccagguccuguggcacacuau

SEQ ID NO: 59055 - RNA, 20 nt, Human
gccuagggcugggucccacu

SEQ ID NO: 59056 - RNA, 18 nt, Human
gcgggaguggcucucucc

SEQ ID NO: 59057 - RNA, 18 nt, Human
gggcgcggcgccuggguu

SEQ ID NO: 59058 - RNA, 24 nt, Human
gucccgggcgcggcgccuggguuc

SEQ ID NO: 59059 - RNA, 19 nt, Human
ucuuuuggccuuuuccugg

SEQ ID NO: 59060 - RNA, 22 nt, Human
ugaaacaucuauuuuagcagca

SEQ ID NO: 59061 - RNA, 21 nt, Human
ugggcgggaguggcucucucc

SEQ ID NO: 59062 - RNA, 21 nt, Human
uucagaaaaaugaaacaucua

SEQ ID NO: 59063 - RNA, 24 nt, Human
uuucagaaaaaugaaacaucuauu

SEQ ID NO: 59064 - RNA, 23 nt, Human
uuuccuggcacugguguugccgg

SEQ ID NO: 59065 - RNA, 25 nt, Human
aggcaacuaaaaugagguugggggu

SEQ ID NO: 59066 - RNA, 19 nt, Human
cacaguacacaggaggcaa

SEQ ID NO: 59067 - RNA, 22 nt, Human
ccgagagcugagagcgucccca

SEQ ID NO: 59068 - RNA, 19 nt, Human
cuaaaaugagguugggggu

SEQ ID NO: 59069 - RNA, 25 nt, Human
gucacccucacagggauggccacgg

SEQ ID NO: 59070 - RNA, 20 nt, Human
uuuucuagaccuguuagcug

SEQ ID NO: 59071 - RNA, 19 nt, Human
acauuauaaaugagaugcu

SEQ ID NO: 59072 - RNA, 22 nt, Human
cccaucguggaccuuuggagau

SEQ ID NO: 59073 - RNA, 28 nt, Human
cgcuuuuguuguuguuguuauagaacaa

SEQ ID NO: 59074 - RNA, 21 nt, Human
uaacuuugaaagcagaaauau

SEQ ID NO: 59075 - RNA, 20 nt, Human
ugccuugagcugagaucacc

SEQ ID NO: 59076 - RNA, 20 nt, Human
uggagcuguugggaaagccc

SEQ ID NO: 59077 - RNA, 21 nt, Human
uugagcugagaucacacuaau

SEQ ID NO: 59078 - RNA, 22 nt, Human
uuguuguuguuguuauagaaca

SEQ ID NO: 59079 - RNA, 18 nt, Human
uuuucaauuucauuuaug

SEQ ID NO: 59080 - RNA, 18 nt, Human
aaaaacuuaguaaggauc

SEQ ID NO: 59081 - RNA, 28 nt, Human
aaacacaaaguagaaaguaagggacccc

SEQ ID NO: 59082 - RNA, 21 nt, Human
aagaucagaguucagccaccc

SEQ ID NO: 59083 - RNA, 24 nt, Human
aaugauaauagcaguguagaaaaa

SEQ ID NO: 59084 - RNA, 26 nt, Human
acuacagaaagugauuucaacauaag

SEQ ID NO: 59085 - RNA, 22 nt, Human
acucuaaaaauuggauuaggga

SEQ ID NO: 59086 - RNA, 18 nt, Human
agaauccuccuguccuuc

SEQ ID NO: 59087 - RNA, 18 nt, Human
aggaggcagcuguaggcg

SEQ ID NO: 59088 - RNA, 19 nt, Human
aggcguuuuaauuggaaau

SEQ ID NO: 59089 - RNA, 22 nt, Human
augaagaaacuacuagccacuc

SEQ ID NO: 59090 - RNA, 22 nt, Human
caagaucagaguucagccaccc

SEQ ID NO: 59091 - RNA, 21 nt, Human
caagcuggauuaagacauuag

SEQ ID NO: 59092 - RNA, 21 nt, Human
cagccacccaagcagaaguuc

SEQ ID NO: 59093 - RNA, 18 nt, Human
caguguagaaaaaugaag

SEQ ID NO: 59094 - RNA, 24 nt, Human
ccuccuguccuucugggauuuuua

SEQ ID NO: 59095 - RNA, 21 nt, Human
cuuauaagcuuugaaaugcaa

SEQ ID NO: 59096 - RNA, 24 nt, Human
gacauuaacuauaauaauauggaa

SEQ ID NO: 59097 - RNA, 28 nt, Human
gacuacagaaagugauuucaacauaaga

SEQ ID NO: 59098 - RNA, 18 nt, Human
gagcauuacaucauuccc

SEQ ID NO: 59099 - RNA, 20 nt, Human
gauuaagacauuaacuauaa

SEQ ID NO: 59100 - RNA, 22 nt, Human
ggaagucucccaugaaaaacuu

SEQ ID NO: 59101 - RNA, 19 nt, Human
ggaguugaaaggcacagug

SEQ ID NO: 59102 - RNA, 20 nt, Human
uaaagcaucauaaugacuaa

SEQ ID NO: 59103 - RNA, 18 nt, Human
uaauaauacagacagucu

SEQ ID NO: 59104 - RNA, 25 nt, Human
uacuuugacuacagaaagugauuuc

SEQ ID NO: 59105 - RNA, 20 nt, Human
uaggaggcagcuguaggcgg

SEQ ID NO: 59106 - RNA, 26 nt, Human
uaguuugaagcuuauuuuuuuuucca

SEQ ID NO: 59107 - RNA, 19 nt, Human
uauggacaaaaccuaaaaa

SEQ ID NO: 59108 - RNA, 21 nt, Human
uauggacaaaaccuaaaaaaa

SEQ ID NO: 59109 - RNA, 20 nt, Human
ucacugaaaagaaaauaugg

SEQ ID NO: 59110 - RNA, 26 nt, Human
ucucccaugaaaaacuuaguaaggau

SEQ ID NO: 59111 - RNA, 22 nt, Human
ugaaacacaaaguagaaaguaa

SEQ ID NO: 59112 - RNA, 18 nt, Human
ugaaaggcacagugcaaa

SEQ ID NO: 59113 - RNA, 21 nt, Human
ugaaaugcaaguacagcuuua

SEQ ID NO: 59114 - RNA, 20 nt, Human
ugcaaguacagcuuuaaagc

SEQ ID NO: 59115 - RNA, 23 nt, Human
uggacaaaaccuaaaaaaagaga

SEQ ID NO: 59116 - RNA, 30 nt, Human
uggacaaaaccuaaaaaaagagauuuguaa

SEQ ID NO: 59117 - RNA, 21 nt, Human
uggauuagggaaaaaagugau

SEQ ID NO: 59118 - RNA, 25 nt, Human
ugugaaacacaaaguagaaaguaau

SEQ ID NO: 59119 - RNA, 22 nt, Human
uucaaaguguugagaauccucc

SEQ ID NO: 59120 - RNA, 22 nt, Human
uugguauacuuugacuacagaa

SEQ ID NO: 59121 - RNA, 23 nt, Human
aaaagcacucuagccucuuaaaa

SEQ ID NO: 59122 - RNA, 22 nt, Human
aagcaacggaaacgccagcgcc

SEQ ID NO: 59123 - RNA, 19 nt, Human
aagcacuggcauacaaaug

SEQ ID NO: 59124 - RNA, 21 nt, Human
aagcaggaccagacuguggga

SEQ ID NO: 59125 - RNA, 22 nt, Human
aaggugcugaaggaaggcagug

SEQ ID NO: 59126 - RNA, 22 nt, Human
aauaacauuuccaagaguucac

SEQ ID NO: 59127 - RNA, 22 nt, Human
agacgcugaaggauccgcagcu

SEQ ID NO: 59128 - RNA, 20 nt, Human
augcagcuaaaggugcugaa

SEQ ID NO: 59129 - RNA, 24 nt, Human
caccuagacugauccaagcaacgg

SEQ ID NO: 59130 - RNA, 19 nt, Human
cagcagggagcucuucccc

SEQ ID NO: 59131 - RNA, 25 nt, Human
caggaccagacugugggacccaagu

SEQ ID NO: 59132 - RNA, 23 nt, Human
ccccgaacccccgggagagcggc

SEQ ID NO: 59133 - RNA, 23 nt, Human
cgccagcgccccaccccggcccu

SEQ ID NO: 59134 - RNA, 21 nt, Human
cucaggucaggggaaggugaa

SEQ ID NO: 59135 - RNA, 18 nt, Human
cugauccaagcaacggaa

SEQ ID NO: 59136 - RNA, 19 nt, Human
cuucuaugacguguaugug

SEQ ID NO: 59137 - RNA, 21 nt, Human
gacugauccaagcaacggaaa

SEQ ID NO: 59138 - RNA, 20 nt, Human
gagcaugcuaguaugaauaa

SEQ ID NO: 59139 - RNA, 25 nt, Human
gccccgaacccccgggagagcggcg

SEQ ID NO: 59140 - RNA, 19 nt, Human
ggaaacgccagcgccccac

SEQ ID NO: 59141 - RNA, 20 nt, Human
ggaaggugaagcaggaccag

SEQ ID NO: 59142 - RNA, 26 nt, Human
gguggugcaggcacacagcagggagc

SEQ ID NO: 59143 - RNA, 25 nt, Human
guggugcaggcacacagcagggagc

SEQ ID NO: 59144 - RNA, 22 nt, Human
uaaaaaaggcuaaaagcacucu

SEQ ID NO: 59145 - RNA, 20 nt, Human
uaauauaaauggaguuuuua

SEQ ID NO: 59146 - RNA, 20 nt, Human
uagacugauccaagcaacgg

SEQ ID NO: 59147 - RNA, 23 nt, Human
uagacugauccaagcaacggaaa

SEQ ID NO: 59148 - RNA, 18 nt, Human
ucagaaagaagcaccacu

SEQ ID NO: 59149 - RNA, 19 nt, Human
uccaagcaacggaaacgcc

SEQ ID NO: 59150 - RNA, 22 nt, Human
ugccccgaacccccgggagagc

SEQ ID NO: 59151 - RNA, 23 nt, Human
uucuaugacguguauguguuggu

SEQ ID NO: 59152 - RNA, 20 nt, Human
aacccaaccccuccccccac

SEQ ID NO: 59153 - RNA, 21 nt, Human
aacccaaccccuccccccacc

SEQ ID NO: 59154 - RNA, 23 nt, Human
aacccaaccccuccccccacccc

SEQ ID NO: 59155 - RNA, 26 nt, Human
aacccaaccccuccccccaccccugg

SEQ ID NO: 59156 - RNA, 23 nt, Human
aagugcccgccaaagcuguggcc

SEQ ID NO: 59157 - RNA, 18 nt, Human
acccaaccccucccccca

SEQ ID NO: 59158 - RNA, 22 nt, Human
acccaaccccuccccccacccc

SEQ ID NO: 59159 - RNA, 18 nt, Human
agagcccaacccaacccc

SEQ ID NO: 59160 - RNA, 20 nt, Human
agauaagagcccaacccaac

SEQ ID NO: 59161 - RNA, 22 nt, Human
augaagauaagagcccaaccca

SEQ ID NO: 59162 - RNA, 19 nt, Human
auggcccgugggaguggga

SEQ ID NO: 59163 - RNA, 19 nt, Human
caacccaaccccucccccc

SEQ ID NO: 59164 - RNA, 20 nt, Human
caacccaaccccucccccca

SEQ ID NO: 59165 - RNA, 22 nt, Human
caacccaaccccuccccccacc

SEQ ID NO: 59166 - RNA, 23 nt, Human
caacccaaccccuccccccaccc

SEQ ID NO: 59167 - RNA, 24 nt, Human
caaccccuccccccaccccugccc

SEQ ID NO: 59168 - RNA, 23 nt, Human
caccccugccccuuccuuagucu

SEQ ID NO: 59169 - RNA, 18 nt, Human
cagcagaauccagccgca

SEQ ID NO: 59170 - RNA, 24 nt, Human
cagcagaauccagccgcagcggag

SEQ ID NO: 59171 - RNA, 23 nt, Human
cagccgcagcggaggccucgggu

SEQ ID NO: 59172 - RNA, 20 nt, Human
cauuucuuggcagaagugcc

SEQ ID NO: 59173 - RNA, 21 nt, Human
ccaaccccuccccccaccccu

SEQ ID NO: 59174 - RNA, 25 nt, Human
ccaaccccuccccccaccccugccc

SEQ ID NO: 59175 - RNA, 24 nt, Human
cccaaccccuccccccaccccugc

SEQ ID NO: 59176 - RNA, 20 nt, Human
ccccaccccugccccuuccu

SEQ ID NO: 59177 - RNA, 21 nt, Human
ccccuccccccaccccugccc

SEQ ID NO: 59178 - RNA, 23 nt, Human
ccgguucgcagcagaauccagcc

SEQ ID NO: 59179 - RNA, 21 nt, Human
cgcacgggcggacucgaggac

SEQ ID NO: 59180 - RNA, 21 nt, Human
cugccccuuccuuagucucug

SEQ ID NO: 59181 - RNA, 22 nt, Human
cuggugcugauaaccauuucuu

SEQ ID NO: 59182 - RNA, 23 nt, Human
gagcguuuccuaagcuccaugaa

SEQ ID NO: 59183 - RNA, 24 nt, Human
gaggcuguagcaaggggaggaagc

SEQ ID NO: 59184 - RNA, 21 nt, Human
gagggucagaggggaguggag

SEQ ID NO: 59185 - RNA, 20 nt, Human
gcagcggcgcggaccgggag

SEQ ID NO: 59186 - RNA, 19 nt, Human
gcccaacccaaccccuccc

SEQ ID NO: 59187 - RNA, 26 nt, Human
gcccaacccaaccccuccccccaccc

SEQ ID NO: 59188 - RNA, 18 nt, Human
ggcagaggcuguagcaag

SEQ ID NO: 59189 - RNA, 19 nt, Human
ggccauggcggcuggugcu

SEQ ID NO: 59190 - RNA, 26 nt, Human
ggccauggcggcuggugcugauaacc

SEQ ID NO: 59191 - RNA, 18 nt, Human
gggaguggagguggacag

SEQ ID NO: 59192 - RNA, 22 nt, Human
gggcagaggcuguagcaagggg

SEQ ID NO: 59193 - RNA, 19 nt, Human
uaagagcccaacccaaccc

SEQ ID NO: 59194 - RNA, 22 nt, Human
ucaggcuuggccauggcggcug

SEQ ID NO: 59195 - RNA, 22 nt, Human
ucuggagcuggaacaaucaggc

SEQ ID NO: 59196 - RNA, 21 nt, Human
ugaagauaagagcccaaccca

SEQ ID NO: 59197 - RNA, 19 nt, Human
uggagguggacaggaucua

SEQ ID NO: 59198 - RNA, 20 nt, Human
uggagguggacaggaucuau

SEQ ID NO: 59199 - RNA, 21 nt, Human
uuccuuagucucuggagcugg

SEQ ID NO: 59200 - RNA, 27 nt, Human
uuggcagaagugcccgccaaagcugug

SEQ ID NO: 59201 - RNA, 26 nt, Human
aaaaaaaggaaacaacgcgaaaaaaa

SEQ ID NO: 59202 - RNA, 24 nt, Human
aaaaaggaaacaacgcgaaaaaaa

SEQ ID NO: 59203 - RNA, 21 nt, Human
aaacaacgcgaaaaaaaggga

SEQ ID NO: 59204 - RNA, 20 nt, Human
aacccggcuccaucuugcgg

SEQ ID NO: 59205 - RNA, 18 nt, Human
aacgcgaaaaaaagggag

SEQ ID NO: 59206 - RNA, 18 nt, Human
aaggaaacaacgcgaaaa

SEQ ID NO: 59207 - RNA, 20 nt, Human
aaugaaacuaguaagaauga

SEQ ID NO: 59208 - RNA, 18 nt, Human
accaagcacauuacccug

SEQ ID NO: 59209 - RNA, 23 nt, Human
agaaucagagauugcugugauuu

SEQ ID NO: 59210 - RNA, 25 nt, Human
agaaucagagauugcugugauuuuu

SEQ ID NO: 59211 - RNA, 23 nt, Human
agagaacaaaauaaaauuagaau

SEQ ID NO: 59212 - RNA, 19 nt, Human
aggaaacaacgcgaaaaaa

SEQ ID NO: 59213 - RNA, 19 nt, Human
augaaacuaguaagaauga

SEQ ID NO: 59214 - RNA, 18 nt, Human
caacccggcuccaucuug

SEQ ID NO: 59215 - RNA, 18 nt, Human
caagcacauuacccugau

SEQ ID NO: 59216 - RNA, 19 nt, Human
cacagcccaacccggcucc

SEQ ID NO: 59217 - RNA, 23 nt, Human
cacagcccaacccggcuccaucu

SEQ ID NO: 59218 - RNA, 21 nt, Human
cauugcaauauuacuguauca

SEQ ID NO: 59219 - RNA, 18 nt, Human
ccagcagcagcgucacag

SEQ ID NO: 59220 - RNA, 21 nt, Human
cugaccccagcagcagcguca

SEQ ID NO: 59221 - RNA, 20 nt, Human
gaauacagaaccaauuuagg

SEQ ID NO: 59222 - RNA, 24 nt, Human
gaccccagcagcagcgucacagcc

SEQ ID NO: 59223 - RNA, 22 nt, Human
gucacagcccaacccggcucca

SEQ ID NO: 59224 - RNA, 24 nt, Human
gucacagcccaacccggcuccauc

SEQ ID NO: 59225 - RNA, 19 nt, Human
uaaaaggugccacagguaa

SEQ ID NO: 59226 - RNA, 20 nt, Human
uaaaaggugccacagguaau

SEQ ID NO: 59227 - RNA, 27 nt, Human
uaacucaauuuaaaaaaaggaaacaac

SEQ ID NO: 59228 - RNA, 24 nt, Human
uaaggcaauaacaacaugugcaaa

SEQ ID NO: 59229 - RNA, 21 nt, Human
uagagggauuccggaaggcag

SEQ ID NO: 59230 - RNA, 18 nt, Human
uaguaagaaugaagguuu

SEQ ID NO: 59231 - RNA, 20 nt, Human
uaguaagaaugaagguuuac

SEQ ID NO: 59232 - RNA, 18 nt, Human
uauuacuguaucauugug

SEQ ID NO: 59233 - RNA, 20 nt, Human
uauucuagauguaaagguug

SEQ ID NO: 59234 - RNA, 19 nt, Human
ucacagcccaacccggcuc

SEQ ID NO: 59235 - RNA, 24 nt, Human
ugaaacuaguaagaaugaagguuu

SEQ ID NO: 59236 - RNA, 22 nt, Human
uguaaagguugaauuuuuuuuu

SEQ ID NO: 59237 - RNA, 21 nt, Human
uguuugauauugcugcaugca

SEQ ID NO: 59238 - RNA, 22 nt, Human
uugauuguauguagagaacaaa

SEQ ID NO: 59239 - RNA, 24 nt, Human
uuucaguaaccuucuaaaaaauua

SEQ ID NO: 59240 - RNA, 25 nt, Human
aaaaacccauauucccuggccccuc

SEQ ID NO: 59241 - RNA, 25 nt, Human
aaaaacccauauucccuggccccuc

SEQ ID NO: 59242 - RNA, 22 nt, Human
aaccacagcaaaggcacuucaa

SEQ ID NO: 59243 - RNA, 25 nt, Human
aagcuccugcagggaggaaggaaug

SEQ ID NO: 59244 - RNA, 25 nt, Human
aagcuccugcagggaggaaggaaug

SEQ ID NO: 59245 - RNA, 21 nt, Human
accccccucacacccaaccug

SEQ ID NO: 59246 - RNA, 18 nt, Human
acuaagguuggcauugug

SEQ ID NO: 59247 - RNA, 18 nt, Human
acuaagguuggcauugug

SEQ ID NO: 59248 - RNA, 20 nt, Human
agacgcuuguuaaaaaccca

SEQ ID NO: 59249 - RNA, 19 nt, Human
agaugggaauggggcuggg

SEQ ID NO: 59250 - RNA, 19 nt, Human
agaugggaauggggcuggg

SEQ ID NO: 59251 - RNA, 25 nt, Human
aggaaguugggaagaggaguccagg

SEQ ID NO: 59252 - RNA, 24 nt, Human
agugaggaguccuggagacucugg

SEQ ID NO: 59253 - RNA, 18 nt, Human
aguggugcugagggcaug

SEQ ID NO: 59254 - RNA, 18 nt, Human
cacacccaaccugcgucc

SEQ ID NO: 59255 - RNA, 22 nt, Human
caugauagagaaguguuuugua

SEQ ID NO: 59256 - RNA, 22 nt, Human
caugauagagaaguguuuugua

SEQ ID NO: 59257 - RNA, 18 nt, Human
ccacaaguccccaagccc

SEQ ID NO: 59258 - RNA, 18 nt, Human
ccacaaguccccaagccc

SEQ ID NO: 59259 - RNA, 24 nt, Human
ccaggccgguuccaccucuggguc

SEQ ID NO: 59260 - RNA, 19 nt, Human
cccuucaugcugaggcauc

SEQ ID NO: 59261 - RNA, 19 nt, Human
cccuucaugcugaggcauc

SEQ ID NO: 59262 - RNA, 21 nt, Human
ccucacacccaaccugcgucc

SEQ ID NO: 59263 - RNA, 19 nt, Human
ccugcagcugaggagugag

SEQ ID NO: 59264 - RNA, 20 nt, Human
cucccaggccccacccagac

SEQ ID NO: 59265 - RNA, 19 nt, Human
cugaggcaucugucuggcu

SEQ ID NO: 59266 - RNA, 19 nt, Human
cugaggcaucugucuggcu

SEQ ID NO: 59267 - RNA, 23 nt, Human
cugcguccauggccgagguugaa

SEQ ID NO: 59268 - RNA, 18 nt, Human
cuggcuccugcagcugag

SEQ ID NO: 59269 - RNA, 21 nt, Human
cugggaccccccucacaccca

SEQ ID NO: 59270 - RNA, 20 nt, Human
cuucgggggcaccuuucuca

SEQ ID NO: 59271 - RNA, 20 nt, Human
cuuugcucuuguucuucugu

SEQ ID NO: 59272 - RNA, 19 nt, Human
gaaaaccacagcaaaggca

SEQ ID NO: 59273 - RNA, 19 nt, Human
gaauuuguaguuuauuuug

SEQ ID NO: 59274 - RNA, 27 nt, Human
gacccuguuucaguagaugggaauggg

SEQ ID NO: 59275 - RNA, 27 nt, Human
gacccuguuucaguagaugggaauggg

SEQ ID NO: 59276 - RNA, 21 nt, Human
ggaaugauccacaagucccca

SEQ ID NO: 59277 - RNA, 21 nt, Human
ggaaugauccacaagucccca

SEQ ID NO: 59278 - RNA, 21 nt, Human
ggacaagaguggugcugaggg

SEQ ID NO: 59279 - RNA, 19 nt, Human
ggaccccccucacacccaa

SEQ ID NO: 59280 - RNA, 22 nt, Human
ggaccccccucacacccaaccu

SEQ ID NO: 59281 - RNA, 22 nt, Human
ggaggaaggaaugauccacaag

SEQ ID NO: 59282 - RNA, 22 nt, Human
ggaggaaggaaugauccacaag

SEQ ID NO: 59283 - RNA, 18 nt, Human
ggcuucauggucuuugcu

SEQ ID NO: 59284 - RNA, 19 nt, Human
guggugcugagggcauggu

SEQ ID NO: 59285 - RNA, 22 nt, Human
uaagacgcuuguuaaaaaccca

SEQ ID NO: 59286 - RNA, 22 nt, Human
uaagacgcuuguuaaaaaccca

SEQ ID NO: 59287 - RNA, 18 nt, Human
uagaagaccgaaaggcug

SEQ ID NO: 59288 - RNA, 19 nt, Human
uagaugggaauggggcugg

SEQ ID NO: 59289 - RNA, 19 nt, Human
uagaugggaauggggcugg

SEQ ID NO: 59290 - RNA, 22 nt, Human
ucaggaauuuguaguuuauuuu

SEQ ID NO: 59291 - RNA, 22 nt, Human
uccagguacccagucucaguug

SEQ ID NO: 59292 - RNA, 18 nt, Human
ucccaggccccacccaga

SEQ ID NO: 59293 - RNA, 22 nt, Human
ucuguauaaccugugcccagga

SEQ ID NO: 59294 - RNA, 22 nt, Human
ucuguauaaccugugcccagga

SEQ ID NO: 59295 - RNA, 23 nt, Human
ucuguauaaccugugcccaggag

SEQ ID NO: 59296 - RNA, 23 nt, Human
ucuguauaaccugugcccaggag

SEQ ID NO: 59297 - RNA, 26 nt, Human
ucugucuggcuggagaaacacuaagg

SEQ ID NO: 59298 - RNA, 26 nt, Human
ucugucuggcuggagaaacacuaagg

SEQ ID NO: 59299 - RNA, 21 nt, Human
ucugugcugcaugcagagggg

SEQ ID NO: 59300 - RNA, 24 nt, Human
ugaccuggucagccaccaggggag

SEQ ID NO: 59301 - RNA, 23 nt, Human
ugagggcauggucacacccuucu

SEQ ID NO: 59302 - RNA, 18 nt, Human
ugagugaggaguccugga

SEQ ID NO: 59303 - RNA, 20 nt, Human
uggaggaaguugggaagagg

SEQ ID NO: 59304 - RNA, 25 nt, Human
uggaggaaguugggaagaggagucc

SEQ ID NO: 59305 - RNA, 22 nt, Human
uggcauugugcucacacuggga

SEQ ID NO: 59306 - RNA, 22 nt, Human
uggcauugugcucacacuggga

SEQ ID NO: 59307 - RNA, 22 nt, Human
uggcucccaggccccacccaga

SEQ ID NO: 59308 - RNA, 28 nt, Human
uggcuggagaaacacuaagguuggcauu

SEQ ID NO: 59309 - RNA, 28 nt, Human
uggcuggagaaacacuaagguuggcauu

SEQ ID NO: 59310 - RNA, 18 nt, Human
ugggaagaggaguccagg

SEQ ID NO: 59311 - RNA, 19 nt, Human
ugggaauggggcugggguc

SEQ ID NO: 59312 - RNA, 21 nt, Human
ugggaccccccucacacccaa

SEQ ID NO: 59313 - RNA, 23 nt, Human
uggggacaagaguggugcugagg

SEQ ID NO: 59314 - RNA, 24 nt, Human
uggggucuguauaaccugugccca

SEQ ID NO: 59315 - RNA, 24 nt, Human
uggggucuguauaaccugugccca

SEQ ID NO: 59316 - RNA, 19 nt, Human
uggugcugagggcaugguc

SEQ ID NO: 59317 - RNA, 19 nt, Human
uggugcugagggcaugguc

SEQ ID NO: 59318 - RNA, 18 nt, Human
uguggcucccaggcccca

SEQ ID NO: 59319 - RNA, 22 nt, Human
aaagaauucgaguaucagugag

SEQ ID NO: 59320 - RNA, 20 nt, Human
aacucauuuccccacaccca

SEQ ID NO: 59321 - RNA, 21 nt, Human
aacucauuuccccacacccaa

SEQ ID NO: 59322 - RNA, 20 nt, Human
aagaaggagcuggaugaccc

SEQ ID NO: 59323 - RNA, 23 nt, Human
acaagaagcuagagaauguggug

SEQ ID NO: 59324 - RNA, 18 nt, Human
agacaccuuccugcccag

SEQ ID NO: 59325 - RNA, 19 nt, Human
aggagggaugagugaggca

SEQ ID NO: 59326 - RNA, 23 nt, Human
aucaaagaaaacucauuucccca

SEQ ID NO: 59327 - RNA, 21 nt, Human
auuuugagaugggaaaauuaa

SEQ ID NO: 59328 - RNA, 26 nt, Human
cagagucccacaugcagacaccuucc

SEQ ID NO: 59329 - RNA, 18 nt, Human
cagcuggucucccagguu

SEQ ID NO: 59330 - RNA, 21 nt, Human
ccacacccaagaaggagcugg

SEQ ID NO: 59331 - RNA, 22 nt, Human
ccagcaguugucugacucuggc

SEQ ID NO: 59332 - RNA, 25 nt, Human
ccagcuggucucccagguucagcca

SEQ ID NO: 59333 - RNA, 23 nt, Human
cccaagaaggagcuggaugaccc

SEQ ID NO: 59334 - RNA, 21 nt, Human
cccugcucagcagcacaggag

SEQ ID NO: 59335 - RNA, 19 nt, Human
ccugcccagcaucucuucu

SEQ ID NO: 59336 - RNA, 25 nt, Human
ccuuccugcccagcaucucuucucc

SEQ ID NO: 59337 - RNA, 21 nt, Human
cugguugcccugcucagcagc

SEQ ID NO: 59338 - RNA, 19 nt, Human
cuuagggacgaacccagca

SEQ ID NO: 59339 - RNA, 20 nt, Human
gagcacaggccggaaucucu

SEQ ID NO: 59340 - RNA, 19 nt, Human
gccccucccagauguggga

SEQ ID NO: 59341 - RNA, 20 nt, Human
gugaacuccacucagccucu

SEQ ID NO: 59342 - RNA, 21 nt, Human
gugaggcagaaacuaucaaag

SEQ ID NO: 59343 - RNA, 19 nt, Human
uaaagaaacaguuccagcc

SEQ ID NO: 59344 - RNA, 19 nt, Human
ucagcagcacaggagcaca

SEQ ID NO: 59345 - RNA, 19 nt, Human
ucucuaggucagcaggugc

SEQ ID NO: 59346 - RNA, 24 nt, Human
ucucuaggucagcaggugcaaucu

SEQ ID NO: 59347 - RNA, 19 nt, Human
ugagaugggaaaauuaagg

SEQ ID NO: 59348 - RNA, 28 nt, Human
ugaggcagaaacuaucaaagaaaacuca

SEQ ID NO: 59349 - RNA, 20 nt, Human
ugagugaacuccacucagcc

SEQ ID NO: 59350 - RNA, 23 nt, Human
ugccaaaagaauucgaguaucag

SEQ ID NO: 59351 - RNA, 20 nt, Human
ugggagaggaccgggcugua

SEQ ID NO: 59352 - RNA, 19 nt, Human
ugugagcaagaguucuugc

SEQ ID NO: 59353 - RNA, 18 nt, Human
uucuggccaggguacagg

SEQ ID NO: 59354 - RNA, 25 nt, Human
aaagagcuggagggagucuguggga

SEQ ID NO: 59355 - RNA, 21 nt, Human
aagaagaguccuuugggccug

SEQ ID NO: 59356 - RNA, 24 nt, Human
acacacacaccccacccucucaca

SEQ ID NO: 59357 - RNA, 26 nt, Human
acccugagagagccacacacaaagag

SEQ ID NO: 59358 - RNA, 27 nt, Human
acccugagagagccacacacaaagagc

SEQ ID NO: 59359 - RNA, 25 nt, Human
agcuaugcaccccaagugaucaccc

SEQ ID NO: 59360 - RNA, 20 nt, Human
aggaacagcggaaggguuac

SEQ ID NO: 59361 - RNA, 22 nt, Human
caagugaucacccggcuuugga

SEQ ID NO: 59362 - RNA, 21 nt, Human
cacagcauugcacagucgucc

SEQ ID NO: 59363 - RNA, 19 nt, Human
cacucucuuugacacacac

SEQ ID NO: 59364 - RNA, 21 nt, Human
ccccaagugaucacccggcuu

SEQ ID NO: 59365 - RNA, 25 nt, Human
ccccaagugaucacccggcuuugga

SEQ ID NO: 59366 - RNA, 20 nt, Human
ccucucacauacacacuuuu

SEQ ID NO: 59367 - RNA, 22 nt, Human
ccucugccucccugugcucccc

SEQ ID NO: 59368 - RNA, 20 nt, Human
cucuccuucucuuccucacu

SEQ ID NO: 59369 - RNA, 20 nt, Human
cucucuccuucucuuccuca

SEQ ID NO: 59370 - RNA, 26 nt, Human
cugcugaagaagaguccuuugggccc

SEQ ID NO: 59371 - RNA, 22 nt, Human
gcuugcucuuguuggacccuga

SEQ ID NO: 59372 - RNA, 18 nt, Human
uaaaagcacacauaaaca

SEQ ID NO: 59373 - RNA, 20 nt, Human
uaugcaccccaagugaucac

SEQ ID NO: 59374 - RNA, 23 nt, Human
ucacagacccacagcuugcucuu

SEQ ID NO: 59375 - RNA, 19 nt, Human
ucacccggcuuuggaagcu

SEQ ID NO: 59376 - RNA, 22 nt, Human
uccccaggggugcaugcuccug

SEQ ID NO: 59377 - RNA, 20 nt, Human
uccucacucucuuugacaca

SEQ ID NO: 59378 - RNA, 20 nt, Human
uccuucucuuccucacucuc

SEQ ID NO: 59379 - RNA, 20 nt, Human
ucucucucuccuucucuucc

SEQ ID NO: 59380 - RNA, 25 nt, Human
ugaauaaaagcacacauaaacacuc

SEQ ID NO: 59381 - RNA, 22 nt, Human
ugacacacacaccccacccucu

SEQ ID NO: 59382 - RNA, 26 nt, Human
ugacacacacaccccacccucucaca

SEQ ID NO: 59383 - RNA, 18 nt, Human
ugagagaaagacauuugc

SEQ ID NO: 59384 - RNA, 21 nt, Human
uggaauggcacccaaagcacu

SEQ ID NO: 59385 - RNA, 18 nt, Human
uggagcugaggcugcaga

SEQ ID NO: 59386 - RNA, 22 nt, Human
ugggccugugacguggcagccc

SEQ ID NO: 59387 - RNA, 23 nt, Human
aaccacgccgcccgccacacccu

SEQ ID NO: 59388 - RNA, 21 nt, Human
acagggaaaaguacaugugcc

SEQ ID NO: 59389 - RNA, 20 nt, Human
accacgccgcccgccacacc

SEQ ID NO: 59390 - RNA, 21 nt, Human
cacuuuagagaugaacaggaa

SEQ ID NO: 59391 - RNA, 18 nt, Human
gcugaaaucagaauucua

SEQ ID NO: 59392 - RNA, 20 nt, Human
gggggugggaaucuggggag

SEQ ID NO: 59393 - RNA, 22 nt, Human
uacauacaacaucuguuuuaca

SEQ ID NO: 59394 - RNA, 18 nt, Human
ugagaggaacauugaggg

SEQ ID NO: 59395 - RNA, 24 nt, Human
ugagaggaacauugaggggguggg

SEQ ID NO: 59396 - RNA, 24 nt, Human
ugauaaaaacacggagaauagaaa

SEQ ID NO: 59397 - RNA, 18 nt, Human
ugccuaaccacgccgccc

SEQ ID NO: 59398 - RNA, 20 nt, Human
ugccuaaccacgccgcccgc

SEQ ID NO: 59399 - RNA, 19 nt, Human
ugggaaucuggggagcagg

SEQ ID NO: 59400 - RNA, 18 nt, Human
aaacugagggcuggggga

SEQ ID NO: 59401 - RNA, 20 nt, Human
aaagagggaaccaggcugcc

SEQ ID NO: 59402 - RNA, 19 nt, Human
aacacacccagccccagga

SEQ ID NO: 59403 - RNA, 26 nt, Human
aagacccuucccucuccuguccucaa

SEQ ID NO: 59404 - RNA, 25 nt, Human
aagcaacagacacaagggaacgaca

SEQ ID NO: 59405 - RNA, 23 nt, Human
aaucacuugaaaugcuaacuuga

SEQ ID NO: 59406 - RNA, 22 nt, Human
acagacacaagggaacgacaca

SEQ ID NO: 59407 - RNA, 28 nt, Human
acccagccccaggacaggggggaacgcc

SEQ ID NO: 59408 - RNA, 22 nt, Human
acgacacacagggauuggccac

SEQ ID NO: 59409 - RNA, 18 nt, Human
acgggguggggggcuccc

SEQ ID NO: 59410 - RNA, 23 nt, Human
acuccuacucccaauaagcaaca

SEQ ID NO: 59411 - RNA, 18 nt, Human
agaaggaaaggaccugga

SEQ ID NO: 59412 - RNA, 19 nt, Human
agacccccaccucacccag

SEQ ID NO: 59413 - RNA, 22 nt, Human
agacgagaaggaaaggaccugg

SEQ ID NO: 59414 - RNA, 23 nt, Human
agagcaauguauucucacgccag

SEQ ID NO: 59415 - RNA, 25 nt, Human
agcaacaaagggaaccaucuaggga

SEQ ID NO: 59416 - RNA, 25 nt, Human
agcccccuuuuagaguccuuggagg

SEQ ID NO: 59417 - RNA, 26 nt, Human
agcuguccugaaacacacccagcccc

SEQ ID NO: 59418 - RNA, 23 nt, Human
aggaacaggaggaggaggaggaa

SEQ ID NO: 59419 - RNA, 21 nt, Human
aggaggcuccuggcucagagg

SEQ ID NO: 59420 - RNA, 20 nt, Human
aggcaggaacaggaggagga

SEQ ID NO: 59421 - RNA, 25 nt, Human
aggcaggcagacacaaaugcacaga

SEQ ID NO: 59422 - RNA, 18 nt, Human
aggcccugccccacccag

SEQ ID NO: 59423 - RNA, 18 nt, Human
aggcugggccaugccugg

SEQ ID NO: 59424 - RNA, 22 nt, Human
aggcugggccaugccuggccuc

SEQ ID NO: 59425 - RNA, 23 nt, Human
agggcugggggaguaccaggggc

SEQ ID NO: 59426 - RNA, 24 nt, Human
aguggaagaaagagaguccuggca

SEQ ID NO: 59427 - RNA, 24 nt, Human
auagcccccuuuuagaguccuugg

SEQ ID NO: 59428 - RNA, 19 nt, Human
aucauugcacccccaaauc

SEQ ID NO: 59429 - RNA, 19 nt, Human
auccccaauccagaccuca

SEQ ID NO: 59430 - RNA, 19 nt, Human
auuucuguggcuugccuuu

SEQ ID NO: 59431 - RNA, 23 nt, Human
caaccuacugguuccccucccaa

SEQ ID NO: 59432 - RNA, 25 nt, Human
cacacccagccccaggacaggggua

SEQ ID NO: 59433 - RNA, 21 nt, Human
cacccagggcccagcucauuc

SEQ ID NO: 59434 - RNA, 19 nt, Human
cacccuggcccuggagccc

SEQ ID NO: 59435 - RNA, 20 nt, Human
caccucacccagggcccagc

SEQ ID NO: 59436 - RNA, 21 nt, Human
cacuccagccucccaaacagg

SEQ ID NO: 59437 - RNA, 20 nt, Human
cagaagcagcuguccugaaa

SEQ ID NO: 59438 - RNA, 21 nt, Human
cagaauacagagcccugguac

SEQ ID NO: 59439 - RNA, 18 nt, Human
cagacagcaacaaaggga

SEQ ID NO: 59440 - RNA, 20 nt, Human
cagcaacaaagggaaccauc

SEQ ID NO: 59441 - RNA, 18 nt, Human
cagcaagacgggggcucu

SEQ ID NO: 59442 - RNA, 22 nt, Human
cagccccuccuggcuggguggc

SEQ ID NO: 59443 - RNA, 19 nt, Human
cagcuggcaucaacaaggu

SEQ ID NO: 59444 - RNA, 18 nt, Human
caggaacaggaggaggag

SEQ ID NO: 59445 - RNA, 18 nt, Human
caggacuggcaacccuac

SEQ ID NO: 59446 - RNA, 20 nt, Human
caggcagacacaaaugcaca

SEQ ID NO: 59447 - RNA, 19 nt, Human
cagggcccagcucauucgc

SEQ ID NO: 59448 - RNA, 24 nt, Human
ccaaaggagagcaauguauucuca

SEQ ID NO: 59449 - RNA, 19 nt, Human
ccacaugccccaucccagg

SEQ ID NO: 59450 - RNA, 23 nt, Human
ccaucccucacacccuggcccug

SEQ ID NO: 59451 - RNA, 24 nt, Human
ccaucuagggaagcccucggccac

SEQ ID NO: 59452 - RNA, 20 nt, Human
cccacuaggccagaccccca

SEQ ID NO: 59453 - RNA, 21 nt, Human
cccagcugcuccccaucccuc

SEQ ID NO: 59454 - RNA, 21 nt, Human
cccagugcccagcugcucccc

SEQ ID NO: 59455 - RNA, 22 nt, Human
ccccacccaggccaggccccuc

SEQ ID NO: 59456 - RNA, 21 nt, Human
ccccaggacagggguaggagc

SEQ ID NO: 59457 - RNA, 21 nt, Human
ccccauccccaauccagaccu

SEQ ID NO: 59458 - RNA, 22 nt, Human
cccccaccucacccagggccca

SEQ ID NO: 59459 - RNA, 19 nt, Human
ccccuccccacuaggccag

SEQ ID NO: 59460 - RNA, 22 nt, Human
cccuuggccacaugccccaucu

SEQ ID NO: 59461 - RNA, 22 nt, Human
ccgguagucagaugccugggac

SEQ ID NO: 59462 - RNA, 18 nt, Human
ccugaaacacacccagcc

SEQ ID NO: 59463 - RNA, 21 nt, Human
cgacacacagggauuggccac

SEQ ID NO: 59464 - RNA, 20 nt, Human
cgggggcucuguuggcuccu

SEQ ID NO: 59465 - RNA, 23 nt, Human
cuaaaaagauucgggaaagccag

SEQ ID NO: 59466 - RNA, 28 nt, Human
cucacacccuggcccuggagcccuuggc

SEQ ID NO: 59467 - RNA, 18 nt, Human
cucaucuuugaugcccac

SEQ ID NO: 59468 - RNA, 19 nt, Human
cuccaggcugggccaugcc

SEQ ID NO: 59469 - RNA, 25 nt, Human
cuccaggcugggccaugccuggccu

SEQ ID NO: 59470 - RNA, 18 nt, Human
cuccagggaauagccccc

SEQ ID NO: 59471 - RNA, 22 nt, Human
cuccccacuaggccagaccccc

SEQ ID NO: 59472 - RNA, 18 nt, Human
cuccuggcuggguggcug

SEQ ID NO: 59473 - RNA, 23 nt, Human
cuugagacuuccauagggcugga

SEQ ID NO: 59474 - RNA, 19 nt, Human
gaaagagaguccuggcaca

SEQ ID NO: 59475 - RNA, 20 nt, Human
gaaagagaguccuggcacag

SEQ ID NO: 59476 - RNA, 18 nt, Human
gacacaagggaacgacac

SEQ ID NO: 59477 - RNA, 18 nt, Human
gagagaggaagacgagaa

SEQ ID NO: 59478 - RNA, 20 nt, Human
gauucgggaaagccagacag

SEQ ID NO: 59479 - RNA, 23 nt, Human
gcaacaaagggaaccaucuaggg

SEQ ID NO: 59480 - RNA, 18 nt, Human
gcagaauacagagcccug

SEQ ID NO: 59481 - RNA, 23 nt, Human
gcagacacaaaugcacagaagca

SEQ ID NO: 59482 - RNA, 18 nt, Human
gccacaugccccauccca

SEQ ID NO: 59483 - RNA, 22 nt, Human
gcccaagccuggaccaggccag

SEQ ID NO: 59484 - RNA, 24 nt, Human
gccccuccccacuaggccagaccc

SEQ ID NO: 59485 - RNA, 18 nt, Human
gccuggaccaggccaggc

SEQ ID NO: 59486 - RNA, 24 nt, Human
ggacauagggauauccccucagga

SEQ ID NO: 59487 - RNA, 19 nt, Human
ggagcccuuggccacaugc

SEQ ID NO: 59488 - RNA, 22 nt, Human
ggaggaggaggaggaaguaggu

SEQ ID NO: 59489 - RNA, 24 nt, Human
ggaggaggaggaggaaguagguga

SEQ ID NO: 59490 - RNA, 22 nt, Human
gggaauggagcccaagccugga

SEQ ID NO: 59491 - RNA, 20 nt, Human
gggaaugugagcagaagcau

SEQ ID NO: 59492 - RNA, 19 nt, Human
ggggggcucccggacucug

SEQ ID NO: 59493 - RNA, 23 nt, Human
ggguggcuggaguuguaggggcu

SEQ ID NO: 59494 - RNA, 22 nt, Human
ggucaggaggcuccuggcucag

SEQ ID NO: 59495 - RNA, 22 nt, Human
guccugaaacacacccagcccc

SEQ ID NO: 59496 - RNA, 23 nt, Human
guggaagaaagagaguccuggca

SEQ ID NO: 59497 - RNA, 22 nt, Human
ucacccagggcccagcucauuc

SEQ ID NO: 59498 - RNA, 19 nt, Human
ucaggagggacagcaguga

SEQ ID NO: 59499 - RNA, 21 nt, Human
uccacuccagccucccaaaca

SEQ ID NO: 59500 - RNA, 24 nt, Human
uccccaucccucacacccuggccc

SEQ ID NO: 59501 - RNA, 21 nt, Human
uccuggacgggguggggggcu

SEQ ID NO: 59502 - RNA, 18 nt, Human
ucuacuccuuucugaaac

SEQ ID NO: 59503 - RNA, 19 nt, Human
ucuagggaagcccucggcc

SEQ ID NO: 59504 - RNA, 18 nt, Human
ucuauagagagcaugagg

SEQ ID NO: 59505 - RNA, 23 nt, Human
ucucacgccagcaagacgggggc

SEQ ID NO: 59506 - RNA, 23 nt, Human
ugaccuugagacuuccauagggc

SEQ ID NO: 59507 - RNA, 18 nt, Human
ugacugaaaacugagggc

SEQ ID NO: 59508 - RNA, 25 nt, Human
ugagaacucaguacagcuggcauca

SEQ ID NO: 59509 - RNA, 24 nt, Human
ugagagagaggaagacgagaagga

SEQ ID NO: 59510 - RNA, 23 nt, Human
ugagagggaaugugagcagaagc

SEQ ID NO: 59511 - RNA, 23 nt, Human
ugaggcaggcagacacaaaugca

SEQ ID NO: 59512 - RNA, 24 nt, Human
ugagggcugggggaguaccagggg

SEQ ID NO: 59513 - RNA, 21 nt, Human
ugauuaggggucccgugaccu

SEQ ID NO: 59514 - RNA, 21 nt, Human
ugccugaaugugauuggacag

SEQ ID NO: 59515 - RNA, 24 nt, Human
ugccugggacuaagggugggaagg

SEQ ID NO: 59516 - RNA, 21 nt, Human
ugcuccccaucccucacaccc

SEQ ID NO: 59517 - RNA, 22 nt, Human
ugcuccccaucccucacacccu

SEQ ID NO: 59518 - RNA, 24 nt, Human
uggagaggagacggaacuugacug

SEQ ID NO: 59519 - RNA, 23 nt, Human
uggcacaggaaagagggaaccag

SEQ ID NO: 59520 - RNA, 18 nt, Human
uggccacaugccccaucc

SEQ ID NO: 59521 - RNA, 20 nt, Human
uggcucagaggcggaugcga

SEQ ID NO: 59522 - RNA, 21 nt, Human
uggcuggaguuguaggggcuu

SEQ ID NO: 59523 - RNA, 21 nt, Human
uggcuggaguuguaggggcuu

SEQ ID NO: 59524 - RNA, 22 nt, Human
uggcuggaguuguaggggcuuu

SEQ ID NO: 59525 - RNA, 24 nt, Human
uggcuggguggcuggaguuguagg

SEQ ID NO: 59526 - RNA, 22 nt, Human
uguaaguguuaagacccuuccc

SEQ ID NO: 59527 - RNA, 21 nt, Human
uguccccauccccaauccaga

SEQ ID NO: 59528 - RNA, 23 nt, Human
uguuuccacuccagccucccaaa

SEQ ID NO: 59529 - RNA, 21 nt, Human
uuaguauauaaagacauacaa

SEQ ID NO: 59530 - RNA, 19 nt, Human
uucccgguagucagaugcc

SEQ ID NO: 59531 - RNA, 19 nt, Human
uuggcuccuggacggggug

SEQ ID NO: 59532 - RNA, 21 nt, Human
uuguaaggcuguaucagaauu

SEQ ID NO: 59533 - RNA, 18 nt, Human
uuuuuuuuuuuugggccc

SEQ ID NO: 59534 - RNA, 19 nt, Human
uuuuuuuuuuuuuugggcc

SEQ ID NO: 59535 - RNA, 20 nt, Human
uuuuuuuuuuuuuuuuuggg

SEQ ID NO: 59536 - RNA, 22 nt, Human
aaaaugacaacuucacaguuca

SEQ ID NO: 59537 - RNA, 20 nt, Human
aaaugacaacuucacaguuc

SEQ ID NO: 59538 - RNA, 23 nt, Human
aagagacagaguaaugacgaaua

SEQ ID NO: 59539 - RNA, 19 nt, Human
aagcaacacugugggauga

SEQ ID NO: 59540 - RNA, 21 nt, Human
aagcaacacugugggaugauu

SEQ ID NO: 59541 - RNA, 18 nt, Human
aagcauaucuaucaaauc

SEQ ID NO: 59542 - RNA, 23 nt, Human
aaugaucaagucagaguaguuag

SEQ ID NO: 59543 - RNA, 24 nt, Human
accccgaacggagaaagccuugaa

SEQ ID NO: 59544 - RNA, 19 nt, Human
accccuucaucuccucgcc

SEQ ID NO: 59545 - RNA, 23 nt, Human
acccgccgaguggggcggggcuu

SEQ ID NO: 59546 - RNA, 25 nt, Human
acuuuaaaucagcuccagagaaaag

SEQ ID NO: 59547 - RNA, 24 nt, Human
agaaagccuugaauuaagauccaa

SEQ ID NO: 59548 - RNA, 21 nt, Human
agcaauucuuuugccuauuuu

SEQ ID NO: 59549 - RNA, 23 nt, Human
aggaaggugauagcagaaaagga

SEQ ID NO: 59550 - RNA, 18 nt, Human
auccuauucuguggguuu

SEQ ID NO: 59551 - RNA, 18 nt, Human
cacauccaagucaucacc

SEQ ID NO: 59552 - RNA, 18 nt, Human
ccauccaccccgaacgga

SEQ ID NO: 59553 - RNA, 22 nt, Human
cccacuuagauacaugugucua

SEQ ID NO: 59554 - RNA, 20 nt, Human
cccgccgaguggggcggggc

SEQ ID NO: 59555 - RNA, 19 nt, Human
ccggagcgggaggcggagg

SEQ ID NO: 59556 - RNA, 22 nt, Human
ccggcggcaccgacccgccgag

SEQ ID NO: 59557 - RNA, 25 nt, Human
ccuaaaguaccaacccauccacccc

SEQ ID NO: 59558 - RNA, 18 nt, Human
ccugggacccggcggcac

SEQ ID NO: 59559 - RNA, 25 nt, Human
cgaauaucacccuagaggaaaccaa

SEQ ID NO: 59560 - RNA, 21 nt, Human
cgacccgccgaguggggcggg

SEQ ID NO: 59561 - RNA, 18 nt, Human
cggcggcaccgacccgcc

SEQ ID NO: 59562 - RNA, 23 nt, Human
cuccagagaaaagcaacacugug

SEQ ID NO: 59563 - RNA, 24 nt, Human
cuccagagaaaagcaacacugugg

SEQ ID NO: 59564 - RNA, 25 nt, Human
cuccagagaaaagcaacacuguggg

SEQ ID NO: 59565 - RNA, 26 nt, Human
cugucuuucagaucuagcaucuucca

SEQ ID NO: 59566 - RNA, 18 nt, Human
cuugaauuaagauccaac

SEQ ID NO: 59567 - RNA, 23 nt, Human
cuuuaaaucagcuccagagaaaa

SEQ ID NO: 59568 - RNA, 23 nt, Human
cuuucagaucuagcaucuuccag

SEQ ID NO: 59569 - RNA, 18 nt, Human
cuuugccaggaacucuuc

SEQ ID NO: 59570 - RNA, 20 nt, Human
gacccggcggcaccgacccg

SEQ ID NO: 59571 - RNA, 18 nt, Human
gcggggcuugcuggagcc

SEQ ID NO: 59572 - RNA, 24 nt, Human
gcuggagccuaaaguaccaaccca

SEQ ID NO: 59573 - RNA, 19 nt, Human
ggacagauugccaucuggg

SEQ ID NO: 59574 - RNA, 20 nt, Human
gggcccggagcgggaggcgg

SEQ ID NO: 59575 - RNA, 21 nt, Human
ggugauagaagccaaguagga

SEQ ID NO: 59576 - RNA, 19 nt, Human
guuuucaugaaaacuuugg

SEQ ID NO: 59577 - RNA, 23 nt, Human
uacacagaauguuaaaugaucaa

SEQ ID NO: 59578 - RNA, 20 nt, Human
uaccugagcucuuugccagg

SEQ ID NO: 59579 - RNA, 23 nt, Human
uaccugagcucuuugccaggaac

SEQ ID NO: 59580 - RNA, 24 nt, Human
uaugguauaauuucuguuggugau

SEQ ID NO: 59581 - RNA, 24 nt, Human
uauuuuauccuauucuguggguuu

SEQ ID NO: 59582 - RNA, 19 nt, Human
uccggcgaagaugaagacg

SEQ ID NO: 59583 - RNA, 22 nt, Human
ucuguuggugauagaagccaag

SEQ ID NO: 59584 - RNA, 24 nt, Human
ugacaagaggaaggugauagcaga

SEQ ID NO: 59585 - RNA, 24 nt, Human
ugacacauaauauuuaugcaugug

SEQ ID NO: 59586 - RNA, 22 nt, Human
ugauuuacaaauauuuuauccu

SEQ ID NO: 59587 - RNA, 23 nt, Human
ugcaugugauauuuuguuacaua

SEQ ID NO: 59588 - RNA, 21 nt, Human
ugccaggaacucuucccggga

SEQ ID NO: 59589 - RNA, 18 nt, Human
ugggaugauuucugaacu

SEQ ID NO: 59590 - RNA, 25 nt, Human
uggugauagaagccaaguaggaguc

SEQ ID NO: 59591 - RNA, 18 nt, Human
ugguucgagggcccggag

SEQ ID NO: 59592 - RNA, 18 nt, Human
ugugggcgucacuggcgc

SEQ ID NO: 59593 - RNA, 20 nt, Human
uuccuuucaauuucuugaua

SEQ ID NO: 59594 - RNA, 21 nt, Human
uucuuuggucccacuuagaua

SEQ ID NO: 59595 - RNA, 19 nt, Human
uugaagagacagaguaaug

SEQ ID NO: 59596 - RNA, 19 nt, Human
aaaccauccccaaccacuc

SEQ ID NO: 59597 - RNA, 23 nt, Human
aaccacucggaggcagcuuucaa

SEQ ID NO: 59598 - RNA, 18 nt, Human
aaccccgaagaaacccaa

SEQ ID NO: 59599 - RNA, 29 nt, Human
aagaaacccaaacaggaggcggugggcac

SEQ ID NO: 59600 - RNA, 20 nt, Human
aagcuccacacucacccuuc

SEQ ID NO: 59601 - RNA, 22 nt, Human
aagcuccacacucacccuucag

SEQ ID NO: 59602 - RNA, 22 nt, Human
acacagcaguaacaggaaaacc

SEQ ID NO: 59603 - RNA, 19 nt, Human
acagagaaaccccgaagaa

SEQ ID NO: 59604 - RNA, 21 nt, Human
acccagccccaucucucggcc

SEQ ID NO: 59605 - RNA, 22 nt, Human
accucacuuaaccccacaucac

SEQ ID NO: 59606 - RNA, 19 nt, Human
agacaggggcucugggagc

SEQ ID NO: 59607 - RNA, 24 nt, Human
agagaaaccccgaagaaacccaaa

SEQ ID NO: 59608 - RNA, 21 nt, Human
agcuccuugagccccaggccc

SEQ ID NO: 59609 - RNA, 25 nt, Human
agcucugccccucugccggcaccua

SEQ ID NO: 59610 - RNA, 19 nt, Human
agcugccagucggugggga

SEQ ID NO: 59611 - RNA, 23 nt, Human
aggagccaggggcugccggggcu

SEQ ID NO: 59612 - RNA, 22 nt, Human
aggcagugaccacccuuggggc

SEQ ID NO: 59613 - RNA, 20 nt, Human
aggcccuaagugagcagcuc

SEQ ID NO: 59614 - RNA, 18 nt, Human
aggccugggcucagaggc

SEQ ID NO: 59615 - RNA, 19 nt, Human
aggcuggggugggcgcugg

SEQ ID NO: 59616 - RNA, 24 nt, Human
aggggccuccucgauggggcgggc

SEQ ID NO: 59617 - RNA, 21 nt, Human
aggggcucugggagcuucugc

SEQ ID NO: 59618 - RNA, 18 nt, Human
aguaacaggaaaaccuaa

SEQ ID NO: 59619 - RNA, 21 nt, Human
agugcagcugccagucggugg

SEQ ID NO: 59620 - RNA, 18 nt, Human
aguggguggugcaggccc

SEQ ID NO: 59621 - RNA, 19 nt, Human
augauauauauuagaucua

SEQ ID NO: 59622 - RNA, 18 nt, Human
caaaauguccgcggccuc

SEQ ID NO: 59623 - RNA, 19 nt, Human
caaacaggaggcgcacccg

SEQ ID NO: 59624 - RNA, 21 nt, Human
caacugaaaccugggaggcca

SEQ ID NO: 59625 - RNA, 20 nt, Human
cacagccacaggagcagggg

SEQ ID NO: 59626 - RNA, 21 nt, Human
cacccuuggggcagaaguggg

SEQ ID NO: 59627 - RNA, 20 nt, Human
cacuuaaccccacaucacag

SEQ ID NO: 59628 - RNA, 23 nt, Human
cagacacuacagagaaaccccga

SEQ ID NO: 59629 - RNA, 21 nt, Human
cagcagacacuacagagaaac

SEQ ID NO: 59630 - RNA, 18 nt, Human
cagccuagcucugccccu

SEQ ID NO: 59631 - RNA, 25 nt, Human
cagggcaccagccuggugguugcaa

SEQ ID NO: 59632 - RNA, 23 nt, Human
caguaacaggaaaaccuaaugcu

SEQ ID NO: 59633 - RNA, 22 nt, Human
ccacaucacagccacaggagca

SEQ ID NO: 59634 - RNA, 23 nt, Human
ccaccucacuuaaccccacauca

SEQ ID NO: 59635 - RNA, 22 nt, Human
ccacugaguggccuggagcccu

SEQ ID NO: 59636 - RNA, 23 nt, Human
ccaggccagguuggcagggucca

SEQ ID NO: 59637 - RNA, 20 nt, Human
ccaugagagguggcagugga

SEQ ID NO: 59638 - RNA, 25 nt, Human
cccaccucacuuaaccccacaucac

SEQ ID NO: 59639 - RNA, 21 nt, Human
cccagggaucggguggguucu

SEQ ID NO: 59640 - RNA, 23 nt, Human
cccucccugcacacccaggccag

SEQ ID NO: 59641 - RNA, 19 nt, Human
ccgcaggucccaauagcuc

SEQ ID NO: 59642 - RNA, 20 nt, Human
ccggggcugugagccggagg

SEQ ID NO: 59643 - RNA, 21 nt, Human
ccucccagccuagcucugccc

SEQ ID NO: 59644 - RNA, 21 nt, Human
ccucccugcacacccaggcca

SEQ ID NO: 59645 - RNA, 23 nt, Human
ccugguaccaaggggaaccccuc

SEQ ID NO: 59646 - RNA, 20 nt, Human
ccuuugguccccaccucacu

SEQ ID NO: 59647 - RNA, 21 nt, Human
cgccccggcucgguucggcuu

SEQ ID NO: 59648 - RNA, 23 nt, Human
cgggaggcuguggcccaacuggc

SEQ ID NO: 59649 - RNA, 25 nt, Human
cggggcugugagccggaggggcaac

SEQ ID NO: 59650 - RNA, 25 nt, Human
cuacagagaaaccccgaagaaaccc

SEQ ID NO: 59651 - RNA, 19 nt, Human
cucagaggcgacacugagg

SEQ ID NO: 59652 - RNA, 18 nt, Human
cuggcacagcugcagggc

SEQ ID NO: 59653 - RNA, 24 nt, Human
cugguaccaaggggaaccccuccc

SEQ ID NO: 59654 - RNA, 20 nt, Human
cuugagccccaggcccuaag

SEQ ID NO: 59655 - RNA, 23 nt, Human
cuuucugaaaauaagaguaaaca

SEQ ID NO: 59656 - RNA, 22 nt, Human
gagaaaccccgaagaaacccaa

SEQ ID NO: 59657 - RNA, 18 nt, Human
gagagguggcaguggagg

SEQ ID NO: 59658 - RNA, 19 nt, Human
gaggaggaagaugugcugc

SEQ ID NO: 59659 - RNA, 22 nt, Human
gaggagggcagcagacacuaca

SEQ ID NO: 59660 - RNA, 20 nt, Human
gagguggcaguggagggccc

SEQ ID NO: 59661 - RNA, 20 nt, Human
gcaaguggguggugcaggcc

SEQ ID NO: 59662 - RNA, 21 nt, Human
gcagcucuccugguaccaagg

SEQ ID NO: 59663 - RNA, 23 nt, Human
gccccaggcccuaagugagcagc

SEQ ID NO: 59664 - RNA, 24 nt, Human
gccggaggggcaagcuccacacuc

SEQ ID NO: 59665 - RNA, 18 nt, Human
gcugccggggcugugagc

SEQ ID NO: 59666 - RNA, 21 nt, Human
gcugcucuggcucuguuuccu

SEQ ID NO: 59667 - RNA, 18 nt, Human
gcuucugccuggucuuga

SEQ ID NO: 59668 - RNA, 20 nt, Human
ggaggcuguggcccaacugg

SEQ ID NO: 59669 - RNA, 20 nt, Human
ggagggcagcagacacuaca

SEQ ID NO: 59670 - RNA, 23 nt, Human
ggagggcagcagacacuacagag

SEQ ID NO: 59671 - RNA, 21 nt, Human
ggcuggggugggcgcuggccg

SEQ ID NO: 59672 - RNA, 19 nt, Human
gggagcccgagacaggggc

SEQ ID NO: 59673 - RNA, 20 nt, Human
gggagcccgagacaggggcu

SEQ ID NO: 59674 - RNA, 22 nt, Human
gggaggcuguggcccaacuggc

SEQ ID NO: 59675 - RNA, 25 nt, Human
gggcaagcuccacacucacccuuca

SEQ ID NO: 59676 - RNA, 22 nt, Human
gggcagaaggcuggggugggcg

SEQ ID NO: 59677 - RNA, 22 nt, Human
ggggcugugagccggaggggca

SEQ ID NO: 59678 - RNA, 18 nt, Human
gguggugcaggcccuggg

SEQ ID NO: 59679 - RNA, 18 nt, Human
uaaccccacaucacagcc

SEQ ID NO: 59680 - RNA, 21 nt, Human
uacagagaaaccccgaagaaa

SEQ ID NO: 59681 - RNA, 21 nt, Human
uagccaggcuuccgcaggucc

SEQ ID NO: 59682 - RNA, 20 nt, Human
uagcucccggcgccccggcu

SEQ ID NO: 59683 - RNA, 20 nt, Human
uagcucugccccucugccgg

SEQ ID NO: 59684 - RNA, 23 nt, Human
uaucacaggcagugaccacccuu

SEQ ID NO: 59685 - RNA, 18 nt, Human
uauuacacagcaguaaca

SEQ ID NO: 59686 - RNA, 18 nt, Human
ucaccugccgggcggaag

SEQ ID NO: 59687 - RNA, 24 nt, Human
ucagacacaacugaaaccugggag

SEQ ID NO: 59688 - RNA, 19 nt, Human
ucccugcacacccaggcca

SEQ ID NO: 59689 - RNA, 27 nt, Human
ucgguggggagcccgagacaggggcuc

SEQ ID NO: 59690 - RNA, 21 nt, Human
ucucuuucugaaaauaagagu

SEQ ID NO: 59691 - RNA, 22 nt, Human
ucugccaucaggaccagggagc

SEQ ID NO: 59692 - RNA, 19 nt, Human
ucugccccucugccggcac

SEQ ID NO: 59693 - RNA, 18 nt, Human
ucugucagacacaacuga

SEQ ID NO: 59694 - RNA, 23 nt, Human
ugaaaauaagaguaaacauacaa

SEQ ID NO: 59695 - RNA, 23 nt, Human
ugagcagcucuccugguaccaac

SEQ ID NO: 59696 - RNA, 19 nt, Human
ugcgaggaggaagaugugc

SEQ ID NO: 59697 - RNA, 23 nt, Human
uggagccccgccuggucccuccu

SEQ ID NO: 59698 - RNA, 19 nt, Human
uggcacagcugcagggcac

SEQ ID NO: 59699 - RNA, 18 nt, Human
uggcugcucuggcucugu

SEQ ID NO: 59700 - RNA, 23 nt, Human
uggggcagaaguggggaguuggg

SEQ ID NO: 59701 - RNA, 20 nt, Human
uggggcgggcagaaggcugg

SEQ ID NO: 59702 - RNA, 19 nt, Human
uggugcccuaccccaggga

SEQ ID NO: 59703 - RNA, 23 nt, Human
uguagccaggcuuccgcaggucc

SEQ ID NO: 59704 - RNA, 18 nt, Human
ugucccagagcacgggag

SEQ ID NO: 59705 - RNA, 23 nt, Human
uguggcccaacuggcacagcugc

SEQ ID NO: 59706 - RNA, 23 nt, Human
uuaacaccaaccggagagaccaa

SEQ ID NO: 59707 - RNA, 23 nt, Human
uuaaccccacaucacagccacug

SEQ ID NO: 59708 - RNA, 18 nt, Human
aagcagccagccucaaca

SEQ ID NO: 59709 - RNA, 20 nt, Human
aaucucaacaaaagcucuuu

SEQ ID NO: 59710 - RNA, 23 nt, Human
acauacaugugugugucugugug

SEQ ID NO: 59711 - RNA, 22 nt, Human
acucacucuuccuaagggcaaa

SEQ ID NO: 59712 - RNA, 24 nt, Human
acucgcaaggucugaccaguucuu

SEQ ID NO: 59713 - RNA, 22 nt, Human
agaaaaaggcagggcucccuaa

SEQ ID NO: 59714 - RNA, 24 nt, Human
agagcaccauauccuucaugccaa

SEQ ID NO: 59715 - RNA, 24 nt, Human
agauaagaugacuccaauacucac

SEQ ID NO: 59716 - RNA, 18 nt, Human
aguaacuuuaggaaaauc

SEQ ID NO: 59717 - RNA, 21 nt, Human
auugcaguccuuuucuuccag

SEQ ID NO: 59718 - RNA, 23 nt, Human
caacaguagaaagaaggggcaac

SEQ ID NO: 59719 - RNA, 26 nt, Human
cacagaaaaggcuaccaggagccuaa

SEQ ID NO: 59720 - RNA, 18 nt, Human
caccauauccuucaugcc

SEQ ID NO: 59721 - RNA, 21 nt, Human
cagauacaacacaaauguucc

SEQ ID NO: 59722 - RNA, 19 nt, Human
cagcaguaacuuuaggaaa

SEQ ID NO: 59723 - RNA, 24 nt, Human
cagcaguaacuuuaggaaaauccu

SEQ ID NO: 59724 - RNA, 22 nt, Human
cagcaguucucuucagcuccuc

SEQ ID NO: 59725 - RNA, 27 nt, Human
cagugccaguguuacagauacaacaca

SEQ ID NO: 59726 - RNA, 20 nt, Human
caugugugugucugugugua

SEQ ID NO: 59727 - RNA, 22 nt, Human
cauuuccauuccgaaugccaga

SEQ ID NO: 59728 - RNA, 19 nt, Human
ccaagguccaagccaggcu

SEQ ID NO: 59729 - RNA, 19 nt, Human
ccaguccacagagaaacaa

SEQ ID NO: 59730 - RNA, 20 nt, Human
ccauauccuucaugccaaau

SEQ ID NO: 59731 - RNA, 21 nt, Human
ccauauccuucaugccaaauc

SEQ ID NO: 59732 - RNA, 21 nt, Human
ccuccagaagcagccagccuc

SEQ ID NO: 59733 - RNA, 23 nt, Human
cucaagaaauaaaaagggagguu

SEQ ID NO: 59734 - RNA, 19 nt, Human
cuccagaagcagccagccu

SEQ ID NO: 59735 - RNA, 24 nt, Human
cuuugaaacuggugaacuccucuu

SEQ ID NO: 59736 - RNA, 21 nt, Human
gaagagugcaaaguagccucc

SEQ ID NO: 59737 - RNA, 19 nt, Human
gcaaaguagccuccagaag

SEQ ID NO: 59738 - RNA, 20 nt, Human
gcaaaguagccuccagaagc

SEQ ID NO: 59739 - RNA, 20 nt, Human
gccaagguccaagccaggcu

SEQ ID NO: 59740 - RNA, 19 nt, Human
gcuguaaaugugggagggg

SEQ ID NO: 59741 - RNA, 20 nt, Human
ggcagggcucccuaaugucc

SEQ ID NO: 59742 - RNA, 22 nt, Human
gggaaccaguagaaaaaggccg

SEQ ID NO: 59743 - RNA, 21 nt, Human
gggaaucaauuuugaaaauca

SEQ ID NO: 59744 - RNA, 21 nt, Human
gggagcuggaagagccuugga

SEQ ID NO: 59745 - RNA, 23 nt, Human
guucaaacaggcaaguuaugggc

SEQ ID NO: 59746 - RNA, 20 nt, Human
uaacaaugcuucaaggucag

SEQ ID NO: 59747 - RNA, 24 nt, Human
uacaugugugugucuguguguaua

SEQ ID NO: 59748 - RNA, 20 nt, Human
uagaaagaaggggcaacucc

SEQ ID NO: 59749 - RNA, 19 nt, Human
uagaaggugaccauuuugc

SEQ ID NO: 59750 - RNA, 22 nt, Human
ucagcaguucucuucagcuccu

SEQ ID NO: 59751 - RNA, 24 nt, Human
uccaagccaggcucaagaaauaaa

SEQ ID NO: 59752 - RNA, 21 nt, Human
uccacccauuaccauaguuca

SEQ ID NO: 59753 - RNA, 18 nt, Human
uccuaagggcaaagguac

SEQ ID NO: 59754 - RNA, 23 nt, Human
ucuucagcuccucaugcccgugg

SEQ ID NO: 59755 - RNA, 21 nt, Human
ucuuccuaagggcaaagguug

SEQ ID NO: 59756 - RNA, 20 nt, Human
ugaagaugguaacccagcua

SEQ ID NO: 59757 - RNA, 20 nt, Human
uggaagagccuuggaaguuu

SEQ ID NO: 59758 - RNA, 20 nt, Human
uggcgagaaaggggagcugg

SEQ ID NO: 59759 - RNA, 19 nt, Human
ugggagggguggagaagug

SEQ ID NO: 59760 - RNA, 24 nt, Human
ugguaacaaacauacaugugugug

SEQ ID NO: 59761 - RNA, 25 nt, Human
ugguaacaaacauacaugugugugu

SEQ ID NO: 59762 - RNA, 20 nt, Human
uguguauacagcaaugcaca

SEQ ID NO: 59763 - RNA, 21 nt, Human
ugugucuguguguauacagca

SEQ ID NO: 59764 - RNA, 22 nt, Human
uguguguauacagcaaugcaca

SEQ ID NO: 59765 - RNA, 20 nt, Human
ugugugugucuguguguaua

SEQ ID NO: 59766 - RNA, 22 nt, Human
uuagucuuuaacaaugcuucaa

SEQ ID NO: 59767 - RNA, 19 nt, Human
uuggaaguuucuauuacaa

SEQ ID NO: 59768 - RNA, 23 nt, Human
uuuuuuuuuuuuuuuuuuaaccg

SEQ ID NO: 59769 - RNA, 26 nt, Human
aaagaaacgagacuucuugaagacca

SEQ ID NO: 59770 - RNA, 23 nt, Human
aaggcgccacaggcgaggggacu

SEQ ID NO: 59771 - RNA, 20 nt, Human
aaggggcuucugagacgagu

SEQ ID NO: 59772 - RNA, 18 nt, Human
aagugcuuccugagugcc

SEQ ID NO: 59773 - RNA, 26 nt, Human
aaugcacaaagacaaguuccaggaaa

SEQ ID NO: 59774 - RNA, 18 nt, Human
acaaaauggcaacaaaac

SEQ ID NO: 59775 - RNA, 18 nt, Human
acaaacagcaacgaaugc

SEQ ID NO: 59776 - RNA, 21 nt, Human
acaggguggggaggacgggug

SEQ ID NO: 59777 - RNA, 19 nt, Human
accaaaccccaccuccccu

SEQ ID NO: 59778 - RNA, 21 nt, Human
accaagugcuuccugagugcc

SEQ ID NO: 59779 - RNA, 18 nt, Human
acuucaggggcaaagaaa

SEQ ID NO: 59780 - RNA, 24 nt, Human
agcggccgagggcgguggcggcgg

SEQ ID NO: 59781 - RNA, 23 nt, Human
aggaacacccauaaacccauaac

SEQ ID NO: 59782 - RNA, 23 nt, Human
aggaagacaagaagggugagggc

SEQ ID NO: 59783 - RNA, 18 nt, Human
aggagccccgaggccggg

SEQ ID NO: 59784 - RNA, 25 nt, Human
agggcgguggcggcggcagcgacgg

SEQ ID NO: 59785 - RNA, 24 nt, Human
aggggcaaagaaacgagacuucuu

SEQ ID NO: 59786 - RNA, 22 nt, Human
aucucgugacccaggcuggccc

SEQ ID NO: 59787 - RNA, 19 nt, Human
caaaacgacgccccugcug

SEQ ID NO: 59788 - RNA, 23 nt, Human
caaacagcaacgaaugcacaaag

SEQ ID NO: 59789 - RNA, 20 nt, Human
caaagacaaguuccaggaac

SEQ ID NO: 59790 - RNA, 20 nt, Human
caacaaaacgacgccccugc

SEQ ID NO: 59791 - RNA, 22 nt, Human
caaguuccaggaacacccauaa

SEQ ID NO: 59792 - RNA, 23 nt, Human
cacaaacagcaacgaaugcacaa

SEQ ID NO: 59793 - RNA, 22 nt, Human
caccaaaccccaccuccccugg

SEQ ID NO: 59794 - RNA, 24 nt, Human
cacccauaaacccauaacguucaa

SEQ ID NO: 59795 - RNA, 19 nt, Human
caccugcagcuggcuggcu

SEQ ID NO: 59796 - RNA, 25 nt, Human
cagcauaaaaggcuguaaccucuac

SEQ ID NO: 59797 - RNA, 23 nt, Human
cagccucgacguguaaauggccc

SEQ ID NO: 59798 - RNA, 21 nt, Human
caggagccccgaggccggggu

SEQ ID NO: 59799 - RNA, 24 nt, Human
ccaagcgcagacgugggugacacg

SEQ ID NO: 59800 - RNA, 23 nt, Human
ccaggaacacccauaaacccagc

SEQ ID NO: 59801 - RNA, 20 nt, Human
cccauaacguucaacaaaau

SEQ ID NO: 59802 - RNA, 26 nt, Human
cccccgagcgcgccaggugccagccu

SEQ ID NO: 59803 - RNA, 27 nt, Human
ccccugaaacugacuucaggggcaaag

SEQ ID NO: 59804 - RNA, 20 nt, Human
cccgagcgcgccaggugcca

SEQ ID NO: 59805 - RNA, 22 nt, Human
cccugggaaggcgccacaggcg

SEQ ID NO: 59806 - RNA, 22 nt, Human
ccgagggcgguggcggcggcuu

SEQ ID NO: 59807 - RNA, 20 nt, Human
ccugcagcuggcuggcuggc

SEQ ID NO: 59808 - RNA, 21 nt, Human
ccuucguggcagaugccaccu

SEQ ID NO: 59809 - RNA, 22 nt, Human
cggcggcagcgacgguggggac

SEQ ID NO: 59810 - RNA, 21 nt, Human
cgggguguuggcugcgacagc

SEQ ID NO: 59811 - RNA, 23 nt, Human
cucucaccaaaccccaccucccc

SEQ ID NO: 59812 - RNA, 19 nt, Human
cugccaccaggagccccga

SEQ ID NO: 59813 - RNA, 21 nt, Human
cugggcagaggcugggagggu

SEQ ID NO: 59814 - RNA, 20 nt, Human
gcaaagaaacgagacuucuu

SEQ ID NO: 59815 - RNA, 24 nt, Human
gcaacaaaacgacgccccugcugg

SEQ ID NO: 59816 - RNA, 24 nt, Human
gcacaaagacaaguuccaggaaca

SEQ ID NO: 59817 - RNA, 21 nt, Human
gcagguguguccccuggugcu

SEQ ID NO: 59818 - RNA, 19 nt, Human
gccagagaccagggagggc

SEQ ID NO: 59819 - RNA, 21 nt, Human
gccuggcgaggcuggcgcuuc

SEQ ID NO: 59820 - RNA, 28 nt, Human
gcggccgagggcgguggcggcggcagcg

SEQ ID NO: 59821 - RNA, 23 nt, Human
ggaacacccauaaacccauaacg

SEQ ID NO: 59822 - RNA, 22 nt, Human
ggcagagcagauggccugggga

SEQ ID NO: 59823 - RNA, 18 nt, Human
ggccagagaccagggagg

SEQ ID NO: 59824 - RNA, 18 nt, Human
ggcgguggcggcggcagc

SEQ ID NO: 59825 - RNA, 19 nt, Human
ggcugggaggguggccaga

SEQ ID NO: 59826 - RNA, 23 nt, Human
gggaaaggggcuucugagacgag

SEQ ID NO: 59827 - RNA, 21 nt, Human
gggcaaagaaacgagacuucu

SEQ ID NO: 59828 - RNA, 18 nt, Human
gggcagaggcugggaggg

SEQ ID NO: 59829 - RNA, 19 nt, Human
gggccccuccaucuggugg

SEQ ID NO: 59830 - RNA, 25 nt, Human
gggcgguggcggcggcagcgacggu

SEQ ID NO: 59831 - RNA, 25 nt, Human
ggggacagugaggguaaccgguacc

SEQ ID NO: 59832 - RNA, 20 nt, Human
gggugaccaagcgcagacgu

SEQ ID NO: 59833 - RNA, 18 nt, Human
gguaacacaaacagcaac

SEQ ID NO: 59834 - RNA, 19 nt, Human
guaacacaaacagcaacga

SEQ ID NO: 59835 - RNA, 21 nt, Human
guggcggcggcagcgacggug

SEQ ID NO: 59836 - RNA, 22 nt, Human
uaaacccauaacguucaacaaa

SEQ ID NO: 59837 - RNA, 24 nt, Human
uaacguucaacaaaauggcaacaa

SEQ ID NO: 59838 - RNA, 19 nt, Human
uaccugggagcucaacagc

SEQ ID NO: 59839 - RNA, 23 nt, Human
ucccugggcagaggcugggaggg

SEQ ID NO: 59840 - RNA, 18 nt, Human
ucucaccaaaccccaccu

SEQ ID NO: 59841 - RNA, 22 nt, Human
ucucaccaaaccccaccucccc

SEQ ID NO: 59842 - RNA, 25 nt, Human
ugacagcaucucgugacccaggcug

SEQ ID NO: 59843 - RNA, 25 nt, Human
ugagugccguaggacguggguggga

SEQ ID NO: 59844 - RNA, 21 nt, Human
uggccagagaccagggagggc

SEQ ID NO: 59845 - RNA, 22 nt, Human
uggcgaggcuggcgcuuccuuc

SEQ ID NO: 59846 - RNA, 20 nt, Human
uggcggcggcagcgacggug

SEQ ID NO: 59847 - RNA, 21 nt, Human
ugggaaaaagucugaggcugg

SEQ ID NO: 59848 - RNA, 18 nt, Human
ugggaaaggggcuucuga

SEQ ID NO: 59849 - RNA, 23 nt, Human
ugggaaaggggcuucugagacga

SEQ ID NO: 59850 - RNA, 19 nt, Human
ugggaaggcgccacaggcg

SEQ ID NO: 59851 - RNA, 23 nt, Human
ugggcguugagcaaggccgggcg

SEQ ID NO: 59852 - RNA, 23 nt, Human
uggggaaggcaggggucccuggg

SEQ ID NO: 59853 - RNA, 19 nt, Human
uugaagaccagccucuucu

SEQ ID NO: 59854 - RNA, 21 nt, Human
aagaaaggacauaaaggcaga

SEQ ID NO: 59855 - RNA, 18 nt, Human
aagcugccuggcuggcua

SEQ ID NO: 59856 - RNA, 22 nt, Human
aaggccccacugcagccaagga

SEQ ID NO: 59857 - RNA, 21 nt, Human
acagggcccugggcagaggag

SEQ ID NO: 59858 - RNA, 23 nt, Human
acuggagugaaaggccagggcca

SEQ ID NO: 59859 - RNA, 22 nt, Human
acuucccccucccccuccccac

SEQ ID NO: 59860 - RNA, 18 nt, Human
agaaagagggggguccag

SEQ ID NO: 59861 - RNA, 20 nt, Human
agaaaggacauaaaggcaga

SEQ ID NO: 59862 - RNA, 23 nt, Human
agaacagggcccugggcagagga

SEQ ID NO: 59863 - RNA, 23 nt, Human
agaagaaaggacauaaaggcaga

SEQ ID NO: 59864 - RNA, 21 nt, Human
agcugccuggcuggcuagggg

SEQ ID NO: 59865 - RNA, 20 nt, Human
aggagaaagagggggguccg

SEQ ID NO: 59866 - RNA, 19 nt, Human
aggcagacacuucccccuc

SEQ ID NO: 59867 - RNA, 21 nt, Human
aggcagggaauaaaagccaaa

SEQ ID NO: 59868 - RNA, 21 nt, Human
agggagggaaggacaucuggg

SEQ ID NO: 59869 - RNA, 23 nt, Human
agggagggaaggacaucuggggu

SEQ ID NO: 59870 - RNA, 20 nt, Human
cacccccaucugggucacau

SEQ ID NO: 59871 - RNA, 22 nt, Human
cacuucccccucccccucccca

SEQ ID NO: 59872 - RNA, 24 nt, Human
cacuucccccucccccuccccacc

SEQ ID NO: 59873 - RNA, 18 nt, Human
cagccgagucccaccaag

SEQ ID NO: 59874 - RNA, 24 nt, Human
cagccuccggcucggcgcguccca

SEQ ID NO: 59875 - RNA, 20 nt, Human
ccccucccaggcagagaagc

SEQ ID NO: 59876 - RNA, 24 nt, Human
ccccuccccaccccucccagcucc

SEQ ID NO: 59877 - RNA, 20 nt, Human
cccgccacgcugccaggacc

SEQ ID NO: 59878 - RNA, 21 nt, Human
cccgccacgcugccaggaccc

SEQ ID NO: 59879 - RNA, 22 nt, Human
cccucccagcuccugccucacc

SEQ ID NO: 59880 - RNA, 22 nt, Human
ccuccccaccccucccagcucc

SEQ ID NO: 59881 - RNA, 23 nt, Human
ccucccccuccccaccccuccca

SEQ ID NO: 59882 - RNA, 23 nt, Human
ccucccuggcacuggauaaaggc

SEQ ID NO: 59883 - RNA, 21 nt, Human
ccugaacaccuuuucccuuua

SEQ ID NO: 59884 - RNA, 18 nt, Human
cgccacgcugccaggacc

SEQ ID NO: 59885 - RNA, 24 nt, Human
cucaaaguggcaagguuagaaaaa

SEQ ID NO: 59886 - RNA, 23 nt, Human
cuucccccucccccuccccaccc

SEQ ID NO: 59887 - RNA, 19 nt, Human
cuugcccuucccccaaccc

SEQ ID NO: 59888 - RNA, 21 nt, Human
gagaaagagggggguccaggc

SEQ ID NO: 59889 - RNA, 18 nt, Human
gcagccaaggagaaagag

SEQ ID NO: 59890 - RNA, 24 nt, Human
gccaaggagaaagaggggggucca

SEQ ID NO: 59891 - RNA, 27 nt, Human
gcccugaacaccuuuucccuuuaaccu

SEQ ID NO: 59892 - RNA, 22 nt, Human
gccuggcuggcuagggggaggg

SEQ ID NO: 59893 - RNA, 19 nt, Human
gcuagggggaggguggagg

SEQ ID NO: 59894 - RNA, 21 nt, Human
gcugccaggaccccaucgcca

SEQ ID NO: 59895 - RNA, 18 nt, Human
ggcaagguuagaaaaaaa

SEQ ID NO: 59896 - RNA, 19 nt, Human
ggcuagggggaggguggag

SEQ ID NO: 59897 - RNA, 18 nt, Human
gguuaugggacagagagg

SEQ ID NO: 59898 - RNA, 20 nt, Human
gugaaaggccagggccagga

SEQ ID NO: 59899 - RNA, 21 nt, Human
uaaaagccaaauagcaccccc

SEQ ID NO: 59900 - RNA, 19 nt, Human
uagggggaggguggaggua

SEQ ID NO: 59901 - RNA, 20 nt, Human
uagggggaggguggagguag

SEQ ID NO: 59902 - RNA, 23 nt, Human
uaugggacagagaggacaagaag

SEQ ID NO: 59903 - RNA, 24 nt, Human
ucccauaaagcuugcccuuccccc

SEQ ID NO: 59904 - RNA, 19 nt, Human
uccccaccccucccagcuc

SEQ ID NO: 59905 - RNA, 19 nt, Human
ucccccaacccuuccuucc

SEQ ID NO: 59906 - RNA, 22 nt, Human
ucccccaacccuuccuucccuc

SEQ ID NO: 59907 - RNA, 18 nt, Human
ucccgccacgcugccagg

SEQ ID NO: 59908 - RNA, 22 nt, Human
ugaaaggccagggccaggacca

SEQ ID NO: 59909 - RNA, 21 nt, Human
ugcagccaaggagaaagaggg

SEQ ID NO: 59910 - RNA, 22 nt, Human
ugccuggcuggcuagggggagg

SEQ ID NO: 59911 - RNA, 25 nt, Human
ugccuggcuggcuagggggagggug

SEQ ID NO: 59912 - RNA, 20 nt, Human
uggcacuggauaaaggcccc

SEQ ID NO: 59913 - RNA, 19 nt, Human
uggcuggcuagggggaggg

SEQ ID NO: 59914 - RNA, 21 nt, Human
uggcuggcuagggggagggug

SEQ ID NO: 59915 - RNA, 19 nt, Human
ugggcagaggagaagcagc

SEQ ID NO: 59916 - RNA, 19 nt, Human
uucccccucccccucccca

SEQ ID NO: 59917 - RNA, 22 nt, Human
uuuuuuuuuuuuuuuuuuccag

SEQ ID NO: 59918 - RNA, 21 nt, Human
aaaauaaaaauacaaaaggcc

SEQ ID NO: 59919 - RNA, 21 nt, Human
aaagucccaggcaucccccaa

SEQ ID NO: 59920 - RNA, 27 nt, Human
aacagcagcagaugaacaaaaauaaaa

SEQ ID NO: 59921 - RNA, 23 nt, Human
aagcggggaccgggcggaaagga

SEQ ID NO: 59922 - RNA, 21 nt, Human
aaggagccgagccggccgcgg

SEQ ID NO: 59923 - RNA, 22 nt, Human
accccaggcagcgccaaggagc

SEQ ID NO: 59924 - RNA, 21 nt, Human
accgcccccugccccuccccu

SEQ ID NO: 59925 - RNA, 20 nt, Human
aggaccccaggcagcgccaa

SEQ ID NO: 59926 - RNA, 24 nt, Human
agggcuggcuggcgggcgggcggg

SEQ ID NO: 59927 - RNA, 26 nt, Human
aggguggggugggaggggaggagaca

SEQ ID NO: 59928 - RNA, 19 nt, Human
agucccaggcaucccccaa

SEQ ID NO: 59929 - RNA, 22 nt, Human
agucccaggcaucccccaaacc

SEQ ID NO: 59930 - RNA, 23 nt, Human
caaaaauaaaaauacaaaaggcc

SEQ ID NO: 59931 - RNA, 18 nt, Human
caacagggugggguggga

SEQ ID NO: 59932 - RNA, 24 nt, Human
cacaauaauacacagccccuggau

SEQ ID NO: 59933 - RNA, 22 nt, Human
caccaaaacugccucaguccaa

SEQ ID NO: 59934 - RNA, 18 nt, Human
cagaauguaaacagcagc

SEQ ID NO: 59935 - RNA, 20 nt, Human
cagcgccaaggagccgagcc

SEQ ID NO: 59936 - RNA, 21 nt, Human
cagcgccaaggagccgagccg

SEQ ID NO: 59937 - RNA, 18 nt, Human
caggguggggugggaggg

SEQ ID NO: 59938 - RNA, 24 nt, Human
cauccacuucccuggccccucucc

SEQ ID NO: 59939 - RNA, 18 nt, Human
ccaggcagcgccaaggag

SEQ ID NO: 59940 - RNA, 23 nt, Human
cccccaaacccuggugucuucuc

SEQ ID NO: 59941 - RNA, 18 nt, Human
ccccccagaauguaaaca

SEQ ID NO: 59942 - RNA, 18 nt, Human
cccccugccccuccccuc

SEQ ID NO: 59943 - RNA, 22 nt, Human
ccccugccccuccccuccgccc

SEQ ID NO: 59944 - RNA, 21 nt, Human
cccgcgguccggagcucugag

SEQ ID NO: 59945 - RNA, 20 nt, Human
cccuggccccucuccccucu

SEQ ID NO: 59946 - RNA, 20 nt, Human
ccgcccccugccccuccccu

SEQ ID NO: 59947 - RNA, 23 nt, Human
ccucaguccaaggggcugcccag

SEQ ID NO: 59948 - RNA, 24 nt, Human
cgcccccugccccuccccuccgcc

SEQ ID NO: 59949 - RNA, 18 nt, Human
cgggcgggcgggcgggcu

SEQ ID NO: 59950 - RNA, 23 nt, Human
cguggcaccgcccccugccccuc

SEQ ID NO: 59951 - RNA, 21 nt, Human
cuacaacagggugggguggga

SEQ ID NO: 59952 - RNA, 25 nt, Human
cucacaauaauacacagccccugga

SEQ ID NO: 59953 - RNA, 18 nt, Human
cucccccuaaccccccag

SEQ ID NO: 59954 - RNA, 20 nt, Human
cucccccuaaccccccagaa

SEQ ID NO: 59955 - RNA, 24 nt, Human
cuggauggggaggggguaggaggg

SEQ ID NO: 59956 - RNA, 22 nt, Human
cuggugucuucucugucaccag

SEQ ID NO: 59957 - RNA, 24 nt, Human
cuggugucuucucugucaccagug

SEQ ID NO: 59958 - RNA, 21 nt, Human
gagccgagccggccgcgggga

SEQ ID NO: 59959 - RNA, 25 nt, Human
gcagcagaugaacaaaaauaaaaau

SEQ ID NO: 59960 - RNA, 20 nt, Human
gcuggcgggcgggcgggcgg

SEQ ID NO: 59961 - RNA, 23 nt, Human
ggaccgggcggaaaggaccccag

SEQ ID NO: 59962 - RNA, 23 nt, Human
ggauggggaggggguaggagggg

SEQ ID NO: 59963 - RNA, 19 nt, Human
ggccggaggaaagucccag

SEQ ID NO: 59964 - RNA, 23 nt, Human
ggccggaggaaagucccaggcau

SEQ ID NO: 59965 - RNA, 19 nt, Human
ggcuggcgggcgggcgggc

SEQ ID NO: 59966 - RNA, 22 nt, Human
ggcuggcgggcgggcgggcggg

SEQ ID NO: 59967 - RNA, 24 nt, Human
gggcacagagcagcgggggcuggc

SEQ ID NO: 59968 - RNA, 20 nt, Human
ggggaaagggagggaggggg

SEQ ID NO: 59969 - RNA, 19 nt, Human
gggggcuggcaagcgggga

SEQ ID NO: 59970 - RNA, 20 nt, Human
ggggggaaagggagggaggg

SEQ ID NO: 59971 - RNA, 21 nt, Human
gucccaggcaucccccaaacc

SEQ ID NO: 59972 - RNA, 19 nt, Human
uaaaaauacaaaaggccgg

SEQ ID NO: 59973 - RNA, 23 nt, Human
uaaacagcagcagaugaacaaaa

SEQ ID NO: 59974 - RNA, 19 nt, Human
uacacagccccuggauggg

SEQ ID NO: 59975 - RNA, 24 nt, Human
uaggaggggcuacaacaggguggg

SEQ ID NO: 59976 - RNA, 18 nt, Human
ucaguccaaggggcugcc

SEQ ID NO: 59977 - RNA, 24 nt, Human
ucccccaaacccuggugucuucuc

SEQ ID NO: 59978 - RNA, 23 nt, Human
ucccccggggcagaguccagggc

SEQ ID NO: 59979 - RNA, 18 nt, Human
ucugugcuugggggggaa

SEQ ID NO: 59980 - RNA, 20 nt, Human
ucuucucugucaccagugga

SEQ ID NO: 59981 - RNA, 22 nt, Human
ugccggccacaucccccggggc

SEQ ID NO: 59982 - RNA, 20 nt, Human
uggaggucccccauccacca

SEQ ID NO: 59983 - RNA, 20 nt, Human
uggcaccgcccccugccccu

SEQ ID NO: 59984 - RNA, 24 nt, Human
uggcaggccguggcaccgcccccu

SEQ ID NO: 59985 - RNA, 20 nt, Human
uggccggacagggcacagag

SEQ ID NO: 59986 - RNA, 23 nt, Human
uggcuggcgggcgggcgggcggg

SEQ ID NO: 59987 - RNA, 18 nt, Human
uggggaggggguaggagg

SEQ ID NO: 59988 - RNA, 18 nt, Human
uggggugggaggggagga

SEQ ID NO: 59989 - RNA, 22 nt, Human
uggggugggaggggaggagaca

SEQ ID NO: 59990 - RNA, 20 nt, Human
uggugucggcuccaggccug

SEQ ID NO: 59991 - RNA, 23 nt, Human
aaaaaaagaaaaaagcaaacuga

SEQ ID NO: 59992 - RNA, 25 nt, Human
aaaaaagaaaaaagcaaacugaaaa

SEQ ID NO: 59993 - RNA, 22 nt, Human
aaacaguguaacacugcuaaac

SEQ ID NO: 59994 - RNA, 21 nt, Human
aaagaaaaaagcaaacugaaa

SEQ ID NO: 59995 - RNA, 18 nt, Human
aacaggcugguauuuugg

SEQ ID NO: 59996 - RNA, 22 nt, Human
aacagguuuugccucucaggag

SEQ ID NO: 59997 - RNA, 19 nt, Human
aaccuccaucccacuuccc

SEQ ID NO: 59998 - RNA, 19 nt, Human
aaccugcuuuuccgcucca

SEQ ID NO: 59999 - RNA, 20 nt, Human
aacuaggcacagaaaaggca

SEQ ID NO: 60000 - RNA, 18 nt, Human
aagcccacaaguaaggac

SEQ ID NO: 60001 - RNA, 24 nt, Human
aagccgugguggaggcaacagguu

SEQ ID NO: 60002 - RNA, 25 nt, Human
aagcuucacaacacagacacagagc

SEQ ID NO: 60003 - RNA, 21 nt, Human
aagcuucccccaacccccacc

SEQ ID NO: 60004 - RNA, 22 nt, Human
aagcuuggaaugagccaagagg

SEQ ID NO: 60005 - RNA, 20 nt, Human
aaucucugaccagcaaaaga

SEQ ID NO: 60006 - RNA, 22 nt, Human
aaugagccaagagggaagccgu

SEQ ID NO: 60007 - RNA, 19 nt, Human
acacacuuuuccuucugga

SEQ ID NO: 60008 - RNA, 19 nt, Human
acagagcgucaaaaucaau

SEQ ID NO: 60009 - RNA, 22 nt, Human
acccaauaagaacagaggaaug

SEQ ID NO: 60010 - RNA, 21 nt, Human
accuccaucccacuuccccaa

SEQ ID NO: 60011 - RNA, 23 nt, Human
acugguggggaggcugagagaag

SEQ ID NO: 60012 - RNA, 20 nt, Human
acuuuaccaaccugcuuuuc

SEQ ID NO: 60013 - RNA, 18 nt, Human
agaaaaaagcaaacugaa

SEQ ID NO: 60014 - RNA, 19 nt, Human
agaaaaaagcaaacugaaa

SEQ ID NO: 60015 - RNA, 24 nt, Human
agaaaaaagcaaacugaaaaucca

SEQ ID NO: 60016 - RNA, 18 nt, Human
agaacccaucaaaagcua

SEQ ID NO: 60017 - RNA, 23 nt, Human
agaauuccucccuaacucugcuc

SEQ ID NO: 60018 - RNA, 23 nt, Human
agacacacucaggcagaggaggg

SEQ ID NO: 60019 - RNA, 21 nt, Human
agaggaggggggaugcagggc

SEQ ID NO: 60020 - RNA, 18 nt, Human
agcaugguugaaggguac

SEQ ID NO: 60021 - RNA, 19 nt, Human
agcuucccccaacccccac

SEQ ID NO: 60022 - RNA, 18 nt, Human
agcuuugcaacugguaug

SEQ ID NO: 60023 - RNA, 19 nt, Human
aggcagaggaggggggaug

SEQ ID NO: 60024 - RNA, 19 nt, Human
aggcaggagaaggcauuag

SEQ ID NO: 60025 - RNA, 21 nt, Human
aggcuuggccaaggaaaagga

SEQ ID NO: 60026 - RNA, 20 nt, Human
agggcaacauuuccccugcc

SEQ ID NO: 60027 - RNA, 19 nt, Human
aggggaaaacgacaagaga

SEQ ID NO: 60028 - RNA, 23 nt, Human
aguaucaugaagaaagagcagau

SEQ ID NO: 60029 - RNA, 23 nt, Human
agugcaguguuucaguuacacuu

SEQ ID NO: 60030 - RNA, 19 nt, Human
aguguaacacugcuaaaca

SEQ ID NO: 60031 - RNA, 19 nt, Human
auggaauaugugaagagcc

SEQ ID NO: 60032 - RNA, 23 nt, Human
auuccuccucugaguccagugag

SEQ ID NO: 60033 - RNA, 19 nt, Human
caaaagauauucagcugcc

SEQ ID NO: 60034 - RNA, 23 nt, Human
caacaagugcccgcagaucaaac

SEQ ID NO: 60035 - RNA, 20 nt, Human
caacauuuccccugcccccc

SEQ ID NO: 60036 - RNA, 22 nt, Human
caacauuuccccugcccccccu

SEQ ID NO: 60037 - RNA, 19 nt, Human
caacccccacccucccgaa

SEQ ID NO: 60038 - RNA, 21 nt, Human
caacgcauuaagugggguagg

SEQ ID NO: 60039 - RNA, 23 nt, Human
caaggucaagcuucccccaaccc

SEQ ID NO: 60040 - RNA, 19 nt, Human
caauacaauuucuuccagu

SEQ ID NO: 60041 - RNA, 20 nt, Human
cacaacacagacacagagca

SEQ ID NO: 60042 - RNA, 21 nt, Human
cacaacacagacacagagcag

SEQ ID NO: 60043 - RNA, 25 nt, Human
cacagacacagagcaggcuugggug

SEQ ID NO: 60044 - RNA, 21 nt, Human
cacaggaagcuaaaacuaucc

SEQ ID NO: 60045 - RNA, 25 nt, Human
cacccucccgaaaaacaggacccaa

SEQ ID NO: 60046 - RNA, 22 nt, Human
caccuucauucuggcaucuggc

SEQ ID NO: 60047 - RNA, 19 nt, Human
cacuacacagcugacgggc

SEQ ID NO: 60048 - RNA, 26 nt, Human
cacuacacagcugacgggccuuggcg

SEQ ID NO: 60049 - RNA, 23 nt, Human
cagacaugaaauagggguguggg

SEQ ID NO: 60050 - RNA, 23 nt, Human
cagaggaaugagaagcauucuua

SEQ ID NO: 60051 - RNA, 20 nt, Human
cagcaaaagaguucugggug

SEQ ID NO: 60052 - RNA, 21 nt, Human
cagcaauacaauuucuuccag

SEQ ID NO: 60053 - RNA, 26 nt, Human
cagcagcagguggcaagaggugggag

SEQ ID NO: 60054 - RNA, 22 nt, Human
cagcaucuggguucuuguuccc

SEQ ID NO: 60055 - RNA, 23 nt, Human
cagcugacauuacaaagacacac

SEQ ID NO: 60056 - RNA, 21 nt, Human
caggcaaugcaacaagugccc

SEQ ID NO: 60057 - RNA, 26 nt, Human
caggcagaggaggggggaugcagggc

SEQ ID NO: 60058 - RNA, 19 nt, Human
caucaaaagcuaggguagg

SEQ ID NO: 60059 - RNA, 20 nt, Human
caucaaaagcuaggguaggu

SEQ ID NO: 60060 - RNA, 20 nt, Human
caugaagaaagagcagauca

SEQ ID NO: 60061 - RNA, 19 nt, Human
cauggacccugaauauugg

SEQ ID NO: 60062 - RNA, 19 nt, Human
ccaaacuacacucaaaaga

SEQ ID NO: 60063 - RNA, 20 nt, Human
ccacaaguaaggacagauag

SEQ ID NO: 60064 - RNA, 23 nt, Human
ccacccucccgaaaaacaggacc

SEQ ID NO: 60065 - RNA, 19 nt, Human
ccaccucccacauacaauc

SEQ ID NO: 60066 - RNA, 21 nt, Human
ccaccucccacauacaauccu

SEQ ID NO: 60067 - RNA, 22 nt, Human
cccaacccccacccucccgaaa

SEQ ID NO: 60068 - RNA, 18 nt, Human
cccacccucccgaaaaac

SEQ ID NO: 60069 - RNA, 23 nt, Human
cccacuuugccagggacaaagau

SEQ ID NO: 60070 - RNA, 20 nt, Human
ccccaacccccacccucccg

SEQ ID NO: 60071 - RNA, 23 nt, Human
ccccaacccccacccucccgaaa

SEQ ID NO: 60072 - RNA, 25 nt, Human
ccccaacccccacccucccgaaaaa

SEQ ID NO: 60073 - RNA, 20 nt, Human
cccccaacccccacccuccc

SEQ ID NO: 60074 - RNA, 22 nt, Human
cccccccuccccauuucuuucc

SEQ ID NO: 60075 - RNA, 22 nt, Human
cccccccuccccauuucuuucc

SEQ ID NO: 60076 - RNA, 25 nt, Human
ccccugcccccccuccccauuucuu

SEQ ID NO: 60077 - RNA, 20 nt, Human
cccuccccauuucuuuccaa

SEQ ID NO: 60078 - RNA, 23 nt, Human
ccugcccgucacgauucuuuucu

SEQ ID NO: 60079 - RNA, 20 nt, Human
ccuucugcacuacuuguauc

SEQ ID NO: 60080 - RNA, 22 nt, Human
cgaaaaacaggacccaauaaga

SEQ ID NO: 60081 - RNA, 19 nt, Human
cuccaucccacuuccccaa

SEQ ID NO: 60082 - RNA, 20 nt, Human
cucccacauacaauccuaug

SEQ ID NO: 60083 - RNA, 21 nt, Human
cucugcucaggggugugaugg

SEQ ID NO: 60084 - RNA, 23 nt, Human
cugaagugccccugauuuaagca

SEQ ID NO: 60085 - RNA, 19 nt, Human
cuucccccaacccccaccc

SEQ ID NO: 60086 - RNA, 22 nt, Human
cuucccccaacccccacccucc

SEQ ID NO: 60087 - RNA, 21 nt, Human
gaaaauccaaaugaccaggga

SEQ ID NO: 60088 - RNA, 23 nt, Human
gaagagccaaaaacuaggcacag

SEQ ID NO: 60089 - RNA, 20 nt, Human
gaagcaugaaggcuuggcca

SEQ ID NO: 60090 - RNA, 19 nt, Human
gacacacuuuuccuucugg

SEQ ID NO: 60091 - RNA, 20 nt, Human
gaccgcuccccacaagcuuu

SEQ ID NO: 60092 - RNA, 21 nt, Human
gagagcacagcccagguggug

SEQ ID NO: 60093 - RNA, 21 nt, Human
gagagggggugaggggacagc

SEQ ID NO: 60094 - RNA, 24 nt, Human
gagcuguuauccaucacugguggg

SEQ ID NO: 60095 - RNA, 19 nt, Human
gcaagaggugggaggugac

SEQ ID NO: 60096 - RNA, 21 nt, Human
gccgugguggaggcaacaggu

SEQ ID NO: 60097 - RNA, 18 nt, Human
gcgaaggcgagggcgggg

SEQ ID NO: 60098 - RNA, 21 nt, Human
gcgaaggcgagggcgggggug

SEQ ID NO: 60099 - RNA, 18 nt, Human
ggaacugccugaaccucu

SEQ ID NO: 60100 - RNA, 22 nt, Human
ggacagacacucagggaaucuc

SEQ ID NO: 60101 - RNA, 22 nt, Human
ggagaaggcauuaggggaaaac

SEQ ID NO: 60102 - RNA, 18 nt, Human
gggaaucucugaccagca

SEQ ID NO: 60103 - RNA, 21 nt, Human
gggagccggagagcacagccc

SEQ ID NO: 60104 - RNA, 21 nt, Human
ggggguggcggcgggagccgg

SEQ ID NO: 60105 - RNA, 22 nt, Human
guuuguucaggggaaaggaaag

SEQ ID NO: 60106 - RNA, 18 nt, Human
uaaagagcauuugcaaca

SEQ ID NO: 60107 - RNA, 23 nt, Human
uaaagagcauuugcaacaucucu

SEQ ID NO: 60108 - RNA, 19 nt, Human
uaagguauaacuucuguca

SEQ ID NO: 60109 - RNA, 24 nt, Human
uaaguaucaugaagaaagagcaga

SEQ ID NO: 60110 - RNA, 18 nt, Human
uaagucccaagaagggaa

SEQ ID NO: 60111 - RNA, 26 nt, Human
uaccaaccugcuuuuccgcuccacac

SEQ ID NO: 60112 - RNA, 20 nt, Human
uagcacagguuagacuaguu

SEQ ID NO: 60113 - RNA, 20 nt, Human
uaggaaauuguguugucugc

SEQ ID NO: 60114 - RNA, 21 nt, Human
uaggggaaaacgacaagagac

SEQ ID NO: 60115 - RNA, 20 nt, Human
uaggucucaguccaacauga

SEQ ID NO: 60116 - RNA, 22 nt, Human
uaguuugcuuugagaugagaac

SEQ ID NO: 60117 - RNA, 21 nt, Human
ucaggucagcugagaauagga

SEQ ID NO: 60118 - RNA, 21 nt, Human
ucaguccaacaugacgccugu

SEQ ID NO: 60119 - RNA, 20 nt, Human
uccaacgcauuaaguggggu

SEQ ID NO: 60120 - RNA, 23 nt, Human
uccacacaucaccgaccuaucca

SEQ ID NO: 60121 - RNA, 27 nt, Human
uccacacaucaccgaccuauccaccuc

SEQ ID NO: 60122 - RNA, 18 nt, Human
uccagagucucaagcuuc

SEQ ID NO: 60123 - RNA, 23 nt, Human
ucccacuuccccaauuuggccaa

SEQ ID NO: 60124 - RNA, 20 nt, Human
ucccccaacccccacccucc

SEQ ID NO: 60125 - RNA, 21 nt, Human
ucccccaacccccacccuccc

SEQ ID NO: 60126 - RNA, 21 nt, Human
ucccccagucuuuucagagau

SEQ ID NO: 60127 - RNA, 19 nt, Human
uccccugcccccccucccc

SEQ ID NO: 60128 - RNA, 20 nt, Human
uccccugcccccccucccca

SEQ ID NO: 60129 - RNA, 19 nt, Human
ucucuuggagauucucaag

SEQ ID NO: 60130 - RNA, 23 nt, Human
ucugcaccuauucugcuggccuc

SEQ ID NO: 60131 - RNA, 18 nt, Human
ugaaaaccacacugacgg

SEQ ID NO: 60132 - RNA, 23 nt, Human
ugaaaugagcucucaauuacaaa

SEQ ID NO: 60133 - RNA, 19 nt, Human
ugaagugccccugauuuaa

SEQ ID NO: 60134 - RNA, 22 nt, Human
ugacgaagacacaaggucaagc

SEQ ID NO: 60135 - RNA, 20 nt, Human
ugacggggacuuaggagacu

SEQ ID NO: 60136 - RNA, 22 nt, Human
ugaggacagacacucagggaau

SEQ ID NO: 60137 - RNA, 22 nt, Human
ugaggggacagcaucuggguug

SEQ ID NO: 60138 - RNA, 23 nt, Human
ugaugccagcugacauuacaaag

SEQ ID NO: 60139 - RNA, 21 nt, Human
ugcgcaaaacccacuuugcca

SEQ ID NO: 60140 - RNA, 27 nt, Human
uggaaagggggaagcaugaaggcuugg

SEQ ID NO: 60141 - RNA, 27 nt, Human
uggaaugauaguuugcuuugagauggc

SEQ ID NO: 60142 - RNA, 22 nt, Human
ugggagguggcuuccccaagga

SEQ ID NO: 60143 - RNA, 19 nt, Human
ugugaagagccaaaaacua

SEQ ID NO: 60144 - RNA, 27 nt, Human
uuaaugacagucauuucaaugccuucu

SEQ ID NO: 60145 - RNA, 19 nt, Human
uuacaaauguucacaggaa

SEQ ID NO: 60146 - RNA, 19 nt, Human
uucaagaagaucaccguuc

SEQ ID NO: 60147 - RNA, 19 nt, Human
uucacaggaagcuaaaacu

SEQ ID NO: 60148 - RNA, 19 nt, Human
uuccagagucucaagcuuc

SEQ ID NO: 60149 - RNA, 22 nt, Human
uuccgcuccacacaucaccgac

SEQ ID NO: 60150 - RNA, 20 nt, Human
uuccucccuccuuccccaaa

SEQ ID NO: 60151 - RNA, 21 nt, Human
uucucauauguacaaaaguau

SEQ ID NO: 60152 - RNA, 22 nt, Human
uugcagugugaaccuucugcac

SEQ ID NO: 60153 - RNA, 22 nt, Human
uuggaggggaaaaaaagaaaaa

SEQ ID NO: 60154 - RNA, 21 nt, Human
uuggcacagcauggagaagcc

SEQ ID NO: 60155 - RNA, 22 nt, Human
uuuccccugcccccccucccca

SEQ ID NO: 60156 - RNA, 21 nt, Human
uuucucauauguacaaaagua

SEQ ID NO: 60157 - RNA, 22 nt, Human
uuugccagggacaaagauggug

SEQ ID NO: 60158 - RNA, 20 nt, Human
uuuguugucuuuuucugcuu

SEQ ID NO: 60159 - RNA, 21 nt, Human
uuuuagauuugaacuggaccu

SEQ ID NO: 60160 - RNA, 21 nt, Human
uuuugcucuuguuuuccacga

SEQ ID NO: 60161 - RNA, 22 nt, Human
aagcagaguagggacugaggcc

SEQ ID NO: 60162 - RNA, 18 nt, Human
aagcaggagggaggagac

SEQ ID NO: 60163 - RNA, 23 nt, Human
aagcaggagggaggagacacuga

SEQ ID NO: 60164 - RNA, 25 nt, Human
aagcaggagggaggagacacugaug

SEQ ID NO: 60165 - RNA, 21 nt, Human
aagcucacacuaucccaaagc

SEQ ID NO: 60166 - RNA, 26 nt, Human
acagaccugguguccucggcccccug

SEQ ID NO: 60167 - RNA, 21 nt, Human
agagcuguggccacaggggug

SEQ ID NO: 60168 - RNA, 23 nt, Human
agauguccgcccgcccccugcuc

SEQ ID NO: 60169 - RNA, 21 nt, Human
agcaaagcaggagggaggaga

SEQ ID NO: 60170 - RNA, 21 nt, Human
agcggcaccuggaccugugga

SEQ ID NO: 60171 - RNA, 22 nt, Human
agcuguggccacagggguggga

SEQ ID NO: 60172 - RNA, 28 nt, Human
aggccaggacagacagguggaugggaga

SEQ ID NO: 60173 - RNA, 19 nt, Human
agggaaggcagcaaagcag

SEQ ID NO: 60174 - RNA, 23 nt, Human
augggagagcaggagccucagaa

SEQ ID NO: 60175 - RNA, 23 nt, Human
caaaaugaagcucacacuauccc

SEQ ID NO: 60176 - RNA, 21 nt, Human
cacacguguacaaaaugaagc

SEQ ID NO: 60177 - RNA, 19 nt, Human
cacuaucccaaagcagagu

SEQ ID NO: 60178 - RNA, 19 nt, Human
cagguggaugggagagcag

SEQ ID NO: 60179 - RNA, 23 nt, Human
ccaacccucccacuccagagcuu

SEQ ID NO: 60180 - RNA, 20 nt, Human
ccagagcuguggccacaggg

SEQ ID NO: 60181 - RNA, 22 nt, Human
ccaggacagacagguggauggg

SEQ ID NO: 60182 - RNA, 20 nt, Human
cccccugcucugccggcccg

SEQ ID NO: 60183 - RNA, 19 nt, Human
ccccugcucgucugcccgc

SEQ ID NO: 60184 - RNA, 24 nt, Human
ccccugcucgucugcccgcugccu

SEQ ID NO: 60185 - RNA, 25 nt, Human
cggcccccugcucugccggcccggc

SEQ ID NO: 60186 - RNA, 19 nt, Human
cgggcuggugcaaagggaa

SEQ ID NO: 60187 - RNA, 26 nt, Human
cucccacuccagagcuguggccacag

SEQ ID NO: 60188 - RNA, 24 nt, Human
cuccggaucccaagauguccgccc

SEQ ID NO: 60189 - RNA, 22 nt, Human
cuuggcccagaccuagacucgg

SEQ ID NO: 60190 - RNA, 20 nt, Human
gaccuagacucgggcuggug

SEQ ID NO: 60191 - RNA, 18 nt, Human
gcaaccaacccucccacu

SEQ ID NO: 60192 - RNA, 18 nt, Human
gcccagggagcccagggg

SEQ ID NO: 60193 - RNA, 18 nt, Human
gcccaggggcugcuccac

SEQ ID NO: 60194 - RNA, 19 nt, Human
ggaaggaaagggaacccac

SEQ ID NO: 60195 - RNA, 24 nt, Human
ggagcccaggggcugcuccaccgg

SEQ ID NO: 60196 - RNA, 23 nt, Human
ggagccucagaacuccccugccc

SEQ ID NO: 60197 - RNA, 19 nt, Human
ggccacaggggugggaagg

SEQ ID NO: 60198 - RNA, 21 nt, Human
gguguccucggcccccugcuc

SEQ ID NO: 60199 - RNA, 22 nt, Human
guggaugggagagcaggagccu

SEQ ID NO: 60200 - RNA, 27 nt, Human
uacaaaaugaagcucacacuaucccaa

SEQ ID NO: 60201 - RNA, 22 nt, Human
ucacagaacucagagccuggca

SEQ ID NO: 60202 - RNA, 20 nt, Human
ucccaaagcagaguagggac

SEQ ID NO: 60203 - RNA, 18 nt, Human
uccccugcccagggagcc

SEQ ID NO: 60204 - RNA, 18 nt, Human
ucuccgcggcccaucgcu

SEQ ID NO: 60205 - RNA, 21 nt, Human
ugaagcucacacuaucccaaa

SEQ ID NO: 60206 - RNA, 20 nt, Human
ugagaacagaccuggugucc

SEQ ID NO: 60207 - RNA, 22 nt, Human
ugagaacagaccugguguccuc

SEQ ID NO: 60208 - RNA, 22 nt, Human
ugaggccggggauccauuacug

SEQ ID NO: 60209 - RNA, 24 nt, Human
ugcaaagggaaggcagcaaagcag

SEQ ID NO: 60210 - RNA, 21 nt, Human
ugcuccaccggucccacuugu

SEQ ID NO: 60211 - RNA, 21 nt, Human
uggaggaggguggcuggggag

SEQ ID NO: 60212 - RNA, 22 nt, Human
ugggaaggaaagggaacccacc

SEQ ID NO: 60213 - RNA, 25 nt, Human
ugggggagggagcggcaccuggacc

SEQ ID NO: 60214 - RNA, 22 nt, Human
uggugcaaagggaaggcagcaa

SEQ ID NO: 60215 - RNA, 22 nt, Human
uuuuuuuuuuuuuuuuuccacu

SEQ ID NO: 60216 - RNA, 20 nt, Human
accccagcggccccgguccc

SEQ ID NO: 60217 - RNA, 21 nt, Human
acccccguccagaccccagcg

SEQ ID NO: 60218 - RNA, 24 nt, Human
agcaggcgauuccaggaggggccg

SEQ ID NO: 60219 - RNA, 21 nt, Human
aggaggggccggggccggggu

SEQ ID NO: 60220 - RNA, 21 nt, Human
cagcugggucccuuccuccuu

SEQ ID NO: 60221 - RNA, 24 nt, Human
ccccguccagaccccagcggcccc

SEQ ID NO: 60222 - RNA, 26 nt, Human
cgcacagacgcuuauggaaucacacg

SEQ ID NO: 60223 - RNA, 22 nt, Human
cgggguggggugcucgccugcc

SEQ ID NO: 60224 - RNA, 18 nt, Human
cgguggccucugcccaca

SEQ ID NO: 60225 - RNA, 21 nt, Human
cugggucccuuccuccuaggc

SEQ ID NO: 60226 - RNA, 19 nt, Human
cuuguggcccagacccagc

SEQ ID NO: 60227 - RNA, 23 nt, Human
ggccggggccgggguggggugcu

SEQ ID NO: 60228 - RNA, 21 nt, Human
ggggccggggccggggugggg

SEQ ID NO: 60229 - RNA, 19 nt, Human
guggcccagacccagcugg

SEQ ID NO: 60230 - RNA, 26 nt, Human
ucugcccacagccagggcccagagga

SEQ ID NO: 60231 - RNA, 23 nt, Human
ugagggaaggacugcuggguugg

SEQ ID NO: 60232 - RNA, 24 nt, Human
ugagggaaggacugcuggguuggc

SEQ ID NO: 60233 - RNA, 27 nt, Human
ugagggaaggacugcuggguuggccac

SEQ ID NO: 60234 - RNA, 24 nt, Human
ugggaaggggaagcgagcaggcga

SEQ ID NO: 60235 - RNA, 19 nt, Human
uuacucgggacacacacgg

SEQ ID NO: 60236 - RNA, 22 nt, Human
aagcaggagacaagaaugucaa

SEQ ID NO: 60237 - RNA, 24 nt, Human
aagcaggagacaagaaugucaaga

SEQ ID NO: 60238 - RNA, 20 nt, Human
aggcacuuuuguugugugcc

SEQ ID NO: 60239 - RNA, 23 nt, Human
caguaguggaugccaggcacuuu

SEQ ID NO: 60240 - RNA, 25 nt, Human
cccacugccagauggaagggcuauu

SEQ ID NO: 60241 - RNA, 22 nt, Human
gcaaagcaaaaagggggaaagu

SEQ ID NO: 60242 - RNA, 21 nt, Human
gcaguaguggaugccaggcac

SEQ ID NO: 60243 - RNA, 18 nt, Human
ggugcuggcgggugcggg

SEQ ID NO: 60244 - RNA, 22 nt, Human
uauugcauacaugauagauaca

SEQ ID NO: 60245 - RNA, 21 nt, Human
uccugccggggguucucucca

SEQ ID NO: 60246 - RNA, 20 nt, Human
ugagacaacugacaguaaaa

SEQ ID NO: 60247 - RNA, 20 nt, Human
agacuucgccgaggaggagg

SEQ ID NO: 60248 - RNA, 26 nt, Human
agccaaacaggucacagcauuuggaa

SEQ ID NO: 60249 - RNA, 18 nt, Human
cgaggaggagguugcggc

SEQ ID NO: 60250 - RNA, 18 nt, Human
gaggaggagguugcggcg

SEQ ID NO: 60251 - RNA, 22 nt, Human
gaugaugagagagagagagaaa

SEQ ID NO: 60252 - RNA, 18 nt, Human
ggagccaaacaggucaca

SEQ ID NO: 60253 - RNA, 18 nt, Human
ggagguugcggcgcggga

SEQ ID NO: 60254 - RNA, 21 nt, Human
ggaugaugagagagagagaga

SEQ ID NO: 60255 - RNA, 23 nt, Human
gggagagaggacacccugaaugc

SEQ ID NO: 60256 - RNA, 24 nt, Human
ugagagagacugacagccuaggug

SEQ ID NO: 60257 - RNA, 18 nt, Human
ugagagagagagagaaag

SEQ ID NO: 60258 - RNA, 22 nt, Human
ugaugagagagagagagaaaga

SEQ ID NO: 60259 - RNA, 19 nt, Human
ugggagccaaacaggucac

SEQ ID NO: 60260 - RNA, 19 nt, Human
uggggagguauagauggga

SEQ ID NO: 60261 - RNA, 27 nt, Human
aagaacagcaacauugaacuuucauac

SEQ ID NO: 60262 - RNA, 21 nt, Human
acacaacuucuauacaguacc

SEQ ID NO: 60263 - RNA, 23 nt, Human
agaaaaaaaaaaaucacauagga

SEQ ID NO: 60264 - RNA, 23 nt, Human
agaaaaaagucauaauguuuuca

SEQ ID NO: 60265 - RNA, 19 nt, Human
aggugcuuuagaaguccag

SEQ ID NO: 60266 - RNA, 23 nt, Human
auacugauuuuacacaacuucua

SEQ ID NO: 60267 - RNA, 25 nt, Human
auagaggcaugccguaggugggcac

SEQ ID NO: 60268 - RNA, 21 nt, Human
caaaacaccaacauuuuaggu

SEQ ID NO: 60269 - RNA, 18 nt, Human
cacugggggccagggcgg

SEQ ID NO: 60270 - RNA, 20 nt, Human
ccaagagcaaaaguuaagac

SEQ ID NO: 60271 - RNA, 22 nt, Human
gaaaaaaaaaaaucacauagga

SEQ ID NO: 60272 - RNA, 23 nt, Human
gcggaccgggugggcacuggggg

SEQ ID NO: 60273 - RNA, 20 nt, Human
ggggccagggcgggggcggg

SEQ ID NO: 60274 - RNA, 20 nt, Human
gugccgggcggaccgggugg

SEQ ID NO: 60275 - RNA, 24 nt, Human
guuuagaaaagaaaaaaaaaaauc

SEQ ID NO: 60276 - RNA, 25 nt, Human
uaguagccaauacauagaggcaugc

SEQ ID NO: 60277 - RNA, 23 nt, Human
ugaaacacuuuuuaaaacacugu

SEQ ID NO: 60278 - RNA, 19 nt, Human
ugacuuaaauccaagagca

SEQ ID NO: 60279 - RNA, 18 nt, Human
ugagcaagaacagcaaca

SEQ ID NO: 60280 - RNA, 26 nt, Human
ugcaguuuagaaaagaaaaaaaaaaa

SEQ ID NO: 60281 - RNA, 18 nt, Human
ugggaguggccuuuuuac

SEQ ID NO: 60282 - RNA, 24 nt, Human
ugguaaacuuagaugacucuuccc

SEQ ID NO: 60283 - RNA, 21 nt, Human
uuaaaacacuguaguagccaa

SEQ ID NO: 60284 - RNA, 26 nt, Human
uucuuuaaaaucacugagcaagaaca

SEQ ID NO: 60285 - RNA, 23 nt, Human
uuuagaaaagaaaaaaaaaaauc

SEQ ID NO: 60286 - RNA, 19 nt, Human
aaaaaagaaaaaagugagg

SEQ ID NO: 60287 - RNA, 20 nt, Human
aaaaaagaaaaaagugagga

SEQ ID NO: 60288 - RNA, 18 nt, Human
aaaaacaaaaaaaaaagg

SEQ ID NO: 60289 - RNA, 27 nt, Human
aaaacaaaaaaaaaaggugggggggcc

SEQ ID NO: 60290 - RNA, 28 nt, Human
aaaacaaaaaaaaaaggugggggggccu

SEQ ID NO: 60291 - RNA, 18 nt, Human
aaacaagagggagcagga

SEQ ID NO: 60292 - RNA, 22 nt, Human
aaacaagagggagcaggaauag

SEQ ID NO: 60293 - RNA, 18 nt, Human
aaacauacaagagacaua

SEQ ID NO: 60294 - RNA, 19 nt, Human
aaagaaggaaggaaaagag

SEQ ID NO: 60295 - RNA, 23 nt, Human
aaagcaaauuuaaagagugcaaa

SEQ ID NO: 60296 - RNA, 24 nt, Human
aaauuagcugggugugguggcucg

SEQ ID NO: 60297 - RNA, 24 nt, Human
aaauuggccccaccucaaugacua

SEQ ID NO: 60298 - RNA, 18 nt, Human
aacacuuugggaggcuga

SEQ ID NO: 60299 - RNA, 24 nt, Human
aacacuuugggaggcugaggcagg

SEQ ID NO: 60300 - RNA, 20 nt, Human
aacauacaagagacauauaa

SEQ ID NO: 60301 - RNA, 20 nt, Human
aacauagugagacccugucu

SEQ ID NO: 60302 - RNA, 19 nt, Human
aacauggugaaaccccguc

SEQ ID NO: 60303 - RNA, 20 nt, Human
aacauggugaaaccccgucu

SEQ ID NO: 60304 - RNA, 21 nt, Human
aacauggugaaaccccgucuc

SEQ ID NO: 60305 - RNA, 21 nt, Human
aacugcugaaggccaggccuc

SEQ ID NO: 60306 - RNA, 22 nt, Human
aagaaaacuuaaaaauuagcug

SEQ ID NO: 60307 - RNA, 20 nt, Human
aagacagggucuugcuaugu

SEQ ID NO: 60308 - RNA, 23 nt, Human
aagaguucaagaccagccuagac

SEQ ID NO: 60309 - RNA, 18 nt, Human
aagauuguauuuaggaga

SEQ ID NO: 60310 - RNA, 22 nt, Human
aagcaaauuuaaagagugcaaa

SEQ ID NO: 60311 - RNA, 19 nt, Human
aagcaagacucugucucca

SEQ ID NO: 60312 - RNA, 23 nt, Human
aaggcggguagaucaugagguca

SEQ ID NO: 60313 - RNA, 24 nt, Human
aaggguagaccaauaaaaucuacu

SEQ ID NO: 60314 - RNA, 20 nt, Human
aauugcuugaacccaggagg

SEQ ID NO: 60315 - RNA, 20 nt, Human
acaaagcaagacucugucuc

SEQ ID NO: 60316 - RNA, 25 nt, Human
acaaagcaagacucugucuccaaaa

SEQ ID NO: 60317 - RNA, 21 nt, Human
acaagaguuucaaaacauaca

SEQ ID NO: 60318 - RNA, 18 nt, Human
acagaauuuuaccaacag

SEQ ID NO: 60319 - RNA, 22 nt, Human
acauuaauauuauucauccaac

SEQ ID NO: 60320 - RNA, 23 nt, Human
acccaacgcagccugaccccaca

SEQ ID NO: 60321 - RNA, 24 nt, Human
accccgucucuacuaaaaauacaa

SEQ ID NO: 60322 - RNA, 23 nt, Human
accuguagucccagcuacucggg

SEQ ID NO: 60323 - RNA, 18 nt, Human
accuugucuuucuuccca

SEQ ID NO: 60324 - RNA, 24 nt, Human
acgaagacccccagggaccuccga

SEQ ID NO: 60325 - RNA, 19 nt, Human
acucugucuccaaaaacaa

SEQ ID NO: 60326 - RNA, 22 nt, Human
acugcacuccagccuggcaaca

SEQ ID NO: 60327 - RNA, 24 nt, Human
acugcacuccagccuggcaacaaa

SEQ ID NO: 60328 - RNA, 18 nt, Human
acugcacuccagccuggg

SEQ ID NO: 60329 - RNA, 21 nt, Human
acugcacuccagccuggguga

SEQ ID NO: 60330 - RNA, 24 nt, Human
acugcacuccagccugggugauag

SEQ ID NO: 60331 - RNA, 20 nt, Human
acugcugaaggccaggccag

SEQ ID NO: 60332 - RNA, 20 nt, Human
acuugaggccaagaguucaa

SEQ ID NO: 60333 - RNA, 19 nt, Human
agaaaggaaagaaggaagg

SEQ ID NO: 60334 - RNA, 22 nt, Human
agaauugcuugaacccaggagg

SEQ ID NO: 60335 - RNA, 20 nt, Human
agacagaauuuuaccaacag

SEQ ID NO: 60336 - RNA, 18 nt, Human
agacagggucuugcuaug

SEQ ID NO: 60337 - RNA, 25 nt, Human
agacugggagacuccaggccggugg

SEQ ID NO: 60338 - RNA, 26 nt, Human
agagaaaggaaagaaggaaggaaaag

SEQ ID NO: 60339 - RNA, 21 nt, Human
agagugcaaaaaaccucuaag

SEQ ID NO: 60340 - RNA, 21 nt, Human
agccuggcaacaaagcaagac

SEQ ID NO: 60341 - RNA, 23 nt, Human
agccuggcaacaaagcaagacuc

SEQ ID NO: 60342 - RNA, 24 nt, Human
agcgauuguggugagccgagaucg

SEQ ID NO: 60343 - RNA, 18 nt, Human
agcugggugugguggcuc

SEQ ID NO: 60344 - RNA, 23 nt, Human
agcugggugugguggcucgugcc

SEQ ID NO: 60345 - RNA, 22 nt, Human
aggaaagaaggaaggaaaagag

SEQ ID NO: 60346 - RNA, 19 nt, Human
aggaauaguguccaacuca

SEQ ID NO: 60347 - RNA, 21 nt, Human
aggaauaguguccaacucaga

SEQ ID NO: 60348 - RNA, 24 nt, Human
aggagucugaggcugcaaugaggu

SEQ ID NO: 60349 - RNA, 21 nt, Human
aggauuacuugaggccaagag

SEQ ID NO: 60350 - RNA, 24 nt, Human
aggauuacuugaggccaagaguuc

SEQ ID NO: 60351 - RNA, 19 nt, Human
aggcacagccugcauaaca

SEQ ID NO: 60352 - RNA, 24 nt, Human
aggcacgguggcucacgccuguaa

SEQ ID NO: 60353 - RNA, 20 nt, Human
aggcagcgauuguggugagc

SEQ ID NO: 60354 - RNA, 21 nt, Human
aggcagcgauuguggugagcc

SEQ ID NO: 60355 - RNA, 24 nt, Human
aggcagcgauuguggugagccgag

SEQ ID NO: 60356 - RNA, 23 nt, Human
aggcaggagaauugcuugaaccc

SEQ ID NO: 60357 - RNA, 18 nt, Human
aggcaggaggauuacuug

SEQ ID NO: 60358 - RNA, 23 nt, Human
aggcaggaggauugcuugaaccc

SEQ ID NO: 60359 - RNA, 20 nt, Human
aggccaaggcggguagauca

SEQ ID NO: 60360 - RNA, 23 nt, Human
aggccaggccaguggcucauauc

SEQ ID NO: 60361 - RNA, 24 nt, Human
aggcggguagaucaugaggucaag

SEQ ID NO: 60362 - RNA, 21 nt, Human
aggcugaggcaggagaauugc

SEQ ID NO: 60363 - RNA, 24 nt, Human
aggcugaggcaggagaauugcuug

SEQ ID NO: 60364 - RNA, 21 nt, Human
aggcugaggcaggaggauuac

SEQ ID NO: 60365 - RNA, 24 nt, Human
aggcugaggcaggaggauuacuug

SEQ ID NO: 60366 - RNA, 21 nt, Human
aggcugaggcaggaggauugc

SEQ ID NO: 60367 - RNA, 24 nt, Human
aggcugaggcaggaggauugcuug

SEQ ID NO: 60368 - RNA, 23 nt, Human
agggagcccggcgcuacuccgga

SEQ ID NO: 60369 - RNA, 22 nt, Human
agugaggauuaggaaagaucag

SEQ ID NO: 60370 - RNA, 18 nt, Human
aguggggagggcggcacu

SEQ ID NO: 60371 - RNA, 20 nt, Human
auagugcaagacccugucuc

SEQ ID NO: 60372 - RNA, 19 nt, Human
auaucugcaaucccaacac

SEQ ID NO: 60373 - RNA, 21 nt, Human
auccuccugucucagccuccc

SEQ ID NO: 60374 - RNA, 24 nt, Human
aucgcgccacugcacuccagccug

SEQ ID NO: 60375 - RNA, 22 nt, Human
augccacugcacuccagccugg

SEQ ID NO: 60376 - RNA, 22 nt, Human
augugcgcacaccuguaguccc

SEQ ID NO: 60377 - RNA, 24 nt, Human
augugcgcacaccuguagucccag

SEQ ID NO: 60378 - RNA, 24 nt, Human
auuaugccacugcacuccagccug

SEQ ID NO: 60379 - RNA, 23 nt, Human
auuuaugauuccaucaaaggcua

SEQ ID NO: 60380 - RNA, 21 nt, Human
caaaaaaccuccuuaacaaug

SEQ ID NO: 60381 - RNA, 23 nt, Human
caaaaacaaaaaaaaaagguggg

SEQ ID NO: 60382 - RNA, 20 nt, Human
caaaacauacaagagacaua

SEQ ID NO: 60383 - RNA, 23 nt, Human
caaagcaagacucugucuccaaa

SEQ ID NO: 60384 - RNA, 19 nt, Human
caacaauaaaaacaaguua

SEQ ID NO: 60385 - RNA, 24 nt, Human
caacacuuugggaggcugaggcag

SEQ ID NO: 60386 - RNA, 24 nt, Human
caacacuuugggaggcugaggcag

SEQ ID NO: 60387 - RNA, 25 nt, Human
caacacuuugggaggcugaggcagg

SEQ ID NO: 60388 - RNA, 21 nt, Human
caacauagugagacccugucu

SEQ ID NO: 60389 - RNA, 22 nt, Human
caacauagugagacccugucuc

SEQ ID NO: 60390 - RNA, 24 nt, Human
caacauagugagacccugucucua

SEQ ID NO: 60391 - RNA, 24 nt, Human
caacauggugaaaccccgucucua

SEQ ID NO: 60392 - RNA, 20 nt, Human
caacuacauuaaugcuuaac

SEQ ID NO: 60393 - RNA, 23 nt, Human
caagccuuugcgccuaggucuua

SEQ ID NO: 60394 - RNA, 22 nt, Human
caaggaauccuccugucucagc

SEQ ID NO: 60395 - RNA, 18 nt, Human
caaggcaaaaaaaucaua

SEQ ID NO: 60396 - RNA, 19 nt, Human
cacaccuguagucccagcu

SEQ ID NO: 60397 - RNA, 24 nt, Human
caccucugguucuaucccuuuugc

SEQ ID NO: 60398 - RNA, 23 nt, Human
caccuguagucccagcuacucgg

SEQ ID NO: 60399 - RNA, 24 nt, Human
caccuguagucccagcuacucggg

SEQ ID NO: 60400 - RNA, 24 nt, Human
cacgccuguaaucucagcacuuug

SEQ ID NO: 60401 - RNA, 18 nt, Human
cacuacuggacacaaagg

SEQ ID NO: 60402 - RNA, 22 nt, Human
cacuccagccuggcaacaaagc

SEQ ID NO: 60403 - RNA, 20 nt, Human
cacuccagccugggugauag

SEQ ID NO: 60404 - RNA, 20 nt, Human
cacuccagccugggugauag

SEQ ID NO: 60405 - RNA, 21 nt, Human
cacuccagccugggugauagu

SEQ ID NO: 60406 - RNA, 22 nt, Human
cacuccagccugggugauagug

SEQ ID NO: 60407 - RNA, 18 nt, Human
cacugcacuccagccugg

SEQ ID NO: 60408 - RNA, 20 nt, Human
cacugcacuccagccuggca

SEQ ID NO: 60409 - RNA, 23 nt, Human
cacugcacuccagccuggcaaca

SEQ ID NO: 60410 - RNA, 24 nt, Human
cacugcacuccagccuggcaacaa

SEQ ID NO: 60411 - RNA, 19 nt, Human
cacugcacuccagccuggg

SEQ ID NO: 60412 - RNA, 19 nt, Human
cacugcacuccagccuggg

SEQ ID NO: 60413 - RNA, 19 nt, Human
cacugcacuccagccuggg

SEQ ID NO: 60414 - RNA, 21 nt, Human
cacugcacuccagccugggug

SEQ ID NO: 60415 - RNA, 22 nt, Human
cacugcacuccagccuggguga

SEQ ID NO: 60416 - RNA, 22 nt, Human
cacugcacuccagccuggguga

SEQ ID NO: 60417 - RNA, 23 nt, Human
cacugcacuccagccugggugau

SEQ ID NO: 60418 - RNA, 24 nt, Human
cacugcacuccagccugggugaua

SEQ ID NO: 60419 - RNA, 25 nt, Human
cacugcacuccagccugggugauag

SEQ ID NO: 60420 - RNA, 27 nt, Human
cacugcacuccagccugggugauagug

SEQ ID NO: 60421 - RNA, 22 nt, Human
cagcacuuugggaggccaaggc

SEQ ID NO: 60422 - RNA, 24 nt, Human
cagcacuuugggaggccaaggcgg

SEQ ID NO: 60423 - RNA, 24 nt, Human
cagcuacucgggaggcugaggcag

SEQ ID NO: 60424 - RNA, 24 nt, Human
cagcuacuugggaggcugaggcag

SEQ ID NO: 60425 - RNA, 24 nt, Human
caggaauaguguccaacucagaua

SEQ ID NO: 60426 - RNA, 20 nt, Human
caggagucugaggcugcaau

SEQ ID NO: 60427 - RNA, 24 nt, Human
cagggucuugcuaugucacccagg

SEQ ID NO: 60428 - RNA, 20 nt, Human
cauaucugcaaucccaacac

SEQ ID NO: 60429 - RNA, 24 nt, Human
cauaucugcaaucccaacacuuug

SEQ ID NO: 60430 - RNA, 21 nt, Human
cauuaauauuauucauccaac

SEQ ID NO: 60431 - RNA, 19 nt, Human
ccaacaguacaacaaggua

SEQ ID NO: 60432 - RNA, 18 nt, Human
ccaaccacaaacacuuuu

SEQ ID NO: 60433 - RNA, 18 nt, Human
ccaaggcaaaaaaaucau

SEQ ID NO: 60434 - RNA, 26 nt, Human
ccacgggccgcccuccgguggacccc

SEQ ID NO: 60435 - RNA, 18 nt, Human
ccacugcacuccagccug

SEQ ID NO: 60436 - RNA, 19 nt, Human
ccacugcacuccagccugg

SEQ ID NO: 60437 - RNA, 19 nt, Human
ccacugcacuccagccugg

SEQ ID NO: 60438 - RNA, 20 nt, Human
ccacugcacuccagccuggc

SEQ ID NO: 60439 - RNA, 22 nt, Human
ccacugcacuccagccuggcaa

SEQ ID NO: 60440 - RNA, 23 nt, Human
ccacugcacuccagccuggcaac

SEQ ID NO: 60441 - RNA, 20 nt, Human
ccacugcacuccagccuggg

SEQ ID NO: 60442 - RNA, 20 nt, Human
ccacugcacuccagccuggg

SEQ ID NO: 60443 - RNA, 20 nt, Human
ccacugcacuccagccuggg

SEQ ID NO: 60444 - RNA, 21 nt, Human
ccacugcacuccagccugggu

SEQ ID NO: 60445 - RNA, 21 nt, Human
ccacugcacuccagccugggu

SEQ ID NO: 60446 - RNA, 23 nt, Human
ccacugcacuccagccuggguga

SEQ ID NO: 60447 - RNA, 24 nt, Human
ccacugcacuccagccugggugau

SEQ ID NO: 60448 - RNA, 20 nt, Human
ccagauauggcacagggcug

SEQ ID NO: 60449 - RNA, 18 nt, Human
ccagggcucaaggaaucc

SEQ ID NO: 60450 - RNA, 22 nt, Human
ccaguuacagaaacaaaaaaaa

SEQ ID NO: 60451 - RNA, 24 nt, Human
cccaaggagcugggacuacaggca

SEQ ID NO: 60452 - RNA, 22 nt, Human
ccccggggcagguccgggccuc

SEQ ID NO: 60453 - RNA, 21 nt, Human
ccccggggcgcacgaagaccc

SEQ ID NO: 60454 - RNA, 20 nt, Human
cccgaccuaccccacaguua

SEQ ID NO: 60455 - RNA, 22 nt, Human
cccggccaacauggugaaaccc

SEQ ID NO: 60456 - RNA, 23 nt, Human
cccggccaacauggugaaacccc

SEQ ID NO: 60457 - RNA, 24 nt, Human
cccggccaacauggugaaaccccg

SEQ ID NO: 60458 - RNA, 22 nt, Human
ccgacugcccagacuccccacc

SEQ ID NO: 60459 - RNA, 20 nt, Human
ccucugguucuaucccuuuu

SEQ ID NO: 60460 - RNA, 18 nt, Human
ccugcagucucagcuacu

SEQ ID NO: 60461 - RNA, 18 nt, Human
ccugcagucucagcuacu

SEQ ID NO: 60462 - RNA, 21 nt, Human
ccugcagucucagcuacuugg

SEQ ID NO: 60463 - RNA, 22 nt, Human
ccugcagucucagcuacuuggg

SEQ ID NO: 60464 - RNA, 24 nt, Human
ccuggccaggcacgguggcucacg

SEQ ID NO: 60465 - RNA, 22 nt, Human
ccuguaaucucagcacuuuggg

SEQ ID NO: 60466 - RNA, 21 nt, Human
ccuguagucccagcuacucgg

SEQ ID NO: 60467 - RNA, 24 nt, Human
ccugucucagccucccaaggagcu

SEQ ID NO: 60468 - RNA, 18 nt, Human
cgaagacccccagggacc

SEQ ID NO: 60469 - RNA, 23 nt, Human
cgaagacccccagggaccuccga

SEQ ID NO: 60470 - RNA, 24 nt, Human
cgagaccaucccggccaacauggu

SEQ ID NO: 60471 - RNA, 24 nt, Human
cgagaucgcgccacugcacuccag

SEQ ID NO: 60472 - RNA, 22 nt, Human
cgcacgaagacccccagggacc

SEQ ID NO: 60473 - RNA, 25 nt, Human
cgccacugcacuccagccuggcaac

SEQ ID NO: 60474 - RNA, 19 nt, Human
cgccccggggcagguccgg

SEQ ID NO: 60475 - RNA, 22 nt, Human
cgccccggggcagguccgggcc

SEQ ID NO: 60476 - RNA, 23 nt, Human
cgccuguaaucucagcacuuugg

SEQ ID NO: 60477 - RNA, 21 nt, Human
cggccuguggcgcccuucccc

SEQ ID NO: 60478 - RNA, 26 nt, Human
cggccuguggcgcccuucccccgaag

SEQ ID NO: 60479 - RNA, 19 nt, Human
cucacaggcgccuccccug

SEQ ID NO: 60480 - RNA, 22 nt, Human
cucacgccuguaaucucagcac

SEQ ID NO: 60481 - RNA, 24 nt, Human
cucacgccuguaaucucagcacuu

SEQ ID NO: 60482 - RNA, 24 nt, Human
cuccccuggaucucugcagccccc

SEQ ID NO: 60483 - RNA, 25 nt, Human
cucugucuccaaaaacaaaaaaaaa

SEQ ID NO: 60484 - RNA, 21 nt, Human
cugcaaucccaacacuuuggg

SEQ ID NO: 60485 - RNA, 21 nt, Human
cuggaauuacacagaaaacca

SEQ ID NO: 60486 - RNA, 23 nt, Human
cugucucagccucccaaggagcu

SEQ ID NO: 60487 - RNA, 18 nt, Human
cuuaguggggagggcggc

SEQ ID NO: 60488 - RNA, 19 nt, Human
cuuuuuaaaaccugaugug

SEQ ID NO: 60489 - RNA, 22 nt, Human
gaaaggaaagaaggaaggaaaa

SEQ ID NO: 60490 - RNA, 18 nt, Human
gaacccaggaggcagcga

SEQ ID NO: 60491 - RNA, 22 nt, Human
gaagacccccagggaccuccga

SEQ ID NO: 60492 - RNA, 23 nt, Human
gagagagacaagggaaaggaaaa

SEQ ID NO: 60493 - RNA, 23 nt, Human
gagaucgcgccacugcacuccag

SEQ ID NO: 60494 - RNA, 24 nt, Human
gauuacuugaggccaagaguucaa

SEQ ID NO: 60495 - RNA, 21 nt, Human
gauuaugccacugcacuccag

SEQ ID NO: 60496 - RNA, 20 nt, Human
gcaccaacaauaaaaacaag

SEQ ID NO: 60497 - RNA, 22 nt, Human
gcaggagaauugcuugaaccca

SEQ ID NO: 60498 - RNA, 22 nt, Human
gcaggaggauugcuugaaccca

SEQ ID NO: 60499 - RNA, 22 nt, Human
gcagguccgggccucacaggcg

SEQ ID NO: 60500 - RNA, 24 nt, Human
gccaacauggugaaaccccgucuc

SEQ ID NO: 60501 - RNA, 20 nt, Human
gccaccgcaccuggcuccua

SEQ ID NO: 60502 - RNA, 19 nt, Human
gccacugcacuccagccug

SEQ ID NO: 60503 - RNA, 24 nt, Human
gccacugcacuccagccuggguga

SEQ ID NO: 60504 - RNA, 19 nt, Human
gccacugcuacccugaggc

SEQ ID NO: 60505 - RNA, 20 nt, Human
gcccacgggccgcccuccgg

SEQ ID NO: 60506 - RNA, 20 nt, Human
gccgagaucgcgccacugca

SEQ ID NO: 60507 - RNA, 18 nt, Human
gccgcccuccgguggacc

SEQ ID NO: 60508 - RNA, 23 nt, Human
ggaaaauagguuggcuggaaggu

SEQ ID NO: 60509 - RNA, 22 nt, Human
ggaauaguguccaacucagaua

SEQ ID NO: 60510 - RNA, 18 nt, Human
ggagcugggacuacaggc

SEQ ID NO: 60511 - RNA, 19 nt, Human
ggauuacuugaggccaaga

SEQ ID NO: 60512 - RNA, 23 nt, Human
ggauuacuugaggccaagaguuc

SEQ ID NO: 60513 - RNA, 21 nt, Human
ggccaggcacgguggcucacg

SEQ ID NO: 60514 - RNA, 18 nt, Human
gggccuggccaggcacgg

SEQ ID NO: 60515 - RNA, 23 nt, Human
ggguaagugugguucaaaaagca

SEQ ID NO: 60516 - RNA, 19 nt, Human
ggguagaucaugaggucaa

SEQ ID NO: 60517 - RNA, 18 nt, Human
gguagaucaugaggucaa

SEQ ID NO: 60518 - RNA, 23 nt, Human
gguggcucacgccuguaaucuca

SEQ ID NO: 60519 - RNA, 24 nt, Human
gguggcucacgccuguaaucucag

SEQ ID NO: 60520 - RNA, 23 nt, Human
guggcucacgccuguaaucucag

SEQ ID NO: 60521 - RNA, 21 nt, Human
uaaaaacaaaaaaccuccuua

SEQ ID NO: 60522 - RNA, 23 nt, Human
uaaaaacaaaaaaccuccuuaac

SEQ ID NO: 60523 - RNA, 20 nt, Human
uaaaaauacaaaaauuagcc

SEQ ID NO: 60524 - RNA, 21 nt, Human
uaaaaauacaaaaauuagccu

SEQ ID NO: 60525 - RNA, 20 nt, Human
uaaaaccugauguguguugu

SEQ ID NO: 60526 - RNA, 19 nt, Human
uaaaucacaguaagccugu

SEQ ID NO: 60527 - RNA, 19 nt, Human
uaaauggaauuagaugaaa

SEQ ID NO: 60528 - RNA, 22 nt, Human
uacacagaaaaccagagaauuc

SEQ ID NO: 60529 - RNA, 19 nt, Human
uacagaaacaaaaaaaauc

SEQ ID NO: 60530 - RNA, 22 nt, Human
uacaggcacgugccaccgcacc

SEQ ID NO: 60531 - RNA, 19 nt, Human
uaccuugucuuucuuccca

SEQ ID NO: 60532 - RNA, 21 nt, Human
uacuggacacaaagggaggag

SEQ ID NO: 60533 - RNA, 21 nt, Human
uagaguccagauauggcacag

SEQ ID NO: 60534 - RNA, 23 nt, Human
uaucugcaaucccaacacuuugg

SEQ ID NO: 60535 - RNA, 24 nt, Human
uaugauuaugccacugcacuccag

SEQ ID NO: 60536 - RNA, 18 nt, Human
uaugucacccaggcugga

SEQ ID NO: 60537 - RNA, 22 nt, Human
uaugucacccaggcuggacuca

SEQ ID NO: 60538 - RNA, 22 nt, Human
uauucuaaggagacauaccauu

SEQ ID NO: 60539 - RNA, 20 nt, Human
ucaaaaauagcuaguuauug

SEQ ID NO: 60540 - RNA, 18 nt, Human
ucagccucccaaggagcu

SEQ ID NO: 60541 - RNA, 20 nt, Human
ucagccucccaaggagcugg

SEQ ID NO: 60542 - RNA, 24 nt, Human
ucaucugcaaacuacaaaacaaaa

SEQ ID NO: 60543 - RNA, 24 nt, Human
ucaugaggucaagagaucgagacc

SEQ ID NO: 60544 - RNA, 21 nt, Human
uccaaaaacaaaaaaaaaagg

SEQ ID NO: 60545 - RNA, 21 nt, Human
uccaacucagauacugacaac

SEQ ID NO: 60546 - RNA, 24 nt, Human
uccagccugggugauagugcaaga

SEQ ID NO: 60547 - RNA, 20 nt, Human
uccaggccgguggagggaaa

SEQ ID NO: 60548 - RNA, 24 nt, Human
ucccaaggagcugggacuacaggc

SEQ ID NO: 60549 - RNA, 18 nt, Human
uccggaugccgcugcggc

SEQ ID NO: 60550 - RNA, 22 nt, Human
uccgggccucacaggcgccucc

SEQ ID NO: 60551 - RNA, 27 nt, Human
uccuccugucucagccucccaaggagc

SEQ ID NO: 60552 - RNA, 23 nt, Human
ucgcgccacugcacuccagccug

SEQ ID NO: 60553 - RNA, 23 nt, Human
ucgggaggcugaggcaggagaau

SEQ ID NO: 60554 - RNA, 22 nt, Human
ucucgccacauacccuucgccc

SEQ ID NO: 60555 - RNA, 21 nt, Human
ucucuacuaaaaauacaaaaa

SEQ ID NO: 60556 - RNA, 23 nt, Human
ucucuacuaaaaauacaaaaauu

SEQ ID NO: 60557 - RNA, 19 nt, Human
ucuugcuaugucacccagg

SEQ ID NO: 60558 - RNA, 23 nt, Human
ucuugcuaugucacccaggcugg

SEQ ID NO: 60559 - RNA, 24 nt, Human
ucuugcuaugucacccaggcugga

SEQ ID NO: 60560 - RNA, 20 nt, Human
ugaaaaacaagauuaaaggu

SEQ ID NO: 60561 - RNA, 18 nt, Human
ugaacccaggagucugag

SEQ ID NO: 60562 - RNA, 22 nt, Human
ugagagagacaagggaaaggaa

SEQ ID NO: 60563 - RNA, 20 nt, Human
ugagaugagccccuaacagu

SEQ ID NO: 60564 - RNA, 22 nt, Human
ugagccgagaucgcgccacugc

SEQ ID NO: 60565 - RNA, 24 nt, Human
ugaggcaggagaauugcuugaacc

SEQ ID NO: 60566 - RNA, 25 nt, Human
ugaggcaggagaauugcuugaaccc

SEQ ID NO: 60567 - RNA, 20 nt, Human
ugaggcaggaggauuacuuc

SEQ ID NO: 60568 - RNA, 26 nt, Human
ugaggcaggaggauuacuugaggcca

SEQ ID NO: 60569 - RNA, 24 nt, Human
ugaggcaggaggauugcuugaacc

SEQ ID NO: 60570 - RNA, 25 nt, Human
ugaggcaggaggauugcuugaaccc

SEQ ID NO: 60571 - RNA, 23 nt, Human
ugaggcugcaaugagguaugauu

SEQ ID NO: 60572 - RNA, 22 nt, Human
ugauagugcaagacccugucuc

SEQ ID NO: 60573 - RNA, 23 nt, Human
ugccugcagucucagcuacuugg

SEQ ID NO: 60574 - RNA, 24 nt, Human
ugccugcagucucagcuacuuggg

SEQ ID NO: 60575 - RNA, 24 nt, Human
ugcuaugucacccaggcuggacuc

SEQ ID NO: 60576 - RNA, 19 nt, Human
ugcuugaacccaggagucu

SEQ ID NO: 60577 - RNA, 23 nt, Human
uggaauuacacagaaaaccagag

SEQ ID NO: 60578 - RNA, 22 nt, Human
uggaauuagaugaaaauuguuc

SEQ ID NO: 60579 - RNA, 22 nt, Human
uggcucacgccuguaaucucag

SEQ ID NO: 60580 - RNA, 24 nt, Human
uggcucacgccuguaaucucagca

SEQ ID NO: 60581 - RNA, 21 nt, Human
uggcucauaucugcaauccca

SEQ ID NO: 60582 - RNA, 21 nt, Human
ugggacuacaggcacgugcca

SEQ ID NO: 60583 - RNA, 22 nt, Human
ugggacuacaggcacgugccac

SEQ ID NO: 60584 - RNA, 23 nt, Human
ugggacuacaggcacgugccacc

SEQ ID NO: 60585 - RNA, 24 nt, Human
ugggacuacaggcacgugccaccg

SEQ ID NO: 60586 - RNA, 24 nt, Human
ugggaggccaaggcggguagauca

SEQ ID NO: 60587 - RNA, 20 nt, Human
ugggaggcugaggcaggagg

SEQ ID NO: 60588 - RNA, 20 nt, Human
ugggaggcugaggcaggagg

SEQ ID NO: 60589 - RNA, 22 nt, Human
ugggaggcugaggcaggaggau

SEQ ID NO: 60590 - RNA, 22 nt, Human
ugggaggcugaggcaggaggau

SEQ ID NO: 60591 - RNA, 18 nt, Human
ugggugugguggcucgug

SEQ ID NO: 60592 - RNA, 24 nt, Human
ugguggcucgugccugcagucuca

SEQ ID NO: 60593 - RNA, 24 nt, Human
uguaaacuagcuccuugacccacc

SEQ ID NO: 60594 - RNA, 24 nt, Human
ugucucagccucccaaggagcugg

SEQ ID NO: 60595 - RNA, 22 nt, Human
uuaagacagggucuugcuaugu

SEQ ID NO: 60596 - RNA, 25 nt, Human
uuaauauuauucauccaaccacaaa

SEQ ID NO: 60597 - RNA, 20 nt, Human
uuacagaaacaaaaaaaauc

SEQ ID NO: 60598 - RNA, 23 nt, Human
uuacuugaggccaagaguucaag

SEQ ID NO: 60599 - RNA, 24 nt, Human
uuagcugggugugguggcucgugc

SEQ ID NO: 60600 - RNA, 23 nt, Human
uuaugccacugcacuccagccug

SEQ ID NO: 60601 - RNA, 25 nt, Human
uucacaaaaagaacugcugaaggcc

SEQ ID NO: 60602 - RNA, 26 nt, Human
uucacauuucuuagaaaaaucuuauu

SEQ ID NO: 60603 - RNA, 23 nt, Human
uuccugaucaggaggucaaaaau

SEQ ID NO: 60604 - RNA, 18 nt, Human
uugaaugcaucaagacag

SEQ ID NO: 60605 - RNA, 23 nt, Human
uugacccaccauuuaaaaacaaa

SEQ ID NO: 60606 - RNA, 22 nt, Human
uugaggccaagaguucaagacc

SEQ ID NO: 60607 - RNA, 18 nt, Human
uugcuugaacccaggagg

SEQ ID NO: 60608 - RNA, 24 nt, Human
uugcuugaacccaggagucugagg

SEQ ID NO: 60609 - RNA, 20 nt, Human
uugggaggcugaggcaggag

SEQ ID NO: 60610 - RNA, 20 nt, Human
uugggaggcugaggcaggag

SEQ ID NO: 60611 - RNA, 18 nt, Human
uuguggugagccgagauc

SEQ ID NO: 60612 - RNA, 22 nt, Human
uuguggugagccgagaucgcgc

SEQ ID NO: 60613 - RNA, 24 nt, Human
uuuaaaaaagaaaaaagugaggau

SEQ ID NO: 60614 - RNA, 21 nt, Human
uuuaaaauguauaccaaggca

SEQ ID NO: 60615 - RNA, 22 nt, Human
uuuaugauuccaucaaaggcua

SEQ ID NO: 60616 - RNA, 22 nt, Human
aaaaaaaaaaaaaaaaagcaaa

SEQ ID NO: 60617 - RNA, 29 nt, Human
aaaaaaaaaaaaaaaagcaaaucggagag

SEQ ID NO: 60618 - RNA, 26 nt, Human
aaaaaaaaaaagcaaaucggagagag

SEQ ID NO: 60619 - RNA, 25 nt, Human
aaaaaaaagcaaaucggagagagua

SEQ ID NO: 60620 - RNA, 19 nt, Human
aaggggccuuccagagagg

SEQ ID NO: 60621 - RNA, 20 nt, Human
aaggggccuuccagagaggu

SEQ ID NO: 60622 - RNA, 21 nt, Human
aaggggccuuccagagaggug

SEQ ID NO: 60623 - RNA, 18 nt, Human
accaggugggugcuggcu

SEQ ID NO: 60624 - RNA, 23 nt, Human
agagguggguuuccaggggaucu

SEQ ID NO: 60625 - RNA, 22 nt, Human
agcacgagaaacacaaccacga

SEQ ID NO: 60626 - RNA, 21 nt, Human
aggaggaggaugcuuuaagcc

SEQ ID NO: 60627 - RNA, 21 nt, Human
agggaggggaguccaggagga

SEQ ID NO: 60628 - RNA, 19 nt, Human
agguccuuguggauucuuc

SEQ ID NO: 60629 - RNA, 26 nt, Human
aggugggugcuggcugcucuccaucc

SEQ ID NO: 60630 - RNA, 19 nt, Human
augcaugccaccgcgugug

SEQ ID NO: 60631 - RNA, 19 nt, Human
cacacccagaaagcccucc

SEQ ID NO: 60632 - RNA, 24 nt, Human
cacacccagaaagcccuccaggau

SEQ ID NO: 60633 - RNA, 19 nt, Human
cacugcgcucucauuuugc

SEQ ID NO: 60634 - RNA, 18 nt, Human
cagcccacccccuggaca

SEQ ID NO: 60635 - RNA, 22 nt, Human
caugcaugccaccgcguguggc

SEQ ID NO: 60636 - RNA, 24 nt, Human
cccacccccuggacacacccagaa

SEQ ID NO: 60637 - RNA, 25 nt, Human
cccacccccuggacacacccagaaa

SEQ ID NO: 60638 - RNA, 19 nt, Human
cccccuggacacacccaga

SEQ ID NO: 60639 - RNA, 19 nt, Human
ccccuggacacacccagaa

SEQ ID NO: 60640 - RNA, 18 nt, Human
cccuccaggaugguccug

SEQ ID NO: 60641 - RNA, 23 nt, Human
cccuggacacacccagaaagccc

SEQ ID NO: 60642 - RNA, 24 nt, Human
cccuggacacacccagaaagcccu

SEQ ID NO: 60643 - RNA, 19 nt, Human
ccgccugccuggccaccug

SEQ ID NO: 60644 - RNA, 24 nt, Human
ccgcgagcuccuuuuaagaagucu

SEQ ID NO: 60645 - RNA, 19 nt, Human
ccuccaugcaugccaccgc

SEQ ID NO: 60646 - RNA, 24 nt, Human
ccuuguggauucuucucuuccugu

SEQ ID NO: 60647 - RNA, 22 nt, Human
cuggaggggcugggccucagcg

SEQ ID NO: 60648 - RNA, 18 nt, Human
gacugugugugugugugu

SEQ ID NO: 60649 - RNA, 21 nt, Human
gccugacagcuggguccgcgg

SEQ ID NO: 60650 - RNA, 25 nt, Human
gcuccgcuccagccgcugcugccuc

SEQ ID NO: 60651 - RNA, 23 nt, Human
ggaacggcuaggagagaagcugg

SEQ ID NO: 60652 - RNA, 20 nt, Human
ggacacagggaugcagcacg

SEQ ID NO: 60653 - RNA, 19 nt, Human
ggcagugcauaaccuuaau

SEQ ID NO: 60654 - RNA, 27 nt, Human
gggacugugugugugugugugugugug

SEQ ID NO: 60655 - RNA, 18 nt, Human
gguggugggagcagggaa

SEQ ID NO: 60656 - RNA, 18 nt, Human
uaagaagucugcaccucc

SEQ ID NO: 60657 - RNA, 24 nt, Human
uaccacauucccacagauaaacuc

SEQ ID NO: 60658 - RNA, 20 nt, Human
uaccaggugggugcuggcug

SEQ ID NO: 60659 - RNA, 21 nt, Human
uaccaggugggugcuggcugc

SEQ ID NO: 60660 - RNA, 23 nt, Human
uagaagagguuuaagguuggcuc

SEQ ID NO: 60661 - RNA, 20 nt, Human
uauccuggggugagaaggcu

SEQ ID NO: 60662 - RNA, 24 nt, Human
uaugcaaaugggacugugugugug

SEQ ID NO: 60663 - RNA, 20 nt, Human
ucacugcgcucucauuuugc

SEQ ID NO: 60664 - RNA, 18 nt, Human
ucagagagcagggaucag

SEQ ID NO: 60665 - RNA, 26 nt, Human
uccaugcaugccaccgcguguggccg

SEQ ID NO: 60666 - RNA, 28 nt, Human
uccaugcaugccaccgcguguggccgcg

SEQ ID NO: 60667 - RNA, 19 nt, Human
uccuggggugagaaggcuc

SEQ ID NO: 60668 - RNA, 22 nt, Human
ucugugacacuaugguguccuu

SEQ ID NO: 60669 - RNA, 24 nt, Human
ugaauugccaagcucucugugaca

SEQ ID NO: 60670 - RNA, 22 nt, Human
ugacacuaugguguccuugccc

SEQ ID NO: 60671 - RNA, 21 nt, Human
ugacagcgcuggugccaagcc

SEQ ID NO: 60672 - RNA, 19 nt, Human
ugaggacaaccugguaaag

SEQ ID NO: 60673 - RNA, 21 nt, Human
ugccaagcucucugugacacu

SEQ ID NO: 60674 - RNA, 24 nt, Human
ugccagggaaggggccuuccagag

SEQ ID NO: 60675 - RNA, 18 nt, Human
ugccuaaucuucagcuug

SEQ ID NO: 60676 - RNA, 19 nt, Human
uggaggggcugggccucag

SEQ ID NO: 60677 - RNA, 22 nt, Human
ugggaagaaauaauguauggug

SEQ ID NO: 60678 - RNA, 18 nt, Human
ugggaagggaggauucuc

SEQ ID NO: 60679 - RNA, 21 nt, Human
ugggacugugugugugugugu

SEQ ID NO: 60680 - RNA, 26 nt, Human
ugggacugugugugugugugugugug

SEQ ID NO: 60681 - RNA, 25 nt, Human
uggguuuccaggggaucugugugcc

SEQ ID NO: 60682 - RNA, 21 nt, Human
ugguauugaaaaaaaaaaaaa

SEQ ID NO: 60683 - RNA, 18 nt, Human
uggugcuggaggggcugg

SEQ ID NO: 60684 - RNA, 24 nt, Human
ugguugauaacuugaggacaaccu

SEQ ID NO: 60685 - RNA, 18 nt, Human
ugugugugugugugugug

SEQ ID NO: 60686 - RNA, 18 nt, Human
ugugugugugugugugug

SEQ ID NO: 60687 - RNA, 21 nt, Human
ugugugugugugugugugugu

SEQ ID NO: 60688 - RNA, 21 nt, Human
ugugugugugugugugugugu

SEQ ID NO: 60689 - RNA, 19 nt, Human
uuccagagagguggguuuc

SEQ ID NO: 60690 - RNA, 21 nt, Human
uuccccuuuuauccuggggug

SEQ ID NO: 60691 - RNA, 24 nt, Human
uugaaauuagaacuagcaauagaa

SEQ ID NO: 60692 - RNA, 20 nt, Human
aaaaaaagagacuucgagac

SEQ ID NO: 60693 - RNA, 20 nt, Human
aaagacacacacuccacacc

SEQ ID NO: 60694 - RNA, 25 nt, Human
aaagacacacacuccacaccacgca

SEQ ID NO: 60695 - RNA, 21 nt, Human
aaagacauaccccuuuuuggc

SEQ ID NO: 60696 - RNA, 23 nt, Human
aaagccugccaaaauaaaagucc

SEQ ID NO: 60697 - RNA, 21 nt, Human
aagagacuucgagacaagaug

SEQ ID NO: 60698 - RNA, 18 nt, Human
acaagaagaggcucaccc

SEQ ID NO: 60699 - RNA, 20 nt, Human
acaagaagaggcucaccccg

SEQ ID NO: 60700 - RNA, 18 nt, Human
acacagccaucaucaccc

SEQ ID NO: 60701 - RNA, 21 nt, Human
acaguaauaauagcaucuaaa

SEQ ID NO: 60702 - RNA, 18 nt, Human
accccgucuguccacagg

SEQ ID NO: 60703 - RNA, 20 nt, Human
acuccacaccacgcacagcu

SEQ ID NO: 60704 - RNA, 23 nt, Human
acuugaucuacacacaugccacu

SEQ ID NO: 60705 - RNA, 19 nt, Human
agaaucuccagacacaaga

SEQ ID NO: 60706 - RNA, 23 nt, Human
agacacacacuccacaccacgca

SEQ ID NO: 60707 - RNA, 23 nt, Human
agacgacgggagaggcaggugug

SEQ ID NO: 60708 - RNA, 21 nt, Human
agcuguuugggaccauugugg

SEQ ID NO: 60709 - RNA, 19 nt, Human
aggcaggggugacggcugc

SEQ ID NO: 60710 - RNA, 18 nt, Human
aggccugggccaaaaaaa

SEQ ID NO: 60711 - RNA, 19 nt, Human
agggagaagacaguccaga

SEQ ID NO: 60712 - RNA, 19 nt, Human
agucaguggcagaggcagc

SEQ ID NO: 60713 - RNA, 24 nt, Human
aguggcagaggcagcuguuuggga

SEQ ID NO: 60714 - RNA, 18 nt, Human
aucuaaauaaauauggag

SEQ ID NO: 60715 - RNA, 18 nt, Human
augugcguggaugugugu

SEQ ID NO: 60716 - RNA, 23 nt, Human
caaaauacuuggaacgcuuuaca

SEQ ID NO: 60717 - RNA, 22 nt, Human
caagucugcggcccggcuccca

SEQ ID NO: 60718 - RNA, 19 nt, Human
cacacagccaucaucaccc

SEQ ID NO: 60719 - RNA, 21 nt, Human
cacacuccacaccacgcacag

SEQ ID NO: 60720 - RNA, 24 nt, Human
cacacuccacaccacgcacagcua

SEQ ID NO: 60721 - RNA, 18 nt, Human
cacauuggaaaacccuag

SEQ ID NO: 60722 - RNA, 20 nt, Human
cacgcacagcuaccgagaca

SEQ ID NO: 60723 - RNA, 21 nt, Human
cagaggcagcuguuugggacc

SEQ ID NO: 60724 - RNA, 23 nt, Human
ccaaaaaaagagacuucgagaca

SEQ ID NO: 60725 - RNA, 20 nt, Human
cccacaggaccccagacguc

SEQ ID NO: 60726 - RNA, 18 nt, Human
ccccgggagccgcguccc

SEQ ID NO: 60727 - RNA, 19 nt, Human
ccccgggagccgcgucccu

SEQ ID NO: 60728 - RNA, 19 nt, Human
cccgaaaaaucuccuggug

SEQ ID NO: 60729 - RNA, 21 nt, Human
cccggcucccagcuccucugg

SEQ ID NO: 60730 - RNA, 22 nt, Human
cccgggagccgcgucccucgga

SEQ ID NO: 60731 - RNA, 24 nt, Human
cccuagagucuggaaaaaagccug

SEQ ID NO: 60732 - RNA, 23 nt, Human
cccugcagucaguggcagaggca

SEQ ID NO: 60733 - RNA, 19 nt, Human
ccuccuugucucuguggga

SEQ ID NO: 60734 - RNA, 21 nt, Human
ccugcccgguguccuggcugc

SEQ ID NO: 60735 - RNA, 24 nt, Human
cgcacagcuaccgagacacacccu

SEQ ID NO: 60736 - RNA, 21 nt, Human
cgccacgcuggccaagggguc

SEQ ID NO: 60737 - RNA, 23 nt, Human
cggcucccagcuccucugggccc

SEQ ID NO: 60738 - RNA, 22 nt, Human
cuccacaccacgcacagcuacc

SEQ ID NO: 60739 - RNA, 21 nt, Human
cugcgccacgcuggccaaggg

SEQ ID NO: 60740 - RNA, 19 nt, Human
gaggcagccacuaaaauga

SEQ ID NO: 60741 - RNA, 25 nt, Human
gcacagcuucagggaggaaagacac

SEQ ID NO: 60742 - RNA, 23 nt, Human
gcacucacggcuggcugcuuuag

SEQ ID NO: 60743 - RNA, 19 nt, Human
gcagccgggugggagggug

SEQ ID NO: 60744 - RNA, 19 nt, Human
gccccgggagccgcguccc

SEQ ID NO: 60745 - RNA, 25 nt, Human
ggagaagacaguccagaacguggca

SEQ ID NO: 60746 - RNA, 19 nt, Human
ggaggcaggggugacggcu

SEQ ID NO: 60747 - RNA, 23 nt, Human
ggaggcaggggugacggcugccc

SEQ ID NO: 60748 - RNA, 22 nt, Human
ggccugggccaaaaaaagagac

SEQ ID NO: 60749 - RNA, 21 nt, Human
ggcugggcuguggcgucgggg

SEQ ID NO: 60750 - RNA, 23 nt, Human
gggcggcccugcccgguguccug

SEQ ID NO: 60751 - RNA, 24 nt, Human
uaaagacauaccccuuuuuggcaa

SEQ ID NO: 60752 - RNA, 20 nt, Human
uaaagagggggcagacaccu

SEQ ID NO: 60753 - RNA, 22 nt, Human
uaaagagggggcagacaccugu

SEQ ID NO: 60754 - RNA, 21 nt, Human
uacauggaucgcuaaugaacc

SEQ ID NO: 60755 - RNA, 20 nt, Human
ucccugcagucaguggcaga

SEQ ID NO: 60756 - RNA, 23 nt, Human
ucccugcagucaguggcagaggc

SEQ ID NO: 60757 - RNA, 18 nt, Human
uccuggugaucaaaucuu

SEQ ID NO: 60758 - RNA, 23 nt, Human
ucgaauacagucauccuaaagcu

SEQ ID NO: 60759 - RNA, 25 nt, Human
ucuccagacacaagaagaggcucac

SEQ ID NO: 60760 - RNA, 19 nt, Human
ucucugugggagcccugcc

SEQ ID NO: 60761 - RNA, 24 nt, Human
ucucugugggagcccugcccgggu

SEQ ID NO: 60762 - RNA, 22 nt, Human
ugcagccgggugggagggugcc

SEQ ID NO: 60763 - RNA, 22 nt, Human
ugcagucaguggcagaggcagc

SEQ ID NO: 60764 - RNA, 22 nt, Human
ugcaugcaacacacggcacucc

SEQ ID NO: 60765 - RNA, 19 nt, Human
ugcccagaagagacgacgg

SEQ ID NO: 60766 - RNA, 21 nt, Human
ugcccagaagagacgacggga

SEQ ID NO: 60767 - RNA, 20 nt, Human
ugcccggguaugcagccggg

SEQ ID NO: 60768 - RNA, 20 nt, Human
ugcccggguaugcagccggg

SEQ ID NO: 60769 - RNA, 19 nt, Human
uggaaaaaagccugccaaa

SEQ ID NO: 60770 - RNA, 21 nt, Human
uggccaaggggucugcacuca

SEQ ID NO: 60771 - RNA, 23 nt, Human
uggcgucggggucaagucugcgg

SEQ ID NO: 60772 - RNA, 19 nt, Human
ugggcuguggcgucggggu

SEQ ID NO: 60773 - RNA, 22 nt, Human
ugguaaugucccgaaaaaucuc

SEQ ID NO: 60774 - RNA, 20 nt, Human
ugguuuguccacaggagauu

SEQ ID NO: 60775 - RNA, 20 nt, Human
uguccuggcugcguggccag

SEQ ID NO: 60776 - RNA, 21 nt, Human
uucacacagccaucaucaccc

SEQ ID NO: 60777 - RNA, 19 nt, Human
acaagcagguggagggaag

SEQ ID NO: 60778 - RNA, 20 nt, Human
acagcagaggugcccaugga

SEQ ID NO: 60779 - RNA, 21 nt, Human
accagggcuggccuugcuucc

SEQ ID NO: 60780 - RNA, 21 nt, Human
acuccaguguuaucacuuccu

SEQ ID NO: 60781 - RNA, 23 nt, Human
cacaagcagguggagggaaggug

SEQ ID NO: 60782 - RNA, 23 nt, Human
caccugaaacacauggggaugga

SEQ ID NO: 60783 - RNA, 18 nt, Human
cagguggagggaaggugg

SEQ ID NO: 60784 - RNA, 25 nt, Human
ccaugccuggaccagucccuuccuc

SEQ ID NO: 60785 - RNA, 18 nt, Human
cccucccugacccacacc

SEQ ID NO: 60786 - RNA, 24 nt, Human
ccucuuguuaccacuccaguguua

SEQ ID NO: 60787 - RNA, 18 nt, Human
ccuuccuccuucugcccc

SEQ ID NO: 60788 - RNA, 18 nt, Human
ccuugcuuccugcuccuc

SEQ ID NO: 60789 - RNA, 20 nt, Human
ccuugcuuccugcuccucuu

SEQ ID NO: 60790 - RNA, 21 nt, Human
ccuugcuuccugcuccucuug

SEQ ID NO: 60791 - RNA, 19 nt, Human
cggagguggcucaggcugc

SEQ ID NO: 60792 - RNA, 25 nt, Human
gcagggggaagggacccaugccugg

SEQ ID NO: 60793 - RNA, 21 nt, Human
ggauggagaaccagggcuggc

SEQ ID NO: 60794 - RNA, 22 nt, Human
ggggauggagaaccagggcugg

SEQ ID NO: 60795 - RNA, 20 nt, Human
gguggagggaaggugggggc

SEQ ID NO: 60796 - RNA, 18 nt, Human
guagcuacuggggagggg

SEQ ID NO: 60797 - RNA, 21 nt, Human
uagccucuagaccccucccug

SEQ ID NO: 60798 - RNA, 20 nt, Human
uccuccuucugccccugcug

SEQ ID NO: 60799 - RNA, 22 nt, Human
uccuucugccccugcugggucc

SEQ ID NO: 60800 - RNA, 26 nt, Human
ugccuggaccagucccuuccuccuuc

SEQ ID NO: 60801 - RNA, 18 nt, Human
aacacaaacucgccaucc

SEQ ID NO: 60802 - RNA, 25 nt, Human
aacagcuguagacaugaaaugguga

SEQ ID NO: 60803 - RNA, 25 nt, Human
accacagcagcucacccacagcaac

SEQ ID NO: 60804 - RNA, 20 nt, Human
agcagcucacccacagcaac

SEQ ID NO: 60805 - RNA, 19 nt, Human
aggguaaauucucugaaga

SEQ ID NO: 60806 - RNA, 18 nt, Human
aggucuuugguacaaagc

SEQ ID NO: 60807 - RNA, 19 nt, Human
aucagcaacuggauggaag

SEQ ID NO: 60808 - RNA, 21 nt, Human
caaagcucagaaggcaagcuc

SEQ ID NO: 60809 - RNA, 23 nt, Human
caacagguucaauuuuaugaaaa

SEQ ID NO: 60810 - RNA, 18 nt, Human
caaccaacagguucaauu

SEQ ID NO: 60811 - RNA, 27 nt, Human
caaccaacagguucaauuuuaugaaaa

SEQ ID NO: 60812 - RNA, 24 nt, Human
caagacgagagaacaugcuugucu

SEQ ID NO: 60813 - RNA, 23 nt, Human
caauaagaaaaagaccuuccacu

SEQ ID NO: 60814 - RNA, 19 nt, Human
cacaugaugguggcaagac

SEQ ID NO: 60815 - RNA, 20 nt, Human
caccaggcgucagcaauggu

SEQ ID NO: 60816 - RNA, 18 nt, Human
ccaggucuuugguacaaa

SEQ ID NO: 60817 - RNA, 25 nt, Human
ccgaccacagcaugcuuggcuacag

SEQ ID NO: 60818 - RNA, 18 nt, Human
cucacgcaucauucauuc

SEQ ID NO: 60819 - RNA, 20 nt, Human
cuccuuuuuuuccccacaaa

SEQ ID NO: 60820 - RNA, 22 nt, Human
cuuggcuacagaccacagcagc

SEQ ID NO: 60821 - RNA, 20 nt, Human
cuugguuaaggguaaauucu

SEQ ID NO: 60822 - RNA, 22 nt, Human
gacaaagcaucagcaacuggau

SEQ ID NO: 60823 - RNA, 23 nt, Human
gcaaagugcuguaggacuuaaag

SEQ ID NO: 60824 - RNA, 23 nt, Human
gcaagcuccuuuuuuuccccaca

SEQ ID NO: 60825 - RNA, 22 nt, Human
gcucacccacagcaacuccaac

SEQ ID NO: 60826 - RNA, 23 nt, Human
ggcaaagugcuguaggacuuaaa

SEQ ID NO: 60827 - RNA, 22 nt, Human
gguaaauucucugaagacaaag

SEQ ID NO: 60828 - RNA, 23 nt, Human
uaaaacacaaacucgccauccua

SEQ ID NO: 60829 - RNA, 21 nt, Human
uacaaagcucagaaggcaagc

SEQ ID NO: 60830 - RNA, 24 nt, Human
uaggagggguggggccacacucuu

SEQ ID NO: 60831 - RNA, 22 nt, Human
uccacggcugggcagauccgac

SEQ ID NO: 60832 - RNA, 22 nt, Human
ucccaggucuuugguacaaagc

SEQ ID NO: 60833 - RNA, 20 nt, Human
uccgaccacagcaugcuugg

SEQ ID NO: 60834 - RNA, 18 nt, Human
ucugugugugugugaagu

SEQ ID NO: 60835 - RNA, 25 nt, Human
ugaaaaauuaaaacacaaacucgcc

SEQ ID NO: 60836 - RNA, 19 nt, Human
ugaagacaaagcaucagca

SEQ ID NO: 60837 - RNA, 20 nt, Human
ugcuguaggacuuaaagguu

SEQ ID NO: 60838 - RNA, 21 nt, Human
ugcuugucuaacacugcuugg

SEQ ID NO: 60839 - RNA, 21 nt, Human
uguaggacuuaaagguugcuu

SEQ ID NO: 60840 - RNA, 18 nt, Human
ugucaaagagcuugucag

SEQ ID NO: 60841 - RNA, 21 nt, Human
ugucagggaaagcugccaguu

SEQ ID NO: 60842 - RNA, 19 nt, Human
uucacaauauuuacaauaa

SEQ ID NO: 60843 - RNA, 19 nt, Human
uucagguaaauagccgagu

SEQ ID NO: 60844 - RNA, 21 nt, Human
uuccacggcugggcagauccg

SEQ ID NO: 60845 - RNA, 24 nt, Human
uuucuauacugaugccaacagcca

SEQ ID NO: 60846 - RNA, 21 nt, Human
uuuuguucgauuuuaauuccu

SEQ ID NO: 60847 - RNA, 23 nt, Human
cccuuggaccucauuuccgaguc

SEQ ID NO: 60848 - RNA, 21 nt, Human
ccuuggcuacccuuggaccuc

SEQ ID NO: 60849 - RNA, 26 nt, Human
uacccuuggaccucauuuccgagucc

SEQ ID NO: 60850 - RNA, 18 nt, Human
ucauuuccgaguccucaa

SEQ ID NO: 60851 - RNA, 27 nt, Human
acuaacacggccccaguggccucuccc

SEQ ID NO: 60852 - RNA, 21 nt, Human
caccggcagacuaacacggcc

SEQ ID NO: 60853 - RNA, 23 nt, Human
cagccuccaggccgccccgcccc

SEQ ID NO: 60854 - RNA, 24 nt, Human
cagccuccaggccgccccgccccg

SEQ ID NO: 60855 - RNA, 23 nt, Human
cauaagugagccacauacuguag

SEQ ID NO: 60856 - RNA, 21 nt, Human
ccccaguggccucuccccucc

SEQ ID NO: 60857 - RNA, 18 nt, Human
ccccucccucugccggcc

SEQ ID NO: 60858 - RNA, 24 nt, Human
cccgccccgccgcugucggggccg

SEQ ID NO: 60859 - RNA, 20 nt, Human
ccgccccgccccgccgcugu

SEQ ID NO: 60860 - RNA, 20 nt, Human
ccgccccgccgcugucgcgc

SEQ ID NO: 60861 - RNA, 21 nt, Human
cuccaggccgccccgccccgc

SEQ ID NO: 60862 - RNA, 24 nt, Human
agaagcagugaccaggaugagggu

SEQ ID NO: 60863 - RNA, 21 nt, Human
agauaggaaauucaaagaaga

SEQ ID NO: 60864 - RNA, 18 nt, Human
agggcuguuauagcagaa

SEQ ID NO: 60865 - RNA, 22 nt, Human
auccaguugcuuugaccagauc

SEQ ID NO: 60866 - RNA, 20 nt, Human
cagugaccaggaugagggua

SEQ ID NO: 60867 - RNA, 19 nt, Human
gaagcagugaccaggauga

SEQ ID NO: 60868 - RNA, 18 nt, Human
uaagaucuaguauccagu

SEQ ID NO: 60869 - RNA, 21 nt, Human
uagcagaagcagugaccagga

SEQ ID NO: 60870 - RNA, 21 nt, Human
ucaaagaagaaagacugcaga

SEQ ID NO: 60871 - RNA, 22 nt, Human
ugaccagaucucuuagacaguc

SEQ ID NO: 60872 - RNA, 20 nt, Human
ugaggguagcagacaacaca

SEQ ID NO: 60873 - RNA, 22 nt, Human
uucaaagaagaaagacugcaga

SEQ ID NO: 60874 - RNA, 21 nt, Human
uuuuuuuuuuuuuugcaggua

SEQ ID NO: 60875 - RNA, 22 nt, Human
uuuuuuuuuuuuuuuuugcagg

SEQ ID NO: 60876 - RNA, 23 nt, Human
uuuuuuuuuuuuuuuuugcaggu

SEQ ID NO: 60877 - RNA, 27 nt, Human
uuuuuuuuuuuuuuuuuuuuuuugggg

SEQ ID NO: 60878 - RNA, 20 nt, Human
aaaaacccucaaauaaaaaa

SEQ ID NO: 60879 - RNA, 22 nt, Human
aaaagaacucuaucacaggagc

SEQ ID NO: 60880 - RNA, 30 nt, Human
aacccucaaauaaaaaaucuugggcuuaaa

SEQ ID NO: 60881 - RNA, 19 nt, Human
aaggaaugguaguugaggg

SEQ ID NO: 60882 - RNA, 29 nt, Human
acccucaaauaaaaaaucuugggcuuaaa

SEQ ID NO: 60883 - RNA, 24 nt, Human
acgcugagcccccacguggguagc

SEQ ID NO: 60884 - RNA, 21 nt, Human
agaaggaaugguaguugaggg

SEQ ID NO: 60885 - RNA, 22 nt, Human
auaaaaaaucuugggcuuaaaa

SEQ ID NO: 60886 - RNA, 21 nt, Human
aucuugggcuuaaaagaacuc

SEQ ID NO: 60887 - RNA, 19 nt, Human
augagcaaaagagcaaccc

SEQ ID NO: 60888 - RNA, 23 nt, Human
auucaaacaaagucauuaguagu

SEQ ID NO: 60889 - RNA, 25 nt, Human
cacgcugagcccccacguggguagc

SEQ ID NO: 60890 - RNA, 21 nt, Human
ccacguggguagcggaccugg

SEQ ID NO: 60891 - RNA, 24 nt, Human
cccgauggcagccuagcuccuccu

SEQ ID NO: 60892 - RNA, 21 nt, Human
cccucuuaugagcaaaagagc

SEQ ID NO: 60893 - RNA, 23 nt, Human
ccgauggcagccuagcuccuccu

SEQ ID NO: 60894 - RNA, 23 nt, Human
ccucuuaugagcaaaagagcaac

SEQ ID NO: 60895 - RNA, 21 nt, Human
cgcccuugggcagcuguaccg

SEQ ID NO: 60896 - RNA, 21 nt, Human
cgcccuugggcagcuguaccg

SEQ ID NO: 60897 - RNA, 21 nt, Human
cgcccuugggcagcuguaccg

SEQ ID NO: 60898 - RNA, 20 nt, Human
cucgcgagaucugcccucca

SEQ ID NO: 60899 - RNA, 24 nt, Human
cucugaagaguguuuaaagaagga

SEQ ID NO: 60900 - RNA, 28 nt, Human
gcacaaagaagggugcacgcugagcccc

SEQ ID NO: 60901 - RNA, 18 nt, Human
gcccuugggcagcuguac

SEQ ID NO: 60902 - RNA, 18 nt, Human
gcccuugggcagcuguac

SEQ ID NO: 60903 - RNA, 23 nt, Human
uaaaaaacaaaaaacccucaaau

SEQ ID NO: 60904 - RNA, 24 nt, Human
uaaaagaacucuaucacaggagcc

SEQ ID NO: 60905 - RNA, 21 nt, Human
uaccgcgucacccaccgaagc

SEQ ID NO: 60906 - RNA, 21 nt, Human
uaccgcgucacccaccgaagc

SEQ ID NO: 60907 - RNA, 21 nt, Human
uaccgcgucacccaccgaagc

SEQ ID NO: 60908 - RNA, 22 nt, Human
uaucacaggagccugguuggag

SEQ ID NO: 60909 - RNA, 24 nt, Human
uaucacaggagccugguuggagga

SEQ ID NO: 60910 - RNA, 23 nt, Human
ucagaggcgcgcuugucguggcc

SEQ ID NO: 60911 - RNA, 19 nt, Human
ucccaggcucaaagugauu

SEQ ID NO: 60912 - RNA, 22 nt, Human
ucugaagaguguuuaaagaagg

SEQ ID NO: 60913 - RNA, 20 nt, Human
ucuugggcuuaaaagaacuc

SEQ ID NO: 60914 - RNA, 21 nt, Human
ugcacgcugagcccccacgug

SEQ ID NO: 60915 - RNA, 22 nt, Human
ugcagauuucucugaagagugu

SEQ ID NO: 60916 - RNA, 19 nt, Human
uggccgaagaaugcgcgug

SEQ ID NO: 60917 - RNA, 26 nt, Human
uuaguagucuuuguucaauuuuuuuu

SEQ ID NO: 60918 - RNA, 20 nt, Human
uucaaacaaagucauuagua

SEQ ID NO: 60919 - RNA, 22 nt, Human
uucagacugccagcgaagcccc

SEQ ID NO: 60920 - RNA, 18 nt, Human
uuuuuuuugaaacuaugg

SEQ ID NO: 60921 - RNA, 20 nt, Human
uuuuuuuuugaaacuauggc

SEQ ID NO: 60922 - RNA, 22 nt, Human
uuuuuuuuuuugaaacuauggg

SEQ ID NO: 60923 - RNA, 24 nt, Human
uuuuuuuuuuuugaaacuauggcu

SEQ ID NO: 60924 - RNA, 18 nt, Human
uuuuuuuuuuuuuuuuug

SEQ ID NO: 60925 - RNA, 23 nt, Human
uuuuuuuuuuuuuuuuuuuuggg

SEQ ID NO: 60926 - RNA, 21 nt, Human
aaaaagcaccggcgcggaggu

SEQ ID NO: 60927 - RNA, 21 nt, Human
aaaagacuggcugccagggac

SEQ ID NO: 60928 - RNA, 18 nt, Human
aaaaggaaaaagaaaagg

SEQ ID NO: 60929 - RNA, 23 nt, Human
aaacaacaaagaugaacaguuac

SEQ ID NO: 60930 - RNA, 21 nt, Human
aaagccaaaccuacuccaagc

SEQ ID NO: 60931 - RNA, 20 nt, Human
aaccucuggauauuuuuggu

SEQ ID NO: 60932 - RNA, 22 nt, Human
aagaacacagguuuuuuaauug

SEQ ID NO: 60933 - RNA, 26 nt, Human
aagcagaggugaugcaaaggggaccc

SEQ ID NO: 60934 - RNA, 21 nt, Human
aauccuaugcccuauauccac

SEQ ID NO: 60935 - RNA, 18 nt, Human
aaugaaaagaaacaaaaa

SEQ ID NO: 60936 - RNA, 18 nt, Human
aaugauggcaguggagga

SEQ ID NO: 60937 - RNA, 21 nt, Human
aauuuugugaagaaaugugcu

SEQ ID NO: 60938 - RNA, 22 nt, Human
acagugaaaaauuagaccugga

SEQ ID NO: 60939 - RNA, 22 nt, Human
accaaagccaaaccuacuccaa

SEQ ID NO: 60940 - RNA, 21 nt, Human
accccaugccaaugacgacca

SEQ ID NO: 60941 - RNA, 21 nt, Human
acuaaagcucacuucaaucug

SEQ ID NO: 60942 - RNA, 24 nt, Human
agaucagaaguucacucaagccua

SEQ ID NO: 60943 - RNA, 21 nt, Human
agcaggacuccaggaagcccg

SEQ ID NO: 60944 - RNA, 19 nt, Human
agcuaugaugcugguacaa

SEQ ID NO: 60945 - RNA, 24 nt, Human
aggaauggguuuuuccaaaaaugc

SEQ ID NO: 60946 - RNA, 20 nt, Human
agugaaaaucgcaaaaggaa

SEQ ID NO: 60947 - RNA, 19 nt, Human
agugauaaaacaacaaaga

SEQ ID NO: 60948 - RNA, 23 nt, Human
auaaacacucuuaaugugaacaa

SEQ ID NO: 60949 - RNA, 22 nt, Human
auauucaaaugaaaagaaacaa

SEQ ID NO: 60950 - RNA, 18 nt, Human
aucgaguggcacauacuu

SEQ ID NO: 60951 - RNA, 19 nt, Human
augcccuauauccacccca

SEQ ID NO: 60952 - RNA, 20 nt, Human
auuaaagaaaagguacugca

SEQ ID NO: 60953 - RNA, 20 nt, Human
caaaaaugcaaaauuagcau

SEQ ID NO: 60954 - RNA, 19 nt, Human
caaaaggaaaaagaaaagg

SEQ ID NO: 60955 - RNA, 25 nt, Human
caaagccaaaccuacuccaagcuau

SEQ ID NO: 60956 - RNA, 25 nt, Human
caaguaauccuaugcccuauaucca

SEQ ID NO: 60957 - RNA, 24 nt, Human
caaugaaaaacacuagcuuggaag

SEQ ID NO: 60958 - RNA, 20 nt, Human
cagcaugaauuucugguuuu

SEQ ID NO: 60959 - RNA, 22 nt, Human
cagcgaauacaaccggcaacgc

SEQ ID NO: 60960 - RNA, 18 nt, Human
cagcuucauuauauuuua

SEQ ID NO: 60961 - RNA, 18 nt, Human
cagcuucugagacaagua

SEQ ID NO: 60962 - RNA, 18 nt, Human
cagggaccacagugaaaa

SEQ ID NO: 60963 - RNA, 21 nt, Human
ccaaaaaugcaaaauuagcau

SEQ ID NO: 60964 - RNA, 24 nt, Human
ccaaaaugaaccgacgaauaaaca

SEQ ID NO: 60965 - RNA, 20 nt, Human
ccaaugacgaccagucaaaa

SEQ ID NO: 60966 - RNA, 21 nt, Human
cccuauauccaccccaugcca

SEQ ID NO: 60967 - RNA, 19 nt, Human
ccuccuuccggcuccccgc

SEQ ID NO: 60968 - RNA, 26 nt, Human
ccucuagggcauuguaggcuugacuu

SEQ ID NO: 60969 - RNA, 21 nt, Human
ccuggagccaaugaaaaacac

SEQ ID NO: 60970 - RNA, 23 nt, Human
cgcaaaaagcaccggcgcggagg

SEQ ID NO: 60971 - RNA, 20 nt, Human
cgcgcagccgcaaaaagcac

SEQ ID NO: 60972 - RNA, 19 nt, Human
cuaaaaccaugaucguguc

SEQ ID NO: 60973 - RNA, 21 nt, Human
cuaaagcucacuucaaucugu

SEQ ID NO: 60974 - RNA, 19 nt, Human
cuagcucacaagaaaugaa

SEQ ID NO: 60975 - RNA, 19 nt, Human
cuccuuccggcuccccgca

SEQ ID NO: 60976 - RNA, 21 nt, Human
cugccuuuacuaaaauggcac

SEQ ID NO: 60977 - RNA, 23 nt, Human
cuggagccaaugaaaaacacuag

SEQ ID NO: 60978 - RNA, 20 nt, Human
cugguacaauaaugaaugag

SEQ ID NO: 60979 - RNA, 20 nt, Human
cuucuaaguuucugagauug

SEQ ID NO: 60980 - RNA, 20 nt, Human
cuucuaaguuucugagauug

SEQ ID NO: 60981 - RNA, 23 nt, Human
cuugcuucuaaguuucugagauu

SEQ ID NO: 60982 - RNA, 25 nt, Human
cuugcuucuaaguuucugagauugu

SEQ ID NO: 60983 - RNA, 22 nt, Human
gaauaaacacucuuaaugugaa

SEQ ID NO: 60984 - RNA, 21 nt, Human
gacacacuguccugcggggac

SEQ ID NO: 60985 - RNA, 22 nt, Human
gaccacagugaaaaauuagacc

SEQ ID NO: 60986 - RNA, 21 nt, Human
gaccuggagccaaugaaaaac

SEQ ID NO: 60987 - RNA, 18 nt, Human
gcaaaggccugacacugg

SEQ ID NO: 60988 - RNA, 26 nt, Human
gcccgcgcagccgcaaaaagcaccgg

SEQ ID NO: 60989 - RNA, 20 nt, Human
gcgcagccgcaaaaagcacc

SEQ ID NO: 60990 - RNA, 21 nt, Human
gcgcagccgcaaaaagcaccg

SEQ ID NO: 60991 - RNA, 18 nt, Human
gcggggcaagcugcccgc

SEQ ID NO: 60992 - RNA, 24 nt, Human
gcucacuaaagcucacuucaaucu

SEQ ID NO: 60993 - RNA, 20 nt, Human
gcuuuauuuaaaaaucucuc

SEQ ID NO: 60994 - RNA, 23 nt, Human
ggaagcccgcgcagccgcaaaaa

SEQ ID NO: 60995 - RNA, 25 nt, Human
ggaucccuggcagcgcaccacaagu

SEQ ID NO: 60996 - RNA, 23 nt, Human
ggcacuuucguuuacaucaacca

SEQ ID NO: 60997 - RNA, 19 nt, Human
gggggaaaauccccaaaau

SEQ ID NO: 60998 - RNA, 25 nt, Human
gucagguugccuccaccaaaccuga

SEQ ID NO: 60999 - RNA, 24 nt, Human
gugaaaaauuagaccuggagccaa

SEQ ID NO: 61000 - RNA, 24 nt, Human
guucacucaagccuacugcaaagg

SEQ ID NO: 61001 - RNA, 25 nt, Human
uaaaacaacaaagaugaagggaggc

SEQ ID NO: 61002 - RNA, 19 nt, Human
uaaagcaguacauacaggc

SEQ ID NO: 61003 - RNA, 24 nt, Human
uaaagcucacuucaaucugucaaa

SEQ ID NO: 61004 - RNA, 21 nt, Human
uaucuggucuuugaccaacuu

SEQ ID NO: 61005 - RNA, 21 nt, Human
uauguuauuaaaugacaaaac

SEQ ID NO: 61006 - RNA, 21 nt, Human
ucaaaucuagaucagaaguuc

SEQ ID NO: 61007 - RNA, 21 nt, Human
ucaaaugaaaagaaacaaaaa

SEQ ID NO: 61008 - RNA, 22 nt, Human
uccaccaaaccugauugaagca

SEQ ID NO: 61009 - RNA, 19 nt, Human
uccaccccaugccaaugac

SEQ ID NO: 61010 - RNA, 18 nt, Human
uccagaauaucuggucuu

SEQ ID NO: 61011 - RNA, 18 nt, Human
ucccugcauucugauccu

SEQ ID NO: 61012 - RNA, 25 nt, Human
uccggcuccccgcacugguggggac

SEQ ID NO: 61013 - RNA, 21 nt, Human
uccuccuuccggcuccccgca

SEQ ID NO: 61014 - RNA, 23 nt, Human
ucuaaaaccaugaucgugucuga

SEQ ID NO: 61015 - RNA, 20 nt, Human
ucuagggcauuguaggcuug

SEQ ID NO: 61016 - RNA, 19 nt, Human
ucuaugacagcuucugaga

SEQ ID NO: 61017 - RNA, 23 nt, Human
ugaaaagaaacaaaaauagauua

SEQ ID NO: 61018 - RNA, 20 nt, Human
ugaaccgacgaauaaacacu

SEQ ID NO: 61019 - RNA, 19 nt, Human
ugacacacuguccugcggg

SEQ ID NO: 61020 - RNA, 23 nt, Human
ugacauggaaucuuuuuccuguc

SEQ ID NO: 61021 - RNA, 20 nt, Human
ugacgaccagucaaaauggu

SEQ ID NO: 61022 - RNA, 22 nt, Human
ugacugguaaaaucccagaggc

SEQ ID NO: 61023 - RNA, 21 nt, Human
ugaggaaguaaaaaugggcaa

SEQ ID NO: 61024 - RNA, 18 nt, Human
ugcagcaaacuuuccuua

SEQ ID NO: 61025 - RNA, 23 nt, Human
ugccaaugacgaccagucaaaau

SEQ ID NO: 61026 - RNA, 21 nt, Human
ugccuuuacuaaaauggcacu

SEQ ID NO: 61027 - RNA, 23 nt, Human
ugcuuaggauacuaugauuugac

SEQ ID NO: 61028 - RNA, 23 nt, Human
uggaaggaauggguuuuuccaaa

SEQ ID NO: 61029 - RNA, 18 nt, Human
uggacagccagcuagcuc

SEQ ID NO: 61030 - RNA, 19 nt, Human
uggagccaaugaaaaacac

SEQ ID NO: 61031 - RNA, 21 nt, Human
uggcaguggaggaaagcagag

SEQ ID NO: 61032 - RNA, 20 nt, Human
uggcuccuccuuccggcucc

SEQ ID NO: 61033 - RNA, 22 nt, Human
uucacucaagccuacugcaaag

SEQ ID NO: 61034 - RNA, 20 nt, Human
uuccaaaaaugcaaaauuag

SEQ ID NO: 61035 - RNA, 20 nt, Human
uugcuauuuuuuuccugccu

SEQ ID NO: 61036 - RNA, 24 nt, Human
uuuacagaagaccuucaguggucc

SEQ ID NO: 61037 - RNA, 22 nt, Human
uuuuaauuggcagcaagaaauu

SEQ ID NO: 61038 - RNA, 23 nt, Human
aaagagccauaaauaaacuuaaa

SEQ ID NO: 61039 - RNA, 24 nt, Human
aaagagccauaaauaaacuuaaaa

SEQ ID NO: 61040 - RNA, 23 nt, Human
aggaagaggggaggucugggcuc

SEQ ID NO: 61041 - RNA, 19 nt, Human
aggaggugccacgugggga

SEQ ID NO: 61042 - RNA, 23 nt, Human
aggcugggaguugggguucuggg

SEQ ID NO: 61043 - RNA, 21 nt, Human
aggugccacguggggaggcug

SEQ ID NO: 61044 - RNA, 22 nt, Human
ccaggaagaggggaggucuggg

SEQ ID NO: 61045 - RNA, 22 nt, Human
ccccugcacucccgcccggccc

SEQ ID NO: 61046 - RNA, 21 nt, Human
cccgcccggcccggccccagc

SEQ ID NO: 61047 - RNA, 23 nt, Human
cccggcccggccccagcggugac

SEQ ID NO: 61048 - RNA, 21 nt, Human
cgcccggcccggccccagcgg

SEQ ID NO: 61049 - RNA, 21 nt, Human
cgcccucacguccccugcacu

SEQ ID NO: 61050 - RNA, 19 nt, Human
cggcugaaggggugaaggg

SEQ ID NO: 61051 - RNA, 20 nt, Human
cugggaauucuuagggaugg

SEQ ID NO: 61052 - RNA, 19 nt, Human
gcuccaggaagaggggagg

SEQ ID NO: 61053 - RNA, 21 nt, Human
ggucugggcucggcugaaggg

SEQ ID NO: 61054 - RNA, 23 nt, Human
gguucuggggcuccaggaagagg

SEQ ID NO: 61055 - RNA, 19 nt, Human
ucccgcccggcccggcccc

SEQ ID NO: 61056 - RNA, 21 nt, Human
ucuggggcuccaggaagaggg

SEQ ID NO: 61057 - RNA, 20 nt, Human
ugaggaggugccacgugggg

SEQ ID NO: 61058 - RNA, 23 nt, Human
ugaggaggugccacguggggagg

SEQ ID NO: 61059 - RNA, 18 nt, Human
ugcugcccuaggcuggga

SEQ ID NO: 61060 - RNA, 20 nt, Human
uggaaaggggaaauaagaau

SEQ ID NO: 61061 - RNA, 18 nt, Human
ugggguucuggggcucca

SEQ ID NO: 61062 - RNA, 20 nt, Human
uucaagacucccugcugccc

SEQ ID NO: 61063 - RNA, 23 nt, Human
uucaagacucccugcugcccuag

SEQ ID NO: 61064 - RNA, 23 nt, Human
aaaaacaaaacaaaaacagucaa

SEQ ID NO: 61065 - RNA, 21 nt, Human
aaaacaaaaacagucacagga

SEQ ID NO: 61066 - RNA, 22 nt, Human
aaaacaaaaacagucacaggaa

SEQ ID NO: 61067 - RNA, 20 nt, Human
aaaagaaagaaaaagcagaa

SEQ ID NO: 61068 - RNA, 20 nt, Human
aaaagccaggacagugaaug

SEQ ID NO: 61069 - RNA, 27 nt, Human
aaacaaaacaaaaacagucacaggaag

SEQ ID NO: 61070 - RNA, 20 nt, Human
aaacaacagacagugaagaa

SEQ ID NO: 61071 - RNA, 20 nt, Human
aacaaaacaaaaacagucac

SEQ ID NO: 61072 - RNA, 24 nt, Human
aacaaaacaaaaacagucacagga

SEQ ID NO: 61073 - RNA, 22 nt, Human
aaccuccccguguucucuccug

SEQ ID NO: 61074 - RNA, 20 nt, Human
aagaaaaagcagaagcagug

SEQ ID NO: 61075 - RNA, 27 nt, Human
aagaaaaagcagaagcagugagcaucg

SEQ ID NO: 61076 - RNA, 18 nt, Human
aagcucacacacucggac

SEQ ID NO: 61077 - RNA, 23 nt, Human
aauacaccacagguuaccagaac

SEQ ID NO: 61078 - RNA, 23 nt, Human
acaaaacaaaaacagucacagga

SEQ ID NO: 61079 - RNA, 24 nt, Human
acaaaacaaaaacagucacaggaa

SEQ ID NO: 61080 - RNA, 18 nt, Human
accccauuucucagcaac

SEQ ID NO: 61081 - RNA, 20 nt, Human
agaaagaaaaagcagaagca

SEQ ID NO: 61082 - RNA, 22 nt, Human
aggaaaaaaacaaaacaaaaac

SEQ ID NO: 61083 - RNA, 23 nt, Human
aggaaaaaaacaaaacaaaaaca

SEQ ID NO: 61084 - RNA, 22 nt, Human
aggaaaaaggaaaaaaacaaaa

SEQ ID NO: 61085 - RNA, 22 nt, Human
aggacagugaaugaggcugaag

SEQ ID NO: 61086 - RNA, 21 nt, Human
aggaggggguggaggugaggg

SEQ ID NO: 61087 - RNA, 21 nt, Human
agguauccagccguggaaaca

SEQ ID NO: 61088 - RNA, 24 nt, Human
aucgacaucaacuguacaagcauu

SEQ ID NO: 61089 - RNA, 24 nt, Human
auugaaaaucgacauuucccauuu

SEQ ID NO: 61090 - RNA, 25 nt, Human
caaacaaaccuccccguguucucuc

SEQ ID NO: 61091 - RNA, 22 nt, Human
caaaguagaggccgagggucag

SEQ ID NO: 61092 - RNA, 20 nt, Human
caauacaauggaaguggggu

SEQ ID NO: 61093 - RNA, 20 nt, Human
cacacaaacaaaccuccccg

SEQ ID NO: 61094 - RNA, 24 nt, Human
caccccauuucucagcaacuuccu

SEQ ID NO: 61095 - RNA, 19 nt, Human
cagccuggacuacuuuccu

SEQ ID NO: 61096 - RNA, 24 nt, Human
cagcggacacccucaucuguauac

SEQ ID NO: 61097 - RNA, 19 nt, Human
ccacagacucaguuucagg

SEQ ID NO: 61098 - RNA, 18 nt, Human
ccaccccauuucucagca

SEQ ID NO: 61099 - RNA, 18 nt, Human
ccagccguggaaacacug

SEQ ID NO: 61100 - RNA, 21 nt, Human
cccuggcagcggcugcugcuu

SEQ ID NO: 61101 - RNA, 24 nt, Human
cccuggcagcggcugcugcuuggc

SEQ ID NO: 61102 - RNA, 19 nt, Human
ccgaaggaaagcagcagcg

SEQ ID NO: 61103 - RNA, 22 nt, Human
ccgaaggaaagcagcagcggac

SEQ ID NO: 61104 - RNA, 22 nt, Human
ccggugacaggaggggguggag

SEQ ID NO: 61105 - RNA, 25 nt, Human
ccuccuugguguggucuucucugag

SEQ ID NO: 61106 - RNA, 23 nt, Human
ccugcaucccuccgccagggcug

SEQ ID NO: 61107 - RNA, 19 nt, Human
ccuucagauuuaaaauaaa

SEQ ID NO: 61108 - RNA, 21 nt, Human
cgagggucucucacgugcuuc

SEQ ID NO: 61109 - RNA, 22 nt, Human
cucucacgugcuucaguggcca

SEQ ID NO: 61110 - RNA, 18 nt, Human
cugcaucccuccgccagg

SEQ ID NO: 61111 - RNA, 24 nt, Human
gaaaaaggaaaaaaacaaaacaaa

SEQ ID NO: 61112 - RNA, 20 nt, Human
gaaacugguccuuucacauu

SEQ ID NO: 61113 - RNA, 19 nt, Human
gacagccugcauauaaguc

SEQ ID NO: 61114 - RNA, 21 nt, Human
gacaggaggggguggagguga

SEQ ID NO: 61115 - RNA, 23 nt, Human
gcagcggacacccucaucuguau

SEQ ID NO: 61116 - RNA, 21 nt, Human
gcaucccuccgccagggcugc

SEQ ID NO: 61117 - RNA, 23 nt, Human
gccagggcugccgcgcucccugc

SEQ ID NO: 61118 - RNA, 20 nt, Human
gcugccgcgcucccugccac

SEQ ID NO: 61119 - RNA, 21 nt, Human
ggaaagcagcagcggacaccc

SEQ ID NO: 61120 - RNA, 20 nt, Human
ggcagcggcugcugcuuggc

SEQ ID NO: 61121 - RNA, 23 nt, Human
uaaaaaagaaaacuacaucaaau

SEQ ID NO: 61122 - RNA, 24 nt, Human
uaaaaagcuacgguagguaaacaa

SEQ ID NO: 61123 - RNA, 23 nt, Human
uaaaaauacaccacagguuacca

SEQ ID NO: 61124 - RNA, 21 nt, Human
uaaaaugccuuuaacguccuu

SEQ ID NO: 61125 - RNA, 21 nt, Human
uagaagacgcuggaauaaaau

SEQ ID NO: 61126 - RNA, 22 nt, Human
uauaagcuacaggcuaaucucu

SEQ ID NO: 61127 - RNA, 20 nt, Human
ucaagcucacacacucggac

SEQ ID NO: 61128 - RNA, 24 nt, Human
ucacccauuuaaaagaauggaaau

SEQ ID NO: 61129 - RNA, 22 nt, Human
uccacagacucaguuucaggga

SEQ ID NO: 61130 - RNA, 22 nt, Human
uccacaguguccacagacucag

SEQ ID NO: 61131 - RNA, 18 nt, Human
uccuuggugacaggacuu

SEQ ID NO: 61132 - RNA, 18 nt, Human
ucgacaucaacuguacaa

SEQ ID NO: 61133 - RNA, 23 nt, Human
ucuacaguaguacuuuauauagu

SEQ ID NO: 61134 - RNA, 22 nt, Human
ucucaagcucacacacucggac

SEQ ID NO: 61135 - RNA, 18 nt, Human
ugaaugaggcugaagagu

SEQ ID NO: 61136 - RNA, 22 nt, Human
ugacaggacuuuuauggagaca

SEQ ID NO: 61137 - RNA, 20 nt, Human
ugacaggaggggguggaggu

SEQ ID NO: 61138 - RNA, 19 nt, Human
ugagugaaugucacaaggc

SEQ ID NO: 61139 - RNA, 19 nt, Human
ugccuuuggagaaagucca

SEQ ID NO: 61140 - RNA, 21 nt, Human
uggcagcggcugcugcuuggc

SEQ ID NO: 61141 - RNA, 18 nt, Human
uggcagucgaucggaauc

SEQ ID NO: 61142 - RNA, 18 nt, Human
ugucaaauauaagcuaca

SEQ ID NO: 61143 - RNA, 23 nt, Human
uucacacaaacaaaccuccccgu

SEQ ID NO: 61144 - RNA, 19 nt, Human
uuguucaaagcuuuccaca

SEQ ID NO: 61145 - RNA, 21 nt, Human
uuucacacaaacaaaccuccc

SEQ ID NO: 61146 - RNA, 19 nt, Human
uuucucagcaacuuccuga

SEQ ID NO: 61147 - RNA, 24 nt, Human
aaaaauacaaaaauuagccaugug

SEQ ID NO: 61148 - RNA, 21 nt, Human
aaaacaacaacaacaacaaaa

SEQ ID NO: 61149 - RNA, 22 nt, Human
aaaacaacaacaacaacaaaac

SEQ ID NO: 61150 - RNA, 24 nt, Human
aaacagacaccuaccaacacucca

SEQ ID NO: 61151 - RNA, 24 nt, Human
aaacaggcacacaacucagccaga

SEQ ID NO: 61152 - RNA, 26 nt, Human
aaaggaggaaggaaggaaggaaagag

SEQ ID NO: 61153 - RNA, 20 nt, Human
aaaguugaccaggugugaug

SEQ ID NO: 61154 - RNA, 24 nt, Human
aacaacaacaacaaaaagacaaag

SEQ ID NO: 61155 - RNA, 20 nt, Human
aacaacaacaacaacaaaaa

SEQ ID NO: 61156 - RNA, 20 nt, Human
aacagagggaaacuccaucu

SEQ ID NO: 61157 - RNA, 19 nt, Human
aacaugacgaaaccccauu

SEQ ID NO: 61158 - RNA, 20 nt, Human
aacaugacgaaaccccauuu

SEQ ID NO: 61159 - RNA, 21 nt, Human
aacaugacgaaaccccauuuc

SEQ ID NO: 61160 - RNA, 24 nt, Human
aaccugacgaauguggugaaaccc

SEQ ID NO: 61161 - RNA, 23 nt, Human
aagaaagaaaggaaggaagaaag

SEQ ID NO: 61162 - RNA, 24 nt, Human
aagaggaaguagaguagugcaggg

SEQ ID NO: 61163 - RNA, 21 nt, Human
aaguagacuucagaacacaga

SEQ ID NO: 61164 - RNA, 21 nt, Human
aauaacccugccccagagagu

SEQ ID NO: 61165 - RNA, 23 nt, Human
aaucacagucaucccuaacuuca

SEQ ID NO: 61166 - RNA, 24 nt, Human
aaucgcuuaaaccugggaggcaaa

SEQ ID NO: 61167 - RNA, 21 nt, Human
aauguggugaaaccccgucuc

SEQ ID NO: 61168 - RNA, 20 nt, Human
aauugcuuggacccaggaga

SEQ ID NO: 61169 - RNA, 23 nt, Human
acaacaacaacaaaaagacaaag

SEQ ID NO: 61170 - RNA, 24 nt, Human
acaacaacaacaacaaaaagacaa

SEQ ID NO: 61171 - RNA, 23 nt, Human
acaacacagaguucugacuaaca

SEQ ID NO: 61172 - RNA, 23 nt, Human
acagagugagacuccaucucaaa

SEQ ID NO: 61173 - RNA, 24 nt, Human
acagagugagacuccaucucaaaa

SEQ ID NO: 61174 - RNA, 24 nt, Human
acccaggagaaggaggcugcagug

SEQ ID NO: 61175 - RNA, 24 nt, Human
accccauuucuacuaaaaauacaa

SEQ ID NO: 61176 - RNA, 24 nt, Human
accccgucucuacgaaaaauacaa

SEQ ID NO: 61177 - RNA, 24 nt, Human
acccugucuuuacuaaaaauacaa

SEQ ID NO: 61178 - RNA, 23 nt, Human
accuguggucccagcuacucggg

SEQ ID NO: 61179 - RNA, 24 nt, Human
acuccagccagggccacagaacga

SEQ ID NO: 61180 - RNA, 24 nt, Human
acuccagccugggugacagaguga

SEQ ID NO: 61181 - RNA, 18 nt, Human
acugaacuccagccaggg

SEQ ID NO: 61182 - RNA, 23 nt, Human
acugcacucuagccuggcaacag

SEQ ID NO: 61183 - RNA, 23 nt, Human
acugcacucuagccuggcaacag

SEQ ID NO: 61184 - RNA, 24 nt, Human
acugggcaugguggcucaugccug

SEQ ID NO: 61185 - RNA, 24 nt, Human
acuguacuccagccugggugacag

SEQ ID NO: 61186 - RNA, 26 nt, Human
acuguacuccagccugggugacagag

SEQ ID NO: 61187 - RNA, 20 nt, Human
acuguguagcaccugagggu

SEQ ID NO: 61188 - RNA, 20 nt, Human
agaaacaggcacacaacuca

SEQ ID NO: 61189 - RNA, 25 nt, Human
agaaaggaaggaagaaagaaaggaa

SEQ ID NO: 61190 - RNA, 24 nt, Human
agaaggaggcugcagugagccgag

SEQ ID NO: 61191 - RNA, 24 nt, Human
agaauuccuccauggguuuugcau

SEQ ID NO: 61192 - RNA, 22 nt, Human
agagagaaaaggaggaaggaag

SEQ ID NO: 61193 - RNA, 18 nt, Human
agagagagaaaaggagga

SEQ ID NO: 61194 - RNA, 24 nt, Human
agagagagagaaagaaaggaaggg

SEQ ID NO: 61195 - RNA, 23 nt, Human
agagguagcagugagccaagauc

SEQ ID NO: 61196 - RNA, 23 nt, Human
agaucacaaggucaggaguucga

SEQ ID NO: 61197 - RNA, 18 nt, Human
agauggaguuggcuuucc

SEQ ID NO: 61198 - RNA, 22 nt, Human
agcacugucacuuaauacugug

SEQ ID NO: 61199 - RNA, 24 nt, Human
agcacuuugggaggccgaggcggg

SEQ ID NO: 61200 - RNA, 20 nt, Human
agcacuuugggaggucgagg

SEQ ID NO: 61201 - RNA, 21 nt, Human
agccuggcaacagagggaaac

SEQ ID NO: 61202 - RNA, 24 nt, Human
agccuggccaacaugacgaaaccc

SEQ ID NO: 61203 - RNA, 22 nt, Human
agccuggccaauauggugaaac

SEQ ID NO: 61204 - RNA, 24 nt, Human
agccuggccaauauggugaaaccc

SEQ ID NO: 61205 - RNA, 24 nt, Human
agccuggccaauauggugaaaccc

SEQ ID NO: 61206 - RNA, 24 nt, Human
agccugggugacagagugagacuc

SEQ ID NO: 61207 - RNA, 24 nt, Human
agccuguaguuccagcuacuuggg

SEQ ID NO: 61208 - RNA, 22 nt, Human
agcuaugucucucugggaaacu

SEQ ID NO: 61209 - RNA, 20 nt, Human
agcuccuggccagguggccc

SEQ ID NO: 61210 - RNA, 24 nt, Human
aggaaggaagaaagaaaggaaggg

SEQ ID NO: 61211 - RNA, 19 nt, Human
aggaccauuaauccugaaa

SEQ ID NO: 61212 - RNA, 20 nt, Human
aggaggcugcagugagccga

SEQ ID NO: 61213 - RNA, 21 nt, Human
aggaggcugcagugagccgag

SEQ ID NO: 61214 - RNA, 21 nt, Human
aggcaaagguugcaguaagcc

SEQ ID NO: 61215 - RNA, 24 nt, Human
aggcaaagguugcaguaagccgag

SEQ ID NO: 61216 - RNA, 22 nt, Human
aggcagaagaaucgcuuaaacc

SEQ ID NO: 61217 - RNA, 24 nt, Human
aggcagaagaaucgcuuaaaccug

SEQ ID NO: 61218 - RNA, 18 nt, Human
aggcaggagaauugcuca

SEQ ID NO: 61219 - RNA, 20 nt, Human
aggcaggagaauugcucaug

SEQ ID NO: 61220 - RNA, 21 nt, Human
aggcaugagaagggacauagg

SEQ ID NO: 61221 - RNA, 22 nt, Human
aggcauuuaucaaggaucugca

SEQ ID NO: 61222 - RNA, 21 nt, Human
aggccgaggcggguggaucac

SEQ ID NO: 61223 - RNA, 24 nt, Human
aggcgggcagaucacaaggucagg

SEQ ID NO: 61224 - RNA, 24 nt, Human
aggcggguggaucacaaagucagg

SEQ ID NO: 61225 - RNA, 25 nt, Human
aggcggguggaucaccuaggccagg

SEQ ID NO: 61226 - RNA, 24 nt, Human
aggcugaggcacaauaauugcuug

SEQ ID NO: 61227 - RNA, 20 nt, Human
aggcugaggcaggagaauug

SEQ ID NO: 61228 - RNA, 21 nt, Human
aggcugaggcaggagaauugc

SEQ ID NO: 61229 - RNA, 21 nt, Human
aggucgaggcggguggaucac

SEQ ID NO: 61230 - RNA, 24 nt, Human
aggugugauggcucaugccuguaa

SEQ ID NO: 61231 - RNA, 21 nt, Human
auaaucaacuuccuaaccgua

SEQ ID NO: 61232 - RNA, 18 nt, Human
aucacaaagucaggaguu

SEQ ID NO: 61233 - RNA, 21 nt, Human
aucacaaggucaggaguucga

SEQ ID NO: 61234 - RNA, 24 nt, Human
aucaccuaggccaggaguucgaga

SEQ ID NO: 61235 - RNA, 24 nt, Human
aucaugccacugcacucuagccug

SEQ ID NO: 61236 - RNA, 24 nt, Human
aucgacugggcaugguggcucaug

SEQ ID NO: 61237 - RNA, 20 nt, Human
aucucaaaaaaaaaaaaaag

SEQ ID NO: 61238 - RNA, 21 nt, Human
augaagcaaaagcugacagaa

SEQ ID NO: 61239 - RNA, 23 nt, Human
augaguaaaugaaugaauaauau

SEQ ID NO: 61240 - RNA, 22 nt, Human
augauaagagaguaaaugcacc

SEQ ID NO: 61241 - RNA, 19 nt, Human
augccuguaaucccagcac

SEQ ID NO: 61242 - RNA, 19 nt, Human
augccuguaaucccagcac

SEQ ID NO: 61243 - RNA, 23 nt, Human
auggcucaugccuguaaucccag

SEQ ID NO: 61244 - RNA, 21 nt, Human
caaacacagcauuaagaguuu

SEQ ID NO: 61245 - RNA, 19 nt, Human
caaaggaauaacccugccc

SEQ ID NO: 61246 - RNA, 23 nt, Human
caaaggaauaacccugccccaga

SEQ ID NO: 61247 - RNA, 22 nt, Human
caacaacaacaacaaaaagaca

SEQ ID NO: 61248 - RNA, 18 nt, Human
caacacuccaaagagaac

SEQ ID NO: 61249 - RNA, 18 nt, Human
caagaaaagagagagaga

SEQ ID NO: 61250 - RNA, 19 nt, Human
caccagaaaacaugauguc

SEQ ID NO: 61251 - RNA, 21 nt, Human
caccagaaaacaugaugucca

SEQ ID NO: 61252 - RNA, 27 nt, Human
caccagaaaacaugauguccauuuagc

SEQ ID NO: 61253 - RNA, 22 nt, Human
caccaucaacuaccucaaccug

SEQ ID NO: 61254 - RNA, 20 nt, Human
caccucuucaucccucucua

SEQ ID NO: 61255 - RNA, 23 nt, Human
caccugaagucucagcuacucgg

SEQ ID NO: 61256 - RNA, 24 nt, Human
caccugaagucucagcuacucggg

SEQ ID NO: 61257 - RNA, 23 nt, Human
caccuguggucccagcuacucgg

SEQ ID NO: 61258 - RNA, 24 nt, Human
caccuguggucccagcuacucggg

SEQ ID NO: 61259 - RNA, 18 nt, Human
cacugcacucuagccugg

SEQ ID NO: 61260 - RNA, 20 nt, Human
cacugcacucuagccuggca

SEQ ID NO: 61261 - RNA, 23 nt, Human
cacugcacucuagccuggcaaca

SEQ ID NO: 61262 - RNA, 24 nt, Human
cacugcacucuagccuggcaacag

SEQ ID NO: 61263 - RNA, 18 nt, Human
cacugcggaaggcagaac

SEQ ID NO: 61264 - RNA, 19 nt, Human
cacuguacuccagccuggg

SEQ ID NO: 61265 - RNA, 19 nt, Human
cacuguacuccagccuggg

SEQ ID NO: 61266 - RNA, 19 nt, Human
cacuguacuccagccuggg

SEQ ID NO: 61267 - RNA, 20 nt, Human
cacuguacuccagccugggu

SEQ ID NO: 61268 - RNA, 22 nt, Human
cacuguacuccagccuggguga

SEQ ID NO: 61269 - RNA, 23 nt, Human
cacuguacuccagccugggugac

SEQ ID NO: 61270 - RNA, 24 nt, Human
cacuguacuccagccugggugaca

SEQ ID NO: 61271 - RNA, 24 nt, Human
cacuguacuccagccugggugaca

SEQ ID NO: 61272 - RNA, 24 nt, Human
cagcacuuugggaggccgaggcgg

SEQ ID NO: 61273 - RNA, 24 nt, Human
cagcacuuugggaggucgaggcgg

SEQ ID NO: 61274 - RNA, 22 nt, Human
cagccagagcaaugagaugcaa

SEQ ID NO: 61275 - RNA, 24 nt, Human
cagcuacucgggaggcugaggcag

SEQ ID NO: 61276 - RNA, 24 nt, Human
cagcuacuugggaggcugaggcag

SEQ ID NO: 61277 - RNA, 18 nt, Human
caguccuuccugggcagu

SEQ ID NO: 61278 - RNA, 21 nt, Human
cauaucuaucuuucucacaaa

SEQ ID NO: 61279 - RNA, 20 nt, Human
caugccuguaaucccagcac

SEQ ID NO: 61280 - RNA, 24 nt, Human
caugccuguaaucccagcacuuug

SEQ ID NO: 61281 - RNA, 19 nt, Human
ccacugaacuccagccagg

SEQ ID NO: 61282 - RNA, 21 nt, Human
ccacugaacuccagccagggc

SEQ ID NO: 61283 - RNA, 19 nt, Human
ccacugcacucuagccugg

SEQ ID NO: 61284 - RNA, 19 nt, Human
ccacugcacucuagccugg

SEQ ID NO: 61285 - RNA, 20 nt, Human
ccacugcacucuagccuggc

SEQ ID NO: 61286 - RNA, 23 nt, Human
ccacugcacucuagccuggcaac

SEQ ID NO: 61287 - RNA, 20 nt, Human
ccaggaguucgagaccagcc

SEQ ID NO: 61288 - RNA, 21 nt, Human
ccuacacugcggaaggcagaa

SEQ ID NO: 61289 - RNA, 21 nt, Human
ccuaggccaggaguucgagac

SEQ ID NO: 61290 - RNA, 20 nt, Human
ccucuacauaccccuaacuu

SEQ ID NO: 61291 - RNA, 21 nt, Human
ccugaagucucagcuacucgg

SEQ ID NO: 61292 - RNA, 23 nt, Human
ccugacgaauguggugaaacccc

SEQ ID NO: 61293 - RNA, 24 nt, Human
ccugacgaauguggugaaaccccg

SEQ ID NO: 61294 - RNA, 24 nt, Human
ccuggccaacaugacgaaacccca

SEQ ID NO: 61295 - RNA, 22 nt, Human
ccuggccaauauggugaaaccc

SEQ ID NO: 61296 - RNA, 24 nt, Human
ccuggccaauauggugaaacccug

SEQ ID NO: 61297 - RNA, 19 nt, Human
ccugggcaguugccucuag

SEQ ID NO: 61298 - RNA, 22 nt, Human
ccugggugacagagugagacuc

SEQ ID NO: 61299 - RNA, 20 nt, Human
ccuguaaucccagcacuuug

SEQ ID NO: 61300 - RNA, 22 nt, Human
ccuguaaucccagcacuuuggg

SEQ ID NO: 61301 - RNA, 22 nt, Human
ccuguaaucccagcacuuuggg

SEQ ID NO: 61302 - RNA, 18 nt, Human
ccuguaguuccagcuacu

SEQ ID NO: 61303 - RNA, 21 nt, Human
ccuguaguuccagcuacuugg

SEQ ID NO: 61304 - RNA, 21 nt, Human
ccuguggucccagcuacucgg

SEQ ID NO: 61305 - RNA, 21 nt, Human
cgagaccagccuggccaacau

SEQ ID NO: 61306 - RNA, 24 nt, Human
cgagaccagccuggccaauauggu

SEQ ID NO: 61307 - RNA, 21 nt, Human
cgaggcggguggaucacaaag

SEQ ID NO: 61308 - RNA, 26 nt, Human
cgaggcggguggaucacaaagucagg

SEQ ID NO: 61309 - RNA, 19 nt, Human
cgaggcggguggaucaccu

SEQ ID NO: 61310 - RNA, 22 nt, Human
cgggcagaucacaaggucagga

SEQ ID NO: 61311 - RNA, 22 nt, Human
cucaguuucucucaggccucug

SEQ ID NO: 61312 - RNA, 21 nt, Human
cucauaucuaucuuucucaca

SEQ ID NO: 61313 - RNA, 23 nt, Human
cucaugccuguaaucccagcacu

SEQ ID NO: 61314 - RNA, 24 nt, Human
cucaugccuguaaucccagcacuu

SEQ ID NO: 61315 - RNA, 24 nt, Human
cucaugccuguaaucccagcacuu

SEQ ID NO: 61316 - RNA, 19 nt, Human
cuccaucucaaaaaaaaaa

SEQ ID NO: 61317 - RNA, 20 nt, Human
cucuacgaaaaauacaaaaa

SEQ ID NO: 61318 - RNA, 25 nt, Human
cucucaggccucuguugggccucag

SEQ ID NO: 61319 - RNA, 21 nt, Human
cugaagucucagcuacucggg

SEQ ID NO: 61320 - RNA, 22 nt, Human
cugcagugagccgaggucgugu

SEQ ID NO: 61321 - RNA, 24 nt, Human
cuggccaauauggugaaacccugu

SEQ ID NO: 61322 - RNA, 22 nt, Human
cuuaacucucucagccucagga

SEQ ID NO: 61323 - RNA, 18 nt, Human
gaaaaggaggaaggaagg

SEQ ID NO: 61324 - RNA, 23 nt, Human
gaaacaggcacacaacucagcca

SEQ ID NO: 61325 - RNA, 19 nt, Human
gaaacccugucuuuacuaa

SEQ ID NO: 61326 - RNA, 19 nt, Human
gaaagagagcuuccucucu

SEQ ID NO: 61327 - RNA, 19 nt, Human
gaacaaaguccacagcucu

SEQ ID NO: 61328 - RNA, 22 nt, Human
gaauguggugaaaccccgucuc

SEQ ID NO: 61329 - RNA, 23 nt, Human
gagaaagaaaggaaggaagaaag

SEQ ID NO: 61330 - RNA, 23 nt, Human
gagaagcuccuggccagguggcc

SEQ ID NO: 61331 - RNA, 20 nt, Human
gagaucaugccacugcacuc

SEQ ID NO: 61332 - RNA, 23 nt, Human
gaggaagcucugcuugggggagg

SEQ ID NO: 61333 - RNA, 24 nt, Human
gaggcacaauaauugcuuggaccc

SEQ ID NO: 61334 - RNA, 22 nt, Human
gaggcccagucuucccugaccc

SEQ ID NO: 61335 - RNA, 18 nt, Human
gaggcgggcagaucacaa

SEQ ID NO: 61336 - RNA, 24 nt, Human
gaggcggguggaucaccuaggcca

SEQ ID NO: 61337 - RNA, 21 nt, Human
gagugcguauguuauuuuuag

SEQ ID NO: 61338 - RNA, 23 nt, Human
gauaugagcaucaggagagacag

SEQ ID NO: 61339 - RNA, 19 nt, Human
gaucacaaagucaggaguu

SEQ ID NO: 61340 - RNA, 22 nt, Human
gaucacaaagucaggaguuuga

SEQ ID NO: 61341 - RNA, 21 nt, Human
gaucacaaggucaggaguucg

SEQ ID NO: 61342 - RNA, 24 nt, Human
gaucacaaggucaggaguucgaga

SEQ ID NO: 61343 - RNA, 23 nt, Human
gaucaccuaggccaggaguucga

SEQ ID NO: 61344 - RNA, 24 nt, Human
gauggcucaugccuguaaucccag

SEQ ID NO: 61345 - RNA, 23 nt, Human
gcagaacagaaggacauacagaa

SEQ ID NO: 61346 - RNA, 19 nt, Human
gcaucaccagaaaacauga

SEQ ID NO: 61347 - RNA, 24 nt, Human
gcauggugguaggcaccugugguc

SEQ ID NO: 61348 - RNA, 23 nt, Human
gccaauauggugaaacccugucu

SEQ ID NO: 61349 - RNA, 23 nt, Human
gccacugcacucuagccuggcaa

SEQ ID NO: 61350 - RNA, 20 nt, Human
gccgagaucaugccacugca

SEQ ID NO: 61351 - RNA, 23 nt, Human
gccuguaguuccagcuacuuggg

SEQ ID NO: 61352 - RNA, 21 nt, Human
gcuaugucucucugggaaacu

SEQ ID NO: 61353 - RNA, 21 nt, Human
ggaaacagacaccuaccaacc

SEQ ID NO: 61354 - RNA, 22 nt, Human
ggaauaacccugccccagagag

SEQ ID NO: 61355 - RNA, 24 nt, Human
ggaggcgggcagaucacaagguca

SEQ ID NO: 61356 - RNA, 24 nt, Human
ggaggcugcagugagccgaggucg

SEQ ID NO: 61357 - RNA, 23 nt, Human
ggcaugguggcucaugccuguaa

SEQ ID NO: 61358 - RNA, 21 nt, Human
ggcucaugccuguaaucccag

SEQ ID NO: 61359 - RNA, 21 nt, Human
ggcucaugccuguaaucccag

SEQ ID NO: 61360 - RNA, 19 nt, Human
gggaaacagacaccuacca

SEQ ID NO: 61361 - RNA, 22 nt, Human
gggaaacucaugaaagcucaaa

SEQ ID NO: 61362 - RNA, 22 nt, Human
gggaggcugaggcacaauaauu

SEQ ID NO: 61363 - RNA, 24 nt, Human
gggaggcugaggcagaagaaucgc

SEQ ID NO: 61364 - RNA, 24 nt, Human
gggcagaucacaaggucaggaguu

SEQ ID NO: 61365 - RNA, 24 nt, Human
ggguggaucacaaagucaggaguu

SEQ ID NO: 61366 - RNA, 23 nt, Human
gguagagguagcagugagccaag

SEQ ID NO: 61367 - RNA, 21 nt, Human
gguggaucaccuaggccagga

SEQ ID NO: 61368 - RNA, 24 nt, Human
gguggcucaugccuguaaucccag

SEQ ID NO: 61369 - RNA, 24 nt, Human
guacuccagccugggugacagagu

SEQ ID NO: 61370 - RNA, 24 nt, Human
gucacuguacuccagccuggguga

SEQ ID NO: 61371 - RNA, 24 nt, Human
gucgugucacuguacuccagccug

SEQ ID NO: 61372 - RNA, 23 nt, Human
guggaucacaaagucaggaguuu

SEQ ID NO: 61373 - RNA, 19 nt, Human
guucugacuaacacaaggc

SEQ ID NO: 61374 - RNA, 24 nt, Human
guugaccaggugugauggcucaug

SEQ ID NO: 61375 - RNA, 19 nt, Human
uaaaaacaacaacaacaac

SEQ ID NO: 61376 - RNA, 23 nt, Human
uaaaaacaacaacaacaacaaaa

SEQ ID NO: 61377 - RNA, 27 nt, Human
uaaaaacaacaacaacaacaaaaagac

SEQ ID NO: 61378 - RNA, 20 nt, Human
uaaaaauacaaaaauuagcc

SEQ ID NO: 61379 - RNA, 21 nt, Human
uaaaaauacaaaaauuagcca

SEQ ID NO: 61380 - RNA, 21 nt, Human
uaaaaauacaaaaauuagccu

SEQ ID NO: 61381 - RNA, 26 nt, Human
uaacacaaggcuuacucucaccucuu

SEQ ID NO: 61382 - RNA, 21 nt, Human
uaauauagauauauuuaaagu

SEQ ID NO: 61383 - RNA, 22 nt, Human
uacccaacuacaugcagucugu

SEQ ID NO: 61384 - RNA, 22 nt, Human
uacuccagccugggugacagag

SEQ ID NO: 61385 - RNA, 24 nt, Human
uacuccagccugggugacagagug

SEQ ID NO: 61386 - RNA, 21 nt, Human
uacuguguagcaccugagggu

SEQ ID NO: 61387 - RNA, 18 nt, Human
uagagauggaguuggcuu

SEQ ID NO: 61388 - RNA, 20 nt, Human
uagcugggcgcaguggcaug

SEQ ID NO: 61389 - RNA, 19 nt, Human
uaggccaggaguucgagac

SEQ ID NO: 61390 - RNA, 20 nt, Human
uaucacaucagagaagcucc

SEQ ID NO: 61391 - RNA, 20 nt, Human
uaucauccacucuccuauuu

SEQ ID NO: 61392 - RNA, 20 nt, Human
uaucuaaagacagaacaacu

SEQ ID NO: 61393 - RNA, 23 nt, Human
uaucuaauaauagagcgcuaaaa

SEQ ID NO: 61394 - RNA, 20 nt, Human
uauuuugcaucuaucaucca

SEQ ID NO: 61395 - RNA, 21 nt, Human
ucaaaaaaaaaaaaaagugga

SEQ ID NO: 61396 - RNA, 24 nt, Human
ucaauaggaauuuuccagcuaugu

SEQ ID NO: 61397 - RNA, 24 nt, Human
ucacaaagucaggaguuugaaacc

SEQ ID NO: 61398 - RNA, 24 nt, Human
ucacaaggucaggaguucgagacc

SEQ ID NO: 61399 - RNA, 23 nt, Human
ucaccagaaaacaugauguccau

SEQ ID NO: 61400 - RNA, 21 nt, Human
ucaccuaggccaggaguucga

SEQ ID NO: 61401 - RNA, 20 nt, Human
ucacuguacuccagccuggg

SEQ ID NO: 61402 - RNA, 21 nt, Human
ucacuguacuccagccugggu

SEQ ID NO: 61403 - RNA, 24 nt, Human
ucacuguacuccagccugggugac

SEQ ID NO: 61404 - RNA, 21 nt, Human
ucagaacacagaaaauuauca

SEQ ID NO: 61405 - RNA, 22 nt, Human
ucagaacacagaaaauuaucac

SEQ ID NO: 61406 - RNA, 21 nt, Human
ucagccagagcaaugagaugc

SEQ ID NO: 61407 - RNA, 22 nt, Human
ucaugccuguaaucccagcacu

SEQ ID NO: 61408 - RNA, 21 nt, Human
ucaugguagagguagcaguga

SEQ ID NO: 61409 - RNA, 18 nt, Human
uccacaaaggaauaaccc

SEQ ID NO: 61410 - RNA, 23 nt, Human
uccagccugggugacagagugag

SEQ ID NO: 61411 - RNA, 24 nt, Human
uccagccugggugacagagugaga

SEQ ID NO: 61412 - RNA, 22 nt, Human
uccaucucaaaaaaaaaaaaaa

SEQ ID NO: 61413 - RNA, 18 nt, Human
uccucucuccucuuuggg

SEQ ID NO: 61414 - RNA, 24 nt, Human
ucgggaggcugaggcagaagaauc

SEQ ID NO: 61415 - RNA, 23 nt, Human
ucgugucacuguacuccagccug

SEQ ID NO: 61416 - RNA, 22 nt, Human
ucucaggccucuguugggccuc

SEQ ID NO: 61417 - RNA, 25 nt, Human
ucucugaggaagcucugcuuggggg

SEQ ID NO: 61418 - RNA, 23 nt, Human
ucuuuacuaaaaauacaaaaauu

SEQ ID NO: 61419 - RNA, 22 nt, Human
ugaaugaauaaaugaaugagua

SEQ ID NO: 61420 - RNA, 26 nt, Human
ugaaugaguaaaugaaugaauaauau

SEQ ID NO: 61421 - RNA, 22 nt, Human
ugacgaauguggugaaaccccg

SEQ ID NO: 61422 - RNA, 24 nt, Human
ugacgaauguggugaaaccccguc

SEQ ID NO: 61423 - RNA, 22 nt, Human
ugagauaucgacugggcauggu

SEQ ID NO: 61424 - RNA, 22 nt, Human
ugagccgaggucgugucacugu

SEQ ID NO: 61425 - RNA, 24 nt, Human
ugaggcagaagaaucgcuuaaacc

SEQ ID NO: 61426 - RNA, 23 nt, Human
ugaggcaggagaauugcucaugg

SEQ ID NO: 61427 - RNA, 20 nt, Human
ugaggcaggagaauugcucc

SEQ ID NO: 61428 - RNA, 25 nt, Human
ugaguucagcacuuagagauggagu

SEQ ID NO: 61429 - RNA, 24 nt, Human
ugauggcucaugccuguaauccca

SEQ ID NO: 61430 - RNA, 20 nt, Human
ugauuacaugcagagacugg

SEQ ID NO: 61431 - RNA, 23 nt, Human
ugccuguaaucccagcacuuugg

SEQ ID NO: 61432 - RNA, 23 nt, Human
ugccuguaaucccagcacuuugg

SEQ ID NO: 61433 - RNA, 22 nt, Human
ugcguauguuauuuuuagacaa

SEQ ID NO: 61434 - RNA, 21 nt, Human
ugcuuggacccaggagaagga

SEQ ID NO: 61435 - RNA, 26 nt, Human
uggacaaauccacaauuguacuucaa

SEQ ID NO: 61436 - RNA, 26 nt, Human
uggaggaggcucugaguuccgaccac

SEQ ID NO: 61437 - RNA, 24 nt, Human
uggagggaaaggcaugagaaggga

SEQ ID NO: 61438 - RNA, 21 nt, Human
uggaucacaaagucaggaguu

SEQ ID NO: 61439 - RNA, 23 nt, Human
uggaucaccuaggccaggaguuc

SEQ ID NO: 61440 - RNA, 18 nt, Human
uggcaaaauaaaaaguga

SEQ ID NO: 61441 - RNA, 19 nt, Human
uggcaugagccuguaguuc

SEQ ID NO: 61442 - RNA, 20 nt, Human
uggcauggugguaggcaccu

SEQ ID NO: 61443 - RNA, 23 nt, Human
uggcauggugguaggcaccugug

SEQ ID NO: 61444 - RNA, 24 nt, Human
uggccaauauggugaaacccuguc

SEQ ID NO: 61445 - RNA, 24 nt, Human
uggcucaugccuguaaucccagca

SEQ ID NO: 61446 - RNA, 24 nt, Human
uggcucaugccuguaaucccagca

SEQ ID NO: 61447 - RNA, 20 nt, Human
ugggaaacagacaccuacca

SEQ ID NO: 61448 - RNA, 23 nt, Human
ugggaggccgaggcggguggauc

SEQ ID NO: 61449 - RNA, 24 nt, Human
ugggaggccgaggcggguggauca

SEQ ID NO: 61450 - RNA, 19 nt, Human
ugggaggcugaggcaggag

SEQ ID NO: 61451 - RNA, 22 nt, Human
ugggaggcugaggcaggagaau

SEQ ID NO: 61452 - RNA, 23 nt, Human
ugggaggucgaggcggguggauc

SEQ ID NO: 61453 - RNA, 19 nt, Human
uggggauacgagagcuggg

SEQ ID NO: 61454 - RNA, 24 nt, Human
ugguagagguagcagugagccaag

SEQ ID NO: 61455 - RNA, 24 nt, Human
ugguaggcaccuguggucccagcu

SEQ ID NO: 61456 - RNA, 19 nt, Human
uggugaaaccccgucucua

SEQ ID NO: 61457 - RNA, 24 nt, Human
ugguggcucaugccuguaauccca

SEQ ID NO: 61458 - RNA, 24 nt, Human
uggugguaggcaccugugguccca

SEQ ID NO: 61459 - RNA, 21 nt, Human
ugucaagaaaagagagagaga

SEQ ID NO: 61460 - RNA, 18 nt, Human
ugugaccuuagacauuca

SEQ ID NO: 61461 - RNA, 19 nt, Human
ugugguggaaugcaccuga

SEQ ID NO: 61462 - RNA, 24 nt, Human
uuaaaaacaacaacaacaacaaaa

SEQ ID NO: 61463 - RNA, 25 nt, Human
uuaauccugaaaucuugaccucagu

SEQ ID NO: 61464 - RNA, 24 nt, Human
uuaccaccaucaacuaccucaacc

SEQ ID NO: 61465 - RNA, 18 nt, Human
uuagccagaugguguggc

SEQ ID NO: 61466 - RNA, 20 nt, Human
uugcaguaagccgagaucau

SEQ ID NO: 61467 - RNA, 24 nt, Human
uugcuuggacccaggagaaggagg

SEQ ID NO: 61468 - RNA, 19 nt, Human
uuggcuuuccccguuggag

SEQ ID NO: 61469 - RNA, 25 nt, Human
uugggaggccgaggcggguggauca

SEQ ID NO: 61470 - RNA, 23 nt, Human
uugggaggcugaggcaggagaau

SEQ ID NO: 61471 - RNA, 18 nt, Human
uuguggacagguauuauu

SEQ ID NO: 61472 - RNA, 19 nt, Human
uuuaccaccaucaacuacc

SEQ ID NO: 61473 - RNA, 18 nt, Human
uuuagcuacuuguugaaa

SEQ ID NO: 61474 - RNA, 22 nt, Human
uuuagcuacuuguugaaauuuu

SEQ ID NO: 61475 - RNA, 24 nt, Human
uuucaggcucaagcuaccuucuug

SEQ ID NO: 61476 - RNA, 21 nt, Human
uuucuacuaaaaauacaaaaa

SEQ ID NO: 61477 - RNA, 24 nt, Human
uuugcauaauauuuuggguuuucu

SEQ ID NO: 61478 - RNA, 22 nt, Human
uuuguuguggacagguauuauu

SEQ ID NO: 61479 - RNA, 20 nt, Human
ucugagcaccgggaaggggg

SEQ ID NO: 61480 - RNA, 19 nt, Human
agggacaggagcucuagga

SEQ ID NO: 61481 - RNA, 21 nt, Human
cagcgucucuguccuuggugu

SEQ ID NO: 61482 - RNA, 23 nt, Human
ggggagggcggccuagccagcgu

SEQ ID NO: 61483 - RNA, 19 nt, Human
guaacaguggggagggcgg

SEQ ID NO: 61484 - RNA, 20 nt, Human
uagcaaagaguggguaggga

SEQ ID NO: 61485 - RNA, 18 nt, Human
ucucuguccuuggugucu

SEQ ID NO: 61486 - RNA, 21 nt, Human
uggaagacaauggucuggaca

SEQ ID NO: 61487 - RNA, 18 nt, Human
ugggguuggaagacaaug

SEQ ID NO: 61488 - RNA, 20 nt, Human
uggguguucuagaggccagc

SEQ ID NO: 61489 - RNA, 23 nt, Human
uguagcaaagaguggguagggac

SEQ ID NO: 61490 - RNA, 18 nt, Human
uguccuuggugucugugc

SEQ ID NO: 61491 - RNA, 21 nt, Human
agacagacagguggcagggca

SEQ ID NO: 61492 - RNA, 19 nt, Human
agagagguccucaggagag

SEQ ID NO: 61493 - RNA, 19 nt, Human
agagguccucaggagagcu

SEQ ID NO: 61494 - RNA, 20 nt, Human
aggaguuucuugccacacug

SEQ ID NO: 61495 - RNA, 22 nt, Human
aggaguuucuugccacacugga

SEQ ID NO: 61496 - RNA, 19 nt, Human
aggggagcugacagagagg

SEQ ID NO: 61497 - RNA, 25 nt, Human
agguggcagggcagggcaggugucc

SEQ ID NO: 61498 - RNA, 21 nt, Human
auucucagcagcuuuauugaa

SEQ ID NO: 61499 - RNA, 22 nt, Human
cacacuggaugccucccuacaa

SEQ ID NO: 61500 - RNA, 22 nt, Human
caccugcgcugcagugggaacu

SEQ ID NO: 61501 - RNA, 19 nt, Human
cagacagguggcagggcag

SEQ ID NO: 61502 - RNA, 21 nt, Human
ccuacaaucaggggagcugac

SEQ ID NO: 61503 - RNA, 23 nt, Human
ccucccacuggacauguguccuc

SEQ ID NO: 61504 - RNA, 19 nt, Human
cucaccucccacuggacau

SEQ ID NO: 61505 - RNA, 22 nt, Human
gagagguggucucaccucccac

SEQ ID NO: 61506 - RNA, 20 nt, Human
gcuugcugggcuggaggagu

SEQ ID NO: 61507 - RNA, 22 nt, Human
ggacagacagacagguggcagg

SEQ ID NO: 61508 - RNA, 22 nt, Human
ggcuagauucucagcagcuuua

SEQ ID NO: 61509 - RNA, 18 nt, Human
ggcuggaggaguuucuug

SEQ ID NO: 61510 - RNA, 22 nt, Human
ucaccugcgcugcagugggaac

SEQ ID NO: 61511 - RNA, 21 nt, Human
ucaggagagcucaccugcgcu

SEQ ID NO: 61512 - RNA, 23 nt, Human
ugacagagagguccucaggagag

SEQ ID NO: 61513 - RNA, 24 nt, Human
ugacagagagguccucaggagagc

SEQ ID NO: 61514 - RNA, 21 nt, Human
ugagagguggucucaccuccc

SEQ ID NO: 61515 - RNA, 18 nt, Human
uggcagggcagggcaggu

SEQ ID NO: 61516 - RNA, 18 nt, Human
acacaauaaagacuccau

SEQ ID NO: 61517 - RNA, 18 nt, Human
agagaccuuccgagcccu

SEQ ID NO: 61518 - RNA, 18 nt, Human
agcggcagcaaccgagaa

SEQ ID NO: 61519 - RNA, 18 nt, Human
cagccccgcaggucccgg

SEQ ID NO: 61520 - RNA, 20 nt, Human
cagcggcagcaaccgagaag

SEQ ID NO: 61521 - RNA, 18 nt, Human
ccccgcaggucccggugg

SEQ ID NO: 61522 - RNA, 18 nt, Human
ccgagcccuggugccagc

SEQ ID NO: 61523 - RNA, 23 nt, Human
ccuccucccccaaguuuagcaaa

SEQ ID NO: 61524 - RNA, 26 nt, Human
ccuggccucggccucgcggcccuggc

SEQ ID NO: 61525 - RNA, 27 nt, Human
cggccucgcggcccuggcuggcugggc

SEQ ID NO: 61526 - RNA, 20 nt, Human
cggcuccugggcugcggccu

SEQ ID NO: 61527 - RNA, 28 nt, Human
cuccauuuauuuguuccuccucccccaa

SEQ ID NO: 61528 - RNA, 18 nt, Human
cuccugggcugcggccug

SEQ ID NO: 61529 - RNA, 23 nt, Human
cugggcugcggccuggccucggc

SEQ ID NO: 61530 - RNA, 20 nt, Human
gagaagggcacucagccccg

SEQ ID NO: 61531 - RNA, 18 nt, Human
gcccuggugccagcuuug

SEQ ID NO: 61532 - RNA, 22 nt, Human
gcccuggugccagcuuuggugc

SEQ ID NO: 61533 - RNA, 22 nt, Human
uaacuugcaaaaaaugccaucc

SEQ ID NO: 61534 - RNA, 24 nt, Human
uaacuugcaaaaaaugccauccuu

SEQ ID NO: 61535 - RNA, 18 nt, Human
ucaauuggaaaagaagaa

SEQ ID NO: 61536 - RNA, 21 nt, Human
uccugggcugcggccuggccu

SEQ ID NO: 61537 - RNA, 22 nt, Human
uccugggcugcggccuggccuc

SEQ ID NO: 61538 - RNA, 23 nt, Human
ugcagguccaguucauaugugcu

SEQ ID NO: 61539 - RNA, 20 nt, Human
uggcuggcugggcgggcucc

SEQ ID NO: 61540 - RNA, 23 nt, Human
uggcugggcgggcuccucagcgg

SEQ ID NO: 61541 - RNA, 20 nt, Human
uucagagaccuuccgagccc

SEQ ID NO: 61542 - RNA, 23 nt, Human
uuuaacuugcaaaaaaugccauc

SEQ ID NO: 61543 - RNA, 25 nt, Human
aagcgauccucccaccuuggccucc

SEQ ID NO: 61544 - RNA, 20 nt, Human
acccugagagguggucucag

SEQ ID NO: 61545 - RNA, 25 nt, Human
acccugagagguggucucagugggg

SEQ ID NO: 61546 - RNA, 27 nt, Human
caagcgauccucccaccuuggccuccc

SEQ ID NO: 61547 - RNA, 27 nt, Human
caagcgauccucccaccuuggccuccc

SEQ ID NO: 61548 - RNA, 19 nt, Human
cagcugacucaggcugggg

SEQ ID NO: 61549 - RNA, 18 nt, Human
caggcuggggaggaacca

SEQ ID NO: 61550 - RNA, 19 nt, Human
ccacaguggcagagggagc

SEQ ID NO: 61551 - RNA, 21 nt, Human
cccaccuuggccucccaaagc

SEQ ID NO: 61552 - RNA, 21 nt, Human
cccccgugcccagccuccuug

SEQ ID NO: 61553 - RNA, 24 nt, Human
ccucccaccuuggccucccaaagc

SEQ ID NO: 61554 - RNA, 20 nt, Human
ccuggucucaagcgauccuc

SEQ ID NO: 61555 - RNA, 24 nt, Human
cucaagcgauccucccaccuuggc

SEQ ID NO: 61556 - RNA, 27 nt, Human
cuccuggucucaagcgauccucccacc

SEQ ID NO: 61557 - RNA, 21 nt, Human
cuggucucgaacuccuggucu

SEQ ID NO: 61558 - RNA, 23 nt, Human
gaaccagggcaggcacccugaga

SEQ ID NO: 61559 - RNA, 19 nt, Human
gcagagggagcagggcuca

SEQ ID NO: 61560 - RNA, 19 nt, Human
gccucccaaagcucugggg

SEQ ID NO: 61561 - RNA, 24 nt, Human
gcuaugcugcccaggcuggucucg

SEQ ID NO: 61562 - RNA, 22 nt, Human
ggaucuugcuaugcugcccagg

SEQ ID NO: 61563 - RNA, 24 nt, Human
ggcuggucucgaacuccuggucuc

SEQ ID NO: 61564 - RNA, 20 nt, Human
gggagcagggcucaguggca

SEQ ID NO: 61565 - RNA, 24 nt, Human
ggggaucuugcuaugcugcccagg

SEQ ID NO: 61566 - RNA, 20 nt, Human
guggagaggauguguccaca

SEQ ID NO: 61567 - RNA, 19 nt, Human
guggcagagggagcagggc

SEQ ID NO: 61568 - RNA, 19 nt, Human
uacaucaagacacugaggc

SEQ ID NO: 61569 - RNA, 21 nt, Human
uacaucaagacacugaggccc

SEQ ID NO: 61570 - RNA, 21 nt, Human
uaugcugcccaggcuggucuc

SEQ ID NO: 61571 - RNA, 23 nt, Human
uaugcugcccaggcuggucucga

SEQ ID NO: 61572 - RNA, 24 nt, Human
uaugcugcccaggcuggucucgaa

SEQ ID NO: 61573 - RNA, 24 nt, Human
ucaagcgauccucccaccuuggcc

SEQ ID NO: 61574 - RNA, 19 nt, Human
ucaguggcauuggagcaag

SEQ ID NO: 61575 - RNA, 21 nt, Human
ucucgaacuccuggucucaag

SEQ ID NO: 61576 - RNA, 22 nt, Human
ucugguuuugccugcuccauga

SEQ ID NO: 61577 - RNA, 22 nt, Human
ucuugcuaugcugcccaggcug

SEQ ID NO: 61578 - RNA, 23 nt, Human
ucuugcuaugcugcccaggcugg

SEQ ID NO: 61579 - RNA, 24 nt, Human
ucuugcuaugcugcccaggcuggu

SEQ ID NO: 61580 - RNA, 24 nt, Human
ugagagguggucucagugggguag

SEQ ID NO: 61581 - RNA, 18 nt, Human
ugagcccccgugcccagc

SEQ ID NO: 61582 - RNA, 22 nt, Human
ugagcccccgugcccagccucc

SEQ ID NO: 61583 - RNA, 23 nt, Human
ugcccagccuccuugcaguccag

SEQ ID NO: 61584 - RNA, 24 nt, Human
ugcccaggcuggucucgaacuccu

SEQ ID NO: 61585 - RNA, 24 nt, Human
ugcuaugcugcccaggcuggucuc

SEQ ID NO: 61586 - RNA, 27 nt, Human
ugcuaugcugcccaggcuggucucgaa

SEQ ID NO: 61587 - RNA, 21 nt, Human
uggggaggaaccagggcaggc

SEQ ID NO: 61588 - RNA, 24 nt, Human
uggggugacaggcgugagcccccg

SEQ ID NO: 61589 - RNA, 25 nt, Human
uggggugacaggcgugagcccccgu

SEQ ID NO: 61590 - RNA, 18 nt, Human
ugguccaccagccugugu

SEQ ID NO: 61591 - RNA, 21 nt, Human
uuauuuuguuuuuaaaagaug

SEQ ID NO: 61592 - RNA, 24 nt, Human
uuggccucccaaagcucuggggug

SEQ ID NO: 61593 - RNA, 18 nt, Human
uuuuguuuuuaaaagaug

SEQ ID NO: 61594 - RNA, 18 nt, Human
uuuuuuuuuuuuuccuug

SEQ ID NO: 61595 - RNA, 21 nt, Human
acaaaauuccuccagcaguga

SEQ ID NO: 61596 - RNA, 20 nt, Human
agacuuagaauuaugcagug

SEQ ID NO: 61597 - RNA, 23 nt, Human
agggacuccaggacaagaaccag

SEQ ID NO: 61598 - RNA, 18 nt, Human
agggugccgacucagaaa

SEQ ID NO: 61599 - RNA, 21 nt, Human
augugccaaaaaagccgagcu

SEQ ID NO: 61600 - RNA, 24 nt, Human
cacagagguggguauuguggccag

SEQ ID NO: 61601 - RNA, 24 nt, Human
cacggaaucauccuauucaucucc

SEQ ID NO: 61602 - RNA, 22 nt, Human
cagguggguaguugacaaaauu

SEQ ID NO: 61603 - RNA, 21 nt, Human
cagugagcuucauccccaggu

SEQ ID NO: 61604 - RNA, 19 nt, Human
cauucacucuuuagugggu

SEQ ID NO: 61605 - RNA, 19 nt, Human
cauucacucuuuagugggu

SEQ ID NO: 61606 - RNA, 20 nt, Human
ccagcagugauaauacucug

SEQ ID NO: 61607 - RNA, 22 nt, Human
ccgauuuuguugauccaugugc

SEQ ID NO: 61608 - RNA, 24 nt, Human
cuagagucacaccagggugccgac

SEQ ID NO: 61609 - RNA, 18 nt, Human
gaucacuagagucacacc

SEQ ID NO: 61610 - RNA, 19 nt, Human
ggacaagaaccaggugaug

SEQ ID NO: 61611 - RNA, 19 nt, Human
uaaacaggguggaagacuu

SEQ ID NO: 61612 - RNA, 24 nt, Human
uaagaugauuuugccaucuucuug

SEQ ID NO: 61613 - RNA, 24 nt, Human
uacaacaucauccacagagguggg

SEQ ID NO: 61614 - RNA, 21 nt, Human
uauaaaauuaacuuccacgug

SEQ ID NO: 61615 - RNA, 25 nt, Human
uccuccagcagugauaauacucuga

SEQ ID NO: 61616 - RNA, 18 nt, Human
ucuaauagccugggagca

SEQ ID NO: 61617 - RNA, 18 nt, Human
ugauggaugggugaaaau

SEQ ID NO: 61618 - RNA, 19 nt, Human
ugccaaaaaagccgagcua

SEQ ID NO: 61619 - RNA, 20 nt, Human
ugccugagcuucgccagauc

SEQ ID NO: 61620 - RNA, 22 nt, Human
ugcucugucucuggacuuccuc

SEQ ID NO: 61621 - RNA, 18 nt, Human
uggaagacuuagaauuau

SEQ ID NO: 61622 - RNA, 22 nt, Human
uggaagacuuagaauuaugcag

SEQ ID NO: 61623 - RNA, 18 nt, Human
uugauccaugugccaaaa

SEQ ID NO: 61624 - RNA, 18 nt, Human
aggagucacugagggaga

SEQ ID NO: 61625 - RNA, 21 nt, Human
aggcaugucccagauggcugu

SEQ ID NO: 61626 - RNA, 22 nt, Human
aucuaaaccucgggucugaggc

SEQ ID NO: 61627 - RNA, 21 nt, Human
cacuuucguccuucccgagag

SEQ ID NO: 61628 - RNA, 23 nt, Human
cagcaggaauacgugaggcaaag

SEQ ID NO: 61629 - RNA, 21 nt, Human
cagcaugagaaguauauuuca

SEQ ID NO: 61630 - RNA, 21 nt, Human
cgggucugaggcuguuugugu

SEQ ID NO: 61631 - RNA, 20 nt, Human
gaggagagaggccgccggaa

SEQ ID NO: 61632 - RNA, 24 nt, Human
guuuuucuuuuuuuaaaaaaauac

SEQ ID NO: 61633 - RNA, 24 nt, Human
uaaaaaaauacccaacuuaacaua

SEQ ID NO: 61634 - RNA, 19 nt, Human
uaaauaaacuacagcauga

SEQ ID NO: 61635 - RNA, 21 nt, Human
uaggaagacaggcauguccca

SEQ ID NO: 61636 - RNA, 20 nt, Human
ucaaauguuguccagcucca

SEQ ID NO: 61637 - RNA, 19 nt, Human
ucacugagggagaggagag

SEQ ID NO: 61638 - RNA, 22 nt, Human
ucuaaaccucgggucugaggcu

SEQ ID NO: 61639 - RNA, 21 nt, Human
ucucuugguggcagcaggaau

SEQ ID NO: 61640 - RNA, 18 nt, Human
ucuuuuauuaauguugcu

SEQ ID NO: 61641 - RNA, 19 nt, Human
ugacuggagcccauguaug

SEQ ID NO: 61642 - RNA, 19 nt, Human
ugagggagaggagagaggc

SEQ ID NO: 61643 - RNA, 18 nt, Human
uguggcucaggagucacu

SEQ ID NO: 61644 - RNA, 21 nt, Human
uguugcuguuuuucuuuuuuu

SEQ ID NO: 61645 - RNA, 23 nt, Human
uugcauuucucuccuugcagguc

SEQ ID NO: 61646 - RNA, 21 nt, Human
uuucaaguccucuaagggccu

SEQ ID NO: 61647 - RNA, 18 nt, Human
agaaccaagagaggaagc

SEQ ID NO: 61648 - RNA, 24 nt, Human
agcuggagaugguggugaacggcu

SEQ ID NO: 61649 - RNA, 20 nt, Human
aguaguaguagaggcgggcg

SEQ ID NO: 61650 - RNA, 20 nt, Human
aguguuuguggaaacaauua

SEQ ID NO: 61651 - RNA, 23 nt, Human
cacagaaccaagagaggaagcac

SEQ ID NO: 61652 - RNA, 21 nt, Human
cacuucauagcacagccaagu

SEQ ID NO: 61653 - RNA, 21 nt, Human
cacuuguaagcaggcagcugg

SEQ ID NO: 61654 - RNA, 18 nt, Human
caggagcacauugcuuug

SEQ ID NO: 61655 - RNA, 21 nt, Human
caggagcacauugcuuugcug

SEQ ID NO: 61656 - RNA, 23 nt, Human
cauagcacagccaaguguagcuc

SEQ ID NO: 61657 - RNA, 18 nt, Human
caucggauuucugaucug

SEQ ID NO: 61658 - RNA, 24 nt, Human
cauugaaaacuauucugggaauau

SEQ ID NO: 61659 - RNA, 21 nt, Human
cgaaauacaccuggcucgaaa

SEQ ID NO: 61660 - RNA, 24 nt, Human
cgccacacaguccgggcagggggu

SEQ ID NO: 61661 - RNA, 20 nt, Human
cuccgaccauagaggauggg

SEQ ID NO: 61662 - RNA, 21 nt, Human
cucgaaagaccccuguguccc

SEQ ID NO: 61663 - RNA, 22 nt, Human
cucugccuuccuuagagacuga

SEQ ID NO: 61664 - RNA, 23 nt, Human
cuggagaugguggugaacggcuc

SEQ ID NO: 61665 - RNA, 24 nt, Human
cuggcucgaaauacaccuggccuc

SEQ ID NO: 61666 - RNA, 22 nt, Human
cuggugucugugagcagcugga

SEQ ID NO: 61667 - RNA, 18 nt, Human
cuugaucaggagcacauu

SEQ ID NO: 61668 - RNA, 21 nt, Human
cuugaucaggagcacauugcu

SEQ ID NO: 61669 - RNA, 19 nt, Human
gaaagaccccuguguccca

SEQ ID NO: 61670 - RNA, 21 nt, Human
gaaauacaccuggccucgaaa

SEQ ID NO: 61671 - RNA, 19 nt, Human
ggagcacauugcuuugcug

SEQ ID NO: 61672 - RNA, 19 nt, Human
ggccucgaaagaccccugu

SEQ ID NO: 61673 - RNA, 22 nt, Human
gggcuccugccugacucagccu

SEQ ID NO: 61674 - RNA, 20 nt, Human
guggauucauguucagccuc

SEQ ID NO: 61675 - RNA, 22 nt, Human
uacaccuggccucgaaagaccc

SEQ ID NO: 61676 - RNA, 22 nt, Human
uaguagaggcgggcggcggaga

SEQ ID NO: 61677 - RNA, 22 nt, Human
ucuuucccaguaguaguagagg

SEQ ID NO: 61678 - RNA, 18 nt, Human
ucuuuuauucugcugcuc

SEQ ID NO: 61679 - RNA, 20 nt, Human
uggugucugugagcagcugg

SEQ ID NO: 61680 - RNA, 24 nt, Human
uucacuucauagcacagccaagug

SEQ ID NO: 61681 - RNA, 21 nt, Human
uuuauuagucuaaauauggag

SEQ ID NO: 61682 - RNA, 22 nt, Human
aggauuuuuauugguggcaccu

SEQ ID NO: 61683 - RNA, 22 nt, Human
ccuugcuggagggcuugguugg

SEQ ID NO: 61684 - RNA, 20 nt, Human
gcaccuggggccacauggcg

SEQ ID NO: 61685 - RNA, 20 nt, Human
gggcacuccugaauccuugc

SEQ ID NO: 61686 - RNA, 18 nt, Human
ggggcacuccugaauccu

SEQ ID NO: 61687 - RNA, 22 nt, Human
guggcaccuggggccacauggc

SEQ ID NO: 61688 - RNA, 23 nt, Human
uggcaccuggggccacauggcgg

SEQ ID NO: 61689 - RNA, 18 nt, Human
uuucagaggccccuccug

SEQ ID NO: 61690 - RNA, 23 nt, Human
gacucuccccuuguccagggagc

SEQ ID NO: 61691 - RNA, 21 nt, Human
gcacagaaagaacuuggucag

SEQ ID NO: 61692 - RNA, 22 nt, Human
ggagcucagucugaaccugggg

SEQ ID NO: 61693 - RNA, 22 nt, Human
ggaggaggaugcaagagcuacu

SEQ ID NO: 61694 - RNA, 26 nt, Human
uaggggacucuccccuuguccagucu

SEQ ID NO: 61695 - RNA, 20 nt, Human
ugaaccugggggaucagggg

SEQ ID NO: 61696 - RNA, 19 nt, Human
aaggagcucgcaggaugga

SEQ ID NO: 61697 - RNA, 24 nt, Human
aaggagcucgcaggauggauaggc

SEQ ID NO: 61698 - RNA, 20 nt, Human
cagcaugccuggaggggggc

SEQ ID NO: 61699 - RNA, 23 nt, Human
cagcuuuauugggaggccagcau

SEQ ID NO: 61700 - RNA, 20 nt, Human
cuggagcagcugccucuagg

SEQ ID NO: 61701 - RNA, 21 nt, Human
gagcagcugccucuagggaug

SEQ ID NO: 61702 - RNA, 20 nt, Human
ggcagcccuggagauugcag

SEQ ID NO: 61703 - RNA, 21 nt, Human
uacugucccuuuuaagcaacc

SEQ ID NO: 61704 - RNA, 21 nt, Human
uagcagcuucuuguccagcuu

SEQ ID NO: 61705 - RNA, 19 nt, Human
ugagaauacugucccuuuu

SEQ ID NO: 61706 - RNA, 18 nt, Human
ugaggugggguaggagag

SEQ ID NO: 61707 - RNA, 20 nt, Human
ugccuggaggggggccaggc

SEQ ID NO: 61708 - RNA, 21 nt, Human
ugccuggaggggggccaggca

SEQ ID NO: 61709 - RNA, 23 nt, Human
uucuuguccagcuuuauugggag

SEQ ID NO: 61710 - RNA, 20 nt, Human
accucagccuccugaguagc

SEQ ID NO: 61711 - RNA, 22 nt, Human
agaucucgcuguguugcccagg

SEQ ID NO: 61712 - RNA, 22 nt, Human
aggcacccgccacaaccacacc

SEQ ID NO: 61713 - RNA, 18 nt, Human
aguagcugggacuacagg

SEQ ID NO: 61714 - RNA, 19 nt, Human
aguagcugggacuacaggc

SEQ ID NO: 61715 - RNA, 18 nt, Human
caagagaucucgcugugu

SEQ ID NO: 61716 - RNA, 20 nt, Human
cagccuccugaguagcuggg

SEQ ID NO: 61717 - RNA, 19 nt, Human
caggcacccgccacaacca

SEQ ID NO: 61718 - RNA, 20 nt, Human
caggcacccgccacaaccac

SEQ ID NO: 61719 - RNA, 24 nt, Human
cauccuaccucagccuccugagua

SEQ ID NO: 61720 - RNA, 23 nt, Human
cccgccacaaccacaccuggcuu

SEQ ID NO: 61721 - RNA, 24 nt, Human
ccuaccucagccuccugaguagcu

SEQ ID NO: 61722 - RNA, 20 nt, Human
ccucugucccucugugcuca

SEQ ID NO: 61723 - RNA, 23 nt, Human
ccugaguagcugggacuacaggc

SEQ ID NO: 61724 - RNA, 24 nt, Human
ccugaguagcugggacuacaggca

SEQ ID NO: 61725 - RNA, 20 nt, Human
cgaacuccugggcucaagcc

SEQ ID NO: 61726 - RNA, 24 nt, Human
cgccacaaccacaccuggcuuuua

SEQ ID NO: 61727 - RNA, 24 nt, Human
cucagccuccugaguagcugggac

SEQ ID NO: 61728 - RNA, 22 nt, Human
cuuuuuguuuuacccccaagag

SEQ ID NO: 61729 - RNA, 25 nt, Human
gaguagcugggacuacaggcacccg

SEQ ID NO: 61730 - RNA, 24 nt, Human
gcuguguugcccaggcuggucucg

SEQ ID NO: 61731 - RNA, 24 nt, Human
uaccucagccuccugaguagcugg

SEQ ID NO: 61732 - RNA, 23 nt, Human
ucagccuccugaguagcugggac

SEQ ID NO: 61733 - RNA, 18 nt, Human
uccgugccucugucccuc

SEQ ID NO: 61734 - RNA, 24 nt, Human
uccugaguagcugggacuacaggc

SEQ ID NO: 61735 - RNA, 18 nt, Human
uccugggcucaagccauc

SEQ ID NO: 61736 - RNA, 18 nt, Human
uccugggcucaagccauc

SEQ ID NO: 61737 - RNA, 23 nt, Human
ucucgaacuccugggcucaagcc

SEQ ID NO: 61738 - RNA, 19 nt, Human
ucucgcuguguugcccagg

SEQ ID NO: 61739 - RNA, 23 nt, Human
ucucgcuguguugcccaggcugg

SEQ ID NO: 61740 - RNA, 24 nt, Human
ucucgcuguguugcccaggcuggu

SEQ ID NO: 61741 - RNA, 26 nt, Human
ucucgcuguguugcccaggcuggucu

SEQ ID NO: 61742 - RNA, 27 nt, Human
ucucgcuguguugcccaggcuggucuc

SEQ ID NO: 61743 - RNA, 24 nt, Human
ugcccaggcuggucucgaacuccu

SEQ ID NO: 61744 - RNA, 28 nt, Human
ugcccaggcuggucucgaacuccugggc

SEQ ID NO: 61745 - RNA, 21 nt, Human
ugggacuacaggcacccgcca

SEQ ID NO: 61746 - RNA, 22 nt, Human
ugggacuacaggcacccgccac

SEQ ID NO: 61747 - RNA, 27 nt, Human
ugggacuacaggcacccgccacaacca

SEQ ID NO: 61748 - RNA, 24 nt, Human
uguguugcccaggcuggucucgaa

SEQ ID NO: 61749 - RNA, 19 nt, Human
uguugcccaggcuggucuc

SEQ ID NO: 61750 - RNA, 19 nt, Human
uguugcccaggcuggucuc

SEQ ID NO: 61751 - RNA, 22 nt, Human
uguugcccaggcuggucucgaa

SEQ ID NO: 61752 - RNA, 20 nt, Human
uuuucuuuuuguuuuacccc

SEQ ID NO: 61753 - RNA, 21 nt, Human
uuuuuuuuuucuuuuuguuuu

SEQ ID NO: 61754 - RNA, 18 nt, Human
accuggagcuuuucuuuc

SEQ ID NO: 61755 - RNA, 18 nt, Human
caacuuccuuugucgugg

SEQ ID NO: 61756 - RNA, 23 nt, Human
cuuggggcuggguggcuggagaa

SEQ ID NO: 61757 - RNA, 20 nt, Human
gcuggguggcuggagaaggg

SEQ ID NO: 61758 - RNA, 22 nt, Human
ggcuggagaagggaccuggagc

SEQ ID NO: 61759 - RNA, 21 nt, Human
uagggcaugguuacauguuua

SEQ ID NO: 61760 - RNA, 20 nt, Human
uggcuggagaagggaccugg

SEQ ID NO: 61761 - RNA, 21 nt, Human
ugggggggggugggguagggg

SEQ ID NO: 61762 - RNA, 26 nt, Human
ugggggggggugggguaggggaaagc

SEQ ID NO: 61763 - RNA, 23 nt, Human
ugucgugguugauugguuugucu

SEQ ID NO: 61764 - RNA, 19 nt, Human
uuggggcuggguggcugga

SEQ ID NO: 61765 - RNA, 20 nt, Human
uuugucuuuauggggggggg

SEQ ID NO: 61766 - RNA, 21 nt, Human
aggguccaccccaggaggacg

SEQ ID NO: 61767 - RNA, 23 nt, Human
aggguccaccccaggaggacggc

SEQ ID NO: 61768 - RNA, 22 nt, Human
cgcugcaggcugcgcggaggca

SEQ ID NO: 61769 - RNA, 25 nt, Human
cucccgcugcaggcugcgcggaggc

SEQ ID NO: 61770 - RNA, 19 nt, Human
gaggcacgggguggcgugg

SEQ ID NO: 61771 - RNA, 22 nt, Human
ggaggcacgggguggcgugggg

SEQ ID NO: 61772 - RNA, 18 nt, Human
ggcguggggucgcauggc

SEQ ID NO: 61773 - RNA, 23 nt, Human
ggcuggggcggggacagggucuc

SEQ ID NO: 61774 - RNA, 23 nt, Human
gggguggcguggggucgcauggc

SEQ ID NO: 61775 - RNA, 24 nt, Human
uccaccccaggaggacggcugggg

SEQ ID NO: 61776 - RNA, 24 nt, Human
ucccgcugcaggcugcgcggaggc

SEQ ID NO: 61777 - RNA, 21 nt, Human
ugagucacacuggcacuacca

SEQ ID NO: 61778 - RNA, 21 nt, Human
uggaugaacaagaaacaagug

SEQ ID NO: 61779 - RNA, 18 nt, Human
uguggaugagucacacug

SEQ ID NO: 61780 - RNA, 22 nt, Human
uuuugcggcaauaaauucagua

SEQ ID NO: 61781 - RNA, 18 nt, Human
aaaauuagcugggcaugg

SEQ ID NO: 61782 - RNA, 19 nt, Human
aaagugcucggauuacagg

SEQ ID NO: 61783 - RNA, 24 nt, Human
aaagugcucggauuacaggcauga

SEQ ID NO: 61784 - RNA, 19 nt, Human
aacauggugaaaccccauc

SEQ ID NO: 61785 - RNA, 20 nt, Human
aacauggugaaaccccaucu

SEQ ID NO: 61786 - RNA, 21 nt, Human
aacauggugaaaccccaucuc

SEQ ID NO: 61787 - RNA, 21 nt, Human
aacauggugaaaccccaucuc

SEQ ID NO: 61788 - RNA, 23 nt, Human
aacugcuucuucccauuccccac

SEQ ID NO: 61789 - RNA, 21 nt, Human
aagacagcucuagagaucuga

SEQ ID NO: 61790 - RNA, 22 nt, Human
aagcgauggcucacgccuguaa

SEQ ID NO: 61791 - RNA, 20 nt, Human
aagucccuaacacucaguuc

SEQ ID NO: 61792 - RNA, 24 nt, Human
aaucgcuugaacacgggaggcaga

SEQ ID NO: 61793 - RNA, 24 nt, Human
acagagcaagacucugucucagaa

SEQ ID NO: 61794 - RNA, 23 nt, Human
accaccugcccuucaguguucaa

SEQ ID NO: 61795 - RNA, 19 nt, Human
acccaggcuggagugcagu

SEQ ID NO: 61796 - RNA, 24 nt, Human
accccaucucuauuaaaaauacaa

SEQ ID NO: 61797 - RNA, 25 nt, Human
accucccagguucacgccauucucc

SEQ ID NO: 61798 - RNA, 24 nt, Human
accucgugauccgcccgccuuggc

SEQ ID NO: 61799 - RNA, 18 nt, Human
acgggguuucacuguguu

SEQ ID NO: 61800 - RNA, 19 nt, Human
acgggguuucacuguguua

SEQ ID NO: 61801 - RNA, 20 nt, Human
acgggguuucacuguguuag

SEQ ID NO: 61802 - RNA, 24 nt, Human
acgggguuucacuguguuagccag

SEQ ID NO: 61803 - RNA, 21 nt, Human
acuacacccggccccccaaua

SEQ ID NO: 61804 - RNA, 20 nt, Human
acugcaagcuccaccuccca

SEQ ID NO: 61805 - RNA, 18 nt, Human
agagaucugagcuuccuc

SEQ ID NO: 61806 - RNA, 18 nt, Human
agagcuugcagugagcug

SEQ ID NO: 61807 - RNA, 24 nt, Human
agagcuugcagugagcugagaucg

SEQ ID NO: 61808 - RNA, 24 nt, Human
agcacuuugggaggccaagguggg

SEQ ID NO: 61809 - RNA, 23 nt, Human
agcugggcauggugguaggcgcc

SEQ ID NO: 61810 - RNA, 20 nt, Human
aggcagagcuugcagugagc

SEQ ID NO: 61811 - RNA, 24 nt, Human
aggcagagcuugcagugagcugag

SEQ ID NO: 61812 - RNA, 21 nt, Human
aggcaggagaaucgcuugaac

SEQ ID NO: 61813 - RNA, 24 nt, Human
aggcaggagaaucgcuugaacacg

SEQ ID NO: 61814 - RNA, 18 nt, Human
aggccaaggugggcagau

SEQ ID NO: 61815 - RNA, 25 nt, Human
aggcuggagugcaguggcgauaucu

SEQ ID NO: 61816 - RNA, 24 nt, Human
aggugggcagaucaagaggucagg

SEQ ID NO: 61817 - RNA, 23 nt, Human
agugcaguggcgauaucucggcu

SEQ ID NO: 61818 - RNA, 24 nt, Human
agugcaguggcgauaucucggcuc

SEQ ID NO: 61819 - RNA, 21 nt, Human
aguggagccgcuguuucuucu

SEQ ID NO: 61820 - RNA, 22 nt, Human
aucccagcacuuugggaggcca

SEQ ID NO: 61821 - RNA, 19 nt, Human
auccgcccgccuuggccuc

SEQ ID NO: 61822 - RNA, 21 nt, Human
auccuggccaacauggugaaa

SEQ ID NO: 61823 - RNA, 24 nt, Human
aucgcaccauugcacuccaacuug

SEQ ID NO: 61824 - RNA, 20 nt, Human
aucugcauuaaccccucccc

SEQ ID NO: 61825 - RNA, 21 nt, Human
augaguaggugaguuuauugg

SEQ ID NO: 61826 - RNA, 23 nt, Human
auggcucacgccuguaaucccag

SEQ ID NO: 61827 - RNA, 23 nt, Human
auguuccugccuucuccuugcug

SEQ ID NO: 61828 - RNA, 23 nt, Human
auugcacuccaacuuggcgacag

SEQ ID NO: 61829 - RNA, 24 nt, Human
caaagugcucggauuacaggcaug

SEQ ID NO: 61830 - RNA, 24 nt, Human
caacauggugaaaccccaucucua

SEQ ID NO: 61831 - RNA, 22 nt, Human
caagacagcucuagagaucuga

SEQ ID NO: 61832 - RNA, 23 nt, Human
caagacucugucucagaaaaaaa

SEQ ID NO: 61833 - RNA, 23 nt, Human
caaggcaggagaaucgcuugaac

SEQ ID NO: 61834 - RNA, 22 nt, Human
caaggugggcagaucaagaggu

SEQ ID NO: 61835 - RNA, 24 nt, Human
caaggugggcagaucaagagguca

SEQ ID NO: 61836 - RNA, 19 nt, Human
cacacaggucaauccuggg

SEQ ID NO: 61837 - RNA, 24 nt, Human
caccauugcacuccaacuuggcga

SEQ ID NO: 61838 - RNA, 24 nt, Human
cacccaggcuggagugcaguggcg

SEQ ID NO: 61839 - RNA, 22 nt, Human
cacgccauucuccugccucagc

SEQ ID NO: 61840 - RNA, 24 nt, Human
cacgccuguaaucccagcacuuug

SEQ ID NO: 61841 - RNA, 22 nt, Human
cacuccaacuuggcgacagagc

SEQ ID NO: 61842 - RNA, 21 nt, Human
cacugcaagcuccaccuccca

SEQ ID NO: 61843 - RNA, 18 nt, Human
cacuguguuagccaggau

SEQ ID NO: 61844 - RNA, 19 nt, Human
cacuguguuagccaggaug

SEQ ID NO: 61845 - RNA, 24 nt, Human
cacuguguuagccaggauggucuc

SEQ ID NO: 61846 - RNA, 24 nt, Human
cagcacuuugggaggccaaggugg

SEQ ID NO: 61847 - RNA, 23 nt, Human
caguccccaagauauaccgagga

SEQ ID NO: 61848 - RNA, 21 nt, Human
caugacaaccaccccaaugac

SEQ ID NO: 61849 - RNA, 22 nt, Human
caugacaaccaccccaaugacc

SEQ ID NO: 61850 - RNA, 23 nt, Human
caugacaaccaccccaaugacca

SEQ ID NO: 61851 - RNA, 22 nt, Human
cauggugguaggcgccuguagu

SEQ ID NO: 61852 - RNA, 18 nt, Human
cauugcacuccaacuugg

SEQ ID NO: 61853 - RNA, 21 nt, Human
cauugcacuccaacuuggcga

SEQ ID NO: 61854 - RNA, 23 nt, Human
cauugcacuccaacuuggcgaca

SEQ ID NO: 61855 - RNA, 19 nt, Human
ccaaagugcucggauuaca

SEQ ID NO: 61856 - RNA, 24 nt, Human
ccaaagugcucggauuacaggcau

SEQ ID NO: 61857 - RNA, 21 nt, Human
ccaggcauaucucuccuggug

SEQ ID NO: 61858 - RNA, 19 nt, Human
ccauugcacuccaacuugg

SEQ ID NO: 61859 - RNA, 22 nt, Human
ccauugcacuccaacuuggcga

SEQ ID NO: 61860 - RNA, 23 nt, Human
ccauugcacuccaacuuggcgac

SEQ ID NO: 61861 - RNA, 20 nt, Human
cccaaugcuaaacugcuuuc

SEQ ID NO: 61862 - RNA, 20 nt, Human
cccagguucacgccauucuc

SEQ ID NO: 61863 - RNA, 21 nt, Human
ccccaagauauaccgaggaau

SEQ ID NO: 61864 - RNA, 24 nt, Human
ccccaaugaccaucaucaggaagc

SEQ ID NO: 61865 - RNA, 19 nt, Human
cccccaggaggacaaggga

SEQ ID NO: 61866 - RNA, 22 nt, Human
ccccugccaggcauaucucucc

SEQ ID NO: 61867 - RNA, 22 nt, Human
cccgccuuggccucccaaagug

SEQ ID NO: 61868 - RNA, 24 nt, Human
ccgcccaguuagcuggaacuacag

SEQ ID NO: 61869 - RNA, 18 nt, Human
ccucacccucuuuauccc

SEQ ID NO: 61870 - RNA, 19 nt, Human
ccugcugugcucagcuaug

SEQ ID NO: 61871 - RNA, 22 nt, Human
ccuggccaacauggugaaaccc

SEQ ID NO: 61872 - RNA, 23 nt, Human
ccuggccaacauggugaaacccc

SEQ ID NO: 61873 - RNA, 24 nt, Human
ccuggccaacauggugaaacccca

SEQ ID NO: 61874 - RNA, 20 nt, Human
ccugguggcugcccugcccu

SEQ ID NO: 61875 - RNA, 22 nt, Human
ccuguaaucccagcacuuuggg

SEQ ID NO: 61876 - RNA, 18 nt, Human
ccuguagucccagcuacu

SEQ ID NO: 61877 - RNA, 21 nt, Human
ccuguagucccagcuacuugg

SEQ ID NO: 61878 - RNA, 24 nt, Human
cgagaccauccuggccaacauggu

SEQ ID NO: 61879 - RNA, 23 nt, Human
cgccuguaaucccagcacuuugg

SEQ ID NO: 61880 - RNA, 24 nt, Human
cgccuguagucccagcuacuuggg

SEQ ID NO: 61881 - RNA, 24 nt, Human
cgcucugucacccaggcuggagug

SEQ ID NO: 61882 - RNA, 20 nt, Human
cggauuacaggcaugagcca

SEQ ID NO: 61883 - RNA, 23 nt, Human
cggauuacaggcaugagccacua

SEQ ID NO: 61884 - RNA, 20 nt, Human
cggccccccaauauauucuu

SEQ ID NO: 61885 - RNA, 22 nt, Human
cggcgacaagacagcucuagag

SEQ ID NO: 61886 - RNA, 21 nt, Human
cgggaggcagagcuugcagug

SEQ ID NO: 61887 - RNA, 24 nt, Human
cgggguuucacuguguuagccagg

SEQ ID NO: 61888 - RNA, 22 nt, Human
cucacgccuguaaucccagcac

SEQ ID NO: 61889 - RNA, 24 nt, Human
cucacgccuguaaucccagcacuu

SEQ ID NO: 61890 - RNA, 24 nt, Human
cucacugcaagcuccaccucccag

SEQ ID NO: 61891 - RNA, 19 nt, Human
cuccauuuucagcucuuuc

SEQ ID NO: 61892 - RNA, 24 nt, Human
cuccugaccucgugauccgcccgc

SEQ ID NO: 61893 - RNA, 21 nt, Human
cucgcucugucacccaggcug

SEQ ID NO: 61894 - RNA, 24 nt, Human
cucgcucugucacccaggcuggag

SEQ ID NO: 61895 - RNA, 20 nt, Human
cucggauuacaggcaugagc

SEQ ID NO: 61896 - RNA, 20 nt, Human
cucuauuaaaaauacaaaaa

SEQ ID NO: 61897 - RNA, 20 nt, Human
cucuuuaucccccuaauaaa

SEQ ID NO: 61898 - RNA, 24 nt, Human
cugcaagcuccaccucccagguuc

SEQ ID NO: 61899 - RNA, 23 nt, Human
cuggccaacauggugaaacccca

SEQ ID NO: 61900 - RNA, 19 nt, Human
cuugcagugagcugagauc

SEQ ID NO: 61901 - RNA, 21 nt, Human
cuugcagugagcugagaucgc

SEQ ID NO: 61902 - RNA, 21 nt, Human
cuuggcgacagagcaagacuc

SEQ ID NO: 61903 - RNA, 23 nt, Human
cuuuuuuuuuuuuuuuuugagau

SEQ ID NO: 61904 - RNA, 19 nt, Human
gacaaccaccccaaugacc

SEQ ID NO: 61905 - RNA, 24 nt, Human
gacaagggagaguggaugcuggaa

SEQ ID NO: 61906 - RNA, 24 nt, Human
gacagagcaagacucugucucaga

SEQ ID NO: 61907 - RNA, 19 nt, Human
gacauugaaccuggggcug

SEQ ID NO: 61908 - RNA, 21 nt, Human
gaccauggccauggcccacca

SEQ ID NO: 61909 - RNA, 20 nt, Human
gaccucgugauccgcccgcc

SEQ ID NO: 61910 - RNA, 21 nt, Human
gaccucgugauccgcccgccu

SEQ ID NO: 61911 - RNA, 24 nt, Human
gaccucgugauccgcccgccuugg

SEQ ID NO: 61912 - RNA, 18 nt, Human
gacucugucucagaaaaa

SEQ ID NO: 61913 - RNA, 23 nt, Human
gagaaucgcuugaacacgggagg

SEQ ID NO: 61914 - RNA, 23 nt, Human
gagccacuacacccggcccccca

SEQ ID NO: 61915 - RNA, 19 nt, Human
gagccgcuguuucuucucc

SEQ ID NO: 61916 - RNA, 22 nt, Human
gaggcagagcuugcagugagcu

SEQ ID NO: 61917 - RNA, 18 nt, Human
gauuacaggcaugagcca

SEQ ID NO: 61918 - RNA, 21 nt, Human
gauuacaggcaugagccacua

SEQ ID NO: 61919 - RNA, 22 nt, Human
gauuacaggcaugagccacuac

SEQ ID NO: 61920 - RNA, 22 nt, Human
gcaagcuccaccucccagguuc

SEQ ID NO: 61921 - RNA, 20 nt, Human
gcacuuugggaggccaaggu

SEQ ID NO: 61922 - RNA, 20 nt, Human
gcagggccuccuccaaggaa

SEQ ID NO: 61923 - RNA, 24 nt, Human
gccaacauggugaaaccccaucuc

SEQ ID NO: 61924 - RNA, 20 nt, Human
gcccccaggaggacaaggga

SEQ ID NO: 61925 - RNA, 23 nt, Human
gcccggcuaauuuuuuguauuuu

SEQ ID NO: 61926 - RNA, 19 nt, Human
gcucuagagaucugagcuu

SEQ ID NO: 61927 - RNA, 25 nt, Human
gcucugucacccaggcuggagugca

SEQ ID NO: 61928 - RNA, 20 nt, Human
gcuggagugcaguggcgaua

SEQ ID NO: 61929 - RNA, 24 nt, Human
ggauggucucgaucuccugaccuc

SEQ ID NO: 61930 - RNA, 19 nt, Human
ggauuacaggcaugagcca

SEQ ID NO: 61931 - RNA, 20 nt, Human
ggauuacaggcaugagccac

SEQ ID NO: 61932 - RNA, 24 nt, Human
ggauuacaggcaugagccacuaca

SEQ ID NO: 61933 - RNA, 21 nt, Human
ggcagaucaagaggucaggag

SEQ ID NO: 61934 - RNA, 22 nt, Human
ggcauggugguaggcgccugua

SEQ ID NO: 61935 - RNA, 21 nt, Human
ggccccugccaggcauaucuc

SEQ ID NO: 61936 - RNA, 22 nt, Human
ggcgacaagacagcucuagaga

SEQ ID NO: 61937 - RNA, 21 nt, Human
ggcucacgccuguaaucccag

SEQ ID NO: 61938 - RNA, 21 nt, Human
gggaaguuuggguucucaggg

SEQ ID NO: 61939 - RNA, 23 nt, Human
gggacaugcacccuuuaguaacc

SEQ ID NO: 61940 - RNA, 24 nt, Human
gggcugggucuguaguggagccgc

SEQ ID NO: 61941 - RNA, 23 nt, Human
gggguuucacuguguuagccagg

SEQ ID NO: 61942 - RNA, 23 nt, Human
guagagacgggguuucacugugu

SEQ ID NO: 61943 - RNA, 19 nt, Human
gucaaaagcgauggcucac

SEQ ID NO: 61944 - RNA, 22 nt, Human
gucccagcuacuugggaggcca

SEQ ID NO: 61945 - RNA, 23 nt, Human
gugguaggcgccuguagucccag

SEQ ID NO: 61946 - RNA, 19 nt, Human
uaaccagacagguccucca

SEQ ID NO: 61947 - RNA, 27 nt, Human
uaaccagacagguccuccaguccccaa

SEQ ID NO: 61948 - RNA, 24 nt, Human
uaauaaccagacagguccuccagu

SEQ ID NO: 61949 - RNA, 24 nt, Human
uaauuuuuuguauuuuuaguagag

SEQ ID NO: 61950 - RNA, 25 nt, Human
uaauuuuuuguauuuuuaguagaga

SEQ ID NO: 61951 - RNA, 23 nt, Human
uacaggcaugagccacuacaccc

SEQ ID NO: 61952 - RNA, 20 nt, Human
uagcuggaacuacaggcgcc

SEQ ID NO: 61953 - RNA, 18 nt, Human
uaguaaccuggaggggac

SEQ ID NO: 61954 - RNA, 20 nt, Human
uaguagagacgggguuucac

SEQ ID NO: 61955 - RNA, 24 nt, Human
uaguagagacgggguuucacugug

SEQ ID NO: 61956 - RNA, 24 nt, Human
ucaagaggucaggagaucgagacc

SEQ ID NO: 61957 - RNA, 25 nt, Human
ucaagaggucaggagaucgagaccc

SEQ ID NO: 61958 - RNA, 22 nt, Human
ucacccaggcuggagugcagug

SEQ ID NO: 61959 - RNA, 19 nt, Human
ucacugcaagcuccaccuc

SEQ ID NO: 61960 - RNA, 24 nt, Human
ucacugcaagcuccaccucccagg

SEQ ID NO: 61961 - RNA, 24 nt, Human
ucacuguguuagccaggauggucu

SEQ ID NO: 61962 - RNA, 19 nt, Human
uccaaggaaucuuccccug

SEQ ID NO: 61963 - RNA, 24 nt, Human
ucccaaagugcucggauuacaggc

SEQ ID NO: 61964 - RNA, 19 nt, Human
ucccagguucacgccauuc

SEQ ID NO: 61965 - RNA, 20 nt, Human
ucccagguucacgccauucu

SEQ ID NO: 61966 - RNA, 21 nt, Human
ucccagguucacgccauucuc

SEQ ID NO: 61967 - RNA, 24 nt, Human
ucccagguucacgccauucuccug

SEQ ID NO: 61968 - RNA, 22 nt, Human
ucccauuccccacacucuccag

SEQ ID NO: 61969 - RNA, 22 nt, Human
uccccacacucuccaguuccca

SEQ ID NO: 61970 - RNA, 18 nt, Human
uccccuggcagagacuga

SEQ ID NO: 61971 - RNA, 20 nt, Human
uccucucuauucuuccguca

SEQ ID NO: 61972 - RNA, 23 nt, Human
ucgcaccauugcacuccaacuug

SEQ ID NO: 61973 - RNA, 24 nt, Human
ucgcucugucacccaggcuggagu

SEQ ID NO: 61974 - RNA, 18 nt, Human
ucggauuacaggcaugag

SEQ ID NO: 61975 - RNA, 22 nt, Human
ucggauuacaggcaugagccac

SEQ ID NO: 61976 - RNA, 24 nt, Human
ucggauuacaggcaugagccacua

SEQ ID NO: 61977 - RNA, 22 nt, Human
ucucacauacucucugggaagu

SEQ ID NO: 61978 - RNA, 19 nt, Human
ucucagaaaaaaaaaaaag

SEQ ID NO: 61979 - RNA, 19 nt, Human
ucucgcucugucacccagg

SEQ ID NO: 61980 - RNA, 23 nt, Human
ucucgcucugucacccaggcugg

SEQ ID NO: 61981 - RNA, 24 nt, Human
ucucgcucugucacccaggcugga

SEQ ID NO: 61982 - RNA, 26 nt, Human
ucucgcucugucacccaggcuggagu

SEQ ID NO: 61983 - RNA, 27 nt, Human
ucucgcucugucacccaggcuggagug

SEQ ID NO: 61984 - RNA, 23 nt, Human
ucucuauuaaaaauacaaaaauu

SEQ ID NO: 61985 - RNA, 24 nt, Human
ucugucacccaggcuggagugcag

SEQ ID NO: 61986 - RNA, 22 nt, Human
ucugucucagaaaaaaaaaaaa

SEQ ID NO: 61987 - RNA, 20 nt, Human
ucuuucuuuuccuggccuuc

SEQ ID NO: 61988 - RNA, 18 nt, Human
ucuuuuuuuuuuuuuuuu

SEQ ID NO: 61989 - RNA, 22 nt, Human
ugacaaccaccccaaugaccau

SEQ ID NO: 61990 - RNA, 22 nt, Human
ugagauggagucucgcucuguc

SEQ ID NO: 61991 - RNA, 22 nt, Human
ugagcugagaucgcaccauugc

SEQ ID NO: 61992 - RNA, 23 nt, Human
ugaugaguaggugaguuuauugg

SEQ ID NO: 61993 - RNA, 19 nt, Human
ugcaagcuccaccucccag

SEQ ID NO: 61994 - RNA, 21 nt, Human
ugcacuccaacuuggcgacag

SEQ ID NO: 61995 - RNA, 23 nt, Human
ugcacuccaacuuggcgacagag

SEQ ID NO: 61996 - RNA, 23 nt, Human
ugcacugccaucugcauuaaccc

SEQ ID NO: 61997 - RNA, 24 nt, Human
ugcacugccaucugcauuaacccu

SEQ ID NO: 61998 - RNA, 22 nt, Human
ugcaguggcgauaucucggcuc

SEQ ID NO: 61999 - RNA, 21 nt, Human
ugccaaagucccuaacacuca

SEQ ID NO: 62000 - RNA, 25 nt, Human
ugcccggcuaauuuuuuguauuuuu

SEQ ID NO: 62001 - RNA, 21 nt, Human
ugccucagccgcccaguuagc

SEQ ID NO: 62002 - RNA, 24 nt, Human
ugccucagccgcccaguuagcugg

SEQ ID NO: 62003 - RNA, 21 nt, Human
uggaacuacaggcgcccgcca

SEQ ID NO: 62004 - RNA, 24 nt, Human
uggaacuacaggcgcccgccacca

SEQ ID NO: 62005 - RNA, 20 nt, Human
uggagugcaguggcgauauc

SEQ ID NO: 62006 - RNA, 23 nt, Human
uggagugcaguggcgauaucucg

SEQ ID NO: 62007 - RNA, 24 nt, Human
uggagugcaguggcgauaucucgg

SEQ ID NO: 62008 - RNA, 22 nt, Human
uggaucccaccuccaguuaugc

SEQ ID NO: 62009 - RNA, 24 nt, Human
uggccaacauggugaaaccccauc

SEQ ID NO: 62010 - RNA, 24 nt, Human
uggcucacgccuguaaucccagca

SEQ ID NO: 62011 - RNA, 20 nt, Human
ugggaggccaaggugggcag

SEQ ID NO: 62012 - RNA, 24 nt, Human
ugggaggccaaggugggcagauca

SEQ ID NO: 62013 - RNA, 22 nt, Human
ugggcagaucaagaggucagga

SEQ ID NO: 62014 - RNA, 24 nt, Human
uggugguaggcgccuguaguccca

SEQ ID NO: 62015 - RNA, 21 nt, Human
uguauuuuuaguagagacggg

SEQ ID NO: 62016 - RNA, 20 nt, Human
uguggaucccaccuccaguu

SEQ ID NO: 62017 - RNA, 18 nt, Human
uuagcugggcaugguggu

SEQ ID NO: 62018 - RNA, 24 nt, Human
uuagcugggcauggugguaggcgc

SEQ ID NO: 62019 - RNA, 18 nt, Human
uuaguagagacgggguuu

SEQ ID NO: 62020 - RNA, 21 nt, Human
uuaguagagacgggguuucac

SEQ ID NO: 62021 - RNA, 21 nt, Human
uuaguagagacgggguuucac

SEQ ID NO: 62022 - RNA, 24 nt, Human
uuaguagagacgggguuucacugu

SEQ ID NO: 62023 - RNA, 21 nt, Human
uucacuguguuagccaggaug

SEQ ID NO: 62024 - RNA, 21 nt, Human
uugcaggcuccaauguuccug

SEQ ID NO: 62025 - RNA, 18 nt, Human
uugcagugagcugagauc

SEQ ID NO: 62026 - RNA, 19 nt, Human
uugcagugagcugagaucg

SEQ ID NO: 62027 - RNA, 22 nt, Human
uugcagugagcugagaucgcac

SEQ ID NO: 62028 - RNA, 19 nt, Human
uuucacuguguuagccagg

SEQ ID NO: 62029 - RNA, 19 nt, Human
uuuccuggccuucucauug

SEQ ID NO: 62030 - RNA, 24 nt, Human
uuuuuaguagagacgggguuucac

SEQ ID NO: 62031 - RNA, 21 nt, Human
uuuuuguauuuuuaguagaga

SEQ ID NO: 62032 - RNA, 24 nt, Human
uuuuuuguauuuuuaguagagacg

SEQ ID NO: 62033 - RNA, 25 nt, Human
uuuuuuuuuuuugagauggagucuc

SEQ ID NO: 62034 - RNA, 22 nt, Human
uuuuuuuuuuuuuugagaugga

SEQ ID NO: 62035 - RNA, 18 nt, Human
uuuuuuuuuuuuuuuuug

SEQ ID NO: 62036 - RNA, 25 nt, Human
aaaaaaagaaaagcuugaagucuca

SEQ ID NO: 62037 - RNA, 24 nt, Human
aaaaaagaaaagcuugaagucuca

SEQ ID NO: 62038 - RNA, 24 nt, Human
aagcaucugaaauacuuaaaaaug

SEQ ID NO: 62039 - RNA, 18 nt, Human
aaucugccucuucucccc

SEQ ID NO: 62040 - RNA, 21 nt, Human
agaaaagucuugcccgggguu

SEQ ID NO: 62041 - RNA, 24 nt, Human
agaccagcagagcaccccucccca

SEQ ID NO: 62042 - RNA, 18 nt, Human
agagcaccccuccccacc

SEQ ID NO: 62043 - RNA, 25 nt, Human
agcaaucuguacaguaaaaugcagu

SEQ ID NO: 62044 - RNA, 19 nt, Human
agcacagcugucaaaaggc

SEQ ID NO: 62045 - RNA, 21 nt, Human
agcaccccuccccacccgccc

SEQ ID NO: 62046 - RNA, 21 nt, Human
auaagcaaugauucuguacaa

SEQ ID NO: 62047 - RNA, 22 nt, Human
auagugaucaggaaaggaauac

SEQ ID NO: 62048 - RNA, 28 nt, Human
augaagcaucccccaucgauucuuaaag

SEQ ID NO: 62049 - RNA, 26 nt, Human
auugaaucugccucuucuccccaccc

SEQ ID NO: 62050 - RNA, 24 nt, Human
caccgauggguagugaagcaaugg

SEQ ID NO: 62051 - RNA, 23 nt, Human
cagagcaccccuccccacccgcc

SEQ ID NO: 62052 - RNA, 19 nt, Human
cagcagagcaccccucccc

SEQ ID NO: 62053 - RNA, 23 nt, Human
ccacccaaaauuacuucgauuau

SEQ ID NO: 62054 - RNA, 20 nt, Human
ccacuuccauuuucaucuuc

SEQ ID NO: 62055 - RNA, 21 nt, Human
cccccgcgcacgcuccuccgc

SEQ ID NO: 62056 - RNA, 25 nt, Human
ccccgcgcacgcuccuccgcgugcu

SEQ ID NO: 62057 - RNA, 18 nt, Human
cccgcgcacgcuccuccg

SEQ ID NO: 62058 - RNA, 19 nt, Human
cccgcgcacgcuccuccgc

SEQ ID NO: 62059 - RNA, 21 nt, Human
cccgcgccgccaccgccgccg

SEQ ID NO: 62060 - RNA, 22 nt, Human
cccggggcccccgcgcacgcuc

SEQ ID NO: 62061 - RNA, 22 nt, Human
ccgccgcguccuugcucugccc

SEQ ID NO: 62062 - RNA, 24 nt, Human
ccuuauauugccacuuccauuuuc

SEQ ID NO: 62063 - RNA, 22 nt, Human
cgccgccaccgccgccgucucc

SEQ ID NO: 62064 - RNA, 22 nt, Human
cgcugcugugcgagugggaucc

SEQ ID NO: 62065 - RNA, 21 nt, Human
cuccccacccaaaauuacuuc

SEQ ID NO: 62066 - RNA, 19 nt, Human
cuucagaggcugcuguggc

SEQ ID NO: 62067 - RNA, 19 nt, Human
gaagcagcaaucuguacag

SEQ ID NO: 62068 - RNA, 21 nt, Human
gcccgcgccgccaccgccgcc

SEQ ID NO: 62069 - RNA, 23 nt, Human
gccgucucccggggcccccgcgc

SEQ ID NO: 62070 - RNA, 26 nt, Human
gcgccgccaccgccgccgucucccgg

SEQ ID NO: 62071 - RNA, 19 nt, Human
ggcaagagaagcagcugaa

SEQ ID NO: 62072 - RNA, 21 nt, Human
gugugcacauaaaacaggcac

SEQ ID NO: 62073 - RNA, 22 nt, Human
uaaaaugcagucauggaaaaaa

SEQ ID NO: 62074 - RNA, 18 nt, Human
uaauacaguguagaaagc

SEQ ID NO: 62075 - RNA, 24 nt, Human
uacaguaaaaugcagucauggaaa

SEQ ID NO: 62076 - RNA, 21 nt, Human
uacguggacaaaaaaagaaaa

SEQ ID NO: 62077 - RNA, 25 nt, Human
uagucauccuucaaagaaaagucuu

SEQ ID NO: 62078 - RNA, 20 nt, Human
ucacaaauauagcagaagca

SEQ ID NO: 62079 - RNA, 19 nt, Human
ucauccugcagaaaauugu

SEQ ID NO: 62080 - RNA, 26 nt, Human
uccccacccgccccguaaaagugcuu

SEQ ID NO: 62081 - RNA, 22 nt, Human
uccuauaucacaaauauagcag

SEQ ID NO: 62082 - RNA, 19 nt, Human
uccuugcucugcccgcgcc

SEQ ID NO: 62083 - RNA, 19 nt, Human
ucugccucuucuccccacc

SEQ ID NO: 62084 - RNA, 22 nt, Human
ugaagucucaaugccuaaugug

SEQ ID NO: 62085 - RNA, 23 nt, Human
ugcacauaaaacaggcacgaagg

SEQ ID NO: 62086 - RNA, 18 nt, Human
ugcccgcgccgccaccgc

SEQ ID NO: 62087 - RNA, 23 nt, Human
ugcgcugcugugcgagugggauc

SEQ ID NO: 62088 - RNA, 22 nt, Human
ugucauaagcaaugauucugua

SEQ ID NO: 62089 - RNA, 21 nt, Human
ugugcacauaaaacaggcacg

SEQ ID NO: 62090 - RNA, 19 nt, Human
uguuuuggagaauucuugg

SEQ ID NO: 62091 - RNA, 22 nt, Human
uuacaguacacaaaacccauua

SEQ ID NO: 62092 - RNA, 21 nt, Human
uuaucaaagacccaaagauac

SEQ ID NO: 62093 - RNA, 22 nt, Human
uuggagaauucuugguaauuga

SEQ ID NO: 62094 - RNA, 24 nt, Human
uuugauacagcuaaauucuuuaca

SEQ ID NO: 62095 - RNA, 19 nt, Human
acaacccgaaggcaauuac

SEQ ID NO: 62096 - RNA, 20 nt, Human
acagacuaaagcacaacccg

SEQ ID NO: 62097 - RNA, 20 nt, Human
caacccgaaggcaauuacag

SEQ ID NO: 62098 - RNA, 22 nt, Human
cacaacccgaaggcaauuacag

SEQ ID NO: 62099 - RNA, 19 nt, Human
cagacuaaagcacaacccg

SEQ ID NO: 62100 - RNA, 19 nt, Human
gccgccaccagcuccacaa

SEQ ID NO: 62101 - RNA, 21 nt, Human
gcgcggaaaacagccgagccc

SEQ ID NO: 62102 - RNA, 20 nt, Human
gcggaaaacagccgagcccc

SEQ ID NO: 62103 - RNA, 18 nt, Human
ggaaaacagccgagcccc

SEQ ID NO: 62104 - RNA, 20 nt, Human
uuacaguuucaaucauuaac

SEQ ID NO: 62105 - RNA, 19 nt, Human
aaacaucccuacuuaaagg

SEQ ID NO: 62106 - RNA, 20 nt, Human
aacaagguugggaaguucaa

SEQ ID NO: 62107 - RNA, 23 nt, Human
aaccuaacauuuccaucugaaca

SEQ ID NO: 62108 - RNA, 19 nt, Human
aacggugggcacuacaagu

SEQ ID NO: 62109 - RNA, 18 nt, Human
aaggcccccaccucccuc

SEQ ID NO: 62110 - RNA, 27 nt, Human
aaucauaguggcacacaucuaacuuag

SEQ ID NO: 62111 - RNA, 19 nt, Human
aauggaguuagggaggaug

SEQ ID NO: 62112 - RNA, 20 nt, Human
acaagagcgaaacuccgucu

SEQ ID NO: 62113 - RNA, 19 nt, Human
acacaaugaagaaccgucu

SEQ ID NO: 62114 - RNA, 21 nt, Human
acccagaagaaaagcaagcag

SEQ ID NO: 62115 - RNA, 22 nt, Human
acccugugauccuaggcuucua

SEQ ID NO: 62116 - RNA, 22 nt, Human
acugcaguuuucugucugcacu

SEQ ID NO: 62117 - RNA, 24 nt, Human
agacagcuuagauuuuuuuccccu

SEQ ID NO: 62118 - RNA, 18 nt, Human
agacugcaauuaacugag

SEQ ID NO: 62119 - RNA, 23 nt, Human
agccaggcgugguggcaggagcc

SEQ ID NO: 62120 - RNA, 24 nt, Human
agccucugguccaaauaaccaccu

SEQ ID NO: 62121 - RNA, 20 nt, Human
agcuggagauuaauccaaau

SEQ ID NO: 62122 - RNA, 24 nt, Human
aggcaggagaaucgcuggaacccg

SEQ ID NO: 62123 - RNA, 21 nt, Human
aggccaaaagcgucacaaucc

SEQ ID NO: 62124 - RNA, 24 nt, Human
aggcggagguugcagugagccaag

SEQ ID NO: 62125 - RNA, 24 nt, Human
aggcgugguggcaggagccuguaa

SEQ ID NO: 62126 - RNA, 20 nt, Human
aggcugaggcaggagaaucg

SEQ ID NO: 62127 - RNA, 23 nt, Human
aggcugaggcaggagaaucgcug

SEQ ID NO: 62128 - RNA, 19 nt, Human
aguguuuuguuuuuaacug

SEQ ID NO: 62129 - RNA, 21 nt, Human
aguuagggaggaugaggcugu

SEQ ID NO: 62130 - RNA, 20 nt, Human
auaaaguuucagccaaaggc

SEQ ID NO: 62131 - RNA, 22 nt, Human
auccaacacuuaacugugcacc

SEQ ID NO: 62132 - RNA, 19 nt, Human
aucucuuucaguacauccc

SEQ ID NO: 62133 - RNA, 20 nt, Human
augcaggcaugaguggccac

SEQ ID NO: 62134 - RNA, 19 nt, Human
augcuguaugugcacaaaa

SEQ ID NO: 62135 - RNA, 22 nt, Human
auugaaaaacaauuuaccauga

SEQ ID NO: 62136 - RNA, 24 nt, Human
auugcccucccagccugggcaaca

SEQ ID NO: 62137 - RNA, 24 nt, Human
caaaagcgucacaaucccgguucg

SEQ ID NO: 62138 - RNA, 23 nt, Human
caauuuuuaaccaagcagagaca

SEQ ID NO: 62139 - RNA, 19 nt, Human
cacaaaccaaguuuucuag

SEQ ID NO: 62140 - RNA, 25 nt, Human
caccauauguaaaaaguuugcgcaa

SEQ ID NO: 62141 - RNA, 22 nt, Human
cacccagaagaaaagcaagcag

SEQ ID NO: 62142 - RNA, 21 nt, Human
caccucccuccguagcgaacc

SEQ ID NO: 62143 - RNA, 24 nt, Human
cagaauauaucacaaugcugguua

SEQ ID NO: 62144 - RNA, 24 nt, Human
cagcuacucggaaggcugaggcag

SEQ ID NO: 62145 - RNA, 18 nt, Human
caggcaugaguggccacc

SEQ ID NO: 62146 - RNA, 24 nt, Human
caguaaccuaacauuuccaucuga

SEQ ID NO: 62147 - RNA, 22 nt, Human
caucuugcauuguuguaccaaa

SEQ ID NO: 62148 - RNA, 24 nt, Human
cauugcccucccagccugggcaac

SEQ ID NO: 62149 - RNA, 21 nt, Human
ccaaauaaccaccuucuacau

SEQ ID NO: 62150 - RNA, 27 nt, Human
ccacccagaagaaaagcaagcagcaag

SEQ ID NO: 62151 - RNA, 23 nt, Human
ccaccucccuccguagcgaaccc

SEQ ID NO: 62152 - RNA, 19 nt, Human
ccacucaugcuauagauac

SEQ ID NO: 62153 - RNA, 25 nt, Human
ccagccaggccaaaagcgucacaau

SEQ ID NO: 62154 - RNA, 19 nt, Human
ccaggccaaaagcgucaca

SEQ ID NO: 62155 - RNA, 18 nt, Human
cccacagacuacuccaag

SEQ ID NO: 62156 - RNA, 19 nt, Human
cccacagacuacuccaagc

SEQ ID NO: 62157 - RNA, 18 nt, Human
ccccaaaacaacaugguu

SEQ ID NO: 62158 - RNA, 24 nt, Human
ccccaaccaacccccuccuaggga

SEQ ID NO: 62159 - RNA, 18 nt, Human
cccccaccucccuccgua

SEQ ID NO: 62160 - RNA, 23 nt, Human
ccccggaggauucggaggggcgg

SEQ ID NO: 62161 - RNA, 20 nt, Human
cccuccguagcgaaccccuc

SEQ ID NO: 62162 - RNA, 22 nt, Human
cccugccuccuccgggggcaaa

SEQ ID NO: 62163 - RNA, 18 nt, Human
ccgccuccuccucccgaa

SEQ ID NO: 62164 - RNA, 20 nt, Human
ccuccagaaaaaucuuuaag

SEQ ID NO: 62165 - RNA, 21 nt, Human
ccucccgaaggcccccaccuc

SEQ ID NO: 62166 - RNA, 18 nt, Human
ccuccuccgccuccuccu

SEQ ID NO: 62167 - RNA, 21 nt, Human
ccuccugguccuguuagcaaa

SEQ ID NO: 62168 - RNA, 19 nt, Human
ccuguaaucccagcuacuc

SEQ ID NO: 62169 - RNA, 21 nt, Human
ccuguaaucccagcuacucgg

SEQ ID NO: 62170 - RNA, 22 nt, Human
ccuucccuccuccuccgccucc

SEQ ID NO: 62171 - RNA, 23 nt, Human
cgaaggcccccaccucccuccgu

SEQ ID NO: 62172 - RNA, 22 nt, Human
cgcccugccuccuccgggggca

SEQ ID NO: 62173 - RNA, 24 nt, Human
cgcccugccuccuccgggggcaaa

SEQ ID NO: 62174 - RNA, 25 nt, Human
cgccuccuccucccgaaggccccca

SEQ ID NO: 62175 - RNA, 20 nt, Human
cggaaggcugaggcaggaga

SEQ ID NO: 62176 - RNA, 23 nt, Human
cggccgcccugccuccuccgggg

SEQ ID NO: 62177 - RNA, 20 nt, Human
cggcggcagcggacgcaggc

SEQ ID NO: 62178 - RNA, 24 nt, Human
cgggaggcggagguugcagugagc

SEQ ID NO: 62179 - RNA, 21 nt, Human
cggugccauugcccucccagc

SEQ ID NO: 62180 - RNA, 24 nt, Human
cguaaagauuguuaguguuuuguu

SEQ ID NO: 62181 - RNA, 18 nt, Human
cuaaaacauuccugagau

SEQ ID NO: 62182 - RNA, 22 nt, Human
cuaagaucgcagccucuguacu

SEQ ID NO: 62183 - RNA, 18 nt, Human
cuaucagagcaucuugca

SEQ ID NO: 62184 - RNA, 22 nt, Human
cucccgaaggcccccaccuccc

SEQ ID NO: 62185 - RNA, 19 nt, Human
cuccucccgaaggccccca

SEQ ID NO: 62186 - RNA, 18 nt, Human
cugcacuauuaaggagca

SEQ ID NO: 62187 - RNA, 19 nt, Human
cugguccaaauaaccaccu

SEQ ID NO: 62188 - RNA, 18 nt, Human
gaaccagaaauaauagca

SEQ ID NO: 62189 - RNA, 20 nt, Human
gaccaaaggccccuaauuua

SEQ ID NO: 62190 - RNA, 20 nt, Human
gacuugcuuauggcacugcc

SEQ ID NO: 62191 - RNA, 23 nt, Human
gagaaucgcuggaacccgggagg

SEQ ID NO: 62192 - RNA, 21 nt, Human
gagaggaacccggguuccguc

SEQ ID NO: 62193 - RNA, 18 nt, Human
gagguugcagugagccaa

SEQ ID NO: 62194 - RNA, 21 nt, Human
gagguugcagugagccaagac

SEQ ID NO: 62195 - RNA, 22 nt, Human
gaucacccaaaauagggucuuc

SEQ ID NO: 62196 - RNA, 18 nt, Human
gcaauggcucaaaacuaa

SEQ ID NO: 62197 - RNA, 19 nt, Human
gccucuugacauuagacug

SEQ ID NO: 62198 - RNA, 21 nt, Human
gcgaaccccucugcggccccg

SEQ ID NO: 62199 - RNA, 18 nt, Human
ggagguugcagugagcca

SEQ ID NO: 62200 - RNA, 20 nt, Human
ggagguugcagugagccaag

SEQ ID NO: 62201 - RNA, 21 nt, Human
ggcaggagccuguaaucccag

SEQ ID NO: 62202 - RNA, 24 nt, Human
ggggauuuucacguaaagauuguu

SEQ ID NO: 62203 - RNA, 18 nt, Human
gggguggggggcagcuuc

SEQ ID NO: 62204 - RNA, 24 nt, Human
gguggcaggagccuguaaucccag

SEQ ID NO: 62205 - RNA, 22 nt, Human
guagcgaaccccucugcggccc

SEQ ID NO: 62206 - RNA, 19 nt, Human
gugguuguauccacuuauc

SEQ ID NO: 62207 - RNA, 18 nt, Human
uaaagcaaagauaaaacc

SEQ ID NO: 62208 - RNA, 20 nt, Human
uagacugcaauuaacugagg

SEQ ID NO: 62209 - RNA, 18 nt, Human
uaggaaaagacuggguag

SEQ ID NO: 62210 - RNA, 21 nt, Human
uaggaaaugcuguaugugcac

SEQ ID NO: 62211 - RNA, 24 nt, Human
uaugcaauaaauccuaaagcacac

SEQ ID NO: 62212 - RNA, 26 nt, Human
uauuauuuucuucaagauuuuuaaga

SEQ ID NO: 62213 - RNA, 23 nt, Human
uauuguggcacuauuagugggga

SEQ ID NO: 62214 - RNA, 25 nt, Human
ucaacacacauccauucacccacag

SEQ ID NO: 62215 - RNA, 21 nt, Human
ucaaucauguuuuggcaugug

SEQ ID NO: 62216 - RNA, 23 nt, Human
ucacaagugaaaaaauaccuggg

SEQ ID NO: 62217 - RNA, 22 nt, Human
ucacccacagacuacuccaagc

SEQ ID NO: 62218 - RNA, 20 nt, Human
ucagagaaggaugagaccaa

SEQ ID NO: 62219 - RNA, 23 nt, Human
ucaguacaucccccaaccaaccc

SEQ ID NO: 62220 - RNA, 25 nt, Human
uccaaaauuuaaaaagaaaauaauu

SEQ ID NO: 62221 - RNA, 19 nt, Human
uccaaauaaccaccuucua

SEQ ID NO: 62222 - RNA, 21 nt, Human
uccauaaaccauacaguaacc

SEQ ID NO: 62223 - RNA, 23 nt, Human
uccauucacccacagacuacucc

SEQ ID NO: 62224 - RNA, 19 nt, Human
ucccccaaccaacccccuc

SEQ ID NO: 62225 - RNA, 19 nt, Human
ucccuccguagcgaacccc

SEQ ID NO: 62226 - RNA, 18 nt, Human
ucccucuuuuauuaguac

SEQ ID NO: 62227 - RNA, 19 nt, Human
ucccuggaauccgggaaaa

SEQ ID NO: 62228 - RNA, 24 nt, Human
uccgccuccuccucccgaaggccc

SEQ ID NO: 62229 - RNA, 22 nt, Human
uccgucugaaaaaaaaaaaaaa

SEQ ID NO: 62230 - RNA, 19 nt, Human
uccuuacgcaccucaccau

SEQ ID NO: 62231 - RNA, 24 nt, Human
ucgcuggaacccgggaggcggagg

SEQ ID NO: 62232 - RNA, 24 nt, Human
ucggaaggcugaggcaggagaauc

SEQ ID NO: 62233 - RNA, 18 nt, Human
ucuaagacuuauuuuugg

SEQ ID NO: 62234 - RNA, 23 nt, Human
ugaaguacacauccacuucuaaa

SEQ ID NO: 62235 - RNA, 22 nt, Human
ugacacaaugaagaaccgucuu

SEQ ID NO: 62236 - RNA, 19 nt, Human
ugacauuagacugcaauua

SEQ ID NO: 62237 - RNA, 24 nt, Human
ugagaaugauaugaaaggucaucc

SEQ ID NO: 62238 - RNA, 20 nt, Human
ugaggaguaaacucagguuu

SEQ ID NO: 62239 - RNA, 19 nt, Human
ugaggcaggagaaucgcug

SEQ ID NO: 62240 - RNA, 24 nt, Human
ugaggcaggagaaucgcuggaacc

SEQ ID NO: 62241 - RNA, 25 nt, Human
ugaggcaggagaaucgcuggaaccc

SEQ ID NO: 62242 - RNA, 18 nt, Human
ugcaccacaaaccaaguu

SEQ ID NO: 62243 - RNA, 24 nt, Human
uggaacccgggaggcggagguugc

SEQ ID NO: 62244 - RNA, 22 nt, Human
uggaaugcaggcaugaguggcc

SEQ ID NO: 62245 - RNA, 22 nt, Human
uggcaggagccuguaaucccag

SEQ ID NO: 62246 - RNA, 18 nt, Human
uggccaccugagcgacac

SEQ ID NO: 62247 - RNA, 20 nt, Human
uggcucaaaacuaauaggac

SEQ ID NO: 62248 - RNA, 29 nt, Human
ugggcacuacaaguuggugagaaugauau

SEQ ID NO: 62249 - RNA, 23 nt, Human
uggguagaagagucagagaagga

SEQ ID NO: 62250 - RNA, 24 nt, Human
uggguagaagagucagagaaggau

SEQ ID NO: 62251 - RNA, 24 nt, Human
ugguggcaggagccuguaauccca

SEQ ID NO: 62252 - RNA, 21 nt, Human
uguuuuaucacugagugugag

SEQ ID NO: 62253 - RNA, 22 nt, Human
uuaggggaucuuuccauuugac

SEQ ID NO: 62254 - RNA, 21 nt, Human
uucaacaaacucacuaaggcc

SEQ ID NO: 62255 - RNA, 22 nt, Human
uucaacaaacucacuaaggcca

SEQ ID NO: 62256 - RNA, 20 nt, Human
uucacaguaugaauucccug

SEQ ID NO: 62257 - RNA, 22 nt, Human
uuccugagauuuauggacaaaa

SEQ ID NO: 62258 - RNA, 19 nt, Human
uucuacauuaggcuggucc

SEQ ID NO: 62259 - RNA, 19 nt, Human
uugaaaaugugggccagac

SEQ ID NO: 62260 - RNA, 24 nt, Human
uugaaauugccaaacuucccuaau

SEQ ID NO: 62261 - RNA, 22 nt, Human
uugcagugagccaagacggugc

SEQ ID NO: 62262 - RNA, 19 nt, Human
uuucacaguaugaauuccc

SEQ ID NO: 62263 - RNA, 23 nt, Human
aaaaucaccaaauauacaaagca

SEQ ID NO: 62264 - RNA, 22 nt, Human
aaagauaucccaaaaucgaagg

SEQ ID NO: 62265 - RNA, 25 nt, Human
aaagaucaaugcaaaccuaagucau

SEQ ID NO: 62266 - RNA, 19 nt, Human
aacacggugaaaccccguc

SEQ ID NO: 62267 - RNA, 20 nt, Human
aacacggugaaaccccgucu

SEQ ID NO: 62268 - RNA, 21 nt, Human
aacacggugaaaccccgucuc

SEQ ID NO: 62269 - RNA, 24 nt, Human
aacagagcaagacucugucucaaa

SEQ ID NO: 62270 - RNA, 20 nt, Human
aagaaugugauaauaaaaug

SEQ ID NO: 62271 - RNA, 20 nt, Human
aagauaauagcuuuaauccc

SEQ ID NO: 62272 - RNA, 18 nt, Human
aagcaaauauaaagcuua

SEQ ID NO: 62273 - RNA, 24 nt, Human
aauggcgugaaccugggaggcgga

SEQ ID NO: 62274 - RNA, 20 nt, Human
acaccacugcacuccagccu

SEQ ID NO: 62275 - RNA, 24 nt, Human
acaccacugcacuccagccugggc

SEQ ID NO: 62276 - RNA, 21 nt, Human
acacuaugacccagggugcug

SEQ ID NO: 62277 - RNA, 24 nt, Human
acagagcaagacucugucucaaaa

SEQ ID NO: 62278 - RNA, 25 nt, Human
acaguaauggaacaaaagcugaauc

SEQ ID NO: 62279 - RNA, 22 nt, Human
accacugcacuccagccugggc

SEQ ID NO: 62280 - RNA, 21 nt, Human
acccaagaucacaccacugca

SEQ ID NO: 62281 - RNA, 24 nt, Human
accccgucucuacuaaaaauacaa

SEQ ID NO: 62282 - RNA, 24 nt, Human
acugcacuccagccugggcaacag

SEQ ID NO: 62283 - RNA, 24 nt, Human
acugcacuccagccugggcaacag

SEQ ID NO: 62284 - RNA, 20 nt, Human
acuucuccuauacucuacua

SEQ ID NO: 62285 - RNA, 24 nt, Human
agaaaaaacuguauaucaaagaaa

SEQ ID NO: 62286 - RNA, 21 nt, Human
agaaugcauuguagaaguagg

SEQ ID NO: 62287 - RNA, 20 nt, Human
agagccugaggauucuuuug

SEQ ID NO: 62288 - RNA, 18 nt, Human
agagcuuauuaaaacaga

SEQ ID NO: 62289 - RNA, 24 nt, Human
agcacuuugggaggccgaggcggg

SEQ ID NO: 62290 - RNA, 21 nt, Human
agccgggcgcgguggugggcc

SEQ ID NO: 62291 - RNA, 24 nt, Human
agccugggcaacagagcaagacuc

SEQ ID NO: 62292 - RNA, 21 nt, Human
aggcagaaacccaugggcagc

SEQ ID NO: 62293 - RNA, 21 nt, Human
aggcaggagaauggcgugaac

SEQ ID NO: 62294 - RNA, 22 nt, Human
aggcaggagaauggcgugaacc

SEQ ID NO: 62295 - RNA, 24 nt, Human
aggcaggagaauggcgugaaccug

SEQ ID NO: 62296 - RNA, 22 nt, Human
aggcauucaauucauuuucaau

SEQ ID NO: 62297 - RNA, 20 nt, Human
aggccgaggcgggcggauca

SEQ ID NO: 62298 - RNA, 19 nt, Human
aggcggaguuugcagugac

SEQ ID NO: 62299 - RNA, 24 nt, Human
aggcggaguuugcagugacccaag

SEQ ID NO: 62300 - RNA, 24 nt, Human
aggcgggcggaucaugaggucagg

SEQ ID NO: 62301 - RNA, 18 nt, Human
aggcugaggcaggagaau

SEQ ID NO: 62302 - RNA, 19 nt, Human
agucccaaccugagaacua

SEQ ID NO: 62303 - RNA, 22 nt, Human
agugcaguacauuagagaaaug

SEQ ID NO: 62304 - RNA, 22 nt, Human
auaaagggcagcacuugcuacc

SEQ ID NO: 62305 - RNA, 21 nt, Human
auauaguuccaguuucaaauc

SEQ ID NO: 62306 - RNA, 24 nt, Human
aucacaccacugcacuccagccug

SEQ ID NO: 62307 - RNA, 28 nt, Human
aucacaccacugcacuccagccugggca

SEQ ID NO: 62308 - RNA, 21 nt, Human
augaaagaaaagcauauccau

SEQ ID NO: 62309 - RNA, 24 nt, Human
auggaacagaaagcuccagucucc

SEQ ID NO: 62310 - RNA, 22 nt, Human
caaagcaccagcuuaguaaagc

SEQ ID NO: 62311 - RNA, 19 nt, Human
caacaguaauggaacaaaa

SEQ ID NO: 62312 - RNA, 21 nt, Human
cacaccacugcacuccagccu

SEQ ID NO: 62313 - RNA, 23 nt, Human
cacagccaauuacaaugcaagaa

SEQ ID NO: 62314 - RNA, 18 nt, Human
caccccacauguauacca

SEQ ID NO: 62315 - RNA, 24 nt, Human
cacgccuguaaucccagcacuuug

SEQ ID NO: 62316 - RNA, 19 nt, Human
cacugcacuccagccuggg

SEQ ID NO: 62317 - RNA, 21 nt, Human
cacugcacuccagccugggca

SEQ ID NO: 62318 - RNA, 22 nt, Human
cacugcacuccagccugggcaa

SEQ ID NO: 62319 - RNA, 23 nt, Human
cacugcacuccagccugggcaac

SEQ ID NO: 62320 - RNA, 24 nt, Human
cacugcacuccagccugggcaaca

SEQ ID NO: 62321 - RNA, 25 nt, Human
cacugcacuccagccugggcaacaa

SEQ ID NO: 62322 - RNA, 26 nt, Human
cacugcacuccagccugggcaacaga

SEQ ID NO: 62323 - RNA, 23 nt, Human
cacuguacaaaaaucauggacca

SEQ ID NO: 62324 - RNA, 30 nt, Human
cagaaaauacaauguaucauuccauagcaa

SEQ ID NO: 62325 - RNA, 22 nt, Human
cagcacuuugggaggccgaggc

SEQ ID NO: 62326 - RNA, 24 nt, Human
cagcacuuugggaggccgaggcgg

SEQ ID NO: 62327 - RNA, 24 nt, Human
cagcuacucgggaggcugaggcag

SEQ ID NO: 62328 - RNA, 19 nt, Human
cauagaaacugucaaauuc

SEQ ID NO: 62329 - RNA, 24 nt, Human
cauauaguucaacaguaauggaac

SEQ ID NO: 62330 - RNA, 21 nt, Human
caucaccagcaaaauguuccu

SEQ ID NO: 62331 - RNA, 21 nt, Human
caugcaaagcaccagcuuagu

SEQ ID NO: 62332 - RNA, 23 nt, Human
cauuuuagggccgggcacggugg

SEQ ID NO: 62333 - RNA, 20 nt, Human
ccacugcacuccagccuggg

SEQ ID NO: 62334 - RNA, 21 nt, Human
ccacugcacuccagccugggc

SEQ ID NO: 62335 - RNA, 23 nt, Human
ccacugcacuccagccugggcaa

SEQ ID NO: 62336 - RNA, 24 nt, Human
ccacugcacuccagccugggcaac

SEQ ID NO: 62337 - RNA, 24 nt, Human
ccaguuacccucaaagcaucucag

SEQ ID NO: 62338 - RNA, 23 nt, Human
cccaagaucacaccacugcacuu

SEQ ID NO: 62339 - RNA, 23 nt, Human
ccccuguggucccagcuacucgg

SEQ ID NO: 62340 - RNA, 24 nt, Human
ccccuguggucccagcuacucggg

SEQ ID NO: 62341 - RNA, 20 nt, Human
cccuguggucccagcuacuc

SEQ ID NO: 62342 - RNA, 18 nt, Human
ccucaucaccagcaaaau

SEQ ID NO: 62343 - RNA, 23 nt, Human
ccuggcuaacacggugaaacccc

SEQ ID NO: 62344 - RNA, 24 nt, Human
ccuggcuaacacggugaaaccccg

SEQ ID NO: 62345 - RNA, 22 nt, Human
ccugggcaacagagcaagacuc

SEQ ID NO: 62346 - RNA, 22 nt, Human
ccuguaaucccagcacuuuggg

SEQ ID NO: 62347 - RNA, 21 nt, Human
ccuguggucccagcuacucgg

SEQ ID NO: 62348 - RNA, 24 nt, Human
cgagaacauccuggcuaacacggu

SEQ ID NO: 62349 - RNA, 24 nt, Human
cgaggcgggcggaucaugagguca

SEQ ID NO: 62350 - RNA, 23 nt, Human
cgguggugggccccugugguccc

SEQ ID NO: 62351 - RNA, 24 nt, Human
cuauauaucauuauccuauuccua

SEQ ID NO: 62352 - RNA, 22 nt, Human
cucacgccuguaaucccagcac

SEQ ID NO: 62353 - RNA, 24 nt, Human
cucacgccuguaaucccagcacuu

SEQ ID NO: 62354 - RNA, 18 nt, Human
cucaucaccagcaaaaug

SEQ ID NO: 62355 - RNA, 19 nt, Human
gaagucccaaccugagaac

SEQ ID NO: 62356 - RNA, 23 nt, Human
gacaaaaugaaaaaauaaguucu

SEQ ID NO: 62357 - RNA, 23 nt, Human
gaggcgggcggaucaugagguca

SEQ ID NO: 62358 - RNA, 22 nt, Human
gaggcuguuucagaaccaacau

SEQ ID NO: 62359 - RNA, 23 nt, Human
gagugaagccacagagauugguu

SEQ ID NO: 62360 - RNA, 24 nt, Human
gcacuccagccugggcaacagagc

SEQ ID NO: 62361 - RNA, 22 nt, Human
gccaagggcucuaucaaucuug

SEQ ID NO: 62362 - RNA, 21 nt, Human
gccacaauuugaaaccuuaac

SEQ ID NO: 62363 - RNA, 24 nt, Human
gcuaacacggugaaaccccgucuc

SEQ ID NO: 62364 - RNA, 22 nt, Human
gcugaggcaggagaauggcgug

SEQ ID NO: 62365 - RNA, 19 nt, Human
ggaaaaaauucuugagcaa

SEQ ID NO: 62366 - RNA, 24 nt, Human
ggaguuugcagugacccaagauca

SEQ ID NO: 62367 - RNA, 23 nt, Human
ggcacgguggcucacgccuguaa

SEQ ID NO: 62368 - RNA, 21 nt, Human
ggccgggcacgguggcucacg

SEQ ID NO: 62369 - RNA, 21 nt, Human
ggcggaucaugaggucaggag

SEQ ID NO: 62370 - RNA, 23 nt, Human
ggcgggcggaucaugaggucagg

SEQ ID NO: 62371 - RNA, 21 nt, Human
ggcucacgccuguaaucccag

SEQ ID NO: 62372 - RNA, 23 nt, Human
gggcagccuuuaaauaacaaaaa

SEQ ID NO: 62373 - RNA, 23 nt, Human
gguggcucacgccuguaauccca

SEQ ID NO: 62374 - RNA, 24 nt, Human
gguggcucacgccuguaaucccag

SEQ ID NO: 62375 - RNA, 23 nt, Human
gguggugggccccugugguccca

SEQ ID NO: 62376 - RNA, 21 nt, Human
guggcggagggagggcggugg

SEQ ID NO: 62377 - RNA, 21 nt, Human
gugggccccuguggucccagc

SEQ ID NO: 62378 - RNA, 23 nt, Human
uaaaaaacacuguacaaaaauca

SEQ ID NO: 62379 - RNA, 24 nt, Human
uaaaacagaugccauuucuaaugc

SEQ ID NO: 62380 - RNA, 19 nt, Human
uaaaacgaacuacaggucu

SEQ ID NO: 62381 - RNA, 20 nt, Human
uaaauaaacauuacacccau

SEQ ID NO: 62382 - RNA, 22 nt, Human
uaacaaaacaaaagaacugaua

SEQ ID NO: 62383 - RNA, 24 nt, Human
uaacaccauuaaguguaagucuga

SEQ ID NO: 62384 - RNA, 22 nt, Human
uaacacggugaaaccccgucuc

SEQ ID NO: 62385 - RNA, 24 nt, Human
uaacacggugaaaccccgucucua

SEQ ID NO: 62386 - RNA, 25 nt, Human
uaaccacuacugcucugcagcagua

SEQ ID NO: 62387 - RNA, 19 nt, Human
uaacccccagucucauauu

SEQ ID NO: 62388 - RNA, 26 nt, Human
uaagcaaauauaaagcuuaaucuccu

SEQ ID NO: 62389 - RNA, 18 nt, Human
uaauaaaaugccaagggc

SEQ ID NO: 62390 - RNA, 20 nt, Human
uaaugaugaacaccuuccuu

SEQ ID NO: 62391 - RNA, 19 nt, Human
uacaaagcaauuuugcaua

SEQ ID NO: 62392 - RNA, 21 nt, Human
uacaacuuaacccccagucuc

SEQ ID NO: 62393 - RNA, 19 nt, Human
uacagugugaaacagccga

SEQ ID NO: 62394 - RNA, 23 nt, Human
uacauuacaaaaucaccaaauau

SEQ ID NO: 62395 - RNA, 18 nt, Human
uaccaccugccacaauuu

SEQ ID NO: 62396 - RNA, 22 nt, Human
uaccaugaucacauaaagucgg

SEQ ID NO: 62397 - RNA, 19 nt, Human
uaccaugcaaagcaccagc

SEQ ID NO: 62398 - RNA, 19 nt, Human
uagaaagacaaaaucucau

SEQ ID NO: 62399 - RNA, 22 nt, Human
uagaacuucuuuugaaauguca

SEQ ID NO: 62400 - RNA, 24 nt, Human
uagauauaaugcaaaauuaacuca

SEQ ID NO: 62401 - RNA, 21 nt, Human
uagauuguagagccugaggau

SEQ ID NO: 62402 - RNA, 20 nt, Human
uagcaguaucuuuacuuguc

SEQ ID NO: 62403 - RNA, 22 nt, Human
uauauaccuauugugacaaaau

SEQ ID NO: 62404 - RNA, 20 nt, Human
uaucaaagaaaaaaaaaggc

SEQ ID NO: 62405 - RNA, 20 nt, Human
uaucaaagaaaaaaaaaggc

SEQ ID NO: 62406 - RNA, 24 nt, Human
uaucaaagaaaaaaaaaggcuuuu

SEQ ID NO: 62407 - RNA, 18 nt, Human
uauguuuaagggggaaaa

SEQ ID NO: 62408 - RNA, 23 nt, Human
ucacaccacugcacuccagccug

SEQ ID NO: 62409 - RNA, 18 nt, Human
ucacauaaagucgaguuc

SEQ ID NO: 62410 - RNA, 18 nt, Human
ucaugaggucaggagauc

SEQ ID NO: 62411 - RNA, 24 nt, Human
ucaugaggucaggagaucgagaac

SEQ ID NO: 62412 - RNA, 21 nt, Human
ucauuccauagcaguaucuuu

SEQ ID NO: 62413 - RNA, 20 nt, Human
ucccagaaaguacccugaga

SEQ ID NO: 62414 - RNA, 21 nt, Human
uccuuccuuggucaacuucuc

SEQ ID NO: 62415 - RNA, 19 nt, Human
ucuauuagcaguguuaaaa

SEQ ID NO: 62416 - RNA, 23 nt, Human
ucuccaccccacauguauaccaa

SEQ ID NO: 62417 - RNA, 24 nt, Human
ucucuacuaaaaauacaaaaaauu

SEQ ID NO: 62418 - RNA, 19 nt, Human
ugaaaaaauaaguucucca

SEQ ID NO: 62419 - RNA, 20 nt, Human
ugaaagcauuccuuuuggua

SEQ ID NO: 62420 - RNA, 25 nt, Human
ugaaaugucacuugacuuucaauaa

SEQ ID NO: 62421 - RNA, 20 nt, Human
ugacuuaaaacgaacuacag

SEQ ID NO: 62422 - RNA, 22 nt, Human
ugagaccuaaaacagaugccau

SEQ ID NO: 62423 - RNA, 21 nt, Human
ugagaucaacaguaccaccug

SEQ ID NO: 62424 - RNA, 24 nt, Human
ugaggcaggagaauggcgugaacc

SEQ ID NO: 62425 - RNA, 24 nt, Human
ugaggcaggagaauggcgugaacc

SEQ ID NO: 62426 - RNA, 23 nt, Human
ugauuucuuauggacacagccaa

SEQ ID NO: 62427 - RNA, 20 nt, Human
ugcaaaccuaagucaucaag

SEQ ID NO: 62428 - RNA, 22 nt, Human
ugcaagaauuaaaaguucacaa

SEQ ID NO: 62429 - RNA, 22 nt, Human
ugcuggcaacagaauaaauucc

SEQ ID NO: 62430 - RNA, 20 nt, Human
uggaacaaaagcugaaucau

SEQ ID NO: 62431 - RNA, 24 nt, Human
uggaauaguucauauaguucaaca

SEQ ID NO: 62432 - RNA, 18 nt, Human
uggcaggagacgcagcug

SEQ ID NO: 62433 - RNA, 18 nt, Human
uggcaucaagugcaguac

SEQ ID NO: 62434 - RNA, 20 nt, Human
uggcggagggagggcggugg

SEQ ID NO: 62435 - RNA, 24 nt, Human
uggcucacgccuguaaucccagca

SEQ ID NO: 62436 - RNA, 19 nt, Human
ugggaggccgaggcgggcg

SEQ ID NO: 62437 - RNA, 24 nt, Human
ugggaggccgaggcgggcggauca

SEQ ID NO: 62438 - RNA, 29 nt, Human
ugggaggcggaguuugcagugacaacggu

SEQ ID NO: 62439 - RNA, 19 nt, Human
ugggccccuguggucccag

SEQ ID NO: 62440 - RNA, 24 nt, Human
uggugggccccuguggucccagcu

SEQ ID NO: 62441 - RNA, 18 nt, Human
uguggcaaaaacuagacu

SEQ ID NO: 62442 - RNA, 20 nt, Human
uuaaagucuuaguggcuaac

SEQ ID NO: 62443 - RNA, 24 nt, Human
uucacuuacauuacaaaaucacca

SEQ ID NO: 62444 - RNA, 20 nt, Human
uuccuagauauaaugcaaaa

SEQ ID NO: 62445 - RNA, 22 nt, Human
uucuaacaacuuuuuuccugaa

SEQ ID NO: 62446 - RNA, 21 nt, Human
uuggcacauggauagaaggaa

SEQ ID NO: 62447 - RNA, 25 nt, Human
uugggaggccgaggcgggcggauca

SEQ ID NO: 62448 - RNA, 18 nt, Human
uuugaaauuaaacaauaa

SEQ ID NO: 62449 - RNA, 21 nt, Human
aaacacagcuuugccccaggc

SEQ ID NO: 62450 - RNA, 24 nt, Human
agauguugggcugggaggcccugu

SEQ ID NO: 62451 - RNA, 22 nt, Human
agccagcggcagcccgagcgcg

SEQ ID NO: 62452 - RNA, 20 nt, Human
agccggugccccuggucacu

SEQ ID NO: 62453 - RNA, 18 nt, Human
agcgcgccugcgcgggga

SEQ ID NO: 62454 - RNA, 21 nt, Human
aggcuuuggcacuuccagccc

SEQ ID NO: 62455 - RNA, 21 nt, Human
cacagcuuugccccaggcuuu

SEQ ID NO: 62456 - RNA, 22 nt, Human
cagcccgagcgcgccugcgcgg

SEQ ID NO: 62457 - RNA, 21 nt, Human
cagcuggagauguugggcugg

SEQ ID NO: 62458 - RNA, 21 nt, Human
caggagaggcgcugaacccca

SEQ ID NO: 62459 - RNA, 21 nt, Human
ccccaggagaggcgcugaacc

SEQ ID NO: 62460 - RNA, 23 nt, Human
cggugccccuggucacugcaguu

SEQ ID NO: 62461 - RNA, 20 nt, Human
cugaaacacagcuuugcccc

SEQ ID NO: 62462 - RNA, 22 nt, Human
gaagagccagcggcagcccgag

SEQ ID NO: 62463 - RNA, 18 nt, Human
gcgcgccugcgcggggac

SEQ ID NO: 62464 - RNA, 18 nt, Human
gugggcagccggugcccc

SEQ ID NO: 62465 - RNA, 19 nt, Human
ucacugcaguugcccaagg

SEQ ID NO: 62466 - RNA, 21 nt, Human
ucaguguggcugaaacacagc

SEQ ID NO: 62467 - RNA, 22 nt, Human
ucccugugggcagccggugccc

SEQ ID NO: 62468 - RNA, 19 nt, Human
ugaaacacagcuuugcccc

SEQ ID NO: 62469 - RNA, 19 nt, Human
ugccccaggcuuuggcacu

SEQ ID NO: 62470 - RNA, 27 nt, Human
ugccccaggcuuuggcacuuccagccc

SEQ ID NO: 62471 - RNA, 20 nt, Human
ugcgcggggacgggcgggac

SEQ ID NO: 62472 - RNA, 24 nt, Human
uggagauguugggcugggaggccc

SEQ ID NO: 62473 - RNA, 20 nt, Human
uggcugaaacacagcuuugc

SEQ ID NO: 62474 - RNA, 20 nt, Human
uugcccaaggcugauauuuc

SEQ ID NO: 62475 - RNA, 21 nt, Human
caccugcggcugguucagagu

SEQ ID NO: 62476 - RNA, 19 nt, Human
cugaagagcuuggcguguc

SEQ ID NO: 62477 - RNA, 23 nt, Human
cugggaugauagcggccagagag

SEQ ID NO: 62478 - RNA, 24 nt, Human
uaauaacaucgugucuucacugaa

SEQ ID NO: 62479 - RNA, 22 nt, Human
ugaacuccacugcugggaugau

SEQ ID NO: 62480 - RNA, 18 nt, Human
ugagaugggaagccaugg

SEQ ID NO: 62481 - RNA, 21 nt, Human
ugagaugggaagccaugggca

SEQ ID NO: 62482 - RNA, 22 nt, Human
ugucuucacugaagagcuuggc

SEQ ID NO: 62483 - RNA, 18 nt, Human
aaaacuccaaccccccac

SEQ ID NO: 62484 - RNA, 24 nt, Human
aaacaaaagaaucacuagaaaaac

SEQ ID NO: 62485 - RNA, 24 nt, Human
aaacaagacccaucaguaccuuca

SEQ ID NO: 62486 - RNA, 24 nt, Human
aaacagaaauguauaaccagccca

SEQ ID NO: 62487 - RNA, 24 nt, Human
aaacagacuaacagaaaacaagac

SEQ ID NO: 62488 - RNA, 22 nt, Human
aagaaaacuccaaccccccaca

SEQ ID NO: 62489 - RNA, 21 nt, Human
aaggacuggacaaacuaagcc

SEQ ID NO: 62490 - RNA, 23 nt, Human
aaucacuagaaaaacagauccac

SEQ ID NO: 62491 - RNA, 22 nt, Human
aauuugugaaaaagcugcaugu

SEQ ID NO: 62492 - RNA, 24 nt, Human
acaaaacaaaagaaucacuagaaa

SEQ ID NO: 62493 - RNA, 19 nt, Human
acaaaacagacuaacagaa

SEQ ID NO: 62494 - RNA, 24 nt, Human
acagaauuccugagaagggaacau

SEQ ID NO: 62495 - RNA, 24 nt, Human
accaucaucuagccucuuuucuca

SEQ ID NO: 62496 - RNA, 19 nt, Human
acuccaaccccccacacca

SEQ ID NO: 62497 - RNA, 24 nt, Human
acucuaagggacaaaacaaaagaa

SEQ ID NO: 62498 - RNA, 18 nt, Human
agaaaaacagauccacua

SEQ ID NO: 62499 - RNA, 19 nt, Human
agaaaacuccaacccccca

SEQ ID NO: 62500 - RNA, 22 nt, Human
agaaauguauaaccagcccaau

SEQ ID NO: 62501 - RNA, 18 nt, Human
agaacugaugaguacaga

SEQ ID NO: 62502 - RNA, 23 nt, Human
agacaacagguccaagaagacuu

SEQ ID NO: 62503 - RNA, 19 nt, Human
agccucagcuuccugagca

SEQ ID NO: 62504 - RNA, 20 nt, Human
agcuuccugagcagcauccc

SEQ ID NO: 62505 - RNA, 19 nt, Human
aggaggcuguugugaaaau

SEQ ID NO: 62506 - RNA, 20 nt, Human
agggaaaaagaaaguagugg

SEQ ID NO: 62507 - RNA, 21 nt, Human
agggacaaaacaaaagaauca

SEQ ID NO: 62508 - RNA, 23 nt, Human
aguacagaauuccugagaaggga

SEQ ID NO: 62509 - RNA, 20 nt, Human
aucccuuucuauagaaucac

SEQ ID NO: 62510 - RNA, 25 nt, Human
aucuaugacaaacccaaauuccuaa

SEQ ID NO: 62511 - RNA, 25 nt, Human
caaaacaaaagaaucacuagaaaaa

SEQ ID NO: 62512 - RNA, 25 nt, Human
caaacucugcuuuaccuugacauau

SEQ ID NO: 62513 - RNA, 25 nt, Human
caacccagaauaggugccagcaggg

SEQ ID NO: 62514 - RNA, 19 nt, Human
cacaccaucaucuagccuc

SEQ ID NO: 62515 - RNA, 24 nt, Human
cacccuagucucaauuuccucacc

SEQ ID NO: 62516 - RNA, 18 nt, Human
caccuuuccaugcaucag

SEQ ID NO: 62517 - RNA, 24 nt, Human
cacucuaagggacaaaacaaaaga

SEQ ID NO: 62518 - RNA, 22 nt, Human
cacucugcuuucaacuguacuu

SEQ ID NO: 62519 - RNA, 24 nt, Human
cagacuaacagaaaacaagaccca

SEQ ID NO: 62520 - RNA, 21 nt, Human
cagcagcagcucaggcucugc

SEQ ID NO: 62521 - RNA, 21 nt, Human
cagccucagcuuccugagcag

SEQ ID NO: 62522 - RNA, 20 nt, Human
caggguucuuugccucuucc

SEQ ID NO: 62523 - RNA, 20 nt, Human
cagugggccacaccacagcc

SEQ ID NO: 62524 - RNA, 22 nt, Human
cauggaaggacuggacaaacua

SEQ ID NO: 62525 - RNA, 25 nt, Human
ccacccuagucucaauuuccucacc

SEQ ID NO: 62526 - RNA, 19 nt, Human
ccagcacacccgcaucauc

SEQ ID NO: 62527 - RNA, 22 nt, Human
ccagccucagcuuccugagcag

SEQ ID NO: 62528 - RNA, 19 nt, Human
ccaggccaggguucuuugc

SEQ ID NO: 62529 - RNA, 21 nt, Human
ccaugcaucagaaccuaugcu

SEQ ID NO: 62530 - RNA, 31 nt, Human
cccagccacccucaccagagaauacaucuag

SEQ ID NO: 62531 - RNA, 24 nt, Human
cccagccucagcuuccugagcagc

SEQ ID NO: 62532 - RNA, 22 nt, Human
ccccccacaccaucaucuagcc

SEQ ID NO: 62533 - RNA, 19 nt, Human
ccggugccaccacgcaugu

SEQ ID NO: 62534 - RNA, 21 nt, Human
ccuacuuaagagagaugccuc

SEQ ID NO: 62535 - RNA, 26 nt, Human
cucaccagagaauacaucuaugacaa

SEQ ID NO: 62536 - RNA, 25 nt, Human
cuccagggccacacccggugccacc

SEQ ID NO: 62537 - RNA, 18 nt, Human
cucuaagggacaaaacaa

SEQ ID NO: 62538 - RNA, 19 nt, Human
cugggauagaagggcaugg

SEQ ID NO: 62539 - RNA, 20 nt, Human
cuuucaacuguacuugcugu

SEQ ID NO: 62540 - RNA, 19 nt, Human
gagaagggaacauuuaggu

SEQ ID NO: 62541 - RNA, 22 nt, Human
gagaauacaucuaugacaaacc

SEQ ID NO: 62542 - RNA, 22 nt, Human
gcuguuuccucacagccaggaa

SEQ ID NO: 62543 - RNA, 23 nt, Human
ggacaaaacaaaagaaucacuag

SEQ ID NO: 62544 - RNA, 18 nt, Human
gggaaaaagaaaguagug

SEQ ID NO: 62545 - RNA, 22 nt, Human
gggauagaagggcauggaagga

SEQ ID NO: 62546 - RNA, 21 nt, Human
ggucagaccugacaugggucc

SEQ ID NO: 62547 - RNA, 20 nt, Human
guuacacucugcuuucaacu

SEQ ID NO: 62548 - RNA, 18 nt, Human
uaauuuaggaaaugagua

SEQ ID NO: 62549 - RNA, 21 nt, Human
uagaagaaaacuccaaccccc

SEQ ID NO: 62550 - RNA, 23 nt, Human
uagaagaaaacuccaacccccca

SEQ ID NO: 62551 - RNA, 20 nt, Human
uagaaguucacaagcaaccc

SEQ ID NO: 62552 - RNA, 18 nt, Human
uaggugcaucuuuucccu

SEQ ID NO: 62553 - RNA, 21 nt, Human
uaguggcucuacgcaacuuuu

SEQ ID NO: 62554 - RNA, 22 nt, Human
ucaauaauagaauaaauuugug

SEQ ID NO: 62555 - RNA, 19 nt, Human
uccaaccccccacaccauc

SEQ ID NO: 62556 - RNA, 22 nt, Human
uccaaccccccacaccaucauc

SEQ ID NO: 62557 - RNA, 21 nt, Human
uccacuagcacgaguccucca

SEQ ID NO: 62558 - RNA, 23 nt, Human
uccagcccugucccagccucagc

SEQ ID NO: 62559 - RNA, 21 nt, Human
ucccagguuccagcccugucc

SEQ ID NO: 62560 - RNA, 21 nt, Human
uccccaugaaggaagggaaaa

SEQ ID NO: 62561 - RNA, 25 nt, Human
ucccuuguuacacucugcuuucaac

SEQ ID NO: 62562 - RNA, 19 nt, Human
ucuaagggacaaaacaaaa

SEQ ID NO: 62563 - RNA, 23 nt, Human
ucuacgcaacuuuuucauucacc

SEQ ID NO: 62564 - RNA, 18 nt, Human
ucucagggaaaaagaaag

SEQ ID NO: 62565 - RNA, 19 nt, Human
ucuuugccucuuccucaaa

SEQ ID NO: 62566 - RNA, 20 nt, Human
ugaaggaagggaaaagaaua

SEQ ID NO: 62567 - RNA, 23 nt, Human
ugacauggguccuucugaagaug

SEQ ID NO: 62568 - RNA, 23 nt, Human
ugaguacagaauuccugagaagg

SEQ ID NO: 62569 - RNA, 23 nt, Human
ugccugaucucuuucucuuccug

SEQ ID NO: 62570 - RNA, 27 nt, Human
ugcuuccauacucugcauuaggucagu

SEQ ID NO: 62571 - RNA, 18 nt, Human
uggaagucugauucgcug

SEQ ID NO: 62572 - RNA, 20 nt, Human
uggccagaguugcucccagg

SEQ ID NO: 62573 - RNA, 20 nt, Human
uggccagaguugcucccagg

SEQ ID NO: 62574 - RNA, 24 nt, Human
ugggccacaccacagcagcagcuc

SEQ ID NO: 62575 - RNA, 22 nt, Human
uggguccuucugaagauggugg

SEQ ID NO: 62576 - RNA, 19 nt, Human
uggucucugggccacgccc

SEQ ID NO: 62577 - RNA, 21 nt, Human
ugucccagccucagcuuccug

SEQ ID NO: 62578 - RNA, 19 nt, Human
uguccugucucaccaacca

SEQ ID NO: 62579 - RNA, 23 nt, Human
ugugaacauggcuuugcucccaa

SEQ ID NO: 62580 - RNA, 18 nt, Human
ugugaucuaccagcuguu

SEQ ID NO: 62581 - RNA, 25 nt, Human
uguggaagucugauucgcuggugcc

SEQ ID NO: 62582 - RNA, 20 nt, Human
uuaaagguuguccaugccua

SEQ ID NO: 62583 - RNA, 24 nt, Human
uucaagccuugacuccaguggccc

SEQ ID NO: 62584 - RNA, 22 nt, Human
uucaccacccuagucucaauuu

SEQ ID NO: 62585 - RNA, 18 nt, Human
uuccugagcagcaucccu

SEQ ID NO: 62586 - RNA, 24 nt, Human
uugcucccagguuccagcccuguc

SEQ ID NO: 62587 - RNA, 27 nt, Human
uuuuuuuuauccaaauuuauucucagg

SEQ ID NO: 62588 - RNA, 18 nt, Human
aaaaagacaucaaaaggc

SEQ ID NO: 62589 - RNA, 21 nt, Human
aaaaggcugaguacagacacc

SEQ ID NO: 62590 - RNA, 21 nt, Human
aaagacauuuauccuuuuggc

SEQ ID NO: 62591 - RNA, 22 nt, Human
aaaguaacugaaaaaaucuucu

SEQ ID NO: 62592 - RNA, 21 nt, Human
aaaguagccaauuaucacgga

SEQ ID NO: 62593 - RNA, 24 nt, Human
aacaaaugcccuaauacgaccuaa

SEQ ID NO: 62594 - RNA, 21 nt, Human
aagagaagaugagcaccaggg

SEQ ID NO: 62595 - RNA, 18 nt, Human
aagcuucgcuggcagaac

SEQ ID NO: 62596 - RNA, 24 nt, Human
aagcuucgcuggcagaacagggau

SEQ ID NO: 62597 - RNA, 22 nt, Human
aaguagccaauuaucacggaca

SEQ ID NO: 62598 - RNA, 23 nt, Human
aagucucuuuccaggccaugaac

SEQ ID NO: 62599 - RNA, 20 nt, Human
aagugacuaccagcuggaga

SEQ ID NO: 62600 - RNA, 26 nt, Human
aagugacuaccagcuggagaggagga

SEQ ID NO: 62601 - RNA, 24 nt, Human
aagugucuauucaagucuuuugcc

SEQ ID NO: 62602 - RNA, 19 nt, Human
aaugagugaacccaaccac

SEQ ID NO: 62603 - RNA, 22 nt, Human
aaugggcauagaaucuuuaaac

SEQ ID NO: 62604 - RNA, 22 nt, Human
acaaaaccuggcagcccaugcc

SEQ ID NO: 62605 - RNA, 23 nt, Human
acacuacaagagggcgaaggagc

SEQ ID NO: 62606 - RNA, 24 nt, Human
acacugaaucuacaauuauuagau

SEQ ID NO: 62607 - RNA, 24 nt, Human
acccaacaacaccagggccaacca

SEQ ID NO: 62608 - RNA, 21 nt, Human
agaaaaagaucaagcucagga

SEQ ID NO: 62609 - RNA, 20 nt, Human
agacaucaaaaggcugagua

SEQ ID NO: 62610 - RNA, 19 nt, Human
agacgggaggaacaacggg

SEQ ID NO: 62611 - RNA, 20 nt, Human
agagcccuccacagccacac

SEQ ID NO: 62612 - RNA, 21 nt, Human
agauaacagagacaaaugcuc

SEQ ID NO: 62613 - RNA, 19 nt, Human
agcagcugccacccaacaa

SEQ ID NO: 62614 - RNA, 23 nt, Human
agcccaugcaguggaaacucaca

SEQ ID NO: 62615 - RNA, 23 nt, Human
agcuguguaguccacgggaccuc

SEQ ID NO: 62616 - RNA, 24 nt, Human
aggaaacaauggaaaaguagccaa

SEQ ID NO: 62617 - RNA, 23 nt, Human
aggaggaagcuucgcuggcagaa

SEQ ID NO: 62618 - RNA, 22 nt, Human
aggcagagcccuccacagccac

SEQ ID NO: 62619 - RNA, 24 nt, Human
agguaaaagcucugccaaacaaaa

SEQ ID NO: 62620 - RNA, 21 nt, Human
aggugguuccuuucacaguug

SEQ ID NO: 62621 - RNA, 21 nt, Human
aggugguuccuuucacaguug

SEQ ID NO: 62622 - RNA, 20 nt, Human
aguaacugaaaaaaucuucu

SEQ ID NO: 62623 - RNA, 19 nt, Human
aucaaaaggcugaguacag

SEQ ID NO: 62624 - RNA, 27 nt, Human
auccuuuuggcauugguaggcugccaa

SEQ ID NO: 62625 - RNA, 22 nt, Human
auuuuacacacauaucaucaaa

SEQ ID NO: 62626 - RNA, 21 nt, Human
caaaaggcugaguacagacac

SEQ ID NO: 62627 - RNA, 23 nt, Human
caaaaggcugaguacagacacca

SEQ ID NO: 62628 - RNA, 25 nt, Human
caaaaugaaaucuccauuccacugg

SEQ ID NO: 62629 - RNA, 21 nt, Human
caacaacaccagggccaacca

SEQ ID NO: 62630 - RNA, 18 nt, Human
cacagccacacuacaaga

SEQ ID NO: 62631 - RNA, 23 nt, Human
caccacaggcccagcccacagcc

SEQ ID NO: 62632 - RNA, 19 nt, Human
caccagggccaaccauuag

SEQ ID NO: 62633 - RNA, 20 nt, Human
cacuccgggcagucccggcc

SEQ ID NO: 62634 - RNA, 18 nt, Human
cacugcugcugacaaaau

SEQ ID NO: 62635 - RNA, 21 nt, Human
cagaaaaagaucaagcucagg

SEQ ID NO: 62636 - RNA, 20 nt, Human
caugcacuccgggcaguccc

SEQ ID NO: 62637 - RNA, 20 nt, Human
ccaaacaaaauacucugaaa

SEQ ID NO: 62638 - RNA, 25 nt, Human
ccacaggccaccccccauaggcaga

SEQ ID NO: 62639 - RNA, 19 nt, Human
cccaugcacuccgggcagu

SEQ ID NO: 62640 - RNA, 22 nt, Human
ccccgugccccuccuccaccgg

SEQ ID NO: 62641 - RNA, 19 nt, Human
cccgagggagaaagauggg

SEQ ID NO: 62642 - RNA, 18 nt, Human
cccuccacagccacacua

SEQ ID NO: 62643 - RNA, 21 nt, Human
cccuggcccgcgcccaugcac

SEQ ID NO: 62644 - RNA, 24 nt, Human
cgaccuaaacacgaagucacccaa

SEQ ID NO: 62645 - RNA, 19 nt, Human
cgauuugcaaauauuuucu

SEQ ID NO: 62646 - RNA, 19 nt, Human
cgcaagugacuaccagcug

SEQ ID NO: 62647 - RNA, 20 nt, Human
cggcggcugaacgucuuuuc

SEQ ID NO: 62648 - RNA, 28 nt, Human
cgugugcuuguuugccacgcguguaugg

SEQ ID NO: 62649 - RNA, 20 nt, Human
cuagauacagaguuauggau

SEQ ID NO: 62650 - RNA, 21 nt, Human
cucaccauuaacaugcauuua

SEQ ID NO: 62651 - RNA, 24 nt, Human
cucacuagaaucuuugggucccca

SEQ ID NO: 62652 - RNA, 19 nt, Human
cugccacccaacaacacca

SEQ ID NO: 62653 - RNA, 22 nt, Human
cugcugcugacaaaaugaaauc

SEQ ID NO: 62654 - RNA, 21 nt, Human
cuggaugaaugacaagagaag

SEQ ID NO: 62655 - RNA, 19 nt, Human
gaacugacagcaugacagu

SEQ ID NO: 62656 - RNA, 19 nt, Human
gaccacaauacuguauuug

SEQ ID NO: 62657 - RNA, 19 nt, Human
gacuugucaauugggaacu

SEQ ID NO: 62658 - RNA, 20 nt, Human
gagacaaaugcucacacugu

SEQ ID NO: 62659 - RNA, 21 nt, Human
gagcuguguaguccacgggac

SEQ ID NO: 62660 - RNA, 26 nt, Human
gauacaagccacaggccaccccccau

SEQ ID NO: 62661 - RNA, 21 nt, Human
gauccaacaaaugcccuaaua

SEQ ID NO: 62662 - RNA, 21 nt, Human
gauuugcaaauauuuucuccc

SEQ ID NO: 62663 - RNA, 18 nt, Human
gcaaagaauaacagguaa

SEQ ID NO: 62664 - RNA, 21 nt, Human
gcagcccaugccuggaugaau

SEQ ID NO: 62665 - RNA, 18 nt, Human
gcccaugcacuccgggca

SEQ ID NO: 62666 - RNA, 18 nt, Human
gccccgugccccuccucc

SEQ ID NO: 62667 - RNA, 21 nt, Human
gccccgugccccuccuccacc

SEQ ID NO: 62668 - RNA, 18 nt, Human
gcgaccgcucagcguccc

SEQ ID NO: 62669 - RNA, 20 nt, Human
gcuggagcucggaggccccg

SEQ ID NO: 62670 - RNA, 21 nt, Human
ggaaaacuucuuuuaugggaa

SEQ ID NO: 62671 - RNA, 19 nt, Human
gggccaaccauuagcacca

SEQ ID NO: 62672 - RNA, 27 nt, Human
gugugugcaucugugcacgcgcacggu

SEQ ID NO: 62673 - RNA, 25 nt, Human
uaaaaagacaucaaaaggcugagua

SEQ ID NO: 62674 - RNA, 21 nt, Human
uaacagagacaaaugcucaca

SEQ ID NO: 62675 - RNA, 23 nt, Human
uaaccaagccaucggcggcugaa

SEQ ID NO: 62676 - RNA, 22 nt, Human
uacaagccacaggccacccccc

SEQ ID NO: 62677 - RNA, 19 nt, Human
ucacccaagggauucacuc

SEQ ID NO: 62678 - RNA, 23 nt, Human
ucacuagaaucuuugggucccca

SEQ ID NO: 62679 - RNA, 21 nt, Human
ucagcgucccuggcccgcgcc

SEQ ID NO: 62680 - RNA, 19 nt, Human
ucaggaaguguggauucua

SEQ ID NO: 62681 - RNA, 24 nt, Human
ucauaugcauacaaaauacauggu

SEQ ID NO: 62682 - RNA, 23 nt, Human
uccaaaaaguuaauaaauuauca

SEQ ID NO: 62683 - RNA, 24 nt, Human
ucccacacaaacacaaaaguuauu

SEQ ID NO: 62684 - RNA, 18 nt, Human
uccuugggaacggagcug

SEQ ID NO: 62685 - RNA, 21 nt, Human
uccuugggaacggagcuggag

SEQ ID NO: 62686 - RNA, 18 nt, Human
ucggaggccccgugcccc

SEQ ID NO: 62687 - RNA, 23 nt, Human
ucugccaaacaaaauacucugaa

SEQ ID NO: 62688 - RNA, 22 nt, Human
ucuuuaaguggcaauuuaaucu

SEQ ID NO: 62689 - RNA, 19 nt, Human
ucuuuuaugggaauaaggg

SEQ ID NO: 62690 - RNA, 24 nt, Human
ucuuuuaugggaauaaggggaagu

SEQ ID NO: 62691 - RNA, 23 nt, Human
ugauccaacaaaugcccuaauac

SEQ ID NO: 62692 - RNA, 18 nt, Human
ugaugugaggugagaagg

SEQ ID NO: 62693 - RNA, 22 nt, Human
ugccccuccuccaccggggacu

SEQ ID NO: 62694 - RNA, 23 nt, Human
ugccccuccuccaccggggacug

SEQ ID NO: 62695 - RNA, 22 nt, Human
ugggagaagucucuuuccagga

SEQ ID NO: 62696 - RNA, 20 nt, Human
ugugcacgcgcacgcgucug

SEQ ID NO: 62697 - RNA, 22 nt, Human
uuacuuugcagaacaacuguga

SEQ ID NO: 62698 - RNA, 21 nt, Human
uugcuguguagaagagaaagu

SEQ ID NO: 62699 - RNA, 18 nt, Human
uuuagaauccugccauuu

SEQ ID NO: 62700 - RNA, 23 nt, Human
aaaagaaggagggccugcccaaa

SEQ ID NO: 62701 - RNA, 27 nt, Human
aaacagaaagagaaagaaaggggaccc

SEQ ID NO: 62702 - RNA, 22 nt, Human
aacagaaagagaaagaaagaga

SEQ ID NO: 62703 - RNA, 22 nt, Human
aagaaagagauagaaacaggga

SEQ ID NO: 62704 - RNA, 19 nt, Human
aagaggcuugaccaugcag

SEQ ID NO: 62705 - RNA, 22 nt, Human
aagcaauuacgguagaauccca

SEQ ID NO: 62706 - RNA, 26 nt, Human
acuccaaagagacauauaugcagagg

SEQ ID NO: 62707 - RNA, 23 nt, Human
acugcaccuccugggaucucuuc

SEQ ID NO: 62708 - RNA, 18 nt, Human
aggcaguaaguccgagcg

SEQ ID NO: 62709 - RNA, 21 nt, Human
aggccaggaaacagaaagaga

SEQ ID NO: 62710 - RNA, 23 nt, Human
auuucaccccuccccucccuccg

SEQ ID NO: 62711 - RNA, 23 nt, Human
caaagcaauuacgguagaauccc

SEQ ID NO: 62712 - RNA, 18 nt, Human
caccauugggagcaaggu

SEQ ID NO: 62713 - RNA, 18 nt, Human
caccccuccccucccucc

SEQ ID NO: 62714 - RNA, 21 nt, Human
caccccuccccucccuccgcc

SEQ ID NO: 62715 - RNA, 18 nt, Human
cccccuccacugcaccuc

SEQ ID NO: 62716 - RNA, 23 nt, Human
cccccuccacugcaccuccuggg

SEQ ID NO: 62717 - RNA, 24 nt, Human
cccuccacugcaccuccugggauc

SEQ ID NO: 62718 - RNA, 23 nt, Human
ccuccugggaucucuucccccuc

SEQ ID NO: 62719 - RNA, 21 nt, Human
ccugggaucucuucccccucc

SEQ ID NO: 62720 - RNA, 21 nt, Human
ccuggggaaagaacacagggc

SEQ ID NO: 62721 - RNA, 24 nt, Human
cggugagcaacuuuggggcgaggg

SEQ ID NO: 62722 - RNA, 21 nt, Human
cucccuccgcccgccccugcc

SEQ ID NO: 62723 - RNA, 19 nt, Human
cuccgcccgccccugcccc

SEQ ID NO: 62724 - RNA, 21 nt, Human
cugcccccuacguggaugccc

SEQ ID NO: 62725 - RNA, 22 nt, Human
gaucucuucccccuccaagcac

SEQ ID NO: 62726 - RNA, 21 nt, Human
gccccuggggaaagaacacag

SEQ ID NO: 62727 - RNA, 23 nt, Human
gcugcaggccuguagagcucugc

SEQ ID NO: 62728 - RNA, 21 nt, Human
ggaaagagcagcccuggucua

SEQ ID NO: 62729 - RNA, 23 nt, Human
ggagcaaagcuugcccccuccaa

SEQ ID NO: 62730 - RNA, 19 nt, Human
ggggaagugacuuuggcca

SEQ ID NO: 62731 - RNA, 20 nt, Human
ggggaagugacuuuggccag

SEQ ID NO: 62732 - RNA, 21 nt, Human
guuaggaaaagaaggagggcc

SEQ ID NO: 62733 - RNA, 18 nt, Human
uagagcucugccgguccc

SEQ ID NO: 62734 - RNA, 27 nt, Human
uagcaggugggucccuuucuuucaccu

SEQ ID NO: 62735 - RNA, 18 nt, Human
ucaccccuccccucccuc

SEQ ID NO: 62736 - RNA, 19 nt, Human
ucaggcaguaaguccgagc

SEQ ID NO: 62737 - RNA, 22 nt, Human
uccaaggucaggcaguaagucc

SEQ ID NO: 62738 - RNA, 24 nt, Human
ucccuuucuuucaccuccuccaca

SEQ ID NO: 62739 - RNA, 19 nt, Human
uccgcccgccccugccccu

SEQ ID NO: 62740 - RNA, 23 nt, Human
uccgcccgccccugccccugccc

SEQ ID NO: 62741 - RNA, 18 nt, Human
uccugggaucucuucccc

SEQ ID NO: 62742 - RNA, 23 nt, Human
uccugggaucucuucccccucca

SEQ ID NO: 62743 - RNA, 21 nt, Human
ugaaauuccaacuccaaagag

SEQ ID NO: 62744 - RNA, 23 nt, Human
ugaggggcgacuagcaggugggu

SEQ ID NO: 62745 - RNA, 19 nt, Human
ugagucggugagcaacuuu

SEQ ID NO: 62746 - RNA, 19 nt, Human
ugcagaaggaggucacuca

SEQ ID NO: 62747 - RNA, 24 nt, Human
ugccacuuugcagaaggaggucac

SEQ ID NO: 62748 - RNA, 21 nt, Human
uggaugcccgggccagacccc

SEQ ID NO: 62749 - RNA, 22 nt, Human
uggggaaagaacacagggcaag

SEQ ID NO: 62750 - RNA, 23 nt, Human
uucuuucaccuccuccacaacuu

SEQ ID NO: 62751 - RNA, 18 nt, Human
uuggccugagaccgcugc

SEQ ID NO: 62752 - RNA, 22 nt, Human
aaaccuguucacacucaggggc

SEQ ID NO: 62753 - RNA, 18 nt, Human
accaguugcaucauuccc

SEQ ID NO: 62754 - RNA, 22 nt, Human
acuucagacugcgggagaggag

SEQ ID NO: 62755 - RNA, 21 nt, Human
agagaacuuggggaugaacac

SEQ ID NO: 62756 - RNA, 26 nt, Human
agagaacuuggggaugaacacacuug

SEQ ID NO: 62757 - RNA, 21 nt, Human
agcagcuacucugcgcugggg

SEQ ID NO: 62758 - RNA, 19 nt, Human
aggcagggucuguacacuc

SEQ ID NO: 62759 - RNA, 21 nt, Human
aggcucaggcuccuccggcag

SEQ ID NO: 62760 - RNA, 19 nt, Human
aggggcaugcacaacucug

SEQ ID NO: 62761 - RNA, 18 nt, Human
agguuggggaggaagggg

SEQ ID NO: 62762 - RNA, 18 nt, Human
augcuccgggcacucgcu

SEQ ID NO: 62763 - RNA, 26 nt, Human
caacguaggcaaaccuguucacacuc

SEQ ID NO: 62764 - RNA, 22 nt, Human
caccugccucccuccccagcuc

SEQ ID NO: 62765 - RNA, 18 nt, Human
cacuccccacucaguacc

SEQ ID NO: 62766 - RNA, 24 nt, Human
cagaguuucccucuuaccacccac

SEQ ID NO: 62767 - RNA, 22 nt, Human
cagcacuggccugggcgcgcac

SEQ ID NO: 62768 - RNA, 18 nt, Human
cagccaugcacacuugca

SEQ ID NO: 62769 - RNA, 23 nt, Human
cagcucaguccccuaaguuuccc

SEQ ID NO: 62770 - RNA, 19 nt, Human
ccacccaccugccucccuc

SEQ ID NO: 62771 - RNA, 22 nt, Human
cccaccugccucccuccccagc

SEQ ID NO: 62772 - RNA, 18 nt, Human
cccccaaggcagggucug

SEQ ID NO: 62773 - RNA, 18 nt, Human
cccugcggggcuggccca

SEQ ID NO: 62774 - RNA, 19 nt, Human
ccuccggcagccuccuccc

SEQ ID NO: 62775 - RNA, 23 nt, Human
ccugcggggcuggcccagcuguc

SEQ ID NO: 62776 - RNA, 18 nt, Human
ccugggcgcgcacgucca

SEQ ID NO: 62777 - RNA, 22 nt, Human
ccugggcgcgcacguccaggaa

SEQ ID NO: 62778 - RNA, 18 nt, Human
cuaguaaaaccaguugca

SEQ ID NO: 62779 - RNA, 18 nt, Human
cuccccagcucagucccc

SEQ ID NO: 62780 - RNA, 21 nt, Human
cucugcgcuggggccaacuuc

SEQ ID NO: 62781 - RNA, 23 nt, Human
cugcaugugaggacaaaagagaa

SEQ ID NO: 62782 - RNA, 18 nt, Human
gcgggagaggagggacgg

SEQ ID NO: 62783 - RNA, 27 nt, Human
gcgggagaggagggacgggguggcccu

SEQ ID NO: 62784 - RNA, 18 nt, Human
ggagggacgggguggccc

SEQ ID NO: 62785 - RNA, 22 nt, Human
ggcaugcacaacucugcaugug

SEQ ID NO: 62786 - RNA, 21 nt, Human
ggcucaggcuccuccggcagc

SEQ ID NO: 62787 - RNA, 28 nt, Human
ucacagccucagggcaggggggaacgcc

SEQ ID NO: 62788 - RNA, 25 nt, Human
ucaggcuccuccggcagccuccucc

SEQ ID NO: 62789 - RNA, 19 nt, Human
ucccagaacccccaaggca

SEQ ID NO: 62790 - RNA, 20 nt, Human
ucccugaaaaaggcaggaga

SEQ ID NO: 62791 - RNA, 22 nt, Human
uccggcagccuccuccccgccu

SEQ ID NO: 62792 - RNA, 22 nt, Human
ucuccagaguuucccucuuacc

SEQ ID NO: 62793 - RNA, 18 nt, Human
ucugccucgggccucaca

SEQ ID NO: 62794 - RNA, 21 nt, Human
ugaaaaaggcaggagaagcca

SEQ ID NO: 62795 - RNA, 21 nt, Human
ugcacacuugcaccaacguag

SEQ ID NO: 62796 - RNA, 22 nt, Human
ugcagguuggggaggaaggggu

SEQ ID NO: 62797 - RNA, 19 nt, Human
ugccucgggccucacaagc

SEQ ID NO: 62798 - RNA, 19 nt, Human
ugccucgggccucacaagc

SEQ ID NO: 62799 - RNA, 22 nt, Human
ugcgggagaggagggacggggu

SEQ ID NO: 62800 - RNA, 19 nt, Human
uggcccagcugucucaggg

SEQ ID NO: 62801 - RNA, 21 nt, Human
ugggcgcgcacguccaggaag

SEQ ID NO: 62802 - RNA, 22 nt, Human
uggggaggaaggggugcaaggg

SEQ ID NO: 62803 - RNA, 25 nt, Human
acacacacacaccccugcacacaca

SEQ ID NO: 62804 - RNA, 23 nt, Human
acacacaugcacacacacacaua

SEQ ID NO: 62805 - RNA, 27 nt, Human
acacacaugcacacacaugcacacaca

SEQ ID NO: 62806 - RNA, 27 nt, Human
acacacaugcacacacaugcacacaca

SEQ ID NO: 62807 - RNA, 30 nt, Human
acacacaugcacacacaugcacacacacag

SEQ ID NO: 62808 - RNA, 30 nt, Human
acacacaugcacacacaugcacacacaugg

SEQ ID NO: 62809 - RNA, 23 nt, Human
acacaugcacacacaugcacaca

SEQ ID NO: 62810 - RNA, 18 nt, Human
accccccccacacacaca

SEQ ID NO: 62811 - RNA, 19 nt, Human
acccuggaacuuuccucuc

SEQ ID NO: 62812 - RNA, 22 nt, Human
acccuggaacuuuccucuccuu

SEQ ID NO: 62813 - RNA, 24 nt, Human
agacaaaaggauguauugacccaa

SEQ ID NO: 62814 - RNA, 21 nt, Human
aggccagggcagcggaguggg

SEQ ID NO: 62815 - RNA, 18 nt, Human
aggcggcggcgcugucgg

SEQ ID NO: 62816 - RNA, 21 nt, Human
agggagcuccuuagccugaaa

SEQ ID NO: 62817 - RNA, 24 nt, Human
augcacacacacacauaccugcug

SEQ ID NO: 62818 - RNA, 24 nt, Human
caauagccagaaucccuuccgacc

SEQ ID NO: 62819 - RNA, 20 nt, Human
cacacacaugcacacacaca

SEQ ID NO: 62820 - RNA, 29 nt, Human
cacacacaugcacacacacacauaccugg

SEQ ID NO: 62821 - RNA, 25 nt, Human
cacacacaugcacacacaugcacac

SEQ ID NO: 62822 - RNA, 25 nt, Human
cacacacaugcacacacaugcacac

SEQ ID NO: 62823 - RNA, 23 nt, Human
cacagauggacaggcugccuucc

SEQ ID NO: 62824 - RNA, 26 nt, Human
caugcacacacaugcacacacacaca

SEQ ID NO: 62825 - RNA, 26 nt, Human
caugcacacacaugcacacacaugca

SEQ ID NO: 62826 - RNA, 22 nt, Human
cauucucuucccuugggagaca

SEQ ID NO: 62827 - RNA, 31 nt, Human
cccacacacacacaccccugcacacacaugg

SEQ ID NO: 62828 - RNA, 25 nt, Human
cccacacacacacaccccugcacag

SEQ ID NO: 62829 - RNA, 23 nt, Human
cccacacacacacaccccugcag

SEQ ID NO: 62830 - RNA, 19 nt, Human
ccccugaaacauacacacc

SEQ ID NO: 62831 - RNA, 22 nt, Human
ccugaaacauacacacccugga

SEQ ID NO: 62832 - RNA, 26 nt, Human
ccugcacacacaugcacacacaugca

SEQ ID NO: 62833 - RNA, 26 nt, Human
ccugcacacacaugcacacacauggu

SEQ ID NO: 62834 - RNA, 21 nt, Human
ccugcugcccauucucuuccc

SEQ ID NO: 62835 - RNA, 22 nt, Human
ccuugcccugaauaucugggaa

SEQ ID NO: 62836 - RNA, 24 nt, Human
ccuugcccugaauaucugggaacc

SEQ ID NO: 62837 - RNA, 25 nt, Human
cgggcagggguggcgggaggcggug

SEQ ID NO: 62838 - RNA, 21 nt, Human
cggggcaggcggcggcgcugu

SEQ ID NO: 62839 - RNA, 20 nt, Human
cucaaggccagggcagcgga

SEQ ID NO: 62840 - RNA, 18 nt, Human
cugcagcuccuccaugug

SEQ ID NO: 62841 - RNA, 22 nt, Human
gcagcuccuccaugugaagccc

SEQ ID NO: 62842 - RNA, 19 nt, Human
gccuuccccugucucuggg

SEQ ID NO: 62843 - RNA, 21 nt, Human
gcggaguggggagauggcccc

SEQ ID NO: 62844 - RNA, 22 nt, Human
gcugucgggcgggcaggggugg

SEQ ID NO: 62845 - RNA, 23 nt, Human
ggcagggguggcgggaggcggug

SEQ ID NO: 62846 - RNA, 23 nt, Human
gggaggcgguggcgcagcgagca

SEQ ID NO: 62847 - RNA, 20 nt, Human
gggcagggguggcgggaggc

SEQ ID NO: 62848 - RNA, 18 nt, Human
gguccaguggaaauccug

SEQ ID NO: 62849 - RNA, 23 nt, Human
uauugacccaaauuccgguucca

SEQ ID NO: 62850 - RNA, 23 nt, Human
ucccccaauagccagaaucccuu

SEQ ID NO: 62851 - RNA, 23 nt, Human
ugaagccccugaaacauacacac

SEQ ID NO: 62852 - RNA, 19 nt, Human
ugcccauucucuucccuug

SEQ ID NO: 62853 - RNA, 21 nt, Human
ugcucaaggccagggcagcgg

SEQ ID NO: 62854 - RNA, 23 nt, Human
uggaugcucaaggccagggcagc

SEQ ID NO: 62855 - RNA, 18 nt, Human
ugggagacaaaaggaugu

SEQ ID NO: 62856 - RNA, 20 nt, Human
ugggagacaaaaggauguau

SEQ ID NO: 62857 - RNA, 21 nt, Human
uguauugacccaaauuccggu

SEQ ID NO: 62858 - RNA, 20 nt, Human
uuccccugucucugggcucc

SEQ ID NO: 62859 - RNA, 21 nt, Human
uuccccugucucugggcuccc

SEQ ID NO: 62860 - RNA, 24 nt, Human
uugggcaagguccaguggaaaucu

SEQ ID NO: 62861 - RNA, 21 nt, Human
aacaaaccugcacauuucuaa

SEQ ID NO: 62862 - RNA, 24 nt, Human
acaaaucuguuuccuuaaugggug

SEQ ID NO: 62863 - RNA, 23 nt, Human
agugcagcucucauugccugccc

SEQ ID NO: 62864 - RNA, 24 nt, Human
caggcaagacuuaaccaaaucuug

SEQ ID NO: 62865 - RNA, 20 nt, Human
gaaggaaaucugaggacagu

SEQ ID NO: 62866 - RNA, 19 nt, Human
guuucuuccguuccuccuu

SEQ ID NO: 62867 - RNA, 21 nt, Human
uaauaugacaugaaacaacaa

SEQ ID NO: 62868 - RNA, 21 nt, Human
uaauggguggaaggaaaucug

SEQ ID NO: 62869 - RNA, 20 nt, Human
uagguuucuuccguuccucc

SEQ ID NO: 62870 - RNA, 21 nt, Human
ugacuauaccaauauuccagu

SEQ ID NO: 62871 - RNA, 22 nt, Human
ugacuauaccaauauuccagua

SEQ ID NO: 62872 - RNA, 20 nt, Human
ugaggacaguucuaaggagu

SEQ ID NO: 62873 - RNA, 23 nt, Human
uucuaaggagucuugucugcuuu

SEQ ID NO: 62874 - RNA, 18 nt, Human
agguggaugcggcggggg

SEQ ID NO: 62875 - RNA, 25 nt, Human
agguggaugcggcgggggcgggggc

SEQ ID NO: 62876 - RNA, 19 nt, Human
augcggcgggggcgggggc

SEQ ID NO: 62877 - RNA, 21 nt, Human
augcggcgggggcgggggccu

SEQ ID NO: 62878 - RNA, 24 nt, Human
caaccccggcgcgacccccgcccc

SEQ ID NO: 62879 - RNA, 18 nt, Human
cagccgccggcccguccg

SEQ ID NO: 62880 - RNA, 18 nt, Human
cagguuggcucccgcgcu

SEQ ID NO: 62881 - RNA, 24 nt, Human
cccccggccggggcagccgccggc

SEQ ID NO: 62882 - RNA, 19 nt, Human
cccgccccccggccggggc

SEQ ID NO: 62883 - RNA, 22 nt, Human
cccggcgcgacccccgcccccc

SEQ ID NO: 62884 - RNA, 20 nt, Human
ccgcugcgggcccgccgcuc

SEQ ID NO: 62885 - RNA, 21 nt, Human
ccgcugcgggcccgccgcucu

SEQ ID NO: 62886 - RNA, 22 nt, Human
ccgcugcgggcccgccgcucuc

SEQ ID NO: 62887 - RNA, 22 nt, Human
ccgucguccagcgcaaccccgg

SEQ ID NO: 62888 - RNA, 20 nt, Human
cggaggagguggaugcggcg

SEQ ID NO: 62889 - RNA, 21 nt, Human
cggcccagcgucccgggcccu

SEQ ID NO: 62890 - RNA, 19 nt, Human
cggcgcgacccccgccccc

SEQ ID NO: 62891 - RNA, 23 nt, Human
cggcgcgggggggcagggggcgg

SEQ ID NO: 62892 - RNA, 21 nt, Human
cggcgggggcgggggccuggc

SEQ ID NO: 62893 - RNA, 18 nt, Human
cggggccggcgcgggggg

SEQ ID NO: 62894 - RNA, 21 nt, Human
gcacugucccgcgcccacucc

SEQ ID NO: 62895 - RNA, 24 nt, Human
gcccggcgcgagcugccggcgggg

SEQ ID NO: 62896 - RNA, 19 nt, Human
gcgcggcgcggguugggag

SEQ ID NO: 62897 - RNA, 22 nt, Human
gcggccuggcgcgggcccugcu

SEQ ID NO: 62898 - RNA, 18 nt, Human
gcgggcggccgggcgcgg

SEQ ID NO: 62899 - RNA, 18 nt, Human
ggccggggcagccgccgg

SEQ ID NO: 62900 - RNA, 22 nt, Human
ggcgccgcgcacugucccgcgc

SEQ ID NO: 62901 - RNA, 20 nt, Human
ggcgcgacccccgccccccg

SEQ ID NO: 62902 - RNA, 20 nt, Human
ggcgcggggccggcgcgggg

SEQ ID NO: 62903 - RNA, 20 nt, Human
ggcgcgggggggcagggggc

SEQ ID NO: 62904 - RNA, 18 nt, Human
ggcggccgggcgcggggc

SEQ ID NO: 62905 - RNA, 18 nt, Human
ggcggcggaggaggugga

SEQ ID NO: 62906 - RNA, 22 nt, Human
ggcuggcggccuggcgcgggcc

SEQ ID NO: 62907 - RNA, 26 nt, Human
gggaggcuccaggccgcugcgggccc

SEQ ID NO: 62908 - RNA, 19 nt, Human
gggccagcgcggcgcgggu

SEQ ID NO: 62909 - RNA, 20 nt, Human
ggggcgggggccuggcugcg

SEQ ID NO: 62910 - RNA, 19 nt, Human
gggucgcaggcggcggagg

SEQ ID NO: 62911 - RNA, 21 nt, Human
uccaggccgcugcgggcccgc

SEQ ID NO: 62912 - RNA, 24 nt, Human
ucccugggagacggggcucggucc

SEQ ID NO: 62913 - RNA, 21 nt, Human
uccgaccucggggcgucuagc

SEQ ID NO: 62914 - RNA, 23 nt, Human
ucgcaggcggcggaggaggugga

SEQ ID NO: 62915 - RNA, 19 nt, Human
ugcgggcccgccgcucucc

SEQ ID NO: 62916 - RNA, 21 nt, Human
uggcgcgggcccugcuggggc

SEQ ID NO: 62917 - RNA, 18 nt, Human
uggcucccgcgcucuccu

SEQ ID NO: 62918 - RNA, 19 nt, Human
uggcucccgcgcucuccuc

SEQ ID NO: 62919 - RNA, 21 nt, Human
aaaccacacccaaggucagag

SEQ ID NO: 62920 - RNA, 21 nt, Human
aaaccacacccaaggucagag

SEQ ID NO: 62921 - RNA, 27 nt, Human
aaaccacacccaaggucagagaaacac

SEQ ID NO: 62922 - RNA, 25 nt, Human
aaagaucuauugguagagcagucuc

SEQ ID NO: 62923 - RNA, 25 nt, Human
aaagaucuauugguagagcagucuc

SEQ ID NO: 62924 - RNA, 18 nt, Human
aaauauaccccccaaaac

SEQ ID NO: 62925 - RNA, 18 nt, Human
aaauauaccccccaaaac

SEQ ID NO: 62926 - RNA, 23 nt, Human
aaauccccugccuuccucugcuc

SEQ ID NO: 62927 - RNA, 23 nt, Human
aaauccccugccuuccucugcuc

SEQ ID NO: 62928 - RNA, 24 nt, Human
aacagaucaagauucugucucaaa

SEQ ID NO: 62929 - RNA, 22 nt, Human
aaccucccccucccgccacccc

SEQ ID NO: 62930 - RNA, 22 nt, Human
aaccucccuuccucuaucccac

SEQ ID NO: 62931 - RNA, 22 nt, Human
aaccucccuuccucuaucccac

SEQ ID NO: 62932 - RNA, 20 nt, Human
aagcgaagacacagagcacc

SEQ ID NO: 62933 - RNA, 24 nt, Human
aaggaggaaauauaccccccaaaa

SEQ ID NO: 62934 - RNA, 20 nt, Human
aaggauugugaacacugcca

SEQ ID NO: 62935 - RNA, 18 nt, Human
aagguggaacacagaugg

SEQ ID NO: 62936 - RNA, 18 nt, Human
aaguucccuccuccacuc

SEQ ID NO: 62937 - RNA, 23 nt, Human
aaguucccuccuccacucccacc

SEQ ID NO: 62938 - RNA, 22 nt, Human
aaguuugaaaauugguccagcc

SEQ ID NO: 62939 - RNA, 20 nt, Human
aauaugaugaaaccccaucu

SEQ ID NO: 62940 - RNA, 20 nt, Human
aauaugaugaaaccccaucu

SEQ ID NO: 62941 - RNA, 21 nt, Human
aauaugaugaaaccccaucuc

SEQ ID NO: 62942 - RNA, 24 nt, Human
aaucccuugaacccaggagguaga

SEQ ID NO: 62943 - RNA, 24 nt, Human
aaucccuugaacccaggagguaga

SEQ ID NO: 62944 - RNA, 24 nt, Human
aaugggacaaauucacucccagau

SEQ ID NO: 62945 - RNA, 22 nt, Human
acaccacaccgugcccguaaac

SEQ ID NO: 62946 - RNA, 19 nt, Human
acacuguggccugcagcug

SEQ ID NO: 62947 - RNA, 23 nt, Human
acagaucaagauucugucucaaa

SEQ ID NO: 62948 - RNA, 24 nt, Human
acagaucaagauucugucucaaaa

SEQ ID NO: 62949 - RNA, 24 nt, Human
acagaucaagauucugucucaaaa

SEQ ID NO: 62950 - RNA, 23 nt, Human
acagcagucccuggaggaggauu

SEQ ID NO: 62951 - RNA, 24 nt, Human
acccaggagguagagguugcagug

SEQ ID NO: 62952 - RNA, 24 nt, Human
acccaggagguagagguugcagug

SEQ ID NO: 62953 - RNA, 24 nt, Human
accccaucucuacuaaaaauacaa

SEQ ID NO: 62954 - RNA, 24 nt, Human
accccaucucuacuaaaaauacaa

SEQ ID NO: 62955 - RNA, 21 nt, Human
acccugggcuuuugcucucug

SEQ ID NO: 62956 - RNA, 23 nt, Human
accucccccucccgccaccccag

SEQ ID NO: 62957 - RNA, 27 nt, Human
acucccaccuauacccgcacucacaga

SEQ ID NO: 62958 - RNA, 21 nt, Human
acuccuacgggguccaguggg

SEQ ID NO: 62959 - RNA, 21 nt, Human
acuccuacgggguccaguggg

SEQ ID NO: 62960 - RNA, 24 nt, Human
acugcacuccagccuggguaacag

SEQ ID NO: 62961 - RNA, 24 nt, Human
acugcacuccagccuggguaacag

SEQ ID NO: 62962 - RNA, 24 nt, Human
acuuugggaggccgaggugggcag

SEQ ID NO: 62963 - RNA, 23 nt, Human
agaaacacccccaggagcucaga

SEQ ID NO: 62964 - RNA, 23 nt, Human
agaaacacccccaggagcucaga

SEQ ID NO: 62965 - RNA, 23 nt, Human
agagaaacacccccaggagcuca

SEQ ID NO: 62966 - RNA, 23 nt, Human
agagaaacacccccaggagcuca

SEQ ID NO: 62967 - RNA, 22 nt, Human
agagcagucucuguccucagga

SEQ ID NO: 62968 - RNA, 22 nt, Human
agagcagucucuguccucagga

SEQ ID NO: 62969 - RNA, 24 nt, Human
agaggccgggcacgguggcucacg

SEQ ID NO: 62970 - RNA, 18 nt, Human
agagguugcagugagccg

SEQ ID NO: 62971 - RNA, 18 nt, Human
agagguugcagugagccg

SEQ ID NO: 62972 - RNA, 23 nt, Human
agagguugcagugagccgagauc

SEQ ID NO: 62973 - RNA, 23 nt, Human
agagguugcagugagccgagauc

SEQ ID NO: 62974 - RNA, 24 nt, Human
agagguugcagugagccgagauca

SEQ ID NO: 62975 - RNA, 24 nt, Human
agagguugcagugagccgagauca

SEQ ID NO: 62976 - RNA, 20 nt, Human
agagugggcugugggguggg

SEQ ID NO: 62977 - RNA, 20 nt, Human
agagugggcugugggguggg

SEQ ID NO: 62978 - RNA, 20 nt, Human
agauccccggccugcuucag

SEQ ID NO: 62979 - RNA, 23 nt, Human
agaucgccucaggucaggaguuu

SEQ ID NO: 62980 - RNA, 23 nt, Human
agaucgccucaggucaggaguuu

SEQ ID NO: 62981 - RNA, 24 nt, Human
agcacuuugggaggccgagguggg

SEQ ID NO: 62982 - RNA, 24 nt, Human
agcacuuugggaggccgagguggg

SEQ ID NO: 62983 - RNA, 18 nt, Human
agcaguugcuuaaccuca

SEQ ID NO: 62984 - RNA, 24 nt, Human
agccuggguaacagaucaagauuc

SEQ ID NO: 62985 - RNA, 24 nt, Human
agccuggguaacagaucaagauuc

SEQ ID NO: 62986 - RNA, 23 nt, Human
agcugggcgugguggcaggcgcc

SEQ ID NO: 62987 - RNA, 23 nt, Human
agcugggcgugguggcaggcgcc

SEQ ID NO: 62988 - RNA, 18 nt, Human
aggaacccaaggcgcggc

SEQ ID NO: 62989 - RNA, 20 nt, Human
aggaacccaaggcgcggcca

SEQ ID NO: 62990 - RNA, 21 nt, Human
aggaacccaaggcgcggccag

SEQ ID NO: 62991 - RNA, 21 nt, Human
aggagagggccuccaagucag

SEQ ID NO: 62992 - RNA, 23 nt, Human
aggagauuugggggaagaaggug

SEQ ID NO: 62993 - RNA, 23 nt, Human
aggaggaaauauaccccccaaaa

SEQ ID NO: 62994 - RNA, 20 nt, Human
aggaggagauuugggggaag

SEQ ID NO: 62995 - RNA, 19 nt, Human
aggcaggaacccaaggcgc

SEQ ID NO: 62996 - RNA, 23 nt, Human
aggcaggagaaucccuugaaccc

SEQ ID NO: 62997 - RNA, 23 nt, Human
aggcaggagaaucccuugaaccc

SEQ ID NO: 62998 - RNA, 24 nt, Human
aggcaggagaaucccuugaaccca

SEQ ID NO: 62999 - RNA, 21 nt, Human
aggccgaggugggcagaucgc

SEQ ID NO: 63000 - RNA, 21 nt, Human
aggccgaggugggcagaucgc

SEQ ID NO: 63001 - RNA, 22 nt, Human
aggccgggcacgguggcucacg

SEQ ID NO: 63002 - RNA, 24 nt, Human
aggcugaggcaggagaaucccuug

SEQ ID NO: 63003 - RNA, 24 nt, Human
aggcugaggcaggagaaucccuug

SEQ ID NO: 63004 - RNA, 23 nt, Human
aggcugccucaagguggccccag

SEQ ID NO: 63005 - RNA, 24 nt, Human
aggggggcgaaggggaggggaagg

SEQ ID NO: 63006 - RNA, 21 nt, Human
agguagagguugcagugagcc

SEQ ID NO: 63007 - RNA, 24 nt, Human
agguagagguugcagugagccgag

SEQ ID NO: 63008 - RNA, 24 nt, Human
agguagagguugcagugagccgag

SEQ ID NO: 63009 - RNA, 21 nt, Human
aggugggcagaucgccucagg

SEQ ID NO: 63010 - RNA, 21 nt, Human
aggugggcagaucgccucagg

SEQ ID NO: 63011 - RNA, 22 nt, Human
aggugggcagaucgccucaggu

SEQ ID NO: 63012 - RNA, 22 nt, Human
aggugggcagaucgccucaggu

SEQ ID NO: 63013 - RNA, 24 nt, Human
agugaguggugcuccucccacccc

SEQ ID NO: 63014 - RNA, 21 nt, Human
aucaccuuguccaccucccag

SEQ ID NO: 63015 - RNA, 24 nt, Human
aucaugccacugcacuccagccug

SEQ ID NO: 63016 - RNA, 24 nt, Human
aucaugccacugcacuccagccug

SEQ ID NO: 63017 - RNA, 24 nt, Human
aucgccucaggucaggaguuugag

SEQ ID NO: 63018 - RNA, 18 nt, Human
augaggccacugaaagga

SEQ ID NO: 63019 - RNA, 21 nt, Human
augccacugcacuccagccug

SEQ ID NO: 63020 - RNA, 22 nt, Human
augccacugcacuccagccugg

SEQ ID NO: 63021 - RNA, 20 nt, Human
augccugcuccagccugagc

SEQ ID NO: 63022 - RNA, 21 nt, Human
augggcuuaugcauguguaug

SEQ ID NO: 63023 - RNA, 21 nt, Human
caaaaguaaccucccccuccc

SEQ ID NO: 63024 - RNA, 22 nt, Human
caaaaguaaccucccccucccg

SEQ ID NO: 63025 - RNA, 24 nt, Human
caagacaggcaccucagcaccugc

SEQ ID NO: 63026 - RNA, 21 nt, Human
caagaggagcggagagaccug

SEQ ID NO: 63027 - RNA, 19 nt, Human
caagcuuuaagcucauuca

SEQ ID NO: 63028 - RNA, 21 nt, Human
caaggacgcuguggacacugu

SEQ ID NO: 63029 - RNA, 19 nt, Human
caccagcugcagggucaga

SEQ ID NO: 63030 - RNA, 18 nt, Human
caccuguggcuuucaggc

SEQ ID NO: 63031 - RNA, 21 nt, Human
caccuuguccaccucccagcu

SEQ ID NO: 63032 - RNA, 24 nt, Human
cacgccuguaaucccagcacuuug

SEQ ID NO: 63033 - RNA, 24 nt, Human
cacgccuguaaucccagcacuuug

SEQ ID NO: 63034 - RNA, 18 nt, Human
cacugcacuccagccugg

SEQ ID NO: 63035 - RNA, 19 nt, Human
cacugcacuccagccuggg

SEQ ID NO: 63036 - RNA, 19 nt, Human
cacugcacuccagccuggg

SEQ ID NO: 63037 - RNA, 19 nt, Human
cacugcacuccagccuggg

SEQ ID NO: 63038 - RNA, 19 nt, Human
cacugcacuccagccuggg

SEQ ID NO: 63039 - RNA, 22 nt, Human
cacugcacuccagccuggguaa

SEQ ID NO: 63040 - RNA, 22 nt, Human
cacugcacuccagccuggguaa

SEQ ID NO: 63041 - RNA, 23 nt, Human
cacugcacuccagccuggguaac

SEQ ID NO: 63042 - RNA, 23 nt, Human
cacugcacuccagccuggguaac

SEQ ID NO: 63043 - RNA, 24 nt, Human
cacugcacuccagccuggguaaca

SEQ ID NO: 63044 - RNA, 24 nt, Human
cacugcacuccagccuggguaaca

SEQ ID NO: 63045 - RNA, 24 nt, Human
cagagaaacacccccaggagcuca

SEQ ID NO: 63046 - RNA, 21 nt, Human
cagaggcacugaaucucaaau

SEQ ID NO: 63047 - RNA, 21 nt, Human
cagauguccuuccuccugucc

SEQ ID NO: 63048 - RNA, 21 nt, Human
cagcacuuugggaggccgagg

SEQ ID NO: 63049 - RNA, 24 nt, Human
cagcacuuugggaggccgaggugg

SEQ ID NO: 63050 - RNA, 24 nt, Human
cagcacuuugggaggccgaggugg

SEQ ID NO: 63051 - RNA, 21 nt, Human
cagcagucccuggaggaggau

SEQ ID NO: 63052 - RNA, 21 nt, Human
cagccccucuguccgcucucc

SEQ ID NO: 63053 - RNA, 28 nt, Human
cagccugggacaagguccuucaccuccu

SEQ ID NO: 63054 - RNA, 24 nt, Human
cagcuacuugggaggcugaggcag

SEQ ID NO: 63055 - RNA, 24 nt, Human
cagcuacuugggaggcugaggcag

SEQ ID NO: 63056 - RNA, 22 nt, Human
cagcuuucuggggauccuguaa

SEQ ID NO: 63057 - RNA, 22 nt, Human
cagcuuucuggggauccuguaa

SEQ ID NO: 63058 - RNA, 26 nt, Human
cagcuuucuggggauccuguaaugcu

SEQ ID NO: 63059 - RNA, 26 nt, Human
cagcuuucuggggauccuguaaugcu

SEQ ID NO: 63060 - RNA, 19 nt, Human
caggaagcccccagucuga

SEQ ID NO: 63061 - RNA, 19 nt, Human
caggaagcccccagucuga

SEQ ID NO: 63062 - RNA, 26 nt, Human
caggacaaaaggucaagccucccccu

SEQ ID NO: 63063 - RNA, 24 nt, Human
caggaggcuugcuugagaggagac

SEQ ID NO: 63064 - RNA, 21 nt, Human
caguggacugugaacuuccca

SEQ ID NO: 63065 - RNA, 20 nt, Human
caucuggggucaggacuccc

SEQ ID NO: 63066 - RNA, 20 nt, Human
caucuggggucaggacuccc

SEQ ID NO: 63067 - RNA, 19 nt, Human
caugacggagacacaugag

SEQ ID NO: 63068 - RNA, 22 nt, Human
ccaaaaccacacccaaggucag

SEQ ID NO: 63069 - RNA, 23 nt, Human
ccaaugaugauggcagggccgaa

SEQ ID NO: 63070 - RNA, 19 nt, Human
ccacacccaaggucagaga

SEQ ID NO: 63071 - RNA, 19 nt, Human
ccacacccaaggucagaga

SEQ ID NO: 63072 - RNA, 19 nt, Human
ccacccccagggagaaccu

SEQ ID NO: 63073 - RNA, 18 nt, Human
ccaccgccuggccaguug

SEQ ID NO: 63074 - RNA, 20 nt, Human
ccacugcacuccagccuggg

SEQ ID NO: 63075 - RNA, 20 nt, Human
ccacugcacuccagccuggg

SEQ ID NO: 63076 - RNA, 20 nt, Human
ccacugcacuccagccuggg

SEQ ID NO: 63077 - RNA, 20 nt, Human
ccacugcacuccagccuggg

SEQ ID NO: 63078 - RNA, 20 nt, Human
ccacugcacuccagccuggg

SEQ ID NO: 63079 - RNA, 21 nt, Human
ccacugcacuccagccugggu

SEQ ID NO: 63080 - RNA, 21 nt, Human
ccacugcacuccagccugggu

SEQ ID NO: 63081 - RNA, 22 nt, Human
ccacugcacuccagccugggua

SEQ ID NO: 63082 - RNA, 22 nt, Human
ccacugcacuccagccugggua

SEQ ID NO: 63083 - RNA, 24 nt, Human
ccacugcacuccagccuggguaac

SEQ ID NO: 63084 - RNA, 24 nt, Human
ccacugcacuccagccuggguaac

SEQ ID NO: 63085 - RNA, 21 nt, Human
ccacugccaccgccuggccag

SEQ ID NO: 63086 - RNA, 22 nt, Human
ccagacgcgggcucugcccacg

SEQ ID NO: 63087 - RNA, 24 nt, Human
ccagcacgugcccgaacccagcca

SEQ ID NO: 63088 - RNA, 20 nt, Human
ccagugguucaggaggcuug

SEQ ID NO: 63089 - RNA, 23 nt, Human
cccacaaaaccuggaaagcggac

SEQ ID NO: 63090 - RNA, 19 nt, Human
cccacccggauaguggggc

SEQ ID NO: 63091 - RNA, 18 nt, Human
cccaggcucugcagccgu

SEQ ID NO: 63092 - RNA, 22 nt, Human
cccauaucaccuuguccaccuc

SEQ ID NO: 63093 - RNA, 19 nt, Human
ccccaaaaccacacccaag

SEQ ID NO: 63094 - RNA, 19 nt, Human
ccccaaaaccacacccaag

SEQ ID NO: 63095 - RNA, 18 nt, Human
ccccacccagaagaccug

SEQ ID NO: 63096 - RNA, 25 nt, Human
ccccacccagaagaccugaggagaa

SEQ ID NO: 63097 - RNA, 19 nt, Human
ccccaccucuacggugccu

SEQ ID NO: 63098 - RNA, 19 nt, Human
cccccaaaaccacacccaa

SEQ ID NO: 63099 - RNA, 19 nt, Human
cccccaaguugugggcaga

SEQ ID NO: 63100 - RNA, 19 nt, Human
cccccaaguugugggcaga

SEQ ID NO: 63101 - RNA, 26 nt, Human
cccccaccugcagcuccuccaccacg

SEQ ID NO: 63102 - RNA, 26 nt, Human
cccccaccugcagcuccuccaccacg

SEQ ID NO: 63103 - RNA, 19 nt, Human
cccccagggagaaccucca

SEQ ID NO: 63104 - RNA, 19 nt, Human
ccccccaaaaccacaccca

SEQ ID NO: 63105 - RNA, 20 nt, Human
ccccccaaaaccacacccaa

SEQ ID NO: 63106 - RNA, 22 nt, Human
ccccccaaaaccacacccaagg

SEQ ID NO: 63107 - RNA, 23 nt, Human
ccccccaaaaccacacccaaggu

SEQ ID NO: 63108 - RNA, 19 nt, Human
cccccucccgccaccccag

SEQ ID NO: 63109 - RNA, 18 nt, Human
cccccucccgccaccccc

SEQ ID NO: 63110 - RNA, 20 nt, Human
ccccucucuucugcgcccca

SEQ ID NO: 63111 - RNA, 21 nt, Human
ccccucuguccgcucuccacc

SEQ ID NO: 63112 - RNA, 22 nt, Human
ccccuugcucucccugcccucc

SEQ ID NO: 63113 - RNA, 22 nt, Human
cccgccaccccagggagaaccu

SEQ ID NO: 63114 - RNA, 18 nt, Human
cccgccacccccagggag

SEQ ID NO: 63115 - RNA, 23 nt, Human
cccgccacccccagggagaaccu

SEQ ID NO: 63116 - RNA, 21 nt, Human
cccgcccccgccucuuuccuc

SEQ ID NO: 63117 - RNA, 20 nt, Human
cccuaagcaguugcuuaacc

SEQ ID NO: 63118 - RNA, 21 nt, Human
cccuaagcaguugcuuaaccu

SEQ ID NO: 63119 - RNA, 20 nt, Human
cccuccagcccaccugguca

SEQ ID NO: 63120 - RNA, 20 nt, Human
cccuccagcccaccugguca

SEQ ID NO: 63121 - RNA, 20 nt, Human
cccucucuuggccuuuccca

SEQ ID NO: 63122 - RNA, 19 nt, Human
cccugcccucccuggggcu

SEQ ID NO: 63123 - RNA, 24 nt, Human
cccugccuuccucugcucuguccc

SEQ ID NO: 63124 - RNA, 24 nt, Human
cccugccuuccucugcucuguccc

SEQ ID NO: 63125 - RNA, 25 nt, Human
cccuguguccuccacuccaccccca

SEQ ID NO: 63126 - RNA, 22 nt, Human
cccuuagggcuuauucaacagc

SEQ ID NO: 63127 - RNA, 22 nt, Human
cccuuagggcuuauucaacagc

SEQ ID NO: 63128 - RNA, 26 nt, Human
ccgcccccgccucuuuccucucacuu

SEQ ID NO: 63129 - RNA, 22 nt, Human
ccgccucuuuccucucacuucc

SEQ ID NO: 63130 - RNA, 22 nt, Human
ccgcugccugcuuccccagugc

SEQ ID NO: 63131 - RNA, 22 nt, Human
ccucaagguggccccaggggac

SEQ ID NO: 63132 - RNA, 18 nt, Human
ccucacccgcccccgccu

SEQ ID NO: 63133 - RNA, 23 nt, Human
ccucaggucaggaguuugagacc

SEQ ID NO: 63134 - RNA, 23 nt, Human
ccucaggucaggaguuugagacc

SEQ ID NO: 63135 - RNA, 22 nt, Human
ccucaucucagugauccccaca

SEQ ID NO: 63136 - RNA, 20 nt, Human
ccucccagcuggugagaacu

SEQ ID NO: 63137 - RNA, 18 nt, Human
ccucccgccaccccaggg

SEQ ID NO: 63138 - RNA, 24 nt, Human
ccucccgccaccccagggagaacc

SEQ ID NO: 63139 - RNA, 18 nt, Human
ccucccgccacccccagg

SEQ ID NO: 63140 - RNA, 25 nt, Human
ccucccgccacccccagggagaacc

SEQ ID NO: 63141 - RNA, 21 nt, Human
ccuccuggguuccuaccaccc

SEQ ID NO: 63142 - RNA, 21 nt, Human
ccuccuggguuccuaccaccc

SEQ ID NO: 63143 - RNA, 19 nt, Human
ccuccuguccacccaucuc

SEQ ID NO: 63144 - RNA, 20 nt, Human
ccucucuuggccuuucccag

SEQ ID NO: 63145 - RNA, 24 nt, Human
ccugaccaauaugaugaaacccca

SEQ ID NO: 63146 - RNA, 24 nt, Human
ccugaccaauaugaugaaacccca

SEQ ID NO: 63147 - RNA, 23 nt, Human
ccugaccucugcccagccuggga

SEQ ID NO: 63148 - RNA, 20 nt, Human
ccugaggagaaggaugucgu

SEQ ID NO: 63149 - RNA, 19 nt, Human
ccugaggucccuauagcuc

SEQ ID NO: 63150 - RNA, 19 nt, Human
ccugaggucccuauagcuc

SEQ ID NO: 63151 - RNA, 20 nt, Human
ccugcagcugcccuguggcc

SEQ ID NO: 63152 - RNA, 19 nt, Human
ccugcuucaggggguccug

SEQ ID NO: 63153 - RNA, 18 nt, Human
ccuggggcugagcccagg

SEQ ID NO: 63154 - RNA, 22 nt, Human
ccuguaaucccagcacuuuggg

SEQ ID NO: 63155 - RNA, 18 nt, Human
ccuguaaucccagcuacu

SEQ ID NO: 63156 - RNA, 21 nt, Human
ccuguaaucccagcuacuugg

SEQ ID NO: 63157 - RNA, 21 nt, Human
ccuguaaucccagcuacuugg

SEQ ID NO: 63158 - RNA, 21 nt, Human
ccuguccccaggacugugcug

SEQ ID NO: 63159 - RNA, 21 nt, Human
ccuguccccaggacugugcug

SEQ ID NO: 63160 - RNA, 21 nt, Human
ccuugccccuugcucucccug

SEQ ID NO: 63161 - RNA, 24 nt, Human
ccuugccuugcucuggggccucuu

SEQ ID NO: 63162 - RNA, 23 nt, Human
ccuugcucucccugcccucccug

SEQ ID NO: 63163 - RNA, 23 nt, Human
ccuugcucuggggccucuucucu

SEQ ID NO: 63164 - RNA, 21 nt, Human
ccuuguccccagcuagcucgg

SEQ ID NO: 63165 - RNA, 22 nt, Human
cgaagacacagagcaccagcug

SEQ ID NO: 63166 - RNA, 24 nt, Human
cgaggugggcagaucgccucaggu

SEQ ID NO: 63167 - RNA, 24 nt, Human
cgaggugggcagaucgccucaggu

SEQ ID NO: 63168 - RNA, 26 nt, Human
cgaggugggcagaucgccucagguca

SEQ ID NO: 63169 - RNA, 26 nt, Human
cgaggugggcagaucgccucagguca

SEQ ID NO: 63170 - RNA, 22 nt, Human
cgauccuaaauccccugccuuc

SEQ ID NO: 63171 - RNA, 22 nt, Human
cgauccuaaauccccugccuuc

SEQ ID NO: 63172 - RNA, 19 nt, Human
cgccacccccagggagaac

SEQ ID NO: 63173 - RNA, 25 nt, Human
cgccagggucuuggugucggggaac

SEQ ID NO: 63174 - RNA, 23 nt, Human
cgccuguaaucccagcacuuugg

SEQ ID NO: 63175 - RNA, 24 nt, Human
cgccuguaaucccagcacuuuggg

SEQ ID NO: 63176 - RNA, 23 nt, Human
cgccuguaaucccagcuacuugg

SEQ ID NO: 63177 - RNA, 24 nt, Human
cgccuguaaucccagcuacuuggg

SEQ ID NO: 63178 - RNA, 24 nt, Human
cgccuguaaucccagcuacuuggg

SEQ ID NO: 63179 - RNA, 24 nt, Human
cggaugggcuuaugcauguguaug

SEQ ID NO: 63180 - RNA, 18 nt, Human
cgggagagaaaaggaggg

SEQ ID NO: 63181 - RNA, 22 nt, Human
cgggagagaaaaggagggagaa

SEQ ID NO: 63182 - RNA, 22 nt, Human
cggggcugcauggcggcuccaa

SEQ ID NO: 63183 - RNA, 24 nt, Human
cggggcugcauggcggcuccaaga

SEQ ID NO: 63184 - RNA, 26 nt, Human
cguaaacccagaaaguaaguucccuc

SEQ ID NO: 63185 - RNA, 20 nt, Human
cgugcccguaaacccagaaa

SEQ ID NO: 63186 - RNA, 21 nt, Human
cguuagacagcuguggggacg

SEQ ID NO: 63187 - RNA, 24 nt, Human
cuagagcccagacccaggacuugu

SEQ ID NO: 63188 - RNA, 27 nt, Human
cucaaaccucccuuccucuaucccacc

SEQ ID NO: 63189 - RNA, 22 nt, Human
cucacgccuguaaucccagcac

SEQ ID NO: 63190 - RNA, 22 nt, Human
cucacgccuguaaucccagcac

SEQ ID NO: 63191 - RNA, 24 nt, Human
cucacgccuguaaucccagcacuu

SEQ ID NO: 63192 - RNA, 24 nt, Human
cucacgccuguaaucccagcacuu

SEQ ID NO: 63193 - RNA, 18 nt, Human
cucaucucagugaucccc

SEQ ID NO: 63194 - RNA, 19 nt, Human
cuccacccccaucuggcua

SEQ ID NO: 63195 - RNA, 22 nt, Human
cuccagaaagccuguccucucu

SEQ ID NO: 63196 - RNA, 22 nt, Human
cuccagaaagccuguccucucu

SEQ ID NO: 63197 - RNA, 21 nt, Human
cuccagccugagcugaccuga

SEQ ID NO: 63198 - RNA, 21 nt, Human
cuccagccugagcugaccuga

SEQ ID NO: 63199 - RNA, 21 nt, Human
cucccagauucuaccuagaac

SEQ ID NO: 63200 - RNA, 22 nt, Human
cuccuccacucccaccuauacc

SEQ ID NO: 63201 - RNA, 20 nt, Human
cuccuggguuccuaccaccc

SEQ ID NO: 63202 - RNA, 20 nt, Human
cuccuggguuccuaccaccc

SEQ ID NO: 63203 - RNA, 23 nt, Human
cucuccccauaucaccuugucca

SEQ ID NO: 63204 - RNA, 24 nt, Human
cucugugucaguucuucucaaggg

SEQ ID NO: 63205 - RNA, 24 nt, Human
cucugugucaguucuucucaaggg

SEQ ID NO: 63206 - RNA, 21 nt, Human
cucuguuccucuggucucuga

SEQ ID NO: 63207 - RNA, 26 nt, Human
cugacaccacaccgugcccguaaacc

SEQ ID NO: 63208 - RNA, 22 nt, Human
cugcagccguggcuggggccug

SEQ ID NO: 63209 - RNA, 23 nt, Human
cugcagccguggcuggggccugg

SEQ ID NO: 63210 - RNA, 18 nt, Human
cugccccugccccugucc

SEQ ID NO: 63211 - RNA, 19 nt, Human
cugccccugccccuguccc

SEQ ID NO: 63212 - RNA, 19 nt, Human
cugccuagggcugccuguc

SEQ ID NO: 63213 - RNA, 21 nt, Human
cuggcccccuccauaucuagg

SEQ ID NO: 63214 - RNA, 21 nt, Human
cuggggcugagcccaggcucu

SEQ ID NO: 63215 - RNA, 19 nt, Human
cugucucaaaacaaacaaa

SEQ ID NO: 63216 - RNA, 19 nt, Human
cugucucaaaacaaacaaa

SEQ ID NO: 63217 - RNA, 24 nt, Human
cugucugggcucccauuccuuucu

SEQ ID NO: 63218 - RNA, 19 nt, Human
cuguggggugggagcuggg

SEQ ID NO: 63219 - RNA, 19 nt, Human
cuguggggugggagcuggg

SEQ ID NO: 63220 - RNA, 24 nt, Human
cuucaggggcuccgccccugcccc

SEQ ID NO: 63221 - RNA, 22 nt, Human
cuuccucuaucccaccucucua

SEQ ID NO: 63222 - RNA, 22 nt, Human
cuuccucuaucccaccucucua

SEQ ID NO: 63223 - RNA, 24 nt, Human
cuugcuccaggccuggcuuccugu

SEQ ID NO: 63224 - RNA, 23 nt, Human
cuuugggaggccgaggugggcag

SEQ ID NO: 63225 - RNA, 23 nt, Human
gagaucaugccacugcacuccag

SEQ ID NO: 63226 - RNA, 23 nt, Human
gagaucaugccacugcacuccag

SEQ ID NO: 63227 - RNA, 24 nt, Human
gaucgccucaggucaggaguuuga

SEQ ID NO: 63228 - RNA, 24 nt, Human
gaucgccucaggucaggaguuuga

SEQ ID NO: 63229 - RNA, 20 nt, Human
gaugugggggcugucucugg

SEQ ID NO: 63230 - RNA, 20 nt, Human
gaugugggggcugucucugg

SEQ ID NO: 63231 - RNA, 19 nt, Human
gcagcuccuccaccacgcu

SEQ ID NO: 63232 - RNA, 19 nt, Human
gcagcuccuccaccacgcu

SEQ ID NO: 63233 - RNA, 22 nt, Human
gcaggagaaucccuugaaccca

SEQ ID NO: 63234 - RNA, 22 nt, Human
gcaggagaaucccuugaaccca

SEQ ID NO: 63235 - RNA, 19 nt, Human
gccacugcacuccagccug

SEQ ID NO: 63236 - RNA, 19 nt, Human
gccacugcacuccagccug

SEQ ID NO: 63237 - RNA, 24 nt, Human
gccacugcacuccagccuggguaa

SEQ ID NO: 63238 - RNA, 24 nt, Human
gccacugcacuccagccuggguaa

SEQ ID NO: 63239 - RNA, 23 nt, Human
gcccccaccugcagcuccuccac

SEQ ID NO: 63240 - RNA, 18 nt, Human
gccccugccccugccccu

SEQ ID NO: 63241 - RNA, 19 nt, Human
gcccugggccuuggagccc

SEQ ID NO: 63242 - RNA, 20 nt, Human
gccgagaucaugccacugca

SEQ ID NO: 63243 - RNA, 20 nt, Human
gccgagaucaugccacugca

SEQ ID NO: 63244 - RNA, 22 nt, Human
gccucaucucagugauccccac

SEQ ID NO: 63245 - RNA, 23 nt, Human
gccuguaaucccagcuacuuggg

SEQ ID NO: 63246 - RNA, 23 nt, Human
gcucauauaccugcuccagccug

SEQ ID NO: 63247 - RNA, 18 nt, Human
gcucauaugccugcucca

SEQ ID NO: 63248 - RNA, 23 nt, Human
gcucauaugccugcuccagccug

SEQ ID NO: 63249 - RNA, 22 nt, Human
gcucccugaggucccuauagcu

SEQ ID NO: 63250 - RNA, 22 nt, Human
gcucccugaggucccuauagcu

SEQ ID NO: 63251 - RNA, 21 nt, Human
gcucucccugcccucccuggg

SEQ ID NO: 63252 - RNA, 21 nt, Human
gcugcccuguggccuugaagu

SEQ ID NO: 63253 - RNA, 19 nt, Human
gcuugcuugagaggagacu

SEQ ID NO: 63254 - RNA, 21 nt, Human
ggaaauauaccccccaaaacc

SEQ ID NO: 63255 - RNA, 21 nt, Human
ggaaauauaccccccaaaacc

SEQ ID NO: 63256 - RNA, 20 nt, Human
ggaaugagggguguugcuca

SEQ ID NO: 63257 - RNA, 20 nt, Human
ggaaugagggguguugcuca

SEQ ID NO: 63258 - RNA, 20 nt, Human
ggacccucucuuggccuuuc

SEQ ID NO: 63259 - RNA, 20 nt, Human
ggacggggcugcauggcggc

SEQ ID NO: 63260 - RNA, 22 nt, Human
ggacucccuguguccuccacuc

SEQ ID NO: 63261 - RNA, 19 nt, Human
ggagaagccgagauccaga

SEQ ID NO: 63262 - RNA, 19 nt, Human
ggagaagccgagauccaga

SEQ ID NO: 63263 - RNA, 21 nt, Human
ggagaaucccuugaacccagg

SEQ ID NO: 63264 - RNA, 21 nt, Human
ggagaaucccuugaacccagg

SEQ ID NO: 63265 - RNA, 23 nt, Human
ggaggccugugcagaggggucca

SEQ ID NO: 63266 - RNA, 22 nt, Human
ggagguagagguugcagugagc

SEQ ID NO: 63267 - RNA, 22 nt, Human
ggagguagagguugcagugagc

SEQ ID NO: 63268 - RNA, 23 nt, Human
ggcacgguggcucacgccuguaa

SEQ ID NO: 63269 - RNA, 23 nt, Human
ggcacgguggcucacgccuguaa

SEQ ID NO: 63270 - RNA, 25 nt, Human
ggcagaucgccucaggucaggaguu

SEQ ID NO: 63271 - RNA, 21 nt, Human
ggcaggcgccuguaaucccag

SEQ ID NO: 63272 - RNA, 24 nt, Human
ggcccccaccugcagcuccuccac

SEQ ID NO: 63273 - RNA, 19 nt, Human
ggccuggucuccucagcug

SEQ ID NO: 63274 - RNA, 24 nt, Human
ggcgccuguaaucccagcuacuug

SEQ ID NO: 63275 - RNA, 24 nt, Human
ggcgccuguaaucccagcuacuug

SEQ ID NO: 63276 - RNA, 21 nt, Human
ggcucacgccuguaaucccag

SEQ ID NO: 63277 - RNA, 19 nt, Human
ggcucugcagccguggcug

SEQ ID NO: 63278 - RNA, 22 nt, Human
ggcuucucuggcccccaccugc

SEQ ID NO: 63279 - RNA, 22 nt, Human
ggcuucucuggcccccaccugc

SEQ ID NO: 63280 - RNA, 26 nt, Human
gggcagaucgccucaggucaggaguu

SEQ ID NO: 63281 - RNA, 24 nt, Human
gggcgugguggcaggcgccuguaa

SEQ ID NO: 63282 - RNA, 24 nt, Human
gggcgugguggcaggcgccuguaa

SEQ ID NO: 63283 - RNA, 21 nt, Human
gggcuguggggugggagcugg

SEQ ID NO: 63284 - RNA, 21 nt, Human
gggcuguggggugggagcugg

SEQ ID NO: 63285 - RNA, 18 nt, Human
ggggaggggaaggaggaa

SEQ ID NO: 63286 - RNA, 21 nt, Human
ggggaugaugcuaauaauucc

SEQ ID NO: 63287 - RNA, 19 nt, Human
ggucaggacuccuacgggg

SEQ ID NO: 63288 - RNA, 21 nt, Human
ggucaggacuccuacgggguc

SEQ ID NO: 63289 - RNA, 19 nt, Human
ggucaggaguuugagacca

SEQ ID NO: 63290 - RNA, 19 nt, Human
ggucaggaguuugagacca

SEQ ID NO: 63291 - RNA, 18 nt, Human
ggugccuuggccguuccu

SEQ ID NO: 63292 - RNA, 24 nt, Human
gguggcaggcgccuguaaucccag

SEQ ID NO: 63293 - RNA, 24 nt, Human
gguggcaggcgccuguaaucccag

SEQ ID NO: 63294 - RNA, 23 nt, Human
gguggcucacgccuguaauccca

SEQ ID NO: 63295 - RNA, 23 nt, Human
gguggcucacgccuguaauccca

SEQ ID NO: 63296 - RNA, 24 nt, Human
gguggcucacgccuguaaucccag

SEQ ID NO: 63297 - RNA, 24 nt, Human
gguggcucacgccuguaaucccag

SEQ ID NO: 63298 - RNA, 19 nt, Human
guaaugccagggauagggc

SEQ ID NO: 63299 - RNA, 20 nt, Human
guaggggcagcccuucucca

SEQ ID NO: 63300 - RNA, 19 nt, Human
gucaccccacccaggagcu

SEQ ID NO: 63301 - RNA, 24 nt, Human
gucagacaaaaguaaccucccccu

SEQ ID NO: 63302 - RNA, 23 nt, Human
gugcauucccagguccuguucgu

SEQ ID NO: 63303 - RNA, 18 nt, Human
gugcccguaaacccagaa

SEQ ID NO: 63304 - RNA, 20 nt, Human
guggcucugggaccgcugcc

SEQ ID NO: 63305 - RNA, 21 nt, Human
guggcucugggaccgcugccu

SEQ ID NO: 63306 - RNA, 19 nt, Human
guggguaagaagcuggggc

SEQ ID NO: 63307 - RNA, 19 nt, Human
guggguaagaagcuggggc

SEQ ID NO: 63308 - RNA, 18 nt, Human
guguccuccacuccaccc

SEQ ID NO: 63309 - RNA, 24 nt, Human
guugcagugagccgagaucaugcc

SEQ ID NO: 63310 - RNA, 24 nt, Human
guugcagugagccgagaucaugcc

SEQ ID NO: 63311 - RNA, 23 nt, Human
uaaccucccccucccgccacccc

SEQ ID NO: 63312 - RNA, 21 nt, Human
uaaggggggcgaaggggaggg

SEQ ID NO: 63313 - RNA, 19 nt, Human
uaaguucccuccuccacuc

SEQ ID NO: 63314 - RNA, 21 nt, Human
uaaguucccuccuccacuccc

SEQ ID NO: 63315 - RNA, 19 nt, Human
uacagcaagaucacucaga

SEQ ID NO: 63316 - RNA, 22 nt, Human
uaccccccaaaaccacacccaa

SEQ ID NO: 63317 - RNA, 22 nt, Human
uaccccccaaaaccacacccaa

SEQ ID NO: 63318 - RNA, 20 nt, Human
uaccuaggagagggccucca

SEQ ID NO: 63319 - RNA, 20 nt, Human
uacucuggaccagacgcgga

SEQ ID NO: 63320 - RNA, 20 nt, Human
uagagcccagacccaggacu

SEQ ID NO: 63321 - RNA, 19 nt, Human
uagaucagugaggccagga

SEQ ID NO: 63322 - RNA, 20 nt, Human
uagccugagggucgcaggug

SEQ ID NO: 63323 - RNA, 19 nt, Human
uaugaugaaaccccaucuc

SEQ ID NO: 63324 - RNA, 19 nt, Human
uaugaugaaaccccaucuc

SEQ ID NO: 63325 - RNA, 20 nt, Human
ucaagauggcuucccgugcc

SEQ ID NO: 63326 - RNA, 20 nt, Human
ucagaggcugucccagggcc

SEQ ID NO: 63327 - RNA, 21 nt, Human
ucagaggcugucccagggccu

SEQ ID NO: 63328 - RNA, 23 nt, Human
ucagaggcugucccagggccuga

SEQ ID NO: 63329 - RNA, 19 nt, Human
ucaggggccccacccagaa

SEQ ID NO: 63330 - RNA, 19 nt, Human
ucaguucuucucaagggug

SEQ ID NO: 63331 - RNA, 19 nt, Human
ucaguucuucucaagggug

SEQ ID NO: 63332 - RNA, 21 nt, Human
ucaguucuucucaagggugac

SEQ ID NO: 63333 - RNA, 21 nt, Human
ucaguucuucucaagggugac

SEQ ID NO: 63334 - RNA, 23 nt, Human
ucaugccacugcacuccagccug

SEQ ID NO: 63335 - RNA, 23 nt, Human
ucaugccacugcacuccagccug

SEQ ID NO: 63336 - RNA, 28 nt, Human
uccagccugagcugaccugauggggugg

SEQ ID NO: 63337 - RNA, 28 nt, Human
uccagccugagcugaccugauggggugg

SEQ ID NO: 63338 - RNA, 18 nt, Human
uccagggcggguugggcc

SEQ ID NO: 63339 - RNA, 19 nt, Human
ucccagggccugauuccuc

SEQ ID NO: 63340 - RNA, 19 nt, Human
ucccagggccugauuccuc

SEQ ID NO: 63341 - RNA, 20 nt, Human
ucccagggccugauuccucc

SEQ ID NO: 63342 - RNA, 20 nt, Human
ucccagggccugauuccucc

SEQ ID NO: 63343 - RNA, 19 nt, Human
ucccaugucuaagcagagu

SEQ ID NO: 63344 - RNA, 19 nt, Human
ucccaugucuaagcagagu

SEQ ID NO: 63345 - RNA, 20 nt, Human
ucccauuccuuucuccccca

SEQ ID NO: 63346 - RNA, 20 nt, Human
ucccauuccuuucuccccca

SEQ ID NO: 63347 - RNA, 19 nt, Human
uccccacaaaaccuggaaa

SEQ ID NO: 63348 - RNA, 21 nt, Human
uccccagugccgacuugaucu

SEQ ID NO: 63349 - RNA, 23 nt, Human
ucccccaagacuugggcaucugg

SEQ ID NO: 63350 - RNA, 23 nt, Human
ucccccaagacuugggcaucugg

SEQ ID NO: 63351 - RNA, 27 nt, Human
uccccuucucuugacuucuucccuaua

SEQ ID NO: 63352 - RNA, 24 nt, Human
ucccugcagaagugaguggugcuc

SEQ ID NO: 63353 - RNA, 18 nt, Human
ucccuggggcugagccca

SEQ ID NO: 63354 - RNA, 21 nt, Human
ucccuggggcugagcccaggc

SEQ ID NO: 63355 - RNA, 18 nt, Human
ucccuguguccuccacuc

SEQ ID NO: 63356 - RNA, 20 nt, Human
ucccuguguguaguuaggag

SEQ ID NO: 63357 - RNA, 21 nt, Human
ucccuuugagugacugggacc

SEQ ID NO: 63358 - RNA, 19 nt, Human
uccuaaauccccugccuuc

SEQ ID NO: 63359 - RNA, 19 nt, Human
uccucuuccaucucucccc

SEQ ID NO: 63360 - RNA, 20 nt, Human
uccucuuccaucucucccca

SEQ ID NO: 63361 - RNA, 23 nt, Human
uccugaccucugcccagccuggg

SEQ ID NO: 63362 - RNA, 24 nt, Human
uccugaccucugcccagccuggga

SEQ ID NO: 63363 - RNA, 18 nt, Human
uccugggucccuccuggg

SEQ ID NO: 63364 - RNA, 18 nt, Human
uccugggucccuccuggg

SEQ ID NO: 63365 - RNA, 21 nt, Human
uccugggucccuccuggguuc

SEQ ID NO: 63366 - RNA, 21 nt, Human
uccugggucccuccuggguuc

SEQ ID NO: 63367 - RNA, 22 nt, Human
uccugggucccuccuggguucc

SEQ ID NO: 63368 - RNA, 22 nt, Human
uccugggucccuccuggguucc

SEQ ID NO: 63369 - RNA, 22 nt, Human
uccuggguggguaagaagcugg

SEQ ID NO: 63370 - RNA, 19 nt, Human
ucgccucaggucaggaguu

SEQ ID NO: 63371 - RNA, 24 nt, Human
ucgccucaggucaggaguuugaga

SEQ ID NO: 63372 - RNA, 24 nt, Human
ucgccucaggucaggaguuugaga

SEQ ID NO: 63373 - RNA, 21 nt, Human
ucuccagagcauuuggaggau

SEQ ID NO: 63374 - RNA, 21 nt, Human
ucuccagagcauuuggaggau

SEQ ID NO: 63375 - RNA, 21 nt, Human
ucuccucccgguccucuucca

SEQ ID NO: 63376 - RNA, 22 nt, Human
ucuccugaccucugcccagccu

SEQ ID NO: 63377 - RNA, 22 nt, Human
ucucuacuaaaaauacaaaaaa

SEQ ID NO: 63378 - RNA, 22 nt, Human
ucucuacuaaaaauacaaaaaa

SEQ ID NO: 63379 - RNA, 20 nt, Human
ucucugaucuccugucucuu

SEQ ID NO: 63380 - RNA, 22 nt, Human
ucucugaucuccugucucuucu

SEQ ID NO: 63381 - RNA, 20 nt, Human
ucucuggcccccaccugcag

SEQ ID NO: 63382 - RNA, 20 nt, Human
ucucuggcccccaccugcag

SEQ ID NO: 63383 - RNA, 21 nt, Human
ucugcagccguggcuggggcc

SEQ ID NO: 63384 - RNA, 24 nt, Human
ucuggucuucuugauucuuccugu

SEQ ID NO: 63385 - RNA, 24 nt, Human
ucuguggaggcuucucuggccccc

SEQ ID NO: 63386 - RNA, 24 nt, Human
ucuguggaggcuucucuggccccc

SEQ ID NO: 63387 - RNA, 24 nt, Human
ucuugccuugcucuggggccucuu

SEQ ID NO: 63388 - RNA, 19 nt, Human
ugaaaccccaucucuacua

SEQ ID NO: 63389 - RNA, 19 nt, Human
ugaaaccccaucucuacua

SEQ ID NO: 63390 - RNA, 19 nt, Human
ugaaguggaucccaaugag

SEQ ID NO: 63391 - RNA, 23 nt, Human
ugacaccacaccgugcccguaaa

SEQ ID NO: 63392 - RNA, 21 nt, Human
ugaccagggcuugcuccaggc

SEQ ID NO: 63393 - RNA, 23 nt, Human
ugaccagggcuugcuccaggccu

SEQ ID NO: 63394 - RNA, 23 nt, Human
ugacccaggucaugagucaaugg

SEQ ID NO: 63395 - RNA, 23 nt, Human
ugacccaggucaugagucaaugg

SEQ ID NO: 63396 - RNA, 24 nt, Human
ugacggagacacaugaggccaaga

SEQ ID NO: 63397 - RNA, 19 nt, Human
ugacugggacccucucuug

SEQ ID NO: 63398 - RNA, 21 nt, Human
ugagaaaauguucuucucugu

SEQ ID NO: 63399 - RNA, 21 nt, Human
ugagaaaauguucuucucugu

SEQ ID NO: 63400 - RNA, 22 nt, Human
ugagccgagaucaugccacugc

SEQ ID NO: 63401 - RNA, 22 nt, Human
ugagccgagaucaugccacugc

SEQ ID NO: 63402 - RNA, 21 nt, Human
ugaggaauaaagaccuauugg

SEQ ID NO: 63403 - RNA, 21 nt, Human
ugaggaauaaagaccuauugg

SEQ ID NO: 63404 - RNA, 19 nt, Human
ugaggcaggagaaucccuu

SEQ ID NO: 63405 - RNA, 19 nt, Human
ugaggcaggagaaucccuu

SEQ ID NO: 63406 - RNA, 24 nt, Human
ugaggcaggagaaucccuugaacc

SEQ ID NO: 63407 - RNA, 24 nt, Human
ugaggcaggagaaucccuugaacc

SEQ ID NO: 63408 - RNA, 25 nt, Human
ugaggcaggagaaucccuugaaccc

SEQ ID NO: 63409 - RNA, 25 nt, Human
ugaggcaggagaaucccuugaaccc

SEQ ID NO: 63410 - RNA, 21 nt, Human
ugagguggcccagugccacag

SEQ ID NO: 63411 - RNA, 20 nt, Human
ugaucucccaggucucccuc

SEQ ID NO: 63412 - RNA, 22 nt, Human
ugcaaggcaggaagcccaaggg

SEQ ID NO: 63413 - RNA, 24 nt, Human
ugcagcuccuccaccacgcuccug

SEQ ID NO: 63414 - RNA, 24 nt, Human
ugcagcuccuccaccacgcuccug

SEQ ID NO: 63415 - RNA, 21 nt, Human
ugcauggcggcuccaagacag

SEQ ID NO: 63416 - RNA, 23 nt, Human
ugccacagagaucccaaucaugg

SEQ ID NO: 63417 - RNA, 24 nt, Human
ugccccugccccuguccccaccuc

SEQ ID NO: 63418 - RNA, 18 nt, Human
ugccccuugcucucccug

SEQ ID NO: 63419 - RNA, 20 nt, Human
ugcccgaacccagccagcac

SEQ ID NO: 63420 - RNA, 19 nt, Human
ugcccugggccuuggagcc

SEQ ID NO: 63421 - RNA, 18 nt, Human
ugccugugaggauagcca

SEQ ID NO: 63422 - RNA, 21 nt, Human
ugcuccagccugagcugaccu

SEQ ID NO: 63423 - RNA, 21 nt, Human
ugcuccagccugagcugaccu

SEQ ID NO: 63424 - RNA, 24 nt, Human
ugcuccagccugagcugaccugau

SEQ ID NO: 63425 - RNA, 24 nt, Human
ugcuccagccugagcugaccugau

SEQ ID NO: 63426 - RNA, 28 nt, Human
ugcuccagccugagcugaccugaugggg

SEQ ID NO: 63427 - RNA, 28 nt, Human
ugcuccagccugagcugaccugaugggg

SEQ ID NO: 63428 - RNA, 28 nt, Human
ugcuccagccugagcugaccugaugggg

SEQ ID NO: 63429 - RNA, 28 nt, Human
ugcuccagccugagcugaccugaugggg

SEQ ID NO: 63430 - RNA, 18 nt, Human
ugcucuggacccuugcuc

SEQ ID NO: 63431 - RNA, 18 nt, Human
uggaaugagggguguugc

SEQ ID NO: 63432 - RNA, 18 nt, Human
uggaaugagggguguugc

SEQ ID NO: 63433 - RNA, 23 nt, Human
uggacagagggaguuacucugga

SEQ ID NO: 63434 - RNA, 22 nt, Human
uggcagcagguguggaaggagg

SEQ ID NO: 63435 - RNA, 18 nt, Human
uggcagcccuugucccca

SEQ ID NO: 63436 - RNA, 21 nt, Human
uggcaggcccugagucuccug

SEQ ID NO: 63437 - RNA, 22 nt, Human
uggcaggcgccuguaaucccag

SEQ ID NO: 63438 - RNA, 25 nt, Human
uggcagggccgaaggagcgggcugg

SEQ ID NO: 63439 - RNA, 19 nt, Human
uggccaguugagacacugu

SEQ ID NO: 63440 - RNA, 22 nt, Human
uggcucacgccuguaaucccag

SEQ ID NO: 63441 - RNA, 22 nt, Human
uggcucacgccuguaaucccag

SEQ ID NO: 63442 - RNA, 24 nt, Human
uggcucacgccuguaaucccagca

SEQ ID NO: 63443 - RNA, 24 nt, Human
uggcucacgccuguaaucccagca

SEQ ID NO: 63444 - RNA, 19 nt, Human
uggcugccuagggcugccu

SEQ ID NO: 63445 - RNA, 24 nt, Human
uggcuuuugcucucuguggaggcu

SEQ ID NO: 63446 - RNA, 21 nt, Human
ugggagaggccgggcacggug

SEQ ID NO: 63447 - RNA, 20 nt, Human
ugggaggccgaggugggcag

SEQ ID NO: 63448 - RNA, 20 nt, Human
ugggaggccgaggugggcag

SEQ ID NO: 63449 - RNA, 23 nt, Human
ugggaggccgaggugggcagauc

SEQ ID NO: 63450 - RNA, 23 nt, Human
ugggaggccgaggugggcagauc

SEQ ID NO: 63451 - RNA, 24 nt, Human
ugggaggccgaggugggcagaucg

SEQ ID NO: 63452 - RNA, 24 nt, Human
ugggaggccgaggugggcagaucg

SEQ ID NO: 63453 - RNA, 18 nt, Human
ugggaggcugaggcagga

SEQ ID NO: 63454 - RNA, 18 nt, Human
ugggaggcugaggcagga

SEQ ID NO: 63455 - RNA, 19 nt, Human
ugggaggcugaggcaggag

SEQ ID NO: 63456 - RNA, 19 nt, Human
ugggaggcugaggcaggag

SEQ ID NO: 63457 - RNA, 20 nt, Human
ugggaugugggggcugucuc

SEQ ID NO: 63458 - RNA, 21 nt, Human
ugggaugugggggcugucucu

SEQ ID NO: 63459 - RNA, 20 nt, Human
ugggcaucuggggucaggac

SEQ ID NO: 63460 - RNA, 20 nt, Human
ugggcaucuggggucaggac

SEQ ID NO: 63461 - RNA, 20 nt, Human
ugggccuuggagccugaaag

SEQ ID NO: 63462 - RNA, 20 nt, Human
uggggaaaguaaggggggcg

SEQ ID NO: 63463 - RNA, 18 nt, Human
uggggagggaauucaaga

SEQ ID NO: 63464 - RNA, 18 nt, Human
uggggcugagcccaggcu

SEQ ID NO: 63465 - RNA, 23 nt, Human
uggggguggaaugagggguguug

SEQ ID NO: 63466 - RNA, 18 nt, Human
uggggugggauguggggg

SEQ ID NO: 63467 - RNA, 18 nt, Human
uggggugggauguggggg

SEQ ID NO: 63468 - RNA, 19 nt, Human
uggggugggaugugggggc

SEQ ID NO: 63469 - RNA, 19 nt, Human
uggggugggaugugggggc

SEQ ID NO: 63470 - RNA, 21 nt, Human
uggguaagaagcuggggcucc

SEQ ID NO: 63471 - RNA, 21 nt, Human
uggguaagaagcuggggcucc

SEQ ID NO: 63472 - RNA, 21 nt, Human
uggguuccuaccacccuuagg

SEQ ID NO: 63473 - RNA, 21 nt, Human
uggguuccuaccacccuuagg

SEQ ID NO: 63474 - RNA, 24 nt, Human
uggucuucuugauucuuccugucu

SEQ ID NO: 63475 - RNA, 24 nt, Human
uggugagaacuggcaggcccugag

SEQ ID NO: 63476 - RNA, 24 nt, Human
ugguggcaggcgccuguaauccca

SEQ ID NO: 63477 - RNA, 24 nt, Human
ugguggcaggcgccuguaauccca

SEQ ID NO: 63478 - RNA, 19 nt, Human
uguccuccacuccaccccc

SEQ ID NO: 63479 - RNA, 19 nt, Human
ugucucaaaacaaacaaag

SEQ ID NO: 63480 - RNA, 19 nt, Human
ugucucaaaacaaacaaag

SEQ ID NO: 63481 - RNA, 23 nt, Human
uguggacacuguggccugcagcu

SEQ ID NO: 63482 - RNA, 19 nt, Human
ugugucaguucuucucaag

SEQ ID NO: 63483 - RNA, 19 nt, Human
ugugucaguucuucucaag

SEQ ID NO: 63484 - RNA, 18 nt, Human
uguuccugccugagagug

SEQ ID NO: 63485 - RNA, 18 nt, Human
uguuccugccugagagug

SEQ ID NO: 63486 - RNA, 19 nt, Human
uguucgucuggcccccucc

SEQ ID NO: 63487 - RNA, 18 nt, Human
uuagcugggcgugguggc

SEQ ID NO: 63488 - RNA, 18 nt, Human
uuagcugggcgugguggc

SEQ ID NO: 63489 - RNA, 22 nt, Human
uuagcugggcgugguggcaggc

SEQ ID NO: 63490 - RNA, 24 nt, Human
uuagcugggcgugguggcaggcgc

SEQ ID NO: 63491 - RNA, 24 nt, Human
uuagcugggcgugguggcaggcgc

SEQ ID NO: 63492 - RNA, 20 nt, Human
uuccagggcggguugggccu

SEQ ID NO: 63493 - RNA, 20 nt, Human
uucccaagcccacaagguaa

SEQ ID NO: 63494 - RNA, 18 nt, Human
uucccagucucaccugug

SEQ ID NO: 63495 - RNA, 24 nt, Human
uucccagucucaccuguggcuuuc

SEQ ID NO: 63496 - RNA, 23 nt, Human
uucccuccuccacucccaccuau

SEQ ID NO: 63497 - RNA, 21 nt, Human
uuccucuggucucugaucucc

SEQ ID NO: 63498 - RNA, 21 nt, Human
uuccugggucccuccuggguu

SEQ ID NO: 63499 - RNA, 21 nt, Human
uuccugggucccuccuggguu

SEQ ID NO: 63500 - RNA, 24 nt, Human
uuccugggucccuccuggguuccu

SEQ ID NO: 63501 - RNA, 24 nt, Human
uuccugggucccuccuggguuccu

SEQ ID NO: 63502 - RNA, 21 nt, Human
uucuucaggggcuccgccccu

SEQ ID NO: 63503 - RNA, 19 nt, Human
uucuugccuugcucugggg

SEQ ID NO: 63504 - RNA, 18 nt, Human
uugcagugagccgagauc

SEQ ID NO: 63505 - RNA, 18 nt, Human
uugcagugagccgagauc

SEQ ID NO: 63506 - RNA, 18 nt, Human
uugcagugagccgagauc

SEQ ID NO: 63507 - RNA, 20 nt, Human
uugcagugagccgagaucau

SEQ ID NO: 63508 - RNA, 21 nt, Human
uugcagugagccgagaucaug

SEQ ID NO: 63509 - RNA, 21 nt, Human
uugcagugagccgagaucaug

SEQ ID NO: 63510 - RNA, 27 nt, Human
uuggacuucuggcucccuuuccuccgg

SEQ ID NO: 63511 - RNA, 19 nt, Human
uuggagccugaaagugcua

SEQ ID NO: 63512 - RNA, 24 nt, Human
uugggaggccgaggugggcagauc

SEQ ID NO: 63513 - RNA, 24 nt, Human
uugggaggccgaggugggcagauc

SEQ ID NO: 63514 - RNA, 19 nt, Human
uugguuggggccagugguu

SEQ ID NO: 63515 - RNA, 18 nt, Human
uugucuuuuucuuuaucc

SEQ ID NO: 63516 - RNA, 23 nt, Human
uugucuuuuucuuuauccaaguu

SEQ ID NO: 63517 - RNA, 20 nt, Human
uuucacacacucuccaucuc

SEQ ID NO: 63518 - RNA, 25 nt, Human
uuuccuggguggguaagaagcuggg

SEQ ID NO: 63519 - RNA, 21 nt, Human
uuucuagcauuuuaacuucug

SEQ ID NO: 63520 - RNA, 21 nt, Human
uuucuagcauuuuaacuucug

SEQ ID NO: 63521 - RNA, 23 nt, Human
uuuucuagcauuuuaacuucuga

SEQ ID NO: 63522 - RNA, 23 nt, Human
uuuucuagcauuuuaacuucuga

SEQ ID NO: 63523 - RNA, 22 nt, Human
cccuggcucagcuuccaccccc

SEQ ID NO: 63524 - RNA, 24 nt, Human
ccgccuugggggcuucucaguuac

SEQ ID NO: 63525 - RNA, 21 nt, Human
ccuguguccccaguccagagc

SEQ ID NO: 63526 - RNA, 21 nt, Human
cucagccuccgccuugggggc

SEQ ID NO: 63527 - RNA, 20 nt, Human
cuggcucagcuuccaccccc

SEQ ID NO: 63528 - RNA, 22 nt, Human
cugucccuggcucagcuuccac

SEQ ID NO: 63529 - RNA, 22 nt, Human
cuuccacccccagcuggggcuc

SEQ ID NO: 63530 - RNA, 21 nt, Human
gcuuccacccccagcuggggc

SEQ ID NO: 63531 - RNA, 25 nt, Human
uggcucagcuuccacccccagcugg

SEQ ID NO: 63532 - RNA, 21 nt, Human
uugcuuuauuggggaauggau

SEQ ID NO: 63533 - RNA, 19 nt, Human
aaacagccuccuuguccaa

SEQ ID NO: 63534 - RNA, 23 nt, Human
aaccuagagccuccucagcaguc

SEQ ID NO: 63535 - RNA, 19 nt, Human
aaccugcaccugcugugca

SEQ ID NO: 63536 - RNA, 20 nt, Human
aacucggggacauuccucuc

SEQ ID NO: 63537 - RNA, 19 nt, Human
aagauacucuuaucuccua

SEQ ID NO: 63538 - RNA, 20 nt, Human
aagcaagaaauggggugcgg

SEQ ID NO: 63539 - RNA, 19 nt, Human
aaggaaguggccaggcccc

SEQ ID NO: 63540 - RNA, 27 nt, Human
agaaagcaggcccaagcaguggaagca

SEQ ID NO: 63541 - RNA, 23 nt, Human
agcugaugugcagaaacagccuc

SEQ ID NO: 63542 - RNA, 22 nt, Human
aggaauuccaagaaccuagagc

SEQ ID NO: 63543 - RNA, 21 nt, Human
agggggucgcuccucugggcc

SEQ ID NO: 63544 - RNA, 23 nt, Human
caacaaagcaaucaagcaagaaa

SEQ ID NO: 63545 - RNA, 24 nt, Human
cagccuccuuguccaacucgggga

SEQ ID NO: 63546 - RNA, 21 nt, Human
cuagagccuccucagcaguca

SEQ ID NO: 63547 - RNA, 22 nt, Human
gacucuugccugagcugcuggg

SEQ ID NO: 63548 - RNA, 22 nt, Human
gcccccaacaaagcaaucaagc

SEQ ID NO: 63549 - RNA, 19 nt, Human
gcgggcagcguguucccca

SEQ ID NO: 63550 - RNA, 21 nt, Human
ggacaggugagcugaggacac

SEQ ID NO: 63551 - RNA, 25 nt, Human
gggcagugcgggcagcgucgggccc

SEQ ID NO: 63552 - RNA, 20 nt, Human
uccccaggcuggggucucug

SEQ ID NO: 63553 - RNA, 22 nt, Human
ugccugagcugcugggaaaccu

SEQ ID NO: 63554 - RNA, 18 nt, Human
uggcacaaacaucggacu

SEQ ID NO: 63555 - RNA, 20 nt, Human
uggcaggaaaugcaggaacu

SEQ ID NO: 63556 - RNA, 21 nt, Human
uggcaggaaaugcaggaacuc

SEQ ID NO: 63557 - RNA, 18 nt, Human
uggccaggcccccaacaa

SEQ ID NO: 63558 - RNA, 22 nt, Human
uggccaggcccccaacaaagca

SEQ ID NO: 63559 - RNA, 19 nt, Human
ugggccucugcccuggcag

SEQ ID NO: 63560 - RNA, 20 nt, Human
ugucagcuugagaagcaagg

SEQ ID NO: 63561 - RNA, 23 nt, Human
ugugguguuugcacugcucucug

SEQ ID NO: 63562 - RNA, 19 nt, Human
uugcacugcucucugggca

SEQ ID NO: 63563 - RNA, 24 nt, Human
aaaaaacaaaauccuccaccuucc

SEQ ID NO: 63564 - RNA, 21 nt, Human
aaaacacagauaggagccaca

SEQ ID NO: 63565 - RNA, 20 nt, Human
aaaauccuccaccuuccaaa

SEQ ID NO: 63566 - RNA, 23 nt, Human
aaacaaaauccuccaccuuccaa

SEQ ID NO: 63567 - RNA, 20 nt, Human
aaacaagcacaacuugacac

SEQ ID NO: 63568 - RNA, 24 nt, Human
aaacuucaccgaagaggaaagggc

SEQ ID NO: 63569 - RNA, 19 nt, Human
aagaaaggagagaaagaga

SEQ ID NO: 63570 - RNA, 18 nt, Human
aagaagaaaaagaaagga

SEQ ID NO: 63571 - RNA, 19 nt, Human
aagaagaaaaagaaaggag

SEQ ID NO: 63572 - RNA, 21 nt, Human
aagaggaaagggcagcuccgg

SEQ ID NO: 63573 - RNA, 20 nt, Human
aagaugcccagaucuuaaaa

SEQ ID NO: 63574 - RNA, 23 nt, Human
aaggaaacuugcgggagcaacca

SEQ ID NO: 63575 - RNA, 22 nt, Human
acaaugggaagcaaagucugaa

SEQ ID NO: 63576 - RNA, 22 nt, Human
accaggcacuuuccuugcuucc

SEQ ID NO: 63577 - RNA, 23 nt, Human
accaggcacuuuccuugcuuccu

SEQ ID NO: 63578 - RNA, 21 nt, Human
agaaaaaaaaagcccagcaaa

SEQ ID NO: 63579 - RNA, 22 nt, Human
agaaaaaaaaagcccagcaaau

SEQ ID NO: 63580 - RNA, 18 nt, Human
agaaaggagagaaagaga

SEQ ID NO: 63581 - RNA, 24 nt, Human
agaaaggagagaaagagaaaaaaa

SEQ ID NO: 63582 - RNA, 26 nt, Human
agaagaaaaagaaaggagagaaagag

SEQ ID NO: 63583 - RNA, 20 nt, Human
agaagacgggggaggggggg

SEQ ID NO: 63584 - RNA, 22 nt, Human
agacgggggagggggggaaggc

SEQ ID NO: 63585 - RNA, 27 nt, Human
agacgggggagggggggaaggcagggu

SEQ ID NO: 63586 - RNA, 24 nt, Human
agagaagacgggggagggggggaa

SEQ ID NO: 63587 - RNA, 20 nt, Human
agagagugggggaaaacaga

SEQ ID NO: 63588 - RNA, 20 nt, Human
agaucuuaaaagaaaaaaac

SEQ ID NO: 63589 - RNA, 25 nt, Human
aggaggagguggagagagagugggg

SEQ ID NO: 63590 - RNA, 23 nt, Human
aggaggagguggagagaggggac

SEQ ID NO: 63591 - RNA, 32 nt, Human
aggcagcugcgggagagaagacgggggagggg

SEQ ID NO: 63592 - RNA, 19 nt, Human
aggcaggguggggggaggc

SEQ ID NO: 63593 - RNA, 23 nt, Human
aggcaggguggggggaggcgggg

SEQ ID NO: 63594 - RNA, 24 nt, Human
aggcaggguggggggaggcggggu

SEQ ID NO: 63595 - RNA, 24 nt, Human
aggcauacaacaccauucaaaaca

SEQ ID NO: 63596 - RNA, 20 nt, Human
agggaagaagaaaaagaaag

SEQ ID NO: 63597 - RNA, 21 nt, Human
agggggggaaggcaggguggg

SEQ ID NO: 63598 - RNA, 22 nt, Human
agugggggaaaacagaggguuc

SEQ ID NO: 63599 - RNA, 23 nt, Human
agugggggaaaacagaggguucu

SEQ ID NO: 63600 - RNA, 18 nt, Human
auuccccaaggcacugca

SEQ ID NO: 63601 - RNA, 18 nt, Human
caaaacacagauaggagc

SEQ ID NO: 63602 - RNA, 21 nt, Human
caaaacacagauaggagccac

SEQ ID NO: 63603 - RNA, 18 nt, Human
cacaaugggaagcaaagu

SEQ ID NO: 63604 - RNA, 21 nt, Human
cacagauuuaaaggcauacaa

SEQ ID NO: 63605 - RNA, 25 nt, Human
cagcugcgggagagaagacggggga

SEQ ID NO: 63606 - RNA, 23 nt, Human
cagcuuuuaaaaacuucaccgaa

SEQ ID NO: 63607 - RNA, 21 nt, Human
cauguucaugacagacuguac

SEQ ID NO: 63608 - RNA, 19 nt, Human
ccacaaugggaagcaaagu

SEQ ID NO: 63609 - RNA, 22 nt, Human
ccacgcaaaaagcgcucugaca

SEQ ID NO: 63610 - RNA, 21 nt, Human
ccagaucuuaaaagaaaaaaa

SEQ ID NO: 63611 - RNA, 24 nt, Human
cccaccugcgggaagcuccagaga

SEQ ID NO: 63612 - RNA, 19 nt, Human
ccccgccuccccuucucuu

SEQ ID NO: 63613 - RNA, 21 nt, Human
cccucugucgccuccucugcc

SEQ ID NO: 63614 - RNA, 23 nt, Human
cccuuuuucccucugucgccucc

SEQ ID NO: 63615 - RNA, 21 nt, Human
ccgccuccccuucucuugcuc

SEQ ID NO: 63616 - RNA, 20 nt, Human
ccgucccgcucucccagcaa

SEQ ID NO: 63617 - RNA, 18 nt, Human
ccucugggcuugcuccgg

SEQ ID NO: 63618 - RNA, 18 nt, Human
ccuguacagcacuggagc

SEQ ID NO: 63619 - RNA, 23 nt, Human
ccuugagcuuggcugaaucuucc

SEQ ID NO: 63620 - RNA, 24 nt, Human
cgggggagggggggaaggcagggu

SEQ ID NO: 63621 - RNA, 18 nt, Human
cgucccgcucucccagca

SEQ ID NO: 63622 - RNA, 23 nt, Human
cgucccgcucucccagcaagcug

SEQ ID NO: 63623 - RNA, 21 nt, Human
cuccggaccgucccgcucucc

SEQ ID NO: 63624 - RNA, 24 nt, Human
cucgggguggggaaggcaggagga

SEQ ID NO: 63625 - RNA, 19 nt, Human
cuggcuccuaagagccuuc

SEQ ID NO: 63626 - RNA, 24 nt, Human
gaacauguucaugacagacuguac

SEQ ID NO: 63627 - RNA, 18 nt, Human
gaagacgggggagggggg

SEQ ID NO: 63628 - RNA, 23 nt, Human
gagaagacgggggagggggggaa

SEQ ID NO: 63629 - RNA, 24 nt, Human
gagccgggcuggggcuggcguggu

SEQ ID NO: 63630 - RNA, 24 nt, Human
gaggcguuggcugucgcuggagcc

SEQ ID NO: 63631 - RNA, 22 nt, Human
gagggaagaagaaaaagaaagg

SEQ ID NO: 63632 - RNA, 26 nt, Human
gagggaagaagaaaaagaaaggagga

SEQ ID NO: 63633 - RNA, 23 nt, Human
gagugggggaaaacagaggguuc

SEQ ID NO: 63634 - RNA, 18 nt, Human
gcaggguggggggaggcg

SEQ ID NO: 63635 - RNA, 21 nt, Human
gccuggcuccuaagagccuuc

SEQ ID NO: 63636 - RNA, 21 nt, Human
gcugcagcuagcugcccaccu

SEQ ID NO: 63637 - RNA, 22 nt, Human
ggaaaacagaggguucucuccu

SEQ ID NO: 63638 - RNA, 19 nt, Human
ggaagaagaaaaagaaagg

SEQ ID NO: 63639 - RNA, 19 nt, Human
ggagagaagacgggggagg

SEQ ID NO: 63640 - RNA, 27 nt, Human
ggagagagagugggggaaaacagaggg

SEQ ID NO: 63641 - RNA, 21 nt, Human
ggaggcgggguggagaggagg

SEQ ID NO: 63642 - RNA, 19 nt, Human
ggcagcuccgggcggcggc

SEQ ID NO: 63643 - RNA, 23 nt, Human
ggcggguggggagaaggguggug

SEQ ID NO: 63644 - RNA, 19 nt, Human
gggaagaagaaaaagaaag

SEQ ID NO: 63645 - RNA, 21 nt, Human
gggaagaagaaaaagaaagga

SEQ ID NO: 63646 - RNA, 22 nt, Human
gggagagaagacgggggagggg

SEQ ID NO: 63647 - RNA, 18 nt, Human
gggcgggggggcgggugg

SEQ ID NO: 63648 - RNA, 19 nt, Human
ggggaaggcaggguggggg

SEQ ID NO: 63649 - RNA, 22 nt, Human
ggggaaggcaggguggggggag

SEQ ID NO: 63650 - RNA, 18 nt, Human
ggggagggggggaaggca

SEQ ID NO: 63651 - RNA, 19 nt, Human
ggggcgggggggcgggugg

SEQ ID NO: 63652 - RNA, 20 nt, Human
ggggcggguggggagaaggg

SEQ ID NO: 63653 - RNA, 20 nt, Human
gggggagggggggaaggcag

SEQ ID NO: 63654 - RNA, 20 nt, Human
gggggcaugagcuggggugg

SEQ ID NO: 63655 - RNA, 29 nt, Human
gggggggaaggcaggguggggggaggcgg

SEQ ID NO: 63656 - RNA, 18 nt, Human
ggguggggagaagggugg

SEQ ID NO: 63657 - RNA, 20 nt, Human
guagugcuguaaacaagcac

SEQ ID NO: 63658 - RNA, 20 nt, Human
guggggaaggcaggaggagg

SEQ ID NO: 63659 - RNA, 18 nt, Human
gugggggaaaacagaggg

SEQ ID NO: 63660 - RNA, 23 nt, Human
guggugcgucccuucggcuccug

SEQ ID NO: 63661 - RNA, 21 nt, Human
guguggcuggcacagaguagu

SEQ ID NO: 63662 - RNA, 18 nt, Human
uaaccaggcgggucgugg

SEQ ID NO: 63663 - RNA, 26 nt, Human
uaccccgccuccccuucucuugcuca

SEQ ID NO: 63664 - RNA, 19 nt, Human
uagcucucuaaacuucccu

SEQ ID NO: 63665 - RNA, 24 nt, Human
ucaaaagaugcccagaucuuaaaa

SEQ ID NO: 63666 - RNA, 18 nt, Human
ucagaagaguucaacagg

SEQ ID NO: 63667 - RNA, 19 nt, Human
ucaggaacauguucaugac

SEQ ID NO: 63668 - RNA, 19 nt, Human
uccaccuacuucccuuacc

SEQ ID NO: 63669 - RNA, 20 nt, Human
ucccagcaagcuggcucccc

SEQ ID NO: 63670 - RNA, 20 nt, Human
uccccagauaaucuuagcuc

SEQ ID NO: 63671 - RNA, 21 nt, Human
uccccagucgccuggcuccua

SEQ ID NO: 63672 - RNA, 21 nt, Human
ucccuuaccccgccuccccuu

SEQ ID NO: 63673 - RNA, 24 nt, Human
ucgccuggcuccuaagagccuucu

SEQ ID NO: 63674 - RNA, 26 nt, Human
ucgcuggagccgggcuggggcuggcg

SEQ ID NO: 63675 - RNA, 21 nt, Human
ucucccagcaagcuggcuccc

SEQ ID NO: 63676 - RNA, 24 nt, Human
ucucccagcaagcuggcuccccgg

SEQ ID NO: 63677 - RNA, 18 nt, Human
ugagcugggguggggaaa

SEQ ID NO: 63678 - RNA, 23 nt, Human
ugagcugggguggggaaauaggg

SEQ ID NO: 63679 - RNA, 24 nt, Human
ugagcugggguggggaaauagggu

SEQ ID NO: 63680 - RNA, 20 nt, Human
ugaguuauuaucuuuuucuu

SEQ ID NO: 63681 - RNA, 19 nt, Human
ugcagaagaagacacacgg

SEQ ID NO: 63682 - RNA, 23 nt, Human
ugcgggagagaagacgggggagg

SEQ ID NO: 63683 - RNA, 21 nt, Human
ugcgucccuucggcuccugua

SEQ ID NO: 63684 - RNA, 21 nt, Human
ugcuccggaccgucccgcucu

SEQ ID NO: 63685 - RNA, 21 nt, Human
uggagaggaggaggacaaagg

SEQ ID NO: 63686 - RNA, 22 nt, Human
uggcuccgcacucggggugggg

SEQ ID NO: 63687 - RNA, 18 nt, Human
uggcugaaucuuccaccu

SEQ ID NO: 63688 - RNA, 19 nt, Human
uggggaaggcaggaggagg

SEQ ID NO: 63689 - RNA, 18 nt, Human
uggggagaagggugguga

SEQ ID NO: 63690 - RNA, 21 nt, Human
ugggguggggaaauaggguuu

SEQ ID NO: 63691 - RNA, 20 nt, Human
uggugagggggguuggcuga

SEQ ID NO: 63692 - RNA, 21 nt, Human
uggugagggggguuggcuggu

SEQ ID NO: 63693 - RNA, 20 nt, Human
uguguggcuggcacagagua

SEQ ID NO: 63694 - RNA, 18 nt, Human
uguuuguuuuguuuuuug

SEQ ID NO: 63695 - RNA, 19 nt, Human
uguuuugauuuccccagau

SEQ ID NO: 63696 - RNA, 18 nt, Human
uguuuuguuuuuuggcua

SEQ ID NO: 63697 - RNA, 21 nt, Human
uugcucagaagaguucaacag

SEQ ID NO: 63698 - RNA, 26 nt, Human
uugcuuccuccgagucuuuagcagcu

SEQ ID NO: 63699 - RNA, 24 nt, Human
uuuguguggcuggcacagaguagu

SEQ ID NO: 63700 - RNA, 18 nt, Human
uuuuguuuguuuuguuuu

SEQ ID NO: 63701 - RNA, 21 nt, Human
uuuuuguuuguuuuguuuuuu

SEQ ID NO: 63702 - RNA, 23 nt, Human
uuuuuuggcuacugaagaccuga

SEQ ID NO: 63703 - RNA, 18 nt, Human
aagccaagaggaaaccaa

SEQ ID NO: 63704 - RNA, 21 nt, Human
acacaaaagggaccccccaaa

SEQ ID NO: 63705 - RNA, 18 nt, Human
acucagccuuccacccuu

SEQ ID NO: 63706 - RNA, 21 nt, Human
acuggaaaagcacauggggac

SEQ ID NO: 63707 - RNA, 21 nt, Human
agaaagagaggaguccuugaa

SEQ ID NO: 63708 - RNA, 19 nt, Human
agaagaacuggaaaagcac

SEQ ID NO: 63709 - RNA, 22 nt, Human
agacacaaaagggaccccccaa

SEQ ID NO: 63710 - RNA, 19 nt, Human
agagagguucugaguggaa

SEQ ID NO: 63711 - RNA, 22 nt, Human
agccauuggagauggaggagcu

SEQ ID NO: 63712 - RNA, 23 nt, Human
agggggcucagucuuuggcgggg

SEQ ID NO: 63713 - RNA, 22 nt, Human
aucuugggccucucuucuuguu

SEQ ID NO: 63714 - RNA, 21 nt, Human
augauggaggagacagggggc

SEQ ID NO: 63715 - RNA, 21 nt, Human
caaagccaagaggaaaccaaa

SEQ ID NO: 63716 - RNA, 23 nt, Human
caaaguccaggcuccugucgccc

SEQ ID NO: 63717 - RNA, 20 nt, Human
caagaggaaaccaaaugaug

SEQ ID NO: 63718 - RNA, 26 nt, Human
cacagaguccgccuccgucgccucuc

SEQ ID NO: 63719 - RNA, 24 nt, Human
cacauggggacccccucaucuccc

SEQ ID NO: 63720 - RNA, 24 nt, Human
cagaguccgccuccgucgccucuc

SEQ ID NO: 63721 - RNA, 24 nt, Human
cagcagaauucugugcuucuuggu

SEQ ID NO: 63722 - RNA, 19 nt, Human
caggcccuccuguugcuug

SEQ ID NO: 63723 - RNA, 22 nt, Human
ccaaaauuuagaaguaucccca

SEQ ID NO: 63724 - RNA, 27 nt, Human
ccaauaaugauagucuagaagcaaaga

SEQ ID NO: 63725 - RNA, 18 nt, Human
ccaggguggggaaugggg

SEQ ID NO: 63726 - RNA, 22 nt, Human
ccccaaaauccaguggaaggca

SEQ ID NO: 63727 - RNA, 19 nt, Human
ccccccaaaauccacaugg

SEQ ID NO: 63728 - RNA, 18 nt, Human
cccuccuguugcuugucc

SEQ ID NO: 63729 - RNA, 25 nt, Human
ccgccuccgucgccucucggacucu

SEQ ID NO: 63730 - RNA, 22 nt, Human
ccgucgccucucggacucucgu

SEQ ID NO: 63731 - RNA, 20 nt, Human
cgccgcuacagccgccgccg

SEQ ID NO: 63732 - RNA, 20 nt, Human
cgccgcuacagccgccgccg

SEQ ID NO: 63733 - RNA, 23 nt, Human
cuaauuuucacacgacaguccaa

SEQ ID NO: 63734 - RNA, 20 nt, Human
cuacaagaaggcagacaaga

SEQ ID NO: 63735 - RNA, 21 nt, Human
cugcagccuaauuuucacacg

SEQ ID NO: 63736 - RNA, 18 nt, Human
gaagcaaaguggcagggg

SEQ ID NO: 63737 - RNA, 21 nt, Human
gaaguauccccaaagccaaga

SEQ ID NO: 63738 - RNA, 27 nt, Human
gaaguccuuccaguuccuucucugcuc

SEQ ID NO: 63739 - RNA, 19 nt, Human
gaccccccaaaauccacau

SEQ ID NO: 63740 - RNA, 26 nt, Human
gcuccuacaagaaggcagacaagaau

SEQ ID NO: 63741 - RNA, 22 nt, Human
gcuccuuggcguggagggcuga

SEQ ID NO: 63742 - RNA, 21 nt, Human
ggacccccucaucucccaggg

SEQ ID NO: 63743 - RNA, 20 nt, Human
ggagacagggggcucagucu

SEQ ID NO: 63744 - RNA, 19 nt, Human
ggcugagguggggcugggc

SEQ ID NO: 63745 - RNA, 20 nt, Human
gggaaugggggauccugagg

SEQ ID NO: 63746 - RNA, 23 nt, Human
gggcucagucuuuggcggggguc

SEQ ID NO: 63747 - RNA, 20 nt, Human
ggggauccugaggcagcauc

SEQ ID NO: 63748 - RNA, 24 nt, Human
gguggggaaugggggauccugagg

SEQ ID NO: 63749 - RNA, 18 nt, Human
gucacgccgcuacagccg

SEQ ID NO: 63750 - RNA, 20 nt, Human
guugcuugucucacucuuga

SEQ ID NO: 63751 - RNA, 21 nt, Human
uagaaguauccccaaagccaa

SEQ ID NO: 63752 - RNA, 21 nt, Human
uccacauggggugcugggaac

SEQ ID NO: 63753 - RNA, 24 nt, Human
uccagaagaacuggaaaagcacau

SEQ ID NO: 63754 - RNA, 18 nt, Human
uccagagagguucugagu

SEQ ID NO: 63755 - RNA, 18 nt, Human
uccagagagguucugagu

SEQ ID NO: 63756 - RNA, 18 nt, Human
uccaguuccuucucuggg

SEQ ID NO: 63757 - RNA, 23 nt, Human
ucccaggguggggaaugggggau

SEQ ID NO: 63758 - RNA, 19 nt, Human
ucccugguggcuugggcgg

SEQ ID NO: 63759 - RNA, 18 nt, Human
ugagguggggcugggcag

SEQ ID NO: 63760 - RNA, 24 nt, Human
ugagguggggcugggcaggugcca

SEQ ID NO: 63761 - RNA, 22 nt, Human
ugaguggaaucccugccacaaa

SEQ ID NO: 63762 - RNA, 18 nt, Human
ugccaaggucucagcuuc

SEQ ID NO: 63763 - RNA, 24 nt, Human
ugccacaaaucccagccauuggag

SEQ ID NO: 63764 - RNA, 21 nt, Human
ugccauggggcuccuacaaga

SEQ ID NO: 63765 - RNA, 19 nt, Human
ugcgggacucagccuucca

SEQ ID NO: 63766 - RNA, 19 nt, Human
uggcguggagggcugagau

SEQ ID NO: 63767 - RNA, 18 nt, Human
ugggcaggugccaugggg

SEQ ID NO: 63768 - RNA, 21 nt, Human
ugggcugagguggggcugggc

SEQ ID NO: 63769 - RNA, 19 nt, Human
uggggaaugggggauccug

SEQ ID NO: 63770 - RNA, 21 nt, Human
uggggaaugggggauccugag

SEQ ID NO: 63771 - RNA, 22 nt, Human
uuagaaguauccccaaagccaa

SEQ ID NO: 63772 - RNA, 20 nt, Human
uucucugcucaggcccuccu

SEQ ID NO: 63773 - RNA, 22 nt, Human
aaaaaagguuuuuugaaauuaa

SEQ ID NO: 63774 - RNA, 19 nt, Human
aaaagaacagaagacaugc

SEQ ID NO: 63775 - RNA, 20 nt, Human
aaauguggagaaaugaaaau

SEQ ID NO: 63776 - RNA, 19 nt, Human
aacacggugaaaccccguc

SEQ ID NO: 63777 - RNA, 20 nt, Human
aacacggugaaaccccgucu

SEQ ID NO: 63778 - RNA, 21 nt, Human
aacacggugaaaccccgucuc

SEQ ID NO: 63779 - RNA, 18 nt, Human
aacacuuugggaggcuga

SEQ ID NO: 63780 - RNA, 24 nt, Human
aacacuuugggaggcugagguggg

SEQ ID NO: 63781 - RNA, 20 nt, Human
aacagcagcagacaugauua

SEQ ID NO: 63782 - RNA, 20 nt, Human
aagcaauuccacacacagcc

SEQ ID NO: 63783 - RNA, 22 nt, Human
aaggauuucagagauggggaca

SEQ ID NO: 63784 - RNA, 24 nt, Human
aaucauaaccccauuucuguuaga

SEQ ID NO: 63785 - RNA, 18 nt, Human
aaugugaauggauuacag

SEQ ID NO: 63786 - RNA, 24 nt, Human
acaaagugagacuccaucucaaaa

SEQ ID NO: 63787 - RNA, 24 nt, Human
acccaggaggcggagguugcagug

SEQ ID NO: 63788 - RNA, 23 nt, Human
accccgucucuacuaaaauacaa

SEQ ID NO: 63789 - RNA, 20 nt, Human
acgggagcaccagcagcucu

SEQ ID NO: 63790 - RNA, 26 nt, Human
acuaaaauacaaaaaauuagccaguc

SEQ ID NO: 63791 - RNA, 19 nt, Human
agaaaaaaggggucuccag

SEQ ID NO: 63792 - RNA, 21 nt, Human
agaaaccaccaguacaugaug

SEQ ID NO: 63793 - RNA, 19 nt, Human
agaaagaaaaaccuaaagg

SEQ ID NO: 63794 - RNA, 23 nt, Human
agcaacuuagguaaagguagagg

SEQ ID NO: 63795 - RNA, 23 nt, Human
agccaggcgugguggcgugcacc

SEQ ID NO: 63796 - RNA, 22 nt, Human
agccugggcaacacggugaaac

SEQ ID NO: 63797 - RNA, 24 nt, Human
agccugggcaacacggugaaaccc

SEQ ID NO: 63798 - RNA, 24 nt, Human
agccuggguuacaaagugagacuc

SEQ ID NO: 63799 - RNA, 23 nt, Human
agcugggcaugguggcucaugcc

SEQ ID NO: 63800 - RNA, 23 nt, Human
aggauuggcaaagacucccugaa

SEQ ID NO: 63801 - RNA, 23 nt, Human
aggcaggagacuugcuugaaccc

SEQ ID NO: 63802 - RNA, 24 nt, Human
aggcaggagacuugcuugaaccca

SEQ ID NO: 63803 - RNA, 24 nt, Human
aggcggagguugcagugagcugag

SEQ ID NO: 63804 - RNA, 24 nt, Human
aggcgugguggcgugcaccuguag

SEQ ID NO: 63805 - RNA, 24 nt, Human
aggcugaggcaggagacuugcuug

SEQ ID NO: 63806 - RNA, 20 nt, Human
aggcugaggugggcggauug

SEQ ID NO: 63807 - RNA, 24 nt, Human
aguaaucucagaaaaaaaagguuu

SEQ ID NO: 63808 - RNA, 24 nt, Human
aucaugccauugcauuccagccug

SEQ ID NO: 63809 - RNA, 21 nt, Human
augacacucaaaagacuuagg

SEQ ID NO: 63810 - RNA, 19 nt, Human
augccuguaaucccaacac

SEQ ID NO: 63811 - RNA, 22 nt, Human
augucucugugacacugaaaca

SEQ ID NO: 63812 - RNA, 22 nt, Human
auguucagagugggagugguac

SEQ ID NO: 63813 - RNA, 23 nt, Human
auuaaacuugacuuuuaaaaaau

SEQ ID NO: 63814 - RNA, 18 nt, Human
auugcauuccagccuggg

SEQ ID NO: 63815 - RNA, 23 nt, Human
auugcauuccagccuggguuaca

SEQ ID NO: 63816 - RNA, 18 nt, Human
caaauaaauauaaugccu

SEQ ID NO: 63817 - RNA, 27 nt, Human
caaauaguucaccugaauaguccaaaa

SEQ ID NO: 63818 - RNA, 24 nt, Human
caacacggugaaaccccgucucua

SEQ ID NO: 63819 - RNA, 21 nt, Human
caacacuuugggaggcugagg

SEQ ID NO: 63820 - RNA, 24 nt, Human
caacacuuugggaggcugaggugg

SEQ ID NO: 63821 - RNA, 20 nt, Human
caacuuagguaaagguagag

SEQ ID NO: 63822 - RNA, 25 nt, Human
caacuuggcaaagagaugaaggaau

SEQ ID NO: 63823 - RNA, 21 nt, Human
caacuuucaaacaaaacugga

SEQ ID NO: 63824 - RNA, 18 nt, Human
caacuuuuaaccaccccu

SEQ ID NO: 63825 - RNA, 19 nt, Human
caagauggcggccccaagc

SEQ ID NO: 63826 - RNA, 22 nt, Human
cacacacagccauuuaugugug

SEQ ID NO: 63827 - RNA, 21 nt, Human
caccuguagucccagcuacuc

SEQ ID NO: 63828 - RNA, 23 nt, Human
caccuguagucccagcuacucgg

SEQ ID NO: 63829 - RNA, 24 nt, Human
cagaugaucccagugccugacuga

SEQ ID NO: 63830 - RNA, 24 nt, Human
caugccuguaaucccaacacuuug

SEQ ID NO: 63831 - RNA, 23 nt, Human
cauuccagccuggguuacaaagu

SEQ ID NO: 63832 - RNA, 24 nt, Human
cauuccagccuggguuacaaagug

SEQ ID NO: 63833 - RNA, 18 nt, Human
cauugcauuccagccugg

SEQ ID NO: 63834 - RNA, 19 nt, Human
cauugcauuccagccuggg

SEQ ID NO: 63835 - RNA, 20 nt, Human
cauugcauuccagccugggu

SEQ ID NO: 63836 - RNA, 22 nt, Human
cauugcauuccagccuggguua

SEQ ID NO: 63837 - RNA, 24 nt, Human
cauugcauuccagccuggguuaca

SEQ ID NO: 63838 - RNA, 23 nt, Human
ccaauacaaucugccaaagaaaa

SEQ ID NO: 63839 - RNA, 20 nt, Human
ccacuggggauagggguagg

SEQ ID NO: 63840 - RNA, 20 nt, Human
ccacuggggauagggguagg

SEQ ID NO: 63841 - RNA, 24 nt, Human
ccagugccugacugaauguauaga

SEQ ID NO: 63842 - RNA, 20 nt, Human
ccauugcauuccagccuggg

SEQ ID NO: 63843 - RNA, 21 nt, Human
ccauugcauuccagccugggu

SEQ ID NO: 63844 - RNA, 22 nt, Human
ccauugcauuccagccuggguu

SEQ ID NO: 63845 - RNA, 24 nt, Human
ccauugcauuccagccuggguuac

SEQ ID NO: 63846 - RNA, 26 nt, Human
cccacagccuucaaaaucauaacccc

SEQ ID NO: 63847 - RNA, 22 nt, Human
ccccuugacaggaaccgcugcc

SEQ ID NO: 63848 - RNA, 21 nt, Human
cccugaaaggaaaacaacuug

SEQ ID NO: 63849 - RNA, 20 nt, Human
ccugaaaggaaaacaacuug

SEQ ID NO: 63850 - RNA, 23 nt, Human
ccugggcaacacggugaaacccc

SEQ ID NO: 63851 - RNA, 24 nt, Human
ccugggcaacacggugaaaccccg

SEQ ID NO: 63852 - RNA, 22 nt, Human
ccuguaaucccaacacuuuggg

SEQ ID NO: 63853 - RNA, 21 nt, Human
ccuguagucccagcuacucgg

SEQ ID NO: 63854 - RNA, 25 nt, Human
ccuucucagaaaaaccucaugugga

SEQ ID NO: 63855 - RNA, 19 nt, Human
cgcgaccagccugggcaac

SEQ ID NO: 63856 - RNA, 24 nt, Human
cggauugccugagcucaggaguuc

SEQ ID NO: 63857 - RNA, 23 nt, Human
cgggagcaccagcagcucuggac

SEQ ID NO: 63858 - RNA, 24 nt, Human
cucaugccuguaaucccaacacuu

SEQ ID NO: 63859 - RNA, 18 nt, Human
cuggaccugcugcccccu

SEQ ID NO: 63860 - RNA, 23 nt, Human
cugggcaugguggcucaugccug

SEQ ID NO: 63861 - RNA, 24 nt, Human
cuucuagaccccauaccccucaaa

SEQ ID NO: 63862 - RNA, 18 nt, Human
cuucucagaaaaaccucu

SEQ ID NO: 63863 - RNA, 23 nt, Human
cuugucccaagcccuucucagaa

SEQ ID NO: 63864 - RNA, 25 nt, Human
cuugucccaagcccuucucagaaaa

SEQ ID NO: 63865 - RNA, 22 nt, Human
gaaaggaaaacaacuuggcaaa

SEQ ID NO: 63866 - RNA, 25 nt, Human
gaaaggaaaacaacuuggcaaagag

SEQ ID NO: 63867 - RNA, 25 nt, Human
gaaauggaugagauggaaccgagaa

SEQ ID NO: 63868 - RNA, 20 nt, Human
gagcuugcuuuccugcuggc

SEQ ID NO: 63869 - RNA, 22 nt, Human
gagguugcagugagcugagauc

SEQ ID NO: 63870 - RNA, 19 nt, Human
gaguucgcgaccagccugg

SEQ ID NO: 63871 - RNA, 18 nt, Human
gauuacagacuguggcca

SEQ ID NO: 63872 - RNA, 23 nt, Human
gauugccugagcucaggaguucg

SEQ ID NO: 63873 - RNA, 21 nt, Human
gcaaagacucccugaacccac

SEQ ID NO: 63874 - RNA, 23 nt, Human
gcagcugggcaugguggcucaug

SEQ ID NO: 63875 - RNA, 22 nt, Human
gcaggagacuugcuugaaccca

SEQ ID NO: 63876 - RNA, 19 nt, Human
gccauugcauuccagccug

SEQ ID NO: 63877 - RNA, 21 nt, Human
gcccugaaaggaaaacaacuu

SEQ ID NO: 63878 - RNA, 22 nt, Human
ggaggcggagguugcagugagc

SEQ ID NO: 63879 - RNA, 22 nt, Human
ggagguugcagugagcugagau

SEQ ID NO: 63880 - RNA, 23 nt, Human
ggagguugcagugagcugagauc

SEQ ID NO: 63881 - RNA, 24 nt, Human
ggagguugcagugagcugagauca

SEQ ID NO: 63882 - RNA, 19 nt, Human
ggauuacagacuguggcca

SEQ ID NO: 63883 - RNA, 23 nt, Human
ggauugccugagcucaggaguuc

SEQ ID NO: 63884 - RNA, 23 nt, Human
ggcaugguggcucaugccuguaa

SEQ ID NO: 63885 - RNA, 21 nt, Human
ggcggugguggggcgcgcccg

SEQ ID NO: 63886 - RNA, 24 nt, Human
ggcuagaaacuucuuuggcaagca

SEQ ID NO: 63887 - RNA, 18 nt, Human
gggaaagagaaggaagga

SEQ ID NO: 63888 - RNA, 20 nt, Human
gggaggcugaggugggcgga

SEQ ID NO: 63889 - RNA, 24 nt, Human
gguggcgugcaccuguagucccag

SEQ ID NO: 63890 - RNA, 23 nt, Human
gguggcucaugccuguaauccca

SEQ ID NO: 63891 - RNA, 18 nt, Human
guaggauuucuugccugc

SEQ ID NO: 63892 - RNA, 20 nt, Human
gugaaauggagccuccuuga

SEQ ID NO: 63893 - RNA, 24 nt, Human
guugcagugagcugagaucaugcc

SEQ ID NO: 63894 - RNA, 22 nt, Human
uaaaauaaaaauaaaggagcaa

SEQ ID NO: 63895 - RNA, 31 nt, Human
uaaaauaaaaauaaaggagcaacuuagguag

SEQ ID NO: 63896 - RNA, 18 nt, Human
uaaaauaaaggagcagcu

SEQ ID NO: 63897 - RNA, 20 nt, Human
uaaacagaugaucccagugc

SEQ ID NO: 63898 - RNA, 23 nt, Human
uaacuucuagaccccauaccccu

SEQ ID NO: 63899 - RNA, 19 nt, Human
uaaucugaaaauuuuccuu

SEQ ID NO: 63900 - RNA, 24 nt, Human
uacaaagugagacuccaucucaaa

SEQ ID NO: 63901 - RNA, 19 nt, Human
uagaaagaaaaaccuaaag

SEQ ID NO: 63902 - RNA, 21 nt, Human
uaguucaccugaauaguccuu

SEQ ID NO: 63903 - RNA, 23 nt, Human
uaucaaagaaugucucugugaca

SEQ ID NO: 63904 - RNA, 22 nt, Human
ucaaaaucauaaccccauuucu

SEQ ID NO: 63905 - RNA, 22 nt, Human
ucaccugaauaguccaaaaauc

SEQ ID NO: 63906 - RNA, 23 nt, Human
ucaugccauugcauuccagccug

SEQ ID NO: 63907 - RNA, 22 nt, Human
uccacacacagccauuuaugug

SEQ ID NO: 63908 - RNA, 19 nt, Human
uccagccuggguuacaaag

SEQ ID NO: 63909 - RNA, 24 nt, Human
uccagccuggguuacaaagugaga

SEQ ID NO: 63910 - RNA, 24 nt, Human
ucccaagcccuucucagaaaaacc

SEQ ID NO: 63911 - RNA, 23 nt, Human
ucucuacuaaaauacaaaaaauu

SEQ ID NO: 63912 - RNA, 25 nt, Human
ucuggagagcuugcuuuccugcugg

SEQ ID NO: 63913 - RNA, 25 nt, Human
ugaaauggagccuccuugauaguuu

SEQ ID NO: 63914 - RNA, 21 nt, Human
ugaauaguccaaaaaucaaga

SEQ ID NO: 63915 - RNA, 22 nt, Human
ugaauaguccaaaaaucaagaa

SEQ ID NO: 63916 - RNA, 19 nt, Human
ugacagacuucuuguccca

SEQ ID NO: 63917 - RNA, 23 nt, Human
ugagauggaaccgagaaaccacc

SEQ ID NO: 63918 - RNA, 24 nt, Human
ugaggcaggagacuugcuugaacc

SEQ ID NO: 63919 - RNA, 25 nt, Human
ugaggcaggagacuugcuugaaccc

SEQ ID NO: 63920 - RNA, 18 nt, Human
ugagggcggugguggggc

SEQ ID NO: 63921 - RNA, 18 nt, Human
ugaggugggcggauugcc

SEQ ID NO: 63922 - RNA, 19 nt, Human
ugaggugggcggauugccu

SEQ ID NO: 63923 - RNA, 23 nt, Human
ugaggugggcggauugccugagc

SEQ ID NO: 63924 - RNA, 24 nt, Human
ugaggugggcggauugccugagcu

SEQ ID NO: 63925 - RNA, 21 nt, Human
ugcaaaaaaucaaauggugaa

SEQ ID NO: 63926 - RNA, 19 nt, Human
ugcaccuguagucccagcu

SEQ ID NO: 63927 - RNA, 24 nt, Human
ugcauuguaucagaaaaaaggggu

SEQ ID NO: 63928 - RNA, 23 nt, Human
ugccuguaaucccaacacuuugg

SEQ ID NO: 63929 - RNA, 23 nt, Human
ugccuguaaucccaacacuuugg

SEQ ID NO: 63930 - RNA, 24 nt, Human
uggaaggacaggcccugaaaggaa

SEQ ID NO: 63931 - RNA, 21 nt, Human
uggauuacagacuguggccau

SEQ ID NO: 63932 - RNA, 22 nt, Human
uggcaagcaauuccacacacag

SEQ ID NO: 63933 - RNA, 21 nt, Human
uggcucaugccuguaauccca

SEQ ID NO: 63934 - RNA, 24 nt, Human
uggcucaugccuguaaucccaaca

SEQ ID NO: 63935 - RNA, 18 nt, Human
ugggaggcugaggugggc

SEQ ID NO: 63936 - RNA, 22 nt, Human
ugggaggcugaggugggcggau

SEQ ID NO: 63937 - RNA, 24 nt, Human
ugggaggcugaggugggcggauug

SEQ ID NO: 63938 - RNA, 19 nt, Human
ugguggaaaauguugggcu

SEQ ID NO: 63939 - RNA, 24 nt, Human
ugguggcgugcaccuguaguccca

SEQ ID NO: 63940 - RNA, 24 nt, Human
ugguggcucaugccuguaauccca

SEQ ID NO: 63941 - RNA, 23 nt, Human
uguaaacagaugaucccagugcc

SEQ ID NO: 63942 - RNA, 20 nt, Human
uuacaaaaugucucucauuu

SEQ ID NO: 63943 - RNA, 22 nt, Human
uuacaaagugagacuccaucuc

SEQ ID NO: 63944 - RNA, 22 nt, Human
uucaaaaucauaaccccauuuc

SEQ ID NO: 63945 - RNA, 27 nt, Human
uuccuuuucagcucccucuucuuggua

SEQ ID NO: 63946 - RNA, 24 nt, Human
uucuaaacuggaaggacaggcccu

SEQ ID NO: 63947 - RNA, 21 nt, Human
uucuuuuagacaucuugaaga

SEQ ID NO: 63948 - RNA, 24 nt, Human
uugaacccaggaggcggagguugc

SEQ ID NO: 63949 - RNA, 21 nt, Human
uugcagggacggccagauguu

SEQ ID NO: 63950 - RNA, 18 nt, Human
uugcagugagcugagauc

SEQ ID NO: 63951 - RNA, 20 nt, Human
uugcagugagcugagaucau

SEQ ID NO: 63952 - RNA, 21 nt, Human
uugcagugagcugagaucaug

SEQ ID NO: 63953 - RNA, 21 nt, Human
uugccugagcucaggaguucg

SEQ ID NO: 63954 - RNA, 20 nt, Human
uugccugcuuaacuaacaug

SEQ ID NO: 63955 - RNA, 24 nt, Human
uugcuugaacccaggaggcggagg

SEQ ID NO: 63956 - RNA, 26 nt, Human
uuucagagauggggacagacugguga

SEQ ID NO: 63957 - RNA, 21 nt, Human
aacggcggcggggcucgcggg

SEQ ID NO: 63958 - RNA, 23 nt, Human
aacggcggcggggcucgcggguc

SEQ ID NO: 63959 - RNA, 21 nt, Human
cgccgggacggccggggcugg

SEQ ID NO: 63960 - RNA, 18 nt, Human
gaggaggggauggggcag

SEQ ID NO: 63961 - RNA, 19 nt, Human
gaggaggggauggggcagg

SEQ ID NO: 63962 - RNA, 24 nt, Human
ggagcgaauuuauugugaaagcuc

SEQ ID NO: 63963 - RNA, 20 nt, Human
gggugaggaggggauggggc

SEQ ID NO: 63964 - RNA, 20 nt, Human
ugaaagcucguggggugagg

SEQ ID NO: 63965 - RNA, 20 nt, Human
uggggugaggaggggauggg

SEQ ID NO: 63966 - RNA, 18 nt, Human
agugacuccaaugugaua

SEQ ID NO: 63967 - RNA, 22 nt, Human
ccucgggcugucccgggaccuc

SEQ ID NO: 63968 - RNA, 19 nt, Human
cgaguggagaccgggagug

SEQ ID NO: 63969 - RNA, 21 nt, Human
cgcagcggcggcgucucgguc

SEQ ID NO: 63970 - RNA, 23 nt, Human
cgggaccucuggggcgcuggcac

SEQ ID NO: 63971 - RNA, 23 nt, Human
cggggcggcgggcgcggcgccuc

SEQ ID NO: 63972 - RNA, 19 nt, Human
gacuccaaugugauauccu

SEQ ID NO: 63973 - RNA, 18 nt, Human
gcgcuggcacccaggugu

SEQ ID NO: 63974 - RNA, 25 nt, Human
gcggcgccucgggcugucccgggac

SEQ ID NO: 63975 - RNA, 19 nt, Human
ggcgcuggcacccaggugu

SEQ ID NO: 63976 - RNA, 18 nt, Human
ggcggcgggcgcggcgcc

SEQ ID NO: 63977 - RNA, 21 nt, Human
ggggagcucggggcggcgggc

SEQ ID NO: 63978 - RNA, 19 nt, Human
gguguuggaagagcgagug

SEQ ID NO: 63979 - RNA, 19 nt, Human
ucucuggggcaacucgguc

SEQ ID NO: 63980 - RNA, 21 nt, Human
ugaaaaaauacuuuuuaccuu

SEQ ID NO: 63981 - RNA, 18 nt, Human
uggaaagaggaccgacuc

SEQ ID NO: 63982 - RNA, 18 nt, Human
uggaaagaggaccgacuc

SEQ ID NO: 63983 - RNA, 20 nt, Human
uggaaagaggaccgacucau

SEQ ID NO: 63984 - RNA, 26 nt, Human
uggaagagcgaguggagaccgggagu

SEQ ID NO: 63985 - RNA, 21 nt, Human
uggggagcucggggcggcggg

SEQ ID NO: 63986 - RNA, 20 nt, Human
ugucccgggaccucuggggc

SEQ ID NO: 63987 - RNA, 18 nt, Human
uuuuuuuuuuuuuuucug

SEQ ID NO: 63988 - RNA, 23 nt, Human
uuuuuuuuuuuuuuucuguuugg

SEQ ID NO: 63989 - RNA, 23 nt, Human
uuuuuuuuuuuuuuuuucuguuu

SEQ ID NO: 63990 - RNA, 19 nt, Human
aaaaaaugcacugaguuug

SEQ ID NO: 63991 - RNA, 21 nt, Human
aaacaaguauacaaaacaguu

SEQ ID NO: 63992 - RNA, 19 nt, Human
aaauagaccaguucugagg

SEQ ID NO: 63993 - RNA, 21 nt, Human
aaggacacuggccagggacac

SEQ ID NO: 63994 - RNA, 22 nt, Human
acagcugggcuggcgacuggca

SEQ ID NO: 63995 - RNA, 19 nt, Human
agaguaaagcagagggcaa

SEQ ID NO: 63996 - RNA, 22 nt, Human
agcgagcacgaguguuggggac

SEQ ID NO: 63997 - RNA, 25 nt, Human
aggagugagagggaggggggucgcg

SEQ ID NO: 63998 - RNA, 26 nt, Human
aggagugagagggaggggggucgcgu

SEQ ID NO: 63999 - RNA, 19 nt, Human
agggacaccucagaggcug

SEQ ID NO: 64000 - RNA, 18 nt, Human
aggggaacagcugggcug

SEQ ID NO: 64001 - RNA, 22 nt, Human
aucuaugcuaggcggggucucc

SEQ ID NO: 64002 - RNA, 20 nt, Human
auggaaugcagggugaccca

SEQ ID NO: 64003 - RNA, 19 nt, Human
caaagugucugagcgagca

SEQ ID NO: 64004 - RNA, 23 nt, Human
caaauagaccaguucugagguuu

SEQ ID NO: 64005 - RNA, 23 nt, Human
caaccaccaaaauggauuucaac

SEQ ID NO: 64006 - RNA, 22 nt, Human
caagauggcggcucugacggcg

SEQ ID NO: 64007 - RNA, 18 nt, Human
cacgacaccaaauagacc

SEQ ID NO: 64008 - RNA, 19 nt, Human
cacggcgaccgagggacag

SEQ ID NO: 64009 - RNA, 21 nt, Human
cauaggaguaccagaaacugc

SEQ ID NO: 64010 - RNA, 23 nt, Human
ccaccaccaccucauguucccga

SEQ ID NO: 64011 - RNA, 22 nt, Human
cccaagauaaauuuaacagcuc

SEQ ID NO: 64012 - RNA, 18 nt, Human
ccuacauccccucucagc

SEQ ID NO: 64013 - RNA, 19 nt, Human
ccucagaggcugcugcucc

SEQ ID NO: 64014 - RNA, 23 nt, Human
ccucagaggcugcugcuccgagc

SEQ ID NO: 64015 - RNA, 26 nt, Human
ccucagaggcugcugcuccgagccag

SEQ ID NO: 64016 - RNA, 21 nt, Human
ccucucagcacugaacaguga

SEQ ID NO: 64017 - RNA, 23 nt, Human
ccuggaggccaggugcccauggg

SEQ ID NO: 64018 - RNA, 23 nt, Human
ccuggccccugggaaccguggga

SEQ ID NO: 64019 - RNA, 20 nt, Human
cuacugugaccaugcagaau

SEQ ID NO: 64020 - RNA, 28 nt, Human
cugacggcggccacgucagcgccuccuu

SEQ ID NO: 64021 - RNA, 25 nt, Human
cuggcacucacaccacgagccgcac

SEQ ID NO: 64022 - RNA, 24 nt, Human
gaaagcaguaagagguuccacgac

SEQ ID NO: 64023 - RNA, 21 nt, Human
gaaggacacuggccagggaca

SEQ ID NO: 64024 - RNA, 20 nt, Human
gaggagugagagggaggggg

SEQ ID NO: 64025 - RNA, 21 nt, Human
gcaagaggagugagagggagg

SEQ ID NO: 64026 - RNA, 18 nt, Human
gcacauggcuauggaaug

SEQ ID NO: 64027 - RNA, 24 nt, Human
gccuggccccugggaaccguggga

SEQ ID NO: 64028 - RNA, 18 nt, Human
ggacagauggggcccugc

SEQ ID NO: 64029 - RNA, 19 nt, Human
ggcaagaggagugagaggg

SEQ ID NO: 64030 - RNA, 22 nt, Human
ggcaagaggagugagagggagg

SEQ ID NO: 64031 - RNA, 25 nt, Human
gguggcugugggcucccagccuggc

SEQ ID NO: 64032 - RNA, 19 nt, Human
guaaagcagagggcaagag

SEQ ID NO: 64033 - RNA, 20 nt, Human
uaaauaaaaagccuggccgc

SEQ ID NO: 64034 - RNA, 21 nt, Human
uaauagcuauaauuacagugc

SEQ ID NO: 64035 - RNA, 23 nt, Human
uaucaaaauacaaaagaaaaaag

SEQ ID NO: 64036 - RNA, 23 nt, Human
uauugaaagcaguaagagguucc

SEQ ID NO: 64037 - RNA, 19 nt, Human
ucacacacagagguggggu

SEQ ID NO: 64038 - RNA, 24 nt, Human
ucacaccacgagccgcacguuugg

SEQ ID NO: 64039 - RNA, 18 nt, Human
ucccagccuggccccugg

SEQ ID NO: 64040 - RNA, 21 nt, Human
ucccauaggcugccugaaggu

SEQ ID NO: 64041 - RNA, 22 nt, Human
ucgcagucugcugcgccaccac

SEQ ID NO: 64042 - RNA, 23 nt, Human
ucucccaacacagcgacuccugg

SEQ ID NO: 64043 - RNA, 18 nt, Human
ucucuacugugaccaugc

SEQ ID NO: 64044 - RNA, 24 nt, Human
ucuuuuuacaauaaaaaaagcuga

SEQ ID NO: 64045 - RNA, 21 nt, Human
ugaaaacaaguauacaaaaca

SEQ ID NO: 64046 - RNA, 24 nt, Human
ugaaagcaguaagagguuccacga

SEQ ID NO: 64047 - RNA, 26 nt, Human
ugacccaaggacaagcgaguugcggg

SEQ ID NO: 64048 - RNA, 19 nt, Human
ugagcgagcacgaguguug

SEQ ID NO: 64049 - RNA, 18 nt, Human
ugagggagagaaagcuac

SEQ ID NO: 64050 - RNA, 19 nt, Human
ugagggagagaaagcuaca

SEQ ID NO: 64051 - RNA, 21 nt, Human
ugccacaugagaguaaagcag

SEQ ID NO: 64052 - RNA, 19 nt, Human
ugccugaagguggguaggg

SEQ ID NO: 64053 - RNA, 20 nt, Human
ugccugaagguggguagggc

SEQ ID NO: 64054 - RNA, 20 nt, Human
ugcgccaccaccaccucaug

SEQ ID NO: 64055 - RNA, 23 nt, Human
uggaaggacacuggccagggaca

SEQ ID NO: 64056 - RNA, 23 nt, Human
uggacagguggaaggacacuggc

SEQ ID NO: 64057 - RNA, 21 nt, Human
uggccccugggaaccguggga

SEQ ID NO: 64058 - RNA, 22 nt, Human
uguucaaguguucucgacuugg

SEQ ID NO: 64059 - RNA, 21 nt, Human
uugaaagcaguaagagguucc

SEQ ID NO: 64060 - RNA, 22 nt, Human
uugaaagcaguaagagguuccc

SEQ ID NO: 64061 - RNA, 24 nt, Human
uugcaggcugagggagagaaagcu

SEQ ID NO: 64062 - RNA, 21 nt, Human
aaaaaaacaaggugaggggug

SEQ ID NO: 64063 - RNA, 24 nt, Human
aaaaaaacaaggugaggggugagg

SEQ ID NO: 64064 - RNA, 24 nt, Human
aaaacaagaguuggagaagagggg

SEQ ID NO: 64065 - RNA, 21 nt, Human
aaaaggaaagaguucaaggaa

SEQ ID NO: 64066 - RNA, 25 nt, Human
aaacaagaguuggagaagagggacc

SEQ ID NO: 64067 - RNA, 19 nt, Human
aaacacccaaucccaaaag

SEQ ID NO: 64068 - RNA, 19 nt, Human
aaacagggaguagaagggc

SEQ ID NO: 64069 - RNA, 20 nt, Human
aaacagggaguagaagggcu

SEQ ID NO: 64070 - RNA, 19 nt, Human
aaauauaucucucuauaca

SEQ ID NO: 64071 - RNA, 18 nt, Human
aacaaaagagaaugaaga

SEQ ID NO: 64072 - RNA, 22 nt, Human
aacaccccccccacaaccacca

SEQ ID NO: 64073 - RNA, 25 nt, Human
aacaccccccccacaaccaccacac

SEQ ID NO: 64074 - RNA, 18 nt, Human
aacacggaaggggcagau

SEQ ID NO: 64075 - RNA, 21 nt, Human
aaccuccaacaccccccccac

SEQ ID NO: 64076 - RNA, 20 nt, Human
aaccuggccccauggagugg

SEQ ID NO: 64077 - RNA, 23 nt, Human
aagaauccaucaucuguccuauc

SEQ ID NO: 64078 - RNA, 19 nt, Human
aagaggacagcaaccacug

SEQ ID NO: 64079 - RNA, 22 nt, Human
aagcagaaagcuggaaucaggg

SEQ ID NO: 64080 - RNA, 19 nt, Human
aagggcuuguggggacagg

SEQ ID NO: 64081 - RNA, 24 nt, Human
aaugaaauagaaccuccaacaccc

SEQ ID NO: 64082 - RNA, 20 nt, Human
acacaaacacacccacaccc

SEQ ID NO: 64083 - RNA, 21 nt, Human
acacacacacucacacacaca

SEQ ID NO: 64084 - RNA, 25 nt, Human
acacacccacacccauauacacaca

SEQ ID NO: 64085 - RNA, 20 nt, Human
acaggagcccacaggacagc

SEQ ID NO: 64086 - RNA, 18 nt, Human
acaggccuagagagcaag

SEQ ID NO: 64087 - RNA, 21 nt, Human
acaguggggcccaaguagggg

SEQ ID NO: 64088 - RNA, 25 nt, Human
accaaggacagaugacccauccaac

SEQ ID NO: 64089 - RNA, 19 nt, Human
accacugcaucccacaagc

SEQ ID NO: 64090 - RNA, 22 nt, Human
acccccacccccagcccgggau

SEQ ID NO: 64091 - RNA, 18 nt, Human
acgcaaacacagagaggc

SEQ ID NO: 64092 - RNA, 19 nt, Human
acucuaacccccagaucca

SEQ ID NO: 64093 - RNA, 23 nt, Human
acugcaguuaccacuauaacacc

SEQ ID NO: 64094 - RNA, 18 nt, Human
agaaaaaccuaccugcag

SEQ ID NO: 64095 - RNA, 21 nt, Human
agaaccuccaacacccccccc

SEQ ID NO: 64096 - RNA, 25 nt, Human
agaaccuccaacaccccccccacaa

SEQ ID NO: 64097 - RNA, 23 nt, Human
agagaauaccccacucgaccucc

SEQ ID NO: 64098 - RNA, 20 nt, Human
agagaggagaggagagggag

SEQ ID NO: 64099 - RNA, 21 nt, Human
agaggagaggagagggagugg

SEQ ID NO: 64100 - RNA, 20 nt, Human
agaucagaaggguggugggg

SEQ ID NO: 64101 - RNA, 23 nt, Human
agcacugacaaccacuucaggau

SEQ ID NO: 64102 - RNA, 23 nt, Human
agcagccagggauacuaccaaga

SEQ ID NO: 64103 - RNA, 22 nt, Human
agccagcacacacaggagccca

SEQ ID NO: 64104 - RNA, 20 nt, Human
aggaaaaaauacauggaaaa

SEQ ID NO: 64105 - RNA, 21 nt, Human
aggaaggagaggcaauggggc

SEQ ID NO: 64106 - RNA, 21 nt, Human
aggcaaaguccucaugaacca

SEQ ID NO: 64107 - RNA, 27 nt, Human
aggcaaggcucuugcugggcauguggu

SEQ ID NO: 64108 - RNA, 21 nt, Human
aggcaggagaagaggcaaagu

SEQ ID NO: 64109 - RNA, 21 nt, Human
aggcgcagccagcacacacag

SEQ ID NO: 64110 - RNA, 20 nt, Human
agggaaaggacucagaugcc

SEQ ID NO: 64111 - RNA, 20 nt, Human
agggagaggguggcaaagga

SEQ ID NO: 64112 - RNA, 18 nt, Human
agggcuuagcagccaggg

SEQ ID NO: 64113 - RNA, 18 nt, Human
aggggaggcaggggaggc

SEQ ID NO: 64114 - RNA, 21 nt, Human
aggggcauggagggugaaggg

SEQ ID NO: 64115 - RNA, 20 nt, Human
aggggccaccccaugaaacc

SEQ ID NO: 64116 - RNA, 19 nt, Human
agggguaggacuggggcag

SEQ ID NO: 64117 - RNA, 19 nt, Human
agggguggguggggugcuu

SEQ ID NO: 64118 - RNA, 24 nt, Human
aggguggagagaagaguacaagga

SEQ ID NO: 64119 - RNA, 22 nt, Human
agguggacaggaaaaaggaggg

SEQ ID NO: 64120 - RNA, 23 nt, Human
auaaaugccauccuccagcccua

SEQ ID NO: 64121 - RNA, 20 nt, Human
auagaaccuccaacaccccc

SEQ ID NO: 64122 - RNA, 23 nt, Human
auagaaccuccaacacccccccc

SEQ ID NO: 64123 - RNA, 19 nt, Human
auccauuuaugagaaguga

SEQ ID NO: 64124 - RNA, 23 nt, Human
augaggcaggagaagaggcaaag

SEQ ID NO: 64125 - RNA, 20 nt, Human
caacaccccccccacaacca

SEQ ID NO: 64126 - RNA, 21 nt, Human
caacaccccccccacaaccac

SEQ ID NO: 64127 - RNA, 23 nt, Human
caacaccccccccacaaccacca

SEQ ID NO: 64128 - RNA, 23 nt, Human
caaccacugccaaacaaagagaa

SEQ ID NO: 64129 - RNA, 18 nt, Human
caagacaaaauaaaucug

SEQ ID NO: 64130 - RNA, 19 nt, Human
caagauaccugcacacacc

SEQ ID NO: 64131 - RNA, 27 nt, Human
caagcccugagcuucacuccacccccu

SEQ ID NO: 64132 - RNA, 23 nt, Human
cacacaaacacacccacacccau

SEQ ID NO: 64133 - RNA, 28 nt, Human
cacacacacucacacacacacacaggcc

SEQ ID NO: 64134 - RNA, 23 nt, Human
cacacaccauggacuugccaucc

SEQ ID NO: 64135 - RNA, 18 nt, Human
cacacaugcacgcaaaca

SEQ ID NO: 64136 - RNA, 22 nt, Human
cacaugcacgcaaacacagaga

SEQ ID NO: 64137 - RNA, 25 nt, Human
caccacacacaaacacacccacacc

SEQ ID NO: 64138 - RNA, 24 nt, Human
cacccacacccauauacacacaca

SEQ ID NO: 64139 - RNA, 20 nt, Human
caccccacuucccagcuccu

SEQ ID NO: 64140 - RNA, 21 nt, Human
cacccccagcccgggauacuu

SEQ ID NO: 64141 - RNA, 21 nt, Human
caccccccccacaaccaccac

SEQ ID NO: 64142 - RNA, 23 nt, Human
caccccccccacaaccaccacac

SEQ ID NO: 64143 - RNA, 26 nt, Human
caccccccccacaaccaccacacaca

SEQ ID NO: 64144 - RNA, 21 nt, Human
cacccccuccccgcucccccc

SEQ ID NO: 64145 - RNA, 20 nt, Human
cacgucuucacagaaacuac

SEQ ID NO: 64146 - RNA, 19 nt, Human
cacuccacccccuccccgc

SEQ ID NO: 64147 - RNA, 23 nt, Human
cacucgaccucccgaaacccaga

SEQ ID NO: 64148 - RNA, 26 nt, Human
cacugcaucccacaagcacugacaac

SEQ ID NO: 64149 - RNA, 24 nt, Human
cagauuggucccuggagcccccaa

SEQ ID NO: 64150 - RNA, 18 nt, Human
cagcaaccacugccaaac

SEQ ID NO: 64151 - RNA, 18 nt, Human
cagcugcgccgcugcggc

SEQ ID NO: 64152 - RNA, 21 nt, Human
caggaaaaaggaggggaggca

SEQ ID NO: 64153 - RNA, 23 nt, Human
caggaagcagaaagcuggaauca

SEQ ID NO: 64154 - RNA, 20 nt, Human
cagggucacagucaucgcgu

SEQ ID NO: 64155 - RNA, 19 nt, Human
caguagcaacagcuucuga

SEQ ID NO: 64156 - RNA, 25 nt, Human
caguagguaugucaggggugggugg

SEQ ID NO: 64157 - RNA, 18 nt, Human
cagucaaagacuggggca

SEQ ID NO: 64158 - RNA, 23 nt, Human
caguggcagucugguuuuggccu

SEQ ID NO: 64159 - RNA, 24 nt, Human
cauccagaaaaaccuaccugcaga

SEQ ID NO: 64160 - RNA, 22 nt, Human
ccacacacaaacacacccacac

SEQ ID NO: 64161 - RNA, 23 nt, Human
ccacccccuccccgcuccccccg

SEQ ID NO: 64162 - RNA, 22 nt, Human
ccacgucuucacagaaacuaca

SEQ ID NO: 64163 - RNA, 21 nt, Human
ccacucuaacccccagaucca

SEQ ID NO: 64164 - RNA, 21 nt, Human
ccacugcaucccacaagcacu

SEQ ID NO: 64165 - RNA, 22 nt, Human
ccagcccgggauacuucccacc

SEQ ID NO: 64166 - RNA, 20 nt, Human
ccaguaaauuggaaugacuc

SEQ ID NO: 64167 - RNA, 30 nt, Human
ccagucaagcuccagaggaacagaucugaa

SEQ ID NO: 64168 - RNA, 22 nt, Human
cccaaugcccugggucccuaac

SEQ ID NO: 64169 - RNA, 22 nt, Human
cccacaaccaccacacacaaac

SEQ ID NO: 64170 - RNA, 21 nt, Human
cccaccuucuucccuuaaucu

SEQ ID NO: 64171 - RNA, 19 nt, Human
cccagauuggucccuggag

SEQ ID NO: 64172 - RNA, 19 nt, Human
ccccaaugcccuggguccc

SEQ ID NO: 64173 - RNA, 20 nt, Human
ccccacccccagcccgggau

SEQ ID NO: 64174 - RNA, 20 nt, Human
cccccaaaaaaacaagguga

SEQ ID NO: 64175 - RNA, 21 nt, Human
cccccaaaaaaacaaggugag

SEQ ID NO: 64176 - RNA, 22 nt, Human
cccccaaugcccugggucccua

SEQ ID NO: 64177 - RNA, 23 nt, Human
cccccacaaccaccacacacaaa

SEQ ID NO: 64178 - RNA, 24 nt, Human
ccccccacaaccaccacacacaaa

SEQ ID NO: 64179 - RNA, 24 nt, Human
cccccuccccgcuccccccggccc

SEQ ID NO: 64180 - RNA, 21 nt, Human
ccccgcuccccccggccccca

SEQ ID NO: 64181 - RNA, 18 nt, Human
ccccggcucccuccuucc

SEQ ID NO: 64182 - RNA, 18 nt, Human
cccggcucccuccuuccu

SEQ ID NO: 64183 - RNA, 21 nt, Human
cccugagcuucacuccacccc

SEQ ID NO: 64184 - RNA, 25 nt, Human
ccgcuccgcucccucuggcucccca

SEQ ID NO: 64185 - RNA, 18 nt, Human
ccggcugcugcccuggcc

SEQ ID NO: 64186 - RNA, 18 nt, Human
ccuaacacacaccaugga

SEQ ID NO: 64187 - RNA, 21 nt, Human
ccucaggaacaagugcccccu

SEQ ID NO: 64188 - RNA, 21 nt, Human
ccuccaacaccccccccacaa

SEQ ID NO: 64189 - RNA, 21 nt, Human
ccucccaccuucuucccuuaa

SEQ ID NO: 64190 - RNA, 22 nt, Human
ccuccccgcuccccccggcccc

SEQ ID NO: 64191 - RNA, 23 nt, Human
ccuccuaacauuuccagccccag

SEQ ID NO: 64192 - RNA, 21 nt, Human
ccugagcuucacuccaccccc

SEQ ID NO: 64193 - RNA, 18 nt, Human
ccugcacacaccugcugc

SEQ ID NO: 64194 - RNA, 23 nt, Human
ccugcacacaccugcugcauccu

SEQ ID NO: 64195 - RNA, 24 nt, Human
cgcaaacacagagaggcccgugca

SEQ ID NO: 64196 - RNA, 19 nt, Human
cgccucugccccgcagguu

SEQ ID NO: 64197 - RNA, 22 nt, Human
cgcugcggccgccgccucugcc

SEQ ID NO: 64198 - RNA, 22 nt, Human
cuagagaaagucagggaaugag

SEQ ID NO: 64199 - RNA, 26 nt, Human
cucaucaucaggacagcaauuaggga

SEQ ID NO: 64200 - RNA, 24 nt, Human
cuccaacaccccccccacaaccac

SEQ ID NO: 64201 - RNA, 22 nt, Human
cuccacccccuccccgcucccc

SEQ ID NO: 64202 - RNA, 21 nt, Human
cucccuccuuccuucccucca

SEQ ID NO: 64203 - RNA, 22 nt, Human
cucccucuggcuccccaagccg

SEQ ID NO: 64204 - RNA, 18 nt, Human
cugcagacagagagacgc

SEQ ID NO: 64205 - RNA, 23 nt, Human
cuggagcccccaaaaaaacaagg

SEQ ID NO: 64206 - RNA, 23 nt, Human
cuggagcugugcggcguaccccc

SEQ ID NO: 64207 - RNA, 25 nt, Human
cuggccccauggaguggggcuuggg

SEQ ID NO: 64208 - RNA, 18 nt, Human
cuguccuaucauccagaa

SEQ ID NO: 64209 - RNA, 24 nt, Human
gaaaaugguggugaagaauccauc

SEQ ID NO: 64210 - RNA, 22 nt, Human
gaaaugaauacauuuuuaaaug

SEQ ID NO: 64211 - RNA, 20 nt, Human
gaagggacagcaaggauggu

SEQ ID NO: 64212 - RNA, 26 nt, Human
gaaugggauuggcccaugccucaccu

SEQ ID NO: 64213 - RNA, 24 nt, Human
gacagcccuacugggagaccgugu

SEQ ID NO: 64214 - RNA, 20 nt, Human
gacaggaaaaaggaggggag

SEQ ID NO: 64215 - RNA, 26 nt, Human
gaccaaggacagaugacccauccaac

SEQ ID NO: 64216 - RNA, 24 nt, Human
gacccaggcgaggaccucaggaac

SEQ ID NO: 64217 - RNA, 21 nt, Human
gagaaaauucugaccaaggac

SEQ ID NO: 64218 - RNA, 19 nt, Human
gagaagaguacaaggaaaa

SEQ ID NO: 64219 - RNA, 18 nt, Human
gagaggagagggaguggg

SEQ ID NO: 64220 - RNA, 20 nt, Human
gagcaagauaccugcacaca

SEQ ID NO: 64221 - RNA, 22 nt, Human
gauccuguuccugcuaucagcu

SEQ ID NO: 64222 - RNA, 23 nt, Human
gcacacacaggagcccacaggac

SEQ ID NO: 64223 - RNA, 18 nt, Human
gcacuggaaggcaggaau

SEQ ID NO: 64224 - RNA, 23 nt, Human
gcagccagcacacacaggagccc

SEQ ID NO: 64225 - RNA, 21 nt, Human
gcccugggcccugaccuuagc

SEQ ID NO: 64226 - RNA, 18 nt, Human
gccgcugcggccgccgcc

SEQ ID NO: 64227 - RNA, 20 nt, Human
gcggccgccgccucugcccc

SEQ ID NO: 64228 - RNA, 23 nt, Human
gcucccuccuuccuucccuccac

SEQ ID NO: 64229 - RNA, 25 nt, Human
gcucccuccuuccuucccuccaccu

SEQ ID NO: 64230 - RNA, 23 nt, Human
gcuccgcucccucuggcucccca

SEQ ID NO: 64231 - RNA, 21 nt, Human
ggacuugccauccccaccccc

SEQ ID NO: 64232 - RNA, 19 nt, Human
ggagggaagcaucuguggg

SEQ ID NO: 64233 - RNA, 20 nt, Human
ggcagcugucucggagcuca

SEQ ID NO: 64234 - RNA, 22 nt, Human
ggcaguguccuggcugcaagcc

SEQ ID NO: 64235 - RNA, 24 nt, Human
gggauuggucauauagguggacag

SEQ ID NO: 64236 - RNA, 19 nt, Human
gggcauguggacaugauac

SEQ ID NO: 64237 - RNA, 18 nt, Human
ggggggcccugggcccug

SEQ ID NO: 64238 - RNA, 20 nt, Human
gggugaggccugaagugagg

SEQ ID NO: 64239 - RNA, 20 nt, Human
gggugguggggcacuggaag

SEQ ID NO: 64240 - RNA, 20 nt, Human
ggugagagagagagaggggc

SEQ ID NO: 64241 - RNA, 19 nt, Human
gguuuuggccuggucccug

SEQ ID NO: 64242 - RNA, 20 nt, Human
gugaggggugaggccugaag

SEQ ID NO: 64243 - RNA, 20 nt, Human
guggggggcccugggcccug

SEQ ID NO: 64244 - RNA, 24 nt, Human
guucaaggaaggagaggcaauggg

SEQ ID NO: 64245 - RNA, 33 nt, Human
uaaaugaaauagaaccuccaacaccccccccuu

SEQ ID NO: 64246 - RNA, 19 nt, Human
uaacaaaagagaaugaaga

SEQ ID NO: 64247 - RNA, 18 nt, Human
uaacaccacagacaaacu

SEQ ID NO: 64248 - RNA, 23 nt, Human
uaaccagucaaagacuggggcag

SEQ ID NO: 64249 - RNA, 20 nt, Human
uaaggucagcuaugucaccc

SEQ ID NO: 64250 - RNA, 24 nt, Human
uacacacacacucacacacacaca

SEQ ID NO: 64251 - RNA, 19 nt, Human
uacauggaaaagggcaaau

SEQ ID NO: 64252 - RNA, 21 nt, Human
uacccagggcccuggccacac

SEQ ID NO: 64253 - RNA, 20 nt, Human
uacugcccccugcuggacag

SEQ ID NO: 64254 - RNA, 20 nt, Human
uagaaccuccaacacccccc

SEQ ID NO: 64255 - RNA, 19 nt, Human
uaggaaaaaauacauggaa

SEQ ID NO: 64256 - RNA, 18 nt, Human
uaggacuggggcagggug

SEQ ID NO: 64257 - RNA, 21 nt, Human
uauacacacacacucacacac

SEQ ID NO: 64258 - RNA, 20 nt, Human
ucaaggaaggagaggcaaug

SEQ ID NO: 64259 - RNA, 22 nt, Human
ucacagaaacuacagaagucag

SEQ ID NO: 64260 - RNA, 21 nt, Human
ucagcugcgccgcugcggccg

SEQ ID NO: 64261 - RNA, 23 nt, Human
ucagggaaugaggcaggagaaga

SEQ ID NO: 64262 - RNA, 21 nt, Human
uccacucuaacccccagaucc

SEQ ID NO: 64263 - RNA, 19 nt, Human
uccccaccccccagucaag

SEQ ID NO: 64264 - RNA, 22 nt, Human
uccccaccccccagucaagcuc

SEQ ID NO: 64265 - RNA, 19 nt, Human
uccccgcuccccccggccc

SEQ ID NO: 64266 - RNA, 19 nt, Human
uccccggcucccuccuucc

SEQ ID NO: 64267 - RNA, 21 nt, Human
ucccuggagcccccaaaaaaa

SEQ ID NO: 64268 - RNA, 22 nt, Human
ucccuggagcccccaaaaaaac

SEQ ID NO: 64269 - RNA, 24 nt, Human
ucccugguauggaagacuugaucc

SEQ ID NO: 64270 - RNA, 24 nt, Human
uccuaucauccagaaaaaccuacc

SEQ ID NO: 64271 - RNA, 18 nt, Human
uccuuccuucccuccacc

SEQ ID NO: 64272 - RNA, 18 nt, Human
uccuuuagcauauccugg

SEQ ID NO: 64273 - RNA, 24 nt, Human
ucuggcuccccaagccgacuucag

SEQ ID NO: 64274 - RNA, 18 nt, Human
ucuguccuaucauccaga

SEQ ID NO: 64275 - RNA, 21 nt, Human
ugaaacacccaaucccaaaag

SEQ ID NO: 64276 - RNA, 21 nt, Human
ugaaauagaaccuccaacacc

SEQ ID NO: 64277 - RNA, 20 nt, Human
ugacaggcuccagugggcag

SEQ ID NO: 64278 - RNA, 24 nt, Human
ugacccauccaaccccuaagauca

SEQ ID NO: 64279 - RNA, 23 nt, Human
ugagaaaauucugaccaaggaca

SEQ ID NO: 64280 - RNA, 22 nt, Human
ugagaagugagugaggauggca

SEQ ID NO: 64281 - RNA, 21 nt, Human
ugagagagagagaggggccac

SEQ ID NO: 64282 - RNA, 19 nt, Human
ugagcaaggauagagaagg

SEQ ID NO: 64283 - RNA, 22 nt, Human
ugccaaacaaagagaauacccc

SEQ ID NO: 64284 - RNA, 19 nt, Human
ugccaagggcuuagcagcc

SEQ ID NO: 64285 - RNA, 23 nt, Human
ugcccuggcccacuccccggcuc

SEQ ID NO: 64286 - RNA, 21 nt, Human
ugcccugggucccuaacacac

SEQ ID NO: 64287 - RNA, 25 nt, Human
ugccucaccuucuccuaauaacaaa

SEQ ID NO: 64288 - RNA, 21 nt, Human
ugcugcccuggcccacucccc

SEQ ID NO: 64289 - RNA, 18 nt, Human
ugcuguggggggcccugg

SEQ ID NO: 64290 - RNA, 21 nt, Human
ugcuuucuggggacagugggg

SEQ ID NO: 64291 - RNA, 21 nt, Human
uggacaggaaaaaggagggga

SEQ ID NO: 64292 - RNA, 20 nt, Human
uggagcccccaaaaaaacaa

SEQ ID NO: 64293 - RNA, 28 nt, Human
uggagcccccaaaaaaacaaggugaggg

SEQ ID NO: 64294 - RNA, 21 nt, Human
uggcaggggcauggaggguga

SEQ ID NO: 64295 - RNA, 25 nt, Human
ugggaacagucaucuagagauaaau

SEQ ID NO: 64296 - RNA, 18 nt, Human
ugggaaggggucccucag

SEQ ID NO: 64297 - RNA, 19 nt, Human
ugggcccugaccuuagcag

SEQ ID NO: 64298 - RNA, 20 nt, Human
ugggguggggggagcgggag

SEQ ID NO: 64299 - RNA, 23 nt, Human
ugguauggaagacuugauccugu

SEQ ID NO: 64300 - RNA, 21 nt, Human
ugguggggaaggaucaguuga

SEQ ID NO: 64301 - RNA, 23 nt, Human
uguagaaaggaccaccccugcca

SEQ ID NO: 64302 - RNA, 21 nt, Human
ugucucggagcucaggcgcag

SEQ ID NO: 64303 - RNA, 19 nt, Human
uguggggacagggaaagga

SEQ ID NO: 64304 - RNA, 18 nt, Human
uguuagggcugucuggcu

SEQ ID NO: 64305 - RNA, 21 nt, Human
uucaaggaaggagaggcaaug

SEQ ID NO: 64306 - RNA, 21 nt, Human
uucacuccacccccuccccgc

SEQ ID NO: 64307 - RNA, 19 nt, Human
uuccauguaaaacagggag

SEQ ID NO: 64308 - RNA, 26 nt, Human
uugggaacagucaucuagagauaaau

SEQ ID NO: 64309 - RNA, 22 nt, Human
uuuauuuccuccacucuaaccc

SEQ ID NO: 64310 - RNA, 20 nt, Human
uuucuggggacaguggggcc

SEQ ID NO: 64311 - RNA, 18 nt, Human
aaacaccgcagccgcccc

SEQ ID NO: 64312 - RNA, 24 nt, Human
aacuuacaggcaaaugcuaaaaaa

SEQ ID NO: 64313 - RNA, 18 nt, Human
aagaaacagggucgaggu

SEQ ID NO: 64314 - RNA, 25 nt, Human
aagucacuuccauccccccgccccc

SEQ ID NO: 64315 - RNA, 24 nt, Human
acaaaaauaaaaacuaugugacug

SEQ ID NO: 64316 - RNA, 22 nt, Human
acccugcuguccaagugugcag

SEQ ID NO: 64317 - RNA, 22 nt, Human
acugccagccucuucuccaccu

SEQ ID NO: 64318 - RNA, 19 nt, Human
acuuccauccccccgcccc

SEQ ID NO: 64319 - RNA, 24 nt, Human
agaaaaauaagaaacagggucgag

SEQ ID NO: 64320 - RNA, 23 nt, Human
agaagaaaaauaagaaacagggg

SEQ ID NO: 64321 - RNA, 24 nt, Human
agacacaaaaauaaaaacuaugug

SEQ ID NO: 64322 - RNA, 19 nt, Human
aggaaagggagggggggcu

SEQ ID NO: 64323 - RNA, 18 nt, Human
aggcagggaggccuugaa

SEQ ID NO: 64324 - RNA, 21 nt, Human
agguuccagggagcacagcug

SEQ ID NO: 64325 - RNA, 22 nt, Human
aguguggcaccaaaacgggaca

SEQ ID NO: 64326 - RNA, 25 nt, Human
aucccaucucccauccccaccccag

SEQ ID NO: 64327 - RNA, 20 nt, Human
caaaacgggacaccccaugc

SEQ ID NO: 64328 - RNA, 21 nt, Human
cacagacacaaaaauaaaaac

SEQ ID NO: 64329 - RNA, 23 nt, Human
cagacacaaaaauaaaaacuaug

SEQ ID NO: 64330 - RNA, 26 nt, Human
caucccaaacacauucuccaagucac

SEQ ID NO: 64331 - RNA, 20 nt, Human
ccaccccgagcugccuucuu

SEQ ID NO: 64332 - RNA, 24 nt, Human
ccccaccccaguguggcaccaaaa

SEQ ID NO: 64333 - RNA, 25 nt, Human
ccccaccccaguguggcaccaaaag

SEQ ID NO: 64334 - RNA, 20 nt, Human
cccgagcugccuucuuccuc

SEQ ID NO: 64335 - RNA, 23 nt, Human
cccgcccccaaacacauccaauu

SEQ ID NO: 64336 - RNA, 19 nt, Human
cccgcgagacccccgcaga

SEQ ID NO: 64337 - RNA, 21 nt, Human
cccggugaaacaccgcagccg

SEQ ID NO: 64338 - RNA, 18 nt, Human
ccgccccgcgagaccccc

SEQ ID NO: 64339 - RNA, 21 nt, Human
cgcgagacccccgcagacacc

SEQ ID NO: 64340 - RNA, 20 nt, Human
cgggacaccccaugcuccuu

SEQ ID NO: 64341 - RNA, 25 nt, Human
cuaggugggaggaaagggagggggg

SEQ ID NO: 64342 - RNA, 22 nt, Human
cucauagaggcgcucaaggccc

SEQ ID NO: 64343 - RNA, 24 nt, Human
cuccacaguccugcagcgcccacu

SEQ ID NO: 64344 - RNA, 19 nt, Human
cucuccucgagccuuuccc

SEQ ID NO: 64345 - RNA, 21 nt, Human
cugacugagaggucacaggcu

SEQ ID NO: 64346 - RNA, 22 nt, Human
cugcagccuugcacaugaguga

SEQ ID NO: 64347 - RNA, 19 nt, Human
gaggcgcucaaggcccugc

SEQ ID NO: 64348 - RNA, 23 nt, Human
gaucaucucauagaggcgcucaa

SEQ ID NO: 64349 - RNA, 19 nt, Human
gcucaaggcccugcugcag

SEQ ID NO: 64350 - RNA, 22 nt, Human
ggaaagggagggggggcuuggg

SEQ ID NO: 64351 - RNA, 23 nt, Human
ggagauaguuauuucaucccaaa

SEQ ID NO: 64352 - RNA, 25 nt, Human
ggaggaaagggagggggggcuuggg

SEQ ID NO: 64353 - RNA, 22 nt, Human
ggugaaacaccgcagccgcccc

SEQ ID NO: 64354 - RNA, 20 nt, Human
gugggaggaaagggaggggg

SEQ ID NO: 64355 - RNA, 18 nt, Human
uaaggcgccuaguagagg

SEQ ID NO: 64356 - RNA, 23 nt, Human
uacuaggugggaggaaagggagg

SEQ ID NO: 64357 - RNA, 21 nt, Human
uagcucucggacugccagccu

SEQ ID NO: 64358 - RNA, 21 nt, Human
uaggugggaggaaagggaggg

SEQ ID NO: 64359 - RNA, 22 nt, Human
ucacaggcuggucccacccugc

SEQ ID NO: 64360 - RNA, 22 nt, Human
ucacaggcuggucccacccugc

SEQ ID NO: 64361 - RNA, 24 nt, Human
uccaagucacuuccauccccccgc

SEQ ID NO: 64362 - RNA, 22 nt, Human
uccauccccccgcccccaaaca

SEQ ID NO: 64363 - RNA, 24 nt, Human
ucccacccugcuguccaagugugc

SEQ ID NO: 64364 - RNA, 25 nt, Human
ucccacccugcuguccaagugugca

SEQ ID NO: 64365 - RNA, 22 nt, Human
ucccaucucccauccccacccc

SEQ ID NO: 64366 - RNA, 19 nt, Human
uccucuugaggaucaucuc

SEQ ID NO: 64367 - RNA, 22 nt, Human
ucgagguagagucacaguuuac

SEQ ID NO: 64368 - RNA, 20 nt, Human
ucuccaagucacuuccaucc

SEQ ID NO: 64369 - RNA, 22 nt, Human
ucucuccuucauugagguggac

SEQ ID NO: 64370 - RNA, 18 nt, Human
ucuugccaccccgagcug

SEQ ID NO: 64371 - RNA, 20 nt, Human
ugaaacaccgcagccgcccc

SEQ ID NO: 64372 - RNA, 20 nt, Human
ugacugagaggucacaggcu

SEQ ID NO: 64373 - RNA, 24 nt, Human
ugagguggacagguccugcacccc

SEQ ID NO: 64374 - RNA, 22 nt, Human
ugcaaagacaucccaucuccca

SEQ ID NO: 64375 - RNA, 18 nt, Human
ugcagccuugcacaugag

SEQ ID NO: 64376 - RNA, 23 nt, Human
ugguauuccuagaaaagcagccu

SEQ ID NO: 64377 - RNA, 19 nt, Human
uguggggagggguucuugg

SEQ ID NO: 64378 - RNA, 24 nt, Human
uuacauuuacgucuccacaguccu

SEQ ID NO: 64379 - RNA, 18 nt, Human
aaacagaaaaaaaaaagg

SEQ ID NO: 64380 - RNA, 21 nt, Human
aaacagaaaaaaaaaaggaaa

SEQ ID NO: 64381 - RNA, 24 nt, Human
aaacagaaaaaaaaaaggaaaccc

SEQ ID NO: 64382 - RNA, 25 nt, Human
aaacagaaaaaaaaaaggaaaccca

SEQ ID NO: 64383 - RNA, 26 nt, Human
aaacagaaaaaaaaaaggaaacccag

SEQ ID NO: 64384 - RNA, 19 nt, Human
acccaaaacagaaaaaaaa

SEQ ID NO: 64385 - RNA, 18 nt, Human
acccgaagcccucaccuu

SEQ ID NO: 64386 - RNA, 25 nt, Human
agaacaugcaggcaggagcaggagc

SEQ ID NO: 64387 - RNA, 20 nt, Human
agcaccacccgaagcccuca

SEQ ID NO: 64388 - RNA, 18 nt, Human
aggaaagggcacugccug

SEQ ID NO: 64389 - RNA, 18 nt, Human
aggcaggagaguggaccc

SEQ ID NO: 64390 - RNA, 21 nt, Human
aggcaggagaguggaccccuc

SEQ ID NO: 64391 - RNA, 23 nt, Human
aggcaggagaguggaccccucug

SEQ ID NO: 64392 - RNA, 25 nt, Human
aggcaggagaguggaccccucuggu

SEQ ID NO: 64393 - RNA, 19 nt, Human
aggcaggagcaggagcaga

SEQ ID NO: 64394 - RNA, 21 nt, Human
agucuggucaucccggggaug

SEQ ID NO: 64395 - RNA, 21 nt, Human
aucccggggaugcacgcagga

SEQ ID NO: 64396 - RNA, 22 nt, Human
aucccugcuccuccucuggaag

SEQ ID NO: 64397 - RNA, 21 nt, Human
caaaacagaaaaaaaaaagga

SEQ ID NO: 64398 - RNA, 26 nt, Human
caaccuggccccuagaguacacccaa

SEQ ID NO: 64399 - RNA, 26 nt, Human
cacccaaaacagaaaaaaaaaaggaa

SEQ ID NO: 64400 - RNA, 23 nt, Human
cacccgaagcccucaccuucccc

SEQ ID NO: 64401 - RNA, 23 nt, Human
caggaagccccuuccauaggucc

SEQ ID NO: 64402 - RNA, 20 nt, Human
caucaggggccugccccugg

SEQ ID NO: 64403 - RNA, 24 nt, Human
cauuauagcaccacccgaagcccu

SEQ ID NO: 64404 - RNA, 19 nt, Human
ccaaaacagaaaaaaaaaa

SEQ ID NO: 64405 - RNA, 19 nt, Human
ccacccgaagcccucaccu

SEQ ID NO: 64406 - RNA, 18 nt, Human
cccaaaacagaaaaaaaa

SEQ ID NO: 64407 - RNA, 23 nt, Human
cccaaaacagaaaaaaaaaagga

SEQ ID NO: 64408 - RNA, 25 nt, Human
cccaaaacagaaaaaaaaaaggaaa

SEQ ID NO: 64409 - RNA, 19 nt, Human
ccccuagaguacacccaaa

SEQ ID NO: 64410 - RNA, 25 nt, Human
ccuggccccuagaguacacccaaaa

SEQ ID NO: 64411 - RNA, 25 nt, Human
cgggagucuggucaucccggggaug

SEQ ID NO: 64412 - RNA, 20 nt, Human
gaaaaaaaaaaggaaaccca

SEQ ID NO: 64413 - RNA, 21 nt, Human
gaagccccuuccauagguccc

SEQ ID NO: 64414 - RNA, 21 nt, Human
gaguacacccaaaacagaaaa

SEQ ID NO: 64415 - RNA, 19 nt, Human
gaguggaccccucugugcc

SEQ ID NO: 64416 - RNA, 20 nt, Human
ggccccuagaguacacccaa

SEQ ID NO: 64417 - RNA, 24 nt, Human
gggccuuggccaggaagccccuuc

SEQ ID NO: 64418 - RNA, 24 nt, Human
gggggccuuggccaggaagccccu

SEQ ID NO: 64419 - RNA, 19 nt, Human
uacacccaaaacagaaaaa

SEQ ID NO: 64420 - RNA, 23 nt, Human
ucccggggaugcacgcaggagcu

SEQ ID NO: 64421 - RNA, 23 nt, Human
ucccugcuccuccucuggaagag

SEQ ID NO: 64422 - RNA, 19 nt, Human
uggaagagggggccuuggc

SEQ ID NO: 64423 - RNA, 19 nt, Human
uggaccccucugugcccag

SEQ ID NO: 64424 - RNA, 22 nt, Human
uggccaggaagccccuuccaua

SEQ ID NO: 64425 - RNA, 19 nt, Human
uggccccuagaguacaccc

SEQ ID NO: 64426 - RNA, 22 nt, Human
ugggggaggaaaagugggagga

SEQ ID NO: 64427 - RNA, 23 nt, Human
uguggcuaugggggaggaaaagu

SEQ ID NO: 64428 - RNA, 19 nt, Human
aagaaaaugauuagcuuuc

SEQ ID NO: 64429 - RNA, 24 nt, Human
caaguuagaaaauauaagcuuuua

SEQ ID NO: 64430 - RNA, 22 nt, Human
cuccugauuccaagagucccac

SEQ ID NO: 64431 - RNA, 24 nt, Human
uaacucuaugcuuaagaaaaugau

SEQ ID NO: 64432 - RNA, 21 nt, Human
uaaugccagcaaauuuuuaau

SEQ ID NO: 64433 - RNA, 23 nt, Human
uagcuuugucuccugauuccaag

SEQ ID NO: 64434 - RNA, 21 nt, Human
ugaaagaacaagucuuuagaa

SEQ ID NO: 64435 - RNA, 21 nt, Human
uggaaaaacauuuuucugaaa

SEQ ID NO: 64436 - RNA, 23 nt, Human
uuggaaaaacauuuuucugaaag

SEQ ID NO: 64437 - RNA, 19 nt, Human
aaaugcuguuuaugacuuc

SEQ ID NO: 64438 - RNA, 19 nt, Human
aacugcaaaaaaccaaaua

SEQ ID NO: 64439 - RNA, 21 nt, Human
acaacagcaacaagaccagua

SEQ ID NO: 64440 - RNA, 18 nt, Human
acccugugaacugcaaaa

SEQ ID NO: 64441 - RNA, 22 nt, Human
acccugugaacugcaaaaaacc

SEQ ID NO: 64442 - RNA, 22 nt, Human
acuguagcauauuaauacccug

SEQ ID NO: 64443 - RNA, 19 nt, Human
agaauguguaaauguucuc

SEQ ID NO: 64444 - RNA, 20 nt, Human
agccauugaacuucuauagg

SEQ ID NO: 64445 - RNA, 24 nt, Human
aguauucaucuauccccucaaugc

SEQ ID NO: 64446 - RNA, 19 nt, Human
caaacuucugacuacuccc

SEQ ID NO: 64447 - RNA, 20 nt, Human
caaacuucugacuacucccc

SEQ ID NO: 64448 - RNA, 22 nt, Human
caucuauccccucaaugccuca

SEQ ID NO: 64449 - RNA, 24 nt, Human
ccaaaauagaggggaaacuuuaca

SEQ ID NO: 64450 - RNA, 18 nt, Human
ccacuuugcuucucuuug

SEQ ID NO: 64451 - RNA, 18 nt, Human
cccagacaaccauuuagu

SEQ ID NO: 64452 - RNA, 21 nt, Human
cccuaagugacagcuaaagaa

SEQ ID NO: 64453 - RNA, 20 nt, Human
ccucaaugccucauaauucu

SEQ ID NO: 64454 - RNA, 21 nt, Human
ccugggaggccugguuuacua

SEQ ID NO: 64455 - RNA, 21 nt, Human
cuaacccccaaauguuuagaa

SEQ ID NO: 64456 - RNA, 21 nt, Human
cuauccccucaaugccucaua

SEQ ID NO: 64457 - RNA, 19 nt, Human
cuggagcucgccauccugg

SEQ ID NO: 64458 - RNA, 21 nt, Human
gaacaacagcaacaagaccag

SEQ ID NO: 64459 - RNA, 23 nt, Human
gaggaaagaugaaaaaccacuua

SEQ ID NO: 64460 - RNA, 19 nt, Human
ggagcucgccauccuggga

SEQ ID NO: 64461 - RNA, 19 nt, Human
gggaaacuuuacaauugug

SEQ ID NO: 64462 - RNA, 24 nt, Human
guauagccaggcugugggaggagg

SEQ ID NO: 64463 - RNA, 22 nt, Human
ucaaugccucauaauucuggaa

SEQ ID NO: 64464 - RNA, 24 nt, Human
ugaaaaaccacuuaaaugugaagg

SEQ ID NO: 64465 - RNA, 20 nt, Human
ugacaaccaacaagcugcug

SEQ ID NO: 64466 - RNA, 19 nt, Human
ugagguagacaguguuauc

SEQ ID NO: 64467 - RNA, 18 nt, Human
ugcacuguauagccaggc

SEQ ID NO: 64468 - RNA, 19 nt, Human
uggaaugccuguugugaaa

SEQ ID NO: 64469 - RNA, 24 nt, Human
ugggaggagggaggaaagaugaag

SEQ ID NO: 64470 - RNA, 20 nt, Human
uggucccaggucuaaccccc

SEQ ID NO: 64471 - RNA, 22 nt, Human
uuuacauaguacuguagcauau

SEQ ID NO: 64472 - RNA, 22 nt, Human
uuuagaaggaagguuauccaaa

SEQ ID NO: 64473 - RNA, 20 nt, Human
aaacugccuuuauucuauua

SEQ ID NO: 64474 - RNA, 22 nt, Human
aaaugaauuuuccaucugacuu

SEQ ID NO: 64475 - RNA, 21 nt, Human
acagugaggagaaaagagcac

SEQ ID NO: 64476 - RNA, 22 nt, Human
acaugaaaccacagaacuguaa

SEQ ID NO: 64477 - RNA, 19 nt, Human
acuuagcccagcuccaugg

SEQ ID NO: 64478 - RNA, 19 nt, Human
agaagagagacugagugcc

SEQ ID NO: 64479 - RNA, 21 nt, Human
agacagguuaugccaucuucc

SEQ ID NO: 64480 - RNA, 19 nt, Human
agauaaaugaaaaaggcca

SEQ ID NO: 64481 - RNA, 22 nt, Human
agcacugugaauuagagccaga

SEQ ID NO: 64482 - RNA, 22 nt, Human
augaaaccacagaacuguaacu

SEQ ID NO: 64483 - RNA, 18 nt, Human
augaauuuuccaucugac

SEQ ID NO: 64484 - RNA, 22 nt, Human
caccccagagcuaugccaacaa

SEQ ID NO: 64485 - RNA, 19 nt, Human
cagcugcaugaacuugggc

SEQ ID NO: 64486 - RNA, 22 nt, Human
caggugggagugcagaggaggg

SEQ ID NO: 64487 - RNA, 25 nt, Human
cggaguaaagcccugaaguggugac

SEQ ID NO: 64488 - RNA, 22 nt, Human
cuagaaagaagcaagaaguuaa

SEQ ID NO: 64489 - RNA, 24 nt, Human
cucaccagaguaccuugcagcuga

SEQ ID NO: 64490 - RNA, 19 nt, Human
cuccucugggagggaaccu

SEQ ID NO: 64491 - RNA, 25 nt, Human
cugccacagcugcaugaacuugggc

SEQ ID NO: 64492 - RNA, 18 nt, Human
gaaaccacagaacuguaa

SEQ ID NO: 64493 - RNA, 24 nt, Human
guaacucugccacagcugcaugaa

SEQ ID NO: 64494 - RNA, 21 nt, Human
gugucaggugggagugcagag

SEQ ID NO: 64495 - RNA, 19 nt, Human
uaaauacugguagcaagau

SEQ ID NO: 64496 - RNA, 19 nt, Human
uaagauuaauaaacagcac

SEQ ID NO: 64497 - RNA, 22 nt, Human
uaagauuaauaaacagcacuuc

SEQ ID NO: 64498 - RNA, 22 nt, Human
uaauucacaaaaguuaccaacu

SEQ ID NO: 64499 - RNA, 23 nt, Human
uacacaguaacuauaagguaacu

SEQ ID NO: 64500 - RNA, 24 nt, Human
uacacuuucuuuuuuaaaaaacca

SEQ ID NO: 64501 - RNA, 18 nt, Human
uacagugaggagaaaaga

SEQ ID NO: 64502 - RNA, 19 nt, Human
uaguuggcuucuaaauacu

SEQ ID NO: 64503 - RNA, 23 nt, Human
uauuaggaaauccaauuauacaa

SEQ ID NO: 64504 - RNA, 18 nt, Human
ucaggugggagugcagag

SEQ ID NO: 64505 - RNA, 22 nt, Human
uccaaauacacuuucuuuuuua

SEQ ID NO: 64506 - RNA, 18 nt, Human
ucugccacagcugcauga

SEQ ID NO: 64507 - RNA, 18 nt, Human
ucugguugagcccauuuu

SEQ ID NO: 64508 - RNA, 18 nt, Human
ugaauuagagccagaugc

SEQ ID NO: 64509 - RNA, 19 nt, Human
ugagaacugguggcuccuc

SEQ ID NO: 64510 - RNA, 20 nt, Human
ugagauacauggggccgaaa

SEQ ID NO: 64511 - RNA, 23 nt, Human
ugagugccacccaugagaacugg

SEQ ID NO: 64512 - RNA, 18 nt, Human
uggagagaagagagacug

SEQ ID NO: 64513 - RNA, 23 nt, Human
ugggagggaaccuggauacagug

SEQ ID NO: 64514 - RNA, 23 nt, Human
ugguaacauacauuaaguggcac

SEQ ID NO: 64515 - RNA, 24 nt, Human
ugugaauuagagccagaugcuuaa

SEQ ID NO: 64516 - RNA, 21 nt, Human
uugcagcugacagauaauagg

SEQ ID NO: 64517 - RNA, 23 nt, Human
uuuaaaaaaugaauuuuccaucu

SEQ ID NO: 64518 - RNA, 25 nt, Human
aaaaagaaccccgcuccuucgugaa

SEQ ID NO: 64519 - RNA, 19 nt, Human
aaauggguugggagggggu

SEQ ID NO: 64520 - RNA, 21 nt, Human
aagaaggugacacaggcugcc

SEQ ID NO: 64521 - RNA, 27 nt, Human
aagaaggugacacaggcugccccccac

SEQ ID NO: 64522 - RNA, 19 nt, Human
aagaggaacugaaauagag

SEQ ID NO: 64523 - RNA, 23 nt, Human
aagcucuccagcccagaucggga

SEQ ID NO: 64524 - RNA, 20 nt, Human
acuggaaaauggguugggag

SEQ ID NO: 64525 - RNA, 21 nt, Human
acuucagaauuugggcuguga

SEQ ID NO: 64526 - RNA, 23 nt, Human
agaugcauuuaaaauacacacag

SEQ ID NO: 64527 - RNA, 24 nt, Human
agccggccgcuccgggcagggggu

SEQ ID NO: 64528 - RNA, 18 nt, Human
agcuggggagaggggugg

SEQ ID NO: 64529 - RNA, 21 nt, Human
aggaggcuaagggagguggug

SEQ ID NO: 64530 - RNA, 20 nt, Human
aggcggagcgcccccggagc

SEQ ID NO: 64531 - RNA, 20 nt, Human
aggcggcggcccguguccgg

SEQ ID NO: 64532 - RNA, 18 nt, Human
aggcggcgugggcgaggg

SEQ ID NO: 64533 - RNA, 19 nt, Human
aggcggcgugggcgagggc

SEQ ID NO: 64534 - RNA, 22 nt, Human
aggcggcguugggcagguccgg

SEQ ID NO: 64535 - RNA, 22 nt, Human
aggcggcguugggcagguccgg

SEQ ID NO: 64536 - RNA, 23 nt, Human
aggcuaagggagguggugguggg

SEQ ID NO: 64537 - RNA, 24 nt, Human
aggggugggagccccauccugguu

SEQ ID NO: 64538 - RNA, 19 nt, Human
agguggugguggguccaug

SEQ ID NO: 64539 - RNA, 20 nt, Human
aguuggcaggcugaagggca

SEQ ID NO: 64540 - RNA, 21 nt, Human
auacccauaaacuccucccac

SEQ ID NO: 64541 - RNA, 22 nt, Human
auagcaaagguccacggaaaag

SEQ ID NO: 64542 - RNA, 24 nt, Human
auagcggacaucccuucuucaguu

SEQ ID NO: 64543 - RNA, 20 nt, Human
aucucguuuauuugccaaua

SEQ ID NO: 64544 - RNA, 18 nt, Human
cacacagcccgggggcca

SEQ ID NO: 64545 - RNA, 19 nt, Human
caccuggacugggcaggag

SEQ ID NO: 64546 - RNA, 18 nt, Human
cagcgaacugagcgcccc

SEQ ID NO: 64547 - RNA, 19 nt, Human
caggagccacauacccaua

SEQ ID NO: 64548 - RNA, 22 nt, Human
cauacccauaaacuccucccac

SEQ ID NO: 64549 - RNA, 24 nt, Human
ccacauacccauaaacuccuccca

SEQ ID NO: 64550 - RNA, 18 nt, Human
ccacggaaaagggagcuc

SEQ ID NO: 64551 - RNA, 21 nt, Human
ccaugggccaccagccaccuu

SEQ ID NO: 64552 - RNA, 21 nt, Human
cccagaucgggaaagaggaac

SEQ ID NO: 64553 - RNA, 20 nt, Human
cccaguaguagaagcagagu

SEQ ID NO: 64554 - RNA, 23 nt, Human
ccccagggggcgcucacucggcg

SEQ ID NO: 64555 - RNA, 18 nt, Human
cccccacuggaaaauggg

SEQ ID NO: 64556 - RNA, 23 nt, Human
ccccggagcucaccaggugcgcc

SEQ ID NO: 64557 - RNA, 23 nt, Human
ccccggagcucaccaggugcgcc

SEQ ID NO: 64558 - RNA, 18 nt, Human
ccccgggcgucccccucc

SEQ ID NO: 64559 - RNA, 18 nt, Human
cccggagcucaccaggug

SEQ ID NO: 64560 - RNA, 23 nt, Human
ccgcccuccgggcucuggggcag

SEQ ID NO: 64561 - RNA, 22 nt, Human
ccgcgacggggaacuggccaac

SEQ ID NO: 64562 - RNA, 19 nt, Human
ccggagcucaccaggugcg

SEQ ID NO: 64563 - RNA, 19 nt, Human
ccucggugcucugcguucc

SEQ ID NO: 64564 - RNA, 23 nt, Human
ccugcaugcccaucaaauaggcc

SEQ ID NO: 64565 - RNA, 22 nt, Human
ccuuccacauacaccacuucac

SEQ ID NO: 64566 - RNA, 24 nt, Human
ccuucgccgggcucuccgcccucc

SEQ ID NO: 64567 - RNA, 19 nt, Human
cgcgcucccgcucccagcc

SEQ ID NO: 64568 - RNA, 22 nt, Human
cggcccguguccggggggcuuu

SEQ ID NO: 64569 - RNA, 19 nt, Human
cggcuaggcucccuaggua

SEQ ID NO: 64570 - RNA, 20 nt, Human
cggcuaggcucccuagguac

SEQ ID NO: 64571 - RNA, 18 nt, Human
cgggagggcuccugggcg

SEQ ID NO: 64572 - RNA, 22 nt, Human
cgggcgucccccuccccgcucc

SEQ ID NO: 64573 - RNA, 23 nt, Human
cggggauuuggggcgcggaggcg

SEQ ID NO: 64574 - RNA, 20 nt, Human
cguagccugugcuccagggc

SEQ ID NO: 64575 - RNA, 21 nt, Human
cuccagggcaggcggcggccc

SEQ ID NO: 64576 - RNA, 19 nt, Human
cuccuccgaccuuccacau

SEQ ID NO: 64577 - RNA, 29 nt, Human
cugaaauagaguagaagugaaagcccacu

SEQ ID NO: 64578 - RNA, 22 nt, Human
cuucacagcaagccugguccuc

SEQ ID NO: 64579 - RNA, 18 nt, Human
cuuccacauacaccacuu

SEQ ID NO: 64580 - RNA, 19 nt, Human
gagcgcccccggagcucac

SEQ ID NO: 64581 - RNA, 19 nt, Human
gagcuggggagaggggugg

SEQ ID NO: 64582 - RNA, 23 nt, Human
gagguggugguggguccaugggc

SEQ ID NO: 64583 - RNA, 19 nt, Human
gaugcggagcuggggagag

SEQ ID NO: 64584 - RNA, 21 nt, Human
gccaccuuccucagcgaacug

SEQ ID NO: 64585 - RNA, 19 nt, Human
gcccggacgcggcgugggg

SEQ ID NO: 64586 - RNA, 20 nt, Human
gcccguguccggggggcuuu

SEQ ID NO: 64587 - RNA, 18 nt, Human
gccuucgcgggagggcuc

SEQ ID NO: 64588 - RNA, 18 nt, Human
gcucgcucgagccucaac

SEQ ID NO: 64589 - RNA, 20 nt, Human
gcugaagggcaucuaaaugg

SEQ ID NO: 64590 - RNA, 22 nt, Human
gcugcagaaaggucggucugga

SEQ ID NO: 64591 - RNA, 20 nt, Human
ggaagcuggcggccuccugg

SEQ ID NO: 64592 - RNA, 19 nt, Human
ggagaggcuagugggaggg

SEQ ID NO: 64593 - RNA, 20 nt, Human
ggagggcuccugggcgcuuc

SEQ ID NO: 64594 - RNA, 22 nt, Human
ggagguggugguggguccaugg

SEQ ID NO: 64595 - RNA, 18 nt, Human
ggccagcacgaguuggca

SEQ ID NO: 64596 - RNA, 21 nt, Human
ggccccaguaguagaagcaga

SEQ ID NO: 64597 - RNA, 24 nt, Human
ggcguugggcagguccggggauuu

SEQ ID NO: 64598 - RNA, 19 nt, Human
ggcucuggggcagaacagg

SEQ ID NO: 64599 - RNA, 22 nt, Human
gggaaggacgugaagaagguga

SEQ ID NO: 64600 - RNA, 23 nt, Human
gggagguggugguggguccaugg

SEQ ID NO: 64601 - RNA, 18 nt, Human
gggauuuggggcgcggag

SEQ ID NO: 64602 - RNA, 18 nt, Human
gggcaggggguccgcuuc

SEQ ID NO: 64603 - RNA, 18 nt, Human
gggcgcggaggcggagcg

SEQ ID NO: 64604 - RNA, 19 nt, Human
ggggaggggaacuacggua

SEQ ID NO: 64605 - RNA, 22 nt, Human
ggggccagccggccgcuccggg

SEQ ID NO: 64606 - RNA, 19 nt, Human
ggguugggagggggugcgg

SEQ ID NO: 64607 - RNA, 21 nt, Human
ggguugggagggggugcggcc

SEQ ID NO: 64608 - RNA, 25 nt, Human
ggugagcgagucuucccaaccgccg

SEQ ID NO: 64609 - RNA, 21 nt, Human
guggagggggaggggaacuac

SEQ ID NO: 64610 - RNA, 22 nt, Human
guggugguggguccaugggcca

SEQ ID NO: 64611 - RNA, 23 nt, Human
uaagagggacagggaacuggggc

SEQ ID NO: 64612 - RNA, 18 nt, Human
uaagcugccgggccgcga

SEQ ID NO: 64613 - RNA, 22 nt, Human
uacaccacuucacagcaagccu

SEQ ID NO: 64614 - RNA, 28 nt, Human
uccacauacaccacuucacagcaagccu

SEQ ID NO: 64615 - RNA, 25 nt, Human
uccugguuugggugccccagggggc

SEQ ID NO: 64616 - RNA, 19 nt, Human
uccuucgccgggcucuccg

SEQ ID NO: 64617 - RNA, 18 nt, Human
ugaaauagaguagaagug

SEQ ID NO: 64618 - RNA, 22 nt, Human
ugacacaggcugccccccacug

SEQ ID NO: 64619 - RNA, 19 nt, Human
uggaaaauggguugggagg

SEQ ID NO: 64620 - RNA, 20 nt, Human
uggagggggaggggaacuac

SEQ ID NO: 64621 - RNA, 19 nt, Human
ugggcagguccggggauuu

SEQ ID NO: 64622 - RNA, 24 nt, Human
ugggcagguccggggauuuggggc

SEQ ID NO: 64623 - RNA, 20 nt, Human
ugggccaccagccaccuucc

SEQ ID NO: 64624 - RNA, 18 nt, Human
uggggagaggggugggag

SEQ ID NO: 64625 - RNA, 21 nt, Human
uggggagaggggugggagccc

SEQ ID NO: 64626 - RNA, 18 nt, Human
ugggugccccagggggcg

SEQ ID NO: 64627 - RNA, 24 nt, Human
uuaaaaagaaccccgcuccuucgu

SEQ ID NO: 64628 - RNA, 22 nt, Human
uucacagcaagccugguccuca

SEQ ID NO: 64629 - RNA, 20 nt, Human
uucgugaaaccccuuuuccc

SEQ ID NO: 64630 - RNA, 19 nt, Human
uugggagggggugcggccc

SEQ ID NO: 64631 - RNA, 18 nt, Human
uuuaaaauacacacagcc

SEQ ID NO: 64632 - RNA, 18 nt, Human
aacccccuuucucagucc

SEQ ID NO: 64633 - RNA, 20 nt, Human
aacccccuuucucaguccag

SEQ ID NO: 64634 - RNA, 23 nt, Human
agagcaggugggcccaggaaccc

SEQ ID NO: 64635 - RNA, 20 nt, Human
aggaacccccuuucucaguc

SEQ ID NO: 64636 - RNA, 18 nt, Human
cagccagcucagcagcag

SEQ ID NO: 64637 - RNA, 22 nt, Human
caggaacccccuuucucagucc

SEQ ID NO: 64638 - RNA, 20 nt, Human
caggugcagcccugggagca

SEQ ID NO: 64639 - RNA, 19 nt, Human
cccaggaacccccuuucuc

SEQ ID NO: 64640 - RNA, 20 nt, Human
cccaggccucagggccuggc

SEQ ID NO: 64641 - RNA, 18 nt, Human
cgcugagcgggcgggcgg

SEQ ID NO: 64642 - RNA, 20 nt, Human
cggcggucacagccuaggga

SEQ ID NO: 64643 - RNA, 20 nt, Human
cucccaggccucagggccug

SEQ ID NO: 64644 - RNA, 19 nt, Human
cugccccuucccgcgucgc

SEQ ID NO: 64645 - RNA, 25 nt, Human
gagcaggugggcccaggaacccccu

SEQ ID NO: 64646 - RNA, 18 nt, Human
gagcgggcgggcgggcgg

SEQ ID NO: 64647 - RNA, 21 nt, Human
gagugauucucgggcaccgca

SEQ ID NO: 64648 - RNA, 20 nt, Human
gaugucguuuuucuuguuac

SEQ ID NO: 64649 - RNA, 21 nt, Human
gcaccgcaggacgagcccuac

SEQ ID NO: 64650 - RNA, 26 nt, Human
gcaguggaguucggcggucacagccu

SEQ ID NO: 64651 - RNA, 19 nt, Human
gcccagccagcucagcagc

SEQ ID NO: 64652 - RNA, 20 nt, Human
gcccaggaacccccuuucuc

SEQ ID NO: 64653 - RNA, 25 nt, Human
gccgggcgcugagcgggcgggcggg

SEQ ID NO: 64654 - RNA, 22 nt, Human
gcgggcgggcgggcggcugcgg

SEQ ID NO: 64655 - RNA, 20 nt, Human
ggcgggcgggcggcugcggc

SEQ ID NO: 64656 - RNA, 20 nt, Human
ggguguggguucuggccaga

SEQ ID NO: 64657 - RNA, 21 nt, Human
ggucagcgcccugccccuucc

SEQ ID NO: 64658 - RNA, 23 nt, Human
gguccuggcaggugcagcccugg

SEQ ID NO: 64659 - RNA, 22 nt, Human
guccaggacucccaggccucag

SEQ ID NO: 64660 - RNA, 19 nt, Human
guggcgcccgucuguugca

SEQ ID NO: 64661 - RNA, 19 nt, Human
gugggcccaggaacccccu

SEQ ID NO: 64662 - RNA, 25 nt, Human
uagcgagugauucucgggcaccgcc

SEQ ID NO: 64663 - RNA, 22 nt, Human
uagguccuggcaggugcagccc

SEQ ID NO: 64664 - RNA, 20 nt, Human
uaugacaggugggaaggggc

SEQ ID NO: 64665 - RNA, 22 nt, Human
uccuggcaggugcagcccuggg

SEQ ID NO: 64666 - RNA, 25 nt, Human
ucucgggcaccgcaggacgagcccu

SEQ ID NO: 64667 - RNA, 18 nt, Human
ucuguugcaguggaguuc

SEQ ID NO: 64668 - RNA, 20 nt, Human
ugagcgggcgggcgggcggc

SEQ ID NO: 64669 - RNA, 20 nt, Human
uggcaggugcagcccuggga

SEQ ID NO: 64670 - RNA, 21 nt, Human
uggcgcccgucuguugcagug

SEQ ID NO: 64671 - RNA, 21 nt, Human
aagagcagcgagggcagaggu

SEQ ID NO: 64672 - RNA, 20 nt, Human
aaggcaccaaggcacaacug

SEQ ID NO: 64673 - RNA, 18 nt, Human
acaaggcaccaaggcaca

SEQ ID NO: 64674 - RNA, 20 nt, Human
acaaggcaccaaggcacaac

SEQ ID NO: 64675 - RNA, 21 nt, Human
acucagagaaaaaggcauuca

SEQ ID NO: 64676 - RNA, 21 nt, Human
agaggagcagguuaggguaca

SEQ ID NO: 64677 - RNA, 19 nt, Human
agaggggcagagcccaaag

SEQ ID NO: 64678 - RNA, 24 nt, Human
agcagcgagggcagagguuagaga

SEQ ID NO: 64679 - RNA, 30 nt, Human
agcccaaagccccuuucucugcaggccucu

SEQ ID NO: 64680 - RNA, 18 nt, Human
agcugggggcggcggcag

SEQ ID NO: 64681 - RNA, 24 nt, Human
aggcagcaacaacuguguggaaag

SEQ ID NO: 64682 - RNA, 18 nt, Human
aggggcagagcccaaagc

SEQ ID NO: 64683 - RNA, 18 nt, Human
aguccuuaaggcacagcu

SEQ ID NO: 64684 - RNA, 19 nt, Human
auacccaguguucccaagc

SEQ ID NO: 64685 - RNA, 20 nt, Human
caagagcagcgagggcagag

SEQ ID NO: 64686 - RNA, 18 nt, Human
caagccagaggggcagag

SEQ ID NO: 64687 - RNA, 21 nt, Human
ccaaggcacaacugguggggg

SEQ ID NO: 64688 - RNA, 31 nt, Human
ccaaguucccaggcucucaugccuagcccaa

SEQ ID NO: 64689 - RNA, 20 nt, Human
ccacaauaggcagcaacaac

SEQ ID NO: 64690 - RNA, 24 nt, Human
ccagaauuaguccuuaaggcacag

SEQ ID NO: 64691 - RNA, 23 nt, Human
ccccuaaccugaggcggcaccac

SEQ ID NO: 64692 - RNA, 21 nt, Human
ccccuggaaaggggugccaga

SEQ ID NO: 64693 - RNA, 19 nt, Human
ccucccgaggcgggggagc

SEQ ID NO: 64694 - RNA, 20 nt, Human
cggcggcagcggcuccgggc

SEQ ID NO: 64695 - RNA, 20 nt, Human
cugagagccccuaaccugag

SEQ ID NO: 64696 - RNA, 21 nt, Human
cugcaggccuccuuaaggaga

SEQ ID NO: 64697 - RNA, 28 nt, Human
cuggcugcagugacaucugagccuuuuu

SEQ ID NO: 64698 - RNA, 27 nt, Human
cuggcugcagugaccuggugccccucc

SEQ ID NO: 64699 - RNA, 24 nt, Human
cugggggcggcggcagcggcuccu

SEQ ID NO: 64700 - RNA, 28 nt, Human
cuuaaggagaaaaaggcacucagagaaa

SEQ ID NO: 64701 - RNA, 24 nt, Human
cuuggcuuggaugagcucaugaga

SEQ ID NO: 64702 - RNA, 22 nt, Human
cuuuuugcuuccaaguucccag

SEQ ID NO: 64703 - RNA, 18 nt, Human
gaccccucuggcugcagu

SEQ ID NO: 64704 - RNA, 18 nt, Human
gaccccucuggcugcagu

SEQ ID NO: 64705 - RNA, 22 nt, Human
gagaaaaaggcauucagggaac

SEQ ID NO: 64706 - RNA, 20 nt, Human
gaggcgggggagcugggggc

SEQ ID NO: 64707 - RNA, 26 nt, Human
gauucuguggcucccucauuggagaa

SEQ ID NO: 64708 - RNA, 19 nt, Human
gcagcaacaacugugugga

SEQ ID NO: 64709 - RNA, 23 nt, Human
gccagaggggcagagcccaaagc

SEQ ID NO: 64710 - RNA, 24 nt, Human
gcgcaauuccaagagcagcgaggg

SEQ ID NO: 64711 - RNA, 21 nt, Human
gcggcggcagcggcuccgggc

SEQ ID NO: 64712 - RNA, 21 nt, Human
gcggcggcagcggcuccgggc

SEQ ID NO: 64713 - RNA, 21 nt, Human
gcucaugagaauacccagugu

SEQ ID NO: 64714 - RNA, 19 nt, Human
ggcggcagcggcuccgggc

SEQ ID NO: 64715 - RNA, 19 nt, Human
ggcggcggcagcggcuccg

SEQ ID NO: 64716 - RNA, 24 nt, Human
gggcagagguuagagauggcugag

SEQ ID NO: 64717 - RNA, 21 nt, Human
gggcaggggcagccuccaagc

SEQ ID NO: 64718 - RNA, 21 nt, Human
ggggagggcaggggcagccuc

SEQ ID NO: 64719 - RNA, 21 nt, Human
ggguuggccucuuggggaggg

SEQ ID NO: 64720 - RNA, 19 nt, Human
uaaggagaaaaaggcacuc

SEQ ID NO: 64721 - RNA, 21 nt, Human
uacccaguguucccaagccag

SEQ ID NO: 64722 - RNA, 21 nt, Human
ucagggaaccccuggaaaggg

SEQ ID NO: 64723 - RNA, 23 nt, Human
ucccaggcucucaugccuagccc

SEQ ID NO: 64724 - RNA, 21 nt, Human
uccccagaagcaugggggcug

SEQ ID NO: 64725 - RNA, 21 nt, Human
ucugcaggccuccuuaaggag

SEQ ID NO: 64726 - RNA, 22 nt, Human
ucugcaggccuccuuaaggaga

SEQ ID NO: 64727 - RNA, 18 nt, Human
ucuucuggaccccucugg

SEQ ID NO: 64728 - RNA, 18 nt, Human
ucuucuggaccccucugg

SEQ ID NO: 64729 - RNA, 22 nt, Human
ucuucuggaccccucuggcugc

SEQ ID NO: 64730 - RNA, 22 nt, Human
ucuucuggaccccucuggcugc

SEQ ID NO: 64731 - RNA, 21 nt, Human
ugagaauacccaguguuccca

SEQ ID NO: 64732 - RNA, 23 nt, Human
ugaggcggacaaggcaccaaggc

SEQ ID NO: 64733 - RNA, 22 nt, Human
ugcuguagugaggcagugccuc

SEQ ID NO: 64734 - RNA, 23 nt, Human
ugcuguaguggaggcagugccuc

SEQ ID NO: 64735 - RNA, 18 nt, Human
ugggagggggcacugggu

SEQ ID NO: 64736 - RNA, 20 nt, Human
ugggagggggcacuggguug

SEQ ID NO: 64737 - RNA, 21 nt, Human
ugggagggggcacuggguugg

SEQ ID NO: 64738 - RNA, 22 nt, Human
ugggagggggcacuggguuggc

SEQ ID NO: 64739 - RNA, 18 nt, Human
uggggagggguccaaccu

SEQ ID NO: 64740 - RNA, 20 nt, Human
uggggagggguccaaccuug

SEQ ID NO: 64741 - RNA, 18 nt, Human
ugggggcggcggcagcgg

SEQ ID NO: 64742 - RNA, 18 nt, Human
uggguuggccucuugggg

SEQ ID NO: 64743 - RNA, 20 nt, Human
uggguuggccucuuggggag

SEQ ID NO: 64744 - RNA, 23 nt, Human
ugguggggggagggcaggggcag

SEQ ID NO: 64745 - RNA, 21 nt, Human
uuaguccuuaaggcacagcug

SEQ ID NO: 64746 - RNA, 18 nt, Human
uucccaggcucucaugcc

SEQ ID NO: 64747 - RNA, 22 nt, Human
uugaugcugauggggguaggaa

SEQ ID NO: 64748 - RNA, 19 nt, Human
aaaaauaugcaaucuuuuc

SEQ ID NO: 64749 - RNA, 18 nt, Human
aaagcuauggcaaaagca

SEQ ID NO: 64750 - RNA, 18 nt, Human
aaagcuauggcaaaagca

SEQ ID NO: 64751 - RNA, 25 nt, Human
aaagcuucuccgagccccccggggc

SEQ ID NO: 64752 - RNA, 21 nt, Human
aacuccaacucggauuuccac

SEQ ID NO: 64753 - RNA, 19 nt, Human
aagaaaacauuuccucagc

SEQ ID NO: 64754 - RNA, 19 nt, Human
aagaaaacauuuccucagc

SEQ ID NO: 64755 - RNA, 21 nt, Human
aagagggucaggaagaggagg

SEQ ID NO: 64756 - RNA, 20 nt, Human
acacaauagucaaaaccgaa

SEQ ID NO: 64757 - RNA, 20 nt, Human
acacaauagucaaaaccgaa

SEQ ID NO: 64758 - RNA, 21 nt, Human
acacuaagugugccaguggcc

SEQ ID NO: 64759 - RNA, 21 nt, Human
acacuaagugugccaguggcc

SEQ ID NO: 64760 - RNA, 19 nt, Human
acagaaggcaggucccagg

SEQ ID NO: 64761 - RNA, 23 nt, Human
acagaauacacaauagucaaaac

SEQ ID NO: 64762 - RNA, 23 nt, Human
acagaauacacaauagucaaaac

SEQ ID NO: 64763 - RNA, 22 nt, Human
acccaaauccaguauacauaaa

SEQ ID NO: 64764 - RNA, 20 nt, Human
accgaggccaauuuggggac

SEQ ID NO: 64765 - RNA, 22 nt, Human
accuccuaggagaagcgaagau

SEQ ID NO: 64766 - RNA, 18 nt, Human
acuaaaguacgguagaac

SEQ ID NO: 64767 - RNA, 18 nt, Human
acuaaaguacgguagaac

SEQ ID NO: 64768 - RNA, 22 nt, Human
acuuggaguguggccugcaggg

SEQ ID NO: 64769 - RNA, 24 nt, Human
acuuuauaguuggauuccaguuug

SEQ ID NO: 64770 - RNA, 24 nt, Human
acuuuauaguuggauuccaguuug

SEQ ID NO: 64771 - RNA, 23 nt, Human
agaaccuuccuccggagcccaag

SEQ ID NO: 64772 - RNA, 18 nt, Human
agaaggacgagcaaagag

SEQ ID NO: 64773 - RNA, 26 nt, Human
agaaggacgagcaaagagguccagga

SEQ ID NO: 64774 - RNA, 31 nt, Human
agaauacacaauagucaaaaccgaagacacc

SEQ ID NO: 64775 - RNA, 25 nt, Human
agaggcggcccgccguggcuccccg

SEQ ID NO: 64776 - RNA, 21 nt, Human
agagggucaggaagaggagga

SEQ ID NO: 64777 - RNA, 21 nt, Human
agaucugaagaucauacaacu

SEQ ID NO: 64778 - RNA, 21 nt, Human
agaucugaagaucauacaacu

SEQ ID NO: 64779 - RNA, 20 nt, Human
agcaaagcccagcucacgcg

SEQ ID NO: 64780 - RNA, 18 nt, Human
agccagccagcguccccc

SEQ ID NO: 64781 - RNA, 20 nt, Human
agccugccagcgccacuccc

SEQ ID NO: 64782 - RNA, 19 nt, Human
agccugguggcccuggggg

SEQ ID NO: 64783 - RNA, 21 nt, Human
agcgugcugcgcccgggaccu

SEQ ID NO: 64784 - RNA, 18 nt, Human
aggaacaggagaagacgc

SEQ ID NO: 64785 - RNA, 19 nt, Human
aggaggaaaugggacucug

SEQ ID NO: 64786 - RNA, 19 nt, Human
aggaggaaaugggacucug

SEQ ID NO: 64787 - RNA, 21 nt, Human
aggcaaaggugccaggcgggg

SEQ ID NO: 64788 - RNA, 19 nt, Human
agggacguuuuuagauugg

SEQ ID NO: 64789 - RNA, 19 nt, Human
agggacguuuuuagauugg

SEQ ID NO: 64790 - RNA, 19 nt, Human
agggagcagggccccgcuc

SEQ ID NO: 64791 - RNA, 18 nt, Human
agggagcgcucagacagc

SEQ ID NO: 64792 - RNA, 26 nt, Human
agggggggcucggcugggugcgggcu

SEQ ID NO: 64793 - RNA, 20 nt, Human
agggucaggaagaggaggag

SEQ ID NO: 64794 - RNA, 22 nt, Human
agguguggcccggcucugcagc

SEQ ID NO: 64795 - RNA, 22 nt, Human
agguugcgcgccuggccuccgc

SEQ ID NO: 64796 - RNA, 21 nt, Human
auauuauagagccaagaggga

SEQ ID NO: 64797 - RNA, 21 nt, Human
auauuauagagccaagaggga

SEQ ID NO: 64798 - RNA, 24 nt, Human
auauugaaugucugagaaauggcc

SEQ ID NO: 64799 - RNA, 20 nt, Human
aucucggcggggcugcaccu

SEQ ID NO: 64800 - RNA, 24 nt, Human
auggggucuuuggcacugaggugu

SEQ ID NO: 64801 - RNA, 19 nt, Human
caaaagcacagaaacccgc

SEQ ID NO: 64802 - RNA, 19 nt, Human
caaaagcacagaaacccgc

SEQ ID NO: 64803 - RNA, 20 nt, Human
caaaagcacagaaacccgcu

SEQ ID NO: 64804 - RNA, 20 nt, Human
caaaagcacagaaacccgcu

SEQ ID NO: 64805 - RNA, 27 nt, Human
caaaagcacagaaacccggcaggaacu

SEQ ID NO: 64806 - RNA, 27 nt, Human
caaaagcacagaaacccggcaggaacu

SEQ ID NO: 64807 - RNA, 22 nt, Human
caaagcccagcucacgcgccgc

SEQ ID NO: 64808 - RNA, 22 nt, Human
caauagucaaaaccgaagacac

SEQ ID NO: 64809 - RNA, 22 nt, Human
caauagucaaaaccgaagacac

SEQ ID NO: 64810 - RNA, 18 nt, Human
cacagcaggaggaaaugg

SEQ ID NO: 64811 - RNA, 21 nt, Human
caccagcauaaacugcccugg

SEQ ID NO: 64812 - RNA, 20 nt, Human
caccccauaaauuauaauca

SEQ ID NO: 64813 - RNA, 23 nt, Human
caccccauaaauuauaaucagcc

SEQ ID NO: 64814 - RNA, 18 nt, Human
caccgcagggugggcccu

SEQ ID NO: 64815 - RNA, 19 nt, Human
caccuccuccucccucccu

SEQ ID NO: 64816 - RNA, 21 nt, Human
cacggaaaaggaaacuuccga

SEQ ID NO: 64817 - RNA, 20 nt, Human
cacugcccuccgcgcccgcc

SEQ ID NO: 64818 - RNA, 23 nt, Human
cagagcagguuugugacucccag

SEQ ID NO: 64819 - RNA, 18 nt, Human
cagaggcucaaggguugu

SEQ ID NO: 64820 - RNA, 21 nt, Human
cagccugccagcgccacuccc

SEQ ID NO: 64821 - RNA, 26 nt, Human
caggaagaggaggaggaaggucaggc

SEQ ID NO: 64822 - RNA, 21 nt, Human
caggagaagacgcuguggagc

SEQ ID NO: 64823 - RNA, 18 nt, Human
caggaggcgguagccugg

SEQ ID NO: 64824 - RNA, 22 nt, Human
cagggacccucccagccaacga

SEQ ID NO: 64825 - RNA, 21 nt, Human
cagggccggguccaggcugcg

SEQ ID NO: 64826 - RNA, 22 nt, Human
cagggccggguccaggcugcgg

SEQ ID NO: 64827 - RNA, 23 nt, Human
cagggugggcccugcccuccguc

SEQ ID NO: 64828 - RNA, 22 nt, Human
caggucccaggccaugcucuuc

SEQ ID NO: 64829 - RNA, 22 nt, Human
ccacccacgguccccccugggc

SEQ ID NO: 64830 - RNA, 22 nt, Human
ccacccacgguccccccugggc

SEQ ID NO: 64831 - RNA, 19 nt, Human
ccaccgcgcucccggcgcc

SEQ ID NO: 64832 - RNA, 19 nt, Human
ccagagaccuccgcuacug

SEQ ID NO: 64833 - RNA, 24 nt, Human
ccagcaagcuccuccuugccgccc

SEQ ID NO: 64834 - RNA, 24 nt, Human
ccagccuucuaggaaaaugggucu

SEQ ID NO: 64835 - RNA, 22 nt, Human
cccccaggcgcggacuguccug

SEQ ID NO: 64836 - RNA, 18 nt, Human
cccccuuccuagcugagg

SEQ ID NO: 64837 - RNA, 19 nt, Human
ccccggggccgcguccucu

SEQ ID NO: 64838 - RNA, 20 nt, Human
ccccugggcuggagggcggg

SEQ ID NO: 64839 - RNA, 21 nt, Human
ccccugggcuggagggcgggg

SEQ ID NO: 64840 - RNA, 21 nt, Human
ccccugggcuggagggcgggg

SEQ ID NO: 64841 - RNA, 18 nt, Human
cccgccguggcuccccgc

SEQ ID NO: 64842 - RNA, 19 nt, Human
cccuccgcgcccgccucgu

SEQ ID NO: 64843 - RNA, 18 nt, Human
cccuggauccaggcugcc

SEQ ID NO: 64844 - RNA, 21 nt, Human
cccuggggggcggaccccggg

SEQ ID NO: 64845 - RNA, 23 nt, Human
cccuuggccgaggccgcgcuacu

SEQ ID NO: 64846 - RNA, 24 nt, Human
ccgcccgaggacagucccgagggc

SEQ ID NO: 64847 - RNA, 19 nt, Human
ccgcuagaaccuuccuccg

SEQ ID NO: 64848 - RNA, 22 nt, Human
ccggcgcccgagguugcgcgcc

SEQ ID NO: 64849 - RNA, 22 nt, Human
ccuccaaagacugcgugcccac

SEQ ID NO: 64850 - RNA, 19 nt, Human
ccucccgcuccugagccgg

SEQ ID NO: 64851 - RNA, 21 nt, Human
ccucccugcacucucuccuug

SEQ ID NO: 64852 - RNA, 22 nt, Human
ccucccugcacucucuccuugc

SEQ ID NO: 64853 - RNA, 23 nt, Human
ccuccgcgcccgccucgucgcuc

SEQ ID NO: 64854 - RNA, 22 nt, Human
ccugcagggacccucccagcca

SEQ ID NO: 64855 - RNA, 23 nt, Human
ccugcagggacccucccagccaa

SEQ ID NO: 64856 - RNA, 23 nt, Human
ccugcggggugcuggguguggag

SEQ ID NO: 64857 - RNA, 18 nt, Human
ccuggacguggggcgugc

SEQ ID NO: 64858 - RNA, 22 nt, Human
ccugggcuggagggcggggggc

SEQ ID NO: 64859 - RNA, 22 nt, Human
ccugggcuggagggcggggggc

SEQ ID NO: 64860 - RNA, 21 nt, Human
cgacaaguggcccaccagcau

SEQ ID NO: 64861 - RNA, 21 nt, Human
cgacugggcucgccauaccuu

SEQ ID NO: 64862 - RNA, 21 nt, Human
cgagcaaagagguccaggagg

SEQ ID NO: 64863 - RNA, 22 nt, Human
cgaggccgcgcuacuugaagcg

SEQ ID NO: 64864 - RNA, 26 nt, Human
cgcccacucuuccgacugcagaggcu

SEQ ID NO: 64865 - RNA, 23 nt, Human
cgcccgaggacagucccgagggc

SEQ ID NO: 64866 - RNA, 19 nt, Human
cgcccgggaccuccaaaga

SEQ ID NO: 64867 - RNA, 24 nt, Human
cgcgccgccggugcgcuccaagug

SEQ ID NO: 64868 - RNA, 22 nt, Human
cgcucagggucaaguacugcuc

SEQ ID NO: 64869 - RNA, 24 nt, Human
cggagcccaagacgcgaagagggu

SEQ ID NO: 64870 - RNA, 20 nt, Human
cggcggcggcaggagcagcg

SEQ ID NO: 64871 - RNA, 22 nt, Human
cgggggccccuggauccaggcu

SEQ ID NO: 64872 - RNA, 21 nt, Human
cggguccaggcugcgggucug

SEQ ID NO: 64873 - RNA, 23 nt, Human
cgguagccugguggcccuggggg

SEQ ID NO: 64874 - RNA, 19 nt, Human
cuccaaagacugcgugccc

SEQ ID NO: 64875 - RNA, 23 nt, Human
cucccugguccgugggugucucc

SEQ ID NO: 64876 - RNA, 21 nt, Human
cuccucccucccuggacgcug

SEQ ID NO: 64877 - RNA, 21 nt, Human
cucgcuggguucccagcucca

SEQ ID NO: 64878 - RNA, 21 nt, Human
cucugggcaugcguuuauuuc

SEQ ID NO: 64879 - RNA, 22 nt, Human
cugcacucucuccuugccccgg

SEQ ID NO: 64880 - RNA, 18 nt, Human
cugcagcaugucagggcu

SEQ ID NO: 64881 - RNA, 19 nt, Human
cugcagggacccucccagc

SEQ ID NO: 64882 - RNA, 22 nt, Human
cugcgcccgggaccuccaaaga

SEQ ID NO: 64883 - RNA, 25 nt, Human
cugcugcucucgcucggcugcuugg

SEQ ID NO: 64884 - RNA, 23 nt, Human
cugcuggucaaaaauaguuaugc

SEQ ID NO: 64885 - RNA, 23 nt, Human
cugcuggucaaaaauaguuaugc

SEQ ID NO: 64886 - RNA, 21 nt, Human
cuggagccaccuccuaggaga

SEQ ID NO: 64887 - RNA, 24 nt, Human
cugggcuggagggcggggggcucg

SEQ ID NO: 64888 - RNA, 24 nt, Human
cugggcuggagggcggggggcucg

SEQ ID NO: 64889 - RNA, 24 nt, Human
cuggggaccuccugcagccgcuag

SEQ ID NO: 64890 - RNA, 19 nt, Human
cuugaaaacuucaaacuac

SEQ ID NO: 64891 - RNA, 21 nt, Human
cuuugggucgggaaccgaaag

SEQ ID NO: 64892 - RNA, 19 nt, Human
gaaaacuucaaacuacuaa

SEQ ID NO: 64893 - RNA, 19 nt, Human
gaaaacuucaaacuacuaa

SEQ ID NO: 64894 - RNA, 19 nt, Human
gaaaucaccccauaaauua

SEQ ID NO: 64895 - RNA, 20 nt, Human
gaagagggucaggaagagga

SEQ ID NO: 64896 - RNA, 21 nt, Human
gaagaugccauuggggccucc

SEQ ID NO: 64897 - RNA, 18 nt, Human
gacaccgcagggugggcc

SEQ ID NO: 64898 - RNA, 20 nt, Human
gacaggagcucccagaucug

SEQ ID NO: 64899 - RNA, 19 nt, Human
gacccaggggaaccucaua

SEQ ID NO: 64900 - RNA, 18 nt, Human
gacugggcucgccauacc

SEQ ID NO: 64901 - RNA, 20 nt, Human
gagaagcccuuggccgaggc

SEQ ID NO: 64902 - RNA, 19 nt, Human
gaggacagucccgagggcc

SEQ ID NO: 64903 - RNA, 20 nt, Human
gagggucaggaagaggagga

SEQ ID NO: 64904 - RNA, 18 nt, Human
gaugcuggagggaaaaag

SEQ ID NO: 64905 - RNA, 22 nt, Human
gauuauggggcaaagggaaaaa

SEQ ID NO: 64906 - RNA, 22 nt, Human
gauuauggggcaaagggaaaaa

SEQ ID NO: 64907 - RNA, 21 nt, Human
gcccagggcgguggagagcaa

SEQ ID NO: 64908 - RNA, 21 nt, Human
gccgagacucucggcugggag

SEQ ID NO: 64909 - RNA, 18 nt, Human
gccgcccgaggacagucc

SEQ ID NO: 64910 - RNA, 18 nt, Human
gccgcgacccaggggaac

SEQ ID NO: 64911 - RNA, 21 nt, Human
gccgcuagaaccuuccuccgg

SEQ ID NO: 64912 - RNA, 18 nt, Human
gccucgucgcucccgcag

SEQ ID NO: 64913 - RNA, 20 nt, Human
gccucuaagacuccagcaag

SEQ ID NO: 64914 - RNA, 19 nt, Human
gccugaguccuccgagccc

SEQ ID NO: 64915 - RNA, 27 nt, Human
gcgcucagcgcucuccguggaggaggg

SEQ ID NO: 64916 - RNA, 21 nt, Human
gcgguggagagcaaagcccag

SEQ ID NO: 64917 - RNA, 22 nt, Human
gcgugagugcucuaccucugua

SEQ ID NO: 64918 - RNA, 22 nt, Human
gcgugagugcucuaccucugua

SEQ ID NO: 64919 - RNA, 21 nt, Human
gcgugcugcaggcgcgcgaca

SEQ ID NO: 64920 - RNA, 23 nt, Human
gcucaguuuuuucugcgugaccu

SEQ ID NO: 64921 - RNA, 22 nt, Human
gcuccaagugccccggcggcgg

SEQ ID NO: 64922 - RNA, 19 nt, Human
gcucgccauaccuuccucu

SEQ ID NO: 64923 - RNA, 21 nt, Human
gcugcucucgcucggcugcuu

SEQ ID NO: 64924 - RNA, 18 nt, Human
gcuguggagcaggcucug

SEQ ID NO: 64925 - RNA, 21 nt, Human
gcuguggagcaggcucugcgc

SEQ ID NO: 64926 - RNA, 21 nt, Human
gcuugucaucccucccacucc

SEQ ID NO: 64927 - RNA, 22 nt, Human
ggaaaaggaaacuuccgacugc

SEQ ID NO: 64928 - RNA, 24 nt, Human
ggaagaggaggaggaaggucaggc

SEQ ID NO: 64929 - RNA, 18 nt, Human
ggagaagcgaagaugcca

SEQ ID NO: 64930 - RNA, 19 nt, Human
ggagaaggacgagcaaaga

SEQ ID NO: 64931 - RNA, 20 nt, Human
ggcaaaagcacagaaacccg

SEQ ID NO: 64932 - RNA, 20 nt, Human
ggcaaaagcacagaaacccg

SEQ ID NO: 64933 - RNA, 18 nt, Human
ggcacugagguguggccc

SEQ ID NO: 64934 - RNA, 18 nt, Human
ggcaggagcagcagaucc

SEQ ID NO: 64935 - RNA, 24 nt, Human
ggcagggggggcucggcugggugc

SEQ ID NO: 64936 - RNA, 24 nt, Human
ggcagggggggcucggcugggugc

SEQ ID NO: 64937 - RNA, 18 nt, Human
ggccaggacagaaggcag

SEQ ID NO: 64938 - RNA, 21 nt, Human
ggccugaguccuccgagcccc

SEQ ID NO: 64939 - RNA, 20 nt, Human
ggcggggcugcaccugagga

SEQ ID NO: 64940 - RNA, 19 nt, Human
ggcgugcgcccagggcgcg

SEQ ID NO: 64941 - RNA, 21 nt, Human
ggcugcgggucuggcgcagcu

SEQ ID NO: 64942 - RNA, 18 nt, Human
gggcagggcaucggggug

SEQ ID NO: 64943 - RNA, 18 nt, Human
gggcuggagggcgggggg

SEQ ID NO: 64944 - RNA, 18 nt, Human
gggcuggagggcgggggg

SEQ ID NO: 64945 - RNA, 22 nt, Human
ggggccccuggauccaggcugc

SEQ ID NO: 64946 - RNA, 19 nt, Human
ggugcgggcucagaccagc

SEQ ID NO: 64947 - RNA, 21 nt, Human
guggagaaggacgagcaaaga

SEQ ID NO: 64948 - RNA, 22 nt, Human
guggagaaggacgagcaaagag

SEQ ID NO: 64949 - RNA, 22 nt, Human
uaacagcaguaauuggguggca

SEQ ID NO: 64950 - RNA, 23 nt, Human
uaacgugggacggacaacuucuu

SEQ ID NO: 64951 - RNA, 23 nt, Human
uaacgugggacggacaacuucuu

SEQ ID NO: 64952 - RNA, 22 nt, Human
uaagaaacaccacugggaauuu

SEQ ID NO: 64953 - RNA, 22 nt, Human
uaagaaacaccacugggaauuu

SEQ ID NO: 64954 - RNA, 23 nt, Human
uaaggggagaugucuccgcugga

SEQ ID NO: 64955 - RNA, 18 nt, Human
uaagugugccaguggcca

SEQ ID NO: 64956 - RNA, 18 nt, Human
uaagugugccaguggcca

SEQ ID NO: 64957 - RNA, 22 nt, Human
uacacaauagucaaaaccgaag

SEQ ID NO: 64958 - RNA, 22 nt, Human
uacacaauagucaaaaccgaag

SEQ ID NO: 64959 - RNA, 18 nt, Human
uacauaaucuguuacaga

SEQ ID NO: 64960 - RNA, 18 nt, Human
uacauaaucuguuacaga

SEQ ID NO: 64961 - RNA, 21 nt, Human
uaccucuguaggugaacugga

SEQ ID NO: 64962 - RNA, 21 nt, Human
uaccucuguaggugaacugga

SEQ ID NO: 64963 - RNA, 24 nt, Human
uacgcaauggaaccuuauucucaa

SEQ ID NO: 64964 - RNA, 24 nt, Human
uacgcaauggaaccuuauucucaa

SEQ ID NO: 64965 - RNA, 21 nt, Human
uagaacauucuauagaaucuc

SEQ ID NO: 64966 - RNA, 21 nt, Human
uagaacauucuauagaaucuc

SEQ ID NO: 64967 - RNA, 21 nt, Human
uagccugguggcccugggggg

SEQ ID NO: 64968 - RNA, 19 nt, Human
uaguagguucagcuuguuu

SEQ ID NO: 64969 - RNA, 18 nt, Human
uaguauaucucauugcuu

SEQ ID NO: 64970 - RNA, 18 nt, Human
uaguauaucucauugcuu

SEQ ID NO: 64971 - RNA, 23 nt, Human
uaugcaacccaaauccaguauac

SEQ ID NO: 64972 - RNA, 18 nt, Human
ucaaacuacuaaaguacg

SEQ ID NO: 64973 - RNA, 20 nt, Human
ucaauggcgggggcgugagu

SEQ ID NO: 64974 - RNA, 20 nt, Human
ucaauggcgggggcgugagu

SEQ ID NO: 64975 - RNA, 21 nt, Human
ucagaccagcgucucgggcag

SEQ ID NO: 64976 - RNA, 22 nt, Human
ucaggaagaggaggaggaaggu

SEQ ID NO: 64977 - RNA, 19 nt, Human
ucaggagacagccccaagg

SEQ ID NO: 64978 - RNA, 19 nt, Human
ucagggcuuccuuagcugg

SEQ ID NO: 64979 - RNA, 19 nt, Human
ucauacaacuccaacucgg

SEQ ID NO: 64980 - RNA, 23 nt, Human
uccaggugaaaucacccugauuu

SEQ ID NO: 64981 - RNA, 22 nt, Human
ucccacgauaccuuuuguugcc

SEQ ID NO: 64982 - RNA, 24 nt, Human
ucccagauaucugagacuuggagu

SEQ ID NO: 64983 - RNA, 25 nt, Human
ucccccaggcgcggacuguccugcu

SEQ ID NO: 64984 - RNA, 20 nt, Human
uccccgcgcacugcccuccg

SEQ ID NO: 64985 - RNA, 22 nt, Human
uccccgcgcacugcccuccgcg

SEQ ID NO: 64986 - RNA, 19 nt, Human
ucccuggacgcugguggcu

SEQ ID NO: 64987 - RNA, 20 nt, Human
uccgcuacugugaaucuugg

SEQ ID NO: 64988 - RNA, 20 nt, Human
uccgucgcgggggcugcggc

SEQ ID NO: 64989 - RNA, 18 nt, Human
uccugggucuuuggaucc

SEQ ID NO: 64990 - RNA, 21 nt, Human
uccugggucuuuggauccgcu

SEQ ID NO: 64991 - RNA, 21 nt, Human
uccugggucuuuggauccgcu

SEQ ID NO: 64992 - RNA, 18 nt, Human
ucucggcggggcugcacc

SEQ ID NO: 64993 - RNA, 21 nt, Human
ucugacagaucuuucccaagc

SEQ ID NO: 64994 - RNA, 23 nt, Human
ucugcagcccggccacauccagc

SEQ ID NO: 64995 - RNA, 19 nt, Human
ucugcgugaccugcugcuc

SEQ ID NO: 64996 - RNA, 20 nt, Human
ucugggaagcucaaucgcuc

SEQ ID NO: 64997 - RNA, 20 nt, Human
ucuguaaagcuucuccgagc

SEQ ID NO: 64998 - RNA, 23 nt, Human
ugaaaaaaaauugcauaaaauac

SEQ ID NO: 64999 - RNA, 23 nt, Human
ugaaaaaaaauugcauaaaauac

SEQ ID NO: 65000 - RNA, 22 nt, Human
ugaaaucacccugauuucuaag

SEQ ID NO: 65001 - RNA, 24 nt, Human
ugaaauggcagaucauauugaaug

SEQ ID NO: 65002 - RNA, 19 nt, Human
ugaaugccaaguuccccag

SEQ ID NO: 65003 - RNA, 20 nt, Human
ugaaugucugagaaauggcc

SEQ ID NO: 65004 - RNA, 25 nt, Human
ugacucccacgauaccuuuuguugc

SEQ ID NO: 65005 - RNA, 22 nt, Human
ugagaaauggcccagcuggcau

SEQ ID NO: 65006 - RNA, 24 nt, Human
ugagccgggcgccugagcugcgcc

SEQ ID NO: 65007 - RNA, 24 nt, Human
ugaggaccaccuccuccucccucc

SEQ ID NO: 65008 - RNA, 19 nt, Human
ugcauccugaaauggcaga

SEQ ID NO: 65009 - RNA, 18 nt, Human
ugcccuccgcgcccgccu

SEQ ID NO: 65010 - RNA, 19 nt, Human
ugccgcccgaggacagucc

SEQ ID NO: 65011 - RNA, 19 nt, Human
ugccugggcgugcgcccag

SEQ ID NO: 65012 - RNA, 19 nt, Human
ugccugggcgugcgcccag

SEQ ID NO: 65013 - RNA, 18 nt, Human
ugcguuuauuucccagau

SEQ ID NO: 65014 - RNA, 21 nt, Human
ugcugcaguguggggacaccg

SEQ ID NO: 65015 - RNA, 21 nt, Human
uggagagcaaagcccagcuca

SEQ ID NO: 65016 - RNA, 22 nt, Human
uggagggaaaaagaaucagcug

SEQ ID NO: 65017 - RNA, 19 nt, Human
uggcacugagguguggccc

SEQ ID NO: 65018 - RNA, 18 nt, Human
uggcccagcuggcauagc

SEQ ID NO: 65019 - RNA, 28 nt, Human
uggccucuaagacuccagcaagcuccuu

SEQ ID NO: 65020 - RNA, 18 nt, Human
uggccugcagggacccuc

SEQ ID NO: 65021 - RNA, 18 nt, Human
ugggcuggagggcggggg

SEQ ID NO: 65022 - RNA, 18 nt, Human
ugggcuggagggcggggg

SEQ ID NO: 65023 - RNA, 19 nt, Human
ugggcuggagggcgggggg

SEQ ID NO: 65024 - RNA, 19 nt, Human
ugggcuggagggcgggggg

SEQ ID NO: 65025 - RNA, 20 nt, Human
ugggcuggagggcggggggc

SEQ ID NO: 65026 - RNA, 20 nt, Human
ugggcuggagggcggggggc

SEQ ID NO: 65027 - RNA, 21 nt, Human
ugggcuggagggcggggggcu

SEQ ID NO: 65028 - RNA, 21 nt, Human
ugggcuggagggcggggggcu

SEQ ID NO: 65029 - RNA, 18 nt, Human
ugggugcgggcucagacc

SEQ ID NO: 65030 - RNA, 20 nt, Human
ugguuuugugccuaagaucu

SEQ ID NO: 65031 - RNA, 20 nt, Human
ugguuuugugccuaagaucu

SEQ ID NO: 65032 - RNA, 23 nt, Human
uguuuucucuuugugaauauauc

SEQ ID NO: 65033 - RNA, 23 nt, Human
uguuuucucuuugugaauauauc

SEQ ID NO: 65034 - RNA, 18 nt, Human
uuccuaggaugcuggagg

SEQ ID NO: 65035 - RNA, 27 nt, Human
uuccuguccuuucagaacagaggcugg

SEQ ID NO: 65036 - RNA, 23 nt, Human
uugcccagggcgguggagagcaa

SEQ ID NO: 65037 - RNA, 24 nt, Human
uugcugcaguguggggacaccgag

SEQ ID NO: 65038 - RNA, 21 nt, Human
uuggaguguggccugcaggga

SEQ ID NO: 65039 - RNA, 22 nt, Human
uuggauacuaacacuauuuggu

SEQ ID NO: 65040 - RNA, 18 nt, Human
uugggucgggaaccgaaa

SEQ ID NO: 65041 - RNA, 18 nt, Human
uugguucuggaagguugu

SEQ ID NO: 65042 - RNA, 19 nt, Human
uuuggcaaauacugauuau

SEQ ID NO: 65043 - RNA, 19 nt, Human
uuuggcaaauacugauuau

SEQ ID NO: 65044 - RNA, 21 nt, Human
uuuguaguuuugaaaaauaca

SEQ ID NO: 65045 - RNA, 21 nt, Human
uuuguaguuuugaaaaauaca

SEQ ID NO: 65046 - RNA, 18 nt, Human
uuuuuuuuuuuuuuuuug

SEQ ID NO: 65047 - RNA, 18 nt, Human
uuuuuuuuuuuuuuuuug

SEQ ID NO: 65048 - RNA, 21 nt, Human
uuuuuuuuuuuuuuuuugcuu

SEQ ID NO: 65049 - RNA, 25 nt, Human
uuuuuuuuuuuuuuuuuuugcuuaa

SEQ ID NO: 65050 - RNA, 23 nt, Human
aaccuggggggcacagaaagggc

SEQ ID NO: 65051 - RNA, 19 nt, Human
acucgguugagccaggcca

SEQ ID NO: 65052 - RNA, 22 nt, Human
agaccggggauggggcggggga

SEQ ID NO: 65053 - RNA, 24 nt, Human
agacgcacacguccaggggcaacc

SEQ ID NO: 65054 - RNA, 20 nt, Human
agcagaggccuggcugcggc

SEQ ID NO: 65055 - RNA, 25 nt, Human
aggaggcugggccuguggguggggg

SEQ ID NO: 65056 - RNA, 21 nt, Human
aggccccacgguacacuccac

SEQ ID NO: 65057 - RNA, 24 nt, Human
aggcugggccugugggugggggag

SEQ ID NO: 65058 - RNA, 22 nt, Human
agggacggggaggccacaugcu

SEQ ID NO: 65059 - RNA, 18 nt, Human
agggccugucagcacuuu

SEQ ID NO: 65060 - RNA, 21 nt, Human
aggggggucggaggcacucgg

SEQ ID NO: 65061 - RNA, 19 nt, Human
caacacgaagaccggggau

SEQ ID NO: 65062 - RNA, 21 nt, Human
caagcuuagccugggucggga

SEQ ID NO: 65063 - RNA, 20 nt, Human
cacaacacgaagaccgggga

SEQ ID NO: 65064 - RNA, 18 nt, Human
cacaccccagcuccaccc

SEQ ID NO: 65065 - RNA, 23 nt, Human
cagaagcagcaacgagacaggag

SEQ ID NO: 65066 - RNA, 21 nt, Human
cagacacaacacgaagaccgg

SEQ ID NO: 65067 - RNA, 20 nt, Human
cagcacaccccacguguccc

SEQ ID NO: 65068 - RNA, 22 nt, Human
cagcacaccccacgugucccug

SEQ ID NO: 65069 - RNA, 24 nt, Human
cagcacaccccacgugucccuggg

SEQ ID NO: 65070 - RNA, 20 nt, Human
cagcagaggccuggcugcgg

SEQ ID NO: 65071 - RNA, 23 nt, Human
cagcuccaccccggagcagcaga

SEQ ID NO: 65072 - RNA, 19 nt, Human
caggacaauacccagccuc

SEQ ID NO: 65073 - RNA, 19 nt, Human
caggggcaaccacggggcc

SEQ ID NO: 65074 - RNA, 23 nt, Human
cagggugggaggggcacggaggg

SEQ ID NO: 65075 - RNA, 19 nt, Human
cagguggggugggugaggc

SEQ ID NO: 65076 - RNA, 24 nt, Human
caucaugguuagacgggaccgaca

SEQ ID NO: 65077 - RNA, 22 nt, Human
ccagggaggcggaccagggugg

SEQ ID NO: 65078 - RNA, 21 nt, Human
cccacaccccagcuccacccc

SEQ ID NO: 65079 - RNA, 18 nt, Human
cccacagcacaggcagaa

SEQ ID NO: 65080 - RNA, 20 nt, Human
ccccaagccgccggagccau

SEQ ID NO: 65081 - RNA, 18 nt, Human
cccugcccgccucuggcu

SEQ ID NO: 65082 - RNA, 22 nt, Human
ccgcugagacagaaaaggcaga

SEQ ID NO: 65083 - RNA, 23 nt, Human
ccggggauggggcgggggaggca

SEQ ID NO: 65084 - RNA, 19 nt, Human
ccucgggugugacggggag

SEQ ID NO: 65085 - RNA, 20 nt, Human
ccuggcugggcccagguggg

SEQ ID NO: 65086 - RNA, 18 nt, Human
ccuguccagggaaggggg

SEQ ID NO: 65087 - RNA, 18 nt, Human
ccugugggugggggaggg

SEQ ID NO: 65088 - RNA, 20 nt, Human
ccuuguuuguuccuggcugg

SEQ ID NO: 65089 - RNA, 18 nt, Human
cggggauggggcggggga

SEQ ID NO: 65090 - RNA, 23 nt, Human
cguccaggggcaaccacggggcc

SEQ ID NO: 65091 - RNA, 23 nt, Human
cuccgcucccuccugaagccagg

SEQ ID NO: 65092 - RNA, 18 nt, Human
cuccuggcugggcccagg

SEQ ID NO: 65093 - RNA, 19 nt, Human
cugcggccucucuccccca

SEQ ID NO: 65094 - RNA, 22 nt, Human
cuggaggacggcccggccccca

SEQ ID NO: 65095 - RNA, 24 nt, Human
cuggcugggcccaggugggguggg

SEQ ID NO: 65096 - RNA, 24 nt, Human
cuugggggggugugggcucugggc

SEQ ID NO: 65097 - RNA, 18 nt, Human
gaccgaggaggcugggcc

SEQ ID NO: 65098 - RNA, 23 nt, Human
gagcagcagacgcacacguccag

SEQ ID NO: 65099 - RNA, 21 nt, Human
gaggaggcugggccugugggu

SEQ ID NO: 65100 - RNA, 18 nt, Human
gcagcagcagcacacccc

SEQ ID NO: 65101 - RNA, 21 nt, Human
gcaggacaauacccagccucc

SEQ ID NO: 65102 - RNA, 22 nt, Human
gccaggccaguggcccagggac

SEQ ID NO: 65103 - RNA, 18 nt, Human
gccaggcggggcuccugg

SEQ ID NO: 65104 - RNA, 19 nt, Human
gcgguucaggaucccuccc

SEQ ID NO: 65105 - RNA, 23 nt, Human
gcugggcccagguggggugggug

SEQ ID NO: 65106 - RNA, 22 nt, Human
ggaggggaggggcuggggggga

SEQ ID NO: 65107 - RNA, 21 nt, Human
ggcagcagaggccuggcugcg

SEQ ID NO: 65108 - RNA, 20 nt, Human
ggccaggcggggcuccuggc

SEQ ID NO: 65109 - RNA, 18 nt, Human
ggcccggcccccacgagg

SEQ ID NO: 65110 - RNA, 18 nt, Human
ggcugaggaggggggucg

SEQ ID NO: 65111 - RNA, 23 nt, Human
ggcugaggaggggggucggaggc

SEQ ID NO: 65112 - RNA, 24 nt, Human
ggcugggcccagguggggugggug

SEQ ID NO: 65113 - RNA, 18 nt, Human
gggauggggcgggggagg

SEQ ID NO: 65114 - RNA, 24 nt, Human
gggauggggcgggggaggcacagg

SEQ ID NO: 65115 - RNA, 21 nt, Human
gggcagcagaggccuggcugc

SEQ ID NO: 65116 - RNA, 24 nt, Human
gggcccagguggggugggggacuc

SEQ ID NO: 65117 - RNA, 22 nt, Human
gggcucuugggggggugugggc

SEQ ID NO: 65118 - RNA, 19 nt, Human
gggcuggggagcagcagca

SEQ ID NO: 65119 - RNA, 21 nt, Human
ggggagggcugaggagggggg

SEQ ID NO: 65120 - RNA, 21 nt, Human
ggggauggggcgggggaggca

SEQ ID NO: 65121 - RNA, 19 nt, Human
ggggcgggggaggcacagg

SEQ ID NO: 65122 - RNA, 20 nt, Human
gguauggggaggggaggggc

SEQ ID NO: 65123 - RNA, 18 nt, Human
gucccuuguuuguuccug

SEQ ID NO: 65124 - RNA, 25 nt, Human
uacccagccuccuggaugguacuga

SEQ ID NO: 65125 - RNA, 21 nt, Human
uagacgggaccgacagcgaca

SEQ ID NO: 65126 - RNA, 19 nt, Human
uauggggaggggaggggcu

SEQ ID NO: 65127 - RNA, 20 nt, Human
ucagaaaagaagcagggaca

SEQ ID NO: 65128 - RNA, 21 nt, Human
ucaggggcauuuauuucccgg

SEQ ID NO: 65129 - RNA, 23 nt, Human
uccaggggcaaccacggggccug

SEQ ID NO: 65130 - RNA, 22 nt, Human
ucccacaccccagcuccacccc

SEQ ID NO: 65131 - RNA, 23 nt, Human
ucccccacagcacaggcagaagc

SEQ ID NO: 65132 - RNA, 20 nt, Human
ucuccacagcccuguccagg

SEQ ID NO: 65133 - RNA, 22 nt, Human
ugagagccugggggaacaggcg

SEQ ID NO: 65134 - RNA, 18 nt, Human
ugagccuggcagacacaa

SEQ ID NO: 65135 - RNA, 21 nt, Human
ugcggccucucucccccacag

SEQ ID NO: 65136 - RNA, 20 nt, Human
ugcucaugcagacacaggga

SEQ ID NO: 65137 - RNA, 18 nt, Human
uggaugguacugagguga

SEQ ID NO: 65138 - RNA, 25 nt, Human
uggccaggcacuggugggcugggga

SEQ ID NO: 65139 - RNA, 23 nt, Human
uggcccagggacggcacggacgg

SEQ ID NO: 65140 - RNA, 19 nt, Human
ugggcucugggcacugccc

SEQ ID NO: 65141 - RNA, 19 nt, Human
uggggaggggaggggcugg

SEQ ID NO: 65142 - RNA, 21 nt, Human
uggggaggggaggggcugggg

SEQ ID NO: 65143 - RNA, 23 nt, Human
ugggggggugugggcucugggca

SEQ ID NO: 65144 - RNA, 24 nt, Human
ugguauggggaggggaggggcugg

SEQ ID NO: 65145 - RNA, 21 nt, Human
ugguggcacugagagccuggg

SEQ ID NO: 65146 - RNA, 19 nt, Human
uuccuggcugggucaggga

SEQ ID NO: 65147 - RNA, 18 nt, Human
uugguauggggaggggag

SEQ ID NO: 65148 - RNA, 19 nt, Human
uuggucccuuguuuguucc

SEQ ID NO: 65149 - RNA, 25 nt, Human
uuuuuuuuuuuuuuuccuucagggg

SEQ ID NO: 65150 - RNA, 20 nt, Human
aagaagaacucccucuggca

SEQ ID NO: 65151 - RNA, 20 nt, Human
accacguugagugacagggu

SEQ ID NO: 65152 - RNA, 24 nt, Human
accacguugagugacaggguggga

SEQ ID NO: 65153 - RNA, 25 nt, Human
accuacuugaagaggaaacccuggc

SEQ ID NO: 65154 - RNA, 24 nt, Human
agagggacccagcuguggacaggg

SEQ ID NO: 65155 - RNA, 23 nt, Human
agccucuuguucuagggaccacg

SEQ ID NO: 65156 - RNA, 20 nt, Human
agugacagggugggaaaaga

SEQ ID NO: 65157 - RNA, 19 nt, Human
cagcaacaaccacaaaaga

SEQ ID NO: 65158 - RNA, 20 nt, Human
caguuagaacaggaaggaag

SEQ ID NO: 65159 - RNA, 22 nt, Human
cuaggcauuagaaugaacuacu

SEQ ID NO: 65160 - RNA, 21 nt, Human
cuuccagguggcaaggguggg

SEQ ID NO: 65161 - RNA, 18 nt, Human
gaaacccuggcucgugcc

SEQ ID NO: 65162 - RNA, 22 nt, Human
gaaugaacuacuggaaccugag

SEQ ID NO: 65163 - RNA, 19 nt, Human
gacagggaggagggacagg

SEQ ID NO: 65164 - RNA, 22 nt, Human
gacagggaggagggacagggug

SEQ ID NO: 65165 - RNA, 19 nt, Human
gccagcaacaaccacaaaa

SEQ ID NO: 65166 - RNA, 21 nt, Human
gcccgguuuuaagccucuugu

SEQ ID NO: 65167 - RNA, 19 nt, Human
ggacagggaggagggacag

SEQ ID NO: 65168 - RNA, 19 nt, Human
ggaggagggacagggugcu

SEQ ID NO: 65169 - RNA, 20 nt, Human
ggcaggggaugugacuaggg

SEQ ID NO: 65170 - RNA, 23 nt, Human
ggguaagacagggaaauauuaaa

SEQ ID NO: 65171 - RNA, 18 nt, Human
guugagugacaggguggg

SEQ ID NO: 65172 - RNA, 19 nt, Human
uaaggaaauguggcagugu

SEQ ID NO: 65173 - RNA, 25 nt, Human
uauucuuguucucuugugucguuua

SEQ ID NO: 65174 - RNA, 18 nt, Human
ucucucacaaaagaagaa

SEQ ID NO: 65175 - RNA, 20 nt, Human
ugaagaggaaacccuggcuc

SEQ ID NO: 65176 - RNA, 20 nt, Human
ugagagaauucuuccaggug

SEQ ID NO: 65177 - RNA, 21 nt, Human
uggagacguggaagaucuggc

SEQ ID NO: 65178 - RNA, 19 nt, Human
uggcaggggaugugacuag

SEQ ID NO: 65179 - RNA, 22 nt, Human
uguguacugagauggagacgug

SEQ ID NO: 65180 - RNA, 23 nt, Human
ugugucguuuacagugucucuca

SEQ ID NO: 65181 - RNA, 21 nt, Human
uugaagaggaaacccuggcuc

SEQ ID NO: 65182 - RNA, 24 nt, Human
uugggugaaagcccgguuuuaagc

SEQ ID NO: 65183 - RNA, 18 nt, Human
aaaaacagagcgaaggca

SEQ ID NO: 65184 - RNA, 21 nt, Human
aagcagagggcaggagggaga

SEQ ID NO: 65185 - RNA, 22 nt, Human
agagggcaggagggagagaugg

SEQ ID NO: 65186 - RNA, 25 nt, Human
agagggcaggagggagagauggccg

SEQ ID NO: 65187 - RNA, 21 nt, Human
agcccugagucccccaagcag

SEQ ID NO: 65188 - RNA, 18 nt, Human
agcugugugggugggggu

SEQ ID NO: 65189 - RNA, 18 nt, Human
cacuugggggugggggug

SEQ ID NO: 65190 - RNA, 23 nt, Human
cacuuggggguggggguggaggg

SEQ ID NO: 65191 - RNA, 19 nt, Human
cagaauggagcccugaguc

SEQ ID NO: 65192 - RNA, 22 nt, Human
cagcucccucuccucaggcccc

SEQ ID NO: 65193 - RNA, 24 nt, Human
cagcugggccccucccaggcgugg

SEQ ID NO: 65194 - RNA, 24 nt, Human
cagcugggccccucccaggcgugg

SEQ ID NO: 65195 - RNA, 18 nt, Human
cccagcugggccccuccc

SEQ ID NO: 65196 - RNA, 22 nt, Human
cccccacaggcaauacugagau

SEQ ID NO: 65197 - RNA, 18 nt, Human
cccccauuccucuccuuc

SEQ ID NO: 65198 - RNA, 24 nt, Human
cccccauuccucuccuucuugcaa

SEQ ID NO: 65199 - RNA, 22 nt, Human
cucccaggcguggcccacagcu

SEQ ID NO: 65200 - RNA, 18 nt, Human
cugugugggugggggugg

SEQ ID NO: 65201 - RNA, 19 nt, Human
cuuggggguggggguggag

SEQ ID NO: 65202 - RNA, 22 nt, Human
cuuggggguggggguggagggg

SEQ ID NO: 65203 - RNA, 19 nt, Human
gcagcuguguggguggggg

SEQ ID NO: 65204 - RNA, 20 nt, Human
gccccucccaggcguggcca

SEQ ID NO: 65205 - RNA, 18 nt, Human
gcccugagucccccaagc

SEQ ID NO: 65206 - RNA, 22 nt, Human
gcgaaggcacuugggggugggg

SEQ ID NO: 65207 - RNA, 18 nt, Human
ggcucugcaaggcuggug

SEQ ID NO: 65208 - RNA, 20 nt, Human
ggggguggggguggaggggu

SEQ ID NO: 65209 - RNA, 18 nt, Human
gggguggggguggagggg

SEQ ID NO: 65210 - RNA, 18 nt, Human
guccucucccccauuccu

SEQ ID NO: 65211 - RNA, 19 nt, Human
uaaaaaauaaacccuccaa

SEQ ID NO: 65212 - RNA, 20 nt, Human
uaaaaaauaaacccuccaau

SEQ ID NO: 65213 - RNA, 22 nt, Human
uauaaaaacagagcgaaggcac

SEQ ID NO: 65214 - RNA, 21 nt, Human
ucccucacguccucuccccca

SEQ ID NO: 65215 - RNA, 20 nt, Human
ugagauggcccgggucaccg

SEQ ID NO: 65216 - RNA, 18 nt, Human
ugcggcagcugugugggu

SEQ ID NO: 65217 - RNA, 21 nt, Human
uggagcccugagucccccaag

SEQ ID NO: 65218 - RNA, 18 nt, Human
ugggccccucccaggcgu

SEQ ID NO: 65219 - RNA, 20 nt, Human
ugggcucugcaaggcuggug

SEQ ID NO: 65220 - RNA, 24 nt, Human
uggugcccuccagaauggagcccu

SEQ ID NO: 65221 - RNA, 19 nt, Human
uucaggguauaaaaacaga

SEQ ID NO: 65222 - RNA, 24 nt, Human
uugcaaaaggccuuccugggcggg

SEQ ID NO: 65223 - RNA, 24 nt, Human
aaaaaagaaagccaaaaagcucau

SEQ ID NO: 65224 - RNA, 26 nt, Human
aaaaagcucauaaaauauaccuccca

SEQ ID NO: 65225 - RNA, 18 nt, Human
aaaauacagcaaaugccc

SEQ ID NO: 65226 - RNA, 24 nt, Human
aaaauauaccucccaugaaauaca

SEQ ID NO: 65227 - RNA, 24 nt, Human
aaaaucaaauaaacaacaacaaca

SEQ ID NO: 65228 - RNA, 23 nt, Human
aaaccaaaauacagcaaaugccc

SEQ ID NO: 65229 - RNA, 24 nt, Human
aaaccuccagguacuaaaauuuuc

SEQ ID NO: 65230 - RNA, 24 nt, Human
aaagccaggcauacaaacagguua

SEQ ID NO: 65231 - RNA, 23 nt, Human
aaauuacaaguauuucaaaacca

SEQ ID NO: 65232 - RNA, 23 nt, Human
aacaaaacaaggcaaauaaaaau

SEQ ID NO: 65233 - RNA, 20 nt, Human
aacagaaaucuggacauaga

SEQ ID NO: 65234 - RNA, 19 nt, Human
aacagugugcacaugacag

SEQ ID NO: 65235 - RNA, 23 nt, Human
aaggugcuccucccuuccccguc

SEQ ID NO: 65236 - RNA, 23 nt, Human
aagucaaacggaugugacuauaa

SEQ ID NO: 65237 - RNA, 22 nt, Human
aaucccaacccucaauagaaaa

SEQ ID NO: 65238 - RNA, 20 nt, Human
aauuaauuacaggcuccucg

SEQ ID NO: 65239 - RNA, 20 nt, Human
aauuacuaaggacaagacac

SEQ ID NO: 65240 - RNA, 19 nt, Human
aauuucauauccuacaccc

SEQ ID NO: 65241 - RNA, 22 nt, Human
acaacaacaacaacaacuuuuu

SEQ ID NO: 65242 - RNA, 24 nt, Human
acaacaacaacaacaacuuuuuaa

SEQ ID NO: 65243 - RNA, 21 nt, Human
acaaguauuucaaaaccaaaa

SEQ ID NO: 65244 - RNA, 24 nt, Human
acacggccgauacuccaaauccaa

SEQ ID NO: 65245 - RNA, 19 nt, Human
acagaagagagcacagugu

SEQ ID NO: 65246 - RNA, 23 nt, Human
accaaaauacagcaaaugcccag

SEQ ID NO: 65247 - RNA, 20 nt, Human
accaacaccuugccugcagu

SEQ ID NO: 65248 - RNA, 31 nt, Human
accaauuuauuaucaaaacccucaauaccaa

SEQ ID NO: 65249 - RNA, 23 nt, Human
acgacaauggaagaaaacacacc

SEQ ID NO: 65250 - RNA, 21 nt, Human
acgcaguucucaguggugccc

SEQ ID NO: 65251 - RNA, 18 nt, Human
acuccaaauccaacaacc

SEQ ID NO: 65252 - RNA, 23 nt, Human
agaaaaaacuccucugaugguga

SEQ ID NO: 65253 - RNA, 18 nt, Human
agaaacagaaaucuggac

SEQ ID NO: 65254 - RNA, 19 nt, Human
agaugaccaauauuuuguu

SEQ ID NO: 65255 - RNA, 24 nt, Human
agaugaccaauauuuuguuccaga

SEQ ID NO: 65256 - RNA, 23 nt, Human
agccacacggcauagcauaccuu

SEQ ID NO: 65257 - RNA, 21 nt, Human
agccaggcauacaaacagguu

SEQ ID NO: 65258 - RNA, 20 nt, Human
agccuacuggacagcagaga

SEQ ID NO: 65259 - RNA, 21 nt, Human
aggaaaaccaaagaaagucaa

SEQ ID NO: 65260 - RNA, 22 nt, Human
aggcaaaaggaacucuuuucuu

SEQ ID NO: 65261 - RNA, 19 nt, Human
aggcauuucaaaaugugau

SEQ ID NO: 65262 - RNA, 22 nt, Human
aggugcgucauaaaagcuggcc

SEQ ID NO: 65263 - RNA, 19 nt, Human
aggugguucacaggcagau

SEQ ID NO: 65264 - RNA, 18 nt, Human
agucccacucugggcacc

SEQ ID NO: 65265 - RNA, 22 nt, Human
aucaucuuuggacugcagggaa

SEQ ID NO: 65266 - RNA, 20 nt, Human
auggaagaaaacacacccau

SEQ ID NO: 65267 - RNA, 21 nt, Human
auguaucuguaucuguaucua

SEQ ID NO: 65268 - RNA, 22 nt, Human
auugaacugcagggaaagcaaa

SEQ ID NO: 65269 - RNA, 24 nt, Human
caaaaagcucauaaaauauaccuc

SEQ ID NO: 65270 - RNA, 24 nt, Human
caaaacccucaauaccagugggga

SEQ ID NO: 65271 - RNA, 24 nt, Human
caaaauacagcaaaugcccaaagu

SEQ ID NO: 65272 - RNA, 22 nt, Human
caaaggucuaaaacucucacua

SEQ ID NO: 65273 - RNA, 31 nt, Human
caaauaaacaacaacaacaacaacuuuuuuu

SEQ ID NO: 65274 - RNA, 19 nt, Human
caacaaaccugccccacau

SEQ ID NO: 65275 - RNA, 24 nt, Human
caacaaccugcagucaccuccagg

SEQ ID NO: 65276 - RNA, 18 nt, Human
caagaauaacaaauuuau

SEQ ID NO: 65277 - RNA, 24 nt, Human
caaugucuaauguauaauuauaaa

SEQ ID NO: 65278 - RNA, 18 nt, Human
cacagcaggucacuucca

SEQ ID NO: 65279 - RNA, 26 nt, Human
caccaaauuuacuaacaucaaagagg

SEQ ID NO: 65280 - RNA, 21 nt, Human
cacccaaaucccaacccucaa

SEQ ID NO: 65281 - RNA, 21 nt, Human
cacggcauagcauaccuuuga

SEQ ID NO: 65282 - RNA, 19 nt, Human
cacuucauagcaaaggaac

SEQ ID NO: 65283 - RNA, 18 nt, Human
cagaauacaaaguaaaag

SEQ ID NO: 65284 - RNA, 18 nt, Human
cagcacuuugggggcuug

SEQ ID NO: 65285 - RNA, 20 nt, Human
cagcaguaccuguggcuaau

SEQ ID NO: 65286 - RNA, 21 nt, Human
cagccuacuggacagcagaga

SEQ ID NO: 65287 - RNA, 18 nt, Human
caggcauacaaacagguu

SEQ ID NO: 65288 - RNA, 24 nt, Human
caugcaaauacagaguuuuauugu

SEQ ID NO: 65289 - RNA, 21 nt, Human
ccaaaacccaucugauuauac

SEQ ID NO: 65290 - RNA, 21 nt, Human
ccaaagcucuauacauuuggu

SEQ ID NO: 65291 - RNA, 23 nt, Human
ccaaauccaacaaccugcaguca

SEQ ID NO: 65292 - RNA, 22 nt, Human
ccacaugcuagggcaagcccac

SEQ ID NO: 65293 - RNA, 18 nt, Human
ccacccaaaucccaaccc

SEQ ID NO: 65294 - RNA, 19 nt, Human
cccaaaucccaacccucaa

SEQ ID NO: 65295 - RNA, 27 nt, Human
cccaacccucaauagaaaagacgacaa

SEQ ID NO: 65296 - RNA, 22 nt, Human
cccacagaguucagagggcacc

SEQ ID NO: 65297 - RNA, 19 nt, Human
cccacccaaaucccaaccc

SEQ ID NO: 65298 - RNA, 25 nt, Human
cccacccuuuccuuagcaaccccca

SEQ ID NO: 65299 - RNA, 24 nt, Human
cccauccacucucugaccacacca

SEQ ID NO: 65300 - RNA, 23 nt, Human
ccccaccccugccacuauccgaa

SEQ ID NO: 65301 - RNA, 21 nt, Human
ccgauacuccaaauccaacaa

SEQ ID NO: 65302 - RNA, 20 nt, Human
ccucaacuuuucuaauauaa

SEQ ID NO: 65303 - RNA, 19 nt, Human
ccucagggcgggaggaagc

SEQ ID NO: 65304 - RNA, 19 nt, Human
ccuucccaaacucuuuacc

SEQ ID NO: 65305 - RNA, 23 nt, Human
ccuucccaaacucuuuacccacu

SEQ ID NO: 65306 - RNA, 20 nt, Human
cgacuucagagaagaaagcu

SEQ ID NO: 65307 - RNA, 20 nt, Human
cgcaguucucaguggugccc

SEQ ID NO: 65308 - RNA, 18 nt, Human
cgucauaaaagcuggccu

SEQ ID NO: 65309 - RNA, 20 nt, Human
cuacaagcuucuuaauugag

SEQ ID NO: 65310 - RNA, 19 nt, Human
cuauuuucccagaccccag

SEQ ID NO: 65311 - RNA, 26 nt, Human
cucaacuuuucuaauauaacuuggac

SEQ ID NO: 65312 - RNA, 24 nt, Human
cucacaaacagauuagugcagcug

SEQ ID NO: 65313 - RNA, 20 nt, Human
cuccaaauccaacaaccugc

SEQ ID NO: 65314 - RNA, 22 nt, Human
cucugcauccacacuggagcca

SEQ ID NO: 65315 - RNA, 19 nt, Human
cuguaucuguaucuauaua

SEQ ID NO: 65316 - RNA, 19 nt, Human
cuucccaaacucuuuaccc

SEQ ID NO: 65317 - RNA, 20 nt, Human
cuuggacaagacaaaucaac

SEQ ID NO: 65318 - RNA, 21 nt, Human
gaaccauuaagcccacagaag

SEQ ID NO: 65319 - RNA, 23 nt, Human
gcuccucccuuccccgucucacu

SEQ ID NO: 65320 - RNA, 20 nt, Human
ggaaaaaagaaagccaaaaa

SEQ ID NO: 65321 - RNA, 21 nt, Human
ggagaguagagugagggaaug

SEQ ID NO: 65322 - RNA, 22 nt, Human
ggagggaaaagagaaguuaggu

SEQ ID NO: 65323 - RNA, 21 nt, Human
ggccgauacuccaaauccaac

SEQ ID NO: 65324 - RNA, 21 nt, Human
gggcaccaaugaaagauguga

SEQ ID NO: 65325 - RNA, 19 nt, Human
guuaucuucaggugcguca

SEQ ID NO: 65326 - RNA, 23 nt, Human
uaaaaacacagaucaauuuagga

SEQ ID NO: 65327 - RNA, 25 nt, Human
uaaaaacacagaucaauuuaggaca

SEQ ID NO: 65328 - RNA, 20 nt, Human
uaaaacaaaacaaggcaaau

SEQ ID NO: 65329 - RNA, 20 nt, Human
uaaaagacaauucacaggaa

SEQ ID NO: 65330 - RNA, 22 nt, Human
uaagcgagccuucugagcuaaa

SEQ ID NO: 65331 - RNA, 19 nt, Human
uagcuaaaaugcagccugc

SEQ ID NO: 65332 - RNA, 21 nt, Human
uagcuucuaaaaauaauuuuu

SEQ ID NO: 65333 - RNA, 23 nt, Human
uaggacagaaacagaaaucugga

SEQ ID NO: 65334 - RNA, 19 nt, Human
uauauagauauagauauau

SEQ ID NO: 65335 - RNA, 19 nt, Human
uaucaggaaaaaaaugacu

SEQ ID NO: 65336 - RNA, 18 nt, Human
uaugcuucauuuagggua

SEQ ID NO: 65337 - RNA, 21 nt, Human
uauuuuacaaagguacaucug

SEQ ID NO: 65338 - RNA, 23 nt, Human
ucaaaacccucaauaccaguggg

SEQ ID NO: 65339 - RNA, 18 nt, Human
ucaaauuacaaguauuuc

SEQ ID NO: 65340 - RNA, 22 nt, Human
ucaaauuacaaguauuucaaaa

SEQ ID NO: 65341 - RNA, 19 nt, Human
ucaucuuuggacugcaggg

SEQ ID NO: 65342 - RNA, 21 nt, Human
uccacucucugaccacaccac

SEQ ID NO: 65343 - RNA, 25 nt, Human
ucccagaccccagaaaacagaaagu

SEQ ID NO: 65344 - RNA, 19 nt, Human
ucccaggugguucacaggc

SEQ ID NO: 65345 - RNA, 24 nt, Human
ucccuccuaacucaaaaucaaaua

SEQ ID NO: 65346 - RNA, 19 nt, Human
uccgucagccaaaugugcc

SEQ ID NO: 65347 - RNA, 22 nt, Human
uccuuggguguacuaaagacaa

SEQ ID NO: 65348 - RNA, 18 nt, Human
ucgaugguguuaguguca

SEQ ID NO: 65349 - RNA, 23 nt, Human
ucuauuaucccuccuaacucaaa

SEQ ID NO: 65350 - RNA, 19 nt, Human
ucugauuuucucuuuuucu

SEQ ID NO: 65351 - RNA, 23 nt, Human
ugaaauacaauacauaguuacaa

SEQ ID NO: 65352 - RNA, 22 nt, Human
ugaacuagagaaacugaaauuu

SEQ ID NO: 65353 - RNA, 21 nt, Human
ugacucagggcccuuuggcac

SEQ ID NO: 65354 - RNA, 19 nt, Human
ugaggaagcugacugugag

SEQ ID NO: 65355 - RNA, 22 nt, Human
ugaggaagcugacugugaggcc

SEQ ID NO: 65356 - RNA, 24 nt, Human
ugauuugccuugauuaacuguucu

SEQ ID NO: 65357 - RNA, 18 nt, Human
ugcacaaggaaaaccaaa

SEQ ID NO: 65358 - RNA, 18 nt, Human
uggagccaggauguggug

SEQ ID NO: 65359 - RNA, 21 nt, Human
ugguacagguauuucuuuguu

SEQ ID NO: 65360 - RNA, 24 nt, Human
uguauaauuauaaaaaugaaauga

SEQ ID NO: 65361 - RNA, 20 nt, Human
ugugaagaagcccagcacug

SEQ ID NO: 65362 - RNA, 24 nt, Human
ugugggaggccaaguugggaggga

SEQ ID NO: 65363 - RNA, 26 nt, Human
uuacuaacaucaaagaggaaaacaaa

SEQ ID NO: 65364 - RNA, 20 nt, Human
uuagcuucugcuucuaaaau

SEQ ID NO: 65365 - RNA, 24 nt, Human
uuaggguaggauuaaaaccaaagu

SEQ ID NO: 65366 - RNA, 19 nt, Human
uucauuggcaguugcugug

SEQ ID NO: 65367 - RNA, 20 nt, Human
uucauuggcaguugcugugg

SEQ ID NO: 65368 - RNA, 19 nt, Human
uucuuuguacaccaccccu

SEQ ID NO: 65369 - RNA, 20 nt, Human
uuggacugcagggaagcauu

SEQ ID NO: 65370 - RNA, 21 nt, Human
uugggggcuugcugauuugcc

SEQ ID NO: 65371 - RNA, 21 nt, Human
uuucccagaccccagaaaacc

SEQ ID NO: 65372 - RNA, 24 nt, Human
uuugagguccuaugcacgcaguuc

SEQ ID NO: 65373 - RNA, 19 nt, Human
aacagugucugaggguccc

SEQ ID NO: 65374 - RNA, 24 nt, Human
aagucccucgaaaucccccccacc

SEQ ID NO: 65375 - RNA, 22 nt, Human
aaugaugaaagguucccagagu

SEQ ID NO: 65376 - RNA, 19 nt, Human
acaaagcacgaaaggaggc

SEQ ID NO: 65377 - RNA, 20 nt, Human
acaaagcacgaaaggaggcc

SEQ ID NO: 65378 - RNA, 25 nt, Human
accccucuuaaacaucucccuccag

SEQ ID NO: 65379 - RNA, 21 nt, Human
agcccuugccaugagcagcuu

SEQ ID NO: 65380 - RNA, 26 nt, Human
agucccucgaaaucccccccaccaag

SEQ ID NO: 65381 - RNA, 22 nt, Human
caaagucccucgaaaucccccc

SEQ ID NO: 65382 - RNA, 25 nt, Human
caacagugucugagggucggcgucg

SEQ ID NO: 65383 - RNA, 21 nt, Human
caagcacaaagcacgaaagga

SEQ ID NO: 65384 - RNA, 18 nt, Human
cacugaccuugcaccaua

SEQ ID NO: 65385 - RNA, 24 nt, Human
cagaaggccucucuugcaggguuc

SEQ ID NO: 65386 - RNA, 20 nt, Human
cagcucugaaucugcacccu

SEQ ID NO: 65387 - RNA, 26 nt, Human
caggccccaauggucccccuuuuuuu

SEQ ID NO: 65388 - RNA, 19 nt, Human
caggguucuggggccagcc

SEQ ID NO: 65389 - RNA, 18 nt, Human
ccccaauggucccccuuu

SEQ ID NO: 65390 - RNA, 21 nt, Human
ccccccaccaagcacaaagca

SEQ ID NO: 65391 - RNA, 24 nt, Human
cccgaaaaacaacagugucugagg

SEQ ID NO: 65392 - RNA, 21 nt, Human
ccgaaaaacaacagugucuga

SEQ ID NO: 65393 - RNA, 18 nt, Human
ccucgaaaucccccccac

SEQ ID NO: 65394 - RNA, 19 nt, Human
cucacgaaacuccucucag

SEQ ID NO: 65395 - RNA, 23 nt, Human
cucaggccccaauggucccccuu

SEQ ID NO: 65396 - RNA, 18 nt, Human
cucuuaaacaucucccuc

SEQ ID NO: 65397 - RNA, 18 nt, Human
cugaaucugcacccugga

SEQ ID NO: 65398 - RNA, 22 nt, Human
cuuaaacaucucccuccaggag

SEQ ID NO: 65399 - RNA, 21 nt, Human
gaaaucccccccaccaagcac

SEQ ID NO: 65400 - RNA, 18 nt, Human
gagcagcuuguucuucag

SEQ ID NO: 65401 - RNA, 19 nt, Human
gcacaaagcacgaaaggag

SEQ ID NO: 65402 - RNA, 20 nt, Human
gccuaguucuccauccacag

SEQ ID NO: 65403 - RNA, 23 nt, Human
ggccugggccgagggacuggguu

SEQ ID NO: 65404 - RNA, 22 nt, Human
uagaagauaccuuagaggucac

SEQ ID NO: 65405 - RNA, 18 nt, Human
uagaggucaccgggcuga

SEQ ID NO: 65406 - RNA, 18 nt, Human
ucacgaaacuccucucag

SEQ ID NO: 65407 - RNA, 22 nt, Human
ucagcucacgaaacuccucuca

SEQ ID NO: 65408 - RNA, 18 nt, Human
uccaggagacugagguga

SEQ ID NO: 65409 - RNA, 22 nt, Human
uccagugcaaagucccucgaaa

SEQ ID NO: 65410 - RNA, 25 nt, Human
ucccccccaccaagcacaaagcacg

SEQ ID NO: 65411 - RNA, 23 nt, Human
ucccucgaaaucccccccaccaa

SEQ ID NO: 65412 - RNA, 19 nt, Human
ucugcacccuggaggcgga

SEQ ID NO: 65413 - RNA, 19 nt, Human
ucuugaaucugaagagccc

SEQ ID NO: 65414 - RNA, 21 nt, Human
uggggccagcccuugccauga

SEQ ID NO: 65415 - RNA, 23 nt, Human
uguccuuagcuuugagaaggccu

SEQ ID NO: 65416 - RNA, 20 nt, Human
ugucugagggucccggaugu

SEQ ID NO: 65417 - RNA, 19 nt, Human
uuaaugaugaaagguuccc

SEQ ID NO: 65418 - RNA, 19 nt, Human
aaaaaacagaacaacagcc

SEQ ID NO: 65419 - RNA, 19 nt, Human
aaaaugaacaaccaaccaa

SEQ ID NO: 65420 - RNA, 26 nt, Human
aaacaacagcaaaugcccaagcgcgc

SEQ ID NO: 65421 - RNA, 22 nt, Human
aaacacaaaacaaaagccaaag

SEQ ID NO: 65422 - RNA, 21 nt, Human
aaagaggccaauuaauauuac

SEQ ID NO: 65423 - RNA, 18 nt, Human
aaaguuggguucacauuu

SEQ ID NO: 65424 - RNA, 21 nt, Human
aaauaaaaagggcuccucagc

SEQ ID NO: 65425 - RNA, 20 nt, Human
aacaugcauauguacucauc

SEQ ID NO: 65426 - RNA, 25 nt, Human
aaccaaacaacagcaaaugcccaag

SEQ ID NO: 65427 - RNA, 21 nt, Human
aaccaaccaauaaccaaacaa

SEQ ID NO: 65428 - RNA, 22 nt, Human
aaccugugauugaggggaggca

SEQ ID NO: 65429 - RNA, 23 nt, Human
aacuaaaguauuccguaaucaca

SEQ ID NO: 65430 - RNA, 21 nt, Human
aagcacuguuuauuuuuaugu

SEQ ID NO: 65431 - RNA, 20 nt, Human
aagcaugguuaccacucugc

SEQ ID NO: 65432 - RNA, 19 nt, Human
aagggccaaguccccgaaa

SEQ ID NO: 65433 - RNA, 19 nt, Human
aagggcuccucagcaagcu

SEQ ID NO: 65434 - RNA, 24 nt, Human
aaggguacuacaguuuucuugguc

SEQ ID NO: 65435 - RNA, 23 nt, Human
aaguauuccguaaucacaaaaau

SEQ ID NO: 65436 - RNA, 25 nt, Human
aaugaacaaccaaccaauaaccaaa

SEQ ID NO: 65437 - RNA, 18 nt, Human
acaaaacaaaagccaaag

SEQ ID NO: 65438 - RNA, 21 nt, Human
acaaaacaaaagccaaagaag

SEQ ID NO: 65439 - RNA, 23 nt, Human
acaaaaggaauaaggguacuaca

SEQ ID NO: 65440 - RNA, 19 nt, Human
acaaguuagaaaauuugag

SEQ ID NO: 65441 - RNA, 24 nt, Human
acaccacuugguaagguuggcuaa

SEQ ID NO: 65442 - RNA, 21 nt, Human
acagggcaacaggaacccauu

SEQ ID NO: 65443 - RNA, 28 nt, Human
acagggcaacaggaacccauuuauagag

SEQ ID NO: 65444 - RNA, 23 nt, Human
accucagccuccugaguagcugg

SEQ ID NO: 65445 - RNA, 21 nt, Human
acgcacacacauaugcacaca

SEQ ID NO: 65446 - RNA, 22 nt, Human
acugagucaaaucauucagcgg

SEQ ID NO: 65447 - RNA, 18 nt, Human
acugcagccuugaccucc

SEQ ID NO: 65448 - RNA, 22 nt, Human
agaagugagcaaacugagucaa

SEQ ID NO: 65449 - RNA, 21 nt, Human
agaaugagggaaagaaaccua

SEQ ID NO: 65450 - RNA, 26 nt, Human
agagagacucaaacacaaaacaaaag

SEQ ID NO: 65451 - RNA, 19 nt, Human
agcaagcagacaacagccc

SEQ ID NO: 65452 - RNA, 31 nt, Human
agcgcgcacgugcacgcacacacauaugcag

SEQ ID NO: 65453 - RNA, 20 nt, Human
aggcacacuccacccagugg

SEQ ID NO: 65454 - RNA, 18 nt, Human
agguuggagugcaguggu

SEQ ID NO: 65455 - RNA, 22 nt, Human
agugaaggauguuauaucuaaa

SEQ ID NO: 65456 - RNA, 23 nt, Human
agugcaguggugucaucacagcu

SEQ ID NO: 65457 - RNA, 24 nt, Human
agugcaguggugucaucacagcuc

SEQ ID NO: 65458 - RNA, 22 nt, Human
caaaacaaaagccaaagaagug

SEQ ID NO: 65459 - RNA, 23 nt, Human
caaaacccacauuuauaggcauc

SEQ ID NO: 65460 - RNA, 19 nt, Human
caaaagccaaagaagugag

SEQ ID NO: 65461 - RNA, 21 nt, Human
caaacacaaaacaaaagccaa

SEQ ID NO: 65462 - RNA, 22 nt, Human
caaacacaaaacaaaagccaaa

SEQ ID NO: 65463 - RNA, 24 nt, Human
caaacacaaaacaaaagccaaaga

SEQ ID NO: 65464 - RNA, 20 nt, Human
caaaugauccucccaccuca

SEQ ID NO: 65465 - RNA, 27 nt, Human
caaaugauccucccaccucagccuccu

SEQ ID NO: 65466 - RNA, 24 nt, Human
caaaugcccaagcgcgcacgugca

SEQ ID NO: 65467 - RNA, 23 nt, Human
caacacaacuauggcgacacugc

SEQ ID NO: 65468 - RNA, 21 nt, Human
caaccaaccaauaaccaaaca

SEQ ID NO: 65469 - RNA, 28 nt, Human
caagcgcgcacgugcacgcacacacaua

SEQ ID NO: 65470 - RNA, 24 nt, Human
caccaugccuggcuucaaguuugg

SEQ ID NO: 65471 - RNA, 25 nt, Human
cacgugcacgcacacacauaugcac

SEQ ID NO: 65472 - RNA, 19 nt, Human
cacugcagccuugaccucc

SEQ ID NO: 65473 - RNA, 18 nt, Human
cagcacacagcuacuaga

SEQ ID NO: 65474 - RNA, 20 nt, Human
cagccuccugaguagcuggg

SEQ ID NO: 65475 - RNA, 20 nt, Human
cagccuugaccuccugggcu

SEQ ID NO: 65476 - RNA, 23 nt, Human
cagccuugaccuccugggcucaa

SEQ ID NO: 65477 - RNA, 24 nt, Human
cagccuugaccuccugggcucaaa

SEQ ID NO: 65478 - RNA, 24 nt, Human
cagcucacugcagccuugaccucc

SEQ ID NO: 65479 - RNA, 18 nt, Human
caucagaagggccaaguc

SEQ ID NO: 65480 - RNA, 22 nt, Human
ccaaacaacagcaaaugcccaa

SEQ ID NO: 65481 - RNA, 21 nt, Human
ccaacuuucaauggcgcugaa

SEQ ID NO: 65482 - RNA, 21 nt, Human
ccaccaugccuggcuucaagu

SEQ ID NO: 65483 - RNA, 23 nt, Human
ccaccucagccuccugaguagcu

SEQ ID NO: 65484 - RNA, 20 nt, Human
ccagcccaaagaaugugacc

SEQ ID NO: 65485 - RNA, 21 nt, Human
ccagcccaaagaaugugaccu

SEQ ID NO: 65486 - RNA, 23 nt, Human
cccaccucagccuccugaguagc

SEQ ID NO: 65487 - RNA, 18 nt, Human
cccuggggaaaaguuggg

SEQ ID NO: 65488 - RNA, 22 nt, Human
cccuuucucuuucuuacugaau

SEQ ID NO: 65489 - RNA, 24 nt, Human
ccuccugggcucaaaugauccucc

SEQ ID NO: 65490 - RNA, 18 nt, Human
ccuggcuucaaguuuggu

SEQ ID NO: 65491 - RNA, 22 nt, Human
ccugggcucaaaugauccuccc

SEQ ID NO: 65492 - RNA, 18 nt, Human
ccugugauugaggggagg

SEQ ID NO: 65493 - RNA, 22 nt, Human
ccuugaccuccugggcucaaau

SEQ ID NO: 65494 - RNA, 21 nt, Human
ccuuggccagcugcuuugcaa

SEQ ID NO: 65495 - RNA, 22 nt, Human
cucaaacacaaaacaaaagcca

SEQ ID NO: 65496 - RNA, 24 nt, Human
cucaaaugauccucccaccucagc

SEQ ID NO: 65497 - RNA, 24 nt, Human
cucacugcagccuugaccuccugg

SEQ ID NO: 65498 - RNA, 24 nt, Human
cucagccuccugaguagcugggac

SEQ ID NO: 65499 - RNA, 24 nt, Human
cuccugaguagcugggaccacagg

SEQ ID NO: 65500 - RNA, 18 nt, Human
cucuguuaccuagguugg

SEQ ID NO: 65501 - RNA, 24 nt, Human
cugaaggcacacuccacccagugg

SEQ ID NO: 65502 - RNA, 22 nt, Human
cugcagccuugaccuccugggc

SEQ ID NO: 65503 - RNA, 18 nt, Human
cugcugugcagcaagcag

SEQ ID NO: 65504 - RNA, 24 nt, Human
cuugcagguacaggaaagcccugg

SEQ ID NO: 65505 - RNA, 20 nt, Human
gaaagcccuggggaaaaguu

SEQ ID NO: 65506 - RNA, 18 nt, Human
gaccacaggugugggcca

SEQ ID NO: 65507 - RNA, 21 nt, Human
gagagagacucaaacacaaaa

SEQ ID NO: 65508 - RNA, 25 nt, Human
gaguagcugggaccacagguguggg

SEQ ID NO: 65509 - RNA, 25 nt, Human
gcagaaugagggaaagaaaccuauc

SEQ ID NO: 65510 - RNA, 21 nt, Human
gcagacaacagcccuguacca

SEQ ID NO: 65511 - RNA, 22 nt, Human
gcucaaaugauccucccaccuc

SEQ ID NO: 65512 - RNA, 25 nt, Human
ggaacugaaaggccucuacgggcag

SEQ ID NO: 65513 - RNA, 24 nt, Human
ggaccacaggugugggccaccaug

SEQ ID NO: 65514 - RNA, 21 nt, Human
ggccagcugcuuugcaagggc

SEQ ID NO: 65515 - RNA, 19 nt, Human
ggcuguugcagaggcacug

SEQ ID NO: 65516 - RNA, 18 nt, Human
gugaccuuccccaucugg

SEQ ID NO: 65517 - RNA, 21 nt, Human
gugcacgcacacacauaugca

SEQ ID NO: 65518 - RNA, 19 nt, Human
guucacauuuaauaagccu

SEQ ID NO: 65519 - RNA, 21 nt, Human
uaaaaaacagaacaacagcca

SEQ ID NO: 65520 - RNA, 28 nt, Human
uaaaaaguaagcaaagcacauacauacu

SEQ ID NO: 65521 - RNA, 22 nt, Human
uaaaguggaugaugugauucaa

SEQ ID NO: 65522 - RNA, 23 nt, Human
uaaauuaaguacuaagaggcuug

SEQ ID NO: 65523 - RNA, 23 nt, Human
uaaccaaacaacagcaaaugccc

SEQ ID NO: 65524 - RNA, 25 nt, Human
uaaccaaacaacagcaaaugcccaa

SEQ ID NO: 65525 - RNA, 21 nt, Human
uaaccacagaaugggcagaug

SEQ ID NO: 65526 - RNA, 18 nt, Human
uaaguaacuggccugcau

SEQ ID NO: 65527 - RNA, 23 nt, Human
uaauuacagggcaacaggaaccc

SEQ ID NO: 65528 - RNA, 20 nt, Human
uacagggcaacaggaaccca

SEQ ID NO: 65529 - RNA, 22 nt, Human
uaccaaaaauaaaaagggcucc

SEQ ID NO: 65530 - RNA, 26 nt, Human
uaccaaaaauaaaaagggcuccucag

SEQ ID NO: 65531 - RNA, 24 nt, Human
uaccuagguuggagugcaguggug

SEQ ID NO: 65532 - RNA, 20 nt, Human
ucaaacacaaaacaaaagcc

SEQ ID NO: 65533 - RNA, 23 nt, Human
ucacugcagccuugaccuccugg

SEQ ID NO: 65534 - RNA, 24 nt, Human
ucacugcagccuugaccuccuggg

SEQ ID NO: 65535 - RNA, 23 nt, Human
ucagccuccugaguagcugggac

SEQ ID NO: 65536 - RNA, 19 nt, Human
uccagaguaccgagggccc

SEQ ID NO: 65537 - RNA, 20 nt, Human
uccguaaucacaaaaauguu

SEQ ID NO: 65538 - RNA, 24 nt, Human
uccguaaucacaaaaauguuuccu

SEQ ID NO: 65539 - RNA, 26 nt, Human
uccucccaccucagccuccugaguag

SEQ ID NO: 65540 - RNA, 24 nt, Human
uccugaguagcugggaccacaggu

SEQ ID NO: 65541 - RNA, 24 nt, Human
uccugggcucaaaugauccuccca

SEQ ID NO: 65542 - RNA, 23 nt, Human
ucuaguuucugggauaaagugga

SEQ ID NO: 65543 - RNA, 19 nt, Human
ucucuguuaccuagguugg

SEQ ID NO: 65544 - RNA, 22 nt, Human
ucuguuaccuagguuggagugc

SEQ ID NO: 65545 - RNA, 24 nt, Human
ucuguuaccuagguuggagugcag

SEQ ID NO: 65546 - RNA, 19 nt, Human
ucuuauagacaacauaggg

SEQ ID NO: 65547 - RNA, 18 nt, Human
ugaaagcugucuaguagg

SEQ ID NO: 65548 - RNA, 24 nt, Human
ugaaaggccucuacgggcagcagu

SEQ ID NO: 65549 - RNA, 24 nt, Human
ugaacaaccaaccaauaaccaaac

SEQ ID NO: 65550 - RNA, 19 nt, Human
ugaacugaaggcaaucuga

SEQ ID NO: 65551 - RNA, 25 nt, Human
ugaaggcacacuccacccaguggca

SEQ ID NO: 65552 - RNA, 18 nt, Human
ugacacaaaaggaauaag

SEQ ID NO: 65553 - RNA, 25 nt, Human
ugaccuccugggcucaaaugauccu

SEQ ID NO: 65554 - RNA, 21 nt, Human
ugagcaaacugagucaaauca

SEQ ID NO: 65555 - RNA, 23 nt, Human
ugagggcaauggcuguugcagag

SEQ ID NO: 65556 - RNA, 18 nt, Human
ugagucaaaucauucagc

SEQ ID NO: 65557 - RNA, 20 nt, Human
ugagucaaaucauucagcgg

SEQ ID NO: 65558 - RNA, 24 nt, Human
ugaguuaaucaguccugaauaauc

SEQ ID NO: 65559 - RNA, 23 nt, Human
ugauguuggacugcaaaaauagu

SEQ ID NO: 65560 - RNA, 20 nt, Human
ugcaacguacauaaaguaac

SEQ ID NO: 65561 - RNA, 20 nt, Human
ugcagcaagcagacaacagc

SEQ ID NO: 65562 - RNA, 23 nt, Human
ugcugauggauuugguguuggug

SEQ ID NO: 65563 - RNA, 20 nt, Human
uggagugcaguggugucauc

SEQ ID NO: 65564 - RNA, 23 nt, Human
uggagugcaguggugucaucaca

SEQ ID NO: 65565 - RNA, 28 nt, Human
uggagugcaguggugucauggcucuagc

SEQ ID NO: 65566 - RNA, 21 nt, Human
ugggaccacaggugugggcca

SEQ ID NO: 65567 - RNA, 22 nt, Human
ugggaccacaggugugggccac

SEQ ID NO: 65568 - RNA, 24 nt, Human
ugggaccacaggugugggccacca

SEQ ID NO: 65569 - RNA, 19 nt, Human
ugggaccuugagacucuca

SEQ ID NO: 65570 - RNA, 24 nt, Human
ugggcagaugugaagaucuguguu

SEQ ID NO: 65571 - RNA, 18 nt, Human
uggggagggaggggugag

SEQ ID NO: 65572 - RNA, 21 nt, Human
uggggagggaggggugagugg

SEQ ID NO: 65573 - RNA, 24 nt, Human
uggugucaucacagcucacugcag

SEQ ID NO: 65574 - RNA, 19 nt, Human
uggugugggugaccagagc

SEQ ID NO: 65575 - RNA, 19 nt, Human
uguaaaaugaagaccuuuc

SEQ ID NO: 65576 - RNA, 20 nt, Human
uguaaacaacacaacuaugg

SEQ ID NO: 65577 - RNA, 20 nt, Human
ugugcuaaaaaacagaacaa

SEQ ID NO: 65578 - RNA, 21 nt, Human
ugugugcuguucugugacugu

SEQ ID NO: 65579 - RNA, 26 nt, Human
uuaaacaauauuugcaaaacccacau

SEQ ID NO: 65580 - RNA, 24 nt, Human
uuaccuagguuggagugcaguggu

SEQ ID NO: 65581 - RNA, 23 nt, Human
uucaagaugcccugaaggcacac

SEQ ID NO: 65582 - RNA, 25 nt, Human
uuccguaaucacaaaaauguuuccu

SEQ ID NO: 65583 - RNA, 19 nt, Human
uucguuauccagaguaccu

SEQ ID NO: 65584 - RNA, 23 nt, Human
uuggguucacauuuaauaagccu

SEQ ID NO: 65585 - RNA, 22 nt, Human
uuggucuuauagacaacauagg

SEQ ID NO: 65586 - RNA, 24 nt, Human
uuuccuauagaugcaguuugcaca

SEQ ID NO: 65587 - RNA, 23 nt, Human
uuugcaaaacccacauuuauagg

SEQ ID NO: 65588 - RNA, 23 nt, Human
aaaacuccacccaucaguaucag

SEQ ID NO: 65589 - RNA, 24 nt, Human
aaaacugaaagugcuucacaucua

SEQ ID NO: 65590 - RNA, 23 nt, Human
aaacagacacaguuauauacaac

SEQ ID NO: 65591 - RNA, 24 nt, Human
aaacagcaacacaacacucuccca

SEQ ID NO: 65592 - RNA, 23 nt, Human
aaacgcagcaaacucaucugaga

SEQ ID NO: 65593 - RNA, 27 nt, Human
aacacaacacucucccaaggugccccc

SEQ ID NO: 65594 - RNA, 18 nt, Human
aacaguguagcaucaaca

SEQ ID NO: 65595 - RNA, 19 nt, Human
aaccaggcauccaccaggc

SEQ ID NO: 65596 - RNA, 18 nt, Human
aaccuuuucacaggaaag

SEQ ID NO: 65597 - RNA, 21 nt, Human
aagcagaacgaaaaccugcuc

SEQ ID NO: 65598 - RNA, 18 nt, Human
aaggucccagacgcccag

SEQ ID NO: 65599 - RNA, 20 nt, Human
aaggugcccagcucaaaggc

SEQ ID NO: 65600 - RNA, 24 nt, Human
acacaacacucucccaaggugccc

SEQ ID NO: 65601 - RNA, 23 nt, Human
acagcaacacaacacucucccaa

SEQ ID NO: 65602 - RNA, 22 nt, Human
accaccacagguaugcauucaa

SEQ ID NO: 65603 - RNA, 23 nt, Human
accccgacuugggucaggggugc

SEQ ID NO: 65604 - RNA, 20 nt, Human
acccgcaggucugggacugu

SEQ ID NO: 65605 - RNA, 22 nt, Human
acgcugagcccaggcagacaac

SEQ ID NO: 65606 - RNA, 24 nt, Human
acuccgauacuggcccuggaacag

SEQ ID NO: 65607 - RNA, 18 nt, Human
agaaccguaaacagcaac

SEQ ID NO: 65608 - RNA, 23 nt, Human
agacagaaaaucagagagucaaa

SEQ ID NO: 65609 - RNA, 24 nt, Human
agacgagggccgggcacacacgga

SEQ ID NO: 65610 - RNA, 22 nt, Human
agagagcaagguggcgccccac

SEQ ID NO: 65611 - RNA, 20 nt, Human
agagcaaaggaguaacccuc

SEQ ID NO: 65612 - RNA, 23 nt, Human
agccgcagggaagccccgcagcc

SEQ ID NO: 65613 - RNA, 22 nt, Human
aggaagaaccguaaacagcaac

SEQ ID NO: 65614 - RNA, 20 nt, Human
aggaagccaaaggggcuugc

SEQ ID NO: 65615 - RNA, 22 nt, Human
aggaguuucuccacacuuguca

SEQ ID NO: 65616 - RNA, 18 nt, Human
aggcagacaacgugacca

SEQ ID NO: 65617 - RNA, 21 nt, Human
agggagucaaaagacuuuaug

SEQ ID NO: 65618 - RNA, 20 nt, Human
aucacaguacucagacagcg

SEQ ID NO: 65619 - RNA, 20 nt, Human
augggccuuccuugagguca

SEQ ID NO: 65620 - RNA, 19 nt, Human
auggggcagguccacgcug

SEQ ID NO: 65621 - RNA, 22 nt, Human
caaaacgcagcaaacucaucug

SEQ ID NO: 65622 - RNA, 18 nt, Human
caacagaaagaacugagg

SEQ ID NO: 65623 - RNA, 21 nt, Human
caacagaaagaacugaggacg

SEQ ID NO: 65624 - RNA, 21 nt, Human
caacagcaaacuccaauaaac

SEQ ID NO: 65625 - RNA, 19 nt, Human
caagcacagacgccacuga

SEQ ID NO: 65626 - RNA, 21 nt, Human
caaggccgagcgacgcccacg

SEQ ID NO: 65627 - RNA, 21 nt, Human
cacaaccagggcaggcauuca

SEQ ID NO: 65628 - RNA, 22 nt, Human
cacacaaccagggcaggcauuc

SEQ ID NO: 65629 - RNA, 24 nt, Human
cacccaucaguaucagccugcagc

SEQ ID NO: 65630 - RNA, 19 nt, Human
caccguccaggggaagggc

SEQ ID NO: 65631 - RNA, 21 nt, Human
cacggcccgcgcucccaacac

SEQ ID NO: 65632 - RNA, 24 nt, Human
cacgggccgggcuuccugcccagg

SEQ ID NO: 65633 - RNA, 23 nt, Human
cagaaacccgcaggucugggacu

SEQ ID NO: 65634 - RNA, 18 nt, Human
cagaaccaccacagguau

SEQ ID NO: 65635 - RNA, 19 nt, Human
cagaaccgucuguguccuc

SEQ ID NO: 65636 - RNA, 22 nt, Human
cagcaacacaacacucucccaa

SEQ ID NO: 65637 - RNA, 20 nt, Human
cagcauggccuccaucuguu

SEQ ID NO: 65638 - RNA, 20 nt, Human
cagcugcagugacuuauaau

SEQ ID NO: 65639 - RNA, 19 nt, Human
cagcuuuucuauauacaga

SEQ ID NO: 65640 - RNA, 21 nt, Human
caggcgcccugggugucccag

SEQ ID NO: 65641 - RNA, 19 nt, Human
caguacacaaaggauucag

SEQ ID NO: 65642 - RNA, 23 nt, Human
cagugacuuauaauaaauaauac

SEQ ID NO: 65643 - RNA, 18 nt, Human
cauccaccaggcuucugc

SEQ ID NO: 65644 - RNA, 22 nt, Human
ccaaaagcaaagucccuguggu

SEQ ID NO: 65645 - RNA, 23 nt, Human
ccacacuugucaacaggcgcccu

SEQ ID NO: 65646 - RNA, 18 nt, Human
ccacagaaagaaaaggca

SEQ ID NO: 65647 - RNA, 19 nt, Human
ccaccaggcuucugcuucc

SEQ ID NO: 65648 - RNA, 21 nt, Human
cccaaaacgcagcaaacucau

SEQ ID NO: 65649 - RNA, 19 nt, Human
cccagagaagugaagaaau

SEQ ID NO: 65650 - RNA, 24 nt, Human
ccucccaaaacgcagcaaacucau

SEQ ID NO: 65651 - RNA, 19 nt, Human
ccugagugcaccccgacuu

SEQ ID NO: 65652 - RNA, 18 nt, Human
ccugcuacaacagcaaac

SEQ ID NO: 65653 - RNA, 22 nt, Human
ccugcuacaacagcaaacucuu

SEQ ID NO: 65654 - RNA, 24 nt, Human
cgcccagcgcauguggacaagcac

SEQ ID NO: 65655 - RNA, 22 nt, Human
cggaacgaaccaggcauccacc

SEQ ID NO: 65656 - RNA, 20 nt, Human
cucgggcaaaucguggcccc

SEQ ID NO: 65657 - RNA, 18 nt, Human
cugaagcagaacgaaaac

SEQ ID NO: 65658 - RNA, 19 nt, Human
cugaugacaaaacuccacc

SEQ ID NO: 65659 - RNA, 20 nt, Human
cugaugacaaaacuccaccc

SEQ ID NO: 65660 - RNA, 22 nt, Human
cugcuacaacagcaaacuccaa

SEQ ID NO: 65661 - RNA, 20 nt, Human
cuggaaaaacaagacuuuua

SEQ ID NO: 65662 - RNA, 20 nt, Human
cuggucuucaacagaaagaa

SEQ ID NO: 65663 - RNA, 24 nt, Human
cuggugcugcggaacgaaccaggc

SEQ ID NO: 65664 - RNA, 20 nt, Human
cuugcugggcaccagagacu

SEQ ID NO: 65665 - RNA, 18 nt, Human
gacaagcacagacgccac

SEQ ID NO: 65666 - RNA, 21 nt, Human
gacgcccacggcccgcgcucc

SEQ ID NO: 65667 - RNA, 18 nt, Human
gagcgacgcccacggccc

SEQ ID NO: 65668 - RNA, 22 nt, Human
gaggacaguuaaugucgccucc

SEQ ID NO: 65669 - RNA, 27 nt, Human
gagugcaccccgacuugggucaggggu

SEQ ID NO: 65670 - RNA, 22 nt, Human
gauacuggauccacagaaagaa

SEQ ID NO: 65671 - RNA, 19 nt, Human
gcaaagacugugauccaag

SEQ ID NO: 65672 - RNA, 21 nt, Human
gcaaugaguuguucugagacc

SEQ ID NO: 65673 - RNA, 26 nt, Human
gcacugaagccugcuggcuacggcca

SEQ ID NO: 65674 - RNA, 18 nt, Human
gccuggagcgagcccgcu

SEQ ID NO: 65675 - RNA, 18 nt, Human
gccugggcccagcgagcc

SEQ ID NO: 65676 - RNA, 22 nt, Human
gcugaagcagaacgaaaaccug

SEQ ID NO: 65677 - RNA, 21 nt, Human
ggaagauacuggauccacaga

SEQ ID NO: 65678 - RNA, 22 nt, Human
ggacaaggccgagcgacgccca

SEQ ID NO: 65679 - RNA, 25 nt, Human
ggagucaaaagacuuuaugcggugg

SEQ ID NO: 65680 - RNA, 23 nt, Human
ggaguuucuccacacuugucaac

SEQ ID NO: 65681 - RNA, 20 nt, Human
ggccugaugacaaaacucca

SEQ ID NO: 65682 - RNA, 22 nt, Human
ggccugaugacaaaacuccacc

SEQ ID NO: 65683 - RNA, 22 nt, Human
ggcgacgcuggcgagcggcccc

SEQ ID NO: 65684 - RNA, 20 nt, Human
gggaagggcuguuaaaaacc

SEQ ID NO: 65685 - RNA, 20 nt, Human
gggccgggcuuccugcccag

SEQ ID NO: 65686 - RNA, 18 nt, Human
ggugcugccacagcacgg

SEQ ID NO: 65687 - RNA, 23 nt, Human
gugccguaugggccuuccuugag

SEQ ID NO: 65688 - RNA, 21 nt, Human
guggacaagcacagacgccac

SEQ ID NO: 65689 - RNA, 18 nt, Human
gugugaaggaacgagcuu

SEQ ID NO: 65690 - RNA, 18 nt, Human
uaaaaccugcuacaacag

SEQ ID NO: 65691 - RNA, 21 nt, Human
uaaagggcaauuuggccaaua

SEQ ID NO: 65692 - RNA, 23 nt, Human
uaaggaguccacacaaccagggc

SEQ ID NO: 65693 - RNA, 22 nt, Human
uaccaaaaaagaaaguguugau

SEQ ID NO: 65694 - RNA, 20 nt, Human
uaccgacauggggggugcug

SEQ ID NO: 65695 - RNA, 23 nt, Human
uauacaacagggcagguuuuuaa

SEQ ID NO: 65696 - RNA, 24 nt, Human
uaucaaguucccacccccuuggga

SEQ ID NO: 65697 - RNA, 22 nt, Human
uaugcggugagacgagggccgg

SEQ ID NO: 65698 - RNA, 23 nt, Human
uauuuacaagaaacauguauaua

SEQ ID NO: 65699 - RNA, 20 nt, Human
ucaaaagacuuuaugcggug

SEQ ID NO: 65700 - RNA, 20 nt, Human
ucacuaaggaacugaggacc

SEQ ID NO: 65701 - RNA, 20 nt, Human
ucagacagcggacaagagca

SEQ ID NO: 65702 - RNA, 28 nt, Human
ucagccagcaaguugcccucagaaaccc

SEQ ID NO: 65703 - RNA, 19 nt, Human
ucaggcacucgcucucgcu

SEQ ID NO: 65704 - RNA, 19 nt, Human
ucaggugcaguuaaagggc

SEQ ID NO: 65705 - RNA, 21 nt, Human
ucaucagcugcagugacuuau

SEQ ID NO: 65706 - RNA, 21 nt, Human
uccacacaaccagggcaggca

SEQ ID NO: 65707 - RNA, 20 nt, Human
uccacagaaagaaaaggcaa

SEQ ID NO: 65708 - RNA, 21 nt, Human
uccacgcugagcccaggcaga

SEQ ID NO: 65709 - RNA, 18 nt, Human
ucccaaggugcccagcuc

SEQ ID NO: 65710 - RNA, 20 nt, Human
ucuagugaaaaguccaggug

SEQ ID NO: 65711 - RNA, 22 nt, Human
ucucagacgcauuuuuccugcu

SEQ ID NO: 65712 - RNA, 19 nt, Human
ucuccagccgcagggaagc

SEQ ID NO: 65713 - RNA, 22 nt, Human
ucugcacuggaacacagugggg

SEQ ID NO: 65714 - RNA, 24 nt, Human
ucugcagcauggggcagguccacc

SEQ ID NO: 65715 - RNA, 24 nt, Human
ugaaagugcuucacaucuacagga

SEQ ID NO: 65716 - RNA, 20 nt, Human
ugaagaaaugauuggcauua

SEQ ID NO: 65717 - RNA, 22 nt, Human
ugaagcagaacgaaaaccugcu

SEQ ID NO: 65718 - RNA, 19 nt, Human
ugagcccaggcagacaacg

SEQ ID NO: 65719 - RNA, 20 nt, Human
ugagcccaggcagacaacgu

SEQ ID NO: 65720 - RNA, 26 nt, Human
ugagcccaggcagacaacgugaccag

SEQ ID NO: 65721 - RNA, 21 nt, Human
ugcaauuuggguuuuuaaaga

SEQ ID NO: 65722 - RNA, 18 nt, Human
ugcaggagauccguccug

SEQ ID NO: 65723 - RNA, 22 nt, Human
ugcccaggaccgcacaggcuuu

SEQ ID NO: 65724 - RNA, 22 nt, Human
ugcccugugguccugagugcac

SEQ ID NO: 65725 - RNA, 23 nt, Human
ugcugaagcagaacgaaaaccug

SEQ ID NO: 65726 - RNA, 19 nt, Human
ugcuuuauucuugcugaag

SEQ ID NO: 65727 - RNA, 19 nt, Human
uggaaaaacaagacuuuua

SEQ ID NO: 65728 - RNA, 20 nt, Human
uggacaagcacagacgccac

SEQ ID NO: 65729 - RNA, 20 nt, Human
uggacaagcacagacgccac

SEQ ID NO: 65730 - RNA, 23 nt, Human
uggacaagcacagacgccacuga

SEQ ID NO: 65731 - RNA, 19 nt, Human
uggagcgagcccgcugccc

SEQ ID NO: 65732 - RNA, 22 nt, Human
uggauccacagaaagaaaaggc

SEQ ID NO: 65733 - RNA, 19 nt, Human
uggcgccccacccagcccu

SEQ ID NO: 65734 - RNA, 23 nt, Human
uggcgccccacccagcccugccc

SEQ ID NO: 65735 - RNA, 18 nt, Human
uggggcagguccacgcug

SEQ ID NO: 65736 - RNA, 18 nt, Human
ugguccugagugcacccc

SEQ ID NO: 65737 - RNA, 20 nt, Human
uucaaaaugggauauuuacc

SEQ ID NO: 65738 - RNA, 27 nt, Human
uucaucagcugcagugacuuauaauaa

SEQ ID NO: 65739 - RNA, 19 nt, Human
uuccugcccaggaccgcac

SEQ ID NO: 65740 - RNA, 24 nt, Human
uucgcagaauaagcuccagcuuuu

SEQ ID NO: 65741 - RNA, 24 nt, Human
uucgcagaauaagcuccagcuuuu

SEQ ID NO: 65742 - RNA, 19 nt, Human
uuucacaggaaaggaaacc

SEQ ID NO: 65743 - RNA, 23 nt, Human
aaccuccaaagccuagucuucaa

SEQ ID NO: 65744 - RNA, 23 nt, Human
acaguaaaaugacugacuccgga

SEQ ID NO: 65745 - RNA, 22 nt, Human
acuccaagaaguggcaaaggcc

SEQ ID NO: 65746 - RNA, 22 nt, Human
aggaggcgaaaacaaaagggac

SEQ ID NO: 65747 - RNA, 19 nt, Human
aggcgaaaacaaaagcggc

SEQ ID NO: 65748 - RNA, 22 nt, Human
aggcgaaaacaaaagcggccca

SEQ ID NO: 65749 - RNA, 22 nt, Human
agguaggucuguguccucagga

SEQ ID NO: 65750 - RNA, 19 nt, Human
auaggaucaaccucucccu

SEQ ID NO: 65751 - RNA, 22 nt, Human
cacaguuccccaagggauuuuc

SEQ ID NO: 65752 - RNA, 24 nt, Human
cagaaucccagggaaaagagcccu

SEQ ID NO: 65753 - RNA, 22 nt, Human
ccucuccccauuagucuuuggg

SEQ ID NO: 65754 - RNA, 21 nt, Human
cgaaaacaaaagcggcccaag

SEQ ID NO: 65755 - RNA, 22 nt, Human
cgaaaacaaaagcggcccaagc

SEQ ID NO: 65756 - RNA, 20 nt, Human
cggcccaagccuuuucacug

SEQ ID NO: 65757 - RNA, 24 nt, Human
cggcccucccucuccccauuaguc

SEQ ID NO: 65758 - RNA, 18 nt, Human
cuaacuggccugggcaag

SEQ ID NO: 65759 - RNA, 23 nt, Human
cuccaaagccuagucuucaacug

SEQ ID NO: 65760 - RNA, 23 nt, Human
cuucccggcccucccucucccca

SEQ ID NO: 65761 - RNA, 23 nt, Human
cuuugaaaaccuccaaagccuag

SEQ ID NO: 65762 - RNA, 20 nt, Human
gaguucacuuguagagugua

SEQ ID NO: 65763 - RNA, 26 nt, Human
gauuugcagaauguuacuucucccuu

SEQ ID NO: 65764 - RNA, 23 nt, Human
gcugcuugggguguacccagaga

SEQ ID NO: 65765 - RNA, 18 nt, Human
ggccugggcaaggaguuc

SEQ ID NO: 65766 - RNA, 23 nt, Human
gugaaggagaaguuuccaaacag

SEQ ID NO: 65767 - RNA, 18 nt, Human
uacccagagaaaacacca

SEQ ID NO: 65768 - RNA, 19 nt, Human
uagaguguaguuagugaaa

SEQ ID NO: 65769 - RNA, 22 nt, Human
ucaacaaaaggaggcgaaaaca

SEQ ID NO: 65770 - RNA, 25 nt, Human
uccagaaucccagggaaaagagccc

SEQ ID NO: 65771 - RNA, 20 nt, Human
ucccugcccauccaagcacc

SEQ ID NO: 65772 - RNA, 23 nt, Human
ugaaggagaaguuuccaaacagc

SEQ ID NO: 65773 - RNA, 21 nt, Human
ugaaguccagaaucccaggga

SEQ ID NO: 65774 - RNA, 21 nt, Human
ugcauacauaaguguugugug

SEQ ID NO: 65775 - RNA, 23 nt, Human
ugcuugggguguacccagagaaa

SEQ ID NO: 65776 - RNA, 18 nt, Human
uggcaaaggccccgagag

SEQ ID NO: 65777 - RNA, 24 nt, Human
uggcuucccggcccucccucuccc

SEQ ID NO: 65778 - RNA, 23 nt, Human
uggugugugaaggagaaguuucc

SEQ ID NO: 65779 - RNA, 18 nt, Human
ugugaaggagaaguuucc

SEQ ID NO: 65780 - RNA, 22 nt, Human
uucacacuggaagaacugaaaa

SEQ ID NO: 65781 - RNA, 18 nt, Human
uucacuuuuuuaaucaaa

SEQ ID NO: 65782 - RNA, 24 nt, Human
uucuccacggcuucaguuucugau

SEQ ID NO: 65783 - RNA, 18 nt, Human
uuggaaacuguugcagaa

SEQ ID NO: 65784 - RNA, 24 nt, Human
uuuccaaacagcucucugucggcu

SEQ ID NO: 65785 - RNA, 22 nt, Human
uuucugauggaucuagccaugu

SEQ ID NO: 65786 - RNA, 21 nt, Human
uuuuuuuuuuuuauggagacu

SEQ ID NO: 65787 - RNA, 19 nt, Human
aaacaacagcacaaaauca

SEQ ID NO: 65788 - RNA, 24 nt, Human
aaacaacagcacaaaaucaaccau

SEQ ID NO: 65789 - RNA, 20 nt, Human
aacauagugaaaugaguccu

SEQ ID NO: 65790 - RNA, 24 nt, Human
aacugcuaugcagaauacucaaac

SEQ ID NO: 65791 - RNA, 24 nt, Human
acgcagcaauuuaucaaaagccga

SEQ ID NO: 65792 - RNA, 20 nt, Human
agcacaaaaucaaccaugua

SEQ ID NO: 65793 - RNA, 18 nt, Human
agcuggcucuuaaggccc

SEQ ID NO: 65794 - RNA, 19 nt, Human
aggaagagcuggcucuuaa

SEQ ID NO: 65795 - RNA, 19 nt, Human
cagcaggagaccccuuucu

SEQ ID NO: 65796 - RNA, 23 nt, Human
caggaaaagcuuuauuaagucaa

SEQ ID NO: 65797 - RNA, 21 nt, Human
caguccaaacaacagcacaaa

SEQ ID NO: 65798 - RNA, 26 nt, Human
caguccaaacaacagcacaaaaucaa

SEQ ID NO: 65799 - RNA, 19 nt, Human
caugagaaacuacuaacau

SEQ ID NO: 65800 - RNA, 21 nt, Human
cccuaaugaucaacauauuca

SEQ ID NO: 65801 - RNA, 25 nt, Human
gacgccuuccaauuuuucuuucuau

SEQ ID NO: 65802 - RNA, 18 nt, Human
ggagagacugccgcggca

SEQ ID NO: 65803 - RNA, 18 nt, Human
ggcagcaggagaccccuu

SEQ ID NO: 65804 - RNA, 22 nt, Human
gguuaccaaaaggacgccuucc

SEQ ID NO: 65805 - RNA, 24 nt, Human
gugcacaaguucucccacacuuag

SEQ ID NO: 65806 - RNA, 19 nt, Human
uacacaauaaucggguuac

SEQ ID NO: 65807 - RNA, 24 nt, Human
uacacaauuaaaagauaugauuaa

SEQ ID NO: 65808 - RNA, 21 nt, Human
uacaggauaggaagagcuggc

SEQ ID NO: 65809 - RNA, 24 nt, Human
uacuaaaggccuuacuuuaaauac

SEQ ID NO: 65810 - RNA, 19 nt, Human
uagaagacaaaugcgcugc

SEQ ID NO: 65811 - RNA, 18 nt, Human
uagugaaaugaguccacg

SEQ ID NO: 65812 - RNA, 19 nt, Human
uauccacuuacaagguaua

SEQ ID NO: 65813 - RNA, 21 nt, Human
ucacgcagcaauuuaucaaaa

SEQ ID NO: 65814 - RNA, 20 nt, Human
ucacuuucacaauuuucucu

SEQ ID NO: 65815 - RNA, 18 nt, Human
ucucugcucccacacccc

SEQ ID NO: 65816 - RNA, 21 nt, Human
ucugcucccacaccccuaaug

SEQ ID NO: 65817 - RNA, 24 nt, Human
ugauguuuuguucuuuucaaaaca

SEQ ID NO: 65818 - RNA, 25 nt, Human
ugcagaauacucaaacauuuuuaaa

SEQ ID NO: 65819 - RNA, 23 nt, Human
ugccgcggcaaccaacuggacac

SEQ ID NO: 65820 - RNA, 23 nt, Human
uggcagcaggagaccccuuucuc

SEQ ID NO: 65821 - RNA, 23 nt, Human
uguuuuguucuuuucaaaacauu

SEQ ID NO: 65822 - RNA, 19 nt, Human
uuacauucauuacuaaagg

SEQ ID NO: 65823 - RNA, 26 nt, Human
uuagcuggcagcaggagaccccuuuc

SEQ ID NO: 65824 - RNA, 22 nt, Human
aaaacaguccccaacgccaccu

SEQ ID NO: 65825 - RNA, 19 nt, Human
agaaaacaguccccaacgc

SEQ ID NO: 65826 - RNA, 21 nt, Human
aggagggagggagggagcgag

SEQ ID NO: 65827 - RNA, 22 nt, Human
aggcggggagagggcggggacg

SEQ ID NO: 65828 - RNA, 19 nt, Human
agggcggggacgccgaggc

SEQ ID NO: 65829 - RNA, 21 nt, Human
caaaacaauucugguacuaca

SEQ ID NO: 65830 - RNA, 19 nt, Human
cccaacgccaccuccacgg

SEQ ID NO: 65831 - RNA, 22 nt, Human
cccaacgccaccuccacggccg

SEQ ID NO: 65832 - RNA, 22 nt, Human
cccgcgagccgcggcuccuccc

SEQ ID NO: 65833 - RNA, 24 nt, Human
ccggccuccgagagaaaacagucc

SEQ ID NO: 65834 - RNA, 22 nt, Human
ccuccgagagaaaacagucccc

SEQ ID NO: 65835 - RNA, 29 nt, Human
ccuggcuccggccccgcgagccgguuccg

SEQ ID NO: 65836 - RNA, 23 nt, Human
cgccgaggccccggcucucgcuc

SEQ ID NO: 65837 - RNA, 20 nt, Human
cggcuccgcuccggccuccg

SEQ ID NO: 65838 - RNA, 23 nt, Human
cggcuccuccccaggagcggcgg

SEQ ID NO: 65839 - RNA, 19 nt, Human
cggggagggcgcggaggag

SEQ ID NO: 65840 - RNA, 22 nt, Human
cuccacggccgcugcuaucgcu

SEQ ID NO: 65841 - RNA, 19 nt, Human
cuccgcuccggccuccgag

SEQ ID NO: 65842 - RNA, 18 nt, Human
gagccgcggcuccucccc

SEQ ID NO: 65843 - RNA, 22 nt, Human
gcuccggcuccggcugaugucc

SEQ ID NO: 65844 - RNA, 19 nt, Human
gcugguggcggcggggagg

SEQ ID NO: 65845 - RNA, 24 nt, Human
ggagcgagggggccgcuugcugcc

SEQ ID NO: 65846 - RNA, 20 nt, Human
ggaggagggagggagggagc

SEQ ID NO: 65847 - RNA, 21 nt, Human
ggaggagggagggagggagcg

SEQ ID NO: 65848 - RNA, 22 nt, Human
ggccuccgagagaaaacagucc

SEQ ID NO: 65849 - RNA, 18 nt, Human
ggcgcggaggagggaggg

SEQ ID NO: 65850 - RNA, 21 nt, Human
ggcggcggggagggcgcggag

SEQ ID NO: 65851 - RNA, 18 nt, Human
guggcggcggggagggcg

SEQ ID NO: 65852 - RNA, 23 nt, Human
uccccaacgccaccuccacggcc

SEQ ID NO: 65853 - RNA, 20 nt, Human
uccggacgcaggccuggcuc

SEQ ID NO: 65854 - RNA, 22 nt, Human
uggcggcggggagggcgcggag

SEQ ID NO: 65855 - RNA, 22 nt, Human
uguguuuguuuuguuuuaauug

SEQ ID NO: 65856 - RNA, 18 nt, Human
uuguguuuguuuuguuuu

SEQ ID NO: 65857 - RNA, 19 nt, Human
cagcccgggugcaacgcaa

SEQ ID NO: 65858 - RNA, 23 nt, Human
cccggggggcgggggcgggggcc

SEQ ID NO: 65859 - RNA, 19 nt, Human
cgaggacccgaggccagcu

SEQ ID NO: 65860 - RNA, 21 nt, Human
cgcccgagaguccgcccgccc

SEQ ID NO: 65861 - RNA, 21 nt, Human
cggcccggggggcgggggcgg

SEQ ID NO: 65862 - RNA, 20 nt, Human
gcccggggggcgggggcggg

SEQ ID NO: 65863 - RNA, 18 nt, Human
gccgggccaggccggguc

SEQ ID NO: 65864 - RNA, 20 nt, Human
ggaggucggaagggagguuc

SEQ ID NO: 65865 - RNA, 24 nt, Human
ggcgggggccgggccaggccgggu

SEQ ID NO: 65866 - RNA, 25 nt, Human
gggggccgggccaggccgggucggg

SEQ ID NO: 65867 - RNA, 18 nt, Human
agcagcagcaggcugggg

SEQ ID NO: 65868 - RNA, 21 nt, Human
agguugagggaccuggacugc

SEQ ID NO: 65869 - RNA, 23 nt, Human
cagcaggcugggguggaggaggg

SEQ ID NO: 65870 - RNA, 19 nt, Human
cagcaguagcagcuccucc

SEQ ID NO: 65871 - RNA, 20 nt, Human
cagcaguagcagcuccuccc

SEQ ID NO: 65872 - RNA, 18 nt, Human
cagccucgguagcagcag

SEQ ID NO: 65873 - RNA, 23 nt, Human
cagcuccuccccgcccagcccuc

SEQ ID NO: 65874 - RNA, 20 nt, Human
caguagcagcagcaggcugg

SEQ ID NO: 65875 - RNA, 21 nt, Human
ccaaaggccaggucaggagcc

SEQ ID NO: 65876 - RNA, 23 nt, Human
ccagagagacagccagggcacag

SEQ ID NO: 65877 - RNA, 28 nt, Human
ccccccauggguaguguuuggugaaggu

SEQ ID NO: 65878 - RNA, 21 nt, Human
ccccgcccagcccucucuucu

SEQ ID NO: 65879 - RNA, 22 nt, Human
ccccgcccagcccucucuucuu

SEQ ID NO: 65880 - RNA, 19 nt, Human
ccucccgccaugggagccg

SEQ ID NO: 65881 - RNA, 25 nt, Human
cggcagcaguagcagcagcaggcuu

SEQ ID NO: 65882 - RNA, 19 nt, Human
gagcgguuuauuucacaac

SEQ ID NO: 65883 - RNA, 22 nt, Human
gccaaaggccaggucaggagcc

SEQ ID NO: 65884 - RNA, 23 nt, Human
gccagggcacagccucccgccau

SEQ ID NO: 65885 - RNA, 20 nt, Human
gccggcugacucccaacccc

SEQ ID NO: 65886 - RNA, 30 nt, Human
gccucgguagcagcaguagcagcuccuccc

SEQ ID NO: 65887 - RNA, 19 nt, Human
ggagccagagagacagcca

SEQ ID NO: 65888 - RNA, 20 nt, Human
ggcagcaguagcagcagcag

SEQ ID NO: 65889 - RNA, 19 nt, Human
gggaccuggacugcuaggu

SEQ ID NO: 65890 - RNA, 19 nt, Human
ggguggaggagggggagug

SEQ ID NO: 65891 - RNA, 20 nt, Human
ggguggccacagagcagcag

SEQ ID NO: 65892 - RNA, 19 nt, Human
gguggccacagagcagcag

SEQ ID NO: 65893 - RNA, 22 nt, Human
guagcagcagcaggcuggggug

SEQ ID NO: 65894 - RNA, 23 nt, Human
guagcagcagcaggcuggggugg

SEQ ID NO: 65895 - RNA, 19 nt, Human
guagcagcaguagcagcuc

SEQ ID NO: 65896 - RNA, 22 nt, Human
uagcagcuccuccccgcccagc

SEQ ID NO: 65897 - RNA, 24 nt, Human
uagcagcuccuccccgcccagccc

SEQ ID NO: 65898 - RNA, 20 nt, Human
uggaggagggggaguguuag

SEQ ID NO: 65899 - RNA, 22 nt, Human
uggccacagagcagcagcggca

SEQ ID NO: 65900 - RNA, 21 nt, Human
ugggguggaggagggggagug

SEQ ID NO: 65901 - RNA, 18 nt, Human
ugguaugguagccaaagg

SEQ ID NO: 65902 - RNA, 18 nt, Human
acaggcaaaggacggugu

SEQ ID NO: 65903 - RNA, 24 nt, Human
aggagggcagacaggcaaaggacg

SEQ ID NO: 65904 - RNA, 20 nt, Human
aggugcaaauaaauguccca

SEQ ID NO: 65905 - RNA, 20 nt, Human
caaauaaaugucccaaauug

SEQ ID NO: 65906 - RNA, 26 nt, Human
cacuaacuucagaccaaauucccaca

SEQ ID NO: 65907 - RNA, 22 nt, Human
cuugguuuacaacuucucuugg

SEQ ID NO: 65908 - RNA, 21 nt, Human
gcuauaagacugcucccgauc

SEQ ID NO: 65909 - RNA, 19 nt, Human
ggcagacaggcaaaggacg

SEQ ID NO: 65910 - RNA, 26 nt, Human
ucagaccagagaaaaccuacuccaca

SEQ ID NO: 65911 - RNA, 23 nt, Human
uuccaggugcaaauaaauguccc

SEQ ID NO: 65912 - RNA, 20 nt, Human
uucccacaacuguguucugg

SEQ ID NO: 65913 - RNA, 22 nt, Human
agacaguuguggccgcugauug

SEQ ID NO: 65914 - RNA, 27 nt, Human
agacgcggcuccacgugcccucccuca

SEQ ID NO: 65915 - RNA, 21 nt, Human
cagaaggcacuacagcaggac

SEQ ID NO: 65916 - RNA, 22 nt, Human
caggcuucacaucugauacagu

SEQ ID NO: 65917 - RNA, 22 nt, Human
ccgcugauugaaccgggccugg

SEQ ID NO: 65918 - RNA, 21 nt, Human
ccucaggugcaacagagauug

SEQ ID NO: 65919 - RNA, 20 nt, Human
ccucccucauuggcuggugg

SEQ ID NO: 65920 - RNA, 25 nt, Human
cuagacaguuguggccgcugauuga

SEQ ID NO: 65921 - RNA, 23 nt, Human
ucaucaggaaagcuccaggcuuc

SEQ ID NO: 65922 - RNA, 22 nt, Human
ucccagacacacuuugaagucc

SEQ ID NO: 65923 - RNA, 20 nt, Human
ucccucauuggcugguggug

SEQ ID NO: 65924 - RNA, 25 nt, Human
uuguggccgcugauugaaccgggcc

SEQ ID NO: 65925 - RNA, 20 nt, Human
uuucuuuaauaaaaaaaucc

SEQ ID NO: 65926 - RNA, 25 nt, Human
uuugaaguccuagaguacaccagca

SEQ ID NO: 65927 - RNA, 24 nt, Human
uuuuugacagcuagaaauuuuuuu

SEQ ID NO: 65928 - RNA, 24 nt, Human
agcaggggaacagccagaagggaa

SEQ ID NO: 65929 - RNA, 19 nt, Human
agggaagggaagggagagg

SEQ ID NO: 65930 - RNA, 18 nt, Human
caccccuuauccucaccc

SEQ ID NO: 65931 - RNA, 21 nt, Human
caccccuuauccucaccccaa

SEQ ID NO: 65932 - RNA, 26 nt, Human
cagaugccaccgccgccgcgccaccc

SEQ ID NO: 65933 - RNA, 23 nt, Human
cagugauuuuuucucccccaccc

SEQ ID NO: 65934 - RNA, 19 nt, Human
ccagugggaggagccgcca

SEQ ID NO: 65935 - RNA, 19 nt, Human
cccccccccagugggagga

SEQ ID NO: 65936 - RNA, 20 nt, Human
cgccgccgcgccaccccccc

SEQ ID NO: 65937 - RNA, 21 nt, Human
cgccgcgccacccccccccca

SEQ ID NO: 65938 - RNA, 18 nt, Human
gaagggaaaggggguaca

SEQ ID NO: 65939 - RNA, 23 nt, Human
gagcaggggaacagccagaaggg

SEQ ID NO: 65940 - RNA, 23 nt, Human
gccgccgcgccacccccccccca

SEQ ID NO: 65941 - RNA, 20 nt, Human
gugauuuuuucucccccacc

SEQ ID NO: 65942 - RNA, 19 nt, Human
ucucccccaccccuuaucc

SEQ ID NO: 65943 - RNA, 18 nt, Human
ugccaccgccgccgcgcc

SEQ ID NO: 65944 - RNA, 21 nt, Human
ugucaggggugagggaaggga

SEQ ID NO: 65945 - RNA, 18 nt, Human
uuaggaggcaacagagca

SEQ ID NO: 65946 - RNA, 21 nt, Human
aaaaagcucuagaaacugcaa

SEQ ID NO: 65947 - RNA, 24 nt, Human
aaacaaacauaagaccccccaaac

SEQ ID NO: 65948 - RNA, 18 nt, Human
aaacaaagucacaagugc

SEQ ID NO: 65949 - RNA, 21 nt, Human
aaacauaagaccccccaaacc

SEQ ID NO: 65950 - RNA, 18 nt, Human
aaacuguccacugacacc

SEQ ID NO: 65951 - RNA, 22 nt, Human
aaagugcugccgggagugggga

SEQ ID NO: 65952 - RNA, 20 nt, Human
aaaugauuuauccacagcaa

SEQ ID NO: 65953 - RNA, 22 nt, Human
aacaaacauaagaccccccaaa

SEQ ID NO: 65954 - RNA, 19 nt, Human
aacucuccuccaagaaaca

SEQ ID NO: 65955 - RNA, 19 nt, Human
aacuggaacccaugucuuc

SEQ ID NO: 65956 - RNA, 18 nt, Human
aagaagaaagagaaaugg

SEQ ID NO: 65957 - RNA, 18 nt, Human
aagaagaaagagaaaugg

SEQ ID NO: 65958 - RNA, 22 nt, Human
aagaggccgaaggaguccucac

SEQ ID NO: 65959 - RNA, 25 nt, Human
aagcagaccacaggggccaugagca

SEQ ID NO: 65960 - RNA, 18 nt, Human
aaggacucugggagggac

SEQ ID NO: 65961 - RNA, 26 nt, Human
aaggagcugcuuccucuaagaggagg

SEQ ID NO: 65962 - RNA, 21 nt, Human
aagugagucacagagucaaac

SEQ ID NO: 65963 - RNA, 23 nt, Human
aaugccuccccaucaggucuagc

SEQ ID NO: 65964 - RNA, 24 nt, Human
aauugucuaucaagagauuauuca

SEQ ID NO: 65965 - RNA, 21 nt, Human
acaaaaagcucuagaaacugc

SEQ ID NO: 65966 - RNA, 18 nt, Human
acaaaagccagggacacc

SEQ ID NO: 65967 - RNA, 22 nt, Human
acacuagcuuuggccacaaaag

SEQ ID NO: 65968 - RNA, 18 nt, Human
acagacaaaaagcucuag

SEQ ID NO: 65969 - RNA, 21 nt, Human
acagacacaaggcacaacaca

SEQ ID NO: 65970 - RNA, 22 nt, Human
accccccaaacuuccaaacuca

SEQ ID NO: 65971 - RNA, 18 nt, Human
acccuggaccccuguuga

SEQ ID NO: 65972 - RNA, 20 nt, Human
accucuucaguggggagcug

SEQ ID NO: 65973 - RNA, 24 nt, Human
acucugcuugcccauuuucccagc

SEQ ID NO: 65974 - RNA, 20 nt, Human
acugagcaauguuugacuuu

SEQ ID NO: 65975 - RNA, 18 nt, Human
acuggcaugggaggcucu

SEQ ID NO: 65976 - RNA, 22 nt, Human
agaagaaagagaaaugguuaag

SEQ ID NO: 65977 - RNA, 23 nt, Human
agacagaccagcggagcugaggg

SEQ ID NO: 65978 - RNA, 21 nt, Human
agagccauccuuggccauccu

SEQ ID NO: 65979 - RNA, 19 nt, Human
agaguguucuagagccauc

SEQ ID NO: 65980 - RNA, 18 nt, Human
agauccaauugggaggag

SEQ ID NO: 65981 - RNA, 24 nt, Human
agccagggaucaugggcucagagg

SEQ ID NO: 65982 - RNA, 20 nt, Human
agcggagcugaggggcaggu

SEQ ID NO: 65983 - RNA, 24 nt, Human
agcugaggggcaggugccucugug

SEQ ID NO: 65984 - RNA, 23 nt, Human
aggagacagcgacuuaggccaag

SEQ ID NO: 65985 - RNA, 27 nt, Human
aggcaaaacaaacauaagaccccccaa

SEQ ID NO: 65986 - RNA, 18 nt, Human
aggcagagguggccccaa

SEQ ID NO: 65987 - RNA, 20 nt, Human
aggcucuuuugcaaaccagg

SEQ ID NO: 65988 - RNA, 18 nt, Human
agucagugggcugauggg

SEQ ID NO: 65989 - RNA, 21 nt, Human
auaaacucuccucaaauccaa

SEQ ID NO: 65990 - RNA, 22 nt, Human
auaaacucuccucaaauccaag

SEQ ID NO: 65991 - RNA, 23 nt, Human
augaagcaagccguccugcuccc

SEQ ID NO: 65992 - RNA, 23 nt, Human
auuaggacagcaaguccauguca

SEQ ID NO: 65993 - RNA, 20 nt, Human
caaaacaaacauaagacccc

SEQ ID NO: 65994 - RNA, 19 nt, Human
caaaaggaagaaaacacaa

SEQ ID NO: 65995 - RNA, 18 nt, Human
caaacuccuuccugcaug

SEQ ID NO: 65996 - RNA, 20 nt, Human
caaagucacaagugccucuc

SEQ ID NO: 65997 - RNA, 19 nt, Human
caaaugauuuauccacagc

SEQ ID NO: 65998 - RNA, 22 nt, Human
caacacauccauuaggacagca

SEQ ID NO: 65999 - RNA, 24 nt, Human
caagaaacagaagaggcaaaacaa

SEQ ID NO: 66000 - RNA, 20 nt, Human
caagcagaccacaggggcca

SEQ ID NO: 66001 - RNA, 19 nt, Human
caagccagggaucaugggc

SEQ ID NO: 66002 - RNA, 24 nt, Human
caagugccucuccccuuucuaauc

SEQ ID NO: 66003 - RNA, 21 nt, Human
cacaaccaaacuuaaggaccc

SEQ ID NO: 66004 - RNA, 20 nt, Human
cacagcaaacacucucucca

SEQ ID NO: 66005 - RNA, 23 nt, Human
cacagcacaguucacauccauaa

SEQ ID NO: 66006 - RNA, 18 nt, Human
caccaguggggcaaggau

SEQ ID NO: 66007 - RNA, 20 nt, Human
caccuaagaaaagccucaac

SEQ ID NO: 66008 - RNA, 21 nt, Human
caccuaagaaaagccucaacu

SEQ ID NO: 66009 - RNA, 24 nt, Human
caccugccauuuccccagaagcaa

SEQ ID NO: 66010 - RNA, 22 nt, Human
cacuguacagcaggagccucac

SEQ ID NO: 66011 - RNA, 22 nt, Human
cacuuucaaggucagugcccca

SEQ ID NO: 66012 - RNA, 19 nt, Human
cagaauccccccacucucu

SEQ ID NO: 66013 - RNA, 18 nt, Human
cagacaaaaagcucuaga

SEQ ID NO: 66014 - RNA, 22 nt, Human
cagacccugggccgagcauccu

SEQ ID NO: 66015 - RNA, 18 nt, Human
cagagaaauucaaggccg

SEQ ID NO: 66016 - RNA, 19 nt, Human
cagaggucccugaaaacag

SEQ ID NO: 66017 - RNA, 19 nt, Human
caggcacaagguccuccuc

SEQ ID NO: 66018 - RNA, 20 nt, Human
caggcucugggcaggcacaa

SEQ ID NO: 66019 - RNA, 20 nt, Human
cagggccccuggucaguggc

SEQ ID NO: 66020 - RNA, 19 nt, Human
caggugccucugugucucu

SEQ ID NO: 66021 - RNA, 18 nt, Human
caguccugggcuucuccc

SEQ ID NO: 66022 - RNA, 23 nt, Human
caguggccgagcagccgcggcug

SEQ ID NO: 66023 - RNA, 21 nt, Human
cauaacacuagcuuuggccac

SEQ ID NO: 66024 - RNA, 27 nt, Human
cauaagaccccccaaacuuccaaacuc

SEQ ID NO: 66025 - RNA, 19 nt, Human
cauaagcaaaaacugcagu

SEQ ID NO: 66026 - RNA, 21 nt, Human
cauauacacaaccgacuuaau

SEQ ID NO: 66027 - RNA, 26 nt, Human
caucgacaucacaguauggguggcac

SEQ ID NO: 66028 - RNA, 26 nt, Human
caugacagacacaaggcacaacacau

SEQ ID NO: 66029 - RNA, 23 nt, Human
caugagcauuccggccuccaagg

SEQ ID NO: 66030 - RNA, 19 nt, Human
caugcacagcuggcgacca

SEQ ID NO: 66031 - RNA, 21 nt, Human
caugcaucuacaguggagacc

SEQ ID NO: 66032 - RNA, 19 nt, Human
caugugcccugcagcagcc

SEQ ID NO: 66033 - RNA, 22 nt, Human
ccacaaaagccagggacaccuc

SEQ ID NO: 66034 - RNA, 22 nt, Human
ccagaacuggaacccaugucuu

SEQ ID NO: 66035 - RNA, 23 nt, Human
ccauccuguugccaucacugacc

SEQ ID NO: 66036 - RNA, 20 nt, Human
ccauucuggggcuggcccug

SEQ ID NO: 66037 - RNA, 19 nt, Human
cccaaacuuccaaacucac

SEQ ID NO: 66038 - RNA, 19 nt, Human
ccccagaagcaagaaagcc

SEQ ID NO: 66039 - RNA, 21 nt, Human
ccccagaagcaagaaagccuc

SEQ ID NO: 66040 - RNA, 21 nt, Human
cccccaaacuuccaaacucac

SEQ ID NO: 66041 - RNA, 23 nt, Human
cccccaaacuuccaaacucacaa

SEQ ID NO: 66042 - RNA, 24 nt, Human
ccccuggggcacgugcgauucucc

SEQ ID NO: 66043 - RNA, 21 nt, Human
cccucagugcccagcacagcu

SEQ ID NO: 66044 - RNA, 18 nt, Human
cccugcuaucuacaucug

SEQ ID NO: 66045 - RNA, 20 nt, Human
ccugggccgagcauccucug

SEQ ID NO: 66046 - RNA, 19 nt, Human
ccugggcuucucccccucc

SEQ ID NO: 66047 - RNA, 22 nt, Human
ccugugaaaccuccauuuugcc

SEQ ID NO: 66048 - RNA, 23 nt, Human
ccuuucuuucuuuuuuuaaagga

SEQ ID NO: 66049 - RNA, 18 nt, Human
cgcggcugcaggggagag

SEQ ID NO: 66050 - RNA, 20 nt, Human
cucacuccacucucagguuc

SEQ ID NO: 66051 - RNA, 19 nt, Human
cuccaucaccccuauuuuc

SEQ ID NO: 66052 - RNA, 22 nt, Human
cucccagagcugcuguuccucc

SEQ ID NO: 66053 - RNA, 22 nt, Human
cucuuguucuugucuugagacc

SEQ ID NO: 66054 - RNA, 20 nt, Human
cugcaucuguguccuugcug

SEQ ID NO: 66055 - RNA, 21 nt, Human
cugcuggaggcagagguggcc

SEQ ID NO: 66056 - RNA, 19 nt, Human
cugcuggugcugcuugguc

SEQ ID NO: 66057 - RNA, 25 nt, Human
cuggugcugcuuggucacucugggc

SEQ ID NO: 66058 - RNA, 25 nt, Human
cuugagaccaccagagaaauucaag

SEQ ID NO: 66059 - RNA, 18 nt, Human
cuuggaaaugugccugca

SEQ ID NO: 66060 - RNA, 19 nt, Human
cuuggaccaaagaacugac

SEQ ID NO: 66061 - RNA, 24 nt, Human
gaaaaccccuggggcacgugcgau

SEQ ID NO: 66062 - RNA, 21 nt, Human
gacagggcugggguuuaaugu

SEQ ID NO: 66063 - RNA, 19 nt, Human
gacaugcuuaugugggauc

SEQ ID NO: 66064 - RNA, 21 nt, Human
gaccucuucaguggggagcug

SEQ ID NO: 66065 - RNA, 23 nt, Human
gagcacacacagauaaaauacaa

SEQ ID NO: 66066 - RNA, 20 nt, Human
gagcuggaagggaaggaggc

SEQ ID NO: 66067 - RNA, 24 nt, Human
gagggacacaagggcuuucccaga

SEQ ID NO: 66068 - RNA, 19 nt, Human
gagggggcguaauggucac

SEQ ID NO: 66069 - RNA, 18 nt, Human
gauucauaaacucuccuc

SEQ ID NO: 66070 - RNA, 23 nt, Human
gcaaaacaaacauaagacccccc

SEQ ID NO: 66071 - RNA, 22 nt, Human
gcagagaaaggcccauucuggg

SEQ ID NO: 66072 - RNA, 23 nt, Human
gcagggcaagcagggcgagggug

SEQ ID NO: 66073 - RNA, 19 nt, Human
gcauucccccagagcccca

SEQ ID NO: 66074 - RNA, 21 nt, Human
gccagggccccuggucagugg

SEQ ID NO: 66075 - RNA, 19 nt, Human
gccccaagggcagggcagg

SEQ ID NO: 66076 - RNA, 21 nt, Human
gccccaagggcagggcaggca

SEQ ID NO: 66077 - RNA, 20 nt, Human
gccugcuggugcugcuuggu

SEQ ID NO: 66078 - RNA, 24 nt, Human
gcggagcugaggggcaggugccuc

SEQ ID NO: 66079 - RNA, 19 nt, Human
gcucuuguucuugucuuga

SEQ ID NO: 66080 - RNA, 19 nt, Human
gcugcaucuguguccuugc

SEQ ID NO: 66081 - RNA, 21 nt, Human
gcuucucccccuccaucaccc

SEQ ID NO: 66082 - RNA, 22 nt, Human
gcuucugguggggggccugcgg

SEQ ID NO: 66083 - RNA, 21 nt, Human
ggaacccaugucuucugcccc

SEQ ID NO: 66084 - RNA, 20 nt, Human
ggaaugaccccggcagguua

SEQ ID NO: 66085 - RNA, 18 nt, Human
ggacaagcagaccacagg

SEQ ID NO: 66086 - RNA, 19 nt, Human
ggcccauucuggggcuggc

SEQ ID NO: 66087 - RNA, 22 nt, Human
ggccgguggugcugagcuuggg

SEQ ID NO: 66088 - RNA, 19 nt, Human
ggcugcaucuguguccuug

SEQ ID NO: 66089 - RNA, 20 nt, Human
gggcaaggaugagacaugcu

SEQ ID NO: 66090 - RNA, 22 nt, Human
gggcagggaugcacggguuguu

SEQ ID NO: 66091 - RNA, 20 nt, Human
gggccccuggucaggacccu

SEQ ID NO: 66092 - RNA, 20 nt, Human
gggcuucucccccuccauca

SEQ ID NO: 66093 - RNA, 21 nt, Human
ggggagaccaccauucauucc

SEQ ID NO: 66094 - RNA, 21 nt, Human
gggggccugcggcagggcaag

SEQ ID NO: 66095 - RNA, 19 nt, Human
gugcucccuuggggcuccu

SEQ ID NO: 66096 - RNA, 22 nt, Human
gugcugagcuuggggacagggc

SEQ ID NO: 66097 - RNA, 22 nt, Human
guuggagaguagagcagaaugu

SEQ ID NO: 66098 - RNA, 22 nt, Human
uaaaauacaauaaauacaacug

SEQ ID NO: 66099 - RNA, 21 nt, Human
uaagaaacagggagggggcgu

SEQ ID NO: 66100 - RNA, 19 nt, Human
uaagaccccccaaacuucc

SEQ ID NO: 66101 - RNA, 21 nt, Human
uaagaccccccaaacuuccaa

SEQ ID NO: 66102 - RNA, 23 nt, Human
uaaggaaagccaguugaaagucc

SEQ ID NO: 66103 - RNA, 21 nt, Human
uacaauaaauacaacugaucc

SEQ ID NO: 66104 - RNA, 24 nt, Human
ucacuggcuucuuccuguuuaugu

SEQ ID NO: 66105 - RNA, 20 nt, Human
ucagauuucccgccuaugcu

SEQ ID NO: 66106 - RNA, 24 nt, Human
ucagccaggcagaagauucuagag

SEQ ID NO: 66107 - RNA, 18 nt, Human
ucauuucacugagaaaca

SEQ ID NO: 66108 - RNA, 22 nt, Human
uccaaacucacaagcuaaaggc

SEQ ID NO: 66109 - RNA, 22 nt, Human
uccaagagaagcacagcaagcc

SEQ ID NO: 66110 - RNA, 22 nt, Human
uccacugacaccugcuuaugaa

SEQ ID NO: 66111 - RNA, 23 nt, Human
uccaggugagagaugacaaggcc

SEQ ID NO: 66112 - RNA, 19 nt, Human
uccagguggcucauggcuc

SEQ ID NO: 66113 - RNA, 21 nt, Human
ucccagaggguaggucccucc

SEQ ID NO: 66114 - RNA, 22 nt, Human
uccccagaagcaagaaagccuc

SEQ ID NO: 66115 - RNA, 19 nt, Human
ucccuuggggcuccugugg

SEQ ID NO: 66116 - RNA, 21 nt, Human
uccucuggucauggccggugg

SEQ ID NO: 66117 - RNA, 24 nt, Human
uccugggcaggccugcuggugcug

SEQ ID NO: 66118 - RNA, 20 nt, Human
uccugggcuucucccccucc

SEQ ID NO: 66119 - RNA, 19 nt, Human
ucuccaaacuccuuccugc

SEQ ID NO: 66120 - RNA, 23 nt, Human
ucucccaguccugggcuucuccc

SEQ ID NO: 66121 - RNA, 18 nt, Human
ucuccugggaaugaauga

SEQ ID NO: 66122 - RNA, 22 nt, Human
ucuccugggaaugaaugaaggu

SEQ ID NO: 66123 - RNA, 22 nt, Human
ucucuccaaacuccuuccugca

SEQ ID NO: 66124 - RNA, 23 nt, Human
ucugugcuucuuggcuccagcug

SEQ ID NO: 66125 - RNA, 20 nt, Human
ucuuucuuuuuuuaaaggaa

SEQ ID NO: 66126 - RNA, 19 nt, Human
ugaaggacaagcagaccac

SEQ ID NO: 66127 - RNA, 22 nt, Human
ugaaggacaagcagaccacagg

SEQ ID NO: 66128 - RNA, 22 nt, Human
ugaaggacucugggagggacac

SEQ ID NO: 66129 - RNA, 22 nt, Human
ugaccucaaggcgugcuguccu

SEQ ID NO: 66130 - RNA, 22 nt, Human
ugagaaacacuucuuugaucca

SEQ ID NO: 66131 - RNA, 21 nt, Human
ugauccccuaaugucugccag

SEQ ID NO: 66132 - RNA, 18 nt, Human
ugcagucagacucuacuc

SEQ ID NO: 66133 - RNA, 24 nt, Human
ugcauguguggcuaaucuggagaa

SEQ ID NO: 66134 - RNA, 20 nt, Human
ugccccagacuccagauggu

SEQ ID NO: 66135 - RNA, 18 nt, Human
ugccuaaagugcugccgg

SEQ ID NO: 66136 - RNA, 24 nt, Human
ugcugcuuggucacucugggcauu

SEQ ID NO: 66137 - RNA, 21 nt, Human
ugcuuaaacuguccacugaca

SEQ ID NO: 66138 - RNA, 21 nt, Human
ugcuuaugaaaucuuuuccuu

SEQ ID NO: 66139 - RNA, 20 nt, Human
uggaagggaaggaggcuggg

SEQ ID NO: 66140 - RNA, 18 nt, Human
uggacagaguguucuaga

SEQ ID NO: 66141 - RNA, 19 nt, Human
uggagccuuacuguggcug

SEQ ID NO: 66142 - RNA, 24 nt, Human
uggaggcagagguggccccaaggg

SEQ ID NO: 66143 - RNA, 27 nt, Human
uggaggcagagguggccccaagggcag

SEQ ID NO: 66144 - RNA, 18 nt, Human
uggaucacagcaaacacu

SEQ ID NO: 66145 - RNA, 24 nt, Human
uggaugcacagacagaccagcgga

SEQ ID NO: 66146 - RNA, 21 nt, Human
uggcaugggaggcucuuuugc

SEQ ID NO: 66147 - RNA, 18 nt, Human
uggcuaaucuggagaaca

SEQ ID NO: 66148 - RNA, 23 nt, Human
uggcugaacuuucauggguauaa

SEQ ID NO: 66149 - RNA, 20 nt, Human
uggcugcaucuguguccuug

SEQ ID NO: 66150 - RNA, 23 nt, Human
uggcugcaucuguguccuugcug

SEQ ID NO: 66151 - RNA, 21 nt, Human
ugggacugguuucuuucucgg

SEQ ID NO: 66152 - RNA, 23 nt, Human
ugggagaaggcagaggucccuga

SEQ ID NO: 66153 - RNA, 18 nt, Human
ugggaggagggugagugc

SEQ ID NO: 66154 - RNA, 23 nt, Human
uggggcaagcucaagccugcugg

SEQ ID NO: 66155 - RNA, 23 nt, Human
uggggggagugacgcauggacag

SEQ ID NO: 66156 - RNA, 24 nt, Human
uggguguguggcagaaccagaacu

SEQ ID NO: 66157 - RNA, 24 nt, Human
ugucacacugcacaaauuacauau

SEQ ID NO: 66158 - RNA, 20 nt, Human
ugucuucugccccugagacc

SEQ ID NO: 66159 - RNA, 19 nt, Human
ugugcaggguuucaaccac

SEQ ID NO: 66160 - RNA, 23 nt, Human
uguggcugcaucuguguccuugc

SEQ ID NO: 66161 - RNA, 23 nt, Human
uguuccuccagucgggcugaaga

SEQ ID NO: 66162 - RNA, 22 nt, Human
uuacugagcaauguuugacuuu

SEQ ID NO: 66163 - RNA, 19 nt, Human
uucaaggucagugccccac

SEQ ID NO: 66164 - RNA, 19 nt, Human
uuucacugagaaacacuuc

SEQ ID NO: 66165 - RNA, 25 nt, Human
uuuccuuucuuucuuuuuuuaaagg

SEQ ID NO: 66166 - RNA, 21 nt, Human
uuuucauuucacugagaaaca

SEQ ID NO: 66167 - RNA, 22 nt, Human
aaaacaccauacaucugaaaug

SEQ ID NO: 66168 - RNA, 24 nt, Human
aaaugaccauuugcauauaaaagc

SEQ ID NO: 66169 - RNA, 21 nt, Human
aauaaucaaugaugaggaaac

SEQ ID NO: 66170 - RNA, 20 nt, Human
aaugaugaggaaacacugga

SEQ ID NO: 66171 - RNA, 19 nt, Human
accauacaucugaaaugac

SEQ ID NO: 66172 - RNA, 24 nt, Human
auccacagcuagcccaauaaucaa

SEQ ID NO: 66173 - RNA, 22 nt, Human
caagcuauccacagcuagccca

SEQ ID NO: 66174 - RNA, 19 nt, Human
caauggcucugagauggcu

SEQ ID NO: 66175 - RNA, 24 nt, Human
caggaagcccucuagcguagauuc

SEQ ID NO: 66176 - RNA, 21 nt, Human
cauuggaaaaguuaagcuugg

SEQ ID NO: 66177 - RNA, 22 nt, Human
ccuuauccaguaagcuucacag

SEQ ID NO: 66178 - RNA, 19 nt, Human
cgcccgcgcccgcgcccgc

SEQ ID NO: 66179 - RNA, 18 nt, Human
cggcggcggcggcgguga

SEQ ID NO: 66180 - RNA, 20 nt, Human
gaaccaaugaaggcccagga

SEQ ID NO: 66181 - RNA, 19 nt, Human
gagcaggcuuaguuccacu

SEQ ID NO: 66182 - RNA, 18 nt, Human
gauacuauagcuguugcc

SEQ ID NO: 66183 - RNA, 21 nt, Human
gcccucuagcguagauuccua

SEQ ID NO: 66184 - RNA, 24 nt, Human
gcggcggcggcggugaguccggcg

SEQ ID NO: 66185 - RNA, 19 nt, Human
gcggcggugaguccggcgc

SEQ ID NO: 66186 - RNA, 23 nt, Human
ggaucccgcggcggcggcggcgg

SEQ ID NO: 66187 - RNA, 26 nt, Human
ggaucccgcggcggcggcggcgguga

SEQ ID NO: 66188 - RNA, 21 nt, Human
uaagauugacuuguaucaaug

SEQ ID NO: 66189 - RNA, 19 nt, Human
uacaaggaagaauaaacgg

SEQ ID NO: 66190 - RNA, 19 nt, Human
ucaggcggucagcuucuuc

SEQ ID NO: 66191 - RNA, 24 nt, Human
uccaaaaaccacagugcccggcac

SEQ ID NO: 66192 - RNA, 21 nt, Human
uccaaaauauacaauuaaugc

SEQ ID NO: 66193 - RNA, 18 nt, Human
ucccgcggcggcggcggc

SEQ ID NO: 66194 - RNA, 18 nt, Human
uccuaugacaucggaacc

SEQ ID NO: 66195 - RNA, 19 nt, Human
ucggaaccaaugaaggccc

SEQ ID NO: 66196 - RNA, 18 nt, Human
ucugaaaugaccauuugc

SEQ ID NO: 66197 - RNA, 18 nt, Human
ugaggaaacacuggagca

SEQ ID NO: 66198 - RNA, 23 nt, Human
ugaggaaacacuggagcaggcuu

SEQ ID NO: 66199 - RNA, 25 nt, Human
ugauuaaaaaauucaacacaaacag

SEQ ID NO: 66200 - RNA, 23 nt, Human
ugggaggaguuaggggccucugg

SEQ ID NO: 66201 - RNA, 24 nt, Human
ugggaggaguuaggggccucugga

SEQ ID NO: 66202 - RNA, 19 nt, Human
uuaaaaauauuuaacuguc

SEQ ID NO: 66203 - RNA, 18 nt, Human
uuacaccccagauccagc

SEQ ID NO: 66204 - RNA, 21 nt, Human
uuaugaagucaguacauaaaa

SEQ ID NO: 66205 - RNA, 22 nt, Human
uucaacacaaacagaauccaaa

SEQ ID NO: 66206 - RNA, 26 nt, Human
uuuuuuuuuuuuuuuauagaacaagg

SEQ ID NO: 66207 - RNA, 24 nt, Human
aaaacggagaaucccuuaagaacc

SEQ ID NO: 66208 - RNA, 27 nt, Human
aggcaaggacggagggagaggggaccc

SEQ ID NO: 66209 - RNA, 24 nt, Human
caaaacggagaaucccuuaagaac

SEQ ID NO: 66210 - RNA, 27 nt, Human
caaaauggaaccaaaacggagaaucuu

SEQ ID NO: 66211 - RNA, 26 nt, Human
caacauuaaaagcuacgauuauccag

SEQ ID NO: 66212 - RNA, 24 nt, Human
ccaaaacggagaaucccuuaagaa

SEQ ID NO: 66213 - RNA, 23 nt, Human
ggagaaucccuuaagaaccugaa

SEQ ID NO: 66214 - RNA, 25 nt, Human
gguaagggaggcaaggacggaggga

SEQ ID NO: 66215 - RNA, 22 nt, Human
uacaaaauggaaccaaaacgga

SEQ ID NO: 66216 - RNA, 19 nt, Human
uguacaaaauggaaccaaa

SEQ ID NO: 66217 - RNA, 24 nt, Human
agccuuuucuggggagagagauga

SEQ ID NO: 66218 - RNA, 18 nt, Human
auguugagccuuuucugg

SEQ ID NO: 66219 - RNA, 22 nt, Human
ccuuuucuggggagagagauga

SEQ ID NO: 66220 - RNA, 19 nt, Human
ucccacacagacgggcacc

SEQ ID NO: 66221 - RNA, 22 nt, Human
uuuuuuuuuuuuuuuuucacau

SEQ ID NO: 66222 - RNA, 24 nt, Human
aguggagccggagccacguggagg

SEQ ID NO: 66223 - RNA, 23 nt, Human
accagcggagucgggccgggggg

SEQ ID NO: 66224 - RNA, 19 nt, Human
acccccuccagacaccugg

SEQ ID NO: 66225 - RNA, 18 nt, Human
agacaccugagccucccc

SEQ ID NO: 66226 - RNA, 20 nt, Human
aggagccgguaccgggcugc

SEQ ID NO: 66227 - RNA, 20 nt, Human
aggcacaaacccccuccaga

SEQ ID NO: 66228 - RNA, 18 nt, Human
agggagcccaggaggagc

SEQ ID NO: 66229 - RNA, 18 nt, Human
aucacaugcccaggccag

SEQ ID NO: 66230 - RNA, 23 nt, Human
augggaccgaggggucuguccca

SEQ ID NO: 66231 - RNA, 21 nt, Human
caaacccccuccagacaccuu

SEQ ID NO: 66232 - RNA, 20 nt, Human
cacaaacccccuccagacac

SEQ ID NO: 66233 - RNA, 22 nt, Human
cacaaacccccuccagacaccu

SEQ ID NO: 66234 - RNA, 24 nt, Human
caccugagccucccccaaccggag

SEQ ID NO: 66235 - RNA, 27 nt, Human
caccugagccucccccacaggcuccca

SEQ ID NO: 66236 - RNA, 18 nt, Human
ccaaauacuccccgaccc

SEQ ID NO: 66237 - RNA, 26 nt, Human
ccaggcgccgcccuucccugagaccc

SEQ ID NO: 66238 - RNA, 18 nt, Human
ccccggacccaaauacuc

SEQ ID NO: 66239 - RNA, 30 nt, Human
cccggacccaaauacuccccgacccugacc

SEQ ID NO: 66240 - RNA, 20 nt, Human
cccugagaccccggacccaa

SEQ ID NO: 66241 - RNA, 20 nt, Human
ccgauaccgcagacccaggc

SEQ ID NO: 66242 - RNA, 22 nt, Human
ccugacggccgccuccugaagc

SEQ ID NO: 66243 - RNA, 20 nt, Human
ccugagaccccggacccaaa

SEQ ID NO: 66244 - RNA, 18 nt, Human
cgacccugacggccgccu

SEQ ID NO: 66245 - RNA, 19 nt, Human
cgggagaccgcgggcuggg

SEQ ID NO: 66246 - RNA, 22 nt, Human
cuccagacaccugagccucccc

SEQ ID NO: 66247 - RNA, 25 nt, Human
cuccccgacccugacggccgccucc

SEQ ID NO: 66248 - RNA, 22 nt, Human
gacaccugagccucccccacag

SEQ ID NO: 66249 - RNA, 22 nt, Human
gacccaaauacuccccgacccu

SEQ ID NO: 66250 - RNA, 22 nt, Human
gacggccgccuccugaagcucc

SEQ ID NO: 66251 - RNA, 18 nt, Human
gaucugauccuccucgcc

SEQ ID NO: 66252 - RNA, 18 nt, Human
gcagacccaggcgccgcc

SEQ ID NO: 66253 - RNA, 21 nt, Human
ggacaugggaccgaggggucu

SEQ ID NO: 66254 - RNA, 22 nt, Human
ggagggcuacuuggcuccagca

SEQ ID NO: 66255 - RNA, 18 nt, Human
ggccgccuccugaagcuc

SEQ ID NO: 66256 - RNA, 21 nt, Human
ggcugggacggaacuccucca

SEQ ID NO: 66257 - RNA, 27 nt, Human
gggccggggcccgacaguaccgggaga

SEQ ID NO: 66258 - RNA, 22 nt, Human
uagagggagcccaggaggagcc

SEQ ID NO: 66259 - RNA, 22 nt, Human
ucacaugcccaggccagccgag

SEQ ID NO: 66260 - RNA, 21 nt, Human
ucccugagaccccggacccaa

SEQ ID NO: 66261 - RNA, 22 nt, Human
ucccugagaccccggacccaaa

SEQ ID NO: 66262 - RNA, 21 nt, Human
ugaagcuccagagggccgggg

SEQ ID NO: 66263 - RNA, 21 nt, Human
ugagccucccccacaggcucc

SEQ ID NO: 66264 - RNA, 21 nt, Human
ugcccaggccagccgaggggc

SEQ ID NO: 66265 - RNA, 18 nt, Human
ugggacggaacuccucca

SEQ ID NO: 66266 - RNA, 21 nt, Human
uucccugagaccccggaccca

SEQ ID NO: 66267 - RNA, 18 nt, Human
uuuccgauaccgcagacc

SEQ ID NO: 66268 - RNA, 23 nt, Human
uuuuuuuuuucagaugugcaagu

SEQ ID NO: 66269 - RNA, 21 nt, Human
aaacccagccacccccaccuc

SEQ ID NO: 66270 - RNA, 25 nt, Human
aaaggccugagguccaacuuccaau

SEQ ID NO: 66271 - RNA, 18 nt, Human
aaaugguuaaaccucuga

SEQ ID NO: 66272 - RNA, 21 nt, Human
aacuggcuauuggcagagggg

SEQ ID NO: 66273 - RNA, 22 nt, Human
aagccacagucauggugcaggc

SEQ ID NO: 66274 - RNA, 18 nt, Human
aagccugcaacaacucug

SEQ ID NO: 66275 - RNA, 28 nt, Human
acaaagcaucuucacagcccgcgucucc

SEQ ID NO: 66276 - RNA, 18 nt, Human
acaugcuccagccaacag

SEQ ID NO: 66277 - RNA, 24 nt, Human
acccccaccucuagacacaugcuc

SEQ ID NO: 66278 - RNA, 23 nt, Human
accugaacaacaaaaugggccuu

SEQ ID NO: 66279 - RNA, 18 nt, Human
agaaaugugauucacucc

SEQ ID NO: 66280 - RNA, 21 nt, Human
agaagccuugccaacagaacc

SEQ ID NO: 66281 - RNA, 18 nt, Human
agcaagagaagggccaag

SEQ ID NO: 66282 - RNA, 20 nt, Human
agccacccccaccucuagac

SEQ ID NO: 66283 - RNA, 18 nt, Human
agccagcuguuccagccu

SEQ ID NO: 66284 - RNA, 24 nt, Human
caacaaaaugggccuuaugcucug

SEQ ID NO: 66285 - RNA, 20 nt, Human
caacagcaggaguguugcag

SEQ ID NO: 66286 - RNA, 20 nt, Human
caccaaggcccguuaucuuc

SEQ ID NO: 66287 - RNA, 21 nt, Human
cacuuggagugccugaacaug

SEQ ID NO: 66288 - RNA, 21 nt, Human
cagcuguuccagccuccagga

SEQ ID NO: 66289 - RNA, 25 nt, Human
ccacagucauggugcaggcauucug

SEQ ID NO: 66290 - RNA, 24 nt, Human
ccacccccaccucuagacacaugc

SEQ ID NO: 66291 - RNA, 19 nt, Human
ccccgccgccuccgacccg

SEQ ID NO: 66292 - RNA, 22 nt, Human
ccccgccgccuccgacccgggc

SEQ ID NO: 66293 - RNA, 21 nt, Human
cccgcgggcgcccgcugcccg

SEQ ID NO: 66294 - RNA, 24 nt, Human
ccuccgacccgggcccccggcugc

SEQ ID NO: 66295 - RNA, 20 nt, Human
ccuguaaagccugcaacaac

SEQ ID NO: 66296 - RNA, 25 nt, Human
cgaggccgggcgcucggcccccgcc

SEQ ID NO: 66297 - RNA, 19 nt, Human
cggcccccgccgccuccga

SEQ ID NO: 66298 - RNA, 22 nt, Human
cucggcccccgccgccuccgac

SEQ ID NO: 66299 - RNA, 23 nt, Human
cugaacaugauccuucaccgaca

SEQ ID NO: 66300 - RNA, 24 nt, Human
cugaaccaugaugucuagcuagca

SEQ ID NO: 66301 - RNA, 24 nt, Human
cugucugcucccuucauuugcgua

SEQ ID NO: 66302 - RNA, 18 nt, Human
gagccagcuguuccagcc

SEQ ID NO: 66303 - RNA, 19 nt, Human
gauaacaaaugagacaaga

SEQ ID NO: 66304 - RNA, 24 nt, Human
gcuuaggaaagggggauaaaccca

SEQ ID NO: 66305 - RNA, 23 nt, Human
ggccaagugaacccagguuggga

SEQ ID NO: 66306 - RNA, 20 nt, Human
gggggauaaacccagccacc

SEQ ID NO: 66307 - RNA, 22 nt, Human
gugaguaaggggugaaccaaga

SEQ ID NO: 66308 - RNA, 18 nt, Human
uaaaagccacagucaugg

SEQ ID NO: 66309 - RNA, 26 nt, Human
uaaaccucugacucagauccugaacc

SEQ ID NO: 66310 - RNA, 22 nt, Human
uaaaccucugacucaggacccu

SEQ ID NO: 66311 - RNA, 27 nt, Human
uaaagccugcaacaacucugacaguua

SEQ ID NO: 66312 - RNA, 23 nt, Human
uaagaaaugugauucacuccaau

SEQ ID NO: 66313 - RNA, 26 nt, Human
uaagaaaugugauucacuccaauaau

SEQ ID NO: 66314 - RNA, 21 nt, Human
uaagagcaagagaagggccaa

SEQ ID NO: 66315 - RNA, 23 nt, Human
uaaguucccagcugucccaaggc

SEQ ID NO: 66316 - RNA, 22 nt, Human
ugacuugugagucuaaaagagc

SEQ ID NO: 66317 - RNA, 24 nt, Human
ugagacaagagucgugagaaaagg

SEQ ID NO: 66318 - RNA, 24 nt, Human
ugccaauuuuucauaagaaaaaag

SEQ ID NO: 66319 - RNA, 18 nt, Human
ugcccggcuucuuggaaa

SEQ ID NO: 66320 - RNA, 22 nt, Human
ugccggggccugcuccgccccg

SEQ ID NO: 66321 - RNA, 18 nt, Human
ugcuguggcggaggagga

SEQ ID NO: 66322 - RNA, 21 nt, Human
ugggccuuaugcucugugaug

SEQ ID NO: 66323 - RNA, 19 nt, Human
ugugaugagauaagugagu

SEQ ID NO: 66324 - RNA, 21 nt, Human
uguggcagguccagcaauguc

SEQ ID NO: 66325 - RNA, 21 nt, Human
ugugguuuaagagcaagagaa

SEQ ID NO: 66326 - RNA, 21 nt, Human
uuagacauuauaauuagugcc

SEQ ID NO: 66327 - RNA, 23 nt, Human
uucauaagaaaaaagcuuauaaa

SEQ ID NO: 66328 - RNA, 20 nt, Human
uuccccggcaauuaaauuug

SEQ ID NO: 66329 - RNA, 19 nt, Human
uuccuaaaaaaaaagaugu

SEQ ID NO: 66330 - RNA, 19 nt, Human
uugcuguugaccugaacaa

SEQ ID NO: 66331 - RNA, 19 nt, Human
aaaacuccccgaggucucc

SEQ ID NO: 66332 - RNA, 24 nt, Human
aaaaugcugggauuaaaggcauga

SEQ ID NO: 66333 - RNA, 23 nt, Human
acagggucuugcuauguggccca

SEQ ID NO: 66334 - RNA, 23 nt, Human
accucagccucuggaguagcugg

SEQ ID NO: 66335 - RNA, 24 nt, Human
acgagaucugguuguuuaaaagug

SEQ ID NO: 66336 - RNA, 24 nt, Human
acuauguugcccaggcuggucuug

SEQ ID NO: 66337 - RNA, 25 nt, Human
acuauguugcccaggcuggucuuga

SEQ ID NO: 66338 - RNA, 22 nt, Human
acuccuggucucaagccaucuu

SEQ ID NO: 66339 - RNA, 20 nt, Human
agacagggucuugcuaugug

SEQ ID NO: 66340 - RNA, 20 nt, Human
agccucagccuccugggcuc

SEQ ID NO: 66341 - RNA, 21 nt, Human
aucucccugccuuagccuccc

SEQ ID NO: 66342 - RNA, 20 nt, Human
augcuucugugcagcugcag

SEQ ID NO: 66343 - RNA, 24 nt, Human
caaaaugcugggauuaaaggcaug

SEQ ID NO: 66344 - RNA, 21 nt, Human
caccucagccucuggaguagc

SEQ ID NO: 66345 - RNA, 19 nt, Human
cacuauguugcccaggcug

SEQ ID NO: 66346 - RNA, 24 nt, Human
cacuauguugcccaggcuggucuu

SEQ ID NO: 66347 - RNA, 27 nt, Human
cacuauguugcccaggcuggucuugaa

SEQ ID NO: 66348 - RNA, 20 nt, Human
cagaaauacugaaggaccag

SEQ ID NO: 66349 - RNA, 23 nt, Human
cagccucagccuccugggcucaa

SEQ ID NO: 66350 - RNA, 24 nt, Human
cagccucagccuccugggcucaaa

SEQ ID NO: 66351 - RNA, 22 nt, Human
cagccuccugggcucaaaugau

SEQ ID NO: 66352 - RNA, 24 nt, Human
cagggucuugcuauguggcccagg

SEQ ID NO: 66353 - RNA, 20 nt, Human
cagguauuucuuugcaagaa

SEQ ID NO: 66354 - RNA, 19 nt, Human
cauugcagccucagccucc

SEQ ID NO: 66355 - RNA, 24 nt, Human
ccaaaaugcugggauuaaaggcau

SEQ ID NO: 66356 - RNA, 22 nt, Human
ccaugagcaaaaacuccccgag

SEQ ID NO: 66357 - RNA, 23 nt, Human
cccaccucagccucuggaguagc

SEQ ID NO: 66358 - RNA, 23 nt, Human
ccccgaggucucccagaagcaga

SEQ ID NO: 66359 - RNA, 19 nt, Human
cccgaggucucccagaagc

SEQ ID NO: 66360 - RNA, 20 nt, Human
ccgcaagacgccugcucccc

SEQ ID NO: 66361 - RNA, 22 nt, Human
ccucagccuccugggcucaaau

SEQ ID NO: 66362 - RNA, 21 nt, Human
ccucagccucuggaguagcug

SEQ ID NO: 66363 - RNA, 24 nt, Human
ccuccugggcucaaaugaucuucc

SEQ ID NO: 66364 - RNA, 18 nt, Human
ccucuccucucuuggucc

SEQ ID NO: 66365 - RNA, 22 nt, Human
ccugggcucaaaugaucuuccc

SEQ ID NO: 66366 - RNA, 20 nt, Human
ccuggucucaagccaucucc

SEQ ID NO: 66367 - RNA, 26 nt, Human
ccuuuuuuuuuuuuuuuuuuuuuuug

SEQ ID NO: 66368 - RNA, 19 nt, Human
cgcaagacgccugcucccc

SEQ ID NO: 66369 - RNA, 23 nt, Human
cgccugcucccccuucgccuucc

SEQ ID NO: 66370 - RNA, 24 nt, Human
cucaaaugaucuucccaccucagc

SEQ ID NO: 66371 - RNA, 24 nt, Human
cucagccucuggaguagcugggac

SEQ ID NO: 66372 - RNA, 23 nt, Human
cucccagaagcagaugcugccau

SEQ ID NO: 66373 - RNA, 26 nt, Human
cucccugccuuagccucccaaaaugc

SEQ ID NO: 66374 - RNA, 24 nt, Human
cucuggaguagcugggaccacagg

SEQ ID NO: 66375 - RNA, 23 nt, Human
cugaaggaccaaauaaaugauau

SEQ ID NO: 66376 - RNA, 23 nt, Human
cugccuuagccucccaaaaugcu

SEQ ID NO: 66377 - RNA, 24 nt, Human
cugccuuagccucccaaaaugcug

SEQ ID NO: 66378 - RNA, 24 nt, Human
cuggaguagcugggaccacaggug

SEQ ID NO: 66379 - RNA, 22 nt, Human
cuggcccagagcgcaggaccuu

SEQ ID NO: 66380 - RNA, 20 nt, Human
cugggauuaaaggcaugagc

SEQ ID NO: 66381 - RNA, 23 nt, Human
cuucccaccucagccucuggagu

SEQ ID NO: 66382 - RNA, 21 nt, Human
cuugcuauguggcccaggcug

SEQ ID NO: 66383 - RNA, 20 nt, Human
gagacagggucuugcuaugu

SEQ ID NO: 66384 - RNA, 26 nt, Human
gaguagcugggaccacaggugcacac

SEQ ID NO: 66385 - RNA, 18 nt, Human
gauuaaaggcaugagcca

SEQ ID NO: 66386 - RNA, 20 nt, Human
gcagccucagccuccugggc

SEQ ID NO: 66387 - RNA, 19 nt, Human
gccauagaaggaaggugac

SEQ ID NO: 66388 - RNA, 20 nt, Human
gcccaggcuggaguucagug

SEQ ID NO: 66389 - RNA, 18 nt, Human
gccucagccuccugggcu

SEQ ID NO: 66390 - RNA, 26 nt, Human
gcguccuuuauuccuuuuuuuuuuuu

SEQ ID NO: 66391 - RNA, 19 nt, Human
ggcgguggggccugggggg

SEQ ID NO: 66392 - RNA, 24 nt, Human
ggcuggucuugaacuccuggucuc

SEQ ID NO: 66393 - RNA, 24 nt, Human
gggcgucucacuauguugcccagg

SEQ ID NO: 66394 - RNA, 21 nt, Human
guagcuucucacgagaucugg

SEQ ID NO: 66395 - RNA, 20 nt, Human
guggugcaauaauuaucagu

SEQ ID NO: 66396 - RNA, 19 nt, Human
uacccagucucagguauuu

SEQ ID NO: 66397 - RNA, 20 nt, Human
uagagaugggggggggggcg

SEQ ID NO: 66398 - RNA, 22 nt, Human
uaguuucuguaacuucuaauga

SEQ ID NO: 66399 - RNA, 18 nt, Human
uauguggcccaggcugga

SEQ ID NO: 66400 - RNA, 19 nt, Human
uauguugcccaggcugguc

SEQ ID NO: 66401 - RNA, 23 nt, Human
uauguugcccaggcuggucuuga

SEQ ID NO: 66402 - RNA, 24 nt, Human
uauguugcccaggcuggucuugaa

SEQ ID NO: 66403 - RNA, 18 nt, Human
ucagccucuggaguagcu

SEQ ID NO: 66404 - RNA, 22 nt, Human
ucaguggugcaauaauuaucag

SEQ ID NO: 66405 - RNA, 23 nt, Human
ucauugcagccucagccuccugg

SEQ ID NO: 66406 - RNA, 24 nt, Human
ucauugcagccucagccuccuggg

SEQ ID NO: 66407 - RNA, 28 nt, Human
uccaccaugagcaaaaacuccccgaggu

SEQ ID NO: 66408 - RNA, 24 nt, Human
ucccaaaaugcugggauuaaaggc

SEQ ID NO: 66409 - RNA, 25 nt, Human
ucccagaagcagaugcugccaugcu

SEQ ID NO: 66410 - RNA, 18 nt, Human
ucccccgcuuggugcugc

SEQ ID NO: 66411 - RNA, 21 nt, Human
uccccgaggucucccagaagc

SEQ ID NO: 66412 - RNA, 20 nt, Human
uccugggcucaaaugaucuu

SEQ ID NO: 66413 - RNA, 24 nt, Human
uccugggcucaaaugaucuuccca

SEQ ID NO: 66414 - RNA, 18 nt, Human
uccuuuuuuuuuuuuuuu

SEQ ID NO: 66415 - RNA, 18 nt, Human
uccuuuuuuuuuuuuuuu

SEQ ID NO: 66416 - RNA, 19 nt, Human
ucucacuauguugcccagg

SEQ ID NO: 66417 - RNA, 23 nt, Human
ucucacuauguugcccaggcugg

SEQ ID NO: 66418 - RNA, 24 nt, Human
ucucacuauguugcccaggcuggu

SEQ ID NO: 66419 - RNA, 26 nt, Human
ucucacuauguugcccaggcuggucu

SEQ ID NO: 66420 - RNA, 27 nt, Human
ucucacuauguugcccaggcuggucuu

SEQ ID NO: 66421 - RNA, 24 nt, Human
ucuggaguagcugggaccacaggu

SEQ ID NO: 66422 - RNA, 21 nt, Human
ucuugaacuccuggucucaag

SEQ ID NO: 66423 - RNA, 22 nt, Human
ucuugcuauguggcccaggcug

SEQ ID NO: 66424 - RNA, 23 nt, Human
ucuugcuauguggcccaggcugg

SEQ ID NO: 66425 - RNA, 24 nt, Human
ucuugcuauguggcccaggcugga

SEQ ID NO: 66426 - RNA, 23 nt, Human
ugagcaaaaacuccccgaggucu

SEQ ID NO: 66427 - RNA, 21 nt, Human
ugaggcuguuaagucauuggc

SEQ ID NO: 66428 - RNA, 22 nt, Human
ugcagaacgugagccaauccaa

SEQ ID NO: 66429 - RNA, 24 nt, Human
ugcccaggcuggucuugaacuccu

SEQ ID NO: 66430 - RNA, 21 nt, Human
ugccccaccugaaaaugcaga

SEQ ID NO: 66431 - RNA, 23 nt, Human
ugcccugcgcacuccgcgcccgg

SEQ ID NO: 66432 - RNA, 24 nt, Human
ugccuuagccucccaaaaugcugg

SEQ ID NO: 66433 - RNA, 24 nt, Human
uggaguagcugggaccacaggugc

SEQ ID NO: 66434 - RNA, 24 nt, Human
ugggaccacaggugcacaccacca

SEQ ID NO: 66435 - RNA, 22 nt, Human
ugggauuaaaggcaugagccac

SEQ ID NO: 66436 - RNA, 23 nt, Human
ugggauuaaaggcaugagccacc

SEQ ID NO: 66437 - RNA, 25 nt, Human
ugggauuaaaggcaugagccaccuu

SEQ ID NO: 66438 - RNA, 22 nt, Human
ugggcucaaaugaucuucccac

SEQ ID NO: 66439 - RNA, 24 nt, Human
ugggcucaaaugaucuucccaccu

SEQ ID NO: 66440 - RNA, 18 nt, Human
uggggggaggugacugaa

SEQ ID NO: 66441 - RNA, 20 nt, Human
uuaaauuuuuuguagagaug

SEQ ID NO: 66442 - RNA, 23 nt, Human
uucccaccucagccucuggagua

SEQ ID NO: 66443 - RNA, 20 nt, Human
uuccucuccucucuuggucc

SEQ ID NO: 66444 - RNA, 20 nt, Human
uugcagccucagccuccugg

SEQ ID NO: 66445 - RNA, 21 nt, Human
uuguuuaaaagugugcggcuc

SEQ ID NO: 66446 - RNA, 18 nt, Human
uuuuuuguagagaugggg

SEQ ID NO: 66447 - RNA, 25 nt, Human
uuuuuuuuuuuuggagacagggucu

SEQ ID NO: 66448 - RNA, 18 nt, Human
uuuuuuuuuuuuuuuuug

SEQ ID NO: 66449 - RNA, 28 nt, Human
uuuuuuuuuuuuuuuuuuggagacaggg

SEQ ID NO: 66450 - RNA, 19 nt, Human
ccugaauccccgaucaaga

SEQ ID NO: 66451 - RNA, 20 nt, Human
cugcuccugggcuccuuccu

SEQ ID NO: 66452 - RNA, 18 nt, Human
ucucucucuacuuccucu

SEQ ID NO: 66453 - RNA, 19 nt, Human
ucugcuccugggcuccuuc

SEQ ID NO: 66454 - RNA, 26 nt, Human
aaacaaaaagguuggaucccaacagu

SEQ ID NO: 66455 - RNA, 24 nt, Human
agcacuuugggaggccgaggccgg

SEQ ID NO: 66456 - RNA, 24 nt, Human
agccuggucaacauggugagagcc

SEQ ID NO: 66457 - RNA, 24 nt, Human
aggaguggugguucacgccuguaa

SEQ ID NO: 66458 - RNA, 21 nt, Human
aggccgaggccggcggaucac

SEQ ID NO: 66459 - RNA, 22 nt, Human
aggccggcggaucacuugaggg

SEQ ID NO: 66460 - RNA, 21 nt, Human
aucacuugaggucgggaguuc

SEQ ID NO: 66461 - RNA, 25 nt, Human
caacagcaguggaaaaguaacagaa

SEQ ID NO: 66462 - RNA, 20 nt, Human
caacauggugagagccuguc

SEQ ID NO: 66463 - RNA, 22 nt, Human
caacauggugagagccugucuc

SEQ ID NO: 66464 - RNA, 24 nt, Human
cacgccuguaaucccagcacuuug

SEQ ID NO: 66465 - RNA, 20 nt, Human
cagaagggccaggaguggug

SEQ ID NO: 66466 - RNA, 22 nt, Human
cagcacuuugggaggccgaggc

SEQ ID NO: 66467 - RNA, 25 nt, Human
cagcacuuugggaggccgaggccgg

SEQ ID NO: 66468 - RNA, 20 nt, Human
cagugggccuuuaauaaucu

SEQ ID NO: 66469 - RNA, 18 nt, Human
ccaaaggcuuccucuggu

SEQ ID NO: 66470 - RNA, 22 nt, Human
ccuggucaacauggugagagcc

SEQ ID NO: 66471 - RNA, 24 nt, Human
ccuggucaacauggugagagccug

SEQ ID NO: 66472 - RNA, 22 nt, Human
ccuguaaucccagcacuuuggg

SEQ ID NO: 66473 - RNA, 24 nt, Human
cgagaccagccuggucaacauggu

SEQ ID NO: 66474 - RNA, 21 nt, Human
cgaggccggcggaucacuuga

SEQ ID NO: 66475 - RNA, 24 nt, Human
cgaggccggcggaucacuugaggu

SEQ ID NO: 66476 - RNA, 23 nt, Human
cgccuguaaucccagcacuuugg

SEQ ID NO: 66477 - RNA, 24 nt, Human
cggaucacuugaggucgggaguuc

SEQ ID NO: 66478 - RNA, 26 nt, Human
gacuucuaucucaacagcaguggaaa

SEQ ID NO: 66479 - RNA, 24 nt, Human
gaucacuugaggucgggaguucga

SEQ ID NO: 66480 - RNA, 20 nt, Human
ggaucacuugaggucgggaa

SEQ ID NO: 66481 - RNA, 23 nt, Human
ggaucacuugaggucgggaguuc

SEQ ID NO: 66482 - RNA, 19 nt, Human
gggaggccgaggccggcgg

SEQ ID NO: 66483 - RNA, 24 nt, Human
ggugguucacgccuguaaucccag

SEQ ID NO: 66484 - RNA, 19 nt, Human
uaauuaucucuucucguua

SEQ ID NO: 66485 - RNA, 19 nt, Human
uagccugauuguaauuauc

SEQ ID NO: 66486 - RNA, 24 nt, Human
uauacaaacaaaaagguuggaucc

SEQ ID NO: 66487 - RNA, 23 nt, Human
ucacgccuguaaucccagcacuu

SEQ ID NO: 66488 - RNA, 28 nt, Human
ugaaagcaccaaaguuaguuggagaccc

SEQ ID NO: 66489 - RNA, 18 nt, Human
ugggaggccgaggccggc

SEQ ID NO: 66490 - RNA, 24 nt, Human
ugggaggccgaggccggcggauca

SEQ ID NO: 66491 - RNA, 24 nt, Human
uggugguucacgccuguaauccca

SEQ ID NO: 66492 - RNA, 24 nt, Human
ugguucacgccuguaaucccagca

SEQ ID NO: 66493 - RNA, 25 nt, Human
uugggaggccgaggccggcggauca

SEQ ID NO: 66494 - RNA, 21 nt, Human
aagcacacauggccaacaucc

SEQ ID NO: 66495 - RNA, 20 nt, Human
agccggucuggcagcuacca

SEQ ID NO: 66496 - RNA, 18 nt, Human
cacacauggccaacaucc

SEQ ID NO: 66497 - RNA, 19 nt, Human
ccucaucuaggccuugucc

SEQ ID NO: 66498 - RNA, 19 nt, Human
cucaguuuccucaucuagg

SEQ ID NO: 66499 - RNA, 21 nt, Human
cugaagcacacauggccaaca

SEQ ID NO: 66500 - RNA, 22 nt, Human
uacagcccuggguaagguucag

SEQ ID NO: 66501 - RNA, 19 nt, Human
ucuaggccuuguccugggu

SEQ ID NO: 66502 - RNA, 18 nt, Human
ucuccuguuucuccacca

SEQ ID NO: 66503 - RNA, 25 nt, Human
uggguaagguucaguccccagauug

SEQ ID NO: 66504 - RNA, 22 nt, Human
uuacacugaagcacacauggcc

SEQ ID NO: 66505 - RNA, 18 nt, Human
uuuuuuuuuugccggccc

SEQ ID NO: 66506 - RNA, 19 nt, Human
uuuuuuuuuuuuuugccgg

SEQ ID NO: 66507 - RNA, 22 nt, Human
uuuuuuuuuuuuuuuuugccgg

SEQ ID NO: 66508 - RNA, 27 nt, Human
uuuuuuuuuuuuuuuuuuuuuuugggg

SEQ ID NO: 66509 - RNA, 27 nt, Human
aaaaauacaucauuccuuuugaucucc

SEQ ID NO: 66510 - RNA, 19 nt, Human
aaacugacuccccacucuc

SEQ ID NO: 66511 - RNA, 18 nt, Human
aagugaaaaguucuguga

SEQ ID NO: 66512 - RNA, 22 nt, Human
caaacugacuccccacucucag

SEQ ID NO: 66513 - RNA, 18 nt, Human
cagaaguauacaguuuuc

SEQ ID NO: 66514 - RNA, 23 nt, Human
ccaacacguaaaaaauacaucau

SEQ ID NO: 66515 - RNA, 24 nt, Human
cuuucugaauuugcaaaaugaaua

SEQ ID NO: 66516 - RNA, 22 nt, Human
uauccagugacuuuggccaaca

SEQ ID NO: 66517 - RNA, 21 nt, Human
ucaaacugacuccccacucuc

SEQ ID NO: 66518 - RNA, 23 nt, Human
ugaauaacaaauauacaauucuc

SEQ ID NO: 66519 - RNA, 24 nt, Human
ugacauauaucuggaccaacuuuc

SEQ ID NO: 66520 - RNA, 21 nt, Human
uguggaucccuauaguuauuu

SEQ ID NO: 66521 - RNA, 24 nt, Human
uuggccaacacguaaaaaauacau

SEQ ID NO: 66522 - RNA, 21 nt, Human
uuuaccuaaucaaaaucuuuu

SEQ ID NO: 66523 - RNA, 24 nt, Human
uuuuuuuuuuuuuuuuuuaccuaa

SEQ ID NO: 66524 - RNA, 19 nt, Human
aaagcccagccaggcaccc

SEQ ID NO: 66525 - RNA, 24 nt, Human
acacacagcaccaugucaguaaac

SEQ ID NO: 66526 - RNA, 20 nt, Human
acgaacagcaggcacugaaa

SEQ ID NO: 66527 - RNA, 22 nt, Human
acggcacgaucugcucagggug

SEQ ID NO: 66528 - RNA, 19 nt, Human
acugcagggcucuggggag

SEQ ID NO: 66529 - RNA, 21 nt, Human
acugcagggcucuggggaggu

SEQ ID NO: 66530 - RNA, 22 nt, Human
agcagcccagucggccuccucg

SEQ ID NO: 66531 - RNA, 18 nt, Human
agcaugggcuggagaaag

SEQ ID NO: 66532 - RNA, 20 nt, Human
agcccagccaggcacccuuc

SEQ ID NO: 66533 - RNA, 25 nt, Human
aggcuccaggcagaugcggcagccc

SEQ ID NO: 66534 - RNA, 19 nt, Human
agguaggauggggggagug

SEQ ID NO: 66535 - RNA, 22 nt, Human
augcggcagccccggccccagc

SEQ ID NO: 66536 - RNA, 23 nt, Human
caaagcccagccaggcacccuuc

SEQ ID NO: 66537 - RNA, 19 nt, Human
cacagcaccaugucaguaa

SEQ ID NO: 66538 - RNA, 21 nt, Human
caccccccacaccguggucug

SEQ ID NO: 66539 - RNA, 23 nt, Human
caccccccacaccguggucugcc

SEQ ID NO: 66540 - RNA, 26 nt, Human
cacccuccuaucccaccagccccaaa

SEQ ID NO: 66541 - RNA, 23 nt, Human
cacccuccuaucccaccagccuc

SEQ ID NO: 66542 - RNA, 21 nt, Human
cacccuucccugccaccuccc

SEQ ID NO: 66543 - RNA, 19 nt, Human
caccucccugggcccugcc

SEQ ID NO: 66544 - RNA, 21 nt, Human
cacgcggccgcaacucggacc

SEQ ID NO: 66545 - RNA, 23 nt, Human
cagaccuggcccgcaccacuggg

SEQ ID NO: 66546 - RNA, 24 nt, Human
cagcaugggcuggagaaaggcucu

SEQ ID NO: 66547 - RNA, 24 nt, Human
cagcccccucccugccuagcugcc

SEQ ID NO: 66548 - RNA, 20 nt, Human
caggccuagggaguuaggua

SEQ ID NO: 66549 - RNA, 22 nt, Human
ccagcagcccagucggccuccu

SEQ ID NO: 66550 - RNA, 22 nt, Human
ccagccccaaagcccagccagg

SEQ ID NO: 66551 - RNA, 22 nt, Human
ccaggcagaugcggcagccccg

SEQ ID NO: 66552 - RNA, 24 nt, Human
ccagucggccuccucgggccuucu

SEQ ID NO: 66553 - RNA, 19 nt, Human
cccaccagccccaaagccc

SEQ ID NO: 66554 - RNA, 24 nt, Human
cccaggcuccaggcagaugcggca

SEQ ID NO: 66555 - RNA, 23 nt, Human
cccagggcugggccuuguggggc

SEQ ID NO: 66556 - RNA, 19 nt, Human
ccccaaagcccagccaggc

SEQ ID NO: 66557 - RNA, 22 nt, Human
ccccaaagcccagccaggcacc

SEQ ID NO: 66558 - RNA, 22 nt, Human
ccccaaagucaggcuuggcugg

SEQ ID NO: 66559 - RNA, 19 nt, Human
ccccaccuugcugcuucca

SEQ ID NO: 66560 - RNA, 24 nt, Human
ccccggccccagccagcaugggcu

SEQ ID NO: 66561 - RNA, 20 nt, Human
ccccggguccguuggcgcgc

SEQ ID NO: 66562 - RNA, 18 nt, Human
ccccucccuccaggccca

SEQ ID NO: 66563 - RNA, 22 nt, Human
ccccuggcgccagaccuggccc

SEQ ID NO: 66564 - RNA, 23 nt, Human
cccuccuaucccaccagccccaa

SEQ ID NO: 66565 - RNA, 19 nt, Human
ccuccaggcccagcgcgca

SEQ ID NO: 66566 - RNA, 19 nt, Human
ccucccugccuagcugccu

SEQ ID NO: 66567 - RNA, 20 nt, Human
ccuccuaucccaccagcccc

SEQ ID NO: 66568 - RNA, 26 nt, Human
ccuccuaucccaccagccccaaagcc

SEQ ID NO: 66569 - RNA, 27 nt, Human
ccuccuaucccaccagccggguccuuc

SEQ ID NO: 66570 - RNA, 23 nt, Human
ccuccucgggccuucugucacuc

SEQ ID NO: 66571 - RNA, 23 nt, Human
ccucggaccccagaagggcuucc

SEQ ID NO: 66572 - RNA, 28 nt, Human
ccucggaccccagaagggcuuccccggg

SEQ ID NO: 66573 - RNA, 27 nt, Human
ccugacccccaccuugcugccgguucc

SEQ ID NO: 66574 - RNA, 21 nt, Human
ccugcagggugcccagggaga

SEQ ID NO: 66575 - RNA, 23 nt, Human
ccugccugcagggugcccaggga

SEQ ID NO: 66576 - RNA, 20 nt, Human
ccuggcgccagaccuggccc

SEQ ID NO: 66577 - RNA, 22 nt, Human
ccuucccugccaccucccuggg

SEQ ID NO: 66578 - RNA, 23 nt, Human
ccuucccugccaccucccugggc

SEQ ID NO: 66579 - RNA, 24 nt, Human
ccuugcccagggcugggccuugug

SEQ ID NO: 66580 - RNA, 24 nt, Human
cgacacccacccugcaggcucugg

SEQ ID NO: 66581 - RNA, 19 nt, Human
cgccagaccuggcccgcac

SEQ ID NO: 66582 - RNA, 18 nt, Human
cgcccccucccuccaggc

SEQ ID NO: 66583 - RNA, 21 nt, Human
cgcccccucccuccaggccca

SEQ ID NO: 66584 - RNA, 19 nt, Human
cggugcggcgcggcgcggg

SEQ ID NO: 66585 - RNA, 24 nt, Human
cucccugggcccugccccagcagc

SEQ ID NO: 66586 - RNA, 18 nt, Human
cugcagggcucuggggag

SEQ ID NO: 66587 - RNA, 19 nt, Human
cugccaccucccugggccc

SEQ ID NO: 66588 - RNA, 19 nt, Human
cugccugcagggugcccag

SEQ ID NO: 66589 - RNA, 19 nt, Human
cuugcccagggcugggccu

SEQ ID NO: 66590 - RNA, 21 nt, Human
gaccggugcgggggccgcccc

SEQ ID NO: 66591 - RNA, 20 nt, Human
gaccuggcccgcaccacugg

SEQ ID NO: 66592 - RNA, 21 nt, Human
gccccaaagcccagccaggca

SEQ ID NO: 66593 - RNA, 23 nt, Human
gccccaaagcccagccaggcacc

SEQ ID NO: 66594 - RNA, 21 nt, Human
gccuccucgggccuucuguca

SEQ ID NO: 66595 - RNA, 18 nt, Human
gcgcggcgcgggucgcag

SEQ ID NO: 66596 - RNA, 21 nt, Human
ggcaggaggguguccccaaag

SEQ ID NO: 66597 - RNA, 20 nt, Human
gggagcggcguucccagggc

SEQ ID NO: 66598 - RNA, 18 nt, Human
gggagugggguggggggg

SEQ ID NO: 66599 - RNA, 20 nt, Human
gggcaccccccacaccgugg

SEQ ID NO: 66600 - RNA, 18 nt, Human
ggggagguggggcaccug

SEQ ID NO: 66601 - RNA, 18 nt, Human
ggggaguggggugggggg

SEQ ID NO: 66602 - RNA, 22 nt, Human
ggggaguggggugggggggcag

SEQ ID NO: 66603 - RNA, 22 nt, Human
guucuuucccagcccccucccu

SEQ ID NO: 66604 - RNA, 19 nt, Human
uaagaacaagaggcugggc

SEQ ID NO: 66605 - RNA, 19 nt, Human
uagccugacccccaccuug

SEQ ID NO: 66606 - RNA, 21 nt, Human
uagccugacccccaccuugcu

SEQ ID NO: 66607 - RNA, 19 nt, Human
uaggauggggggagugggg

SEQ ID NO: 66608 - RNA, 23 nt, Human
uccaaagcuuccuugcccagggc

SEQ ID NO: 66609 - RNA, 19 nt, Human
uccaagcccuaagaacaag

SEQ ID NO: 66610 - RNA, 23 nt, Human
uccaagcccuaagaacaagaggc

SEQ ID NO: 66611 - RNA, 22 nt, Human
uccacgauccaagcccuaagaa

SEQ ID NO: 66612 - RNA, 24 nt, Human
uccacgcggccgcaacucggaccg

SEQ ID NO: 66613 - RNA, 19 nt, Human
ucccagggcgcggcgcggu

SEQ ID NO: 66614 - RNA, 18 nt, Human
ucccaggggcacccuccu

SEQ ID NO: 66615 - RNA, 24 nt, Human
uccccggguccguuggcgcgcggg

SEQ ID NO: 66616 - RNA, 22 nt, Human
ucccuccaggcccagcgcgcaa

SEQ ID NO: 66617 - RNA, 18 nt, Human
uccuggagcgcagcgugg

SEQ ID NO: 66618 - RNA, 19 nt, Human
ugagggaagaucagcaugu

SEQ ID NO: 66619 - RNA, 22 nt, Human
ugagggaagaucagcauguccc

SEQ ID NO: 66620 - RNA, 25 nt, Human
ugcccaggcuccaggcagaugcggg

SEQ ID NO: 66621 - RNA, 19 nt, Human
ugcccagggcugggccuug

SEQ ID NO: 66622 - RNA, 21 nt, Human
ugccccagcagcccagucggc

SEQ ID NO: 66623 - RNA, 24 nt, Human
ugccccuggcgccagaccuggccc

SEQ ID NO: 66624 - RNA, 19 nt, Human
ugccugcagggugcccagg

SEQ ID NO: 66625 - RNA, 24 nt, Human
ugccugccccuggcgccagaccug

SEQ ID NO: 66626 - RNA, 21 nt, Human
ugcuuuaauuuuuaaauuuuc

SEQ ID NO: 66627 - RNA, 19 nt, Human
uggcuggggcgaggcgcug

SEQ ID NO: 66628 - RNA, 21 nt, Human
ugggcccugccccagcagccc

SEQ ID NO: 66629 - RNA, 23 nt, Human
uggggcaccuguagccugacccc

SEQ ID NO: 66630 - RNA, 19 nt, Human
uggggugggggggcaggag

SEQ ID NO: 66631 - RNA, 21 nt, Human
uggggugggggggcaggaggg

SEQ ID NO: 66632 - RNA, 22 nt, Human
ugucaguaaacagcuaacucag

SEQ ID NO: 66633 - RNA, 22 nt, Human
uguuuaccaauagucuuauuuu

SEQ ID NO: 66634 - RNA, 24 nt, Human
uucuguuucugagucacgaacagc

SEQ ID NO: 66635 - RNA, 23 nt, Human
uucuuccacgauccaagcccuaa

SEQ ID NO: 66636 - RNA, 21 nt, Human
uuuuucucaguguuuuucuuu

SEQ ID NO: 66637 - RNA, 23 nt, Human
aaaaagaaaaaagauauuuacaa

SEQ ID NO: 66638 - RNA, 19 nt, Human
aaaauugcagaaaauacaa

SEQ ID NO: 66639 - RNA, 23 nt, Human
aaagaaaaaagauauuuacaagu

SEQ ID NO: 66640 - RNA, 24 nt, Human
aagauuuuuccaaagcuuucacag

SEQ ID NO: 66641 - RNA, 23 nt, Human
aagcacuucagaaaucagaaaca

SEQ ID NO: 66642 - RNA, 19 nt, Human
aauuugcaugguuguccuc

SEQ ID NO: 66643 - RNA, 19 nt, Human
acuguccacucuucagcag

SEQ ID NO: 66644 - RNA, 22 nt, Human
aggccagaaaauucugggacaa

SEQ ID NO: 66645 - RNA, 23 nt, Human
auacaagcacuucagaaaucaga

SEQ ID NO: 66646 - RNA, 21 nt, Human
auacacaaagggaagagacca

SEQ ID NO: 66647 - RNA, 21 nt, Human
caaauucuuuucaaaucaaua

SEQ ID NO: 66648 - RNA, 18 nt, Human
cacaagacuccauaguca

SEQ ID NO: 66649 - RNA, 19 nt, Human
cacaauuugcaugguuguc

SEQ ID NO: 66650 - RNA, 19 nt, Human
cacaguaaaauugcagaaa

SEQ ID NO: 66651 - RNA, 18 nt, Human
cagaaaauucugggacaa

SEQ ID NO: 66652 - RNA, 22 nt, Human
cagaaacauuaaaaaaaagaaa

SEQ ID NO: 66653 - RNA, 21 nt, Human
cagccucaagcuugaccaaaa

SEQ ID NO: 66654 - RNA, 21 nt, Human
caucaagaaaaugacaccaau

SEQ ID NO: 66655 - RNA, 22 nt, Human
ccaaaaaaaaaaaaaaaaaaaa

SEQ ID NO: 66656 - RNA, 23 nt, Human
ccaaaaaaaaaaaaaaaaaaaaa

SEQ ID NO: 66657 - RNA, 22 nt, Human
ccaaaguaagguccaacugucc

SEQ ID NO: 66658 - RNA, 24 nt, Human
ccaaaguaagguccaacuguccac

SEQ ID NO: 66659 - RNA, 18 nt, Human
ccuccggguugccgacuc

SEQ ID NO: 66660 - RNA, 19 nt, Human
cuuuaugucuacauagcca

SEQ ID NO: 66661 - RNA, 19 nt, Human
gaagauuaagggugcccag

SEQ ID NO: 66662 - RNA, 20 nt, Human
gacaccaauuguugaaaaca

SEQ ID NO: 66663 - RNA, 22 nt, Human
gacucgcuacuccgcucacucc

SEQ ID NO: 66664 - RNA, 22 nt, Human
gccgcagauaaaagcuauacaa

SEQ ID NO: 66665 - RNA, 21 nt, Human
ggcuaaagcaugugaccacaa

SEQ ID NO: 66666 - RNA, 21 nt, Human
uaaagcaugugaccacaaaug

SEQ ID NO: 66667 - RNA, 23 nt, Human
uaaagccgcagauaaaagcuaua

SEQ ID NO: 66668 - RNA, 23 nt, Human
uaacucuccaacaaauagugaca

SEQ ID NO: 66669 - RNA, 20 nt, Human
uagcacuucgccgccguacc

SEQ ID NO: 66670 - RNA, 23 nt, Human
uagugacaucaagaaaaugacac

SEQ ID NO: 66671 - RNA, 21 nt, Human
uauguuuacaaauuuaggaac

SEQ ID NO: 66672 - RNA, 27 nt, Human
ucagaaacauuaaaaaaaagaaaaaag

SEQ ID NO: 66673 - RNA, 22 nt, Human
ucagccucaagcuugaccaaaa

SEQ ID NO: 66674 - RNA, 22 nt, Human
ucccuuuuagcacuucgccgcc

SEQ ID NO: 66675 - RNA, 21 nt, Human
ucuuuucaaaucaauagaucc

SEQ ID NO: 66676 - RNA, 23 nt, Human
ugaaaggccagaaaauucuggga

SEQ ID NO: 66677 - RNA, 21 nt, Human
ugcaucaaaggcuuuauucag

SEQ ID NO: 66678 - RNA, 22 nt, Human
uggcuaaagcaugugaccacaa

SEQ ID NO: 66679 - RNA, 23 nt, Human
uguaauggcagacaauuuagcac

SEQ ID NO: 66680 - RNA, 22 nt, Human
uguccacucuucagcaguccca

SEQ ID NO: 66681 - RNA, 21 nt, Human
ugucuacauagccaucgcaca

SEQ ID NO: 66682 - RNA, 23 nt, Human
uugaccaaaaaaaaaaaaaaaaa

SEQ ID NO: 66683 - RNA, 20 nt, Human
uugcaugguuguccuccuau

SEQ ID NO: 66684 - RNA, 23 nt, Human
uuucaaaucaauagauccaauaa

SEQ ID NO: 66685 - RNA, 23 nt, Human
uuucacaauuugcaugguugucc

SEQ ID NO: 66686 - RNA, 24 nt, Human
aacaauaauaacuuuaguauaagc

SEQ ID NO: 66687 - RNA, 19 nt, Human
aagcagaacgacccgcgac

SEQ ID NO: 66688 - RNA, 18 nt, Human
aaucaaccgcagcacuug

SEQ ID NO: 66689 - RNA, 21 nt, Human
agcagaacgacccgcgaccac

SEQ ID NO: 66690 - RNA, 22 nt, Human
caccugaggagcaaugacaguc

SEQ ID NO: 66691 - RNA, 19 nt, Human
cagaacgacccgcgaccac

SEQ ID NO: 66692 - RNA, 21 nt, Human
cccgcgcacgccccucgggca

SEQ ID NO: 66693 - RNA, 22 nt, Human
cccugcagaucacuuucucccu

SEQ ID NO: 66694 - RNA, 24 nt, Human
cccugcagaucacuuucucccuca

SEQ ID NO: 66695 - RNA, 19 nt, Human
ccgccuccgcggccgcccc

SEQ ID NO: 66696 - RNA, 21 nt, Human
ccgcggccgccccugacccgc

SEQ ID NO: 66697 - RNA, 24 nt, Human
ccucccugcagaucacuuucuccc

SEQ ID NO: 66698 - RNA, 24 nt, Human
ccuccgcggccgccccugacccgc

SEQ ID NO: 66699 - RNA, 21 nt, Human
cuuccggcgccgccucgugcc

SEQ ID NO: 66700 - RNA, 22 nt, Human
gccuccgcggccgccccugacc

SEQ ID NO: 66701 - RNA, 20 nt, Human
gcucgguguccaccucccug

SEQ ID NO: 66702 - RNA, 18 nt, Human
ucagcggcccaggcaccu

SEQ ID NO: 66703 - RNA, 19 nt, Human
ucagcugacaaugacccaa

SEQ ID NO: 66704 - RNA, 19 nt, Human
uccaccucccugcagauca

SEQ ID NO: 66705 - RNA, 22 nt, Human
ugacccaaggacuguucagcgg

SEQ ID NO: 66706 - RNA, 19 nt, Human
ugacccgcgcacgccccuc

SEQ ID NO: 66707 - RNA, 24 nt, Human
ugggaaaaacaauaauaacuuuag

SEQ ID NO: 66708 - RNA, 21 nt, Human
uuuuuuuuuuuuuuuuuuggg

SEQ ID NO: 66709 - RNA, 18 nt, Human
aaagcagauggccggguc

SEQ ID NO: 66710 - RNA, 22 nt, Human
aacaaagcccuccaagacccag

SEQ ID NO: 66711 - RNA, 23 nt, Human
aacaaagcccuccaagacccagg

SEQ ID NO: 66712 - RNA, 19 nt, Human
aaccucaccccaccccccg

SEQ ID NO: 66713 - RNA, 22 nt, Human
aagcucuggcccugagacccag

SEQ ID NO: 66714 - RNA, 21 nt, Human
aaggggcucaggcucacugcu

SEQ ID NO: 66715 - RNA, 25 nt, Human
aaugagguuaaccucaccccacccc

SEQ ID NO: 66716 - RNA, 27 nt, Human
accccaccccccggucccccuccccag

SEQ ID NO: 66717 - RNA, 23 nt, Human
acuccucucuccccguggcccca

SEQ ID NO: 66718 - RNA, 21 nt, Human
agaacaccucaagcucugccc

SEQ ID NO: 66719 - RNA, 20 nt, Human
agagguuucugccauuccug

SEQ ID NO: 66720 - RNA, 20 nt, Human
agcaccaccuuccccagaac

SEQ ID NO: 66721 - RNA, 23 nt, Human
agcaccaccuuccccagaacacc

SEQ ID NO: 66722 - RNA, 18 nt, Human
aggaaugaggauggaggg

SEQ ID NO: 66723 - RNA, 19 nt, Human
aggaaugaggauggaggga

SEQ ID NO: 66724 - RNA, 22 nt, Human
aggcagauaggaagcaagguga

SEQ ID NO: 66725 - RNA, 18 nt, Human
aggcagaucccugcgggg

SEQ ID NO: 66726 - RNA, 21 nt, Human
aggcucccccuacccccuacc

SEQ ID NO: 66727 - RNA, 22 nt, Human
aggcucccccuacccccuaccu

SEQ ID NO: 66728 - RNA, 23 nt, Human
aggggcacagggaaggcucugag

SEQ ID NO: 66729 - RNA, 21 nt, Human
agguagagaaggucugggauc

SEQ ID NO: 66730 - RNA, 19 nt, Human
agucuuuggagagaaagcu

SEQ ID NO: 66731 - RNA, 20 nt, Human
aguggugaguuuuccagaac

SEQ ID NO: 66732 - RNA, 21 nt, Human
caaagcccuccaagacccagg

SEQ ID NO: 66733 - RNA, 28 nt, Human
caaagcccuccaagacccaggcuccccc

SEQ ID NO: 66734 - RNA, 23 nt, Human
caaagcugagaagccaagcugua

SEQ ID NO: 66735 - RNA, 24 nt, Human
caagacccaggcucccccuacccc

SEQ ID NO: 66736 - RNA, 23 nt, Human
cacagggcucugaaccaaagcag

SEQ ID NO: 66737 - RNA, 24 nt, Human
cacagggcucugaaccaaagcaga

SEQ ID NO: 66738 - RNA, 21 nt, Human
caccucaagcucugcccuggc

SEQ ID NO: 66739 - RNA, 23 nt, Human
caccucaagcucugcccuggccc

SEQ ID NO: 66740 - RNA, 22 nt, Human
caggcaggaaugaggauggagg

SEQ ID NO: 66741 - RNA, 18 nt, Human
caggcucccccuaccccc

SEQ ID NO: 66742 - RNA, 19 nt, Human
caggcucccccuacccccu

SEQ ID NO: 66743 - RNA, 21 nt, Human
caggucccaggaugaaagggg

SEQ ID NO: 66744 - RNA, 20 nt, Human
ccaaagcagauggccggguu

SEQ ID NO: 66745 - RNA, 23 nt, Human
ccagaacaaguggaggggcacag

SEQ ID NO: 66746 - RNA, 22 nt, Human
cccaggcucccccuacccccua

SEQ ID NO: 66747 - RNA, 22 nt, Human
ccccaccccccggucccccucc

SEQ ID NO: 66748 - RNA, 24 nt, Human
ccccagaacaccucaagcucugcc

SEQ ID NO: 66749 - RNA, 21 nt, Human
ccccccacgcccaccugccag

SEQ ID NO: 66750 - RNA, 20 nt, Human
ccccccggucccccucccca

SEQ ID NO: 66751 - RNA, 18 nt, Human
ccccuccccagccaacca

SEQ ID NO: 66752 - RNA, 25 nt, Human
cccggucccccuccccagccaacca

SEQ ID NO: 66753 - RNA, 20 nt, Human
cccuccaagacccaggcucc

SEQ ID NO: 66754 - RNA, 22 nt, Human
ccucaagcucugcccuggcccc

SEQ ID NO: 66755 - RNA, 20 nt, Human
cgcugcugugucuccggauu

SEQ ID NO: 66756 - RNA, 24 nt, Human
cgucuucaucuuagucuuuggaga

SEQ ID NO: 66757 - RNA, 24 nt, Human
cuacuccucucuccccguggcccc

SEQ ID NO: 66758 - RNA, 23 nt, Human
cucaccccaccccccgguccccc

SEQ ID NO: 66759 - RNA, 20 nt, Human
cuccaagacccaggcucccc

SEQ ID NO: 66760 - RNA, 21 nt, Human
cuggccaaagcucuggcccug

SEQ ID NO: 66761 - RNA, 22 nt, Human
cuggccccaggaauagagguuu

SEQ ID NO: 66762 - RNA, 23 nt, Human
cuguaccugugccccccacgccc

SEQ ID NO: 66763 - RNA, 19 nt, Human
cugugugcuggacaccgcu

SEQ ID NO: 66764 - RNA, 20 nt, Human
cuucaggcaggaaugaggau

SEQ ID NO: 66765 - RNA, 20 nt, Human
gaggauggagggagagccag

SEQ ID NO: 66766 - RNA, 21 nt, Human
gcaaagcagaggauaggggag

SEQ ID NO: 66767 - RNA, 18 nt, Human
gcacagggaaggcucuga

SEQ ID NO: 66768 - RNA, 21 nt, Human
gccaagcuguaccugugcccc

SEQ ID NO: 66769 - RNA, 20 nt, Human
gccccaggaauagagguuuc

SEQ ID NO: 66770 - RNA, 20 nt, Human
gcccuggccccaggaauaga

SEQ ID NO: 66771 - RNA, 22 nt, Human
gcucuggcccugagacccagug

SEQ ID NO: 66772 - RNA, 21 nt, Human
ggagagccagggagagacuga

SEQ ID NO: 66773 - RNA, 18 nt, Human
ggagauuuaaaugaccau

SEQ ID NO: 66774 - RNA, 23 nt, Human
ggccaggcagaucccugcggggc

SEQ ID NO: 66775 - RNA, 23 nt, Human
guuuuccagaacaaguggagggg

SEQ ID NO: 66776 - RNA, 24 nt, Human
uaauacuuaacaaagcccuccaag

SEQ ID NO: 66777 - RNA, 22 nt, Human
uagagaaggucugggaucugcu

SEQ ID NO: 66778 - RNA, 23 nt, Human
uaggagcagacacuauaguaacc

SEQ ID NO: 66779 - RNA, 18 nt, Human
uccaggcugagagggagg

SEQ ID NO: 66780 - RNA, 21 nt, Human
uccccagaacaccucaagcuc

SEQ ID NO: 66781 - RNA, 19 nt, Human
ucuggccaaagcucuggcc

SEQ ID NO: 66782 - RNA, 21 nt, Human
ucuggccaaagcucuggcccu

SEQ ID NO: 66783 - RNA, 21 nt, Human
ucuugucccagggguaggagc

SEQ ID NO: 66784 - RNA, 18 nt, Human
ugacugacagacacaggg

SEQ ID NO: 66785 - RNA, 20 nt, Human
ugagacccagugagauccug

SEQ ID NO: 66786 - RNA, 22 nt, Human
ugagacuuaguaagaagagucu

SEQ ID NO: 66787 - RNA, 19 nt, Human
uggagagaaagcucugaag

SEQ ID NO: 66788 - RNA, 22 nt, Human
uggcaaagcagaggauagggga

SEQ ID NO: 66789 - RNA, 21 nt, Human
uguccaggcugagagggaggc

SEQ ID NO: 66790 - RNA, 19 nt, Human
uuaaccucaccccaccccc

SEQ ID NO: 66791 - RNA, 24 nt, Human
uucaucuuagucuuuggagagaaa

SEQ ID NO: 66792 - RNA, 22 nt, Human
uuuggcccuuggaggaagcccu

SEQ ID NO: 66793 - RNA, 22 nt, Human
aaaaacuuguacucuguggcuc

SEQ ID NO: 66794 - RNA, 18 nt, Human
aaaaugaucagguaaaua

SEQ ID NO: 66795 - RNA, 22 nt, Human
aaaaugaucagguaaauaaaua

SEQ ID NO: 66796 - RNA, 25 nt, Human
aagcagaaaaugaucaaaagggacc

SEQ ID NO: 66797 - RNA, 23 nt, Human
acaauuuuuuuuuuuuuuuuuuu

SEQ ID NO: 66798 - RNA, 18 nt, Human
cacugaacuacuggcccc

SEQ ID NO: 66799 - RNA, 19 nt, Human
cacugaacuacuggccccc

SEQ ID NO: 66800 - RNA, 20 nt, Human
cauucucacugaacuacugg

SEQ ID NO: 66801 - RNA, 23 nt, Human
cucacugaacuacuggcccccca

SEQ ID NO: 66802 - RNA, 20 nt, Human
cuucuacaccgaaauggcug

SEQ ID NO: 66803 - RNA, 24 nt, Human
uaagugauguuuacaauuuuuuuu

SEQ ID NO: 66804 - RNA, 24 nt, Human
uacuggugaugaagcugcaauaaa

SEQ ID NO: 66805 - RNA, 23 nt, Human
uaguuguaaacauaaacauucuc

SEQ ID NO: 66806 - RNA, 24 nt, Human
ucacugaacuacuggccccccaaa

SEQ ID NO: 66807 - RNA, 18 nt, Human
ugccgugcugccacuucu

SEQ ID NO: 66808 - RNA, 20 nt, Human
ugggaaggcuaguuguaaac

SEQ ID NO: 66809 - RNA, 24 nt, Human
uuguacucuguggcucuuuugucu

SEQ ID NO: 66810 - RNA, 21 nt, Human
uuucagagaaaaaaauuagcu

SEQ ID NO: 66811 - RNA, 21 nt, Human
uuuuuuuuuuuuuuuuacugg

SEQ ID NO: 66812 - RNA, 23 nt, Human
uuuuuuuuuuuuuuuuuauguuu

SEQ ID NO: 66813 - RNA, 24 nt, Human
uuuuuuuuuuuuuuuuuuacuggg

SEQ ID NO: 66814 - RNA, 23 nt, Human
acuacacccuugguccccuccca

SEQ ID NO: 66815 - RNA, 24 nt, Human
ccccgccccgguccguugcccucc

SEQ ID NO: 66816 - RNA, 25 nt, Human
ccccgcugcagccgccgaccaggag

SEQ ID NO: 66817 - RNA, 19 nt, Human
ccccggccgcugccgccgc

SEQ ID NO: 66818 - RNA, 25 nt, Human
ccccgguccguugcccuccagcaaa

SEQ ID NO: 66819 - RNA, 21 nt, Human
ccgcucaccccgcugcagccg

SEQ ID NO: 66820 - RNA, 22 nt, Human
ccgcugccgccgcucaccccgc

SEQ ID NO: 66821 - RNA, 24 nt, Human
ccgcugccgccgcucaccccgcug

SEQ ID NO: 66822 - RNA, 22 nt, Human
ccguugcccuccagcaaaaggc

SEQ ID NO: 66823 - RNA, 23 nt, Human
gcaaaaggcgcuuccuuacuaca

SEQ ID NO: 66824 - RNA, 20 nt, Human
gccccgguccguugcccucc

SEQ ID NO: 66825 - RNA, 20 nt, Human
ggccucuggauuggggcccc

SEQ ID NO: 66826 - RNA, 22 nt, Human
uccccggccgcugccgccgcuc

SEQ ID NO: 66827 - RNA, 24 nt, Human
uccccggccgcugccgccgcucac

SEQ ID NO: 66828 - RNA, 19 nt, Human
uccccucccacccaggccu

SEQ ID NO: 66829 - RNA, 19 nt, Human
ucuggauuggggccccagg

SEQ ID NO: 66830 - RNA, 21 nt, Human
ugccaggggcugaccggagug

SEQ ID NO: 66831 - RNA, 23 nt, Human
uggauuggggccccaggccgucg

SEQ ID NO: 66832 - RNA, 18 nt, Human
ugguccccucccacccag

SEQ ID NO: 66833 - RNA, 23 nt, Human
uugguccccucccacccaggccu

SEQ ID NO: 66834 - RNA, 22 nt, Human
aaaaaaaagcagaagcagcagc

SEQ ID NO: 66835 - RNA, 21 nt, Human
aaaaggaaauaugaagcggga

SEQ ID NO: 66836 - RNA, 22 nt, Human
aaagccaugucucucaggcaug

SEQ ID NO: 66837 - RNA, 27 nt, Human
aagcagaagcagcagcaaaagggaccc

SEQ ID NO: 66838 - RNA, 27 nt, Human
aagcagcagcaaaagucagugcugaac

SEQ ID NO: 66839 - RNA, 24 nt, Human
aagggacccgagcaagaacuuuca

SEQ ID NO: 66840 - RNA, 21 nt, Human
acuuuaagaaagggcgaggag

SEQ ID NO: 66841 - RNA, 21 nt, Human
agaaaaaaaaaagcagaagca

SEQ ID NO: 66842 - RNA, 23 nt, Human
agaaagggcgaggaggugaaggg

SEQ ID NO: 66843 - RNA, 20 nt, Human
agagggaaagaaaaggaaau

SEQ ID NO: 66844 - RNA, 18 nt, Human
agcagcagcaaaagucag

SEQ ID NO: 66845 - RNA, 22 nt, Human
aggaacagagagggaaagaaaa

SEQ ID NO: 66846 - RNA, 22 nt, Human
auccgggacgcgaggugcgggg

SEQ ID NO: 66847 - RNA, 25 nt, Human
auuggagugcaaagauacuguucug

SEQ ID NO: 66848 - RNA, 20 nt, Human
caaaauccccgggagacuuc

SEQ ID NO: 66849 - RNA, 19 nt, Human
caagaaagcacuaaagaug

SEQ ID NO: 66850 - RNA, 23 nt, Human
caagaaagcacuaaagaugcagg

SEQ ID NO: 66851 - RNA, 18 nt, Human
caccagggccugaccagg

SEQ ID NO: 66852 - RNA, 18 nt, Human
cacccugcuuccaaaguc

SEQ ID NO: 66853 - RNA, 21 nt, Human
ccagggccugaccaggccgag

SEQ ID NO: 66854 - RNA, 22 nt, Human
cccugcacgccgccuccuccuc

SEQ ID NO: 66855 - RNA, 20 nt, Human
cccuucugccaggagcccac

SEQ ID NO: 66856 - RNA, 18 nt, Human
ccuuuucucccccuccca

SEQ ID NO: 66857 - RNA, 21 nt, Human
cgcagcggcggccaaggaguc

SEQ ID NO: 66858 - RNA, 19 nt, Human
cucccuucugccaggagcc

SEQ ID NO: 66859 - RNA, 19 nt, Human
cucucaggcaugccucgcu

SEQ ID NO: 66860 - RNA, 18 nt, Human
cugcacgccgccuccucc

SEQ ID NO: 66861 - RNA, 21 nt, Human
cuuagagugggagcaaaaaaa

SEQ ID NO: 66862 - RNA, 19 nt, Human
cuuuucuucuucuucuucu

SEQ ID NO: 66863 - RNA, 20 nt, Human
gaaaaugcuuuuucuccucc

SEQ ID NO: 66864 - RNA, 23 nt, Human
gaacagagagggaaagaaaagga

SEQ ID NO: 66865 - RNA, 25 nt, Human
gaacugcacuuuaagaaagggcgag

SEQ ID NO: 66866 - RNA, 18 nt, Human
gcagcggcggccaaggag

SEQ ID NO: 66867 - RNA, 19 nt, Human
gccucgcguggcgcucgcg

SEQ ID NO: 66868 - RNA, 21 nt, Human
gcgaggugcggggcccgcgag

SEQ ID NO: 66869 - RNA, 18 nt, Human
gcgcucugccgcgucucg

SEQ ID NO: 66870 - RNA, 19 nt, Human
gggcgaggaggugaaggga

SEQ ID NO: 66871 - RNA, 20 nt, Human
gggugcaggaacagagaggg

SEQ ID NO: 66872 - RNA, 24 nt, Human
ggugcaggaacagagagggaaaga

SEQ ID NO: 66873 - RNA, 26 nt, Human
uaagaaaaaaaaaagcagaagcugga

SEQ ID NO: 66874 - RNA, 20 nt, Human
uaagaaagggcgaggaggug

SEQ ID NO: 66875 - RNA, 21 nt, Human
ucagagcgauccgggacgcga

SEQ ID NO: 66876 - RNA, 19 nt, Human
uccaaaguccauucgcacc

SEQ ID NO: 66877 - RNA, 23 nt, Human
uccauucgcaccagggccugacc

SEQ ID NO: 66878 - RNA, 19 nt, Human
uccucccuccccuccuccc

SEQ ID NO: 66879 - RNA, 22 nt, Human
ucguuuuuuucuucuucucuuu

SEQ ID NO: 66880 - RNA, 25 nt, Human
ucuaagaaaaaaaaaagcagaagca

SEQ ID NO: 66881 - RNA, 18 nt, Human
ucuucucuuuucuucuuc

SEQ ID NO: 66882 - RNA, 18 nt, Human
ucuucuucucuuuucuuc

SEQ ID NO: 66883 - RNA, 21 nt, Human
ugaaaaugcuuuuucuccucc

SEQ ID NO: 66884 - RNA, 22 nt, Human
ugaaaaugcuuuuucuccuccc

SEQ ID NO: 66885 - RNA, 20 nt, Human
ugacaagaaagcacuaaaga

SEQ ID NO: 66886 - RNA, 21 nt, Human
ugacucaggucccaguugcuc

SEQ ID NO: 66887 - RNA, 24 nt, Human
ugcacacaagcugcauuuugcgca

SEQ ID NO: 66888 - RNA, 20 nt, Human
ugcugcucccuucugccagg

SEQ ID NO: 66889 - RNA, 24 nt, Human
ugggagcaaaaaaagugaaaaugc

SEQ ID NO: 66890 - RNA, 24 nt, Human
uuaaaaaauauauacaaaaucccc

SEQ ID NO: 66891 - RNA, 22 nt, Human
uuacuauaacgcgugugcugcu

SEQ ID NO: 66892 - RNA, 21 nt, Human
uuuccuuuucucccccuccca

SEQ ID NO: 66893 - RNA, 21 nt, Human
uuuuucuuuuccuuuucuccc

SEQ ID NO: 66894 - RNA, 22 nt, Human
uuuuucuuuuccuuuucucccc

SEQ ID NO: 66895 - RNA, 21 nt, Human
aggaggccuagugguggcagg

SEQ ID NO: 66896 - RNA, 24 nt, Human
aggcagaggaaccggaggcgacgg

SEQ ID NO: 66897 - RNA, 19 nt, Human
caggaaggugcaggcagag

SEQ ID NO: 66898 - RNA, 19 nt, Human
cccgcccgcuccagguccc

SEQ ID NO: 66899 - RNA, 21 nt, Human
cccgcccgcuccaggucccgg

SEQ ID NO: 66900 - RNA, 18 nt, Human
ccgcccgcuccagguccc

SEQ ID NO: 66901 - RNA, 18 nt, Human
ccgcccgcuccagguccc

SEQ ID NO: 66902 - RNA, 21 nt, Human
ccgcccgcuccaggucccggc

SEQ ID NO: 66903 - RNA, 21 nt, Human
ccgccgccgucgccuuucuca

SEQ ID NO: 66904 - RNA, 21 nt, Human
ccgccgucgccuuucucacgc

SEQ ID NO: 66905 - RNA, 23 nt, Human
ccgccgucgccuuucucacgccc

SEQ ID NO: 66906 - RNA, 21 nt, Human
ccgcgccgccgccgucgccuu

SEQ ID NO: 66907 - RNA, 23 nt, Human
ccuccgcgccgccgccgucgccu

SEQ ID NO: 66908 - RNA, 24 nt, Human
ccuccgcgccgccgccgucgccuu

SEQ ID NO: 66909 - RNA, 20 nt, Human
ccugcauccacccgcccgcu

SEQ ID NO: 66910 - RNA, 23 nt, Human
cgccgccaggcaacuccccaggg

SEQ ID NO: 66911 - RNA, 20 nt, Human
cgccgccgccgucgccuuuc

SEQ ID NO: 66912 - RNA, 20 nt, Human
cggggaaaacuguggcgccc

SEQ ID NO: 66913 - RNA, 21 nt, Human
cgucuggagcccggggauagg

SEQ ID NO: 66914 - RNA, 19 nt, Human
cuccaggucccggcgcgcc

SEQ ID NO: 66915 - RNA, 18 nt, Human
cuccgcgccgccgccguc

SEQ ID NO: 66916 - RNA, 21 nt, Human
gccgcaggaaggugcaggcag

SEQ ID NO: 66917 - RNA, 22 nt, Human
gccgccaggcaacuccccaggg

SEQ ID NO: 66918 - RNA, 18 nt, Human
gcgccccaagggggcuuc

SEQ ID NO: 66919 - RNA, 18 nt, Human
ggagcccggggauaggag

SEQ ID NO: 66920 - RNA, 19 nt, Human
ggaggccuagugguggcag

SEQ ID NO: 66921 - RNA, 23 nt, Human
ggcgccgccaggcaacuccccag

SEQ ID NO: 66922 - RNA, 21 nt, Human
uaggaggccuagugguggcag

SEQ ID NO: 66923 - RNA, 22 nt, Human
uaggaggccuagugguggcagg

SEQ ID NO: 66924 - RNA, 18 nt, Human
uccaggucccggcgcgcc

SEQ ID NO: 66925 - RNA, 24 nt, Human
ucccggcgcgccgcaggaaggugc

SEQ ID NO: 66926 - RNA, 18 nt, Human
uccgcgccgccgccgucg

SEQ ID NO: 66927 - RNA, 20 nt, Human
uccuaggucgucuggagccc

SEQ ID NO: 66928 - RNA, 19 nt, Human
uccuccgcgccgccgccgu

SEQ ID NO: 66929 - RNA, 19 nt, Human
ucuccgcaggcgcggcgca

SEQ ID NO: 66930 - RNA, 24 nt, Human
uggcgccccaagggggcuucuggg

SEQ ID NO: 66931 - RNA, 24 nt, Human
ugucccgcgcgugcggccggacuc

SEQ ID NO: 66932 - RNA, 20 nt, Human
uguggcgccccaagggggcu

SEQ ID NO: 66933 - RNA, 19 nt, Human
aaaaaaaaaguucacaaug

SEQ ID NO: 66934 - RNA, 22 nt, Human
aaaaaaaaguucacaaugauaa

SEQ ID NO: 66935 - RNA, 24 nt, Human
acccuauccuuccccuucccuuaa

SEQ ID NO: 66936 - RNA, 18 nt, Human
aggcccccagaugggcgg

SEQ ID NO: 66937 - RNA, 21 nt, Human
cagggucucagggucugauuc

SEQ ID NO: 66938 - RNA, 25 nt, Human
ccccagaugggcggauucccaaucc

SEQ ID NO: 66939 - RNA, 22 nt, Human
cccuuaaaauccuagaugaaaa

SEQ ID NO: 66940 - RNA, 18 nt, Human
ccuauccuuccccuuccc

SEQ ID NO: 66941 - RNA, 24 nt, Human
cgaacuaaggagggggcugaagcu

SEQ ID NO: 66942 - RNA, 18 nt, Human
cucaccuucggaacauca

SEQ ID NO: 66943 - RNA, 20 nt, Human
cucagggucugauucccagg

SEQ ID NO: 66944 - RNA, 19 nt, Human
cuucccuuaaaauccuaga

SEQ ID NO: 66945 - RNA, 22 nt, Human
gaacuaaggagggggcugaagc

SEQ ID NO: 66946 - RNA, 22 nt, Human
gaaugggggugggcggacagcc

SEQ ID NO: 66947 - RNA, 18 nt, Human
gcagaagaggcccccaga

SEQ ID NO: 66948 - RNA, 23 nt, Human
gcccccagaugggcggauuccca

SEQ ID NO: 66949 - RNA, 18 nt, Human
ggagggggcugaagcuug

SEQ ID NO: 66950 - RNA, 19 nt, Human
ggcuggcgcuggaccuggg

SEQ ID NO: 66951 - RNA, 21 nt, Human
ggucucagggucugauuccca

SEQ ID NO: 66952 - RNA, 19 nt, Human
uaaccugcaaacugcagaa

SEQ ID NO: 66953 - RNA, 20 nt, Human
uaaggagggggcugaagcuu

SEQ ID NO: 66954 - RNA, 21 nt, Human
ucccaaucccggaccccugcg

SEQ ID NO: 66955 - RNA, 24 nt, Human
ucccuuaaaauccuagaugaaaau

SEQ ID NO: 66956 - RNA, 23 nt, Human
uccuagaugaaaauucccgagaa

SEQ ID NO: 66957 - RNA, 19 nt, Human
ucucagggucugauuccca

SEQ ID NO: 66958 - RNA, 18 nt, Human
ugauaaccugcaaacugc

SEQ ID NO: 66959 - RNA, 22 nt, Human
ugcagaaagcgccacggguuuc

SEQ ID NO: 66960 - RNA, 19 nt, Human
ugccgaacuaaggaggggg

SEQ ID NO: 66961 - RNA, 21 nt, Human
ugcucagggucucagggucug

SEQ ID NO: 66962 - RNA, 24 nt, Human
aacgcagggucggagggguucggg

SEQ ID NO: 66963 - RNA, 23 nt, Human
acgcagggucggagggguucggg

SEQ ID NO: 66964 - RNA, 24 nt, Human
acgcagggucggagggguucgggg

SEQ ID NO: 66965 - RNA, 22 nt, Human
agaagccagagcugggcaggug

SEQ ID NO: 66966 - RNA, 18 nt, Human
agaguggaggaggggcug

SEQ ID NO: 66967 - RNA, 22 nt, Human
agaguggaggaggggcuggucc

SEQ ID NO: 66968 - RNA, 19 nt, Human
agcucuuccccauaccccu

SEQ ID NO: 66969 - RNA, 20 nt, Human
aggugcagauucacguggag

SEQ ID NO: 66970 - RNA, 19 nt, Human
aucugugaaagguguggag

SEQ ID NO: 66971 - RNA, 23 nt, Human
caaaauccucaacagagaagcca

SEQ ID NO: 66972 - RNA, 26 nt, Human
caacagagaagccagagcugggcagg

SEQ ID NO: 66973 - RNA, 27 nt, Human
caacagagaagccagagcugggcagga

SEQ ID NO: 66974 - RNA, 22 nt, Human
caaggagggguuaaagccagga

SEQ ID NO: 66975 - RNA, 25 nt, Human
cccgggcuggagcuggagcuggagc

SEQ ID NO: 66976 - RNA, 25 nt, Human
cccgggcuggagcuggagcuggagc

SEQ ID NO: 66977 - RNA, 25 nt, Human
cccgggcuggagcuggagcuggagc

SEQ ID NO: 66978 - RNA, 18 nt, Human
ccuggccuuggccaagga

SEQ ID NO: 66979 - RNA, 24 nt, Human
cuaccuccuuucucucuuugcuca

SEQ ID NO: 66980 - RNA, 25 nt, Human
cugagguugcucugagggcuggggc

SEQ ID NO: 66981 - RNA, 25 nt, Human
cugagguugcucugagggcuggggc

SEQ ID NO: 66982 - RNA, 23 nt, Human
cuggagcuggagcugggcugggc

SEQ ID NO: 66983 - RNA, 23 nt, Human
cuggggcagaggugcagauucac

SEQ ID NO: 66984 - RNA, 22 nt, Human
gaagaggcugacgauuauaaua

SEQ ID NO: 66985 - RNA, 21 nt, Human
gagaagccagagcugggcagg

SEQ ID NO: 66986 - RNA, 23 nt, Human
gagaagccagagcugggcaggug

SEQ ID NO: 66987 - RNA, 21 nt, Human
gaggaggggcugguccgggca

SEQ ID NO: 66988 - RNA, 24 nt, Human
gagggcuggggcuggggcagaggu

SEQ ID NO: 66989 - RNA, 20 nt, Human
gaucugugaaagguguggag

SEQ ID NO: 66990 - RNA, 23 nt, Human
gcuggagcugggcugggcugggc

SEQ ID NO: 66991 - RNA, 20 nt, Human
ggagaggagaguggaggagg

SEQ ID NO: 66992 - RNA, 22 nt, Human
ggagcuggagcuggagcugggc

SEQ ID NO: 66993 - RNA, 22 nt, Human
ggagcuggagcuggagcugggc

SEQ ID NO: 66994 - RNA, 22 nt, Human
ggagcuggagcuggagcugggc

SEQ ID NO: 66995 - RNA, 18 nt, Human
ggagcuggagcugggcug

SEQ ID NO: 66996 - RNA, 18 nt, Human
ggagcuggagcugggcug

SEQ ID NO: 66997 - RNA, 20 nt, Human
ggagcuggagcugggcuggg

SEQ ID NO: 66998 - RNA, 20 nt, Human
ggagcuggagcugggcuggg

SEQ ID NO: 66999 - RNA, 20 nt, Human
ggagcuggagcugggcuggg

SEQ ID NO: 67000 - RNA, 21 nt, Human
ggagcuggagcugggcugggc

SEQ ID NO: 67001 - RNA, 21 nt, Human
ggagcuggagcugggcugggc

SEQ ID NO: 67002 - RNA, 21 nt, Human
ggagcuggagcugggcugggc

SEQ ID NO: 67003 - RNA, 19 nt, Human
ggagcugggcugggcuggg

SEQ ID NO: 67004 - RNA, 19 nt, Human
ggagcugggcugggcuggg

SEQ ID NO: 67005 - RNA, 19 nt, Human
ggagcugggcugggcuggg

SEQ ID NO: 67006 - RNA, 20 nt, Human
ggagcugggcugggcugggc

SEQ ID NO: 67007 - RNA, 20 nt, Human
ggagcugggcugggcugggc

SEQ ID NO: 67008 - RNA, 20 nt, Human
ggagcugggcugggcugggc

SEQ ID NO: 67009 - RNA, 19 nt, Human
ggagguugauggugggaug

SEQ ID NO: 67010 - RNA, 25 nt, Human
ggauggaacgcagggucggaggggu

SEQ ID NO: 67011 - RNA, 21 nt, Human
ggccaaggagggguuaaagcc

SEQ ID NO: 67012 - RNA, 22 nt, Human
ggccuuggccaaggagggguua

SEQ ID NO: 67013 - RNA, 18 nt, Human
ggcugagguugcucugag

SEQ ID NO: 67014 - RNA, 18 nt, Human
ggcugagguugcucugag

SEQ ID NO: 67015 - RNA, 18 nt, Human
ggcugagguugcucugag

SEQ ID NO: 67016 - RNA, 23 nt, Human
gggcugggcugggcugagguugc

SEQ ID NO: 67017 - RNA, 23 nt, Human
gggcugggcugggcugagguugc

SEQ ID NO: 67018 - RNA, 23 nt, Human
gggcugggcugggcugagguugc

SEQ ID NO: 67019 - RNA, 23 nt, Human
gggcuggggcagaggugcagauu

SEQ ID NO: 67020 - RNA, 19 nt, Human
gguguggagagcggacgcc

SEQ ID NO: 67021 - RNA, 18 nt, Human
gucagggacucuuaaacu

SEQ ID NO: 67022 - RNA, 21 nt, Human
ucagcucuuccccauaccccu

SEQ ID NO: 67023 - RNA, 23 nt, Human
uccccauaccccugucucagugu

SEQ ID NO: 67024 - RNA, 21 nt, Human
ucccgcaggcaacccuggccu

SEQ ID NO: 67025 - RNA, 18 nt, Human
ugcucugagggcuggggc

SEQ ID NO: 67026 - RNA, 18 nt, Human
ugcucugagggcuggggc

SEQ ID NO: 67027 - RNA, 19 nt, Human
uggagcuggagcugggcug

SEQ ID NO: 67028 - RNA, 19 nt, Human
uggagcuggagcugggcug

SEQ ID NO: 67029 - RNA, 19 nt, Human
uggagcuggagcugggcug

SEQ ID NO: 67030 - RNA, 22 nt, Human
uggagcuggagcugggcugggc

SEQ ID NO: 67031 - RNA, 22 nt, Human
uggagcuggagcugggcugggc

SEQ ID NO: 67032 - RNA, 18 nt, Human
uggagcugggcugggcug

SEQ ID NO: 67033 - RNA, 18 nt, Human
uggagcugggcugggcug

SEQ ID NO: 67034 - RNA, 21 nt, Human
uggagcugggcugggcugggc

SEQ ID NO: 67035 - RNA, 21 nt, Human
uggagcugggcugggcugggc

SEQ ID NO: 67036 - RNA, 21 nt, Human
uggagcugggcugggcugggc

SEQ ID NO: 67037 - RNA, 19 nt, Human
ugggaucucaguccuccag

SEQ ID NO: 67038 - RNA, 23 nt, Human
ugggcugggcugagguugcucug

SEQ ID NO: 67039 - RNA, 23 nt, Human
ugggcugggcugagguugcucug

SEQ ID NO: 67040 - RNA, 23 nt, Human
ugggcugggcugagguugcucug

SEQ ID NO: 67041 - RNA, 19 nt, Human
ugggcugggcugggcugag

SEQ ID NO: 67042 - RNA, 19 nt, Human
ugggcugggcugggcugag

SEQ ID NO: 67043 - RNA, 19 nt, Human
ugggcugggcugggcugag

SEQ ID NO: 67044 - RNA, 21 nt, Human
ugggcugggcugggcugaggu

SEQ ID NO: 67045 - RNA, 21 nt, Human
ugggcugggcugggcugaggu

SEQ ID NO: 67046 - RNA, 21 nt, Human
ugggcugggcugggcugaggu

SEQ ID NO: 67047 - RNA, 21 nt, Human
uggggcccgggcuggagcugg

SEQ ID NO: 67048 - RNA, 21 nt, Human
uggggcccgggcuggagcugg

SEQ ID NO: 67049 - RNA, 21 nt, Human
uggggcccgggcuggagcugg

SEQ ID NO: 67050 - RNA, 22 nt, Human
uguggagagcggacgccuggcu

SEQ ID NO: 67051 - RNA, 24 nt, Human
uugaagaggcugacgauuauaaua

SEQ ID NO: 67052 - RNA, 19 nt, Human
aaaacaaggaucuccaaaa

SEQ ID NO: 67053 - RNA, 19 nt, Human
aaaacucgaaaccagcauc

SEQ ID NO: 67054 - RNA, 24 nt, Human
aaacaaggaucuccaaaacucgaa

SEQ ID NO: 67055 - RNA, 21 nt, Human
aacaacauggccccauucccc

SEQ ID NO: 67056 - RNA, 19 nt, Human
aacauggccccauuccccu

SEQ ID NO: 67057 - RNA, 23 nt, Human
aacccuuuccucucccucuccac

SEQ ID NO: 67058 - RNA, 19 nt, Human
aagaacuaccgugcccuuc

SEQ ID NO: 67059 - RNA, 19 nt, Human
aaggcuaaagggggcaaac

SEQ ID NO: 67060 - RNA, 21 nt, Human
aaggugaagcaauggagaaga

SEQ ID NO: 67061 - RNA, 22 nt, Human
aaguggggaagaggggguggcc

SEQ ID NO: 67062 - RNA, 23 nt, Human
acagaacccuuuccucucccucu

SEQ ID NO: 67063 - RNA, 20 nt, Human
acccuuuccucucccucucc

SEQ ID NO: 67064 - RNA, 23 nt, Human
accuaaugucaacaacauggccc

SEQ ID NO: 67065 - RNA, 20 nt, Human
agagguagggagggggcagc

SEQ ID NO: 67066 - RNA, 27 nt, Human
agcaauggagaagaaaaagggagggcc

SEQ ID NO: 67067 - RNA, 18 nt, Human
agcaggaggcaggacuga

SEQ ID NO: 67068 - RNA, 22 nt, Human
aggagaagggaaagguggaagg

SEQ ID NO: 67069 - RNA, 24 nt, Human
aggccgaggccgagagcgaugaga

SEQ ID NO: 67070 - RNA, 18 nt, Human
agggaaguggggaagagg

SEQ ID NO: 67071 - RNA, 18 nt, Human
agggaaguggggaagagg

SEQ ID NO: 67072 - RNA, 18 nt, Human
agguagggagggggcagc

SEQ ID NO: 67073 - RNA, 23 nt, Human
auaaaaaacaaggaucuccaaaa

SEQ ID NO: 67074 - RNA, 21 nt, Human
auaggaagcagcuucuucgca

SEQ ID NO: 67075 - RNA, 19 nt, Human
auggccccauuccccuugc

SEQ ID NO: 67076 - RNA, 19 nt, Human
auuccauuuuggggaguag

SEQ ID NO: 67077 - RNA, 21 nt, Human
caaugugguccucccuccucu

SEQ ID NO: 67078 - RNA, 19 nt, Human
cagaaaaaccuaagcugug

SEQ ID NO: 67079 - RNA, 18 nt, Human
cagaacccuuuccucucc

SEQ ID NO: 67080 - RNA, 22 nt, Human
caggacugauuagcuccacugg

SEQ ID NO: 67081 - RNA, 23 nt, Human
cauaaaaaacaaggaucuccaaa

SEQ ID NO: 67082 - RNA, 23 nt, Human
caucaaugugguccucccuccuc

SEQ ID NO: 67083 - RNA, 19 nt, Human
caucuuucucgugucggag

SEQ ID NO: 67084 - RNA, 23 nt, Human
ccaaaacucgaaaccagcaucuu

SEQ ID NO: 67085 - RNA, 24 nt, Human
cccaccccugucuauacccagaga

SEQ ID NO: 67086 - RNA, 19 nt, Human
cccauuccccuugcccaga

SEQ ID NO: 67087 - RNA, 18 nt, Human
ccccauuccccuugccca

SEQ ID NO: 67088 - RNA, 21 nt, Human
ccuccgcuucccuggguccac

SEQ ID NO: 67089 - RNA, 22 nt, Human
ccucucccucuccacuagcucc

SEQ ID NO: 67090 - RNA, 24 nt, Human
ccuugcccagauggacccuuccca

SEQ ID NO: 67091 - RNA, 22 nt, Human
cgagagaggagaagggaaaggu

SEQ ID NO: 67092 - RNA, 22 nt, Human
cgaggccgaggccgagagcgau

SEQ ID NO: 67093 - RNA, 28 nt, Human
cucacauuuuacuuugaccugguugggc

SEQ ID NO: 67094 - RNA, 22 nt, Human
cuccucucuacauuauuaaccc

SEQ ID NO: 67095 - RNA, 22 nt, Human
cuguguuccauaaaaaacaagg

SEQ ID NO: 67096 - RNA, 18 nt, Human
gaaaaaccuaagcugugg

SEQ ID NO: 67097 - RNA, 21 nt, Human
gagcugucaacucacauuuua

SEQ ID NO: 67098 - RNA, 22 nt, Human
gaggccgaggccgaggccgaga

SEQ ID NO: 67099 - RNA, 23 nt, Human
gaguagagguagggagggggcag

SEQ ID NO: 67100 - RNA, 20 nt, Human
gccgaggccgagagcgauga

SEQ ID NO: 67101 - RNA, 18 nt, Human
ggacccuucccaccccug

SEQ ID NO: 67102 - RNA, 20 nt, Human
ggcuccuccgcuucccuggg

SEQ ID NO: 67103 - RNA, 26 nt, Human
ggggaguagagguagggagggggcag

SEQ ID NO: 67104 - RNA, 22 nt, Human
guagcucuuggagccaacagag

SEQ ID NO: 67105 - RNA, 24 nt, Human
gugggguggggcaaaugcuauaaa

SEQ ID NO: 67106 - RNA, 22 nt, Human
uaaaaaacaaggaucuccaaaa

SEQ ID NO: 67107 - RNA, 24 nt, Human
uaaaaaacaaggaucuccaaaacu

SEQ ID NO: 67108 - RNA, 19 nt, Human
uaccuggguauaggaagca

SEQ ID NO: 67109 - RNA, 21 nt, Human
uaucccaugauuccauuuugg

SEQ ID NO: 67110 - RNA, 23 nt, Human
uaucccaugauuccauuuugggg

SEQ ID NO: 67111 - RNA, 19 nt, Human
ucccucuccacuagcucca

SEQ ID NO: 67112 - RNA, 19 nt, Human
ucggaggccgaggccgagg

SEQ ID NO: 67113 - RNA, 21 nt, Human
ucuauacccagagagcaggag

SEQ ID NO: 67114 - RNA, 23 nt, Human
ucuauacccagagagcaggaggc

SEQ ID NO: 67115 - RNA, 21 nt, Human
ucuuggacagaacccuuuccu

SEQ ID NO: 67116 - RNA, 18 nt, Human
ugacagaaaaaccuaagc

SEQ ID NO: 67117 - RNA, 19 nt, Human
ugacagaaaaaccuaagcu

SEQ ID NO: 67118 - RNA, 21 nt, Human
ugcagggaaguggggaagagg

SEQ ID NO: 67119 - RNA, 18 nt, Human
ugccaaggaaucuuauga

SEQ ID NO: 67120 - RNA, 18 nt, Human
uggacccuucccaccccu

SEQ ID NO: 67121 - RNA, 21 nt, Human
uggccgccaggcuccuccgcu

SEQ ID NO: 67122 - RNA, 22 nt, Human
ugggggccuucccuaucccaug

SEQ ID NO: 67123 - RNA, 18 nt, Human
uucccuggguccacggcg

SEQ ID NO: 67124 - RNA, 23 nt, Human
aaaacaaaaacaaaacccccagu

SEQ ID NO: 67125 - RNA, 19 nt, Human
acccccaguauuauuccca

SEQ ID NO: 67126 - RNA, 23 nt, Human
agacaguucaaaaacaaaaacaa

SEQ ID NO: 67127 - RNA, 22 nt, Human
agggggcuuaugcaauccugga

SEQ ID NO: 67128 - RNA, 26 nt, Human
augguacacaaaauaagagcagucac

SEQ ID NO: 67129 - RNA, 23 nt, Human
caaaaacaaaaacaaaaccccca

SEQ ID NO: 67130 - RNA, 24 nt, Human
caaaaacaaaaacaaaacccccag

SEQ ID NO: 67131 - RNA, 21 nt, Human
cacuggaaguggggagaaaau

SEQ ID NO: 67132 - RNA, 21 nt, Human
cagcgguuguuggcuuauggu

SEQ ID NO: 67133 - RNA, 23 nt, Human
cagggggcuuaugcaauccugga

SEQ ID NO: 67134 - RNA, 24 nt, Human
cuguguuuuuagcaucuuugggag

SEQ ID NO: 67135 - RNA, 28 nt, Human
gaaaauggugaaaggcaggccgguaccc

SEQ ID NO: 67136 - RNA, 24 nt, Human
gaacauuugagacaguucaaaaac

SEQ ID NO: 67137 - RNA, 23 nt, Human
ggguaugcaguacagcaccgauu

SEQ ID NO: 67138 - RNA, 23 nt, Human
ucaaaaacaaaaacaaaaccccc

SEQ ID NO: 67139 - RNA, 18 nt, Human
ucaaugcccacagaagga

SEQ ID NO: 67140 - RNA, 21 nt, Human
ugaaaggcaggcagucucccg

SEQ ID NO: 67141 - RNA, 24 nt, Human
uguguuuuuagcaucuuugggaga

SEQ ID NO: 67142 - RNA, 20 nt, Human
uuaccauuuccuuggaaaac

SEQ ID NO: 67143 - RNA, 21 nt, Human
uuaccauuuccuuggaaaaca

SEQ ID NO: 67144 - RNA, 22 nt, Human
uucaaaaacaaaaacaaaaccc

SEQ ID NO: 67145 - RNA, 24 nt, Human
uugagacaguucaaaaacaaaaac

SEQ ID NO: 67146 - RNA, 21 nt, Human
uugauuucagguguucucaga

SEQ ID NO: 67147 - RNA, 21 nt, Human
aagcagcugacaucagggcag

SEQ ID NO: 67148 - RNA, 24 nt, Human
aagcagcugacaucagggcagggg

SEQ ID NO: 67149 - RNA, 23 nt, Human
aagcgggaagaggacagggacag

SEQ ID NO: 67150 - RNA, 22 nt, Human
aaggucuccugcccccucccua

SEQ ID NO: 67151 - RNA, 21 nt, Human
accgcccccaggccucuccca

SEQ ID NO: 67152 - RNA, 23 nt, Human
acgccgcgcagccccagccgcuc

SEQ ID NO: 67153 - RNA, 24 nt, Human
acugggagcugggccaggccugcu

SEQ ID NO: 67154 - RNA, 23 nt, Human
agaagggacucuagggguggggc

SEQ ID NO: 67155 - RNA, 19 nt, Human
agcagcccuggugcccucc

SEQ ID NO: 67156 - RNA, 21 nt, Human
agccagcagcccuggugcccu

SEQ ID NO: 67157 - RNA, 21 nt, Human
agccucccugcccugucccuc

SEQ ID NO: 67158 - RNA, 21 nt, Human
agcugggccaggccugcuggg

SEQ ID NO: 67159 - RNA, 20 nt, Human
agggguggggcuggugcagg

SEQ ID NO: 67160 - RNA, 20 nt, Human
aguggcagugguggcagcgg

SEQ ID NO: 67161 - RNA, 23 nt, Human
aguggcagugguggcagcggcug

SEQ ID NO: 67162 - RNA, 22 nt, Human
aucagggcaggggaggaugaga

SEQ ID NO: 67163 - RNA, 21 nt, Human
caaagcagcugacaucagggc

SEQ ID NO: 67164 - RNA, 24 nt, Human
cacccuccaagcucagccgaaguc

SEQ ID NO: 67165 - RNA, 19 nt, Human
cagagggcucccccucccc

SEQ ID NO: 67166 - RNA, 19 nt, Human
cagcacagcugucagcccc

SEQ ID NO: 67167 - RNA, 21 nt, Human
cagcacagcugucagccccug

SEQ ID NO: 67168 - RNA, 20 nt, Human
cagcagcccuggugcccucc

SEQ ID NO: 67169 - RNA, 18 nt, Human
cagggugggggcccgagg

SEQ ID NO: 67170 - RNA, 23 nt, Human
ccaccccuguagcccuacccacc

SEQ ID NO: 67171 - RNA, 18 nt, Human
ccacccuccaagcucagc

SEQ ID NO: 67172 - RNA, 21 nt, Human
ccagcagcccuggugcccucc

SEQ ID NO: 67173 - RNA, 18 nt, Human
cccagcacuccugagucc

SEQ ID NO: 67174 - RNA, 20 nt, Human
cccagcagcuccgcagcccu

SEQ ID NO: 67175 - RNA, 18 nt, Human
cccaggccucucccagga

SEQ ID NO: 67176 - RNA, 19 nt, Human
ccccacccggcuuucccua

SEQ ID NO: 67177 - RNA, 20 nt, Human
cccccucccucuccuuccuu

SEQ ID NO: 67178 - RNA, 21 nt, Human
ccccucccucuccuuccuucc

SEQ ID NO: 67179 - RNA, 19 nt, Human
cccggggcaccagccuggg

SEQ ID NO: 67180 - RNA, 22 nt, Human
cccuccccccacccggcuuucc

SEQ ID NO: 67181 - RNA, 20 nt, Human
cccucccucuccuuccuucc

SEQ ID NO: 67182 - RNA, 19 nt, Human
cccugucccucccuagcca

SEQ ID NO: 67183 - RNA, 18 nt, Human
ccgcagcccuggugcugc

SEQ ID NO: 67184 - RNA, 19 nt, Human
ccgcugcugccucugcugc

SEQ ID NO: 67185 - RNA, 25 nt, Human
ccuccaagcucagccgaagucugga

SEQ ID NO: 67186 - RNA, 23 nt, Human
ccucccugcccugucccucccua

SEQ ID NO: 67187 - RNA, 21 nt, Human
ccugcccccucccuauagaag

SEQ ID NO: 67188 - RNA, 19 nt, Human
ccuguagcccuacccaccu

SEQ ID NO: 67189 - RNA, 24 nt, Human
ccuuaucagcaccagcacagcugu

SEQ ID NO: 67190 - RNA, 20 nt, Human
ccuuccuucccuuccucucc

SEQ ID NO: 67191 - RNA, 26 nt, Human
ccuucuacaucuguauccccuccccc

SEQ ID NO: 67192 - RNA, 18 nt, Human
cgaggugggggagucacu

SEQ ID NO: 67193 - RNA, 18 nt, Human
cgccacgccgcgcagccc

SEQ ID NO: 67194 - RNA, 23 nt, Human
cggcugcugggacuggccagagc

SEQ ID NO: 67195 - RNA, 19 nt, Human
cucagggcaagcgggaaga

SEQ ID NO: 67196 - RNA, 20 nt, Human
cucccccucccucuccuucc

SEQ ID NO: 67197 - RNA, 21 nt, Human
cucccuagccagcagcccugg

SEQ ID NO: 67198 - RNA, 21 nt, Human
cuccgcagcccuggugcugcc

SEQ ID NO: 67199 - RNA, 22 nt, Human
cuccgcagcccuggugcugccu

SEQ ID NO: 67200 - RNA, 24 nt, Human
cuccgccacgccgcgcagccccag

SEQ ID NO: 67201 - RNA, 20 nt, Human
cugccaagaggggagcuggg

SEQ ID NO: 67202 - RNA, 21 nt, Human
cugcugccucugcugccgcuu

SEQ ID NO: 67203 - RNA, 20 nt, Human
cuggugcccucccgaguggc

SEQ ID NO: 67204 - RNA, 18 nt, Human
gacagggacagggugggg

SEQ ID NO: 67205 - RNA, 22 nt, Human
gacagggugggggcccgaggug

SEQ ID NO: 67206 - RNA, 22 nt, Human
gacauuggggcugggacccugg

SEQ ID NO: 67207 - RNA, 23 nt, Human
gacauuggggcugggacccuggc

SEQ ID NO: 67208 - RNA, 22 nt, Human
gaggaugagagcaggaacugag

SEQ ID NO: 67209 - RNA, 23 nt, Human
gagggagagaggacugagaaggc

SEQ ID NO: 67210 - RNA, 20 nt, Human
gcagcuccgcagcccuggug

SEQ ID NO: 67211 - RNA, 23 nt, Human
gcagggggaacugggagcugggg

SEQ ID NO: 67212 - RNA, 20 nt, Human
gccaagaggggagcugggcc

SEQ ID NO: 67213 - RNA, 21 nt, Human
gccacgccgcgcagccccagc

SEQ ID NO: 67214 - RNA, 24 nt, Human
gcccauggccuggucuccagcccu

SEQ ID NO: 67215 - RNA, 18 nt, Human
gcugccucugccgcugcu

SEQ ID NO: 67216 - RNA, 18 nt, Human
ggacagggacaggguggg

SEQ ID NO: 67217 - RNA, 23 nt, Human
ggagaaugugcuggggaucccag

SEQ ID NO: 67218 - RNA, 20 nt, Human
ggccagagccucccugcccu

SEQ ID NO: 67219 - RNA, 18 nt, Human
ggccaggccugcugggcc

SEQ ID NO: 67220 - RNA, 25 nt, Human
ggcuggugcagggggaacugggagc

SEQ ID NO: 67221 - RNA, 22 nt, Human
gggacucuagggguggggcugg

SEQ ID NO: 67222 - RNA, 18 nt, Human
ggggaacugggagcuggg

SEQ ID NO: 67223 - RNA, 22 nt, Human
gggguguggacaagaaggaccu

SEQ ID NO: 67224 - RNA, 20 nt, Human
ggguguggacaagaaggacc

SEQ ID NO: 67225 - RNA, 20 nt, Human
ggguguggacaagaaggacc

SEQ ID NO: 67226 - RNA, 24 nt, Human
gugcugccucugccgcugcugccu

SEQ ID NO: 67227 - RNA, 20 nt, Human
guggcagcggcugcucuucu

SEQ ID NO: 67228 - RNA, 29 nt, Human
guggcagugguggcagcggcugcucuucu

SEQ ID NO: 67229 - RNA, 24 nt, Human
gugggggcccgaggugggggaguc

SEQ ID NO: 67230 - RNA, 19 nt, Human
uacagagggcucccccucc

SEQ ID NO: 67231 - RNA, 25 nt, Human
uaggaccagcccagcacuccugagu

SEQ ID NO: 67232 - RNA, 21 nt, Human
ucagggcaggggaggaugaga

SEQ ID NO: 67233 - RNA, 19 nt, Human
ucccacccuccaagcucag

SEQ ID NO: 67234 - RNA, 24 nt, Human
ucccacccuccaagcucagccgaa

SEQ ID NO: 67235 - RNA, 23 nt, Human
ucccacucccagcagcuccgcag

SEQ ID NO: 67236 - RNA, 19 nt, Human
ucccccucccucuccuucc

SEQ ID NO: 67237 - RNA, 20 nt, Human
ucccgaguggcagugguggc

SEQ ID NO: 67238 - RNA, 21 nt, Human
ucccuaaaucacccaccccug

SEQ ID NO: 67239 - RNA, 21 nt, Human
uccgcagcccuggugcugccu

SEQ ID NO: 67240 - RNA, 19 nt, Human
uccgccacgccgcgcagcc

SEQ ID NO: 67241 - RNA, 23 nt, Human
uccgccacgccgcgcagccccag

SEQ ID NO: 67242 - RNA, 18 nt, Human
uccugaguccuggggcuc

SEQ ID NO: 67243 - RNA, 19 nt, Human
uccuuccuucccuuccucu

SEQ ID NO: 67244 - RNA, 20 nt, Human
uccuuccuucccuuccucuc

SEQ ID NO: 67245 - RNA, 28 nt, Human
ucuacaucuguauccccuccccccaccc

SEQ ID NO: 67246 - RNA, 23 nt, Human
ucuccugcccccucccuauagaa

SEQ ID NO: 67247 - RNA, 24 nt, Human
ucuggaaggucuccugcccccucc

SEQ ID NO: 67248 - RNA, 21 nt, Human
ucuguauccccuccccccacc

SEQ ID NO: 67249 - RNA, 21 nt, Human
ugacauuggggcugggacccu

SEQ ID NO: 67250 - RNA, 23 nt, Human
ugacauuggggcugggacccugg

SEQ ID NO: 67251 - RNA, 22 nt, Human
ugagagcaggaacugaguccug

SEQ ID NO: 67252 - RNA, 23 nt, Human
ugagagcaggaacugaguccugg

SEQ ID NO: 67253 - RNA, 20 nt, Human
ugaguccuggggcucucccu

SEQ ID NO: 67254 - RNA, 21 nt, Human
ugccaagaggggagcugggcc

SEQ ID NO: 67255 - RNA, 21 nt, Human
ugcccugucccucccuagcca

SEQ ID NO: 67256 - RNA, 24 nt, Human
ugccucugccgcugcugccucugc

SEQ ID NO: 67257 - RNA, 25 nt, Human
ugcuccgccacgccgcgcagcccca

SEQ ID NO: 67258 - RNA, 18 nt, Human
uggaaggucuccugcccc

SEQ ID NO: 67259 - RNA, 21 nt, Human
uggaaggucuccugcccccuc

SEQ ID NO: 67260 - RNA, 18 nt, Human
uggagggagagaggacug

SEQ ID NO: 67261 - RNA, 19 nt, Human
uggcagugguggcagcggc

SEQ ID NO: 67262 - RNA, 24 nt, Human
uggggauaagggguguggacaaga

SEQ ID NO: 67263 - RNA, 28 nt, Human
uggggcuggugcagggggaacugggagc

SEQ ID NO: 67264 - RNA, 18 nt, Human
uggugcagggggaacugg

SEQ ID NO: 67265 - RNA, 22 nt, Human
ugguggcagcggcugcucuucu

SEQ ID NO: 67266 - RNA, 24 nt, Human
ugucccuaaaucacccaccccugu

SEQ ID NO: 67267 - RNA, 19 nt, Human
ugugcaaagcagcugacau

SEQ ID NO: 67268 - RNA, 23 nt, Human
uucccuuccucuccgugagggcc

SEQ ID NO: 67269 - RNA, 23 nt, Human
uuucccuaaauauuuacaaaugu

SEQ ID NO: 67270 - RNA, 23 nt, Human
caagccaggucucccugaagucc

SEQ ID NO: 67271 - RNA, 19 nt, Human
ccccgcguccccgaagccc

SEQ ID NO: 67272 - RNA, 26 nt, Human
ccccgcguccccgaagcccugccugc

SEQ ID NO: 67273 - RNA, 19 nt, Human
cccgaagcccugccugcuc

SEQ ID NO: 67274 - RNA, 19 nt, Human
cccgccugcagcccuggga

SEQ ID NO: 67275 - RNA, 18 nt, Human
ccgcccgagaagcgcccc

SEQ ID NO: 67276 - RNA, 22 nt, Human
ccugccugcucgcggccgggag

SEQ ID NO: 67277 - RNA, 19 nt, Human
cgcggccgggagugggggc

SEQ ID NO: 67278 - RNA, 22 nt, Human
cuggaaccuccgcccgccugca

SEQ ID NO: 67279 - RNA, 18 nt, Human
gaagcgccccgcgucccc

SEQ ID NO: 67280 - RNA, 18 nt, Human
ucccugaagucccaucuc

SEQ ID NO: 67281 - RNA, 19 nt, Human
acaaacgagugggcugcgg

SEQ ID NO: 67282 - RNA, 18 nt, Human
acaggacggccgccucuc

SEQ ID NO: 67283 - RNA, 21 nt, Human
agccucagagagcucgugccg

SEQ ID NO: 67284 - RNA, 24 nt, Human
caggacggccgccucucuccuucc

SEQ ID NO: 67285 - RNA, 24 nt, Human
cauuccguugcucucucagucuca

SEQ ID NO: 67286 - RNA, 20 nt, Human
ccccgcccccucacgccgcc

SEQ ID NO: 67287 - RNA, 21 nt, Human
ccccucacgccgccguccuuc

SEQ ID NO: 67288 - RNA, 19 nt, Human
ccccucgugccugccuucu

SEQ ID NO: 67289 - RNA, 24 nt, Human
cccucacgccgccguccuucucgc

SEQ ID NO: 67290 - RNA, 26 nt, Human
ccgccguccuucucgcgccucgcucu

SEQ ID NO: 67291 - RNA, 22 nt, Human
ccgcgaaagcacggcuuccccc

SEQ ID NO: 67292 - RNA, 20 nt, Human
ccggagaaagugucgcaccg

SEQ ID NO: 67293 - RNA, 22 nt, Human
ccggcaccuacaugcugggucc

SEQ ID NO: 67294 - RNA, 22 nt, Human
ccggcuccaaggcgcggaggag

SEQ ID NO: 67295 - RNA, 19 nt, Human
ccgggcucucgguccgccg

SEQ ID NO: 67296 - RNA, 22 nt, Human
cgugccugccuucucgcgcugc

SEQ ID NO: 67297 - RNA, 22 nt, Human
cuccuuccgccagcuacggccu

SEQ ID NO: 67298 - RNA, 23 nt, Human
cucgaguuuuuuuuuuuuuuuuu

SEQ ID NO: 67299 - RNA, 27 nt, Human
cucgcgcucgccccucgugccugccuu

SEQ ID NO: 67300 - RNA, 20 nt, Human
gaguuuuuuuuuuuuuuuuu

SEQ ID NO: 67301 - RNA, 22 nt, Human
gaguuuuuuuuuuuuuuuuuuu

SEQ ID NO: 67302 - RNA, 18 nt, Human
gccucgcgcucgccccuc

SEQ ID NO: 67303 - RNA, 19 nt, Human
gcgcagccucagagagcuc

SEQ ID NO: 67304 - RNA, 21 nt, Human
gcgccucgcucuggcccugca

SEQ ID NO: 67305 - RNA, 20 nt, Human
gcucuggcccugcagguugu

SEQ ID NO: 67306 - RNA, 18 nt, Human
guguuuccgccucuaccc

SEQ ID NO: 67307 - RNA, 23 nt, Human
guugacaggacggccgccucucu

SEQ ID NO: 67308 - RNA, 21 nt, Human
uccggggccggauccggcucc

SEQ ID NO: 67309 - RNA, 18 nt, Human
ucgcgcugcgcgccccgc

SEQ ID NO: 67310 - RNA, 22 nt, Human
ucgcgcugcgcgccccgccccc

SEQ ID NO: 67311 - RNA, 23 nt, Human
ucgugccugccuucucgcgcugc

SEQ ID NO: 67312 - RNA, 21 nt, Human
ucucacgccacgcgccgugcc

SEQ ID NO: 67313 - RNA, 24 nt, Human
ucucacgccacgcgccgugccccg

SEQ ID NO: 67314 - RNA, 18 nt, Human
ucucucagucucagaccc

SEQ ID NO: 67315 - RNA, 24 nt, Human
ucucuccuuccgccagcuacggcc

SEQ ID NO: 67316 - RNA, 22 nt, Human
ugaaaacgcgucacgcggccgc

SEQ ID NO: 67317 - RNA, 18 nt, Human
uguuuccgccucuacccc

SEQ ID NO: 67318 - RNA, 23 nt, Human
uugacaggacggccgccucucuc

SEQ ID NO: 67319 - RNA, 19 nt, Human
uuuuuuuuuuuuuuuuuaa

SEQ ID NO: 67320 - RNA, 19 nt, Human
aaagugcugggauuacagg

SEQ ID NO: 67321 - RNA, 18 nt, Human
aagugcugggauuacagg

SEQ ID NO: 67322 - RNA, 19 nt, Human
aagugcugggauuacaggc

SEQ ID NO: 67323 - RNA, 19 nt, Human
aagugcugggauuacaggc

SEQ ID NO: 67324 - RNA, 24 nt, Human
acacagcagccuccucucgcgccc

SEQ ID NO: 67325 - RNA, 20 nt, Human
accuccuuggccagcagggu

SEQ ID NO: 67326 - RNA, 19 nt, Human
agcaacgagggagccaggc

SEQ ID NO: 67327 - RNA, 21 nt, Human
agcccagcaacgagggagccc

SEQ ID NO: 67328 - RNA, 21 nt, Human
agccccgaaagcccagcaacg

SEQ ID NO: 67329 - RNA, 19 nt, Human
aggccacccugcccugccu

SEQ ID NO: 67330 - RNA, 24 nt, Human
aggcugugucaaacuccuggccuc

SEQ ID NO: 67331 - RNA, 18 nt, Human
agugcugggauuacaggc

SEQ ID NO: 67332 - RNA, 24 nt, Human
auuuguuuuauuauugaguagaga

SEQ ID NO: 67333 - RNA, 23 nt, Human
caaagugcugggauuacaggcca

SEQ ID NO: 67334 - RNA, 21 nt, Human
cacgcccgucccgcccauccg

SEQ ID NO: 67335 - RNA, 21 nt, Human
cagccccgaaagcccagcaac

SEQ ID NO: 67336 - RNA, 22 nt, Human
cagcccuuggggacgcggacgu

SEQ ID NO: 67337 - RNA, 18 nt, Human
caggaaacacacagcagc

SEQ ID NO: 67338 - RNA, 25 nt, Human
cauccucgcaccuugcccuuccaaa

SEQ ID NO: 67339 - RNA, 19 nt, Human
ccaaagugcugggauuaca

SEQ ID NO: 67340 - RNA, 20 nt, Human
ccaaagugcugggauuacag

SEQ ID NO: 67341 - RNA, 22 nt, Human
ccaaagugcugggauuacaggc

SEQ ID NO: 67342 - RNA, 22 nt, Human
ccaaagugcugggauuacaggc

SEQ ID NO: 67343 - RNA, 23 nt, Human
ccaaagugcugggauuacaggcc

SEQ ID NO: 67344 - RNA, 22 nt, Human
ccacgcccgucccgcccauccg

SEQ ID NO: 67345 - RNA, 24 nt, Human
ccucaagcauccucgcaccuugcc

SEQ ID NO: 67346 - RNA, 21 nt, Human
ccuccgggucuggaagacaag

SEQ ID NO: 67347 - RNA, 19 nt, Human
ccuggccucaagcauccuc

SEQ ID NO: 67348 - RNA, 18 nt, Human
ccuguguugcccaggcug

SEQ ID NO: 67349 - RNA, 20 nt, Human
cgaaagcccagcaacgaggg

SEQ ID NO: 67350 - RNA, 25 nt, Human
cuccuggccucaagcauccucgcac

SEQ ID NO: 67351 - RNA, 19 nt, Human
cucggcguccuccacgccc

SEQ ID NO: 67352 - RNA, 18 nt, Human
cugacuguccccacuggc

SEQ ID NO: 67353 - RNA, 20 nt, Human
cuguccccacuggccagccc

SEQ ID NO: 67354 - RNA, 21 nt, Human
cuguccccacuggccagcccc

SEQ ID NO: 67355 - RNA, 19 nt, Human
gaaagcccagcaacgaggg

SEQ ID NO: 67356 - RNA, 19 nt, Human
gagccaggcuggggcagga

SEQ ID NO: 67357 - RNA, 21 nt, Human
gagccaggcuggggcaggaaa

SEQ ID NO: 67358 - RNA, 19 nt, Human
gcaacgagggagccaggcu

SEQ ID NO: 67359 - RNA, 18 nt, Human
gcccugccucuccagucc

SEQ ID NO: 67360 - RNA, 22 nt, Human
gcugugucaaacuccuggccuc

SEQ ID NO: 67361 - RNA, 20 nt, Human
ggaaacacacagcagccucc

SEQ ID NO: 67362 - RNA, 23 nt, Human
gggcaggaaacacacagcagccu

SEQ ID NO: 67363 - RNA, 24 nt, Human
gggggucucccuguguugcccagg

SEQ ID NO: 67364 - RNA, 22 nt, Human
gggucucccuguguugcccagg

SEQ ID NO: 67365 - RNA, 23 nt, Human
uccaaagugcugggauuacaggc

SEQ ID NO: 67366 - RNA, 24 nt, Human
uccccacuggccagccccgaaagc

SEQ ID NO: 67367 - RNA, 22 nt, Human
ucccccgggccgggcuggcucc

SEQ ID NO: 67368 - RNA, 20 nt, Human
ucccugacuguccccacugg

SEQ ID NO: 67369 - RNA, 21 nt, Human
ucccuguguugcccaggcugu

SEQ ID NO: 67370 - RNA, 23 nt, Human
uccucgcaccuugcccuuccaaa

SEQ ID NO: 67371 - RNA, 23 nt, Human
ucggcguccuccacgcccguccc

SEQ ID NO: 67372 - RNA, 21 nt, Human
ucgucguccggaagcuucggu

SEQ ID NO: 67373 - RNA, 25 nt, Human
ucuccagucccugacuguccccacu

SEQ ID NO: 67374 - RNA, 19 nt, Human
ucucccuguguugcccagg

SEQ ID NO: 67375 - RNA, 21 nt, Human
ugcucggcguccuccacgccc

SEQ ID NO: 67376 - RNA, 18 nt, Human
ugcugggauuacaggcca

SEQ ID NO: 67377 - RNA, 21 nt, Human
uggcuccgaguucugggcacu

SEQ ID NO: 67378 - RNA, 21 nt, Human
ugggauuacaggccacccugc

SEQ ID NO: 67379 - RNA, 22 nt, Human
uguguugcccaggcugugucaa

SEQ ID NO: 67380 - RNA, 23 nt, Human
uguguugcccaggcugugucaaa

SEQ ID NO: 67381 - RNA, 21 nt, Human
uguugcccaggcugugucaaa

SEQ ID NO: 67382 - RNA, 23 nt, Human
ccgcuuccuucucucugcgcuuu

SEQ ID NO: 67383 - RNA, 23 nt, Human
ccuccgcucgcugccucuccucc

SEQ ID NO: 67384 - RNA, 21 nt, Human
cucacagcugcuuuccuccgc

SEQ ID NO: 67385 - RNA, 22 nt, Human
cucgcugccucuccuccgcuuc

SEQ ID NO: 67386 - RNA, 19 nt, Human
ggagccucuggagcgcuug

SEQ ID NO: 67387 - RNA, 18 nt, Human
uccaggucacaagaaaca

SEQ ID NO: 67388 - RNA, 21 nt, Human
uccgcucgcugccucuccucc

SEQ ID NO: 67389 - RNA, 23 nt, Human
uuccggagccucuggagcgcuug

SEQ ID NO: 67390 - RNA, 24 nt, Human
uucuucucuuugcugcuccaguuc

SEQ ID NO: 67391 - RNA, 23 nt, Human
uuuguucuucucuuugcugcucc

SEQ ID NO: 67392 - RNA, 22 nt, Human
aauggaccccucccugccuccu

SEQ ID NO: 67393 - RNA, 20 nt, Human
aggugggagagguagggggc

SEQ ID NO: 67394 - RNA, 23 nt, Human
cacgugauccagcggagcgcacc

SEQ ID NO: 67395 - RNA, 21 nt, Human
cagccccaccagggggaaugg

SEQ ID NO: 67396 - RNA, 19 nt, Human
ccccgaggggguggggagg

SEQ ID NO: 67397 - RNA, 22 nt, Human
ccccgaggggguggggagggug

SEQ ID NO: 67398 - RNA, 24 nt, Human
ccccgaggggguggggagggugga

SEQ ID NO: 67399 - RNA, 21 nt, Human
ccugcccaaguggcucccccu

SEQ ID NO: 67400 - RNA, 20 nt, Human
cuuugugcaaacucugcccc

SEQ ID NO: 67401 - RNA, 23 nt, Human
gaagagcaagaggugggagaggu

SEQ ID NO: 67402 - RNA, 18 nt, Human
gggguggggaggguggag

SEQ ID NO: 67403 - RNA, 20 nt, Human
gugaaauggcagcgguuggg

SEQ ID NO: 67404 - RNA, 20 nt, Human
guggagggugagugugaaau

SEQ ID NO: 67405 - RNA, 20 nt, Human
uacagcuccccaccagcccc

SEQ ID NO: 67406 - RNA, 19 nt, Human
ucccugccuccugcccaag

SEQ ID NO: 67407 - RNA, 21 nt, Human
ucccugccuccugcccaagug

SEQ ID NO: 67408 - RNA, 21 nt, Human
ucccugccuccugcccaagug

SEQ ID NO: 67409 - RNA, 25 nt, Human
ucugccccgaggggguggggagggu

SEQ ID NO: 67410 - RNA, 27 nt, Human
uggaccccucccugccuccugcccaag

SEQ ID NO: 67411 - RNA, 23 nt, Human
uggagggugagugugaaauggca

SEQ ID NO: 67412 - RNA, 19 nt, Human
uggcagcgguuggggcugg

SEQ ID NO: 67413 - RNA, 18 nt, Human
uggcucacgugauccagc

SEQ ID NO: 67414 - RNA, 19 nt, Human
uuuauugaagagcaagagg

SEQ ID NO: 67415 - RNA, 26 nt, Human
acugguggggauggcggggugagagg

SEQ ID NO: 67416 - RNA, 18 nt, Human
agacagguggggacuggu

SEQ ID NO: 67417 - RNA, 20 nt, Human
aggaggagggugagcggucc

SEQ ID NO: 67418 - RNA, 23 nt, Human
aggggaggaggagggugagcggu

SEQ ID NO: 67419 - RNA, 19 nt, Human
caacacgaagaaauauuug

SEQ ID NO: 67420 - RNA, 19 nt, Human
cacaguccccauccaacac

SEQ ID NO: 67421 - RNA, 23 nt, Human
cagacaccgagacggugauaagg

SEQ ID NO: 67422 - RNA, 22 nt, Human
caggguuugcucagcaagucac

SEQ ID NO: 67423 - RNA, 20 nt, Human
cagguggggacuggugggga

SEQ ID NO: 67424 - RNA, 18 nt, Human
cccacaguccccauccaa

SEQ ID NO: 67425 - RNA, 23 nt, Human
ccccuaucuacccacagucccca

SEQ ID NO: 67426 - RNA, 24 nt, Human
ccccuaucuacccacaguccccau

SEQ ID NO: 67427 - RNA, 22 nt, Human
cgacgccacauaguaaaaaaaa

SEQ ID NO: 67428 - RNA, 23 nt, Human
cgacgccacauaguaaaaaaaag

SEQ ID NO: 67429 - RNA, 25 nt, Human
cggugauaaggccgcagucucuucc

SEQ ID NO: 67430 - RNA, 21 nt, Human
cucucauuguuccccuaucua

SEQ ID NO: 67431 - RNA, 21 nt, Human
cugccggccgcgguucccucu

SEQ ID NO: 67432 - RNA, 25 nt, Human
gacagguggggacugguggggaugg

SEQ ID NO: 67433 - RNA, 21 nt, Human
gacgccacauaguaaaaaaaa

SEQ ID NO: 67434 - RNA, 19 nt, Human
gagcacgauccgacccguc

SEQ ID NO: 67435 - RNA, 22 nt, Human
gccacgagcacgauccgacccg

SEQ ID NO: 67436 - RNA, 24 nt, Human
gccgcuggcgcuuauaccgaccug

SEQ ID NO: 67437 - RNA, 25 nt, Human
gcgguucccucucgaugcuucaggg

SEQ ID NO: 67438 - RNA, 22 nt, Human
ggaggaggagggugagcggucc

SEQ ID NO: 67439 - RNA, 22 nt, Human
ggaggagggugagcgguccagg

SEQ ID NO: 67440 - RNA, 22 nt, Human
ggggugagaggggaggaggagg

SEQ ID NO: 67441 - RNA, 27 nt, Human
gguggggacugguggggauggcggggu

SEQ ID NO: 67442 - RNA, 21 nt, Human
uaaaaaaaaguacacauauaa

SEQ ID NO: 67443 - RNA, 20 nt, Human
uaagcaggucagggugaugu

SEQ ID NO: 67444 - RNA, 23 nt, Human
uaccgaccuggcuccuguaacgc

SEQ ID NO: 67445 - RNA, 21 nt, Human
ucagcaagucacuugaugagu

SEQ ID NO: 67446 - RNA, 20 nt, Human
ucuccggagcgguccggccu

SEQ ID NO: 67447 - RNA, 22 nt, Human
ugacgggcggcgaggccgcugg

SEQ ID NO: 67448 - RNA, 25 nt, Human
ugacgggcggcgaggccgcuggcgc

SEQ ID NO: 67449 - RNA, 18 nt, Human
ugagaggggaggaggagg

SEQ ID NO: 67450 - RNA, 18 nt, Human
ugagaggggaggaggagg

SEQ ID NO: 67451 - RNA, 25 nt, Human
ugaggaggggggcaguugaagguga

SEQ ID NO: 67452 - RNA, 21 nt, Human
ugaggccagggauguggacag

SEQ ID NO: 67453 - RNA, 23 nt, Human
uggcggggugagaggggaggagg

SEQ ID NO: 67454 - RNA, 18 nt, Human
ugugauugaagaaaaucu

SEQ ID NO: 67455 - RNA, 18 nt, Human
uguggcgggcugaggcca

SEQ ID NO: 67456 - RNA, 23 nt, Human
uucacacccaaguuagccugagu

SEQ ID NO: 67457 - RNA, 20 nt, Human
aaauuugcuuagaugccuac

SEQ ID NO: 67458 - RNA, 21 nt, Human
auaaggcacugugcuaggagc

SEQ ID NO: 67459 - RNA, 22 nt, Human
cagaagagagaucaaaggaaau

SEQ ID NO: 67460 - RNA, 19 nt, Human
gcuguuuauuaagaauguu

SEQ ID NO: 67461 - RNA, 18 nt, Human
ggagcuuacagacuagca

SEQ ID NO: 67462 - RNA, 26 nt, Human
guacagaauucccuugaguggaagau

SEQ ID NO: 67463 - RNA, 20 nt, Human
uaagaaagguuuagaaaugu

SEQ ID NO: 67464 - RNA, 21 nt, Human
uaaggcacaacccuacucuua

SEQ ID NO: 67465 - RNA, 21 nt, Human
uauauagaaauaggaaacacu

SEQ ID NO: 67466 - RNA, 20 nt, Human
ucccuugaguggaguauauu

SEQ ID NO: 67467 - RNA, 18 nt, Human
ucugaauacaaaggcugu

SEQ ID NO: 67468 - RNA, 18 nt, Human
ugaauaaggcacaacccu

SEQ ID NO: 67469 - RNA, 22 nt, Human
uggaguauauuuuaauuuucug

SEQ ID NO: 67470 - RNA, 20 nt, Human
uguaaaugagacuuuaccaa

SEQ ID NO: 67471 - RNA, 18 nt, Human
uguauaauaaacuauaua

SEQ ID NO: 67472 - RNA, 21 nt, Human
uucagaagagagaucaaagga

SEQ ID NO: 67473 - RNA, 21 nt, Human
aaaaagaaaaaagaaauccaa

SEQ ID NO: 67474 - RNA, 21 nt, Human
aaaaagaaaaaagaaauccaa

SEQ ID NO: 67475 - RNA, 22 nt, Human
aaaaauauuuaaaguuaaccac

SEQ ID NO: 67476 - RNA, 23 nt, Human
aaaagaaaaaaaaauacacuaaa

SEQ ID NO: 67477 - RNA, 23 nt, Human
aaaagaaaaaaaaauacacuaaa

SEQ ID NO: 67478 - RNA, 22 nt, Human
aaacucaaaaguacugcuggca

SEQ ID NO: 67479 - RNA, 22 nt, Human
aaacucaaaaguacugcuggca

SEQ ID NO: 67480 - RNA, 23 nt, Human
aaacucaaaaguacugcuggcag

SEQ ID NO: 67481 - RNA, 23 nt, Human
aaacucaaaaguacugcuggcag

SEQ ID NO: 67482 - RNA, 26 nt, Human
aacaaaacaaaaaaaaaaacucaaaa

SEQ ID NO: 67483 - RNA, 25 nt, Human
aacaaaacaaaaaaaaaacucaaaa

SEQ ID NO: 67484 - RNA, 23 nt, Human
aacaacgagcaaauccaucuccc

SEQ ID NO: 67485 - RNA, 25 nt, Human
aagaaaaaaaaauacacuaaaaugc

SEQ ID NO: 67486 - RNA, 18 nt, Human
aagagcacugagcggucu

SEQ ID NO: 67487 - RNA, 18 nt, Human
aagagcacugagcggucu

SEQ ID NO: 67488 - RNA, 19 nt, Human
aagagcacugagcggucuc

SEQ ID NO: 67489 - RNA, 19 nt, Human
aagagcacugagcggucuc

SEQ ID NO: 67490 - RNA, 18 nt, Human
aagcaggaaggggaagga

SEQ ID NO: 67491 - RNA, 21 nt, Human
aagcaggaaggggaaggaggg

SEQ ID NO: 67492 - RNA, 18 nt, Human
aauugcuucacaagaucu

SEQ ID NO: 67493 - RNA, 20 nt, Human
aauugcuucacaagaucuau

SEQ ID NO: 67494 - RNA, 21 nt, Human
acaaaacaaaaaaaaaacuca

SEQ ID NO: 67495 - RNA, 21 nt, Human
acacaagucaguccaacaguu

SEQ ID NO: 67496 - RNA, 21 nt, Human
acacaagucaguccaacaguu

SEQ ID NO: 67497 - RNA, 21 nt, Human
acagggaagcaggaaggggaa

SEQ ID NO: 67498 - RNA, 18 nt, Human
acauaaauucagguaaga

SEQ ID NO: 67499 - RNA, 18 nt, Human
acauaaauucagguaaga

SEQ ID NO: 67500 - RNA, 24 nt, Human
accacugucggaaaaacacacaua

SEQ ID NO: 67501 - RNA, 24 nt, Human
accacugucggaaaaacacacaua

SEQ ID NO: 67502 - RNA, 24 nt, Human
agaaaaaaaaauacacuaaaaugc

SEQ ID NO: 67503 - RNA, 20 nt, Human
agaggagggaaggugguggc

SEQ ID NO: 67504 - RNA, 20 nt, Human
agaguuucccaagcuugcau

SEQ ID NO: 67505 - RNA, 19 nt, Human
agcccaaaauaaaccacca

SEQ ID NO: 67506 - RNA, 18 nt, Human
aggcugguccuccugugg

SEQ ID NO: 67507 - RNA, 25 nt, Human
auagugauaaaaauauagaaguauc

SEQ ID NO: 67508 - RNA, 25 nt, Human
auagugauaaaaauauagaaguauc

SEQ ID NO: 67509 - RNA, 26 nt, Human
auagugauaaaaauauagaaguaucu

SEQ ID NO: 67510 - RNA, 26 nt, Human
auagugauaaaaauauagaaguaucu

SEQ ID NO: 67511 - RNA, 21 nt, Human
augaauccucaacguccagag

SEQ ID NO: 67512 - RNA, 28 nt, Human
augcuaaaguaaaacaaaacaaaaaaaa

SEQ ID NO: 67513 - RNA, 18 nt, Human
caaaaaaaaaaacucaaa

SEQ ID NO: 67514 - RNA, 27 nt, Human
caaaagggacaugcaggaauguaacag

SEQ ID NO: 67515 - RNA, 27 nt, Human
caaaagggacaugcaggaauguaacag

SEQ ID NO: 67516 - RNA, 21 nt, Human
caaaaguacugcuggcaggcc

SEQ ID NO: 67517 - RNA, 21 nt, Human
caacgagcaaauccaucuccc

SEQ ID NO: 67518 - RNA, 22 nt, Human
cacacauaaauucagguaagac

SEQ ID NO: 67519 - RNA, 22 nt, Human
cacacauaaauucagguaagac

SEQ ID NO: 67520 - RNA, 22 nt, Human
cacccucaccaaucagagcaau

SEQ ID NO: 67521 - RNA, 23 nt, Human
cagaaaggcagccucucuccagu

SEQ ID NO: 67522 - RNA, 21 nt, Human
caggguaacauuuaaaaucuu

SEQ ID NO: 67523 - RNA, 23 nt, Human
ccaaaauaaaccacauuaaauaa

SEQ ID NO: 67524 - RNA, 19 nt, Human
ccaacaaaggcauuuuugc

SEQ ID NO: 67525 - RNA, 20 nt, Human
ccuccuguggugguaggggc

SEQ ID NO: 67526 - RNA, 21 nt, Human
ccuccuucagugcgcgggggu

SEQ ID NO: 67527 - RNA, 20 nt, Human
ccucucuccagaguuuccca

SEQ ID NO: 67528 - RNA, 18 nt, Human
cgacagcacagcuuuaga

SEQ ID NO: 67529 - RNA, 25 nt, Human
cucacaaaaagaaaaaagaaaucca

SEQ ID NO: 67530 - RNA, 25 nt, Human
cucacaaaaagaaaaaagaaaucca

SEQ ID NO: 67531 - RNA, 19 nt, Human
cugcucaguaauugcuuca

SEQ ID NO: 67532 - RNA, 19 nt, Human
cugcucaguaauugcuuca

SEQ ID NO: 67533 - RNA, 19 nt, Human
gaaaggcagccucucucca

SEQ ID NO: 67534 - RNA, 22 nt, Human
gagaaaacagggaagcaggaag

SEQ ID NO: 67535 - RNA, 19 nt, Human
gagccuggggaggugucca

SEQ ID NO: 67536 - RNA, 18 nt, Human
gagcuuuucacacauccu

SEQ ID NO: 67537 - RNA, 22 nt, Human
gaucuugaucugcucaguaauu

SEQ ID NO: 67538 - RNA, 22 nt, Human
gaucuugaucugcucaguaauu

SEQ ID NO: 67539 - RNA, 18 nt, Human
gcguaugguuaggcuggu

SEQ ID NO: 67540 - RNA, 18 nt, Human
gcguaugguuaggcuggu

SEQ ID NO: 67541 - RNA, 23 nt, Human
ggaaaaacacacauaaauucagg

SEQ ID NO: 67542 - RNA, 23 nt, Human
ggaaaaacacacauaaauucagg

SEQ ID NO: 67543 - RNA, 19 nt, Human
ggcuggagaggagggaagg

SEQ ID NO: 67544 - RNA, 18 nt, Human
gggaagcaggaaggggaa

SEQ ID NO: 67545 - RNA, 24 nt, Human
guaaaacaaaacaaaaaaaaaaac

SEQ ID NO: 67546 - RNA, 23 nt, Human
guaaaacaaaacaaaaaaaaaac

SEQ ID NO: 67547 - RNA, 24 nt, Human
guaaaacaaaacaaaaaaaaaacu

SEQ ID NO: 67548 - RNA, 20 nt, Human
guccagaguucuacaaaaau

SEQ ID NO: 67549 - RNA, 24 nt, Human
uaaaaagaaaaaaaaauacacuaa

SEQ ID NO: 67550 - RNA, 24 nt, Human
uaaaaagaaaaaaaaauacacuaa

SEQ ID NO: 67551 - RNA, 21 nt, Human
uaaaagcugucucacaaaaag

SEQ ID NO: 67552 - RNA, 22 nt, Human
uaaaagcugucucacaaaaagu

SEQ ID NO: 67553 - RNA, 21 nt, Human
uaaaaugccaguggacuauaa

SEQ ID NO: 67554 - RNA, 21 nt, Human
uaaaaugccaguggacuauaa

SEQ ID NO: 67555 - RNA, 19 nt, Human
uaaagcuaauguagaaauu

SEQ ID NO: 67556 - RNA, 19 nt, Human
uaaagcuaauguagaaauu

SEQ ID NO: 67557 - RNA, 19 nt, Human
uaacacaguguacacaagu

SEQ ID NO: 67558 - RNA, 19 nt, Human
uaacacaguguacacaagu

SEQ ID NO: 67559 - RNA, 25 nt, Human
uaacacaguguacacaagucagucc

SEQ ID NO: 67560 - RNA, 25 nt, Human
uaacacaguguacacaagucagucc

SEQ ID NO: 67561 - RNA, 25 nt, Human
uaacgucaaugaaaguauucaauau

SEQ ID NO: 67562 - RNA, 21 nt, Human
uaagaagaaaaucuucagugu

SEQ ID NO: 67563 - RNA, 23 nt, Human
uacacacccucaccaaucagagc

SEQ ID NO: 67564 - RNA, 21 nt, Human
uacauucaauggcuaauuuac

SEQ ID NO: 67565 - RNA, 21 nt, Human
uacuuuugcucauucaucagu

SEQ ID NO: 67566 - RNA, 19 nt, Human
uagaaagaaaaaggcucau

SEQ ID NO: 67567 - RNA, 22 nt, Human
uagaaguaucuuugauuuuaau

SEQ ID NO: 67568 - RNA, 22 nt, Human
uagaaguaucuuugauuuuaau

SEQ ID NO: 67569 - RNA, 20 nt, Human
uauacaacucaaaucuucac

SEQ ID NO: 67570 - RNA, 20 nt, Human
uauacaacucaaaucuucac

SEQ ID NO: 67571 - RNA, 24 nt, Human
ucaccuuaucuuaauguuaacaaa

SEQ ID NO: 67572 - RNA, 24 nt, Human
ucaccuuaucuuaauguuaacaaa

SEQ ID NO: 67573 - RNA, 21 nt, Human
ucagauauuuggaauucaaaa

SEQ ID NO: 67574 - RNA, 25 nt, Human
ucauucaucaguucuaugucacucc

SEQ ID NO: 67575 - RNA, 22 nt, Human
uccucaacguccagaguucuac

SEQ ID NO: 67576 - RNA, 22 nt, Human
ucgaguacccaugcaggacuca

SEQ ID NO: 67577 - RNA, 23 nt, Human
ucuaaaauuuaaacaaaugcuga

SEQ ID NO: 67578 - RNA, 25 nt, Human
ucuauagugauaaaaauauagaagu

SEQ ID NO: 67579 - RNA, 25 nt, Human
ucuauagugauaaaaauauagaagu

SEQ ID NO: 67580 - RNA, 19 nt, Human
ucuauccucacacccaagg

SEQ ID NO: 67581 - RNA, 18 nt, Human
ucucacaaaaagaaaaaa

SEQ ID NO: 67582 - RNA, 18 nt, Human
ucucacaaaaagaaaaaa

SEQ ID NO: 67583 - RNA, 25 nt, Human
ucuuauggcuuugcuuauaguugcu

SEQ ID NO: 67584 - RNA, 25 nt, Human
ucuuauggcuuugcuuauaguugcu

SEQ ID NO: 67585 - RNA, 18 nt, Human
ucuucaguguagaaagaa

SEQ ID NO: 67586 - RNA, 28 nt, Human
ugaacacuuaaagcuaauguagaaauuu

SEQ ID NO: 67587 - RNA, 28 nt, Human
ugaacacuuaaagcuaauguagaaauuu

SEQ ID NO: 67588 - RNA, 23 nt, Human
ugaauccucaacguccagaguuc

SEQ ID NO: 67589 - RNA, 24 nt, Human
ugaauccucaacguccagaguucu

SEQ ID NO: 67590 - RNA, 21 nt, Human
ugagcccaaaauaaaccacca

SEQ ID NO: 67591 - RNA, 20 nt, Human
ugagccuggggaggugucca

SEQ ID NO: 67592 - RNA, 22 nt, Human
ugaugugguagcuaccuucuuu

SEQ ID NO: 67593 - RNA, 22 nt, Human
ugaugugguagcuaccuucuuu

SEQ ID NO: 67594 - RNA, 27 nt, Human
ugcuaaaguaaaacaaaacaaaaaaaa

SEQ ID NO: 67595 - RNA, 20 nt, Human
uggagaggagggaagguggu

SEQ ID NO: 67596 - RNA, 22 nt, Human
uggagaggagggaagguggugg

SEQ ID NO: 67597 - RNA, 18 nt, Human
uggugguaggggcagucu

SEQ ID NO: 67598 - RNA, 18 nt, Human
uggugguaggggcagucu

SEQ ID NO: 67599 - RNA, 21 nt, Human
uguaaaaagaaaaaaaaauac

SEQ ID NO: 67600 - RNA, 19 nt, Human
uguagaaagaaaaaggcuc

SEQ ID NO: 67601 - RNA, 30 nt, Human
uguggugguaggggcagucuuuuugaagcu

SEQ ID NO: 67602 - RNA, 30 nt, Human; identical to SEQ ID NO: 67601

SEQ ID NO: 67603 - RNA, 20 nt, Human
uuaaucugaacacuuaaagc

SEQ ID NO: 67604 - RNA, 20 nt, Human
uuaaucugaacacuuaaagc

SEQ ID NO: 67605 - RNA, 18 nt, Human
uuacacaucgaguacccc

SEQ ID NO: 67606 - RNA, 20 nt, Human
uuccagguuuucauuacaca

SEQ ID NO: 67607 - RNA, 18 nt, Human
uuuacacacccucaccaa

SEQ ID NO: 67608 - RNA, 18 nt, Human
agcaggacuggcaggggu

SEQ ID NO: 67609 - RNA, 19 nt, Human
agcugccccccacccuucc

SEQ ID NO: 67610 - RNA, 22 nt, Human
agggggaccagggaacaaagcu

SEQ ID NO: 67611 - RNA, 24 nt, Human
caccgcagcugccccccacccuuc

SEQ ID NO: 67612 - RNA, 23 nt, Human
cacuacgcugccagccggggaga

SEQ ID NO: 67613 - RNA, 21 nt, Human
cagcugccccccacccuuccc

SEQ ID NO: 67614 - RNA, 27 nt, Human
caggcggcagagcaggacuggcagggg

SEQ ID NO: 67615 - RNA, 20 nt, Human
ccccaccgcagcugcccccc

SEQ ID NO: 67616 - RNA, 21 nt, Human
ccccaccgcagcugcccccca

SEQ ID NO: 67617 - RNA, 21 nt, Human
ccccacuacgcugccagccgg

SEQ ID NO: 67618 - RNA, 22 nt, Human
ccccacuacgcugccagccggg

SEQ ID NO: 67619 - RNA, 20 nt, Human
ccccccacccuucccuucga

SEQ ID NO: 67620 - RNA, 23 nt, Human
ccgcagcugccccccacccuucc

SEQ ID NO: 67621 - RNA, 22 nt, Human
cuccccaccgcagcugcccccc

SEQ ID NO: 67622 - RNA, 24 nt, Human
cuccccaccgcagcugccccccac

SEQ ID NO: 67623 - RNA, 21 nt, Human
cugccccccacccuucccuuc

SEQ ID NO: 67624 - RNA, 22 nt, Human
gcaggcuucagggggaccaggg

SEQ ID NO: 67625 - RNA, 23 nt, Human
uggaggcgugaguucccggcguc

SEQ ID NO: 67626 - RNA, 19 nt, Human
uggcaggcggcagagcagg

SEQ ID NO: 67627 - RNA, 18 nt, Human
ugggauuggaggcgugag

SEQ ID NO: 67628 - RNA, 24 nt, Human
ugggauuggaggcgugaguucccg

SEQ ID NO: 67629 - RNA, 25 nt, Human
ugggauuggaggcgugaguucccgg

SEQ ID NO: 67630 - RNA, 20 nt, Human
uggggccuggcagccccacu

SEQ ID NO: 67631 - RNA, 21 nt, Human
aaaaaaaccaauauagcucaa

SEQ ID NO: 67632 - RNA, 19 nt, Human
aaaaaaccaauauagcuca

SEQ ID NO: 67633 - RNA, 20 nt, Human
aaaaauccacagaccaaccc

SEQ ID NO: 67634 - RNA, 21 nt, Human
aaaaauccacagaccaaccca

SEQ ID NO: 67635 - RNA, 21 nt, Human
aaaacuagcaacacaagcaaa

SEQ ID NO: 67636 - RNA, 24 nt, Human
aaaagucagcagguugagaucaau

SEQ ID NO: 67637 - RNA, 23 nt, Human
aaacagaaggagaggguacagag

SEQ ID NO: 67638 - RNA, 24 nt, Human
aaacaggaggaagaaagucuuggg

SEQ ID NO: 67639 - RNA, 22 nt, Human
aaagucuuggggaaagaggagg

SEQ ID NO: 67640 - RNA, 21 nt, Human
aaaguguugaccccuccuggu

SEQ ID NO: 67641 - RNA, 23 nt, Human
aagaaaaccaggagacacagaca

SEQ ID NO: 67642 - RNA, 23 nt, Human
aagcaaauuuagcaaggugggga

SEQ ID NO: 67643 - RNA, 21 nt, Human
aaggccuaggaagaaaaccag

SEQ ID NO: 67644 - RNA, 19 nt, Human
aagguaagagguguggggg

SEQ ID NO: 67645 - RNA, 18 nt, Human
aaucaguggugcuucccu

SEQ ID NO: 67646 - RNA, 21 nt, Human
aaugaaagcugguuucaccuu

SEQ ID NO: 67647 - RNA, 20 nt, Human
acagugcacaagggauuuga

SEQ ID NO: 67648 - RNA, 21 nt, Human
acagugcacaagggauuugag

SEQ ID NO: 67649 - RNA, 21 nt, Human
accaucacccuuucuagccag

SEQ ID NO: 67650 - RNA, 20 nt, Human
accugcuucacccucucccu

SEQ ID NO: 67651 - RNA, 25 nt, Human
accugcuucacccucucccuggccu

SEQ ID NO: 67652 - RNA, 19 nt, Human
acugaaaacagaacugggu

SEQ ID NO: 67653 - RNA, 20 nt, Human
agaggaacuugggagacuga

SEQ ID NO: 67654 - RNA, 19 nt, Human
agcaaaccccaaaguaauc

SEQ ID NO: 67655 - RNA, 22 nt, Human
aggaaggaucucaaaacccaag

SEQ ID NO: 67656 - RNA, 25 nt, Human
aggaaugcuugaggguggggccugc

SEQ ID NO: 67657 - RNA, 25 nt, Human
aggagaggguacagaggagugacuc

SEQ ID NO: 67658 - RNA, 18 nt, Human
aggagccagucauaggag

SEQ ID NO: 67659 - RNA, 20 nt, Human
aggaggaagaaagucuuggg

SEQ ID NO: 67660 - RNA, 23 nt, Human
aggaucucaaaacccaaguggcc

SEQ ID NO: 67661 - RNA, 18 nt, Human
aggcaugguggcugaagg

SEQ ID NO: 67662 - RNA, 21 nt, Human
aggguggggaggagggccaug

SEQ ID NO: 67663 - RNA, 25 nt, Human
agucagcagguugagaucaauagug

SEQ ID NO: 67664 - RNA, 24 nt, Human
aguuguauaaccucucuuugccuc

SEQ ID NO: 67665 - RNA, 19 nt, Human
auagcacuuuccucaggag

SEQ ID NO: 67666 - RNA, 23 nt, Human
aucuuguucccucucaaagauca

SEQ ID NO: 67667 - RNA, 22 nt, Human
caaaacccaaguggcccacugg

SEQ ID NO: 67668 - RNA, 21 nt, Human
caacgagaaacaggaggaaga

SEQ ID NO: 67669 - RNA, 22 nt, Human
cacaagcaaauuuagcaaggug

SEQ ID NO: 67670 - RNA, 18 nt, Human
cacaagggauuugaggca

SEQ ID NO: 67671 - RNA, 24 nt, Human
cacccuccuuucacucaagcuuaa

SEQ ID NO: 67672 - RNA, 20 nt, Human
cacccuccuuucacucaagg

SEQ ID NO: 67673 - RNA, 18 nt, Human
cagggccaaggcucccag

SEQ ID NO: 67674 - RNA, 21 nt, Human
cauucuggcagcagcucccug

SEQ ID NO: 67675 - RNA, 19 nt, Human
cauugcuagucaacagggc

SEQ ID NO: 67676 - RNA, 20 nt, Human
ccaacagccugaaaucacac

SEQ ID NO: 67677 - RNA, 20 nt, Human
ccaacccagauggaucccuc

SEQ ID NO: 67678 - RNA, 19 nt, Human
ccaccauucaugaccaugc

SEQ ID NO: 67679 - RNA, 18 nt, Human
ccagaggucuuggggaca

SEQ ID NO: 67680 - RNA, 20 nt, Human
cccacuggggccuauaauga

SEQ ID NO: 67681 - RNA, 19 nt, Human
cccagauggaucccuccuc

SEQ ID NO: 67682 - RNA, 18 nt, Human
ccucguuuuccucaacac

SEQ ID NO: 67683 - RNA, 21 nt, Human
ccugaggaaugcuugagggug

SEQ ID NO: 67684 - RNA, 22 nt, Human
ccuguuggcugggccaccauuc

SEQ ID NO: 67685 - RNA, 18 nt, Human
cgccccuccuccuuccac

SEQ ID NO: 67686 - RNA, 22 nt, Human
cuccaaaggcuaagggcguacu

SEQ ID NO: 67687 - RNA, 20 nt, Human
cucccuggccugucaacucc

SEQ ID NO: 67688 - RNA, 23 nt, Human
cucuaaagaaauauggcacugca

SEQ ID NO: 67689 - RNA, 22 nt, Human
cucugcucccaguugcaauggg

SEQ ID NO: 67690 - RNA, 19 nt, Human
cuggaugggcagugaccau

SEQ ID NO: 67691 - RNA, 22 nt, Human
cuggcagauuucccaaucaugc

SEQ ID NO: 67692 - RNA, 19 nt, Human
cuggcagcagcucccuggc

SEQ ID NO: 67693 - RNA, 19 nt, Human
cugggcagguucccugugg

SEQ ID NO: 67694 - RNA, 22 nt, Human
cugggcccugucugauuggccu

SEQ ID NO: 67695 - RNA, 21 nt, Human
gaaagaaggagagaggagagu

SEQ ID NO: 67696 - RNA, 21 nt, Human
gaacagaaguuuuuugugauc

SEQ ID NO: 67697 - RNA, 21 nt, Human
gaagguagaggaacuugggag

SEQ ID NO: 67698 - RNA, 20 nt, Human
gacaagggccaccuuccuca

SEQ ID NO: 67699 - RNA, 22 nt, Human
gagcugggagaguguugguggg

SEQ ID NO: 67700 - RNA, 18 nt, Human
gagggccaugugcagugg

SEQ ID NO: 67701 - RNA, 18 nt, Human
gauaugaaaguguugacc

SEQ ID NO: 67702 - RNA, 21 nt, Human
gcccacuggggccuauaauga

SEQ ID NO: 67703 - RNA, 21 nt, Human
gcuugaggguggggccugcgg

SEQ ID NO: 67704 - RNA, 22 nt, Human
ggaaucucugaggcaggugcau

SEQ ID NO: 67705 - RNA, 24 nt, Human
ggacaugggagcugggagaguguu

SEQ ID NO: 67706 - RNA, 22 nt, Human
ggagcccuggucaaaggcaugg

SEQ ID NO: 67707 - RNA, 18 nt, Human
ggaguugugugcauugug

SEQ ID NO: 67708 - RNA, 24 nt, Human
ggccaaaaaaggagggucacagaa

SEQ ID NO: 67709 - RNA, 20 nt, Human
gggacagcuaaggccauugc

SEQ ID NO: 67710 - RNA, 19 nt, Human
gggcagguucccugugggg

SEQ ID NO: 67711 - RNA, 19 nt, Human
gggccaugugcaguggaac

SEQ ID NO: 67712 - RNA, 24 nt, Human
gucaauuguacaaccauccuaaga

SEQ ID NO: 67713 - RNA, 21 nt, Human
gucugauuggccugucacauc

SEQ ID NO: 67714 - RNA, 24 nt, Human
gugacucugauaccugcuucaccc

SEQ ID NO: 67715 - RNA, 18 nt, Human
guguguguguguguacau

SEQ ID NO: 67716 - RNA, 19 nt, Human
uaaaauaaaaacagaagga

SEQ ID NO: 67717 - RNA, 24 nt, Human
uaaaauggagacaagaauagcacu

SEQ ID NO: 67718 - RNA, 19 nt, Human
uaaguaggagccagucaua

SEQ ID NO: 67719 - RNA, 20 nt, Human
uacagaggagugacucugau

SEQ ID NO: 67720 - RNA, 21 nt, Human
uacagcaagcacucaauaaau

SEQ ID NO: 67721 - RNA, 22 nt, Human
uacagcaagcacucaauaaaug

SEQ ID NO: 67722 - RNA, 24 nt, Human
uaccuaaagugcuuacaucagcgc

SEQ ID NO: 67723 - RNA, 26 nt, Human
uagaaaaaaaaccaauauagcucaau

SEQ ID NO: 67724 - RNA, 19 nt, Human
uagcagcaaagagaugcuc

SEQ ID NO: 67725 - RNA, 22 nt, Human
uauaagcaccucccuuaagacc

SEQ ID NO: 67726 - RNA, 26 nt, Human
uauuaaaaauccacagaccaacccag

SEQ ID NO: 67727 - RNA, 21 nt, Human
uauuugccccuugaggcacuu

SEQ ID NO: 67728 - RNA, 18 nt, Human
ucaaaggcaugguggcug

SEQ ID NO: 67729 - RNA, 22 nt, Human
ucaacagggccuugccaggcuc

SEQ ID NO: 67730 - RNA, 21 nt, Human
ucagccucaucacaggcuucc

SEQ ID NO: 67731 - RNA, 23 nt, Human
ucaggccacugaguuguguggga

SEQ ID NO: 67732 - RNA, 22 nt, Human
ucaguggugcuucccuacacag

SEQ ID NO: 67733 - RNA, 21 nt, Human
ucauauguuuccagaugagga

SEQ ID NO: 67734 - RNA, 24 nt, Human
ucauucuggcagcagcucccuggc

SEQ ID NO: 67735 - RNA, 18 nt, Human
uccacagaccaacccaga

SEQ ID NO: 67736 - RNA, 22 nt, Human
uccacagaccaacccagaugga

SEQ ID NO: 67737 - RNA, 22 nt, Human
uccacugcacagaggacauguc

SEQ ID NO: 67738 - RNA, 23 nt, Human
uccaugccacagaugcuugggaa

SEQ ID NO: 67739 - RNA, 24 nt, Human
ucccacaucauccacuucugggca

SEQ ID NO: 67740 - RNA, 23 nt, Human
ucccagguagacuuuucugaagg

SEQ ID NO: 67741 - RNA, 19 nt, Human
ucggcagccucacccuccu

SEQ ID NO: 67742 - RNA, 22 nt, Human
ucucagccucaucacaggcuuc

SEQ ID NO: 67743 - RNA, 24 nt, Human
ucucugggcagguucccugugggg

SEQ ID NO: 67744 - RNA, 21 nt, Human
ucugcaguaguaaaguguuuu

SEQ ID NO: 67745 - RNA, 18 nt, Human
ugaaaggcugggcuuccu

SEQ ID NO: 67746 - RNA, 22 nt, Human
ugaguuacagugcacaagggaa

SEQ ID NO: 67747 - RNA, 19 nt, Human
ugcaaaacuagcaacacaa

SEQ ID NO: 67748 - RNA, 25 nt, Human
ugcacaagggauuugaggcaaguug

SEQ ID NO: 67749 - RNA, 19 nt, Human
ugccacagaugcuugggaa

SEQ ID NO: 67750 - RNA, 19 nt, Human
ugcccuggagaccaacagc

SEQ ID NO: 67751 - RNA, 22 nt, Human
ugccuacuuaauagacuuuuca

SEQ ID NO: 67752 - RNA, 21 nt, Human
ugcuagucaacagggccuugc

SEQ ID NO: 67753 - RNA, 21 nt, Human
ugcuucacccucucccuggcc

SEQ ID NO: 67754 - RNA, 20 nt, Human
uggaaagaaggagagaggag

SEQ ID NO: 67755 - RNA, 23 nt, Human
uggaacaaauuaauggcaaagca

SEQ ID NO: 67756 - RNA, 22 nt, Human
uggaacuaggggucccaagggu

SEQ ID NO: 67757 - RNA, 23 nt, Human
uggagacaagaauagcacuuucc

SEQ ID NO: 67758 - RNA, 20 nt, Human
uggagaccaacagccugaaa

SEQ ID NO: 67759 - RNA, 24 nt, Human
uggcagauuucccaaucaugcaga

SEQ ID NO: 67760 - RNA, 19 nt, Human
uggcagcagcucccuggcc

SEQ ID NO: 67761 - RNA, 18 nt, Human
uggcauacagcaagcacu

SEQ ID NO: 67762 - RNA, 21 nt, Human
uggcaucuuguucccucucaa

SEQ ID NO: 67763 - RNA, 25 nt, Human
ugggagcugggagaguguugguggg

SEQ ID NO: 67764 - RNA, 22 nt, Human
uggggccugcggcaggccuaac

SEQ ID NO: 67765 - RNA, 20 nt, Human
uggucaaaggcaugguggcu

SEQ ID NO: 67766 - RNA, 24 nt, Human
ugguggaauccuccugcuuauggu

SEQ ID NO: 67767 - RNA, 19 nt, Human
ugugcacacgugugugugu

SEQ ID NO: 67768 - RNA, 22 nt, Human
uguguacauacauacacacauu

SEQ ID NO: 67769 - RNA, 27 nt, Human
ugugugcacacguguguguguguguaa

SEQ ID NO: 67770 - RNA, 22 nt, Human
ugugugcauugugugugcacac

SEQ ID NO: 67771 - RNA, 18 nt, Human
uguguguacauacauaca

SEQ ID NO: 67772 - RNA, 19 nt, Human
ugugugugcacacgugugu

SEQ ID NO: 67773 - RNA, 20 nt, Human
ugugugugcacacgugugug

SEQ ID NO: 67774 - RNA, 21 nt, Human
ugugugugcacacgugugugu

SEQ ID NO: 67775 - RNA, 26 nt, Human
ugugugugcacacgugugugugugug

SEQ ID NO: 67776 - RNA, 18 nt, Human
uguguguguguacauaca

SEQ ID NO: 67777 - RNA, 25 nt, Human
uuaaaaauccacagaccaacccaga

SEQ ID NO: 67778 - RNA, 22 nt, Human
uucacucaagcuuaaaacaccg

SEQ ID NO: 67779 - RNA, 18 nt, Human
uucaguguuuggaaagaa

SEQ ID NO: 67780 - RNA, 25 nt, Human
uuccugaggaaugcuugaggguggg

SEQ ID NO: 67781 - RNA, 20 nt, Human
uuugccacaggugggacagc

SEQ ID NO: 67782 - RNA, 18 nt, Human
uuuggaaagaaggagaga

SEQ ID NO: 67783 - RNA, 25 nt, Human
uuuuuuaaaaaacaauaaacuccaa

SEQ ID NO: 67784 - RNA, 22 nt, Human
uuuuuugugaucaauaauagcu

SEQ ID NO: 67785 - RNA, 18 nt, Human
acaccaagccuccgcgca

SEQ ID NO: 67786 - RNA, 21 nt, Human
acccgagccccgagcucaccc

SEQ ID NO: 67787 - RNA, 23 nt, Human
acuugcagguccgggggccgcgc

SEQ ID NO: 67788 - RNA, 18 nt, Human
aggagcagggggcccgga

SEQ ID NO: 67789 - RNA, 25 nt, Human
aggcucggaccuggcacaccaagcc

SEQ ID NO: 67790 - RNA, 23 nt, Human
agggggcccggagacaggggagg

SEQ ID NO: 67791 - RNA, 19 nt, Human
agguggcucuggucaggag

SEQ ID NO: 67792 - RNA, 22 nt, Human
caccaagccuccgcgcaccucc

SEQ ID NO: 67793 - RNA, 19 nt, Human
cauuacacagcaacaaagc

SEQ ID NO: 67794 - RNA, 18 nt, Human
cauugcacccaguacgga

SEQ ID NO: 67795 - RNA, 25 nt, Human
cauugcacccaguacggaacagugg

SEQ ID NO: 67796 - RNA, 19 nt, Human
ccccgagcucacccacccc

SEQ ID NO: 67797 - RNA, 23 nt, Human
ccccgcugccgcucggcuccccg

SEQ ID NO: 67798 - RNA, 19 nt, Human
ccgagccccgagcucaccc

SEQ ID NO: 67799 - RNA, 21 nt, Human
ccgcccgcccggaaucgcuuu

SEQ ID NO: 67800 - RNA, 19 nt, Human
ccgccgccgccgccuccuc

SEQ ID NO: 67801 - RNA, 27 nt, Human
ccgccgccuccuccucuuccgccgccc

SEQ ID NO: 67802 - RNA, 21 nt, Human
ccgcgcccgcccgcccgcagg

SEQ ID NO: 67803 - RNA, 18 nt, Human
ccgcugccgcucggcucc

SEQ ID NO: 67804 - RNA, 19 nt, Human
ccugcccgccgccgccgcc

SEQ ID NO: 67805 - RNA, 24 nt, Human
ccugcccgccgccgccgccuccuc

SEQ ID NO: 67806 - RNA, 23 nt, Human
cgagccccgagcucacccacccc

SEQ ID NO: 67807 - RNA, 20 nt, Human
cgcaguuugcagcgcgcacc

SEQ ID NO: 67808 - RNA, 21 nt, Human
cgcccggggaaggggggcggg

SEQ ID NO: 67809 - RNA, 22 nt, Human
cgcgccgccaugcgcaacaacg

SEQ ID NO: 67810 - RNA, 24 nt, Human
cgcggcgcuggcguccgggucccc

SEQ ID NO: 67811 - RNA, 24 nt, Human
cggcggcgaccgcgcccgcccgcc

SEQ ID NO: 67812 - RNA, 21 nt, Human
cgggacgcggcggggauucac

SEQ ID NO: 67813 - RNA, 19 nt, Human
cgguaugcuccccaccucc

SEQ ID NO: 67814 - RNA, 22 nt, Human
cguccggguccccggccugccc

SEQ ID NO: 67815 - RNA, 20 nt, Human
cucacagccccgcugccgcu

SEQ ID NO: 67816 - RNA, 19 nt, Human
gagcucacccaccccaggc

SEQ ID NO: 67817 - RNA, 18 nt, Human
gaggggagcucauggugg

SEQ ID NO: 67818 - RNA, 20 nt, Human
gcagggcuggcggucggccc

SEQ ID NO: 67819 - RNA, 18 nt, Human
gccccgagcucacccacc

SEQ ID NO: 67820 - RNA, 19 nt, Human
gccgccgccgccuccuccu

SEQ ID NO: 67821 - RNA, 18 nt, Human
gcggggauucacccacgg

SEQ ID NO: 67822 - RNA, 19 nt, Human
gcucuggucaggagcaggg

SEQ ID NO: 67823 - RNA, 22 nt, Human
ggagacaggggaggggagcuca

SEQ ID NO: 67824 - RNA, 21 nt, Human
ggcggcgaccgcgcccgcccg

SEQ ID NO: 67825 - RNA, 22 nt, Human
gggcgcggcgcuggcguccggg

SEQ ID NO: 67826 - RNA, 18 nt, Human
gggcggggcggggggccu

SEQ ID NO: 67827 - RNA, 19 nt, Human
ggggaaggggggcgggcgg

SEQ ID NO: 67828 - RNA, 19 nt, Human
ggggcgggcggggcggggg

SEQ ID NO: 67829 - RNA, 21 nt, Human
guccccggagggagguccccg

SEQ ID NO: 67830 - RNA, 20 nt, Human
guuugcagcgcgcaccgccc

SEQ ID NO: 67831 - RNA, 18 nt, Human
uaaauucauuuguuugua

SEQ ID NO: 67832 - RNA, 19 nt, Human
uacacagcaacaaagcgga

SEQ ID NO: 67833 - RNA, 22 nt, Human
uacacagcaacaaagcggaagg

SEQ ID NO: 67834 - RNA, 23 nt, Human
uccaguggcacccgagccccgag

SEQ ID NO: 67835 - RNA, 19 nt, Human
uccccaccucccgcuggcc

SEQ ID NO: 67836 - RNA, 19 nt, Human
ugaaacucacagccccgcu

SEQ ID NO: 67837 - RNA, 19 nt, Human
ugcagguccgggggccgcg

SEQ ID NO: 67838 - RNA, 21 nt, Human
uggcguccggguccccggccu

SEQ ID NO: 67839 - RNA, 18 nt, Human
uggucaggagcagggggc

SEQ ID NO: 67840 - RNA, 18 nt, Human
uuguauuguucaucuuca

SEQ ID NO: 67841 - RNA, 22 nt, Human
aaccacagauuucgcauaaaug

SEQ ID NO: 67842 - RNA, 19 nt, Human
aaacccgcgccggccccag

SEQ ID NO: 67843 - RNA, 24 nt, Human
aaagcgcuccguccccacguccag

SEQ ID NO: 67844 - RNA, 22 nt, Human
aacccgcgccggccccaggagc

SEQ ID NO: 67845 - RNA, 25 nt, Human
aacccgcgccggccccaggagcaca

SEQ ID NO: 67846 - RNA, 20 nt, Human
acaagcacauugacgcuccu

SEQ ID NO: 67847 - RNA, 26 nt, Human
accaauccaaaacccgcgccggcccc

SEQ ID NO: 67848 - RNA, 19 nt, Human
acccugagggcgggggagg

SEQ ID NO: 67849 - RNA, 21 nt, Human
acccugagggcgggggaggag

SEQ ID NO: 67850 - RNA, 18 nt, Human
accuugcggggcucgggg

SEQ ID NO: 67851 - RNA, 23 nt, Human
aggccgcaccccaccaauccaaa

SEQ ID NO: 67852 - RNA, 24 nt, Human
aggggauucuuccaccggccgcca

SEQ ID NO: 67853 - RNA, 19 nt, Human
augcugccgcaggcacugc

SEQ ID NO: 67854 - RNA, 22 nt, Human
caaaacccgcgccggccccagg

SEQ ID NO: 67855 - RNA, 20 nt, Human
caagaggaaagcgcuccguc

SEQ ID NO: 67856 - RNA, 27 nt, Human
caagcacauugacgcuccugacuaucc

SEQ ID NO: 67857 - RNA, 24 nt, Human
caccgcccgcccuugacucacgcc

SEQ ID NO: 67858 - RNA, 22 nt, Human
cagcggccgcgccccgcccacc

SEQ ID NO: 67859 - RNA, 23 nt, Human
cagggcaguuguauuugccccuc

SEQ ID NO: 67860 - RNA, 22 nt, Human
caucuagagaaucgggaacagg

SEQ ID NO: 67861 - RNA, 24 nt, Human
caucuugguuccugcacguuucgu

SEQ ID NO: 67862 - RNA, 19 nt, Human
ccaauccaaaacccgcgcc

SEQ ID NO: 67863 - RNA, 26 nt, Human
cccaccaauccaaaacccgcgccggc

SEQ ID NO: 67864 - RNA, 21 nt, Human
ccccaccaauccaaaacccgc

SEQ ID NO: 67865 - RNA, 19 nt, Human
ccccuuggcggcaccgccc

SEQ ID NO: 67866 - RNA, 20 nt, Human
cccgcgccgccgcccugccg

SEQ ID NO: 67867 - RNA, 23 nt, Human
cccugccgccgccaucuugguuc

SEQ ID NO: 67868 - RNA, 21 nt, Human
cccuggccccaggccgcaccc

SEQ ID NO: 67869 - RNA, 24 nt, Human
cccuugacucacgcccgcgccgcc

SEQ ID NO: 67870 - RNA, 20 nt, Human
ccgcaccccaccaauccaaa

SEQ ID NO: 67871 - RNA, 21 nt, Human
ccgcaccccaccaauccaaaa

SEQ ID NO: 67872 - RNA, 23 nt, Human
ccgcaccccaccaauccaaaacc

SEQ ID NO: 67873 - RNA, 24 nt, Human
ccgcccaccgcccgcccuugacuc

SEQ ID NO: 67874 - RNA, 24 nt, Human
ccgcccugccgccgccaucuuggu

SEQ ID NO: 67875 - RNA, 25 nt, Human
ccgccgcccugccgccgccaucuug

SEQ ID NO: 67876 - RNA, 26 nt, Human
ccgcgccccgcccaccgcccgcccuu

SEQ ID NO: 67877 - RNA, 21 nt, Human
ccuggccccaggccgcacccc

SEQ ID NO: 67878 - RNA, 23 nt, Human
ccugggaccuugcggggcucggg

SEQ ID NO: 67879 - RNA, 19 nt, Human
ccuugcggggcucgggguc

SEQ ID NO: 67880 - RNA, 20 nt, Human
cgccaagaggaaagcgcucc

SEQ ID NO: 67881 - RNA, 20 nt, Human
cgccaugguggccguggacc

SEQ ID NO: 67882 - RNA, 26 nt, Human
cgccccgcccaccgcccgcccuugac

SEQ ID NO: 67883 - RNA, 20 nt, Human
cgcccgcgccgccgcccugc

SEQ ID NO: 67884 - RNA, 19 nt, Human
cgccgccgcccugccgccg

SEQ ID NO: 67885 - RNA, 19 nt, Human
cggccccaggagcacagcu

SEQ ID NO: 67886 - RNA, 18 nt, Human
cuagagaaucgggaacag

SEQ ID NO: 67887 - RNA, 18 nt, Human
cugcugccccuaauacgc

SEQ ID NO: 67888 - RNA, 20 nt, Human
cugcugccccuaauacgcca

SEQ ID NO: 67889 - RNA, 18 nt, Human
cuggaaucgaggaaugug

SEQ ID NO: 67890 - RNA, 23 nt, Human
cuugcggggcucgggguccgagg

SEQ ID NO: 67891 - RNA, 23 nt, Human
gaaugagaaucagaagccaacuc

SEQ ID NO: 67892 - RNA, 18 nt, Human
gacacccaagcaaagacc

SEQ ID NO: 67893 - RNA, 18 nt, Human
gcaaagaccacgcguccc

SEQ ID NO: 67894 - RNA, 19 nt, Human
gcacagcuggacgacccgc

SEQ ID NO: 67895 - RNA, 21 nt, Human
gccguggacccugagggcggg

SEQ ID NO: 67896 - RNA, 18 nt, Human
gcuguagggcuccugggg

SEQ ID NO: 67897 - RNA, 18 nt, Human
ggccguggacccugaggg

SEQ ID NO: 67898 - RNA, 21 nt, Human
gggcuccuggggaagcagucc

SEQ ID NO: 67899 - RNA, 19 nt, Human
ggggacacccaagcaaaga

SEQ ID NO: 67900 - RNA, 22 nt, Human
gguggccguggacccugagggc

SEQ ID NO: 67901 - RNA, 22 nt, Human
gguggccguggacccugagggc

SEQ ID NO: 67902 - RNA, 19 nt, Human
guacaagcacauugacgcu

SEQ ID NO: 67903 - RNA, 22 nt, Human
guacaagcacauugacgcuccu

SEQ ID NO: 67904 - RNA, 23 nt, Human
uccacaaaauggacgcucacgga

SEQ ID NO: 67905 - RNA, 22 nt, Human
ucguggggcaacagccaagacc

SEQ ID NO: 67906 - RNA, 24 nt, Human
ucugagaauuucauccuuccacuu

SEQ ID NO: 67907 - RNA, 22 nt, Human
ugagaagccugaaugagaauca

SEQ ID NO: 67908 - RNA, 21 nt, Human
ugcggggcucgggguccgagg

SEQ ID NO: 67909 - RNA, 19 nt, Human
uggccccaggccgcacccc

SEQ ID NO: 67910 - RNA, 22 nt, Human
ugggaccuugcggggcucgggg

SEQ ID NO: 67911 - RNA, 25 nt, Human
aaacgauccuccugccuuggccucc

SEQ ID NO: 67912 - RNA, 18 nt, Human
aaagugcugggauuacaa

SEQ ID NO: 67913 - RNA, 22 nt, Human
aagaaagaaggugggagcggag

SEQ ID NO: 67914 - RNA, 19 nt, Human
aagcucccagcugcuuccc

SEQ ID NO: 67915 - RNA, 19 nt, Human
aagugcugggauuacaagc

SEQ ID NO: 67916 - RNA, 21 nt, Human
aagugcugggauuacaagcau

SEQ ID NO: 67917 - RNA, 26 nt, Human
aagugcugggauuacaagcauaagcc

SEQ ID NO: 67918 - RNA, 19 nt, Human
aauagagacagggucuuac

SEQ ID NO: 67919 - RNA, 21 nt, Human
acacagccccucuccaacacc

SEQ ID NO: 67920 - RNA, 24 nt, Human
acccagacacagccccucuccaac

SEQ ID NO: 67921 - RNA, 25 nt, Human
acuauguugcccaggcugguauuga

SEQ ID NO: 67922 - RNA, 25 nt, Human
agaaggugggagcggagagcgcagg

SEQ ID NO: 67923 - RNA, 18 nt, Human
agacagggucuuacuaug

SEQ ID NO: 67924 - RNA, 23 nt, Human
agacagggucuuacuauguugcc

SEQ ID NO: 67925 - RNA, 23 nt, Human
agaggcugcaccagcagcuggca

SEQ ID NO: 67926 - RNA, 24 nt, Human
agcgcggagacgggccgggggcac

SEQ ID NO: 67927 - RNA, 18 nt, Human
aggcagggggaugaaggc

SEQ ID NO: 67928 - RNA, 18 nt, Human
aggcgaaaguggaagacu

SEQ ID NO: 67929 - RNA, 24 nt, Human
aggcggcggcggccucggcugaag

SEQ ID NO: 67930 - RNA, 19 nt, Human
aggcugcaccagcagcugg

SEQ ID NO: 67931 - RNA, 19 nt, Human
agguagaggcagggggaug

SEQ ID NO: 67932 - RNA, 24 nt, Human
agguagaggcagggggaugaaggc

SEQ ID NO: 67933 - RNA, 18 nt, Human
agugcugggauuacaagc

SEQ ID NO: 67934 - RNA, 20 nt, Human
aguggaagacuccauggcug

SEQ ID NO: 67935 - RNA, 23 nt, Human
auggcaacaggagaggcugcacc

SEQ ID NO: 67936 - RNA, 26 nt, Human
auuuuuuuuuuuuaauagagacaggg

SEQ ID NO: 67937 - RNA, 24 nt, Human
caaagugcugggauuacaagcaua

SEQ ID NO: 67938 - RNA, 21 nt, Human
caacaggagaggcugcaccag

SEQ ID NO: 67939 - RNA, 23 nt, Human
caaccaccuguaagaaaccaggu

SEQ ID NO: 67940 - RNA, 23 nt, Human
caacuacagcccugcccugcccc

SEQ ID NO: 67941 - RNA, 19 nt, Human
cacuccacccaccccagac

SEQ ID NO: 67942 - RNA, 22 nt, Human
cagcccccagaagccacacccc

SEQ ID NO: 67943 - RNA, 18 nt, Human
cagccccucuccaacacc

SEQ ID NO: 67944 - RNA, 20 nt, Human
cagcccugcccugccccucc

SEQ ID NO: 67945 - RNA, 20 nt, Human
caggagaggcugcaccagca

SEQ ID NO: 67946 - RNA, 24 nt, Human
caggcaccaaggcgaaaguggaag

SEQ ID NO: 67947 - RNA, 24 nt, Human
cagggucuuacuauguugcccagg

SEQ ID NO: 67948 - RNA, 21 nt, Human
caucccucacccagacacagc

SEQ ID NO: 67949 - RNA, 21 nt, Human
ccaaacauuucaugauuugga

SEQ ID NO: 67950 - RNA, 19 nt, Human
ccaaagugcugggauuaca

SEQ ID NO: 67951 - RNA, 24 nt, Human
ccaaagugcugggauuacaagcau

SEQ ID NO: 67952 - RNA, 28 nt, Human
ccaagcucccagcugcuucccugugggc

SEQ ID NO: 67953 - RNA, 19 nt, Human
ccaaggcgaaaguggaaga

SEQ ID NO: 67954 - RNA, 18 nt, Human
ccacugcacccggccgag

SEQ ID NO: 67955 - RNA, 20 nt, Human
ccacugcacccggccgagag

SEQ ID NO: 67956 - RNA, 22 nt, Human
ccacugcacccggccgagaggg

SEQ ID NO: 67957 - RNA, 21 nt, Human
ccacuggccugcucaucuucc

SEQ ID NO: 67958 - RNA, 23 nt, Human
cccaaaaaaaucaguaccccgcc

SEQ ID NO: 67959 - RNA, 18 nt, Human
cccaccccagacaaccac

SEQ ID NO: 67960 - RNA, 22 nt, Human
ccccagaagccacaccccugcc

SEQ ID NO: 67961 - RNA, 22 nt, Human
ccccagacaaccaccuguaaga

SEQ ID NO: 67962 - RNA, 23 nt, Human
ccccagacaaccaccuguaagaa

SEQ ID NO: 67963 - RNA, 24 nt, Human
cccccagaagccacaccccugccc

SEQ ID NO: 67964 - RNA, 18 nt, Human
ccccucuccaacaccuuc

SEQ ID NO: 67965 - RNA, 21 nt, Human
cccgccaucccucacccagac

SEQ ID NO: 67966 - RNA, 24 nt, Human
ccgggggcacaaaggggucgaggc

SEQ ID NO: 67967 - RNA, 23 nt, Human
ccucccaaaaaaaucaguacccc

SEQ ID NO: 67968 - RNA, 26 nt, Human
ccuccugccuuggccucccaaagugc

SEQ ID NO: 67969 - RNA, 18 nt, Human
ccuggccucaaacgaucc

SEQ ID NO: 67970 - RNA, 25 nt, Human
ccuucagcucuauccugucgccacu

SEQ ID NO: 67971 - RNA, 31 nt, Human
cgccagagcugaagaccagcccccagaagcc

SEQ ID NO: 67972 - RNA, 23 nt, Human
cuaaaaugaacacccagucacca

SEQ ID NO: 67973 - RNA, 19 nt, Human
cuaaggccaaacauuucau

SEQ ID NO: 67974 - RNA, 24 nt, Human
cucaaacgauccuccugccuuggc

SEQ ID NO: 67975 - RNA, 19 nt, Human
cugccccuccucccacugg

SEQ ID NO: 67976 - RNA, 23 nt, Human
cugccuuggccucccaaagugcu

SEQ ID NO: 67977 - RNA, 20 nt, Human
gaaggugggagcggagagcg

SEQ ID NO: 67978 - RNA, 19 nt, Human
gacgagaaaggagggaagg

SEQ ID NO: 67979 - RNA, 26 nt, Human
gacgagaaaggagggaaggagaucca

SEQ ID NO: 67980 - RNA, 24 nt, Human
gaggaguugggugguuuggugggg

SEQ ID NO: 67981 - RNA, 20 nt, Human
gagggguuuggaaugaaggu

SEQ ID NO: 67982 - RNA, 27 nt, Human
gauaagcagagacagaggauaaaagga

SEQ ID NO: 67983 - RNA, 23 nt, Human
gauuacaagcauaagccacugca

SEQ ID NO: 67984 - RNA, 19 nt, Human
gcccugccccuccucccac

SEQ ID NO: 67985 - RNA, 22 nt, Human
gccuuggccucccaaagugcug

SEQ ID NO: 67986 - RNA, 18 nt, Human
gcgaagacaggcaccaag

SEQ ID NO: 67987 - RNA, 23 nt, Human
gcgcaggcguggugagcgcggag

SEQ ID NO: 67988 - RNA, 24 nt, Human
gcgccagagcugaagaccagcccc

SEQ ID NO: 67989 - RNA, 23 nt, Human
gcuaaaaugaacacccagucacc

SEQ ID NO: 67990 - RNA, 22 nt, Human
gcugguauugaccuccuggccu

SEQ ID NO: 67991 - RNA, 25 nt, Human
ggaaggagauccagaaauacgcaag

SEQ ID NO: 67992 - RNA, 22 nt, Human
ggauuacaagcauaagccacug

SEQ ID NO: 67993 - RNA, 18 nt, Human
ggcggcggcggccucggc

SEQ ID NO: 67994 - RNA, 18 nt, Human
gggccgggggcacaaagg

SEQ ID NO: 67995 - RNA, 18 nt, Human
ggggcuacgcaggcagag

SEQ ID NO: 67996 - RNA, 18 nt, Human
gggugguuugguggggaa

SEQ ID NO: 67997 - RNA, 21 nt, Human
gguagaggcagggggaugaag

SEQ ID NO: 67998 - RNA, 19 nt, Human
ggugggcgaagacaggcac

SEQ ID NO: 67999 - RNA, 21 nt, Human
uaaaaugaacacccagucacc

SEQ ID NO: 68000 - RNA, 21 nt, Human
uaagcagagacagaggauaaa

SEQ ID NO: 68001 - RNA, 24 nt, Human
uaauagagacagggucuuacuaug

SEQ ID NO: 68002 - RNA, 23 nt, Human
uacaagcauaagccacugcaccc

SEQ ID NO: 68003 - RNA, 21 nt, Human
uacagcccugcccugccccuc

SEQ ID NO: 68004 - RNA, 21 nt, Human
uacuauguugcccaggcuggu

SEQ ID NO: 68005 - RNA, 26 nt, Human
uacuauguugcccaggcugguauuga

SEQ ID NO: 68006 - RNA, 22 nt, Human
uagagacagggucuuacuaugu

SEQ ID NO: 68007 - RNA, 19 nt, Human
uagagaggaguuggguggu

SEQ ID NO: 68008 - RNA, 19 nt, Human
uagaggcagggggaugaag

SEQ ID NO: 68009 - RNA, 27 nt, Human
uagccucccucccuuagcguagugucc

SEQ ID NO: 68010 - RNA, 21 nt, Human
uagugagaagagacugugauc

SEQ ID NO: 68011 - RNA, 23 nt, Human
uauggguccccuucucaaagccc

SEQ ID NO: 68012 - RNA, 18 nt, Human
uauguugcccaggcuggu

SEQ ID NO: 68013 - RNA, 19 nt, Human
uauguugcccaggcuggua

SEQ ID NO: 68014 - RNA, 23 nt, Human
uauguugcccaggcugguauuga

SEQ ID NO: 68015 - RNA, 25 nt, Human
uauuuuugcucauaaccucccaaaa

SEQ ID NO: 68016 - RNA, 18 nt, Human
ucaaagcccgcccugacu

SEQ ID NO: 68017 - RNA, 21 nt, Human
ucauaaccucccaaaaaaauc

SEQ ID NO: 68018 - RNA, 21 nt, Human
uccaagcucccagcugcuucc

SEQ ID NO: 68019 - RNA, 21 nt, Human
uccacccaccccagacaacca

SEQ ID NO: 68020 - RNA, 22 nt, Human
uccauggcugcagcaaggagag

SEQ ID NO: 68021 - RNA, 24 nt, Human
uccauggcugcagcaaggagaggc

SEQ ID NO: 68022 - RNA, 18 nt, Human
ucccaaagugcugggauu

SEQ ID NO: 68023 - RNA, 24 nt, Human
ucccaaagugcugggauuacaagc

SEQ ID NO: 68024 - RNA, 19 nt, Human
ucccaaggucaccuagccu

SEQ ID NO: 68025 - RNA, 22 nt, Human
ucccacuggccugcucaucuuc

SEQ ID NO: 68026 - RNA, 24 nt, Human
ucggugccucggcuguuaugugac

SEQ ID NO: 68027 - RNA, 22 nt, Human
ucuccaacaccuucacgaaaca

SEQ ID NO: 68028 - RNA, 19 nt, Human
ucuuacuauguugcccagg

SEQ ID NO: 68029 - RNA, 23 nt, Human
ucuuacuauguugcccaggcugg

SEQ ID NO: 68030 - RNA, 24 nt, Human
ucuuacuauguugcccaggcuggu

SEQ ID NO: 68031 - RNA, 26 nt, Human
ugaacacccagucaccaacuacagcc

SEQ ID NO: 68032 - RNA, 19 nt, Human
ugaagaaagaaggugggag

SEQ ID NO: 68033 - RNA, 21 nt, Human
ugaagaccagcccccagaagc

SEQ ID NO: 68034 - RNA, 21 nt, Human
ugauccgaggacagggaauga

SEQ ID NO: 68035 - RNA, 18 nt, Human
ugcccugccccuccuccc

SEQ ID NO: 68036 - RNA, 24 nt, Human
ugcccugccccuccucccacuggc

SEQ ID NO: 68037 - RNA, 23 nt, Human
ugccuguaggauauggguccccu

SEQ ID NO: 68038 - RNA, 27 nt, Human
ugcugggauuacaagcauaagccacug

SEQ ID NO: 68039 - RNA, 24 nt, Human
uggccucaaacgauccuccugccu

SEQ ID NO: 68040 - RNA, 21 nt, Human
uggccugcucaucuucccgca

SEQ ID NO: 68041 - RNA, 19 nt, Human
uggcugcagcaaggagagg

SEQ ID NO: 68042 - RNA, 25 nt, Human
ugggagcggagagcgcaggcguggu

SEQ ID NO: 68043 - RNA, 21 nt, Human
ugggauuacaagcauaagcca

SEQ ID NO: 68044 - RNA, 22 nt, Human
ugggauuacaagcauaagccac

SEQ ID NO: 68045 - RNA, 22 nt, Human
ugggauuacaagcauaagccac

SEQ ID NO: 68046 - RNA, 24 nt, Human
ugggauuacaagcauaagccacug

SEQ ID NO: 68047 - RNA, 24 nt, Human
ugggauuacaagcauaagccacug

SEQ ID NO: 68048 - RNA, 26 nt, Human
ugggauuacaagcauaagccacugca

SEQ ID NO: 68049 - RNA, 21 nt, Human
ugggcgaagacaggcaccaag

SEQ ID NO: 68050 - RNA, 20 nt, Human
uuagagcuaaaaugaacacc

SEQ ID NO: 68051 - RNA, 23 nt, Human
uucccgcacugcaaaccuggccg

SEQ ID NO: 68052 - RNA, 18 nt, Human
uuggccucccaaagugcu

SEQ ID NO: 68053 - RNA, 18 nt, Human
uuuugcucauaaccuccc

SEQ ID NO: 68054 - RNA, 28 nt, Human
uuuuuuuuuuuuaauagagacagggucu

SEQ ID NO: 68055 - RNA, 26 nt, Human
aaauucacuuuaugaaucaauaagug

SEQ ID NO: 68056 - RNA, 21 nt, Human
aacacuggaggaugcagggcu

SEQ ID NO: 68057 - RNA, 22 nt, Human
acaaguuccuucucccuggaac

SEQ ID NO: 68058 - RNA, 20 nt, Human
agaaagcagcauuuugcuca

SEQ ID NO: 68059 - RNA, 24 nt, Human
agaaagcagcauuuugcucaccug

SEQ ID NO: 68060 - RNA, 19 nt, Human
aggcagaaagcagcauuuu

SEQ ID NO: 68061 - RNA, 19 nt, Human
agugaaauggcaaaaagga

SEQ ID NO: 68062 - RNA, 20 nt, Human
auuuugcucaccugcucuuc

SEQ ID NO: 68063 - RNA, 28 nt, Human
ccaaggcagaaagcagcauuuugcucac

SEQ ID NO: 68064 - RNA, 22 nt, Human
gcagaaagcagcauuuugcuca

SEQ ID NO: 68065 - RNA, 21 nt, Human
gcucaguuuuccagcauagcu

SEQ ID NO: 68066 - RNA, 22 nt, Human
guucucugccugccaccaaggc

SEQ ID NO: 68067 - RNA, 19 nt, Human
uaaaagaagaugacuguuu

SEQ ID NO: 68068 - RNA, 21 nt, Human
uaaacacaaaaccaucacaga

SEQ ID NO: 68069 - RNA, 20 nt, Human
uaguaaagacaaacuacuuu

SEQ ID NO: 68070 - RNA, 24 nt, Human
uauuucuucuucuuuccuccuuga

SEQ ID NO: 68071 - RNA, 21 nt, Human
ucccacgcucaguuuuccagc

SEQ ID NO: 68072 - RNA, 19 nt, Human
ucccuggaacuccgugauu

SEQ ID NO: 68073 - RNA, 21 nt, Human
uccgugauuaauaucugggac

SEQ ID NO: 68074 - RNA, 21 nt, Human
ucucuugcaucugaauuccag

SEQ ID NO: 68075 - RNA, 23 nt, Human
ugccacugaagaaacauuguucu

SEQ ID NO: 68076 - RNA, 20 nt, Human
uggcaaaaaggagaggugga

SEQ ID NO: 68077 - RNA, 20 nt, Human
ugggacggcggcggcagggg

SEQ ID NO: 68078 - RNA, 18 nt, Human
uuccagcauagcugcagg

SEQ ID NO: 68079 - RNA, 19 nt, Human
uuuugcucaccugcucuuc

SEQ ID NO: 68080 - RNA, 23 nt, Human
aaaccuagaagugccaaggguua

SEQ ID NO: 68081 - RNA, 18 nt, Human
aaagaccccaccacuaca

SEQ ID NO: 68082 - RNA, 18 nt, Human
aacaaaggaaccucgaga

SEQ ID NO: 68083 - RNA, 20 nt, Human
aacaagcuuugaaauacuuu

SEQ ID NO: 68084 - RNA, 21 nt, Human
aaccccacccugggggaugau

SEQ ID NO: 68085 - RNA, 19 nt, Human
aagaaggagggaggggagg

SEQ ID NO: 68086 - RNA, 23 nt, Human
aagcaggagcagaaaaaugacca

SEQ ID NO: 68087 - RNA, 26 nt, Human
aagcaggagcagaaaaaugaccaaag

SEQ ID NO: 68088 - RNA, 18 nt, Human
acaacacacaauuccccc

SEQ ID NO: 68089 - RNA, 21 nt, Human
acaacacacaauuccccccac

SEQ ID NO: 68090 - RNA, 19 nt, Human
acacaauuccccccacccc

SEQ ID NO: 68091 - RNA, 24 nt, Human
acccugggggaugaucuaugaggc

SEQ ID NO: 68092 - RNA, 19 nt, Human
agaaggagggaggggagga

SEQ ID NO: 68093 - RNA, 20 nt, Human
agaaggagggaggggaggag

SEQ ID NO: 68094 - RNA, 26 nt, Human
agaaggagggaggggaggagacagaa

SEQ ID NO: 68095 - RNA, 22 nt, Human
agaguccccuacaugacagccu

SEQ ID NO: 68096 - RNA, 19 nt, Human
agccuccaggagggcugag

SEQ ID NO: 68097 - RNA, 18 nt, Human
agcuccuccuuucccccc

SEQ ID NO: 68098 - RNA, 23 nt, Human
aggaacaaaaagguaacagccac

SEQ ID NO: 68099 - RNA, 26 nt, Human
aggaacaaaaagguaacagccacggc

SEQ ID NO: 68100 - RNA, 25 nt, Human
agggacaaaaugagguacccaaaua

SEQ ID NO: 68101 - RNA, 31 nt, Human
auaaagcuuauggaaaaacuggaaaauacuu

SEQ ID NO: 68102 - RNA, 19 nt, Human
augaggcuccggggcuggg

SEQ ID NO: 68103 - RNA, 26 nt, Human
augguuaaacuaaagaaggagggagg

SEQ ID NO: 68104 - RNA, 24 nt, Human
auuaaggaagaggaaaaaggaaac

SEQ ID NO: 68105 - RNA, 20 nt, Human
auuucauauagcagagagga

SEQ ID NO: 68106 - RNA, 24 nt, Human
auuucauauagcagagaggagcgg

SEQ ID NO: 68107 - RNA, 19 nt, Human
caaaaugagguacccaaau

SEQ ID NO: 68108 - RNA, 24 nt, Human
caagcaaucuuuaauaauaaggcc

SEQ ID NO: 68109 - RNA, 20 nt, Human
caagcuuugaaauacuuugu

SEQ ID NO: 68110 - RNA, 20 nt, Human
cacacaauuccccccaccca

SEQ ID NO: 68111 - RNA, 23 nt, Human
caccacuacacuaaagucaaggg

SEQ ID NO: 68112 - RNA, 20 nt, Human
cagaagagacaggggcggua

SEQ ID NO: 68113 - RNA, 19 nt, Human
cagauucugggcccuuccc

SEQ ID NO: 68114 - RNA, 24 nt, Human
ccacuacacuaaagucaagggaca

SEQ ID NO: 68115 - RNA, 24 nt, Human
ccaucuggaaaggccuuuggcugu

SEQ ID NO: 68116 - RNA, 19 nt, Human
ccauguccaaggcagaugg

SEQ ID NO: 68117 - RNA, 21 nt, Human
cccauaucuguccauuacuca

SEQ ID NO: 68118 - RNA, 23 nt, Human
ccccaccacuacacuaaagucaa

SEQ ID NO: 68119 - RNA, 24 nt, Human
cccccacccauauugccaugucca

SEQ ID NO: 68120 - RNA, 18 nt, Human
cuccaggagggcugaguc

SEQ ID NO: 68121 - RNA, 21 nt, Human
cuggaaaauacugcuacuuca

SEQ ID NO: 68122 - RNA, 21 nt, Human
cuguccauuacucacaacaca

SEQ ID NO: 68123 - RNA, 21 nt, Human
cuuugaaauacuuuguuccug

SEQ ID NO: 68124 - RNA, 20 nt, Human
gaagagagacaggggcggua

SEQ ID NO: 68125 - RNA, 18 nt, Human
gagaaaccccaaaccuag

SEQ ID NO: 68126 - RNA, 27 nt, Human
gagaaaccccaaaccuagaagugccaa

SEQ ID NO: 68127 - RNA, 23 nt, Human
gcaggagcagaaaaaugaccaaa

SEQ ID NO: 68128 - RNA, 18 nt, Human
gcagguagagagaaggaa

SEQ ID NO: 68129 - RNA, 21 nt, Human
gcugugcaaauagaugaaaaa

SEQ ID NO: 68130 - RNA, 20 nt, Human
ggaaaggccuuuggcugugg

SEQ ID NO: 68131 - RNA, 22 nt, Human
gggcugggucagcggguaauau

SEQ ID NO: 68132 - RNA, 21 nt, Human
gguagagagaaggaauaaagc

SEQ ID NO: 68133 - RNA, 23 nt, Human
guagaacaaaggaaccucgagag

SEQ ID NO: 68134 - RNA, 30 nt, Human
guagaacaaaggaaccucgagaguccccuu

SEQ ID NO: 68135 - RNA, 21 nt, Human
gucagauucugggcccuuccc

SEQ ID NO: 68136 - RNA, 25 nt, Human
guuaaacuaaagaaggagggagggg

SEQ ID NO: 68137 - RNA, 19 nt, Human
uaaacuaaagaaggaggga

SEQ ID NO: 68138 - RNA, 21 nt, Human
uaaagcuuauggaaaaacugg

SEQ ID NO: 68139 - RNA, 19 nt, Human
uaacuugauggaacaagcu

SEQ ID NO: 68140 - RNA, 21 nt, Human
uaacuugauggaacaagcuuu

SEQ ID NO: 68141 - RNA, 18 nt, Human
uaagcagcuaugggagac

SEQ ID NO: 68142 - RNA, 19 nt, Human
uacacuaaagucaagggac

SEQ ID NO: 68143 - RNA, 24 nt, Human
uagugggaagagagggaacugaga

SEQ ID NO: 68144 - RNA, 21 nt, Human
uaugaggcuccggggcuggga

SEQ ID NO: 68145 - RNA, 22 nt, Human
uaugaggcuccggggcugggag

SEQ ID NO: 68146 - RNA, 26 nt, Human
uauggaaaaacuggaaaauacugcua

SEQ ID NO: 68147 - RNA, 22 nt, Human
ucacaacacacaauucccccca

SEQ ID NO: 68148 - RNA, 27 nt, Human
ucuccagcuccuccuuuccgggccgcc

SEQ ID NO: 68149 - RNA, 23 nt, Human
ucucucuuggcucuugggcgggc

SEQ ID NO: 68150 - RNA, 23 nt, Human
ucugcccugaugguuaaacuaaa

SEQ ID NO: 68151 - RNA, 21 nt, Human
ucuggcaggaaguggcaugcu

SEQ ID NO: 68152 - RNA, 19 nt, Human
ucuuucuuuuugguggcag

SEQ ID NO: 68153 - RNA, 20 nt, Human
ucuuucuuuuugguggcagg

SEQ ID NO: 68154 - RNA, 22 nt, Human
ugaaaaagaauuagaacucuug

SEQ ID NO: 68155 - RNA, 23 nt, Human
ugaccacauggcuaaaaagcccc

SEQ ID NO: 68156 - RNA, 21 nt, Human
ugaggguuucuuucuuuuugg

SEQ ID NO: 68157 - RNA, 23 nt, Human
ugagguugccaaggcuuaguggg

SEQ ID NO: 68158 - RNA, 21 nt, Human
ugaguccaugggguggcuggg

SEQ ID NO: 68159 - RNA, 21 nt, Human
ugauaggggaaugaagagaga

SEQ ID NO: 68160 - RNA, 24 nt, Human
ugaugguuaaacuaaagaaggagg

SEQ ID NO: 68161 - RNA, 24 nt, Human
uggaaaaacuggaaaauacugcua

SEQ ID NO: 68162 - RNA, 23 nt, Human
uggcuggggcugggucagcgggu

SEQ ID NO: 68163 - RNA, 20 nt, Human
ugggaggggauaagaugaca

SEQ ID NO: 68164 - RNA, 25 nt, Human
ugggcccuucccuuuucacuaccaa

SEQ ID NO: 68165 - RNA, 20 nt, Human
ugggguggcuggggcugggu

SEQ ID NO: 68166 - RNA, 18 nt, Human
ugggguggugggaaagac

SEQ ID NO: 68167 - RNA, 24 nt, Human
ugguaaggaacaaaaagguaacag

SEQ ID NO: 68168 - RNA, 23 nt, Human
uuaaucccuaacuugauggaaca

SEQ ID NO: 68169 - RNA, 24 nt, Human
uuccugucugcccugaugguuaaa

SEQ ID NO: 68170 - RNA, 18 nt, Human
aaaaaaacaggaagaaca

SEQ ID NO: 68171 - RNA, 23 nt, Human
aaaaaaacaggaagaacaggaua

SEQ ID NO: 68172 - RNA, 25 nt, Human
aaaacaaaacaaagcaaaaaaacag

SEQ ID NO: 68173 - RNA, 23 nt, Human
aaaacaaagcaaaaaaacaggaa

SEQ ID NO: 68174 - RNA, 18 nt, Human
aaaaccaacauucaaaaa

SEQ ID NO: 68175 - RNA, 23 nt, Human
aaaaccaacauucaaaaaaaccc

SEQ ID NO: 68176 - RNA, 23 nt, Human
aaaagaacaggauagguugggca

SEQ ID NO: 68177 - RNA, 22 nt, Human
aaacaaaacaaaacaaagcaaa

SEQ ID NO: 68178 - RNA, 18 nt, Human
aaacaaaacaaagcaaaa

SEQ ID NO: 68179 - RNA, 19 nt, Human
aaacaaaacaaagcaaaaa

SEQ ID NO: 68180 - RNA, 24 nt, Human
aaagugcugggauuacaggcguga

SEQ ID NO: 68181 - RNA, 24 nt, Human
aaagugcugggauuauagguguga

SEQ ID NO: 68182 - RNA, 19 nt, Human
aacaaaacaaaacaaagca

SEQ ID NO: 68183 - RNA, 27 nt, Human
aacaaagcaaaaaaacaggaagaacag

SEQ ID NO: 68184 - RNA, 18 nt, Human
aaccuguaaccucugccu

SEQ ID NO: 68185 - RNA, 21 nt, Human
aaccuguaaccucugccuccu

SEQ ID NO: 68186 - RNA, 20 nt, Human
aagaggaaaaaguaugaaaa

SEQ ID NO: 68187 - RNA, 22 nt, Human
aagcaaaaaaacaggaagaaca

SEQ ID NO: 68188 - RNA, 21 nt, Human
aagcagagauguuccuuaaga

SEQ ID NO: 68189 - RNA, 19 nt, Human
aagugcugggauuacaggc

SEQ ID NO: 68190 - RNA, 19 nt, Human
aagugcugggauuacaggc

SEQ ID NO: 68191 - RNA, 26 nt, Human
aagugcugggauuacaggcgugagcc

SEQ ID NO: 68192 - RNA, 18 nt, Human
aagugcugggauuauagg

SEQ ID NO: 68193 - RNA, 26 nt, Human
aagugcugggauuauaggugugagcu

SEQ ID NO: 68194 - RNA, 18 nt, Human
aauaagugaucaaucugc

SEQ ID NO: 68195 - RNA, 20 nt, Human
aauauggugaaaccccaccu

SEQ ID NO: 68196 - RNA, 22 nt, Human
acaaaacaaaacaaagcaaaaa

SEQ ID NO: 68197 - RNA, 23 nt, Human
acagagugagucuucgucucaaa

SEQ ID NO: 68198 - RNA, 24 nt, Human
acagagugagucuucgucucaaaa

SEQ ID NO: 68199 - RNA, 20 nt, Human
acaggguuucaccauacugg

SEQ ID NO: 68200 - RNA, 24 nt, Human
acaggguuucaccauacuggccag

SEQ ID NO: 68201 - RNA, 29 nt, Human
acaucauguugcccaggcuggucucuaac

SEQ ID NO: 68202 - RNA, 24 nt, Human
acccaggagguugaggaugcagug

SEQ ID NO: 68203 - RNA, 24 nt, Human
acccaggcuggagugcaauggcau

SEQ ID NO: 68204 - RNA, 19 nt, Human
acccugggcaauaugguga

SEQ ID NO: 68205 - RNA, 22 nt, Human
acccugggcaauauggugaaac

SEQ ID NO: 68206 - RNA, 24 nt, Human
accuugugauccgcucaccucggc

SEQ ID NO: 68207 - RNA, 21 nt, Human
acuacaggugcaugccacaau

SEQ ID NO: 68208 - RNA, 24 nt, Human
acugcacccagccugggcggacag

SEQ ID NO: 68209 - RNA, 24 nt, Human
agaaaauagaugacucaaagucca

SEQ ID NO: 68210 - RNA, 21 nt, Human
agauucuccugccucagccuc

SEQ ID NO: 68211 - RNA, 24 nt, Human
agccaaacaaggcccccuuaaucc

SEQ ID NO: 68212 - RNA, 21 nt, Human
aggcauggugguaugcuccug

SEQ ID NO: 68213 - RNA, 24 nt, Human
aggcugaggcugacaguucgcuug

SEQ ID NO: 68214 - RNA, 19 nt, Human
aggugugagcuaccacacc

SEQ ID NO: 68215 - RNA, 19 nt, Human
aggugugagcuaccacacc

SEQ ID NO: 68216 - RNA, 22 nt, Human
agguugggcauaguagcucaug

SEQ ID NO: 68217 - RNA, 22 nt, Human
aguagagacaggguuucaccau

SEQ ID NO: 68218 - RNA, 24 nt, Human
aguagcucaugccuguaaucccag

SEQ ID NO: 68219 - RNA, 18 nt, Human
aguagcugggacuacagg

SEQ ID NO: 68220 - RNA, 18 nt, Human
aguagcugggauuacagg

SEQ ID NO: 68221 - RNA, 18 nt, Human
aguagcugggauuacagg

SEQ ID NO: 68222 - RNA, 20 nt, Human
agucaggcauggugguaugc

SEQ ID NO: 68223 - RNA, 18 nt, Human
agugcugggauuacaggc

SEQ ID NO: 68224 - RNA, 21 nt, Human
aguguaguggcacaaucuuug

SEQ ID NO: 68225 - RNA, 24 nt, Human
aguuugagaccacccugggcaaua

SEQ ID NO: 68226 - RNA, 22 nt, Human
augcagugagccgugacugcac

SEQ ID NO: 68227 - RNA, 19 nt, Human
augccuguaaucccagcac

SEQ ID NO: 68228 - RNA, 20 nt, Human
auggugaaaccccaccucua

SEQ ID NO: 68229 - RNA, 24 nt, Human
auuuuuguauuuuuaguagagaca

SEQ ID NO: 68230 - RNA, 24 nt, Human
caaagugcugggauuacaggcgug

SEQ ID NO: 68231 - RNA, 24 nt, Human
caaagugcugggauuauaggugug

SEQ ID NO: 68232 - RNA, 22 nt, Human
caagagauucuccugccucagc

SEQ ID NO: 68233 - RNA, 20 nt, Human
caauauggugaaaccccacc

SEQ ID NO: 68234 - RNA, 22 nt, Human
caauauggugaaaccccaccuc

SEQ ID NO: 68235 - RNA, 22 nt, Human
cacagcaaccuucaccucccag

SEQ ID NO: 68236 - RNA, 19 nt, Human
caccauacuggccaggcug

SEQ ID NO: 68237 - RNA, 21 nt, Human
caccauacuggccaggcuggu

SEQ ID NO: 68238 - RNA, 24 nt, Human
caccauacuggccaggcuggucuc

SEQ ID NO: 68239 - RNA, 24 nt, Human
caccaugcucggcuaauuuuugua

SEQ ID NO: 68240 - RNA, 23 nt, Human
cacccagccugggcggacagagu

SEQ ID NO: 68241 - RNA, 20 nt, Human
caccucagccuccggaguag

SEQ ID NO: 68242 - RNA, 24 nt, Human
caccucggccucccaaagugcugg

SEQ ID NO: 68243 - RNA, 24 nt, Human
caccucuacaaaaaacacaaaaag

SEQ ID NO: 68244 - RNA, 22 nt, Human
cagaacacacaucacuguccuc

SEQ ID NO: 68245 - RNA, 20 nt, Human
cagcaaccuucaccucccag

SEQ ID NO: 68246 - RNA, 24 nt, Human
cagcaaccuucaccucccagguuc

SEQ ID NO: 68247 - RNA, 26 nt, Human
cagccaaacaaggcccccuuaauuca

SEQ ID NO: 68248 - RNA, 24 nt, Human
caggguuucaccauacuggccagg

SEQ ID NO: 68249 - RNA, 19 nt, Human
caggugcccgccaccaugc

SEQ ID NO: 68250 - RNA, 21 nt, Human
caggugcccgccaccaugcuc

SEQ ID NO: 68251 - RNA, 25 nt, Human
cagguuaaaaauaaaggcuaaaaua

SEQ ID NO: 68252 - RNA, 19 nt, Human
cagguucaagagauucucc

SEQ ID NO: 68253 - RNA, 19 nt, Human
cauacuggccaggcugguc

SEQ ID NO: 68254 - RNA, 24 nt, Human
caucauguugcccaggcuggucuc

SEQ ID NO: 68255 - RNA, 20 nt, Human
caucuuaaaaagcaaaauuc

SEQ ID NO: 68256 - RNA, 18 nt, Human
caugccacaaucccuggc

SEQ ID NO: 68257 - RNA, 20 nt, Human
caugccuguaaucccagcac

SEQ ID NO: 68258 - RNA, 24 nt, Human
caugccuguaaucccagcacacug

SEQ ID NO: 68259 - RNA, 19 nt, Human
cauguugcccaggcugguc

SEQ ID NO: 68260 - RNA, 24 nt, Human
cauguugcccaggcuggucucuaa

SEQ ID NO: 68261 - RNA, 20 nt, Human
ccaaagugcugggauuacag

SEQ ID NO: 68262 - RNA, 22 nt, Human
ccaaagugcugggauuacaggc

SEQ ID NO: 68263 - RNA, 22 nt, Human
ccaaagugcugggauuacaggc

SEQ ID NO: 68264 - RNA, 24 nt, Human
ccaaagugcugggauuacaggcgu

SEQ ID NO: 68265 - RNA, 21 nt, Human
ccaaagugcugggauuauagg

SEQ ID NO: 68266 - RNA, 24 nt, Human
ccaaagugcugggauuauaggugu

SEQ ID NO: 68267 - RNA, 21 nt, Human
ccaaauuucccacugauguau

SEQ ID NO: 68268 - RNA, 21 nt, Human
ccacagcaaccuucaccuccc

SEQ ID NO: 68269 - RNA, 24 nt, Human
ccacagcaaccuucaccucccagg

SEQ ID NO: 68270 - RNA, 19 nt, Human
ccacugauguauaacugcu

SEQ ID NO: 68271 - RNA, 25 nt, Human
ccaggaguuugagaccacccugggc

SEQ ID NO: 68272 - RNA, 22 nt, Human
cccacagcaaccuucaccuccc

SEQ ID NO: 68273 - RNA, 24 nt, Human
cccacagcaaccuucaccucccag

SEQ ID NO: 68274 - RNA, 23 nt, Human
cccaggcuggagugcaauggcau

SEQ ID NO: 68275 - RNA, 22 nt, Human
cccaggcuggaguguaguggca

SEQ ID NO: 68276 - RNA, 21 nt, Human
cccagguucaagagauucucc

SEQ ID NO: 68277 - RNA, 20 nt, Human
ccccagcuacccggcagggu

SEQ ID NO: 68278 - RNA, 19 nt, Human
ccgcugcgcccagcccgaa

SEQ ID NO: 68279 - RNA, 23 nt, Human
ccgcugcgcccagcccgaaugac

SEQ ID NO: 68280 - RNA, 18 nt, Human
ccucccaccucagccucc

SEQ ID NO: 68281 - RNA, 24 nt, Human
ccucccagguucaagagauucucc

SEQ ID NO: 68282 - RNA, 22 nt, Human
ccugggcaauauggugaaaccc

SEQ ID NO: 68283 - RNA, 24 nt, Human
ccugggcaauauggugaaacccca

SEQ ID NO: 68284 - RNA, 24 nt, Human
ccugggcucaagcaaucuaccuac

SEQ ID NO: 68285 - RNA, 19 nt, Human
ccuguaaucccagcacacu

SEQ ID NO: 68286 - RNA, 22 nt, Human
ccuguaaucccagcacacuggg

SEQ ID NO: 68287 - RNA, 24 nt, Human
ccuguagccccagcuacccggcag

SEQ ID NO: 68288 - RNA, 20 nt, Human
cgcagaucccgacuccucuc

SEQ ID NO: 68289 - RNA, 19 nt, Human
cgcccagcccgaaugacca

SEQ ID NO: 68290 - RNA, 24 nt, Human
cgcucugucucccaggcuggagug

SEQ ID NO: 68291 - RNA, 24 nt, Human
cgcucuugucacccaggcuggagu

SEQ ID NO: 68292 - RNA, 22 nt, Human
cuaagaggaaaaaguaugaaaa

SEQ ID NO: 68293 - RNA, 25 nt, Human
cucaaaacaaaacaaaacaaagcaa

SEQ ID NO: 68294 - RNA, 24 nt, Human
cucaagcaaucuaccuaccucaac

SEQ ID NO: 68295 - RNA, 24 nt, Human
cucagccucucgaguagcugggac

SEQ ID NO: 68296 - RNA, 24 nt, Human
cucagccucucgaguagcugggau

SEQ ID NO: 68297 - RNA, 23 nt, Human
cucaugccuguaaucccagcaca

SEQ ID NO: 68298 - RNA, 22 nt, Human
cuccugaccuugugauccgcuc

SEQ ID NO: 68299 - RNA, 22 nt, Human
cuccugccucagccucucgagu

SEQ ID NO: 68300 - RNA, 20 nt, Human
cuccugggcucaagcaaucu

SEQ ID NO: 68301 - RNA, 23 nt, Human
cucgaguagcugggacuacaggu

SEQ ID NO: 68302 - RNA, 24 nt, Human
cucgaguagcugggacuacaggug

SEQ ID NO: 68303 - RNA, 24 nt, Human
cucgaguagcugggauuacaggug

SEQ ID NO: 68304 - RNA, 24 nt, Human
cucgcucugucucccaggcuggag

SEQ ID NO: 68305 - RNA, 21 nt, Human
cucuacaaaaaacacaaaaaa

SEQ ID NO: 68306 - RNA, 21 nt, Human
cugaauuuuacucuugacuuu

SEQ ID NO: 68307 - RNA, 18 nt, Human
cugacaguucgcuugagc

SEQ ID NO: 68308 - RNA, 23 nt, Human
cugccucagccucucgaguagcu

SEQ ID NO: 68309 - RNA, 24 nt, Human
cuggagugcaauggcaugauuuug

SEQ ID NO: 68310 - RNA, 18 nt, Human
cugggaggcugaggcuga

SEQ ID NO: 68311 - RNA, 20 nt, Human
cugggaggcugaggcugaca

SEQ ID NO: 68312 - RNA, 20 nt, Human
cugggauuauaggugugagc

SEQ ID NO: 68313 - RNA, 23 nt, Human
cugguaauuuuucugccaaccaa

SEQ ID NO: 68314 - RNA, 18 nt, Human
cuguaaccucugccuccu

SEQ ID NO: 68315 - RNA, 18 nt, Human
cuuggccaggcuggucuc

SEQ ID NO: 68316 - RNA, 24 nt, Human
cuugucacccaggcuggagugcaa

SEQ ID NO: 68317 - RNA, 19 nt, Human
gaauucugucucaauuaca

SEQ ID NO: 68318 - RNA, 22 nt, Human
gaccuugugauccgcucaccuc

SEQ ID NO: 68319 - RNA, 22 nt, Human
gaccuugugauccgcucaccuc

SEQ ID NO: 68320 - RNA, 24 nt, Human
gaccuugugauccgcucaccucgg

SEQ ID NO: 68321 - RNA, 22 nt, Human
gacuacaggugcccgccaccau

SEQ ID NO: 68322 - RNA, 24 nt, Human
gagauucuccugccucagccucuc

SEQ ID NO: 68323 - RNA, 18 nt, Human
gauuacaggcgugagccg

SEQ ID NO: 68324 - RNA, 22 nt, Human
gauuacaggcgugagccgcugc

SEQ ID NO: 68325 - RNA, 22 nt, Human
gauuacaggcgugagccgcugc

SEQ ID NO: 68326 - RNA, 18 nt, Human
gauuacaggugcccgcca

SEQ ID NO: 68327 - RNA, 24 nt, Human
gauuacaggugcccgccaccaugc

SEQ ID NO: 68328 - RNA, 20 nt, Human
gauucuccugccucagccuc

SEQ ID NO: 68329 - RNA, 21 nt, Human
gauuuuggcccacagcaaccu

SEQ ID NO: 68330 - RNA, 22 nt, Human
gcaaccuucaccucccagguuc

SEQ ID NO: 68331 - RNA, 21 nt, Human
gcacacugggaggcugaggcu

SEQ ID NO: 68332 - RNA, 23 nt, Human
gcacucggaaggucaaaguagua

SEQ ID NO: 68333 - RNA, 21 nt, Human
gcgcaagccauccucccaccu

SEQ ID NO: 68334 - RNA, 24 nt, Human
gcucuugucacccaggcuggagug

SEQ ID NO: 68335 - RNA, 19 nt, Human
gcugacaguucgcuugagc

SEQ ID NO: 68336 - RNA, 19 nt, Human
gcuggagugcaauggcaug

SEQ ID NO: 68337 - RNA, 18 nt, Human
ggaagaacaggauagaaa

SEQ ID NO: 68338 - RNA, 23 nt, Human
ggaguuucgcucuugucacccag

SEQ ID NO: 68339 - RNA, 23 nt, Human
ggcauaguagcucaugccuguaa

SEQ ID NO: 68340 - RNA, 25 nt, Human
ggcauggugguaugcuccuguagcc

SEQ ID NO: 68341 - RNA, 21 nt, Human
ggccaggcuggucucuuggcc

SEQ ID NO: 68342 - RNA, 18 nt, Human
ggcugcagcgcagauccc

SEQ ID NO: 68343 - RNA, 23 nt, Human
ggcuggucucgaacuccugaccu

SEQ ID NO: 68344 - RNA, 24 nt, Human
gggcucaagcaaucuaccuaccuc

SEQ ID NO: 68345 - RNA, 20 nt, Human
ggucucgaacuccugaccuu

SEQ ID NO: 68346 - RNA, 18 nt, Human
guagcugggauuacaggu

SEQ ID NO: 68347 - RNA, 21 nt, Human
gucucaaaacaaaacaaaaca

SEQ ID NO: 68348 - RNA, 24 nt, Human
uaaaagaacaggauagguugggca

SEQ ID NO: 68349 - RNA, 21 nt, Human
uaaaauauaauuucuaaaggc

SEQ ID NO: 68350 - RNA, 24 nt, Human
uaaguaaauauaauagacaucuua

SEQ ID NO: 68351 - RNA, 24 nt, Human
uaauuuuuguauuuuuaguagaga

SEQ ID NO: 68352 - RNA, 22 nt, Human
uacaaaaaacacaaaaaauuag

SEQ ID NO: 68353 - RNA, 19 nt, Human
uacaggcgugagccgcugc

SEQ ID NO: 68354 - RNA, 23 nt, Human
uaccuaccucaaccucccaaagu

SEQ ID NO: 68355 - RNA, 24 nt, Human
uaccucaaccucccaaagugcugg

SEQ ID NO: 68356 - RNA, 23 nt, Human
uaccuuuuucuucuaugcagcca

SEQ ID NO: 68357 - RNA, 23 nt, Human
uacucuugacuuuauuugggaau

SEQ ID NO: 68358 - RNA, 20 nt, Human
uagagacaggguuucaccau

SEQ ID NO: 68359 - RNA, 24 nt, Human
uagaugacucaaaguccaagauuu

SEQ ID NO: 68360 - RNA, 24 nt, Human
uagcucaugccuguaaucccagca

SEQ ID NO: 68361 - RNA, 23 nt, Human
uaguagaaacgaggucugcuaug

SEQ ID NO: 68362 - RNA, 19 nt, Human
uaguagagacaggguuuca

SEQ ID NO: 68363 - RNA, 25 nt, Human
uaguagagacaggguuucaccauac

SEQ ID NO: 68364 - RNA, 26 nt, Human
uaguagagacaggguuucaccauacu

SEQ ID NO: 68365 - RNA, 24 nt, Human
uaguagcucaugccuguaauccca

SEQ ID NO: 68366 - RNA, 24 nt, Human
uauaggugugagcuaccacaccuu

SEQ ID NO: 68367 - RNA, 24 nt, Human
uaucugaauuuuacucuugacuuu

SEQ ID NO: 68368 - RNA, 20 nt, Human
uauguuucccaggcaaguag

SEQ ID NO: 68369 - RNA, 20 nt, Human
ucaaccgcggcgguggcugc

SEQ ID NO: 68370 - RNA, 18 nt, Human
ucacccaggcuggagugc

SEQ ID NO: 68371 - RNA, 20 nt, Human
ucagccucucgaguagcugg

SEQ ID NO: 68372 - RNA, 23 nt, Human
ucagccucucgaguagcugggac

SEQ ID NO: 68373 - RNA, 22 nt, Human
ucaugccuguaaucccagcaca

SEQ ID NO: 68374 - RNA, 24 nt, Human
ucccaaagugcugggauuacaggc

SEQ ID NO: 68375 - RNA, 23 nt, Human
ucccaaagugcugggauuauagg

SEQ ID NO: 68376 - RNA, 23 nt, Human
ucccaggcuggaguguaguggca

SEQ ID NO: 68377 - RNA, 21 nt, Human
ucccagguucaagagauucuc

SEQ ID NO: 68378 - RNA, 24 nt, Human
ucccagguucaagagauucuccug

SEQ ID NO: 68379 - RNA, 18 nt, Human
uccugggcucaagcaauc

SEQ ID NO: 68380 - RNA, 19 nt, Human
uccugggcucaagcaaucu

SEQ ID NO: 68381 - RNA, 22 nt, Human
ucgcucuugucacccaggcugg

SEQ ID NO: 68382 - RNA, 23 nt, Human
ucgcucuugucacccaggcugga

SEQ ID NO: 68383 - RNA, 18 nt, Human
ucggccucccaaagugcu

SEQ ID NO: 68384 - RNA, 21 nt, Human
ucuaccuaccucaaccuccca

SEQ ID NO: 68385 - RNA, 24 nt, Human
ucucccaggcuggaguguaguggc

SEQ ID NO: 68386 - RNA, 24 nt, Human
ucuccugccucagccucucgagua

SEQ ID NO: 68387 - RNA, 19 nt, Human
ucucgaacuccugaccuug

SEQ ID NO: 68388 - RNA, 23 nt, Human
ucucgaguagcugggacuacagg

SEQ ID NO: 68389 - RNA, 24 nt, Human
ucucgaguagcugggacuacaggu

SEQ ID NO: 68390 - RNA, 23 nt, Human
ucucgaguagcugggauuacagg

SEQ ID NO: 68391 - RNA, 21 nt, Human
ucucgcucugucucccaggcu

SEQ ID NO: 68392 - RNA, 23 nt, Human
ucucgcucugucucccaggcugg

SEQ ID NO: 68393 - RNA, 24 nt, Human
ucucgcucugucucccaggcugga

SEQ ID NO: 68394 - RNA, 23 nt, Human
ucucuaacuccugggcucaagca

SEQ ID NO: 68395 - RNA, 22 nt, Human
ucugccaaccaaauuucccacu

SEQ ID NO: 68396 - RNA, 19 nt, Human
ucugucucccaggcuggag

SEQ ID NO: 68397 - RNA, 22 nt, Human
ucugucucccaggcuggagugu

SEQ ID NO: 68398 - RNA, 24 nt, Human
ucugucucccaggcuggaguguag

SEQ ID NO: 68399 - RNA, 18 nt, Human
ucuugucacccaggcugg

SEQ ID NO: 68400 - RNA, 24 nt, Human
ugacaauaaacaaguaaauugaua

SEQ ID NO: 68401 - RNA, 18 nt, Human
ugacuguaaaagaaaaua

SEQ ID NO: 68402 - RNA, 23 nt, Human
ugagacaagagucucgcucuguc

SEQ ID NO: 68403 - RNA, 21 nt, Human
ugagacuacaggugcaugcca

SEQ ID NO: 68404 - RNA, 22 nt, Human
ugagcccaggaguuugagacca

SEQ ID NO: 68405 - RNA, 24 nt, Human
ugauccgcucaccucggccuccca

SEQ ID NO: 68406 - RNA, 23 nt, Human
ugcaagggcacaaaauuaaaaua

SEQ ID NO: 68407 - RNA, 22 nt, Human
ugcagugagccgugacugcacc

SEQ ID NO: 68408 - RNA, 21 nt, Human
ugcaugccacaaucccuggcu

SEQ ID NO: 68409 - RNA, 24 nt, Human
ugcccaggcuggucucuaacuccu

SEQ ID NO: 68410 - RNA, 28 nt, Human
ugcccaggcuggucucuaacuccugggc

SEQ ID NO: 68411 - RNA, 24 nt, Human
ugccucagccucucgaguagcugg

SEQ ID NO: 68412 - RNA, 24 nt, Human
ugccuguaaucccagcacacuggg

SEQ ID NO: 68413 - RNA, 18 nt, Human
ugcugggauuacaggcgu

SEQ ID NO: 68414 - RNA, 20 nt, Human
ugcugggauuacaggcguga

SEQ ID NO: 68415 - RNA, 19 nt, Human
uggagugcaauggcaugau

SEQ ID NO: 68416 - RNA, 24 nt, Human
uggagugcaauggcaugauuuugg

SEQ ID NO: 68417 - RNA, 18 nt, Human
uggaguguaguggcacaa

SEQ ID NO: 68418 - RNA, 22 nt, Human
uggaguguaguggcacaaucuu

SEQ ID NO: 68419 - RNA, 23 nt, Human
uggaguguaguggcacaaucuuu

SEQ ID NO: 68420 - RNA, 20 nt, Human
uggcacaaucuuugcucacu

SEQ ID NO: 68421 - RNA, 24 nt, Human
uggccaggcuggucucgaacuccu

SEQ ID NO: 68422 - RNA, 18 nt, Human
uggccaggcuggucucuu

SEQ ID NO: 68423 - RNA, 20 nt, Human
uggcuuauuuuuuuaaaaau

SEQ ID NO: 68424 - RNA, 21 nt, Human
ugggacuacaggugcccgcca

SEQ ID NO: 68425 - RNA, 22 nt, Human
ugggacuacaggugcccgccac

SEQ ID NO: 68426 - RNA, 24 nt, Human
ugggacuacaggugcccgccacca

SEQ ID NO: 68427 - RNA, 25 nt, Human
ugggacuacaggugcccgccaccau

SEQ ID NO: 68428 - RNA, 18 nt, Human
ugggaggcugaggcugac

SEQ ID NO: 68429 - RNA, 18 nt, Human
ugggauuacaggcgugag

SEQ ID NO: 68430 - RNA, 19 nt, Human
ugggauuacaggcgugagc

SEQ ID NO: 68431 - RNA, 20 nt, Human
ugggauuacaggcgugagcc

SEQ ID NO: 68432 - RNA, 20 nt, Human
ugggauuacaggcgugagcc

SEQ ID NO: 68433 - RNA, 20 nt, Human
ugggauuacaggcgugagcc

SEQ ID NO: 68434 - RNA, 21 nt, Human
ugggauuacaggcgugagccg

SEQ ID NO: 68435 - RNA, 21 nt, Human
ugggauuacaggcgugagccg

SEQ ID NO: 68436 - RNA, 24 nt, Human
ugggauuacaggcgugagccgcug

SEQ ID NO: 68437 - RNA, 24 nt, Human
ugggauuacaggcgugagccgcug

SEQ ID NO: 68438 - RNA, 21 nt, Human
ugggauuacaggugcccgcca

SEQ ID NO: 68439 - RNA, 22 nt, Human
ugggauuacaggugcccgccac

SEQ ID NO: 68440 - RNA, 24 nt, Human
ugggauuacaggugcccgccacca

SEQ ID NO: 68441 - RNA, 25 nt, Human
ugggauuacaggugcccgccaccau

SEQ ID NO: 68442 - RNA, 18 nt, Human
ugggauuauaggugugag

SEQ ID NO: 68443 - RNA, 19 nt, Human
ugggauuauaggugugagc

SEQ ID NO: 68444 - RNA, 22 nt, Human
ugggauuauaggugugagcuac

SEQ ID NO: 68445 - RNA, 23 nt, Human
ugggauuauaggugugagcuacc

SEQ ID NO: 68446 - RNA, 24 nt, Human
ugggauuauaggugugagcuacca

SEQ ID NO: 68447 - RNA, 22 nt, Human
ugggcaauauggugaaacccca

SEQ ID NO: 68448 - RNA, 22 nt, Human
ugggcauaguagcucaugccug

SEQ ID NO: 68449 - RNA, 24 nt, Human
uggucucuuggccaggcuggucuc

SEQ ID NO: 68450 - RNA, 26 nt, Human
uguagagauggguuuucacaucaugu

SEQ ID NO: 68451 - RNA, 20 nt, Human
ugucacccaggcuggagugc

SEQ ID NO: 68452 - RNA, 22 nt, Human
ugucacccaggcuggagugcaa

SEQ ID NO: 68453 - RNA, 24 nt, Human
uuaguagagacaggguuucaccau

SEQ ID NO: 68454 - RNA, 18 nt, Human
uucaagagauucuccugc

SEQ ID NO: 68455 - RNA, 23 nt, Human
uucaagagauucuccugccucag

SEQ ID NO: 68456 - RNA, 24 nt, Human
uucaccauacuggccaggcugguc

SEQ ID NO: 68457 - RNA, 24 nt, Human
uucgcucuugucacccaggcugga

SEQ ID NO: 68458 - RNA, 23 nt, Human
uucgcuugagcccaggaguuuga

SEQ ID NO: 68459 - RNA, 24 nt, Human
uucgcuugagcccaggaguuugag

SEQ ID NO: 68460 - RNA, 22 nt, Human
uucuucuaugcagccaaccugu

SEQ ID NO: 68461 - RNA, 25 nt, Human
uucuucuaugcagccaaccuguaga

SEQ ID NO: 68462 - RNA, 22 nt, Human
uugagcccaggaguuugagacc

SEQ ID NO: 68463 - RNA, 24 nt, Human
uuggccaggcuggucucgaacucc

SEQ ID NO: 68464 - RNA, 24 nt, Human
uuucacaucauguugcccaggcug

SEQ ID NO: 68465 - RNA, 24 nt, Human
uuucccacugauguauaacugcuc

SEQ ID NO: 68466 - RNA, 24 nt, Human
uuucgcucuugucacccaggcugg

SEQ ID NO: 68467 - RNA, 24 nt, Human
uuuuuaguagagacaggguuucac

SEQ ID NO: 68468 - RNA, 23 nt, Human
uuuuuguagagauggguuuucac

SEQ ID NO: 68469 - RNA, 20 nt, Human
uuuuuguauuuuuaguagag

SEQ ID NO: 68470 - RNA, 24 nt, Human
uuuuuuuuuuuugagacaagaguc

SEQ ID NO: 68471 - RNA, 26 nt, Human
uuuuuuuuuuuugagacaagagucuc

SEQ ID NO: 68472 - RNA, 27 nt, Human
uuuuuuuuuuuuuuuuuuuuuuugggg

SEQ ID NO: 68473 - RNA, 18 nt, Human
aggcagcggcgguguggc

SEQ ID NO: 68474 - RNA, 20 nt, Human
aggcagcggcgguguggccg

SEQ ID NO: 68475 - RNA, 21 nt, Human
auaggacaacugagggucucc

SEQ ID NO: 68476 - RNA, 22 nt, Human
cacccggauccuggccaugaag

SEQ ID NO: 68477 - RNA, 19 nt, Human
cacccggcaugacugccaa

SEQ ID NO: 68478 - RNA, 23 nt, Human
cagcagcgccucuccacccggau

SEQ ID NO: 68479 - RNA, 21 nt, Human
cauccugcccccuuuggucca

SEQ ID NO: 68480 - RNA, 21 nt, Human
ccauccugugggcugugggga

SEQ ID NO: 68481 - RNA, 18 nt, Human
ccuggccaugaaggccuc

SEQ ID NO: 68482 - RNA, 22 nt, Human
ccugugggcuguggggaccagg

SEQ ID NO: 68483 - RNA, 19 nt, Human
cgcacacgcgggucaccgu

SEQ ID NO: 68484 - RNA, 19 nt, Human
cggcggugucagcagcgcc

SEQ ID NO: 68485 - RNA, 19 nt, Human
cucgcacacgcgggucacc

SEQ ID NO: 68486 - RNA, 18 nt, Human
gcggcgguguggcggcgg

SEQ ID NO: 68487 - RNA, 21 nt, Human
ggcuguggggaccaggccccu

SEQ ID NO: 68488 - RNA, 18 nt, Human
gguccauccugugggcug

SEQ ID NO: 68489 - RNA, 20 nt, Human
guggcggcggugucagcagc

SEQ ID NO: 68490 - RNA, 21 nt, Human
guguggcggcggugucagcaa

SEQ ID NO: 68491 - RNA, 26 nt, Human
guguggcggcgguguggcggcgguga

SEQ ID NO: 68492 - RNA, 24 nt, Human
uccugugggcuguggggaccaggc

SEQ ID NO: 68493 - RNA, 23 nt, Human
ucuccgcaggaacacgaucaccc

SEQ ID NO: 68494 - RNA, 19 nt, Human
uggcggcgguguggcggcg

SEQ ID NO: 68495 - RNA, 19 nt, Human
ugucuggaagccagcggga

SEQ ID NO: 68496 - RNA, 20 nt, Human
aaaauacgacaccagggaug

SEQ ID NO: 68497 - RNA, 24 nt, Human
aaacaaaucguacugcuuguucuu

SEQ ID NO: 68498 - RNA, 20 nt, Human
aaagaggcccuaggucccuc

SEQ ID NO: 68499 - RNA, 23 nt, Human
aaaugccugcccggaacagaaug

SEQ ID NO: 68500 - RNA, 20 nt, Human
aacuaagaacuguuugacaa

SEQ ID NO: 68501 - RNA, 18 nt, Human
aacuggaaucaaaaucca

SEQ ID NO: 68502 - RNA, 22 nt, Human
aagcauccccgugaacagaggc

SEQ ID NO: 68503 - RNA, 23 nt, Human
aauaauaaacauaaauaauauua

SEQ ID NO: 68504 - RNA, 19 nt, Human
acacugucuuugcaaagug

SEQ ID NO: 68505 - RNA, 21 nt, Human
accaccccuuugucuccccau

SEQ ID NO: 68506 - RNA, 18 nt, Human
accccuuugucuccccau

SEQ ID NO: 68507 - RNA, 19 nt, Human
accucuccucccagcucca

SEQ ID NO: 68508 - RNA, 18 nt, Human
acucuguuuggaaugugg

SEQ ID NO: 68509 - RNA, 22 nt, Human
agaaagacauccucuggaaaga

SEQ ID NO: 68510 - RNA, 26 nt, Human
agaaauacaucucccuagaacucuuc

SEQ ID NO: 68511 - RNA, 18 nt, Human
agguggcaucaggcuggg

SEQ ID NO: 68512 - RNA, 20 nt, Human
caauauacucuacuuagaau

SEQ ID NO: 68513 - RNA, 18 nt, Human
caauuucugugacuugcg

SEQ ID NO: 68514 - RNA, 22 nt, Human
cacagccccggugccgagcaga

SEQ ID NO: 68515 - RNA, 24 nt, Human
caccagggauguaauaccuacaag

SEQ ID NO: 68516 - RNA, 26 nt, Human
caccagugguaacuggacacacuguc

SEQ ID NO: 68517 - RNA, 24 nt, Human
caccugccugcauuaaccaugagc

SEQ ID NO: 68518 - RNA, 20 nt, Human
cagaaugagccaugcuuucc

SEQ ID NO: 68519 - RNA, 20 nt, Human
cagagccagcaacuaagaac

SEQ ID NO: 68520 - RNA, 25 nt, Human
cagcaacuaagaacuguuugacaag

SEQ ID NO: 68521 - RNA, 24 nt, Human
caggacaaagcugucccugaaagc

SEQ ID NO: 68522 - RNA, 21 nt, Human
cagucacacauguugaagaaa

SEQ ID NO: 68523 - RNA, 18 nt, Human
cauguauuucucuaaacu

SEQ ID NO: 68524 - RNA, 23 nt, Human
ccacacagcagggaguacacccu

SEQ ID NO: 68525 - RNA, 20 nt, Human
ccaggacucuguuuggaaug

SEQ ID NO: 68526 - RNA, 23 nt, Human
cccccaccaccccuuugucuccc

SEQ ID NO: 68527 - RNA, 23 nt, Human
ccucagauccuaugcccucucug

SEQ ID NO: 68528 - RNA, 24 nt, Human
ccucccagcuccagcugggagucc

SEQ ID NO: 68529 - RNA, 20 nt, Human
ccucugggggccaugugcuc

SEQ ID NO: 68530 - RNA, 23 nt, Human
ccucugugucuucugaauaguga

SEQ ID NO: 68531 - RNA, 18 nt, Human
ccugcccuuccuuuucua

SEQ ID NO: 68532 - RNA, 19 nt, Human
ccuggacggcgaaacgacc

SEQ ID NO: 68533 - RNA, 19 nt, Human
ccuggacggcgaaacgacc

SEQ ID NO: 68534 - RNA, 19 nt, Human
ccuucgguccgaaaucacu

SEQ ID NO: 68535 - RNA, 26 nt, Human
ccuuggguuguuaucauuuccugccc

SEQ ID NO: 68536 - RNA, 22 nt, Human
cgcccggcuccuccgccgcuca

SEQ ID NO: 68537 - RNA, 19 nt, Human
cgccgcgcccggcuccucc

SEQ ID NO: 68538 - RNA, 19 nt, Human
cguccacucaugcagcagc

SEQ ID NO: 68539 - RNA, 20 nt, Human
cucagaagaugacaugccau

SEQ ID NO: 68540 - RNA, 23 nt, Human
cucaggacaaagcugucccugaa

SEQ ID NO: 68541 - RNA, 22 nt, Human
cucgcaaccauuaccuuaauuc

SEQ ID NO: 68542 - RNA, 22 nt, Human
cucuccucccagcuccagcugg

SEQ ID NO: 68543 - RNA, 20 nt, Human
cucugcucauuguuccccca

SEQ ID NO: 68544 - RNA, 18 nt, Human
cugaaaugccugcccgga

SEQ ID NO: 68545 - RNA, 23 nt, Human
cugccaucucugcucauuguucc

SEQ ID NO: 68546 - RNA, 19 nt, Human
cugggaugcacucaacugu

SEQ ID NO: 68547 - RNA, 24 nt, Human
cugggcaggguugggacggcuguc

SEQ ID NO: 68548 - RNA, 21 nt, Human
cuggugcagggugccauggug

SEQ ID NO: 68549 - RNA, 22 nt, Human
gaaaucacuggcugaagccccc

SEQ ID NO: 68550 - RNA, 20 nt, Human
gaaugaggugcaauuucugu

SEQ ID NO: 68551 - RNA, 18 nt, Human
gacuugcgauggcccaca

SEQ ID NO: 68552 - RNA, 18 nt, Human
gagcuccccgccugcucc

SEQ ID NO: 68553 - RNA, 19 nt, Human
gaggcugaggaaaccagga

SEQ ID NO: 68554 - RNA, 22 nt, Human
gauuguuauuguggauuuccau

SEQ ID NO: 68555 - RNA, 21 nt, Human
gcaaccauuaccuuaauucag

SEQ ID NO: 68556 - RNA, 27 nt, Human
gcccccaccaccccuuugucuccccau

SEQ ID NO: 68557 - RNA, 23 nt, Human
ggaagccucugggggccaugugc

SEQ ID NO: 68558 - RNA, 18 nt, Human
ggcaggguugggacggcu

SEQ ID NO: 68559 - RNA, 24 nt, Human
ggcccuaggucccucccacacagc

SEQ ID NO: 68560 - RNA, 20 nt, Human
ggccggcugugcagcagcuu

SEQ ID NO: 68561 - RNA, 21 nt, Human
ggcugggcaggguugggacgg

SEQ ID NO: 68562 - RNA, 21 nt, Human
gggaugcauauuccugaagcc

SEQ ID NO: 68563 - RNA, 22 nt, Human
gggugacuccagccaagcaucc

SEQ ID NO: 68564 - RNA, 21 nt, Human
gucaccuuccaaaggagauuc

SEQ ID NO: 68565 - RNA, 21 nt, Human
gucuuccuuuccuucaucugg

SEQ ID NO: 68566 - RNA, 22 nt, Human
gugcagcagcuuugguaugugc

SEQ ID NO: 68567 - RNA, 18 nt, Human
guggugcugauggccugg

SEQ ID NO: 68568 - RNA, 25 nt, Human
uaaaaaauaaacuuucuuuuuuggu

SEQ ID NO: 68569 - RNA, 19 nt, Human
uaaggcucuucuuuuucug

SEQ ID NO: 68570 - RNA, 22 nt, Human
uacaaaaaugccugaagaccgc

SEQ ID NO: 68571 - RNA, 18 nt, Human
uacacugagccugugccu

SEQ ID NO: 68572 - RNA, 23 nt, Human
ucaggacaaagcugucccugaaa

SEQ ID NO: 68573 - RNA, 25 nt, Human
ucagguauuaaucauuucauacacc

SEQ ID NO: 68574 - RNA, 20 nt, Human
ucauuacaaaaaugccugaa

SEQ ID NO: 68575 - RNA, 21 nt, Human
uccaaagaggcccuagguccc

SEQ ID NO: 68576 - RNA, 18 nt, Human
ucccagcuccagcuggga

SEQ ID NO: 68577 - RNA, 20 nt, Human
uccccgugaacagaggcaga

SEQ ID NO: 68578 - RNA, 21 nt, Human
ucccugaaagcugggagaaaa

SEQ ID NO: 68579 - RNA, 23 nt, Human
uccuaugcccucucugcauugcu

SEQ ID NO: 68580 - RNA, 19 nt, Human
ucgaagacagcauccaaag

SEQ ID NO: 68581 - RNA, 19 nt, Human
ucuaguuuuagagggacag

SEQ ID NO: 68582 - RNA, 24 nt, Human
ucuggaugaaguggagcccagccc

SEQ ID NO: 68583 - RNA, 19 nt, Human
ugaacagaggcagacucag

SEQ ID NO: 68584 - RNA, 19 nt, Human
ugaagccagcgccaagguc

SEQ ID NO: 68585 - RNA, 18 nt, Human
ugaaguggagcccagccu

SEQ ID NO: 68586 - RNA, 23 nt, Human
ugacuugcgauggcccacacuca

SEQ ID NO: 68587 - RNA, 24 nt, Human
ugcaaagugaaaguuguuuauugc

SEQ ID NO: 68588 - RNA, 24 nt, Human
ugcagaaugagccaugcuuuccug

SEQ ID NO: 68589 - RNA, 21 nt, Human
ugccugaagaccgcugagcuc

SEQ ID NO: 68590 - RNA, 24 nt, Human
ugcgcagucacacauguugaagaa

SEQ ID NO: 68591 - RNA, 19 nt, Human
uggaaagaagguagguugu

SEQ ID NO: 68592 - RNA, 21 nt, Human
uggaagcugggaaucuggaac

SEQ ID NO: 68593 - RNA, 22 nt, Human
uggaaucaaaauccaaaggauc

SEQ ID NO: 68594 - RNA, 20 nt, Human
uggcugaagcccccaccacc

SEQ ID NO: 68595 - RNA, 19 nt, Human
ugggaaucuggaacucuca

SEQ ID NO: 68596 - RNA, 20 nt, Human
ugggaugcacucaacuguga

SEQ ID NO: 68597 - RNA, 19 nt, Human
uggugcagggugccauggu

SEQ ID NO: 68598 - RNA, 24 nt, Human
ugugcaaauaauaaacauaaauaa

SEQ ID NO: 68599 - RNA, 19 nt, Human
uguuaaggcucuucuuuuu

SEQ ID NO: 68600 - RNA, 23 nt, Human
uuaaacuuuuauauauguuaagg

SEQ ID NO: 68601 - RNA, 20 nt, Human
uuacgauuuaacaggcaaaa

SEQ ID NO: 68602 - RNA, 25 nt, Human
uucauacaccagugguaacuggaca

SEQ ID NO: 68603 - RNA, 24 nt, Human
uucauagccucuaaaaggacuugc

SEQ ID NO: 68604 - RNA, 19 nt, Human
uuguuuccuguauuagccu

SEQ ID NO: 68605 - RNA, 23 nt, Human
uuugacaaaguagaaagaagggc

SEQ ID NO: 68606 - RNA, 23 nt, Human
aaaaugaaagcuuuaaaaaccua

SEQ ID NO: 68607 - RNA, 21 nt, Human
aaacagcuaugaaaauacuuc

SEQ ID NO: 68608 - RNA, 18 nt, Human
aaacauagaaagcagaug

SEQ ID NO: 68609 - RNA, 20 nt, Human
aaacgcacacaccauuguuu

SEQ ID NO: 68610 - RNA, 21 nt, Human
aaaugccaguacggagaacaa

SEQ ID NO: 68611 - RNA, 21 nt, Human
aacugcaguggugaugggaac

SEQ ID NO: 68612 - RNA, 24 nt, Human
aacugcaguggugaugggaacccc

SEQ ID NO: 68613 - RNA, 19 nt, Human
aagcagaugaaauugcaac

SEQ ID NO: 68614 - RNA, 18 nt, Human
aagcaggaaacagcagca

SEQ ID NO: 68615 - RNA, 22 nt, Human
aagcaggaaacagcagcaugug

SEQ ID NO: 68616 - RNA, 24 nt, Human
acacacagggcaggcgggcuugga

SEQ ID NO: 68617 - RNA, 24 nt, Human
acacagggcaggcgggcuuggacg

SEQ ID NO: 68618 - RNA, 18 nt, Human
acauguguguauaugugu

SEQ ID NO: 68619 - RNA, 26 nt, Human
accaccauggcuccaccucacccuag

SEQ ID NO: 68620 - RNA, 23 nt, Human
accauccaucacacgagcauucc

SEQ ID NO: 68621 - RNA, 23 nt, Human
accgccgaggaugggugggggcu

SEQ ID NO: 68622 - RNA, 19 nt, Human
acgcagagcccggcgggcg

SEQ ID NO: 68623 - RNA, 24 nt, Human
agaaaagaagagguguguguagag

SEQ ID NO: 68624 - RNA, 19 nt, Human
agcaaggaggcaggaugca

SEQ ID NO: 68625 - RNA, 21 nt, Human
agccuugcucacagagcagcu

SEQ ID NO: 68626 - RNA, 21 nt, Human
aggcagagcugggacccaacu

SEQ ID NO: 68627 - RNA, 18 nt, Human
aggcggccgagggacagg

SEQ ID NO: 68628 - RNA, 20 nt, Human
aggcgggcagaggugcggug

SEQ ID NO: 68629 - RNA, 21 nt, Human
aggggaagggccuuguccagg

SEQ ID NO: 68630 - RNA, 19 nt, Human
aggggacguggggacgagg

SEQ ID NO: 68631 - RNA, 22 nt, Human
agugacccggcccuucccacag

SEQ ID NO: 68632 - RNA, 26 nt, Human
agugcaaaggcaauuuuaagauuucu

SEQ ID NO: 68633 - RNA, 22 nt, Human
auguacacguguguguguguau

SEQ ID NO: 68634 - RNA, 23 nt, Human
auguguacgugugggagcucacg

SEQ ID NO: 68635 - RNA, 18 nt, Human
augugugugcaugugugu

SEQ ID NO: 68636 - RNA, 24 nt, Human
caaaaauaccuacugucgagcacc

SEQ ID NO: 68637 - RNA, 18 nt, Human
caacagggacuuccuauc

SEQ ID NO: 68638 - RNA, 20 nt, Human
caacagggacuuccuaucac

SEQ ID NO: 68639 - RNA, 24 nt, Human
caagccaguugcucgcuacccuca

SEQ ID NO: 68640 - RNA, 22 nt, Human
caaggggacgagaggacguggg

SEQ ID NO: 68641 - RNA, 23 nt, Human
caaguaucugucucccggcccuc

SEQ ID NO: 68642 - RNA, 20 nt, Human
cacacuaaaacuuguuguca

SEQ ID NO: 68643 - RNA, 26 nt, Human
cacagccaaguaucugucucccggcc

SEQ ID NO: 68644 - RNA, 20 nt, Human
cacaggggccccucagcaag

SEQ ID NO: 68645 - RNA, 22 nt, Human
caccucggaaacacccucuggg

SEQ ID NO: 68646 - RNA, 22 nt, Human
cacguggcacugccuucuccac

SEQ ID NO: 68647 - RNA, 20 nt, Human
cagagcccggcgggcggagc

SEQ ID NO: 68648 - RNA, 19 nt, Human
cagccaaguaucugucucc

SEQ ID NO: 68649 - RNA, 18 nt, Human
cagcgcuggacagauccu

SEQ ID NO: 68650 - RNA, 22 nt, Human
cauguacacgugugugugugua

SEQ ID NO: 68651 - RNA, 20 nt, Human
cauguguguauucacgccug

SEQ ID NO: 68652 - RNA, 19 nt, Human
ccaagccagggcggccaca

SEQ ID NO: 68653 - RNA, 23 nt, Human
ccacccagagcagcgcuggacag

SEQ ID NO: 68654 - RNA, 19 nt, Human
ccacuguguucacuguucu

SEQ ID NO: 68655 - RNA, 18 nt, Human
ccagguaacacgcaugca

SEQ ID NO: 68656 - RNA, 23 nt, Human
ccagugacagcaaaggccaauga

SEQ ID NO: 68657 - RNA, 23 nt, Human
cccggcccuucccacagcauccc

SEQ ID NO: 68658 - RNA, 24 nt, Human
cccguuccacagcguggcgcgggg

SEQ ID NO: 68659 - RNA, 21 nt, Human
ccuacugucgagcaccucgga

SEQ ID NO: 68660 - RNA, 21 nt, Human
cgaggggacguggggacgcag

SEQ ID NO: 68661 - RNA, 20 nt, Human
cgaggugacaggacaagggg

SEQ ID NO: 68662 - RNA, 18 nt, Human
cggcguggguguggccag

SEQ ID NO: 68663 - RNA, 20 nt, Human
cgugggcagggcugccaagc

SEQ ID NO: 68664 - RNA, 21 nt, Human
cuccuugccugcugggggcca

SEQ ID NO: 68665 - RNA, 21 nt, Human
cugcucugcaaagcccagaca

SEQ ID NO: 68666 - RNA, 19 nt, Human
cuguucaacuaaucacugc

SEQ ID NO: 68667 - RNA, 20 nt, Human
cuugccggagccccguucca

SEQ ID NO: 68668 - RNA, 20 nt, Human
gaagacacaggccuggggga

SEQ ID NO: 68669 - RNA, 19 nt, Human
gaagcugccggcguggccu

SEQ ID NO: 68670 - RNA, 19 nt, Human
gacgaggugacgggaugag

SEQ ID NO: 68671 - RNA, 23 nt, Human
gacgccugcggcuggccccucgg

SEQ ID NO: 68672 - RNA, 18 nt, Human
gacguggggaugaggaga

SEQ ID NO: 68673 - RNA, 23 nt, Human
gagcuugcacguuuguggugggu

SEQ ID NO: 68674 - RNA, 23 nt, Human
gaggaugggugggggcuccgugg

SEQ ID NO: 68675 - RNA, 19 nt, Human
gcaccaccauggcuccacc

SEQ ID NO: 68676 - RNA, 22 nt, Human
gcaccucggaaacacccucugg

SEQ ID NO: 68677 - RNA, 19 nt, Human
gcacggaugaggugcggcg

SEQ ID NO: 68678 - RNA, 20 nt, Human
gcaggguggcccuggggacg

SEQ ID NO: 68679 - RNA, 22 nt, Human
gcccacugugcgugucugagac

SEQ ID NO: 68680 - RNA, 22 nt, Human
gcccacugugcgugucugagac

SEQ ID NO: 68681 - RNA, 22 nt, Human
gcccacugugcgugucugagac

SEQ ID NO: 68682 - RNA, 22 nt, Human
gcgcggggcgggcgugagggcc

SEQ ID NO: 68683 - RNA, 22 nt, Human
gcuaacccacccagagcagcgc

SEQ ID NO: 68684 - RNA, 20 nt, Human
gcuccgugcccuggcgagug

SEQ ID NO: 68685 - RNA, 22 nt, Human
gcugccaagccagggcggccac

SEQ ID NO: 68686 - RNA, 20 nt, Human
gcuuccaaaaauaccuacug

SEQ ID NO: 68687 - RNA, 19 nt, Human
ggacgggacaaggggacga

SEQ ID NO: 68688 - RNA, 18 nt, Human
ggacguggggaugaggag

SEQ ID NO: 68689 - RNA, 20 nt, Human
ggcaaguaaauacuaacuac

SEQ ID NO: 68690 - RNA, 20 nt, Human
ggcauccacaugugggccac

SEQ ID NO: 68691 - RNA, 21 nt, Human
ggccgcggcccuucccagcug

SEQ ID NO: 68692 - RNA, 18 nt, Human
ggccugggggaauggccu

SEQ ID NO: 68693 - RNA, 20 nt, Human
ggcggagcugcagugcggga

SEQ ID NO: 68694 - RNA, 22 nt, Human
ggcguggguguggccaguccug

SEQ ID NO: 68695 - RNA, 18 nt, Human
ggcuggaagcugccggcg

SEQ ID NO: 68696 - RNA, 19 nt, Human
gggcaugggugguggccgg

SEQ ID NO: 68697 - RNA, 20 nt, Human
gggcaugggugguggccggg

SEQ ID NO: 68698 - RNA, 20 nt, Human
gggcuggaagcugccggcgu

SEQ ID NO: 68699 - RNA, 18 nt, Human
ggggacgggacaagggga

SEQ ID NO: 68700 - RNA, 21 nt, Human
gguggguacauguacauaugu

SEQ ID NO: 68701 - RNA, 21 nt, Human
guacacgugcauguucugcau

SEQ ID NO: 68702 - RNA, 19 nt, Human
gucaccuuauuuuauccca

SEQ ID NO: 68703 - RNA, 20 nt, Human
guccaggcggccagggugcc

SEQ ID NO: 68704 - RNA, 18 nt, Human
gugcauguguacgugugg

SEQ ID NO: 68705 - RNA, 21 nt, Human
guggagccaaaagccagguaa

SEQ ID NO: 68706 - RNA, 20 nt, Human
gugguguacacgugugugca

SEQ ID NO: 68707 - RNA, 24 nt, Human
guguggcucaacaaccacagugcu

SEQ ID NO: 68708 - RNA, 21 nt, Human
guguguguguguaugcgugua

SEQ ID NO: 68709 - RNA, 23 nt, Human
uacaaucaaauggugaaaucuga

SEQ ID NO: 68710 - RNA, 18 nt, Human
uacagagaaucugccccc

SEQ ID NO: 68711 - RNA, 20 nt, Human
uacgugugcgugugugugug

SEQ ID NO: 68712 - RNA, 18 nt, Human
uagaaagcagaugaaauu

SEQ ID NO: 68713 - RNA, 19 nt, Human
uagaaagcagaugaaauug

SEQ ID NO: 68714 - RNA, 22 nt, Human
uagaaagcagaugaaauugcaa

SEQ ID NO: 68715 - RNA, 23 nt, Human
uauagggcugagccgaggggagg

SEQ ID NO: 68716 - RNA, 22 nt, Human
uauaugugugugcaugugugua

SEQ ID NO: 68717 - RNA, 21 nt, Human
uaugugcauauguauugugua

SEQ ID NO: 68718 - RNA, 21 nt, Human
ucaaaacucucaccagaaucu

SEQ ID NO: 68719 - RNA, 18 nt, Human
ucacacugaaaugucuuc

SEQ ID NO: 68720 - RNA, 20 nt, Human
uccacaggcuuaggaccauc

SEQ ID NO: 68721 - RNA, 25 nt, Human
ucccaaccacuguguucacuguucu

SEQ ID NO: 68722 - RNA, 20 nt, Human
ucccacacgggaccuagggc

SEQ ID NO: 68723 - RNA, 22 nt, Human
ucccagugacagcaaaggccaa

SEQ ID NO: 68724 - RNA, 21 nt, Human
ucccuggacggcucuucucuc

SEQ ID NO: 68725 - RNA, 23 nt, Human
ucccuggacggcucuucucuccc

SEQ ID NO: 68726 - RNA, 21 nt, Human
uccuaagacgaaggagagccc

SEQ ID NO: 68727 - RNA, 21 nt, Human
uccuaucacagcagcccuggg

SEQ ID NO: 68728 - RNA, 20 nt, Human
ucucacacugaaaugucuuc

SEQ ID NO: 68729 - RNA, 24 nt, Human
ucugaaaauucgcauucaucagag

SEQ ID NO: 68730 - RNA, 19 nt, Human
ugagacggucuguggcagg

SEQ ID NO: 68731 - RNA, 19 nt, Human
ugagacggucuguggcagg

SEQ ID NO: 68732 - RNA, 19 nt, Human
ugagacggucuguggcagg

SEQ ID NO: 68733 - RNA, 21 nt, Human
ugagagugggagcuguaccag

SEQ ID NO: 68734 - RNA, 20 nt, Human
ugagcaggguacggcggugc

SEQ ID NO: 68735 - RNA, 21 nt, Human
ugagccgaaugcccagaggcc

SEQ ID NO: 68736 - RNA, 22 nt, Human
ugagcguggagccaaaagccag

SEQ ID NO: 68737 - RNA, 20 nt, Human
ugaggacgaggugacggggc

SEQ ID NO: 68738 - RNA, 18 nt, Human
ugagggccggcuccuccu

SEQ ID NO: 68739 - RNA, 25 nt, Human
ugagugauccugugugcaagccccc

SEQ ID NO: 68740 - RNA, 23 nt, Human
ugcaacgucauucacugaggauc

SEQ ID NO: 68741 - RNA, 22 nt, Human
ugcaguagaagcucauacgucu

SEQ ID NO: 68742 - RNA, 21 nt, Human
ugcaugacagcgcgcagggug

SEQ ID NO: 68743 - RNA, 19 nt, Human
ugcauguacacgugugugu

SEQ ID NO: 68744 - RNA, 21 nt, Human
ugcaugucuguaggucacaca

SEQ ID NO: 68745 - RNA, 26 nt, Human
ugcaugugugcaggagcuugcacguu

SEQ ID NO: 68746 - RNA, 18 nt, Human
ugcauguguguaucacac

SEQ ID NO: 68747 - RNA, 22 nt, Human
ugccaguacggagaacaacagg

SEQ ID NO: 68748 - RNA, 19 nt, Human
ugcccuggcgaguggcuga

SEQ ID NO: 68749 - RNA, 22 nt, Human
ugccggagccccguuccacagc

SEQ ID NO: 68750 - RNA, 20 nt, Human
ugcgggggcagcgugggcag

SEQ ID NO: 68751 - RNA, 20 nt, Human
ugcguacaugugcaugugua

SEQ ID NO: 68752 - RNA, 19 nt, Human
ugcgugugugugugcaugu

SEQ ID NO: 68753 - RNA, 21 nt, Human
ugcgugugugugugcaugugu

SEQ ID NO: 68754 - RNA, 22 nt, Human
ugcgugugugugugcaugugug

SEQ ID NO: 68755 - RNA, 18 nt, Human
ugcuaacccacccagagc

SEQ ID NO: 68756 - RNA, 23 nt, Human
ugcugccuguugggauccacccg

SEQ ID NO: 68757 - RNA, 19 nt, Human
ugcuguucaacuaaucacu

SEQ ID NO: 68758 - RNA, 21 nt, Human
uggcaggugggugaagacaca

SEQ ID NO: 68759 - RNA, 19 nt, Human
uggggaugggacgagggga

SEQ ID NO: 68760 - RNA, 20 nt, Human
uggguacauguacauaugug

SEQ ID NO: 68761 - RNA, 19 nt, Human
uggguccaggcggccaggg

SEQ ID NO: 68762 - RNA, 19 nt, Human
ugggugugaaucagugacc

SEQ ID NO: 68763 - RNA, 25 nt, Human
uggugcauguacacgugugugugug

SEQ ID NO: 68764 - RNA, 18 nt, Human
uguacacguuugugugca

SEQ ID NO: 68765 - RNA, 18 nt, Human
ugucugagacggucugug

SEQ ID NO: 68766 - RNA, 18 nt, Human
ugucugagacggucugug

SEQ ID NO: 68767 - RNA, 18 nt, Human
ugucugagacggucugug

SEQ ID NO: 68768 - RNA, 22 nt, Human
ugugcaugugugcaguagaagc

SEQ ID NO: 68769 - RNA, 20 nt, Human
uguggcacauguguguauau

SEQ ID NO: 68770 - RNA, 22 nt, Human
uguggcauccacaugugggcca

SEQ ID NO: 68771 - RNA, 18 nt, Human
uguggugcguacaugugc

SEQ ID NO: 68772 - RNA, 20 nt, Human
ugugguguacacaugaaugu

SEQ ID NO: 68773 - RNA, 20 nt, Human
ugugguguacacgugugugc

SEQ ID NO: 68774 - RNA, 21 nt, Human
uguguacacgugcauguucug

SEQ ID NO: 68775 - RNA, 18 nt, Human
uguguacgaugugugcac

SEQ ID NO: 68776 - RNA, 18 nt, Human
uguguacgaugugugcac

SEQ ID NO: 68777 - RNA, 23 nt, Human
uguguacgugugggagcucacau

SEQ ID NO: 68778 - RNA, 18 nt, Human
uguguauaugugugugca

SEQ ID NO: 68779 - RNA, 19 nt, Human
uguguauaugugugugcau

SEQ ID NO: 68780 - RNA, 19 nt, Human
ugugugcacguguguuuac

SEQ ID NO: 68781 - RNA, 18 nt, Human
ugugugcaugcaugugug

SEQ ID NO: 68782 - RNA, 20 nt, Human
ugugugcaugcaugugugca

SEQ ID NO: 68783 - RNA, 20 nt, Human
ugugugccacccccgucagc

SEQ ID NO: 68784 - RNA, 19 nt, Human
uguguguauaugugugugc

SEQ ID NO: 68785 - RNA, 21 nt, Human
uguguguauaugugugugcau

SEQ ID NO: 68786 - RNA, 23 nt, Human
uguguguauaugugugugcaugu

SEQ ID NO: 68787 - RNA, 18 nt, Human
ugugugugcaugugugca

SEQ ID NO: 68788 - RNA, 19 nt, Human
ugugugugugcaugugugc

SEQ ID NO: 68789 - RNA, 18 nt, Human
uguguguguguaugcgug

SEQ ID NO: 68790 - RNA, 19 nt, Human
uguguguguguaugcgugu

SEQ ID NO: 68791 - RNA, 20 nt, Human
uguguguguguaugcgugua

SEQ ID NO: 68792 - RNA, 19 nt, Human
uucacugaggaucuucuca

SEQ ID NO: 68793 - RNA, 19 nt, Human
uucuagaaauagaaaugcc

SEQ ID NO: 68794 - RNA, 20 nt, Human
uucuuuuuuaucucgugccc

SEQ ID NO: 68795 - RNA, 21 nt, Human
uuguugucagagguacauggu

SEQ ID NO: 68796 - RNA, 19 nt, Human
uuuguagugaauguacguu

SEQ ID NO: 68797 - RNA, 26 nt, Human
uuuguggcacauguguguauauuaca

SEQ ID NO: 68798 - RNA, 19 nt, Human
aaaacaaaaacaaaugaca

SEQ ID NO: 68799 - RNA, 20 nt, Human
aaacaaaugacaauacugaa

SEQ ID NO: 68800 - RNA, 23 nt, Human
aaacaccaacauggaagauucuc

SEQ ID NO: 68801 - RNA, 25 nt, Human
aaacacggucauguaaauguaaugc

SEQ ID NO: 68802 - RNA, 23 nt, Human
aacaaaaacaaaugacaauacug

SEQ ID NO: 68803 - RNA, 21 nt, Human
aaggggacacuuuccuuguga

SEQ ID NO: 68804 - RNA, 20 nt, Human
aauaacuuaauauccuuaca

SEQ ID NO: 68805 - RNA, 21 nt, Human
aaugguuggaaaugauucucc

SEQ ID NO: 68806 - RNA, 25 nt, Human
aaugucucuuuauucucaaauuuua

SEQ ID NO: 68807 - RNA, 20 nt, Human
acaggaaaaacaccaacaug

SEQ ID NO: 68808 - RNA, 22 nt, Human
acaggaaaaacaccaacaugga

SEQ ID NO: 68809 - RNA, 22 nt, Human
accaaaauuccucaguauucac

SEQ ID NO: 68810 - RNA, 19 nt, Human
accaaguauugcuacaaua

SEQ ID NO: 68811 - RNA, 21 nt, Human
acggaccugauuccugauuug

SEQ ID NO: 68812 - RNA, 18 nt, Human
agaugacauaaccugaaa

SEQ ID NO: 68813 - RNA, 19 nt, Human
agcaacagacugaaaugcc

SEQ ID NO: 68814 - RNA, 22 nt, Human
agcuuuagacccaagaaagagg

SEQ ID NO: 68815 - RNA, 21 nt, Human
aggcagggugcugagucacuu

SEQ ID NO: 68816 - RNA, 23 nt, Human
aguuaauuacaguaacauguacc

SEQ ID NO: 68817 - RNA, 18 nt, Human
auaaaguucuccuuaacu

SEQ ID NO: 68818 - RNA, 20 nt, Human
auaaaguucuccuuaacuaa

SEQ ID NO: 68819 - RNA, 28 nt, Human
auaaauauaacuucauaaacuuuaaaaa

SEQ ID NO: 68820 - RNA, 23 nt, Human
auagggccuggguguggcucagg

SEQ ID NO: 68821 - RNA, 21 nt, Human
aucacacuuuaagcaccauua

SEQ ID NO: 68822 - RNA, 18 nt, Human
aucaugaguuaugaucua

SEQ ID NO: 68823 - RNA, 24 nt, Human
aucuuccuaaauccagcuaugaaa

SEQ ID NO: 68824 - RNA, 24 nt, Human
augaaaaaugucucuuuauucuca

SEQ ID NO: 68825 - RNA, 23 nt, Human
augcagagaauuuuuaaaggauu

SEQ ID NO: 68826 - RNA, 23 nt, Human
auggaaguuagguuuugaagugc

SEQ ID NO: 68827 - RNA, 23 nt, Human
caaaaacaaaugacaauacugaa

SEQ ID NO: 68828 - RNA, 22 nt, Human
caaaauuccucaguauucacau

SEQ ID NO: 68829 - RNA, 25 nt, Human
caacacaggucacugagggaccaaa

SEQ ID NO: 68830 - RNA, 30 nt, Human
caagaaaauaauaguuuacaagcaaacaaa

SEQ ID NO: 68831 - RNA, 18 nt, Human
caaguauugcuacaauau

SEQ ID NO: 68832 - RNA, 18 nt, Human
cagaacucacuguauugu

SEQ ID NO: 68833 - RNA, 23 nt, Human
cagaaugcauuaaugaauuaaca

SEQ ID NO: 68834 - RNA, 23 nt, Human
caugcaaaagauccaaugauaaa

SEQ ID NO: 68835 - RNA, 19 nt, Human
cauuccacagccacaccug

SEQ ID NO: 68836 - RNA, 19 nt, Human
cauucuuuccccugccagu

SEQ ID NO: 68837 - RNA, 23 nt, Human
ccaacauggaagauucucccuuu

SEQ ID NO: 68838 - RNA, 21 nt, Human
ccaguccaauucuagaagccu

SEQ ID NO: 68839 - RNA, 23 nt, Human
ccauauccucccaccuaguacuc

SEQ ID NO: 68840 - RNA, 22 nt, Human
cccacaaaguacuacugccccu

SEQ ID NO: 68841 - RNA, 27 nt, Human
cccauaagcacaagggacaaaccagac

SEQ ID NO: 68842 - RNA, 18 nt, Human
cccugccaguccaauucu

SEQ ID NO: 68843 - RNA, 25 nt, Human
ccuggcccauacuuugguccccugg

SEQ ID NO: 68844 - RNA, 21 nt, Human
cggugaacggaccugauuccu

SEQ ID NO: 68845 - RNA, 19 nt, Human
cucccacaaaguacuacug

SEQ ID NO: 68846 - RNA, 27 nt, Human
cugccaguccaauucuagaagccuuau

SEQ ID NO: 68847 - RNA, 22 nt, Human
gaaaaacaccaacauggaagau

SEQ ID NO: 68848 - RNA, 24 nt, Human
gaaaagcuuuaaauauaacucuaa

SEQ ID NO: 68849 - RNA, 20 nt, Human
gaacucagaaugcauuaaug

SEQ ID NO: 68850 - RNA, 23 nt, Human
gcaaauaaacacggucauguaaa

SEQ ID NO: 68851 - RNA, 18 nt, Human
gccuggguguggcucagg

SEQ ID NO: 68852 - RNA, 31 nt, Human
ggaaaugauucuccuaauuugcucugugaaa

SEQ ID NO: 68853 - RNA, 19 nt, Human
ggaagagcaugucuaaguc

SEQ ID NO: 68854 - RNA, 21 nt, Human
gugaacggaccugauuccuga

SEQ ID NO: 68855 - RNA, 20 nt, Human
guguggcucaggucuggaag

SEQ ID NO: 68856 - RNA, 20 nt, Human
guuagaggaauugguauaaa

SEQ ID NO: 68857 - RNA, 21 nt, Human
uaaacaucaauuugaaguucg

SEQ ID NO: 68858 - RNA, 22 nt, Human
uaacaguucaggaugagcacac

SEQ ID NO: 68859 - RNA, 23 nt, Human
uaacuaacuucaaauggugagua

SEQ ID NO: 68860 - RNA, 20 nt, Human
uaacuuuucccaugaaaagc

SEQ ID NO: 68861 - RNA, 19 nt, Human
uaagcaccauuauaggcga

SEQ ID NO: 68862 - RNA, 20 nt, Human
uaauauguauacaaucauua

SEQ ID NO: 68863 - RNA, 22 nt, Human
uacagcccucagacgaggcaaa

SEQ ID NO: 68864 - RNA, 22 nt, Human
uaccaugauuacaaacauauca

SEQ ID NO: 68865 - RNA, 19 nt, Human
uaccccaaacugaucuuua

SEQ ID NO: 68866 - RNA, 18 nt, Human
uagaaaacuacugaaagc

SEQ ID NO: 68867 - RNA, 21 nt, Human
uagacagccacagugucucag

SEQ ID NO: 68868 - RNA, 20 nt, Human
uagaugacauaaccugaaaa

SEQ ID NO: 68869 - RNA, 18 nt, Human
uauaggaacaacauucaa

SEQ ID NO: 68870 - RNA, 23 nt, Human
ucaaggcaaacuuucagcauaau

SEQ ID NO: 68871 - RNA, 20 nt, Human
ucagaccauaaauucucccc

SEQ ID NO: 68872 - RNA, 18 nt, Human
ucagacgaggcaaaggga

SEQ ID NO: 68873 - RNA, 20 nt, Human
ucagauaaguucaaucucac

SEQ ID NO: 68874 - RNA, 20 nt, Human
ucaggucuggaagccuuugu

SEQ ID NO: 68875 - RNA, 21 nt, Human
ucaugaguuaugaucuauuuu

SEQ ID NO: 68876 - RNA, 24 nt, Human
uccagaauaacagaucuuccuaaa

SEQ ID NO: 68877 - RNA, 27 nt, Human
uccccauacugcaguaaauaaugguug

SEQ ID NO: 68878 - RNA, 21 nt, Human
uccuaggguugauuugccucu

SEQ ID NO: 68879 - RNA, 19 nt, Human
ucuaguggccuugacuccu

SEQ ID NO: 68880 - RNA, 21 nt, Human
ucucaacucgacagcaggucu

SEQ ID NO: 68881 - RNA, 22 nt, Human
ucugucucuaccauucuuuccc

SEQ ID NO: 68882 - RNA, 22 nt, Human
ugaaaugccauuaggaguccca

SEQ ID NO: 68883 - RNA, 21 nt, Human
ugacaauacugaacuacuuga

SEQ ID NO: 68884 - RNA, 22 nt, Human
ugacuuggugcuugccacuauc

SEQ ID NO: 68885 - RNA, 23 nt, Human
ugaguacagaaaauuacaucaau

SEQ ID NO: 68886 - RNA, 21 nt, Human
ugaguagcuguacaauaauau

SEQ ID NO: 68887 - RNA, 19 nt, Human
ugaguuaauuacaguaaca

SEQ ID NO: 68888 - RNA, 23 nt, Human
ugcacaauaaaucuccauaaagg

SEQ ID NO: 68889 - RNA, 18 nt, Human
ugcugcaguuggucauag

SEQ ID NO: 68890 - RNA, 19 nt, Human
uggaagauucucccuuuuc

SEQ ID NO: 68891 - RNA, 19 nt, Human
uuacauuccacagccacac

SEQ ID NO: 68892 - RNA, 22 nt, Human
uucaaguuauuucacauaaaac

SEQ ID NO: 68893 - RNA, 24 nt, Human
uucauuauuuccucuucuggaaca

SEQ ID NO: 68894 - RNA, 23 nt, Human
uuccuaaauccagcuaugaaaua

SEQ ID NO: 68895 - RNA, 24 nt, Human
uucuagaagccuuauauucaugaa

SEQ ID NO: 68896 - RNA, 22 nt, Human
uuguauucauuuaauuacccau

SEQ ID NO: 68897 - RNA, 22 nt, Human
uuuaagcaccauuauaggcgag

SEQ ID NO: 68898 - RNA, 19 nt, Human
uuuacuaagauuucucucu

SEQ ID NO: 68899 - RNA, 25 nt, Human
uuucagagcuaguguggccauuaac

SEQ ID NO: 68900 - RNA, 25 nt, Human
agaaaagaaaauccuauauaaagag

SEQ ID NO: 68901 - RNA, 18 nt, Human
caguggcaguggcugagg

SEQ ID NO: 68902 - RNA, 26 nt, Human
caugaaaauuuccucuuguaugaauu

SEQ ID NO: 68903 - RNA, 20 nt, Human
ccggcggcggcgcgggcccu

SEQ ID NO: 68904 - RNA, 22 nt, Human
ccugcacgcaccuccgcggccg

SEQ ID NO: 68905 - RNA, 23 nt, Human
ccugcacgcaccuccgcggccga

SEQ ID NO: 68906 - RNA, 18 nt, Human
gagagacauaggaaggga

SEQ ID NO: 68907 - RNA, 21 nt, Human
gcggcggagcgcacggugggg

SEQ ID NO: 68908 - RNA, 20 nt, Human
gcggcggcgcgggcccugca

SEQ ID NO: 68909 - RNA, 19 nt, Human
gcgggcugcgggcguggag

SEQ ID NO: 68910 - RNA, 18 nt, Human
gcugcugagagacauagg

SEQ ID NO: 68911 - RNA, 19 nt, Human
ggagauggagauagaaaag

SEQ ID NO: 68912 - RNA, 19 nt, Human
ggcggagcgcacggugggg

SEQ ID NO: 68913 - RNA, 23 nt, Human
guggcaguggcaguggcugaggu

SEQ ID NO: 68914 - RNA, 22 nt, Human
uaaagugcaaaacaucagugag

SEQ ID NO: 68915 - RNA, 19 nt, Human
ugagagacauaggaaggga

SEQ ID NO: 68916 - RNA, 22 nt, Human
ugagcauccugcauacagcuuu

SEQ ID NO: 68917 - RNA, 19 nt, Human
ugcauacagcuuucugcau

SEQ ID NO: 68918 - RNA, 21 nt, Human
ugccccaacgugcugcugaga

SEQ ID NO: 68919 - RNA, 28 nt, Human
ugugccccaacgugcugcuuggaggucc

SEQ ID NO: 68920 - RNA, 18 nt, Human
uuaaugaggagauggaga

SEQ ID NO: 68921 - RNA, 18 nt, Human
aaaaauccagauauaaaa

SEQ ID NO: 68922 - RNA, 24 nt, Human
accgcuguugccacgugucgcgcc

SEQ ID NO: 68923 - RNA, 22 nt, Human
agagaaaagcacagagcagcuc

SEQ ID NO: 68924 - RNA, 23 nt, Human
agccaaguggagggagcuagggc

SEQ ID NO: 68925 - RNA, 22 nt, Human
auggaugguuuucaggcagccc

SEQ ID NO: 68926 - RNA, 22 nt, Human
cagauggaugguuuucaggcag

SEQ ID NO: 68927 - RNA, 25 nt, Human
caggcagcccuccccccucccccca

SEQ ID NO: 68928 - RNA, 20 nt, Human
caggguagaguuccaaacuu

SEQ ID NO: 68929 - RNA, 23 nt, Human
cauaaaaaccuuccccgcuguca

SEQ ID NO: 68930 - RNA, 24 nt, Human
caucuuuauuuguaaaaauccaga

SEQ ID NO: 68931 - RNA, 21 nt, Human
cccccauagagcuacaugcuu

SEQ ID NO: 68932 - RNA, 20 nt, Human
ccccccuccccccauagagc

SEQ ID NO: 68933 - RNA, 19 nt, Human
ccgaugccgccgccgcugu

SEQ ID NO: 68934 - RNA, 22 nt, Human
ccgaugccgccgccgcuguugc

SEQ ID NO: 68935 - RNA, 24 nt, Human
ccgccgccgcuguugcugccgccg

SEQ ID NO: 68936 - RNA, 24 nt, Human
ccgccgcuguugcugccgccgccc

SEQ ID NO: 68937 - RNA, 20 nt, Human
ccgccuccucccgccgcugc

SEQ ID NO: 68938 - RNA, 23 nt, Human
ccgccuccucccgccgcugcucu

SEQ ID NO: 68939 - RNA, 19 nt, Human
ccucccgccgcugcucugc

SEQ ID NO: 68940 - RNA, 22 nt, Human
ccuccucccgccgcugcucugc

SEQ ID NO: 68941 - RNA, 20 nt, Human
cggcggcucgggccgaugcc

SEQ ID NO: 68942 - RNA, 19 nt, Human
cugcucugcgccccagccu

SEQ ID NO: 68943 - RNA, 18 nt, Human
cuggagaaucagagagaa

SEQ ID NO: 68944 - RNA, 22 nt, Human
cuguugcugccgccgcccgggc

SEQ ID NO: 68945 - RNA, 22 nt, Human
cuuccccgcugucauuuccaca

SEQ ID NO: 68946 - RNA, 22 nt, Human
gagcgggaccaggggagccaag

SEQ ID NO: 68947 - RNA, 22 nt, Human
gagggugggagggcggccggcg

SEQ ID NO: 68948 - RNA, 21 nt, Human
gcagcccuccccccucccccc

SEQ ID NO: 68949 - RNA, 29 nt, Human
gccgaugccgccgccgcuguugcugccgg

SEQ ID NO: 68950 - RNA, 21 nt, Human
gccgcugcucugcgccccagc

SEQ ID NO: 68951 - RNA, 23 nt, Human
gcugcucugcgccccagccucgu

SEQ ID NO: 68952 - RNA, 22 nt, Human
guaaaaauccagauauaaaaug

SEQ ID NO: 68953 - RNA, 24 nt, Human
guguguggccugaugcuccacggc

SEQ ID NO: 68954 - RNA, 18 nt, Human
uacaaaaacaaaaaggca

SEQ ID NO: 68955 - RNA, 19 nt, Human
uacaaaaacaaaaaggcac

SEQ ID NO: 68956 - RNA, 21 nt, Human
ucaggcagcccuccccccucc

SEQ ID NO: 68957 - RNA, 19 nt, Human
uccccacaugcugcggucg

SEQ ID NO: 68958 - RNA, 21 nt, Human
uccccccuccccccauagagc

SEQ ID NO: 68959 - RNA, 21 nt, Human
ucccggccgagcgagcgggac

SEQ ID NO: 68960 - RNA, 23 nt, Human
uccgccuccucccgccgcugcuc

SEQ ID NO: 68961 - RNA, 21 nt, Human
ucgggccgaugccgccgccgc

SEQ ID NO: 68962 - RNA, 18 nt, Human
uggagggagcuagggcug

SEQ ID NO: 68963 - RNA, 26 nt, Human
uggaugguuuucaggcagcccucccc

SEQ ID NO: 68964 - RNA, 18 nt, Human
uggccugaugcuccacgg

SEQ ID NO: 68965 - RNA, 22 nt, Human
uggccugaugcuccacggcgug

SEQ ID NO: 68966 - RNA, 25 nt, Human
uuacaaaaacaaaaaggcacauaaa

SEQ ID NO: 68967 - RNA, 21 nt, Human
uuccaggacgucuugcuuccc

SEQ ID NO: 68968 - RNA, 19 nt, Human
uugcugccgccgcccgggc

SEQ ID NO: 68969 - RNA, 22 nt, Human
uuuguaaaaauccagauauaaa

SEQ ID NO: 68970 - RNA, 21 nt, Human
uuuuuuuuuuuuuuuuccauu

SEQ ID NO: 68971 - RNA, 22 nt, Human
aaaauuccagugcaaugaaaug

SEQ ID NO: 68972 - RNA, 23 nt, Human
aaagggaauggaagaggcuggga

SEQ ID NO: 68973 - RNA, 24 nt, Human
aaagugcugggauuacaggcauga

SEQ ID NO: 68974 - RNA, 18 nt, Human
aacuuguggccaucccuu

SEQ ID NO: 68975 - RNA, 23 nt, Human
aagaaagcuaucuccuguaggaa

SEQ ID NO: 68976 - RNA, 19 nt, Human
aagugcugggauuacaggc

SEQ ID NO: 68977 - RNA, 21 nt, Human
aagugcugggauuacaggcau

SEQ ID NO: 68978 - RNA, 26 nt, Human
aagugcugggauuacaggcaugagcc

SEQ ID NO: 68979 - RNA, 26 nt, Human
aaguguggcauuucuggaagcucuug

SEQ ID NO: 68980 - RNA, 18 nt, Human
acaggguuucaccauguu

SEQ ID NO: 68981 - RNA, 21 nt, Human
acaggguuucaccauguuggc

SEQ ID NO: 68982 - RNA, 24 nt, Human
acaggguuucaccauguuggccag

SEQ ID NO: 68983 - RNA, 23 nt, Human
acccagaaaaagcaaaucucuua

SEQ ID NO: 68984 - RNA, 21 nt, Human
accccgcaacuuagccugcug

SEQ ID NO: 68985 - RNA, 27 nt, Human
acccuuucgcccaggcuggaguguaau

SEQ ID NO: 68986 - RNA, 19 nt, Human
accuccaucucccaccugu

SEQ ID NO: 68987 - RNA, 23 nt, Human
accuccaucucccaccugucugc

SEQ ID NO: 68988 - RNA, 19 nt, Human
accuuuuccagucucaggc

SEQ ID NO: 68989 - RNA, 23 nt, Human
acucuguggcacacaaguguggc

SEQ ID NO: 68990 - RNA, 18 nt, Human
agacaggaagguucaggg

SEQ ID NO: 68991 - RNA, 19 nt, Human
agauuacaggcgugugcca

SEQ ID NO: 68992 - RNA, 23 nt, Human
agccaccgcacccagaaaaagca

SEQ ID NO: 68993 - RNA, 24 nt, Human
agccuuugggaggugguuuauggg

SEQ ID NO: 68994 - RNA, 20 nt, Human
agcgaacuccuuuuccaggg

SEQ ID NO: 68995 - RNA, 26 nt, Human
aggaaccugaaaccaacucuccagcc

SEQ ID NO: 68996 - RNA, 20 nt, Human
aggaagugggguugaagggg

SEQ ID NO: 68997 - RNA, 19 nt, Human
aggucaccaauaaagaucc

SEQ ID NO: 68998 - RNA, 19 nt, Human
aggucuuccauuuuccuca

SEQ ID NO: 68999 - RNA, 19 nt, Human
aguagcugagauuacaggc

SEQ ID NO: 69000 - RNA, 23 nt, Human
aguagcugagauuacaggcgugu

SEQ ID NO: 69001 - RNA, 18 nt, Human
agugcugggauuacaggc

SEQ ID NO: 69002 - RNA, 20 nt, Human
agugggaaauggagugaggc

SEQ ID NO: 69003 - RNA, 21 nt, Human
agugucuaaucugauuguuca

SEQ ID NO: 69004 - RNA, 24 nt, Human
augauccaccugccucggccuccc

SEQ ID NO: 69005 - RNA, 18 nt, Human
augggucugacccaaugc

SEQ ID NO: 69006 - RNA, 24 nt, Human
caaagugcugggauuacaggcaug

SEQ ID NO: 69007 - RNA, 24 nt, Human
caaccucuuccucacagguucaag

SEQ ID NO: 69008 - RNA, 22 nt, Human
caagcaauucuccugccucagc

SEQ ID NO: 69009 - RNA, 22 nt, Human
cacaacaccuccagagcucccc

SEQ ID NO: 69010 - RNA, 19 nt, Human
caccauguuggccaggcuc

SEQ ID NO: 69011 - RNA, 22 nt, Human
caccauguuggccaggcucgcc

SEQ ID NO: 69012 - RNA, 31 nt, Human
caccauguuggccaggcucgccucgaacucc

SEQ ID NO: 69013 - RNA, 25 nt, Human
cacccaaugccacccguuauuucca

SEQ ID NO: 69014 - RNA, 18 nt, Human
cacccagaaaaagcaaau

SEQ ID NO: 69015 - RNA, 20 nt, Human
cacccguuauuuccaucccu

SEQ ID NO: 69016 - RNA, 22 nt, Human
cacccuuucgcccaggcuggag

SEQ ID NO: 69017 - RNA, 22 nt, Human
cacccuuucgcccaggcuggag

SEQ ID NO: 69018 - RNA, 19 nt, Human
caccgcacccagaaaaagc

SEQ ID NO: 69019 - RNA, 22 nt, Human
caccgcacccagaaaaagcaaa

SEQ ID NO: 69020 - RNA, 23 nt, Human
caccugccucggccucccaaagu

SEQ ID NO: 69021 - RNA, 18 nt, Human
caccugucugcccagcuc

SEQ ID NO: 69022 - RNA, 21 nt, Human
cacugcaaccucuuccucaca

SEQ ID NO: 69023 - RNA, 22 nt, Human
cacugcaaccucuuccucacag

SEQ ID NO: 69024 - RNA, 25 nt, Human
cagaaaaaauagacaacauagugga

SEQ ID NO: 69025 - RNA, 18 nt, Human
cagagcuccccaucuuuc

SEQ ID NO: 69026 - RNA, 19 nt, Human
cagagcuccccaucuuucc

SEQ ID NO: 69027 - RNA, 23 nt, Human
cagcccaggguaagugggcacaa

SEQ ID NO: 69028 - RNA, 20 nt, Human
cagccuccugaguagcugag

SEQ ID NO: 69029 - RNA, 21 nt, Human
cagggaacuucuccacccuga

SEQ ID NO: 69030 - RNA, 24 nt, Human
caggguuucaccauguuggccagg

SEQ ID NO: 69031 - RNA, 21 nt, Human
cagugccuucuaagccaggcu

SEQ ID NO: 69032 - RNA, 22 nt, Human
caucccucuccaucaccauccc

SEQ ID NO: 69033 - RNA, 20 nt, Human
caugaaaagaaagggaaugg

SEQ ID NO: 69034 - RNA, 22 nt, Human
caugagccaccgcacccagaaa

SEQ ID NO: 69035 - RNA, 23 nt, Human
ccaaagugcugggauuacaggca

SEQ ID NO: 69036 - RNA, 24 nt, Human
ccaaagugcugggauuacaggcau

SEQ ID NO: 69037 - RNA, 25 nt, Human
ccacccguuauuuccaucccucucc

SEQ ID NO: 69038 - RNA, 23 nt, Human
ccacuuagauucccaggcccaag

SEQ ID NO: 69039 - RNA, 24 nt, Human
cccaaagugcugggauuacaggca

SEQ ID NO: 69040 - RNA, 22 nt, Human
cccaaauguugccacccaaugc

SEQ ID NO: 69041 - RNA, 23 nt, Human
cccaauuuauauaccccgcaacu

SEQ ID NO: 69042 - RNA, 21 nt, Human
cccaugcacucgcugcuucua

SEQ ID NO: 69043 - RNA, 18 nt, Human
ccccacaacaccuccaga

SEQ ID NO: 69044 - RNA, 26 nt, Human
ccccacaacaccuccagagcucccca

SEQ ID NO: 69045 - RNA, 24 nt, Human
cccucuccaucaccauccccacaa

SEQ ID NO: 69046 - RNA, 20 nt, Human
cccugaugagaucugaguuu

SEQ ID NO: 69047 - RNA, 24 nt, Human
ccucacagguucaagcaauucucc

SEQ ID NO: 69048 - RNA, 19 nt, Human
ccugaccucaugauccacc

SEQ ID NO: 69049 - RNA, 19 nt, Human
ccugaguagcugagauuac

SEQ ID NO: 69050 - RNA, 23 nt, Human
ccugaguagcugagauuacaggc

SEQ ID NO: 69051 - RNA, 23 nt, Human
ccugaguagcugagauuacaggc

SEQ ID NO: 69052 - RNA, 18 nt, Human
ccugauucuagccaaugg

SEQ ID NO: 69053 - RNA, 20 nt, Human
ccugcaggaagcuaacgggg

SEQ ID NO: 69054 - RNA, 23 nt, Human
ccugccucagccuccugaguagc

SEQ ID NO: 69055 - RNA, 24 nt, Human
ccuuucgcccaggcuggaguguaa

SEQ ID NO: 69056 - RNA, 23 nt, Human
cgcacccagaaaaagcaaaucuc

SEQ ID NO: 69057 - RNA, 25 nt, Human
cucaaacuaaugucuuacaaaaggu

SEQ ID NO: 69058 - RNA, 19 nt, Human
cucacagguucaagcaauu

SEQ ID NO: 69059 - RNA, 19 nt, Human
cucacugcaaccucuuccu

SEQ ID NO: 69060 - RNA, 21 nt, Human
cuccccaucuuuccaugccug

SEQ ID NO: 69061 - RNA, 24 nt, Human
cuccugaccucaugauccaccugc

SEQ ID NO: 69062 - RNA, 21 nt, Human
cucuccaucaccauccccaca

SEQ ID NO: 69063 - RNA, 19 nt, Human
cucuuaguauuuuuccucu

SEQ ID NO: 69064 - RNA, 18 nt, Human
cugaguagcugagauuac

SEQ ID NO: 69065 - RNA, 22 nt, Human
cugaguagcugagauuacaggc

SEQ ID NO: 69066 - RNA, 24 nt, Human
cugaguagcugagauuacaggcgu

SEQ ID NO: 69067 - RNA, 18 nt, Human
cugauaaagcaaaauucc

SEQ ID NO: 69068 - RNA, 24 nt, Human
cugcaaccucuuccucacagguuc

SEQ ID NO: 69069 - RNA, 23 nt, Human
cugccucagccuccugaguagcu

SEQ ID NO: 69070 - RNA, 23 nt, Human
cugccucggccucccaaagugcu

SEQ ID NO: 69071 - RNA, 18 nt, Human
cugccucugcugcuaccc

SEQ ID NO: 69072 - RNA, 18 nt, Human
cugccucugcugcuaccc

SEQ ID NO: 69073 - RNA, 20 nt, Human
cugcugaguugccucauuau

SEQ ID NO: 69074 - RNA, 21 nt, Human
cuuagagaaugggcaaggcug

SEQ ID NO: 69075 - RNA, 18 nt, Human
cuuggggcagaguggcug

SEQ ID NO: 69076 - RNA, 24 nt, Human
cuuuuaguagagacaggguuucac

SEQ ID NO: 69077 - RNA, 22 nt, Human
gaccucaugauccaccugccuc

SEQ ID NO: 69078 - RNA, 22 nt, Human
gaccucaugauccaccugccuc

SEQ ID NO: 69079 - RNA, 24 nt, Human
gaccucaugauccaccugccucgg

SEQ ID NO: 69080 - RNA, 18 nt, Human
gaggaccccuaaccaagg

SEQ ID NO: 69081 - RNA, 20 nt, Human
gaguagcugagauuacaggc

SEQ ID NO: 69082 - RNA, 25 nt, Human
gaguagcugagauuacaggcgugug

SEQ ID NO: 69083 - RNA, 21 nt, Human
gagugggcagggugggguaac

SEQ ID NO: 69084 - RNA, 22 nt, Human
gaugggcaugaaaagaaaggga

SEQ ID NO: 69085 - RNA, 18 nt, Human
gauuacaggcaugagcca

SEQ ID NO: 69086 - RNA, 22 nt, Human
gauuacaggcaugagccaccgc

SEQ ID NO: 69087 - RNA, 23 nt, Human
gauuacaggcaugagccaccgca

SEQ ID NO: 69088 - RNA, 18 nt, Human
gauuacaggcgugugcca

SEQ ID NO: 69089 - RNA, 22 nt, Human
gcaaccucuuccucacagguuc

SEQ ID NO: 69090 - RNA, 23 nt, Human
gcccaggcuggaguguaauggca

SEQ ID NO: 69091 - RNA, 19 nt, Human
gccucauuaucucucccca

SEQ ID NO: 69092 - RNA, 18 nt, Human
gccucgaacuccugaccu

SEQ ID NO: 69093 - RNA, 26 nt, Human
gccucugcugcuacccugaugagauc

SEQ ID NO: 69094 - RNA, 23 nt, Human
gccuuugggaggugguuuauggg

SEQ ID NO: 69095 - RNA, 21 nt, Human
gcgaacuccuuuuccaggguu

SEQ ID NO: 69096 - RNA, 21 nt, Human
gcucacugcaaccucuuccuc

SEQ ID NO: 69097 - RNA, 20 nt, Human
gcuucugauaaagcaaaauu

SEQ ID NO: 69098 - RNA, 19 nt, Human
ggaagugggguugaaggga

SEQ ID NO: 69099 - RNA, 20 nt, Human
ggagacaggaagguucaggg

SEQ ID NO: 69100 - RNA, 18 nt, Human
ggagugggcagggugggg

SEQ ID NO: 69101 - RNA, 22 nt, Human
ggauuacaggcaugagccaccg

SEQ ID NO: 69102 - RNA, 19 nt, Human
gggaauggaagaggcuggg

SEQ ID NO: 69103 - RNA, 24 nt, Human
gggaauggaagaggcugggaaaga

SEQ ID NO: 69104 - RNA, 22 nt, Human
ggguuucaccauguuggccagg

SEQ ID NO: 69105 - RNA, 18 nt, Human
guagcugagauuacaggc

SEQ ID NO: 69106 - RNA, 24 nt, Human
uaauuuuuuguacuuuuaguagag

SEQ ID NO: 69107 - RNA, 25 nt, Human
uaauuuuuuguacuuuuaguagaga

SEQ ID NO: 69108 - RNA, 24 nt, Human
uacaggcaugagccaccgcaccca

SEQ ID NO: 69109 - RNA, 22 nt, Human
uagagacaggguuucaccaugu

SEQ ID NO: 69110 - RNA, 19 nt, Human
uaggaaccugaaaccaacu

SEQ ID NO: 69111 - RNA, 24 nt, Human
uaguagagacaggguuucaccaug

SEQ ID NO: 69112 - RNA, 26 nt, Human
uaguagagacaggguuucaccauguu

SEQ ID NO: 69113 - RNA, 21 nt, Human
uauuacagaaggugaaguguu

SEQ ID NO: 69114 - RNA, 21 nt, Human
ucacagguucaagcaauucuc

SEQ ID NO: 69115 - RNA, 24 nt, Human
ucacagguucaagcaauucuccug

SEQ ID NO: 69116 - RNA, 24 nt, Human
ucaccauccccacaacaccuccag

SEQ ID NO: 69117 - RNA, 24 nt, Human
ucacccuuucgcccaggcuggagu

SEQ ID NO: 69118 - RNA, 19 nt, Human
ucacugcaaccucuuccuc

SEQ ID NO: 69119 - RNA, 24 nt, Human
ucacugcaaccucuuccucacagg

SEQ ID NO: 69120 - RNA, 24 nt, Human
ucagcucacugcaaccucuuccuc

SEQ ID NO: 69121 - RNA, 24 nt, Human
ucccaaagugcugggauuacaggc

SEQ ID NO: 69122 - RNA, 22 nt, Human
ucccacuuagauucccaggccc

SEQ ID NO: 69123 - RNA, 23 nt, Human
ucccaggcccaaggcaaugacuc

SEQ ID NO: 69124 - RNA, 24 nt, Human
uccccaucuuuccaugccugguuc

SEQ ID NO: 69125 - RNA, 19 nt, Human
ucccucuccaucaccaucc

SEQ ID NO: 69126 - RNA, 21 nt, Human
uccucagaugucuuucucacu

SEQ ID NO: 69127 - RNA, 19 nt, Human
uccuccagccagcccuacc

SEQ ID NO: 69128 - RNA, 24 nt, Human
uccugaguagcugagauuacaggc

SEQ ID NO: 69129 - RNA, 18 nt, Human
ucggccucccaaagugcu

SEQ ID NO: 69130 - RNA, 24 nt, Human
ucucacccuuucgcccaggcugga

SEQ ID NO: 69131 - RNA, 21 nt, Human
ucucaggcucuugcacucacc

SEQ ID NO: 69132 - RNA, 21 nt, Human
ucuccccaaauguugccaccc

SEQ ID NO: 69133 - RNA, 24 nt, Human
ucuccugccucagccuccugagua

SEQ ID NO: 69134 - RNA, 20 nt, Human
ugaaaccaacucuccagccc

SEQ ID NO: 69135 - RNA, 21 nt, Human
ugacauccggaccuuguggac

SEQ ID NO: 69136 - RNA, 24 nt, Human
ugaccuaagcuugucccuggaagc

SEQ ID NO: 69137 - RNA, 18 nt, Human
ugagauuacaggcgugug

SEQ ID NO: 69138 - RNA, 21 nt, Human
ugagauuacaggcgugugcca

SEQ ID NO: 69139 - RNA, 22 nt, Human
ugagauuacaggcgugugccac

SEQ ID NO: 69140 - RNA, 24 nt, Human
ugagauuacaggcgugugccacca

SEQ ID NO: 69141 - RNA, 25 nt, Human
ugagauuacaggcgugugccaccau

SEQ ID NO: 69142 - RNA, 18 nt, Human
ugcaaugaaaugacagcc

SEQ ID NO: 69143 - RNA, 21 nt, Human
ugccacccaaugccacccguu

SEQ ID NO: 69144 - RNA, 24 nt, Human
ugccucagccuccugaguagcuga

SEQ ID NO: 69145 - RNA, 19 nt, Human
ugccucauuaucucucccc

SEQ ID NO: 69146 - RNA, 21 nt, Human
ugccucggccucccaaagugc

SEQ ID NO: 69147 - RNA, 24 nt, Human
ugccucggccucccaaagugcugg

SEQ ID NO: 69148 - RNA, 22 nt, Human
ugccugaaaaguauuguuuuug

SEQ ID NO: 69149 - RNA, 21 nt, Human
ugccuggagggaacagcccug

SEQ ID NO: 69150 - RNA, 22 nt, Human
ugccugguucuucuuccaaugg

SEQ ID NO: 69151 - RNA, 22 nt, Human
uggaagaggcugggaaagaacu

SEQ ID NO: 69152 - RNA, 23 nt, Human
uggaagaggcugggaaagaacuu

SEQ ID NO: 69153 - RNA, 18 nt, Human
uggaagugggaaauggag

SEQ ID NO: 69154 - RNA, 22 nt, Human
uggaagugggaaauggagugag

SEQ ID NO: 69155 - RNA, 20 nt, Human
uggaguguaauggcacgauc

SEQ ID NO: 69156 - RNA, 23 nt, Human
uggaguguaauggcacgaucuca

SEQ ID NO: 69157 - RNA, 24 nt, Human
uggaguguaauggcacgaucucag

SEQ ID NO: 69158 - RNA, 24 nt, Human
uggcacgaucucagcucacugcaa

SEQ ID NO: 69159 - RNA, 24 nt, Human
uggccaggcucgccucgaacuccu

SEQ ID NO: 69160 - RNA, 25 nt, Human
ugggagacaaguccaccuuuuccag

SEQ ID NO: 69161 - RNA, 22 nt, Human
ugggagacaggaagguucaggg

SEQ ID NO: 69162 - RNA, 20 nt, Human
ugggauggaaaaggaucugg

SEQ ID NO: 69163 - RNA, 18 nt, Human
ugggauuacaggcaugag

SEQ ID NO: 69164 - RNA, 19 nt, Human
ugggauuacaggcaugagc

SEQ ID NO: 69165 - RNA, 21 nt, Human
ugggauuacaggcaugagcca

SEQ ID NO: 69166 - RNA, 22 nt, Human
ugggauuacaggcaugagccac

SEQ ID NO: 69167 - RNA, 23 nt, Human
ugggauuacaggcaugagccacc

SEQ ID NO: 69168 - RNA, 24 nt, Human
ugggauuacaggcaugagccaccg

SEQ ID NO: 69169 - RNA, 24 nt, Human
ugggauuacaggcaugagccaccg

SEQ ID NO: 69170 - RNA, 26 nt, Human
ugggauuacaggcaugagccaccgca

SEQ ID NO: 69171 - RNA, 19 nt, Human
uggggcagaguggcugagg

SEQ ID NO: 69172 - RNA, 19 nt, Human
uggggugaucugagagggc

SEQ ID NO: 69173 - RNA, 23 nt, Human
ugucuuacaaaaggucaccaaua

SEQ ID NO: 69174 - RNA, 19 nt, Human
uuaggucuuccauuuuccu

SEQ ID NO: 69175 - RNA, 24 nt, Human
uuaguagagacaggguuucaccau

SEQ ID NO: 69176 - RNA, 21 nt, Human
uucaagcaauucuccugccuc

SEQ ID NO: 69177 - RNA, 24 nt, Human
uucaagcaauucuccugccucagc

SEQ ID NO: 69178 - RNA, 20 nt, Human
uucacaguuaggucuauggg

SEQ ID NO: 69179 - RNA, 22 nt, Human
uuuagauggguuccugcuuuug

SEQ ID NO: 69180 - RNA, 23 nt, Human
uuucaccauguuggccaggcucg

SEQ ID NO: 69181 - RNA, 21 nt, Human
uuuuuguacuuuuaguagaga

SEQ ID NO: 69182 - RNA, 24 nt, Human
uuuuuuguacuuuuaguagagaca

SEQ ID NO: 69183 - RNA, 24 nt, Human
aaaaaacaaaaaacaaacaaaaaa

SEQ ID NO: 69184 - RNA, 22 nt, Human
aaaaaaggaaaguaaaagaaaa

SEQ ID NO: 69185 - RNA, 21 nt, Human
aaaaaggaaaguaaaagaaaa

SEQ ID NO: 69186 - RNA, 21 nt, Human
aaaacaaaaaacaaacaaaaa

SEQ ID NO: 69187 - RNA, 26 nt, Human
aaaacaaacaaaaaaaaaaaauuacc

SEQ ID NO: 69188 - RNA, 20 nt, Human
aaaauaaaaauaaagaccua

SEQ ID NO: 69189 - RNA, 18 nt, Human
aaacagauacaauaaaac

SEQ ID NO: 69190 - RNA, 22 nt, Human
aaagagccaaaaaacaaaaaac

SEQ ID NO: 69191 - RNA, 26 nt, Human
aaagagccaaaaaacaaaaaacaaac

SEQ ID NO: 69192 - RNA, 27 nt, Human
aaauaaaaauaaagaccuaacaccaca

SEQ ID NO: 69193 - RNA, 21 nt, Human
aaauacacaaggcagcaauac

SEQ ID NO: 69194 - RNA, 22 nt, Human
aaaugggcacgucccaaggcuc

SEQ ID NO: 69195 - RNA, 18 nt, Human
aaauuguacaacugcaua

SEQ ID NO: 69196 - RNA, 20 nt, Human
aacacugcuuacuacaaggu

SEQ ID NO: 69197 - RNA, 21 nt, Human
aaggaaaaaaggaaaguaaaa

SEQ ID NO: 69198 - RNA, 24 nt, Human
aaggcucaauuuuucuuuuucuuu

SEQ ID NO: 69199 - RNA, 18 nt, Human
aauaaaauacacaaggca

SEQ ID NO: 69200 - RNA, 21 nt, Human
acaaggcaagagaugucaaga

SEQ ID NO: 69201 - RNA, 23 nt, Human
acagcagagacgcagccuuccag

SEQ ID NO: 69202 - RNA, 21 nt, Human
acauggcuugaaaaaugacca

SEQ ID NO: 69203 - RNA, 20 nt, Human
accacagcagagacgcagcc

SEQ ID NO: 69204 - RNA, 21 nt, Human
accacagcagagacgcagccu

SEQ ID NO: 69205 - RNA, 18 nt, Human
acccccaccccagccccc

SEQ ID NO: 69206 - RNA, 20 nt, Human
accuuugaaagagccaaaaa

SEQ ID NO: 69207 - RNA, 22 nt, Human
agaaaaaaauaaaauuguacaa

SEQ ID NO: 69208 - RNA, 20 nt, Human
agaaaacagauacaauaaaa

SEQ ID NO: 69209 - RNA, 22 nt, Human
agaaaacagauacaauaaaaca

SEQ ID NO: 69210 - RNA, 18 nt, Human
agagccaaaaaacaaaaa

SEQ ID NO: 69211 - RNA, 19 nt, Human
agccaaaaaacaaaaaaca

SEQ ID NO: 69212 - RNA, 24 nt, Human
agccaaaaaacaaaaaacaaacaa

SEQ ID NO: 69213 - RNA, 25 nt, Human
agccaaaaaacaaaaaacaaacaaa

SEQ ID NO: 69214 - RNA, 31 nt, Human
agccaaaaaacaaaaaacaaacaaaaaaaag

SEQ ID NO: 69215 - RNA, 21 nt, Human
agcccugucccuaggccaaag

SEQ ID NO: 69216 - RNA, 22 nt, Human
aggaaaaaaauaaaaauaaaga

SEQ ID NO: 69217 - RNA, 20 nt, Human
aggccaaagugaugggcaga

SEQ ID NO: 69218 - RNA, 25 nt, Human
aguucccccaugacaaacccccacc

SEQ ID NO: 69219 - RNA, 22 nt, Human
auaaagcaaauuaauuagcccu

SEQ ID NO: 69220 - RNA, 23 nt, Human
caaaaaacaaaaaacaaacaaaa

SEQ ID NO: 69221 - RNA, 21 nt, Human
caaacccccaccccagccccc

SEQ ID NO: 69222 - RNA, 22 nt, Human
caaacccccaccccagccccca

SEQ ID NO: 69223 - RNA, 22 nt, Human
caaacccccaccccagccccca

SEQ ID NO: 69224 - RNA, 19 nt, Human
caauacuuaggggccagaa

SEQ ID NO: 69225 - RNA, 25 nt, Human
cacagcuuuagaacauaccggagga

SEQ ID NO: 69226 - RNA, 21 nt, Human
caccacagcagagacgcagcc

SEQ ID NO: 69227 - RNA, 21 nt, Human
cagcagagacgcagccuucca

SEQ ID NO: 69228 - RNA, 18 nt, Human
cagcccccaggaaaaaaa

SEQ ID NO: 69229 - RNA, 20 nt, Human
caggaaaagacuauggagua

SEQ ID NO: 69230 - RNA, 19 nt, Human
cauaacacaacccaucacc

SEQ ID NO: 69231 - RNA, 23 nt, Human
caugacaaacccccaccccagcc

SEQ ID NO: 69232 - RNA, 24 nt, Human
caugacaaacccccaccccagccc

SEQ ID NO: 69233 - RNA, 27 nt, Human
caugacaaacccccaccccagccccca

SEQ ID NO: 69234 - RNA, 18 nt, Human
cauuacacuuuuucuugc

SEQ ID NO: 69235 - RNA, 28 nt, Human
ccaaaaaacaaaaaacaaacaaaaaaaa

SEQ ID NO: 69236 - RNA, 21 nt, Human
ccacaggaaaagacuauggag

SEQ ID NO: 69237 - RNA, 25 nt, Human
cccaggaaaaaaauaaaaauaaaga

SEQ ID NO: 69238 - RNA, 23 nt, Human
cccaugacaaacccccaccccag

SEQ ID NO: 69239 - RNA, 19 nt, Human
ccccagcccccaggaaaaa

SEQ ID NO: 69240 - RNA, 24 nt, Human
cccccaccccagcccccaggaaaa

SEQ ID NO: 69241 - RNA, 21 nt, Human
cccccaggaaaaaaauaaaaa

SEQ ID NO: 69242 - RNA, 22 nt, Human
cccccaugacaaacccccaccc

SEQ ID NO: 69243 - RNA, 21 nt, Human
cgggucagcagcugccgcggu

SEQ ID NO: 69244 - RNA, 22 nt, Human
cucacauaaaguagaaaacaga

SEQ ID NO: 69245 - RNA, 24 nt, Human
gcaauacuuaggggccagaaacac

SEQ ID NO: 69246 - RNA, 28 nt, Human
gcaguucccccaugacaaacccccaccc

SEQ ID NO: 69247 - RNA, 22 nt, Human
gcucaauuuuucuuuuucuuuu

SEQ ID NO: 69248 - RNA, 19 nt, Human
gggcacgucccaaggcuca

SEQ ID NO: 69249 - RNA, 21 nt, Human
guaaaagaaaauguauaaagc

SEQ ID NO: 69250 - RNA, 24 nt, Human
uaaaaaugcucaucgaugggccau

SEQ ID NO: 69251 - RNA, 22 nt, Human
uaaagcaaauuaauuagcccug

SEQ ID NO: 69252 - RNA, 31 nt, Human
uagaaaacagauacaauaaaacauggcuugg

SEQ ID NO: 69253 - RNA, 24 nt, Human
uagaacauaccggaggacaaggca

SEQ ID NO: 69254 - RNA, 19 nt, Human
uagcccugucccuaggcca

SEQ ID NO: 69255 - RNA, 19 nt, Human
uauuuacaccuuggacagc

SEQ ID NO: 69256 - RNA, 21 nt, Human
uccaccaugaaaaugguuaaa

SEQ ID NO: 69257 - RNA, 18 nt, Human
ucccccaugacaaacccc

SEQ ID NO: 69258 - RNA, 22 nt, Human
ucccuaggccaaagugaugggc

SEQ ID NO: 69259 - RNA, 21 nt, Human
uccggaggguggguggcugcg

SEQ ID NO: 69260 - RNA, 24 nt, Human
ucuaaccuauuaaaugcagaaagc

SEQ ID NO: 69261 - RNA, 25 nt, Human
ugaaagagccaaaaaacaaaaaaca

SEQ ID NO: 69262 - RNA, 20 nt, Human
ugacaaacccccaccccagc

SEQ ID NO: 69263 - RNA, 21 nt, Human
ugacaaacccccaccccagcc

SEQ ID NO: 69264 - RNA, 22 nt, Human
ugacugaauacaagaucaacaa

SEQ ID NO: 69265 - RNA, 22 nt, Human
uggcuugaaaaaugaccagagu

SEQ ID NO: 69266 - RNA, 20 nt, Human
uucauacauuacacuuuuuc

SEQ ID NO: 69267 - RNA, 22 nt, Human
uuuacaccuuggacagcaaacc

SEQ ID NO: 69268 - RNA, 24 nt, Human
aaaaaaaaaaaaaaaaagaaagaa

SEQ ID NO: 69269 - RNA, 19 nt, Human
aaaccagaacuagaaaggc

SEQ ID NO: 69270 - RNA, 20 nt, Human
aaaccagaacuagaaaggcu

SEQ ID NO: 69271 - RNA, 21 nt, Human
aaccagaacuagaaaggcucc

SEQ ID NO: 69272 - RNA, 25 nt, Human
aacuccaucucaaaaaaacaaagaa

SEQ ID NO: 69273 - RNA, 22 nt, Human
aagaaagaaagaaauuagccgg

SEQ ID NO: 69274 - RNA, 19 nt, Human
aagaagccagagaaaggau

SEQ ID NO: 69275 - RNA, 22 nt, Human
aaggggugcauuucagaggagg

SEQ ID NO: 69276 - RNA, 18 nt, Human
aaucgcuugaaccuggga

SEQ ID NO: 69277 - RNA, 21 nt, Human
aaugcaaaaaaaaaaaaaaaa

SEQ ID NO: 69278 - RNA, 18 nt, Human
acaaaggggugcauuuca

SEQ ID NO: 69279 - RNA, 19 nt, Human
acaagagcgaaacuccauc

SEQ ID NO: 69280 - RNA, 20 nt, Human
acaagagcgaaacuccaucu

SEQ ID NO: 69281 - RNA, 21 nt, Human
acaagagcgaaacuccaucuc

SEQ ID NO: 69282 - RNA, 18 nt, Human
accaagauggcgacugug

SEQ ID NO: 69283 - RNA, 22 nt, Human
accauugcacuccagccugggc

SEQ ID NO: 69284 - RNA, 18 nt, Human
acuuccagucccgcauuu

SEQ ID NO: 69285 - RNA, 19 nt, Human
agaaaguaugagagaucaa

SEQ ID NO: 69286 - RNA, 24 nt, Human
agaaguuggugggaaaggcgagug

SEQ ID NO: 69287 - RNA, 25 nt, Human
agacagggagaaaguaugagagauc

SEQ ID NO: 69288 - RNA, 18 nt, Human
agagauggggugggagga

SEQ ID NO: 69289 - RNA, 19 nt, Human
agaggaggagaagaccugc

SEQ ID NO: 69290 - RNA, 22 nt, Human
agcaaagagggaaaaggccaca

SEQ ID NO: 69291 - RNA, 20 nt, Human
agcccagcucccugucugac

SEQ ID NO: 69292 - RNA, 23 nt, Human
agccgggcaugguggcacaugcc

SEQ ID NO: 69293 - RNA, 24 nt, Human
aggaagaaacugaaggccaggcgc

SEQ ID NO: 69294 - RNA, 28 nt, Human
aggaaggaguuagugauuaacuaagggg

SEQ ID NO: 69295 - RNA, 18 nt, Human
aggagagagauggggugg

SEQ ID NO: 69296 - RNA, 20 nt, Human
aggaggagaagaccugccca

SEQ ID NO: 69297 - RNA, 23 nt, Human
aggauauucugggaaggcgaaug

SEQ ID NO: 69298 - RNA, 18 nt, Human
aggcagguggaucaccug

SEQ ID NO: 69299 - RNA, 22 nt, Human
aggcagguggaucaccugaggg

SEQ ID NO: 69300 - RNA, 22 nt, Human
aggcagguggaucaccugaggu

SEQ ID NO: 69301 - RNA, 21 nt, Human
aggccgaggcagguggaucac

SEQ ID NO: 69302 - RNA, 24 nt, Human
aggcgcgguggcucacgccuguaa

SEQ ID NO: 69303 - RNA, 22 nt, Human
aggcgggagaaucgcuugaacc

SEQ ID NO: 69304 - RNA, 24 nt, Human
aggcgggagaaucgcuugaaccug

SEQ ID NO: 69305 - RNA, 23 nt, Human
agggaauagggauggagaggagg

SEQ ID NO: 69306 - RNA, 20 nt, Human
agggagccauccauaaaaac

SEQ ID NO: 69307 - RNA, 24 nt, Human
augcaaaaaaaaaaaaaaaaagaa

SEQ ID NO: 69308 - RNA, 24 nt, Human
augcggaaguugcagugagcugag

SEQ ID NO: 69309 - RNA, 21 nt, Human
auggaaggagggagugccaca

SEQ ID NO: 69310 - RNA, 20 nt, Human
auucagaggcuagauuugga

SEQ ID NO: 69311 - RNA, 24 nt, Human
auugcaccauugcacuccagccug

SEQ ID NO: 69312 - RNA, 28 nt, Human
auugcaccauugcacuccagccugggca

SEQ ID NO: 69313 - RNA, 24 nt, Human
auugcacuccagccugggcaacaa

SEQ ID NO: 69314 - RNA, 25 nt, Human
auugcacuccagccugggcaacaag

SEQ ID NO: 69315 - RNA, 23 nt, Human
caaagccagccgauguuuccaag

SEQ ID NO: 69316 - RNA, 21 nt, Human
caacacaggccucacuuccag

SEQ ID NO: 69317 - RNA, 24 nt, Human
caacacuuugggaggccgaggcag

SEQ ID NO: 69318 - RNA, 25 nt, Human
caacacuuugggaggccgaggcagg

SEQ ID NO: 69319 - RNA, 18 nt, Human
caaccccgccccucuggg

SEQ ID NO: 69320 - RNA, 21 nt, Human
caccagagggugagaagcaga

SEQ ID NO: 69321 - RNA, 24 nt, Human
cacgccuguaaucccaacacuuug

SEQ ID NO: 69322 - RNA, 24 nt, Human
cacuccagccugggcaacaagagc

SEQ ID NO: 69323 - RNA, 25 nt, Human
cacuccagccugggcaacaagagcg

SEQ ID NO: 69324 - RNA, 23 nt, Human
cagcaaagagggaaaaggccaca

SEQ ID NO: 69325 - RNA, 24 nt, Human
cagccuaggucaaccccgccccuc

SEQ ID NO: 69326 - RNA, 18 nt, Human
cagcucacagagucacca

SEQ ID NO: 69327 - RNA, 24 nt, Human
cagguggaucaccugaggucggga

SEQ ID NO: 69328 - RNA, 23 nt, Human
caucucaaaaaaacaaagaaaga

SEQ ID NO: 69329 - RNA, 20 nt, Human
cauucaucucuggaagcaaa

SEQ ID NO: 69330 - RNA, 19 nt, Human
cauugcacuccagccuggg

SEQ ID NO: 69331 - RNA, 21 nt, Human
cauugcacuccagccugggca

SEQ ID NO: 69332 - RNA, 25 nt, Human
cauugcacuccagccugggcaacaa

SEQ ID NO: 69333 - RNA, 21 nt, Human
ccaacaaggagaaacccccau

SEQ ID NO: 69334 - RNA, 23 nt, Human
ccagagcucccugggaaguggaa

SEQ ID NO: 69335 - RNA, 18 nt, Human
ccauaaaaacaaagugga

SEQ ID NO: 69336 - RNA, 19 nt, Human
ccauccauaaaaacaaagu

SEQ ID NO: 69337 - RNA, 18 nt, Human
ccaucuuagcccagcucc

SEQ ID NO: 69338 - RNA, 20 nt, Human
ccauugcacuccagccuggg

SEQ ID NO: 69339 - RNA, 21 nt, Human
ccauugcacuccagccugggc

SEQ ID NO: 69340 - RNA, 23 nt, Human
ccauugcacuccagccugggcaa

SEQ ID NO: 69341 - RNA, 24 nt, Human
ccauugcacuccagccugggcaac

SEQ ID NO: 69342 - RNA, 25 nt, Human
ccauugcacuccagccugggcaaca

SEQ ID NO: 69343 - RNA, 24 nt, Human
cccagcuacucgggaaccugaggc

SEQ ID NO: 69344 - RNA, 18 nt, Human
ccccucuggguagcagcu

SEQ ID NO: 69345 - RNA, 18 nt, Human
ccgccccucccccagagc

SEQ ID NO: 69346 - RNA, 19 nt, Human
ccugaggcgggagaaucgc

SEQ ID NO: 69347 - RNA, 22 nt, Human
ccugaggucgggaguucgagac

SEQ ID NO: 69348 - RNA, 22 nt, Human
ccuguaaucccaacacuuuggg

SEQ ID NO: 69349 - RNA, 21 nt, Human
ccuguagucccagcuacucgg

SEQ ID NO: 69350 - RNA, 22 nt, Human
ccuguagucccagcuacucggg

SEQ ID NO: 69351 - RNA, 21 nt, Human
cgagaccagccugaccaacaa

SEQ ID NO: 69352 - RNA, 20 nt, Human
cgaggcagguggaucaccug

SEQ ID NO: 69353 - RNA, 19 nt, Human
cuacuaaaaaaugcaaaaa

SEQ ID NO: 69354 - RNA, 22 nt, Human
cucacgccuguaaucccaacac

SEQ ID NO: 69355 - RNA, 24 nt, Human
cucacgccuguaaucccaacacuu

SEQ ID NO: 69356 - RNA, 22 nt, Human
cucccccagagcucccugggaa

SEQ ID NO: 69357 - RNA, 25 nt, Human
cucuacuaaaaaaugcaaaaaaaaa

SEQ ID NO: 69358 - RNA, 19 nt, Human
cugaccaacaaggagaaac

SEQ ID NO: 69359 - RNA, 18 nt, Human
cuuagcccagcucccugu

SEQ ID NO: 69360 - RNA, 24 nt, Human
gaaggccaggcgcgguggcucacg

SEQ ID NO: 69361 - RNA, 19 nt, Human
gaagucgggggcugcuaga

SEQ ID NO: 69362 - RNA, 23 nt, Human
gaaguugcagugagcugagauug

SEQ ID NO: 69363 - RNA, 22 nt, Human
gaauagucccaaagccagccga

SEQ ID NO: 69364 - RNA, 19 nt, Human
gaauggaaggagggagugc

SEQ ID NO: 69365 - RNA, 22 nt, Human
gacugaucugagguugggagaa

SEQ ID NO: 69366 - RNA, 22 nt, Human
gacugcgugugcacguuugugu

SEQ ID NO: 69367 - RNA, 22 nt, Human
gagaaacccccaucucuacuaa

SEQ ID NO: 69368 - RNA, 20 nt, Human
gagauggggugggaggaagg

SEQ ID NO: 69369 - RNA, 23 nt, Human
gagauugcaccauugcacuccag

SEQ ID NO: 69370 - RNA, 19 nt, Human
gaggagaagaccugcccag

SEQ ID NO: 69371 - RNA, 22 nt, Human
gaggaggagaagaccugcccag

SEQ ID NO: 69372 - RNA, 23 nt, Human
gaggcagguggaucaccugaggu

SEQ ID NO: 69373 - RNA, 23 nt, Human
gagggaauagggauggagaggag

SEQ ID NO: 69374 - RNA, 18 nt, Human
gagggagggaucaggcag

SEQ ID NO: 69375 - RNA, 18 nt, Human
gaguuagugauuaguuga

SEQ ID NO: 69376 - RNA, 24 nt, Human
gaucaccugaggucgggaguucga

SEQ ID NO: 69377 - RNA, 20 nt, Human
gaucaggcagggucagggac

SEQ ID NO: 69378 - RNA, 23 nt, Human
gaucugggcucaggggaaggagg

SEQ ID NO: 69379 - RNA, 18 nt, Human
gcggaaguugcagugagc

SEQ ID NO: 69380 - RNA, 20 nt, Human
gcggaaguugcagugagcug

SEQ ID NO: 69381 - RNA, 22 nt, Human
gcggaaguugcagugagcugag

SEQ ID NO: 69382 - RNA, 23 nt, Human
gcgugugcacguuugugugugug

SEQ ID NO: 69383 - RNA, 22 nt, Human
ggaaaaggaugugaggcucaga

SEQ ID NO: 69384 - RNA, 20 nt, Human
ggaaggagggagugccacau

SEQ ID NO: 69385 - RNA, 22 nt, Human
ggaagggagccauccauaaaaa

SEQ ID NO: 69386 - RNA, 18 nt, Human
ggaaguugcagugagcug

SEQ ID NO: 69387 - RNA, 22 nt, Human
ggaaguugcagugagcugagau

SEQ ID NO: 69388 - RNA, 24 nt, Human
ggaaguugcagugagcugagauug

SEQ ID NO: 69389 - RNA, 18 nt, Human
ggcgagugacggaaccgc

SEQ ID NO: 69390 - RNA, 19 nt, Human
ggcgcggggcgaguccggg

SEQ ID NO: 69391 - RNA, 24 nt, Human
ggugacagaacggccuaggaagaa

SEQ ID NO: 69392 - RNA, 23 nt, Human
gguggcucacgccuguaauccca

SEQ ID NO: 69393 - RNA, 21 nt, Human
guaggugggugggugggucag

SEQ ID NO: 69394 - RNA, 22 nt, Human
guggcucacgccuguaauccca

SEQ ID NO: 69395 - RNA, 19 nt, Human
gugggaaaggcgagugacg

SEQ ID NO: 69396 - RNA, 22 nt, Human
guguagguggguggguggguca

SEQ ID NO: 69397 - RNA, 19 nt, Human
guugcagugagcugagauu

SEQ ID NO: 69398 - RNA, 27 nt, Human
uaaaagaagccagagaaaggauggugg

SEQ ID NO: 69399 - RNA, 24 nt, Human
uagcccagcucccugucugacuga

SEQ ID NO: 69400 - RNA, 24 nt, Human
uaggaagaaacugaaggccaggcg

SEQ ID NO: 69401 - RNA, 21 nt, Human
uaggugggugggugggucagu

SEQ ID NO: 69402 - RNA, 24 nt, Human
ucaggaagggucaacacaggccuc

SEQ ID NO: 69403 - RNA, 23 nt, Human
ucccugggaaguggaacuugaag

SEQ ID NO: 69404 - RNA, 26 nt, Human
uccucaauuacaaaggggugcauuuc

SEQ ID NO: 69405 - RNA, 21 nt, Human
ucgcuugaaccugggaugcgg

SEQ ID NO: 69406 - RNA, 25 nt, Human
ucgcuugaaccugggaugcggaagu

SEQ ID NO: 69407 - RNA, 24 nt, Human
ugaagagauggagccaagacauuc

SEQ ID NO: 69408 - RNA, 19 nt, Human
ugagaagcagaacgugcca

SEQ ID NO: 69409 - RNA, 20 nt, Human
ugagaagucaaggaaaagga

SEQ ID NO: 69410 - RNA, 24 nt, Human
ugaggcgggagaaucgcuugaacc

SEQ ID NO: 69411 - RNA, 19 nt, Human
ugcaaaaaaaaaaaaaaaa

SEQ ID NO: 69412 - RNA, 21 nt, Human
ugcaccauugcacuccagccu

SEQ ID NO: 69413 - RNA, 19 nt, Human
ugcacuccagccugggcaa

SEQ ID NO: 69414 - RNA, 21 nt, Human
ugcagaggaaaaggaaggagu

SEQ ID NO: 69415 - RNA, 23 nt, Human
ugccuguagucccagcuacucgg

SEQ ID NO: 69416 - RNA, 24 nt, Human
ugccuguagucccagcuacucggg

SEQ ID NO: 69417 - RNA, 21 nt, Human
ugcggaaguugcagugagcug

SEQ ID NO: 69418 - RNA, 21 nt, Human
ugcgugugcacguuugugugu

SEQ ID NO: 69419 - RNA, 27 nt, Human
ugcgugugcacguuugugugugugugu

SEQ ID NO: 69420 - RNA, 27 nt, Human
ugcgugugcacguuugugugugugugu

SEQ ID NO: 69421 - RNA, 28 nt, Human
ugcgugugcacguuugugugugugugug

SEQ ID NO: 69422 - RNA, 19 nt, Human
ugcugaagucgggggcugc

SEQ ID NO: 69423 - RNA, 24 nt, Human
uggaucaccugaggucgggaguuc

SEQ ID NO: 69424 - RNA, 24 nt, Human
uggccgccccucccccagagcucc

SEQ ID NO: 69425 - RNA, 21 nt, Human
uggcucacgccuguaauccca

SEQ ID NO: 69426 - RNA, 24 nt, Human
uggcucacgccuguaaucccaaca

SEQ ID NO: 69427 - RNA, 21 nt, Human
ugggaaaggcgagugacggaa

SEQ ID NO: 69428 - RNA, 22 nt, Human
ugggagaaguuggugggaaagg

SEQ ID NO: 69429 - RNA, 23 nt, Human
ugggagaaguuggugggaaaggc

SEQ ID NO: 69430 - RNA, 24 nt, Human
ugggaggccgaggcagguggauca

SEQ ID NO: 69431 - RNA, 20 nt, Human
ugggcucaggggaaggaggu

SEQ ID NO: 69432 - RNA, 19 nt, Human
uggggugggaggaaggggc

SEQ ID NO: 69433 - RNA, 20 nt, Human
uggggugggaggaaggggcc

SEQ ID NO: 69434 - RNA, 19 nt, Human
uggggugggugagggaggg

SEQ ID NO: 69435 - RNA, 24 nt, Human
ugguggcacaugccuguaguccca

SEQ ID NO: 69436 - RNA, 21 nt, Human
uguagguggguggguggguca

SEQ ID NO: 69437 - RNA, 18 nt, Human
uuagccgggcaugguggc

SEQ ID NO: 69438 - RNA, 22 nt, Human
uucaucucuggaagcaaagggg

SEQ ID NO: 69439 - RNA, 18 nt, Human
uugagaagucaaggaaaa

SEQ ID NO: 69440 - RNA, 23 nt, Human
uugcaccauugcacuccagccug

SEQ ID NO: 69441 - RNA, 19 nt, Human
uugcagugagcugagauug

SEQ ID NO: 69442 - RNA, 20 nt, Human
uugcagugagcugagauugc

SEQ ID NO: 69443 - RNA, 22 nt, Human
uugcagugagcugagauugcac

SEQ ID NO: 69444 - RNA, 25 nt, Human
uugggaggccgaggcagguggauca

SEQ ID NO: 69445 - RNA, 24 nt, Human
uuguguguguguguggcggggggu

SEQ ID NO: 69446 - RNA, 24 nt, Human
aagcaguaacaagauauuucacaa

SEQ ID NO: 69447 - RNA, 26 nt, Human
acacaacauuuacucuguggagauau

SEQ ID NO: 69448 - RNA, 20 nt, Human
acucuguggagauauccuac

SEQ ID NO: 69449 - RNA, 22 nt, Human
agaacuucuccacauaccacau

SEQ ID NO: 69450 - RNA, 21 nt, Human
agacacuuggcaauuaaacca

SEQ ID NO: 69451 - RNA, 22 nt, Human
agacagacaacacaacauuuac

SEQ ID NO: 69452 - RNA, 24 nt, Human
agccuaaaauaagaggcaguucca

SEQ ID NO: 69453 - RNA, 20 nt, Human
caacacaacauuuacucugu

SEQ ID NO: 69454 - RNA, 21 nt, Human
caacacuaaaaauuaauccca

SEQ ID NO: 69455 - RNA, 22 nt, Human
cacauaaaaagaggacaagacc

SEQ ID NO: 69456 - RNA, 19 nt, Human
cacugguucaaagggcagc

SEQ ID NO: 69457 - RNA, 22 nt, Human
cauaaaaagaggacaagacccc

SEQ ID NO: 69458 - RNA, 24 nt, Human
cauaaaaagaggacaagaccccca

SEQ ID NO: 69459 - RNA, 25 nt, Human
ccacauaaaaagaggacaagacccc

SEQ ID NO: 69460 - RNA, 18 nt, Human
cccccauccuacauguuu

SEQ ID NO: 69461 - RNA, 22 nt, Human
ggguaccauuuuaucccuaaaa

SEQ ID NO: 69462 - RNA, 23 nt, Human
uaaaaagaggacaagacccccau

SEQ ID NO: 69463 - RNA, 22 nt, Human
uaacaagauauuucacaaacua

SEQ ID NO: 69464 - RNA, 25 nt, Human
uaacaagauauuucacaaacuauug

SEQ ID NO: 69465 - RNA, 19 nt, Human
uaacccaaugucauguacc

SEQ ID NO: 69466 - RNA, 25 nt, Human
uaagucuuaugaauuuaaucucaua

SEQ ID NO: 69467 - RNA, 25 nt, Human
uacagccuaaaauaagaggcaguuc

SEQ ID NO: 69468 - RNA, 23 nt, Human
uaucccuaaaacucuguugacau

SEQ ID NO: 69469 - RNA, 18 nt, Human
uauuacaguccacagucu

SEQ ID NO: 69470 - RNA, 19 nt, Human
ucaaagggcagcagaggca

SEQ ID NO: 69471 - RNA, 22 nt, Human
ucacauacagaacuucuccaca

SEQ ID NO: 69472 - RNA, 20 nt, Human
ucacuugauguuggccgggu

SEQ ID NO: 69473 - RNA, 23 nt, Human
ucccaguuuuuuuuuuuacaugu

SEQ ID NO: 69474 - RNA, 24 nt, Human
ucugcuaaauaaaagcaguaacaa

SEQ ID NO: 69475 - RNA, 18 nt, Human
ugacaucaaaauaugaca

SEQ ID NO: 69476 - RNA, 23 nt, Human
uggaaucagguguucaccggucc

SEQ ID NO: 69477 - RNA, 19 nt, Human
uggcuaaccuaaaaaugcu

SEQ ID NO: 69478 - RNA, 22 nt, Human
uuagacacuuggcaauuaaacc

SEQ ID NO: 69479 - RNA, 22 nt, Human
aaagaaaccaaacuucucugga

SEQ ID NO: 69480 - RNA, 18 nt, Human
aagcuaacaaccccauug

SEQ ID NO: 69481 - RNA, 21 nt, Human
acgcucauuguuaccagcaca

SEQ ID NO: 69482 - RNA, 19 nt, Human
agcaaagaaaccaaacuuc

SEQ ID NO: 69483 - RNA, 23 nt, Human
auuacaauugaauacuguacauu

SEQ ID NO: 69484 - RNA, 19 nt, Human
cacacucagaaaauaacug

SEQ ID NO: 69485 - RNA, 18 nt, Human
cacagaaagaaacaaacu

SEQ ID NO: 69486 - RNA, 23 nt, Human
cagaaagaaacaaacugaucucu

SEQ ID NO: 69487 - RNA, 25 nt, Human
cagcaaagaaaccaaacuucucugg

SEQ ID NO: 69488 - RNA, 21 nt, Human
caucugucuacugcuucugau

SEQ ID NO: 69489 - RNA, 21 nt, Human
caugcacgcaaccgaacaccc

SEQ ID NO: 69490 - RNA, 19 nt, Human
cauuuuauuaagauaaaug

SEQ ID NO: 69491 - RNA, 18 nt, Human
ccagcacagaaagaaaca

SEQ ID NO: 69492 - RNA, 22 nt, Human
ccuacauuuuaaccauucaaca

SEQ ID NO: 69493 - RNA, 30 nt, Human
cgcaaccgaacacccuuacauuucugcaag

SEQ ID NO: 69494 - RNA, 23 nt, Human
cugaaaaugaacuggaggccuac

SEQ ID NO: 69495 - RNA, 21 nt, Human
cuugcagcaaagaaaccaaac

SEQ ID NO: 69496 - RNA, 20 nt, Human
gcaaaaugguuuaggaagcg

SEQ ID NO: 69497 - RNA, 27 nt, Human
gcagcaaagaaaccaaacuucucugga

SEQ ID NO: 69498 - RNA, 19 nt, Human
guuacagagccucauuccu

SEQ ID NO: 69499 - RNA, 20 nt, Human
guuacagagccucauuccuu

SEQ ID NO: 69500 - RNA, 22 nt, Human
guuccaaugucacuggagaggg

SEQ ID NO: 69501 - RNA, 20 nt, Human
uaacaaccccauugguaaua

SEQ ID NO: 69502 - RNA, 18 nt, Human
uaacacaaagugaguugg

SEQ ID NO: 69503 - RNA, 19 nt, Human
uaagauaaaugcaucacaa

SEQ ID NO: 69504 - RNA, 19 nt, Human
ucacaauauuuguauugca

SEQ ID NO: 69505 - RNA, 23 nt, Human
ucacuggagagggaucuggcuac

SEQ ID NO: 69506 - RNA, 21 nt, Human
ucagaaaauaacugaaaauga

SEQ ID NO: 69507 - RNA, 24 nt, Human
ucugcaaaaugguuuaggaagcgg

SEQ ID NO: 69508 - RNA, 23 nt, Human
ucuggagaggcuuucugauuaag

SEQ ID NO: 69509 - RNA, 21 nt, Human
ugaaaaugaacuggaggccua

SEQ ID NO: 69510 - RNA, 21 nt, Human
ugcacacucagaaaauaacug

SEQ ID NO: 69511 - RNA, 22 nt, Human
ugcacacucagaaaauaacuga

SEQ ID NO: 69512 - RNA, 22 nt, Human
ugcacaggguugguagaugugu

SEQ ID NO: 69513 - RNA, 20 nt, Human
ugcgcagugauaaauugaca

SEQ ID NO: 69514 - RNA, 26 nt, Human
uguguugcuaaaaacgcacaugcacg

SEQ ID NO: 69515 - RNA, 20 nt, Human
uuaaaagcuaacaaccccau

SEQ ID NO: 69516 - RNA, 18 nt, Human
aagcccaccaggcucaga

SEQ ID NO: 69517 - RNA, 19 nt, Human
aaucucugcaggcaccaga

SEQ ID NO: 69518 - RNA, 21 nt, Human
accagacucccugccuccccc

SEQ ID NO: 69519 - RNA, 23 nt, Human
acccggugggcaagugggcgagu

SEQ ID NO: 69520 - RNA, 19 nt, Human
agaaggaaguggggacaga

SEQ ID NO: 69521 - RNA, 22 nt, Human
agaccucccaggccaggacccu

SEQ ID NO: 69522 - RNA, 24 nt, Human
agagaccccaggacggggcccggg

SEQ ID NO: 69523 - RNA, 20 nt, Human
agagggaggaggggugaggc

SEQ ID NO: 69524 - RNA, 18 nt, Human
agaguccaggagacagga

SEQ ID NO: 69525 - RNA, 23 nt, Human
agcagggaacuucccaggagagu

SEQ ID NO: 69526 - RNA, 18 nt, Human
agcugcagagcagggaac

SEQ ID NO: 69527 - RNA, 23 nt, Human
aggccagaaggaaguggggacag

SEQ ID NO: 69528 - RNA, 20 nt, Human
aggcguaggggagggggccg

SEQ ID NO: 69529 - RNA, 19 nt, Human
aggcucagaggcccccagc

SEQ ID NO: 69530 - RNA, 20 nt, Human
agggagggagggagagcggg

SEQ ID NO: 69531 - RNA, 21 nt, Human
agggagggagggagagcgggu

SEQ ID NO: 69532 - RNA, 18 nt, Human
aggggccaagacauaggg

SEQ ID NO: 69533 - RNA, 22 nt, Human
aggucagagccgguaagaagga

SEQ ID NO: 69534 - RNA, 21 nt, Human
aguccaggaggcgcgcggggc

SEQ ID NO: 69535 - RNA, 18 nt, Human
augcugccagcuccggcu

SEQ ID NO: 69536 - RNA, 19 nt, Human
caaguuggaccucugcgug

SEQ ID NO: 69537 - RNA, 19 nt, Human
caccaggcucagaggcccc

SEQ ID NO: 69538 - RNA, 18 nt, Human
caccggagacuccacccu

SEQ ID NO: 69539 - RNA, 19 nt, Human
cagagaaucucugcaggca

SEQ ID NO: 69540 - RNA, 21 nt, Human
cagagccgguaagaaggaccc

SEQ ID NO: 69541 - RNA, 20 nt, Human
caggaaccugaggaugucgg

SEQ ID NO: 69542 - RNA, 26 nt, Human
caggacggggcccggggauggccauu

SEQ ID NO: 69543 - RNA, 22 nt, Human
cagguuucugcuaccccucgcu

SEQ ID NO: 69544 - RNA, 30 nt, Human
ccaccaggcucagaggcccccagcugugcu

SEQ ID NO: 69545 - RNA, 21 nt, Human
ccaggccagaaggaagugggg

SEQ ID NO: 69546 - RNA, 20 nt, Human
ccaucagaggccaucuuccu

SEQ ID NO: 69547 - RNA, 23 nt, Human
cccaccaggcucagaggccccca

SEQ ID NO: 69548 - RNA, 23 nt, Human
ccccaggaaagaagcagagaauc

SEQ ID NO: 69549 - RNA, 21 nt, Human
cccccagggcugacccagucc

SEQ ID NO: 69550 - RNA, 24 nt, Human
cccccagggcugacccagucccag

SEQ ID NO: 69551 - RNA, 23 nt, Human
cccccagucacacaaccuuuauu

SEQ ID NO: 69552 - RNA, 18 nt, Human
ccggggauggccauucug

SEQ ID NO: 69553 - RNA, 21 nt, Human
ccucccagccugcagcuccug

SEQ ID NO: 69554 - RNA, 24 nt, Human
ccucccagccugcagcuccugggc

SEQ ID NO: 69555 - RNA, 22 nt, Human
ccuccccaccuccccccaggaa

SEQ ID NO: 69556 - RNA, 21 nt, Human
ccugcuaagaccuccccaccu

SEQ ID NO: 69557 - RNA, 25 nt, Human
ccugcuaagaccuccccaccucccc

SEQ ID NO: 69558 - RNA, 26 nt, Human
ccugcuaagaccuccccaccuccccc

SEQ ID NO: 69559 - RNA, 21 nt, Human
ccugggccagagcugcagagc

SEQ ID NO: 69560 - RNA, 21 nt, Human
ccuuggugcagguuucugcua

SEQ ID NO: 69561 - RNA, 24 nt, Human
cucaugggugucguggggaggggg

SEQ ID NO: 69562 - RNA, 22 nt, Human
cucccaggccagaaggaagugg

SEQ ID NO: 69563 - RNA, 19 nt, Human
cuccugcuaagaccucccc

SEQ ID NO: 69564 - RNA, 19 nt, Human
cucgcuccgcccuccugcc

SEQ ID NO: 69565 - RNA, 25 nt, Human
cugacccagucccagaccaggcacg

SEQ ID NO: 69566 - RNA, 24 nt, Human
cugggcccagauggccccuucuga

SEQ ID NO: 69567 - RNA, 24 nt, Human
gaacguccagcuuccgaacaaggg

SEQ ID NO: 69568 - RNA, 19 nt, Human
gaagcagaguggaguggag

SEQ ID NO: 69569 - RNA, 23 nt, Human
gacccagucccagaccaggcacg

SEQ ID NO: 69570 - RNA, 24 nt, Human
gacuuuguggaagcagaguggagu

SEQ ID NO: 69571 - RNA, 18 nt, Human
gagagcgggugcccuugg

SEQ ID NO: 69572 - RNA, 23 nt, Human
gaugugggggacuaggaaaggga

SEQ ID NO: 69573 - RNA, 23 nt, Human
gcaaggagugaggccaagagucc

SEQ ID NO: 69574 - RNA, 18 nt, Human
gcacauauaaacagaagc

SEQ ID NO: 69575 - RNA, 19 nt, Human
gcagaguggaguggagggg

SEQ ID NO: 69576 - RNA, 23 nt, Human
gcagguuucugcuaccccucgcu

SEQ ID NO: 69577 - RNA, 24 nt, Human
gccaaaguagcaaaagcugaguua

SEQ ID NO: 69578 - RNA, 21 nt, Human
gcuaagaccuccccaccuccc

SEQ ID NO: 69579 - RNA, 22 nt, Human
gcucaggacggggaacccugag

SEQ ID NO: 69580 - RNA, 22 nt, Human
gcugaggcaguccagccaggcu

SEQ ID NO: 69581 - RNA, 27 nt, Human
ggaggaggggugaggcguaggggaggg

SEQ ID NO: 69582 - RNA, 21 nt, Human
ggaggcgaacacaugggcacc

SEQ ID NO: 69583 - RNA, 18 nt, Human
ggcaaguuggaccucugc

SEQ ID NO: 69584 - RNA, 19 nt, Human
ggcuggguagaagggcgcc

SEQ ID NO: 69585 - RNA, 18 nt, Human
ggcuucuuggcugccccc

SEQ ID NO: 69586 - RNA, 19 nt, Human
gggacagagaccccaggac

SEQ ID NO: 69587 - RNA, 24 nt, Human
gggccagagcugcagagcagggaa

SEQ ID NO: 69588 - RNA, 24 nt, Human
ggggagggggcaaggagugaggcc

SEQ ID NO: 69589 - RNA, 23 nt, Human
gggggugggggggccccggaucu

SEQ ID NO: 69590 - RNA, 20 nt, Human
gggugggggggccccggauc

SEQ ID NO: 69591 - RNA, 19 nt, Human
gguggcaaggguggggggc

SEQ ID NO: 69592 - RNA, 18 nt, Human
guagaagggcgccacggu

SEQ ID NO: 69593 - RNA, 19 nt, Human
guccaggaggcgcgcgggg

SEQ ID NO: 69594 - RNA, 21 nt, Human
gugagagggaggaggggugag

SEQ ID NO: 69595 - RNA, 21 nt, Human
gugguggcaaggguggggggc

SEQ ID NO: 69596 - RNA, 18 nt, Human
uaaaaucaucagucugca

SEQ ID NO: 69597 - RNA, 21 nt, Human
uaagaccuccccaccuccccc

SEQ ID NO: 69598 - RNA, 22 nt, Human
uaagaccuccccaccucccccc

SEQ ID NO: 69599 - RNA, 22 nt, Human
uaggaaagggaugugagucuug

SEQ ID NO: 69600 - RNA, 23 nt, Human
uaggaggggccaagacauaggga

SEQ ID NO: 69601 - RNA, 23 nt, Human
ucaccaagugaacguccagcuuu

SEQ ID NO: 69602 - RNA, 21 nt, Human
ucccagccugcagcuccuggg

SEQ ID NO: 69603 - RNA, 23 nt, Human
ucccagccugcagcuccugggcc

SEQ ID NO: 69604 - RNA, 20 nt, Human
ucccugccucccccacugcg

SEQ ID NO: 69605 - RNA, 21 nt, Human
uccuccgucagugcagaggca

SEQ ID NO: 69606 - RNA, 19 nt, Human
uccugcuaagaccucccca

SEQ ID NO: 69607 - RNA, 21 nt, Human
uccugcuaagaccuccccacc

SEQ ID NO: 69608 - RNA, 19 nt, Human
uccugggccagagcugcag

SEQ ID NO: 69609 - RNA, 18 nt, Human
uccuuggugcagguuucu

SEQ ID NO: 69610 - RNA, 25 nt, Human
ucgcuccgcccuccugccggcuccu

SEQ ID NO: 69611 - RNA, 21 nt, Human
ucgugauuugggggugggggg

SEQ ID NO: 69612 - RNA, 27 nt, Human
ucucuggguaugcugccagccgacuuc

SEQ ID NO: 69613 - RNA, 28 nt, Human
ucucuggguaugcugccagccgacuuuc

SEQ ID NO: 69614 - RNA, 22 nt, Human
ucucuggguaugcugccagcuc

SEQ ID NO: 69615 - RNA, 18 nt, Human
ucugcacacgcucuagga

SEQ ID NO: 69616 - RNA, 21 nt, Human
ugacccagucccagaccaggc

SEQ ID NO: 69617 - RNA, 21 nt, Human
ugacucugaacaucucccgag

SEQ ID NO: 69618 - RNA, 22 nt, Human
ugaucccccagggcugacccag

SEQ ID NO: 69619 - RNA, 19 nt, Human
ugcacauauaaacagaagc

SEQ ID NO: 69620 - RNA, 22 nt, Human
ugcagacagcgcggcggccgca

SEQ ID NO: 69621 - RNA, 18 nt, Human
ugcccuuggggaaucagc

SEQ ID NO: 69622 - RNA, 18 nt, Human
uggaagcagaguggagug

SEQ ID NO: 69623 - RNA, 22 nt, Human
uggaagcagaguggaguggagg

SEQ ID NO: 69624 - RNA, 24 nt, Human
uggaagcagaguggaguggagggg

SEQ ID NO: 69625 - RNA, 18 nt, Human
uggcaaggguggggggcg

SEQ ID NO: 69626 - RNA, 19 nt, Human
uggcaaguuggaccucugc

SEQ ID NO: 69627 - RNA, 19 nt, Human
uggcaaguuggaccucugc

SEQ ID NO: 69628 - RNA, 19 nt, Human
ugggcuggguagaagggcg

SEQ ID NO: 69629 - RNA, 18 nt, Human
uggggagggggcaaggag

SEQ ID NO: 69630 - RNA, 23 nt, Human
uggggagggggcaaggagugagg

SEQ ID NO: 69631 - RNA, 23 nt, Human
uggggggcggaggcgaacacaug

SEQ ID NO: 69632 - RNA, 26 nt, Human
uguggaagcagaguggaguggagggg

SEQ ID NO: 69633 - RNA, 22 nt, Human
ugugguggcaaggguggggggc

SEQ ID NO: 69634 - RNA, 22 nt, Human
uguguccgucucucugacccuu

SEQ ID NO: 69635 - RNA, 21 nt, Human
uugggggugggggggccccgg

SEQ ID NO: 69636 - RNA, 27 nt, Human
uuuacauauaaaaucaucagucugcag

SEQ ID NO: 69637 - RNA, 18 nt, Human
uuugggggugggggggcc

SEQ ID NO: 69638 - RNA, 23 nt, Human
aacaggaacaaaaaaaguaucua

SEQ ID NO: 69639 - RNA, 18 nt, Human
aagcagcaucagcagcaa

SEQ ID NO: 69640 - RNA, 23 nt, Human
acccucagucuggcagaaagcuu

SEQ ID NO: 69641 - RNA, 19 nt, Human
acuccucccucucucuccc

SEQ ID NO: 69642 - RNA, 20 nt, Human
acuccucccucucucuccca

SEQ ID NO: 69643 - RNA, 21 nt, Human
agcaguauuugaaggacuaau

SEQ ID NO: 69644 - RNA, 20 nt, Human
aggacugagauaaacuaaag

SEQ ID NO: 69645 - RNA, 26 nt, Human
aucuuucuuaaaccaaacacucauug

SEQ ID NO: 69646 - RNA, 24 nt, Human
caacagcagaaauuaaacuaucaa

SEQ ID NO: 69647 - RNA, 26 nt, Human
cagaaauuaaacuaucaauucaacga

SEQ ID NO: 69648 - RNA, 19 nt, Human
cagcagcaacauuucccag

SEQ ID NO: 69649 - RNA, 21 nt, Human
caguucauuucucccaccccc

SEQ ID NO: 69650 - RNA, 27 nt, Human
cccaguuuuacuccucccucucucucc

SEQ ID NO: 69651 - RNA, 23 nt, Human
cccccaaaaagcacccucagucu

SEQ ID NO: 69652 - RNA, 18 nt, Human
cccucucucucccaucca

SEQ ID NO: 69653 - RNA, 23 nt, Human
cuaaagcucugcuaauacacugu

SEQ ID NO: 69654 - RNA, 21 nt, Human
cucccaccccccaaaaagcac

SEQ ID NO: 69655 - RNA, 20 nt, Human
cugaguuacuguuuaucugu

SEQ ID NO: 69656 - RNA, 24 nt, Human
cuggcagaaagcuuugcuuuuuuu

SEQ ID NO: 69657 - RNA, 24 nt, Human
cuugcccaguuuuacuccucccuc

SEQ ID NO: 69658 - RNA, 24 nt, Human
guuuuacuccucccucucucuccc

SEQ ID NO: 69659 - RNA, 25 nt, Human
uaaguaugaaaaucuuucuuaaacc

SEQ ID NO: 69660 - RNA, 23 nt, Human
uaauccaaauuauuaacagccaa

SEQ ID NO: 69661 - RNA, 19 nt, Human
uaucagaaggaaaauguuu

SEQ ID NO: 69662 - RNA, 24 nt, Human
uaucagaaggaaaauguuucccaa

SEQ ID NO: 69663 - RNA, 30 nt, Human
uaugaacaggaacaaaaaaaguaucuacaa

SEQ ID NO: 69664 - RNA, 24 nt, Human
ucaguucauuucucccacccccca

SEQ ID NO: 69665 - RNA, 21 nt, Human
ucauuucucccaccccccaaa

SEQ ID NO: 69666 - RNA, 22 nt, Human
ucauuucucccaccccccaaaa

SEQ ID NO: 69667 - RNA, 21 nt, Human
uccacaggucacuuacgcuga

SEQ ID NO: 69668 - RNA, 24 nt, Human
uccaggacugagauaaacuaaagc

SEQ ID NO: 69669 - RNA, 20 nt, Human
ucccaucuaugaacaggaac

SEQ ID NO: 69670 - RNA, 24 nt, Human
uccucccucucucucccauccagg

SEQ ID NO: 69671 - RNA, 24 nt, Human
ucuacaaaccuuguaaacagaucu

SEQ ID NO: 69672 - RNA, 23 nt, Human
ugaacaggaacaaaaaaaguauc

SEQ ID NO: 69673 - RNA, 25 nt, Human
ugaacaggaacaaaaaaaguaucua

SEQ ID NO: 69674 - RNA, 20 nt, Human
ugagauaaacuaaagcucug

SEQ ID NO: 69675 - RNA, 22 nt, Human
uuacuccucccucucucuccca

SEQ ID NO: 69676 - RNA, 22 nt, Human
uucccaaaagaauuuaauuuuc

SEQ ID NO: 69677 - RNA, 27 nt, Human
uuuuacuccucccucucucucccaucc

SEQ ID NO: 69678 - RNA, 21 nt, Human
aaaaaccccuccccaaccccc

SEQ ID NO: 69679 - RNA, 25 nt, Human
aaaacaaacaaacaaacaaaaaccc

SEQ ID NO: 69680 - RNA, 21 nt, Human
aaacaaacaaaaaccccuccc

SEQ ID NO: 69681 - RNA, 27 nt, Human
aaacaaacaaacaaaaaccccucccca

SEQ ID NO: 69682 - RNA, 26 nt, Human
aaacaaacaaacaaacaaaaaccccu

SEQ ID NO: 69683 - RNA, 18 nt, Human
aaaccccuccccaacccc

SEQ ID NO: 69684 - RNA, 19 nt, Human
aaaccccuccccaaccccc

SEQ ID NO: 69685 - RNA, 18 nt, Human
aaaccugcgccggcuccg

SEQ ID NO: 69686 - RNA, 19 nt, Human
aaccccuccccaaccccca

SEQ ID NO: 69687 - RNA, 21 nt, Human
aaccccuccccaacccccaaa

SEQ ID NO: 69688 - RNA, 20 nt, Human
acaaacaaacaaacaaaaac

SEQ ID NO: 69689 - RNA, 22 nt, Human
acaaagaaauggauauaaccuu

SEQ ID NO: 69690 - RNA, 22 nt, Human
acaaggcaacaugccggcaaag

SEQ ID NO: 69691 - RNA, 23 nt, Human
accccuccccaacccccaaaaac

SEQ ID NO: 69692 - RNA, 23 nt, Human
acucccguaagcccccaguggag

SEQ ID NO: 69693 - RNA, 19 nt, Human
aggcgggcuggugacagug

SEQ ID NO: 69694 - RNA, 21 nt, Human
aggugucagggucuggaaacu

SEQ ID NO: 69695 - RNA, 19 nt, Human
agugguggugagcuccaag

SEQ ID NO: 69696 - RNA, 22 nt, Human
caaaaaccccuccccaaccccc

SEQ ID NO: 69697 - RNA, 19 nt, Human
caaacaaaaaccccucccc

SEQ ID NO: 69698 - RNA, 25 nt, Human
caaacaaaaaccccuccccaacccc

SEQ ID NO: 69699 - RNA, 27 nt, Human
caaacaaaaaccccuccccaaccccca

SEQ ID NO: 69700 - RNA, 22 nt, Human
caaacaaacaaaaaccccuccc

SEQ ID NO: 69701 - RNA, 30 nt, Human
caaacaaacaaacaaaaaccccuccccaag

SEQ ID NO: 69702 - RNA, 24 nt, Human
caaacaaggggaggauugaaagug

SEQ ID NO: 69703 - RNA, 24 nt, Human
caacugagaccaugcugugcaagc

SEQ ID NO: 69704 - RNA, 21 nt, Human
cacaguccacgcucuaaguac

SEQ ID NO: 69705 - RNA, 22 nt, Human
caccaggcggccgacuccgggu

SEQ ID NO: 69706 - RNA, 19 nt, Human
cagaccaguggauuggaua

SEQ ID NO: 69707 - RNA, 19 nt, Human
caugagggcgggcgggcag

SEQ ID NO: 69708 - RNA, 22 nt, Human
ccacgcucuaaguacagggaaa

SEQ ID NO: 69709 - RNA, 19 nt, Human
cccaugcugcucccuggaa

SEQ ID NO: 69710 - RNA, 21 nt, Human
ccccaacccccaaaaaccaaa

SEQ ID NO: 69711 - RNA, 23 nt, Human
cccccaaaaaccaaacaagggga

SEQ ID NO: 69712 - RNA, 21 nt, Human
ccccgcugcggcugcggcucc

SEQ ID NO: 69713 - RNA, 22 nt, Human
cccggcccggccccgcugcggc

SEQ ID NO: 69714 - RNA, 20 nt, Human
cccggcccggcccggccccc

SEQ ID NO: 69715 - RNA, 18 nt, Human
cccguaagcccccagugg

SEQ ID NO: 69716 - RNA, 18 nt, Human
ccgaggcgggcuggugac

SEQ ID NO: 69717 - RNA, 22 nt, Human
ccgccgccgcugccgcugccgc

SEQ ID NO: 69718 - RNA, 24 nt, Human
ccgccgcugccgcugccgcugccg

SEQ ID NO: 69719 - RNA, 18 nt, Human
ccgcucacucccguaagc

SEQ ID NO: 69720 - RNA, 21 nt, Human
ccgcugccgcugccgcugccg

SEQ ID NO: 69721 - RNA, 24 nt, Human
ccgcugccgcugccgcugccgcug

SEQ ID NO: 69722 - RNA, 21 nt, Human
ccgcugccgcugccgcuggug

SEQ ID NO: 69723 - RNA, 18 nt, Human
ccgcugccgcuggugcgc

SEQ ID NO: 69724 - RNA, 23 nt, Human
ccguaagcccccaguggagaucc

SEQ ID NO: 69725 - RNA, 18 nt, Human
ccuugaagugaaaaagag

SEQ ID NO: 69726 - RNA, 22 nt, Human
cgagagcgagaugcugccgccg

SEQ ID NO: 69727 - RNA, 19 nt, Human
cgagaugcugccgccgccg

SEQ ID NO: 69728 - RNA, 18 nt, Human
cgccccuugccuugaagu

SEQ ID NO: 69729 - RNA, 19 nt, Human
cgccggcuccgagagcgag

SEQ ID NO: 69730 - RNA, 23 nt, Human
cgccuaagaaaacaaacaaacaa

SEQ ID NO: 69731 - RNA, 24 nt, Human
cgccuaagaaaacaaacaaacaaa

SEQ ID NO: 69732 - RNA, 25 nt, Human
cgccuaagaaaacaaacaaacaaac

SEQ ID NO: 69733 - RNA, 22 nt, Human
cgcgcccggcccggcccggccc

SEQ ID NO: 69734 - RNA, 19 nt, Human
cggcccggccccgcugcgg

SEQ ID NO: 69735 - RNA, 18 nt, Human
cgggcuggugacaguggu

SEQ ID NO: 69736 - RNA, 24 nt, Human
cgggggacguggugacugggcggg

SEQ ID NO: 69737 - RNA, 23 nt, Human
cuaaguacagggaaaccugcgcc

SEQ ID NO: 69738 - RNA, 22 nt, Human
cuccccaacccccaaaaaccaa

SEQ ID NO: 69739 - RNA, 24 nt, Human
cucccguaagcccccaguggagau

SEQ ID NO: 69740 - RNA, 23 nt, Human
cucugcaauuucaaaaaguuauu

SEQ ID NO: 69741 - RNA, 19 nt, Human
cugccgcugccgcugccgc

SEQ ID NO: 69742 - RNA, 22 nt, Human
cugccgcugccgcugccgcugg

SEQ ID NO: 69743 - RNA, 23 nt, Human
cugggcccaagggucagcgcugg

SEQ ID NO: 69744 - RNA, 21 nt, Human
gccaggaagggcuuguuuugg

SEQ ID NO: 69745 - RNA, 22 nt, Human
gccgccgccgcugccgcugccg

SEQ ID NO: 69746 - RNA, 24 nt, Human
gccuaagaaaacaaacaaacaaac

SEQ ID NO: 69747 - RNA, 23 nt, Human
gcggccgacuccgggucccgggg

SEQ ID NO: 69748 - RNA, 20 nt, Human
gcucgggcugggcccaaggg

SEQ ID NO: 69749 - RNA, 20 nt, Human
gcugccgccgccgcugccgc

SEQ ID NO: 69750 - RNA, 18 nt, Human
gcugccgggugauggcug

SEQ ID NO: 69751 - RNA, 21 nt, Human
ggaaaaccgcucacucccgua

SEQ ID NO: 69752 - RNA, 19 nt, Human
ggcccaugucuugcuggcu

SEQ ID NO: 69753 - RNA, 22 nt, Human
ggcugccgggugauggcugcuc

SEQ ID NO: 69754 - RNA, 18 nt, Human
ggcugcggcuccucugcc

SEQ ID NO: 69755 - RNA, 19 nt, Human
ggggguggggguggccgag

SEQ ID NO: 69756 - RNA, 19 nt, Human
gggguggggguggccgagg

SEQ ID NO: 69757 - RNA, 21 nt, Human
ggucuguggguggaaacguug

SEQ ID NO: 69758 - RNA, 18 nt, Human
ggugacagugguggugag

SEQ ID NO: 69759 - RNA, 19 nt, Human
ggugauggcugcuuguggc

SEQ ID NO: 69760 - RNA, 20 nt, Human
ggugugggacgagguccagg

SEQ ID NO: 69761 - RNA, 18 nt, Human
guucuucgguuccauugg

SEQ ID NO: 69762 - RNA, 21 nt, Human
uaaaauagagcaauuuaagcg

SEQ ID NO: 69763 - RNA, 24 nt, Human
uaaauuaaucuauacaacugagac

SEQ ID NO: 69764 - RNA, 23 nt, Human
uaagaaaacaaacaaacaaacaa

SEQ ID NO: 69765 - RNA, 27 nt, Human
uaagaaaacaaacaaacaaacaaaaac

SEQ ID NO: 69766 - RNA, 24 nt, Human
uaagcccccaguggagaucccgcc

SEQ ID NO: 69767 - RNA, 26 nt, Human
uaagcccccaguggagaucccgcccc

SEQ ID NO: 69768 - RNA, 26 nt, Human
uaccuaucuauauggacguauacagu

SEQ ID NO: 69769 - RNA, 18 nt, Human
uauauauauauauauaua

SEQ ID NO: 69770 - RNA, 20 nt, Human
uauauauuuauauauauaua

SEQ ID NO: 69771 - RNA, 22 nt, Human
uauauuuauauauauauauaua

SEQ ID NO: 69772 - RNA, 21 nt, Human
ucacuggucagcuguggcacc

SEQ ID NO: 69773 - RNA, 21 nt, Human
ucagcuguggcaccaggcggc

SEQ ID NO: 69774 - RNA, 19 nt, Human
uccucugccgcggcugccc

SEQ ID NO: 69775 - RNA, 22 nt, Human
ucugggugggagccaggaaggg

SEQ ID NO: 69776 - RNA, 19 nt, Human
ugaaaaagaguucaaacag

SEQ ID NO: 69777 - RNA, 23 nt, Human
ugaaaaagaguucaaacagcauc

SEQ ID NO: 69778 - RNA, 18 nt, Human
ugacagcgggguccauga

SEQ ID NO: 69779 - RNA, 19 nt, Human
ugacagugguggugagcuc

SEQ ID NO: 69780 - RNA, 18 nt, Human
ugagugucuaugaaguuc

SEQ ID NO: 69781 - RNA, 20 nt, Human
ugagugucuaugaaguucuu

SEQ ID NO: 69782 - RNA, 25 nt, Human
ugcauggcugguccaugucugggug

SEQ ID NO: 69783 - RNA, 18 nt, Human
ugcccggaaagcggguga

SEQ ID NO: 69784 - RNA, 20 nt, Human
uggaaacguugguuuucucu

SEQ ID NO: 69785 - RNA, 18 nt, Human
uggaaacuggggcccaug

SEQ ID NO: 69786 - RNA, 19 nt, Human
uggacaagaggcugccggg

SEQ ID NO: 69787 - RNA, 22 nt, Human
uggcugcuuguggcuguccuca

SEQ ID NO: 69788 - RNA, 23 nt, Human
uggcuguccucagcacacccuca

SEQ ID NO: 69789 - RNA, 18 nt, Human
ugggagccaggaagggcu

SEQ ID NO: 69790 - RNA, 21 nt, Human
ugggagccaggaagggcuugu

SEQ ID NO: 69791 - RNA, 19 nt, Human
ugggugccuggauggaugg

SEQ ID NO: 69792 - RNA, 21 nt, Human
uggguggaaacguugguuuuc

SEQ ID NO: 69793 - RNA, 24 nt, Human
uggucaggggugguggcuccccuc

SEQ ID NO: 69794 - RNA, 30 nt, Human
uguauauauauuuauauauauauauauauu

SEQ ID NO: 69795 - RNA, 19 nt, Human
uuuauauauauauauauau

SEQ ID NO: 69796 - RNA, 20 nt, Human
uuuauauauauauauauauu

SEQ ID NO: 69797 - RNA, 22 nt, Human
acgaagaaccuucuccuccccc

SEQ ID NO: 69798 - RNA, 25 nt, Human
acgcuguggagcgggcucccgggac

SEQ ID NO: 69799 - RNA, 27 nt, Human
acgcuguggagcgggcucccgggacca

SEQ ID NO: 69800 - RNA, 23 nt, Human
agaaagcugcuaagcguggacac

SEQ ID NO: 69801 - RNA, 20 nt, Human
aggcaagguuuggcggcggu

SEQ ID NO: 69802 - RNA, 18 nt, Human
auggcguuguuguucugg

SEQ ID NO: 69803 - RNA, 20 nt, Human
auucugguuucuccaggccu

SEQ ID NO: 69804 - RNA, 21 nt, Human
cacaagugcaaucuuggcuca

SEQ ID NO: 69805 - RNA, 22 nt, Human
cacgcuguggagcgggcucccg

SEQ ID NO: 69806 - RNA, 18 nt, Human
cagcuagggacaggcggc

SEQ ID NO: 69807 - RNA, 18 nt, Human
cagugcccaggcaagguu

SEQ ID NO: 69808 - RNA, 21 nt, Human
cauaugugugugugcgugcau

SEQ ID NO: 69809 - RNA, 23 nt, Human
ccgggacuggaggaaaacacuga

SEQ ID NO: 69810 - RNA, 18 nt, Human
ccgugucgucaaugagcg

SEQ ID NO: 69811 - RNA, 18 nt, Human
ccuccucuuccuccuuuu

SEQ ID NO: 69812 - RNA, 19 nt, Human
ccuccucuuccuccuuuuc

SEQ ID NO: 69813 - RNA, 23 nt, Human
ccuccuuuuccuccucccugucc

SEQ ID NO: 69814 - RNA, 23 nt, Human
ccuuguugaauggauuugggucc

SEQ ID NO: 69815 - RNA, 19 nt, Human
cuccucccccuuuuugucc

SEQ ID NO: 69816 - RNA, 19 nt, Human
cucguucucguccacgucc

SEQ ID NO: 69817 - RNA, 23 nt, Human
cuucuccucccccuuuuuguccu

SEQ ID NO: 69818 - RNA, 23 nt, Human
gacuuggugacaugcguggucag

SEQ ID NO: 69819 - RNA, 19 nt, Human
gcagguccccauaugugug

SEQ ID NO: 69820 - RNA, 24 nt, Human
gcccugccagaaaggucuucagcc

SEQ ID NO: 69821 - RNA, 20 nt, Human
gcguuguuguucugguuggg

SEQ ID NO: 69822 - RNA, 23 nt, Human
ggaaaacacugaagagguagcug

SEQ ID NO: 69823 - RNA, 25 nt, Human
ggacaggcggccacccacgguccca

SEQ ID NO: 69824 - RNA, 24 nt, Human
ggauguuguggguguagucauuga

SEQ ID NO: 69825 - RNA, 22 nt, Human
ggccaugaaguugugaauggag

SEQ ID NO: 69826 - RNA, 18 nt, Human
ggggacgggggcgggggg

SEQ ID NO: 69827 - RNA, 23 nt, Human
ggggggcccggaggcgcuccucg

SEQ ID NO: 69828 - RNA, 23 nt, Human
gguuuggcggcggugagaaagcu

SEQ ID NO: 69829 - RNA, 20 nt, Human
gucuuggauucugguuucuc

SEQ ID NO: 69830 - RNA, 19 nt, Human
gugcgcagguccccauaug

SEQ ID NO: 69831 - RNA, 19 nt, Human
uaugugugugugcgugcau

SEQ ID NO: 69832 - RNA, 23 nt, Human
uaugugugugugcgugcaugugu

SEQ ID NO: 69833 - RNA, 22 nt, Human
ucagccaccuuaguuguucccu

SEQ ID NO: 69834 - RNA, 21 nt, Human
uccuccucuuccuccuuuucc

SEQ ID NO: 69835 - RNA, 24 nt, Human
uccuccuuuuccuccucccugucc

SEQ ID NO: 69836 - RNA, 21 nt, Human
uccucguucucguccacgucc

SEQ ID NO: 69837 - RNA, 23 nt, Human
ucucacaagugcaaucuuggcuc

SEQ ID NO: 69838 - RNA, 19 nt, Human
ugcccaggcaagguuuggc

SEQ ID NO: 69839 - RNA, 20 nt, Human
ugcccaggcaagguuuggcg

SEQ ID NO: 69840 - RNA, 19 nt, Human
ugcgugcaugugugcgugu

SEQ ID NO: 69841 - RNA, 21 nt, Human
ugcgugugacuucgugugagu

SEQ ID NO: 69842 - RNA, 22 nt, Human
uggauuuggguccuugcaaaug

SEQ ID NO: 69843 - RNA, 21 nt, Human
uguccucgucuuccucagucc

SEQ ID NO: 69844 - RNA, 18 nt, Human
ugugcgugugcgcaugug

SEQ ID NO: 69845 - RNA, 19 nt, Human
ugugugcgugcaugugugc

SEQ ID NO: 69846 - RNA, 20 nt, Human
ugugugcgugcaugugugcg

SEQ ID NO: 69847 - RNA, 24 nt, Human
ugugugcgugcaugugugcgugug

SEQ ID NO: 69848 - RNA, 24 nt, Human
ugugugugcgugcaugugugcgug

SEQ ID NO: 69849 - RNA, 20 nt, Human
ugugugugugcgugcaugug

SEQ ID NO: 69850 - RNA, 23 nt, Human
ugugugugugcgugcaugugugc

SEQ ID NO: 69851 - RNA, 22 nt, Human
aaagaaaaagggugcaggagag

SEQ ID NO: 69852 - RNA, 18 nt, Human
aaagucccaucaucaccu

SEQ ID NO: 69853 - RNA, 18 nt, Human
aacuuagcuuauaaaugg

SEQ ID NO: 69854 - RNA, 20 nt, Human
aaggccggggagugggcugg

SEQ ID NO: 69855 - RNA, 24 nt, Human
aaugaaagggcagaaagaguuaga

SEQ ID NO: 69856 - RNA, 24 nt, Human
accaaggaguagauucuaccauga

SEQ ID NO: 69857 - RNA, 18 nt, Human
accgcaacauauuucacu

SEQ ID NO: 69858 - RNA, 20 nt, Human
acgaaguucgugcccccccu

SEQ ID NO: 69859 - RNA, 20 nt, Human
acucucccuccggguuucca

SEQ ID NO: 69860 - RNA, 20 nt, Human
agaaagaguuagaggccuac

SEQ ID NO: 69861 - RNA, 23 nt, Human
agaaagaguuagaggccuacagg

SEQ ID NO: 69862 - RNA, 20 nt, Human
agacgaaaauggaaauaggu

SEQ ID NO: 69863 - RNA, 22 nt, Human
aggaggaggaagaggagagcuu

SEQ ID NO: 69864 - RNA, 25 nt, Human
aguagauucuaccaugaccugaaug

SEQ ID NO: 69865 - RNA, 22 nt, Human
aguuguccaggguagguagguu

SEQ ID NO: 69866 - RNA, 18 nt, Human
aucggggagaaugugggg

SEQ ID NO: 69867 - RNA, 22 nt, Human
caaaccccaagucaagcuuaag

SEQ ID NO: 69868 - RNA, 25 nt, Human
cacagcagcugacgugacaaugaaa

SEQ ID NO: 69869 - RNA, 23 nt, Human
ccccacgaaguucgugccccccc

SEQ ID NO: 69870 - RNA, 19 nt, Human
cccccccucccagccccca

SEQ ID NO: 69871 - RNA, 28 nt, Human
cccccccucccagcccccagcuuuggac

SEQ ID NO: 69872 - RNA, 22 nt, Human
cccccugccccuccaaugggaa

SEQ ID NO: 69873 - RNA, 24 nt, Human
ccucccagcccccagcuuuggacg

SEQ ID NO: 69874 - RNA, 23 nt, Human
ccucugaacccucaacuuagcuu

SEQ ID NO: 69875 - RNA, 23 nt, Human
ccucuucauggucagguagaggu

SEQ ID NO: 69876 - RNA, 21 nt, Human
ccugccucccugucucaacuu

SEQ ID NO: 69877 - RNA, 22 nt, Human
cgggugucucugaucuugcucu

SEQ ID NO: 69878 - RNA, 20 nt, Human
cucucucuuucuagcaaaga

SEQ ID NO: 69879 - RNA, 23 nt, Human
cuggcuuugcucucuugccuuuc

SEQ ID NO: 69880 - RNA, 25 nt, Human
cuucauggucagguagagguucacu

SEQ ID NO: 69881 - RNA, 18 nt, Human
cuucuugcuucucugggg

SEQ ID NO: 69882 - RNA, 18 nt, Human
cuuucuagcaaagauccg

SEQ ID NO: 69883 - RNA, 25 nt, Human
gagguucacuucacacacacugcug

SEQ ID NO: 69884 - RNA, 19 nt, Human
gcagaaagaguuagaggcc

SEQ ID NO: 69885 - RNA, 23 nt, Human
gcagaaagaguuagaggccuaca

SEQ ID NO: 69886 - RNA, 20 nt, Human
gcagagcuuucuuaagaaaa

SEQ ID NO: 69887 - RNA, 19 nt, Human
gcaggagagcugggcgggu

SEQ ID NO: 69888 - RNA, 20 nt, Human
gcccagaugaagguguaaac

SEQ ID NO: 69889 - RNA, 21 nt, Human
gcccccagcuuuggacgaucu

SEQ ID NO: 69890 - RNA, 19 nt, Human
gcuacaaaccccaagucaa

SEQ ID NO: 69891 - RNA, 21 nt, Human
ggaagaggagagcuuccugga

SEQ ID NO: 69892 - RNA, 20 nt, Human
ggauuuuauacauuccaucu

SEQ ID NO: 69893 - RNA, 24 nt, Human
ggggaacugaguggaagguggacu

SEQ ID NO: 69894 - RNA, 20 nt, Human
ggugaccacccaccagucuc

SEQ ID NO: 69895 - RNA, 20 nt, Human
guaggacaaaauccagaauu

SEQ ID NO: 69896 - RNA, 24 nt, Human
guaggguggggugaccacccaccu

SEQ ID NO: 69897 - RNA, 26 nt, Human
gucaggaggaggaagaggagagcuuc

SEQ ID NO: 69898 - RNA, 21 nt, Human
gugaccacccaccagucuccc

SEQ ID NO: 69899 - RNA, 24 nt, Human
guggaagguggacuccgugucacg

SEQ ID NO: 69900 - RNA, 22 nt, Human
uaagaaaaugcuugucauggca

SEQ ID NO: 69901 - RNA, 22 nt, Human
uagauugaauauaucuugugca

SEQ ID NO: 69902 - RNA, 20 nt, Human
uaggacaaaauccagaauuc

SEQ ID NO: 69903 - RNA, 20 nt, Human
uagguuccuagcuuagacca

SEQ ID NO: 69904 - RNA, 26 nt, Human
ucaccucauagaugggauagacgaaa

SEQ ID NO: 69905 - RNA, 19 nt, Human
uccagguuucuucaggcgg

SEQ ID NO: 69906 - RNA, 18 nt, Human
ucucugaucuugcucucu

SEQ ID NO: 69907 - RNA, 20 nt, Human
ugacaaugaaaagucccauc

SEQ ID NO: 69908 - RNA, 18 nt, Human
ugaccacccaccagucuc

SEQ ID NO: 69909 - RNA, 18 nt, Human
ugaguggaagguggacuc

SEQ ID NO: 69910 - RNA, 24 nt, Human
ugcauguuaccauggcagcaaccu

SEQ ID NO: 69911 - RNA, 21 nt, Human
ugcccagaugaagguguaaac

SEQ ID NO: 69912 - RNA, 18 nt, Human
uggcaacagcucuagcua

SEQ ID NO: 69913 - RNA, 20 nt, Human
uggcagcaaccuuagcaacu

SEQ ID NO: 69914 - RNA, 21 nt, Human
ugggcgggugucucugauccu

SEQ ID NO: 69915 - RNA, 20 nt, Human
ugggguuugacugggucccg

SEQ ID NO: 69916 - RNA, 21 nt, Human
ugggucuccucccccugcccc

SEQ ID NO: 69917 - RNA, 24 nt, Human
ugggucuccucccccugccccucc

SEQ ID NO: 69918 - RNA, 23 nt, Human
uuagcaacaaccagcaacuguag

SEQ ID NO: 69919 - RNA, 23 nt, Human
uuagcuuauaaauggcacagacu

SEQ ID NO: 69920 - RNA, 26 nt, Human
aaaaaacuugauacaaaaaugauagc

SEQ ID NO: 69921 - RNA, 21 nt, Human
aaagaaagaaaagaacaguga

SEQ ID NO: 69922 - RNA, 25 nt, Human
aagaaaaaggaaauacaguagcuga

SEQ ID NO: 69923 - RNA, 25 nt, Human
aagaaagaaaagaacagugaucuga

SEQ ID NO: 69924 - RNA, 25 nt, Human
aagccaauuuaaaucaaggaauaug

SEQ ID NO: 69925 - RNA, 18 nt, Human
aagcccccggaaucccag

SEQ ID NO: 69926 - RNA, 22 nt, Human
aaggaaauacaguagcugaaau

SEQ ID NO: 69927 - RNA, 23 nt, Human
acaaaaagaaagaaaagaacagu

SEQ ID NO: 69928 - RNA, 19 nt, Human
acaaggaagagaagccccc

SEQ ID NO: 69929 - RNA, 18 nt, Human
acaguagcugaaauaugg

SEQ ID NO: 69930 - RNA, 19 nt, Human
agcaucugcaagagaaacc

SEQ ID NO: 69931 - RNA, 24 nt, Human
auaaaguuucacucaaucacaaaa

SEQ ID NO: 69932 - RNA, 23 nt, Human
auacaaaaaugauagcacauggu

SEQ ID NO: 69933 - RNA, 20 nt, Human
caaaaagaaagaaaagaaca

SEQ ID NO: 69934 - RNA, 22 nt, Human
caaaagccaauuuaaaucaagg

SEQ ID NO: 69935 - RNA, 24 nt, Human
caagagaaaccaggagaagcggcg

SEQ ID NO: 69936 - RNA, 23 nt, Human
cacaaaaagaaagaaaagaacag

SEQ ID NO: 69937 - RNA, 19 nt, Human
cacccccgcucccggccac

SEQ ID NO: 69938 - RNA, 28 nt, Human
cacgcgucccacggcugcucccaccacc

SEQ ID NO: 69939 - RNA, 18 nt, Human
caguagcugaaauauggc

SEQ ID NO: 69940 - RNA, 19 nt, Human
caguagcugaaauauggca

SEQ ID NO: 69941 - RNA, 20 nt, Human
caguagcugaaauauggcac

SEQ ID NO: 69942 - RNA, 21 nt, Human
caguagcugaaauauggcacu

SEQ ID NO: 69943 - RNA, 23 nt, Human
cccacggcugcucccaccacccc

SEQ ID NO: 69944 - RNA, 19 nt, Human
cccccggaaucccaggcug

SEQ ID NO: 69945 - RNA, 23 nt, Human
cccccggaaucccaggcugucac

SEQ ID NO: 69946 - RNA, 24 nt, Human
ccccggaaucccaggcugucaccc

SEQ ID NO: 69947 - RNA, 18 nt, Human
ccggccacgcgucccacg

SEQ ID NO: 69948 - RNA, 22 nt, Human
cggaaucccaggcugucacccc

SEQ ID NO: 69949 - RNA, 21 nt, Human
cuaaaccaaauagaaugccuu

SEQ ID NO: 69950 - RNA, 21 nt, Human
cuaaaugauccucagacugca

SEQ ID NO: 69951 - RNA, 24 nt, Human
gaaaaaggaaauacaguagcugaa

SEQ ID NO: 69952 - RNA, 23 nt, Human
gaaucaacuucuaaaccaaauag

SEQ ID NO: 69953 - RNA, 23 nt, Human
gcugacgagaggcugaggaagga

SEQ ID NO: 69954 - RNA, 21 nt, Human
ggaaucccaggcugucacccc

SEQ ID NO: 69955 - RNA, 23 nt, Human
gucccacggcugcucccaccacc

SEQ ID NO: 69956 - RNA, 21 nt, Human
uaaaucaaggaauaugauauc

SEQ ID NO: 69957 - RNA, 21 nt, Human
uaaaucaaggaauaugauauc

SEQ ID NO: 69958 - RNA, 20 nt, Human
uaaaugauccucagacugca

SEQ ID NO: 69959 - RNA, 22 nt, Human
uaacugaccauaugcuuuauaa

SEQ ID NO: 69960 - RNA, 22 nt, Human
uaagucuuuaacauuaauguuc

SEQ ID NO: 69961 - RNA, 23 nt, Human
uaagucuuuaacauuaauguuca

SEQ ID NO: 69962 - RNA, 22 nt, Human
uaagugcagaaggugguucagg

SEQ ID NO: 69963 - RNA, 20 nt, Human
uacaagaaaaaggaaauaca

SEQ ID NO: 69964 - RNA, 22 nt, Human
uacaagaaaaaggaaauacagu

SEQ ID NO: 69965 - RNA, 22 nt, Human
uacaguagcugaaauauggcac

SEQ ID NO: 69966 - RNA, 22 nt, Human
uagugucagccacggccacacu

SEQ ID NO: 69967 - RNA, 25 nt, Human
ucaaucacaaaaagaaagaaaagaa

SEQ ID NO: 69968 - RNA, 21 nt, Human
ucacaaaaagaaagaaaagaa

SEQ ID NO: 69969 - RNA, 24 nt, Human
ucacaaaagccaauuuaaaucaag

SEQ ID NO: 69970 - RNA, 21 nt, Human
ucagccacggccacacuggga

SEQ ID NO: 69971 - RNA, 20 nt, Human
uccucagacugcaauuccua

SEQ ID NO: 69972 - RNA, 18 nt, Human
ucuaaaccaaauagaaug

SEQ ID NO: 69973 - RNA, 24 nt, Human
ugggaauagagaggagaggaggaa

SEQ ID NO: 69974 - RNA, 22 nt, Human
uguauuaguaagaaagccccac

SEQ ID NO: 69975 - RNA, 21 nt, Human
uucaaucacaaaaagaaagaa

SEQ ID NO: 69976 - RNA, 22 nt, Human
uucuaaaugauccucagacugc

SEQ ID NO: 69977 - RNA, 20 nt, Human
uugauggcuacaaagucuuu

SEQ ID NO: 69978 - RNA, 18 nt, Human
cacgugcccugcccccac

SEQ ID NO: 69979 - RNA, 19 nt, Human
cagaaacacccuccagaag

SEQ ID NO: 69980 - RNA, 18 nt, Human
cagaggacugcccaggcg

SEQ ID NO: 69981 - RNA, 21 nt, Human
cagccuggacuggaguccuaa

SEQ ID NO: 69982 - RNA, 24 nt, Human
ccaccgccaccacagguggcgggg

SEQ ID NO: 69983 - RNA, 18 nt, Human
ccagcccagaggacugcc

SEQ ID NO: 69984 - RNA, 18 nt, Human
ccagcccagaggacugcc

SEQ ID NO: 69985 - RNA, 20 nt, Human
cccaccgccaccacaggugg

SEQ ID NO: 69986 - RNA, 20 nt, Human
ccccaccgccaccacaggug

SEQ ID NO: 69987 - RNA, 24 nt, Human
cccgaggccagcccagaggacugc

SEQ ID NO: 69988 - RNA, 23 nt, Human
ccguccagccuggacuggagucc

SEQ ID NO: 69989 - RNA, 21 nt, Human
ccucaggcagccguccagccu

SEQ ID NO: 69990 - RNA, 23 nt, Human
ccugcuguggcaguugcagggau

SEQ ID NO: 69991 - RNA, 20 nt, Human
ccuggacuggaguccuaaga

SEQ ID NO: 69992 - RNA, 19 nt, Human
cguccagccuggacuggag

SEQ ID NO: 69993 - RNA, 24 nt, Human
gaaugggggaggggagugggcagg

SEQ ID NO: 69994 - RNA, 26 nt, Human
gcccaggacacaagcgugucuuuaac

SEQ ID NO: 69995 - RNA, 20 nt, Human
gcccggugccugugcuccca

SEQ ID NO: 69996 - RNA, 20 nt, Human
gcccugcccccaccugcugu

SEQ ID NO: 69997 - RNA, 23 nt, Human
gccuggacuggaguccuaagaac

SEQ ID NO: 69998 - RNA, 21 nt, Human
ggcggcuuucccgaggccagc

SEQ ID NO: 69999 - RNA, 25 nt, Human
gggcaggucccuccaaguuuggggu

SEQ ID NO: 70000 - RNA, 20 nt, Human
uaagaacagaaacacccucc

SEQ ID NO: 70001 - RNA, 21 nt, Human
uaagaacagaaacacccucca

SEQ ID NO: 70002 - RNA, 18 nt, Human
uaccaucgcccaggacac

SEQ ID NO: 70003 - RNA, 22 nt, Human
uaccaucgcccaggacacaagc

SEQ ID NO: 70004 - RNA, 21 nt, Human
ucagagccccaccgccaccac

SEQ ID NO: 70005 - RNA, 19 nt, Human
uccagagggucccacgugc

SEQ ID NO: 70006 - RNA, 19 nt, Human
ugcuguggcaguugcaggg

SEQ ID NO: 70007 - RNA, 18 nt, Human
ugggaaugggggagggga

SEQ ID NO: 70008 - RNA, 21 nt, Human
ugguggggcugggacucuugg

SEQ ID NO: 70009 - RNA, 19 nt, Human
uugggaaugggggagggga

SEQ ID NO: 70010 - RNA, 22 nt, Human
uuuuauuaccaucgcccaggac

SEQ ID NO: 70011 - RNA, 19 nt, Human
acaaauggaacuaauuuac

SEQ ID NO: 70012 - RNA, 19 nt, Human
aggaguaugagaguaaccc

SEQ ID NO: 70013 - RNA, 23 nt, Human
aguaugagaguaacccuuuuaca

SEQ ID NO: 70014 - RNA, 21 nt, Human
uagaacaaugacaaaacugaa

SEQ ID NO: 70015 - RNA, 24 nt, Human
uaugagaguaacccuuuuacaaau

SEQ ID NO: 70016 - RNA, 22 nt, Human
uccgcaggcgguacuucugcag

SEQ ID NO: 70017 - RNA, 18 nt, Human
ugaugugaauccacagga

SEQ ID NO: 70018 - RNA, 20 nt, Human
uuugcaguuacuccgcaggc

SEQ ID NO: 70019 - RNA, 19 nt, Human
aaacacagaguaaccacca

SEQ ID NO: 70020 - RNA, 21 nt, Human
aacacucauuuccaugaacuc

SEQ ID NO: 70021 - RNA, 22 nt, Human
aacaucguaaugcucacugcca

SEQ ID NO: 70022 - RNA, 21 nt, Human
aacuccagcaccaccaaaaag

SEQ ID NO: 70023 - RNA, 23 nt, Human
acaucguaaugcucacugccaac

SEQ ID NO: 70024 - RNA, 21 nt, Human
accagaauuuccugcucaaca

SEQ ID NO: 70025 - RNA, 21 nt, Human
agcuagcagaucgacaaccuu

SEQ ID NO: 70026 - RNA, 21 nt, Human
aguacagugguagcauccaaa

SEQ ID NO: 70027 - RNA, 18 nt, Human
agucccucaucaaacugg

SEQ ID NO: 70028 - RNA, 23 nt, Human
caaaaccagucuggucucccugc

SEQ ID NO: 70029 - RNA, 26 nt, Human
caacaccagcaaacacagaguaacca

SEQ ID NO: 70030 - RNA, 21 nt, Human
caauguugggauccaugauac

SEQ ID NO: 70031 - RNA, 18 nt, Human
caccagcaaacacagagu

SEQ ID NO: 70032 - RNA, 24 nt, Human
caccagcaaacacagaguaaccaa

SEQ ID NO: 70033 - RNA, 22 nt, Human
cacggguccucucaccaacacc

SEQ ID NO: 70034 - RNA, 19 nt, Human
cagaguaaccaccaugggc

SEQ ID NO: 70035 - RNA, 21 nt, Human
cagcaaacacagaguaaccac

SEQ ID NO: 70036 - RNA, 24 nt, Human
cagcucagcaauggcacgcgacag

SEQ ID NO: 70037 - RNA, 23 nt, Human
caucguaaugcucacugccaaca

SEQ ID NO: 70038 - RNA, 20 nt, Human
ccaaaaagcccaauuuugcc

SEQ ID NO: 70039 - RNA, 24 nt, Human
ccaaaaagcccaauuuugccaccc

SEQ ID NO: 70040 - RNA, 20 nt, Human
ccaaagucucaggaccaaca

SEQ ID NO: 70041 - RNA, 18 nt, Human
ccacgggcaacaucguaa

SEQ ID NO: 70042 - RNA, 24 nt, Human
ccagcaaacacagaguaaccacca

SEQ ID NO: 70043 - RNA, 19 nt, Human
cccacgggcaacaucguaa

SEQ ID NO: 70044 - RNA, 24 nt, Human
ccccggaggccggagcagcggcca

SEQ ID NO: 70045 - RNA, 18 nt, Human
cccgguggcggcgccugc

SEQ ID NO: 70046 - RNA, 22 nt, Human
ccgcaguaagagcugagcuggg

SEQ ID NO: 70047 - RNA, 26 nt, Human
ccgcaguaagagcugagcugggggca

SEQ ID NO: 70048 - RNA, 21 nt, Human
ccucucaccaacaccagcaaa

SEQ ID NO: 70049 - RNA, 23 nt, Human
ccugcaggaucuuuugcacccca

SEQ ID NO: 70050 - RNA, 25 nt, Human
cgcaaggccccggaggccggagcag

SEQ ID NO: 70051 - RNA, 24 nt, Human
cgccaaugaccgccacgaugcgcc

SEQ ID NO: 70052 - RNA, 23 nt, Human
cgccgcauagucccugacaggau

SEQ ID NO: 70053 - RNA, 19 nt, Human
cgggcacgagcaccaggug

SEQ ID NO: 70054 - RNA, 23 nt, Human
cucaacacucauuuccaugaacu

SEQ ID NO: 70055 - RNA, 21 nt, Human
cuccagcaccaccaaaaagcc

SEQ ID NO: 70056 - RNA, 22 nt, Human
cuccagcaccaccaaaaagccc

SEQ ID NO: 70057 - RNA, 24 nt, Human
cuccaugaucaguacagucuugcc

SEQ ID NO: 70058 - RNA, 24 nt, Human
cucucacccaaaugcugggccacc

SEQ ID NO: 70059 - RNA, 24 nt, Human
cugcucaacacucauuuccaugaa

SEQ ID NO: 70060 - RNA, 18 nt, Human
gaccucuuucaucaauag

SEQ ID NO: 70061 - RNA, 19 nt, Human
guaguagcaggggcagggu

SEQ ID NO: 70062 - RNA, 20 nt, Human
gugagucuccgcaaggcccc

SEQ ID NO: 70063 - RNA, 18 nt, Human
gugcaccagaauccagua

SEQ ID NO: 70064 - RNA, 18 nt, Human
guuuugaugggaccucuu

SEQ ID NO: 70065 - RNA, 21 nt, Human
uagcagaucgacaaccuugau

SEQ ID NO: 70066 - RNA, 20 nt, Human
ucagcccagucagagcuacc

SEQ ID NO: 70067 - RNA, 19 nt, Human
uccaugauacgagaggugg

SEQ ID NO: 70068 - RNA, 19 nt, Human
uccgcaaggccccggaggc

SEQ ID NO: 70069 - RNA, 22 nt, Human
uccgcaaggccccggaggccgg

SEQ ID NO: 70070 - RNA, 21 nt, Human
ucuccgcaaggccccggaggc

SEQ ID NO: 70071 - RNA, 18 nt, Human
ucucugaaguauucagcc

SEQ ID NO: 70072 - RNA, 19 nt, Human
ugauucugcccaaagucuc

SEQ ID NO: 70073 - RNA, 18 nt, Human
ugcccagcucagcaaugg

SEQ ID NO: 70074 - RNA, 24 nt, Human
ugccuugcacuuccagggcauuua

SEQ ID NO: 70075 - RNA, 18 nt, Human
uggccucuaaccaagccu

SEQ ID NO: 70076 - RNA, 19 nt, Human
uggccucuaaccaagccuu

SEQ ID NO: 70077 - RNA, 19 nt, Human
ugggggcagcgacgcugaa

SEQ ID NO: 70078 - RNA, 22 nt, Human
uguuugguuuugaugggaccuc

SEQ ID NO: 70079 - RNA, 21 nt, Human
uuacugugcucucacccaaau

SEQ ID NO: 70080 - RNA, 23 nt, Human
uuccagggcauuuagaauuggug

SEQ ID NO: 70081 - RNA, 22 nt, Human
uuucaugguauaaaucauugcc

SEQ ID NO: 70082 - RNA, 19 nt, Human
uuugaugggaccucuuuca

SEQ ID NO: 70083 - RNA, 22 nt, Human
uuuggcgaaggagauguuugcg

SEQ ID NO: 70084 - RNA, 19 nt, Human
aggcagcaguaagcuaaaa

SEQ ID NO: 70085 - RNA, 22 nt, Human
cagcaguaagcuaaaaacaaaa

SEQ ID NO: 70086 - RNA, 22 nt, Human
caguaagcuaaaaacaaaauca

SEQ ID NO: 70087 - RNA, 18 nt, Human
cuaaaaacaaaaucaacu

SEQ ID NO: 70088 - RNA, 23 nt, Human
guaagcuaaaaacaaaaucaacu

SEQ ID NO: 70089 - RNA, 25 nt, Human
uaaguuguuuauuuuaagauaauuu

SEQ ID NO: 70090 - RNA, 19 nt, Human
uaauggaggaacaguuucu

SEQ ID NO: 70091 - RNA, 18 nt, Human
uggcugaauuuuccuucu

SEQ ID NO: 70092 - RNA, 18 nt, Human
auggaaugagauccuuuu

SEQ ID NO: 70093 - RNA, 19 nt, Human
auuuuuuuuuuucccaugg

SEQ ID NO: 70094 - RNA, 23 nt, Human
ugagauccuuuucaaucugccau

SEQ ID NO: 70095 - RNA, 26 nt, Human
ugagauccuuuucaaucuuccacagg

SEQ ID NO: 70096 - RNA, 19 nt, Human
ugccauaacaugugcccac

SEQ ID NO: 70097 - RNA, 19 nt, Human
ugccauaacaugugcccac

SEQ ID NO: 70098 - RNA, 19 nt, Human
uggaaugagauccuuuuca

SEQ ID NO: 70099 - RNA, 26 nt, Human
uggaaugagauccuuuucaaucugcc

SEQ ID NO: 70100 - RNA, 22 nt, Human
uucaauuuauugacauugucaa

SEQ ID NO: 70101 - RNA, 20 nt, Human
aacacaccccagcaccaaga

SEQ ID NO: 70102 - RNA, 18 nt, Human
acacaccccagcaccaag

SEQ ID NO: 70103 - RNA, 19 nt, Human
acugcccugcaaccccugc

SEQ ID NO: 70104 - RNA, 25 nt, Human
cccagcuuuagcccuuggucucagc

SEQ ID NO: 70105 - RNA, 28 nt, Human
ccucccagcuuuagcccuuggucuccug

SEQ ID NO: 70106 - RNA, 24 nt, Human
ccuuggucucagcccucagcuucc

SEQ ID NO: 70107 - RNA, 21 nt, Human
cugcaaccccugcuuggccca

SEQ ID NO: 70108 - RNA, 20 nt, Human
cuuggucucagcccucagcc

SEQ ID NO: 70109 - RNA, 23 nt, Human
ucaaggugacagacucaccuccc

SEQ ID NO: 70110 - RNA, 26 nt, Human
ugcccugcaaccccugcuuggcccac

SEQ ID NO: 70111 - RNA, 21 nt, Human
ugguaaagcuuaacacacccc

SEQ ID NO: 70112 - RNA, 22 nt, Human
uggucucagcccucagcuuccc

SEQ ID NO: 70113 - RNA, 23 nt, Human
uuaacacaccccagcaccaagaa

SEQ ID NO: 70114 - RNA, 18 nt, Human
uugcaguagcaacaggcc

SEQ ID NO: 70115 - RNA, 18 nt, Human
agcuguggcaggagagcu

SEQ ID NO: 70116 - RNA, 19 nt, Human
cgaaggcacucagccaacu

SEQ ID NO: 70117 - RNA, 19 nt, Human
cucacgaaggcacucagcc

SEQ ID NO: 70118 - RNA, 21 nt, Human
cucacgaaggcacucagccaa

SEQ ID NO: 70119 - RNA, 20 nt, Human
gaaaagaaauauacacagga

SEQ ID NO: 70120 - RNA, 25 nt, Human
gagaacuaugggagguggagacggc

SEQ ID NO: 70121 - RNA, 21 nt, Human
gaggagcuguggcaggagagc

SEQ ID NO: 70122 - RNA, 20 nt, Human
gagguauaggaaaaggaaca

SEQ ID NO: 70123 - RNA, 21 nt, Human
ggaaaagaaauauacacagga

SEQ ID NO: 70124 - RNA, 22 nt, Human
ggagguauaggaaaaggaacac

SEQ ID NO: 70125 - RNA, 18 nt, Human
uccccaggcugccugggg

SEQ ID NO: 70126 - RNA, 23 nt, Human
ugaggagcuguggcaggagagcu

SEQ ID NO: 70127 - RNA, 19 nt, Human
ugccuggggagguauagga

SEQ ID NO: 70128 - RNA, 22 nt, Human
uggaaaagaaauauacacagga

SEQ ID NO: 70129 - RNA, 21 nt, Human
uggcaggagagcugcucccac

SEQ ID NO: 70130 - RNA, 18 nt, Human
ugggagguggagacggcu

SEQ ID NO: 70131 - RNA, 25 nt, Human
ugucaaacccugagccaaccggcgc

SEQ ID NO: 70132 - RNA, 21 nt, Human
ugucuuuucucugucaaaccc

SEQ ID NO: 70133 - RNA, 20 nt, Human
uuccccaggcugccugggga

SEQ ID NO: 70134 - RNA, 19 nt, Human
uucucugucaaacccugag

SEQ ID NO: 70135 - RNA, 18 nt, Human
aagugcccuccaggggcc

SEQ ID NO: 70136 - RNA, 18 nt, Human
acacagaauuacauccgu

SEQ ID NO: 70137 - RNA, 18 nt, Human
acuacaguuuucggaguc

SEQ ID NO: 70138 - RNA, 25 nt, Human
aggcucccgugcacgccgucagcuu

SEQ ID NO: 70139 - RNA, 22 nt, Human
caagugcccuccaggggccugu

SEQ ID NO: 70140 - RNA, 21 nt, Human
caggcgacgugggcuccucuc

SEQ ID NO: 70141 - RNA, 18 nt, Human
caugacaccaauacuaca

SEQ ID NO: 70142 - RNA, 24 nt, Human
ccacccaggcuccgcaggcucccg

SEQ ID NO: 70143 - RNA, 22 nt, Human
cccagugaggcgccggcacaau

SEQ ID NO: 70144 - RNA, 18 nt, Human
cccgugcacgccgucagc

SEQ ID NO: 70145 - RNA, 21 nt, Human
cccgugcacgccgucagcuug

SEQ ID NO: 70146 - RNA, 22 nt, Human
ccuggccaggccggggaauucc

SEQ ID NO: 70147 - RNA, 23 nt, Human
ccuggccaggccggggaauuccg

SEQ ID NO: 70148 - RNA, 20 nt, Human
cgugggcuccucucccgcuu

SEQ ID NO: 70149 - RNA, 21 nt, Human
cugggcgccgcuccgcccugg

SEQ ID NO: 70150 - RNA, 19 nt, Human
gaggaaaagaggcuuaagg

SEQ ID NO: 70151 - RNA, 24 nt, Human
ggaaauaacguacauucccaugac

SEQ ID NO: 70152 - RNA, 23 nt, Human
ucccuacugggcgccgcuccgcc

SEQ ID NO: 70153 - RNA, 19 nt, Human
aaacaggaggaggaagugg

SEQ ID NO: 70154 - RNA, 23 nt, Human
aaacaggaggaggaaguggaggg

SEQ ID NO: 70155 - RNA, 19 nt, Human
aagcgucucggagacaguc

SEQ ID NO: 70156 - RNA, 24 nt, Human
aagcuccccuccgagucagcgucc

SEQ ID NO: 70157 - RNA, 22 nt, Human
aaggugccugggaggcgggagg

SEQ ID NO: 70158 - RNA, 25 nt, Human
acccggagagacgcugcacguggag

SEQ ID NO: 70159 - RNA, 19 nt, Human
acgcugcacguggagcccu

SEQ ID NO: 70160 - RNA, 18 nt, Human
agacagaagccaaacagg

SEQ ID NO: 70161 - RNA, 25 nt, Human
agacagaagccaaacaggaggagga

SEQ ID NO: 70162 - RNA, 24 nt, Human
agagacgcugcacguggagcccuc

SEQ ID NO: 70163 - RNA, 21 nt, Human
aggcgggagggggguuggggc

SEQ ID NO: 70164 - RNA, 22 nt, Human
auaaaggugcagggaaagugag

SEQ ID NO: 70165 - RNA, 21 nt, Human
cccacaagggcccccccgcgg

SEQ ID NO: 70166 - RNA, 18 nt, Human
ccccacaagggccccccc

SEQ ID NO: 70167 - RNA, 18 nt, Human
cccuccgagucagcgucc

SEQ ID NO: 70168 - RNA, 21 nt, Human
ccgccggggaggaggggagcg

SEQ ID NO: 70169 - RNA, 19 nt, Human
ccguucucagccggcucug

SEQ ID NO: 70170 - RNA, 20 nt, Human
ccuccguugccuugggcggu

SEQ ID NO: 70171 - RNA, 26 nt, Human
ccuccuugaaaccuugcuccucaccg

SEQ ID NO: 70172 - RNA, 21 nt, Human
ccucgugagccuccguugccu

SEQ ID NO: 70173 - RNA, 20 nt, Human
ccugggaggcgggagggggg

SEQ ID NO: 70174 - RNA, 21 nt, Human
cgaccggacgggucuagguga

SEQ ID NO: 70175 - RNA, 22 nt, Human
cgggccggccucguuccggggc

SEQ ID NO: 70176 - RNA, 23 nt, Human
gaacauuugacaguuaugaaaug

SEQ ID NO: 70177 - RNA, 19 nt, Human
gacagaagccaaacaggag

SEQ ID NO: 70178 - RNA, 24 nt, Human
gcccucgccgcugccguucucagc

SEQ ID NO: 70179 - RNA, 23 nt, Human
gccugggaggcgggagggggguu

SEQ ID NO: 70180 - RNA, 20 nt, Human
gcugcacguggagcccucgc

SEQ ID NO: 70181 - RNA, 25 nt, Human
ggagagacgcugcacguggagcccu

SEQ ID NO: 70182 - RNA, 18 nt, Human
ggaggaaguggaggguaa

SEQ ID NO: 70183 - RNA, 22 nt, Human
ggauuggggcguugugcuuccu

SEQ ID NO: 70184 - RNA, 19 nt, Human
gggaagggcccugggaccu

SEQ ID NO: 70185 - RNA, 18 nt, Human
ggguccccuggcacagcc

SEQ ID NO: 70186 - RNA, 18 nt, Human
gugagacagaagccaaac

SEQ ID NO: 70187 - RNA, 18 nt, Human
uaccucgugagccuccgu

SEQ ID NO: 70188 - RNA, 21 nt, Human
uccgccaucuuuucuucgccu

SEQ ID NO: 70189 - RNA, 19 nt, Human
uccuggacccgaaggugcc

SEQ ID NO: 70190 - RNA, 23 nt, Human
uccuuguaccucgugagccuccg

SEQ ID NO: 70191 - RNA, 18 nt, Human
ucuuugaguggccuuucc

SEQ ID NO: 70192 - RNA, 26 nt, Human
ucuuugaguggccuuuccccuaguuc

SEQ ID NO: 70193 - RNA, 19 nt, Human
ugacccguucuuuuucccc

SEQ ID NO: 70194 - RNA, 19 nt, Human
ugaguggccuuuccccuag

SEQ ID NO: 70195 - RNA, 24 nt, Human
ugcucuguacgcaugcgcucuuug

SEQ ID NO: 70196 - RNA, 23 nt, Human
uggagcccucgccgcugccguuc

SEQ ID NO: 70197 - RNA, 23 nt, Human
uggaggguaagugcuuccggguc

SEQ ID NO: 70198 - RNA, 24 nt, Human
uggcacagccuccgccaucuuuuc

SEQ ID NO: 70199 - RNA, 18 nt, Human
ugggaggcgggagggggg

SEQ ID NO: 70200 - RNA, 24 nt, Human
ugggaggcgggagggggguugggg

SEQ ID NO: 70201 - RNA, 20 nt, Human
uguauaaaggugcagggaaa

SEQ ID NO: 70202 - RNA, 24 nt, Human
uuaaaagaacauuugacaguuaug

SEQ ID NO: 70203 - RNA, 23 nt, Human
uuaccagauuaauuuuacuuuau

SEQ ID NO: 70204 - RNA, 19 nt, Human
uuccccuaguucaagcucc

SEQ ID NO: 70205 - RNA, 19 nt, Human
uuccggagugggugagugc

SEQ ID NO: 70206 - RNA, 24 nt, Human
uugcucuguacgcaugcgcucuuu

SEQ ID NO: 70207 - RNA, 19 nt, Human
uuuuccccuccuugaaacc

SEQ ID NO: 70208 - RNA, 21 nt, Human
cuuuuuauuguugcuccaagu

SEQ ID NO: 70209 - RNA, 21 nt, Human
ucccgggcgguuguaggccuc

SEQ ID NO: 70210 - RNA, 18 nt, Human
uuugaucuguucuggaag

SEQ ID NO: 70211 - RNA, 18 nt, Human
uuuuuuuuuuuuuuuuug

SEQ ID NO: 70212 - RNA, 20 nt, Human
aaagcaacaacacggacacu

SEQ ID NO: 70213 - RNA, 18 nt, Human
aaagcacuauccacagcc

SEQ ID NO: 70214 - RNA, 21 nt, Human
aaccaagcaccccaugcuccu

SEQ ID NO: 70215 - RNA, 24 nt, Human
aacgauaacgacagccaagcagga

SEQ ID NO: 70216 - RNA, 21 nt, Human
aagaaagcuccucagcgggcu

SEQ ID NO: 70217 - RNA, 22 nt, Human
aagcaccccaugcuccugcccg

SEQ ID NO: 70218 - RNA, 18 nt, Human
accaagcaccccaugcuc

SEQ ID NO: 70219 - RNA, 20 nt, Human
accaagcaccccaugcuccu

SEQ ID NO: 70220 - RNA, 23 nt, Human
accgucccacccucaaccccccc

SEQ ID NO: 70221 - RNA, 23 nt, Human
agagaugggggcagcccaagaaa

SEQ ID NO: 70222 - RNA, 18 nt, Human
agagggagcaagaugggc

SEQ ID NO: 70223 - RNA, 23 nt, Human
agcacuauccacagccagggaug

SEQ ID NO: 70224 - RNA, 18 nt, Human
aggagaaaggagacccua

SEQ ID NO: 70225 - RNA, 21 nt, Human
aggagaaaggagacccuagaa

SEQ ID NO: 70226 - RNA, 19 nt, Human
agggagcaagaugggcuga

SEQ ID NO: 70227 - RNA, 20 nt, Human
caaaagcacuauccacagcc

SEQ ID NO: 70228 - RNA, 28 nt, Human
caaacagccggcgaucgcacccagccca

SEQ ID NO: 70229 - RNA, 22 nt, Human
caacaacacggacaccguccca

SEQ ID NO: 70230 - RNA, 23 nt, Human
caacaucaccagaaaacgauaac

SEQ ID NO: 70231 - RNA, 19 nt, Human
caagaauaaauaaggagaa

SEQ ID NO: 70232 - RNA, 22 nt, Human
caagcaccccaugcuccugccc

SEQ ID NO: 70233 - RNA, 24 nt, Human
caccuuguugggagagaugggggc

SEQ ID NO: 70234 - RNA, 23 nt, Human
cagaaaacgauaacgacagccaa

SEQ ID NO: 70235 - RNA, 24 nt, Human
cagcccaagaaagcuccucagcgg

SEQ ID NO: 70236 - RNA, 20 nt, Human
caugucccuuacgccucaca

SEQ ID NO: 70237 - RNA, 26 nt, Human
ccacagaaauaaacccguuguccgga

SEQ ID NO: 70238 - RNA, 20 nt, Human
cccacccucaacccccccac

SEQ ID NO: 70239 - RNA, 21 nt, Human
cccacccucaacccccccacu

SEQ ID NO: 70240 - RNA, 24 nt, Human
cccacccucaacccccccacuggc

SEQ ID NO: 70241 - RNA, 23 nt, Human
cccagcccaccugucguggaggu

SEQ ID NO: 70242 - RNA, 20 nt, Human
cccucaacccccccacuggc

SEQ ID NO: 70243 - RNA, 21 nt, Human
cccucaacccccccacuggca

SEQ ID NO: 70244 - RNA, 21 nt, Human
cccugggaagcugguuggucu

SEQ ID NO: 70245 - RNA, 18 nt, Human
ccucacagcgacgaaccc

SEQ ID NO: 70246 - RNA, 21 nt, Human
ccucacagcgacgaacccugg

SEQ ID NO: 70247 - RNA, 18 nt, Human
cgacgaacccugggaagc

SEQ ID NO: 70248 - RNA, 23 nt, Human
cuacacaaaagcacuauccacag

SEQ ID NO: 70249 - RNA, 19 nt, Human
cucccaaacucagggagcc

SEQ ID NO: 70250 - RNA, 19 nt, Human
cucccggugggaacaugcc

SEQ ID NO: 70251 - RNA, 22 nt, Human
cugcagggugggaaagcaacaa

SEQ ID NO: 70252 - RNA, 20 nt, Human
gaagagggagcaagaugggc

SEQ ID NO: 70253 - RNA, 26 nt, Human
gagaaaggagacccuagaauucaugu

SEQ ID NO: 70254 - RNA, 19 nt, Human
gagagaugggggcagccca

SEQ ID NO: 70255 - RNA, 24 nt, Human
gagcaagaugggcugaggggagcu

SEQ ID NO: 70256 - RNA, 18 nt, Human
gagggagcaagaugggcu

SEQ ID NO: 70257 - RNA, 23 nt, Human
gggcugaggggagcuugcaguuc

SEQ ID NO: 70258 - RNA, 21 nt, Human
gucccacccucaaccccccca

SEQ ID NO: 70259 - RNA, 20 nt, Human
guugggagagaugggggcag

SEQ ID NO: 70260 - RNA, 18 nt, Human
uaaggagaaaggagaccc

SEQ ID NO: 70261 - RNA, 20 nt, Human
uaaggagaaaggagacccua

SEQ ID NO: 70262 - RNA, 19 nt, Human
uacuuccacacucccaaac

SEQ ID NO: 70263 - RNA, 21 nt, Human
uagcacaacaucaccagaaaa

SEQ ID NO: 70264 - RNA, 26 nt, Human
uaggaaggaaacaaccaagcacccca

SEQ ID NO: 70265 - RNA, 20 nt, Human
ucagcgggcugaagagggag

SEQ ID NO: 70266 - RNA, 21 nt, Human
ucaggccacagaaauaaaccc

SEQ ID NO: 70267 - RNA, 23 nt, Human
ucaguccagugcgcugcagggug

SEQ ID NO: 70268 - RNA, 19 nt, Human
ucccaaacucagggagccc

SEQ ID NO: 70269 - RNA, 22 nt, Human
ucccacccucaacccccccacu

SEQ ID NO: 70270 - RNA, 22 nt, Human
ucccuuccuucucaggccacag

SEQ ID NO: 70271 - RNA, 23 nt, Human
ugaggggagcuugcaguucaugc

SEQ ID NO: 70272 - RNA, 20 nt, Human
ugcuccugcccggcacuccc

SEQ ID NO: 70273 - RNA, 24 nt, Human
ugggaaagcaacaacacggacacc

SEQ ID NO: 70274 - RNA, 25 nt, Human
ugggaacaugccaaacagccggcga

SEQ ID NO: 70275 - RNA, 18 nt, Human
ugggagagaugggggcag

SEQ ID NO: 70276 - RNA, 22 nt, Human
uguagccacaagaauaaauaag

SEQ ID NO: 70277 - RNA, 18 nt, Human
ugucguggaggucccuuc

SEQ ID NO: 70278 - RNA, 21 nt, Human
uucaugcugcaguaggaagag

SEQ ID NO: 70279 - RNA, 25 nt, Human
uuuauuuuauuaggaaggaaacaac

SEQ ID NO: 70280 - RNA, 20 nt, Human
aagagccaggaggcagcucu

SEQ ID NO: 70281 - RNA, 20 nt, Human
aauccgcagguggcuucccc

SEQ ID NO: 70282 - RNA, 18 nt, Human
acaauaucacuugccaaa

SEQ ID NO: 70283 - RNA, 23 nt, Human
accggcucaccugcaccgggcac

SEQ ID NO: 70284 - RNA, 25 nt, Human
agacaauaucacuugccaaaguccu

SEQ ID NO: 70285 - RNA, 22 nt, Human
agcaugcagcgccuccccgcug

SEQ ID NO: 70286 - RNA, 21 nt, Human
agcgccuccccgcugccaccc

SEQ ID NO: 70287 - RNA, 20 nt, Human
aggcacucggcacaacuccg

SEQ ID NO: 70288 - RNA, 20 nt, Human
auccucagccuggccuuugc

SEQ ID NO: 70289 - RNA, 20 nt, Human
aucuguuuagcauucucccc

SEQ ID NO: 70290 - RNA, 21 nt, Human
caccgggcacucagcacagcc

SEQ ID NO: 70291 - RNA, 21 nt, Human
cagagaaaagcugcuuuacau

SEQ ID NO: 70292 - RNA, 19 nt, Human
cagccucggucugcagcag

SEQ ID NO: 70293 - RNA, 19 nt, Human
cagccuggccuuugccucc

SEQ ID NO: 70294 - RNA, 22 nt, Human
caggcugacguccaaauaauac

SEQ ID NO: 70295 - RNA, 24 nt, Human
cagugaauccgcagguggcuuccc

SEQ ID NO: 70296 - RNA, 22 nt, Human
caugcuucaggugagccaagaa

SEQ ID NO: 70297 - RNA, 19 nt, Human
ccaagaacaaccuucccau

SEQ ID NO: 70298 - RNA, 24 nt, Human
cccagccucggucuuggcuguguc

SEQ ID NO: 70299 - RNA, 18 nt, Human
cccagcuuccuccaggcg

SEQ ID NO: 70300 - RNA, 24 nt, Human
cccaggcucccaaagagccaggag

SEQ ID NO: 70301 - RNA, 18 nt, Human
ccccgcagcgccccuccc

SEQ ID NO: 70302 - RNA, 21 nt, Human
cccgcugccacccgggccacc

SEQ ID NO: 70303 - RNA, 19 nt, Human
cccucccggcuccuucucc

SEQ ID NO: 70304 - RNA, 18 nt, Human
ccucccggcuccuucucc

SEQ ID NO: 70305 - RNA, 26 nt, Human
ccucccggcuccuucuccucccaggc

SEQ ID NO: 70306 - RNA, 22 nt, Human
ccucggucccagcuuccuccag

SEQ ID NO: 70307 - RNA, 20 nt, Human
ccuggccuuugccucccucc

SEQ ID NO: 70308 - RNA, 27 nt, Human
ccuggccuuugccucccuccacucggc

SEQ ID NO: 70309 - RNA, 19 nt, Human
ccugggucagggucugggg

SEQ ID NO: 70310 - RNA, 22 nt, Human
ccuuugccucccuccacucggc

SEQ ID NO: 70311 - RNA, 23 nt, Human
cggcuccuucuccucccaggcuc

SEQ ID NO: 70312 - RNA, 23 nt, Human
cuagcaguccugggcggagcagc

SEQ ID NO: 70313 - RNA, 22 nt, Human
cuccagcaugcagcgccucccc

SEQ ID NO: 70314 - RNA, 30 nt, Human
cuccccgcugccacccgggccacccugauu

SEQ ID NO: 70315 - RNA, 24 nt, Human
cuggcagcccuccgugcuugcuag

SEQ ID NO: 70316 - RNA, 18 nt, Human
cugggucagggucugggg

SEQ ID NO: 70317 - RNA, 23 nt, Human
cuuggcccagccucggucccagc

SEQ ID NO: 70318 - RNA, 24 nt, Human
cuuggcccagccucggucugcagc

SEQ ID NO: 70319 - RNA, 23 nt, Human
cuuggcccagccucggucuuggc

SEQ ID NO: 70320 - RNA, 24 nt, Human
cuuucauuccugucuucacuugcc

SEQ ID NO: 70321 - RNA, 24 nt, Human
gacaauaucacuugccaaaguccu

SEQ ID NO: 70322 - RNA, 26 nt, Human
gagcagcagccagugaaaagggcgcc

SEQ ID NO: 70323 - RNA, 24 nt, Human
gagcagcagccagugaauccgcag

SEQ ID NO: 70324 - RNA, 19 nt, Human
gagccccaggucuggcagc

SEQ ID NO: 70325 - RNA, 23 nt, Human
gauaucaaagacaagacugaacu

SEQ ID NO: 70326 - RNA, 18 nt, Human
gauguuuauuuucucaaa

SEQ ID NO: 70327 - RNA, 19 nt, Human
gccaagaacaaccuuccca

SEQ ID NO: 70328 - RNA, 19 nt, Human
gccucggucuuggcugugu

SEQ ID NO: 70329 - RNA, 21 nt, Human
gccuggccuuugccucccucc

SEQ ID NO: 70330 - RNA, 19 nt, Human
gcugugucucucucucuuc

SEQ ID NO: 70331 - RNA, 18 nt, Human
ggaggaacuggaaaugag

SEQ ID NO: 70332 - RNA, 23 nt, Human
gggagccccaggucuggcagccc

SEQ ID NO: 70333 - RNA, 20 nt, Human
gggucuggggcagacggugg

SEQ ID NO: 70334 - RNA, 24 nt, Human
ggugaccaccgugggaggugcagc

SEQ ID NO: 70335 - RNA, 24 nt, Human
gucucucucucuucuucucuucag

SEQ ID NO: 70336 - RNA, 20 nt, Human
uacacaguuucaugcuucag

SEQ ID NO: 70337 - RNA, 24 nt, Human
ucaaauccacaggcugacguccaa

SEQ ID NO: 70338 - RNA, 20 nt, Human
ucccaggcucccaaagagcc

SEQ ID NO: 70339 - RNA, 19 nt, Human
uccccaaccugacgcacgg

SEQ ID NO: 70340 - RNA, 20 nt, Human
ucuccucccaggcucccaaa

SEQ ID NO: 70341 - RNA, 21 nt, Human
ucuccucccaggcucccaaag

SEQ ID NO: 70342 - RNA, 26 nt, Human
ucucucucucuucuucucuucagaga

SEQ ID NO: 70343 - RNA, 21 nt, Human
ugagcgccuugcaggggcuga

SEQ ID NO: 70344 - RNA, 24 nt, Human
ugauaucaaagacaagacugaacu

SEQ ID NO: 70345 - RNA, 19 nt, Human
uggaaaugagacugcagca

SEQ ID NO: 70346 - RNA, 20 nt, Human
uggaaaugagacugcagcag

SEQ ID NO: 70347 - RNA, 20 nt, Human
uuagcauucuccccucauuu

SEQ ID NO: 70348 - RNA, 22 nt, Human
uuggcccagccucggucccagc

SEQ ID NO: 70349 - RNA, 18 nt, Human
uuuuuuuuuuuuuuuuug

SEQ ID NO: 70350 - RNA, 28 nt, Human
acacagcuccagcugucccaggaaaacc

SEQ ID NO: 70351 - RNA, 24 nt, Human
acgcagcaagaggggagugcaggg

SEQ ID NO: 70352 - RNA, 25 nt, Human
acgcagcaagaggggagugcaggga

SEQ ID NO: 70353 - RNA, 18 nt, Human
agaggggagugcagggag

SEQ ID NO: 70354 - RNA, 21 nt, Human
caagccucugaaaggcuaagg

SEQ ID NO: 70355 - RNA, 18 nt, Human
cacgcagcaagaggggag

SEQ ID NO: 70356 - RNA, 23 nt, Human
cagcugcacagagucagcagcag

SEQ ID NO: 70357 - RNA, 18 nt, Human
cccagcguccaccguccg

SEQ ID NO: 70358 - RNA, 19 nt, Human
cccgcacugaggacucggc

SEQ ID NO: 70359 - RNA, 18 nt, Human
cccugaacaccaagccuc

SEQ ID NO: 70360 - RNA, 22 nt, Human
cccugaacaccaagccucugaa

SEQ ID NO: 70361 - RNA, 22 nt, Human
ccuggacugcagugccuccaaa

SEQ ID NO: 70362 - RNA, 21 nt, Human
cggcggcgggggucggaacgg

SEQ ID NO: 70363 - RNA, 21 nt, Human
cggcgggggucggaacggcgg

SEQ ID NO: 70364 - RNA, 20 nt, Human
gaggcacggccccacccaca

SEQ ID NO: 70365 - RNA, 18 nt, Human
gaggguggagguggggga

SEQ ID NO: 70366 - RNA, 18 nt, Human
gagucagcagcagcagcc

SEQ ID NO: 70367 - RNA, 24 nt, Human
gcagcagcagccugcuccccgcac

SEQ ID NO: 70368 - RNA, 20 nt, Human
ggagcuacaaacgcguccca

SEQ ID NO: 70369 - RNA, 20 nt, Human
ggggagugcagggagggccc

SEQ ID NO: 70370 - RNA, 19 nt, Human
gggggucggaacggcgggg

SEQ ID NO: 70371 - RNA, 20 nt, Human
uccagcugucccaggaaaac

SEQ ID NO: 70372 - RNA, 23 nt, Human
uccccgcacugaggacucggccu

SEQ ID NO: 70373 - RNA, 22 nt, Human
ucggccuggacugcagugccuc

SEQ ID NO: 70374 - RNA, 20 nt, Human
ugaaaggcuaagggacacag

SEQ ID NO: 70375 - RNA, 25 nt, Human
ugaaaggcuaagggacacagcucca

SEQ ID NO: 70376 - RNA, 22 nt, Human
ugaggacucggccuggacugca

SEQ ID NO: 70377 - RNA, 24 nt, Human
ugaggguggaggugggggacacag

SEQ ID NO: 70378 - RNA, 20 nt, Human
ugggggacacaggugcgcag

SEQ ID NO: 70379 - RNA, 21 nt, Human
uggguugaggguggagguggg

SEQ ID NO: 70380 - RNA, 22 nt, Human
uugaggguggaggugggggaca

SEQ ID NO: 70381 - RNA, 22 nt, Human
acggcacggggcgggcgggggc

SEQ ID NO: 70382 - RNA, 18 nt, Human
aguaaagagaaaugacaa

SEQ ID NO: 70383 - RNA, 18 nt, Human
cacggcacggggcgggcg

SEQ ID NO: 70384 - RNA, 21 nt, Human
caggaacccacaaggcgacac

SEQ ID NO: 70385 - RNA, 24 nt, Human
ccggcggugagggcggcuccaucc

SEQ ID NO: 70386 - RNA, 21 nt, Human
cgcgcagggccacgggcccgg

SEQ ID NO: 70387 - RNA, 22 nt, Human
cuccgcgcagggccacgggccc

SEQ ID NO: 70388 - RNA, 20 nt, Human
gcaacaggaacccacaaggc

SEQ ID NO: 70389 - RNA, 23 nt, Human
gccgcuccgcagacgcaggaaca

SEQ ID NO: 70390 - RNA, 23 nt, Human
gcgcagggccacgggcccggcgg

SEQ ID NO: 70391 - RNA, 23 nt, Human
gcggcggccccgugcguaugugu

SEQ ID NO: 70392 - RNA, 20 nt, Human
gcgggcgggggcaaggccgg

SEQ ID NO: 70393 - RNA, 19 nt, Human
gcugggagacaagggccgc

SEQ ID NO: 70394 - RNA, 23 nt, Human
ggacacagcuccgcgcagggcca

SEQ ID NO: 70395 - RNA, 19 nt, Human
ggcggcuccauccaggaag

SEQ ID NO: 70396 - RNA, 19 nt, Human
ggcgggcgggggcaaggcc

SEQ ID NO: 70397 - RNA, 23 nt, Human
gggccacgggcccggcggugagg

SEQ ID NO: 70398 - RNA, 19 nt, Human
ggggguggggcgccggggg

SEQ ID NO: 70399 - RNA, 18 nt, Human
ggguggggcgccgggggc

SEQ ID NO: 70400 - RNA, 20 nt, Human
ggucuuuacauaauauucug

SEQ ID NO: 70401 - RNA, 18 nt, Human
guacaagaccaacuacug

SEQ ID NO: 70402 - RNA, 20 nt, Human
guggggcgccgggggccugg

SEQ ID NO: 70403 - RNA, 18 nt, Human
uaacauccaguaaagaga

SEQ ID NO: 70404 - RNA, 20 nt, Human
uacaagaccaacuacugggg

SEQ ID NO: 70405 - RNA, 21 nt, Human
uacaagaccaacuacuggggg

SEQ ID NO: 70406 - RNA, 22 nt, Human
uaggggguggggcgccgggggc

SEQ ID NO: 70407 - RNA, 18 nt, Human
ucagcaacaggaacccac

SEQ ID NO: 70408 - RNA, 25 nt, Human
uccacggcacggggcgggcgggggc

SEQ ID NO: 70409 - RNA, 22 nt, Human
uccgcagacgcaggaacaggcc

SEQ ID NO: 70410 - RNA, 22 nt, Human
ugagggcggcuccauccaggaa

SEQ ID NO: 70411 - RNA, 19 nt, Human
ugccgguaccgcucuuggc

SEQ ID NO: 70412 - RNA, 19 nt, Human
aaacugcccccaggcccca

SEQ ID NO: 70413 - RNA, 19 nt, Human
aaccaggaccggccggcac

SEQ ID NO: 70414 - RNA, 21 nt, Human
acacacacacacacacacaca

SEQ ID NO: 70415 - RNA, 22 nt, Human
acacucuguccuucccaugggc

SEQ ID NO: 70416 - RNA, 31 nt, Human
acagaccacauacacacacacgcacacacag

SEQ ID NO: 70417 - RNA, 18 nt, Human
acaggcuugucacagacc

SEQ ID NO: 70418 - RNA, 26 nt, Human
accacauacacacacacgcacacaca

SEQ ID NO: 70419 - RNA, 25 nt, Human
acgcacacacacgcgcacacacaca

SEQ ID NO: 70420 - RNA, 26 nt, Human
acgcacacacacgcgcacacacacac

SEQ ID NO: 70421 - RNA, 19 nt, Human
acuacaccccggacaggca

SEQ ID NO: 70422 - RNA, 23 nt, Human
agaggggcagggcugagggaggg

SEQ ID NO: 70423 - RNA, 18 nt, Human
aggcaggugagccacagg

SEQ ID NO: 70424 - RNA, 23 nt, Human
auacacacacacgcacacacacg

SEQ ID NO: 70425 - RNA, 22 nt, Human
auccccccaggccccaaggaca

SEQ ID NO: 70426 - RNA, 23 nt, Human
cacacacacacacaaagagugca

SEQ ID NO: 70427 - RNA, 23 nt, Human
cacacacacacacacaaagagug

SEQ ID NO: 70428 - RNA, 18 nt, Human
cacacacacacacacaca

SEQ ID NO: 70429 - RNA, 20 nt, Human
cacacacacacacacacaca

SEQ ID NO: 70430 - RNA, 20 nt, Human
cacacacacacacacacaca

SEQ ID NO: 70431 - RNA, 26 nt, Human
cacacacacgcacacacacgcgcaca

SEQ ID NO: 70432 - RNA, 22 nt, Human
cacacacacgcgcacacacaca

SEQ ID NO: 70433 - RNA, 33 nt, Human
cacacacacgcgcacacacacacacacacagug

SEQ ID NO: 70434 - RNA, 19 nt, Human
cacacacacucuguccuuc

SEQ ID NO: 70435 - RNA, 25 nt, Human
cacacgcacacacacgcgcacacac

SEQ ID NO: 70436 - RNA, 25 nt, Human
cacgcacacacacgcgcacacacac

SEQ ID NO: 70437 - RNA, 23 nt, Human
cacucuguccuucccaugggcca

SEQ ID NO: 70438 - RNA, 22 nt, Human
cagcggcuguaaccacagggcu

SEQ ID NO: 70439 - RNA, 27 nt, Human
caggccccaggguucucaggucaggga

SEQ ID NO: 70440 - RNA, 28 nt, Human
cauacacacacacgcacacacacgcgca

SEQ ID NO: 70441 - RNA, 20 nt, Human
caugggccauggcucuggga

SEQ ID NO: 70442 - RNA, 25 nt, Human
ccacagaagggagaggaggcucaaa

SEQ ID NO: 70443 - RNA, 25 nt, Human
ccaggccccaaggacacacacacuc

SEQ ID NO: 70444 - RNA, 24 nt, Human
cccagccccuuuucaggccuaaga

SEQ ID NO: 70445 - RNA, 22 nt, Human
cccaggccccaggguucucagg

SEQ ID NO: 70446 - RNA, 20 nt, Human
cccaggucagcugacgcugc

SEQ ID NO: 70447 - RNA, 20 nt, Human
ccccaggccccaggguucuc

SEQ ID NO: 70448 - RNA, 22 nt, Human
ccccaggguucucaggucagga

SEQ ID NO: 70449 - RNA, 22 nt, Human
ccccaggguucucaggucaggg

SEQ ID NO: 70450 - RNA, 22 nt, Human
ccccaggucagcugacgcugcc

SEQ ID NO: 70451 - RNA, 19 nt, Human
ccccccaggccccaaggac

SEQ ID NO: 70452 - RNA, 20 nt, Human
ccgcuaggacagcguacuac

SEQ ID NO: 70453 - RNA, 25 nt, Human
cgcgcacacacacacacacacacac

SEQ ID NO: 70454 - RNA, 20 nt, Human
cgggagcggcgggaccggag

SEQ ID NO: 70455 - RNA, 23 nt, Human
gaaccaggaccggccggcacgaa

SEQ ID NO: 70456 - RNA, 21 nt, Human
gaguuagggaggaacaugaaa

SEQ ID NO: 70457 - RNA, 23 nt, Human
gcgcacacacacacacacacaca

SEQ ID NO: 70458 - RNA, 22 nt, Human
gcucaaacugcccccaggcccc

SEQ ID NO: 70459 - RNA, 21 nt, Human
ggacacacacacucuguccuu

SEQ ID NO: 70460 - RNA, 22 nt, Human
ggacacacacacucuguccuuc

SEQ ID NO: 70461 - RNA, 19 nt, Human
gggagcgacccacagaagg

SEQ ID NO: 70462 - RNA, 21 nt, Human
ggggggggugcccagccccuu

SEQ ID NO: 70463 - RNA, 20 nt, Human
uaaccacagggcugaggggg

SEQ ID NO: 70464 - RNA, 21 nt, Human
uaggacagcguacuacacccc

SEQ ID NO: 70465 - RNA, 19 nt, Human
ucaggucagggaguuaggg

SEQ ID NO: 70466 - RNA, 21 nt, Human
uccccaggucagcugacgcug

SEQ ID NO: 70467 - RNA, 20 nt, Human
uccuuggugggggggggugc

SEQ ID NO: 70468 - RNA, 20 nt, Human
ugagagccuugggccaggac

SEQ ID NO: 70469 - RNA, 22 nt, Human
ugagccacaggcuugucacaga

SEQ ID NO: 70470 - RNA, 21 nt, Human
ugcccccaggccccaggguuc

SEQ ID NO: 70471 - RNA, 22 nt, Human
uggugggggggggugcccagcc

SEQ ID NO: 70472 - RNA, 22 nt, Human
uucuuagauacaucagcggcug

SEQ ID NO: 70473 - RNA, 22 nt, Human
uuuuuuuuuuuuuuuuugccuu

SEQ ID NO: 70474 - RNA, 26 nt, Human
uuuuuuuuuuuuuuuuuuugccuuag

SEQ ID NO: 70475 - RNA, 27 nt, Human
uuuuuuuuuuuuuuuuuuuuuuugggg

SEQ ID NO: 70476 - RNA, 18 nt, Human
aaaggaaaacacgcugca

SEQ ID NO: 70477 - RNA, 20 nt, Human
aaccccuaccccgucgccuc

SEQ ID NO: 70478 - RNA, 18 nt, Human
aagugucaauagcugacc

SEQ ID NO: 70479 - RNA, 23 nt, Human
aggaggaaaauauuuauuccaaa

SEQ ID NO: 70480 - RNA, 24 nt, Human
aggcaggagccaucuucaaaucca

SEQ ID NO: 70481 - RNA, 19 nt, Human
caaaaaaggcaaaggaaaa

SEQ ID NO: 70482 - RNA, 26 nt, Human
caaagugcaaaaaaggcaaaggaaaa

SEQ ID NO: 70483 - RNA, 18 nt, Human
caccaaagugcaaaaaag

SEQ ID NO: 70484 - RNA, 23 nt, Human
caucuucaaauccacagauucca

SEQ ID NO: 70485 - RNA, 23 nt, Human
ccaaccccuaccccgucgccuca

SEQ ID NO: 70486 - RNA, 24 nt, Human
cccuaccccgucgccucacucgga

SEQ ID NO: 70487 - RNA, 21 nt, Human
ccgccugagcgccaaccccua

SEQ ID NO: 70488 - RNA, 21 nt, Human
cgccaaccccuaccccgucgc

SEQ ID NO: 70489 - RNA, 23 nt, Human
cgccugagcgccaaccccuaccc

SEQ ID NO: 70490 - RNA, 24 nt, Human
cuaaacacuucacugauucccacg

SEQ ID NO: 70491 - RNA, 20 nt, Human
cucaaagacugagcacugua

SEQ ID NO: 70492 - RNA, 19 nt, Human
cugagcgccaaccccuacc

SEQ ID NO: 70493 - RNA, 19 nt, Human
ggccaaaacaggcaaguca

SEQ ID NO: 70494 - RNA, 19 nt, Human
guaauucaccaaagugcaa

SEQ ID NO: 70495 - RNA, 20 nt, Human
uagaaaggaggaaaauauuu

SEQ ID NO: 70496 - RNA, 20 nt, Human
uauuuauuccaaaagauggc

SEQ ID NO: 70497 - RNA, 19 nt, Human
ucaaauccacagauuccaa

SEQ ID NO: 70498 - RNA, 22 nt, Human
uccaaaagauggcagaaagaag

SEQ ID NO: 70499 - RNA, 23 nt, Human
ucggaucccaccaggaaguguca

SEQ ID NO: 70500 - RNA, 22 nt, Human
ucucucagaagaacagcaucuu

SEQ ID NO: 70501 - RNA, 21 nt, Human
ucuguugagauggcucuuccc

SEQ ID NO: 70502 - RNA, 21 nt, Human
ugagaaggcaggagccaucuu

SEQ ID NO: 70503 - RNA, 18 nt, Human
uggaggugauuuugcauc

SEQ ID NO: 70504 - RNA, 19 nt, Human
uggcagaaagaagaaauuc

SEQ ID NO: 70505 - RNA, 21 nt, Human
ugucuugcagcaguuucuaaa

SEQ ID NO: 70506 - RNA, 21 nt, Human
uucaccaaagugcaaaaaagg

SEQ ID NO: 70507 - RNA, 23 nt, Human
uucccacgugagaaggcaggagc

SEQ ID NO: 70508 - RNA, 18 nt, Human
uucuguugagauggcucu

SEQ ID NO: 70509 - RNA, 22 nt, Human
aaaaaaaaaauaauaaaaaaaa

SEQ ID NO: 70510 - RNA, 24 nt, Human
aaaaaaacagggaaacaaauaaca

SEQ ID NO: 70511 - RNA, 23 nt, Human
aaaaauucaacaagcaaacaaac

SEQ ID NO: 70512 - RNA, 24 nt, Human
aaaacaaauuuggucaaacuuucu

SEQ ID NO: 70513 - RNA, 23 nt, Human
aaaacaacaacaacaacaaaaaa

SEQ ID NO: 70514 - RNA, 23 nt, Human
aaacaaacaugcaaacaugugac

SEQ ID NO: 70515 - RNA, 23 nt, Human
aaaguuauagaaaccuggccuuc

SEQ ID NO: 70516 - RNA, 18 nt, Human
aaauacauacuaucagug

SEQ ID NO: 70517 - RNA, 23 nt, Human
aacaacaacaacaaaaaaacaaa

SEQ ID NO: 70518 - RNA, 23 nt, Human
aagaucacgccauugcacuccag

SEQ ID NO: 70519 - RNA, 21 nt, Human
aagcaaacaaacaugcaaaca

SEQ ID NO: 70520 - RNA, 18 nt, Human
aaggcugcagugagccaa

SEQ ID NO: 70521 - RNA, 19 nt, Human
aaguauguaauaguccuug

SEQ ID NO: 70522 - RNA, 23 nt, Human
aaucacuugaacccgggaggcga

SEQ ID NO: 70523 - RNA, 21 nt, Human
aaucugcaagaauuuaaacaa

SEQ ID NO: 70524 - RNA, 24 nt, Human
aauuauacacaacuuuuaacauaa

SEQ ID NO: 70525 - RNA, 19 nt, Human
aauuccuuugcaaaaugcu

SEQ ID NO: 70526 - RNA, 23 nt, Human
acaaaaaaacaaauuuggucaaa

SEQ ID NO: 70527 - RNA, 20 nt, Human
acaaacaugcaaacauguga

SEQ ID NO: 70528 - RNA, 24 nt, Human
acaacaacaacaacaaaaaaacaa

SEQ ID NO: 70529 - RNA, 18 nt, Human
acaauaaagaagcaaagg

SEQ ID NO: 70530 - RNA, 19 nt, Human
acaauuuaauagagaugag

SEQ ID NO: 70531 - RNA, 20 nt, Human
acacucauacauaaacauuc

SEQ ID NO: 70532 - RNA, 21 nt, Human
accaauauggugaaaccccgu

SEQ ID NO: 70533 - RNA, 24 nt, Human
accccguuucuacuaaaaauacaa

SEQ ID NO: 70534 - RNA, 18 nt, Human
acuagucucaaagcugca

SEQ ID NO: 70535 - RNA, 24 nt, Human
acuccguccccaaaaaaaaaauaa

SEQ ID NO: 70536 - RNA, 18 nt, Human
agagaugaggaaagggua

SEQ ID NO: 70537 - RNA, 20 nt, Human
agcaaacaaacaugcaaaca

SEQ ID NO: 70538 - RNA, 24 nt, Human
agcaguuugggaggccgagguggg

SEQ ID NO: 70539 - RNA, 24 nt, Human
agccugaccaauauggugaaaccc

SEQ ID NO: 70540 - RNA, 23 nt, Human
agcugggcaugguggagcaugcc

SEQ ID NO: 70541 - RNA, 23 nt, Human
aggaagagggaggcccuucacaa

SEQ ID NO: 70542 - RNA, 18 nt, Human
aggcaggagaaucacuug

SEQ ID NO: 70543 - RNA, 24 nt, Human
aggcaggagaaucacuugaacccg

SEQ ID NO: 70544 - RNA, 21 nt, Human
aggccgaggugggcggaucac

SEQ ID NO: 70545 - RNA, 19 nt, Human
aggcgaaggcugcagugag

SEQ ID NO: 70546 - RNA, 24 nt, Human
aggcgaaggcugcagugagccaag

SEQ ID NO: 70547 - RNA, 24 nt, Human
aggcgcgguggcucacgccuguaa

SEQ ID NO: 70548 - RNA, 24 nt, Human
aggcugaggcaggagaaucacuug

SEQ ID NO: 70549 - RNA, 18 nt, Human
aggugcagagacuguacc

SEQ ID NO: 70550 - RNA, 22 nt, Human
aggugggcggaucaccugaggu

SEQ ID NO: 70551 - RNA, 21 nt, Human
aguucccaaugguuucucaca

SEQ ID NO: 70552 - RNA, 24 nt, Human
aucacgccauugcacuccagccug

SEQ ID NO: 70553 - RNA, 20 nt, Human
auggugaaaccccguuucua

SEQ ID NO: 70554 - RNA, 24 nt, Human
auugcacuccagccugggcaacaa

SEQ ID NO: 70555 - RNA, 25 nt, Human
auugcacuccagccugggcaacaag

SEQ ID NO: 70556 - RNA, 18 nt, Human
auuucauuccuauuagga

SEQ ID NO: 70557 - RNA, 21 nt, Human
auuucauuccuauuaggaugg

SEQ ID NO: 70558 - RNA, 22 nt, Human
caaaacaacaacaacaacaaaa

SEQ ID NO: 70559 - RNA, 24 nt, Human
caaaaugcuaagcugccaaugagc

SEQ ID NO: 70560 - RNA, 19 nt, Human
caaaauuagcugggcaugg

SEQ ID NO: 70561 - RNA, 24 nt, Human
caaauucaaaacaacaacaacaac

SEQ ID NO: 70562 - RNA, 22 nt, Human
caacaacaacaacaaaaaaaca

SEQ ID NO: 70563 - RNA, 21 nt, Human
caacaagcaaacaaacaugca

SEQ ID NO: 70564 - RNA, 22 nt, Human
caacaagcaaacaaacaugcaa

SEQ ID NO: 70565 - RNA, 24 nt, Human
caauagaaauugagucauuucaca

SEQ ID NO: 70566 - RNA, 20 nt, Human
cacaacacuagaacaaagga

SEQ ID NO: 70567 - RNA, 22 nt, Human
cacacccuuuccucuucccaaa

SEQ ID NO: 70568 - RNA, 23 nt, Human
cacacccuuuccucuucccaaag

SEQ ID NO: 70569 - RNA, 23 nt, Human
cacacucauacauaaacauucuu

SEQ ID NO: 70570 - RNA, 21 nt, Human
cacccuacauacaaguuuaca

SEQ ID NO: 70571 - RNA, 22 nt, Human
caccugaggucuggaguucgag

SEQ ID NO: 70572 - RNA, 24 nt, Human
cacgccuguaaucccagcaguuug

SEQ ID NO: 70573 - RNA, 18 nt, Human
cagaagcuuaggcuucca

SEQ ID NO: 70574 - RNA, 24 nt, Human
cagcaguuugggaggccgaggugg

SEQ ID NO: 70575 - RNA, 24 nt, Human
cagcuacucgggaggcugaggcag

SEQ ID NO: 70576 - RNA, 23 nt, Human
cauaggcacuagucucaaagcug

SEQ ID NO: 70577 - RNA, 24 nt, Human
cauguucacacacccuuuccucuu

SEQ ID NO: 70578 - RNA, 18 nt, Human
cauugcacuccagccugg

SEQ ID NO: 70579 - RNA, 19 nt, Human
cauugcacuccagccuggg

SEQ ID NO: 70580 - RNA, 21 nt, Human
cauugcacuccagccugggca

SEQ ID NO: 70581 - RNA, 24 nt, Human
cauugcacuccagccugggcaaca

SEQ ID NO: 70582 - RNA, 22 nt, Human
cauugcuaucacaauccuaguu

SEQ ID NO: 70583 - RNA, 22 nt, Human
ccagcugguccuuaaaggugca

SEQ ID NO: 70584 - RNA, 20 nt, Human
ccauugcacuccagccuggg

SEQ ID NO: 70585 - RNA, 21 nt, Human
ccauugcacuccagccugggc

SEQ ID NO: 70586 - RNA, 23 nt, Human
ccauugcacuccagccugggcaa

SEQ ID NO: 70587 - RNA, 24 nt, Human
ccauugcacuccagccugggcaac

SEQ ID NO: 70588 - RNA, 20 nt, Human
cccaaaaaaaaaauaauaaa

SEQ ID NO: 70589 - RNA, 18 nt, Human
cccaucacacuugccaca

SEQ ID NO: 70590 - RNA, 21 nt, Human
ccccaggaaucacuacagccc

SEQ ID NO: 70591 - RNA, 22 nt, Human
ccgggaggcgaaggcugcagug

SEQ ID NO: 70592 - RNA, 22 nt, Human
ccuaguaaugaaguauguaaua

SEQ ID NO: 70593 - RNA, 18 nt, Human
ccucuugaguaggccacu

SEQ ID NO: 70594 - RNA, 23 nt, Human
ccugaccaauauggugaaacccc

SEQ ID NO: 70595 - RNA, 24 nt, Human
ccugaccaauauggugaaaccccg

SEQ ID NO: 70596 - RNA, 22 nt, Human
ccugcuggggcgcgaggugcag

SEQ ID NO: 70597 - RNA, 24 nt, Human
ccuggccaggcgcgguggcucacg

SEQ ID NO: 70598 - RNA, 22 nt, Human
ccuguaaucccagcaguuuggg

SEQ ID NO: 70599 - RNA, 21 nt, Human
ccuguaaucccagcuacucgg

SEQ ID NO: 70600 - RNA, 24 nt, Human
cgagaccagccugaccaauauggu

SEQ ID NO: 70601 - RNA, 24 nt, Human
cgaggugggcggaucaccugaggu

SEQ ID NO: 70602 - RNA, 24 nt, Human
cgccauugcacuccagccugggca

SEQ ID NO: 70603 - RNA, 24 nt, Human
cggaucaccugaggucuggaguuc

SEQ ID NO: 70604 - RNA, 21 nt, Human
cucacgccuguaaucccagca

SEQ ID NO: 70605 - RNA, 21 nt, Human
cucacgccuguaaucccagca

SEQ ID NO: 70606 - RNA, 23 nt, Human
cucuaaguuugaccgccugauuu

SEQ ID NO: 70607 - RNA, 21 nt, Human
cugaaacucuguaacagguga

SEQ ID NO: 70608 - RNA, 21 nt, Human
cugcacaauaaagaagcaaag

SEQ ID NO: 70609 - RNA, 22 nt, Human
gaaccaaaaaccauaugaaaga

SEQ ID NO: 70610 - RNA, 23 nt, Human
gagaaucacuugaacccgggagg

SEQ ID NO: 70611 - RNA, 18 nt, Human
gagauucaacacuggaaa

SEQ ID NO: 70612 - RNA, 22 nt, Human
gagauucaacacuggaaaaaua

SEQ ID NO: 70613 - RNA, 20 nt, Human
gaggcaauauauauggccuc

SEQ ID NO: 70614 - RNA, 18 nt, Human
gaucaccugaggucugga

SEQ ID NO: 70615 - RNA, 24 nt, Human
gaucaccugaggucuggaguucga

SEQ ID NO: 70616 - RNA, 20 nt, Human
gcaauuccuuugcaaaaugc

SEQ ID NO: 70617 - RNA, 23 nt, Human
gcaggagaaucacuugaacccgg

SEQ ID NO: 70618 - RNA, 25 nt, Human
gcaggccacuguaaaaacauguaau

SEQ ID NO: 70619 - RNA, 22 nt, Human
gccauugcacuccagccugggc

SEQ ID NO: 70620 - RNA, 24 nt, Human
gccauugcacuccagccugggcaa

SEQ ID NO: 70621 - RNA, 19 nt, Human
ggaaaucacaguuguaauc

SEQ ID NO: 70622 - RNA, 24 nt, Human
ggaagugaugcauaauuggaacau

SEQ ID NO: 70623 - RNA, 24 nt, Human
ggacacuccguccccaaaaaaaaa

SEQ ID NO: 70624 - RNA, 22 nt, Human
ggagcaugccuguaaucccagc

SEQ ID NO: 70625 - RNA, 23 nt, Human
ggaucaccugaggucuggaguuc

SEQ ID NO: 70626 - RNA, 23 nt, Human
ggcaugguggagcaugccuguaa

SEQ ID NO: 70627 - RNA, 21 nt, Human
ggcucacgccuguaaucccag

SEQ ID NO: 70628 - RNA, 20 nt, Human
gggaggccgaggugggcgga

SEQ ID NO: 70629 - RNA, 23 nt, Human
gggaggcugaggcaggagaauca

SEQ ID NO: 70630 - RNA, 24 nt, Human
gguggagcaugccuguaaucccag

SEQ ID NO: 70631 - RNA, 23 nt, Human
gguggcucacgccuguaauccca

SEQ ID NO: 70632 - RNA, 24 nt, Human
gguggcucacgccuguaaucccag

SEQ ID NO: 70633 - RNA, 22 nt, Human
ggugugauguggaucaaguuuu

SEQ ID NO: 70634 - RNA, 22 nt, Human
guaaaaacauguaaucugcaag

SEQ ID NO: 70635 - RNA, 25 nt, Human
guccccaaaaaaaaaauaauaaaaa

SEQ ID NO: 70636 - RNA, 20 nt, Human
guggagcaugccuguaaucc

SEQ ID NO: 70637 - RNA, 23 nt, Human
guggcucacgccuguaaucccag

SEQ ID NO: 70638 - RNA, 21 nt, Human
guuugggaggccgaggugggc

SEQ ID NO: 70639 - RNA, 18 nt, Human
uaaaaauacaaaauuagc

SEQ ID NO: 70640 - RNA, 19 nt, Human
uaaaaauacaaaauuagcu

SEQ ID NO: 70641 - RNA, 23 nt, Human
uaacacacauaggcacuagucuc

SEQ ID NO: 70642 - RNA, 20 nt, Human
uaauuucugucaauguucuc

SEQ ID NO: 70643 - RNA, 19 nt, Human
uacagcccagcugguccuu

SEQ ID NO: 70644 - RNA, 25 nt, Human
uaggaccagacacagcacaauaaau

SEQ ID NO: 70645 - RNA, 21 nt, Human
uagggccucuugaguaggcca

SEQ ID NO: 70646 - RNA, 20 nt, Human
uaguuugcugguagguuuaa

SEQ ID NO: 70647 - RNA, 21 nt, Human
uaucaguagauacaaaauuaa

SEQ ID NO: 70648 - RNA, 21 nt, Human
uauuucauauauugugugagc

SEQ ID NO: 70649 - RNA, 23 nt, Human
ucaaaacaacaacaacaacaaaa

SEQ ID NO: 70650 - RNA, 19 nt, Human
ucaaauucaaaacaacaac

SEQ ID NO: 70651 - RNA, 23 nt, Human
ucacgccauugcacuccagccug

SEQ ID NO: 70652 - RNA, 18 nt, Human
ucacuacagcccagcugg

SEQ ID NO: 70653 - RNA, 21 nt, Human
ucagauaaaggaagagggagg

SEQ ID NO: 70654 - RNA, 22 nt, Human
ucaggauggaaggaaauuuuca

SEQ ID NO: 70655 - RNA, 18 nt, Human
uccaaauucacugcaaag

SEQ ID NO: 70656 - RNA, 19 nt, Human
uccaagauguuuaaggaaa

SEQ ID NO: 70657 - RNA, 25 nt, Human
ucgggaggcugaggcaggagaauca

SEQ ID NO: 70658 - RNA, 19 nt, Human
ucguuauucaggauggaag

SEQ ID NO: 70659 - RNA, 22 nt, Human
ucuauucguuauucaggaugga

SEQ ID NO: 70660 - RNA, 18 nt, Human
ucucugguauuuuacugc

SEQ ID NO: 70661 - RNA, 22 nt, Human
ucugagaaaccucuuaagccag

SEQ ID NO: 70662 - RNA, 21 nt, Human
ucuguaacaggugaagggaga

SEQ ID NO: 70663 - RNA, 27 nt, Human
ugaaauaaacuaugcuuuaauaagaca

SEQ ID NO: 70664 - RNA, 23 nt, Human
ugaccaauauggugaaaccccgu

SEQ ID NO: 70665 - RNA, 25 nt, Human
ugacccagauucuguuaucaguagg

SEQ ID NO: 70666 - RNA, 18 nt, Human
ugagcuuaccacaauaga

SEQ ID NO: 70667 - RNA, 20 nt, Human
ugaggcaggagaaucacuug

SEQ ID NO: 70668 - RNA, 24 nt, Human
ugaggcaggagaaucacuugaacc

SEQ ID NO: 70669 - RNA, 25 nt, Human
ugaggcaggagaaucacuugaaccc

SEQ ID NO: 70670 - RNA, 21 nt, Human
ugcacaauaaagaagcaaagg

SEQ ID NO: 70671 - RNA, 19 nt, Human
ugcacuccagccugggcaa

SEQ ID NO: 70672 - RNA, 23 nt, Human
ugccuguaaucccagcuacucgg

SEQ ID NO: 70673 - RNA, 24 nt, Human
ugccuguaaucccagcuacucggg

SEQ ID NO: 70674 - RNA, 24 nt, Human
uggccaggcgcgguggcucacgcc

SEQ ID NO: 70675 - RNA, 24 nt, Human
uggcucacgccuguaaucccagca

SEQ ID NO: 70676 - RNA, 19 nt, Human
ugggaggccgaggugggcg

SEQ ID NO: 70677 - RNA, 24 nt, Human
ugggaggccgaggugggcggauca

SEQ ID NO: 70678 - RNA, 24 nt, Human
ugggcggaucaccugaggucugga

SEQ ID NO: 70679 - RNA, 24 nt, Human
ugguggagcaugccuguaauccca

SEQ ID NO: 70680 - RNA, 18 nt, Human
ugugagauucaacacugg

SEQ ID NO: 70681 - RNA, 20 nt, Human
uguucacacacccuuuccuc

SEQ ID NO: 70682 - RNA, 25 nt, Human
uguuuaaggaaaauaaacaggguga

SEQ ID NO: 70683 - RNA, 20 nt, Human
uuagcugggcaugguggagc

SEQ ID NO: 70684 - RNA, 24 nt, Human
uuagcugggcaugguggagcaugc

SEQ ID NO: 70685 - RNA, 25 nt, Human
uucaaaacaacaacaacaacaaaaa

SEQ ID NO: 70686 - RNA, 20 nt, Human
uucaacacuggaaaaauaca

SEQ ID NO: 70687 - RNA, 21 nt, Human
uucccaaagaggaagcaacgg

SEQ ID NO: 70688 - RNA, 21 nt, Human
uugcugguagguuuaagaaag

SEQ ID NO: 70689 - RNA, 25 nt, Human
uugggaggccgaggugggcggauca

SEQ ID NO: 70690 - RNA, 22 nt, Human
uuuaacacauucuuacuaaaga

SEQ ID NO: 70691 - RNA, 25 nt, Human
uuuacaguaguguaaccagaaugua

SEQ ID NO: 70692 - RNA, 20 nt, Human
uuucuacuaaaaauacaaaa

SEQ ID NO: 70693 - RNA, 23 nt, Human
aaaacuggcucuauucuuaauua

SEQ ID NO: 70694 - RNA, 20 nt, Human
aagcaagcaaaggauacuag

SEQ ID NO: 70695 - RNA, 20 nt, Human
aagcagcauagcaagugagc

SEQ ID NO: 70696 - RNA, 21 nt, Human
aagcagcauagcaagugagcu

SEQ ID NO: 70697 - RNA, 26 nt, Human
aagucaucuucaaauuuguguucuga

SEQ ID NO: 70698 - RNA, 18 nt, Human
acaccauuccccugugaa

SEQ ID NO: 70699 - RNA, 23 nt, Human
acgaaagucagacaacacaaaug

SEQ ID NO: 70700 - RNA, 22 nt, Human
acucugauuuuuuuaguacaca

SEQ ID NO: 70701 - RNA, 21 nt, Human
agaagcaagcaaaggauacua

SEQ ID NO: 70702 - RNA, 18 nt, Human
agaccuaaaauucuagug

SEQ ID NO: 70703 - RNA, 24 nt, Human
aguacgaccauacugcaacuuauu

SEQ ID NO: 70704 - RNA, 24 nt, Human
augauaucaauaaggaagagaccu

SEQ ID NO: 70705 - RNA, 19 nt, Human
caauaaaaagaaacuauau

SEQ ID NO: 70706 - RNA, 21 nt, Human
cacauauucuuuacaucauga

SEQ ID NO: 70707 - RNA, 23 nt, Human
caccacaauacaccuuugcacag

SEQ ID NO: 70708 - RNA, 21 nt, Human
caccuuugcacagguaauuuu

SEQ ID NO: 70709 - RNA, 19 nt, Human
cagguaccgaggcagacag

SEQ ID NO: 70710 - RNA, 19 nt, Human
caguaacuauucaacaguu

SEQ ID NO: 70711 - RNA, 22 nt, Human
cauacgaaagucagacaacaca

SEQ ID NO: 70712 - RNA, 18 nt, Human
ccuggaagcagcauagca

SEQ ID NO: 70713 - RNA, 22 nt, Human
cgaggcagacagccuagcggac

SEQ ID NO: 70714 - RNA, 24 nt, Human
cgaggcagacagccuagcggacgc

SEQ ID NO: 70715 - RNA, 23 nt, Human
cuauauauauauauuuuuuccuu

SEQ ID NO: 70716 - RNA, 22 nt, Human
gacaacacaaaugguuacaccu

SEQ ID NO: 70717 - RNA, 20 nt, Human
gagaauucaccuaggaaagg

SEQ ID NO: 70718 - RNA, 22 nt, Human
gcacaauaguaacaaauggaau

SEQ ID NO: 70719 - RNA, 18 nt, Human
gcaguaacagguaccgag

SEQ ID NO: 70720 - RNA, 22 nt, Human
uaaacucugauuuuuuuaguac

SEQ ID NO: 70721 - RNA, 20 nt, Human
uaaauacccaucauauacug

SEQ ID NO: 70722 - RNA, 23 nt, Human
uaacaaauggaauuaaugcauac

SEQ ID NO: 70723 - RNA, 21 nt, Human
uaacucucaaacagaacugua

SEQ ID NO: 70724 - RNA, 23 nt, Human
uaagaagcaagcaaaggauacua

SEQ ID NO: 70725 - RNA, 19 nt, Human
uacacacaccacaauacac

SEQ ID NO: 70726 - RNA, 22 nt, Human
uacccaucauauacugaaaagu

SEQ ID NO: 70727 - RNA, 18 nt, Human
uacugaaaagucaucuuc

SEQ ID NO: 70728 - RNA, 21 nt, Human
uagcacacacaaacacaagga

SEQ ID NO: 70729 - RNA, 23 nt, Human
uagcagcaguaacagguaccgag

SEQ ID NO: 70730 - RNA, 23 nt, Human
uaggaaaggggguaagaagcaag

SEQ ID NO: 70731 - RNA, 19 nt, Human
uauaacaaaauccuggaag

SEQ ID NO: 70732 - RNA, 18 nt, Human
ucagcgauccaucccuuc

SEQ ID NO: 70733 - RNA, 19 nt, Human
ugaaacguucagaaauccc

SEQ ID NO: 70734 - RNA, 21 nt, Human
ugaaacguucagaaaucccau

SEQ ID NO: 70735 - RNA, 20 nt, Human
ugagauacagaccacugugg

SEQ ID NO: 70736 - RNA, 25 nt, Human
ugugcacaauaguaacaaauggaau

SEQ ID NO: 70737 - RNA, 21 nt, Human
uguucugacccaaauuuggcu

SEQ ID NO: 70738 - RNA, 23 nt, Human
uuacacacaccacaauacaccuu

SEQ ID NO: 70739 - RNA, 24 nt, Human
uuccccugugaacagggcuuuugu

SEQ ID NO: 70740 - RNA, 23 nt, Human
aauacuggggcagugaagaggaa

SEQ ID NO: 70741 - RNA, 23 nt, Human
acaguaaagcgacuacugcugga

SEQ ID NO: 70742 - RNA, 18 nt, Human
acugcagggccaaacacc

SEQ ID NO: 70743 - RNA, 21 nt, Human
agacccaggaagcccaugcaa

SEQ ID NO: 70744 - RNA, 20 nt, Human
aggcaugagugacagagggg

SEQ ID NO: 70745 - RNA, 24 nt, Human
agggaaaacuucuaggccuaaaca

SEQ ID NO: 70746 - RNA, 19 nt, Human
caagaguggggacugcagg

SEQ ID NO: 70747 - RNA, 21 nt, Human
cacuuucagaagaacuggagg

SEQ ID NO: 70748 - RNA, 20 nt, Human
caggaagcccaugcaaccac

SEQ ID NO: 70749 - RNA, 21 nt, Human
cauaacucuuuuaauaaauaa

SEQ ID NO: 70750 - RNA, 23 nt, Human
caugcaaccaccaucugcccccu

SEQ ID NO: 70751 - RNA, 22 nt, Human
cccaggaagcccaugcaaccac

SEQ ID NO: 70752 - RNA, 20 nt, Human
ccuuaagccucaagaguggg

SEQ ID NO: 70753 - RNA, 24 nt, Human
cgacuacugcuggaaggaguggug

SEQ ID NO: 70754 - RNA, 18 nt, Human
cuacugcuggaaggagug

SEQ ID NO: 70755 - RNA, 22 nt, Human
ggagacccaggaagcccaugca

SEQ ID NO: 70756 - RNA, 23 nt, Human
ggugagagaaaucggcaaaggga

SEQ ID NO: 70757 - RNA, 21 nt, Human
uacagagacauucguguuucu

SEQ ID NO: 70758 - RNA, 21 nt, Human
uacagagcaauacuggggcag

SEQ ID NO: 70759 - RNA, 19 nt, Human
uacaugaagcuuuccacca

SEQ ID NO: 70760 - RNA, 18 nt, Human
uacugcuggaaggagugg

SEQ ID NO: 70761 - RNA, 24 nt, Human
uacuuuauaaccgcggguuccggu

SEQ ID NO: 70762 - RNA, 25 nt, Human
uaggcaaggcaugaguggcgaacac

SEQ ID NO: 70763 - RNA, 21 nt, Human
ucagaagcuuccacaucacag

SEQ ID NO: 70764 - RNA, 19 nt, Human
ugacagaggggcaucgcug

SEQ ID NO: 70765 - RNA, 21 nt, Human
ugcaaccaccaucugcccccu

SEQ ID NO: 70766 - RNA, 24 nt, Human
ugcagggccaaacaccaaauacau

SEQ ID NO: 70767 - RNA, 21 nt, Human
uggacacugucacacuuucag

SEQ ID NO: 70768 - RNA, 23 nt, Human
uggagacccaggaagcccaugca

SEQ ID NO: 70769 - RNA, 24 nt, Human
uggcuuagauuuuaaaucacauuu

SEQ ID NO: 70770 - RNA, 23 nt, Human
uggggcagugaagaggaagcuac

SEQ ID NO: 70771 - RNA, 19 nt, Human
aaaaacaaagagaggcuac

SEQ ID NO: 70772 - RNA, 26 nt, Human
aaagaaaaacaaagagaggcuacaaa

SEQ ID NO: 70773 - RNA, 21 nt, Human
aaagaacaacaaggagauuca

SEQ ID NO: 70774 - RNA, 22 nt, Human
aaagaacaacaaggagauucag

SEQ ID NO: 70775 - RNA, 20 nt, Human
aaagacaaagaucagcaaaa

SEQ ID NO: 70776 - RNA, 24 nt, Human
aaagacaaagaucagcaaaagaaa

SEQ ID NO: 70777 - RNA, 23 nt, Human
aaagaucagcaaaagaaaaacaa

SEQ ID NO: 70778 - RNA, 23 nt, Human
aaaugcaguuaucuaccuggaau

SEQ ID NO: 70779 - RNA, 25 nt, Human
aagaaaaacaaagagaggcuacaaa

SEQ ID NO: 70780 - RNA, 26 nt, Human
aagaaaaacaaagagaggcuacaaaa

SEQ ID NO: 70781 - RNA, 21 nt, Human
aagaagacagggauuauggug

SEQ ID NO: 70782 - RNA, 24 nt, Human
aagacaaagaucagcaaaagaaaa

SEQ ID NO: 70783 - RNA, 28 nt, Human
aagaucagcaaaagaaaaaccgguaccc

SEQ ID NO: 70784 - RNA, 23 nt, Human
aagugacagggucaagagaggga

SEQ ID NO: 70785 - RNA, 18 nt, Human
acaaagagaggcuacaaa

SEQ ID NO: 70786 - RNA, 18 nt, Human
acaaauuucacagagggu

SEQ ID NO: 70787 - RNA, 21 nt, Human
acccaaaggggccgccuggga

SEQ ID NO: 70788 - RNA, 22 nt, Human
accccugggucuuagugcuccc

SEQ ID NO: 70789 - RNA, 22 nt, Human
acugaagucaggauguuuucca

SEQ ID NO: 70790 - RNA, 24 nt, Human
agaaaaacaaagagaggcuacaaa

SEQ ID NO: 70791 - RNA, 22 nt, Human
agagaccaggcccaaagcugcg

SEQ ID NO: 70792 - RNA, 22 nt, Human
agagaggggcuaaauguaguca

SEQ ID NO: 70793 - RNA, 22 nt, Human
agcaaaagaaaaacaaagagag

SEQ ID NO: 70794 - RNA, 22 nt, Human
agcagcagagaccaggcccaaa

SEQ ID NO: 70795 - RNA, 18 nt, Human
agccagcaagugacaggg

SEQ ID NO: 70796 - RNA, 20 nt, Human
aggaaaggaggaaaaucuaa

SEQ ID NO: 70797 - RNA, 18 nt, Human
aggaagggcaugcauaug

SEQ ID NO: 70798 - RNA, 22 nt, Human
agugacagggucaagagaggga

SEQ ID NO: 70799 - RNA, 23 nt, Human
auuacaaauuucacagaggguuu

SEQ ID NO: 70800 - RNA, 18 nt, Human
auuggaggauuucuuuga

SEQ ID NO: 70801 - RNA, 24 nt, Human
caaaagaaaaacaaagagaggcua

SEQ ID NO: 70802 - RNA, 25 nt, Human
caaaagaaaaacaaagagaggcuac

SEQ ID NO: 70803 - RNA, 23 nt, Human
caagguaggcauuauuaucaucc

SEQ ID NO: 70804 - RNA, 21 nt, Human
cacagaggguuuaggugagaa

SEQ ID NO: 70805 - RNA, 19 nt, Human
cacucagccuccugcaccg

SEQ ID NO: 70806 - RNA, 21 nt, Human
cacugcuacaacaugcaagga

SEQ ID NO: 70807 - RNA, 24 nt, Human
cagaaggagucaggcccuacggug

SEQ ID NO: 70808 - RNA, 22 nt, Human
cagaaugauuccuaaucauuga

SEQ ID NO: 70809 - RNA, 24 nt, Human
cagcaaaagaaaaacaaagagagg

SEQ ID NO: 70810 - RNA, 20 nt, Human
cagcagagaccaggcccaaa

SEQ ID NO: 70811 - RNA, 20 nt, Human
caucggccagacacugaagu

SEQ ID NO: 70812 - RNA, 22 nt, Human
ccccaccgcuuacuucuccucc

SEQ ID NO: 70813 - RNA, 20 nt, Human
ccccccaccgcuuacuucuc

SEQ ID NO: 70814 - RNA, 18 nt, Human
ccccugggucuuagugcu

SEQ ID NO: 70815 - RNA, 18 nt, Human
cccugggucuuagugcuc

SEQ ID NO: 70816 - RNA, 20 nt, Human
ccugcaccgagugucucucc

SEQ ID NO: 70817 - RNA, 19 nt, Human
cgagugucucucccaaucu

SEQ ID NO: 70818 - RNA, 19 nt, Human
cgugaggaaacagcugugu

SEQ ID NO: 70819 - RNA, 24 nt, Human
cuaccccugggucuuagugcuccc

SEQ ID NO: 70820 - RNA, 22 nt, Human
cuauugaugacugguccuccuc

SEQ ID NO: 70821 - RNA, 29 nt, Human
cuccagcacuucuugcucaggcaguaccc

SEQ ID NO: 70822 - RNA, 22 nt, Human
cuccuccuuugccugcuucagu

SEQ ID NO: 70823 - RNA, 21 nt, Human
cuccucuccagcacuucuugc

SEQ ID NO: 70824 - RNA, 20 nt, Human
cucucccaaucucauccucc

SEQ ID NO: 70825 - RNA, 22 nt, Human
cucucccaaucucauccuccua

SEQ ID NO: 70826 - RNA, 18 nt, Human
cugugccuccuccuuugc

SEQ ID NO: 70827 - RNA, 21 nt, Human
cuuugagggagggaacuggca

SEQ ID NO: 70828 - RNA, 23 nt, Human
cuuuggggaaauaggaaaggagg

SEQ ID NO: 70829 - RNA, 22 nt, Human
gaacuggcagaaggagucaggc

SEQ ID NO: 70830 - RNA, 21 nt, Human
gaauuauaagagaggggcuaa

SEQ ID NO: 70831 - RNA, 23 nt, Human
gagcagcagagaccaggcccaaa

SEQ ID NO: 70832 - RNA, 18 nt, Human
gaucagcaaaagaaaaac

SEQ ID NO: 70833 - RNA, 21 nt, Human
gcaaaagaaaaacaaagagag

SEQ ID NO: 70834 - RNA, 24 nt, Human
gcaccgagugucucucccaaucuc

SEQ ID NO: 70835 - RNA, 19 nt, Human
gcagagaccaggcccaaag

SEQ ID NO: 70836 - RNA, 22 nt, Human
gcagcagagaccaggcccaaag

SEQ ID NO: 70837 - RNA, 19 nt, Human
gcaguuaucuaccuggaau

SEQ ID NO: 70838 - RNA, 22 nt, Human
gcuacuuacugaaucacugcua

SEQ ID NO: 70839 - RNA, 22 nt, Human
gcugcaguccuccacuaccccu

SEQ ID NO: 70840 - RNA, 23 nt, Human
gcugcaguccuccacuaccccug

SEQ ID NO: 70841 - RNA, 18 nt, Human
gcuuacuucuccuccucc

SEQ ID NO: 70842 - RNA, 23 nt, Human
ggaaaaucuaauaaagacaaaga

SEQ ID NO: 70843 - RNA, 19 nt, Human
ggcuacaaaaugcaguuau

SEQ ID NO: 70844 - RNA, 22 nt, Human
ggugucaaggauauagaaagga

SEQ ID NO: 70845 - RNA, 21 nt, Human
gucaggauguuuuccacauuc

SEQ ID NO: 70846 - RNA, 21 nt, Human
uaauaaagacaaagaucagca

SEQ ID NO: 70847 - RNA, 19 nt, Human
uacaaugggaaaguaaggu

SEQ ID NO: 70848 - RNA, 22 nt, Human
uaccaaguuaaguagcuugucc

SEQ ID NO: 70849 - RNA, 22 nt, Human
uaccagauggcucccacccccc

SEQ ID NO: 70850 - RNA, 19 nt, Human
uauaagugucacaggaaaa

SEQ ID NO: 70851 - RNA, 22 nt, Human
ucacagaggguuuaggugagaa

SEQ ID NO: 70852 - RNA, 22 nt, Human
ucagaaaauaacuagggucaca

SEQ ID NO: 70853 - RNA, 25 nt, Human
ucagcaaaagaaaaacaaagagagg

SEQ ID NO: 70854 - RNA, 22 nt, Human
uccacauuccuacuuccccaua

SEQ ID NO: 70855 - RNA, 19 nt, Human
ucccaccccccaccgcuua

SEQ ID NO: 70856 - RNA, 20 nt, Human
ugaggaaacagcuguguagg

SEQ ID NO: 70857 - RNA, 18 nt, Human
ugaugacugguccuccuc

SEQ ID NO: 70858 - RNA, 23 nt, Human
ugccuccuccuuugccugcuuca

SEQ ID NO: 70859 - RNA, 23 nt, Human
uggaauuauaagagaggggcuaa

SEQ ID NO: 70860 - RNA, 21 nt, Human
uggagaucagaaggucucugg

SEQ ID NO: 70861 - RNA, 19 nt, Human
ugggaaaagagaagaacca

SEQ ID NO: 70862 - RNA, 21 nt, Human
ugggagcagcagagaccaggc

SEQ ID NO: 70863 - RNA, 18 nt, Human
uggugggaggugauuuug

SEQ ID NO: 70864 - RNA, 19 nt, Human
ugucaaaguaccagauggc

SEQ ID NO: 70865 - RNA, 18 nt, Human
ugucaaggauauagaaag

SEQ ID NO: 70866 - RNA, 22 nt, Human
ugucaaggauauagaaaggaag

SEQ ID NO: 70867 - RNA, 23 nt, Human
uguccugguuucacagccagcaa

SEQ ID NO: 70868 - RNA, 19 nt, Human
uucacagccagcaagugac

SEQ ID NO: 70869 - RNA, 21 nt, Human
uugauuggaggauuucuuuga

SEQ ID NO: 70870 - RNA, 23 nt, Human
uuuugaaugcugucaaaguacca

SEQ ID NO: 70871 - RNA, 22 nt, Human
aaaaaacaaaauggaguaaaau

SEQ ID NO: 70872 - RNA, 21 nt, Human
aaaaaauucucuuaacauaca

SEQ ID NO: 70873 - RNA, 23 nt, Human
aaaacaaacaaaaacccaaaagg

SEQ ID NO: 70874 - RNA, 19 nt, Human
aaaagcaccugcaaggaca

SEQ ID NO: 70875 - RNA, 22 nt, Human
aaacaaaacaaacaaaaaccca

SEQ ID NO: 70876 - RNA, 23 nt, Human
aaacaaaacaaacaaaaacccaa

SEQ ID NO: 70877 - RNA, 30 nt, Human
aaacaagacucugucucaacaacaacaacc

SEQ ID NO: 70878 - RNA, 25 nt, Human
aaagaaacaaaacaaacaaaaaccc

SEQ ID NO: 70879 - RNA, 28 nt, Human
aaagaaacaaaacaaacaaaaacccaag

SEQ ID NO: 70880 - RNA, 21 nt, Human
aaaggauaaaagagaaaaggg

SEQ ID NO: 70881 - RNA, 21 nt, Human
aacaacaacaacaacaacaaa

SEQ ID NO: 70882 - RNA, 24 nt, Human
aacaacaacaacaacaacaacaac

SEQ ID NO: 70883 - RNA, 27 nt, Human
aacaacaacaacaacaacaacaacaac

SEQ ID NO: 70884 - RNA, 19 nt, Human
aacauggcgaaaccccguc

SEQ ID NO: 70885 - RNA, 20 nt, Human
aacauggcgaaaccccgucu

SEQ ID NO: 70886 - RNA, 21 nt, Human
aacauggcgaaaccccgucuc

SEQ ID NO: 70887 - RNA, 18 nt, Human
aacccaaaaggagugauu

SEQ ID NO: 70888 - RNA, 18 nt, Human
aacucaugcuugugcucu

SEQ ID NO: 70889 - RNA, 19 nt, Human
aacugcuugaggugggugg

SEQ ID NO: 70890 - RNA, 22 nt, Human
aagaaaaaucauuuuaaagcau

SEQ ID NO: 70891 - RNA, 20 nt, Human
aagaacucaugcuugugcuc

SEQ ID NO: 70892 - RNA, 22 nt, Human
aagaaguccauccccuaccccc

SEQ ID NO: 70893 - RNA, 20 nt, Human
aagacauauuggagcaucua

SEQ ID NO: 70894 - RNA, 19 nt, Human
aagagcaugagaaaaaucc

SEQ ID NO: 70895 - RNA, 21 nt, Human
aagcaccugcaaggacaagga

SEQ ID NO: 70896 - RNA, 19 nt, Human
aagcaugaauaucuucaug

SEQ ID NO: 70897 - RNA, 19 nt, Human
aaggagcaaaauauuagaa

SEQ ID NO: 70898 - RNA, 25 nt, Human
aauaaauaauaaaacucaaacugaa

SEQ ID NO: 70899 - RNA, 21 nt, Human
acaaaacaaacaaaaacccaa

SEQ ID NO: 70900 - RNA, 23 nt, Human
acaaaacaaacaaaaacccaaaa

SEQ ID NO: 70901 - RNA, 24 nt, Human
acaaaacaaacaaaaacccaaaag

SEQ ID NO: 70902 - RNA, 23 nt, Human
acaaaagaagacauauuggagca

SEQ ID NO: 70903 - RNA, 24 nt, Human
acaaacaaaaacccaaaaggagug

SEQ ID NO: 70904 - RNA, 18 nt, Human
acaaauuuaggcugggca

SEQ ID NO: 70905 - RNA, 26 nt, Human
acaacaacaacaacaaacaaauuuag

SEQ ID NO: 70906 - RNA, 19 nt, Human
acaacaacaacaacaacaa

SEQ ID NO: 70907 - RNA, 19 nt, Human
acaacaacaacaacaacaa

SEQ ID NO: 70908 - RNA, 19 nt, Human
acaacaacaacaacaacaa

SEQ ID NO: 70909 - RNA, 19 nt, Human
acaacaacaacaacaacaa

SEQ ID NO: 70910 - RNA, 19 nt, Human
acaacaacaacaacaacaa

SEQ ID NO: 70911 - RNA, 19 nt, Human
acaacaacaacaacaacaa

SEQ ID NO: 70912 - RNA, 23 nt, Human
acaacaacaacaacaacaaacaa

SEQ ID NO: 70913 - RNA, 22 nt, Human
acaacaacaacaacaacaacaa

SEQ ID NO: 70914 - RNA, 22 nt, Human
acaacaacaacaacaacaacaa

SEQ ID NO: 70915 - RNA, 22 nt, Human
acaacaacaacaacaacaacaa

SEQ ID NO: 70916 - RNA, 23 nt, Human
acaagacucugucucaacaacaa

SEQ ID NO: 70917 - RNA, 20 nt, Human
acaagcuccuaaauuugcca

SEQ ID NO: 70918 - RNA, 20 nt, Human
acaguagcugcggcugcggc

SEQ ID NO: 70919 - RNA, 24 nt, Human
accaaacaaucaauguucaacagc

SEQ ID NO: 70920 - RNA, 19 nt, Human
accccgucucuacugaaaa

SEQ ID NO: 70921 - RNA, 21 nt, Human
acugaagaacaagaacucaug

SEQ ID NO: 70922 - RNA, 18 nt, Human
acugcacuccagccuggg

SEQ ID NO: 70923 - RNA, 23 nt, Human
acugcacuccagccugggcugca

SEQ ID NO: 70924 - RNA, 19 nt, Human
acugcagaaaguuagugua

SEQ ID NO: 70925 - RNA, 24 nt, Human
agaaaaaaacaaaauggaguaaaa

SEQ ID NO: 70926 - RNA, 26 nt, Human
agaaaaaauucucuuaacauacauuu

SEQ ID NO: 70927 - RNA, 18 nt, Human
agagguugcagugagcca

SEQ ID NO: 70928 - RNA, 20 nt, Human
agagguugcagugagccaag

SEQ ID NO: 70929 - RNA, 22 nt, Human
agagguugcagugagccaagau

SEQ ID NO: 70930 - RNA, 24 nt, Human
agagguugcagugagccaagaugg

SEQ ID NO: 70931 - RNA, 22 nt, Human
agauggugccacugcacuccag

SEQ ID NO: 70932 - RNA, 20 nt, Human
agccugggcugcaaaacaag

SEQ ID NO: 70933 - RNA, 24 nt, Human
agccugggcugcaaaacaagacuc

SEQ ID NO: 70934 - RNA, 20 nt, Human
aggcagagguugcagugagc

SEQ ID NO: 70935 - RNA, 24 nt, Human
aggcagagguugcagugagccaag

SEQ ID NO: 70936 - RNA, 21 nt, Human
aggccaaggcggguggaucac

SEQ ID NO: 70937 - RNA, 22 nt, Human
aggcggguggaucaccugaggg

SEQ ID NO: 70938 - RNA, 22 nt, Human
aggcggguggaucaccugaggu

SEQ ID NO: 70939 - RNA, 25 nt, Human
aggcugaggcagggagaauuccuug

SEQ ID NO: 70940 - RNA, 19 nt, Human
aguagauggauauugcaca

SEQ ID NO: 70941 - RNA, 24 nt, Human
agugaaaaaacaaaaauauacugg

SEQ ID NO: 70942 - RNA, 21 nt, Human
auacuacuacucuagcugugu

SEQ ID NO: 70943 - RNA, 24 nt, Human
auauauguguguauauauauaugu

SEQ ID NO: 70944 - RNA, 18 nt, Human
auauguauguauguguau

SEQ ID NO: 70945 - RNA, 22 nt, Human
auauguguguauauauauaugu

SEQ ID NO: 70946 - RNA, 20 nt, Human
aucaccugagguuaggaguu

SEQ ID NO: 70947 - RNA, 22 nt, Human
aucccagcacuuugggaggcca

SEQ ID NO: 70948 - RNA, 22 nt, Human
augggaggcagggaacccuaca

SEQ ID NO: 70949 - RNA, 24 nt, Human
auggugccacugcacuccagccug

SEQ ID NO: 70950 - RNA, 23 nt, Human
auguguauguacauauauaugug

SEQ ID NO: 70951 - RNA, 19 nt, Human
auuacauuccugguuucuc

SEQ ID NO: 70952 - RNA, 22 nt, Human
caaaacaagacucugucucaac

SEQ ID NO: 70953 - RNA, 22 nt, Human
caaaagaagacauauuggagca

SEQ ID NO: 70954 - RNA, 20 nt, Human
caaacaaaaacccaaaagga

SEQ ID NO: 70955 - RNA, 19 nt, Human
caaaguguuauacucaauu

SEQ ID NO: 70956 - RNA, 27 nt, Human
caacaacaacaacaaacaaauuuagug

SEQ ID NO: 70957 - RNA, 18 nt, Human
caacaacaacaacaacaa

SEQ ID NO: 70958 - RNA, 18 nt, Human
caacaacaacaacaacaa

SEQ ID NO: 70959 - RNA, 24 nt, Human
caacaacaacaacaacaacaaaca

SEQ ID NO: 70960 - RNA, 23 nt, Human
caacaacaacaacaacaacaaca

SEQ ID NO: 70961 - RNA, 23 nt, Human
caacaacaacaacaacaacaaca

SEQ ID NO: 70962 - RNA, 23 nt, Human
caacaacaacaacaacaacaaca

SEQ ID NO: 70963 - RNA, 25 nt, Human
caacaacaacaacaacaacaacaac

SEQ ID NO: 70964 - RNA, 24 nt, Human
caacauggcgaaaccccgucucua

SEQ ID NO: 70965 - RNA, 24 nt, Human
caacuuggcaggagugaacugaaa

SEQ ID NO: 70966 - RNA, 21 nt, Human
caagaccaagaggaugacucc

SEQ ID NO: 70967 - RNA, 21 nt, Human
caagauugccaaaaagacuug

SEQ ID NO: 70968 - RNA, 20 nt, Human
caaggaugcagggagaaugg

SEQ ID NO: 70969 - RNA, 21 nt, Human
caaggcggguggaucaccuga

SEQ ID NO: 70970 - RNA, 24 nt, Human
caaggcggguggaucaccugaggu

SEQ ID NO: 70971 - RNA, 22 nt, Human
caauaugaauacaagaccaaga

SEQ ID NO: 70972 - RNA, 18 nt, Human
cacaaucggagaagucac

SEQ ID NO: 70973 - RNA, 24 nt, Human
cacaccuguaaucccagcacuuug

SEQ ID NO: 70974 - RNA, 21 nt, Human
cacaguagcugcggcugcggc

SEQ ID NO: 70975 - RNA, 23 nt, Human
caccuguaaucccagcacuuugg

SEQ ID NO: 70976 - RNA, 24 nt, Human
caccuguaaucccagcacuuuggg

SEQ ID NO: 70977 - RNA, 24 nt, Human
caccuguaauccuagcuacucagg

SEQ ID NO: 70978 - RNA, 18 nt, Human
cacugcacuccagccugg

SEQ ID NO: 70979 - RNA, 19 nt, Human
cacugcacuccagccuggg

SEQ ID NO: 70980 - RNA, 24 nt, Human
cacugcacuccagccugggcugca

SEQ ID NO: 70981 - RNA, 27 nt, Human
cacugcacuccagccugggcugcaaaa

SEQ ID NO: 70982 - RNA, 21 nt, Human
cagagaaaaaaacaaaaugga

SEQ ID NO: 70983 - RNA, 21 nt, Human
cagauaaacgcaacucaaaua

SEQ ID NO: 70984 - RNA, 24 nt, Human
cagcacuuugggaggccaaggcgg

SEQ ID NO: 70985 - RNA, 21 nt, Human
caguaaccagaugccucaccc

SEQ ID NO: 70986 - RNA, 18 nt, Human
cauaaguaauagaaaaaa

SEQ ID NO: 70987 - RNA, 25 nt, Human
cauaugaauaaagaauacuuuuuaa

SEQ ID NO: 70988 - RNA, 19 nt, Human
caucuaaaaaagcaccugc

SEQ ID NO: 70989 - RNA, 21 nt, Human
cauguguauauaugaaaggau

SEQ ID NO: 70990 - RNA, 24 nt, Human
cauucuauacauaugaauaaagaa

SEQ ID NO: 70991 - RNA, 18 nt, Human
cauugcuccccagugggc

SEQ ID NO: 70992 - RNA, 19 nt, Human
cauuuuugauuuuaagccu

SEQ ID NO: 70993 - RNA, 20 nt, Human
ccacugcacuccagccuggg

SEQ ID NO: 70994 - RNA, 21 nt, Human
ccacugcacuccagccugggc

SEQ ID NO: 70995 - RNA, 21 nt, Human
ccacugcacuccagccugggc

SEQ ID NO: 70996 - RNA, 21 nt, Human
ccacugcacuccagccugggc

SEQ ID NO: 70997 - RNA, 24 nt, Human
ccacugcacuccagccugggcugc

SEQ ID NO: 70998 - RNA, 24 nt, Human
ccgucucuacugaaaaauaugaaa

SEQ ID NO: 70999 - RNA, 21 nt, Human
ccuaauauaagagcaugagaa

SEQ ID NO: 71000 - RNA, 22 nt, Human
ccuaugguuaaaccucuggaac

SEQ ID NO: 71001 - RNA, 21 nt, Human
ccugacuaaaagcuagcuacu

SEQ ID NO: 71002 - RNA, 22 nt, Human
ccugagguuaggaguuuaagac

SEQ ID NO: 71003 - RNA, 24 nt, Human
ccugcaauaaauaaggcacaucua

SEQ ID NO: 71004 - RNA, 24 nt, Human
ccugcaauaaauaaggccgggguc

SEQ ID NO: 71005 - RNA, 24 nt, Human
cggguggaucaccugagguuagga

SEQ ID NO: 71006 - RNA, 21 nt, Human
cuacaauacuacuacucuagc

SEQ ID NO: 71007 - RNA, 26 nt, Human
cuauuuuuaaacaguuucaacuguuu

SEQ ID NO: 71008 - RNA, 22 nt, Human
cucacaccuguaaucccagcac

SEQ ID NO: 71009 - RNA, 24 nt, Human
cucacaccuguaaucccagcacuu

SEQ ID NO: 71010 - RNA, 19 nt, Human
cuccccagugggcagggau

SEQ ID NO: 71011 - RNA, 23 nt, Human
cugggcauggaggcucacaccug

SEQ ID NO: 71012 - RNA, 21 nt, Human
cuguaauccuagcuacucagg

SEQ ID NO: 71013 - RNA, 25 nt, Human
cuucaaauuuuucauuuucuucuuc

SEQ ID NO: 71014 - RNA, 19 nt, Human
gaaaccccgucucuacuga

SEQ ID NO: 71015 - RNA, 28 nt, Human
gaacaagcuccuaaauuugccaaccaca

SEQ ID NO: 71016 - RNA, 24 nt, Human
gaaguccauccccuacccccaccu

SEQ ID NO: 71017 - RNA, 18 nt, Human
gaccuuuaaggucuuuug

SEQ ID NO: 71018 - RNA, 20 nt, Human
gagaaggaggcaugcuucuu

SEQ ID NO: 71019 - RNA, 20 nt, Human
gagcaucuaaaaaagcaccu

SEQ ID NO: 71020 - RNA, 21 nt, Human
gaucaccugagguuaggaguu

SEQ ID NO: 71021 - RNA, 23 nt, Human
gaucaccugagguuaggaguuua

SEQ ID NO: 71022 - RNA, 24 nt, Human
gaucaccugagguuaggaguuuaa

SEQ ID NO: 71023 - RNA, 21 nt, Human
gauucccuccauaaucaccuc

SEQ ID NO: 71024 - RNA, 24 nt, Human
gccaacauggcgaaaccccgucuc

SEQ ID NO: 71025 - RNA, 22 nt, Human
gccacugcacuccagccugggc

SEQ ID NO: 71026 - RNA, 22 nt, Human
gcuaaaaagcgucauaaccuag

SEQ ID NO: 71027 - RNA, 20 nt, Human
gcuccaacaaagcucacaca

SEQ ID NO: 71028 - RNA, 19 nt, Human
gcuguguucaacugcuuga

SEQ ID NO: 71029 - RNA, 24 nt, Human
ggaggcucacaccuguaaucccag

SEQ ID NO: 71030 - RNA, 23 nt, Human
ggcauggaggcucacaccuguaa

SEQ ID NO: 71031 - RNA, 21 nt, Human
ggcucacaccuguaaucccag

SEQ ID NO: 71032 - RNA, 23 nt, Human
ggcucacaccuguaaucccagca

SEQ ID NO: 71033 - RNA, 24 nt, Human
gguggcaggcaccuguaauccuag

SEQ ID NO: 71034 - RNA, 23 nt, Human
ggugugguggcaggcaccuguaa

SEQ ID NO: 71035 - RNA, 18 nt, Human
gucaaauaaaaaaaaaau

SEQ ID NO: 71036 - RNA, 25 nt, Human
gugaaaaaacaaaaauauacuggaa

SEQ ID NO: 71037 - RNA, 23 nt, Human
guggcagcgauaaauccacguac

SEQ ID NO: 71038 - RNA, 19 nt, Human
guguauguacauauauaug

SEQ ID NO: 71039 - RNA, 22 nt, Human
uaaaaaagcaccugcaaggaca

SEQ ID NO: 71040 - RNA, 20 nt, Human
uaaaaaauuaaagcacaaua

SEQ ID NO: 71041 - RNA, 21 nt, Human
uaaaauaaccaguaaccagau

SEQ ID NO: 71042 - RNA, 23 nt, Human
uaaacgcaacucaaauagaaucc

SEQ ID NO: 71043 - RNA, 19 nt, Human
uaaacugguuagcucgaaa

SEQ ID NO: 71044 - RNA, 23 nt, Human
uaaauagucuuacaaguaccaac

SEQ ID NO: 71045 - RNA, 19 nt, Human
uaacugaagaacaagaacu

SEQ ID NO: 71046 - RNA, 20 nt, Human
uaacugaagaacaagaacuc

SEQ ID NO: 71047 - RNA, 19 nt, Human
uaaggugccacauagguga

SEQ ID NO: 71048 - RNA, 18 nt, Human
uaagguugagacgccugg

SEQ ID NO: 71049 - RNA, 21 nt, Human
uaauaauggaagaauaacugg

SEQ ID NO: 71050 - RNA, 21 nt, Human
uacaaaaggcauuuguuauca

SEQ ID NO: 71051 - RNA, 21 nt, Human
uacaagcugcuauucccacug

SEQ ID NO: 71052 - RNA, 21 nt, Human
uacauauauauguguguauau

SEQ ID NO: 71053 - RNA, 23 nt, Human
uacaucuugagacuacaauacua

SEQ ID NO: 71054 - RNA, 21 nt, Human
uaccaaacaaucaauguucaa

SEQ ID NO: 71055 - RNA, 26 nt, Human
uaccaggcacucacaagggaauuucu

SEQ ID NO: 71056 - RNA, 20 nt, Human
uacugaaaaauaugaaaauu

SEQ ID NO: 71057 - RNA, 19 nt, Human
uacuuaaaaauguagaaaa

SEQ ID NO: 71058 - RNA, 25 nt, Human
uagaaaagaaacaaaacaaacaaaa

SEQ ID NO: 71059 - RNA, 23 nt, Human
uagaaucccuaauauaagagcau

SEQ ID NO: 71060 - RNA, 22 nt, Human
uagcagcagcuuugcuucuggu

SEQ ID NO: 71061 - RNA, 24 nt, Human
uagcuacucaggaggcugaggcag

SEQ ID NO: 71062 - RNA, 21 nt, Human
uagcucgaaagaaaauaacaa

SEQ ID NO: 71063 - RNA, 22 nt, Human
uauauacuagcaaaguguuaua

SEQ ID NO: 71064 - RNA, 18 nt, Human
uauauauauauguaugug

SEQ ID NO: 71065 - RNA, 24 nt, Human
uauauauauguaugugaauacaca

SEQ ID NO: 71066 - RNA, 22 nt, Human
uauauauguguguauauauaua

SEQ ID NO: 71067 - RNA, 20 nt, Human
uauauguguguauauauaua

SEQ ID NO: 71068 - RNA, 30 nt, Human
uaucaagaaaaaucauuuuaaagcaugauu

SEQ ID NO: 71069 - RNA, 23 nt, Human
uaucuucaauauuuugaguucaa

SEQ ID NO: 71070 - RNA, 22 nt, Human
uaucuucagacuaagggcaugg

SEQ ID NO: 71071 - RNA, 28 nt, Human
uauguacauauauauguguguauauaau

SEQ ID NO: 71072 - RNA, 18 nt, Human
uauguauguauguguaug

SEQ ID NO: 71073 - RNA, 20 nt, Human
uauguauguauguguaugua

SEQ ID NO: 71074 - RNA, 24 nt, Human
uauguauguauguguauguacaua

SEQ ID NO: 71075 - RNA, 24 nt, Human
uauguauguguauguacauauaua

SEQ ID NO: 71076 - RNA, 20 nt, Human
uauguguauguacauauaua

SEQ ID NO: 71077 - RNA, 22 nt, Human
uauguguguauauauauaugua

SEQ ID NO: 71078 - RNA, 23 nt, Human
uauguguguauauauauauguau

SEQ ID NO: 71079 - RNA, 26 nt, Human
uauuaaauuauauauacuagcaaagu

SEQ ID NO: 71080 - RNA, 19 nt, Human
ucaacaacaacaacaacaa

SEQ ID NO: 71081 - RNA, 21 nt, Human
ucaaugaaaaaccacccuaaa

SEQ ID NO: 71082 - RNA, 25 nt, Human
ucagugaaauggguuugccuuucua

SEQ ID NO: 71083 - RNA, 18 nt, Human
ucauaccagauggaggga

SEQ ID NO: 71084 - RNA, 25 nt, Human
uccacugcuguuuucgguaccaaac

SEQ ID NO: 71085 - RNA, 21 nt, Human
uccgguaggcagagguugcag

SEQ ID NO: 71086 - RNA, 20 nt, Human
uccuugaauccgguaggcag

SEQ ID NO: 71087 - RNA, 24 nt, Human
ucuccuguaaagacagcuucucuu

SEQ ID NO: 71088 - RNA, 22 nt, Human
ucugaccaguguauuagcuacc

SEQ ID NO: 71089 - RNA, 22 nt, Human
ugaaaaaacaaaaauauacugg

SEQ ID NO: 71090 - RNA, 23 nt, Human
ugaaaaaacaaaaauauacugga

SEQ ID NO: 71091 - RNA, 22 nt, Human
ugaaaauuagccggguguggug

SEQ ID NO: 71092 - RNA, 20 nt, Human
ugaaagacagcauggaauaa

SEQ ID NO: 71093 - RNA, 21 nt, Human
ugaaagacagcauggaauaag

SEQ ID NO: 71094 - RNA, 19 nt, Human
ugaaagcauggaggauggc

SEQ ID NO: 71095 - RNA, 21 nt, Human
ugaaggcacauccuuggcaga

SEQ ID NO: 71096 - RNA, 18 nt, Human
ugaauacacagaaauaca

SEQ ID NO: 71097 - RNA, 23 nt, Human
ugaauacagaagagugauaaaug

SEQ ID NO: 71098 - RNA, 22 nt, Human
ugaaugcugugucagugcauga

SEQ ID NO: 71099 - RNA, 27 nt, Human
ugacaaguuaaacuggcagcacucucc

SEQ ID NO: 71100 - RNA, 18 nt, Human
ugaccaguguauuagcua

SEQ ID NO: 71101 - RNA, 19 nt, Human
ugagcagaaaaggcucaua

SEQ ID NO: 71102 - RNA, 23 nt, Human
ugagcagaaaaggcucauaaugu

SEQ ID NO: 71103 - RNA, 21 nt, Human
ugaggcagggagaauuccuug

SEQ ID NO: 71104 - RNA, 26 nt, Human
ugaggcagggagaauuccuugaaucc

SEQ ID NO: 71105 - RNA, 21 nt, Human
ugauucccuccauaaucaccu

SEQ ID NO: 71106 - RNA, 22 nt, Human
ugauucccuccauaaucaccuc

SEQ ID NO: 71107 - RNA, 24 nt, Human
ugauuuuaagccuguauacagaaa

SEQ ID NO: 71108 - RNA, 22 nt, Human
ugcaaaacaagacucugucuca

SEQ ID NO: 71109 - RNA, 23 nt, Human
ugcaaaacaagacucugucucaa

SEQ ID NO: 71110 - RNA, 18 nt, Human
ugccagauguuggguuag

SEQ ID NO: 71111 - RNA, 23 nt, Human
ugcucuagaaaaaugauuuuuuu

SEQ ID NO: 71112 - RNA, 19 nt, Human
uggaaacaucuugucuaca

SEQ ID NO: 71113 - RNA, 24 nt, Human
uggaggauggcauaggcauugguc

SEQ ID NO: 71114 - RNA, 24 nt, Human
uggaggcucacaccuguaauccca

SEQ ID NO: 71115 - RNA, 23 nt, Human
uggaucaccugagguuaggaguu

SEQ ID NO: 71116 - RNA, 24 nt, Human
uggaucaccugagguuaggaguuu

SEQ ID NO: 71117 - RNA, 24 nt, Human
uggcaggagugaacugaaacugag

SEQ ID NO: 71118 - RNA, 21 nt, Human
uggcuacauauuacuuaaagc

SEQ ID NO: 71119 - RNA, 24 nt, Human
ugggaggccaaggcggguggauca

SEQ ID NO: 71120 - RNA, 20 nt, Human
ugggcauggaggcucacacc

SEQ ID NO: 71121 - RNA, 22 nt, Human
ugggugggagggagaaggaggc

SEQ ID NO: 71122 - RNA, 21 nt, Human
ugguagaggauucaaaugugg

SEQ ID NO: 71123 - RNA, 22 nt, Human
ugguggcaggcaccuguaaucc

SEQ ID NO: 71124 - RNA, 19 nt, Human
uguagaaaagaaacaaaac

SEQ ID NO: 71125 - RNA, 19 nt, Human
uguauauauauauguaugu

SEQ ID NO: 71126 - RNA, 19 nt, Human
uguauguacauauauaugu

SEQ ID NO: 71127 - RNA, 18 nt, Human
uguauguauguguaugua

SEQ ID NO: 71128 - RNA, 21 nt, Human
uguauguauguguauguacau

SEQ ID NO: 71129 - RNA, 20 nt, Human
uguauguguauguacauaua

SEQ ID NO: 71130 - RNA, 27 nt, Human
uguauguguauguacauauauaugugu

SEQ ID NO: 71131 - RNA, 22 nt, Human
ugugccagauguuggguuagcc

SEQ ID NO: 71132 - RNA, 19 nt, Human
uguguauauauauauguau

SEQ ID NO: 71133 - RNA, 19 nt, Human
uguguauauauauauguau

SEQ ID NO: 71134 - RNA, 25 nt, Human
uguguauauauauauguaugugaau

SEQ ID NO: 71135 - RNA, 18 nt, Human
uguguauguacauauaua

SEQ ID NO: 71136 - RNA, 18 nt, Human
uguguauguacauauaua

SEQ ID NO: 71137 - RNA, 23 nt, Human
uguguauguacauauauaugugu

SEQ ID NO: 71138 - RNA, 23 nt, Human
uguguauguacauauauaugugu

SEQ ID NO: 71139 - RNA, 21 nt, Human
uguguguauauauauauguau

SEQ ID NO: 71140 - RNA, 23 nt, Human
uguguguauauauauauguaugu

SEQ ID NO: 71141 - RNA, 19 nt, Human
uuaaaguuuuggaaacauc

SEQ ID NO: 71142 - RNA, 22 nt, Human
uuaccgaguacaaauccuaugu

SEQ ID NO: 71143 - RNA, 18 nt, Human
uuagccgggugugguggc

SEQ ID NO: 71144 - RNA, 24 nt, Human
uuagccgggugugguggcaggcac

SEQ ID NO: 71145 - RNA, 19 nt, Human
uucacaaaugacacaccau

SEQ ID NO: 71146 - RNA, 19 nt, Human
uucacaaaugacacaccau

SEQ ID NO: 71147 - RNA, 20 nt, Human
uuccucauuacauuccuggu

SEQ ID NO: 71148 - RNA, 24 nt, Human
uucuguucuuguuguaagagcuga

SEQ ID NO: 71149 - RNA, 20 nt, Human
uugaaggcacauccuuggca

SEQ ID NO: 71150 - RNA, 22 nt, Human
uugagacgccugguuuuggcua

SEQ ID NO: 71151 - RNA, 22 nt, Human
uugcagugagccaagauggugc

SEQ ID NO: 71152 - RNA, 19 nt, Human
uuuacccuaucagcucugu

SEQ ID NO: 71153 - RNA, 24 nt, Human
uuuuucuauuuuguaaaauaauac

SEQ ID NO: 71154 - RNA, 25 nt, Human
aaaaaagaacucuccucaacuugaa

SEQ ID NO: 71155 - RNA, 22 nt, Human
aaaacccugcaaaaacuauaug

SEQ ID NO: 71156 - RNA, 23 nt, Human
aaagaacucuccucaacuugaag

SEQ ID NO: 71157 - RNA, 22 nt, Human
aaagcuggaggcuagcucagcc

SEQ ID NO: 71158 - RNA, 19 nt, Human
aaaggaacagacuaugcag

SEQ ID NO: 71159 - RNA, 23 nt, Human
aacacucuauugagaagccaaca

SEQ ID NO: 71160 - RNA, 25 nt, Human
aaccaacuucagagucuaaaacuga

SEQ ID NO: 71161 - RNA, 26 nt, Human
aaccauccaaggugaaggucagauga

SEQ ID NO: 71162 - RNA, 26 nt, Human
aacccugcaaaaacuauauguaaaaa

SEQ ID NO: 71163 - RNA, 21 nt, Human
aacuauauguaaaaagugaaa

SEQ ID NO: 71164 - RNA, 19 nt, Human
aagaguguggcaagcuccc

SEQ ID NO: 71165 - RNA, 21 nt, Human
aagcaaaaaagaacucuccuc

SEQ ID NO: 71166 - RNA, 22 nt, Human
aagcagaggucugugaggaggg

SEQ ID NO: 71167 - RNA, 24 nt, Human
aagcagguucaagcugaaaugcac

SEQ ID NO: 71168 - RNA, 24 nt, Human
aagcugaaaugcacacuccagagc

SEQ ID NO: 71169 - RNA, 23 nt, Human
aagugcauucugaguugaaacaa

SEQ ID NO: 71170 - RNA, 26 nt, Human
aauggacaaugaaaaaaaucacuaaa

SEQ ID NO: 71171 - RNA, 21 nt, Human
acaaggaaaacacaaucaaca

SEQ ID NO: 71172 - RNA, 21 nt, Human
acaaugaauagaucaccuggu

SEQ ID NO: 71173 - RNA, 18 nt, Human
acacaacguuuauggucc

SEQ ID NO: 71174 - RNA, 20 nt, Human
acacuccagagcauuggaga

SEQ ID NO: 71175 - RNA, 19 nt, Human
acccugcugguugguuggg

SEQ ID NO: 71176 - RNA, 29 nt, Human
accugagguaaacuguggucucagaaacc

SEQ ID NO: 71177 - RNA, 25 nt, Human
acuagaguccaagacaaagcccagu

SEQ ID NO: 71178 - RNA, 21 nt, Human
acuaugcaggaagaaagcaac

SEQ ID NO: 71179 - RNA, 21 nt, Human
agaacucuccucaacuugaag

SEQ ID NO: 71180 - RNA, 24 nt, Human
agacuauguacgaagaaaggaaca

SEQ ID NO: 71181 - RNA, 24 nt, Human
agcaagcauaaagagaggacacaa

SEQ ID NO: 71182 - RNA, 21 nt, Human
agccaaggacuagaguccaag

SEQ ID NO: 71183 - RNA, 23 nt, Human
agguaaacuguggucucagaaac

SEQ ID NO: 71184 - RNA, 21 nt, Human
aguaauggacaaugaaaaaaa

SEQ ID NO: 71185 - RNA, 18 nt, Human
auaaaacccugcaaaaac

SEQ ID NO: 71186 - RNA, 24 nt, Human
auaaaauaaaacccugcaaaaacu

SEQ ID NO: 71187 - RNA, 21 nt, Human
augguccuaaaaguuuuaaaa

SEQ ID NO: 71188 - RNA, 21 nt, Human
caaaagugcugcuaaaacugc

SEQ ID NO: 71189 - RNA, 19 nt, Human
caagacaaagcccaugcug

SEQ ID NO: 71190 - RNA, 21 nt, Human
caagacaaagcccaugcugac

SEQ ID NO: 71191 - RNA, 22 nt, Human
caagcaccacaggcugggcagg

SEQ ID NO: 71192 - RNA, 18 nt, Human
caaguaauggacaaugaa

SEQ ID NO: 71193 - RNA, 19 nt, Human
cacaaccaacuucagaguc

SEQ ID NO: 71194 - RNA, 23 nt, Human
cacacauacguuucccauggggc

SEQ ID NO: 71195 - RNA, 21 nt, Human
caccgaauucuucucugaucu

SEQ ID NO: 71196 - RNA, 20 nt, Human
cacugacaagcacacaggag

SEQ ID NO: 71197 - RNA, 20 nt, Human
cacugccagguaaauagaug

SEQ ID NO: 71198 - RNA, 22 nt, Human
cagcagcaaagaccacaaggac

SEQ ID NO: 71199 - RNA, 24 nt, Human
cagcagcaaagaccacaaggacau

SEQ ID NO: 71200 - RNA, 23 nt, Human
cagugaggucugcaguucucugg

SEQ ID NO: 71201 - RNA, 23 nt, Human
ccaagcccagcugcacccagaca

SEQ ID NO: 71202 - RNA, 21 nt, Human
ccauuggcuaugucauccugg

SEQ ID NO: 71203 - RNA, 19 nt, Human
cccacugacaagcacacag

SEQ ID NO: 71204 - RNA, 19 nt, Human
ccccuugggccgugcaggg

SEQ ID NO: 71205 - RNA, 21 nt, Human
cccguucugcugcucugagag

SEQ ID NO: 71206 - RNA, 23 nt, Human
ccucccaggugacaggcaggguu

SEQ ID NO: 71207 - RNA, 21 nt, Human
ccugcacacauacguuuccca

SEQ ID NO: 71208 - RNA, 18 nt, Human
cuaaagcaaacagggguc

SEQ ID NO: 71209 - RNA, 21 nt, Human
cuaauauugcaugaaauguuu

SEQ ID NO: 71210 - RNA, 21 nt, Human
cuccagcuggucagcaacaac

SEQ ID NO: 71211 - RNA, 21 nt, Human
cugaaucgcgagaaccuacac

SEQ ID NO: 71212 - RNA, 23 nt, Human
cuucacagcugacagacacugcu

SEQ ID NO: 71213 - RNA, 24 nt, Human
cuucacagcugacagacacugcuu

SEQ ID NO: 71214 - RNA, 25 nt, Human
gaggcuguguuuuccuccuauuugg

SEQ ID NO: 71215 - RNA, 19 nt, Human
gcagcagcaaagaccacaa

SEQ ID NO: 71216 - RNA, 22 nt, Human
gcagcagcaaagaccacaagga

SEQ ID NO: 71217 - RNA, 24 nt, Human
gcuacccugcugguugguugggag

SEQ ID NO: 71218 - RNA, 22 nt, Human
gcugcacccagacaaggccgcg

SEQ ID NO: 71219 - RNA, 21 nt, Human
gcuggucagcaacaacacucu

SEQ ID NO: 71220 - RNA, 22 nt, Human
gcuguguuuuccuccuauuugg

SEQ ID NO: 71221 - RNA, 20 nt, Human
ggagaggaggcgcagagugu

SEQ ID NO: 71222 - RNA, 19 nt, Human
ggccaagaggcaggcaggg

SEQ ID NO: 71223 - RNA, 23 nt, Human
ggcugaaaacaaggaaaacacaa

SEQ ID NO: 71224 - RNA, 20 nt, Human
ggcuggggaugugugagcca

SEQ ID NO: 71225 - RNA, 21 nt, Human
gggaggcuguguuuuccuccu

SEQ ID NO: 71226 - RNA, 18 nt, Human
ggucccgugaggccaaga

SEQ ID NO: 71227 - RNA, 19 nt, Human
guaaauagaugcucccuuc

SEQ ID NO: 71228 - RNA, 27 nt, Human
guccugaaucgcgagaaccuacacccc

SEQ ID NO: 71229 - RNA, 21 nt, Human
uaaaacccugcaaaaacuaua

SEQ ID NO: 71230 - RNA, 21 nt, Human
uaaaauaaaacccugcaaaaa

SEQ ID NO: 71231 - RNA, 22 nt, Human
uaaaauaaaacccugcaaaaac

SEQ ID NO: 71232 - RNA, 18 nt, Human
uacaguccagccaaggac

SEQ ID NO: 71233 - RNA, 19 nt, Human
uagaguccaagacaaagcc

SEQ ID NO: 71234 - RNA, 20 nt, Human
uauaaaauaaaacccugcaa

SEQ ID NO: 71235 - RNA, 22 nt, Human
ucaaucacaaccaacuucagag

SEQ ID NO: 71236 - RNA, 18 nt, Human
ucccauggggcaaacguu

SEQ ID NO: 71237 - RNA, 18 nt, Human
uccccaaagcuggaggcu

SEQ ID NO: 71238 - RNA, 19 nt, Human
uccccaagcaagcauaaag

SEQ ID NO: 71239 - RNA, 21 nt, Human
uccugaaucgcgagaaccuac

SEQ ID NO: 71240 - RNA, 20 nt, Human
ucuaaagcaaacaggggucc

SEQ ID NO: 71241 - RNA, 23 nt, Human
ucucaggucaggcucugaggccc

SEQ ID NO: 71242 - RNA, 19 nt, Human
ugaauagaucaccugguag

SEQ ID NO: 71243 - RNA, 20 nt, Human
ugacaagcacacaggagaga

SEQ ID NO: 71244 - RNA, 21 nt, Human
ugacaagcacacaggagagaa

SEQ ID NO: 71245 - RNA, 19 nt, Human
ugagagcagcagcaaagac

SEQ ID NO: 71246 - RNA, 21 nt, Human
ugagagcagcagcaaagacca

SEQ ID NO: 71247 - RNA, 25 nt, Human
ugagagcagcagcaaagaccacaag

SEQ ID NO: 71248 - RNA, 21 nt, Human
ugagccaggaagcagguucaa

SEQ ID NO: 71249 - RNA, 20 nt, Human
ugaguggaggcaagucccug

SEQ ID NO: 71250 - RNA, 21 nt, Human
ugccagguaaauagaugcucc

SEQ ID NO: 71251 - RNA, 28 nt, Human
ugccagguaaauagaugcucccuucuuu

SEQ ID NO: 71252 - RNA, 19 nt, Human
ugccccgggccgccugccu

SEQ ID NO: 71253 - RNA, 22 nt, Human
uggccacuccuuuucugaagcc

SEQ ID NO: 71254 - RNA, 24 nt, Human
uggcucagagcaaaaggucaccug

SEQ ID NO: 71255 - RNA, 20 nt, Human
ugguccuaaaaguuuuaaaa

SEQ ID NO: 71256 - RNA, 19 nt, Human
uuagauucuuuagauaaug

SEQ ID NO: 71257 - RNA, 22 nt, Human
uuauauaaauauuuccaugucc

SEQ ID NO: 71258 - RNA, 21 nt, Human
uucagagucuaaaacugaacc

SEQ ID NO: 71259 - RNA, 19 nt, Human
uugaagaagaguguggcaa

SEQ ID NO: 71260 - RNA, 21 nt, Human
uuuucugaagccccugggcag

SEQ ID NO: 71261 - RNA, 22 nt, Human
aaaaaauaaaugaaggguacaa

SEQ ID NO: 71262 - RNA, 20 nt, Human
aaaaccccaaacaaacacaa

SEQ ID NO: 71263 - RNA, 21 nt, Human
aaaauccaaaacaugcucucc

SEQ ID NO: 71264 - RNA, 20 nt, Human
aaacaaaaguuaggcuaagc

SEQ ID NO: 71265 - RNA, 18 nt, Human
aaacaaacacaaacacac

SEQ ID NO: 71266 - RNA, 24 nt, Human
aaacagcacuccucgccccaaagc

SEQ ID NO: 71267 - RNA, 22 nt, Human
aaaucacucauagccaacaaau

SEQ ID NO: 71268 - RNA, 22 nt, Human
aacaaauggaaauuacagacua

SEQ ID NO: 71269 - RNA, 18 nt, Human
aagaaccaaaaccaaacc

SEQ ID NO: 71270 - RNA, 21 nt, Human
aagguguuucccugaaauguu

SEQ ID NO: 71271 - RNA, 21 nt, Human
aagugugcccugcuccaauua

SEQ ID NO: 71272 - RNA, 18 nt, Human
aagugugggacucugcag

SEQ ID NO: 71273 - RNA, 22 nt, Human
aaucacucauagccaacaaauu

SEQ ID NO: 71274 - RNA, 26 nt, Human
acaaaaaccccaaacaaacacaaaca

SEQ ID NO: 71275 - RNA, 18 nt, Human
acaaaugacacagccccu

SEQ ID NO: 71276 - RNA, 18 nt, Human
accaaaaccaaacccaac

SEQ ID NO: 71277 - RNA, 25 nt, Human
accagagcagagaacagggcuccag

SEQ ID NO: 71278 - RNA, 24 nt, Human
acugggcugucuguacacagcagu

SEQ ID NO: 71279 - RNA, 18 nt, Human
agauugucacuugaaaau

SEQ ID NO: 71280 - RNA, 20 nt, Human
agcugagcucucccaaagcc

SEQ ID NO: 71281 - RNA, 24 nt, Human
aggagaugaagacuacauuucaaa

SEQ ID NO: 71282 - RNA, 21 nt, Human
aggcagguuguuuaguaaggg

SEQ ID NO: 71283 - RNA, 24 nt, Human
aggcuucaaguucaagacagagcu

SEQ ID NO: 71284 - RNA, 20 nt, Human
agggaggggguuuuaacugu

SEQ ID NO: 71285 - RNA, 21 nt, Human
agggcaaagauagcuuccccu

SEQ ID NO: 71286 - RNA, 18 nt, Human
aguccaguccacccugcc

SEQ ID NO: 71287 - RNA, 22 nt, Human
auaaaugaaggguacaacacau

SEQ ID NO: 71288 - RNA, 24 nt, Human
auacaccuguauccuuaaauccca

SEQ ID NO: 71289 - RNA, 23 nt, Human
auaggacaaaugacacagccccu

SEQ ID NO: 71290 - RNA, 18 nt, Human
aucauuuccaugcccagu

SEQ ID NO: 71291 - RNA, 20 nt, Human
auggaucccaggagaugaag

SEQ ID NO: 71292 - RNA, 21 nt, Human
auucaccuauaaaccacauau

SEQ ID NO: 71293 - RNA, 19 nt, Human
auugauucaccuauaaacc

SEQ ID NO: 71294 - RNA, 20 nt, Human
caaacaaacacaaacacaca

SEQ ID NO: 71295 - RNA, 24 nt, Human
caaacaaacacaaacacacacuua

SEQ ID NO: 71296 - RNA, 22 nt, Human
caaacacacacuuaaauacaua

SEQ ID NO: 71297 - RNA, 21 nt, Human
caaagcccagguucacuucuc

SEQ ID NO: 71298 - RNA, 21 nt, Human
caaaggcccagcagucuggau

SEQ ID NO: 71299 - RNA, 19 nt, Human
caaccagagcagagaacag

SEQ ID NO: 71300 - RNA, 19 nt, Human
caagagaauaggaaaauac

SEQ ID NO: 71301 - RNA, 18 nt, Human
caauuuuacacacaaaac

SEQ ID NO: 71302 - RNA, 23 nt, Human
cacacaaaacaggaaucaaagcc

SEQ ID NO: 71303 - RNA, 20 nt, Human
cacaucagcuccacuccuaa

SEQ ID NO: 71304 - RNA, 20 nt, Human
cacccccccgcauuuuucac

SEQ ID NO: 71305 - RNA, 21 nt, Human
cacugcaaauauuguuuaguc

SEQ ID NO: 71306 - RNA, 21 nt, Human
cacugggugcaacaaacugaa

SEQ ID NO: 71307 - RNA, 20 nt, Human
cagaacuaagcccacaguac

SEQ ID NO: 71308 - RNA, 23 nt, Human
cagaauucucagcugagcucucc

SEQ ID NO: 71309 - RNA, 19 nt, Human
cagaguauucauccagacu

SEQ ID NO: 71310 - RNA, 18 nt, Human
cagaguggauaucucaaa

SEQ ID NO: 71311 - RNA, 20 nt, Human
cagaucauauuuuaaaucau

SEQ ID NO: 71312 - RNA, 21 nt, Human
caggauaugccguauucugau

SEQ ID NO: 71313 - RNA, 18 nt, Human
caggauggaaaaauggcu

SEQ ID NO: 71314 - RNA, 19 nt, Human
caguagguuguagauuucu

SEQ ID NO: 71315 - RNA, 20 nt, Human
ccaguaacaguugcccacaa

SEQ ID NO: 71316 - RNA, 22 nt, Human
cccaaacaaacacaaacacaca

SEQ ID NO: 71317 - RNA, 21 nt, Human
ccccaaacaaacacaaacaca

SEQ ID NO: 71318 - RNA, 20 nt, Human
cccguucugaucagcacaga

SEQ ID NO: 71319 - RNA, 20 nt, Human
cccucaccuccgaaaccccu

SEQ ID NO: 71320 - RNA, 18 nt, Human
cccucaggcccucucugc

SEQ ID NO: 71321 - RNA, 18 nt, Human
cccuuggaacagagguac

SEQ ID NO: 71322 - RNA, 20 nt, Human
cccuuuucuccucacucagg

SEQ ID NO: 71323 - RNA, 24 nt, Human
ccgcauuuuucacugcuucuugac

SEQ ID NO: 71324 - RNA, 19 nt, Human
ccuaggcucuuuccacccc

SEQ ID NO: 71325 - RNA, 22 nt, Human
ccuccgaaaccccucaaaaacc

SEQ ID NO: 71326 - RNA, 22 nt, Human
ccucucagugucuccguguccu

SEQ ID NO: 71327 - RNA, 27 nt, Human
ccuuaaaucccagaaaauaugaacucc

SEQ ID NO: 71328 - RNA, 21 nt, Human
ccuuggggagaaagaaauggc

SEQ ID NO: 71329 - RNA, 25 nt, Human
cuaauccacucuuuccaaauaggcu

SEQ ID NO: 71330 - RNA, 22 nt, Human
cuacucugcucuccugauacgu

SEQ ID NO: 71331 - RNA, 19 nt, Human
cuccugauacguguuuucc

SEQ ID NO: 71332 - RNA, 18 nt, Human
cuccuuucccuuucuccc

SEQ ID NO: 71333 - RNA, 21 nt, Human
cucgcccuucuuuucugcucc

SEQ ID NO: 71334 - RNA, 20 nt, Human
cucucagugucuccgugucc

SEQ ID NO: 71335 - RNA, 24 nt, Human
cucucucccucuuuccggccuuuu

SEQ ID NO: 71336 - RNA, 31 nt, Human
cugaggcaggacagacacaucagcuccacuu

SEQ ID NO: 71337 - RNA, 18 nt, Human
cugagucugcaguggaac

SEQ ID NO: 71338 - RNA, 18 nt, Human
cugauagguaccuguguc

SEQ ID NO: 71339 - RNA, 22 nt, Human
cugcaaucaagaaguuuaugcc

SEQ ID NO: 71340 - RNA, 20 nt, Human
cugcacuccagguuugcgag

SEQ ID NO: 71341 - RNA, 18 nt, Human
cugccaguuuagcucaau

SEQ ID NO: 71342 - RNA, 23 nt, Human
cuguucacauuuuuuuauggauc

SEQ ID NO: 71343 - RNA, 20 nt, Human
cuucugugugcgucugucau

SEQ ID NO: 71344 - RNA, 22 nt, Human
cuugacccccaaguuuccuggg

SEQ ID NO: 71345 - RNA, 23 nt, Human
cuugagccaaugaagaaccaaaa

SEQ ID NO: 71346 - RNA, 19 nt, Human
cuuucuucuuccucuuucu

SEQ ID NO: 71347 - RNA, 21 nt, Human
gaaaauccaaaacaugcucuc

SEQ ID NO: 71348 - RNA, 23 nt, Human
gaacugccuaugggcuaaucuug

SEQ ID NO: 71349 - RNA, 20 nt, Human
gaacugugugugaaggucuu

SEQ ID NO: 71350 - RNA, 20 nt, Human
gaagaaccaaaaccaaaccc

SEQ ID NO: 71351 - RNA, 18 nt, Human
gaagacaucuagguucug

SEQ ID NO: 71352 - RNA, 21 nt, Human
gacagacacaucagcuccacu

SEQ ID NO: 71353 - RNA, 24 nt, Human
gacucuuccagggcaucaguuggu

SEQ ID NO: 71354 - RNA, 24 nt, Human
gagcgugaccugccagcccgugag

SEQ ID NO: 71355 - RNA, 21 nt, Human
gagugcaccuggagagggugc

SEQ ID NO: 71356 - RNA, 22 nt, Human
gaguucgcagccugcucucugg

SEQ ID NO: 71357 - RNA, 19 nt, Human
gcccugcuccaauuacaca

SEQ ID NO: 71358 - RNA, 19 nt, Human
gccugaccacggcugggag

SEQ ID NO: 71359 - RNA, 21 nt, Human
gcgcgggggagcucgcccuuc

SEQ ID NO: 71360 - RNA, 19 nt, Human
ggaaacccagaacuaagcc

SEQ ID NO: 71361 - RNA, 21 nt, Human
ggaaacccagaacuaagccca

SEQ ID NO: 71362 - RNA, 19 nt, Human
ggaaagaaaaugucaacag

SEQ ID NO: 71363 - RNA, 23 nt, Human
ggaaaggcgcggguuuggguugg

SEQ ID NO: 71364 - RNA, 25 nt, Human
ggacagacacaucagcuccacuccu

SEQ ID NO: 71365 - RNA, 21 nt, Human
ggacugggcugucuguacaca

SEQ ID NO: 71366 - RNA, 22 nt, Human
ggacugggcugucuguacacag

SEQ ID NO: 71367 - RNA, 23 nt, Human
ggacugggcugucuguacacagc

SEQ ID NO: 71368 - RNA, 26 nt, Human
ggagagggugcggaagacucuuccag

SEQ ID NO: 71369 - RNA, 18 nt, Human
ggcacauuuuguguuaga

SEQ ID NO: 71370 - RNA, 21 nt, Human
ggcauuuuugcugagcugaca

SEQ ID NO: 71371 - RNA, 22 nt, Human
ggcgcgggggagcucgcccuuc

SEQ ID NO: 71372 - RNA, 22 nt, Human
ggcuaaucuugagagcauguuu

SEQ ID NO: 71373 - RNA, 18 nt, Human
gggcucucucccucuuuc

SEQ ID NO: 71374 - RNA, 20 nt, Human
guaagaaacaaaaaccccaa

SEQ ID NO: 71375 - RNA, 21 nt, Human
guaagaaacaaaaaccccaaa

SEQ ID NO: 71376 - RNA, 19 nt, Human
guauccuuaaaucccagaa

SEQ ID NO: 71377 - RNA, 19 nt, Human
guguguguugggagauggg

SEQ ID NO: 71378 - RNA, 22 nt, Human
uaacaggggaugccauguuuug

SEQ ID NO: 71379 - RNA, 20 nt, Human
uaaccgagcgugaccugcca

SEQ ID NO: 71380 - RNA, 18 nt, Human
uaacucaacaggaagcaa

SEQ ID NO: 71381 - RNA, 18 nt, Human
uaaguggaugccaaaggc

SEQ ID NO: 71382 - RNA, 22 nt, Human
uacacacaaaacaggaaucaaa

SEQ ID NO: 71383 - RNA, 18 nt, Human
uacacacugggcugauca

SEQ ID NO: 71384 - RNA, 19 nt, Human
uacaugaagaaaacauuuc

SEQ ID NO: 71385 - RNA, 19 nt, Human
uacucauccucugacucua

SEQ ID NO: 71386 - RNA, 22 nt, Human
uacuuugagacgaugacccugg

SEQ ID NO: 71387 - RNA, 23 nt, Human
uagaacugugugugaaggucuug

SEQ ID NO: 71388 - RNA, 25 nt, Human
uagaacugugugugaaggucuuguu

SEQ ID NO: 71389 - RNA, 24 nt, Human
uaucaggcuaucucuuaagaauac

SEQ ID NO: 71390 - RNA, 19 nt, Human
uauuucagaguuucuacug

SEQ ID NO: 71391 - RNA, 22 nt, Human
ucaaaaacccuucuaauagucc

SEQ ID NO: 71392 - RNA, 22 nt, Human
ucaagaaugccuaaugauguca

SEQ ID NO: 71393 - RNA, 18 nt, Human
ucaauccagagucaggcc

SEQ ID NO: 71394 - RNA, 18 nt, Human
ucaauccagagucaggcc

SEQ ID NO: 71395 - RNA, 18 nt, Human
ucacaccucacagagcac

SEQ ID NO: 71396 - RNA, 23 nt, Human
ucacacguucaaaacuaaagacc

SEQ ID NO: 71397 - RNA, 19 nt, Human
ucagagguuaacacuggau

SEQ ID NO: 71398 - RNA, 19 nt, Human
ucagguaaggugaagggga

SEQ ID NO: 71399 - RNA, 18 nt, Human
ucaguugggagagccgag

SEQ ID NO: 71400 - RNA, 23 nt, Human
ucauaggcacauuuugaggaacc

SEQ ID NO: 71401 - RNA, 19 nt, Human
uccaggagaagagagacuc

SEQ ID NO: 71402 - RNA, 20 nt, Human
ucccaaagcccagguucacu

SEQ ID NO: 71403 - RNA, 21 nt, Human
uccgaaaccccucaaaaaccc

SEQ ID NO: 71404 - RNA, 22 nt, Human
uccucucagugucuccgugucc

SEQ ID NO: 71405 - RNA, 20 nt, Human
uccuucuuggccuucaggau

SEQ ID NO: 71406 - RNA, 18 nt, Human
ucucagguugaccacccc

SEQ ID NO: 71407 - RNA, 21 nt, Human
ucucccaaagcccagguucac

SEQ ID NO: 71408 - RNA, 26 nt, Human
ucucccucuuuccggccuuuucucuu

SEQ ID NO: 71409 - RNA, 21 nt, Human
ucugcacuccagguuugcgag

SEQ ID NO: 71410 - RNA, 24 nt, Human
ucuguguccuccucucagugucuc

SEQ ID NO: 71411 - RNA, 26 nt, Human
ugaagaaccaaaaccaaacccaacug

SEQ ID NO: 71412 - RNA, 22 nt, Human
ugacaaagaauucaauuucuaa

SEQ ID NO: 71413 - RNA, 22 nt, Human
ugagaaaaaaaaauaaaugaag

SEQ ID NO: 71414 - RNA, 24 nt, Human
ugagaaaaaaaaauaaaugaaggg

SEQ ID NO: 71415 - RNA, 20 nt, Human
ugagagcauguuuuucuugg

SEQ ID NO: 71416 - RNA, 21 nt, Human
ugagucugcaguggaacaagg

SEQ ID NO: 71417 - RNA, 18 nt, Human
ugagugguguggccagcc

SEQ ID NO: 71418 - RNA, 24 nt, Human
ugaguuaacucaacaggaagcaag

SEQ ID NO: 71419 - RNA, 21 nt, Human
ugcuccuucgcugcacaguca

SEQ ID NO: 71420 - RNA, 23 nt, Human
uggaaaaauggcuagaaugaggu

SEQ ID NO: 71421 - RNA, 23 nt, Human
uggaaacccagaacuaagcccac

SEQ ID NO: 71422 - RNA, 20 nt, Human
uggcggagugacaagcccca

SEQ ID NO: 71423 - RNA, 18 nt, Human
uggcuaagagguucaaau

SEQ ID NO: 71424 - RNA, 21 nt, Human
ugggaugcugagaaaaaaaaa

SEQ ID NO: 71425 - RNA, 23 nt, Human
ugggcugucuguacacagcagua

SEQ ID NO: 71426 - RNA, 22 nt, Human
uguaaaaagaaucccucuuuuc

SEQ ID NO: 71427 - RNA, 20 nt, Human
ugugcaguccuuucacacgu

SEQ ID NO: 71428 - RNA, 23 nt, Human
uguggccagccaugcagcaggug

SEQ ID NO: 71429 - RNA, 19 nt, Human
uguguguugggagaugggu

SEQ ID NO: 71430 - RNA, 23 nt, Human
uguuaacacugggugcaacaaac

SEQ ID NO: 71431 - RNA, 24 nt, Human
uuaaaaaauucaaccuuaaauccu

SEQ ID NO: 71432 - RNA, 18 nt, Human
uuagaguuccugcaugac

SEQ ID NO: 71433 - RNA, 20 nt, Human
uuagccaccauuucccuguu

SEQ ID NO: 71434 - RNA, 24 nt, Human
uucacacguucaaaacuaaaggaa

SEQ ID NO: 71435 - RNA, 18 nt, Human
uucacugcuucuugacaa

SEQ ID NO: 71436 - RNA, 20 nt, Human
uucaugugugcaugugugug

SEQ ID NO: 71437 - RNA, 18 nt, Human
uuccuucgcugugcaggc

SEQ ID NO: 71438 - RNA, 23 nt, Human
uuccuugucuuagauaauucagg

SEQ ID NO: 71439 - RNA, 18 nt, Human
uuuacauacauaugcauu

SEQ ID NO: 71440 - RNA, 22 nt, Human
uuuuacacacaaaacaggaauc

SEQ ID NO: 71441 - RNA, 20 nt, Human
uuuuucgcaucuguaucuga

SEQ ID NO: 71442 - RNA, 22 nt, Human
aaaaaaagaaaaaaagaaaaag

SEQ ID NO: 71443 - RNA, 23 nt, Human
aaaaaaagacaaaaccaaacugg

SEQ ID NO: 71444 - RNA, 21 nt, Human
aaaaagaaaaaaagaaaaaga

SEQ ID NO: 71445 - RNA, 18 nt, Human
aaaaagaaaaaagaaaag

SEQ ID NO: 71446 - RNA, 21 nt, Human
aaaaagacaaaaccaaacugg

SEQ ID NO: 71447 - RNA, 21 nt, Human
aaaagaaaaaaagaaaaagaa

SEQ ID NO: 71448 - RNA, 25 nt, Human
aaaagaaaaagaaaaaagaaaagaa

SEQ ID NO: 71449 - RNA, 18 nt, Human
aaaccaggaauccaaaaa

SEQ ID NO: 71450 - RNA, 18 nt, Human
aaacccuccuuuacacuc

SEQ ID NO: 71451 - RNA, 18 nt, Human
aaacgagagagaaccaaa

SEQ ID NO: 71452 - RNA, 20 nt, Human
aaagaugaccagcccgaagc

SEQ ID NO: 71453 - RNA, 21 nt, Human
aaagccuccuccacuugccaa

SEQ ID NO: 71454 - RNA, 23 nt, Human
aaagucacauaaaagccuccucc

SEQ ID NO: 71455 - RNA, 20 nt, Human
aacaucuucuuaucccaguu

SEQ ID NO: 71456 - RNA, 19 nt, Human
aacauggugaaacaucucu

SEQ ID NO: 71457 - RNA, 23 nt, Human
aaccaagcgugguggugugugcc

SEQ ID NO: 71458 - RNA, 18 nt, Human
aaccaggacagggaagag

SEQ ID NO: 71459 - RNA, 19 nt, Human
aagaaaaagaaaaaagaaa

SEQ ID NO: 71460 - RNA, 19 nt, Human
aagaagaggaaaggauucu

SEQ ID NO: 71461 - RNA, 21 nt, Human
aagaaggcacuguccacugcc

SEQ ID NO: 71462 - RNA, 20 nt, Human
aagacaaaaccaaacuggaa

SEQ ID NO: 71463 - RNA, 22 nt, Human
aagaggaaaggauucuucucaa

SEQ ID NO: 71464 - RNA, 24 nt, Human
aagaugaccagcccgaagcaccac

SEQ ID NO: 71465 - RNA, 24 nt, Human
aagcgugguggugugugccuguaa

SEQ ID NO: 71466 - RNA, 24 nt, Human
aaguguuggcaacuuccuggaacu

SEQ ID NO: 71467 - RNA, 24 nt, Human
aaucgcuugaacccaggaggugga

SEQ ID NO: 71468 - RNA, 23 nt, Human
aauucccguuccagccucaucuc

SEQ ID NO: 71469 - RNA, 18 nt, Human
acaccaaccacaacauaa

SEQ ID NO: 71470 - RNA, 21 nt, Human
acagacagacaugauacuggg

SEQ ID NO: 71471 - RNA, 23 nt, Human
acagcccauggggcucacugcug

SEQ ID NO: 71472 - RNA, 19 nt, Human
acaggaaguaaguguuggc

SEQ ID NO: 71473 - RNA, 23 nt, Human
accaaauuucagacccagcuuua

SEQ ID NO: 71474 - RNA, 21 nt, Human
accaagccaggcacuggccug

SEQ ID NO: 71475 - RNA, 22 nt, Human
accacaacauaaaagucacaua

SEQ ID NO: 71476 - RNA, 24 nt, Human
acccaggagguggagguugcagug

SEQ ID NO: 71477 - RNA, 19 nt, Human
acugaagaagggagcagag

SEQ ID NO: 71478 - RNA, 21 nt, Human
acugaugucucccaauucuga

SEQ ID NO: 71479 - RNA, 18 nt, Human
acuggccugggccugguu

SEQ ID NO: 71480 - RNA, 21 nt, Human
agaaaaaaagaaaaagaaaaa

SEQ ID NO: 71481 - RNA, 20 nt, Human
agaaaaaagaaaagaaaacu

SEQ ID NO: 71482 - RNA, 24 nt, Human
agaaaagaaaacuaccccucccca

SEQ ID NO: 71483 - RNA, 20 nt, Human
agaacucaugcguguggggg

SEQ ID NO: 71484 - RNA, 18 nt, Human
agaagggagcagagaggc

SEQ ID NO: 71485 - RNA, 19 nt, Human
agagggaggcgccugggcc

SEQ ID NO: 71486 - RNA, 24 nt, Human
agagucuaccggggggacgggaag

SEQ ID NO: 71487 - RNA, 22 nt, Human
agagugagacuccaucucaaaa

SEQ ID NO: 71488 - RNA, 24 nt, Human
agcacuuugggagguugagguggg

SEQ ID NO: 71489 - RNA, 24 nt, Human
agccgacauggauccucccaaacc

SEQ ID NO: 71490 - RNA, 24 nt, Human
agccgcucagaggggagccccagc

SEQ ID NO: 71491 - RNA, 22 nt, Human
agccuggccaacauggugaaac

SEQ ID NO: 71492 - RNA, 19 nt, Human
agcugggugugguggcuca

SEQ ID NO: 71493 - RNA, 22 nt, Human
agcugggugugguggcucacgc

SEQ ID NO: 71494 - RNA, 23 nt, Human
aggaagccagagaagaaggcacu

SEQ ID NO: 71495 - RNA, 21 nt, Human
aggaauccaaaaauccagagc

SEQ ID NO: 71496 - RNA, 23 nt, Human
aggaauucaagacuagccuggcc

SEQ ID NO: 71497 - RNA, 20 nt, Human
aggagaagucaacagguuca

SEQ ID NO: 71498 - RNA, 21 nt, Human
aggaucacccccaugcaaacc

SEQ ID NO: 71499 - RNA, 30 nt, Human
aggaucacccccaugcaaaccaggaauccu

SEQ ID NO: 71500 - RNA, 23 nt, Human
aggcaggagaaucgcuugaaccc

SEQ ID NO: 71501 - RNA, 24 nt, Human
aggcaggagaaucgcuugaaccca

SEQ ID NO: 71502 - RNA, 20 nt, Human
aggcugaggcaggagaaucg

SEQ ID NO: 71503 - RNA, 24 nt, Human
aggcugaggcaggagaaucgcuug

SEQ ID NO: 71504 - RNA, 24 nt, Human
agguggagguugcagugagcugag

SEQ ID NO: 71505 - RNA, 24 nt, Human
aggugggcaggucaggaggucagg

SEQ ID NO: 71506 - RNA, 18 nt, Human
agguugaggugggcaggu

SEQ ID NO: 71507 - RNA, 23 nt, Human
agucaacagguucaggccucucu

SEQ ID NO: 71508 - RNA, 24 nt, Human
auaaaagccuccuccacuugccaa

SEQ ID NO: 71509 - RNA, 18 nt, Human
aucacuucaccgucaaac

SEQ ID NO: 71510 - RNA, 23 nt, Human
aucacuucaccgucaaacuuggc

SEQ ID NO: 71511 - RNA, 18 nt, Human
augaaguagcuguggccc

SEQ ID NO: 71512 - RNA, 20 nt, Human
augacacagggaaaggaggc

SEQ ID NO: 71513 - RNA, 19 nt, Human
auggagcacuuguugaaaa

SEQ ID NO: 71514 - RNA, 18 nt, Human
auugcacucuugccuagg

SEQ ID NO: 71515 - RNA, 18 nt, Human
auuguacuuggaggucuu

SEQ ID NO: 71516 - RNA, 23 nt, Human
caaacuggacacaacacaaauca

SEQ ID NO: 71517 - RNA, 22 nt, Human
caaagggaggucaaaagggagu

SEQ ID NO: 71518 - RNA, 26 nt, Human
caacauaaaagucacauaaaagccuc

SEQ ID NO: 71519 - RNA, 21 nt, Human
caacauggugaaacaucucua

SEQ ID NO: 71520 - RNA, 25 nt, Human
caaccacaacauaaaagucacauaa

SEQ ID NO: 71521 - RNA, 23 nt, Human
caagaaagcaccagauggggagg

SEQ ID NO: 71522 - RNA, 23 nt, Human
caagaaccaaaggcacaauggug

SEQ ID NO: 71523 - RNA, 24 nt, Human
caagacuagccuggccaacauggu

SEQ ID NO: 71524 - RNA, 24 nt, Human
caauggccaggaucacccccaugc

SEQ ID NO: 71525 - RNA, 20 nt, Human
cacaacacaaaucaaggaga

SEQ ID NO: 71526 - RNA, 21 nt, Human
cacagccggccaggcugcggc

SEQ ID NO: 71527 - RNA, 19 nt, Human
caccagauggggaggcaaa

SEQ ID NO: 71528 - RNA, 20 nt, Human
caccccacagccggccaggc

SEQ ID NO: 71529 - RNA, 23 nt, Human
cacccgcagcccaggccauccuc

SEQ ID NO: 71530 - RNA, 26 nt, Human
caccucacugcagcccauccaguucc

SEQ ID NO: 71531 - RNA, 24 nt, Human
cacgccuguaaucucagcacuuug

SEQ ID NO: 71532 - RNA, 23 nt, Human
cagaucacuucaccgucaaacuu

SEQ ID NO: 71533 - RNA, 24 nt, Human
cagcacuuugggagguugaggugg

SEQ ID NO: 71534 - RNA, 20 nt, Human
cagcaggacagagucuaccg

SEQ ID NO: 71535 - RNA, 18 nt, Human
cagcccaggccauccucc

SEQ ID NO: 71536 - RNA, 20 nt, Human
cagcccgaagcaccacucgg

SEQ ID NO: 71537 - RNA, 19 nt, Human
cagccggccaggcugcggc

SEQ ID NO: 71538 - RNA, 19 nt, Human
cagccuccagcaggcuggg

SEQ ID NO: 71539 - RNA, 24 nt, Human
cagcuacucaggaggcugaggcag

SEQ ID NO: 71540 - RNA, 24 nt, Human
cagcucaaugcaacuugguacuuu

SEQ ID NO: 71541 - RNA, 21 nt, Human
cagcuccaaaccauuccugaa

SEQ ID NO: 71542 - RNA, 23 nt, Human
caggagaguuaagacaccaacca

SEQ ID NO: 71543 - RNA, 29 nt, Human
caggagguggagguugcagugacaacggu

SEQ ID NO: 71544 - RNA, 22 nt, Human
caggucaggaggucaggaauuc

SEQ ID NO: 71545 - RNA, 22 nt, Human
cauccacugcuccugcuggagg

SEQ ID NO: 71546 - RNA, 19 nt, Human
cauccagaccaagccaggc

SEQ ID NO: 71547 - RNA, 24 nt, Human
caucgacggggcggcuccccgggg

SEQ ID NO: 71548 - RNA, 19 nt, Human
cauugcacucuugccuagg

SEQ ID NO: 71549 - RNA, 23 nt, Human
cauugcacucuugccuaggugac

SEQ ID NO: 71550 - RNA, 24 nt, Human
cauugcacucuugccuaggugaca

SEQ ID NO: 71551 - RNA, 25 nt, Human
cauugcacucuugccuaggugacaa

SEQ ID NO: 71552 - RNA, 19 nt, Human
cauuuaaaaucccccuacc

SEQ ID NO: 71553 - RNA, 18 nt, Human
ccaaaccauuccugaaga

SEQ ID NO: 71554 - RNA, 20 nt, Human
ccaagccaggcacuggccug

SEQ ID NO: 71555 - RNA, 26 nt, Human
ccaaggccagcaggacuaaggaaucc

SEQ ID NO: 71556 - RNA, 18 nt, Human
ccaauggccaggaucacc

SEQ ID NO: 71557 - RNA, 18 nt, Human
ccacccgcccccaccuca

SEQ ID NO: 71558 - RNA, 19 nt, Human
ccagaaggagaggaagcca

SEQ ID NO: 71559 - RNA, 18 nt, Human
ccagcaggcugggguccc

SEQ ID NO: 71560 - RNA, 19 nt, Human
ccagccgucgggcgcgcgc

SEQ ID NO: 71561 - RNA, 21 nt, Human
ccaggacgucaaacacaucac

SEQ ID NO: 71562 - RNA, 23 nt, Human
ccaggacgucaaacacaucacca

SEQ ID NO: 71563 - RNA, 22 nt, Human
ccaugcaaaccaggaauccaaa

SEQ ID NO: 71564 - RNA, 19 nt, Human
ccauugcacucuugccuag

SEQ ID NO: 71565 - RNA, 24 nt, Human
ccauugcacucuugccuaggugac

SEQ ID NO: 71566 - RNA, 20 nt, Human
cccaaaccaccccacagccg

SEQ ID NO: 71567 - RNA, 27 nt, Human
cccacagagcacuggucacugcaggca

SEQ ID NO: 71568 - RNA, 21 nt, Human
cccaggagguggagguugcag

SEQ ID NO: 71569 - RNA, 22 nt, Human
cccauccaguuccuuuggggcu

SEQ ID NO: 71570 - RNA, 18 nt, Human
ccccaagagggcuucuuu

SEQ ID NO: 71571 - RNA, 19 nt, Human
ccccaugcaaaccaggaau

SEQ ID NO: 71572 - RNA, 21 nt, Human
ccccaugcaaaccaggaaucc

SEQ ID NO: 71573 - RNA, 24 nt, Human
cccccaugcaaaccaggaauccaa

SEQ ID NO: 71574 - RNA, 20 nt, Human
ccccgugccucagccucugc

SEQ ID NO: 71575 - RNA, 19 nt, Human
ccccuccccacugaccaaa

SEQ ID NO: 71576 - RNA, 25 nt, Human
cccgcccccaccucacugcagccca

SEQ ID NO: 71577 - RNA, 28 nt, Human
cccgugccucagccucugcucugcccuu

SEQ ID NO: 71578 - RNA, 22 nt, Human
cccuacccacucccagcuccaa

SEQ ID NO: 71579 - RNA, 22 nt, Human
cccuccuuucuucuucuguccc

SEQ ID NO: 71580 - RNA, 18 nt, Human
cccugcccacccgccccc

SEQ ID NO: 71581 - RNA, 21 nt, Human
cccugcccacccgcccccacc

SEQ ID NO: 71582 - RNA, 25 nt, Human
ccuacccacucccagcuccaaacca

SEQ ID NO: 71583 - RNA, 20 nt, Human
ccuaggcuccagcccaaggc

SEQ ID NO: 71584 - RNA, 23 nt, Human
ccuaggugacaagagugagacuc

SEQ ID NO: 71585 - RNA, 20 nt, Human
ccucagccucugcucugccc

SEQ ID NO: 71586 - RNA, 22 nt, Human
ccuccucuacuacccggcacaa

SEQ ID NO: 71587 - RNA, 22 nt, Human
ccucucccauucccugcccacc

SEQ ID NO: 71588 - RNA, 24 nt, Human
ccugccaagacuuccccucuccca

SEQ ID NO: 71589 - RNA, 21 nt, Human
ccugcccacccgcccccaccu

SEQ ID NO: 71590 - RNA, 19 nt, Human
ccuggccaacauggugaaa

SEQ ID NO: 71591 - RNA, 20 nt, Human
ccuggccaacauggugaaac

SEQ ID NO: 71592 - RNA, 21 nt, Human
ccuggccaacauggugaaaca

SEQ ID NO: 71593 - RNA, 19 nt, Human
ccuguaaucccagcuacuc

SEQ ID NO: 71594 - RNA, 21 nt, Human
ccuguaaucccagcuacucag

SEQ ID NO: 71595 - RNA, 23 nt, Human
ccugugggucccaggcagggcag

SEQ ID NO: 71596 - RNA, 23 nt, Human
ccuugagagacacacagacagac

SEQ ID NO: 71597 - RNA, 20 nt, Human
cgacuaacuugggaaaugcc

SEQ ID NO: 71598 - RNA, 21 nt, Human
cgcagcccaggccauccuccc

SEQ ID NO: 71599 - RNA, 24 nt, Human
cgccuguaaucucagcacuuuggg

SEQ ID NO: 71600 - RNA, 19 nt, Human
cgcgccccacccgcagccc

SEQ ID NO: 71601 - RNA, 19 nt, Human
cgcgcgccccacccgcagc

SEQ ID NO: 71602 - RNA, 21 nt, Human
cgggcaucuccuuggggaccg

SEQ ID NO: 71603 - RNA, 24 nt, Human
cuaaaaaacgagagagaaccaaaa

SEQ ID NO: 71604 - RNA, 23 nt, Human
cuacagcugggaacagauguccc

SEQ ID NO: 71605 - RNA, 21 nt, Human
cuacccacucccagcuccaaa

SEQ ID NO: 71606 - RNA, 23 nt, Human
cuaccccuccccacugaccaaau

SEQ ID NO: 71607 - RNA, 22 nt, Human
cuacccggcacaaggauuccac

SEQ ID NO: 71608 - RNA, 22 nt, Human
cucacgccuguaaucucagcac

SEQ ID NO: 71609 - RNA, 24 nt, Human
cucacgccuguaaucucagcacuu

SEQ ID NO: 71610 - RNA, 23 nt, Human
cuccaaaccauuccugaagaauc

SEQ ID NO: 71611 - RNA, 18 nt, Human
cuccaagagggaggcgcc

SEQ ID NO: 71612 - RNA, 19 nt, Human
cuccaucucaaaaaaaaaa

SEQ ID NO: 71613 - RNA, 22 nt, Human
cucccagcuccaaaccauuccu

SEQ ID NO: 71614 - RNA, 25 nt, Human
cucccucuagcuccccagcuggugg

SEQ ID NO: 71615 - RNA, 19 nt, Human
cuccugcuggaggauucca

SEQ ID NO: 71616 - RNA, 24 nt, Human
cuggcuccccgugccucagccucu

SEQ ID NO: 71617 - RNA, 19 nt, Human
cuucaugcagaacaucuuc

SEQ ID NO: 71618 - RNA, 24 nt, Human
cuuguuuuugguuccacuucuggu

SEQ ID NO: 71619 - RNA, 21 nt, Human
gaaaaagaaaaaagaaaagaa

SEQ ID NO: 71620 - RNA, 24 nt, Human
gaaaagaaaacuaccccuccccac

SEQ ID NO: 71621 - RNA, 19 nt, Human
gaaccaggacagggaagag

SEQ ID NO: 71622 - RNA, 18 nt, Human
gacaccaaccacaacaua

SEQ ID NO: 71623 - RNA, 21 nt, Human
gacccagcuuuagcucacuaa

SEQ ID NO: 71624 - RNA, 23 nt, Human
gagaaucgcuugaacccaggagg

SEQ ID NO: 71625 - RNA, 21 nt, Human
gaggaagcagacaggaccaaa

SEQ ID NO: 71626 - RNA, 21 nt, Human
gaggcgccugggcccgggccc

SEQ ID NO: 71627 - RNA, 24 nt, Human
gaggcugggccugaggggcggggc

SEQ ID NO: 71628 - RNA, 21 nt, Human
gagguggagguugcagugagc

SEQ ID NO: 71629 - RNA, 21 nt, Human
gagguugcagugagcugagau

SEQ ID NO: 71630 - RNA, 23 nt, Human
gagguugcagugagcugagauug

SEQ ID NO: 71631 - RNA, 18 nt, Human
gauccgccgccacaaacu

SEQ ID NO: 71632 - RNA, 21 nt, Human
gaugauguaggaccagaagga

SEQ ID NO: 71633 - RNA, 19 nt, Human
gcaggacagagucuaccgg

SEQ ID NO: 71634 - RNA, 22 nt, Human
gcaggagaaucgcuugaaccca

SEQ ID NO: 71635 - RNA, 21 nt, Human
gcagguagaccuggaaacgca

SEQ ID NO: 71636 - RNA, 22 nt, Human
gccugaggggcggggcuccuug

SEQ ID NO: 71637 - RNA, 21 nt, Human
gcugugauggugaggacaaga

SEQ ID NO: 71638 - RNA, 24 nt, Human
ggaaaggauucuucucaaggcuga

SEQ ID NO: 71639 - RNA, 22 nt, Human
ggaagagaucugggggaucaac

SEQ ID NO: 71640 - RNA, 22 nt, Human
ggacagggaagagaucuggggg

SEQ ID NO: 71641 - RNA, 23 nt, Human
ggaccaaacccuccuuuacacuc

SEQ ID NO: 71642 - RNA, 20 nt, Human
ggaggucaaaagggagucug

SEQ ID NO: 71643 - RNA, 18 nt, Human
ggagguugaggugggcag

SEQ ID NO: 71644 - RNA, 22 nt, Human
ggagguugaggugggcagguca

SEQ ID NO: 71645 - RNA, 22 nt, Human
ggagguugcagugagcugagau

SEQ ID NO: 71646 - RNA, 24 nt, Human
ggagguugcagugagcugagauug

SEQ ID NO: 71647 - RNA, 22 nt, Human
ggauccucccaaaccaccccac

SEQ ID NO: 71648 - RNA, 22 nt, Human
ggcaaagggaggucaaaaggga

SEQ ID NO: 71649 - RNA, 23 nt, Human
ggcaggucaggaggucaggaauu

SEQ ID NO: 71650 - RNA, 19 nt, Human
ggccugaggggcggggcuc

SEQ ID NO: 71651 - RNA, 21 nt, Human
ggcucacgccuguaaucucag

SEQ ID NO: 71652 - RNA, 24 nt, Human
ggcuucugcaggcguccgcuucuu

SEQ ID NO: 71653 - RNA, 22 nt, Human
gggaccagcaggacagagucua

SEQ ID NO: 71654 - RNA, 23 nt, Human
gggcaggggcagacacaaucucu

SEQ ID NO: 71655 - RNA, 19 nt, Human
ggggacgggaagcaaggaa

SEQ ID NO: 71656 - RNA, 23 nt, Human
ggggagccccagccgucgggcgc

SEQ ID NO: 71657 - RNA, 21 nt, Human
ggggagggcagaccgucuaua

SEQ ID NO: 71658 - RNA, 24 nt, Human
gggugugguggcucacgccuguaa

SEQ ID NO: 71659 - RNA, 19 nt, Human
ggugaggaagcagacagga

SEQ ID NO: 71660 - RNA, 24 nt, Human
ggugaggacaagaaccaaaggcac

SEQ ID NO: 71661 - RNA, 19 nt, Human
gguggagguugcagugagc

SEQ ID NO: 71662 - RNA, 24 nt, Human
gguggcucacgccuguaaucucag

SEQ ID NO: 71663 - RNA, 24 nt, Human
gguggugugugccuguaaucccag

SEQ ID NO: 71664 - RNA, 21 nt, Human
guaaaggacaggcuguggcca

SEQ ID NO: 71665 - RNA, 22 nt, Human
gucaaaagggagucugccaaua

SEQ ID NO: 71666 - RNA, 23 nt, Human
guggaagggccuacagcugggaa

SEQ ID NO: 71667 - RNA, 20 nt, Human
guggagguugcagugagcug

SEQ ID NO: 71668 - RNA, 21 nt, Human
guggugcgggcuucugcaggc

SEQ ID NO: 71669 - RNA, 28 nt, Human
guggugcgggcuucugcaggcguccgcu

SEQ ID NO: 71670 - RNA, 23 nt, Human
guggugugugccuguaaucccag

SEQ ID NO: 71671 - RNA, 24 nt, Human
guggugugugccuguaaucccagc

SEQ ID NO: 71672 - RNA, 20 nt, Human
gugugccuguaaucccagcu

SEQ ID NO: 71673 - RNA, 20 nt, Human
guucaggccucucucuccca

SEQ ID NO: 71674 - RNA, 23 nt, Human
guucaggccucucucucccaauu

SEQ ID NO: 71675 - RNA, 24 nt, Human
guugcagugagcugagauugugcc

SEQ ID NO: 71676 - RNA, 22 nt, Human
uaaaaaaagacaaaaccaaacu

SEQ ID NO: 71677 - RNA, 24 nt, Human
uaaaaaaagacaaaaccaaacugg

SEQ ID NO: 71678 - RNA, 19 nt, Human
uaaaaaacgagagagaacc

SEQ ID NO: 71679 - RNA, 20 nt, Human
uaaaaaacgagagagaacca

SEQ ID NO: 71680 - RNA, 21 nt, Human
uaaaaaacgagagagaaccaa

SEQ ID NO: 71681 - RNA, 23 nt, Human
uaaaaaacgagagagaaccaaaa

SEQ ID NO: 71682 - RNA, 21 nt, Human
uaaaaauacaaaaauuaacca

SEQ ID NO: 71683 - RNA, 22 nt, Human
uaaaagucacauaaaagccucc

SEQ ID NO: 71684 - RNA, 22 nt, Human
uaaaaucccccuacccacuccc

SEQ ID NO: 71685 - RNA, 25 nt, Human
uaagacaccaaccacaacauaaaag

SEQ ID NO: 71686 - RNA, 22 nt, Human
uacacucucccacuacccucug

SEQ ID NO: 71687 - RNA, 22 nt, Human
uacccacucccagcuccaaacc

SEQ ID NO: 71688 - RNA, 21 nt, Human
uacuggguuuguaaacugugu

SEQ ID NO: 71689 - RNA, 20 nt, Human
uagaccuggaaacgcauccc

SEQ ID NO: 71690 - RNA, 18 nt, Human
uagccuggccaacauggu

SEQ ID NO: 71691 - RNA, 21 nt, Human
uaggcuccagcccaaggccag

SEQ ID NO: 71692 - RNA, 18 nt, Human
uagguagcgacuaacuug

SEQ ID NO: 71693 - RNA, 19 nt, Human
uaguggcaucgacggggcg

SEQ ID NO: 71694 - RNA, 20 nt, Human
uauauaacuguauauauaua

SEQ ID NO: 71695 - RNA, 18 nt, Human
uaucaaagaagaggaaag

SEQ ID NO: 71696 - RNA, 21 nt, Human
uaucaaagaagaggaaaggau

SEQ ID NO: 71697 - RNA, 25 nt, Human
uaucaaagaagaggaaaggauucuu

SEQ ID NO: 71698 - RNA, 21 nt, Human
uauuguacuuggaggucuuga

SEQ ID NO: 71699 - RNA, 18 nt, Human
ucaaagaagaggaaagga

SEQ ID NO: 71700 - RNA, 22 nt, Human
ucaaagagguugacaggcagga

SEQ ID NO: 71701 - RNA, 19 nt, Human
ucacugcagcccauccagu

SEQ ID NO: 71702 - RNA, 19 nt, Human
ucagccucugcucugcccu

SEQ ID NO: 71703 - RNA, 24 nt, Human
ucaggaggucaggaauucaagacu

SEQ ID NO: 71704 - RNA, 21 nt, Human
ucaguggcaucuuuaacagcu

SEQ ID NO: 71705 - RNA, 23 nt, Human
ucauggguaccucccucccuggu

SEQ ID NO: 71706 - RNA, 18 nt, Human
uccaccuggcccagcucc

SEQ ID NO: 71707 - RNA, 19 nt, Human
uccaucucaaaaaaaaaaa

SEQ ID NO: 71708 - RNA, 25 nt, Human
uccaucucaaaaaaaaaaagaaaaa

SEQ ID NO: 71709 - RNA, 20 nt, Human
uccauugaucagcaccugaa

SEQ ID NO: 71710 - RNA, 19 nt, Human
ucccagauggcauugccaa

SEQ ID NO: 71711 - RNA, 19 nt, Human
ucccagcuccaaaccauuc

SEQ ID NO: 71712 - RNA, 23 nt, Human
uccccagcugguggaagggccua

SEQ ID NO: 71713 - RNA, 25 nt, Human
ucccccuacccacucccagcuccaa

SEQ ID NO: 71714 - RNA, 21 nt, Human
ucccccugcagccccaccaca

SEQ ID NO: 71715 - RNA, 19 nt, Human
uccccgaguggggcuggcu

SEQ ID NO: 71716 - RNA, 20 nt, Human
uccccgaucuugacagccuc

SEQ ID NO: 71717 - RNA, 22 nt, Human
uccccgaucuugacagccucca

SEQ ID NO: 71718 - RNA, 20 nt, Human
uccccgugccucagccucug

SEQ ID NO: 71719 - RNA, 23 nt, Human
uccccgugccucagccucugcuc

SEQ ID NO: 71720 - RNA, 18 nt, Human
ucccugagcugggugugg

SEQ ID NO: 71721 - RNA, 21 nt, Human
uccucccaaaccaccccacag

SEQ ID NO: 71722 - RNA, 24 nt, Human
ucgcuugaacccaggagguggagg

SEQ ID NO: 71723 - RNA, 19 nt, Human
ucucccugugggucccagg

SEQ ID NO: 71724 - RNA, 23 nt, Human
ucucuacuaaaaauacaaaaauu

SEQ ID NO: 71725 - RNA, 27 nt, Human
ucucucacaguuuuuucuuguuuuugg

SEQ ID NO: 71726 - RNA, 22 nt, Human
ucugccgcuguuuugcaucagc

SEQ ID NO: 71727 - RNA, 23 nt, Human
ugaaacaucucuacuaaaaauac

SEQ ID NO: 71728 - RNA, 19 nt, Human
ugaagaagggagcagagag

SEQ ID NO: 71729 - RNA, 21 nt, Human
ugaaguagcuguggcccagac

SEQ ID NO: 71730 - RNA, 21 nt, Human
ugacaggcaggaaggugagaa

SEQ ID NO: 71731 - RNA, 21 nt, Human
ugagcugggugugguggcuca

SEQ ID NO: 71732 - RNA, 23 nt, Human
ugagcugggugugguggcucacg

SEQ ID NO: 71733 - RNA, 19 nt, Human
ugaggaagcagacaggacc

SEQ ID NO: 71734 - RNA, 25 nt, Human
ugaggaagcagacaggaccaaaccc

SEQ ID NO: 71735 - RNA, 20 nt, Human
ugaggcaggagaaucgcuug

SEQ ID NO: 71736 - RNA, 24 nt, Human
ugaggcaggagaaucgcuugaacc

SEQ ID NO: 71737 - RNA, 25 nt, Human
ugaggcaggagaaucgcuugaaccc

SEQ ID NO: 71738 - RNA, 22 nt, Human
ugaggugggcaggucaggaggu

SEQ ID NO: 71739 - RNA, 24 nt, Human
ugaggugggcaggucaggagguca

SEQ ID NO: 71740 - RNA, 21 nt, Human
ugagugggggagggcagaccg

SEQ ID NO: 71741 - RNA, 23 nt, Human
ugaucagcaccugagacuggcgg

SEQ ID NO: 71742 - RNA, 18 nt, Human
ugcaucagcuuagugucg

SEQ ID NO: 71743 - RNA, 19 nt, Human
ugccgcuguuuugcaucag

SEQ ID NO: 71744 - RNA, 22 nt, Human
ugccuaggugacaagagugaga

SEQ ID NO: 71745 - RNA, 24 nt, Human
ugccuguaaucccagcuacucagg

SEQ ID NO: 71746 - RNA, 23 nt, Human
ugcucccagauggcauugccaau

SEQ ID NO: 71747 - RNA, 19 nt, Human
ugcuuacugaagaagggag

SEQ ID NO: 71748 - RNA, 18 nt, Human
uggaacauuuaaaauccc

SEQ ID NO: 71749 - RNA, 19 nt, Human
uggaacauuuaaaaucccc

SEQ ID NO: 71750 - RNA, 22 nt, Human
uggaugaaguaaaggacaggcu

SEQ ID NO: 71751 - RNA, 21 nt, Human
uggccaacauggugaaacauc

SEQ ID NO: 71752 - RNA, 20 nt, Human
uggcccagacggaugaccuc

SEQ ID NO: 71753 - RNA, 24 nt, Human
uggcucacgccuguaaucucagca

SEQ ID NO: 71754 - RNA, 23 nt, Human
uggcuccccgugccucagccucu

SEQ ID NO: 71755 - RNA, 20 nt, Human
ugggagguucacagaucacu

SEQ ID NO: 71756 - RNA, 20 nt, Human
ugggagguugaggugggcag

SEQ ID NO: 71757 - RNA, 19 nt, Human
ugggggcagagggcagcac

SEQ ID NO: 71758 - RNA, 27 nt, Human
uggguaccucccucccuggucagcucc

SEQ ID NO: 71759 - RNA, 27 nt, Human
uggugaggacaagaaccaaaggcacaa

SEQ ID NO: 71760 - RNA, 24 nt, Human
ugguggcucacgccuguaaucuca

SEQ ID NO: 71761 - RNA, 18 nt, Human
ugguggugcgggcuucug

SEQ ID NO: 71762 - RNA, 24 nt, Human
ugguggugugugccuguaauccca

SEQ ID NO: 71763 - RNA, 21 nt, Human
uggugugugccuguaauccca

SEQ ID NO: 71764 - RNA, 20 nt, Human
uguccuuggccuuaguggca

SEQ ID NO: 71765 - RNA, 22 nt, Human
uguggaugaaguaaaggacagg

SEQ ID NO: 71766 - RNA, 22 nt, Human
uguggugggaccagcaggacag

SEQ ID NO: 71767 - RNA, 23 nt, Human
uguguguugggggcagagggcag

SEQ ID NO: 71768 - RNA, 21 nt, Human
uguguugggggcagagggcag

SEQ ID NO: 71769 - RNA, 24 nt, Human
uuaaccaagcgugguggugugugc

SEQ ID NO: 71770 - RNA, 19 nt, Human
uuacucgcauacuggaauu

SEQ ID NO: 71771 - RNA, 22 nt, Human
uuauagucucccuguggguccc

SEQ ID NO: 71772 - RNA, 20 nt, Human
uucacagaucacuucaccgu

SEQ ID NO: 71773 - RNA, 18 nt, Human
uuccuggaacugcucaaa

SEQ ID NO: 71774 - RNA, 24 nt, Human
uugaacccaggagguggagguugc

SEQ ID NO: 71775 - RNA, 19 nt, Human
uugcagugagcugagauug

SEQ ID NO: 71776 - RNA, 22 nt, Human
uugcagugagcugagauugugc

SEQ ID NO: 71777 - RNA, 23 nt, Human
uuuaaaaucccccuacccacucc

SEQ ID NO: 71778 - RNA, 18 nt, Human
uuugcccuuauccuccuc

SEQ ID NO: 71779 - RNA, 22 nt, Human
agaaagcaguuuauuucuuaau

SEQ ID NO: 71780 - RNA, 23 nt, Human
gagaaauaacaguugcugagaac

SEQ ID NO: 71781 - RNA, 19 nt, Human
uauaauuaaugaucagaga

SEQ ID NO: 71782 - RNA, 20 nt, Human
aaaacugguccuuugaacaa

SEQ ID NO: 71783 - RNA, 19 nt, Human
aaaaugccucuucccacca

SEQ ID NO: 71784 - RNA, 22 nt, Human
aaacuaagcuugaauccaaaca

SEQ ID NO: 71785 - RNA, 23 nt, Human
aaacuaagcuugaauccaaacaa

SEQ ID NO: 71786 - RNA, 25 nt, Human
aaauaacuauaaaacaaaaacauuu

SEQ ID NO: 71787 - RNA, 23 nt, Human
aacacaauuuccaagcagugccc

SEQ ID NO: 71788 - RNA, 22 nt, Human
aacauuuccagagccagaauua

SEQ ID NO: 71789 - RNA, 24 nt, Human
acaaacgaaaucguaaauaacuau

SEQ ID NO: 71790 - RNA, 25 nt, Human
acacaauggggaugcguuucuuggg

SEQ ID NO: 71791 - RNA, 19 nt, Human
acaggcccuggugugugau

SEQ ID NO: 71792 - RNA, 20 nt, Human
acauacacacacaccgcacg

SEQ ID NO: 71793 - RNA, 22 nt, Human
accaccaucucccaaggaagug

SEQ ID NO: 71794 - RNA, 23 nt, Human
accccagccugagaaugaaccac

SEQ ID NO: 71795 - RNA, 25 nt, Human
accuguaauuaaaucaaguauuucc

SEQ ID NO: 71796 - RNA, 18 nt, Human
agacagucccaagaacaa

SEQ ID NO: 71797 - RNA, 22 nt, Human
agagcaccaagaggcugccaga

SEQ ID NO: 71798 - RNA, 24 nt, Human
agagcaccauaaauggggaaaaca

SEQ ID NO: 71799 - RNA, 20 nt, Human
agaugcucucugauccaggg

SEQ ID NO: 71800 - RNA, 22 nt, Human
agccaccaccuuggucugagag

SEQ ID NO: 71801 - RNA, 19 nt, Human
agccugagaaugaaccaca

SEQ ID NO: 71802 - RNA, 19 nt, Human
agcgccucuuacucccugc

SEQ ID NO: 71803 - RNA, 18 nt, Human
aggaagugaaucagcccc

SEQ ID NO: 71804 - RNA, 18 nt, Human
aggauuugcacuggaagg

SEQ ID NO: 71805 - RNA, 23 nt, Human
agggauggcaggaggcacacagg

SEQ ID NO: 71806 - RNA, 24 nt, Human
agggcaugcccugaggccaggagg

SEQ ID NO: 71807 - RNA, 21 nt, Human
aguuuacauucaaaguaacac

SEQ ID NO: 71808 - RNA, 20 nt, Human
auaacuauaaaacaaaaaca

SEQ ID NO: 71809 - RNA, 19 nt, Human
aucagcucaucccuggacc

SEQ ID NO: 71810 - RNA, 26 nt, Human
aucccuuccccuuccccccaccccac

SEQ ID NO: 71811 - RNA, 20 nt, Human
augcaauuauguaaaaacuu

SEQ ID NO: 71812 - RNA, 19 nt, Human
auuuggcagaguuuucccu

SEQ ID NO: 71813 - RNA, 23 nt, Human
caaaggagaagcagguggauuca

SEQ ID NO: 71814 - RNA, 23 nt, Human
caacacugccagaugacaaccaa

SEQ ID NO: 71815 - RNA, 28 nt, Human
caagggcagcggcagggacuggagaccc

SEQ ID NO: 71816 - RNA, 21 nt, Human
cacaaacucgagcauugcugu

SEQ ID NO: 71817 - RNA, 19 nt, Human
cacacacaccgcacggccg

SEQ ID NO: 71818 - RNA, 26 nt, Human
cacacaggaguccaggguaugucaaa

SEQ ID NO: 71819 - RNA, 25 nt, Human
cacauacacacacaccgcacggccg

SEQ ID NO: 71820 - RNA, 20 nt, Human
caccgcacggccggcuccgc

SEQ ID NO: 71821 - RNA, 22 nt, Human
cacugcaggcgccaugggugcu

SEQ ID NO: 71822 - RNA, 19 nt, Human
cacuugcuccuuccuuccu

SEQ ID NO: 71823 - RNA, 20 nt, Human
cagagcaccaagaggcugcc

SEQ ID NO: 71824 - RNA, 24 nt, Human
cagccccuggccccaguacacccc

SEQ ID NO: 71825 - RNA, 22 nt, Human
caggacacacagaugcucucug

SEQ ID NO: 71826 - RNA, 21 nt, Human
caggcuccgagcccagcgccu

SEQ ID NO: 71827 - RNA, 24 nt, Human
caggggccucccuuuggccuugcu

SEQ ID NO: 71828 - RNA, 20 nt, Human
cagugcccugcucuuuuuau

SEQ ID NO: 71829 - RNA, 23 nt, Human
caugugcacaacaugcagguuug

SEQ ID NO: 71830 - RNA, 19 nt, Human
cauugcuguccagcggucc

SEQ ID NO: 71831 - RNA, 19 nt, Human
ccaaggaagugaaucagcc

SEQ ID NO: 71832 - RNA, 19 nt, Human
ccacacggggaggcacagg

SEQ ID NO: 71833 - RNA, 18 nt, Human
ccaccagcagugcccugc

SEQ ID NO: 71834 - RNA, 18 nt, Human
ccagcagugcccugcucu

SEQ ID NO: 71835 - RNA, 25 nt, Human
ccaggggccucccuuuggccuugau

SEQ ID NO: 71836 - RNA, 19 nt, Human
cccaagaacaguuuuccac

SEQ ID NO: 71837 - RNA, 20 nt, Human
cccaaggaagugaaucagcc

SEQ ID NO: 71838 - RNA, 24 nt, Human
cccagcgccucuuacucccugcca

SEQ ID NO: 71839 - RNA, 22 nt, Human
ccccaguacaccccauuaaauc

SEQ ID NO: 71840 - RNA, 21 nt, Human
cccccaccccacaacaggccc

SEQ ID NO: 71841 - RNA, 20 nt, Human
ccccccaccccacaacaggc

SEQ ID NO: 71842 - RNA, 20 nt, Human
ccccuggccccaguacaccc

SEQ ID NO: 71843 - RNA, 28 nt, Human
ccccuuccccccaccccacaacaggccc

SEQ ID NO: 71844 - RNA, 27 nt, Human
cccuaaugcuaucccuuccccuucccc

SEQ ID NO: 71845 - RNA, 22 nt, Human
cccuggaagagagauaauugcc

SEQ ID NO: 71846 - RNA, 18 nt, Human
cccuuuccuggcaucuga

SEQ ID NO: 71847 - RNA, 22 nt, Human
ccgagcccagcgccucuuacuc

SEQ ID NO: 71848 - RNA, 26 nt, Human
ccuaaugcuaucccuuccccuucccc

SEQ ID NO: 71849 - RNA, 20 nt, Human
ccuccagcaaccaucagcuc

SEQ ID NO: 71850 - RNA, 18 nt, Human
ccuggccccaguacaccc

SEQ ID NO: 71851 - RNA, 20 nt, Human
ccuggccccaguacacccca

SEQ ID NO: 71852 - RNA, 24 nt, Human
ccuucugcugacagucuucugucc

SEQ ID NO: 71853 - RNA, 25 nt, Human
cgaacacauacacacacaccgcacg

SEQ ID NO: 71854 - RNA, 19 nt, Human
cgccacgcccuucccugca

SEQ ID NO: 71855 - RNA, 20 nt, Human
cgccaugggugcuguguucu

SEQ ID NO: 71856 - RNA, 22 nt, Human
cgcgaacacauacacacagugu

SEQ ID NO: 71857 - RNA, 30 nt, Human
cucacuacccagagcaccaagaggcugccu

SEQ ID NO: 71858 - RNA, 19 nt, Human
cucuacacuggccuccucc

SEQ ID NO: 71859 - RNA, 24 nt, Human
cugcacccauuaacucgucauuua

SEQ ID NO: 71860 - RNA, 21 nt, Human
cugcauaaugccagaauacag

SEQ ID NO: 71861 - RNA, 20 nt, Human
cugccguccuggcugugucc

SEQ ID NO: 71862 - RNA, 20 nt, Human
cugccguccuggcugugucc

SEQ ID NO: 71863 - RNA, 24 nt, Human
cuggucuuuaacaguaaugugaaa

SEQ ID NO: 71864 - RNA, 22 nt, Human
cuuccccuuccccccaccccac

SEQ ID NO: 71865 - RNA, 24 nt, Human
cuucuccccaggcugugugcaggg

SEQ ID NO: 71866 - RNA, 26 nt, Human
cuuuuggaaagucugauugcuacagg

SEQ ID NO: 71867 - RNA, 20 nt, Human
cuuuuguuuuuugcacaguu

SEQ ID NO: 71868 - RNA, 23 nt, Human
gaaaacaccaccaucucccaagg

SEQ ID NO: 71869 - RNA, 18 nt, Human
gacaagacuggucauccc

SEQ ID NO: 71870 - RNA, 20 nt, Human
gaggcugucccuuuccuggc

SEQ ID NO: 71871 - RNA, 20 nt, Human
gagggugggugggucgagcc

SEQ ID NO: 71872 - RNA, 23 nt, Human
gaugcaucugaacacaucacaca

SEQ ID NO: 71873 - RNA, 21 nt, Human
gccagaauacagagcaccaua

SEQ ID NO: 71874 - RNA, 24 nt, Human
gccagaugcaucugaacacaucac

SEQ ID NO: 71875 - RNA, 18 nt, Human
gccauguuggugugcugc

SEQ ID NO: 71876 - RNA, 20 nt, Human
gcggcagggacgccucugcu

SEQ ID NO: 71877 - RNA, 23 nt, Human
gcuccuuccuuccuuuuuaaaaa

SEQ ID NO: 71878 - RNA, 19 nt, Human
ggagggugagauggagaag

SEQ ID NO: 71879 - RNA, 23 nt, Human
ggaucugggguugccuucucucc

SEQ ID NO: 71880 - RNA, 20 nt, Human
ggccuggcgagaaccuggau

SEQ ID NO: 71881 - RNA, 20 nt, Human
ggcugcaggacacacagaug

SEQ ID NO: 71882 - RNA, 23 nt, Human
gggaggcacaggcuucuccccag

SEQ ID NO: 71883 - RNA, 23 nt, Human
gggaggcugcugcauaaugccag

SEQ ID NO: 71884 - RNA, 25 nt, Human
gggagugggguuaguguuggggaaa

SEQ ID NO: 71885 - RNA, 24 nt, Human
gggaugacaggggugugaggacuu

SEQ ID NO: 71886 - RNA, 22 nt, Human
gggcaugcccugaggccaggag

SEQ ID NO: 71887 - RNA, 24 nt, Human
gggggccugugggaauuaaggggc

SEQ ID NO: 71888 - RNA, 20 nt, Human
gggggugggggcagggggcg

SEQ ID NO: 71889 - RNA, 22 nt, Human
gucuuuaacaguaaugugaaaa

SEQ ID NO: 71890 - RNA, 19 nt, Human
gugcuugcagggccaaggg

SEQ ID NO: 71891 - RNA, 20 nt, Human
uaaaacaaaaacauuuccag

SEQ ID NO: 71892 - RNA, 27 nt, Human
uaacaaacuaagcuugaauccaaacaa

SEQ ID NO: 71893 - RNA, 21 nt, Human
uaacauggggaagagacuucu

SEQ ID NO: 71894 - RNA, 22 nt, Human
uacacuggccuccuccagcaac

SEQ ID NO: 71895 - RNA, 30 nt, Human
uaccuauuauaccaguuuacauucaaaguu

SEQ ID NO: 71896 - RNA, 22 nt, Human
uagaaaaaaagcagauugccaa

SEQ ID NO: 71897 - RNA, 18 nt, Human
uagacaaaacuacaaaaa

SEQ ID NO: 71898 - RNA, 22 nt, Human
uagaucaaauguuccuugggug

SEQ ID NO: 71899 - RNA, 26 nt, Human
uagcacaucuuuuaaaaaagauagca

SEQ ID NO: 71900 - RNA, 19 nt, Human
uagcagggaugggggagcu

SEQ ID NO: 71901 - RNA, 20 nt, Human
uagcucaggggaucuggggu

SEQ ID NO: 71902 - RNA, 21 nt, Human
uagcucccuacucccaccccc

SEQ ID NO: 71903 - RNA, 20 nt, Human
uaugagaggugagucucaaa

SEQ ID NO: 71904 - RNA, 25 nt, Human
uauguacaagugcaaggucaguguu

SEQ ID NO: 71905 - RNA, 23 nt, Human
uauguguuuguguguguaugugu

SEQ ID NO: 71906 - RNA, 19 nt, Human
ucaaaguaacacugcugac

SEQ ID NO: 71907 - RNA, 22 nt, Human
ucaugagaggaggggucuuuuc

SEQ ID NO: 71908 - RNA, 19 nt, Human
uccagagccagaauuaguu

SEQ ID NO: 71909 - RNA, 21 nt, Human
uccaggcuuugggcagcuucu

SEQ ID NO: 71910 - RNA, 22 nt, Human
ucccaagaacaguuuuccacag

SEQ ID NO: 71911 - RNA, 18 nt, Human
uccccccaccccacaaca

SEQ ID NO: 71912 - RNA, 22 nt, Human
uccccuuccccccaccccacaa

SEQ ID NO: 71913 - RNA, 20 nt, Human
ucccugcugcuagaucaaau

SEQ ID NO: 71914 - RNA, 18 nt, Human
ucccuggaagagagauaa

SEQ ID NO: 71915 - RNA, 19 nt, Human
ucccuuccccuucccccca

SEQ ID NO: 71916 - RNA, 21 nt, Human
ucccuuccccuuccccccacc

SEQ ID NO: 71917 - RNA, 20 nt, Human
uccucauccauuuuuuucca

SEQ ID NO: 71918 - RNA, 19 nt, Human
ucucacagaaaccaccaca

SEQ ID NO: 71919 - RNA, 23 nt, Human
ucuccaaauucacaaacucgagc

SEQ ID NO: 71920 - RNA, 18 nt, Human
ucucuuggugggccuggc

SEQ ID NO: 71921 - RNA, 21 nt, Human
ucugggguugccuucucucca

SEQ ID NO: 71922 - RNA, 19 nt, Human
ucuucaugggagugggguu

SEQ ID NO: 71923 - RNA, 21 nt, Human
ucuucuguccaggacugccuu

SEQ ID NO: 71924 - RNA, 18 nt, Human
ugaaaacaccaccaucuc

SEQ ID NO: 71925 - RNA, 20 nt, Human
ugaaaacaccaccaucuccc

SEQ ID NO: 71926 - RNA, 21 nt, Human
ugaaaacaccaccaucuccca

SEQ ID NO: 71927 - RNA, 22 nt, Human
ugaaauggaaggaucaaagaug

SEQ ID NO: 71928 - RNA, 24 nt, Human
ugaauccaaacaaacgaaaucgua

SEQ ID NO: 71929 - RNA, 18 nt, Human
ugacaaccaauuccuucu

SEQ ID NO: 71930 - RNA, 21 nt, Human
ugacaaugggaggcugucccu

SEQ ID NO: 71931 - RNA, 19 nt, Human
ugacacgggggugggggca

SEQ ID NO: 71932 - RNA, 20 nt, Human
ugagaaaauucuuuccuggc

SEQ ID NO: 71933 - RNA, 22 nt, Human
ugagaggugagucucaaaguag

SEQ ID NO: 71934 - RNA, 20 nt, Human
ugagauggagaaggagaggg

SEQ ID NO: 71935 - RNA, 21 nt, Human
ugagauggagaaggagaggga

SEQ ID NO: 71936 - RNA, 21 nt, Human
ugauaauaaaaacaggagcuu

SEQ ID NO: 71937 - RNA, 19 nt, Human
ugcacaguugagacagucc

SEQ ID NO: 71938 - RNA, 21 nt, Human
ugcaggacacacagaugcucu

SEQ ID NO: 71939 - RNA, 25 nt, Human
ugcaggugagucagaugcuuugagg

SEQ ID NO: 71940 - RNA, 21 nt, Human
ugcagguuuguuacauaugua

SEQ ID NO: 71941 - RNA, 24 nt, Human
ugccagaauacagagcaccauaaa

SEQ ID NO: 71942 - RNA, 19 nt, Human
ugccauguuggugugcugc

SEQ ID NO: 71943 - RNA, 21 nt, Human
ugcugacagucuucuguccag

SEQ ID NO: 71944 - RNA, 18 nt, Human
ugcugcaguuuuagcucu

SEQ ID NO: 71945 - RNA, 18 nt, Human
ugcugcccuccucacagc

SEQ ID NO: 71946 - RNA, 19 nt, Human
uggaaacaggcuccgagcc

SEQ ID NO: 71947 - RNA, 22 nt, Human
uggaagguaaaaugccucuucc

SEQ ID NO: 71948 - RNA, 22 nt, Human
uggcagaguuuucccuccucau

SEQ ID NO: 71949 - RNA, 19 nt, Human
uggcaucugaguccacccc

SEQ ID NO: 71950 - RNA, 21 nt, Human
uggccuaggaaaacugguccu

SEQ ID NO: 71951 - RNA, 18 nt, Human
ugggagaggagcagggga

SEQ ID NO: 71952 - RNA, 21 nt, Human
ugggagaggagcaggggacug

SEQ ID NO: 71953 - RNA, 21 nt, Human
ugggaggcugucccuuuccug

SEQ ID NO: 71954 - RNA, 23 nt, Human
ugggagugggguuaguguugggg

SEQ ID NO: 71955 - RNA, 24 nt, Human
uggggaaaacacaauuuccaagca

SEQ ID NO: 71956 - RNA, 20 nt, Human
ugggggaaagagggcaaaca

SEQ ID NO: 71957 - RNA, 24 nt, Human
ugggggaaagagggcaaacaaguc

SEQ ID NO: 71958 - RNA, 23 nt, Human
ugggggcagggggcgccuucuug

SEQ ID NO: 71959 - RNA, 22 nt, Human
uggucugagagggagggugggu

SEQ ID NO: 71960 - RNA, 18 nt, Human
uguauguauaacacccac

SEQ ID NO: 71961 - RNA, 20 nt, Human
ugugacgcgcaacacugcca

SEQ ID NO: 71962 - RNA, 19 nt, Human
ugugagagagggaggguga

SEQ ID NO: 71963 - RNA, 19 nt, Human
uguguauguguuugugugu

SEQ ID NO: 71964 - RNA, 23 nt, Human
uguguauguguuuguguguguau

SEQ ID NO: 71965 - RNA, 23 nt, Human
uguguauguguuuguguguguau

SEQ ID NO: 71966 - RNA, 24 nt, Human
uguguguauguguuugugugugua

SEQ ID NO: 71967 - RNA, 18 nt, Human
uguuacauauguauacau

SEQ ID NO: 71968 - RNA, 19 nt, Human
uguuacauauguauacaua

SEQ ID NO: 71969 - RNA, 23 nt, Human
uguuggugugcugcacccauuaa

SEQ ID NO: 71970 - RNA, 24 nt, Human
uuaaaagaccauguucaagaacaa

SEQ ID NO: 71971 - RNA, 26 nt, Human
uuaauucaucugacuaguuuuuaaaa

SEQ ID NO: 71972 - RNA, 24 nt, Human
uuacaauacaaaaaauaccaaaaa

SEQ ID NO: 71973 - RNA, 24 nt, Human
uucaaaacaucuccuuguaggcag

SEQ ID NO: 71974 - RNA, 20 nt, Human
uucacaaacucgagcauugc

SEQ ID NO: 71975 - RNA, 22 nt, Human
uucauccuugucagcauuugcu

SEQ ID NO: 71976 - RNA, 19 nt, Human
uucaugaaaacaccaccau

SEQ ID NO: 71977 - RNA, 25 nt, Human
uugccuucucuccacacggggaggc

SEQ ID NO: 71978 - RNA, 20 nt, Human
uugcuccuuccuuccuuuuu

SEQ ID NO: 71979 - RNA, 25 nt, Human
uuuaaagucuaggcacuuaguguug

SEQ ID NO: 71980 - RNA, 20 nt, Human
uuuaagaaauaccuaauugg

SEQ ID NO: 71981 - RNA, 25 nt, Human
uuucccuccucauccauuuuuuucc

SEQ ID NO: 71982 - RNA, 19 nt, Human
uuuggccuugcuggggggg

SEQ ID NO: 71983 - RNA, 22 nt, Human
uuuuccaugugcuuuucauccu

SEQ ID NO: 71984 - RNA, 22 nt, Human
uuuucccuccucauccauuuuu

SEQ ID NO: 71985 - RNA, 19 nt, Human
uuuucuuuuuuuuuuuuua

SEQ ID NO: 71986 - RNA, 22 nt, Human
uuuucuuuuuuuuuuuuuaauu

SEQ ID NO: 71987 - RNA, 23 nt, Human
aaaaaaaaacaaacucugaaaca

SEQ ID NO: 71988 - RNA, 23 nt, Human
aaaaaaaacaaacucugaaacaa

SEQ ID NO: 71989 - RNA, 28 nt, Human
aaaagcagucuaacagaaacaaaggcaa

SEQ ID NO: 71990 - RNA, 18 nt, Human
aaacaaauauaaaaauga

SEQ ID NO: 71991 - RNA, 22 nt, Human
aacaaacucugaaacaauuuaa

SEQ ID NO: 71992 - RNA, 18 nt, Human
aacauauacaauaucaca

SEQ ID NO: 71993 - RNA, 28 nt, Human
aacccaguuuucuuuuuuuuuuuuuuuu

SEQ ID NO: 71994 - RNA, 22 nt, Human
aacugggacaaaacauauacaa

SEQ ID NO: 71995 - RNA, 24 nt, Human
aacuuguuucuucagauucuucug

SEQ ID NO: 71996 - RNA, 24 nt, Human
aagcaaaaacgcuuuacacccaaa

SEQ ID NO: 71997 - RNA, 24 nt, Human
aauggcagaaggacuaaagaagaa

SEQ ID NO: 71998 - RNA, 24 nt, Human
acaaaacagccuuaaaggaagaag

SEQ ID NO: 71999 - RNA, 19 nt, Human
acagaaacaaaggcaaguc

SEQ ID NO: 72000 - RNA, 18 nt, Human
acccaaagaaauaaaaca

SEQ ID NO: 72001 - RNA, 23 nt, Human
acuaaaaaaaaaacaaacucuga

SEQ ID NO: 72002 - RNA, 26 nt, Human
acuaaaaugcuagaacuugauuuucu

SEQ ID NO: 72003 - RNA, 21 nt, Human
agaagauucuaggcaacauca

SEQ ID NO: 72004 - RNA, 21 nt, Human
agacaauaaagcaggagccca

SEQ ID NO: 72005 - RNA, 21 nt, Human
agagaaaagaagcgcauagaa

SEQ ID NO: 72006 - RNA, 18 nt, Human
agagaggaaaucugugga

SEQ ID NO: 72007 - RNA, 20 nt, Human
agaggaaaucuguggaguug

SEQ ID NO: 72008 - RNA, 22 nt, Human
agaguuacuuccagaaccacug

SEQ ID NO: 72009 - RNA, 23 nt, Human
agcaaaaacgcuuuacacccaaa

SEQ ID NO: 72010 - RNA, 24 nt, Human
agcacuccgcguuuuuugagauuu

SEQ ID NO: 72011 - RNA, 23 nt, Human
agccgcggaaacaaagcgacacc

SEQ ID NO: 72012 - RNA, 23 nt, Human
aggacuuguuuucacugaaaaca

SEQ ID NO: 72013 - RNA, 22 nt, Human
agugcucuuggauguuuuacca

SEQ ID NO: 72014 - RNA, 20 nt, Human
aguuuucuuuuuuuuuuuuu

SEQ ID NO: 72015 - RNA, 20 nt, Human
aucagaguuacuuccagaac

SEQ ID NO: 72016 - RNA, 22 nt, Human
aucagaguuacuuccagaacca

SEQ ID NO: 72017 - RNA, 23 nt, Human
augaagcauuagcacuggcacca

SEQ ID NO: 72018 - RNA, 22 nt, Human
caaaacauauacaauaucacaa

SEQ ID NO: 72019 - RNA, 20 nt, Human
caaagcccaaacccaguuuu

SEQ ID NO: 72020 - RNA, 18 nt, Human
caaauauaaggauaucac

SEQ ID NO: 72021 - RNA, 23 nt, Human
caaucucuuaaucauccaaacaa

SEQ ID NO: 72022 - RNA, 24 nt, Human
cacaaggaaucaaauauaaggaua

SEQ ID NO: 72023 - RNA, 20 nt, Human
cacaccugccccacccaauu

SEQ ID NO: 72024 - RNA, 18 nt, Human
caccugccccacccaauu

SEQ ID NO: 72025 - RNA, 20 nt, Human
cacugccaccgccgcaggag

SEQ ID NO: 72026 - RNA, 21 nt, Human
cacugccaccgccgcaggagc

SEQ ID NO: 72027 - RNA, 19 nt, Human
cagcagccaaagcuggaug

SEQ ID NO: 72028 - RNA, 21 nt, Human
cagcucaaaggccgcuaccac

SEQ ID NO: 72029 - RNA, 20 nt, Human
caggagccgcggaaacaaag

SEQ ID NO: 72030 - RNA, 19 nt, Human
caguuuucauuuuacuucu

SEQ ID NO: 72031 - RNA, 19 nt, Human
caguuuucuuuuuuuuuuu

SEQ ID NO: 72032 - RNA, 23 nt, Human
caucauaucagaguuacuuccag

SEQ ID NO: 72033 - RNA, 20 nt, Human
caucauccaaagguuuuuca

SEQ ID NO: 72034 - RNA, 21 nt, Human
cauuuuacuucugcuucuaaa

SEQ ID NO: 72035 - RNA, 22 nt, Human
ccaaagguuuuucaucaucuga

SEQ ID NO: 72036 - RNA, 26 nt, Human
ccacaacccugaaauuuuaccaguaa

SEQ ID NO: 72037 - RNA, 22 nt, Human
ccacccaauuaaauaaaucuga

SEQ ID NO: 72038 - RNA, 27 nt, Human
ccacugccaccgccgcaggagccgcgg

SEQ ID NO: 72039 - RNA, 24 nt, Human
ccauagucaaaaacaauguuuucu

SEQ ID NO: 72040 - RNA, 18 nt, Human
ccauggugaaaagauuua

SEQ ID NO: 72041 - RNA, 22 nt, Human
cccacagcucaaaggccgcuac

SEQ ID NO: 72042 - RNA, 23 nt, Human
cccgcgcccgguuacgauagaaa

SEQ ID NO: 72043 - RNA, 21 nt, Human
cccucaguuucuaacuuucag

SEQ ID NO: 72044 - RNA, 21 nt, Human
cccucuuccuugcuguuuucc

SEQ ID NO: 72045 - RNA, 18 nt, Human
ccgcggaaacaaagcgac

SEQ ID NO: 72046 - RNA, 23 nt, Human
cgccgaucugcgcucccccgcgc

SEQ ID NO: 72047 - RNA, 21 nt, Human
cgcuuuacacccaaagaaaua

SEQ ID NO: 72048 - RNA, 22 nt, Human
cguggauccaccaaaccucaca

SEQ ID NO: 72049 - RNA, 23 nt, Human
cucacaaucccaugaagcccauc

SEQ ID NO: 72050 - RNA, 19 nt, Human
cucuuaaucauccaaacaa

SEQ ID NO: 72051 - RNA, 24 nt, Human
cugaaaagcagucuaacagaaaca

SEQ ID NO: 72052 - RNA, 21 nt, Human
cugcuucuaaauucaggcccu

SEQ ID NO: 72053 - RNA, 22 nt, Human
cuggaaccuccccacagcucaa

SEQ ID NO: 72054 - RNA, 23 nt, Human
cuucuccaacuuuuagagcagua

SEQ ID NO: 72055 - RNA, 18 nt, Human
gaaaagcagucuaacaga

SEQ ID NO: 72056 - RNA, 20 nt, Human
gaaauaaaacagguuacaaa

SEQ ID NO: 72057 - RNA, 18 nt, Human
gagacaauaaagcaggag

SEQ ID NO: 72058 - RNA, 20 nt, Human
gaggagaacuuguuucuuca

SEQ ID NO: 72059 - RNA, 22 nt, Human
gcccuauuuaaaaaaaaaaaaa

SEQ ID NO: 72060 - RNA, 22 nt, Human
gccgaucugcgcucccccgcgc

SEQ ID NO: 72061 - RNA, 19 nt, Human
gccgcggaaacaaagcgac

SEQ ID NO: 72062 - RNA, 19 nt, Human
gcucaaaggccgcuaccac

SEQ ID NO: 72063 - RNA, 21 nt, Human
gcugcugcuggaaccucccca

SEQ ID NO: 72064 - RNA, 21 nt, Human
ggaagaaaugguaugcccuau

SEQ ID NO: 72065 - RNA, 21 nt, Human
ggcagaaggacuaaagaagaa

SEQ ID NO: 72066 - RNA, 22 nt, Human
ggcauaaaaauuuagagaggaa

SEQ ID NO: 72067 - RNA, 20 nt, Human
ggggagaggggcguggaucc

SEQ ID NO: 72068 - RNA, 22 nt, Human
gugcacaaggaaucaaauauaa

SEQ ID NO: 72069 - RNA, 19 nt, Human
uaaaaacacaauuccaguc

SEQ ID NO: 72070 - RNA, 20 nt, Human
uaaaaacacaauuccagucc

SEQ ID NO: 72071 - RNA, 18 nt, Human
uaaagcaaagcccaaacc

SEQ ID NO: 72072 - RNA, 23 nt, Human
uaaagcaaagcccaaacccaguu

SEQ ID NO: 72073 - RNA, 24 nt, Human
uaaauacacaccugccccacccaa

SEQ ID NO: 72074 - RNA, 22 nt, Human
uaaauacacaccugccccaguu

SEQ ID NO: 72075 - RNA, 18 nt, Human
uaacagaaacaaaggcaa

SEQ ID NO: 72076 - RNA, 21 nt, Human
uaacagaaacaaaggcaaguc

SEQ ID NO: 72077 - RNA, 19 nt, Human
uaacugcaagacuucucca

SEQ ID NO: 72078 - RNA, 21 nt, Human
uaacuuucagucacagagaca

SEQ ID NO: 72079 - RNA, 22 nt, Human
uaacuuucagucacagagacaa

SEQ ID NO: 72080 - RNA, 24 nt, Human
uaagaauauugcacacaauucugu

SEQ ID NO: 72081 - RNA, 19 nt, Human
uaagauacucaauacagaa

SEQ ID NO: 72082 - RNA, 20 nt, Human
uaagauacucaauacagaac

SEQ ID NO: 72083 - RNA, 23 nt, Human
uaagcaaaaacgcuuuacaccca

SEQ ID NO: 72084 - RNA, 21 nt, Human
uaaguccacaucccacugcca

SEQ ID NO: 72085 - RNA, 21 nt, Human
uaaguuucaacuacuaaacag

SEQ ID NO: 72086 - RNA, 19 nt, Human
uaauauggaagauuggcau

SEQ ID NO: 72087 - RNA, 25 nt, Human
uacaacugggacaaaaccggggucc

SEQ ID NO: 72088 - RNA, 24 nt, Human
uacaauaucacaauacuaagcaaa

SEQ ID NO: 72089 - RNA, 19 nt, Human
uaccuaaagcaaagcccaa

SEQ ID NO: 72090 - RNA, 21 nt, Human
uaccuaaagcaaagcccaaac

SEQ ID NO: 72091 - RNA, 24 nt, Human
uaccuaaagcaaagcccaaaccca

SEQ ID NO: 72092 - RNA, 21 nt, Human
uacgauagaaaugcacuggag

SEQ ID NO: 72093 - RNA, 23 nt, Human
uacuauacaacugggacaaaaca

SEQ ID NO: 72094 - RNA, 18 nt, Human
uagguaauucuuuggaga

SEQ ID NO: 72095 - RNA, 23 nt, Human
uauaaaacagggugugaaccuaa

SEQ ID NO: 72096 - RNA, 23 nt, Human
uaugugcuuuggugcauacagug

SEQ ID NO: 72097 - RNA, 24 nt, Human
ucaaagauaacccucaguuucuaa

SEQ ID NO: 72098 - RNA, 21 nt, Human
ucacuguaccuuuuggcaagc

SEQ ID NO: 72099 - RNA, 23 nt, Human
ucagucaaaagaacauuaaaacc

SEQ ID NO: 72100 - RNA, 23 nt, Human
ucaguuucuaacuuucagucaca

SEQ ID NO: 72101 - RNA, 23 nt, Human
ucauaucagaguuacuuccagaa

SEQ ID NO: 72102 - RNA, 21 nt, Human
ucauccaaagguuuuucauca

SEQ ID NO: 72103 - RNA, 19 nt, Human
uccacaucccacugccagc

SEQ ID NO: 72104 - RNA, 20 nt, Human
uccucaugugaaccuaaagu

SEQ ID NO: 72105 - RNA, 23 nt, Human
ucuaaaacaaauauaaaaaugag

SEQ ID NO: 72106 - RNA, 24 nt, Human
ucuaaauucaggcccuuuaaaauc

SEQ ID NO: 72107 - RNA, 22 nt, Human
ucuaaguccacaucccacugcc

SEQ ID NO: 72108 - RNA, 19 nt, Human
ucuaugauuuuaacaaucc

SEQ ID NO: 72109 - RNA, 23 nt, Human
ucuguacucagcguguguaagaa

SEQ ID NO: 72110 - RNA, 18 nt, Human
ucuguguuuugauucauu

SEQ ID NO: 72111 - RNA, 24 nt, Human
ucuuuauucuuuccuaaauuuauu

SEQ ID NO: 72112 - RNA, 23 nt, Human
ugaaaagcagucuaacagaaaca

SEQ ID NO: 72113 - RNA, 22 nt, Human
ugaaauaucuucuguacucagc

SEQ ID NO: 72114 - RNA, 19 nt, Human
ugaagcauuagcacuggca

SEQ ID NO: 72115 - RNA, 19 nt, Human
ugacaaaugucaggaagaa

SEQ ID NO: 72116 - RNA, 22 nt, Human
ugagaagaguguauacaaagug

SEQ ID NO: 72117 - RNA, 24 nt, Human
ugagaagaguguauacaaaguggu

SEQ ID NO: 72118 - RNA, 21 nt, Human
ugccaggagagagaaaauuca

SEQ ID NO: 72119 - RNA, 23 nt, Human
ugccaggagagagaaaauucaug

SEQ ID NO: 72120 - RNA, 21 nt, Human
ugcugcuggaaccuccccaca

SEQ ID NO: 72121 - RNA, 19 nt, Human
uggaagauaauccacaacc

SEQ ID NO: 72122 - RNA, 22 nt, Human
ugggacaaaacauauacaauau

SEQ ID NO: 72123 - RNA, 22 nt, Human
ugggggagaggggcguggaucc

SEQ ID NO: 72124 - RNA, 22 nt, Human
uggucacuuuauuaaaugacau

SEQ ID NO: 72125 - RNA, 21 nt, Human
uggugaaaagauuuagaaggu

SEQ ID NO: 72126 - RNA, 21 nt, Human
ugugucaaagauaacccucag

SEQ ID NO: 72127 - RNA, 21 nt, Human
uguguggaagauaauccacaa

SEQ ID NO: 72128 - RNA, 21 nt, Human
uuaaaaucaucuuugucuuca

SEQ ID NO: 72129 - RNA, 18 nt, Human
uuaaucauccaaacaacu

SEQ ID NO: 72130 - RNA, 23 nt, Human
uuagaccauguugaaaauuccca

SEQ ID NO: 72131 - RNA, 19 nt, Human
uucagcacuggcucuggcu

SEQ ID NO: 72132 - RNA, 24 nt, Human
uucagucaaaagaacauuaaaacc

SEQ ID NO: 72133 - RNA, 28 nt, Human
uucuaugugcuuuggugcauacaucgcu

SEQ ID NO: 72134 - RNA, 22 nt, Human
uugaauggugaaaacacagaua

SEQ ID NO: 72135 - RNA, 20 nt, Human
uuuaaaaaaaaaaaaaaguu

SEQ ID NO: 72136 - RNA, 19 nt, Human
uuuaaaauauucugaacuu

SEQ ID NO: 72137 - RNA, 21 nt, Human
uuucagaggaauuauuucaca

SEQ ID NO: 72138 - RNA, 20 nt, Human
uuugaaauaucuucuguacu

SEQ ID NO: 72139 - RNA, 23 nt, Human
uuuuacuucugcuucuaaauuca

SEQ ID NO: 72140 - RNA, 22 nt, Human
uuuucaguuuucauuuuacuuc

SEQ ID NO: 72141 - RNA, 23 nt, Human
uuuuuugucuuuaaauauuuguu

SEQ ID NO: 72142 - RNA, 18 nt, Human
uuuuuuuuuuuuuuuuug

SEQ ID NO: 72143 - RNA, 19 nt, Human
aaagggacaccgcagaugc

SEQ ID NO: 72144 - RNA, 18 nt, Human
aacaaagagaggaaaguc

SEQ ID NO: 72145 - RNA, 19 nt, Human
aacaaagggacaccgcaga

SEQ ID NO: 72146 - RNA, 26 nt, Human
aaccaccaagccagccaccccaucag

SEQ ID NO: 72147 - RNA, 23 nt, Human
aaccugugcccuuggccccccca

SEQ ID NO: 72148 - RNA, 25 nt, Human
aagagaccaaaucgaccugugggug

SEQ ID NO: 72149 - RNA, 19 nt, Human
aagaggcugcgccacagcc

SEQ ID NO: 72150 - RNA, 22 nt, Human
aauaaccaccaagccagccacc

SEQ ID NO: 72151 - RNA, 18 nt, Human
acacccccccacucuccc

SEQ ID NO: 72152 - RNA, 25 nt, Human
acaggacagacgaggaugagggagg

SEQ ID NO: 72153 - RNA, 22 nt, Human
acauacacccaggacccaugug

SEQ ID NO: 72154 - RNA, 21 nt, Human
accaaagacacccccccacuc

SEQ ID NO: 72155 - RNA, 23 nt, Human
accccgcucccuccugguccccg

SEQ ID NO: 72156 - RNA, 24 nt, Human
acgcacagccucugcugggagcac

SEQ ID NO: 72157 - RNA, 19 nt, Human
acucacuccauuucucgcc

SEQ ID NO: 72158 - RNA, 21 nt, Human
agagaugugcguucucccucc

SEQ ID NO: 72159 - RNA, 23 nt, Human
agaggaacucacaccacccucca

SEQ ID NO: 72160 - RNA, 19 nt, Human
aggaugagggaggggaugg

SEQ ID NO: 72161 - RNA, 20 nt, Human
aggcauuagaaauaaauacu

SEQ ID NO: 72162 - RNA, 20 nt, Human
aggcugcgccacagcccucg

SEQ ID NO: 72163 - RNA, 20 nt, Human
agggaggggaugggcugggc

SEQ ID NO: 72164 - RNA, 21 nt, Human
caagaagaacugacacgcaca

SEQ ID NO: 72165 - RNA, 18 nt, Human
cacagccugggugccguc

SEQ ID NO: 72166 - RNA, 22 nt, Human
caccaagccagccacccuccau

SEQ ID NO: 72167 - RNA, 21 nt, Human
caccacccuacccugaugguc

SEQ ID NO: 72168 - RNA, 19 nt, Human
cacccccccacucucccac

SEQ ID NO: 72169 - RNA, 24 nt, Human
cacgcagucccagagucugcacac

SEQ ID NO: 72170 - RNA, 18 nt, Human
cacuccaggaggcaggau

SEQ ID NO: 72171 - RNA, 24 nt, Human
cagacuucaggcaccaaagacacc

SEQ ID NO: 72172 - RNA, 21 nt, Human
cagagccgagugucaccccuc

SEQ ID NO: 72173 - RNA, 19 nt, Human
cagcagcaaagagcuccuu

SEQ ID NO: 72174 - RNA, 24 nt, Human
cagcagcaaagagcuccuugaaga

SEQ ID NO: 72175 - RNA, 26 nt, Human
caggcgauacacccgugugcuagccc

SEQ ID NO: 72176 - RNA, 18 nt, Human
caucucagagccagagcc

SEQ ID NO: 72177 - RNA, 21 nt, Human
ccacucucccacacauacacc

SEQ ID NO: 72178 - RNA, 24 nt, Human
ccagacccgauguaacugcuccca

SEQ ID NO: 72179 - RNA, 18 nt, Human
ccagagcacauucugcaa

SEQ ID NO: 72180 - RNA, 18 nt, Human
cccaggacccauguggcc

SEQ ID NO: 72181 - RNA, 23 nt, Human
ccccaccccaugggauuuucuca

SEQ ID NO: 72182 - RNA, 21 nt, Human
ccccacucucccacacauaca

SEQ ID NO: 72183 - RNA, 25 nt, Human
ccccacucucccacacauacaccca

SEQ ID NO: 72184 - RNA, 28 nt, Human
cccccguaaccugugcccuuggcccccc

SEQ ID NO: 72185 - RNA, 26 nt, Human
ccccuggggggucgacccggucgugg

SEQ ID NO: 72186 - RNA, 20 nt, Human
cccuccauugccgaccgacc

SEQ ID NO: 72187 - RNA, 20 nt, Human
cccugaauuccgaucuuccc

SEQ ID NO: 72188 - RNA, 18 nt, Human
cccugcccugccuguccc

SEQ ID NO: 72189 - RNA, 19 nt, Human
ccgaccaggauacccccac

SEQ ID NO: 72190 - RNA, 26 nt, Human
ccgaccccgcucccuccugguccccg

SEQ ID NO: 72191 - RNA, 23 nt, Human
ccgaccgaccaggauacccccac

SEQ ID NO: 72192 - RNA, 20 nt, Human
ccgcccaggacagaucacag

SEQ ID NO: 72193 - RNA, 19 nt, Human
ccuccaugccgcgcagacu

SEQ ID NO: 72194 - RNA, 19 nt, Human
ccugugcccuuggcccccc

SEQ ID NO: 72195 - RNA, 24 nt, Human
cgaccgaccaggauacccccaccc

SEQ ID NO: 72196 - RNA, 19 nt, Human
cucacagaaacucucugcc

SEQ ID NO: 72197 - RNA, 20 nt, Human
cucacagaaacucucugccc

SEQ ID NO: 72198 - RNA, 21 nt, Human
cucccacacauacacccagga

SEQ ID NO: 72199 - RNA, 22 nt, Human
cucccuaggccucuggacauga

SEQ ID NO: 72200 - RNA, 19 nt, Human
cuccucgcaguagugggag

SEQ ID NO: 72201 - RNA, 19 nt, Human
cucucccacacauacaccc

SEQ ID NO: 72202 - RNA, 18 nt, Human
cugcccugccugucccua

SEQ ID NO: 72203 - RNA, 22 nt, Human
cugccggaacucuucuuggagu

SEQ ID NO: 72204 - RNA, 24 nt, Human
cuggcaugggcguccccugggggg

SEQ ID NO: 72205 - RNA, 18 nt, Human
cugguccagacagcuccu

SEQ ID NO: 72206 - RNA, 20 nt, Human
cuuccuggucucaacccacc

SEQ ID NO: 72207 - RNA, 21 nt, Human
cuuggcccccccagccucucc

SEQ ID NO: 72208 - RNA, 22 nt, Human
gaagaggcugcgccacagcccu

SEQ ID NO: 72209 - RNA, 21 nt, Human
gacagcacgcagucccagagu

SEQ ID NO: 72210 - RNA, 24 nt, Human
gaccgaccaggauacccccacccc

SEQ ID NO: 72211 - RNA, 19 nt, Human
gacgaggaugagggagggg

SEQ ID NO: 72212 - RNA, 18 nt, Human
gagaggggcugggcggca

SEQ ID NO: 72213 - RNA, 18 nt, Human
gagggaggggaugggcug

SEQ ID NO: 72214 - RNA, 22 nt, Human
gaugcagcagcaaagagcuccu

SEQ ID NO: 72215 - RNA, 24 nt, Human
gcacgcagucccagagucugcaca

SEQ ID NO: 72216 - RNA, 24 nt, Human
gcccugccugucccuagcaggcuu

SEQ ID NO: 72217 - RNA, 21 nt, Human
ggaacaaacaggguggaggug

SEQ ID NO: 72218 - RNA, 21 nt, Human
ggaacaaagagaggaaagucu

SEQ ID NO: 72219 - RNA, 20 nt, Human
ggagaagccuggggcccagg

SEQ ID NO: 72220 - RNA, 19 nt, Human
ggaggggaugggcugggcc

SEQ ID NO: 72221 - RNA, 24 nt, Human
ggcccuaaaaccucccuaggccuc

SEQ ID NO: 72222 - RNA, 19 nt, Human
gggaggggaugggcugggc

SEQ ID NO: 72223 - RNA, 20 nt, Human
ggugacaggacagacgagga

SEQ ID NO: 72224 - RNA, 22 nt, Human
guccggagacagcacgcagucc

SEQ ID NO: 72225 - RNA, 18 nt, Human
guggguggggagggcccu

SEQ ID NO: 72226 - RNA, 21 nt, Human
uaaaaagagaccaaaucgacc

SEQ ID NO: 72227 - RNA, 23 nt, Human
uaaaaagagaccaaaucgaccug

SEQ ID NO: 72228 - RNA, 25 nt, Human
uaaaaagagaccaaaucgaccugug

SEQ ID NO: 72229 - RNA, 21 nt, Human
uacccccaccccaugggauuu

SEQ ID NO: 72230 - RNA, 24 nt, Human
uaccuugacucacuccauuucucg

SEQ ID NO: 72231 - RNA, 21 nt, Human
uagaacggcagcaagaacccc

SEQ ID NO: 72232 - RNA, 22 nt, Human
uaggccucuggacaugacuccu

SEQ ID NO: 72233 - RNA, 24 nt, Human
uaguuaauuuccgaguugacuguu

SEQ ID NO: 72234 - RNA, 22 nt, Human
ucacaccacccuccaugccgcg

SEQ ID NO: 72235 - RNA, 22 nt, Human
ucacaccacccuccaugccgcg

SEQ ID NO: 72236 - RNA, 26 nt, Human
ucaccccucacccuuuccuggggaaa

SEQ ID NO: 72237 - RNA, 18 nt, Human
ucagugggacucacagaa

SEQ ID NO: 72238 - RNA, 27 nt, Human
uccaccagagcacauucugcaagaaga

SEQ ID NO: 72239 - RNA, 22 nt, Human
ucccacacauacacccaggacc

SEQ ID NO: 72240 - RNA, 19 nt, Human
ucccagagucugcacacug

SEQ ID NO: 72241 - RNA, 18 nt, Human
uccccgggccuggcaugg

SEQ ID NO: 72242 - RNA, 19 nt, Human
uccccgggccuggcauggg

SEQ ID NO: 72243 - RNA, 19 nt, Human
uccccuggggggucgaccc

SEQ ID NO: 72244 - RNA, 24 nt, Human
ucccuccugguccccgcccaggac

SEQ ID NO: 72245 - RNA, 20 nt, Human
uccucagguggccgcccaga

SEQ ID NO: 72246 - RNA, 19 nt, Human
ucucgccgcagcugaagag

SEQ ID NO: 72247 - RNA, 25 nt, Human
ugacaggacagacgaggaugaggga

SEQ ID NO: 72248 - RNA, 24 nt, Human
ugaccagacucucagcuuggggcu

SEQ ID NO: 72249 - RNA, 20 nt, Human
ugacuuccuggucucaaccc

SEQ ID NO: 72250 - RNA, 22 nt, Human
ugcaagaagaacugacacgcac

SEQ ID NO: 72251 - RNA, 21 nt, Human
ugcccuuggcccccccagccu

SEQ ID NO: 72252 - RNA, 22 nt, Human
ugcccuuggcccccccagccuc

SEQ ID NO: 72253 - RNA, 19 nt, Human
ugccggaacucuucuugga

SEQ ID NO: 72254 - RNA, 22 nt, Human
ugcugggagcacagcuggucgu

SEQ ID NO: 72255 - RNA, 20 nt, Human
uggacaugacuccuaugacc

SEQ ID NO: 72256 - RNA, 19 nt, Human
uggcacagguccccgggcc

SEQ ID NO: 72257 - RNA, 20 nt, Human
uggcaggagaggggcugggc

SEQ ID NO: 72258 - RNA, 22 nt, Human
uggcaggagaggggcugggcgg

SEQ ID NO: 72259 - RNA, 27 nt, Human
uggcaggugaucccgaccccgcucccu

SEQ ID NO: 72260 - RNA, 23 nt, Human
uggcaugggcguccccugggggg

SEQ ID NO: 72261 - RNA, 20 nt, Human
uggggcccaggcgauacacc

SEQ ID NO: 72262 - RNA, 18 nt, Human
uggguguggguggggagg

SEQ ID NO: 72263 - RNA, 20 nt, Human
uggguguggguggggagggc

SEQ ID NO: 72264 - RNA, 21 nt, Human
ugucccugcccugccuguccc

SEQ ID NO: 72265 - RNA, 21 nt, Human
uguggcacagguccccgggcc

SEQ ID NO: 72266 - RNA, 22 nt, Human
uuccuggucucaacccaccacc

SEQ ID NO: 72267 - RNA, 23 nt, Human
uugagcuaaaaagagaccaaauc

SEQ ID NO: 72268 - RNA, 19 nt, Human
uuggcccccccagccucuc

SEQ ID NO: 72269 - RNA, 27 nt, Human
cacccacccauccagccuguugugagu

SEQ ID NO: 72270 - RNA, 23 nt, Human
cauccuucccuuuuuaccaccca

SEQ ID NO: 72271 - RNA, 24 nt, Human
cauuuucgcgcccaggcgcagggg

SEQ ID NO: 72272 - RNA, 25 nt, Human
ccgccgccgccauuuucgcgcccag

SEQ ID NO: 72273 - RNA, 18 nt, Human
ccgucgccgccgccgcca

SEQ ID NO: 72274 - RNA, 28 nt, Human
ccucauccuucccuuuuuaccacccacc

SEQ ID NO: 72275 - RNA, 18 nt, Human
ccugcggcucugggugcc

SEQ ID NO: 72276 - RNA, 23 nt, Human
ccuguugugaguugggugagggc

SEQ ID NO: 72277 - RNA, 22 nt, Human
cgcccggccgucgccgccgccg

SEQ ID NO: 72278 - RNA, 19 nt, Human
cggcucugggugccauccu

SEQ ID NO: 72279 - RNA, 19 nt, Human
gcggcucugggugccaucc

SEQ ID NO: 72280 - RNA, 20 nt, Human
guugggugagggcugccccc

SEQ ID NO: 72281 - RNA, 25 nt, Human
uccagccuguugugaguugggugag

SEQ ID NO: 72282 - RNA, 18 nt, Human
uccguccugcggcucugg

SEQ ID NO: 72283 - RNA, 18 nt, Human
ugacauugggggagccuu

SEQ ID NO: 72284 - RNA, 26 nt, Human
ugcccccagucuccguccugcggcuc

SEQ ID NO: 72285 - RNA, 23 nt, Human
ugugacauugggggagccucauc

SEQ ID NO: 72286 - RNA, 18 nt, Human
uuuuuuuuuuuuuuuuug

SEQ ID NO: 72287 - RNA, 18 nt, Human
aagaggaaccgaggggcu

SEQ ID NO: 72288 - RNA, 24 nt, Human
acaagauaagggaccaagaacagc

SEQ ID NO: 72289 - RNA, 23 nt, Human
acacccccgcacccccauagagc

SEQ ID NO: 72290 - RNA, 21 nt, Human
acaugacacccccgcaccccc

SEQ ID NO: 72291 - RNA, 25 nt, Human
agacgcggccgccacccccucccca

SEQ ID NO: 72292 - RNA, 20 nt, Human
agacuggggggucaccugga

SEQ ID NO: 72293 - RNA, 20 nt, Human
agacuggggggucaccugga

SEQ ID NO: 72294 - RNA, 18 nt, Human
agagcgcggugggggcag

SEQ ID NO: 72295 - RNA, 21 nt, Human
aggcagccgccgucguggagu

SEQ ID NO: 72296 - RNA, 22 nt, Human
aggcagccgccgucguggaguc

SEQ ID NO: 72297 - RNA, 23 nt, Human
aggcccuggccuaggagcugugg

SEQ ID NO: 72298 - RNA, 23 nt, Human
agggacagacuggggggucaccc

SEQ ID NO: 72299 - RNA, 24 nt, Human
agggagagggacagacuggggggu

SEQ ID NO: 72300 - RNA, 23 nt, Human
agggggguggcagguugcugggg

SEQ ID NO: 72301 - RNA, 22 nt, Human
aggguaagaggaaccgaggggc

SEQ ID NO: 72302 - RNA, 24 nt, Human
caagaagaggguaagaggaaccga

SEQ ID NO: 72303 - RNA, 27 nt, Human
cagcacaagcccagaguggugaggaca

SEQ ID NO: 72304 - RNA, 22 nt, Human
cagcgcucuggauucagggaga

SEQ ID NO: 72305 - RNA, 22 nt, Human
ccaguggcuccccaggagccca

SEQ ID NO: 72306 - RNA, 20 nt, Human
ccauagagcagggcaugggg

SEQ ID NO: 72307 - RNA, 21 nt, Human
cccacggccgccaggucccca

SEQ ID NO: 72308 - RNA, 20 nt, Human
cccccgcacccccauagagc

SEQ ID NO: 72309 - RNA, 19 nt, Human
ccccgcacccccauagagc

SEQ ID NO: 72310 - RNA, 18 nt, Human
ccgccagguccccagccg

SEQ ID NO: 72311 - RNA, 21 nt, Human
cguggaggcgagacgcggccg

SEQ ID NO: 72312 - RNA, 21 nt, Human
cuccccaguggcuccccagga

SEQ ID NO: 72313 - RNA, 25 nt, Human
cuccccaguggcuccccaggagccc

SEQ ID NO: 72314 - RNA, 21 nt, Human
cucugugcugcugccucugcu

SEQ ID NO: 72315 - RNA, 19 nt, Human
cugcaccagagaugagaau

SEQ ID NO: 72316 - RNA, 18 nt, Human
cugcugccucugcuggcu

SEQ ID NO: 72317 - RNA, 22 nt, Human
cugcugccucugcuggcugccu

SEQ ID NO: 72318 - RNA, 22 nt, Human
cuggccuaggagcuguggggca

SEQ ID NO: 72319 - RNA, 21 nt, Human
gacaugacacccccgcacccc

SEQ ID NO: 72320 - RNA, 25 nt, Human
gagcccacggccgccagguccccag

SEQ ID NO: 72321 - RNA, 20 nt, Human
gaggguaagaggaaccgagg

SEQ ID NO: 72322 - RNA, 22 nt, Human
gccacccccuccccaguggcuc

SEQ ID NO: 72323 - RNA, 18 nt, Human
gcccugugacaacaagau

SEQ ID NO: 72324 - RNA, 18 nt, Human
gccgccacccccucccca

SEQ ID NO: 72325 - RNA, 18 nt, Human
gcgggcggaagagcgcgg

SEQ ID NO: 72326 - RNA, 19 nt, Human
gcucugugcugcugccucu

SEQ ID NO: 72327 - RNA, 25 nt, Human
gcugcaccagagaugagaaucccug

SEQ ID NO: 72328 - RNA, 18 nt, Human
gcugcaggggcgggcgga

SEQ ID NO: 72329 - RNA, 19 nt, Human
gcugcugccucugcuggcu

SEQ ID NO: 72330 - RNA, 19 nt, Human
ggaagagcgcggugggggc

SEQ ID NO: 72331 - RNA, 20 nt, Human
ggacaaggcagccgccgucg

SEQ ID NO: 72332 - RNA, 20 nt, Human
ggacacagaaugagaggggc

SEQ ID NO: 72333 - RNA, 23 nt, Human
ggaccaagaacagcacaagccca

SEQ ID NO: 72334 - RNA, 18 nt, Human
ggagucaagggacacaga

SEQ ID NO: 72335 - RNA, 18 nt, Human
ggcaggggacagccaggu

SEQ ID NO: 72336 - RNA, 19 nt, Human
ggcaggggacagccaggug

SEQ ID NO: 72337 - RNA, 18 nt, Human
gggcggaagagcgcggug

SEQ ID NO: 72338 - RNA, 25 nt, Human
gugcugcugccucugcuggcugccu

SEQ ID NO: 72339 - RNA, 20 nt, Human
guggcagguugcuggggaaa

SEQ ID NO: 72340 - RNA, 20 nt, Human
guggcucugugcugcugccu

SEQ ID NO: 72341 - RNA, 22 nt, Human
guggggcaggggacagccaggu

SEQ ID NO: 72342 - RNA, 23 nt, Human
ucaccuggagaccaucucugagc

SEQ ID NO: 72343 - RNA, 26 nt, Human
uccccaguggcuccccaggagcccac

SEQ ID NO: 72344 - RNA, 24 nt, Human
uccgugcugcaggggcgggcggaa

SEQ ID NO: 72345 - RNA, 19 nt, Human
ucugugcugcugccucugc

SEQ ID NO: 72346 - RNA, 23 nt, Human
ugcacacagguggaccccguaug

SEQ ID NO: 72347 - RNA, 21 nt, Human
ugccucguggacaaggcagcc

SEQ ID NO: 72348 - RNA, 22 nt, Human
ugccucugcuggcugccuauuc

SEQ ID NO: 72349 - RNA, 21 nt, Human
ugcguguuaggggcagggaca

SEQ ID NO: 72350 - RNA, 18 nt, Human
uggaggcgagacgcggcc

SEQ ID NO: 72351 - RNA, 18 nt, Human
uggagucaagggacacag

SEQ ID NO: 72352 - RNA, 24 nt, Human
uggcguaggguccaagaagagggu

SEQ ID NO: 72353 - RNA, 18 nt, Human
uguggggaggguuagccc

SEQ ID NO: 72354 - RNA, 24 nt, Human
uguuaggggcagggacaggcccug

SEQ ID NO: 72355 - RNA, 26 nt, Human
uucagggagagggacagacugggggg

SEQ ID NO: 72356 - RNA, 22 nt, Human
uugcuggggaaagugcaagaca

SEQ ID NO: 72357 - RNA, 19 nt, Human
uuguccgugcugcaggggc

SEQ ID NO: 72358 - RNA, 22 nt, Human
uuguccgugcugcaggggcggg

SEQ ID NO: 72359 - RNA, 21 nt, Human
aaacaaccaccuaccuaguaa

SEQ ID NO: 72360 - RNA, 23 nt, Human
aaaguuaccauuuugaaaugcaa

SEQ ID NO: 72361 - RNA, 19 nt, Human
aaugaaaggaccugccuuu

SEQ ID NO: 72362 - RNA, 23 nt, Human
acaagaaucaaguugcaugaaug

SEQ ID NO: 72363 - RNA, 18 nt, Human
acaaggaagaaaggaagc

SEQ ID NO: 72364 - RNA, 22 nt, Human
accaccugucuggaaaaaaucc

SEQ ID NO: 72365 - RNA, 22 nt, Human
accccaggcacuuguacuccua

SEQ ID NO: 72366 - RNA, 25 nt, Human
agaaagaggcaaucucaaagagagg

SEQ ID NO: 72367 - RNA, 19 nt, Human
agaaaugcgaucucccucc

SEQ ID NO: 72368 - RNA, 22 nt, Human
agccaaaaagucaaucacaaga

SEQ ID NO: 72369 - RNA, 20 nt, Human
aggaagccguuucugcaguu

SEQ ID NO: 72370 - RNA, 25 nt, Human
aggcaaaaaaugcaaaagagggacc

SEQ ID NO: 72371 - RNA, 26 nt, Human
aggcagaagauugaaaugguucaggg

SEQ ID NO: 72372 - RNA, 19 nt, Human
aggcagugcuguccagggc

SEQ ID NO: 72373 - RNA, 25 nt, Human
aguaggugggaucguggcgcuuucc

SEQ ID NO: 72374 - RNA, 22 nt, Human
aguccugcuuccuguggcuaga

SEQ ID NO: 72375 - RNA, 23 nt, Human
aguccugcuuccuguggcuagau

SEQ ID NO: 72376 - RNA, 18 nt, Human
auaauuucucugaaguuu

SEQ ID NO: 72377 - RNA, 24 nt, Human
augcgaucucccucagcucuguuu

SEQ ID NO: 72378 - RNA, 23 nt, Human
caaaaagucaaucacaagaauca

SEQ ID NO: 72379 - RNA, 19 nt, Human
caacaggcacgcuaagcgc

SEQ ID NO: 72380 - RNA, 19 nt, Human
caagaaucaaguugcauga

SEQ ID NO: 72381 - RNA, 19 nt, Human
caauucagcuaaugagcca

SEQ ID NO: 72382 - RNA, 19 nt, Human
cacgcaccggcguccacgc

SEQ ID NO: 72383 - RNA, 20 nt, Human
cacgcaccggcguccacgca

SEQ ID NO: 72384 - RNA, 22 nt, Human
cagaccaccugucuggaaaaaa

SEQ ID NO: 72385 - RNA, 22 nt, Human
cagcauagcacaggauacccuu

SEQ ID NO: 72386 - RNA, 24 nt, Human
cagcucuguuuuaacguuggugaa

SEQ ID NO: 72387 - RNA, 25 nt, Human
cagggcaagggacagaaaacccgcc

SEQ ID NO: 72388 - RNA, 18 nt, Human
caguggcugcugugccug

SEQ ID NO: 72389 - RNA, 22 nt, Human
caucacuuucaggccccagugg

SEQ ID NO: 72390 - RNA, 22 nt, Human
ccacgcaucuagcuccugcacc

SEQ ID NO: 72391 - RNA, 18 nt, Human
ccccaguggcugcugugc

SEQ ID NO: 72392 - RNA, 20 nt, Human
ccccaguggcugcugugccu

SEQ ID NO: 72393 - RNA, 23 nt, Human
cccucccgcccuauugccggaag

SEQ ID NO: 72394 - RNA, 24 nt, Human
cccucucccugcucugccuuuuuu

SEQ ID NO: 72395 - RNA, 20 nt, Human
ccggaagacugcugguugcc

SEQ ID NO: 72396 - RNA, 20 nt, Human
ccucacuagccuuccucgcu

SEQ ID NO: 72397 - RNA, 20 nt, Human
ccucagaaaaauaucacccu

SEQ ID NO: 72398 - RNA, 22 nt, Human
ccucgacggacagcaaggggga

SEQ ID NO: 72399 - RNA, 18 nt, Human
ccuggacacuguuuaagg

SEQ ID NO: 72400 - RNA, 18 nt, Human
ccuguauucacagcgggg

SEQ ID NO: 72401 - RNA, 19 nt, Human
cgacgggaagaacgcacuc

SEQ ID NO: 72402 - RNA, 24 nt, Human
cgcuaagcgcgguaccuggaaacc

SEQ ID NO: 72403 - RNA, 21 nt, Human
cggagcagcgucccgccugcc

SEQ ID NO: 72404 - RNA, 25 nt, Human
cgggaaaagccugauucccacagcg

SEQ ID NO: 72405 - RNA, 23 nt, Human
cgggguuuggggggagugucucc

SEQ ID NO: 72406 - RNA, 19 nt, Human
cucauuacaccccaggcac

SEQ ID NO: 72407 - RNA, 21 nt, Human
cucccgcccuauugccggaag

SEQ ID NO: 72408 - RNA, 24 nt, Human
cucgcagcuugccgggcucugcga

SEQ ID NO: 72409 - RNA, 20 nt, Human
cugcagggcgggagggaggc

SEQ ID NO: 72410 - RNA, 22 nt, Human
cugccaguuguaaaguuaccau

SEQ ID NO: 72411 - RNA, 20 nt, Human
cugcugguugccuacucccc

SEQ ID NO: 72412 - RNA, 26 nt, Human
cuggaaaccuccaguccacgcaccgg

SEQ ID NO: 72413 - RNA, 19 nt, Human
cuucucaccgagcucaccc

SEQ ID NO: 72414 - RNA, 25 nt, Human
cuugccgggcucugcgaucccucca

SEQ ID NO: 72415 - RNA, 26 nt, Human
gacacuguuuaaggcugcauuuucug

SEQ ID NO: 72416 - RNA, 19 nt, Human
gaccugcauauuuuaguac

SEQ ID NO: 72417 - RNA, 18 nt, Human
gacggacagcaaggggga

SEQ ID NO: 72418 - RNA, 19 nt, Human
gacucgcagauuccuccuc

SEQ ID NO: 72419 - RNA, 20 nt, Human
gcgggguuuggggggagugu

SEQ ID NO: 72420 - RNA, 21 nt, Human
gcuggccccucucccugcucu

SEQ ID NO: 72421 - RNA, 22 nt, Human
gcuuucccgcuuuucccuucca

SEQ ID NO: 72422 - RNA, 20 nt, Human
ggaaaaaauccuucaagcaa

SEQ ID NO: 72423 - RNA, 19 nt, Human
ggaggggguggagcuggga

SEQ ID NO: 72424 - RNA, 24 nt, Human
ggguuuucugcgggaaaagccuga

SEQ ID NO: 72425 - RNA, 18 nt, Human
gguugccuacuccccgcu

SEQ ID NO: 72426 - RNA, 20 nt, Human
guccacgcaccggcguccac

SEQ ID NO: 72427 - RNA, 21 nt, Human
gucuccugguuuucucuaugg

SEQ ID NO: 72428 - RNA, 19 nt, Human
gugcgucuuauaaauggaa

SEQ ID NO: 72429 - RNA, 24 nt, Human
guuacuacugagucguggggacau

SEQ ID NO: 72430 - RNA, 24 nt, Human
uaaaagaaacuaacaacaaaauau

SEQ ID NO: 72431 - RNA, 21 nt, Human
uaagcgcgguaccuggaaacc

SEQ ID NO: 72432 - RNA, 20 nt, Human
uacagcauguuuccauuaau

SEQ ID NO: 72433 - RNA, 20 nt, Human
uagcuccugcaccugaaccu

SEQ ID NO: 72434 - RNA, 20 nt, Human
uagcuucuaauagaacucuu

SEQ ID NO: 72435 - RNA, 19 nt, Human
uaggcaaaaaaugcaaaag

SEQ ID NO: 72436 - RNA, 26 nt, Human
uauaacuucuguuguauuucugggaa

SEQ ID NO: 72437 - RNA, 23 nt, Human
uaugcggugcuuguuuccuuggg

SEQ ID NO: 72438 - RNA, 19 nt, Human
uauggagacuagggacuua

SEQ ID NO: 72439 - RNA, 23 nt, Human
uauugccggaagacugcugguug

SEQ ID NO: 72440 - RNA, 22 nt, Human
ucaagucuuacuuauguuagaa

SEQ ID NO: 72441 - RNA, 21 nt, Human
ucacaguaggugggaucgugg

SEQ ID NO: 72442 - RNA, 26 nt, Human
ucacuagccuuccucgcuagccuccu

SEQ ID NO: 72443 - RNA, 18 nt, Human
ucacuguggagggggugg

SEQ ID NO: 72444 - RNA, 23 nt, Human
uccaaaaacuuggacaacugacg

SEQ ID NO: 72445 - RNA, 22 nt, Human
uccaagagaaaguccagaguac

SEQ ID NO: 72446 - RNA, 23 nt, Human
uccacaagcuucccucacuagcc

SEQ ID NO: 72447 - RNA, 19 nt, Human
uccacuuuacuauccaguc

SEQ ID NO: 72448 - RNA, 22 nt, Human
uccccgcucccuggaguuuuau

SEQ ID NO: 72449 - RNA, 20 nt, Human
ucccggggcaaacauuucuc

SEQ ID NO: 72450 - RNA, 24 nt, Human
ucccucagcucuguuuuuccucgg

SEQ ID NO: 72451 - RNA, 18 nt, Human
ucgcggcgcgcucccucc

SEQ ID NO: 72452 - RNA, 22 nt, Human
ucgcuagccuccuuaaccaugc

SEQ ID NO: 72453 - RNA, 20 nt, Human
ucucagcagggugagcuggc

SEQ ID NO: 72454 - RNA, 28 nt, Human
ucugcgaucccuccagugggcgucuccc

SEQ ID NO: 72455 - RNA, 22 nt, Human
ucuuuguucagaaauagugccg

SEQ ID NO: 72456 - RNA, 23 nt, Human
ugaaacguaggcaaaaaaugcaa

SEQ ID NO: 72457 - RNA, 19 nt, Human
ugagaugcuggacuugaaa

SEQ ID NO: 72458 - RNA, 22 nt, Human
ugagcagcucucagcaggguga

SEQ ID NO: 72459 - RNA, 21 nt, Human
ugccuguauucacagcggggu

SEQ ID NO: 72460 - RNA, 18 nt, Human
ugcgacgggaagaacgca

SEQ ID NO: 72461 - RNA, 21 nt, Human
ugcggugcuuguuuccuugga

SEQ ID NO: 72462 - RNA, 22 nt, Human
uggacaaagagcagcugccgga

SEQ ID NO: 72463 - RNA, 19 nt, Human
uggagccccucugcagggc

SEQ ID NO: 72464 - RNA, 20 nt, Human
uggccagucaacauuuccuc

SEQ ID NO: 72465 - RNA, 22 nt, Human
uggcucucgaccucaccuccuc

SEQ ID NO: 72466 - RNA, 19 nt, Human
ugguugccuacuccccgcu

SEQ ID NO: 72467 - RNA, 22 nt, Human
ugugccuguauucacagcgggg

SEQ ID NO: 72468 - RNA, 22 nt, Human
uguucagaaauagugccgcauu

SEQ ID NO: 72469 - RNA, 23 nt, Human
uguuguugaggucaucgggaaga

SEQ ID NO: 72470 - RNA, 19 nt, Human
uucagggauggaagguaau

SEQ ID NO: 72471 - RNA, 21 nt, Human
uuccccaggcaaauuuucccg

SEQ ID NO: 72472 - RNA, 22 nt, Human
uuccccaggcaaauuuucccgg

SEQ ID NO: 72473 - RNA, 21 nt, Human
uucccggggcaaacauuucuc

SEQ ID NO: 72474 - RNA, 18 nt, Human
uuccggaagcacuggguu

SEQ ID NO: 72475 - RNA, 19 nt, Human
uuccuccucacaguaggug

SEQ ID NO: 72476 - RNA, 21 nt, Human
uuggacaacugacgagucaug

SEQ ID NO: 72477 - RNA, 21 nt, Human
uuggccagucaacauuuccuc

SEQ ID NO: 72478 - RNA, 19 nt, Human
uuuucaggcaauuuuacaa

SEQ ID NO: 72479 - RNA, 24 nt, Human
uuuuggguggacaaagagcagcug

SEQ ID NO: 72480 - RNA, 22 nt, Human
aaaggcggagacaggaaggucc

SEQ ID NO: 72481 - RNA, 23 nt, Human
aaggagaccccuugccaugugga

SEQ ID NO: 72482 - RNA, 26 nt, Human
agacagacggaugcacagaacccagg

SEQ ID NO: 72483 - RNA, 25 nt, Human
agacggaugcacagaacccaggauc

SEQ ID NO: 72484 - RNA, 18 nt, Human
agccccuccuacacccag

SEQ ID NO: 72485 - RNA, 22 nt, Human
aggagcaaguucaauggcccag

SEQ ID NO: 72486 - RNA, 19 nt, Human
aggcaagacacccaacagc

SEQ ID NO: 72487 - RNA, 20 nt, Human
aggcaggggcuguggcuugu

SEQ ID NO: 72488 - RNA, 21 nt, Human
aggccccugggaccgcugucu

SEQ ID NO: 72489 - RNA, 25 nt, Human
agggagagaaugaggagggagggau

SEQ ID NO: 72490 - RNA, 19 nt, Human
aggggcuguggcuugucca

SEQ ID NO: 72491 - RNA, 26 nt, Human
cacacagugucccagccucggggccu

SEQ ID NO: 72492 - RNA, 22 nt, Human
cacaggcucuggccaauucucc

SEQ ID NO: 72493 - RNA, 18 nt, Human
caccugcucccucuuucc

SEQ ID NO: 72494 - RNA, 20 nt, Human
caccugcucccucuuuccug

SEQ ID NO: 72495 - RNA, 18 nt, Human
caccugggggcaccugcu

SEQ ID NO: 72496 - RNA, 19 nt, Human
cagcugagcuucucaaagc

SEQ ID NO: 72497 - RNA, 23 nt, Human
caggaaggcagcugagcuucuca

SEQ ID NO: 72498 - RNA, 23 nt, Human
cagggucucuggacuggagcccu

SEQ ID NO: 72499 - RNA, 23 nt, Human
cagguguucugagggccuggagg

SEQ ID NO: 72500 - RNA, 21 nt, Human
cagugagcugaccugaggggc

SEQ ID NO: 72501 - RNA, 23 nt, Human
ccaauucuccacgggucccccuc

SEQ ID NO: 72502 - RNA, 25 nt, Human
ccacgggucccccucccaguggcuc

SEQ ID NO: 72503 - RNA, 23 nt, Human
ccagcucagugagcugaccugag

SEQ ID NO: 72504 - RNA, 22 nt, Human
ccccugggaccgcugucucacc

SEQ ID NO: 72505 - RNA, 23 nt, Human
ccucaggccucugcugcagcccc

SEQ ID NO: 72506 - RNA, 24 nt, Human
ccuccuacacccagcucagugagc

SEQ ID NO: 72507 - RNA, 22 nt, Human
ccugccacuccucaggccucug

SEQ ID NO: 72508 - RNA, 19 nt, Human
ccuuccuuuucaggccccu

SEQ ID NO: 72509 - RNA, 20 nt, Human
cuccucaggccucugcugca

SEQ ID NO: 72510 - RNA, 20 nt, Human
cugcagccccuccuacaccc

SEQ ID NO: 72511 - RNA, 21 nt, Human
cugcagccccuccuacaccca

SEQ ID NO: 72512 - RNA, 22 nt, Human
cuggccccagccugguccuucc

SEQ ID NO: 72513 - RNA, 20 nt, Human
cuggggcagguguucugagg

SEQ ID NO: 72514 - RNA, 21 nt, Human
cuggggccugaagcucuccuc

SEQ ID NO: 72515 - RNA, 21 nt, Human
cugggggcaccugcucccucu

SEQ ID NO: 72516 - RNA, 22 nt, Human
gccaauucuccacggguccccc

SEQ ID NO: 72517 - RNA, 19 nt, Human
gccauguggaaaagagcuc

SEQ ID NO: 72518 - RNA, 18 nt, Human
gccccuccuacacccagc

SEQ ID NO: 72519 - RNA, 18 nt, Human
gcggagacaggaaggucc

SEQ ID NO: 72520 - RNA, 22 nt, Human
ggagacaggaagguccccuggc

SEQ ID NO: 72521 - RNA, 21 nt, Human
ggcaccugcucccucuuuccu

SEQ ID NO: 72522 - RNA, 19 nt, Human
ggccuggaggugaugugcg

SEQ ID NO: 72523 - RNA, 22 nt, Human
ggcuggggcagguguucugagg

SEQ ID NO: 72524 - RNA, 19 nt, Human
gggagagaaugaggaggga

SEQ ID NO: 72525 - RNA, 18 nt, Human
gggcagggaagauugaga

SEQ ID NO: 72526 - RNA, 23 nt, Human
gggcuggggcagguguucugagg

SEQ ID NO: 72527 - RNA, 21 nt, Human
ggggcagguguucugagggcc

SEQ ID NO: 72528 - RNA, 21 nt, Human
ggggcagguguucugagggcc

SEQ ID NO: 72529 - RNA, 20 nt, Human
guggagacccaggcaggggc

SEQ ID NO: 72530 - RNA, 22 nt, Human
uauagagaugccagcauggcag

SEQ ID NO: 72531 - RNA, 18 nt, Human
uauuagggagagaaugag

SEQ ID NO: 72532 - RNA, 21 nt, Human
uauuagggagagaaugaggag

SEQ ID NO: 72533 - RNA, 21 nt, Human
ucaccugggggcaccugcucc

SEQ ID NO: 72534 - RNA, 18 nt, Human
ucaggccucugcugcagc

SEQ ID NO: 72535 - RNA, 18 nt, Human
ucagugagcugaccugag

SEQ ID NO: 72536 - RNA, 19 nt, Human
uccaauuuuuauuagggag

SEQ ID NO: 72537 - RNA, 22 nt, Human
uccccuggccccagccuggucc

SEQ ID NO: 72538 - RNA, 22 nt, Human
uccuggggccugaagcucuccu

SEQ ID NO: 72539 - RNA, 21 nt, Human
ucucaaagccucuagaggcaa

SEQ ID NO: 72540 - RNA, 23 nt, Human
ugagcugaccugaggggccccca

SEQ ID NO: 72541 - RNA, 24 nt, Human
ugaggagggagggauuagaaaggc

SEQ ID NO: 72542 - RNA, 20 nt, Human
ugccugaggagcaaguucaa

SEQ ID NO: 72543 - RNA, 22 nt, Human
ugccuguuggcgugugucgugu

SEQ ID NO: 72544 - RNA, 22 nt, Human
uggcaguauggccaguccuggg

SEQ ID NO: 72545 - RNA, 21 nt, Human
uggcgugugugcacgugugcg

SEQ ID NO: 72546 - RNA, 20 nt, Human
uggcucccaggaccagcccc

SEQ ID NO: 72547 - RNA, 22 nt, Human
ugggcagggaagauugagaggg

SEQ ID NO: 72548 - RNA, 23 nt, Human
uggggcagguguucugagggccu

SEQ ID NO: 72549 - RNA, 20 nt, Human
uuccugccacuccucaggcc

SEQ ID NO: 72550 - RNA, 24 nt, Human
uugccauguggaaaagagcuccaa

SEQ ID NO: 72551 - RNA, 21 nt, Human
aaacaccaccccacagucaaa

SEQ ID NO: 72552 - RNA, 18 nt, Human
aagugucaucgcaugaaa

SEQ ID NO: 72553 - RNA, 24 nt, Human
acacaguggcaggcaagagacaag

SEQ ID NO: 72554 - RNA, 18 nt, Human
acccgugcccgccaaggg

SEQ ID NO: 72555 - RNA, 23 nt, Human
agacaagcuguguugaaggcacu

SEQ ID NO: 72556 - RNA, 25 nt, Human
agaggugggagggcugcacggaggu

SEQ ID NO: 72557 - RNA, 21 nt, Human
agccuaucaguccaccuucuc

SEQ ID NO: 72558 - RNA, 19 nt, Human
agcggcagcgcggcgggcg

SEQ ID NO: 72559 - RNA, 18 nt, Human
aggcaccuggcaccucgg

SEQ ID NO: 72560 - RNA, 20 nt, Human
aggcgacuggcggccaggug

SEQ ID NO: 72561 - RNA, 19 nt, Human
agggaggugccgggggaug

SEQ ID NO: 72562 - RNA, 23 nt, Human
auccuccgaggcaccuggcaccu

SEQ ID NO: 72563 - RNA, 24 nt, Human
auugcuaugaggagugguccaggc

SEQ ID NO: 72564 - RNA, 24 nt, Human
cacagcggggcgggaaguggugcc

SEQ ID NO: 72565 - RNA, 19 nt, Human
caccagggugcgguagggg

SEQ ID NO: 72566 - RNA, 23 nt, Human
caccugaagcuggcagcagggac

SEQ ID NO: 72567 - RNA, 23 nt, Human
caccugcuccuugggccgggcug

SEQ ID NO: 72568 - RNA, 20 nt, Human
cacgccacgcccaccuuccc

SEQ ID NO: 72569 - RNA, 18 nt, Human
cacgcccaccuucccacu

SEQ ID NO: 72570 - RNA, 21 nt, Human
cacggcccugggggcccugac

SEQ ID NO: 72571 - RNA, 19 nt, Human
cacuuugccgaugaucuuc

SEQ ID NO: 72572 - RNA, 23 nt, Human
cagacucgggcagccccugcugg

SEQ ID NO: 72573 - RNA, 20 nt, Human
cagaggcccugcaggccucu

SEQ ID NO: 72574 - RNA, 18 nt, Human
cagccgccagcucccacc

SEQ ID NO: 72575 - RNA, 19 nt, Human
cagccuucuuggcauuucu

SEQ ID NO: 72576 - RNA, 18 nt, Human
cagcggcagcgcggcggg

SEQ ID NO: 72577 - RNA, 19 nt, Human
cagcggcagcgcggcgggc

SEQ ID NO: 72578 - RNA, 26 nt, Human
caggccccaggcgaagcugcucuggg

SEQ ID NO: 72579 - RNA, 18 nt, Human
ccacaacgaugcugucac

SEQ ID NO: 72580 - RNA, 25 nt, Human
cccaccuuccucugcgaucuugucc

SEQ ID NO: 72581 - RNA, 26 nt, Human
cccaccuuccucugcgaucuuguccu

SEQ ID NO: 72582 - RNA, 20 nt, Human
cccauguccacacagcgggg

SEQ ID NO: 72583 - RNA, 22 nt, Human
ccccacagucaaacucgucgcu

SEQ ID NO: 72584 - RNA, 23 nt, Human
ccccacagucaaacucgucgcuc

SEQ ID NO: 72585 - RNA, 19 nt, Human
cccggagcccggcacagcc

SEQ ID NO: 72586 - RNA, 19 nt, Human
cccucagaaaggaggaccc

SEQ ID NO: 72587 - RNA, 23 nt, Human
ccgccagcucccacccgcccgcu

SEQ ID NO: 72588 - RNA, 20 nt, Human
ccgcccaccuuccucugcga

SEQ ID NO: 72589 - RNA, 21 nt, Human
ccggcggcuggaggcaggugc

SEQ ID NO: 72590 - RNA, 18 nt, Human
ccgggggauggggggggg

SEQ ID NO: 72591 - RNA, 23 nt, Human
ccgggggaugggggggggucacc

SEQ ID NO: 72592 - RNA, 20 nt, Human
ccgugacacccgugcccgcc

SEQ ID NO: 72593 - RNA, 24 nt, Human
cgccccugacuuggguacgugcuu

SEQ ID NO: 72594 - RNA, 21 nt, Human
cgcggggcaggccgcgggggc

SEQ ID NO: 72595 - RNA, 23 nt, Human
cggcagcgcggcgggcgggaccc

SEQ ID NO: 72596 - RNA, 18 nt, Human
cggccccucaccagggug

SEQ ID NO: 72597 - RNA, 20 nt, Human
cggcccggaggcggacgcgg

SEQ ID NO: 72598 - RNA, 18 nt, Human
cggcccggggcggccccc

SEQ ID NO: 72599 - RNA, 18 nt, Human
cggcggcagcggccacga

SEQ ID NO: 72600 - RNA, 22 nt, Human
cggcucggcggcccggaggcgg

SEQ ID NO: 72601 - RNA, 20 nt, Human
cgggccugggccccacccag

SEQ ID NO: 72602 - RNA, 23 nt, Human
cuccagcuggguuaggggguugg

SEQ ID NO: 72603 - RNA, 24 nt, Human
cuccgcauccuccgaggcaccugg

SEQ ID NO: 72604 - RNA, 20 nt, Human
cuccgcguggacgcggcucc

SEQ ID NO: 72605 - RNA, 20 nt, Human
cucggcggcccggaggcgga

SEQ ID NO: 72606 - RNA, 23 nt, Human
cucgucgcucacuuucuugaagu

SEQ ID NO: 72607 - RNA, 21 nt, Human
cugcggguggccucggccucc

SEQ ID NO: 72608 - RNA, 20 nt, Human
cuggcaccucggugcuggcg

SEQ ID NO: 72609 - RNA, 23 nt, Human
cuggcaccucggugcuggcgcuc

SEQ ID NO: 72610 - RNA, 20 nt, Human
cuggcagcagggaccucggc

SEQ ID NO: 72611 - RNA, 25 nt, Human
cuggccuagccugagaaauguacau

SEQ ID NO: 72612 - RNA, 24 nt, Human
cuggcggcggcagcggccacgauc

SEQ ID NO: 72613 - RNA, 20 nt, Human
cugggcccugcggguggccu

SEQ ID NO: 72614 - RNA, 24 nt, Human
cugggcccugcggguggccucggc

SEQ ID NO: 72615 - RNA, 21 nt, Human
cugggugggguggcauggugg

SEQ ID NO: 72616 - RNA, 18 nt, Human
gacucagccuucuuggca

SEQ ID NO: 72617 - RNA, 25 nt, Human
gagcugggugggguggcaugguggg

SEQ ID NO: 72618 - RNA, 27 nt, Human
gaggcaggugcagugcuccccaagggg

SEQ ID NO: 72619 - RNA, 25 nt, Human
gcccaccuuccucugcgaucuuguc

SEQ ID NO: 72620 - RNA, 18 nt, Human
gccccaggcgaagcugcu

SEQ ID NO: 72621 - RNA, 24 nt, Human
gccgggggaugggggggggucacc

SEQ ID NO: 72622 - RNA, 23 nt, Human
gccguccucaccuuccuccucca

SEQ ID NO: 72623 - RNA, 22 nt, Human
gcugcccuuuuuggucagcagc

SEQ ID NO: 72624 - RNA, 19 nt, Human
gcuuccucguccccgaaga

SEQ ID NO: 72625 - RNA, 18 nt, Human
ggacccaggacugcacag

SEQ ID NO: 72626 - RNA, 18 nt, Human
ggaugggggggggucacc

SEQ ID NO: 72627 - RNA, 24 nt, Human
ggcuccugaguacgaggucaucug

SEQ ID NO: 72628 - RNA, 18 nt, Human
gggaugggggggggucac

SEQ ID NO: 72629 - RNA, 25 nt, Human
gggcgggaaguggugccaagcgggg

SEQ ID NO: 72630 - RNA, 24 nt, Human
gguggcaugguggggucuuggaug

SEQ ID NO: 72631 - RNA, 21 nt, Human
guccucaccuuccuccuccau

SEQ ID NO: 72632 - RNA, 26 nt, Human
gugacagcgcggccccucaccagggu

SEQ ID NO: 72633 - RNA, 20 nt, Human
guggccgguccugcggugcc

SEQ ID NO: 72634 - RNA, 21 nt, Human
guggcuuccucguccccgaag

SEQ ID NO: 72635 - RNA, 23 nt, Human
uacgugggcaaaucccagaggga

SEQ ID NO: 72636 - RNA, 20 nt, Human
uagccucgggaccuugcccc

SEQ ID NO: 72637 - RNA, 25 nt, Human
ucaaugauccacugcaugauuuucu

SEQ ID NO: 72638 - RNA, 23 nt, Human
ucagaaaggaggacccaggacug

SEQ ID NO: 72639 - RNA, 21 nt, Human
uccacacagcggggcgggaag

SEQ ID NO: 72640 - RNA, 18 nt, Human
uccagcuucgccccugac

SEQ ID NO: 72641 - RNA, 22 nt, Human
ucccagcacacgugcccaaggg

SEQ ID NO: 72642 - RNA, 24 nt, Human
uccccgaagacccguggccggucc

SEQ ID NO: 72643 - RNA, 18 nt, Human
ucccgccgcccaccuucc

SEQ ID NO: 72644 - RNA, 22 nt, Human
ucccgccgcccaccuuccucug

SEQ ID NO: 72645 - RNA, 21 nt, Human
ucccggagcccggcacagccc

SEQ ID NO: 72646 - RNA, 22 nt, Human
ucccgugccccgaggcggcacc

SEQ ID NO: 72647 - RNA, 19 nt, Human
uccucaccuuccuccucca

SEQ ID NO: 72648 - RNA, 21 nt, Human
uccucaccuuccuccuccaug

SEQ ID NO: 72649 - RNA, 20 nt, Human
uccuuuucccccucaaugau

SEQ ID NO: 72650 - RNA, 21 nt, Human
ucucgaaccuccucaaacacc

SEQ ID NO: 72651 - RNA, 20 nt, Human
ucucuuuucuuccuccucca

SEQ ID NO: 72652 - RNA, 21 nt, Human
ucugcuuggagggugcucggc

SEQ ID NO: 72653 - RNA, 23 nt, Human
ucugguucuucuccgcauccucc

SEQ ID NO: 72654 - RNA, 19 nt, Human
ucuuuugcacgccacgccc

SEQ ID NO: 72655 - RNA, 18 nt, Human
ugaacuggcccaggguga

SEQ ID NO: 72656 - RNA, 23 nt, Human
ugacagaggcccugcaggccucu

SEQ ID NO: 72657 - RNA, 19 nt, Human
ugcacagccggcggcugga

SEQ ID NO: 72658 - RNA, 19 nt, Human
ugcaggccggccgcgucca

SEQ ID NO: 72659 - RNA, 20 nt, Human
ugccgggggaugggggggga

SEQ ID NO: 72660 - RNA, 20 nt, Human
ugccgggggauggggggggg

SEQ ID NO: 72661 - RNA, 22 nt, Human
ugccgggggauggggggggguc

SEQ ID NO: 72662 - RNA, 21 nt, Human
ugcggugccugcugaucuccu

SEQ ID NO: 72663 - RNA, 21 nt, Human
uggacgugucggugguggugc

SEQ ID NO: 72664 - RNA, 22 nt, Human
uggaguucucauggggcugugg

SEQ ID NO: 72665 - RNA, 19 nt, Human
uggccaggcccaggcgacu

SEQ ID NO: 72666 - RNA, 20 nt, Human
uggcccagggugacagcgcg

SEQ ID NO: 72667 - RNA, 19 nt, Human
ugggggcaggacagaagcu

SEQ ID NO: 72668 - RNA, 20 nt, Human
ugggggcaggacagaagcuu

SEQ ID NO: 72669 - RNA, 24 nt, Human
ugguggggucuuggaugaagaggu

SEQ ID NO: 72670 - RNA, 18 nt, Human
uggugguggacgugucgg

SEQ ID NO: 72671 - RNA, 24 nt, Human
ugguuccaggccccaggcgaagcu

SEQ ID NO: 72672 - RNA, 21 nt, Human
uguacauauuuacacgggccc

SEQ ID NO: 72673 - RNA, 19 nt, Human
ugugugguuccaggcccca

SEQ ID NO: 72674 - RNA, 21 nt, Human
uucacacaguggcaggcaaga

SEQ ID NO: 72675 - RNA, 20 nt, Human
uucuuuugcacgccacgccc

SEQ ID NO: 72676 - RNA, 21 nt, Human
uuggaugaagaggugggaggg

SEQ ID NO: 72677 - RNA, 24 nt, Human
uuggguacgugcuucccgugcccc

SEQ ID NO: 72678 - RNA, 22 nt, Human
uuugccgaugaucuucuccuca

SEQ ID NO: 72679 - RNA, 19 nt, Human
aaccuccccccgcccuccc

SEQ ID NO: 72680 - RNA, 26 nt, Human
aagcccacuggccgauucuuccuuag

SEQ ID NO: 72681 - RNA, 19 nt, Human
agccaagacaguucacaag

SEQ ID NO: 72682 - RNA, 21 nt, Human
ccccccgcccucccgaagccc

SEQ ID NO: 72683 - RNA, 22 nt, Human
ccccccgcccucccgaagccca

SEQ ID NO: 72684 - RNA, 21 nt, Human
cccucccgaagcccacuggcc

SEQ ID NO: 72685 - RNA, 22 nt, Human
ccucucagcaaucggcgugguc

SEQ ID NO: 72686 - RNA, 22 nt, Human
cggcguggucucucugucucuc

SEQ ID NO: 72687 - RNA, 21 nt, Human
cucccgaagcccacuggccga

SEQ ID NO: 72688 - RNA, 22 nt, Human
cuucgggcuccaacaguucacc

SEQ ID NO: 72689 - RNA, 23 nt, Human
gaaaaucaaccuccccccgcccu

SEQ ID NO: 72690 - RNA, 18 nt, Human
gggaaaucaacuguucua

SEQ ID NO: 72691 - RNA, 21 nt, Human
uaaagcagcauauccauaaac

SEQ ID NO: 72692 - RNA, 20 nt, Human
ucaaccuccccccgcccucc

SEQ ID NO: 72693 - RNA, 23 nt, Human
ucagcaaucggcguggucucucu

SEQ ID NO: 72694 - RNA, 23 nt, Human
ugaaucaugaaaaucaaccuccc

SEQ ID NO: 72695 - RNA, 24 nt, Human
ugguuuaauuuuccuucaaaaugu

SEQ ID NO: 72696 - RNA, 25 nt, Human
uuaauaaauaguucaggcuuuucuu

SEQ ID NO: 72697 - RNA, 19 nt, Human
uuucuucuuccaguuccuc

SEQ ID NO: 72698 - RNA, 27 nt, Human
aaaaaaaaaaaaaaguaggccuuagaa

SEQ ID NO: 72699 - RNA, 20 nt, Human
aaaaaaaaguaggccuuaga

SEQ ID NO: 72700 - RNA, 21 nt, Human
aaaaaaaaguaggccuuagaa

SEQ ID NO: 72701 - RNA, 24 nt, Human
aaacauuccuccagaacuccacuc

SEQ ID NO: 72702 - RNA, 20 nt, Human
aacauggugaaacccugucu

SEQ ID NO: 72703 - RNA, 21 nt, Human
aacauggugaaacccugucuc

SEQ ID NO: 72704 - RNA, 22 nt, Human
aacauuagaaauuauuagaacu

SEQ ID NO: 72705 - RNA, 19 nt, Human
aacccuuucuccgccccug

SEQ ID NO: 72706 - RNA, 19 nt, Human
aagaaccuaaaggugucca

SEQ ID NO: 72707 - RNA, 22 nt, Human
aaggcaggaaaaucacuugaac

SEQ ID NO: 72708 - RNA, 23 nt, Human
aagguugcagugaggcgagauug

SEQ ID NO: 72709 - RNA, 27 nt, Human
aaucaucuagaaucuuggagcaucuga

SEQ ID NO: 72710 - RNA, 21 nt, Human
acaaaguuuuaugugaccuga

SEQ ID NO: 72711 - RNA, 24 nt, Human
acacagugagacucuaucgcaaaa

SEQ ID NO: 72712 - RNA, 26 nt, Human
acagcggcaggggaggcccuugccac

SEQ ID NO: 72713 - RNA, 19 nt, Human
acagggcugcaagugggga

SEQ ID NO: 72714 - RNA, 20 nt, Human
acagggcugcaaguggggau

SEQ ID NO: 72715 - RNA, 19 nt, Human
accacugcacuccagccug

SEQ ID NO: 72716 - RNA, 24 nt, Human
accacugcacuccagccuggguga

SEQ ID NO: 72717 - RNA, 20 nt, Human
accaggccagagccaggggc

SEQ ID NO: 72718 - RNA, 24 nt, Human
acccugucucuacuaaaaauauaa

SEQ ID NO: 72719 - RNA, 18 nt, Human
acugcacuccagccuggg

SEQ ID NO: 72720 - RNA, 26 nt, Human
acugcacuccagccugggugacacag

SEQ ID NO: 72721 - RNA, 23 nt, Human
acuugggcaacccuuucuccgcc

SEQ ID NO: 72722 - RNA, 24 nt, Human
acuuugggaggcugaggugggcag

SEQ ID NO: 72723 - RNA, 21 nt, Human
agaaaaucuaaaaccacauaa

SEQ ID NO: 72724 - RNA, 30 nt, Human
agaaaaucuaaaaccacauaaugucagagg

SEQ ID NO: 72725 - RNA, 22 nt, Human
agaaauguggauucuuggacuc

SEQ ID NO: 72726 - RNA, 21 nt, Human
agaaccagaaaaucuaaaacc

SEQ ID NO: 72727 - RNA, 18 nt, Human
agaaugcagcaaagaacc

SEQ ID NO: 72728 - RNA, 22 nt, Human
agaccagccuggccaacauggu

SEQ ID NO: 72729 - RNA, 22 nt, Human
agagaaucuaagaucuuagagu

SEQ ID NO: 72730 - RNA, 23 nt, Human
agagccaggggccaccuggacaa

SEQ ID NO: 72731 - RNA, 22 nt, Human
agaucacuugaggucaggaguu

SEQ ID NO: 72732 - RNA, 23 nt, Human
agcaaagaaccuaaaggugucca

SEQ ID NO: 72733 - RNA, 21 nt, Human
agcaaugauagcuaagaagga

SEQ ID NO: 72734 - RNA, 24 nt, Human
agcacuuugggaggcugagguggg

SEQ ID NO: 72735 - RNA, 19 nt, Human
agcagccgccuucucagca

SEQ ID NO: 72736 - RNA, 19 nt, Human
agccaggggccaccuggac

SEQ ID NO: 72737 - RNA, 23 nt, Human
agccgggugugguggcacacacc

SEQ ID NO: 72738 - RNA, 22 nt, Human
agccuggccaacauggugaaac

SEQ ID NO: 72739 - RNA, 24 nt, Human
agccuggccaacauggugaaaccc

SEQ ID NO: 72740 - RNA, 22 nt, Human
agccugggugacacagugagac

SEQ ID NO: 72741 - RNA, 24 nt, Human
agccugggugacacagugagacuc

SEQ ID NO: 72742 - RNA, 19 nt, Human
agcgggggagggggcaggg

SEQ ID NO: 72743 - RNA, 20 nt, Human
agcgggggagggggcagggc

SEQ ID NO: 72744 - RNA, 18 nt, Human
aggaagacagggcugcaa

SEQ ID NO: 72745 - RNA, 23 nt, Human
aggagggggaaggggacccuggu

SEQ ID NO: 72746 - RNA, 23 nt, Human
aggcagaaugcagcaaaggggac

SEQ ID NO: 72747 - RNA, 18 nt, Human
aggcaggaaaaucacuug

SEQ ID NO: 72748 - RNA, 24 nt, Human
aggcaggaaaaucacuugaacucg

SEQ ID NO: 72749 - RNA, 25 nt, Human
aggccagagccaggggccaccugga

SEQ ID NO: 72750 - RNA, 21 nt, Human
aggcugaggugggcagaucac

SEQ ID NO: 72751 - RNA, 24 nt, Human
aggcugaggugggcagaucacuug

SEQ ID NO: 72752 - RNA, 23 nt, Human
agggguuaacucaagagaggaga

SEQ ID NO: 72753 - RNA, 19 nt, Human
agguaggaagacagggcug

SEQ ID NO: 72754 - RNA, 21 nt, Human
agguaggaagacagggcugca

SEQ ID NO: 72755 - RNA, 19 nt, Human
aggugaagguugcagugag

SEQ ID NO: 72756 - RNA, 24 nt, Human
aggugaagguugcagugaggcgag

SEQ ID NO: 72757 - RNA, 22 nt, Human
aggugggcagaucacuugaggu

SEQ ID NO: 72758 - RNA, 23 nt, Human
aggugggcagaucacuugagguc

SEQ ID NO: 72759 - RNA, 26 nt, Human
aggugggcagaucacuugaggucagg

SEQ ID NO: 72760 - RNA, 19 nt, Human
agugagacucuaucgcaaa

SEQ ID NO: 72761 - RNA, 23 nt, Human
agugcaguggcucaugccuguaa

SEQ ID NO: 72762 - RNA, 23 nt, Human
aguggcucaugccuguaaucuca

SEQ ID NO: 72763 - RNA, 24 nt, Human
aguggcucaugccuguaaucucag

SEQ ID NO: 72764 - RNA, 20 nt, Human
aucacuugaggucaggaguu

SEQ ID NO: 72765 - RNA, 22 nt, Human
aucccagcuacuugggaggcca

SEQ ID NO: 72766 - RNA, 19 nt, Human
aucuuugaaaccuagaacc

SEQ ID NO: 72767 - RNA, 19 nt, Human
augccuguaaucucagcac

SEQ ID NO: 72768 - RNA, 20 nt, Human
auuccuccagaacuccacuc

SEQ ID NO: 72769 - RNA, 24 nt, Human
auugcaccacugcacuccagccug

SEQ ID NO: 72770 - RNA, 25 nt, Human
auugcagauucuagagcuuucgacc

SEQ ID NO: 72771 - RNA, 20 nt, Human
caaaguuuuaugugaccuga

SEQ ID NO: 72772 - RNA, 24 nt, Human
caacauggugaaacccugucucua

SEQ ID NO: 72773 - RNA, 24 nt, Human
cacaccuguaaucccagcuacuug

SEQ ID NO: 72774 - RNA, 26 nt, Human
caccacugcacuccagccugggugac

SEQ ID NO: 72775 - RNA, 21 nt, Human
caccaggccagagccaggggc

SEQ ID NO: 72776 - RNA, 20 nt, Human
caccccugccuccuucccuc

SEQ ID NO: 72777 - RNA, 19 nt, Human
caccuaauagucuagaccu

SEQ ID NO: 72778 - RNA, 23 nt, Human
caccuguaaucccagcuacuugg

SEQ ID NO: 72779 - RNA, 24 nt, Human
caccuguaaucccagcuacuuggg

SEQ ID NO: 72780 - RNA, 22 nt, Human
cacuccagccugggugacacag

SEQ ID NO: 72781 - RNA, 22 nt, Human
cacuccagccugggugacacag

SEQ ID NO: 72782 - RNA, 23 nt, Human
cacuccagccugggugacacagu

SEQ ID NO: 72783 - RNA, 24 nt, Human
cacuccagccugggugacacagug

SEQ ID NO: 72784 - RNA, 19 nt, Human
cacugcacuccagccuggg

SEQ ID NO: 72785 - RNA, 19 nt, Human
cacugcacuccagccuggg

SEQ ID NO: 72786 - RNA, 19 nt, Human
cacugcacuccagccuggg

SEQ ID NO: 72787 - RNA, 21 nt, Human
cacugcacuccagccugggug

SEQ ID NO: 72788 - RNA, 22 nt, Human
cacugcacuccagccuggguga

SEQ ID NO: 72789 - RNA, 23 nt, Human
cacugcacuccagccugggugac

SEQ ID NO: 72790 - RNA, 24 nt, Human
cacugcacuccagccugggugaca

SEQ ID NO: 72791 - RNA, 21 nt, Human
cacuugaggucaggaguuuua

SEQ ID NO: 72792 - RNA, 21 nt, Human
cagaaguugcugggcucccag

SEQ ID NO: 72793 - RNA, 21 nt, Human
cagaaugcagcaaagaaccua

SEQ ID NO: 72794 - RNA, 24 nt, Human
cagaucacuugaggucaggaguuu

SEQ ID NO: 72795 - RNA, 27 nt, Human
cagaucacuugaggucaggaguuuuag

SEQ ID NO: 72796 - RNA, 24 nt, Human
cagcaaagaaccuaaaggugucuu

SEQ ID NO: 72797 - RNA, 24 nt, Human
cagcacuuugggaggcugaggugg

SEQ ID NO: 72798 - RNA, 19 nt, Human
cagcucuuucuuaaagggg

SEQ ID NO: 72799 - RNA, 24 nt, Human
caugccuguaaucucagcacuuug

SEQ ID NO: 72800 - RNA, 19 nt, Human
caugguccuagagaggcag

SEQ ID NO: 72801 - RNA, 20 nt, Human
ccacugcacuccagccuggg

SEQ ID NO: 72802 - RNA, 20 nt, Human
ccacugcacuccagccuggg

SEQ ID NO: 72803 - RNA, 20 nt, Human
ccacugcacuccagccuggg

SEQ ID NO: 72804 - RNA, 21 nt, Human
ccacugcacuccagccugggu

SEQ ID NO: 72805 - RNA, 21 nt, Human
ccacugcacuccagccugggu

SEQ ID NO: 72806 - RNA, 23 nt, Human
ccacugcacuccagccuggguga

SEQ ID NO: 72807 - RNA, 23 nt, Human
ccacugcacuccagccuggguga

SEQ ID NO: 72808 - RNA, 24 nt, Human
ccacugcacuccagccugggugac

SEQ ID NO: 72809 - RNA, 25 nt, Human
ccacugcacuccagccugggugaca

SEQ ID NO: 72810 - RNA, 26 nt, Human
ccagcagccgccuucucagcaccccu

SEQ ID NO: 72811 - RNA, 21 nt, Human
ccaggccagagccaggggccc

SEQ ID NO: 72812 - RNA, 19 nt, Human
ccaggggccaccuggacaa

SEQ ID NO: 72813 - RNA, 21 nt, Human
ccagugaggccgugucucucu

SEQ ID NO: 72814 - RNA, 23 nt, Human
cccacaguuggggaggaggaagc

SEQ ID NO: 72815 - RNA, 22 nt, Human
cccaccaggccagagccagggg

SEQ ID NO: 72816 - RNA, 23 nt, Human
ccccagcuccaggcuccccggau

SEQ ID NO: 72817 - RNA, 22 nt, Human
ccccaguggcagugcuuagcuu

SEQ ID NO: 72818 - RNA, 23 nt, Human
ccccuggcucccccuuugccucc

SEQ ID NO: 72819 - RNA, 21 nt, Human
cccggcccuccccccagcucc

SEQ ID NO: 72820 - RNA, 21 nt, Human
ccucagaaguugcugggcucc

SEQ ID NO: 72821 - RNA, 18 nt, Human
ccuccuucccucacuccc

SEQ ID NO: 72822 - RNA, 22 nt, Human
ccuccuucccucacucccagac

SEQ ID NO: 72823 - RNA, 26 nt, Human
ccucugggcucugugucugguaaaca

SEQ ID NO: 72824 - RNA, 23 nt, Human
ccugagagggaguaccaggugga

SEQ ID NO: 72825 - RNA, 22 nt, Human
ccuggccaacauggugaaaccc

SEQ ID NO: 72826 - RNA, 24 nt, Human
ccuggccaacauggugaaacccug

SEQ ID NO: 72827 - RNA, 21 nt, Human
ccuggcucccccuuugccucc

SEQ ID NO: 72828 - RNA, 20 nt, Human
ccugggugacacagugagac

SEQ ID NO: 72829 - RNA, 22 nt, Human
ccugggugacacagugagacuc

SEQ ID NO: 72830 - RNA, 21 nt, Human
ccuguaaucccagcuacuugg

SEQ ID NO: 72831 - RNA, 20 nt, Human
ccuguaaucucagcacuuug

SEQ ID NO: 72832 - RNA, 22 nt, Human
ccuguaaucucagcacuuuggg

SEQ ID NO: 72833 - RNA, 24 nt, Human
ccuuuagaaucuuagaaacuuaga

SEQ ID NO: 72834 - RNA, 22 nt, Human
cgcaaaaaaaaaaaaaaaaaaa

SEQ ID NO: 72835 - RNA, 22 nt, Human
cggcaggggaggcccuugccac

SEQ ID NO: 72836 - RNA, 19 nt, Human
cggcccuccccccagcucc

SEQ ID NO: 72837 - RNA, 24 nt, Human
cgggggagggggcagggccgggcu

SEQ ID NO: 72838 - RNA, 19 nt, Human
cgguaggugaagguugcag

SEQ ID NO: 72839 - RNA, 19 nt, Human
cuacugcacagagaagggg

SEQ ID NO: 72840 - RNA, 21 nt, Human
cuagagaggcagaaugcagca

SEQ ID NO: 72841 - RNA, 21 nt, Human
cuagagucuuggaauguuaac

SEQ ID NO: 72842 - RNA, 24 nt, Human
cucaugccuguaaucucagcacuu

SEQ ID NO: 72843 - RNA, 18 nt, Human
cuccccccagcuccaggc

SEQ ID NO: 72844 - RNA, 18 nt, Human
cuccgccccuggcucccc

SEQ ID NO: 72845 - RNA, 24 nt, Human
cucuaucgcaaaaaaaaaaaaaaa

SEQ ID NO: 72846 - RNA, 27 nt, Human
cucuaucgcaaaaaaaaaaaaaaaaaa

SEQ ID NO: 72847 - RNA, 19 nt, Human
cugaucuagaaucuuagac

SEQ ID NO: 72848 - RNA, 21 nt, Human
cugaucuagaaucuuagacac

SEQ ID NO: 72849 - RNA, 27 nt, Human
cuggcacagcggcaggggaggcccuuu

SEQ ID NO: 72850 - RNA, 24 nt, Human
cuggccaacauggugaaacccugu

SEQ ID NO: 72851 - RNA, 21 nt, Human
cugggcgcugucccucugggc

SEQ ID NO: 72852 - RNA, 25 nt, Human
cugggcucugggcgcugucccucug

SEQ ID NO: 72853 - RNA, 23 nt, Human
cugggugacacagugagacucua

SEQ ID NO: 72854 - RNA, 21 nt, Human
cuguaaucccagcuacuuggg

SEQ ID NO: 72855 - RNA, 21 nt, Human
cuuagaacaccggaccuuaga

SEQ ID NO: 72856 - RNA, 21 nt, Human
cuuucuuaaaggggccaggga

SEQ ID NO: 72857 - RNA, 23 nt, Human
cuuugggaggcugaggugggcag

SEQ ID NO: 72858 - RNA, 19 nt, Human
gaaacccugucucuacuaa

SEQ ID NO: 72859 - RNA, 22 nt, Human
gaaccagaaaaucuaaaaccac

SEQ ID NO: 72860 - RNA, 22 nt, Human
gaagguugcagugaggcgagau

SEQ ID NO: 72861 - RNA, 24 nt, Human
gaagguugcagugaggcgagauug

SEQ ID NO: 72862 - RNA, 23 nt, Human
gagauugcaccacugcacuccag

SEQ ID NO: 72863 - RNA, 21 nt, Human
gaggcagaaugcagcaaagaa

SEQ ID NO: 72864 - RNA, 23 nt, Human
gaggugggcagaucacuugaggu

SEQ ID NO: 72865 - RNA, 24 nt, Human
gaucacuugaggucaggaguuuua

SEQ ID NO: 72866 - RNA, 24 nt, Human
gaucacuugaggucaggaguuuua

SEQ ID NO: 72867 - RNA, 25 nt, Human
gaucacuugaggucaggaguuuuag

SEQ ID NO: 72868 - RNA, 25 nt, Human
gaucacuugaggucaggaguuuuag

SEQ ID NO: 72869 - RNA, 20 nt, Human
gcaaaaaaaaaaaaaaaaaa

SEQ ID NO: 72870 - RNA, 18 nt, Human
gcaacauggcccgaaagg

SEQ ID NO: 72871 - RNA, 23 nt, Human
gcaggaaaaucacuugaacucgg

SEQ ID NO: 72872 - RNA, 24 nt, Human
gccaacauggugaaacccugucuc

SEQ ID NO: 72873 - RNA, 22 nt, Human
gcccaccaggccagagccaggg

SEQ ID NO: 72874 - RNA, 22 nt, Human
ggaccugucugggauggaggug

SEQ ID NO: 72875 - RNA, 23 nt, Human
ggagggagcugaggagggggaag

SEQ ID NO: 72876 - RNA, 21 nt, Human
ggcacacaccuguaaucccag

SEQ ID NO: 72877 - RNA, 25 nt, Human
ggcagaucacuugaggucaggaguu

SEQ ID NO: 72878 - RNA, 18 nt, Human
ggcccuccccccagcucc

SEQ ID NO: 72879 - RNA, 22 nt, Human
ggcccuugccaccggcucugcc

SEQ ID NO: 72880 - RNA, 23 nt, Human
gggaaaggaggcaucccuaaugc

SEQ ID NO: 72881 - RNA, 20 nt, Human
gggaaggggacccuggugcu

SEQ ID NO: 72882 - RNA, 26 nt, Human
gggcagaucacuugaggucaggaguu

SEQ ID NO: 72883 - RNA, 18 nt, Human
ggggaggaggaagcaaug

SEQ ID NO: 72884 - RNA, 19 nt, Human
ggggcaacauggcccgaaa

SEQ ID NO: 72885 - RNA, 21 nt, Human
ggggcaacauggcccgaaagg

SEQ ID NO: 72886 - RNA, 18 nt, Human
gggggagggggcagggcc

SEQ ID NO: 72887 - RNA, 23 nt, Human
ggugugguggcacacaccuguaa

SEQ ID NO: 72888 - RNA, 18 nt, Human
gguugagugcaguggcuc

SEQ ID NO: 72889 - RNA, 20 nt, Human
guaaacauuccuccagaacu

SEQ ID NO: 72890 - RNA, 23 nt, Human
guaaacauuccuccagaacucca

SEQ ID NO: 72891 - RNA, 24 nt, Human
guaaacauuccuccagaacuccac

SEQ ID NO: 72892 - RNA, 21 nt, Human
gugaaacccugucucuacuaa

SEQ ID NO: 72893 - RNA, 22 nt, Human
guggaguuuuccccaguggcag

SEQ ID NO: 72894 - RNA, 20 nt, Human
guggggugggaaagugggaa

SEQ ID NO: 72895 - RNA, 23 nt, Human
uaaggcguggggugggaaagugg

SEQ ID NO: 72896 - RNA, 24 nt, Human
uaagguugagugcaguggcucaug

SEQ ID NO: 72897 - RNA, 19 nt, Human
uacaguauaggguuagaac

SEQ ID NO: 72898 - RNA, 18 nt, Human
uacugcuuucaaggugau

SEQ ID NO: 72899 - RNA, 19 nt, Human
uagaaacuccaucuuuaga

SEQ ID NO: 72900 - RNA, 19 nt, Human
uagaaccuugaaauugcac

SEQ ID NO: 72901 - RNA, 23 nt, Human
uagaacuacagugccuagaacua

SEQ ID NO: 72902 - RNA, 24 nt, Human
uagaauccuaggccuuagaaccuc

SEQ ID NO: 72903 - RNA, 21 nt, Human
uagaaucuuggagcaucugau

SEQ ID NO: 72904 - RNA, 19 nt, Human
uagaccagccuggccaaca

SEQ ID NO: 72905 - RNA, 19 nt, Human
uagccgggugugguggcac

SEQ ID NO: 72906 - RNA, 22 nt, Human
uagcuaagaaggagaggggcac

SEQ ID NO: 72907 - RNA, 22 nt, Human
uagcuccuaaaaucagaaucuu

SEQ ID NO: 72908 - RNA, 18 nt, Human
uagguaggaagacagggc

SEQ ID NO: 72909 - RNA, 18 nt, Human
uauaagauuuuagaaaug

SEQ ID NO: 72910 - RNA, 21 nt, Human
uauacaagagaaucuauuauc

SEQ ID NO: 72911 - RNA, 19 nt, Human
uaucauaaagccucagaaa

SEQ ID NO: 72912 - RNA, 21 nt, Human
ucagguccuuagaaccaaaga

SEQ ID NO: 72913 - RNA, 19 nt, Human
uccaaccccuuccuuuuac

SEQ ID NO: 72914 - RNA, 23 nt, Human
uccagccugggugacacagugag

SEQ ID NO: 72915 - RNA, 24 nt, Human
uccagccugggugacacagugaga

SEQ ID NO: 72916 - RNA, 20 nt, Human
uccccccagcuccaggcucc

SEQ ID NO: 72917 - RNA, 19 nt, Human
uccuuagaaccaaagacuc

SEQ ID NO: 72918 - RNA, 18 nt, Human
uccuucccucacucccag

SEQ ID NO: 72919 - RNA, 21 nt, Human
ucuccgccccuggcucccccu

SEQ ID NO: 72920 - RNA, 21 nt, Human
ucucuacuaaaaauauaaaaa

SEQ ID NO: 72921 - RNA, 23 nt, Human
ucucuacuaaaaauauaaaaauu

SEQ ID NO: 72922 - RNA, 18 nt, Human
ucuuagaacaccggaccu

SEQ ID NO: 72923 - RNA, 23 nt, Human
ucuuggaccaauggaaucuagag

SEQ ID NO: 72924 - RNA, 20 nt, Human
ugaaacagaacagaccguua

SEQ ID NO: 72925 - RNA, 22 nt, Human
ugaccugagccccucuggaggc

SEQ ID NO: 72926 - RNA, 21 nt, Human
ugaggagggggaaggggaccc

SEQ ID NO: 72927 - RNA, 24 nt, Human
ugaggagggggaaggggacccugg

SEQ ID NO: 72928 - RNA, 24 nt, Human
ugaggugggcagaucacuugaggu

SEQ ID NO: 72929 - RNA, 26 nt, Human
ugaggugggcagaucacuugagguca

SEQ ID NO: 72930 - RNA, 18 nt, Human
ugcaaguggggauaaggc

SEQ ID NO: 72931 - RNA, 22 nt, Human
ugcacaggcuugaagggggcac

SEQ ID NO: 72932 - RNA, 23 nt, Human
ugcacaggcuugaagggggcaca

SEQ ID NO: 72933 - RNA, 21 nt, Human
ugcaccacugcacuccagccu

SEQ ID NO: 72934 - RNA, 21 nt, Human
ugccugccuggcacagcggca

SEQ ID NO: 72935 - RNA, 23 nt, Human
ugccuguaaucucagcacuuugg

SEQ ID NO: 72936 - RNA, 23 nt, Human
ugccuguaaucucagcacuuugg

SEQ ID NO: 72937 - RNA, 24 nt, Human
ugccuguaaucucagcacuuuggg

SEQ ID NO: 72938 - RNA, 22 nt, Human
uggcacacaccuguaaucccag

SEQ ID NO: 72939 - RNA, 18 nt, Human
uggcacugccugccuggc

SEQ ID NO: 72940 - RNA, 23 nt, Human
uggcagugcuuagcuuggauccu

SEQ ID NO: 72941 - RNA, 24 nt, Human
uggccaacauggugaaacccuguc

SEQ ID NO: 72942 - RNA, 24 nt, Human
uggcucaugccuguaaucucagca

SEQ ID NO: 72943 - RNA, 24 nt, Human
ugggaggccaaggcaggaaaauca

SEQ ID NO: 72944 - RNA, 19 nt, Human
ugggaggcugaggugggca

SEQ ID NO: 72945 - RNA, 20 nt, Human
ugggaggcugaggugggcag

SEQ ID NO: 72946 - RNA, 24 nt, Human
ugggaggcugaggugggcagauca

SEQ ID NO: 72947 - RNA, 19 nt, Human
ugggauggaggugggauag

SEQ ID NO: 72948 - RNA, 24 nt, Human
ugggauggaggugggauagguagg

SEQ ID NO: 72949 - RNA, 24 nt, Human
ugggcagaucacuugaggucagga

SEQ ID NO: 72950 - RNA, 20 nt, Human
uggggaggaggaagcaauga

SEQ ID NO: 72951 - RNA, 23 nt, Human
ugguggcacacaccuguaauccc

SEQ ID NO: 72952 - RNA, 24 nt, Human
ugguggcacacaccuguaauccca

SEQ ID NO: 72953 - RNA, 24 nt, Human
uguccccggcccuccccccagcuc

SEQ ID NO: 72954 - RNA, 18 nt, Human
ugucugggauggaggugg

SEQ ID NO: 72955 - RNA, 27 nt, Human
uuaaucaucuagaaucuuggagcauug

SEQ ID NO: 72956 - RNA, 28 nt, Human
uuaaucaucuagaaucuuggagcauugu

SEQ ID NO: 72957 - RNA, 23 nt, Human
uuagaacaccggaccuuagaaac

SEQ ID NO: 72958 - RNA, 23 nt, Human
uuagaaccagaaaaucuaaaacc

SEQ ID NO: 72959 - RNA, 18 nt, Human
uuagccgggugugguggc

SEQ ID NO: 72960 - RNA, 20 nt, Human
uuagccgggugugguggcac

SEQ ID NO: 72961 - RNA, 23 nt, Human
uuagucacaacugagugugagag

SEQ ID NO: 72962 - RNA, 23 nt, Human
uuauacaagagaaucuauuauca

SEQ ID NO: 72963 - RNA, 23 nt, Human
uugcaccacugcacuccagccug

SEQ ID NO: 72964 - RNA, 22 nt, Human
uugcagugaggcgagauugcac

SEQ ID NO: 72965 - RNA, 25 nt, Human
uugggaggcugaggugggcagauca

SEQ ID NO: 72966 - RNA, 18 nt, Human
uuuuaaggacucugaacu

SEQ ID NO: 72967 - RNA, 22 nt, Human
uuuuacagauggugaugcuacu

SEQ ID NO: 72968 - RNA, 18 nt, Human
aaacccucaggagccacc

SEQ ID NO: 72969 - RNA, 20 nt, Human
aaagcccaggcagggcaagg

SEQ ID NO: 72970 - RNA, 18 nt, Human
aaagccuccucaaucucc

SEQ ID NO: 72971 - RNA, 18 nt, Human
aaauaaauuauggaaaua

SEQ ID NO: 72972 - RNA, 23 nt, Human
aagaccgaaaaguggucugccaa

SEQ ID NO: 72973 - RNA, 24 nt, Human
aaggcuguggccuuugggaagggg

SEQ ID NO: 72974 - RNA, 26 nt, Human
acacaggcuggcaaggccuccugggc

SEQ ID NO: 72975 - RNA, 24 nt, Human
acaggcuggcaaggccuccugggc

SEQ ID NO: 72976 - RNA, 22 nt, Human
acccaccagccaaagaagugca

SEQ ID NO: 72977 - RNA, 23 nt, Human
accccuggcauuacccaccagcc

SEQ ID NO: 72978 - RNA, 18 nt, Human
acccucaggagccacccc

SEQ ID NO: 72979 - RNA, 24 nt, Human
agagggcaggaaguggagggggca

SEQ ID NO: 72980 - RNA, 24 nt, Human
agauagaagagcaagcugugggug

SEQ ID NO: 72981 - RNA, 19 nt, Human
agcccccucccccuagucc

SEQ ID NO: 72982 - RNA, 18 nt, Human
aggaaguggagggggcag

SEQ ID NO: 72983 - RNA, 21 nt, Human
aggcagcagacauagaucaca

SEQ ID NO: 72984 - RNA, 19 nt, Human
aggcagggcaagguguagg

SEQ ID NO: 72985 - RNA, 23 nt, Human
agggcucaggguggcagaagcca

SEQ ID NO: 72986 - RNA, 18 nt, Human
aggguauaaaaacccuca

SEQ ID NO: 72987 - RNA, 24 nt, Human
agugcaaccaaagccuccucaauc

SEQ ID NO: 72988 - RNA, 21 nt, Human
caaagaagugcaaccaaagcc

SEQ ID NO: 72989 - RNA, 22 nt, Human
caagaaagcagcaacaggucuc

SEQ ID NO: 72990 - RNA, 22 nt, Human
caaggcaaaaggggcucuugag

SEQ ID NO: 72991 - RNA, 25 nt, Human
cacaguccaguggauuuagccaccc

SEQ ID NO: 72992 - RNA, 20 nt, Human
caccaaagcccaggcagggc

SEQ ID NO: 72993 - RNA, 21 nt, Human
caccagccaaagaagugcaac

SEQ ID NO: 72994 - RNA, 27 nt, Human
caccagccaaagaagugcaaccaaagc

SEQ ID NO: 72995 - RNA, 21 nt, Human
cagaagccaccugauuucagc

SEQ ID NO: 72996 - RNA, 21 nt, Human
cagacucuggggagccccaua

SEQ ID NO: 72997 - RNA, 21 nt, Human
cagagcucaaauccacaccua

SEQ ID NO: 72998 - RNA, 23 nt, Human
cagagcucaaauccacaccuagu

SEQ ID NO: 72999 - RNA, 24 nt, Human
cagcaacaggucucuuggggcugg

SEQ ID NO: 73000 - RNA, 20 nt, Human
cagcacagaaaaguuaaaac

SEQ ID NO: 73001 - RNA, 26 nt, Human
cagcacagaaaaguuaaaacaaauaa

SEQ ID NO: 73002 - RNA, 19 nt, Human
cagcggcggcggcggcggg

SEQ ID NO: 73003 - RNA, 19 nt, Human
caggagugugcacauggca

SEQ ID NO: 73004 - RNA, 24 nt, Human
ccaacuggccucagggcaugggca

SEQ ID NO: 73005 - RNA, 30 nt, Human
ccaccagccaaagaagugcaaccaaagcug

SEQ ID NO: 73006 - RNA, 23 nt, Human
cccaccagccaaagaagugcaac

SEQ ID NO: 73007 - RNA, 20 nt, Human
cccaggcucucccccugccu

SEQ ID NO: 73008 - RNA, 21 nt, Human
cccccuccuacaucccugggc

SEQ ID NO: 73009 - RNA, 22 nt, Human
cccccuccuacaucccugggcc

SEQ ID NO: 73010 - RNA, 19 nt, Human
ccccucgcucugcgcgucc

SEQ ID NO: 73011 - RNA, 18 nt, Human
cccgcgucccggccgggg

SEQ ID NO: 73012 - RNA, 19 nt, Human
ccgcgucccggccggggac

SEQ ID NO: 73013 - RNA, 21 nt, Human
ccggcagcggcggcggcggcg

SEQ ID NO: 73014 - RNA, 24 nt, Human
ccugcccgcagagccaucuaggag

SEQ ID NO: 73015 - RNA, 22 nt, Human
ccuguuuccuccuucccccucc

SEQ ID NO: 73016 - RNA, 26 nt, Human
cugaaaggggaagcccccucccccua

SEQ ID NO: 73017 - RNA, 23 nt, Human
gaagggggaagauggaacagagg

SEQ ID NO: 73018 - RNA, 21 nt, Human
gaagugcaaccaaagccuccu

SEQ ID NO: 73019 - RNA, 20 nt, Human
gaaguggagggggcagggug

SEQ ID NO: 73020 - RNA, 24 nt, Human
gagggcaggaaguggagggggcag

SEQ ID NO: 73021 - RNA, 28 nt, Human
gagggcaggaaguggagggggcagggug

SEQ ID NO: 73022 - RNA, 22 nt, Human
gccccucgcucugcgcguccgg

SEQ ID NO: 73023 - RNA, 19 nt, Human
gccuccugggcaaggggca

SEQ ID NO: 73024 - RNA, 26 nt, Human
gcgacccgcgucccggccggggacgc

SEQ ID NO: 73025 - RNA, 21 nt, Human
gcucuggggucuggggacaga

SEQ ID NO: 73026 - RNA, 22 nt, Human
gcucuggggucuggggacagac

SEQ ID NO: 73027 - RNA, 18 nt, Human
gcugaagugcagugccca

SEQ ID NO: 73028 - RNA, 18 nt, Human
ggagggggcagggugggg

SEQ ID NO: 73029 - RNA, 19 nt, Human
ggcagcggcggcggcggcg

SEQ ID NO: 73030 - RNA, 20 nt, Human
ggcagcggcggcggcggcgg

SEQ ID NO: 73031 - RNA, 23 nt, Human
ggcaggaaguggagggggcaggg

SEQ ID NO: 73032 - RNA, 19 nt, Human
ggcaggaaguggagggggg

SEQ ID NO: 73033 - RNA, 22 nt, Human
ggccugugcccaccccaccccu

SEQ ID NO: 73034 - RNA, 19 nt, Human
ggcggcggcggcgggagac

SEQ ID NO: 73035 - RNA, 21 nt, Human
ggcggcggcggcgggagacug

SEQ ID NO: 73036 - RNA, 19 nt, Human
gggcaagguguaggacuac

SEQ ID NO: 73037 - RNA, 22 nt, Human
ggggcaggguggggcagaaggg

SEQ ID NO: 73038 - RNA, 22 nt, Human
gggggaagauggaacagagggc

SEQ ID NO: 73039 - RNA, 20 nt, Human
gugcacauggcaccuguggg

SEQ ID NO: 73040 - RNA, 24 nt, Human
gugggugagccagccagugggaga

SEQ ID NO: 73041 - RNA, 20 nt, Human
uaagcucagguacaaggugu

SEQ ID NO: 73042 - RNA, 19 nt, Human
uauaguucugacacucagg

SEQ ID NO: 73043 - RNA, 23 nt, Human
ucagcccaggcucucccccugcc

SEQ ID NO: 73044 - RNA, 22 nt, Human
ucccugggccuggaauaaaggc

SEQ ID NO: 73045 - RNA, 22 nt, Human
uccugggcaaggggcaggccca

SEQ ID NO: 73046 - RNA, 19 nt, Human
ucuuggcacagacacagag

SEQ ID NO: 73047 - RNA, 19 nt, Human
ugcccagaaagcccugaga

SEQ ID NO: 73048 - RNA, 19 nt, Human
ugccggacgugcucugggg

SEQ ID NO: 73049 - RNA, 23 nt, Human
uggaauaaauuauaguucugaca

SEQ ID NO: 73050 - RNA, 20 nt, Human
uggcagaagccaccugauuu

SEQ ID NO: 73051 - RNA, 24 nt, Human
uggccagcaccugcccgcagagcc

SEQ ID NO: 73052 - RNA, 18 nt, Human
ugggaaaagacauccugg

SEQ ID NO: 73053 - RNA, 18 nt, Human
ugggaagggggaagaugg

SEQ ID NO: 73054 - RNA, 21 nt, Human
ugggccuggaauaaaggcugu

SEQ ID NO: 73055 - RNA, 18 nt, Human
ugggugagccagccagug

SEQ ID NO: 73056 - RNA, 21 nt, Human
uggguguggggggccgggcag

SEQ ID NO: 73057 - RNA, 24 nt, Human
uggucacagcuguucagcccaggc

SEQ ID NO: 73058 - RNA, 22 nt, Human
uggugccggacgugcucugggg

SEQ ID NO: 73059 - RNA, 19 nt, Human
ugugcacauggcaccugug

SEQ ID NO: 73060 - RNA, 19 nt, Human
uugcccucucugggcuucc

SEQ ID NO: 73061 - RNA, 19 nt, Human
uugguaccuguaagcucag

SEQ ID NO: 73062 - RNA, 20 nt, Human
uuucuuggcacagacacagg

SEQ ID NO: 73063 - RNA, 20 nt, Human
uuuuuuuuuaaaaauaaagc

SEQ ID NO: 73064 - RNA, 25 nt, Human
aaaaaaaaacaaaaaaacgcuuaag

SEQ ID NO: 73065 - RNA, 25 nt, Human
aaaaaaaaacaaaacaacaacaaaa

SEQ ID NO: 73066 - RNA, 24 nt, Human
aaaaaaaacaaaacaacaacaaaa

SEQ ID NO: 73067 - RNA, 21 nt, Human
aaaaagcugagaaauaagcac

SEQ ID NO: 73068 - RNA, 20 nt, Human
aaacaaaacaacaacaaaaa

SEQ ID NO: 73069 - RNA, 25 nt, Human
aaacaaaacaacaacaaaaaaaaaa

SEQ ID NO: 73070 - RNA, 19 nt, Human
aaguauucuccuaagccuc

SEQ ID NO: 73071 - RNA, 20 nt, Human
aaucuauauacacuuggaau

SEQ ID NO: 73072 - RNA, 24 nt, Human
acaaaacaacaacaaaaaaaaaac

SEQ ID NO: 73073 - RNA, 28 nt, Human
acaaaacaacaacaaaaaaaaaacaaaa

SEQ ID NO: 73074 - RNA, 30 nt, Human
acaaaacaacaacaaaaaaaaaacaaaaaa

SEQ ID NO: 73075 - RNA, 19 nt, Human
accggagcccguuccugac

SEQ ID NO: 73076 - RNA, 20 nt, Human
agaaagaaaaagcugagaaa

SEQ ID NO: 73077 - RNA, 20 nt, Human
agauaaaacaggggaacaug

SEQ ID NO: 73078 - RNA, 24 nt, Human
agcaaauacacuaaaaaaaaacaa

SEQ ID NO: 73079 - RNA, 22 nt, Human
agccaaagaugccccugcaagc

SEQ ID NO: 73080 - RNA, 21 nt, Human
aggcaagcagugagaagaggc

SEQ ID NO: 73081 - RNA, 19 nt, Human
aggcggcugccacgugaug

SEQ ID NO: 73082 - RNA, 26 nt, Human
auacagaaccauuucccugcugcucu

SEQ ID NO: 73083 - RNA, 21 nt, Human
auagaacuuacaaaaagcacu

SEQ ID NO: 73084 - RNA, 25 nt, Human
augaacuuaagaaagaaaaagcuga

SEQ ID NO: 73085 - RNA, 25 nt, Human
caaaacaacaacaaaaaaaaaacaa

SEQ ID NO: 73086 - RNA, 22 nt, Human
caacaaaaaaaaaacaaaaaaa

SEQ ID NO: 73087 - RNA, 28 nt, Human
caacaacaaaaaaaaaacaaaaaaacgc

SEQ ID NO: 73088 - RNA, 25 nt, Human
cacuaaaaaaaaacaaaacaacaac

SEQ ID NO: 73089 - RNA, 24 nt, Human
cagcccugaauuccuuugcuuccc

SEQ ID NO: 73090 - RNA, 25 nt, Human
cagugagauaaaacaggggaacagu

SEQ ID NO: 73091 - RNA, 21 nt, Human
cccacgccaugcugagguguu

SEQ ID NO: 73092 - RNA, 23 nt, Human
ccccuccuucuucccucaugcca

SEQ ID NO: 73093 - RNA, 22 nt, Human
cccucuuucccauuacaauccc

SEQ ID NO: 73094 - RNA, 20 nt, Human
ccucuuucccauuacaaucc

SEQ ID NO: 73095 - RNA, 20 nt, Human
ccuucuccuugcugugauuu

SEQ ID NO: 73096 - RNA, 21 nt, Human
ccuugcugugauuuccccucc

SEQ ID NO: 73097 - RNA, 21 nt, Human
cucccagcacccucuuuccca

SEQ ID NO: 73098 - RNA, 19 nt, Human
cuggggaaaguuaccuaau

SEQ ID NO: 73099 - RNA, 27 nt, Human
cuugcugugauuuccccuccuucuucc

SEQ ID NO: 73100 - RNA, 24 nt, Human
gaauuccagcuccacuguuuacug

SEQ ID NO: 73101 - RNA, 19 nt, Human
gaguauuaaaaauaaaagc

SEQ ID NO: 73102 - RNA, 20 nt, Human
gaugaucuugaaagcaauga

SEQ ID NO: 73103 - RNA, 21 nt, Human
gcacucauacagaaccauuuc

SEQ ID NO: 73104 - RNA, 19 nt, Human
ggggaggaaaugaaauaag

SEQ ID NO: 73105 - RNA, 21 nt, Human
ggguaguagccaaaugugaug

SEQ ID NO: 73106 - RNA, 20 nt, Human
uaaaacaggggaacaugaug

SEQ ID NO: 73107 - RNA, 23 nt, Human
uaaauagaacuuacaaaaagcac

SEQ ID NO: 73108 - RNA, 22 nt, Human
uaacaaguauucuccuaagccu

SEQ ID NO: 73109 - RNA, 21 nt, Human
uaacuaggauugaucaccaaa

SEQ ID NO: 73110 - RNA, 24 nt, Human
uaagugaaagcagucuagaauuuu

SEQ ID NO: 73111 - RNA, 23 nt, Human
uacacuaaaaaaaaacaaaacaa

SEQ ID NO: 73112 - RNA, 22 nt, Human
uagcaaauacacuaaaaaaaaa

SEQ ID NO: 73113 - RNA, 19 nt, Human
uagccaaaugugaugacuc

SEQ ID NO: 73114 - RNA, 23 nt, Human
uaucaauagcaaauacacuaaaa

SEQ ID NO: 73115 - RNA, 25 nt, Human
uaucaugagccugaggauuuucaac

SEQ ID NO: 73116 - RNA, 21 nt, Human
uauuuuugccuuugauugcuc

SEQ ID NO: 73117 - RNA, 20 nt, Human
ucucccagcacccucuuucc

SEQ ID NO: 73118 - RNA, 22 nt, Human
ugaauuguaagcacucgguguu

SEQ ID NO: 73119 - RNA, 24 nt, Human
ugccuuugauugcucucccagcac

SEQ ID NO: 73120 - RNA, 25 nt, Human
uggccaacuuuaaauaaaucuuggc

SEQ ID NO: 73121 - RNA, 20 nt, Human
uggggaggaaaugaaauaag

SEQ ID NO: 73122 - RNA, 18 nt, Human
uugauugcucucccagca

SEQ ID NO: 73123 - RNA, 18 nt, Human
aaaaagcaagcaagcaga

SEQ ID NO: 73124 - RNA, 18 nt, Human
aaccagauuaaccacaac

SEQ ID NO: 73125 - RNA, 22 nt, Human
aaguugccagcccuccuagagc

SEQ ID NO: 73126 - RNA, 23 nt, Human
acaaaaauaaaccagauuaacca

SEQ ID NO: 73127 - RNA, 24 nt, Human
accacaaccaugccuuacuuuauc

SEQ ID NO: 73128 - RNA, 22 nt, Human
agcaagcaagcagaauuuggaa

SEQ ID NO: 73129 - RNA, 18 nt, Human
aucaaauguauaagaagu

SEQ ID NO: 73130 - RNA, 21 nt, Human
caaaugcggcaucuucaaacc

SEQ ID NO: 73131 - RNA, 20 nt, Human
caauauuaaaaagcaagcaa

SEQ ID NO: 73132 - RNA, 21 nt, Human
caccucuaaguugccagcccu

SEQ ID NO: 73133 - RNA, 26 nt, Human
ccaauaauccugucaauuauauuucu

SEQ ID NO: 73134 - RNA, 23 nt, Human
ccaauccaaaugcggcaucuuca

SEQ ID NO: 73135 - RNA, 22 nt, Human
ccaccucuaaguugccagcccu

SEQ ID NO: 73136 - RNA, 21 nt, Human
ccagcccuccuagagcuaccu

SEQ ID NO: 73137 - RNA, 19 nt, Human
cccccaaauucuaagcaga

SEQ ID NO: 73138 - RNA, 18 nt, Human
ccucuaaguugccagccc

SEQ ID NO: 73139 - RNA, 21 nt, Human
cucaaaguagaauuauaaaga

SEQ ID NO: 73140 - RNA, 20 nt, Human
cucugcuccccaccucuaag

SEQ ID NO: 73141 - RNA, 24 nt, Human
cuuaacuaucuuaacaagcuuuga

SEQ ID NO: 73142 - RNA, 22 nt, Human
gagaauucucugcuccccaccu

SEQ ID NO: 73143 - RNA, 20 nt, Human
uaaaaagcaagcaagcagaa

SEQ ID NO: 73144 - RNA, 28 nt, Human
uaaaccagauuaaccacaaccaugccuu

SEQ ID NO: 73145 - RNA, 22 nt, Human
uaacuuaugcacgcuuaacuau

SEQ ID NO: 73146 - RNA, 22 nt, Human
uaagaaguaaauaugaaucuua

SEQ ID NO: 73147 - RNA, 24 nt, Human
ucaaaguagaauuauaaagaagau

SEQ ID NO: 73148 - RNA, 19 nt, Human
uccaauccaaaugcggcau

SEQ ID NO: 73149 - RNA, 20 nt, Human
ugagugcaagagauugaaga

SEQ ID NO: 73150 - RNA, 24 nt, Human
ugagugcaagagauugaagaguuc

SEQ ID NO: 73151 - RNA, 25 nt, Human
ugcucagauacaucaaacauggagg

SEQ ID NO: 73152 - RNA, 22 nt, Human
uucuaaauuuucccccaaauuc

SEQ ID NO: 73153 - RNA, 20 nt, Human
aaaaauguuuucuucuccuu

SEQ ID NO: 73154 - RNA, 22 nt, Human
aaaagaaaguauuaauaaaaga

SEQ ID NO: 73155 - RNA, 28 nt, Human
aaagaauaggauuuaccucucuucuuuc

SEQ ID NO: 73156 - RNA, 18 nt, Human
aacagaagacuugaacca

SEQ ID NO: 73157 - RNA, 18 nt, Human
aacugcaccugcacucuu

SEQ ID NO: 73158 - RNA, 20 nt, Human
aacugcauugaugaaacauc

SEQ ID NO: 73159 - RNA, 24 nt, Human
aagaaagaaauaggugccauaaaa

SEQ ID NO: 73160 - RNA, 20 nt, Human
aaugaaggaucuuuugacug

SEQ ID NO: 73161 - RNA, 21 nt, Human
acagaagacuugaaccauuga

SEQ ID NO: 73162 - RNA, 20 nt, Human
acagaaucuccuuauacagu

SEQ ID NO: 73163 - RNA, 22 nt, Human
acccuaaaauaggucaaaaaau

SEQ ID NO: 73164 - RNA, 22 nt, Human
aggauuaugcccacugaaaaua

SEQ ID NO: 73165 - RNA, 19 nt, Human
auacuuuuggcacgccauc

SEQ ID NO: 73166 - RNA, 24 nt, Human
auggguccuagucuucugaaauuu

SEQ ID NO: 73167 - RNA, 23 nt, Human
auucuuuggcaaucauuuucuaa

SEQ ID NO: 73168 - RNA, 25 nt, Human
ccacugaaaauacuuuuggcacgcc

SEQ ID NO: 73169 - RNA, 19 nt, Human
ccagagcuaaaauguagug

SEQ ID NO: 73170 - RNA, 20 nt, Human
cccuaaaauaggucaaaaaa

SEQ ID NO: 73171 - RNA, 21 nt, Human
cgcacaucccccaacagucug

SEQ ID NO: 73172 - RNA, 22 nt, Human
cuucaguuguauuggaaaagaa

SEQ ID NO: 73173 - RNA, 21 nt, Human
cuugaaccauugauuuaugca

SEQ ID NO: 73174 - RNA, 22 nt, Human
cuugaauuucuuuaugugauga

SEQ ID NO: 73175 - RNA, 26 nt, Human
cuuguagucauucuccuuggucaggc

SEQ ID NO: 73176 - RNA, 23 nt, Human
gcagauacauuuuauuggccccc

SEQ ID NO: 73177 - RNA, 21 nt, Human
guaaagcagccagagcuaaaa

SEQ ID NO: 73178 - RNA, 24 nt, Human
uaaaaaguaaauacuuucgugaga

SEQ ID NO: 73179 - RNA, 20 nt, Human
uaaaauguagugcuucaguu

SEQ ID NO: 73180 - RNA, 19 nt, Human
uaacacugagcugcaaugu

SEQ ID NO: 73181 - RNA, 20 nt, Human
uacacagaaucuccuuauac

SEQ ID NO: 73182 - RNA, 22 nt, Human
uacacagaaucuccuuauacag

SEQ ID NO: 73183 - RNA, 21 nt, Human
uaccucucuucuuucguuguu

SEQ ID NO: 73184 - RNA, 20 nt, Human
uagaacccuaaaauagguca

SEQ ID NO: 73185 - RNA, 22 nt, Human
uagaacccuaaaauaggucaaa

SEQ ID NO: 73186 - RNA, 24 nt, Human
uauacaguuuuuuaaauagauugu

SEQ ID NO: 73187 - RNA, 23 nt, Human
uauuucuacuaauaacacugagc

SEQ ID NO: 73188 - RNA, 20 nt, Human
ucaaaaaauuuauccuuugc

SEQ ID NO: 73189 - RNA, 21 nt, Human
ucaguuauuuuuaaaaaguaa

SEQ ID NO: 73190 - RNA, 22 nt, Human
ucauugaaauaggaguuugguu

SEQ ID NO: 73191 - RNA, 19 nt, Human
uccaguagugguauaugag

SEQ ID NO: 73192 - RNA, 19 nt, Human
uccaucugucugcuugucu

SEQ ID NO: 73193 - RNA, 22 nt, Human
ucccucccaaaaagguuuuuaa

SEQ ID NO: 73194 - RNA, 22 nt, Human
uccuuugcacaauuaaaaaguu

SEQ ID NO: 73195 - RNA, 22 nt, Human
ucuaaaaugaaggaucuuuuga

SEQ ID NO: 73196 - RNA, 26 nt, Human
ucugaaauuuucccuuucuuucauau

SEQ ID NO: 73197 - RNA, 21 nt, Human
ucuucccgacaguugaugcau

SEQ ID NO: 73198 - RNA, 23 nt, Human
ucuugaauuucuuuaugugauga

SEQ ID NO: 73199 - RNA, 25 nt, Human
ugaaaagcuuaaucuaaaaugaagg

SEQ ID NO: 73200 - RNA, 23 nt, Human
ugaaaauacuuuuggcacgccau

SEQ ID NO: 73201 - RNA, 24 nt, Human
ugaugaguuuuaacuaaaacuugu

SEQ ID NO: 73202 - RNA, 19 nt, Human
ugcaauguaaagcagccag

SEQ ID NO: 73203 - RNA, 19 nt, Human
ugcuucaguuguauuggaa

SEQ ID NO: 73204 - RNA, 23 nt, Human
uggaauaacucaacuaaaucuua

SEQ ID NO: 73205 - RNA, 21 nt, Human
uggcacgccaucacuucagca

SEQ ID NO: 73206 - RNA, 22 nt, Human
uggcacgccaucacuucagcaa

SEQ ID NO: 73207 - RNA, 19 nt, Human
uguaaagcagccagagcua

SEQ ID NO: 73208 - RNA, 18 nt, Human
ugucaaacguuuguaguu

SEQ ID NO: 73209 - RNA, 18 nt, Human
uguguacaccugcuguca

SEQ ID NO: 73210 - RNA, 19 nt, Human
uuaaauuauauauuaaaau

SEQ ID NO: 73211 - RNA, 19 nt, Human
uucguuguugccuggcagc

SEQ ID NO: 73212 - RNA, 24 nt, Human
uucucgucucaguauccauauuuc

SEQ ID NO: 73213 - RNA, 21 nt, Human
uugaagcuuuuuacaucugcu

SEQ ID NO: 73214 - RNA, 22 nt, Human
uugaaugaaacugcaccugcac

SEQ ID NO: 73215 - RNA, 21 nt, Human
uugagccugagacacauuagu

SEQ ID NO: 73216 - RNA, 22 nt, Human
uuguagucauucuccuugguca

SEQ ID NO: 73217 - RNA, 20 nt, Human
uuguauacauuguucauccu

SEQ ID NO: 73218 - RNA, 24 nt, Human
uuuagaacccuaaaauaggucaaa

SEQ ID NO: 73219 - RNA, 24 nt, Human
uuuucaacaguacauccuauuugu

SEQ ID NO: 73220 - RNA, 25 nt, Human
aaacagaaaaaaagacaugguuugg

SEQ ID NO: 73221 - RNA, 25 nt, Human
aaacagaaaaaaagacaugguuugg

SEQ ID NO: 73222 - RNA, 24 nt, Human
aaacucuaaaaagaaaacugcaua

SEQ ID NO: 73223 - RNA, 19 nt, Human
aaaguauccuguccuucua

SEQ ID NO: 73224 - RNA, 21 nt, Human
aaaucacaaguguaacccucc

SEQ ID NO: 73225 - RNA, 18 nt, Human
aacaggucaaccgggucc

SEQ ID NO: 73226 - RNA, 18 nt, Human
aacaggucaaccgggucc

SEQ ID NO: 73227 - RNA, 18 nt, Human
aacaggucaaccgggucc

SEQ ID NO: 73228 - RNA, 25 nt, Human
aacuacucugaaaacagaaaaaaag

SEQ ID NO: 73229 - RNA, 25 nt, Human
aacuacucugaaaacagaaaaaaag

SEQ ID NO: 73230 - RNA, 24 nt, Human
aacuacucugaaacagaaaaaaag

SEQ ID NO: 73231 - RNA, 20 nt, Human
aagaaaacugcauaaaccca

SEQ ID NO: 73232 - RNA, 20 nt, Human
aagaaauucuagucuacaga

SEQ ID NO: 73233 - RNA, 21 nt, Human
aagaacgugacuccuauaugg

SEQ ID NO: 73234 - RNA, 20 nt, Human
aagauauacacaaaaccuuc

SEQ ID NO: 73235 - RNA, 21 nt, Human
aaggaaaaaacacagggcaga

SEQ ID NO: 73236 - RNA, 25 nt, Human
aaggaaaaaacacagggcagauuaa

SEQ ID NO: 73237 - RNA, 24 nt, Human
acaauacuucagauuuucuugcuu

SEQ ID NO: 73238 - RNA, 20 nt, Human
acacaaaccggugucauuua

SEQ ID NO: 73239 - RNA, 19 nt, Human
acaccagcaucuccacaga

SEQ ID NO: 73240 - RNA, 21 nt, Human
acgcagccaccuccuaaacgc

SEQ ID NO: 73241 - RNA, 21 nt, Human
acgcagccaccuccuaaacgc

SEQ ID NO: 73242 - RNA, 20 nt, Human
agaaaaaaagacaugguuug

SEQ ID NO: 73243 - RNA, 21 nt, Human
agaaaaaaagacaugguuugg

SEQ ID NO: 73244 - RNA, 22 nt, Human
agaaacucauaacagcagcagc

SEQ ID NO: 73245 - RNA, 20 nt, Human
agcagccagcgggaagagac

SEQ ID NO: 73246 - RNA, 20 nt, Human
aggaaaaaacacagggcaga

SEQ ID NO: 73247 - RNA, 20 nt, Human
aucacaaguguaacccucca

SEQ ID NO: 73248 - RNA, 19 nt, Human
caaaguauccuguccuucu

SEQ ID NO: 73249 - RNA, 27 nt, Human
caaauuaagugacuucuauaaacacuu

SEQ ID NO: 73250 - RNA, 21 nt, Human
caagaaaugauauaucaccac

SEQ ID NO: 73251 - RNA, 22 nt, Human
caaggagugcuccccuuugacc

SEQ ID NO: 73252 - RNA, 19 nt, Human
cacccagcucggaagcggg

SEQ ID NO: 73253 - RNA, 22 nt, Human
caccgaaaacacauuuucaaaa

SEQ ID NO: 73254 - RNA, 18 nt, Human
caccgcugcaaacgcccc

SEQ ID NO: 73255 - RNA, 18 nt, Human
cagcagcucagaagcacg

SEQ ID NO: 73256 - RNA, 18 nt, Human
cagcagcucagaagcacg

SEQ ID NO: 73257 - RNA, 18 nt, Human
cagcagcucagaagcacg

SEQ ID NO: 73258 - RNA, 18 nt, Human
cagcucagaagcacgcga

SEQ ID NO: 73259 - RNA, 18 nt, Human
cagcucagaagcacgcga

SEQ ID NO: 73260 - RNA, 18 nt, Human
cagcucagaagcacgcga

SEQ ID NO: 73261 - RNA, 21 nt, Human
caugguuuggcaauuucuucc

SEQ ID NO: 73262 - RNA, 21 nt, Human
caugguuuggcaauuucuucc

SEQ ID NO: 73263 - RNA, 24 nt, Human
ccaccuccuaaacgcaggcaaucu

SEQ ID NO: 73264 - RNA, 21 nt, Human
ccacuugcccuauauaaacuc

SEQ ID NO: 73265 - RNA, 23 nt, Human
cccacaacgcagccaccuccuaa

SEQ ID NO: 73266 - RNA, 23 nt, Human
cccacaacgcagccaccuccuaa

SEQ ID NO: 73267 - RNA, 21 nt, Human
ccuccagucuccagucugggu

SEQ ID NO: 73268 - RNA, 21 nt, Human
ccuguaauucagagaaaaaga

SEQ ID NO: 73269 - RNA, 23 nt, Human
ccuguaauucagagaaaaagaac

SEQ ID NO: 73270 - RNA, 22 nt, Human
ccugugcucggcgcgcacccag

SEQ ID NO: 73271 - RNA, 18 nt, Human
cgggaagagaccaacagg

SEQ ID NO: 73272 - RNA, 24 nt, Human
cuauaaacacuaggaacuguauuu

SEQ ID NO: 73273 - RNA, 20 nt, Human
cuccccaugaauuuuccaca

SEQ ID NO: 73274 - RNA, 21 nt, Human
cucucccuucuuuucugccuu

SEQ ID NO: 73275 - RNA, 21 nt, Human
gcagccuccccgcauccgcac

SEQ ID NO: 73276 - RNA, 21 nt, Human
gcauucuacauuauuccuaau

SEQ ID NO: 73277 - RNA, 18 nt, Human
ggagcuaagaaaacugug

SEQ ID NO: 73278 - RNA, 18 nt, Human
ggagcuaagaaaacugug

SEQ ID NO: 73279 - RNA, 18 nt, Human
ggagcuaagaaaacugug

SEQ ID NO: 73280 - RNA, 20 nt, Human
ggcaccgcugcaaacgcccc

SEQ ID NO: 73281 - RNA, 21 nt, Human
guaaaauuuuguucaguauaa

SEQ ID NO: 73282 - RNA, 21 nt, Human
gugaacuacucugaaacagaa

SEQ ID NO: 73283 - RNA, 22 nt, Human
uaaaacaucaugaggcaauaga

SEQ ID NO: 73284 - RNA, 21 nt, Human
uaaaagcacaaaauuuaaauc

SEQ ID NO: 73285 - RNA, 18 nt, Human
uaaacccaggaacagggg

SEQ ID NO: 73286 - RNA, 18 nt, Human
uaaacucuaaaaagaaaa

SEQ ID NO: 73287 - RNA, 26 nt, Human
uaaagaacgugacuccuauauggaag

SEQ ID NO: 73288 - RNA, 23 nt, Human
uaaaucacaaguguaacccucca

SEQ ID NO: 73289 - RNA, 24 nt, Human
uaacaccguucccguccucuuccu

SEQ ID NO: 73290 - RNA, 20 nt, Human
uaacagcagcagcucaaacu

SEQ ID NO: 73291 - RNA, 22 nt, Human
uaaccaugccacaaaaauaacu

SEQ ID NO: 73292 - RNA, 26 nt, Human
uaacuucagugaagaaguuuuuugac

SEQ ID NO: 73293 - RNA, 29 nt, Human
uaacuucagugaagaaguuuuuugacacu

SEQ ID NO: 73294 - RNA, 21 nt, Human
uaagauauacacaaaaccuuc

SEQ ID NO: 73295 - RNA, 23 nt, Human
uaagauauacacaaaaccuucaa

SEQ ID NO: 73296 - RNA, 21 nt, Human
uaagugacuucuauaaacacu

SEQ ID NO: 73297 - RNA, 27 nt, Human
uacacaaaccggugucauuuauuguca

SEQ ID NO: 73298 - RNA, 23 nt, Human
uaccacaguaaaauauuuaacaa

SEQ ID NO: 73299 - RNA, 23 nt, Human
uaccacaguaaaauauuuaacaa

SEQ ID NO: 73300 - RNA, 22 nt, Human
uagagcagccagcgggaagagc

SEQ ID NO: 73301 - RNA, 22 nt, Human
uagagcagccagcgggaagagc

SEQ ID NO: 73302 - RNA, 21 nt, Human
uagcaaaaaccuccaauuccu

SEQ ID NO: 73303 - RNA, 19 nt, Human
uauuuuuuaaaaacaagac

SEQ ID NO: 73304 - RNA, 21 nt, Human
ucaaaugcuggaauaugacaa

SEQ ID NO: 73305 - RNA, 19 nt, Human
ucagagaaaaagaaccacu

SEQ ID NO: 73306 - RNA, 21 nt, Human
ucagaguccuuuccaaaagga

SEQ ID NO: 73307 - RNA, 19 nt, Human
uccaaaaggaaauuacugc

SEQ ID NO: 73308 - RNA, 21 nt, Human
uccaagaaaugauauaucacc

SEQ ID NO: 73309 - RNA, 20 nt, Human
uccagguggaaaaaugagac

SEQ ID NO: 73310 - RNA, 19 nt, Human
uccccaugaauuuuccaca

SEQ ID NO: 73311 - RNA, 23 nt, Human
ucccuucuuuucugccuucagag

SEQ ID NO: 73312 - RNA, 20 nt, Human
ucggagagcaccacgugaua

SEQ ID NO: 73313 - RNA, 20 nt, Human
ucggagagcaccacgugaua

SEQ ID NO: 73314 - RNA, 19 nt, Human
ucuagucuacagaaugaca

SEQ ID NO: 73315 - RNA, 18 nt, Human
ucucccuucuuuucugcc

SEQ ID NO: 73316 - RNA, 25 nt, Human
ucugaaaacagaaaaaaagacaugg

SEQ ID NO: 73317 - RNA, 25 nt, Human
ucugaaaacagaaaaaaagacaugg

SEQ ID NO: 73318 - RNA, 19 nt, Human
ucugcaaaaccagucaaau

SEQ ID NO: 73319 - RNA, 18 nt, Human
ucugucuuaaagaacgug

SEQ ID NO: 73320 - RNA, 21 nt, Human
ucuguugugaacuacucugaa

SEQ ID NO: 73321 - RNA, 21 nt, Human
ucuguugugaacuacucugaa

SEQ ID NO: 73322 - RNA, 21 nt, Human
ucuguugugaacuacucugaa

SEQ ID NO: 73323 - RNA, 20 nt, Human
ugaaaacagaaaaaaagaca

SEQ ID NO: 73324 - RNA, 20 nt, Human
ugaaaacagaaaaaaagaca

SEQ ID NO: 73325 - RNA, 18 nt, Human
ugaaacagaaaaaaagac

SEQ ID NO: 73326 - RNA, 24 nt, Human
ugaacuacucugaaacagaaaaaa

SEQ ID NO: 73327 - RNA, 22 nt, Human
ugacuucuauaaacacuaggaa

SEQ ID NO: 73328 - RNA, 21 nt, Human
ugagcuuauaacucaguaaca

SEQ ID NO: 73329 - RNA, 21 nt, Human
ugagcuuauaauucaguaaca

SEQ ID NO: 73330 - RNA, 21 nt, Human
ugaggcaauagauuuucugcu

SEQ ID NO: 73331 - RNA, 21 nt, Human
ugcaaaaccagucaaaucuaa

SEQ ID NO: 73332 - RNA, 22 nt, Human
ugcuguacuuuuauacaacugg

SEQ ID NO: 73333 - RNA, 23 nt, Human
uggaaaauguuugcauguaaaga

SEQ ID NO: 73334 - RNA, 23 nt, Human
uggaaaauguuugcauguaaaga

SEQ ID NO: 73335 - RNA, 20 nt, Human
uggaucuucacucuucucuu

SEQ ID NO: 73336 - RNA, 19 nt, Human
uggcaguguaguagguuug

SEQ ID NO: 73337 - RNA, 26 nt, Human
ugggaccacuauuguauaugucauua

SEQ ID NO: 73338 - RNA, 23 nt, Human
uguccaaauuguuugguccuauu

SEQ ID NO: 73339 - RNA, 23 nt, Human
uguuaaaaggaaaaaacacaggg

SEQ ID NO: 73340 - RNA, 19 nt, Human
uguuguuuucuguauucca

SEQ ID NO: 73341 - RNA, 19 nt, Human
uguuguuuucuguauucca

SEQ ID NO: 73342 - RNA, 19 nt, Human
uguuguuuucuguauucca

SEQ ID NO: 73343 - RNA, 21 nt, Human
uuacaccagcaucuccacaga

SEQ ID NO: 73344 - RNA, 25 nt, Human
uuaccacaguaaaauauuuaacaaa

SEQ ID NO: 73345 - RNA, 25 nt, Human
uuaccacaguaaaauauuuaacaaa

SEQ ID NO: 73346 - RNA, 27 nt, Human
uuccacaccgaaaacacauuuucaaaa

SEQ ID NO: 73347 - RNA, 21 nt, Human
uucuuuagcaaaaaccuccaa

SEQ ID NO: 73348 - RNA, 21 nt, Human
uuuaagaaauucuagucuaca

SEQ ID NO: 73349 - RNA, 23 nt, Human
uuuaagaaauucuagucuacaga

SEQ ID NO: 73350 - RNA, 20 nt, Human
uuucccacaacgcagccacc

SEQ ID NO: 73351 - RNA, 20 nt, Human
uuucccacaacgcagccacc

SEQ ID NO: 73352 - RNA, 23 nt, Human
uuuuuuuuuuuuuuuuuugcuuu

SEQ ID NO: 73353 - RNA, 27 nt, Human
uuuuuuuuuuuuuuuuuuuugcuuuaa

SEQ ID NO: 73354 - RNA, 27 nt, Human
uuuuuuuuuuuuuuuuuuuuuuugggg

SEQ ID NO: 73355 - RNA, 19 nt, Human
aaaauccaaugauuagacc

SEQ ID NO: 73356 - RNA, 23 nt, Human
aaacagcaaaccacaaaguucag

SEQ ID NO: 73357 - RNA, 20 nt, Human
aaagcucccagaaucccaca

SEQ ID NO: 73358 - RNA, 22 nt, Human
aaaggccugagaacccagaaac

SEQ ID NO: 73359 - RNA, 24 nt, Human
aacagcauccucugucccgccccc

SEQ ID NO: 73360 - RNA, 20 nt, Human
aacugaauucccagaaagcu

SEQ ID NO: 73361 - RNA, 21 nt, Human
aagccacaguguaaaugccaa

SEQ ID NO: 73362 - RNA, 21 nt, Human
aagccacaguguaaaugccaa

SEQ ID NO: 73363 - RNA, 19 nt, Human
aagcucccagaaucccaca

SEQ ID NO: 73364 - RNA, 21 nt, Human
aagcugcaggucuggaaacca

SEQ ID NO: 73365 - RNA, 21 nt, Human
aaggagcuggggugaauuugg

SEQ ID NO: 73366 - RNA, 22 nt, Human
aaggagcuggggugaauuuggu

SEQ ID NO: 73367 - RNA, 21 nt, Human
aaggccaaaggccugagaacc

SEQ ID NO: 73368 - RNA, 27 nt, Human
aaggccugagaacccagaaaccugcuu

SEQ ID NO: 73369 - RNA, 24 nt, Human
aauuaagcagcauuccugcuccca

SEQ ID NO: 73370 - RNA, 19 nt, Human
acaacccugcaacacaggc

SEQ ID NO: 73371 - RNA, 18 nt, Human
acagcaaaccacaaaguu

SEQ ID NO: 73372 - RNA, 23 nt, Human
acagcauccucugucccgccccc

SEQ ID NO: 73373 - RNA, 19 nt, Human
acaggaaucacuccaaaca

SEQ ID NO: 73374 - RNA, 22 nt, Human
accaggucccucacucgguccu

SEQ ID NO: 73375 - RNA, 29 nt, Human
agaacucuguccagagcuggguguucccc

SEQ ID NO: 73376 - RNA, 23 nt, Human
agagagcagcagauggcucagaa

SEQ ID NO: 73377 - RNA, 21 nt, Human
agagcagcagauggcucagaa

SEQ ID NO: 73378 - RNA, 22 nt, Human
agcagagaaagaggaauucaca

SEQ ID NO: 73379 - RNA, 18 nt, Human
agccacaguguaaaugcc

SEQ ID NO: 73380 - RNA, 18 nt, Human
agccacaguguaaaugcc

SEQ ID NO: 73381 - RNA, 18 nt, Human
agccacaguguaaaugcc

SEQ ID NO: 73382 - RNA, 22 nt, Human
agcccgagggguccuugagagc

SEQ ID NO: 73383 - RNA, 18 nt, Human
agcuccagcagagaaaga

SEQ ID NO: 73384 - RNA, 21 nt, Human
aggaaucacuccaaacacauc

SEQ ID NO: 73385 - RNA, 20 nt, Human
aggaccacccugcuucacca

SEQ ID NO: 73386 - RNA, 18 nt, Human
aggacugggagcugaggu

SEQ ID NO: 73387 - RNA, 22 nt, Human
aggagaagaagaauaucccagc

SEQ ID NO: 73388 - RNA, 19 nt, Human
aggcagcacgugggagugg

SEQ ID NO: 73389 - RNA, 20 nt, Human
aggcaggucagcaguguggg

SEQ ID NO: 73390 - RNA, 19 nt, Human
aggcuaaacagcaaaccac

SEQ ID NO: 73391 - RNA, 23 nt, Human
aguccaaggccaaaggccugaga

SEQ ID NO: 73392 - RNA, 19 nt, Human
aguguaaaugccaagagga

SEQ ID NO: 73393 - RNA, 19 nt, Human
aguguaaaugccaagagga

SEQ ID NO: 73394 - RNA, 19 nt, Human
aguguaaaugccaagagga

SEQ ID NO: 73395 - RNA, 19 nt, Human
aguguccccuccuaaggga

SEQ ID NO: 73396 - RNA, 20 nt, Human
auaaauccucggguccaaag

SEQ ID NO: 73397 - RNA, 23 nt, Human
augaagagugugcgugcccaaga

SEQ ID NO: 73398 - RNA, 25 nt, Human
augcagugguuucugagccuaauuu

SEQ ID NO: 73399 - RNA, 22 nt, Human
caaaaucuagcaaaaacuaucc

SEQ ID NO: 73400 - RNA, 23 nt, Human
caaaggccugagaacccagaaac

SEQ ID NO: 73401 - RNA, 21 nt, Human
caacugaauucccagaaagcu

SEQ ID NO: 73402 - RNA, 21 nt, Human
caagaccaagagccucagaac

SEQ ID NO: 73403 - RNA, 24 nt, Human
caagaccaagagccucagaaccag

SEQ ID NO: 73404 - RNA, 25 nt, Human
caagaccaagagccucagaaccaga

SEQ ID NO: 73405 - RNA, 21 nt, Human
cacaucuagaccaccaggcug

SEQ ID NO: 73406 - RNA, 20 nt, Human
cagaaaaaagcaaguccagu

SEQ ID NO: 73407 - RNA, 19 nt, Human
cagaaagcucccagaaucc

SEQ ID NO: 73408 - RNA, 21 nt, Human
cagcaaaacaagcugcagguc

SEQ ID NO: 73409 - RNA, 23 nt, Human
cagcagagaaagaggaauucaca

SEQ ID NO: 73410 - RNA, 22 nt, Human
cagcuccagcagagaaagagga

SEQ ID NO: 73411 - RNA, 23 nt, Human
cagcuccagcagagaaagaggaa

SEQ ID NO: 73412 - RNA, 24 nt, Human
cagcucugcccuucuaugacucca

SEQ ID NO: 73413 - RNA, 21 nt, Human
caggaccacccugcuucacca

SEQ ID NO: 73414 - RNA, 23 nt, Human
caggagaagaagaauaucccagc

SEQ ID NO: 73415 - RNA, 19 nt, Human
caucugaguucaacugucc

SEQ ID NO: 73416 - RNA, 23 nt, Human
cauggacucaaucccagcuacau

SEQ ID NO: 73417 - RNA, 22 nt, Human
cauuccugcucccagaaaaaag

SEQ ID NO: 73418 - RNA, 23 nt, Human
ccaaaggccagagagccugcagc

SEQ ID NO: 73419 - RNA, 30 nt, Human
ccaaaggccugagaacccagaaaccugcuu

SEQ ID NO: 73420 - RNA, 21 nt, Human
ccaaaugagacauucaaugaa

SEQ ID NO: 73421 - RNA, 19 nt, Human
ccagaaaaaagcaagucca

SEQ ID NO: 73422 - RNA, 21 nt, Human
ccagaaucccacaugaacccc

SEQ ID NO: 73423 - RNA, 22 nt, Human
ccagauaugccaaugguguaac

SEQ ID NO: 73424 - RNA, 22 nt, Human
cccagaaucccacaugaacccc

SEQ ID NO: 73425 - RNA, 23 nt, Human
cccagaaucccacaugaaccccc

SEQ ID NO: 73426 - RNA, 23 nt, Human
cccauugaucaaaaacaagggac

SEQ ID NO: 73427 - RNA, 23 nt, Human
ccccucuuccaaaaucuagcaaa

SEQ ID NO: 73428 - RNA, 18 nt, Human
cccgagggguccuugaga

SEQ ID NO: 73429 - RNA, 19 nt, Human
cccgucucugcuauccucg

SEQ ID NO: 73430 - RNA, 22 nt, Human
cccuucuaugacuccaugauga

SEQ ID NO: 73431 - RNA, 19 nt, Human
ccucacucgguccuccagc

SEQ ID NO: 73432 - RNA, 18 nt, Human
ccucggaugaaacuuggg

SEQ ID NO: 73433 - RNA, 18 nt, Human
ccucucgcagcugcugug

SEQ ID NO: 73434 - RNA, 19 nt, Human
ccugaaaugcaaaaaucca

SEQ ID NO: 73435 - RNA, 22 nt, Human
ccugcaacacaggcucgcacaa

SEQ ID NO: 73436 - RNA, 22 nt, Human
ccuucaguuugaacugagagcc

SEQ ID NO: 73437 - RNA, 21 nt, Human
cgcccccucuuccaaaaucua

SEQ ID NO: 73438 - RNA, 24 nt, Human
cuaaagccacaguguaaaugccaa

SEQ ID NO: 73439 - RNA, 18 nt, Human
cuccuggggcaguggcug

SEQ ID NO: 73440 - RNA, 18 nt, Human
cucugaguacaaaguaaa

SEQ ID NO: 73441 - RNA, 22 nt, Human
cucugucccgcccccucuucca

SEQ ID NO: 73442 - RNA, 24 nt, Human
cucugucccgcccccucuuccaaa

SEQ ID NO: 73443 - RNA, 21 nt, Human
cugaagaacagcauccucugu

SEQ ID NO: 73444 - RNA, 22 nt, Human
cugaaggcuaaacagcaaacca

SEQ ID NO: 73445 - RNA, 18 nt, Human
cugucaguguagaaugcu

SEQ ID NO: 73446 - RNA, 18 nt, Human
cugucaguguagaaugcu

SEQ ID NO: 73447 - RNA, 26 nt, Human
cuucaaauucugucucugccagaauu

SEQ ID NO: 73448 - RNA, 22 nt, Human
gaacagcauccucugucccgcc

SEQ ID NO: 73449 - RNA, 20 nt, Human
gaccucaucaucaguguccc

SEQ ID NO: 73450 - RNA, 19 nt, Human
gagaaagaggaauucacau

SEQ ID NO: 73451 - RNA, 24 nt, Human
gagaggagacccguguuuuggaaa

SEQ ID NO: 73452 - RNA, 21 nt, Human
gagccgauaacauggacucaa

SEQ ID NO: 73453 - RNA, 23 nt, Human
gagcuggggugaauuuggucauc

SEQ ID NO: 73454 - RNA, 22 nt, Human
gaggagacccguguuuuggaaa

SEQ ID NO: 73455 - RNA, 19 nt, Human
gagggguccuugagagcau

SEQ ID NO: 73456 - RNA, 22 nt, Human
gagguggaggggacucgacagg

SEQ ID NO: 73457 - RNA, 26 nt, Human
gcagcaaaacaagcugcaggucugga

SEQ ID NO: 73458 - RNA, 19 nt, Human
gcccgagggguccuugaga

SEQ ID NO: 73459 - RNA, 21 nt, Human
gcccgagggguccuugagagc

SEQ ID NO: 73460 - RNA, 27 nt, Human
gcccugugaaugaaggagcugggguga

SEQ ID NO: 73461 - RNA, 19 nt, Human
gcuaggaggcugagguggg

SEQ ID NO: 73462 - RNA, 19 nt, Human
ggaaucacuccaaacacau

SEQ ID NO: 73463 - RNA, 23 nt, Human
ggagaagaagaauaucccagcuc

SEQ ID NO: 73464 - RNA, 19 nt, Human
ggaguguggcucaguccaa

SEQ ID NO: 73465 - RNA, 18 nt, Human
ggcaccaagugggaacua

SEQ ID NO: 73466 - RNA, 18 nt, Human
gucaggguucucgugaca

SEQ ID NO: 73467 - RNA, 20 nt, Human
gucaggguucucgugacagg

SEQ ID NO: 73468 - RNA, 18 nt, Human
guguccccuccuaaggga

SEQ ID NO: 73469 - RNA, 20 nt, Human
uagaaugcuccauaauuauc

SEQ ID NO: 73470 - RNA, 20 nt, Human
uagaaugcuccauaauuauc

SEQ ID NO: 73471 - RNA, 20 nt, Human
uagaaugcuccauaauuauc

SEQ ID NO: 73472 - RNA, 19 nt, Human
uaggagcaagauuacuuug

SEQ ID NO: 73473 - RNA, 19 nt, Human
uaggaggcugaggugggag

SEQ ID NO: 73474 - RNA, 20 nt, Human
uaggauacugaccccugaaa

SEQ ID NO: 73475 - RNA, 19 nt, Human
uagggcucugagcccgagg

SEQ ID NO: 73476 - RNA, 20 nt, Human
uagggcucugagcccgaggg

SEQ ID NO: 73477 - RNA, 22 nt, Human
uaucagguucugggcuugguuu

SEQ ID NO: 73478 - RNA, 22 nt, Human
uaucagguucugggcuugguuu

SEQ ID NO: 73479 - RNA, 22 nt, Human
uaucagguucugggcuugguuu

SEQ ID NO: 73480 - RNA, 18 nt, Human
uaugccuacuggcuguga

SEQ ID NO: 73481 - RNA, 21 nt, Human
uaugcuaggaggcugaggugg

SEQ ID NO: 73482 - RNA, 19 nt, Human
uaugugacacagccaugug

SEQ ID NO: 73483 - RNA, 19 nt, Human
ucaaacacuuaguaugaag

SEQ ID NO: 73484 - RNA, 25 nt, Human
ucaauaacggaauggcaguuucucc

SEQ ID NO: 73485 - RNA, 21 nt, Human
ucaguccaagaccaagagccu

SEQ ID NO: 73486 - RNA, 20 nt, Human
ucagugacuucaugaacacc

SEQ ID NO: 73487 - RNA, 24 nt, Human
uccaaaaucuagcaaaaacuaucc

SEQ ID NO: 73488 - RNA, 22 nt, Human
uccaaacacaucuagaccacca

SEQ ID NO: 73489 - RNA, 18 nt, Human
uccaaaggccagagagcc

SEQ ID NO: 73490 - RNA, 19 nt, Human
uccaaaggccagagagccu

SEQ ID NO: 73491 - RNA, 22 nt, Human
uccaaggccaaaggccugagaa

SEQ ID NO: 73492 - RNA, 22 nt, Human
uccaaggccaaaggccugagaa

SEQ ID NO: 73493 - RNA, 23 nt, Human
uccagcagauucugcacuccagg

SEQ ID NO: 73494 - RNA, 26 nt, Human
uccagcagauucugcacuccaggugu

SEQ ID NO: 73495 - RNA, 18 nt, Human
uccagguguauuagucag

SEQ ID NO: 73496 - RNA, 22 nt, Human
uccagguguauuagucaggguu

SEQ ID NO: 73497 - RNA, 23 nt, Human
uccaugaugaagcgcagcaaaac

SEQ ID NO: 73498 - RNA, 21 nt, Human
ucccagaaaaaagcaagucca

SEQ ID NO: 73499 - RNA, 21 nt, Human
ucccagaaagcucccagaacc

SEQ ID NO: 73500 - RNA, 22 nt, Human
ucccagaaagcucccagaaucc

SEQ ID NO: 73501 - RNA, 22 nt, Human
ucccagaaucccacaugaaccc

SEQ ID NO: 73502 - RNA, 21 nt, Human
ucccucacucgguccuccagc

SEQ ID NO: 73503 - RNA, 18 nt, Human
uccucggguccaaaggcc

SEQ ID NO: 73504 - RNA, 24 nt, Human
ucuauaauuaggagcaagauuacu

SEQ ID NO: 73505 - RNA, 19 nt, Human
ucucugaguacaaaguaaa

SEQ ID NO: 73506 - RNA, 26 nt, Human
ucucugaucugauucuuuccuguucu

SEQ ID NO: 73507 - RNA, 21 nt, Human
ucugacaggaaucacgugaca

SEQ ID NO: 73508 - RNA, 22 nt, Human
ucugacaggaaucacgugacag

SEQ ID NO: 73509 - RNA, 24 nt, Human
ucugacaggaaucacgugacaggc

SEQ ID NO: 73510 - RNA, 21 nt, Human
ucugacaggaaucacuccaaa

SEQ ID NO: 73511 - RNA, 20 nt, Human
ucugaucuaauuaagcagca

SEQ ID NO: 73512 - RNA, 21 nt, Human
ucugaucuaauuaagcagcau

SEQ ID NO: 73513 - RNA, 24 nt, Human
ucugaucugauucuuuccuguucu

SEQ ID NO: 73514 - RNA, 18 nt, Human
ucuggguaggaggcagcg

SEQ ID NO: 73515 - RNA, 19 nt, Human
ugaaaggaacaaaauccaa

SEQ ID NO: 73516 - RNA, 21 nt, Human
ugaaaggaacaaaauccaaug

SEQ ID NO: 73517 - RNA, 22 nt, Human
ugaagagugugcgugcccaaga

SEQ ID NO: 73518 - RNA, 22 nt, Human
ugaagcgcagcaaaacaagcug

SEQ ID NO: 73519 - RNA, 19 nt, Human
ugacacagccaugugaggc

SEQ ID NO: 73520 - RNA, 18 nt, Human
ugacaggaaucacuccaa

SEQ ID NO: 73521 - RNA, 18 nt, Human
ugaccauggcugaauggg

SEQ ID NO: 73522 - RNA, 19 nt, Human
ugagagagcagcagauggc

SEQ ID NO: 73523 - RNA, 26 nt, Human
ugagagcauccugacuugacuccaac

SEQ ID NO: 73524 - RNA, 21 nt, Human
ugccaagaggaaauuugucuc

SEQ ID NO: 73525 - RNA, 21 nt, Human
ugccaagaggaaauuugucuc

SEQ ID NO: 73526 - RNA, 21 nt, Human
ugccaagaggaaauuugucuc

SEQ ID NO: 73527 - RNA, 21 nt, Human
uggacgcaggaccacccugcu

SEQ ID NO: 73528 - RNA, 21 nt, Human
uggacucaaucccagcuacau

SEQ ID NO: 73529 - RNA, 23 nt, Human
uggcaccaggucccucacucggu

SEQ ID NO: 73530 - RNA, 21 nt, Human
uggcucaguccaagaccaaga

SEQ ID NO: 73531 - RNA, 20 nt, Human
ugggcaaaacuaacgaagua

SEQ ID NO: 73532 - RNA, 21 nt, Human
uguauggaccacuugcauucu

SEQ ID NO: 73533 - RNA, 21 nt, Human
ugucccgcccccucuuccaaa

SEQ ID NO: 73534 - RNA, 18 nt, Human
uguccggaugugccucug

SEQ ID NO: 73535 - RNA, 21 nt, Human
uguccuugccuguaaaauuag

SEQ ID NO: 73536 - RNA, 19 nt, Human
ugucucaaagaacugucag

SEQ ID NO: 73537 - RNA, 19 nt, Human
ugucucaaagaacugucag

SEQ ID NO: 73538 - RNA, 19 nt, Human
ugucucaaagaacugucag

SEQ ID NO: 73539 - RNA, 23 nt, Human
ugugcgugcccaagagacgggcc

SEQ ID NO: 73540 - RNA, 23 nt, Human
uguucugcccacccgucucugcu

SEQ ID NO: 73541 - RNA, 18 nt, Human
uuaaguuacuuuuuacag

SEQ ID NO: 73542 - RNA, 22 nt, Human
uuaugcuaggaggcugaggugg

SEQ ID NO: 73543 - RNA, 19 nt, Human
uucuaugacuccaugauga

SEQ ID NO: 73544 - RNA, 19 nt, Human
uucuccagcagauucugca

SEQ ID NO: 73545 - RNA, 20 nt, Human
uucuccagcagauucugcac

SEQ ID NO: 73546 - RNA, 19 nt, Human
uugagagcauccugacuug

SEQ ID NO: 73547 - RNA, 19 nt, Human
uuuuaugcuaggaggcuga

SEQ ID NO: 73548 - RNA, 22 nt, Human
aaaagaacaggcaugggccggg

SEQ ID NO: 73549 - RNA, 23 nt, Human
aaaaugcccacacauaagcucag

SEQ ID NO: 73550 - RNA, 19 nt, Human
aaaggaagaggggccggag

SEQ ID NO: 73551 - RNA, 19 nt, Human
aaaggaagaggggccggag

SEQ ID NO: 73552 - RNA, 24 nt, Human
aauggcccucagaccucuccuggu

SEQ ID NO: 73553 - RNA, 24 nt, Human
aauggcccucagaccucuccuggu

SEQ ID NO: 73554 - RNA, 23 nt, Human
acagccuuaugcucuguaaaggu

SEQ ID NO: 73555 - RNA, 21 nt, Human
accagccaagcugaccuuggc

SEQ ID NO: 73556 - RNA, 23 nt, Human
acccauugcggaagcagguuugg

SEQ ID NO: 73557 - RNA, 18 nt, Human
acccucaccccagccucu

SEQ ID NO: 73558 - RNA, 24 nt, Human
acccugggggguggacaccugcgg

SEQ ID NO: 73559 - RNA, 21 nt, Human
acuccugugugguggggcuug

SEQ ID NO: 73560 - RNA, 21 nt, Human
acuccugugugguggggcuug

SEQ ID NO: 73561 - RNA, 23 nt, Human
acuggagucugagaaggggucgc

SEQ ID NO: 73562 - RNA, 22 nt, Human
agaauagaaaggagggugaugg

SEQ ID NO: 73563 - RNA, 26 nt, Human
agagaacaacaggucugggauuucug

SEQ ID NO: 73564 - RNA, 24 nt, Human
agagcccuuuccagugggcccuuc

SEQ ID NO: 73565 - RNA, 22 nt, Human
aggaacccugggggguggacac

SEQ ID NO: 73566 - RNA, 20 nt, Human
aggagggaguuagggaaugg

SEQ ID NO: 73567 - RNA, 20 nt, Human
aggagggaguuagggaaugg

SEQ ID NO: 73568 - RNA, 20 nt, Human
aggcacacuguucuuucucc

SEQ ID NO: 73569 - RNA, 20 nt, Human
aggcacacuguucuuucucc

SEQ ID NO: 73570 - RNA, 26 nt, Human
aggccaagaacagggucugaggagga

SEQ ID NO: 73571 - RNA, 19 nt, Human
aggcgcuuucccuccccag

SEQ ID NO: 73572 - RNA, 19 nt, Human
aggcgcuuucccuccccag

SEQ ID NO: 73573 - RNA, 19 nt, Human
agggagggccaugcuccac

SEQ ID NO: 73574 - RNA, 20 nt, Human
agggagggccaugcuccacu

SEQ ID NO: 73575 - RNA, 21 nt, Human
aggggcaggggucaggaaccc

SEQ ID NO: 73576 - RNA, 21 nt, Human
aggggcggccacgggcggcgg

SEQ ID NO: 73577 - RNA, 19 nt, Human
aggugcgcuggagcaccag

SEQ ID NO: 73578 - RNA, 21 nt, Human
aggugggcgguggggaggcag

SEQ ID NO: 73579 - RNA, 22 nt, Human
aggugggcgguggggaggcagu

SEQ ID NO: 73580 - RNA, 23 nt, Human
aggugggcgguggggaggcagug

SEQ ID NO: 73581 - RNA, 23 nt, Human
aggugggcgguggggaggcagug

SEQ ID NO: 73582 - RNA, 21 nt, Human
augcagggcugggugccuguu

SEQ ID NO: 73583 - RNA, 19 nt, Human
caaagcagugugcucaggc

SEQ ID NO: 73584 - RNA, 19 nt, Human
caaagcagugugcucaggc

SEQ ID NO: 73585 - RNA, 20 nt, Human
caaagcagugugcucaggcc

SEQ ID NO: 73586 - RNA, 24 nt, Human
caaagcagugugcucaggccuccc

SEQ ID NO: 73587 - RNA, 24 nt, Human
caaagcagugugcucaggccuccc

SEQ ID NO: 73588 - RNA, 20 nt, Human
caauaaagaugaaggcugca

SEQ ID NO: 73589 - RNA, 20 nt, Human
caauaaagaugaaggcugca

SEQ ID NO: 73590 - RNA, 18 nt, Human
cacagccugagguacagg

SEQ ID NO: 73591 - RNA, 18 nt, Human
cacagccugagguacagg

SEQ ID NO: 73592 - RNA, 20 nt, Human
caccuugcccaccacccacc

SEQ ID NO: 73593 - RNA, 20 nt, Human
caccuugcccaccacccacc

SEQ ID NO: 73594 - RNA, 24 nt, Human
cacuagagagcccggcugggccag

SEQ ID NO: 73595 - RNA, 18 nt, Human
cagaauagaaaggagggu

SEQ ID NO: 73596 - RNA, 27 nt, Human
cagaauagaaaggagggugauggugaa

SEQ ID NO: 73597 - RNA, 19 nt, Human
cagcacaggggagaaaaga

SEQ ID NO: 73598 - RNA, 18 nt, Human
cagcagccccugcccccu

SEQ ID NO: 73599 - RNA, 18 nt, Human
cagcagccccugcccccu

SEQ ID NO: 73600 - RNA, 22 nt, Human
cagcgggccccagaggccuggg

SEQ ID NO: 73601 - RNA, 19 nt, Human
cagcugccugggugccacc

SEQ ID NO: 73602 - RNA, 19 nt, Human
cagcugccugggugccacc

SEQ ID NO: 73603 - RNA, 23 nt, Human
caggaacccugggggguggacac

SEQ ID NO: 73604 - RNA, 20 nt, Human
cagggacagggagccaggga

SEQ ID NO: 73605 - RNA, 21 nt, Human
cagggagggccaugcuccacu

SEQ ID NO: 73606 - RNA, 22 nt, Human
cagugggccccagaggccuggg

SEQ ID NO: 73607 - RNA, 21 nt, Human
ccaaagcagugugcucaggcc

SEQ ID NO: 73608 - RNA, 18 nt, Human
ccaccacccaccgccuug

SEQ ID NO: 73609 - RNA, 18 nt, Human
ccaccacccaccgccuug

SEQ ID NO: 73610 - RNA, 18 nt, Human
ccaccacccaccgccuug

SEQ ID NO: 73611 - RNA, 20 nt, Human
ccaccacccaccgccuugcc

SEQ ID NO: 73612 - RNA, 20 nt, Human
ccaccacccaccgccuugcc

SEQ ID NO: 73613 - RNA, 21 nt, Human
ccaccacccaccgccuugccc

SEQ ID NO: 73614 - RNA, 21 nt, Human
ccaccacccaccgccuugccc

SEQ ID NO: 73615 - RNA, 21 nt, Human
ccaccacccaccgccuugccc

SEQ ID NO: 73616 - RNA, 24 nt, Human
ccaccacccaccgccuugcccacc

SEQ ID NO: 73617 - RNA, 21 nt, Human
ccacccacccacccacucagg

SEQ ID NO: 73618 - RNA, 21 nt, Human
ccacccacccacccacucagg

SEQ ID NO: 73619 - RNA, 20 nt, Human
ccacccauugcggaagcagg

SEQ ID NO: 73620 - RNA, 22 nt, Human
ccaccgccuugcccaccaccca

SEQ ID NO: 73621 - RNA, 22 nt, Human
ccacugcaccugcuccugcagc

SEQ ID NO: 73622 - RNA, 24 nt, Human
ccagagucccuccuccucaaacca

SEQ ID NO: 73623 - RNA, 24 nt, Human
ccagagucccuccuccucagacca

SEQ ID NO: 73624 - RNA, 19 nt, Human
ccagcagccccugcccccu

SEQ ID NO: 73625 - RNA, 19 nt, Human
ccagcagccccugcccccu

SEQ ID NO: 73626 - RNA, 20 nt, Human
ccagccaagcugaccuuggc

SEQ ID NO: 73627 - RNA, 23 nt, Human
ccagcgggccccagaggccuggg

SEQ ID NO: 73628 - RNA, 18 nt, Human
ccagggggucagagcccu

SEQ ID NO: 73629 - RNA, 18 nt, Human
ccagggggucagagcccu

SEQ ID NO: 73630 - RNA, 23 nt, Human
ccagugggccccagaggccuggg

SEQ ID NO: 73631 - RNA, 23 nt, Human
ccaugcagggcugggugccuguu

SEQ ID NO: 73632 - RNA, 23 nt, Human
ccaugcagggcugggugccuguu

SEQ ID NO: 73633 - RNA, 22 nt, Human
cccaccacccaccgccuugccc

SEQ ID NO: 73634 - RNA, 22 nt, Human
cccaccacccaccgccuugccc

SEQ ID NO: 73635 - RNA, 22 nt, Human
cccaccacccaccgccuugccc

SEQ ID NO: 73636 - RNA, 24 nt, Human
cccacccacccacccacucaggag

SEQ ID NO: 73637 - RNA, 24 nt, Human
cccacccacccacccacucaggag

SEQ ID NO: 73638 - RNA, 22 nt, Human
cccaccgccuugcccacugccc

SEQ ID NO: 73639 - RNA, 22 nt, Human
cccaccgccuugcccacugccc

SEQ ID NO: 73640 - RNA, 18 nt, Human
cccaccuccucccuucuc

SEQ ID NO: 73641 - RNA, 18 nt, Human
cccaccuccucccuucuc

SEQ ID NO: 73642 - RNA, 23 nt, Human
cccaccuccucccuucucuccca

SEQ ID NO: 73643 - RNA, 23 nt, Human
cccaccuccucccuucucuccca

SEQ ID NO: 73644 - RNA, 20 nt, Human
cccaggcuccccccaugcag

SEQ ID NO: 73645 - RNA, 20 nt, Human
cccaggcuccccccaugcag

SEQ ID NO: 73646 - RNA, 24 nt, Human
ccccggccccggcgccccuagacc

SEQ ID NO: 73647 - RNA, 19 nt, Human
ccccuacgccccggccccg

SEQ ID NO: 73648 - RNA, 19 nt, Human
ccccugcccccucuuuccc

SEQ ID NO: 73649 - RNA, 19 nt, Human
ccccugcccccucuuuccc

SEQ ID NO: 73650 - RNA, 20 nt, Human
ccccugcccccucuuuccca

SEQ ID NO: 73651 - RNA, 20 nt, Human
ccccugcccccucuuuccca

SEQ ID NO: 73652 - RNA, 20 nt, Human
cccggccccggcgccccuag

SEQ ID NO: 73653 - RNA, 19 nt, Human
cccuacgccccggccccgg

SEQ ID NO: 73654 - RNA, 18 nt, Human
cccuagaccgcugcccug

SEQ ID NO: 73655 - RNA, 20 nt, Human
cccucugcuacuccagaguc

SEQ ID NO: 73656 - RNA, 20 nt, Human
cccucugcuacuccagaguc

SEQ ID NO: 73657 - RNA, 20 nt, Human
cccugggccgcgugcggcuc

SEQ ID NO: 73658 - RNA, 23 nt, Human
cccugggggguggacaccugcgg

SEQ ID NO: 73659 - RNA, 23 nt, Human
cccuuuccuuuuccuccacuugg

SEQ ID NO: 73660 - RNA, 23 nt, Human
cccuuuccuuuuccuccacuugg

SEQ ID NO: 73661 - RNA, 19 nt, Human
ccgcugcccugggccgcgu

SEQ ID NO: 73662 - RNA, 19 nt, Human
ccuacgccccggccccggc

SEQ ID NO: 73663 - RNA, 24 nt, Human
ccuagccccuggccucacuccugu

SEQ ID NO: 73664 - RNA, 24 nt, Human
ccuagccccuggccucacuccugu

SEQ ID NO: 73665 - RNA, 24 nt, Human
ccucagaccagccaagcugaccuu

SEQ ID NO: 73666 - RNA, 24 nt, Human
ccucagaccagccaagcugaccuu

SEQ ID NO: 73667 - RNA, 23 nt, Human
ccuccuccucagaccaggggcag

SEQ ID NO: 73668 - RNA, 25 nt, Human
ccuggccucacuccugguccccugg

SEQ ID NO: 73669 - RNA, 25 nt, Human
ccuggccucacuccugguccccugg

SEQ ID NO: 73670 - RNA, 22 nt, Human
ccuugcccaccacccaccgccu

SEQ ID NO: 73671 - RNA, 22 nt, Human
ccuugcccaccacccaccgccu

SEQ ID NO: 73672 - RNA, 22 nt, Human
ccuugcccaccacccaccgccu

SEQ ID NO: 73673 - RNA, 24 nt, Human
ccuuuguucuggcaucaggcuggg

SEQ ID NO: 73674 - RNA, 19 nt, Human
cgccccuagaccgcugccc

SEQ ID NO: 73675 - RNA, 23 nt, Human
cggcagcacaggggagaaaagaa

SEQ ID NO: 73676 - RNA, 21 nt, Human
cggccccuacgccccggcccc

SEQ ID NO: 73677 - RNA, 18 nt, Human
cggcggcagcacagggga

SEQ ID NO: 73678 - RNA, 21 nt, Human
cggcuccucauuaccagcacu

SEQ ID NO: 73679 - RNA, 19 nt, Human
cgggccccagaggccuggg

SEQ ID NO: 73680 - RNA, 23 nt, Human
cgggccccagaggccuggggagg

SEQ ID NO: 73681 - RNA, 20 nt, Human
cgguggggaggcagugugug

SEQ ID NO: 73682 - RNA, 20 nt, Human
cgguggggaggcagugugug

SEQ ID NO: 73683 - RNA, 18 nt, Human
cuacgccccggccccggc

SEQ ID NO: 73684 - RNA, 26 nt, Human
cuagaccgcugcccugggccgcgugc

SEQ ID NO: 73685 - RNA, 21 nt, Human
cuagccccuggccucacuccu

SEQ ID NO: 73686 - RNA, 21 nt, Human
cuagccccuggccucacuccu

SEQ ID NO: 73687 - RNA, 21 nt, Human
cucaccaccugugcccaccuc

SEQ ID NO: 73688 - RNA, 21 nt, Human
cucaccaccugugcccaccuc

SEQ ID NO: 73689 - RNA, 20 nt, Human
cucauuaccagcacucacaa

SEQ ID NO: 73690 - RNA, 26 nt, Human
cucauuaccagcacucacaacccacc

SEQ ID NO: 73691 - RNA, 24 nt, Human
cucccgccacagccugagguacag

SEQ ID NO: 73692 - RNA, 24 nt, Human
cucccgccacagccugagguacag

SEQ ID NO: 73693 - RNA, 20 nt, Human
cuccugcagccccgucagug

SEQ ID NO: 73694 - RNA, 22 nt, Human
cugagcccagggacagggagcc

SEQ ID NO: 73695 - RNA, 24 nt, Human
cugcacccacggcuccucauuacc

SEQ ID NO: 73696 - RNA, 24 nt, Human
cugcacccacggcuccucauuacc

SEQ ID NO: 73697 - RNA, 21 nt, Human
cugcccccucuuucccagccc

SEQ ID NO: 73698 - RNA, 21 nt, Human
cugcccccucuuucccagccc

SEQ ID NO: 73699 - RNA, 22 nt, Human
cugcccccucuuucccagcccc

SEQ ID NO: 73700 - RNA, 22 nt, Human
cugcccccucuuucccagcccc

SEQ ID NO: 73701 - RNA, 23 nt, Human
cugcccugggccgcgugcggcuc

SEQ ID NO: 73702 - RNA, 21 nt, Human
cuggagcaccagcuuggcugg

SEQ ID NO: 73703 - RNA, 22 nt, Human
cuggagucugagaaggggucgc

SEQ ID NO: 73704 - RNA, 21 nt, Human
cuggcucuagagccuaccccu

SEQ ID NO: 73705 - RNA, 21 nt, Human
cuggcucuagagccuaccccu

SEQ ID NO: 73706 - RNA, 23 nt, Human
cuguucuuagaacuccuagcccc

SEQ ID NO: 73707 - RNA, 23 nt, Human
cuguucuuagaacuccuagcccc

SEQ ID NO: 73708 - RNA, 19 nt, Human
cuucagaauucccuggcug

SEQ ID NO: 73709 - RNA, 23 nt, Human
cuuuguucuggcaucaggcuggg

SEQ ID NO: 73710 - RNA, 20 nt, Human
gaacagacuggguuuggaaa

SEQ ID NO: 73711 - RNA, 20 nt, Human
gaacagacuggguuuggaaa

SEQ ID NO: 73712 - RNA, 22 nt, Human
gacagcuggacaugaggugggc

SEQ ID NO: 73713 - RNA, 22 nt, Human
gacagcuggacaugaggugggc

SEQ ID NO: 73714 - RNA, 18 nt, Human
gaccuagcaucugcccaa

SEQ ID NO: 73715 - RNA, 18 nt, Human
gaccuagcaucugcccaa

SEQ ID NO: 73716 - RNA, 27 nt, Human
gaccuagcaucugcccaaagaaguccc

SEQ ID NO: 73717 - RNA, 27 nt, Human
gaccuagcaucugcccaaagaaguccc

SEQ ID NO: 73718 - RNA, 20 nt, Human
gagaggggcggccacgggcg

SEQ ID NO: 73719 - RNA, 20 nt, Human
gagcccagggacagggagcc

SEQ ID NO: 73720 - RNA, 18 nt, Human
gaggaggcuccugcaucc

SEQ ID NO: 73721 - RNA, 21 nt, Human
gagucuuaauggggugggagg

SEQ ID NO: 73722 - RNA, 21 nt, Human
gagucuuaauggggugggagg

SEQ ID NO: 73723 - RNA, 21 nt, Human
gcagagcgcucgugaugcccg

SEQ ID NO: 73724 - RNA, 19 nt, Human
gcagccccgucagugcggg

SEQ ID NO: 73725 - RNA, 18 nt, Human
gcagggccagugugggcg

SEQ ID NO: 73726 - RNA, 25 nt, Human
gccacgggcggcggcagcacagggg

SEQ ID NO: 73727 - RNA, 18 nt, Human
gcccagggacagggagcc

SEQ ID NO: 73728 - RNA, 22 nt, Human
gccccuagaccgcugcccuggg

SEQ ID NO: 73729 - RNA, 18 nt, Human
gccuuggccucccuccuc

SEQ ID NO: 73730 - RNA, 18 nt, Human
gccuuggccucccuccuc

SEQ ID NO: 73731 - RNA, 22 nt, Human
gcggggagcucuggggaggugc

SEQ ID NO: 73732 - RNA, 20 nt, Human
gcugaccuuggcacuuggcc

SEQ ID NO: 73733 - RNA, 20 nt, Human
gcugaccuuggcacuuggcc

SEQ ID NO: 73734 - RNA, 19 nt, Human
gcuggaggagaagggguaa

SEQ ID NO: 73735 - RNA, 19 nt, Human
gcuggaggagaagggguaa

SEQ ID NO: 73736 - RNA, 21 nt, Human
gcuggggcccuuuccuuuucc

SEQ ID NO: 73737 - RNA, 19 nt, Human
ggacagggagccagggagg

SEQ ID NO: 73738 - RNA, 18 nt, Human
ggagcagggaacagacug

SEQ ID NO: 73739 - RNA, 20 nt, Human
ggaucaccacuagagagccc

SEQ ID NO: 73740 - RNA, 20 nt, Human
ggaucaccacuagagagccc

SEQ ID NO: 73741 - RNA, 23 nt, Human
ggcaggagggaguuagggaaugg

SEQ ID NO: 73742 - RNA, 23 nt, Human
ggcaggagggaguuagggaaugg

SEQ ID NO: 73743 - RNA, 22 nt, Human
ggcaggggucaggaacccuggg

SEQ ID NO: 73744 - RNA, 24 nt, Human
ggcaggggucaggaacccuggggg

SEQ ID NO: 73745 - RNA, 20 nt, Human
ggccccuacgccccggcccc

SEQ ID NO: 73746 - RNA, 18 nt, Human
ggcgguggggaggcagug

SEQ ID NO: 73747 - RNA, 18 nt, Human
ggcgguggggaggcagug

SEQ ID NO: 73748 - RNA, 20 nt, Human
gggacagggagccagggagg

SEQ ID NO: 73749 - RNA, 21 nt, Human
gggagcagggaacagacuggg

SEQ ID NO: 73750 - RNA, 18 nt, Human
gggagggcaggaguuuga

SEQ ID NO: 73751 - RNA, 18 nt, Human
gggagggcaggaguuuga

SEQ ID NO: 73752 - RNA, 20 nt, Human
gggcaggggucaggaacccu

SEQ ID NO: 73753 - RNA, 23 nt, Human
gggcaggggucaggaacccuggg

SEQ ID NO: 73754 - RNA, 19 nt, Human
gggccaugcuccacuugac

SEQ ID NO: 73755 - RNA, 19 nt, Human
gggcccaggagaggagcag

SEQ ID NO: 73756 - RNA, 24 nt, Human
gggcccuuuccuuuuccuccacuu

SEQ ID NO: 73757 - RNA, 24 nt, Human
gggcggccacgggcggcggcagca

SEQ ID NO: 73758 - RNA, 25 nt, Human
ggggcccuuuccuuuuccuccacuu

SEQ ID NO: 73759 - RNA, 21 nt, Human
gggugccuguugggauccaag

SEQ ID NO: 73760 - RNA, 21 nt, Human
gggugccuguugggauccaag

SEQ ID NO: 73761 - RNA, 22 nt, Human
gguaugucugauuugggggcag

SEQ ID NO: 73762 - RNA, 19 nt, Human
ggucaggaacccugggggg

SEQ ID NO: 73763 - RNA, 19 nt, Human
ggucaggaacccugggggg

SEQ ID NO: 73764 - RNA, 24 nt, Human
ggucccaccuugcccaccacccac

SEQ ID NO: 73765 - RNA, 24 nt, Human
ggucccaccuugcccaccacccac

SEQ ID NO: 73766 - RNA, 20 nt, Human
gguucuuaguccaggucagg

SEQ ID NO: 73767 - RNA, 20 nt, Human
gguucuuaguccaggucagg

SEQ ID NO: 73768 - RNA, 20 nt, Human
gucaggcagugaccugugcu

SEQ ID NO: 73769 - RNA, 20 nt, Human
guccugaaaaugaacccuag

SEQ ID NO: 73770 - RNA, 20 nt, Human
guccugaaaaugaacccuag

SEQ ID NO: 73771 - RNA, 26 nt, Human
gugaugcccgugggcugcucucuggu

SEQ ID NO: 73772 - RNA, 19 nt, Human
gugcuggacaccccacccu

SEQ ID NO: 73773 - RNA, 22 nt, Human
uaaaaugcccacacauaagcuc

SEQ ID NO: 73774 - RNA, 27 nt, Human
uaccccuuugccacugcuggaggagaa

SEQ ID NO: 73775 - RNA, 27 nt, Human
uaccccuuugccacugcuggaggagaa

SEQ ID NO: 73776 - RNA, 21 nt, Human
uagaaaggagggugaugguga

SEQ ID NO: 73777 - RNA, 18 nt, Human
uagaauaauuuccaaagc

SEQ ID NO: 73778 - RNA, 18 nt, Human
uagaauaauuuccaaagc

SEQ ID NO: 73779 - RNA, 22 nt, Human
uagagugcccacacauaagcuc

SEQ ID NO: 73780 - RNA, 23 nt, Human
uagggagaaauaacauuuucuuu

SEQ ID NO: 73781 - RNA, 23 nt, Human
uagggagaaauaacauuuucuuu

SEQ ID NO: 73782 - RNA, 19 nt, Human
ucaggcagugaccugugcu

SEQ ID NO: 73783 - RNA, 19 nt, Human
ucaggcagugaccugugcu

SEQ ID NO: 73784 - RNA, 19 nt, Human
ucaggcagugaccugugcu

SEQ ID NO: 73785 - RNA, 21 nt, Human
ucaguaggcuggggcccuuuc

SEQ ID NO: 73786 - RNA, 24 nt, Human
ucauucccaauaaagaugaaggcu

SEQ ID NO: 73787 - RNA, 20 nt, Human
uccaaagcagugugcucagg

SEQ ID NO: 73788 - RNA, 20 nt, Human
uccaaagcagugugcucagg

SEQ ID NO: 73789 - RNA, 22 nt, Human
uccaaagcagugugcucaggcc

SEQ ID NO: 73790 - RNA, 22 nt, Human
uccaaagcagugugcucaggcc

SEQ ID NO: 73791 - RNA, 22 nt, Human
uccacccugaggucuguggcuc

SEQ ID NO: 73792 - RNA, 22 nt, Human
uccacccugaggucuguggcuc

SEQ ID NO: 73793 - RNA, 25 nt, Human
uccaguccaggcgaggggccuagca

SEQ ID NO: 73794 - RNA, 25 nt, Human
uccaguccaggcgaggggccuagca

SEQ ID NO: 73795 - RNA, 24 nt, Human
uccagugggccccagaggccuggg

SEQ ID NO: 73796 - RNA, 20 nt, Human
ucccaauaaagaugaaggcu

SEQ ID NO: 73797 - RNA, 18 nt, Human
ucccacccacccacccac

SEQ ID NO: 73798 - RNA, 18 nt, Human
ucccacccacccacccac

SEQ ID NO: 73799 - RNA, 26 nt, Human
ucccaccuugcccaccacccaccgcc

SEQ ID NO: 73800 - RNA, 26 nt, Human
ucccaccuugcccaccacccaccgcc

SEQ ID NO: 73801 - RNA, 22 nt, Human
ucccagcagccccugcccccuc

SEQ ID NO: 73802 - RNA, 22 nt, Human
ucccagcagccccugcccccuc

SEQ ID NO: 73803 - RNA, 24 nt, Human
ucccuccucuuuccaggcugcagg

SEQ ID NO: 73804 - RNA, 24 nt, Human
ucccuccucuuuccaggcugcagg

SEQ ID NO: 73805 - RNA, 19 nt, Human
uccucuuuccaggcugcag

SEQ ID NO: 73806 - RNA, 19 nt, Human
uccucuuuccaggcugcag

SEQ ID NO: 73807 - RNA, 21 nt, Human
ucgcuguccaggggcaggggu

SEQ ID NO: 73808 - RNA, 19 nt, Human
ucgggcccuggucacgcug

SEQ ID NO: 73809 - RNA, 24 nt, Human
ucucuggacugagucccacccacc

SEQ ID NO: 73810 - RNA, 24 nt, Human
ucucuggacugagucccacccacc

SEQ ID NO: 73811 - RNA, 24 nt, Human
ucucuggucuucagaauucccugg

SEQ ID NO: 73812 - RNA, 20 nt, Human
ucugugaggcaguaaaaugc

SEQ ID NO: 73813 - RNA, 20 nt, Human
ucuucagaauucccuggcug

SEQ ID NO: 73814 - RNA, 19 nt, Human
ugaauggcccucagaccuc

SEQ ID NO: 73815 - RNA, 19 nt, Human
ugaauggcccucagaccuc

SEQ ID NO: 73816 - RNA, 22 nt, Human
ugaauggcccucagaccucucc

SEQ ID NO: 73817 - RNA, 22 nt, Human
ugaauggcccucagaccucucc

SEQ ID NO: 73818 - RNA, 24 nt, Human
ugaauggcccucagaccucuccug

SEQ ID NO: 73819 - RNA, 24 nt, Human
ugaauggcccucagaccucuccug

SEQ ID NO: 73820 - RNA, 19 nt, Human
ugacauccaggguguaaga

SEQ ID NO: 73821 - RNA, 19 nt, Human
ugacauccaggguguaaga

SEQ ID NO: 73822 - RNA, 26 nt, Human
ugacuuagggagaaauaacauuuucu

SEQ ID NO: 73823 - RNA, 26 nt, Human
ugacuuagggagaaauaacauuuucu

SEQ ID NO: 73824 - RNA, 23 nt, Human
ugagcccagggacagggagccag

SEQ ID NO: 73825 - RNA, 21 nt, Human
ugaggugggcuagcucugcau

SEQ ID NO: 73826 - RNA, 21 nt, Human
ugaggugggcuagcucugcau

SEQ ID NO: 73827 - RNA, 19 nt, Human
ugcagggcugggugccugu

SEQ ID NO: 73828 - RNA, 21 nt, Human
ugccagcgagggagcagggaa

SEQ ID NO: 73829 - RNA, 21 nt, Human
ugccagcgagggagcagggaa

SEQ ID NO: 73830 - RNA, 27 nt, Human
ugcccaccuccucccuucucucccaac

SEQ ID NO: 73831 - RNA, 27 nt, Human
ugcccaccuccucccuucucucccaac

SEQ ID NO: 73832 - RNA, 21 nt, Human
ugcccccucuuucccagcccc

SEQ ID NO: 73833 - RNA, 21 nt, Human
ugcccccucuuucccagcccc

SEQ ID NO: 73834 - RNA, 20 nt, Human
ugcgcuggagcaccagcuug

SEQ ID NO: 73835 - RNA, 19 nt, Human
ugcucuguaaacgugaacc

SEQ ID NO: 73836 - RNA, 19 nt, Human
ugcuuaaauucucuguccu

SEQ ID NO: 73837 - RNA, 22 nt, Human
uggaggagaagggguaaaggaa

SEQ ID NO: 73838 - RNA, 22 nt, Human
uggaggagaagggguaaaggaa

SEQ ID NO: 73839 - RNA, 19 nt, Human
uggcccucagaccucuccu

SEQ ID NO: 73840 - RNA, 19 nt, Human
uggcccucagaccucuccu

SEQ ID NO: 73841 - RNA, 19 nt, Human
ugggccccagaggccuggg

SEQ ID NO: 73842 - RNA, 20 nt, Human
uggggugggaggcuguuagu

SEQ ID NO: 73843 - RNA, 20 nt, Human
uggggugggaggcuguuagu

SEQ ID NO: 73844 - RNA, 23 nt, Human
ugugcuuaaauucucuguccuuu

SEQ ID NO: 73845 - RNA, 23 nt, Human
uguucauuaucaaaguccugaaa

SEQ ID NO: 73846 - RNA, 23 nt, Human
uguucauuaucaaaguccugaaa

SEQ ID NO: 73847 - RNA, 18 nt, Human
uuaauggggugggaggcu

SEQ ID NO: 73848 - RNA, 18 nt, Human
uuaauggggugggaggcu

SEQ ID NO: 73849 - RNA, 20 nt, Human
uuaguuaaaaaauaaacacc

SEQ ID NO: 73850 - RNA, 20 nt, Human
uuaguuaaaaaauaaacacc

SEQ ID NO: 73851 - RNA, 22 nt, Human
uucccagccccucugcuacucc

SEQ ID NO: 73852 - RNA, 22 nt, Human
uucccagccccucugcuacucc

SEQ ID NO: 73853 - RNA, 19 nt, Human
uucccuuuuuuguguuuag

SEQ ID NO: 73854 - RNA, 19 nt, Human
uucccuuuuuuguguuuag

SEQ ID NO: 73855 - RNA, 19 nt, Human
uugcggaagcagguuugga

SEQ ID NO: 73856 - RNA, 22 nt, Human
uuggagaguccggcccaacugg

SEQ ID NO: 73857 - RNA, 20 nt, Human
uuguucuggcaucaggcugg

SEQ ID NO: 73858 - RNA, 24 nt, Human
uuucugauuuauaacaaacucauu

SEQ ID NO: 73859 - RNA, 24 nt, Human
uuucugauuuauaacaaacucauu

SEQ ID NO: 73860 - RNA, 22 nt, Human
uuuuuuguguuuagaauaauuu

SEQ ID NO: 73861 - RNA, 22 nt, Human
uuuuuuguguuuagaauaauuu

SEQ ID NO: 73862 - RNA, 18 nt, Human
uuuuuuuuuuuuuuuuug

SEQ ID NO: 73863 - RNA, 22 nt, Human
aaccucaaaccuucccuggcac

SEQ ID NO: 73864 - RNA, 24 nt, Human
aagaugcuggaacaguaccaggug

SEQ ID NO: 73865 - RNA, 21 nt, Human
acagucccgccucugccccuc

SEQ ID NO: 73866 - RNA, 23 nt, Human
accaccucucugguaucccccca

SEQ ID NO: 73867 - RNA, 23 nt, Human
accccagaaacucugagcucucu

SEQ ID NO: 73868 - RNA, 23 nt, Human
accugaaucucucccuucuccag

SEQ ID NO: 73869 - RNA, 19 nt, Human
agacacugaggccugaagc

SEQ ID NO: 73870 - RNA, 27 nt, Human
agacccaggaaaggguuaagaucagga

SEQ ID NO: 73871 - RNA, 19 nt, Human
agcugggggcugcaggggg

SEQ ID NO: 73872 - RNA, 18 nt, Human
aggacacuugccucccuc

SEQ ID NO: 73873 - RNA, 21 nt, Human
aggcugccccaucacaaugcc

SEQ ID NO: 73874 - RNA, 19 nt, Human
aguaggugagagcagggaa

SEQ ID NO: 73875 - RNA, 25 nt, Human
caccuccaccauuacagcauuugau

SEQ ID NO: 73876 - RNA, 20 nt, Human
caggaaaggguuaagaucag

SEQ ID NO: 73877 - RNA, 24 nt, Human
ccaccucucugguauccccccaac

SEQ ID NO: 73878 - RNA, 20 nt, Human
cccacaaguaaggagggggc

SEQ ID NO: 73879 - RNA, 21 nt, Human
cccagugcuguucucugaauu

SEQ ID NO: 73880 - RNA, 20 nt, Human
ccccagaaacucugagcucu

SEQ ID NO: 73881 - RNA, 22 nt, Human
ccccagaaacucugagcucuca

SEQ ID NO: 73882 - RNA, 25 nt, Human
ccccagaaacucugagcucucacaa

SEQ ID NO: 73883 - RNA, 19 nt, Human
ccccagacgacagucccgc

SEQ ID NO: 73884 - RNA, 25 nt, Human
cccccagacgacagucccgccucug

SEQ ID NO: 73885 - RNA, 22 nt, Human
cccccguaaucuguaaaacaua

SEQ ID NO: 73886 - RNA, 18 nt, Human
cccuccucugcccacacc

SEQ ID NO: 73887 - RNA, 21 nt, Human
ccuaaugaggaccccagaaac

SEQ ID NO: 73888 - RNA, 18 nt, Human
ccucugccccucuaccug

SEQ ID NO: 73889 - RNA, 23 nt, Human
ccuguuggccuugggcccauuaa

SEQ ID NO: 73890 - RNA, 20 nt, Human
cucccuccucugcccacacc

SEQ ID NO: 73891 - RNA, 19 nt, Human
cuccucugcccacaccucc

SEQ ID NO: 73892 - RNA, 23 nt, Human
cucugccccucuaccugcuccuc

SEQ ID NO: 73893 - RNA, 19 nt, Human
cugccccucuaccugcucc

SEQ ID NO: 73894 - RNA, 19 nt, Human
cugcuccucucagcucgcg

SEQ ID NO: 73895 - RNA, 23 nt, Human
cuucugaguugucugagacccag

SEQ ID NO: 73896 - RNA, 22 nt, Human
cuucugccauuagcagccacaa

SEQ ID NO: 73897 - RNA, 24 nt, Human
gcccacaccuccaccauuacagca

SEQ ID NO: 73898 - RNA, 18 nt, Human
gcccagaggcuggggacc

SEQ ID NO: 73899 - RNA, 19 nt, Human
gcuguucucugaauucuug

SEQ ID NO: 73900 - RNA, 18 nt, Human
ggaguuccuccagccauc

SEQ ID NO: 73901 - RNA, 21 nt, Human
gggaugggggcuccuaaugag

SEQ ID NO: 73902 - RNA, 21 nt, Human
gugaggcauaugccuguuggc

SEQ ID NO: 73903 - RNA, 23 nt, Human
guguaggaguucgccagccagaa

SEQ ID NO: 73904 - RNA, 20 nt, Human
guuaagaucaggaccccucu

SEQ ID NO: 73905 - RNA, 21 nt, Human
uaagaucaggaccccucucuc

SEQ ID NO: 73906 - RNA, 20 nt, Human
uauucacucaucaaaccuca

SEQ ID NO: 73907 - RNA, 30 nt, Human
uauuccaccaccucucugguauccccccaa

SEQ ID NO: 73908 - RNA, 20 nt, Human
ucccuggcacucccuuaugc

SEQ ID NO: 73909 - RNA, 20 nt, Human
uccuauggaaacaggagcug

SEQ ID NO: 73910 - RNA, 21 nt, Human
uccuauuccaccaccucucug

SEQ ID NO: 73911 - RNA, 18 nt, Human
ugaggaccccagaaacuc

SEQ ID NO: 73912 - RNA, 23 nt, Human
ugccccucuaccugcuccucuca

SEQ ID NO: 73913 - RNA, 22 nt, Human
ugccucccuccucugcccacac

SEQ ID NO: 73914 - RNA, 21 nt, Human
uggaaacaggagcccagaggc

SEQ ID NO: 73915 - RNA, 22 nt, Human
uggaacucuagcacaggcacuu

SEQ ID NO: 73916 - RNA, 18 nt, Human
ugggggcugcaggggguc

SEQ ID NO: 73917 - RNA, 18 nt, Human
ugguauccccccaaccuu

SEQ ID NO: 73918 - RNA, 21 nt, Human
uuaaagaucauuccagcccca

SEQ ID NO: 73919 - RNA, 28 nt, Human
uuccagccccagugcuguucucugaauu

SEQ ID NO: 73920 - RNA, 19 nt, Human
uucuggcuggccuggaacu

SEQ ID NO: 73921 - RNA, 22 nt, Human
uugacuggcagacacugaggcc

SEQ ID NO: 73922 - RNA, 25 nt, Human
uugggcccauuaaagaucauuccag

SEQ ID NO: 73923 - RNA, 22 nt, Human
uuucaaaggacacuugccuccc

SEQ ID NO: 73924 - RNA, 21 nt, Human
acacugaguccacucucaggc

SEQ ID NO: 73925 - RNA, 18 nt, Human
aggaugccgggcggcggc

SEQ ID NO: 73926 - RNA, 26 nt, Human
aggaugccgggcggcggcggcggcgg

SEQ ID NO: 73927 - RNA, 21 nt, Human
augccgggcggcggcggcggc

SEQ ID NO: 73928 - RNA, 19 nt, Human
ccgggcggcggcggcggcg

SEQ ID NO: 73929 - RNA, 24 nt, Human
ccgggcggcggcggcggcgggguc

SEQ ID NO: 73930 - RNA, 18 nt, Human
cucucaggcuguugccca

SEQ ID NO: 73931 - RNA, 26 nt, Human
gcggcggcggcggcggggucgaagcg

SEQ ID NO: 73932 - RNA, 21 nt, Human
ggagacugucuccgugcucag

SEQ ID NO: 73933 - RNA, 18 nt, Human
ggcggcggcggcggcggg

SEQ ID NO: 73934 - RNA, 22 nt, Human
ugcucaggaugccgggcggcgg

SEQ ID NO: 73935 - RNA, 26 nt, Human
aaaaaaaaaaaaaaaaaaaacaagaa

SEQ ID NO: 73936 - RNA, 25 nt, Human
aaaaaaaaaaaaaaaaacaagaaaa

SEQ ID NO: 73937 - RNA, 22 nt, Human
aaaaaaaaaaaacaagaaaagg

SEQ ID NO: 73938 - RNA, 21 nt, Human
aaaaaaaacacaacaacuuua

SEQ ID NO: 73939 - RNA, 23 nt, Human
aaaaacacaacaacuuuacauuc

SEQ ID NO: 73940 - RNA, 19 nt, Human
aaaaaugcucaauaccccu

SEQ ID NO: 73941 - RNA, 24 nt, Human
aaacaagaaaagguagaguuuggg

SEQ ID NO: 73942 - RNA, 18 nt, Human
aaacaccagaauaaaaau

SEQ ID NO: 73943 - RNA, 19 nt, Human
aaacaccuugcagagcuaa

SEQ ID NO: 73944 - RNA, 25 nt, Human
aaacaccuugcagagcuaagaauuc

SEQ ID NO: 73945 - RNA, 22 nt, Human
aaacagaaaagggcacggcaca

SEQ ID NO: 73946 - RNA, 24 nt, Human
aaacagaaaagggcacggcacaug

SEQ ID NO: 73947 - RNA, 21 nt, Human
aaauacacagcacaacagguc

SEQ ID NO: 73948 - RNA, 21 nt, Human
aacacagaaguuaccacucag

SEQ ID NO: 73949 - RNA, 20 nt, Human
aacacaucaagaaacccgca

SEQ ID NO: 73950 - RNA, 22 nt, Human
aaccaaaaaaaaaaaaaaaaaa

SEQ ID NO: 73951 - RNA, 21 nt, Human
aacuaccaaaaagaugacacc

SEQ ID NO: 73952 - RNA, 20 nt, Human
aagaaccaaguuagcaucug

SEQ ID NO: 73953 - RNA, 21 nt, Human
aagaaggggguggggggagga

SEQ ID NO: 73954 - RNA, 22 nt, Human
aagaaggggguggggggaggac

SEQ ID NO: 73955 - RNA, 20 nt, Human
aaugguaaauacacacauuu

SEQ ID NO: 73956 - RNA, 25 nt, Human
acagaaaagggcacggcacaugaca

SEQ ID NO: 73957 - RNA, 21 nt, Human
acagaaagagaggcuuucauu

SEQ ID NO: 73958 - RNA, 22 nt, Human
acagcagagacccuguccaggc

SEQ ID NO: 73959 - RNA, 22 nt, Human
acaggcaagaggcaaaggaaca

SEQ ID NO: 73960 - RNA, 23 nt, Human
acaugccgagccaaguugggggc

SEQ ID NO: 73961 - RNA, 19 nt, Human
accuugcagagcuaagaau

SEQ ID NO: 73962 - RNA, 18 nt, Human
agaaggggguggggggag

SEQ ID NO: 73963 - RNA, 24 nt, Human
agaggaaggaggaagaacugggag

SEQ ID NO: 73964 - RNA, 18 nt, Human
aggaaaucaaaauacaca

SEQ ID NO: 73965 - RNA, 22 nt, Human
aggaagaacugguaacaaaggg

SEQ ID NO: 73966 - RNA, 26 nt, Human
aggcaaaaauacaguucuguuuugaa

SEQ ID NO: 73967 - RNA, 21 nt, Human
aggcaaaagguccagggcuca

SEQ ID NO: 73968 - RNA, 23 nt, Human
aggcaagaggcaaaggaacaaaa

SEQ ID NO: 73969 - RNA, 24 nt, Human
aggcagcacagcaucuccuuuacu

SEQ ID NO: 73970 - RNA, 21 nt, Human
aggcuggcaccuggacaaagg

SEQ ID NO: 73971 - RNA, 19 nt, Human
aggugcagaggcuucuguc

SEQ ID NO: 73972 - RNA, 24 nt, Human
aguacagcagagacccuguccagg

SEQ ID NO: 73973 - RNA, 21 nt, Human
aguggagaguucugcacagua

SEQ ID NO: 73974 - RNA, 19 nt, Human
aguucugacucuuggguga

SEQ ID NO: 73975 - RNA, 27 nt, Human
auacaaagccuucuggaaaaagaacca

SEQ ID NO: 73976 - RNA, 23 nt, Human
aucucacggaccaggcaaacauc

SEQ ID NO: 73977 - RNA, 18 nt, Human
augagccaaggggagcug

SEQ ID NO: 73978 - RNA, 19 nt, Human
caaaauaucccaccugucc

SEQ ID NO: 73979 - RNA, 22 nt, Human
caaaggccaguucacacagagu

SEQ ID NO: 73980 - RNA, 24 nt, Human
caacacaaaaucaagcuagaucca

SEQ ID NO: 73981 - RNA, 19 nt, Human
caauaccccuccccauauu

SEQ ID NO: 73982 - RNA, 19 nt, Human
cacacagagucaccagcaa

SEQ ID NO: 73983 - RNA, 19 nt, Human
cacagaaacagaaaagggc

SEQ ID NO: 73984 - RNA, 22 nt, Human
cacagcacaacaggucucuggg

SEQ ID NO: 73985 - RNA, 19 nt, Human
caccaagaucagacacagc

SEQ ID NO: 73986 - RNA, 21 nt, Human
caccagaacagaggcucccuc

SEQ ID NO: 73987 - RNA, 20 nt, Human
cacuuuggaaaagucaggag

SEQ ID NO: 73988 - RNA, 21 nt, Human
cagagcuaagaauucacaugc

SEQ ID NO: 73989 - RNA, 22 nt, Human
cagcagauuggcagagacacac

SEQ ID NO: 73990 - RNA, 19 nt, Human
cagcucagccuccacacug

SEQ ID NO: 73991 - RNA, 20 nt, Human
cauccaggccuaacugugcc

SEQ ID NO: 73992 - RNA, 22 nt, Human
ccaaaaaaaaaaaaaaaaaaaa

SEQ ID NO: 73993 - RNA, 23 nt, Human
ccaaaaaaaaaaaaaaaaaaaaa

SEQ ID NO: 73994 - RNA, 19 nt, Human
ccacauacuugacaugaau

SEQ ID NO: 73995 - RNA, 21 nt, Human
ccaccucugccucucugaucu

SEQ ID NO: 73996 - RNA, 20 nt, Human
ccagcagauuggcagagaca

SEQ ID NO: 73997 - RNA, 19 nt, Human
ccagcucagccuccacacu

SEQ ID NO: 73998 - RNA, 26 nt, Human
ccaggcaccagcucagccuccacacu

SEQ ID NO: 73999 - RNA, 25 nt, Human
ccagggcucaaguuuuaaauccuuc

SEQ ID NO: 74000 - RNA, 18 nt, Human
cccacaacucccucucaa

SEQ ID NO: 74001 - RNA, 20 nt, Human
ccccauauuuaaaacaccag

SEQ ID NO: 74002 - RNA, 19 nt, Human
cccccagcccugaaauccc

SEQ ID NO: 74003 - RNA, 20 nt, Human
cccgcccgcggcgccgcagg

SEQ ID NO: 74004 - RNA, 18 nt, Human
cccgcggcgccgcaggcg

SEQ ID NO: 74005 - RNA, 18 nt, Human
ccucucugaucuuuccca

SEQ ID NO: 74006 - RNA, 20 nt, Human
ccugaacccccagcccugaa

SEQ ID NO: 74007 - RNA, 21 nt, Human
ccuguccuggucaucuggaaa

SEQ ID NO: 74008 - RNA, 21 nt, Human
ccugugaaaaccugaggugga

SEQ ID NO: 74009 - RNA, 21 nt, Human
cgucagcaaauggggggagca

SEQ ID NO: 74010 - RNA, 23 nt, Human
cucacggaccaggcaaacaucca

SEQ ID NO: 74011 - RNA, 20 nt, Human
cucccuccgcccugcccacc

SEQ ID NO: 74012 - RNA, 21 nt, Human
cugaugcuagaguugcccugg

SEQ ID NO: 74013 - RNA, 19 nt, Human
cuggucaucuggaaagcca

SEQ ID NO: 74014 - RNA, 18 nt, Human
cuucccgccgccgcuuuu

SEQ ID NO: 74015 - RNA, 22 nt, Human
gaaaagacauaugacacauuga

SEQ ID NO: 74016 - RNA, 21 nt, Human
gaaccugagcccaggcuggca

SEQ ID NO: 74017 - RNA, 23 nt, Human
gaaguucuugggagggaguuggg

SEQ ID NO: 74018 - RNA, 21 nt, Human
gaccagcccagcagauuggca

SEQ ID NO: 74019 - RNA, 23 nt, Human
gaucauaauuagaacucgaucug

SEQ ID NO: 74020 - RNA, 24 nt, Human
gcaaagcaguaaaggcacagauaa

SEQ ID NO: 74021 - RNA, 21 nt, Human
gcaaaggcauaaacaccuugc

SEQ ID NO: 74022 - RNA, 19 nt, Human
gcaguaaaggcacagauaa

SEQ ID NO: 74023 - RNA, 24 nt, Human
gccaagaaaaauaaauugucauga

SEQ ID NO: 74024 - RNA, 18 nt, Human
gcgguacauaacucccag

SEQ ID NO: 74025 - RNA, 22 nt, Human
ggcaaaagguccagggcucaag

SEQ ID NO: 74026 - RNA, 22 nt, Human
ggcaagaggcaaaggaacaaaa

SEQ ID NO: 74027 - RNA, 22 nt, Human
ggccugaggggucagucuaagg

SEQ ID NO: 74028 - RNA, 25 nt, Human
ggcugguaccaggagggcagugguu

SEQ ID NO: 74029 - RNA, 18 nt, Human
gggagguggcccccacca

SEQ ID NO: 74030 - RNA, 22 nt, Human
gggccagagggugauuuugcuc

SEQ ID NO: 74031 - RNA, 23 nt, Human
gggggcaaaauaucccaccuguc

SEQ ID NO: 74032 - RNA, 20 nt, Human
gguaccaggagggcaguggu

SEQ ID NO: 74033 - RNA, 22 nt, Human
ggugugggcuacaggaggggag

SEQ ID NO: 74034 - RNA, 23 nt, Human
gucagucuaaggaggcugaggcu

SEQ ID NO: 74035 - RNA, 20 nt, Human
gugccaccucugccucucug

SEQ ID NO: 74036 - RNA, 23 nt, Human
uaaaaaaugcucaauaccccucc

SEQ ID NO: 74037 - RNA, 24 nt, Human
uaaaaaaugcucaauaccccuccc

SEQ ID NO: 74038 - RNA, 24 nt, Human
uaaaaaaugcucaauaccccuccc

SEQ ID NO: 74039 - RNA, 19 nt, Human
uaaaggcacagauaagacu

SEQ ID NO: 74040 - RNA, 20 nt, Human
uaaauccuuuugcuaagaaa

SEQ ID NO: 74041 - RNA, 23 nt, Human
uaacacagaaguuaccacucagg

SEQ ID NO: 74042 - RNA, 18 nt, Human
uacaacuaccaaaaagau

SEQ ID NO: 74043 - RNA, 18 nt, Human
uacacagcacaacagguc

SEQ ID NO: 74044 - RNA, 22 nt, Human
uacacaggaaaucaaaauacac

SEQ ID NO: 74045 - RNA, 25 nt, Human
uacacaggaaaucaaaauacacagc

SEQ ID NO: 74046 - RNA, 23 nt, Human
uaccaaaaagaugacaccaaucc

SEQ ID NO: 74047 - RNA, 23 nt, Human
uaccaggagggcagugguuuggg

SEQ ID NO: 74048 - RNA, 21 nt, Human
uauauuuauuuuucucccuaa

SEQ ID NO: 74049 - RNA, 22 nt, Human
uauuucccacaacucccucuca

SEQ ID NO: 74050 - RNA, 20 nt, Human
ucaagaaacccgcaaaggca

SEQ ID NO: 74051 - RNA, 21 nt, Human
ucaccgggaauguguuccacg

SEQ ID NO: 74052 - RNA, 20 nt, Human
ucccaacagagguggguuug

SEQ ID NO: 74053 - RNA, 22 nt, Human
ucccaggaaaaggaaaugcucc

SEQ ID NO: 74054 - RNA, 21 nt, Human
uccccauauuuaaaacaccag

SEQ ID NO: 74055 - RNA, 21 nt, Human
ucccucucaaugcagucauuu

SEQ ID NO: 74056 - RNA, 18 nt, Human
ucccugaacccccagccc

SEQ ID NO: 74057 - RNA, 18 nt, Human
ucucccagguauccuccc

SEQ ID NO: 74058 - RNA, 18 nt, Human
ucugcacaguaggugcag

SEQ ID NO: 74059 - RNA, 19 nt, Human
ucugccucucugaucuuuc

SEQ ID NO: 74060 - RNA, 21 nt, Human
ucugcggacagaaagagaggc

SEQ ID NO: 74061 - RNA, 18 nt, Human
ucuugagaaaaccuggcc

SEQ ID NO: 74062 - RNA, 19 nt, Human
ucuugggagggaguugggg

SEQ ID NO: 74063 - RNA, 21 nt, Human
ugaaagaagggggugggggga

SEQ ID NO: 74064 - RNA, 23 nt, Human
ugaaagaaggggguggggggagg

SEQ ID NO: 74065 - RNA, 27 nt, Human
ugaacccccagcccugaaauccccagg

SEQ ID NO: 74066 - RNA, 25 nt, Human
ugacaugaaugagaagguaaccaaa

SEQ ID NO: 74067 - RNA, 18 nt, Human
ugaccgggaggccuuacc

SEQ ID NO: 74068 - RNA, 24 nt, Human
ugagaaaaccuggccugccagcua

SEQ ID NO: 74069 - RNA, 19 nt, Human
ugagagggaccagcccagc

SEQ ID NO: 74070 - RNA, 23 nt, Human
ugagccaaggggagcugucacuc

SEQ ID NO: 74071 - RNA, 23 nt, Human
ugcaauagaaaauaauuuuuaac

SEQ ID NO: 74072 - RNA, 19 nt, Human
ugcacaguaggugcagagg

SEQ ID NO: 74073 - RNA, 19 nt, Human
ugcccuggaauccacacac

SEQ ID NO: 74074 - RNA, 19 nt, Human
ugccgagccaaguuggggg

SEQ ID NO: 74075 - RNA, 20 nt, Human
ugccuugggcccaggugagc

SEQ ID NO: 74076 - RNA, 21 nt, Human
ugcucaauaccccuccccaua

SEQ ID NO: 74077 - RNA, 21 nt, Human
uggcagagacacacagcagag

SEQ ID NO: 74078 - RNA, 21 nt, Human
uggcagagacacacagcagag

SEQ ID NO: 74079 - RNA, 23 nt, Human
uggcuaugcagagcccccgcccc

SEQ ID NO: 74080 - RNA, 21 nt, Human
uggcucaauagcucccaacag

SEQ ID NO: 74081 - RNA, 18 nt, Human
ugggagggaguuggggug

SEQ ID NO: 74082 - RNA, 18 nt, Human
ugggcccaggugagccca

SEQ ID NO: 74083 - RNA, 21 nt, Human
uggggaggguuggggaagugg

SEQ ID NO: 74084 - RNA, 18 nt, Human
ugguaaaaaugagaggga

SEQ ID NO: 74085 - RNA, 19 nt, Human
ugguaaacaaccugacugc

SEQ ID NO: 74086 - RNA, 18 nt, Human
ugguaacaaagggugggc

SEQ ID NO: 74087 - RNA, 21 nt, Human
ugucuugugucaucucauccc

SEQ ID NO: 74088 - RNA, 23 nt, Human
ugugggcuacaggaggggaggcg

SEQ ID NO: 74089 - RNA, 22 nt, Human
uucuaaccuauuucacgacaau

SEQ ID NO: 74090 - RNA, 19 nt, Human
uugcaugagucacagcugc

SEQ ID NO: 74091 - RNA, 22 nt, Human
uugcccuggaauccacacacau

SEQ ID NO: 74092 - RNA, 25 nt, Human
uuucuaguuuuaauaauauccuugg

SEQ ID NO: 74093 - RNA, 18 nt, Human
uuugcucugaugcuagag

SEQ ID NO: 74094 - RNA, 18 nt, Human
uuugugacagacagaccu

SEQ ID NO: 74095 - RNA, 23 nt, Human
uuugugacagacagaccugugug

SEQ ID NO: 74096 - RNA, 19 nt, Human
uuuugcucugaugcuagag

SEQ ID NO: 74097 - RNA, 23 nt, Human
aagaccugguaccgcacugaccc

SEQ ID NO: 74098 - RNA, 22 nt, Human
aagaucccaggcagcgacacag

SEQ ID NO: 74099 - RNA, 22 nt, Human
aagaucccaggcagcgacacag

SEQ ID NO: 74100 - RNA, 28 nt, Human
aaguagccagcauagggaagccggaagc

SEQ ID NO: 74101 - RNA, 21 nt, Human
aaucuucggcaccgagagccu

SEQ ID NO: 74102 - RNA, 21 nt, Human
aaucuucggcaccgagagccu

SEQ ID NO: 74103 - RNA, 23 nt, Human
acacagcauccccucuggucccc

SEQ ID NO: 74104 - RNA, 24 nt, Human
accccaagaucccaggcagcgaca

SEQ ID NO: 74105 - RNA, 24 nt, Human
accccaagaucccaggcagcgaca

SEQ ID NO: 74106 - RNA, 21 nt, Human
acucaagggggggaaacugag

SEQ ID NO: 74107 - RNA, 21 nt, Human
acucaagggggggaaacugag

SEQ ID NO: 74108 - RNA, 29 nt, Human
acuccaaagagggccacacuugaagaggg

SEQ ID NO: 74109 - RNA, 20 nt, Human
agccauugauucucagaaac

SEQ ID NO: 74110 - RNA, 21 nt, Human
agccauugauucucagaaacu

SEQ ID NO: 74111 - RNA, 18 nt, Human
agcgcagccgcugccgcc

SEQ ID NO: 74112 - RNA, 18 nt, Human
agcgcagccgcugccgcc

SEQ ID NO: 74113 - RNA, 20 nt, Human
aggcaggaggccccccaaag

SEQ ID NO: 74114 - RNA, 24 nt, Human
aggccaaccccaagaucccaggca

SEQ ID NO: 74115 - RNA, 24 nt, Human
aggccaaccccaagaucccaggca

SEQ ID NO: 74116 - RNA, 20 nt, Human
aguccucuggcaggcaaucu

SEQ ID NO: 74117 - RNA, 20 nt, Human
aguccucuggcaggcaaucu

SEQ ID NO: 74118 - RNA, 21 nt, Human
auccucgccaccccagcccca

SEQ ID NO: 74119 - RNA, 20 nt, Human
aucuucaucccagucaggga

SEQ ID NO: 74120 - RNA, 18 nt, Human
aucuucggcaccgagagc

SEQ ID NO: 74121 - RNA, 18 nt, Human
aucuucggcaccgagagc

SEQ ID NO: 74122 - RNA, 18 nt, Human
auggucagcuucguguuu

SEQ ID NO: 74123 - RNA, 22 nt, Human
caaaguagccagcauagggaag

SEQ ID NO: 74124 - RNA, 27 nt, Human
caccccagccccaguacucauugggga

SEQ ID NO: 74125 - RNA, 21 nt, Human
cagagcagcugccagccaggc

SEQ ID NO: 74126 - RNA, 21 nt, Human
cagagcagcugccagccaggc

SEQ ID NO: 74127 - RNA, 21 nt, Human
cagcugccagccaggcugugg

SEQ ID NO: 74128 - RNA, 21 nt, Human
cagcugccagccaggcugugg

SEQ ID NO: 74129 - RNA, 21 nt, Human
caggcaggaggccccccaaag

SEQ ID NO: 74130 - RNA, 22 nt, Human
caggccugacacaccuccaaag

SEQ ID NO: 74131 - RNA, 20 nt, Human
caggcggccacuggcccgcc

SEQ ID NO: 74132 - RNA, 20 nt, Human
caggcggccacuggcccgcc

SEQ ID NO: 74133 - RNA, 20 nt, Human
caguccucuggcaggcaauc

SEQ ID NO: 74134 - RNA, 24 nt, Human
ccaagccccaccugccucccaugc

SEQ ID NO: 74135 - RNA, 24 nt, Human
ccaagccccaccugccucccaugc

SEQ ID NO: 74136 - RNA, 20 nt, Human
ccaccugccucccaugcaaa

SEQ ID NO: 74137 - RNA, 21 nt, Human
cccaccugccucccaugcaaa

SEQ ID NO: 74138 - RNA, 23 nt, Human
cccaggcaggaggccccccaaag

SEQ ID NO: 74139 - RNA, 23 nt, Human
cccaggcaggaggccccccaaag

SEQ ID NO: 74140 - RNA, 20 nt, Human
ccccagccccaguacucauu

SEQ ID NO: 74141 - RNA, 24 nt, Human
ccccugggagcaaggggguuccca

SEQ ID NO: 74142 - RNA, 24 nt, Human
ccccugggagcaaggggguuccca

SEQ ID NO: 74143 - RNA, 19 nt, Human
cccuggggcuccugccucc

SEQ ID NO: 74144 - RNA, 19 nt, Human
cccuggggcuccugccucc

SEQ ID NO: 74145 - RNA, 18 nt, Human
ccgccucaagauggggug

SEQ ID NO: 74146 - RNA, 24 nt, Human
ccggcggcugcggacgguucccuc

SEQ ID NO: 74147 - RNA, 22 nt, Human
ccuagcccaggccacucugcga

SEQ ID NO: 74148 - RNA, 22 nt, Human
ccuagcccaggccacucugcga

SEQ ID NO: 74149 - RNA, 21 nt, Human
ccuaggggacucaaggggggg

SEQ ID NO: 74150 - RNA, 21 nt, Human
ccuaggggacucaaggggggg

SEQ ID NO: 74151 - RNA, 22 nt, Human
ccucccacccuuccaggcccua

SEQ ID NO: 74152 - RNA, 22 nt, Human
ccucccacccuuccaggcccua

SEQ ID NO: 74153 - RNA, 25 nt, Human
ccucccaugcaaaggccaaccccaa

SEQ ID NO: 74154 - RNA, 25 nt, Human
ccucccaugcaaaggccaaccccaa

SEQ ID NO: 74155 - RNA, 26 nt, Human
ccucucucagacagggaggcgggaac

SEQ ID NO: 74156 - RNA, 26 nt, Human
ccucucucagacagggaggcgggaac

SEQ ID NO: 74157 - RNA, 25 nt, Human
ccuggagguccuccacagagcagcu

SEQ ID NO: 74158 - RNA, 25 nt, Human
ccuggagguccuccacagagcagcu

SEQ ID NO: 74159 - RNA, 23 nt, Human
cgagggggccacgacggaggccg

SEQ ID NO: 74160 - RNA, 24 nt, Human
cgcaccaaagcuugcccccuacaa

SEQ ID NO: 74161 - RNA, 21 nt, Human
cgggaaggaggguugacuccc

SEQ ID NO: 74162 - RNA, 21 nt, Human
cgguugaagguguccucacca

SEQ ID NO: 74163 - RNA, 25 nt, Human
cucaggccugacacaccuccaaagu

SEQ ID NO: 74164 - RNA, 20 nt, Human
cuccaagaccugguaccgca

SEQ ID NO: 74165 - RNA, 22 nt, Human
cucccggcuccggcggcugcgg

SEQ ID NO: 74166 - RNA, 18 nt, Human
cugggcuagggggagggg

SEQ ID NO: 74167 - RNA, 18 nt, Human
cugggcuagggggagggg

SEQ ID NO: 74168 - RNA, 23 nt, Human
gacacagcauccccucugguccc

SEQ ID NO: 74169 - RNA, 23 nt, Human
gacacagcauccccucugguccc

SEQ ID NO: 74170 - RNA, 24 nt, Human
gacacagcauccccucuggucccc

SEQ ID NO: 74171 - RNA, 23 nt, Human
gacuggggcugggcuagggggag

SEQ ID NO: 74172 - RNA, 24 nt, Human
gcaaaggccaaccccaagauccca

SEQ ID NO: 74173 - RNA, 24 nt, Human
gcaaaggccaaccccaagauccca

SEQ ID NO: 74174 - RNA, 23 nt, Human
gcaccaaagcuugcccccuacaa

SEQ ID NO: 74175 - RNA, 19 nt, Human
gcagcuuggcccgguugaa

SEQ ID NO: 74176 - RNA, 25 nt, Human
gcuagggggagggggucgggaagga

SEQ ID NO: 74177 - RNA, 25 nt, Human
gcuagggggagggggucgggaagga

SEQ ID NO: 74178 - RNA, 18 nt, Human
gcuagggggccuagugaa

SEQ ID NO: 74179 - RNA, 18 nt, Human
gcuccugccuccucucuc

SEQ ID NO: 74180 - RNA, 18 nt, Human
gcuccugccuccucucuc

SEQ ID NO: 74181 - RNA, 20 nt, Human
ggaaaacagagcccagucuc

SEQ ID NO: 74182 - RNA, 20 nt, Human
ggaaaacagagcccagucuc

SEQ ID NO: 74183 - RNA, 20 nt, Human
ggcuagggggagggggucgg

SEQ ID NO: 74184 - RNA, 20 nt, Human
ggcuagggggagggggucgg

SEQ ID NO: 74185 - RNA, 19 nt, Human
gggaaggaggguugacucc

SEQ ID NO: 74186 - RNA, 19 nt, Human
gggaaggaggguugacucc

SEQ ID NO: 74187 - RNA, 19 nt, Human
ggggaaacugaggcacaga

SEQ ID NO: 74188 - RNA, 18 nt, Human
gggggagggggucgggaa

SEQ ID NO: 74189 - RNA, 18 nt, Human
gggggagggggucgggaa

SEQ ID NO: 74190 - RNA, 22 nt, Human
gucaguccucuggcaggcaauc

SEQ ID NO: 74191 - RNA, 24 nt, Human
guguagcuagggggccuagugaag

SEQ ID NO: 74192 - RNA, 18 nt, Human
guugccgagacaccucca

SEQ ID NO: 74193 - RNA, 22 nt, Human
uacugauccaagccccaccugc

SEQ ID NO: 74194 - RNA, 22 nt, Human
uacugauccaagccccaccugc

SEQ ID NO: 74195 - RNA, 20 nt, Human
uagcccaggccacucugcga

SEQ ID NO: 74196 - RNA, 20 nt, Human
uagcccaggccacucugcga

SEQ ID NO: 74197 - RNA, 23 nt, Human
uccauuagugucagccccgaggg

SEQ ID NO: 74198 - RNA, 20 nt, Human
uccccuccccugggagcaag

SEQ ID NO: 74199 - RNA, 20 nt, Human
uccccuccccugggagcaag

SEQ ID NO: 74200 - RNA, 26 nt, Human
uccccugggagcaaggggguucccaa

SEQ ID NO: 74201 - RNA, 26 nt, Human
uccccugggagcaaggggguucccaa

SEQ ID NO: 74202 - RNA, 21 nt, Human
uccucgccaccccagccccag

SEQ ID NO: 74203 - RNA, 22 nt, Human
ucgcugaagaugaagcagucau

SEQ ID NO: 74204 - RNA, 18 nt, Human
ugaaaaagguuuccccuc

SEQ ID NO: 74205 - RNA, 18 nt, Human
ugaaaaagguuuccccuc

SEQ ID NO: 74206 - RNA, 21 nt, Human
ugaagacccuuggaaaacaga

SEQ ID NO: 74207 - RNA, 21 nt, Human
ugaagacccuuggaaaacaga

SEQ ID NO: 74208 - RNA, 25 nt, Human
ugacacaccuccaaaguagccagca

SEQ ID NO: 74209 - RNA, 23 nt, Human
ugacuggggcugggcuaggggga

SEQ ID NO: 74210 - RNA, 24 nt, Human
ugacuggggcugggcuagggggag

SEQ ID NO: 74211 - RNA, 18 nt, Human
ugauccaagccccaccug

SEQ ID NO: 74212 - RNA, 18 nt, Human
ugauccaagccccaccug

SEQ ID NO: 74213 - RNA, 22 nt, Human
ugcaggggcuggcccgacccug

SEQ ID NO: 74214 - RNA, 22 nt, Human
ugcaggggcuggcccgacccug

SEQ ID NO: 74215 - RNA, 21 nt, Human
ugcccccuagacauaccuccc

SEQ ID NO: 74216 - RNA, 21 nt, Human
ugcccccuagacauaccuccc

SEQ ID NO: 74217 - RNA, 21 nt, Human
uggagccaguagcgcaggugg

SEQ ID NO: 74218 - RNA, 23 nt, Human
uggagccaguagcgcagguggug

SEQ ID NO: 74219 - RNA, 18 nt, Human
uggcccgacccugacagg

SEQ ID NO: 74220 - RNA, 18 nt, Human
uggcccgacccugacagg

SEQ ID NO: 74221 - RNA, 21 nt, Human
ugggagcaaggggguucccaa

SEQ ID NO: 74222 - RNA, 21 nt, Human
ugggagcaaggggguucccaa

SEQ ID NO: 74223 - RNA, 18 nt, Human
ugggcuagggggaggggg

SEQ ID NO: 74224 - RNA, 18 nt, Human
ugggcuagggggaggggg

SEQ ID NO: 74225 - RNA, 19 nt, Human
ugggcuagggggagggggu

SEQ ID NO: 74226 - RNA, 19 nt, Human
ugggcuagggggagggggu

SEQ ID NO: 74227 - RNA, 19 nt, Human
uggggcugcuccucagcag

SEQ ID NO: 74228 - RNA, 19 nt, Human
uggggcugcuccucagcag

SEQ ID NO: 74229 - RNA, 18 nt, Human
uggggcugggcuaggggg

SEQ ID NO: 74230 - RNA, 18 nt, Human
uggggcugggcuaggggg

SEQ ID NO: 74231 - RNA, 22 nt, Human
uuuuuuuuuuuuuuuuuccauu

SEQ ID NO: 74232 - RNA, 24 nt, Human
aaaucccagcccccugagccagga

SEQ ID NO: 74233 - RNA, 19 nt, Human
aacaacuucccgggaacca

SEQ ID NO: 74234 - RNA, 21 nt, Human
agagaaaggcuccauccagca

SEQ ID NO: 74235 - RNA, 24 nt, Human
agagggaccccucaggucuacagg

SEQ ID NO: 74236 - RNA, 18 nt, Human
agagggaggggcuugggg

SEQ ID NO: 74237 - RNA, 27 nt, Human
agagggcagagaaaggcuccccccgag

SEQ ID NO: 74238 - RNA, 18 nt, Human
aggcagaaaaugcccagg

SEQ ID NO: 74239 - RNA, 24 nt, Human
aggcauuaucuaaaauuggaaaug

SEQ ID NO: 74240 - RNA, 18 nt, Human
auagaauaaauauucaca

SEQ ID NO: 74241 - RNA, 21 nt, Human
aucaaaaucccagcccccuga

SEQ ID NO: 74242 - RNA, 18 nt, Human
cagcagcgaaucugggac

SEQ ID NO: 74243 - RNA, 20 nt, Human
cagcccccugagccaggacc

SEQ ID NO: 74244 - RNA, 23 nt, Human
cagcccccugagccaggaccaga

SEQ ID NO: 74245 - RNA, 23 nt, Human
cagcccugcuccuacucuagggg

SEQ ID NO: 74246 - RNA, 23 nt, Human
ccaccccaacagccgggcaggca

SEQ ID NO: 74247 - RNA, 23 nt, Human
ccauccagcacuccagcagcgaa

SEQ ID NO: 74248 - RNA, 24 nt, Human
cccaacagccgggcaggcaucgcu

SEQ ID NO: 74249 - RNA, 22 nt, Human
cccucaggucuacaggagccca

SEQ ID NO: 74250 - RNA, 23 nt, Human
cccucaggucuacaggagcccag

SEQ ID NO: 74251 - RNA, 19 nt, Human
ccgccaucuuggaagcggg

SEQ ID NO: 74252 - RNA, 26 nt, Human
cugccugucgucaccgccaccccaac

SEQ ID NO: 74253 - RNA, 21 nt, Human
cugggaccagcuggucuuuug

SEQ ID NO: 74254 - RNA, 26 nt, Human
gaaaauauaucaaaaucccagccccc

SEQ ID NO: 74255 - RNA, 22 nt, Human
gaaaggcuccauccagcacucc

SEQ ID NO: 74256 - RNA, 19 nt, Human
gaagagggaggggcuuggg

SEQ ID NO: 74257 - RNA, 23 nt, Human
gagccaggaccagaagagggagc

SEQ ID NO: 74258 - RNA, 22 nt, Human
gaucacucuucucuccauggaa

SEQ ID NO: 74259 - RNA, 20 nt, Human
gcuccuacucuaggggcagg

SEQ ID NO: 74260 - RNA, 21 nt, Human
gcuugggguccagcccugcuc

SEQ ID NO: 74261 - RNA, 19 nt, Human
ggaagcgggcgcugcgggg

SEQ ID NO: 74262 - RNA, 21 nt, Human
ggaagcgggcgcugcgggggc

SEQ ID NO: 74263 - RNA, 23 nt, Human
ggaccagcuggucuuuugcugcc

SEQ ID NO: 74264 - RNA, 21 nt, Human
uaaaauuggaaaugucacaga

SEQ ID NO: 74265 - RNA, 18 nt, Human
uaaauauucacagagguc

SEQ ID NO: 74266 - RNA, 19 nt, Human
uacucuaggggcagggacu

SEQ ID NO: 74267 - RNA, 18 nt, Human
uauaucaaaaucccagcc

SEQ ID NO: 74268 - RNA, 22 nt, Human
ucaccgccaccccaacagccgg

SEQ ID NO: 74269 - RNA, 23 nt, Human
ucaccgccaccccaacagccggg

SEQ ID NO: 74270 - RNA, 25 nt, Human
ucgcugccgccaucuuggaagcggg

SEQ ID NO: 74271 - RNA, 21 nt, Human
ucuuuugcugccugucgucac

SEQ ID NO: 74272 - RNA, 22 nt, Human
ugagccaggaccagaagaggga

SEQ ID NO: 74273 - RNA, 24 nt, Human
ugcuccuacucuaggggcagggac

SEQ ID NO: 74274 - RNA, 18 nt, Human
uggaagagggaggggcuu

SEQ ID NO: 74275 - RNA, 23 nt, Human
uuggaagcgggcgcugcgggggc

SEQ ID NO: 74276 - RNA, 25 nt, Human
aaacugcuaauucauauccuacuug

SEQ ID NO: 74277 - RNA, 18 nt, Human
aaacuuguaaacugcuaa

SEQ ID NO: 74278 - RNA, 22 nt, Human
aaaguccuucaaguauccauau

SEQ ID NO: 74279 - RNA, 18 nt, Human
aacaacucugguucucuc

SEQ ID NO: 74280 - RNA, 20 nt, Human
aaccggaguccucaaauagc

SEQ ID NO: 74281 - RNA, 21 nt, Human
aauacaaaaaggaaaaauuca

SEQ ID NO: 74282 - RNA, 24 nt, Human
acaaagaaucagucuuccaaacau

SEQ ID NO: 74283 - RNA, 22 nt, Human
acgugaauaauaucuaucucuc

SEQ ID NO: 74284 - RNA, 24 nt, Human
agagaauguauucucuggugggca

SEQ ID NO: 74285 - RNA, 20 nt, Human
agugauacuucuccuuggcu

SEQ ID NO: 74286 - RNA, 23 nt, Human
agugauacuucuccuuggcuugg

SEQ ID NO: 74287 - RNA, 23 nt, Human
auauaaaguccuucaaguaucca

SEQ ID NO: 74288 - RNA, 23 nt, Human
augacaacugaagauacaaugcc

SEQ ID NO: 74289 - RNA, 18 nt, Human
auuuuauccuuuggaguc

SEQ ID NO: 74290 - RNA, 27 nt, Human
caaacaaagaaucagucuuccaaaagg

SEQ ID NO: 74291 - RNA, 18 nt, Human
caaagugccacugcguga

SEQ ID NO: 74292 - RNA, 19 nt, Human
caccugcaaccagcucagc

SEQ ID NO: 74293 - RNA, 25 nt, Human
cacuccacccuccugcuaccucuuc

SEQ ID NO: 74294 - RNA, 18 nt, Human
caucaccaggagcucugc

SEQ ID NO: 74295 - RNA, 18 nt, Human
ccuccugcuaccucuuca

SEQ ID NO: 74296 - RNA, 23 nt, Human
ccugacaccaccacuucacagau

SEQ ID NO: 74297 - RNA, 25 nt, Human
cucugcuaagaaaauacaaaaagga

SEQ ID NO: 74298 - RNA, 20 nt, Human
cugcuaagaaaauacaaaaa

SEQ ID NO: 74299 - RNA, 18 nt, Human
cugggcagguccuccccu

SEQ ID NO: 74300 - RNA, 21 nt, Human
cuucaaguauccauauuacaa

SEQ ID NO: 74301 - RNA, 25 nt, Human
cuucaaguugagcuuuuccaaucug

SEQ ID NO: 74302 - RNA, 19 nt, Human
cuuuucuccccucuuuugu

SEQ ID NO: 74303 - RNA, 24 nt, Human
cuuuuggucacacccacugccuug

SEQ ID NO: 74304 - RNA, 18 nt, Human
gaaggcauaccugggcag

SEQ ID NO: 74305 - RNA, 24 nt, Human
ggcuuggggaggaaguguugcgug

SEQ ID NO: 74306 - RNA, 27 nt, Human
uaaauaaaucuccuucaaccggagucc

SEQ ID NO: 74307 - RNA, 18 nt, Human
uaagaaaauacaaaaagg

SEQ ID NO: 74308 - RNA, 25 nt, Human
uaauaucuaucucucugcuucacug

SEQ ID NO: 74309 - RNA, 27 nt, Human
uaccugggcagguccuccccugaaggc

SEQ ID NO: 74310 - RNA, 21 nt, Human
uaggccaaaauuauugcaaac

SEQ ID NO: 74311 - RNA, 20 nt, Human
uauguaaacuuguaaacugc

SEQ ID NO: 74312 - RNA, 23 nt, Human
ucaaguugagcuuuuccaaucug

SEQ ID NO: 74313 - RNA, 24 nt, Human
ucacacccacugccuuccgcuccu

SEQ ID NO: 74314 - RNA, 23 nt, Human
uccuuggcuuggggaggaagugu

SEQ ID NO: 74315 - RNA, 19 nt, Human
ucuuguuacaacuguuuua

SEQ ID NO: 74316 - RNA, 21 nt, Human
ucuuuuguggacgccuucuca

SEQ ID NO: 74317 - RNA, 22 nt, Human
ugauucgucgccuuuucucccc

SEQ ID NO: 74318 - RNA, 22 nt, Human
ugcagccgacacuccacccucc

SEQ ID NO: 74319 - RNA, 18 nt, Human
ugccugguuuuucucagu

SEQ ID NO: 74320 - RNA, 18 nt, Human
ugcuaauucauauccuac

SEQ ID NO: 74321 - RNA, 24 nt, Human
uggggaggaaguguugcguggccu

SEQ ID NO: 74322 - RNA, 27 nt, Human
uguacaaaaucauuuuacaaaaacucu

SEQ ID NO: 74323 - RNA, 26 nt, Human
uguccugauucgucgccuuuucuccc

SEQ ID NO: 74324 - RNA, 19 nt, Human
uucacauuuuacuacagag

SEQ ID NO: 74325 - RNA, 20 nt, Human
uuuguggacgccuucucacc

SEQ ID NO: 74326 - RNA, 21 nt, Human
uuuuuuuuuuuuuuugcuuuu

SEQ ID NO: 74327 - RNA, 22 nt, Human
uuuuuuuuuuuuuuugcuuuuu

SEQ ID NO: 74328 - RNA, 24 nt, Human
aaaaaacaaaacaaaaaauaauau

SEQ ID NO: 74329 - RNA, 20 nt, Human
aaaaagcccuaacccacaca

SEQ ID NO: 74330 - RNA, 21 nt, Human
aaaaaggcauuuuacauggcu

SEQ ID NO: 74331 - RNA, 18 nt, Human
aaaaaguaagagggggag

SEQ ID NO: 74332 - RNA, 22 nt, Human
aaaaauguaccccuggcaccuc

SEQ ID NO: 74333 - RNA, 19 nt, Human
aaaagccaaggcagggaca

SEQ ID NO: 74334 - RNA, 21 nt, Human
aaacaaacaaaacaaggccug

SEQ ID NO: 74335 - RNA, 19 nt, Human
aaacacccuccccuccacc

SEQ ID NO: 74336 - RNA, 22 nt, Human
aaacacccuccccuccacccuc

SEQ ID NO: 74337 - RNA, 24 nt, Human
aaagaaucuuuccagaaaccaaaa

SEQ ID NO: 74338 - RNA, 23 nt, Human
aaagacagaacacgaagccugga

SEQ ID NO: 74339 - RNA, 21 nt, Human
aacaaacaaacaaacaaaaca

SEQ ID NO: 74340 - RNA, 18 nt, Human
aaccaaagagaacaccag

SEQ ID NO: 74341 - RNA, 21 nt, Human
aagaucgccugacaacacugc

SEQ ID NO: 74342 - RNA, 22 nt, Human
aagaucgccugacaacacugcc

SEQ ID NO: 74343 - RNA, 19 nt, Human
aagcaacucacagccuuca

SEQ ID NO: 74344 - RNA, 18 nt, Human
aagcagccugcucuaaca

SEQ ID NO: 74345 - RNA, 18 nt, Human
aagggcgggggaggaaaa

SEQ ID NO: 74346 - RNA, 27 nt, Human
aaggggccacccaucagucgaccuggu

SEQ ID NO: 74347 - RNA, 23 nt, Human
aauccggucuuaccuggauccca

SEQ ID NO: 74348 - RNA, 28 nt, Human
aauggcucacacccgcccauaaucccag

SEQ ID NO: 74349 - RNA, 24 nt, Human
acaaacaaacaaacaaaacaaggc

SEQ ID NO: 74350 - RNA, 18 nt, Human
acacaaacaaacaaacaa

SEQ ID NO: 74351 - RNA, 23 nt, Human
acacacacacaccccuacacaca

SEQ ID NO: 74352 - RNA, 21 nt, Human
acacagacaugaccgcaaagg

SEQ ID NO: 74353 - RNA, 18 nt, Human
acacccuccccuccaccc

SEQ ID NO: 74354 - RNA, 22 nt, Human
acagaaccaucacaugcaacga

SEQ ID NO: 74355 - RNA, 22 nt, Human
acagcaugaacaaacggggaca

SEQ ID NO: 74356 - RNA, 26 nt, Human
accacacuccagcuuaggacaucggg

SEQ ID NO: 74357 - RNA, 24 nt, Human
accacucuauucuucaaaagaaca

SEQ ID NO: 74358 - RNA, 20 nt, Human
accagcucccuggcuccugg

SEQ ID NO: 74359 - RNA, 22 nt, Human
acccccccaccccccaaaacag

SEQ ID NO: 74360 - RNA, 23 nt, Human
accuguagucccagcuacucggg

SEQ ID NO: 74361 - RNA, 20 nt, Human
acgaaguacucuucagaaag

SEQ ID NO: 74362 - RNA, 19 nt, Human
agaagccgacagagacuac

SEQ ID NO: 74363 - RNA, 22 nt, Human
agagaaaaaguaagagggggag

SEQ ID NO: 74364 - RNA, 18 nt, Human
agagagccaggcccgggg

SEQ ID NO: 74365 - RNA, 18 nt, Human
agaucuagaagaauggug

SEQ ID NO: 74366 - RNA, 20 nt, Human
agauggaggcugcagugagc

SEQ ID NO: 74367 - RNA, 24 nt, Human
agcacuuugggaagucaagguggg

SEQ ID NO: 74368 - RNA, 23 nt, Human
agccaggugugguggugugcacc

SEQ ID NO: 74369 - RNA, 26 nt, Human
agccagugcugacgaaggaagucccc

SEQ ID NO: 74370 - RNA, 18 nt, Human
agccccgaagggccugcu

SEQ ID NO: 74371 - RNA, 25 nt, Human
agccugggcaacauggaagaaaccc

SEQ ID NO: 74372 - RNA, 19 nt, Human
agccuugaagauuuucagc

SEQ ID NO: 74373 - RNA, 24 nt, Human
agcuacucgggaggcugagguggg

SEQ ID NO: 74374 - RNA, 21 nt, Human
agcucacucccucaguuccag

SEQ ID NO: 74375 - RNA, 20 nt, Human
aggaaguccccaagcucacu

SEQ ID NO: 74376 - RNA, 18 nt, Human
aggaccacggcaggacca

SEQ ID NO: 74377 - RNA, 23 nt, Human
aggaguucgagaccagccugggc

SEQ ID NO: 74378 - RNA, 21 nt, Human
aggcagggacaaaggcccggu

SEQ ID NO: 74379 - RNA, 24 nt, Human
aggcugaggugggaaaauggcuug

SEQ ID NO: 74380 - RNA, 19 nt, Human
agggcaagacucguggggg

SEQ ID NO: 74381 - RNA, 19 nt, Human
aggugggaaaauggcuuga

SEQ ID NO: 74382 - RNA, 24 nt, Human
aggugugguggugugcaccuguag

SEQ ID NO: 74383 - RNA, 21 nt, Human
auaaaacaaaggaaaaccaaa

SEQ ID NO: 74384 - RNA, 22 nt, Human
auacauaaauccucaauuugaa

SEQ ID NO: 74385 - RNA, 19 nt, Human
aucacugaagccagcuggu

SEQ ID NO: 74386 - RNA, 20 nt, Human
augacauucuucaacugcau

SEQ ID NO: 74387 - RNA, 23 nt, Human
auucuacacucaucagacacaga

SEQ ID NO: 74388 - RNA, 24 nt, Human
auugcuugaguccaggaguucgag

SEQ ID NO: 74389 - RNA, 22 nt, Human
caaaaacacaaacaaacaaaca

SEQ ID NO: 74390 - RNA, 26 nt, Human
caaaaacacaaacaaacaaacaaaca

SEQ ID NO: 74391 - RNA, 25 nt, Human
caaaagaacaaaaacacaaacaaac

SEQ ID NO: 74392 - RNA, 27 nt, Human
caaaagaacaaaaacacaaacaaacaa

SEQ ID NO: 74393 - RNA, 18 nt, Human
caaacaaacaaacaaaac

SEQ ID NO: 74394 - RNA, 21 nt, Human
caaacaaacaaacaaaacaag

SEQ ID NO: 74395 - RNA, 22 nt, Human
caaacaaacaaacaaacaaaac

SEQ ID NO: 74396 - RNA, 23 nt, Human
caaacaaacaaacaaacaaaaca

SEQ ID NO: 74397 - RNA, 21 nt, Human
caaacacccuccccuccaccc

SEQ ID NO: 74398 - RNA, 23 nt, Human
caaacacccuccccuccacccuc

SEQ ID NO: 74399 - RNA, 26 nt, Human
caaagagaacaccagagaucuagaag

SEQ ID NO: 74400 - RNA, 24 nt, Human
caacauggaagaaaccccugucuc

SEQ ID NO: 74401 - RNA, 23 nt, Human
caacgaaaaaagcccuaacccac

SEQ ID NO: 74402 - RNA, 22 nt, Human
caagcucaaaaacacguaguga

SEQ ID NO: 74403 - RNA, 19 nt, Human
caaggcagggacaaaggcc

SEQ ID NO: 74404 - RNA, 24 nt, Human
caaggcugggcgcaauggcucaca

SEQ ID NO: 74405 - RNA, 23 nt, Human
caaggugggcggauugcuugagu

SEQ ID NO: 74406 - RNA, 22 nt, Human
cacacacauacacacacacacc

SEQ ID NO: 74407 - RNA, 21 nt, Human
cacacaccccuacacacaccc

SEQ ID NO: 74408 - RNA, 24 nt, Human
cacacauacacacacacaccccua

SEQ ID NO: 74409 - RNA, 23 nt, Human
cacacccccgccccccgcccccc

SEQ ID NO: 74410 - RNA, 26 nt, Human
cacacccccgccccccgccccccgcc

SEQ ID NO: 74411 - RNA, 19 nt, Human
cacaccccuacacacaccc

SEQ ID NO: 74412 - RNA, 28 nt, Human
cacacccgcccauaaucccagcacuuug

SEQ ID NO: 74413 - RNA, 23 nt, Human
cacagaaccaucacaugcaacga

SEQ ID NO: 74414 - RNA, 19 nt, Human
cacagcaaucaaagacaag

SEQ ID NO: 74415 - RNA, 18 nt, Human
cacauuugguuccuguuu

SEQ ID NO: 74416 - RNA, 19 nt, Human
cacauuugguuccuguuuu

SEQ ID NO: 74417 - RNA, 24 nt, Human
caccacacuccagcuuaggcgaca

SEQ ID NO: 74418 - RNA, 18 nt, Human
cacccucaauccccaccc

SEQ ID NO: 74419 - RNA, 22 nt, Human
cacccucaauccccacccaaag

SEQ ID NO: 74420 - RNA, 19 nt, Human
cacccuccccuccacccuc

SEQ ID NO: 74421 - RNA, 30 nt, Human
cacccuccccuccacccucaauccccaccu

SEQ ID NO: 74422 - RNA, 23 nt, Human
caccuguagucccagcuacucgg

SEQ ID NO: 74423 - RNA, 24 nt, Human
caccuguagucccagcuacucggg

SEQ ID NO: 74424 - RNA, 22 nt, Human
cacggcaggaccacggcaggac

SEQ ID NO: 74425 - RNA, 23 nt, Human
cacuccagcuuaggcgacagagc

SEQ ID NO: 74426 - RNA, 22 nt, Human
cagaacacgaagccuggagagc

SEQ ID NO: 74427 - RNA, 21 nt, Human
cagcacacgggccuggcugua

SEQ ID NO: 74428 - RNA, 24 nt, Human
cagcacuuugggaagucaaggugg

SEQ ID NO: 74429 - RNA, 22 nt, Human
cagcaugaacaaacggggacac

SEQ ID NO: 74430 - RNA, 21 nt, Human
cagccuucagugaggaaaggg

SEQ ID NO: 74431 - RNA, 21 nt, Human
cagcuacucgggaggcugagg

SEQ ID NO: 74432 - RNA, 24 nt, Human
cagcuacucgggaggcugaggugg

SEQ ID NO: 74433 - RNA, 23 nt, Human
cagcucccuggcuccuggcuccc

SEQ ID NO: 74434 - RNA, 20 nt, Human
cagugcaccugggcucuugc

SEQ ID NO: 74435 - RNA, 25 nt, Human
caucacaugcaacgaaaaaagcccu

SEQ ID NO: 74436 - RNA, 21 nt, Human
caugaacaaacggggacaccu

SEQ ID NO: 74437 - RNA, 20 nt, Human
caugcccuauauccacuccc

SEQ ID NO: 74438 - RNA, 21 nt, Human
caugcgcggccgacagggaag

SEQ ID NO: 74439 - RNA, 27 nt, Human
cauucuucaacugcauuuuaacugagu

SEQ ID NO: 74440 - RNA, 21 nt, Human
ccaaccaaguaaguggccuaa

SEQ ID NO: 74441 - RNA, 21 nt, Human
ccacacacauacacacacaca

SEQ ID NO: 74442 - RNA, 18 nt, Human
ccacucuauucuucaaaa

SEQ ID NO: 74443 - RNA, 19 nt, Human
ccagcugccccacagcaca

SEQ ID NO: 74444 - RNA, 25 nt, Human
ccaggaguucgagaccagccugggc

SEQ ID NO: 74445 - RNA, 18 nt, Human
ccagugcugacgaaggaa

SEQ ID NO: 74446 - RNA, 23 nt, Human
ccauaaaacaaaggaaaaccaaa

SEQ ID NO: 74447 - RNA, 19 nt, Human
cccaaacacccuccccucc

SEQ ID NO: 74448 - RNA, 21 nt, Human
cccaaacacccuccccuccac

SEQ ID NO: 74449 - RNA, 20 nt, Human
cccacacacauacacacaca

SEQ ID NO: 74450 - RNA, 22 nt, Human
cccacacacauacacacacaca

SEQ ID NO: 74451 - RNA, 25 nt, Human
cccacacacauacacacacacaccc

SEQ ID NO: 74452 - RNA, 22 nt, Human
cccauacacacccccgcccccc

SEQ ID NO: 74453 - RNA, 22 nt, Human
cccauacacacccccgcccccc

SEQ ID NO: 74454 - RNA, 23 nt, Human
cccauacacacccccgccccccg

SEQ ID NO: 74455 - RNA, 18 nt, Human
ccccaaaacagcaugaac

SEQ ID NO: 74456 - RNA, 20 nt, Human
cccccaccccccaaaacagc

SEQ ID NO: 74457 - RNA, 20 nt, Human
ccccccaccccccaaaacag

SEQ ID NO: 74458 - RNA, 24 nt, Human
cccccgccccccgccccccgcccc

SEQ ID NO: 74459 - RNA, 20 nt, Human
cccccgccccccgccccgcc

SEQ ID NO: 74460 - RNA, 18 nt, Human
ccccgccccccgcccccc

SEQ ID NO: 74461 - RNA, 20 nt, Human
ccccuccacccucaaucccc

SEQ ID NO: 74462 - RNA, 19 nt, Human
ccccugaacucugugaucc

SEQ ID NO: 74463 - RNA, 24 nt, Human
ccccugucucuacuaaaaauacaa

SEQ ID NO: 74464 - RNA, 18 nt, Human
cccgcagcuccccguccg

SEQ ID NO: 74465 - RNA, 24 nt, Human
cccgccccccgccccccgccccgc

SEQ ID NO: 74466 - RNA, 24 nt, Human
cccgccccgccaugcugaugaaaa

SEQ ID NO: 74467 - RNA, 20 nt, Human
cccucaauccccacccaaag

SEQ ID NO: 74468 - RNA, 19 nt, Human
cccuccccuccacccucaa

SEQ ID NO: 74469 - RNA, 20 nt, Human
ccgccaccgccugggccucg

SEQ ID NO: 74470 - RNA, 19 nt, Human
ccgccgccaccgccugggc

SEQ ID NO: 74471 - RNA, 21 nt, Human
ccgccgccgccaccgccuggg

SEQ ID NO: 74472 - RNA, 23 nt, Human
ccgccgccgccaccgccugggcc

SEQ ID NO: 74473 - RNA, 20 nt, Human
ccgccgccuccugggccgcc

SEQ ID NO: 74474 - RNA, 19 nt, Human
ccuccaaaaaaaaaucuca

SEQ ID NO: 74475 - RNA, 18 nt, Human
ccuggaucccagcugccc

SEQ ID NO: 74476 - RNA, 21 nt, Human
ccuguagucccagcuacucgg

SEQ ID NO: 74477 - RNA, 19 nt, Human
ccuuccaaaugacaucaua

SEQ ID NO: 74478 - RNA, 21 nt, Human
cgaaaaaagcccuaacccaca

SEQ ID NO: 74479 - RNA, 23 nt, Human
cgccccccgccccccgccccgcc

SEQ ID NO: 74480 - RNA, 24 nt, Human
cggauugcuugaguccaggaguuc

SEQ ID NO: 74481 - RNA, 25 nt, Human
cuaacccacacacauacacacacac

SEQ ID NO: 74482 - RNA, 22 nt, Human
cuauaugcaccauaaaacaaag

SEQ ID NO: 74483 - RNA, 19 nt, Human
cucacacccgcccauaauc

SEQ ID NO: 74484 - RNA, 28 nt, Human
cucacacccgcccauaaucccagcacuu

SEQ ID NO: 74485 - RNA, 20 nt, Human
cuccaaaaaaaaaucucauc

SEQ ID NO: 74486 - RNA, 20 nt, Human
cuccacccucaauccccacc

SEQ ID NO: 74487 - RNA, 24 nt, Human
cuccccguccgccgccuccugggc

SEQ ID NO: 74488 - RNA, 20 nt, Human
cuccccuccacccucaaucc

SEQ ID NO: 74489 - RNA, 23 nt, Human
cuccccuccacccucaaucccca

SEQ ID NO: 74490 - RNA, 20 nt, Human
cugcagaagccgacagagac

SEQ ID NO: 74491 - RNA, 22 nt, Human
cugcagugagcugugaucgugc

SEQ ID NO: 74492 - RNA, 21 nt, Human
cuggccaaucacucccacagu

SEQ ID NO: 74493 - RNA, 18 nt, Human
cuugcaaauaccccccca

SEQ ID NO: 74494 - RNA, 23 nt, Human
cuugcaaauacccccccaccccc

SEQ ID NO: 74495 - RNA, 20 nt, Human
gaaaaaagcccuaacccaca

SEQ ID NO: 74496 - RNA, 20 nt, Human
gaaaagacagaacacgaagg

SEQ ID NO: 74497 - RNA, 19 nt, Human
gaaacuguggccaaguucc

SEQ ID NO: 74498 - RNA, 20 nt, Human
gaacaaaaacacaaacaaac

SEQ ID NO: 74499 - RNA, 18 nt, Human
gaaccaucacaugcaacg

SEQ ID NO: 74500 - RNA, 20 nt, Human
gacaggaugugggguaggag

SEQ ID NO: 74501 - RNA, 20 nt, Human
gacgaaggaaguccccaagc

SEQ ID NO: 74502 - RNA, 24 nt, Human
gacugcuuucuugguggcgguggg

SEQ ID NO: 74503 - RNA, 23 nt, Human
gagaccagccugggcaacaugga

SEQ ID NO: 74504 - RNA, 18 nt, Human
gagcaagcucaaaaacaa

SEQ ID NO: 74505 - RNA, 21 nt, Human
gagggcuuugguuuggggaaa

SEQ ID NO: 74506 - RNA, 18 nt, Human
gauucccauacacacccc

SEQ ID NO: 74507 - RNA, 23 nt, Human
gcaaauacccccccaccccccaa

SEQ ID NO: 74508 - RNA, 24 nt, Human
gcaaauacccccccaccccccaaa

SEQ ID NO: 74509 - RNA, 20 nt, Human
gcacacagcaaucaaagaca

SEQ ID NO: 74510 - RNA, 20 nt, Human
gcagggacaaaggcccggug

SEQ ID NO: 74511 - RNA, 21 nt, Human
gcccuaacccacacacauaca

SEQ ID NO: 74512 - RNA, 24 nt, Human
gccuaggagauggaggcugcagug

SEQ ID NO: 74513 - RNA, 22 nt, Human
gccuggccaaucacucccacag

SEQ ID NO: 74514 - RNA, 25 nt, Human
gccuucagugaggaaaggggagagg

SEQ ID NO: 74515 - RNA, 20 nt, Human
gcggccgacagggaagagug

SEQ ID NO: 74516 - RNA, 20 nt, Human
gcucacacccgcccauaauc

SEQ ID NO: 74517 - RNA, 20 nt, Human
gcugaugaaaagacagaaca

SEQ ID NO: 74518 - RNA, 20 nt, Human
gcugcccugugguggguuug

SEQ ID NO: 74519 - RNA, 20 nt, Human
gcugugaucgugccaccaca

SEQ ID NO: 74520 - RNA, 22 nt, Human
gcuugagccuaggagauggagg

SEQ ID NO: 74521 - RNA, 22 nt, Human
gcuugaguccaggaguucgaga

SEQ ID NO: 74522 - RNA, 22 nt, Human
ggagaugacauucuucaacugc

SEQ ID NO: 74523 - RNA, 18 nt, Human
ggaggcugcagugagcug

SEQ ID NO: 74524 - RNA, 24 nt, Human
ggaggcugcagugagcugugaucg

SEQ ID NO: 74525 - RNA, 19 nt, Human
ggaugugggguaggagaug

SEQ ID NO: 74526 - RNA, 23 nt, Human
ggauugcuugaguccaggaguuc

SEQ ID NO: 74527 - RNA, 22 nt, Human
gggaaaaacaaagaggcacaaa

SEQ ID NO: 74528 - RNA, 18 nt, Human
gggagaaaagccaaggca

SEQ ID NO: 74529 - RNA, 21 nt, Human
gggaggcugaggugggaaaau

SEQ ID NO: 74530 - RNA, 19 nt, Human
ggggauggggguugcaggg

SEQ ID NO: 74531 - RNA, 22 nt, Human
ggggauggggguugcagggugg

SEQ ID NO: 74532 - RNA, 26 nt, Human
guaaagcaaacguacauucucuccuc

SEQ ID NO: 74533 - RNA, 18 nt, Human
guagacccuccccccucc

SEQ ID NO: 74534 - RNA, 22 nt, Human
guagacccuccccccuccaaaa

SEQ ID NO: 74535 - RNA, 21 nt, Human
gugggcggauugcuugagucc

SEQ ID NO: 74536 - RNA, 23 nt, Human
guggugugcaccuguagucccag

SEQ ID NO: 74537 - RNA, 19 nt, Human
guucuugaauauguauuuu

SEQ ID NO: 74538 - RNA, 23 nt, Human
uaaaaaacauaugcuauagcuua

SEQ ID NO: 74539 - RNA, 23 nt, Human
uaaaacaaaggaaaaccaaauga

SEQ ID NO: 74540 - RNA, 20 nt, Human
uaaaacaucuuuagauuuca

SEQ ID NO: 74541 - RNA, 20 nt, Human
uaacagcacacgggccuggc

SEQ ID NO: 74542 - RNA, 21 nt, Human
uaagagcaagcucaaaaacac

SEQ ID NO: 74543 - RNA, 19 nt, Human
uaaggggccacccaucagu

SEQ ID NO: 74544 - RNA, 18 nt, Human
uacccccccaccccccaa

SEQ ID NO: 74545 - RNA, 19 nt, Human
uacccccccaccccccaaa

SEQ ID NO: 74546 - RNA, 21 nt, Human
uacccccccaccccccaaaac

SEQ ID NO: 74547 - RNA, 19 nt, Human
uacgaaguacucuucagaa

SEQ ID NO: 74548 - RNA, 21 nt, Human
uacggcacccaggacucagaa

SEQ ID NO: 74549 - RNA, 23 nt, Human
uacggcacccaggacucagaauc

SEQ ID NO: 74550 - RNA, 20 nt, Human
uaggagauggaggcugcagu

SEQ ID NO: 74551 - RNA, 21 nt, Human
uauauccacucccucgccaaa

SEQ ID NO: 74552 - RNA, 20 nt, Human
uauuaugucaaaaugaguau

SEQ ID NO: 74553 - RNA, 19 nt, Human
uauuuuguucuuuugugac

SEQ ID NO: 74554 - RNA, 27 nt, Human
ucaaagcuucaauccggucuuacuguc

SEQ ID NO: 74555 - RNA, 25 nt, Human
ucaagggcaggaaccugcucucuca

SEQ ID NO: 74556 - RNA, 23 nt, Human
ucacaugcaacgaaaaaagcccu

SEQ ID NO: 74557 - RNA, 18 nt, Human
ucagaaaguacuccucau

SEQ ID NO: 74558 - RNA, 19 nt, Human
ucagacacagacaugaccg

SEQ ID NO: 74559 - RNA, 18 nt, Human
ucaucauggguucuggag

SEQ ID NO: 74560 - RNA, 20 nt, Human
uccaaggucauguguaggga

SEQ ID NO: 74561 - RNA, 21 nt, Human
uccacaagagaaaaaguaaga

SEQ ID NO: 74562 - RNA, 24 nt, Human
uccacggcaggaccacggcaggac

SEQ ID NO: 74563 - RNA, 22 nt, Human
uccacucccucgccaaagugac

SEQ ID NO: 74564 - RNA, 24 nt, Human
uccagcuuaggcgacagagccaga

SEQ ID NO: 74565 - RNA, 18 nt, Human
ucccaaacacccuccccu

SEQ ID NO: 74566 - RNA, 22 nt, Human
uccccccuccaaaaaaaaaucu

SEQ ID NO: 74567 - RNA, 21 nt, Human
ucccccugaacucugugaucc

SEQ ID NO: 74568 - RNA, 24 nt, Human
ucucuacuaaaaauacaaaaaauu

SEQ ID NO: 74569 - RNA, 26 nt, Human
ucuugcaaauacccccccacccccca

SEQ ID NO: 74570 - RNA, 20 nt, Human
ucuugcugucuggagcuuug

SEQ ID NO: 74571 - RNA, 19 nt, Human
ugaaaaaagaccuuuccuu

SEQ ID NO: 74572 - RNA, 22 nt, Human
ugaaaaaaucauucauaaauua

SEQ ID NO: 74573 - RNA, 19 nt, Human
ugaaaacagaaagccagug

SEQ ID NO: 74574 - RNA, 23 nt, Human
ugaaaagacagaacacgaagccu

SEQ ID NO: 74575 - RNA, 23 nt, Human
ugacaugcccuauauccacuccc

SEQ ID NO: 74576 - RNA, 21 nt, Human
ugacugacagugcacauccag

SEQ ID NO: 74577 - RNA, 26 nt, Human
ugacuucaaggcugggcgcaauggcu

SEQ ID NO: 74578 - RNA, 20 nt, Human
ugagaaggggagaaaagcca

SEQ ID NO: 74579 - RNA, 24 nt, Human
ugagccuaggagauggaggcugca

SEQ ID NO: 74580 - RNA, 19 nt, Human
ugagcugugaucgugccac

SEQ ID NO: 74581 - RNA, 19 nt, Human
ugaggaaaggggagaggag

SEQ ID NO: 74582 - RNA, 18 nt, Human
ugaggugggaaaauggcu

SEQ ID NO: 74583 - RNA, 23 nt, Human
ugcaaauacccccccacccccca

SEQ ID NO: 74584 - RNA, 26 nt, Human
ugcagccaggcggccgcuagagagcc

SEQ ID NO: 74585 - RNA, 21 nt, Human
ugcaggguggaggggggucuu

SEQ ID NO: 74586 - RNA, 20 nt, Human
ugcuuuaggcaggaagcagc

SEQ ID NO: 74587 - RNA, 28 nt, Human
uggcucacacccgcccauaaucccagca

SEQ ID NO: 74588 - RNA, 21 nt, Human
ugggaagucaaggugggcgga

SEQ ID NO: 74589 - RNA, 22 nt, Human
ugggcucuugcugucuggagcu

SEQ ID NO: 74590 - RNA, 22 nt, Human
uggggagagagcagcgggacag

SEQ ID NO: 74591 - RNA, 24 nt, Human
ugguggugugcaccuguaguccca

SEQ ID NO: 74592 - RNA, 22 nt, Human
uggugugcaccuguagucccag

SEQ ID NO: 74593 - RNA, 21 nt, Human
ugguuuggggaaaaacaaaga

SEQ ID NO: 74594 - RNA, 18 nt, Human
uguagggacaggcuccac

SEQ ID NO: 74595 - RNA, 26 nt, Human
uguagggacaggcuccacggcaggac

SEQ ID NO: 74596 - RNA, 22 nt, Human
ugucaccagcucccuggcuccu

SEQ ID NO: 74597 - RNA, 22 nt, Human
uguccuggcaaauccuuccaaa

SEQ ID NO: 74598 - RNA, 22 nt, Human
ugugguagaggaucucugacaa

SEQ ID NO: 74599 - RNA, 18 nt, Human
uuaaagcaugaaaugcuu

SEQ ID NO: 74600 - RNA, 22 nt, Human
uuaacaugacaauuucacacua

SEQ ID NO: 74601 - RNA, 23 nt, Human
uuagaacaugacuucaaggcugg

SEQ ID NO: 74602 - RNA, 20 nt, Human
uucuucaaaagaacaaaaac

SEQ ID NO: 74603 - RNA, 21 nt, Human
uucuugguggcgguggguaaa

SEQ ID NO: 74604 - RNA, 22 nt, Human
uugaguccaggaguucgagacc

SEQ ID NO: 74605 - RNA, 23 nt, Human
uugcaaauacccccccacccccc

SEQ ID NO: 74606 - RNA, 21 nt, Human
uugcuugaguccaggaguucg

SEQ ID NO: 74607 - RNA, 20 nt, Human
uuucaagggcaggaaccugc

SEQ ID NO: 74608 - RNA, 21 nt, Human
uuuccagaauucugcagaagc

SEQ ID NO: 74609 - RNA, 23 nt, Human
uuucccaaacacccuccccucca

SEQ ID NO: 74610 - RNA, 19 nt, Human
aaaacaaacaaacaaaaag

SEQ ID NO: 74611 - RNA, 19 nt, Human
aaaaucccugacacaccag

SEQ ID NO: 74612 - RNA, 22 nt, Human
aaacaaaaagcaaacgaggugg

SEQ ID NO: 74613 - RNA, 21 nt, Human
aaacaaaaauuaacaucagac

SEQ ID NO: 74614 - RNA, 18 nt, Human
aaacaaacaaacaaaaag

SEQ ID NO: 74615 - RNA, 19 nt, Human
aaacaaacaaacaaaaagc

SEQ ID NO: 74616 - RNA, 20 nt, Human
aaacaaacaaacaaaaagca

SEQ ID NO: 74617 - RNA, 19 nt, Human
aaacuauauuucaaaacug

SEQ ID NO: 74618 - RNA, 25 nt, Human
aaagaauacuguucggcuuuacugu

SEQ ID NO: 74619 - RNA, 18 nt, Human
aaagcaaacgaggugguu

SEQ ID NO: 74620 - RNA, 19 nt, Human
aacaaauguuaacauucuc

SEQ ID NO: 74621 - RNA, 18 nt, Human
aaccauaguucuguuuua

SEQ ID NO: 74622 - RNA, 19 nt, Human
aagcaaaacaaacaaacaa

SEQ ID NO: 74623 - RNA, 26 nt, Human
aagcaaaacaaacaaacaaaaagcaa

SEQ ID NO: 74624 - RNA, 23 nt, Human
aagcccugacacucaugcaaaca

SEQ ID NO: 74625 - RNA, 22 nt, Human
aagcucaaaacuaguauaacag

SEQ ID NO: 74626 - RNA, 25 nt, Human
acaaaaggcugaggucuaaagcuca

SEQ ID NO: 74627 - RNA, 20 nt, Human
acaaaaucccugacacacca

SEQ ID NO: 74628 - RNA, 23 nt, Human
acaaacaaaaagcaaacgaggug

SEQ ID NO: 74629 - RNA, 21 nt, Human
acacaccagagguacauggaa

SEQ ID NO: 74630 - RNA, 26 nt, Human
acacuaaaaaagcaaaacaaacaaac

SEQ ID NO: 74631 - RNA, 19 nt, Human
accccgagacugcagcggg

SEQ ID NO: 74632 - RNA, 23 nt, Human
acuaaaaaagcaaaacaaacaaa

SEQ ID NO: 74633 - RNA, 21 nt, Human
acugaccuccacuaagagcgc

SEQ ID NO: 74634 - RNA, 22 nt, Human
acuuccauaaaugugcugagaa

SEQ ID NO: 74635 - RNA, 21 nt, Human
agagauccuuuauaucauguc

SEQ ID NO: 74636 - RNA, 21 nt, Human
agagguggaggggggagaggg

SEQ ID NO: 74637 - RNA, 21 nt, Human
agauaaacgggcacagcucug

SEQ ID NO: 74638 - RNA, 21 nt, Human
agcaaaacaaacaaacaaaaa

SEQ ID NO: 74639 - RNA, 23 nt, Human
aggcaaaaauaauuuuaggucua

SEQ ID NO: 74640 - RNA, 19 nt, Human
aggcucuggggagagggcc

SEQ ID NO: 74641 - RNA, 23 nt, Human
aggggggagaggggacugggggc

SEQ ID NO: 74642 - RNA, 24 nt, Human
aggggggagaggggacugggggcu

SEQ ID NO: 74643 - RNA, 19 nt, Human
aguucuguuuuagguaaac

SEQ ID NO: 74644 - RNA, 21 nt, Human
auacuuuuuuuuggcucuucu

SEQ ID NO: 74645 - RNA, 20 nt, Human
augaaguacaaauaucauaa

SEQ ID NO: 74646 - RNA, 22 nt, Human
caaaacaaacaaacaaaaagca

SEQ ID NO: 74647 - RNA, 20 nt, Human
caacaaauguuaacauucuc

SEQ ID NO: 74648 - RNA, 18 nt, Human
caagagguggagggggga

SEQ ID NO: 74649 - RNA, 18 nt, Human
caccaaauaacucaucac

SEQ ID NO: 74650 - RNA, 21 nt, Human
cacucucacagaaacauauua

SEQ ID NO: 74651 - RNA, 20 nt, Human
cagaaaaugaacuaauacac

SEQ ID NO: 74652 - RNA, 18 nt, Human
caugcaaaacugcaacac

SEQ ID NO: 74653 - RNA, 19 nt, Human
ccauaaaaaugacacuuca

SEQ ID NO: 74654 - RNA, 20 nt, Human
ccuuuauaucaugucacauc

SEQ ID NO: 74655 - RNA, 23 nt, Human
cggaaauaaaagcauucucuuga

SEQ ID NO: 74656 - RNA, 18 nt, Human
cggaaugaaugggaggcc

SEQ ID NO: 74657 - RNA, 22 nt, Human
cggcaggacggaagaaagccgg

SEQ ID NO: 74658 - RNA, 18 nt, Human
cuacacuaaaaaagcaaa

SEQ ID NO: 74659 - RNA, 19 nt, Human
cuaguaguacuaaguuuuc

SEQ ID NO: 74660 - RNA, 24 nt, Human
cucaaaacuaguauaacaguuuac

SEQ ID NO: 74661 - RNA, 19 nt, Human
cugagaaccccgagacugc

SEQ ID NO: 74662 - RNA, 19 nt, Human
cuuaagaaaauaaggcaga

SEQ ID NO: 74663 - RNA, 20 nt, Human
gaccuuuuuucagagaacag

SEQ ID NO: 74664 - RNA, 19 nt, Human
gagucgggggaggggaggc

SEQ ID NO: 74665 - RNA, 21 nt, Human
gcaauaugcauaaacaauaug

SEQ ID NO: 74666 - RNA, 24 nt, Human
gcggugcucgccacaggggugugu

SEQ ID NO: 74667 - RNA, 20 nt, Human
ggacugggggcuaggggccc

SEQ ID NO: 74668 - RNA, 18 nt, Human
ggggacggcaggacggaa

SEQ ID NO: 74669 - RNA, 19 nt, Human
ggggacugggggcuagggg

SEQ ID NO: 74670 - RNA, 21 nt, Human
ggggacugggggcuaggggcc

SEQ ID NO: 74671 - RNA, 20 nt, Human
ggggagaggggacugggggc

SEQ ID NO: 74672 - RNA, 21 nt, Human
ggggaggcucuggggagaggg

SEQ ID NO: 74673 - RNA, 19 nt, Human
guggaaaaauucauccaaa

SEQ ID NO: 74674 - RNA, 20 nt, Human
uaaaaaaacugaaauauaaa

SEQ ID NO: 74675 - RNA, 18 nt, Human
uaaaaaagcaaaacaaac

SEQ ID NO: 74676 - RNA, 22 nt, Human
uaaaaaaugucuauaaaagucc

SEQ ID NO: 74677 - RNA, 27 nt, Human
uaaagcucaaaacuaguauaacaguuu

SEQ ID NO: 74678 - RNA, 18 nt, Human
uaacuggacaaagcccug

SEQ ID NO: 74679 - RNA, 22 nt, Human
uaacuggacaaagcccugacac

SEQ ID NO: 74680 - RNA, 20 nt, Human
uaagaccuuuuuucagagaa

SEQ ID NO: 74681 - RNA, 22 nt, Human
uaauuuuuaaacaauuugcaca

SEQ ID NO: 74682 - RNA, 19 nt, Human
uacaaugaagauaaacggg

SEQ ID NO: 74683 - RNA, 18 nt, Human
uagaaacagaaaaugaac

SEQ ID NO: 74684 - RNA, 24 nt, Human
uagaagacauuauaauaucagcgc

SEQ ID NO: 74685 - RNA, 24 nt, Human
uagaucauucuuuuaaaaaaacug

SEQ ID NO: 74686 - RNA, 27 nt, Human
uauaaccgauuacaugcaaaacugcaa

SEQ ID NO: 74687 - RNA, 20 nt, Human
uauauuauaaguacuauugg

SEQ ID NO: 74688 - RNA, 23 nt, Human
ucacaacuuuuaagauuuuucuu

SEQ ID NO: 74689 - RNA, 23 nt, Human
ucacuccugaaacaaaaauuaac

SEQ ID NO: 74690 - RNA, 18 nt, Human
ucagaagguuugauuuuu

SEQ ID NO: 74691 - RNA, 22 nt, Human
ucaucauuguuguugaacauuc

SEQ ID NO: 74692 - RNA, 19 nt, Human
uccaaguuuaugauccagc

SEQ ID NO: 74693 - RNA, 20 nt, Human
uccacacaaaaggcugaggu

SEQ ID NO: 74694 - RNA, 22 nt, Human
uccauaaaugugcugagaaccc

SEQ ID NO: 74695 - RNA, 24 nt, Human
ucuagcaaaaucagaugagauugc

SEQ ID NO: 74696 - RNA, 19 nt, Human
ucuauaaaaguccaauaaa

SEQ ID NO: 74697 - RNA, 21 nt, Human
ucuguaaacacuguggacugc

SEQ ID NO: 74698 - RNA, 27 nt, Human
ugaagauacuuuuuuuuggcucuuccc

SEQ ID NO: 74699 - RNA, 18 nt, Human
ugagagaagggugacugu

SEQ ID NO: 74700 - RNA, 23 nt, Human
ugcaauguauuuguuaaucuuua

SEQ ID NO: 74701 - RNA, 23 nt, Human
uggaaaaauucauccaaaauuaa

SEQ ID NO: 74702 - RNA, 23 nt, Human
uggaaagacauuuaacauaaaga

SEQ ID NO: 74703 - RNA, 22 nt, Human
uggacagcuccacauugaucaa

SEQ ID NO: 74704 - RNA, 18 nt, Human
uggaggggggagagggga

SEQ ID NO: 74705 - RNA, 23 nt, Human
uggaggggggagaggggacuggg

SEQ ID NO: 74706 - RNA, 18 nt, Human
ugggggcuaggggcccgg

SEQ ID NO: 74707 - RNA, 19 nt, Human
ugggggcuaggggcccggg

SEQ ID NO: 74708 - RNA, 18 nt, Human
uguaauagaaacagaaaa

SEQ ID NO: 74709 - RNA, 21 nt, Human
ugucacucucacagaaacaua

SEQ ID NO: 74710 - RNA, 22 nt, Human
ugucucagagcagggaggacgg

SEQ ID NO: 74711 - RNA, 19 nt, Human
uguugaacauucacuuuau

SEQ ID NO: 74712 - RNA, 27 nt, Human
uuaucaauauugccauaaaaaugacac

SEQ ID NO: 74713 - RNA, 20 nt, Human
uucacaggaugacaaacuau

SEQ ID NO: 74714 - RNA, 18 nt, Human
uuggcucuucugaacugg

SEQ ID NO: 74715 - RNA, 19 nt, Human
uuuaaagccuaagaaagcu

SEQ ID NO: 74716 - RNA, 21 nt, Human
uuuaagacaaugcuauuaaau

SEQ ID NO: 74717 - RNA, 18 nt, Human
uuuaaguccuuccuucuu

SEQ ID NO: 74718 - RNA, 18 nt, Human
uuuuuuuggcucuucuga

SEQ ID NO: 74719 - RNA, 23 nt, Human
uuuuuuuggcucuucugaacugg

SEQ ID NO: 74720 - RNA, 19 nt, Human
aacccucaccaggcccaac

SEQ ID NO: 74721 - RNA, 24 nt, Human
aagugggggugaugagagguuguc

SEQ ID NO: 74722 - RNA, 23 nt, Human
aauccagcauucuaguuucuuuc

SEQ ID NO: 74723 - RNA, 23 nt, Human
acccucaccaggcccaacugcca

SEQ ID NO: 74724 - RNA, 19 nt, Human
agcccagcaggaaggaaca

SEQ ID NO: 74725 - RNA, 19 nt, Human
agccugagcaauauggccu

SEQ ID NO: 74726 - RNA, 18 nt, Human
agcugcauggccccuaca

SEQ ID NO: 74727 - RNA, 21 nt, Human
agcuugcugucuugguccugg

SEQ ID NO: 74728 - RNA, 21 nt, Human
aggcagggggggucccggaca

SEQ ID NO: 74729 - RNA, 23 nt, Human
auggcaagcagcgucccaggcac

SEQ ID NO: 74730 - RNA, 19 nt, Human
cacaccccagccucucucu

SEQ ID NO: 74731 - RNA, 22 nt, Human
caccccagccucucucugaggu

SEQ ID NO: 74732 - RNA, 22 nt, Human
cagcccaagccugccuuggcgg

SEQ ID NO: 74733 - RNA, 18 nt, Human
caggaaggaacaaaagug

SEQ ID NO: 74734 - RNA, 23 nt, Human
ccaagccugccuuggcggccggg

SEQ ID NO: 74735 - RNA, 20 nt, Human
ccaggcaccccacguguccu

SEQ ID NO: 74736 - RNA, 21 nt, Human
ccaggcccaacugccaccuac

SEQ ID NO: 74737 - RNA, 18 nt, Human
cccacaggccugggcacg

SEQ ID NO: 74738 - RNA, 21 nt, Human
cccacguguccuggcccagcc

SEQ ID NO: 74739 - RNA, 18 nt, Human
ccccacuacccacaggcc

SEQ ID NO: 74740 - RNA, 19 nt, Human
ccccacuacccacaggccu

SEQ ID NO: 74741 - RNA, 24 nt, Human
ccccacuacccacaggccugggca

SEQ ID NO: 74742 - RNA, 22 nt, Human
cccuccccacuacccacaggcc

SEQ ID NO: 74743 - RNA, 21 nt, Human
ccuaacccucaccaggcccaa

SEQ ID NO: 74744 - RNA, 22 nt, Human
ccuaacccucaccaggcccaac

SEQ ID NO: 74745 - RNA, 23 nt, Human
ccuacgccagcugcauggccccu

SEQ ID NO: 74746 - RNA, 18 nt, Human
ccuggcccagcccaagcc

SEQ ID NO: 74747 - RNA, 19 nt, Human
ccuuguccugagccugagc

SEQ ID NO: 74748 - RNA, 26 nt, Human
cuagagcggugcuggcuguucccccu

SEQ ID NO: 74749 - RNA, 22 nt, Human
cugccuuggcggccggguggcu

SEQ ID NO: 74750 - RNA, 19 nt, Human
cuugcugucuugguccugg

SEQ ID NO: 74751 - RNA, 21 nt, Human
cuugcugucuugguccuggcc

SEQ ID NO: 74752 - RNA, 22 nt, Human
gaccugaggccuuguccugagc

SEQ ID NO: 74753 - RNA, 24 nt, Human
gagaggcggcggcgcauggggcag

SEQ ID NO: 74754 - RNA, 24 nt, Human
gaggccuuguccugagccugagca

SEQ ID NO: 74755 - RNA, 18 nt, Human
gcagcgucccaggcaccc

SEQ ID NO: 74756 - RNA, 19 nt, Human
gcagcgucccaggcacccc

SEQ ID NO: 74757 - RNA, 22 nt, Human
gccagcugcauggccccuacac

SEQ ID NO: 74758 - RNA, 20 nt, Human
gcccaacugccaccuacgcc

SEQ ID NO: 74759 - RNA, 21 nt, Human
gcgcauggggcaggcgcucgc

SEQ ID NO: 74760 - RNA, 21 nt, Human
ggcagggggggucccggacag

SEQ ID NO: 74761 - RNA, 26 nt, Human
gggugagcaggaaggcaggggggguc

SEQ ID NO: 74762 - RNA, 20 nt, Human
guccuguucagcccucccca

SEQ ID NO: 74763 - RNA, 21 nt, Human
gugggggugaugagagguugu

SEQ ID NO: 74764 - RNA, 23 nt, Human
gugggggugaugagagguugucc

SEQ ID NO: 74765 - RNA, 26 nt, Human
ucaccaggcccaacugccaccuacgc

SEQ ID NO: 74766 - RNA, 19 nt, Human
ucagagcugggcccacgac

SEQ ID NO: 74767 - RNA, 22 nt, Human
ucccaggcaccccacguguccu

SEQ ID NO: 74768 - RNA, 21 nt, Human
ucugcacgaggcagcccagca

SEQ ID NO: 74769 - RNA, 23 nt, Human
ugagcaauauggccuguagguac

SEQ ID NO: 74770 - RNA, 24 nt, Human
ugcguagcuugcugucuugguccu

SEQ ID NO: 74771 - RNA, 21 nt, Human
uggcaagcagcgucccaggca

SEQ ID NO: 74772 - RNA, 21 nt, Human
uggcugcaauugcguagcuug

SEQ ID NO: 74773 - RNA, 24 nt, Human
ugggggugaugagagguuguccug

SEQ ID NO: 74774 - RNA, 25 nt, Human
uguccuguucagcccuccccacuac

SEQ ID NO: 74775 - RNA, 19 nt, Human
uuggcggccggguggcugc

SEQ ID NO: 74776 - RNA, 22 nt, Human
uuggcggccggguggcugcaau

SEQ ID NO: 74777 - RNA, 21 nt, Human
acuugggccgcgggagaccuc

SEQ ID NO: 74778 - RNA, 24 nt, Human
ccgcggagaccucggggcgcggag

SEQ ID NO: 74779 - RNA, 19 nt, Human
ccucgggccgcggagaccu

SEQ ID NO: 74780 - RNA, 19 nt, Human
ccucggggcgcggagaccu

SEQ ID NO: 74781 - RNA, 24 nt, Human
gcgcggagaccucggggcgcggag

SEQ ID NO: 74782 - RNA, 24 nt, Human
ggagaccucgggccgcggagaccu

SEQ ID NO: 74783 - RNA, 18 nt, Human
ugcauagagaacacaguc

SEQ ID NO: 74784 - RNA, 18 nt, Human
aaaaugaaggaaggaaag

SEQ ID NO: 74785 - RNA, 21 nt, Human
aaaauugcaaugucuagcuga

SEQ ID NO: 74786 - RNA, 21 nt, Human
aaacagagacacuuucuuaag

SEQ ID NO: 74787 - RNA, 22 nt, Human
aaagaaucacaaaaugaugaag

SEQ ID NO: 74788 - RNA, 23 nt, Human
aaagagacaaacugaacugcaca

SEQ ID NO: 74789 - RNA, 24 nt, Human
aaaugaugaagguuuagaaaaacu

SEQ ID NO: 74790 - RNA, 23 nt, Human
aacaaggauaacaaggaguuuuc

SEQ ID NO: 74791 - RNA, 24 nt, Human
aagaagacaagcaaagggaacugg

SEQ ID NO: 74792 - RNA, 19 nt, Human
aagaaguccaucugcccuu

SEQ ID NO: 74793 - RNA, 18 nt, Human
aaggucccaacaaaucag

SEQ ID NO: 74794 - RNA, 22 nt, Human
aagugaccccgguagagaggga

SEQ ID NO: 74795 - RNA, 21 nt, Human
aaugaugaagguuuagaaaaa

SEQ ID NO: 74796 - RNA, 25 nt, Human
acaaagcacauccccagggagaaag

SEQ ID NO: 74797 - RNA, 20 nt, Human
acaaagcuguaaagagaagc

SEQ ID NO: 74798 - RNA, 19 nt, Human
acaccucccaaagacaugc

SEQ ID NO: 74799 - RNA, 24 nt, Human
acagacaccucccaaagacaugcc

SEQ ID NO: 74800 - RNA, 18 nt, Human
accucauuucuaaugcag

SEQ ID NO: 74801 - RNA, 24 nt, Human
acuauguuacauaaacauaacacc

SEQ ID NO: 74802 - RNA, 22 nt, Human
agaaaaugcauuccuacuuuuc

SEQ ID NO: 74803 - RNA, 22 nt, Human
agaaacaaagcuguaaagagaa

SEQ ID NO: 74804 - RNA, 22 nt, Human
agaagccacaaagcacaucccc

SEQ ID NO: 74805 - RNA, 19 nt, Human
agacaagcaaagggaacug

SEQ ID NO: 74806 - RNA, 19 nt, Human
agacagucaagaagacaag

SEQ ID NO: 74807 - RNA, 22 nt, Human
agcauggugacauuaaggacug

SEQ ID NO: 74808 - RNA, 21 nt, Human
aggaaaaaugacacuacccac

SEQ ID NO: 74809 - RNA, 21 nt, Human
aggcucagaaggucccaacaa

SEQ ID NO: 74810 - RNA, 22 nt, Human
auugacacaaacuuugcaauga

SEQ ID NO: 74811 - RNA, 20 nt, Human
caaacugaacugcacauuug

SEQ ID NO: 74812 - RNA, 23 nt, Human
caacaugcagcagugaacugaug

SEQ ID NO: 74813 - RNA, 23 nt, Human
caauauguggguuuagaguugga

SEQ ID NO: 74814 - RNA, 18 nt, Human
caauauuuaaaaugaagg

SEQ ID NO: 74815 - RNA, 20 nt, Human
cacgacuaaccagaccccaa

SEQ ID NO: 74816 - RNA, 20 nt, Human
cagccccggaggcgcagccc

SEQ ID NO: 74817 - RNA, 19 nt, Human
cagguaugacugcuucaca

SEQ ID NO: 74818 - RNA, 25 nt, Human
cauguuaacaauccuugaaaaauua

SEQ ID NO: 74819 - RNA, 22 nt, Human
ccacaugucucuggaucaucuc

SEQ ID NO: 74820 - RNA, 20 nt, Human
ccagaaaaugcauuccuacu

SEQ ID NO: 74821 - RNA, 19 nt, Human
cccgcccgcgcugcagccg

SEQ ID NO: 74822 - RNA, 21 nt, Human
cccgcccgcgcugcagccgcg

SEQ ID NO: 74823 - RNA, 22 nt, Human
cccgcgcugcagccgcgcggag

SEQ ID NO: 74824 - RNA, 19 nt, Human
ccgcccgcgcugcagccgc

SEQ ID NO: 74825 - RNA, 18 nt, Human
ccuaguuuaagacacaaa

SEQ ID NO: 74826 - RNA, 18 nt, Human
ccuccugcgccgcgggag

SEQ ID NO: 74827 - RNA, 21 nt, Human
cgcguccccgcucccgcccgc

SEQ ID NO: 74828 - RNA, 23 nt, Human
cggcgacaucgcguccccgcucc

SEQ ID NO: 74829 - RNA, 20 nt, Human
cucuccuacgcaguguucaa

SEQ ID NO: 74830 - RNA, 23 nt, Human
cugcuucacagacaccucccaaa

SEQ ID NO: 74831 - RNA, 20 nt, Human
cuuugaugggauccagugcc

SEQ ID NO: 74832 - RNA, 20 nt, Human
gacaauauuuaaaaugaagg

SEQ ID NO: 74833 - RNA, 19 nt, Human
gagcagguaugacugcuuc

SEQ ID NO: 74834 - RNA, 26 nt, Human
gaugcagaaacaaagcuguaaagaga

SEQ ID NO: 74835 - RNA, 21 nt, Human
gaugcauuuuuagucacaugg

SEQ ID NO: 74836 - RNA, 23 nt, Human
gcagcagugaacugaugcagaaa

SEQ ID NO: 74837 - RNA, 21 nt, Human
gccaauggaaggaaggaagga

SEQ ID NO: 74838 - RNA, 18 nt, Human
gccccggaggcgcagccc

SEQ ID NO: 74839 - RNA, 22 nt, Human
gcgcagccccggcccgcaagga

SEQ ID NO: 74840 - RNA, 19 nt, Human
gcgcugcagccgcgcggag

SEQ ID NO: 74841 - RNA, 24 nt, Human
gcgcugcagccgcgcggagcuccu

SEQ ID NO: 74842 - RNA, 27 nt, Human
gcucagccccggaggcgcagccccggc

SEQ ID NO: 74843 - RNA, 21 nt, Human
gcucuggcggcggcucagccc

SEQ ID NO: 74844 - RNA, 19 nt, Human
ggaaggaaaaaugacacua

SEQ ID NO: 74845 - RNA, 18 nt, Human
ggagcgcccagcggcugc

SEQ ID NO: 74846 - RNA, 19 nt, Human
ggauggacauuuaauguuu

SEQ ID NO: 74847 - RNA, 23 nt, Human
ggggagggccagaucaugugccc

SEQ ID NO: 74848 - RNA, 18 nt, Human
gguagagagggaagacag

SEQ ID NO: 74849 - RNA, 19 nt, Human
guccuaucuuucccaaucc

SEQ ID NO: 74850 - RNA, 21 nt, Human
guguacagagaggccaagggg

SEQ ID NO: 74851 - RNA, 18 nt, Human
uaaagagaagccacaaag

SEQ ID NO: 74852 - RNA, 18 nt, Human
uaaagucuuguacauuga

SEQ ID NO: 74853 - RNA, 23 nt, Human
uaacaauugcaagugaccccggu

SEQ ID NO: 74854 - RNA, 26 nt, Human
uaaccagaccccaaaucccucaacau

SEQ ID NO: 74855 - RNA, 21 nt, Human
uaaguagaaggcucagaaggu

SEQ ID NO: 74856 - RNA, 19 nt, Human
uaaugcagugcacaucaau

SEQ ID NO: 74857 - RNA, 23 nt, Human
uaaugccaguggggacauaugaa

SEQ ID NO: 74858 - RNA, 19 nt, Human
uacaggaguugcaaagaga

SEQ ID NO: 74859 - RNA, 25 nt, Human
uacauacaugaaaaaguagccagau

SEQ ID NO: 74860 - RNA, 18 nt, Human
uaccuggcacaggaugga

SEQ ID NO: 74861 - RNA, 25 nt, Human
uacgcaguguucaaucuuugauuaa

SEQ ID NO: 74862 - RNA, 23 nt, Human
uagcacuaaggugugacucuuuc

SEQ ID NO: 74863 - RNA, 22 nt, Human
uagcugagcccugagggguauc

SEQ ID NO: 74864 - RNA, 21 nt, Human
uauaaaacagagacacuuucu

SEQ ID NO: 74865 - RNA, 22 nt, Human
uauuacaggaguugcaaagaga

SEQ ID NO: 74866 - RNA, 24 nt, Human
ucacaugguuuaacuucugguugc

SEQ ID NO: 74867 - RNA, 22 nt, Human
ucccgcccgcgcugcagccgcg

SEQ ID NO: 74868 - RNA, 19 nt, Human
ucuaaagugauuccuuugc

SEQ ID NO: 74869 - RNA, 19 nt, Human
ucuauauaaaacagagaca

SEQ ID NO: 74870 - RNA, 18 nt, Human
ugaacugaugcagaaaca

SEQ ID NO: 74871 - RNA, 22 nt, Human
ugaaggacacugaagaagucca

SEQ ID NO: 74872 - RNA, 27 nt, Human
ugaauaaauauacaaucugccaaugga

SEQ ID NO: 74873 - RNA, 18 nt, Human
ugcagaaacaaagcugua

SEQ ID NO: 74874 - RNA, 19 nt, Human
ugcguaucugacuuuugac

SEQ ID NO: 74875 - RNA, 22 nt, Human
ugggcaguggguuggugcaugg

SEQ ID NO: 74876 - RNA, 26 nt, Human
ugggggcuccugcugaguaaugccag

SEQ ID NO: 74877 - RNA, 21 nt, Human
uguaaugacaauauuuaaaau

SEQ ID NO: 74878 - RNA, 18 nt, Human
uguacagagaggccaagg

SEQ ID NO: 74879 - RNA, 20 nt, Human
ugucuagcugagcccugagg

SEQ ID NO: 74880 - RNA, 23 nt, Human
uguuaaaaacauuuuuuagaaca

SEQ ID NO: 74881 - RNA, 24 nt, Human
uuauugacacaaacuuugcaauga

SEQ ID NO: 74882 - RNA, 26 nt, Human
uugaagaauaacagaguuagcagaua

SEQ ID NO: 74883 - RNA, 18 nt, Human
uuggcacaacuuuagucc

SEQ ID NO: 74884 - RNA, 22 nt, Human
uuggcagcugggggcuccugcu

SEQ ID NO: 74885 - RNA, 18 nt, Human
uuuaaaaugaaggaagga

SEQ ID NO: 74886 - RNA, 27 nt, Human
uuuagaacauaaaguuccuaaaagccc

SEQ ID NO: 74887 - RNA, 23 nt, Human
uuugcagaugccaaaaugacagu

SEQ ID NO: 74888 - RNA, 21 nt, Human
aaagagaaagaguacaaagag

SEQ ID NO: 74889 - RNA, 21 nt, Human
acaaagagaggaauuuacagc

SEQ ID NO: 74890 - RNA, 26 nt, Human
agagauuugcuucuuuauuuucuagg

SEQ ID NO: 74891 - RNA, 21 nt, Human
agcaaaaccucaaaaccuagc

SEQ ID NO: 74892 - RNA, 23 nt, Human
agcaagagaaccugcccccaaaa

SEQ ID NO: 74893 - RNA, 19 nt, Human
aggaauuuacagcugggcu

SEQ ID NO: 74894 - RNA, 24 nt, Human
aguguggcaccugggaugauucuu

SEQ ID NO: 74895 - RNA, 23 nt, Human
cagcaaaaccucaaaaccuagca

SEQ ID NO: 74896 - RNA, 24 nt, Human
cagcaaaaccucaaaaccuagcaa

SEQ ID NO: 74897 - RNA, 23 nt, Human
cauuccgccaugaaaauugagag

SEQ ID NO: 74898 - RNA, 21 nt, Human
cccccaaaauuucagcguagg

SEQ ID NO: 74899 - RNA, 21 nt, Human
ccucaaaaccuagcaagagaa

SEQ ID NO: 74900 - RNA, 21 nt, Human
gaauuuacagcugggcuccgg

SEQ ID NO: 74901 - RNA, 21 nt, Human
gagagaaggucccgguaaaga

SEQ ID NO: 74902 - RNA, 21 nt, Human
gauucuucaggaauaucuuca

SEQ ID NO: 74903 - RNA, 22 nt, Human
gcaaaaccucaaaaccuagcaa

SEQ ID NO: 74904 - RNA, 25 nt, Human
gcaaaaccucaaaaccuagcaagag

SEQ ID NO: 74905 - RNA, 26 nt, Human
gcaaaaccucaaaaccuagcaagaga

SEQ ID NO: 74906 - RNA, 19 nt, Human
gucugagaaauaaagagaa

SEQ ID NO: 74907 - RNA, 22 nt, Human
uacaaagagaggaauuuacagc

SEQ ID NO: 74908 - RNA, 20 nt, Human
uagcaagagaaccugccccc

SEQ ID NO: 74909 - RNA, 18 nt, Human
ucaccauguccaguuugg

SEQ ID NO: 74910 - RNA, 23 nt, Human
ucagcguagguucuauuuucccu

SEQ ID NO: 74911 - RNA, 20 nt, Human
ucagguuuuuacccuaugcu

SEQ ID NO: 74912 - RNA, 21 nt, Human
ucccuaagugucggcuggucu

SEQ ID NO: 74913 - RNA, 25 nt, Human
ugagaaauaaagagaaagaguacaa

SEQ ID NO: 74914 - RNA, 19 nt, Human
uggcaccugggaugauucu

SEQ ID NO: 74915 - RNA, 27 nt, Human
uuaaucauuaaaauuaauacaaaaugu

SEQ ID NO: 74916 - RNA, 18 nt, Human
uuucuaggaauaucuagu

SEQ ID NO: 74917 - RNA, 20 nt, Human
uuucuaggaauaucuagucu

SEQ ID NO: 74918 - RNA, 19 nt, Human
aaacaagugcaaguuuucu

SEQ ID NO: 74919 - RNA, 21 nt, Human
aaaggccccaaaugcagugag

SEQ ID NO: 74920 - RNA, 20 nt, Human
aaauccuuugaagccaaagg

SEQ ID NO: 74921 - RNA, 25 nt, Human
aacaacacccaucuucugagauggg

SEQ ID NO: 74922 - RNA, 23 nt, Human
aacauaaccaggucccaauuccu

SEQ ID NO: 74923 - RNA, 20 nt, Human
aacccagcucuucccacuaa

SEQ ID NO: 74924 - RNA, 23 nt, Human
aacccagcucuucccacuaacac

SEQ ID NO: 74925 - RNA, 21 nt, Human
aagaaccagccuggguaccca

SEQ ID NO: 74926 - RNA, 18 nt, Human
aaggaaggggugaggagg

SEQ ID NO: 74927 - RNA, 20 nt, Human
aaggaaggggugaggagggg

SEQ ID NO: 74928 - RNA, 19 nt, Human
aaggccccaaaugcaguga

SEQ ID NO: 74929 - RNA, 24 nt, Human
aauccuuugaagccaaaggaguaa

SEQ ID NO: 74930 - RNA, 21 nt, Human
aauuauguaaagaucuugcua

SEQ ID NO: 74931 - RNA, 22 nt, Human
acaaccaaguuguuuggugacc

SEQ ID NO: 74932 - RNA, 20 nt, Human
accaaugggaaaggccccaa

SEQ ID NO: 74933 - RNA, 18 nt, Human
accaggaagacagagccc

SEQ ID NO: 74934 - RNA, 19 nt, Human
acggaggugugguccaggg

SEQ ID NO: 74935 - RNA, 24 nt, Human
acucccucuccuucuccucuuucc

SEQ ID NO: 74936 - RNA, 21 nt, Human
acucuuuuccuucuuugucuu

SEQ ID NO: 74937 - RNA, 21 nt, Human
agaaaagaagaauacuuuggg

SEQ ID NO: 74938 - RNA, 21 nt, Human
agaacccagauaaaaaacuga

SEQ ID NO: 74939 - RNA, 23 nt, Human
agacagagcccagcccugcuaua

SEQ ID NO: 74940 - RNA, 24 nt, Human
agagugcuucuuucuucucuuuuc

SEQ ID NO: 74941 - RNA, 19 nt, Human
agauuugggggaaagagug

SEQ ID NO: 74942 - RNA, 19 nt, Human
agcagagugcuucuuucuu

SEQ ID NO: 74943 - RNA, 21 nt, Human
agccaaagcagcaccaagugc

SEQ ID NO: 74944 - RNA, 24 nt, Human
agccugggcagcgggcgcgggcuc

SEQ ID NO: 74945 - RNA, 22 nt, Human
agcugauuuuuuuuuccauucu

SEQ ID NO: 74946 - RNA, 23 nt, Human
agcugauuuuuuuuuccauucuu

SEQ ID NO: 74947 - RNA, 19 nt, Human
aggaacaccagaggcccuc

SEQ ID NO: 74948 - RNA, 19 nt, Human
aggaaggaaguaacuguaa

SEQ ID NO: 74949 - RNA, 18 nt, Human
aggaaggcagugaaacca

SEQ ID NO: 74950 - RNA, 23 nt, Human
aggaaggggugaggagggggcuu

SEQ ID NO: 74951 - RNA, 25 nt, Human
aggcagaggcauuuggugggugggg

SEQ ID NO: 74952 - RNA, 25 nt, Human
aggcagugaaaccacucugaauuau

SEQ ID NO: 74953 - RNA, 18 nt, Human
aggggcaagggcuccggg

SEQ ID NO: 74954 - RNA, 22 nt, Human
auagcugauuuuuuuuuccauu

SEQ ID NO: 74955 - RNA, 24 nt, Human
augguggacaaagguucagggcug

SEQ ID NO: 74956 - RNA, 22 nt, Human
auuguacuucuuaauuuuaggu

SEQ ID NO: 74957 - RNA, 22 nt, Human
caaaauccuuugaagccaaagg

SEQ ID NO: 74958 - RNA, 19 nt, Human
caaagguucagggcugaag

SEQ ID NO: 74959 - RNA, 22 nt, Human
caaccacagaaaagaaaacauu

SEQ ID NO: 74960 - RNA, 23 nt, Human
caagaaccagccuggguacccac

SEQ ID NO: 74961 - RNA, 24 nt, Human
caaugauaaaagacaugcagaccu

SEQ ID NO: 74962 - RNA, 23 nt, Human
cacaaccaaguuguuuggugacc

SEQ ID NO: 74963 - RNA, 22 nt, Human
cacagauggauucuuccucauu

SEQ ID NO: 74964 - RNA, 23 nt, Human
caccuugccagccuuuuccuucu

SEQ ID NO: 74965 - RNA, 21 nt, Human
cacggcggcggccagccuggg

SEQ ID NO: 74966 - RNA, 20 nt, Human
cacucuugcaggaggauaag

SEQ ID NO: 74967 - RNA, 22 nt, Human
cacucuugcaggaggauaagug

SEQ ID NO: 74968 - RNA, 26 nt, Human
cacuggcccacguccgucccuggcgc

SEQ ID NO: 74969 - RNA, 20 nt, Human
cacugugugaugcuuuaguc

SEQ ID NO: 74970 - RNA, 23 nt, Human
cagaaauuagcacaacccacagg

SEQ ID NO: 74971 - RNA, 23 nt, Human
cagaccaaugggaaaggccccaa

SEQ ID NO: 74972 - RNA, 21 nt, Human
cagaggcauuugguggguggg

SEQ ID NO: 74973 - RNA, 21 nt, Human
cagauaaaaaacugacucagu

SEQ ID NO: 74974 - RNA, 18 nt, Human
cagccaaagcagcaccaa

SEQ ID NO: 74975 - RNA, 22 nt, Human
cagcucccgggcgggcugggga

SEQ ID NO: 74976 - RNA, 21 nt, Human
caggaacuagaucauuuucca

SEQ ID NO: 74977 - RNA, 23 nt, Human
caggauaggggaaaaagaugacc

SEQ ID NO: 74978 - RNA, 20 nt, Human
cagggaaacaagcuuggucu

SEQ ID NO: 74979 - RNA, 21 nt, Human
cagggaauggccucagcuccc

SEQ ID NO: 74980 - RNA, 21 nt, Human
cagggcccugggccagccccc

SEQ ID NO: 74981 - RNA, 23 nt, Human
cagucuccagucuuccugucaga

SEQ ID NO: 74982 - RNA, 21 nt, Human
cagugcugccuaucauaugua

SEQ ID NO: 74983 - RNA, 18 nt, Human
cauccucuccuacugacu

SEQ ID NO: 74984 - RNA, 23 nt, Human
cauugaaaacaacacccaucuuc

SEQ ID NO: 74985 - RNA, 24 nt, Human
ccacagaaaagaaaacauugaaaa

SEQ ID NO: 74986 - RNA, 18 nt, Human
ccagaggaagauuugggg

SEQ ID NO: 74987 - RNA, 19 nt, Human
ccagucagccaaagcagca

SEQ ID NO: 74988 - RNA, 19 nt, Human
ccccacuaccuagcccaag

SEQ ID NO: 74989 - RNA, 18 nt, Human
cccccggguccgggcugg

SEQ ID NO: 74990 - RNA, 18 nt, Human
ccccuguucucccuucuc

SEQ ID NO: 74991 - RNA, 19 nt, Human
cccuauuuucuggacagaa

SEQ ID NO: 74992 - RNA, 21 nt, Human
cccuauuuucuggacagaaau

SEQ ID NO: 74993 - RNA, 21 nt, Human
cccuguucucccuucucccuc

SEQ ID NO: 74994 - RNA, 24 nt, Human
cccuucccaucucacuuuugguca

SEQ ID NO: 74995 - RNA, 21 nt, Human
ccuacagguacagucccugga

SEQ ID NO: 74996 - RNA, 22 nt, Human
ccuaugaccaggaagacagagc

SEQ ID NO: 74997 - RNA, 21 nt, Human
ccucuccccucaacuuuacag

SEQ ID NO: 74998 - RNA, 19 nt, Human
ccuuugauacucuuuuccu

SEQ ID NO: 74999 - RNA, 23 nt, Human
cgccagggccugcagggcccugg

SEQ ID NO: 75000 - RNA, 20 nt, Human
cggauagcaaagacuuuucc

SEQ ID NO: 75001 - RNA, 21 nt, Human
cggccuucgggcccucugggc

SEQ ID NO: 75002 - RNA, 24 nt, Human
cggcgcgggcaggggcaagggcuc

SEQ ID NO: 75003 - RNA, 24 nt, Human
cggcggcggccagccugggcagcg

SEQ ID NO: 75004 - RNA, 21 nt, Human
cgggagcaggggagaggcugg

SEQ ID NO: 75005 - RNA, 24 nt, Human
cuaaaaugcuuacagguacuagca

SEQ ID NO: 75006 - RNA, 19 nt, Human
cuaaaugaucuccuuucug

SEQ ID NO: 75007 - RNA, 22 nt, Human
cuagaucauuuuccaccucugc

SEQ ID NO: 75008 - RNA, 20 nt, Human
cuccagaggaagauuugggg

SEQ ID NO: 75009 - RNA, 20 nt, Human
cucgcagcucccgggcgggc

SEQ ID NO: 75010 - RNA, 21 nt, Human
cucgcagcucccgggcgggcu

SEQ ID NO: 75011 - RNA, 24 nt, Human
cucuuuccagccgcccccauuugu

SEQ ID NO: 75012 - RNA, 22 nt, Human
cuggacagaaauuagcacaacc

SEQ ID NO: 75013 - RNA, 18 nt, Human
cuggcccacguccguccc

SEQ ID NO: 75014 - RNA, 22 nt, Human
cuggggugaggagaugucugug

SEQ ID NO: 75015 - RNA, 22 nt, Human
cuucccacuaacacugguaccg

SEQ ID NO: 75016 - RNA, 21 nt, Human
cuuccugggaccuccuuggca

SEQ ID NO: 75017 - RNA, 18 nt, Human
cuucugcccaugggccuc

SEQ ID NO: 75018 - RNA, 22 nt, Human
cuuggucucuucucugccaggg

SEQ ID NO: 75019 - RNA, 18 nt, Human
cuuuguacucccucuccu

SEQ ID NO: 75020 - RNA, 22 nt, Human
cuuuuccuauccuuuuaucuuu

SEQ ID NO: 75021 - RNA, 22 nt, Human
gaaaaaaggaaggggugaggag

SEQ ID NO: 75022 - RNA, 18 nt, Human
gaaaagaagaauacuuug

SEQ ID NO: 75023 - RNA, 19 nt, Human
gaaggggugaggagggggc

SEQ ID NO: 75024 - RNA, 18 nt, Human
gaaguuucaagcagcaga

SEQ ID NO: 75025 - RNA, 21 nt, Human
gaaugaagagaacccagauaa

SEQ ID NO: 75026 - RNA, 18 nt, Human
gaccaggaagacagagcc

SEQ ID NO: 75027 - RNA, 21 nt, Human
gagcacgggagcaggggagag

SEQ ID NO: 75028 - RNA, 21 nt, Human
gaggggcgggcauggcgggcc

SEQ ID NO: 75029 - RNA, 18 nt, Human
gaggguccugaggugcuc

SEQ ID NO: 75030 - RNA, 19 nt, Human
gaggugugguccaggggaa

SEQ ID NO: 75031 - RNA, 19 nt, Human
gaucauuuuccaccucugc

SEQ ID NO: 75032 - RNA, 28 nt, Human
gcaaagcuccagaggaagagggaacgcc

SEQ ID NO: 75033 - RNA, 19 nt, Human
gcagagcacgggagcaggg

SEQ ID NO: 75034 - RNA, 24 nt, Human
gcaggggagaggcugggauccgga

SEQ ID NO: 75035 - RNA, 19 nt, Human
gcagugaguggagaauggg

SEQ ID NO: 75036 - RNA, 19 nt, Human
gccaacauugugaaguccu

SEQ ID NO: 75037 - RNA, 22 nt, Human
gcccugggccagcccccggguc

SEQ ID NO: 75038 - RNA, 18 nt, Human
gcggccagccugggcagc

SEQ ID NO: 75039 - RNA, 20 nt, Human
gcggcggcgcgggcaggggc

SEQ ID NO: 75040 - RNA, 21 nt, Human
gcggcggcgcgggcaggggca

SEQ ID NO: 75041 - RNA, 26 nt, Human
gcggcggcgcgggcaggggcaagggc

SEQ ID NO: 75042 - RNA, 20 nt, Human
gcgggcaggggcaagggcuc

SEQ ID NO: 75043 - RNA, 23 nt, Human
gcgggcgcgggcucccggcgggg

SEQ ID NO: 75044 - RNA, 19 nt, Human
gcgucaguuuaaggagcug

SEQ ID NO: 75045 - RNA, 19 nt, Human
gcuucuuucuucucuuuuc

SEQ ID NO: 75046 - RNA, 24 nt, Human
ggaaaacccagcucuucccacuaa

SEQ ID NO: 75047 - RNA, 21 nt, Human
ggaagaacaggauaggggaaa

SEQ ID NO: 75048 - RNA, 18 nt, Human
ggaaggaaguaacuguaa

SEQ ID NO: 75049 - RNA, 24 nt, Human
ggaaugguggacaaagguucaggg

SEQ ID NO: 75050 - RNA, 22 nt, Human
ggaccuaaaaugcuuacaggua

SEQ ID NO: 75051 - RNA, 18 nt, Human
ggagcaggggagaggcug

SEQ ID NO: 75052 - RNA, 22 nt, Human
ggagguaaugaacuuggucccc

SEQ ID NO: 75053 - RNA, 23 nt, Human
ggaggugugguccaggggaaucu

SEQ ID NO: 75054 - RNA, 20 nt, Human
ggcacggcggcggccagccc

SEQ ID NO: 75055 - RNA, 22 nt, Human
ggcagcuggcugaggccaggaa

SEQ ID NO: 75056 - RNA, 18 nt, Human
ggcaggaaggaaguaacu

SEQ ID NO: 75057 - RNA, 20 nt, Human
ggcaggggcaagggcuccgg

SEQ ID NO: 75058 - RNA, 19 nt, Human
ggccagcagggaaacaagc

SEQ ID NO: 75059 - RNA, 19 nt, Human
gggaaucucuaucuucugc

SEQ ID NO: 75060 - RNA, 23 nt, Human
gggcauggcgggccgguggcggc

SEQ ID NO: 75061 - RNA, 19 nt, Human
gggcccugggccagccccc

SEQ ID NO: 75062 - RNA, 22 nt, Human
gggcccugggccagcccccggg

SEQ ID NO: 75063 - RNA, 21 nt, Human
gggcggcggcgcgggcagggg

SEQ ID NO: 75064 - RNA, 24 nt, Human
gggcggcggcgcgggcaggggcaa

SEQ ID NO: 75065 - RNA, 19 nt, Human
ggggcgggcauggcgggcc

SEQ ID NO: 75066 - RNA, 21 nt, Human
ggguggggaggguccugaggu

SEQ ID NO: 75067 - RNA, 18 nt, Human
gguggugcugguggcuuc

SEQ ID NO: 75068 - RNA, 19 nt, Human
gucaccucacagauggauu

SEQ ID NO: 75069 - RNA, 23 nt, Human
gucccaauuccuccauguacccc

SEQ ID NO: 75070 - RNA, 20 nt, Human
gucuggguggugcugguggc

SEQ ID NO: 75071 - RNA, 18 nt, Human
uaaaaaaacugacuccag

SEQ ID NO: 75072 - RNA, 21 nt, Human
uaaaaaaacugacuccaggga

SEQ ID NO: 75073 - RNA, 24 nt, Human
uacagucccugucucuaaagcaaa

SEQ ID NO: 75074 - RNA, 19 nt, Human
uaccacagggacacacgcc

SEQ ID NO: 75075 - RNA, 21 nt, Human
uaccccacaagcuucugucca

SEQ ID NO: 75076 - RNA, 21 nt, Human
uacuugugaccaaagugaacc

SEQ ID NO: 75077 - RNA, 20 nt, Human
uagaucauuuuccaccucug

SEQ ID NO: 75078 - RNA, 18 nt, Human
uagcacaacccacagguu

SEQ ID NO: 75079 - RNA, 23 nt, Human
uagcaggucccauaccuggaagc

SEQ ID NO: 75080 - RNA, 21 nt, Human
uagcuaaucccccucccccag

SEQ ID NO: 75081 - RNA, 19 nt, Human
uaggagcggggaggggaag

SEQ ID NO: 75082 - RNA, 19 nt, Human
uagggcaucagcuguugaa

SEQ ID NO: 75083 - RNA, 19 nt, Human
uaggggauucguuuuuuau

SEQ ID NO: 75084 - RNA, 20 nt, Human
uagguuuacagaauauucug

SEQ ID NO: 75085 - RNA, 23 nt, Human
uauaaaucacuugcucugugggu

SEQ ID NO: 75086 - RNA, 21 nt, Human
uauacagucccugucucuaaa

SEQ ID NO: 75087 - RNA, 24 nt, Human
uauauuaccaauagcugauuuuuu

SEQ ID NO: 75088 - RNA, 20 nt, Human
uaucaggaacuagaucauuu

SEQ ID NO: 75089 - RNA, 23 nt, Human
uaucagguaauuccacacuuagc

SEQ ID NO: 75090 - RNA, 19 nt, Human
uaugaccaggaagacagag

SEQ ID NO: 75091 - RNA, 21 nt, Human
uaugcccuggaaagggcuggg

SEQ ID NO: 75092 - RNA, 18 nt, Human
uauggcagaaauucaugu

SEQ ID NO: 75093 - RNA, 19 nt, Human
ucaaauaaauggaggggcc

SEQ ID NO: 75094 - RNA, 20 nt, Human
ucacagauggauucuuccuc

SEQ ID NO: 75095 - RNA, 20 nt, Human
ucaggaacuagaucauuuuc

SEQ ID NO: 75096 - RNA, 20 nt, Human
ucaggagagggagcuugggg

SEQ ID NO: 75097 - RNA, 22 nt, Human
uccaaaauccuuugaagccaaa

SEQ ID NO: 75098 - RNA, 21 nt, Human
uccccacuaccuagcccaaga

SEQ ID NO: 75099 - RNA, 22 nt, Human
uccccacuaccuagcccaagaa

SEQ ID NO: 75100 - RNA, 19 nt, Human
ucccccucccccagaaggu

SEQ ID NO: 75101 - RNA, 19 nt, Human
ucccucuguccacuggccu

SEQ ID NO: 75102 - RNA, 20 nt, Human
ucccucuguccacuggccuc

SEQ ID NO: 75103 - RNA, 19 nt, Human
ucccuggaacccaccuugc

SEQ ID NO: 75104 - RNA, 19 nt, Human
ucccugguccccccggcgg

SEQ ID NO: 75105 - RNA, 18 nt, Human
ucccugucucuaaagcaa

SEQ ID NO: 75106 - RNA, 18 nt, Human
uccgcagagcacgggagc

SEQ ID NO: 75107 - RNA, 21 nt, Human
uccuuguauuucccucucccu

SEQ ID NO: 75108 - RNA, 22 nt, Human
ucggcacggcggcggccagccu

SEQ ID NO: 75109 - RNA, 24 nt, Human
ucuaaagcaaauagcaaacugugc

SEQ ID NO: 75110 - RNA, 22 nt, Human
ucuccaggcagccuugauacug

SEQ ID NO: 75111 - RNA, 20 nt, Human
ucucccuucucccucugucc

SEQ ID NO: 75112 - RNA, 21 nt, Human
ucucuaaagcaaauagcaaac

SEQ ID NO: 75113 - RNA, 20 nt, Human
ucuuauugaauauuuuacug

SEQ ID NO: 75114 - RNA, 20 nt, Human
ucuucucuuuucuguuuccu

SEQ ID NO: 75115 - RNA, 24 nt, Human
ucuucugagaugggaugcuaucuu

SEQ ID NO: 75116 - RNA, 21 nt, Human
ucuugugguggaggacauaag

SEQ ID NO: 75117 - RNA, 23 nt, Human
ucuuucuucucuuuucuguuucc

SEQ ID NO: 75118 - RNA, 19 nt, Human
ucuuuggcuagauaagccc

SEQ ID NO: 75119 - RNA, 18 nt, Human
ucuuugguuaaugaaaug

SEQ ID NO: 75120 - RNA, 23 nt, Human
ugaaaacaacacccaucuucuga

SEQ ID NO: 75121 - RNA, 19 nt, Human
ugaaguuucaagcagcaga

SEQ ID NO: 75122 - RNA, 24 nt, Human
ugaccaagaguauucccgccagca

SEQ ID NO: 75123 - RNA, 18 nt, Human
ugaccaggaagacagagc

SEQ ID NO: 75124 - RNA, 21 nt, Human
ugagcuccagacaggcacugg

SEQ ID NO: 75125 - RNA, 19 nt, Human
ugaggugcucuggccacag

SEQ ID NO: 75126 - RNA, 21 nt, Human
ugaucuugggaugcuggauuu

SEQ ID NO: 75127 - RNA, 21 nt, Human
ugccugucaccucacagaugg

SEQ ID NO: 75128 - RNA, 20 nt, Human
ugcucuggccacaggugcca

SEQ ID NO: 75129 - RNA, 22 nt, Human
uggaaagcccacucuugcagga

SEQ ID NO: 75130 - RNA, 18 nt, Human
uggcaaaauggaagacca

SEQ ID NO: 75131 - RNA, 21 nt, Human
uggcccacguccgucccuggc

SEQ ID NO: 75132 - RNA, 20 nt, Human
uggccugaguacucagcucu

SEQ ID NO: 75133 - RNA, 21 nt, Human
uggccugaguacucagcucuu

SEQ ID NO: 75134 - RNA, 23 nt, Human
uggcugcaaagcuccagaggaag

SEQ ID NO: 75135 - RNA, 20 nt, Human
uggcuucuaaucaagcucuu

SEQ ID NO: 75136 - RNA, 20 nt, Human
ugggaaaaauggagaccaaa

SEQ ID NO: 75137 - RNA, 23 nt, Human
ugggaaugaagagaacccagaua

SEQ ID NO: 75138 - RNA, 24 nt, Human
ugggacagucauuuuucaggagca

SEQ ID NO: 75139 - RNA, 20 nt, Human
ugggaggggcgggcauggcg

SEQ ID NO: 75140 - RNA, 19 nt, Human
ugggaugcuggauuuuaau

SEQ ID NO: 75141 - RNA, 23 nt, Human
ugggcagcuggcugaggccagga

SEQ ID NO: 75142 - RNA, 19 nt, Human
ugguggguggggagggucc

SEQ ID NO: 75143 - RNA, 18 nt, Human
uguagaauaaaggguggu

SEQ ID NO: 75144 - RNA, 21 nt, Human
ugucuuuguacucccucuccu

SEQ ID NO: 75145 - RNA, 19 nt, Human
ugugguccaggggaaucuc

SEQ ID NO: 75146 - RNA, 24 nt, Human
uguugaaugaauguucaacauuau

SEQ ID NO: 75147 - RNA, 24 nt, Human
uuccaaaauccuuugaagccaaag

SEQ ID NO: 75148 - RNA, 20 nt, Human
uuccagccgcccccauuugu

SEQ ID NO: 75149 - RNA, 19 nt, Human
uuccuccauguaccccaca

SEQ ID NO: 75150 - RNA, 22 nt, Human
uuccugggaccuccuuggcauc

SEQ ID NO: 75151 - RNA, 21 nt, Human
uucuguuuccuacagguacag

SEQ ID NO: 75152 - RNA, 22 nt, Human
uugccugucaccucacagaugg

SEQ ID NO: 75153 - RNA, 18 nt, Human
uugcugccacugucuugg

SEQ ID NO: 75154 - RNA, 22 nt, Human
uuggagaguugugcaugggagc

SEQ ID NO: 75155 - RNA, 20 nt, Human
uuggcuagauaagcccuucc

SEQ ID NO: 75156 - RNA, 20 nt, Human
uuuaaaaaaacugacuccag

SEQ ID NO: 75157 - RNA, 20 nt, Human
uuuccaaaauccuuugaagc

SEQ ID NO: 75158 - RNA, 20 nt, Human
uuuccuauccuuuuaucuuu

SEQ ID NO: 75159 - RNA, 20 nt, Human
uuugucuuucauccuugccu

SEQ ID NO: 75160 - RNA, 18 nt, Human
aaagacugagcggggaca

SEQ ID NO: 75161 - RNA, 19 nt, Human
aaagcuugaaaaucaagaa

SEQ ID NO: 75162 - RNA, 18 nt, Human
aaaggccuuccaucuuca

SEQ ID NO: 75163 - RNA, 18 nt, Human
aaaggccuuccaucuuca

SEQ ID NO: 75164 - RNA, 19 nt, Human
aaaugggcucgcucaaaga

SEQ ID NO: 75165 - RNA, 18 nt, Human
aagacagugaaucuagaa

SEQ ID NO: 75166 - RNA, 20 nt, Human
aagcgccaccaucgaucccg

SEQ ID NO: 75167 - RNA, 20 nt, Human
aagcgccaccaucgaucccg

SEQ ID NO: 75168 - RNA, 20 nt, Human
acaaaaagcuuccuguaagc

SEQ ID NO: 75169 - RNA, 20 nt, Human
acaaaaagcuuccuguaagc

SEQ ID NO: 75170 - RNA, 19 nt, Human
accugcgccugcccucccc

SEQ ID NO: 75171 - RNA, 24 nt, Human
agagauugaagacgggugggcaca

SEQ ID NO: 75172 - RNA, 24 nt, Human
agagauugaagacgggugggcaca

SEQ ID NO: 75173 - RNA, 18 nt, Human
agcaagaguaagcauaug

SEQ ID NO: 75174 - RNA, 18 nt, Human
agcaagaguaagcauaug

SEQ ID NO: 75175 - RNA, 20 nt, Human
agccccucccccgcggccaa

SEQ ID NO: 75176 - RNA, 23 nt, Human
aggacccugggcaaagucucaaa

SEQ ID NO: 75177 - RNA, 18 nt, Human
aggcucgcgggaggggag

SEQ ID NO: 75178 - RNA, 18 nt, Human
aggcucgcgggaggggag

SEQ ID NO: 75179 - RNA, 19 nt, Human
auaggacacaauccacaaa

SEQ ID NO: 75180 - RNA, 22 nt, Human
auuaagacaaggaggauggcuc

SEQ ID NO: 75181 - RNA, 22 nt, Human
caaaagacagugaaucuagaaa

SEQ ID NO: 75182 - RNA, 21 nt, Human
caagaguaagcauaugugaua

SEQ ID NO: 75183 - RNA, 21 nt, Human
caagaguaagcauaugugaua

SEQ ID NO: 75184 - RNA, 20 nt, Human
cacaaaaugggcucgcucaa

SEQ ID NO: 75185 - RNA, 18 nt, Human
cacagagaaacccacaaa

SEQ ID NO: 75186 - RNA, 18 nt, Human
cacagagaaacccacaaa

SEQ ID NO: 75187 - RNA, 26 nt, Human
cacaggacccugggcaaagucucaaa

SEQ ID NO: 75188 - RNA, 26 nt, Human
cacaggacccugggcaaagucucaaa

SEQ ID NO: 75189 - RNA, 24 nt, Human
cacaguucagcaccuguugggucu

SEQ ID NO: 75190 - RNA, 24 nt, Human
cacaguucagcaccuguugggucu

SEQ ID NO: 75191 - RNA, 19 nt, Human
caccaacaauacaacauaa

SEQ ID NO: 75192 - RNA, 19 nt, Human
caccaacaauacaacauaa

SEQ ID NO: 75193 - RNA, 20 nt, Human
caccggaacggcagcagcag

SEQ ID NO: 75194 - RNA, 23 nt, Human
caccugcgccugcccuccccacc

SEQ ID NO: 75195 - RNA, 24 nt, Human
cagagauugaagacgggugggcac

SEQ ID NO: 75196 - RNA, 24 nt, Human
cagagauugaagacgggugggcac

SEQ ID NO: 75197 - RNA, 21 nt, Human
ccaccaucgaucccggcugcu

SEQ ID NO: 75198 - RNA, 23 nt, Human
ccagccccucccccgcggccaag

SEQ ID NO: 75199 - RNA, 21 nt, Human
ccaggggaggaggcucgcggg

SEQ ID NO: 75200 - RNA, 22 nt, Human
cccacggcggggcccggggggc

SEQ ID NO: 75201 - RNA, 23 nt, Human
cccagccccucccccgcggccaa

SEQ ID NO: 75202 - RNA, 22 nt, Human
ccccaggccccaggcugauucu

SEQ ID NO: 75203 - RNA, 22 nt, Human
ccccaggccccaggcugauucu

SEQ ID NO: 75204 - RNA, 18 nt, Human
ccccaggcugauucuccu

SEQ ID NO: 75205 - RNA, 18 nt, Human
ccccaggcugauucuccu

SEQ ID NO: 75206 - RNA, 20 nt, Human
ccccaggcugauucuccugc

SEQ ID NO: 75207 - RNA, 22 nt, Human
ccccaggcugauucuccugcca

SEQ ID NO: 75208 - RNA, 22 nt, Human
ccccaggcugauucuccugcca

SEQ ID NO: 75209 - RNA, 24 nt, Human
ccccaggcugauucuccugccauc

SEQ ID NO: 75210 - RNA, 24 nt, Human
ccccaggcugauucuccugccauc

SEQ ID NO: 75211 - RNA, 19 nt, Human
cccccauccaggcacagga

SEQ ID NO: 75212 - RNA, 19 nt, Human
cccccauccaggcacagga

SEQ ID NO: 75213 - RNA, 22 nt, Human
cccgaauuuccucggaaagcgc

SEQ ID NO: 75214 - RNA, 23 nt, Human
cccgcagcggcccagccccuccc

SEQ ID NO: 75215 - RNA, 18 nt, Human
cccuccccacccucgccg

SEQ ID NO: 75216 - RNA, 19 nt, Human
cccucccccgcggccaagg

SEQ ID NO: 75217 - RNA, 20 nt, Human
ccgcugcccccucuggcggc

SEQ ID NO: 75218 - RNA, 18 nt, Human
ccggcgcgcggggcugcg

SEQ ID NO: 75219 - RNA, 19 nt, Human
ccucuggcggccgcgacug

SEQ ID NO: 75220 - RNA, 21 nt, Human
cgcaccaacaauacaacauaa

SEQ ID NO: 75221 - RNA, 21 nt, Human
cgcaccaacaauacaacauaa

SEQ ID NO: 75222 - RNA, 23 nt, Human
cgccaccaucgaucccggcugcu

SEQ ID NO: 75223 - RNA, 21 nt, Human
cgcgcccagccuagccggucc

SEQ ID NO: 75224 - RNA, 20 nt, Human
cgcggggcugcgggcaggga

SEQ ID NO: 75225 - RNA, 24 nt, Human
cgggaggagggcccaggggaggag

SEQ ID NO: 75226 - RNA, 22 nt, Human
cgggaggggagaaggcggaggc

SEQ ID NO: 75227 - RNA, 23 nt, Human
cggggcugcgggcagggaugggc

SEQ ID NO: 75228 - RNA, 24 nt, Human
cggggcugcgggcagggaugggcg

SEQ ID NO: 75229 - RNA, 22 nt, Human
cguggucaaggcugccugcacc

SEQ ID NO: 75230 - RNA, 22 nt, Human
cguggucaaggcugccugcacc

SEQ ID NO: 75231 - RNA, 23 nt, Human
cugcacccccauccaggcacagg

SEQ ID NO: 75232 - RNA, 23 nt, Human
cugcacccccauccaggcacagg

SEQ ID NO: 75233 - RNA, 18 nt, Human
cugcccccucuggcggcc

SEQ ID NO: 75234 - RNA, 20 nt, Human
cuggcggccgcgacugcccc

SEQ ID NO: 75235 - RNA, 18 nt, Human
cuguaccacuuugaccca

SEQ ID NO: 75236 - RNA, 18 nt, Human
cuguaccacuuugaccca

SEQ ID NO: 75237 - RNA, 23 nt, Human
cuguggcucugguuccaggucuc

SEQ ID NO: 75238 - RNA, 23 nt, Human
cuguggcucugguuccaggucuc

SEQ ID NO: 75239 - RNA, 21 nt, Human
cuguugggucuuggcuguugg

SEQ ID NO: 75240 - RNA, 21 nt, Human
cuguugggucuuggcuguugg

SEQ ID NO: 75241 - RNA, 24 nt, Human
gagccaaggcuugguuuuguuuua

SEQ ID NO: 75242 - RNA, 24 nt, Human
gagccaaggcuugguuuuguuuua

SEQ ID NO: 75243 - RNA, 19 nt, Human
gagccgccccagcccgcgc

SEQ ID NO: 75244 - RNA, 21 nt, Human
gaguucaugguugcuugaggu

SEQ ID NO: 75245 - RNA, 21 nt, Human
gaguucaugguugcuugaggu

SEQ ID NO: 75246 - RNA, 18 nt, Human
gcccagccuagccggucc

SEQ ID NO: 75247 - RNA, 21 nt, Human
gccccgcagcggcccagcccc

SEQ ID NO: 75248 - RNA, 19 nt, Human
gcccuccccacccucgccg

SEQ ID NO: 75249 - RNA, 22 nt, Human
gccugcccuccccacccucgcc

SEQ ID NO: 75250 - RNA, 21 nt, Human
gcggcggcggggaggacggga

SEQ ID NO: 75251 - RNA, 22 nt, Human
gcggggcugcgggcagggaugg

SEQ ID NO: 75252 - RNA, 24 nt, Human
gcugcugcccuggaaaugugauuu

SEQ ID NO: 75253 - RNA, 24 nt, Human
gcugcugcccuggaaaugugauuu

SEQ ID NO: 75254 - RNA, 25 nt, Human
ggacacaauccacaaaaugggcucg

SEQ ID NO: 75255 - RNA, 19 nt, Human
ggaggaggcucgcgggagg

SEQ ID NO: 75256 - RNA, 28 nt, Human
ggaggggaggaggcucgcgggagggggg

SEQ ID NO: 75257 - RNA, 24 nt, Human
ggcggcggcggggaggacgggagg

SEQ ID NO: 75258 - RNA, 21 nt, Human
gggaggggagaaggcggaggc

SEQ ID NO: 75259 - RNA, 21 nt, Human
gggcagggaugggcgcgcacc

SEQ ID NO: 75260 - RNA, 24 nt, Human
ggugaggggaacagccguggucaa

SEQ ID NO: 75261 - RNA, 24 nt, Human
ggugaggggaacagccguggucaa

SEQ ID NO: 75262 - RNA, 24 nt, Human
gguugcuugaggucaggccuggcu

SEQ ID NO: 75263 - RNA, 24 nt, Human
gguugcuugaggucaggccuggcu

SEQ ID NO: 75264 - RNA, 21 nt, Human
guccaccugcgccugcccucc

SEQ ID NO: 75265 - RNA, 19 nt, Human
gugaauucuggcucccauu

SEQ ID NO: 75266 - RNA, 19 nt, Human
gugaauucuggcucccauu

SEQ ID NO: 75267 - RNA, 21 nt, Human
guggucaaggcugccugcacc

SEQ ID NO: 75268 - RNA, 21 nt, Human
guggucaaggcugccugcacc

SEQ ID NO: 75269 - RNA, 20 nt, Human
guucaugguugcuugagguc

SEQ ID NO: 75270 - RNA, 20 nt, Human
guucaugguugcuugagguc

SEQ ID NO: 75271 - RNA, 22 nt, Human
uaauagcugaguucaugguugc

SEQ ID NO: 75272 - RNA, 22 nt, Human
uaauagcugaguucaugguugc

SEQ ID NO: 75273 - RNA, 24 nt, Human
uacaaaaagcuuccuguaagcuaa

SEQ ID NO: 75274 - RNA, 24 nt, Human
uacaaaaagcuuccuguaagcuaa

SEQ ID NO: 75275 - RNA, 23 nt, Human
uagcugaguucaugguugcuuga

SEQ ID NO: 75276 - RNA, 23 nt, Human
uagcugaguucaugguugcuuga

SEQ ID NO: 75277 - RNA, 21 nt, Human
ucagagcacagagaaacccac

SEQ ID NO: 75278 - RNA, 21 nt, Human
ucagagcacagagaaacccac

SEQ ID NO: 75279 - RNA, 20 nt, Human
uccaccugcgccugcccucc

SEQ ID NO: 75280 - RNA, 21 nt, Human
uccaggucucaaggguacagc

SEQ ID NO: 75281 - RNA, 21 nt, Human
uccaggucucaaggguacagc

SEQ ID NO: 75282 - RNA, 23 nt, Human
ucccccgcggccaaggucacagc

SEQ ID NO: 75283 - RNA, 23 nt, Human
ucgaucccggcugcugcccugga

SEQ ID NO: 75284 - RNA, 23 nt, Human
ucgaucccggcugcugcccugga

SEQ ID NO: 75285 - RNA, 19 nt, Human
ucgccgggcucaggccgcg

SEQ ID NO: 75286 - RNA, 24 nt, Human
ucgccgggcucaggccgcgccucu

SEQ ID NO: 75287 - RNA, 19 nt, Human
ucgcucaaagacugagcgg

SEQ ID NO: 75288 - RNA, 18 nt, Human
ucucaaggguacagcuug

SEQ ID NO: 75289 - RNA, 20 nt, Human
ucucaaggguacagcuuggu

SEQ ID NO: 75290 - RNA, 18 nt, Human
ucugaccagagaggacuc

SEQ ID NO: 75291 - RNA, 20 nt, Human
ucuuccccgggaaacucgag

SEQ ID NO: 75292 - RNA, 20 nt, Human
ugaagagagaagagaacgag

SEQ ID NO: 75293 - RNA, 20 nt, Human
ugaagagagaagagaacgag

SEQ ID NO: 75294 - RNA, 20 nt, Human
ugaccuccuagugaauucuu

SEQ ID NO: 75295 - RNA, 20 nt, Human
ugaccuccuagugaauucuu

SEQ ID NO: 75296 - RNA, 22 nt, Human
ugaguucaugguugcuugaggu

SEQ ID NO: 75297 - RNA, 20 nt, Human
uggaaaugugauuuucuuaa

SEQ ID NO: 75298 - RNA, 20 nt, Human
uggaaaugugauuuucuuaa

SEQ ID NO: 75299 - RNA, 22 nt, Human
uggcacauguagacacuuuggc

SEQ ID NO: 75300 - RNA, 22 nt, Human
uggcacauguagacacuuuggc

SEQ ID NO: 75301 - RNA, 21 nt, Human
ugggcgcgcaccgggaccggc

SEQ ID NO: 75302 - RNA, 21 nt, Human
ugggucuuggcuguugggaug

SEQ ID NO: 75303 - RNA, 21 nt, Human
ugggucuuggcuguugggaug

SEQ ID NO: 75304 - RNA, 25 nt, Human
uuaagacaaggaggauggcuccaca

SEQ ID NO: 75305 - RNA, 21 nt, Human
uucagaagaggcuugugagga

SEQ ID NO: 75306 - RNA, 20 nt, Human
uucagagcacagagaaaccc

SEQ ID NO: 75307 - RNA, 20 nt, Human
uucagagcacagagaaaccc

SEQ ID NO: 75308 - RNA, 23 nt, Human
uucagagcacagagaaacccaca

SEQ ID NO: 75309 - RNA, 24 nt, Human
uucagagcacagagaaacccacaa

SEQ ID NO: 75310 - RNA, 21 nt, Human
uuccugguugaugcacaguuc

SEQ ID NO: 75311 - RNA, 21 nt, Human
uuccugguugaugcacaguuc

SEQ ID NO: 75312 - RNA, 21 nt, Human
uucuuggaaguagggaggauu

SEQ ID NO: 75313 - RNA, 21 nt, Human
uucuuggaaguagggaggauu

SEQ ID NO: 75314 - RNA, 21 nt, Human
uugguuuuguuuuauguuggu

SEQ ID NO: 75315 - RNA, 21 nt, Human
uugguuuuguuuuauguuggu

SEQ ID NO: 75316 - RNA, 20 nt, Human
uuucuuggaaguagggagga

SEQ ID NO: 75317 - RNA, 20 nt, Human
uuucuuggaaguagggagga

SEQ ID NO: 75318 - RNA, 22 nt, Human
aaaaguaagcaacauucuuucc

SEQ ID NO: 75319 - RNA, 24 nt, Human
aaaucuucccaauguagcuuaaag

SEQ ID NO: 75320 - RNA, 21 nt, Human
aaaugccaggaaauaggaagu

SEQ ID NO: 75321 - RNA, 19 nt, Human
aaauucccuugugguaaac

SEQ ID NO: 75322 - RNA, 18 nt, Human
aacacaucuaaccccagc

SEQ ID NO: 75323 - RNA, 18 nt, Human
aacagcuuuacauguugg

SEQ ID NO: 75324 - RNA, 21 nt, Human
aacauuuaaaauauuuacaga

SEQ ID NO: 75325 - RNA, 20 nt, Human
aaccaagugcuuuacaaauu

SEQ ID NO: 75326 - RNA, 23 nt, Human
aaccacugaaaauauacuagcaa

SEQ ID NO: 75327 - RNA, 27 nt, Human
aaccugcuuuucaaaugcaaacccagu

SEQ ID NO: 75328 - RNA, 22 nt, Human
aacuacuaaaggaaaaaaacag

SEQ ID NO: 75329 - RNA, 23 nt, Human
aagcagcccccgucuuaggccaa

SEQ ID NO: 75330 - RNA, 21 nt, Human
aagccugauuuuaggagccga

SEQ ID NO: 75331 - RNA, 18 nt, Human
aagcggggggcagggagg

SEQ ID NO: 75332 - RNA, 22 nt, Human
aaugccaggaaauaggaagucc

SEQ ID NO: 75333 - RNA, 18 nt, Human
aauguuauuuuacugaau

SEQ ID NO: 75334 - RNA, 23 nt, Human
acacacacacacacacacacaca

SEQ ID NO: 75335 - RNA, 23 nt, Human
acacacacacacacacacacaca

SEQ ID NO: 75336 - RNA, 21 nt, Human
acacauacacacacacacaca

SEQ ID NO: 75337 - RNA, 27 nt, Human
acuaaaucuucccaauguagcuuaaag

SEQ ID NO: 75338 - RNA, 19 nt, Human
acugaagcgagagcgcccg

SEQ ID NO: 75339 - RNA, 23 nt, Human
acugaguguccacaugcaaccug

SEQ ID NO: 75340 - RNA, 19 nt, Human
agaacauacaaaccacuga

SEQ ID NO: 75341 - RNA, 23 nt, Human
agagagaacauacaaaccacuga

SEQ ID NO: 75342 - RNA, 25 nt, Human
agucagugacagagagaacauacaa

SEQ ID NO: 75343 - RNA, 24 nt, Human
auaggugcucaguuaucuauuuug

SEQ ID NO: 75344 - RNA, 25 nt, Human
auggagaaccaagacuguauccaca

SEQ ID NO: 75345 - RNA, 18 nt, Human
caaaagacaaacguaaaa

SEQ ID NO: 75346 - RNA, 26 nt, Human
caaacguaaaaucuuuuuuaucuguc

SEQ ID NO: 75347 - RNA, 21 nt, Human
caaagcccuaagauucaggua

SEQ ID NO: 75348 - RNA, 20 nt, Human
cacacacacacacacacaca

SEQ ID NO: 75349 - RNA, 20 nt, Human
cacacacacacacacacaca

SEQ ID NO: 75350 - RNA, 20 nt, Human
cacacacacacacacacaca

SEQ ID NO: 75351 - RNA, 20 nt, Human
cacacacacacacacacaca

SEQ ID NO: 75352 - RNA, 20 nt, Human
cacacacacacacacacaca

SEQ ID NO: 75353 - RNA, 22 nt, Human
cacacacacacacacacacaca

SEQ ID NO: 75354 - RNA, 22 nt, Human
cacacacacacacacacacaca

SEQ ID NO: 75355 - RNA, 18 nt, Human
cacuuauggccaaaagac

SEQ ID NO: 75356 - RNA, 24 nt, Human
cagaaaacuuucccacuuauggcc

SEQ ID NO: 75357 - RNA, 22 nt, Human
cauacacaaacugauacaacca

SEQ ID NO: 75358 - RNA, 22 nt, Human
caugaaggaaaaggcauacacu

SEQ ID NO: 75359 - RNA, 18 nt, Human
cauguugguaagcucucc

SEQ ID NO: 75360 - RNA, 21 nt, Human
cccuaagauucagguaagacc

SEQ ID NO: 75361 - RNA, 20 nt, Human
ccucccccuacacccugauc

SEQ ID NO: 75362 - RNA, 19 nt, Human
cgaagaacaaagcccuaag

SEQ ID NO: 75363 - RNA, 22 nt, Human
cggcagccucaaaaaaaauauu

SEQ ID NO: 75364 - RNA, 21 nt, Human
cucauaauccugucauuuguc

SEQ ID NO: 75365 - RNA, 23 nt, Human
cucccccuacacccugaucaaaa

SEQ ID NO: 75366 - RNA, 21 nt, Human
cuggcauuggugacccacggu

SEQ ID NO: 75367 - RNA, 22 nt, Human
gagagcaaggauucaaccugcu

SEQ ID NO: 75368 - RNA, 18 nt, Human
gcaaaaucauuucuuugu

SEQ ID NO: 75369 - RNA, 23 nt, Human
gcagccucaaaaaaaagggaacc

SEQ ID NO: 75370 - RNA, 21 nt, Human
gccacuguauucugaguccua

SEQ ID NO: 75371 - RNA, 20 nt, Human
gcggcccgacugacugaagc

SEQ ID NO: 75372 - RNA, 23 nt, Human
ggagaaaucaugguugacuuaaa

SEQ ID NO: 75373 - RNA, 23 nt, Human
ggagaagcagcccccgucuuagg

SEQ ID NO: 75374 - RNA, 22 nt, Human
gggcaaggccaacuugcuucag

SEQ ID NO: 75375 - RNA, 20 nt, Human
gugggugguggcugcccaca

SEQ ID NO: 75376 - RNA, 24 nt, Human
uaaaauuacaaguaucaaagaaau

SEQ ID NO: 75377 - RNA, 23 nt, Human
uaagaaauuacacuuggccaaua

SEQ ID NO: 75378 - RNA, 21 nt, Human
uacaaaaauauucccaguagc

SEQ ID NO: 75379 - RNA, 22 nt, Human
uacaaaccacugaaaauauacu

SEQ ID NO: 75380 - RNA, 22 nt, Human
uacaaguaucaaagaaauaccu

SEQ ID NO: 75381 - RNA, 20 nt, Human
uacacacacacacacacaca

SEQ ID NO: 75382 - RNA, 21 nt, Human
uacaguagcaauuaaagcaaa

SEQ ID NO: 75383 - RNA, 25 nt, Human
uagaaaaaacuucuuuagaaguuaa

SEQ ID NO: 75384 - RNA, 20 nt, Human
uagcaauauccucccccuac

SEQ ID NO: 75385 - RNA, 29 nt, Human
uagcaauauccucccccuacacccugauu

SEQ ID NO: 75386 - RNA, 21 nt, Human
uauagcaaacuguuaaaaaaa

SEQ ID NO: 75387 - RNA, 23 nt, Human
uauaugcauuuuuuuuaauugcu

SEQ ID NO: 75388 - RNA, 21 nt, Human
uauucccaguagcugacaccc

SEQ ID NO: 75389 - RNA, 23 nt, Human
ucaaagcaaguacaguagcaauu

SEQ ID NO: 75390 - RNA, 22 nt, Human
ucaacacuauaaacuacuccuc

SEQ ID NO: 75391 - RNA, 19 nt, Human
ucacauggauuuuucugaa

SEQ ID NO: 75392 - RNA, 22 nt, Human
ucagugacagagagaacauaca

SEQ ID NO: 75393 - RNA, 21 nt, Human
ucauaauccugucauuugucu

SEQ ID NO: 75394 - RNA, 20 nt, Human
uccaaagggacaaaaaugcc

SEQ ID NO: 75395 - RNA, 18 nt, Human
uccaggaggcaaaaucau

SEQ ID NO: 75396 - RNA, 19 nt, Human
ucuggcauuggugacccac

SEQ ID NO: 75397 - RNA, 23 nt, Human
ucuuucagcccucugauuuuggu

SEQ ID NO: 75398 - RNA, 21 nt, Human
ugaaaacauuucaaaauucug

SEQ ID NO: 75399 - RNA, 18 nt, Human
ugaagaggagaagcagcc

SEQ ID NO: 75400 - RNA, 22 nt, Human
ugaagaggagaagcagcccccg

SEQ ID NO: 75401 - RNA, 24 nt, Human
ugaagcugaaauuuaaaauuacaa

SEQ ID NO: 75402 - RNA, 25 nt, Human
ugaauucaacauaacagcuuuuaaa

SEQ ID NO: 75403 - RNA, 22 nt, Human
ugacagagagaacauacaaacc

SEQ ID NO: 75404 - RNA, 23 nt, Human
ugacuuaaaggaaauucccuugu

SEQ ID NO: 75405 - RNA, 18 nt, Human
ugagaaggccaguucaua

SEQ ID NO: 75406 - RNA, 22 nt, Human
ugagguaggaaaucaaggguuc

SEQ ID NO: 75407 - RNA, 22 nt, Human
ugccaaaacuucaggagaaaau

SEQ ID NO: 75408 - RNA, 20 nt, Human
ugccaggaaauaggaagucc

SEQ ID NO: 75409 - RNA, 22 nt, Human
ugcugagaagauccauagcuuu

SEQ ID NO: 75410 - RNA, 20 nt, Human
ugcuugggaagaaauuuucu

SEQ ID NO: 75411 - RNA, 18 nt, Human
uggccaaaagacaaacgu

SEQ ID NO: 75412 - RNA, 18 nt, Human
uggcuuaagauuuuacau

SEQ ID NO: 75413 - RNA, 20 nt, Human
ugguaagcucuccagauucu

SEQ ID NO: 75414 - RNA, 21 nt, Human
ugguagagacugaagcggggg

SEQ ID NO: 75415 - RNA, 23 nt, Human
ugugacugaguguccacaugcaa

SEQ ID NO: 75416 - RNA, 20 nt, Human
uguuaugcgauaggugcuca

SEQ ID NO: 75417 - RNA, 21 nt, Human
uucacaaaccugcagaguugc

SEQ ID NO: 75418 - RNA, 19 nt, Human
uugagaaggccaguucaua

SEQ ID NO: 75419 - RNA, 18 nt, Human
uugagcaacagaugguca

SEQ ID NO: 75420 - RNA, 21 nt, Human
uuguuuugaauaugacaauuu

SEQ ID NO: 75421 - RNA, 18 nt, Human
uuuaucuguccaucugca

SEQ ID NO: 75422 - RNA, 21 nt, Human
aaaaaacaaaaacccagaggc

SEQ ID NO: 75423 - RNA, 25 nt, Human
aaaaaauaaggacaagccuaagaac

SEQ ID NO: 75424 - RNA, 19 nt, Human
aaaaacaaacaaaaccccc

SEQ ID NO: 75425 - RNA, 19 nt, Human
aaaaagcuuccaacacuga

SEQ ID NO: 75426 - RNA, 22 nt, Human
aaaacaaaaacaaaaacaaaaa

SEQ ID NO: 75427 - RNA, 23 nt, Human
aaaacaaaaacaaaaacaaaaaa

SEQ ID NO: 75428 - RNA, 22 nt, Human
aaaacaaacaaaaccccccaaa

SEQ ID NO: 75429 - RNA, 23 nt, Human
aaaaccaaaccaaacgaaaaaga

SEQ ID NO: 75430 - RNA, 23 nt, Human
aaaaccccccaaacaaacaaaaa

SEQ ID NO: 75431 - RNA, 26 nt, Human
aaacaaaaaacaccuuguucuuuagu

SEQ ID NO: 75432 - RNA, 24 nt, Human
aaacaaaaacaaaaacaaaaaaca

SEQ ID NO: 75433 - RNA, 26 nt, Human
aaacaaaaacaaaaacaaaaacaaac

SEQ ID NO: 75434 - RNA, 24 nt, Human
aaacaaaaacaaaaacaaacaaaa

SEQ ID NO: 75435 - RNA, 26 nt, Human
aaacaaaaacaaacaaaaccccccaa

SEQ ID NO: 75436 - RNA, 18 nt, Human
aaacaaaaccccccaaac

SEQ ID NO: 75437 - RNA, 19 nt, Human
aaacaaaaccccccaaacc

SEQ ID NO: 75438 - RNA, 22 nt, Human
aaacaaacaaaaccccccaaac

SEQ ID NO: 75439 - RNA, 23 nt, Human
aaacaaacaaaaccccccaaaca

SEQ ID NO: 75440 - RNA, 19 nt, Human
aaacaaagucaaccaucua

SEQ ID NO: 75441 - RNA, 22 nt, Human
aaacaagaaaaaacaaaaaccc

SEQ ID NO: 75442 - RNA, 23 nt, Human
aaacaagaaaaaacaaaaaccca

SEQ ID NO: 75443 - RNA, 24 nt, Human
aaacaagaaaaaacaaaaacccag

SEQ ID NO: 75444 - RNA, 22 nt, Human
aaacagcccgugguuggagggu

SEQ ID NO: 75445 - RNA, 20 nt, Human
aaacauacacuuucaacaca

SEQ ID NO: 75446 - RNA, 19 nt, Human
aaaccaaaccaaacgaaaa

SEQ ID NO: 75447 - RNA, 26 nt, Human
aaaccacgagaaaaaccacaaucacu

SEQ ID NO: 75448 - RNA, 26 nt, Human
aaaccccccaaacaaacaaaaaacaa

SEQ ID NO: 75449 - RNA, 19 nt, Human
aaagacacacacacaucac

SEQ ID NO: 75450 - RNA, 19 nt, Human
aacaaaaacaaaaaacacc

SEQ ID NO: 75451 - RNA, 23 nt, Human
aacaaaaacaaaaacaaacaaaa

SEQ ID NO: 75452 - RNA, 24 nt, Human
aacagaaauggugucuagacaaaa

SEQ ID NO: 75453 - RNA, 21 nt, Human
aaccaaacgaaaaagaaaucu

SEQ ID NO: 75454 - RNA, 25 nt, Human
aaccaaguggguauucuucacaaaa

SEQ ID NO: 75455 - RNA, 23 nt, Human
aaccacagaaaccugaggaaaug

SEQ ID NO: 75456 - RNA, 23 nt, Human
aacccagaggcagguuuuaaaag

SEQ ID NO: 75457 - RNA, 23 nt, Human
aaccccccaaacaaacaaaaaac

SEQ ID NO: 75458 - RNA, 25 nt, Human
aaccucagaagaaaacuccaagccu

SEQ ID NO: 75459 - RNA, 19 nt, Human
aaccugaggaaauggaugg

SEQ ID NO: 75460 - RNA, 24 nt, Human
aacucagugcaaguggcaaaguug

SEQ ID NO: 75461 - RNA, 19 nt, Human
aacuucacacugugcacac

SEQ ID NO: 75462 - RNA, 21 nt, Human
aagaaaaaacaaaaacccaga

SEQ ID NO: 75463 - RNA, 21 nt, Human
aagaggaagaaaagcaaggca

SEQ ID NO: 75464 - RNA, 20 nt, Human
aagcaagaaaaaugaccacg

SEQ ID NO: 75465 - RNA, 23 nt, Human
aagcaggacaaaggcagauccaa

SEQ ID NO: 75466 - RNA, 22 nt, Human
aagcaugcuuucuucuggcuuu

SEQ ID NO: 75467 - RNA, 20 nt, Human
aauguaaggauuacaucccg

SEQ ID NO: 75468 - RNA, 22 nt, Human
acaaaaaacaccuuguucuuua

SEQ ID NO: 75469 - RNA, 19 nt, Human
acaaaaacaaaaaacaccu

SEQ ID NO: 75470 - RNA, 18 nt, Human
acaaaaacaaaaacaaaa

SEQ ID NO: 75471 - RNA, 18 nt, Human
acaaacaaaaccccccaa

SEQ ID NO: 75472 - RNA, 25 nt, Human
acaaacaagaaaaaacaaaaaccca

SEQ ID NO: 75473 - RNA, 25 nt, Human
acaaaggcaaaccucauggugaagc

SEQ ID NO: 75474 - RNA, 24 nt, Human
acaagacacuggcagaaaaaccuc

SEQ ID NO: 75475 - RNA, 24 nt, Human
acacacacaaacaagaaaaaacaa

SEQ ID NO: 75476 - RNA, 21 nt, Human
acacacacacaaacaagaaaa

SEQ ID NO: 75477 - RNA, 23 nt, Human
acacacacacacacacacacaca

SEQ ID NO: 75478 - RNA, 23 nt, Human
acacacacacacacacacacaca

SEQ ID NO: 75479 - RNA, 23 nt, Human
acacacacacacacacacacaca

SEQ ID NO: 75480 - RNA, 23 nt, Human
acacacacacacacacacacaca

SEQ ID NO: 75481 - RNA, 23 nt, Human
acacacacacacacacacacaca

SEQ ID NO: 75482 - RNA, 23 nt, Human
acacacacacacacacacacaca

SEQ ID NO: 75483 - RNA, 23 nt, Human
acacacacacacacacacacaca

SEQ ID NO: 75484 - RNA, 23 nt, Human
acacacacacacacacacacaca

SEQ ID NO: 75485 - RNA, 23 nt, Human
acacacacacacacacacacaca

SEQ ID NO: 75486 - RNA, 19 nt, Human
acaccacuuggaggugcca

SEQ ID NO: 75487 - RNA, 19 nt, Human
acagacagugucaucacug

SEQ ID NO: 75488 - RNA, 19 nt, Human
accacgagaaaaaccacaa

SEQ ID NO: 75489 - RNA, 18 nt, Human
accagaaauugcacuucc

SEQ ID NO: 75490 - RNA, 19 nt, Human
accccauccccacaucaaa

SEQ ID NO: 75491 - RNA, 25 nt, Human
accccccaaacaaacaaaaaacaaa

SEQ ID NO: 75492 - RNA, 21 nt, Human
accugaagcucccaaaugcau

SEQ ID NO: 75493 - RNA, 18 nt, Human
accuugggaaaaagcuuc

SEQ ID NO: 75494 - RNA, 22 nt, Human
acucaccuccacuggcucugcc

SEQ ID NO: 75495 - RNA, 18 nt, Human
acugaaccacagaaaccu

SEQ ID NO: 75496 - RNA, 18 nt, Human
acuggagcgagggagcug

SEQ ID NO: 75497 - RNA, 25 nt, Human
agaaaacaaaaacaaaaacaaaaaa

SEQ ID NO: 75498 - RNA, 23 nt, Human
agaaacaaagucaaccaucuauu

SEQ ID NO: 75499 - RNA, 20 nt, Human
agaaagaaugugucagccug

SEQ ID NO: 75500 - RNA, 20 nt, Human
agaaagcaugcuuucuucug

SEQ ID NO: 75501 - RNA, 22 nt, Human
agaagauaaauagcaggauggc

SEQ ID NO: 75502 - RNA, 22 nt, Human
agacacuggcagaaaaaccuca

SEQ ID NO: 75503 - RNA, 20 nt, Human
agagaaacaaacacauacag

SEQ ID NO: 75504 - RNA, 24 nt, Human
agagaaacaaacacauacagcaaa

SEQ ID NO: 75505 - RNA, 26 nt, Human
agagcuguuuauccauugcuugacag

SEQ ID NO: 75506 - RNA, 27 nt, Human
agagcuguuuauccauugcuugacagc

SEQ ID NO: 75507 - RNA, 24 nt, Human
agaggaagaaaagcaaggcagggg

SEQ ID NO: 75508 - RNA, 21 nt, Human
agaggagaggucacuuggaaa

SEQ ID NO: 75509 - RNA, 19 nt, Human
agccaaauagggacuugag

SEQ ID NO: 75510 - RNA, 18 nt, Human
agcucguucccagccccc

SEQ ID NO: 75511 - RNA, 19 nt, Human
agcucguucccagcccccc

SEQ ID NO: 75512 - RNA, 19 nt, Human
agcugacuccacuguaacc

SEQ ID NO: 75513 - RNA, 21 nt, Human
aggaagaaaagcaaggcaggg

SEQ ID NO: 75514 - RNA, 22 nt, Human
aggacaaaggcagauccaaggg

SEQ ID NO: 75515 - RNA, 24 nt, Human
aggagaaagaaugugucagccugu

SEQ ID NO: 75516 - RNA, 20 nt, Human
aggagccaaugccugcugag

SEQ ID NO: 75517 - RNA, 23 nt, Human
aggcaaagaugaucaacagcaac

SEQ ID NO: 75518 - RNA, 24 nt, Human
aggcagauccaaggggaggacugg

SEQ ID NO: 75519 - RNA, 18 nt, Human
aggcaggaccuucggggc

SEQ ID NO: 75520 - RNA, 22 nt, Human
aggcaggaccuucggggcugug

SEQ ID NO: 75521 - RNA, 22 nt, Human
aggcagguuuuaaaaguggaac

SEQ ID NO: 75522 - RNA, 20 nt, Human
agggaaagguggggaggagg

SEQ ID NO: 75523 - RNA, 20 nt, Human
agggagagaugagaaggcuc

SEQ ID NO: 75524 - RNA, 18 nt, Human
agggaugggagcaaggga

SEQ ID NO: 75525 - RNA, 18 nt, Human
agggggaggggaaggggc

SEQ ID NO: 75526 - RNA, 24 nt, Human
aggguggagagaaauaaagaggcc

SEQ ID NO: 75527 - RNA, 20 nt, Human
aggugaggucugaguuaggg

SEQ ID NO: 75528 - RNA, 20 nt, Human
aggugcacuugcaucagacu

SEQ ID NO: 75529 - RNA, 18 nt, Human
agguggugcuugccuuga

SEQ ID NO: 75530 - RNA, 21 nt, Human
aggugugcggacugggaggca

SEQ ID NO: 75531 - RNA, 18 nt, Human
aguggaacuguuuaaaaa

SEQ ID NO: 75532 - RNA, 19 nt, Human
aguuaggguggagagaaau

SEQ ID NO: 75533 - RNA, 23 nt, Human
auaaaaaccacgagaaaaaccac

SEQ ID NO: 75534 - RNA, 24 nt, Human
auagugcaucuuaaaagcagcaaa

SEQ ID NO: 75535 - RNA, 24 nt, Human
auauggauauauauauauauauau

SEQ ID NO: 75536 - RNA, 21 nt, Human
aucaaggcacccccagguaac

SEQ ID NO: 75537 - RNA, 24 nt, Human
aucauuuucaaaccuuugucuguu

SEQ ID NO: 75538 - RNA, 20 nt, Human
aucuuccugaucacucacua

SEQ ID NO: 75539 - RNA, 19 nt, Human
augaauaccaacuccacac

SEQ ID NO: 75540 - RNA, 24 nt, Human
augagacuuuucuauguacaaaug

SEQ ID NO: 75541 - RNA, 18 nt, Human
augcacugauauucauuu

SEQ ID NO: 75542 - RNA, 19 nt, Human
auggggugaaggcaggacc

SEQ ID NO: 75543 - RNA, 26 nt, Human
caaaaaacaaaccuacaaugcucaaa

SEQ ID NO: 75544 - RNA, 25 nt, Human
caaaaacaaaaaacaccuuguucuu

SEQ ID NO: 75545 - RNA, 22 nt, Human
caaaaacaaaaacaaaaaacac

SEQ ID NO: 75546 - RNA, 26 nt, Human
caaaaacaaaaacaaacaaaaccccc

SEQ ID NO: 75547 - RNA, 22 nt, Human
caaaaacaaacaaaacccccca

SEQ ID NO: 75548 - RNA, 24 nt, Human
caaaaacaaacaaaaccccccaaa

SEQ ID NO: 75549 - RNA, 19 nt, Human
caaaaaccagcagcuccaa

SEQ ID NO: 75550 - RNA, 21 nt, Human
caaaaccccccaaacaaacaa

SEQ ID NO: 75551 - RNA, 23 nt, Human
caaacaaaaccccccaaacaaac

SEQ ID NO: 75552 - RNA, 22 nt, Human
caaacaagaaaaaacaaaaacc

SEQ ID NO: 75553 - RNA, 22 nt, Human
caaagucaaccaucuauucccc

SEQ ID NO: 75554 - RNA, 24 nt, Human
caaaugacaccacuuggaggugcc

SEQ ID NO: 75555 - RNA, 24 nt, Human
caacacacaaugccucgugcacac

SEQ ID NO: 75556 - RNA, 18 nt, Human
caacacggcccccagagc

SEQ ID NO: 75557 - RNA, 21 nt, Human
caacacggcccccagagccaa

SEQ ID NO: 75558 - RNA, 28 nt, Human
caaccauaacaaaaaccagcagcuccaa

SEQ ID NO: 75559 - RNA, 22 nt, Human
caacuucccaggcaaagaugau

SEQ ID NO: 75560 - RNA, 24 nt, Human
caacuugaaaagagguugccugga

SEQ ID NO: 75561 - RNA, 20 nt, Human
caagaaauuccaacaaccau

SEQ ID NO: 75562 - RNA, 23 nt, Human
caagccgaggccucaggacgugu

SEQ ID NO: 75563 - RNA, 22 nt, Human
caagccugggcaggaaagccag

SEQ ID NO: 75564 - RNA, 22 nt, Human
caaggaaaacaaaaacaaaaac

SEQ ID NO: 75565 - RNA, 31 nt, Human
caaggaaaacaaaaacaaaaacaaaaacaaa

SEQ ID NO: 75566 - RNA, 18 nt, Human
cacaaacaagaaaaaaca

SEQ ID NO: 75567 - RNA, 23 nt, Human
cacaaacaagaaaaaacaaaaac

SEQ ID NO: 75568 - RNA, 22 nt, Human
cacaaauaaagaaacaaaguca

SEQ ID NO: 75569 - RNA, 21 nt, Human
cacacacaaacaagaaaaaac

SEQ ID NO: 75570 - RNA, 24 nt, Human
cacacacacacaaacaagaaaaaa

SEQ ID NO: 75571 - RNA, 21 nt, Human
cacacacacacacaaacaaga

SEQ ID NO: 75572 - RNA, 20 nt, Human
cacacacacacacacacaca

SEQ ID NO: 75573 - RNA, 20 nt, Human
cacacacacacacacacaca

SEQ ID NO: 75574 - RNA, 20 nt, Human
cacacacacacacacacaca

SEQ ID NO: 75575 - RNA, 20 nt, Human
cacacacacacacacacaca

SEQ ID NO: 75576 - RNA, 20 nt, Human
cacacacacacacacacaca

SEQ ID NO: 75577 - RNA, 20 nt, Human
cacacacacacacacacaca

SEQ ID NO: 75578 - RNA, 20 nt, Human
cacacacacacacacacaca

SEQ ID NO: 75579 - RNA, 20 nt, Human
cacacacacacacacacaca

SEQ ID NO: 75580 - RNA, 20 nt, Human
cacacacacacacacacaca

SEQ ID NO: 75581 - RNA, 20 nt, Human
cacacacacacacacacaca

SEQ ID NO: 75582 - RNA, 20 nt, Human
cacacacacacacacacaca

SEQ ID NO: 75583 - RNA, 20 nt, Human
cacacacacacacacacaca

SEQ ID NO: 75584 - RNA, 20 nt, Human
cacacacacacacacacaca

SEQ ID NO: 75585 - RNA, 20 nt, Human
cacacacacacacacacaca

SEQ ID NO: 75586 - RNA, 20 nt, Human
cacacacacacacacacaca

SEQ ID NO: 75587 - RNA, 22 nt, Human
cacacacacacacacacacaca

SEQ ID NO: 75588 - RNA, 22 nt, Human
cacacacacacacacacacaca

SEQ ID NO: 75589 - RNA, 22 nt, Human
cacacacacacacacacacaca

SEQ ID NO: 75590 - RNA, 22 nt, Human
cacacacacacacacacacaca

SEQ ID NO: 75591 - RNA, 22 nt, Human
cacacacacacacacacacaca

SEQ ID NO: 75592 - RNA, 22 nt, Human
cacacacacacacacacacaca

SEQ ID NO: 75593 - RNA, 22 nt, Human
cacacacacacacacacacaca

SEQ ID NO: 75594 - RNA, 22 nt, Human
cacacacacacacacacacaca

SEQ ID NO: 75595 - RNA, 26 nt, Human
cacacacacacacacacacacacaaa

SEQ ID NO: 75596 - RNA, 26 nt, Human
cacacacacacacacacacacacaca

SEQ ID NO: 75597 - RNA, 26 nt, Human
cacacacacacacacacacacacaca

SEQ ID NO: 75598 - RNA, 26 nt, Human
cacacacacacacacacacacacaca

SEQ ID NO: 75599 - RNA, 26 nt, Human
cacacacacacacacacacacacaca

SEQ ID NO: 75600 - RNA, 26 nt, Human
cacacacacacacacacacacacaca

SEQ ID NO: 75601 - RNA, 26 nt, Human
cacacacacacacacacacacacaca

SEQ ID NO: 75602 - RNA, 26 nt, Human
cacacacacacacacacacacacaca

SEQ ID NO: 75603 - RNA, 26 nt, Human
cacacacacacacacacacacacaca

SEQ ID NO: 75604 - RNA, 25 nt, Human
cacacacaucacaugaacaacugca

SEQ ID NO: 75605 - RNA, 21 nt, Human
cacaccacuuccaagagcaag

SEQ ID NO: 75606 - RNA, 20 nt, Human
cacauggcagcucguuccca

SEQ ID NO: 75607 - RNA, 21 nt, Human
caccaccccauccccacauca

SEQ ID NO: 75608 - RNA, 21 nt, Human
cacccccagguaacgcagaga

SEQ ID NO: 75609 - RNA, 18 nt, Human
caccuccacuggcucugc

SEQ ID NO: 75610 - RNA, 26 nt, Human
cacucuuaucugcugugcuucaaggg

SEQ ID NO: 75611 - RNA, 24 nt, Human
cacuuaggaaucugaacauccagc

SEQ ID NO: 75612 - RNA, 22 nt, Human
cacuuggaaaggcaacaauaga

SEQ ID NO: 75613 - RNA, 21 nt, Human
cagaagaaauuccugagauag

SEQ ID NO: 75614 - RNA, 26 nt, Human
cagacacacagagucagguuuuccac

SEQ ID NO: 75615 - RNA, 19 nt, Human
cagauuuccuguaugaaua

SEQ ID NO: 75616 - RNA, 21 nt, Human
cagcucuuccucauuuugaga

SEQ ID NO: 75617 - RNA, 21 nt, Human
cagcugacuccacuguaacac

SEQ ID NO: 75618 - RNA, 20 nt, Human
caggcuuaucauuuucaaac

SEQ ID NO: 75619 - RNA, 22 nt, Human
caggggugggugggaggaaggu

SEQ ID NO: 75620 - RNA, 20 nt, Human
caggguaaaccucaugccaa

SEQ ID NO: 75621 - RNA, 22 nt, Human
caguacuauaaacauacacuuu

SEQ ID NO: 75622 - RNA, 18 nt, Human
caguggcugguuggcccc

SEQ ID NO: 75623 - RNA, 25 nt, Human
cauacacuuucaacacacaaugccu

SEQ ID NO: 75624 - RNA, 20 nt, Human
cauauggauauauauauaua

SEQ ID NO: 75625 - RNA, 23 nt, Human
cauauggauauauauauauauau

SEQ ID NO: 75626 - RNA, 23 nt, Human
cauauguuacuaugauuucacuu

SEQ ID NO: 75627 - RNA, 26 nt, Human
caucaacucugaacucucuaucugcg

SEQ ID NO: 75628 - RNA, 19 nt, Human
caucuuaaaagcagcaaac

SEQ ID NO: 75629 - RNA, 21 nt, Human
cauugcuugacagcaaaaugc

SEQ ID NO: 75630 - RNA, 19 nt, Human
ccaaaagguaaaauucuua

SEQ ID NO: 75631 - RNA, 19 nt, Human
ccaaaccaaacgaaaaaga

SEQ ID NO: 75632 - RNA, 21 nt, Human
ccacugcccaccaccccaucc

SEQ ID NO: 75633 - RNA, 22 nt, Human
ccacugcccaccaccccauccc

SEQ ID NO: 75634 - RNA, 22 nt, Human
ccacugcccaccaccccauccc

SEQ ID NO: 75635 - RNA, 18 nt, Human
ccagccccccgagugcgc

SEQ ID NO: 75636 - RNA, 20 nt, Human
ccagguccugugcugccuuc

SEQ ID NO: 75637 - RNA, 18 nt, Human
ccauuuggagacccaagc

SEQ ID NO: 75638 - RNA, 18 nt, Human
cccaagcaggcauccucc

SEQ ID NO: 75639 - RNA, 21 nt, Human
cccacgaguuuuccacaaagg

SEQ ID NO: 75640 - RNA, 22 nt, Human
cccagcaaguccucccuuugaa

SEQ ID NO: 75641 - RNA, 18 nt, Human
cccauggcagaaguuagg

SEQ ID NO: 75642 - RNA, 22 nt, Human
ccccacaucaaaccguucagga

SEQ ID NO: 75643 - RNA, 18 nt, Human
ccccagcaaguccucccu

SEQ ID NO: 75644 - RNA, 18 nt, Human
ccccagcaaguccucccu

SEQ ID NO: 75645 - RNA, 20 nt, Human
cccccaaacaaacaaaaaac

SEQ ID NO: 75646 - RNA, 21 nt, Human
cccccaaacaaacaaaaaaca

SEQ ID NO: 75647 - RNA, 23 nt, Human
ccccccaaacaaacaaaaaacaa

SEQ ID NO: 75648 - RNA, 18 nt, Human
ccuccucuuccccgcguc

SEQ ID NO: 75649 - RNA, 18 nt, Human
ccugaagcucccaaaugc

SEQ ID NO: 75650 - RNA, 24 nt, Human
ccuugggaaaaagcuuccaacacu

SEQ ID NO: 75651 - RNA, 21 nt, Human
ccuugugacaggucagugagu

SEQ ID NO: 75652 - RNA, 19 nt, Human
cgaagggagagaugagaag

SEQ ID NO: 75653 - RNA, 23 nt, Human
cgaggugggcaguucguggguca

SEQ ID NO: 75654 - RNA, 25 nt, Human
cggacccaaggccacuggagcgagg

SEQ ID NO: 75655 - RNA, 22 nt, Human
cggcccccagagccaagggaag

SEQ ID NO: 75656 - RNA, 21 nt, Human
cucaugauacaacgaacagcu

SEQ ID NO: 75657 - RNA, 26 nt, Human
cucaugccaagaagcuggguuggacc

SEQ ID NO: 75658 - RNA, 27 nt, Human
cucaugccaagaagcuggguuggaccu

SEQ ID NO: 75659 - RNA, 21 nt, Human
cuccacuguaacacacgccug

SEQ ID NO: 75660 - RNA, 20 nt, Human
cucgcagcccccucccggca

SEQ ID NO: 75661 - RNA, 23 nt, Human
cucgcagcccccucccggcagcc

SEQ ID NO: 75662 - RNA, 19 nt, Human
cucuccccacuuaggaauc

SEQ ID NO: 75663 - RNA, 23 nt, Human
cugaagcucccaaaugcauaugg

SEQ ID NO: 75664 - RNA, 19 nt, Human
cugcacaccacuuccaaga

SEQ ID NO: 75665 - RNA, 22 nt, Human
cugcagccccuugcauacacug

SEQ ID NO: 75666 - RNA, 20 nt, Human
cugcucucucccaauggggu

SEQ ID NO: 75667 - RNA, 19 nt, Human
cuggaucugagacuccucc

SEQ ID NO: 75668 - RNA, 22 nt, Human
cuggaugggagaggugugcgga

SEQ ID NO: 75669 - RNA, 21 nt, Human
cugguucuggaacaaauuguc

SEQ ID NO: 75670 - RNA, 31 nt, Human
cuguuucagacacacacacacacacacacag

SEQ ID NO: 75671 - RNA, 26 nt, Human
cuuagaaaacaaaaacaaaaacaaaa

SEQ ID NO: 75672 - RNA, 20 nt, Human
cuucacacugugcacacuuc

SEQ ID NO: 75673 - RNA, 21 nt, Human
cuucaguagguggcgaaaugu

SEQ ID NO: 75674 - RNA, 23 nt, Human
cuuccaacacugaauuuugucca

SEQ ID NO: 75675 - RNA, 20 nt, Human
cuucuggcuuuaucauucaa

SEQ ID NO: 75676 - RNA, 20 nt, Human
cuugaagauucuccucauuc

SEQ ID NO: 75677 - RNA, 19 nt, Human
cuugauucuugcuccuucu

SEQ ID NO: 75678 - RNA, 24 nt, Human
cuuggugcacacuucugcuucuaa

SEQ ID NO: 75679 - RNA, 25 nt, Human
gaaaaaacaaaaacccagaggcagg

SEQ ID NO: 75680 - RNA, 22 nt, Human
gaaaaagaaaucugaaauaaaa

SEQ ID NO: 75681 - RNA, 24 nt, Human
gaaaacaaaaacaaaaacaaaaac

SEQ ID NO: 75682 - RNA, 21 nt, Human
gaaauggauggaaugugguca

SEQ ID NO: 75683 - RNA, 20 nt, Human
gaauguggucaagacuacca

SEQ ID NO: 75684 - RNA, 19 nt, Human
gacacacacacaucacaug

SEQ ID NO: 75685 - RNA, 23 nt, Human
gacacacagagucagguuuucca

SEQ ID NO: 75686 - RNA, 21 nt, Human
gacacuggcagaaaaaccuca

SEQ ID NO: 75687 - RNA, 24 nt, Human
gacaugucacagugcgaggaaguu

SEQ ID NO: 75688 - RNA, 18 nt, Human
gacgcuggggucaugaga

SEQ ID NO: 75689 - RNA, 21 nt, Human
gagaacuuugcguccuuuucc

SEQ ID NO: 75690 - RNA, 24 nt, Human
gagaggugugcggacugaccuucg

SEQ ID NO: 75691 - RNA, 18 nt, Human
gaggaagagaagaggggc

SEQ ID NO: 75692 - RNA, 19 nt, Human
gaggagaggucacuuggaa

SEQ ID NO: 75693 - RNA, 24 nt, Human
gcaagccaaccaguuuugcagcaa

SEQ ID NO: 75694 - RNA, 23 nt, Human
gcaauguaaggauuacaucccga

SEQ ID NO: 75695 - RNA, 20 nt, Human
gcacaauaguguauuuacaa

SEQ ID NO: 75696 - RNA, 18 nt, Human
gcagaugccaggaugccc

SEQ ID NO: 75697 - RNA, 19 nt, Human
gcaggacaaaggcagaucc

SEQ ID NO: 75698 - RNA, 19 nt, Human
gcaggauggccucguaacu

SEQ ID NO: 75699 - RNA, 20 nt, Human
gcaguacuauaaacauacac

SEQ ID NO: 75700 - RNA, 18 nt, Human
gcaugcaggacuuuugca

SEQ ID NO: 75701 - RNA, 21 nt, Human
gccgggaagggggaggggaag

SEQ ID NO: 75702 - RNA, 19 nt, Human
gcggcggcgggagugggca

SEQ ID NO: 75703 - RNA, 20 nt, Human
gcggcgggagugggcaggcg

SEQ ID NO: 75704 - RNA, 23 nt, Human
gcugacuccacuguaacacacgc

SEQ ID NO: 75705 - RNA, 21 nt, Human
gcugcagccccuugcauacac

SEQ ID NO: 75706 - RNA, 20 nt, Human
gcugguuggccccguccuuc

SEQ ID NO: 75707 - RNA, 18 nt, Human
ggaaagguggggaggagg

SEQ ID NO: 75708 - RNA, 20 nt, Human
ggacugggaggcagagccga

SEQ ID NO: 75709 - RNA, 18 nt, Human
ggagagaugagaaggcuc

SEQ ID NO: 75710 - RNA, 21 nt, Human
ggagccaaugccugcugaguu

SEQ ID NO: 75711 - RNA, 22 nt, Human
ggaugaauucauuauuuggcaa

SEQ ID NO: 75712 - RNA, 19 nt, Human
ggccucugcaaccaagugg

SEQ ID NO: 75713 - RNA, 19 nt, Human
ggcggcggcgggagugggc

SEQ ID NO: 75714 - RNA, 20 nt, Human
ggcuagguuuuaaaauucca

SEQ ID NO: 75715 - RNA, 18 nt, Human
gggaacugggcgaaggga

SEQ ID NO: 75716 - RNA, 20 nt, Human
gggcgaggggaggccggggg

SEQ ID NO: 75717 - RNA, 20 nt, Human
gggcggcggcgggagugggc

SEQ ID NO: 75718 - RNA, 18 nt, Human
ggggaggaagagaagagg

SEQ ID NO: 75719 - RNA, 19 nt, Human
ggggcggcggcgggagugg

SEQ ID NO: 75720 - RNA, 19 nt, Human
gggguggcgagggcggcgg

SEQ ID NO: 75721 - RNA, 20 nt, Human
gggucacucaccuccacugg

SEQ ID NO: 75722 - RNA, 19 nt, Human
gggugggugggaggaaggu

SEQ ID NO: 75723 - RNA, 18 nt, Human
ggugggaggaaggugagg

SEQ ID NO: 75724 - RNA, 18 nt, Human
ggugggugggaggaaggu

SEQ ID NO: 75725 - RNA, 19 nt, Human
ggugggugggaggaaggug

SEQ ID NO: 75726 - RNA, 27 nt, Human
guaucugcaaggaaaacaaaaacaaaa

SEQ ID NO: 75727 - RNA, 18 nt, Human
guccugugcugccuucga

SEQ ID NO: 75728 - RNA, 19 nt, Human
guccuuuuccgccuccucu

SEQ ID NO: 75729 - RNA, 22 nt, Human
gugcacacagauuuccuguaug

SEQ ID NO: 75730 - RNA, 31 nt, Human
guuucagacacacacacacacacacacacag

SEQ ID NO: 75731 - RNA, 26 nt, Human
uaaaagcaaagaauauacaguauacu

SEQ ID NO: 75732 - RNA, 22 nt, Human
uaaaagcagcaaaccuuuagaa

SEQ ID NO: 75733 - RNA, 27 nt, Human
uaaaagcagcaaaccuuuagaaagaca

SEQ ID NO: 75734 - RNA, 23 nt, Human
uaaaccucaugccaagaagcugg

SEQ ID NO: 75735 - RNA, 21 nt, Human
uaagaaaagagccuuaagaac

SEQ ID NO: 75736 - RNA, 18 nt, Human
uaagaaaauagguuugac

SEQ ID NO: 75737 - RNA, 20 nt, Human
uaagacagcuccuaguuuaa

SEQ ID NO: 75738 - RNA, 24 nt, Human
uacaacuucauuuaagaaaauagg

SEQ ID NO: 75739 - RNA, 23 nt, Human
uacaauaaaaaccacgagaaaaa

SEQ ID NO: 75740 - RNA, 22 nt, Human
uacagagaauaagcaucaacag

SEQ ID NO: 75741 - RNA, 18 nt, Human
uacagcaaaucacucacc

SEQ ID NO: 75742 - RNA, 24 nt, Human
uacagcaaaucacucaccugucca

SEQ ID NO: 75743 - RNA, 19 nt, Human
uacaguaucugcaaggaaa

SEQ ID NO: 75744 - RNA, 21 nt, Human
uacaguaucugcaaggaaaac

SEQ ID NO: 75745 - RNA, 18 nt, Human
uaccaguugcacaugagu

SEQ ID NO: 75746 - RNA, 19 nt, Human
uaccccagccauuuggaga

SEQ ID NO: 75747 - RNA, 23 nt, Human
uaccccagccauuuggagaccca

SEQ ID NO: 75748 - RNA, 19 nt, Human
uagaaaaaaauaaggacaa

SEQ ID NO: 75749 - RNA, 18 nt, Human
uagagaaguagguagcca

SEQ ID NO: 75750 - RNA, 22 nt, Human
uaggaaaaccccucuuugucca

SEQ ID NO: 75751 - RNA, 21 nt, Human
uaggaugagaaaguugaggca

SEQ ID NO: 75752 - RNA, 27 nt, Human
uaggccaagaaauuccaacaaccauaa

SEQ ID NO: 75753 - RNA, 19 nt, Human
uaggguaugugugugauuc

SEQ ID NO: 75754 - RNA, 23 nt, Human
uagugugcaccaaauguguucuc

SEQ ID NO: 75755 - RNA, 19 nt, Human
uauauauauauauauauau

SEQ ID NO: 75756 - RNA, 23 nt, Human
uauauauauauuauauauaauau

SEQ ID NO: 75757 - RNA, 19 nt, Human
uaucaucucccagggugga

SEQ ID NO: 75758 - RNA, 21 nt, Human
uaugaauaccaacuccacaca

SEQ ID NO: 75759 - RNA, 24 nt, Human
uauggauauauauauauauauaua

SEQ ID NO: 75760 - RNA, 23 nt, Human
uauguacaaaugcuauuugcaca

SEQ ID NO: 75761 - RNA, 23 nt, Human
ucaaauccccucaggccagaugu

SEQ ID NO: 75762 - RNA, 24 nt, Human
ucaagcagcuucacgggacaggag

SEQ ID NO: 75763 - RNA, 23 nt, Human
ucaauaaacuggaaugagaauga

SEQ ID NO: 75764 - RNA, 18 nt, Human
ucaggcaguacuauaaac

SEQ ID NO: 75765 - RNA, 24 nt, Human
ucagugaguguccaccuuguucau

SEQ ID NO: 75766 - RNA, 21 nt, Human
ucaugcugcagggaugggagc

SEQ ID NO: 75767 - RNA, 23 nt, Human
uccaacacagagcuuuaucaaga

SEQ ID NO: 75768 - RNA, 19 nt, Human
uccacuggcucugccccaa

SEQ ID NO: 75769 - RNA, 19 nt, Human
uccaucuguaggaaaaccc

SEQ ID NO: 75770 - RNA, 18 nt, Human
ucccaaaugaugucuuca

SEQ ID NO: 75771 - RNA, 24 nt, Human
uccccagcaaguccucccuuugaa

SEQ ID NO: 75772 - RNA, 21 nt, Human
ucccggcagccggcgaggugg

SEQ ID NO: 75773 - RNA, 26 nt, Human
uccgccuccucuuccccgcgucuucc

SEQ ID NO: 75774 - RNA, 22 nt, Human
uccugcucgagaagaggagagg

SEQ ID NO: 75775 - RNA, 19 nt, Human
uccuucuggaucugagacu

SEQ ID NO: 75776 - RNA, 21 nt, Human
ucgcagcccccucccggcagc

SEQ ID NO: 75777 - RNA, 18 nt, Human
ucgcggaggggacgcgca

SEQ ID NO: 75778 - RNA, 20 nt, Human
ucgcggaggggacgcgcauc

SEQ ID NO: 75779 - RNA, 24 nt, Human
ucgugcacacagauuuccuguaug

SEQ ID NO: 75780 - RNA, 20 nt, Human
ucgugggucaccgaaagcuc

SEQ ID NO: 75781 - RNA, 22 nt, Human
ucuaaaugagaaauaaguuucc

SEQ ID NO: 75782 - RNA, 22 nt, Human
ucuagcaucagagacaaaagaa

SEQ ID NO: 75783 - RNA, 19 nt, Human
ucucacugucacccacgag

SEQ ID NO: 75784 - RNA, 24 nt, Human
ucucuggguugcaagccaaccagu

SEQ ID NO: 75785 - RNA, 19 nt, Human
ucuggggcacaccuuccug

SEQ ID NO: 75786 - RNA, 20 nt, Human
ucuuaaaagcagcaaaccuu

SEQ ID NO: 75787 - RNA, 25 nt, Human
ucuuagaaaacaaaaacaaaaacaa

SEQ ID NO: 75788 - RNA, 19 nt, Human
ucuucaguuuggggaagaa

SEQ ID NO: 75789 - RNA, 19 nt, Human
ucuuccccagccgggcugg

SEQ ID NO: 75790 - RNA, 19 nt, Human
ucuuccccagccgggcugg

SEQ ID NO: 75791 - RNA, 22 nt, Human
ucuuccccagccgggcuggagu

SEQ ID NO: 75792 - RNA, 19 nt, Human
ugaaaugaauggucuuggu

SEQ ID NO: 75793 - RNA, 24 nt, Human
ugaacagugccacaggcugacuga

SEQ ID NO: 75794 - RNA, 21 nt, Human
ugaaccacagaaaccugagga

SEQ ID NO: 75795 - RNA, 18 nt, Human
ugaagcacagaacugucc

SEQ ID NO: 75796 - RNA, 24 nt, Human
ugaagcucccaaaugcauauggaa

SEQ ID NO: 75797 - RNA, 21 nt, Human
ugaaucaacccagaaauaauu

SEQ ID NO: 75798 - RNA, 27 nt, Human
ugaauuaaauuacauuaaucgcauaga

SEQ ID NO: 75799 - RNA, 26 nt, Human
ugacaagcacauaguucugaauagga

SEQ ID NO: 75800 - RNA, 21 nt, Human
ugacagagggaucccagggaa

SEQ ID NO: 75801 - RNA, 22 nt, Human
ugacaugggccacugagaaaaa

SEQ ID NO: 75802 - RNA, 20 nt, Human
ugaccacguuaacaguuacc

SEQ ID NO: 75803 - RNA, 20 nt, Human
ugacccaaaacucagugcaa

SEQ ID NO: 75804 - RNA, 18 nt, Human
ugacugaagaacgccugg

SEQ ID NO: 75805 - RNA, 18 nt, Human
ugagaagacccuguuuug

SEQ ID NO: 75806 - RNA, 20 nt, Human
ugagaagacccuguuuugaa

SEQ ID NO: 75807 - RNA, 19 nt, Human
ugagaaugaaagucagagc

SEQ ID NO: 75808 - RNA, 21 nt, Human
ugagacccggacccaaggcca

SEQ ID NO: 75809 - RNA, 22 nt, Human
ugagauaggguuugugacaugg

SEQ ID NO: 75810 - RNA, 18 nt, Human
ugagauggcucaggcagu

SEQ ID NO: 75811 - RNA, 20 nt, Human
ugagccacagacagacagug

SEQ ID NO: 75812 - RNA, 24 nt, Human
ugaggguaggguaugugugugauu

SEQ ID NO: 75813 - RNA, 24 nt, Human
ugaguaaaugaaguuccaauucca

SEQ ID NO: 75814 - RNA, 18 nt, Human
ugcacaccacuuccaaga

SEQ ID NO: 75815 - RNA, 19 nt, Human
ugcacaccacuuccaagag

SEQ ID NO: 75816 - RNA, 20 nt, Human
ugcauauggauauauauaua

SEQ ID NO: 75817 - RNA, 19 nt, Human
ugccaggaugcccugcucu

SEQ ID NO: 75818 - RNA, 22 nt, Human
ugccugagucauugcugggaac

SEQ ID NO: 75819 - RNA, 19 nt, Human
ugccuggauacacaagcag

SEQ ID NO: 75820 - RNA, 18 nt, Human
ugcucgagaagaggagag

SEQ ID NO: 75821 - RNA, 19 nt, Human
uggauauauauauauauau

SEQ ID NO: 75822 - RNA, 19 nt, Human
uggcagaaguuagguuggg

SEQ ID NO: 75823 - RNA, 19 nt, Human
uggcgaaauguuaaaacug

SEQ ID NO: 75824 - RNA, 19 nt, Human
uggcugguuggccccgucc

SEQ ID NO: 75825 - RNA, 19 nt, Human
ugggagaggugugcggacu

SEQ ID NO: 75826 - RNA, 27 nt, Human
ugggagcaagggaucagaaccacgagg

SEQ ID NO: 75827 - RNA, 21 nt, Human
ugggagcaagggaucagacau

SEQ ID NO: 75828 - RNA, 20 nt, Human
ugggaggccaagccugggca

SEQ ID NO: 75829 - RNA, 19 nt, Human
ugggauguucauuagucuc

SEQ ID NO: 75830 - RNA, 20 nt, Human
ugggauguucauuagucuca

SEQ ID NO: 75831 - RNA, 21 nt, Human
ugggcaggaaagccaguggcu

SEQ ID NO: 75832 - RNA, 19 nt, Human
uggggcacaccuuccugua

SEQ ID NO: 75833 - RNA, 21 nt, Human
uggggccuagagguguuguag

SEQ ID NO: 75834 - RNA, 20 nt, Human
ugggggaagaggaagaaaag

SEQ ID NO: 75835 - RNA, 18 nt, Human
ugggugggaggaagguga

SEQ ID NO: 75836 - RNA, 20 nt, Human
ugggugggaggaaggugagg

SEQ ID NO: 75837 - RNA, 20 nt, Human
uggguugcaagccaaccagu

SEQ ID NO: 75838 - RNA, 22 nt, Human
uggucaagacuaccaguugcac

SEQ ID NO: 75839 - RNA, 20 nt, Human
ugguuggccccguccuucag

SEQ ID NO: 75840 - RNA, 23 nt, Human
uguacaaaugcuauuugcacaca

SEQ ID NO: 75841 - RNA, 19 nt, Human
uguaugaauaccaacucca

SEQ ID NO: 75842 - RNA, 22 nt, Human
ugucacaacauuaaaucaaagc

SEQ ID NO: 75843 - RNA, 20 nt, Human
uguccaaagccucagaauga

SEQ ID NO: 75844 - RNA, 19 nt, Human
uguccugggaggccaagcc

SEQ ID NO: 75845 - RNA, 18 nt, Human
ugucuagacaaaauucag

SEQ ID NO: 75846 - RNA, 22 nt, Human
ugugaagcaagaaaaaugacca

SEQ ID NO: 75847 - RNA, 18 nt, Human
ugugacaggucagugagu

SEQ ID NO: 75848 - RNA, 23 nt, Human
uguucucgguuucuucgggacag

SEQ ID NO: 75849 - RNA, 23 nt, Human
uuacagagaauaagcaucaacag

SEQ ID NO: 75850 - RNA, 21 nt, Human
uuaggaaucugaacauccagc

SEQ ID NO: 75851 - RNA, 21 nt, Human
uucacaaaauggcagcaucgu

SEQ ID NO: 75852 - RNA, 24 nt, Human
uucagaagaaauuccugagauagg

SEQ ID NO: 75853 - RNA, 31 nt, Human
uucagacacacacacacacacacacacacag

SEQ ID NO: 75854 - RNA, 18 nt, Human
uuccagguccugugcugc

SEQ ID NO: 75855 - RNA, 21 nt, Human
uuccccacugcccaccacccc

SEQ ID NO: 75856 - RNA, 24 nt, Human
uuccccuuuuacaugcagcuuuaa

SEQ ID NO: 75857 - RNA, 18 nt, Human
uuccucauuuugagagga

SEQ ID NO: 75858 - RNA, 24 nt, Human
uuccuguaugaauaccaacuccac

SEQ ID NO: 75859 - RNA, 22 nt, Human
uuccuguuuuucugauguacuu

SEQ ID NO: 75860 - RNA, 20 nt, Human
uuccuucuuuuucuucuucu

SEQ ID NO: 75861 - RNA, 23 nt, Human
uugaagauucuccucauuccugg

SEQ ID NO: 75862 - RNA, 26 nt, Human
uugcauauggauauauauauauauau

SEQ ID NO: 75863 - RNA, 22 nt, Human
uugcugcuaagaccgcuguagu

SEQ ID NO: 75864 - RNA, 24 nt, Human
uuggaaccuguuucuaaaugagaa

SEQ ID NO: 75865 - RNA, 21 nt, Human
uuggccucugcaaccaagugg

SEQ ID NO: 75866 - RNA, 21 nt, Human
uugggggaagaggaagaaaag

SEQ ID NO: 75867 - RNA, 28 nt, Human
uuguggacugacucaccagaaauugcac

SEQ ID NO: 75868 - RNA, 24 nt, Human
uuuacagucauuugaggaccaaac

SEQ ID NO: 75869 - RNA, 18 nt, Human
uuuggagaaggaaaggag

SEQ ID NO: 75870 - RNA, 23 nt, Human
uuuuggacgcuggggucaugaga

SEQ ID NO: 75871 - RNA, 22 nt, Human
uuuuuuuuauccuacugcauga

SEQ ID NO: 75872 - RNA, 20 nt, Human
cagcagcccugaagaaauca

SEQ ID NO: 75873 - RNA, 19 nt, Human
cccccagcagcccugaaga

SEQ ID NO: 75874 - RNA, 22 nt, Human
ccgcccagcgauggaagcugag

SEQ ID NO: 75875 - RNA, 19 nt, Human
cucacaaccccgcccgacu

SEQ ID NO: 75876 - RNA, 23 nt, Human
cugagcgcggcgucucacaaccc

SEQ ID NO: 75877 - RNA, 18 nt, Human
cugguggcgccauucuuc

SEQ ID NO: 75878 - RNA, 21 nt, Human
guugcccccagcagcccugaa

SEQ ID NO: 75879 - RNA, 22 nt, Human
ucagggcagcacagccuuuuuc

SEQ ID NO: 75880 - RNA, 23 nt, Human
ucauugagaaccagugugagagu

SEQ ID NO: 75881 - RNA, 21 nt, Human
ugagcgcggcgucucacaacc

SEQ ID NO: 75882 - RNA, 20 nt, Human
uggaagcugagcgcggcguc

SEQ ID NO: 75883 - RNA, 22 nt, Human
uggcaaauggccaguugccccc

SEQ ID NO: 75884 - RNA, 22 nt, Human
uggcgccauucuucagggcagc

SEQ ID NO: 75885 - RNA, 23 nt, Human
uucuucagggcagcacagccuuu

SEQ ID NO: 75886 - RNA, 20 nt, Human
aacugcgcacaaccugagcc

SEQ ID NO: 75887 - RNA, 19 nt, Human
acaggagggcacugucagu

SEQ ID NO: 75888 - RNA, 22 nt, Human
agaaacaaggaagggcccuggg

SEQ ID NO: 75889 - RNA, 19 nt, Human
agagggagagaaaggggcg

SEQ ID NO: 75890 - RNA, 22 nt, Human
agagggagagaaaggggcggag

SEQ ID NO: 75891 - RNA, 26 nt, Human
aggagcgggggccggcgcuggcgggg

SEQ ID NO: 75892 - RNA, 21 nt, Human
caacaaaguuccccucccccc

SEQ ID NO: 75893 - RNA, 18 nt, Human
cagcagcaggagcggggg

SEQ ID NO: 75894 - RNA, 20 nt, Human
cagcaggagcgggggccggc

SEQ ID NO: 75895 - RNA, 19 nt, Human
cagccagugugccaggaac

SEQ ID NO: 75896 - RNA, 21 nt, Human
cagcccgggacagggacggac

SEQ ID NO: 75897 - RNA, 18 nt, Human
ccaacaaaguuccccucc

SEQ ID NO: 75898 - RNA, 19 nt, Human
ccaagccauguccggcucc

SEQ ID NO: 75899 - RNA, 19 nt, Human
cccaacaaaguuccccucc

SEQ ID NO: 75900 - RNA, 22 nt, Human
cccccagccuggcugaguccac

SEQ ID NO: 75901 - RNA, 21 nt, Human
ccccccuccccagcccgggac

SEQ ID NO: 75902 - RNA, 23 nt, Human
ccuccccagcccgggacagggac

SEQ ID NO: 75903 - RNA, 23 nt, Human
ccucccugcccagcccucgggag

SEQ ID NO: 75904 - RNA, 21 nt, Human
ccuggccgggcgcaggguagg

SEQ ID NO: 75905 - RNA, 25 nt, Human
ccuugcccauccaaccuguauucuc

SEQ ID NO: 75906 - RNA, 18 nt, Human
cgcgcggagggccgaggc

SEQ ID NO: 75907 - RNA, 20 nt, Human
cggacaggcugggcugaaga

SEQ ID NO: 75908 - RNA, 27 nt, Human
cggacaggcugggcugaagaugggguu

SEQ ID NO: 75909 - RNA, 20 nt, Human
cuccauaacucuugcucucc

SEQ ID NO: 75910 - RNA, 20 nt, Human
cucugagaaacaaggaaggg

SEQ ID NO: 75911 - RNA, 18 nt, Human
gaccccaggccaagccau

SEQ ID NO: 75912 - RNA, 20 nt, Human
gagugugaaaauagagagau

SEQ ID NO: 75913 - RNA, 19 nt, Human
gccggcgcuggcgggggcg

SEQ ID NO: 75914 - RNA, 18 nt, Human
gggaccuggccgggcgca

SEQ ID NO: 75915 - RNA, 25 nt, Human
gggagaggggagagggcgcuggcuc

SEQ ID NO: 75916 - RNA, 21 nt, Human
uaacucuugcucuccaucccc

SEQ ID NO: 75917 - RNA, 22 nt, Human
uagguagcugcagccgcgcgga

SEQ ID NO: 75918 - RNA, 22 nt, Human
ucaccgcguaaucuugcuuuac

SEQ ID NO: 75919 - RNA, 19 nt, Human
uccaaaguggagugugaaa

SEQ ID NO: 75920 - RNA, 20 nt, Human
uccacggcgccucccugccc

SEQ ID NO: 75921 - RNA, 22 nt, Human
uccccuccccccuccccagccc

SEQ ID NO: 75922 - RNA, 19 nt, Human
ugagaaacaaggaagggcc

SEQ ID NO: 75923 - RNA, 20 nt, Human
ugaguccacggcgccucccu

SEQ ID NO: 75924 - RNA, 23 nt, Human
ugaguccacggcgccucccugcc

SEQ ID NO: 75925 - RNA, 20 nt, Human
uggcuccuggguaguuccuc

SEQ ID NO: 75926 - RNA, 18 nt, Human
uuccaguggcugaggggc

SEQ ID NO: 75927 - RNA, 19 nt, Human
uuccccuccccccucccca

SEQ ID NO: 75928 - RNA, 18 nt, Human
aaaacuaaaccauaugaa

SEQ ID NO: 75929 - RNA, 24 nt, Human
agauagaaaugucaggcuucccaa

SEQ ID NO: 75930 - RNA, 23 nt, Human
auaaacuuuaaaaacugcauaaa

SEQ ID NO: 75931 - RNA, 24 nt, Human
gaaagcuucucagagcuuucuaga

SEQ ID NO: 75932 - RNA, 22 nt, Human
gcagcagagaaagcuucucaga

SEQ ID NO: 75933 - RNA, 18 nt, Human
guaauggccaaacagacu

SEQ ID NO: 75934 - RNA, 21 nt, Human
guuacaacaugaaucguugcu

SEQ ID NO: 75935 - RNA, 21 nt, Human
guuauaaacuuuaaaaacugc

SEQ ID NO: 75936 - RNA, 23 nt, Human
uaccauaugaaaacaccacugac

SEQ ID NO: 75937 - RNA, 21 nt, Human
uauaaaagugagauuauuacu

SEQ ID NO: 75938 - RNA, 24 nt, Human
ugacaaaaacuuugcuuuuauauu

SEQ ID NO: 75939 - RNA, 20 nt, Human
uguaguaauggccaaacaga

SEQ ID NO: 75940 - RNA, 24 nt, Human
uuacuuuauugcauuuaaagcaau

SEQ ID NO: 75941 - RNA, 24 nt, Human
uuuaaagcaaugaagaauguagcu

SEQ ID NO: 75942 - RNA, 18 nt, Human
aagcuggccacagugagc

SEQ ID NO: 75943 - RNA, 22 nt, Human
acacaccagacagacacggcca

SEQ ID NO: 75944 - RNA, 24 nt, Human
accagcugcccaccgcccacccag

SEQ ID NO: 75945 - RNA, 18 nt, Human
acccagggccggggagcc

SEQ ID NO: 75946 - RNA, 24 nt, Human
acucaccugcccuuugcauccccu

SEQ ID NO: 75947 - RNA, 22 nt, Human
agaaaaucuagagacaugaggg

SEQ ID NO: 75948 - RNA, 18 nt, Human
agagcacagccacucacu

SEQ ID NO: 75949 - RNA, 22 nt, Human
caaaugaagcugcaggccaaga

SEQ ID NO: 75950 - RNA, 22 nt, Human
caagcccgcucuggccugcacu

SEQ ID NO: 75951 - RNA, 19 nt, Human
cacagcacacaccagacag

SEQ ID NO: 75952 - RNA, 23 nt, Human
cacagcacacaccagacagacac

SEQ ID NO: 75953 - RNA, 20 nt, Human
cacaggaggggcgccguggg

SEQ ID NO: 75954 - RNA, 19 nt, Human
cacccagggccggggagcc

SEQ ID NO: 75955 - RNA, 18 nt, Human
cacccuuuucacucccca

SEQ ID NO: 75956 - RNA, 22 nt, Human
cacggccagggcgguaggcgcc

SEQ ID NO: 75957 - RNA, 23 nt, Human
cagcacaggaggggcgccguggg

SEQ ID NO: 75958 - RNA, 19 nt, Human
cagcugcccaccgcccacc

SEQ ID NO: 75959 - RNA, 24 nt, Human
cagcugcccaccgcccacccaggg

SEQ ID NO: 75960 - RNA, 21 nt, Human
cagggccggggagcccaagga

SEQ ID NO: 75961 - RNA, 23 nt, Human
caggucucagguggccacggaua

SEQ ID NO: 75962 - RNA, 22 nt, Human
ccagggccggggagcccaagga

SEQ ID NO: 75963 - RNA, 24 nt, Human
ccaguggcacccuuuucacucccc

SEQ ID NO: 75964 - RNA, 21 nt, Human
ccugcacuguguccugggcag

SEQ ID NO: 75965 - RNA, 23 nt, Human
ccugcacuguguccugggcagcu

SEQ ID NO: 75966 - RNA, 20 nt, Human
ccuugggugacgucccuggc

SEQ ID NO: 75967 - RNA, 22 nt, Human
ccuugggugacgucccuggccu

SEQ ID NO: 75968 - RNA, 22 nt, Human
cggagcccuucacacugaccac

SEQ ID NO: 75969 - RNA, 19 nt, Human
cggccagggcgguaggcgc

SEQ ID NO: 75970 - RNA, 23 nt, Human
cgucccuggccucagagugaccu

SEQ ID NO: 75971 - RNA, 18 nt, Human
cucgcaaaugaagcugca

SEQ ID NO: 75972 - RNA, 22 nt, Human
cucgcaaaugaagcugcaggcc

SEQ ID NO: 75973 - RNA, 18 nt, Human
cugccucggcgcucucgc

SEQ ID NO: 75974 - RNA, 19 nt, Human
cuggccaaguccugccaag

SEQ ID NO: 75975 - RNA, 20 nt, Human
cuucacacugaccaccagcc

SEQ ID NO: 75976 - RNA, 18 nt, Human
gaagcgggcagggaggcc

SEQ ID NO: 75977 - RNA, 20 nt, Human
gacacacacgucacagcaca

SEQ ID NO: 75978 - RNA, 18 nt, Human
gagggacauaaaugggcc

SEQ ID NO: 75979 - RNA, 24 nt, Human
gcacggagcccuucacacugacca

SEQ ID NO: 75980 - RNA, 22 nt, Human
gcgccgugggcccugguugcac

SEQ ID NO: 75981 - RNA, 20 nt, Human
ggcagggaggcccaccaggu

SEQ ID NO: 75982 - RNA, 22 nt, Human
ggcagggaggcccaccaggugg

SEQ ID NO: 75983 - RNA, 18 nt, Human
ggccaaguccugccaagu

SEQ ID NO: 75984 - RNA, 23 nt, Human
ggccagggccggggcuggcagcu

SEQ ID NO: 75985 - RNA, 20 nt, Human
ggccugcacuguguccuggg

SEQ ID NO: 75986 - RNA, 18 nt, Human
gggaggcccaccaggugg

SEQ ID NO: 75987 - RNA, 20 nt, Human
gggcagggaggcccaccagg

SEQ ID NO: 75988 - RNA, 23 nt, Human
gggcagggaggcccaccaggugg

SEQ ID NO: 75989 - RNA, 26 nt, Human
gggccagggccggggcuggcagcuga

SEQ ID NO: 75990 - RNA, 22 nt, Human
gggccggggagcccaaggaagc

SEQ ID NO: 75991 - RNA, 20 nt, Human
gggccuggggaaggguuggg

SEQ ID NO: 75992 - RNA, 18 nt, Human
gggcgccgugggcccugg

SEQ ID NO: 75993 - RNA, 23 nt, Human
ggggagcccaaggaagcgggcag

SEQ ID NO: 75994 - RNA, 21 nt, Human
ggugacgagaaaaucuagaga

SEQ ID NO: 75995 - RNA, 26 nt, Human
gugcagggguucacagcacacaccag

SEQ ID NO: 75996 - RNA, 23 nt, Human
gugggguugggugcagggguuca

SEQ ID NO: 75997 - RNA, 26 nt, Human
ucacagcacacaccagacagacacgg

SEQ ID NO: 75998 - RNA, 19 nt, Human
uccccucuguggguggagg

SEQ ID NO: 75999 - RNA, 20 nt, Human
ucccuggagaccagcugccc

SEQ ID NO: 76000 - RNA, 24 nt, Human
ucuggaccauccacccaguggugc

SEQ ID NO: 76001 - RNA, 21 nt, Human
ucuguuuuucacacugggccu

SEQ ID NO: 76002 - RNA, 23 nt, Human
ugaccaccagccuugggugacgu

SEQ ID NO: 76003 - RNA, 21 nt, Human
ugacgucccuggccucagagu

SEQ ID NO: 76004 - RNA, 21 nt, Human
ugagcuguccggguucucccc

SEQ ID NO: 76005 - RNA, 22 nt, Human
ugagggacauaaaugggccugg

SEQ ID NO: 76006 - RNA, 18 nt, Human
ugcaggccaagaagcccc

SEQ ID NO: 76007 - RNA, 20 nt, Human
ugccuggaagggucguggag

SEQ ID NO: 76008 - RNA, 27 nt, Human
ugcgguucuugacucaccugcccuuug

SEQ ID NO: 76009 - RNA, 19 nt, Human
uggaggaugcuucagggaa

SEQ ID NO: 76010 - RNA, 19 nt, Human
uggcaggacugagcugucc

SEQ ID NO: 76011 - RNA, 21 nt, Human
uggcaggacugagcuguccgg

SEQ ID NO: 76012 - RNA, 19 nt, Human
uggccaaguccugccaagu

SEQ ID NO: 76013 - RNA, 24 nt, Human
ugggcagcugcuggccaaguccug

SEQ ID NO: 76014 - RNA, 19 nt, Human
uggggugggggccagggcc

SEQ ID NO: 76015 - RNA, 25 nt, Human
uggggugggggccagggccggggcu

SEQ ID NO: 76016 - RNA, 26 nt, Human
uggggugggggccagggccggggcug

SEQ ID NO: 76017 - RNA, 23 nt, Human
uggucaagcccgcucuggccugc

SEQ ID NO: 76018 - RNA, 19 nt, Human
ugugcagagagcacagcca

SEQ ID NO: 76019 - RNA, 20 nt, Human
uuccccggccugggagcccc

SEQ ID NO: 76020 - RNA, 21 nt, Human
uuuucacuccccagcugugau

SEQ ID NO: 76021 - RNA, 19 nt, Human
aacagaguucaaguauuca

SEQ ID NO: 76022 - RNA, 18 nt, Human
aacccuccagaugaacuc

SEQ ID NO: 76023 - RNA, 22 nt, Human
aacuucuccccccugaccccca

SEQ ID NO: 76024 - RNA, 23 nt, Human
aaggcacugucaccccccacccu

SEQ ID NO: 76025 - RNA, 19 nt, Human
accccacaccccaagccca

SEQ ID NO: 76026 - RNA, 21 nt, Human
accccacaccccaagcccaga

SEQ ID NO: 76027 - RNA, 18 nt, Human
accccaccccacacccca

SEQ ID NO: 76028 - RNA, 19 nt, Human
accccaccccacaccccaa

SEQ ID NO: 76029 - RNA, 23 nt, Human
agaacuucuccccccugaccccc

SEQ ID NO: 76030 - RNA, 18 nt, Human
agaagcagagggcagggc

SEQ ID NO: 76031 - RNA, 20 nt, Human
agacccuaggcugugcccaa

SEQ ID NO: 76032 - RNA, 22 nt, Human
agagaggaagggagagaacuga

SEQ ID NO: 76033 - RNA, 23 nt, Human
agaggaagggagagaacugagag

SEQ ID NO: 76034 - RNA, 18 nt, Human
agagggcagggcaggcuc

SEQ ID NO: 76035 - RNA, 21 nt, Human
agcaggaccuuggccccccuc

SEQ ID NO: 76036 - RNA, 23 nt, Human
agcgccuagcagacagggcuaag

SEQ ID NO: 76037 - RNA, 18 nt, Human
agcugaauccuggggaac

SEQ ID NO: 76038 - RNA, 22 nt, Human
aggaaugggagcagggguagag

SEQ ID NO: 76039 - RNA, 24 nt, Human
aggcaaagacuucgcuuaagucca

SEQ ID NO: 76040 - RNA, 21 nt, Human
aggcuucugacacgugaguuc

SEQ ID NO: 76041 - RNA, 23 nt, Human
aucuuccagaauagcugaauccu

SEQ ID NO: 76042 - RNA, 22 nt, Human
caagacccuaggcugugcccaa

SEQ ID NO: 76043 - RNA, 21 nt, Human
caaggguauuauaaaaagcua

SEQ ID NO: 76044 - RNA, 23 nt, Human
cacaccccaagcccagaaucccu

SEQ ID NO: 76045 - RNA, 22 nt, Human
caccccaagcccagaaucccug

SEQ ID NO: 76046 - RNA, 23 nt, Human
caccccacaccccaagcccagaa

SEQ ID NO: 76047 - RNA, 23 nt, Human
caccccaccccacaccccaagcc

SEQ ID NO: 76048 - RNA, 22 nt, Human
caccccuucagccuccuguucc

SEQ ID NO: 76049 - RNA, 19 nt, Human
cagacagcucuggucugcg

SEQ ID NO: 76050 - RNA, 23 nt, Human
cagaugaacucccuacuccuuuu

SEQ ID NO: 76051 - RNA, 23 nt, Human
cagccccugggcccagagagagg

SEQ ID NO: 76052 - RNA, 19 nt, Human
cagcccgagggacccgcga

SEQ ID NO: 76053 - RNA, 24 nt, Human
cagccugccgggauccuggcccaa

SEQ ID NO: 76054 - RNA, 19 nt, Human
caguucccccaucuacacc

SEQ ID NO: 76055 - RNA, 26 nt, Human
cauagacccaccaauccccacacccc

SEQ ID NO: 76056 - RNA, 22 nt, Human
ccaagacccuaggcugugccca

SEQ ID NO: 76057 - RNA, 19 nt, Human
ccaccccacaccccaagcc

SEQ ID NO: 76058 - RNA, 18 nt, Human
ccaccccaccccacaccc

SEQ ID NO: 76059 - RNA, 23 nt, Human
ccaccccaccccacaccccaagc

SEQ ID NO: 76060 - RNA, 18 nt, Human
ccagcgccuagcagacag

SEQ ID NO: 76061 - RNA, 18 nt, Human
cccacaccccaagcccag

SEQ ID NO: 76062 - RNA, 24 nt, Human
cccacaccccaagcccagaauccc

SEQ ID NO: 76063 - RNA, 18 nt, Human
cccacaccccagacgucc

SEQ ID NO: 76064 - RNA, 22 nt, Human
cccacgcaggggcccuccgaag

SEQ ID NO: 76065 - RNA, 23 nt, Human
cccagagagagggcccacuagca

SEQ ID NO: 76066 - RNA, 18 nt, Human
ccccacaccccaagccca

SEQ ID NO: 76067 - RNA, 21 nt, Human
ccccaccccacaccccaagcc

SEQ ID NO: 76068 - RNA, 24 nt, Human
ccccaccccacaccccaagcccag

SEQ ID NO: 76069 - RNA, 25 nt, Human
ccccaccccacaccccaagcccaga

SEQ ID NO: 76070 - RNA, 19 nt, Human
ccccacgcaggggcccucc

SEQ ID NO: 76071 - RNA, 25 nt, Human
ccccccacccugaggagaccuagac

SEQ ID NO: 76072 - RNA, 25 nt, Human
cccccugacccccaagacccuaggc

SEQ ID NO: 76073 - RNA, 22 nt, Human
ccccucccugcauuuggcugaa

SEQ ID NO: 76074 - RNA, 24 nt, Human
ccccucuccuaguagguccugcuc

SEQ ID NO: 76075 - RNA, 20 nt, Human
ccccuucagccuccuguucc

SEQ ID NO: 76076 - RNA, 24 nt, Human
cccgcgagacuccagugaucauag

SEQ ID NO: 76077 - RNA, 23 nt, Human
cccugggcccagagagagggccc

SEQ ID NO: 76078 - RNA, 20 nt, Human
ccugccgggauccuggccca

SEQ ID NO: 76079 - RNA, 19 nt, Human
ccuggcccaacccgggugg

SEQ ID NO: 76080 - RNA, 24 nt, Human
ccuguagucugggcaaggaggagc

SEQ ID NO: 76081 - RNA, 18 nt, Human
cgacuccaccccacccca

SEQ ID NO: 76082 - RNA, 19 nt, Human
cgggauccuggcccaaccc

SEQ ID NO: 76083 - RNA, 22 nt, Human
cucacccaaggcccccagggau

SEQ ID NO: 76084 - RNA, 18 nt, Human
cuccccccugacccccaa

SEQ ID NO: 76085 - RNA, 26 nt, Human
cuuagaacccuccagaugaacucccu

SEQ ID NO: 76086 - RNA, 18 nt, Human
cuucucccacuuagaacc

SEQ ID NO: 76087 - RNA, 23 nt, Human
cuugccccgaagccauuuuucag

SEQ ID NO: 76088 - RNA, 19 nt, Human
cuuggccccccucuccuag

SEQ ID NO: 76089 - RNA, 23 nt, Human
gaacauagacccaccaaucccca

SEQ ID NO: 76090 - RNA, 19 nt, Human
gaaccgggaccccaaaggg

SEQ ID NO: 76091 - RNA, 22 nt, Human
gacccaccaauccccacacccc

SEQ ID NO: 76092 - RNA, 23 nt, Human
gacuccaccccaccccacacccc

SEQ ID NO: 76093 - RNA, 22 nt, Human
gagaaggcacugucacccccca

SEQ ID NO: 76094 - RNA, 23 nt, Human
gagaaggcacugucaccccccac

SEQ ID NO: 76095 - RNA, 21 nt, Human
gagcaggaccuuggccccccu

SEQ ID NO: 76096 - RNA, 25 nt, Human
gaggauaggggguggccuauggggg

SEQ ID NO: 76097 - RNA, 24 nt, Human
gaggucccgaggggcuggcggcug

SEQ ID NO: 76098 - RNA, 19 nt, Human
gaggugccagcggcacccg

SEQ ID NO: 76099 - RNA, 19 nt, Human
gcacaguuuauuuccaaac

SEQ ID NO: 76100 - RNA, 18 nt, Human
gcagaagcagagggcagg

SEQ ID NO: 76101 - RNA, 22 nt, Human
gcagccugacuggcccccacgc

SEQ ID NO: 76102 - RNA, 20 nt, Human
gcccaguuuccaggaauggg

SEQ ID NO: 76103 - RNA, 21 nt, Human
gcccccagggaugggggugag

SEQ ID NO: 76104 - RNA, 25 nt, Human
gccccgaagccauuuuucaggucuc

SEQ ID NO: 76105 - RNA, 22 nt, Human
gccgggauccuggcccaacccg

SEQ ID NO: 76106 - RNA, 18 nt, Human
gcuccugggacacaugcu

SEQ ID NO: 76107 - RNA, 20 nt, Human
ggacccgcgagacuccagug

SEQ ID NO: 76108 - RNA, 19 nt, Human
ggagggugggggaacagag

SEQ ID NO: 76109 - RNA, 23 nt, Human
ggcuggcggcugcugcucccagg

SEQ ID NO: 76110 - RNA, 21 nt, Human
gggaacagagaaggcaaagac

SEQ ID NO: 76111 - RNA, 24 nt, Human
gucugggcaaggaggagccuuagc

SEQ ID NO: 76112 - RNA, 18 nt, Human
gugccagagccaugaggg

SEQ ID NO: 76113 - RNA, 18 nt, Human
uaacaaaccaaguccuaa

SEQ ID NO: 76114 - RNA, 19 nt, Human
uaaggagagaggaagggag

SEQ ID NO: 76115 - RNA, 21 nt, Human
uaaggugaccaucucuggguc

SEQ ID NO: 76116 - RNA, 22 nt, Human
uagaacccuccagaugaacucc

SEQ ID NO: 76117 - RNA, 18 nt, Human
uagaauggugggaauggg

SEQ ID NO: 76118 - RNA, 20 nt, Human
uagggugcugaucuuccaga

SEQ ID NO: 76119 - RNA, 27 nt, Human
uaguccuucucccacuuagaacccucc

SEQ ID NO: 76120 - RNA, 24 nt, Human
ucaagaacuucuccccccugaccc

SEQ ID NO: 76121 - RNA, 21 nt, Human
ucaguggaggacgggaucagc

SEQ ID NO: 76122 - RNA, 24 nt, Human
ucaguggaggacgggaucagccug

SEQ ID NO: 76123 - RNA, 21 nt, Human
uccaacugcaaaggcaguaug

SEQ ID NO: 76124 - RNA, 22 nt, Human
ucccaccucugggauuccuagu

SEQ ID NO: 76125 - RNA, 21 nt, Human
uccccacaccccagacguccu

SEQ ID NO: 76126 - RNA, 22 nt, Human
ucccugauauaacaaaccaagu

SEQ ID NO: 76127 - RNA, 24 nt, Human
uccuggggaacauagacccaccaa

SEQ ID NO: 76128 - RNA, 23 nt, Human
ucggcaggggcagccaccccuuc

SEQ ID NO: 76129 - RNA, 22 nt, Human
ucucugggucggcaggggcagc

SEQ ID NO: 76130 - RNA, 23 nt, Human
ucucugggucggcaggggcagcc

SEQ ID NO: 76131 - RNA, 23 nt, Human
ucugaaccgggaccccaaagggc

SEQ ID NO: 76132 - RNA, 20 nt, Human
ucugcagccugacuggcccc

SEQ ID NO: 76133 - RNA, 22 nt, Human
ucugccuccccucccugcauuu

SEQ ID NO: 76134 - RNA, 24 nt, Human
ucuuccagaauagcugaauccugg

SEQ ID NO: 76135 - RNA, 20 nt, Human
ugagagccuucaccuguagu

SEQ ID NO: 76136 - RNA, 19 nt, Human
ugaggagaccuagacaggu

SEQ ID NO: 76137 - RNA, 20 nt, Human
ugagggaggagacggccaca

SEQ ID NO: 76138 - RNA, 18 nt, Human
ugaguucagacagcucug

SEQ ID NO: 76139 - RNA, 23 nt, Human
ugcagaagcagagggcagggcag

SEQ ID NO: 76140 - RNA, 19 nt, Human
ugccugggaggaccugggc

SEQ ID NO: 76141 - RNA, 23 nt, Human
ugcgacuccaccccaccccacac

SEQ ID NO: 76142 - RNA, 19 nt, Human
ugcugcucccaggggcuga

SEQ ID NO: 76143 - RNA, 19 nt, Human
uggagggugggggaacaga

SEQ ID NO: 76144 - RNA, 19 nt, Human
uggccggagggaggaaugg

SEQ ID NO: 76145 - RNA, 27 nt, Human
uggccuaugggcuccaucugccucccu

SEQ ID NO: 76146 - RNA, 23 nt, Human
uggcucccagucucuugccuccc

SEQ ID NO: 76147 - RNA, 22 nt, Human
ugggaaugggcucucacaaggg

SEQ ID NO: 76148 - RNA, 23 nt, Human
uggggagaaguggcucccagucu

SEQ ID NO: 76149 - RNA, 21 nt, Human
ugucccugugcagcccgaggg

SEQ ID NO: 76150 - RNA, 23 nt, Human
uguugauaguccuucucccacuu

SEQ ID NO: 76151 - RNA, 18 nt, Human
uucacaguucccccaucu

SEQ ID NO: 76152 - RNA, 18 nt, Human
uucccccaucuacacccc

SEQ ID NO: 76153 - RNA, 21 nt, Human
uuuccaggaaugggcgucagu

SEQ ID NO: 76154 - RNA, 19 nt, Human
aaaggggaaguggggcagg

SEQ ID NO: 76155 - RNA, 24 nt, Human
aaaggggaaguggggcagggaagg

SEQ ID NO: 76156 - RNA, 20 nt, Human
aacacugaaggcgaagagcc

SEQ ID NO: 76157 - RNA, 19 nt, Human
aacccugucucugcuaccc

SEQ ID NO: 76158 - RNA, 25 nt, Human
aagaggaaugaagagagaagaccug

SEQ ID NO: 76159 - RNA, 20 nt, Human
aagcauagucagguaggaac

SEQ ID NO: 76160 - RNA, 23 nt, Human
acccaggcccccagcuaggaccc

SEQ ID NO: 76161 - RNA, 18 nt, Human
acccuacucccaacccag

SEQ ID NO: 76162 - RNA, 21 nt, Human
accugggcccaccaggacagc

SEQ ID NO: 76163 - RNA, 21 nt, Human
acuggaguagcaggaagagcu

SEQ ID NO: 76164 - RNA, 22 nt, Human
agaacaaggaagacaguucaca

SEQ ID NO: 76165 - RNA, 23 nt, Human
agagcagcagggcccagagccca

SEQ ID NO: 76166 - RNA, 25 nt, Human
agagcagcagggcccagagcccagg

SEQ ID NO: 76167 - RNA, 21 nt, Human
agagcccagggcccacccagg

SEQ ID NO: 76168 - RNA, 28 nt, Human
agaggcagcugccacacuucccaagggg

SEQ ID NO: 76169 - RNA, 23 nt, Human
agcagccugcucaccccaacccc

SEQ ID NO: 76170 - RNA, 19 nt, Human
aggaagacaguucacaggc

SEQ ID NO: 76171 - RNA, 25 nt, Human
aggaagacaguucacaggccacuga

SEQ ID NO: 76172 - RNA, 22 nt, Human
aggaagagcugaguggugccag

SEQ ID NO: 76173 - RNA, 23 nt, Human
aggaagcugcaguaccucgcugu

SEQ ID NO: 76174 - RNA, 18 nt, Human
agggacagagaccuagag

SEQ ID NO: 76175 - RNA, 18 nt, Human
agggcacgauggaaggaa

SEQ ID NO: 76176 - RNA, 21 nt, Human
aggggcuagaggggucaagcu

SEQ ID NO: 76177 - RNA, 21 nt, Human
augauacaaggaccugggccc

SEQ ID NO: 76178 - RNA, 23 nt, Human
augauacaaggaccugggcccac

SEQ ID NO: 76179 - RNA, 20 nt, Human
auggagagcagucuugaaca

SEQ ID NO: 76180 - RNA, 21 nt, Human
caacuccagaugcugccuccu

SEQ ID NO: 76181 - RNA, 20 nt, Human
cacaacacugaaggcgaaga

SEQ ID NO: 76182 - RNA, 19 nt, Human
caccaggacagcuccuagg

SEQ ID NO: 76183 - RNA, 18 nt, Human
caccccccacucagucac

SEQ ID NO: 76184 - RNA, 20 nt, Human
cacccuacucccaacccagc

SEQ ID NO: 76185 - RNA, 21 nt, Human
caccgcugcccccaccgggag

SEQ ID NO: 76186 - RNA, 21 nt, Human
cacuugccagcaccccccacu

SEQ ID NO: 76187 - RNA, 25 nt, Human
cagagcccagggcccacccaggccc

SEQ ID NO: 76188 - RNA, 19 nt, Human
caggacagcuccuaggaga

SEQ ID NO: 76189 - RNA, 28 nt, Human
caggcccucccuccccaccgcugccccc

SEQ ID NO: 76190 - RNA, 18 nt, Human
cagggaaggacccuggug

SEQ ID NO: 76191 - RNA, 23 nt, Human
cagggcccacccaggcccccagc

SEQ ID NO: 76192 - RNA, 19 nt, Human
caguaccucgcugugcccc

SEQ ID NO: 76193 - RNA, 23 nt, Human
caguauuuacaggggcuagaggg

SEQ ID NO: 76194 - RNA, 22 nt, Human
cagucccacacacagacaacgg

SEQ ID NO: 76195 - RNA, 18 nt, Human
caugggaucccagcagcc

SEQ ID NO: 76196 - RNA, 22 nt, Human
ccacacuugccagcacccccca

SEQ ID NO: 76197 - RNA, 18 nt, Human
ccacaugcucugcucagg

SEQ ID NO: 76198 - RNA, 26 nt, Human
ccacugggacacccuacucccaaccc

SEQ ID NO: 76199 - RNA, 22 nt, Human
ccagcuuccuauaagcaacccu

SEQ ID NO: 76200 - RNA, 21 nt, Human
ccaggcagaagggccaggucc

SEQ ID NO: 76201 - RNA, 23 nt, Human
cccacugggacacccuacuccca

SEQ ID NO: 76202 - RNA, 24 nt, Human
ccccaccgcccccggggccccucc

SEQ ID NO: 76203 - RNA, 18 nt, Human
cccccaccgcccccgggg

SEQ ID NO: 76204 - RNA, 18 nt, Human
cccccaccgggagccccc

SEQ ID NO: 76205 - RNA, 19 nt, Human
cccccggggccccucaguc

SEQ ID NO: 76206 - RNA, 20 nt, Human
cccccggggccccucagucc

SEQ ID NO: 76207 - RNA, 24 nt, Human
ccccggggccccucagucccacac

SEQ ID NO: 76208 - RNA, 23 nt, Human
ccccuuggcaucagguccucugg

SEQ ID NO: 76209 - RNA, 27 nt, Human
ccgcugcccccaccgggagcccccacc

SEQ ID NO: 76210 - RNA, 19 nt, Human
ccgggagcccccaccgccc

SEQ ID NO: 76211 - RNA, 23 nt, Human
ccucagcgccauguccaggcccu

SEQ ID NO: 76212 - RNA, 19 nt, Human
ccucagggcacgauggaag

SEQ ID NO: 76213 - RNA, 23 nt, Human
ccucccauucccagggccuggac

SEQ ID NO: 76214 - RNA, 18 nt, Human
ccugcucaccccaacccc

SEQ ID NO: 76215 - RNA, 21 nt, Human
ccugcugcuccacagccggcu

SEQ ID NO: 76216 - RNA, 19 nt, Human
ccuguaguugggaccgugg

SEQ ID NO: 76217 - RNA, 23 nt, Human
ccugucucugcuaccccugagag

SEQ ID NO: 76218 - RNA, 21 nt, Human
cggcaagagugggcugcagag

SEQ ID NO: 76219 - RNA, 19 nt, Human
cuagagcccaauuuaggcc

SEQ ID NO: 76220 - RNA, 22 nt, Human
cuaggagagaaagcauagucag

SEQ ID NO: 76221 - RNA, 22 nt, Human
cuccagaggcacugcugggccc

SEQ ID NO: 76222 - RNA, 18 nt, Human
cugcagagucagggccag

SEQ ID NO: 76223 - RNA, 25 nt, Human
cugcaguaccucgcugugccccaac

SEQ ID NO: 76224 - RNA, 29 nt, Human
cugcugcuccacagccggcuggugaccac

SEQ ID NO: 76225 - RNA, 18 nt, Human
cuguguuggggccugggc

SEQ ID NO: 76226 - RNA, 21 nt, Human
cuugccagcaccccccacuca

SEQ ID NO: 76227 - RNA, 23 nt, Human
gaacagccuggcuagaacaagga

SEQ ID NO: 76228 - RNA, 20 nt, Human
gacaggcugguggcuggggc

SEQ ID NO: 76229 - RNA, 18 nt, Human
gagagaaagcauagucag

SEQ ID NO: 76230 - RNA, 19 nt, Human
gagcccagggcccacccag

SEQ ID NO: 76231 - RNA, 20 nt, Human
gauccugcugucccccaccc

SEQ ID NO: 76232 - RNA, 20 nt, Human
gcagaggcugaggaaacugg

SEQ ID NO: 76233 - RNA, 22 nt, Human
gcagaggcugaggaaacuggag

SEQ ID NO: 76234 - RNA, 18 nt, Human
gcaguaccucgcugugcc

SEQ ID NO: 76235 - RNA, 23 nt, Human
gcccagagcccagggcccacccc

SEQ ID NO: 76236 - RNA, 21 nt, Human
gcccagugcugggucccugag

SEQ ID NO: 76237 - RNA, 21 nt, Human
gccgugucaggccucagggca

SEQ ID NO: 76238 - RNA, 19 nt, Human
gcuagagcagcagggccca

SEQ ID NO: 76239 - RNA, 22 nt, Human
gcugugcucagcccagaggcag

SEQ ID NO: 76240 - RNA, 21 nt, Human
ggaaggacccuggugagggcc

SEQ ID NO: 76241 - RNA, 19 nt, Human
ggacagagaccuagagccc

SEQ ID NO: 76242 - RNA, 22 nt, Human
ggacaggcugguggcuggggcu

SEQ ID NO: 76243 - RNA, 19 nt, Human
ggcagggaaggacccuggu

SEQ ID NO: 76244 - RNA, 21 nt, Human
ggccaugggaucccagcagcc

SEQ ID NO: 76245 - RNA, 20 nt, Human
ggccugggcuccagaggcac

SEQ ID NO: 76246 - RNA, 23 nt, Human
ggcugguggcuggggcuagagca

SEQ ID NO: 76247 - RNA, 24 nt, Human
gggaaaaggggaaguggggcaggg

SEQ ID NO: 76248 - RNA, 21 nt, Human
gggcuguguuggggccugggc

SEQ ID NO: 76249 - RNA, 24 nt, Human
ggggccugggcuccagaggcacug

SEQ ID NO: 76250 - RNA, 24 nt, Human
guaauacugaggggcuggacagag

SEQ ID NO: 76251 - RNA, 19 nt, Human
guggcuggggcuagagcag

SEQ ID NO: 76252 - RNA, 22 nt, Human
uaaaauauauauucugcugccc

SEQ ID NO: 76253 - RNA, 19 nt, Human
uaccucgcugugccccaac

SEQ ID NO: 76254 - RNA, 22 nt, Human
uaccucgcugugccccaacucc

SEQ ID NO: 76255 - RNA, 19 nt, Human
uauucugcugcccaggcag

SEQ ID NO: 76256 - RNA, 18 nt, Human
ucacaggccacugaacag

SEQ ID NO: 76257 - RNA, 20 nt, Human
ucagcccagaggcagcugcc

SEQ ID NO: 76258 - RNA, 18 nt, Human
ucaggccaugggauccca

SEQ ID NO: 76259 - RNA, 19 nt, Human
ucagguccucuggaacaca

SEQ ID NO: 76260 - RNA, 19 nt, Human
ucagucccacacacagaca

SEQ ID NO: 76261 - RNA, 25 nt, Human
ucccaacccagcccagugcuggguc

SEQ ID NO: 76262 - RNA, 19 nt, Human
ucccagggccuggacucuc

SEQ ID NO: 76263 - RNA, 20 nt, Human
ucccagggccuggacucucc

SEQ ID NO: 76264 - RNA, 23 nt, Human
ucccgcggggcggccccucagcg

SEQ ID NO: 76265 - RNA, 23 nt, Human
ucccuccccaccgcugcccccac

SEQ ID NO: 76266 - RNA, 26 nt, Human
ucccuccccaccgcugcccccaccgg

SEQ ID NO: 76267 - RNA, 19 nt, Human
uccugcugcuccacagccg

SEQ ID NO: 76268 - RNA, 18 nt, Human
ucugccgugucaggccuc

SEQ ID NO: 76269 - RNA, 20 nt, Human
ucuggaacacaggggcucca

SEQ ID NO: 76270 - RNA, 18 nt, Human
ugaagagagaagaccugg

SEQ ID NO: 76271 - RNA, 20 nt, Human
ugaagagagaagaccuggcu

SEQ ID NO: 76272 - RNA, 19 nt, Human
ugaggaaacuggaguagca

SEQ ID NO: 76273 - RNA, 24 nt, Human
ugaggaaacuggaguagcaggaag

SEQ ID NO: 76274 - RNA, 21 nt, Human
ugagugccuugcagaggcuga

SEQ ID NO: 76275 - RNA, 21 nt, Human
ugccagcaccccccacucagu

SEQ ID NO: 76276 - RNA, 23 nt, Human
ugccccaacuccagaugcugccu

SEQ ID NO: 76277 - RNA, 18 nt, Human
ugccuugcagaggcugag

SEQ ID NO: 76278 - RNA, 22 nt, Human
ugcuauggagagcagucuugaa

SEQ ID NO: 76279 - RNA, 18 nt, Human
uggcagaggccauggggc

SEQ ID NO: 76280 - RNA, 21 nt, Human
uggcuagaacaaggaagacag

SEQ ID NO: 76281 - RNA, 26 nt, Human
ugggaucccagcagccugcucacccc

SEQ ID NO: 76282 - RNA, 22 nt, Human
uggggcuguguuggggccuggg

SEQ ID NO: 76283 - RNA, 26 nt, Human
uggguuggagcccagaaaaauagaug

SEQ ID NO: 76284 - RNA, 19 nt, Human
uggugagggccacacggca

SEQ ID NO: 76285 - RNA, 18 nt, Human
ugguggcuggggcuagag

SEQ ID NO: 76286 - RNA, 23 nt, Human
uguccaggcccucccuccccacc

SEQ ID NO: 76287 - RNA, 22 nt, Human
uucacaggccacugaacaguuc

SEQ ID NO: 76288 - RNA, 23 nt, Human
uuuuuuuuuuuuuuuuucucagg

SEQ ID NO: 76289 - RNA, 18 nt, Human
aaaaccccacccccaggc

SEQ ID NO: 76290 - RNA, 23 nt, Human
aaagaaaaaauacagcgaauaga

SEQ ID NO: 76291 - RNA, 24 nt, Human
aaagugcgacacgucuuaaccucc

SEQ ID NO: 76292 - RNA, 22 nt, Human
aagaaaaaauacagcgaauaga

SEQ ID NO: 76293 - RNA, 25 nt, Human
aagaaaccaaggaaaguuuccgcag

SEQ ID NO: 76294 - RNA, 20 nt, Human
acaaauaaaaagaaaccaag

SEQ ID NO: 76295 - RNA, 21 nt, Human
acagcgaauagagcuuccaaa

SEQ ID NO: 76296 - RNA, 20 nt, Human
accaugaacuaguguggccu

SEQ ID NO: 76297 - RNA, 19 nt, Human
acccccacccuagcucuga

SEQ ID NO: 76298 - RNA, 21 nt, Human
acucgcugccucagcccaagc

SEQ ID NO: 76299 - RNA, 22 nt, Human
aggaagauguggagacccccgg

SEQ ID NO: 76300 - RNA, 21 nt, Human
aggagggguggagcagagggc

SEQ ID NO: 76301 - RNA, 23 nt, Human
aggaguugccgcucagggaaaac

SEQ ID NO: 76302 - RNA, 22 nt, Human
aggcagacauauucgaaucaaa

SEQ ID NO: 76303 - RNA, 18 nt, Human
aggcaggugggcgaucag

SEQ ID NO: 76304 - RNA, 18 nt, Human
aggcgcccccucagggca

SEQ ID NO: 76305 - RNA, 20 nt, Human
agggguggagcagagggccu

SEQ ID NO: 76306 - RNA, 23 nt, Human
aguccuggcuaacgggagcugga

SEQ ID NO: 76307 - RNA, 20 nt, Human
auucacauugaguagaaaaa

SEQ ID NO: 76308 - RNA, 24 nt, Human
caaguccuggcuaacgggagcugg

SEQ ID NO: 76309 - RNA, 23 nt, Human
cacagugccauuaaggaggcgaa

SEQ ID NO: 76310 - RNA, 19 nt, Human
cacuggagucgcagagggc

SEQ ID NO: 76311 - RNA, 24 nt, Human
cagaaagcucccagcaggccugaa

SEQ ID NO: 76312 - RNA, 21 nt, Human
cagagggcggaagguagacac

SEQ ID NO: 76313 - RNA, 23 nt, Human
cagcacccgaaucgggcaccccc

SEQ ID NO: 76314 - RNA, 18 nt, Human
cagcgaauagagcuucca

SEQ ID NO: 76315 - RNA, 19 nt, Human
cagcggcacugcggugggc

SEQ ID NO: 76316 - RNA, 23 nt, Human
cauucagcacccgaaucgggcac

SEQ ID NO: 76317 - RNA, 21 nt, Human
cccaggcagacauauucgaau

SEQ ID NO: 76318 - RNA, 20 nt, Human
cccccaggcagacauauucg

SEQ ID NO: 76319 - RNA, 18 nt, Human
ccccggcuugcaccacac

SEQ ID NO: 76320 - RNA, 22 nt, Human
ccccuaggccauagggugccuc

SEQ ID NO: 76321 - RNA, 19 nt, Human
ccccucagggcagacucag

SEQ ID NO: 76322 - RNA, 22 nt, Human
ccccuccuuacauucagcaccc

SEQ ID NO: 76323 - RNA, 21 nt, Human
cccuaggccauagggugccuc

SEQ ID NO: 76324 - RNA, 20 nt, Human
ccuccuuacauucagcaccc

SEQ ID NO: 76325 - RNA, 20 nt, Human
ccuccuuccggggcucccag

SEQ ID NO: 76326 - RNA, 22 nt, Human
ccuccuuccggggcucccaggc

SEQ ID NO: 76327 - RNA, 18 nt, Human
cgaaucgggcacccccac

SEQ ID NO: 76328 - RNA, 24 nt, Human
cgacacgucuuaaccuccuuuaca

SEQ ID NO: 76329 - RNA, 22 nt, Human
cgccguggaaaggcuggccagg

SEQ ID NO: 76330 - RNA, 18 nt, Human
cuccuccuuccggggcuc

SEQ ID NO: 76331 - RNA, 18 nt, Human
cugggugugcgcucuccu

SEQ ID NO: 76332 - RNA, 20 nt, Human
cuuccggggcucccaggcgc

SEQ ID NO: 76333 - RNA, 23 nt, Human
cuuccggggcucccaggcgcuuc

SEQ ID NO: 76334 - RNA, 21 nt, Human
gaaaagcggcgagguugacaa

SEQ ID NO: 76335 - RNA, 18 nt, Human
gacaagacaggugggauc

SEQ ID NO: 76336 - RNA, 21 nt, Human
gcacugcggugggcgccgugg

SEQ ID NO: 76337 - RNA, 21 nt, Human
gcaggugggcgaucagggccc

SEQ ID NO: 76338 - RNA, 18 nt, Human
gccuagugcagaaagcuc

SEQ ID NO: 76339 - RNA, 25 nt, Human
gcucccagcaggccugaaauucuga

SEQ ID NO: 76340 - RNA, 25 nt, Human
ggccccuaggccauagggugccucu

SEQ ID NO: 76341 - RNA, 21 nt, Human
gggcacccccacccuagcucu

SEQ ID NO: 76342 - RNA, 23 nt, Human
gguccggagccggagcgcgggaa

SEQ ID NO: 76343 - RNA, 21 nt, Human
ggugccucuguucaaauuaga

SEQ ID NO: 76344 - RNA, 25 nt, Human
gucaugauaauaaauagagcccagg

SEQ ID NO: 76345 - RNA, 25 nt, Human
uaaaaagaaaccaaggaaaguuucc

SEQ ID NO: 76346 - RNA, 18 nt, Human
uaaauagagcccaggggc

SEQ ID NO: 76347 - RNA, 25 nt, Human
uaauaaauagagcccaggggcuucc

SEQ ID NO: 76348 - RNA, 21 nt, Human
uagcauggauaccaugaacua

SEQ ID NO: 76349 - RNA, 19 nt, Human
uagggugccucuguucaaa

SEQ ID NO: 76350 - RNA, 22 nt, Human
uccggggcucccaggcgcuucc

SEQ ID NO: 76351 - RNA, 21 nt, Human
ucuguucaaauuagaaaaagg

SEQ ID NO: 76352 - RNA, 21 nt, Human
ugcggugggcgccguggaaag

SEQ ID NO: 76353 - RNA, 22 nt, Human
ugcugccugggacugccagggu

SEQ ID NO: 76354 - RNA, 19 nt, Human
uggagcagagggccugaaa

SEQ ID NO: 76355 - RNA, 19 nt, Human
uggagcuggguuucaccuc

SEQ ID NO: 76356 - RNA, 21 nt, Human
ugggcgccguggaaaggcugg

SEQ ID NO: 76357 - RNA, 22 nt, Human
ugugcgcucuccuccuuccggg

SEQ ID NO: 76358 - RNA, 18 nt, Human
uugaauacaaacaacuga

SEQ ID NO: 76359 - RNA, 22 nt, Human
caaaccgugcaaauucaauuug

SEQ ID NO: 76360 - RNA, 19 nt, Human
cgggaagcaaggaagccuc

SEQ ID NO: 76361 - RNA, 23 nt, Human
ucaaagacaaauaugaaugacuc

SEQ ID NO: 76362 - RNA, 18 nt, Human
aaaaagagagaacccggg

SEQ ID NO: 76363 - RNA, 21 nt, Human
aaaggcgggcggaaggggcca

SEQ ID NO: 76364 - RNA, 20 nt, Human
aacccgggccuggcugcccc

SEQ ID NO: 76365 - RNA, 19 nt, Human
aagcccccuuggccccuuc

SEQ ID NO: 76366 - RNA, 18 nt, Human
agacggggcuccgcacuc

SEQ ID NO: 76367 - RNA, 20 nt, Human
agagaggacgccgagggggg

SEQ ID NO: 76368 - RNA, 24 nt, Human
agcguagaaggggcgugggagaga

SEQ ID NO: 76369 - RNA, 19 nt, Human
aggaggccccggagccgac

SEQ ID NO: 76370 - RNA, 22 nt, Human
aggggcgugggagagagcgaag

SEQ ID NO: 76371 - RNA, 24 nt, Human
cacaggccacagacucacuaaucc

SEQ ID NO: 76372 - RNA, 21 nt, Human
cacccgcuccuggggagaaag

SEQ ID NO: 76373 - RNA, 24 nt, Human
cauuuaaaaaagagagaacccggg

SEQ ID NO: 76374 - RNA, 21 nt, Human
cccgcgggaggaggccccgga

SEQ ID NO: 76375 - RNA, 21 nt, Human
cccggaccggggcugaggcug

SEQ ID NO: 76376 - RNA, 23 nt, Human
ccgcgagagaggacgccgagggg

SEQ ID NO: 76377 - RNA, 22 nt, Human
ccggggcugaggcugggggcug

SEQ ID NO: 76378 - RNA, 18 nt, Human
ccucagaaaggcgggcgg

SEQ ID NO: 76379 - RNA, 19 nt, Human
ccucagaaaggcgggcgga

SEQ ID NO: 76380 - RNA, 18 nt, Human
ccuggcgggggcgcgggg

SEQ ID NO: 76381 - RNA, 21 nt, Human
ccuuccugccccgccugggag

SEQ ID NO: 76382 - RNA, 24 nt, Human
cgcuggcccaggugcucgaggggu

SEQ ID NO: 76383 - RNA, 19 nt, Human
cuccuggggagaaaggggu

SEQ ID NO: 76384 - RNA, 25 nt, Human
cugggcuggggcgccagggagggcc

SEQ ID NO: 76385 - RNA, 22 nt, Human
cugggggcuggggucggggugg

SEQ ID NO: 76386 - RNA, 23 nt, Human
gaccggggcugaggcugggggcu

SEQ ID NO: 76387 - RNA, 23 nt, Human
gagcggccgcgagagaggacgcc

SEQ ID NO: 76388 - RNA, 18 nt, Human
gccuggucauuuguaaga

SEQ ID NO: 76389 - RNA, 22 nt, Human
gcucagccgcuggcccaggugc

SEQ ID NO: 76390 - RNA, 21 nt, Human
ggagagagcgaagccuggggg

SEQ ID NO: 76391 - RNA, 21 nt, Human
ggcuggggagacgcaguccgg

SEQ ID NO: 76392 - RNA, 20 nt, Human
gggagaaagggguugccuag

SEQ ID NO: 76393 - RNA, 19 nt, Human
gggaguggggagggcacag

SEQ ID NO: 76394 - RNA, 21 nt, Human
gggcagggcccccucccggga

SEQ ID NO: 76395 - RNA, 23 nt, Human
gggcagggcccccucccgggaaa

SEQ ID NO: 76396 - RNA, 19 nt, Human
gggcgcggggagaggggcu

SEQ ID NO: 76397 - RNA, 22 nt, Human
gggcuggggcgccagggagggc

SEQ ID NO: 76398 - RNA, 21 nt, Human
ggggagaaagggguugccuag

SEQ ID NO: 76399 - RNA, 23 nt, Human
ggggagccggcagaggcuggggg

SEQ ID NO: 76400 - RNA, 21 nt, Human
ggggcuggggucggggugggu

SEQ ID NO: 76401 - RNA, 19 nt, Human
ggggucggggugggugggc

SEQ ID NO: 76402 - RNA, 18 nt, Human
ggggugggugggcaagcc

SEQ ID NO: 76403 - RNA, 22 nt, Human
gggugggcaagcccccuuggcc

SEQ ID NO: 76404 - RNA, 20 nt, Human
uacagcucagccgcuggccc

SEQ ID NO: 76405 - RNA, 18 nt, Human
ucggggggcacugggcug

SEQ ID NO: 76406 - RNA, 21 nt, Human
ugccuaggggagccggcagag

SEQ ID NO: 76407 - RNA, 20 nt, Human
uggcagagacgcguauguac

SEQ ID NO: 76408 - RNA, 22 nt, Human
uggcgggggcgcggggagaggg

SEQ ID NO: 76409 - RNA, 20 nt, Human
ugggaguggggagggcacag

SEQ ID NO: 76410 - RNA, 20 nt, Human
uggggcgccagggagggccg

SEQ ID NO: 76411 - RNA, 21 nt, Human
uggggcgccagggagggccgg

SEQ ID NO: 76412 - RNA, 18 nt, Human
uggggguggggaguggca

SEQ ID NO: 76413 - RNA, 19 nt, Human
uggggguggggaguggcag

SEQ ID NO: 76414 - RNA, 20 nt, Human
uggggucggggugggugggc

SEQ ID NO: 76415 - RNA, 24 nt, Human
uuccugccccgccugggagugggg

SEQ ID NO: 76416 - RNA, 22 nt, Human
aaccgcuggguccccgacgucc

SEQ ID NO: 76417 - RNA, 26 nt, Human
aagcgcgcggccgccggcucccccgg

SEQ ID NO: 76418 - RNA, 22 nt, Human
aaguaaacuucuuggacgcgga

SEQ ID NO: 76419 - RNA, 24 nt, Human
agcgacaucggggacccggccucc

SEQ ID NO: 76420 - RNA, 20 nt, Human
aggaaguaaacuucuuggac

SEQ ID NO: 76421 - RNA, 22 nt, Human
aggcugcggccggugguccggc

SEQ ID NO: 76422 - RNA, 18 nt, Human
cagcucgggggccggcgg

SEQ ID NO: 76423 - RNA, 21 nt, Human
caggccccagacggggugggg

SEQ ID NO: 76424 - RNA, 22 nt, Human
caggccccagacgggguggggg

SEQ ID NO: 76425 - RNA, 24 nt, Human
cagguuagagcccagaagcgcgcu

SEQ ID NO: 76426 - RNA, 23 nt, Human
ccagaagcgcgcugggaccuggg

SEQ ID NO: 76427 - RNA, 21 nt, Human
cccagguuagagcccagaagc

SEQ ID NO: 76428 - RNA, 22 nt, Human
ccccggggcaaucucaggccgu

SEQ ID NO: 76429 - RNA, 27 nt, Human
ccccggggcaaucucaggccguugugg

SEQ ID NO: 76430 - RNA, 23 nt, Human
cccgcgguuuggcggcggcggcg

SEQ ID NO: 76431 - RNA, 19 nt, Human
ccgccggcucccccggccg

SEQ ID NO: 76432 - RNA, 19 nt, Human
ccggccgggcggaggcgca

SEQ ID NO: 76433 - RNA, 21 nt, Human
ccggcucgcggguuuccgccg

SEQ ID NO: 76434 - RNA, 20 nt, Human
cucccccggccgcugcaucc

SEQ ID NO: 76435 - RNA, 21 nt, Human
cugcggguggcgcgggcaucc

SEQ ID NO: 76436 - RNA, 18 nt, Human
gacggggugggggugcag

SEQ ID NO: 76437 - RNA, 19 nt, Human
gacggggugggggugcagg

SEQ ID NO: 76438 - RNA, 25 nt, Human
gcggcggcggcgacggcuuggcucc

SEQ ID NO: 76439 - RNA, 21 nt, Human
gcgguuuggcggcggcggcgg

SEQ ID NO: 76440 - RNA, 26 nt, Human
gcgguuuggcggcggcggcggcgacg

SEQ ID NO: 76441 - RNA, 25 nt, Human
ggccugagcccaaccgcuggguccc

SEQ ID NO: 76442 - RNA, 18 nt, Human
ggcggaggcgcaggggcc

SEQ ID NO: 76443 - RNA, 18 nt, Human
gggaccugggucuggcuu

SEQ ID NO: 76444 - RNA, 22 nt, Human
ggggcugcggguggcgcgggca

SEQ ID NO: 76445 - RNA, 19 nt, Human
gggggugcaggcgaggagc

SEQ ID NO: 76446 - RNA, 19 nt, Human
guccccgacguccagaagc

SEQ ID NO: 76447 - RNA, 19 nt, Human
guggagcgcucugcgcacc

SEQ ID NO: 76448 - RNA, 25 nt, Human
guggcgcgggcaucccaggccccgc

SEQ ID NO: 76449 - RNA, 21 nt, Human
uccccgacguccagaagcggg

SEQ ID NO: 76450 - RNA, 22 nt, Human
uccccgcggccggccgggcgga

SEQ ID NO: 76451 - RNA, 25 nt, Human
uccccgcggccggccgggcggaggc

SEQ ID NO: 76452 - RNA, 19 nt, Human
ucgggggccggcgggcgcc

SEQ ID NO: 76453 - RNA, 20 nt, Human
ucugcgcaccggagcucagg

SEQ ID NO: 76454 - RNA, 22 nt, Human
ucuggcuuuugggucugugucc

SEQ ID NO: 76455 - RNA, 23 nt, Human
ucuucgcaacaggggguaggggc

SEQ ID NO: 76456 - RNA, 19 nt, Human
ugccuggaggcuccccggc

SEQ ID NO: 76457 - RNA, 18 nt, Human
uggaaaaaaagucaccgu

SEQ ID NO: 76458 - RNA, 19 nt, Human
uggcggcggcggcggcgac

SEQ ID NO: 76459 - RNA, 21 nt, Human
uggcggcggcggcggcgacgg

SEQ ID NO: 76460 - RNA, 21 nt, Human
uggcuuuugggucuguguccu

SEQ ID NO: 76461 - RNA, 22 nt, Human
uggcuuuugggucuguguccuu

SEQ ID NO: 76462 - RNA, 18 nt, Human
ugggaccugggucuggcu

SEQ ID NO: 76463 - RNA, 23 nt, Human
ugggaccugggucuggcuuuugg

SEQ ID NO: 76464 - RNA, 23 nt, Human
aaaacuacagaaauaagugcuga

SEQ ID NO: 76465 - RNA, 23 nt, Human
acccucacccccccaaaaaaaua

SEQ ID NO: 76466 - RNA, 27 nt, Human
acucucccugccuucucucuuuucccu

SEQ ID NO: 76467 - RNA, 22 nt, Human
acugugggagggagggagacgg

SEQ ID NO: 76468 - RNA, 22 nt, Human
agacaagcaagucuuugucaaa

SEQ ID NO: 76469 - RNA, 21 nt, Human
aggaggugacaggcccaagac

SEQ ID NO: 76470 - RNA, 23 nt, Human
aggaggugacaggcccaagacaa

SEQ ID NO: 76471 - RNA, 18 nt, Human
aggcccaagacaagcaag

SEQ ID NO: 76472 - RNA, 23 nt, Human
aggugacaggcccaagacaagca

SEQ ID NO: 76473 - RNA, 20 nt, Human
cacccccccaaaaaaauaca

SEQ ID NO: 76474 - RNA, 24 nt, Human
cacccccccaaaaaaauacaacca

SEQ ID NO: 76475 - RNA, 19 nt, Human
cacccucacccccccaaaa

SEQ ID NO: 76476 - RNA, 18 nt, Human
cagcaaggaaccugggca

SEQ ID NO: 76477 - RNA, 22 nt, Human
cagcuccuaggcgcucucuccc

SEQ ID NO: 76478 - RNA, 19 nt, Human
caggcccaagacaagcaag

SEQ ID NO: 76479 - RNA, 20 nt, Human
ccccaaaaaaauacaaccaa

SEQ ID NO: 76480 - RNA, 19 nt, Human
ccccagcuggggcaggcag

SEQ ID NO: 76481 - RNA, 21 nt, Human
ccccagcuggggcaggcagcu

SEQ ID NO: 76482 - RNA, 24 nt, Human
cccccaaaaaaauacaaccaaaaa

SEQ ID NO: 76483 - RNA, 24 nt, Human
cccuacucucccugccuucucucu

SEQ ID NO: 76484 - RNA, 19 nt, Human
cccucacccccccaaaaaa

SEQ ID NO: 76485 - RNA, 20 nt, Human
cccucacccccccaaaaaaa

SEQ ID NO: 76486 - RNA, 24 nt, Human
cccucacccccccaaaaaaauaca

SEQ ID NO: 76487 - RNA, 19 nt, Human
cccugccuucucucuuuuc

SEQ ID NO: 76488 - RNA, 19 nt, Human
cccugccuucucucuuuuc

SEQ ID NO: 76489 - RNA, 23 nt, Human
ccgcuggggccgcggggcuggcg

SEQ ID NO: 76490 - RNA, 24 nt, Human
ccucacccccccaaaaaaauacaa

SEQ ID NO: 76491 - RNA, 19 nt, Human
cgcuggggccgcggggcug

SEQ ID NO: 76492 - RNA, 20 nt, Human
cggcccgagcgcggcugcga

SEQ ID NO: 76493 - RNA, 23 nt, Human
cuggaagguuuucucucccuacu

SEQ ID NO: 76494 - RNA, 19 nt, Human
cugggcugcuggaagguuu

SEQ ID NO: 76495 - RNA, 22 nt, Human
cuuaaucaagggcauccacagc

SEQ ID NO: 76496 - RNA, 22 nt, Human
gagugcccggcccgcuggggcc

SEQ ID NO: 76497 - RNA, 23 nt, Human
gcagccuuucaggaggugacagg

SEQ ID NO: 76498 - RNA, 18 nt, Human
gcugcccagaggucagga

SEQ ID NO: 76499 - RNA, 20 nt, Human
ggagggagggagacggguag

SEQ ID NO: 76500 - RNA, 22 nt, Human
ggcccgcuggggccgcggggcu

SEQ ID NO: 76501 - RNA, 19 nt, Human
gggcaggcagcuccuaggc

SEQ ID NO: 76502 - RNA, 20 nt, Human
gggcaggcagcuccuaggcg

SEQ ID NO: 76503 - RNA, 18 nt, Human
uaaaacuacagaaauaag

SEQ ID NO: 76504 - RNA, 23 nt, Human
uaaaacuacagaaauaagugcug

SEQ ID NO: 76505 - RNA, 18 nt, Human
uaagcacuuuccacugca

SEQ ID NO: 76506 - RNA, 19 nt, Human
uaggcgcucucucccuuaa

SEQ ID NO: 76507 - RNA, 21 nt, Human
ucaggaggugacaggcccaag

SEQ ID NO: 76508 - RNA, 22 nt, Human
uccacagcuaaagcagccuuuc

SEQ ID NO: 76509 - RNA, 20 nt, Human
ucccucuucccucaaaaggg

SEQ ID NO: 76510 - RNA, 19 nt, Human
ugcaugcuaggauauaggg

SEQ ID NO: 76511 - RNA, 23 nt, Human
ugcccacccucacccccccaaaa

SEQ ID NO: 76512 - RNA, 19 nt, Human
uucccucaaaaggguuuua

SEQ ID NO: 76513 - RNA, 24 nt, Human
uuuccacugcaugcuaggauauag

SEQ ID NO: 76514 - RNA, 23 nt, Human
uuuugcccacccucaccccccca

SEQ ID NO: 76515 - RNA, 18 nt, Human
aaaaagaaaacacagaaa

SEQ ID NO: 76516 - RNA, 19 nt, Human
aaaaagaaaacacagaaaa

SEQ ID NO: 76517 - RNA, 19 nt, Human
aaaaagaaaacacagaaaa

SEQ ID NO: 76518 - RNA, 21 nt, Human
aaaaagaaaacacagaaaaua

SEQ ID NO: 76519 - RNA, 26 nt, Human
aaacagaacuacaggugcacccaacc

SEQ ID NO: 76520 - RNA, 26 nt, Human
aaagaaaacacagaaaauacugcucu

SEQ ID NO: 76521 - RNA, 18 nt, Human
acccaaccacggacaugc

SEQ ID NO: 76522 - RNA, 21 nt, Human
acccaaccacggacaugcauu

SEQ ID NO: 76523 - RNA, 25 nt, Human
acucccaaaaauaucuggagaggaa

SEQ ID NO: 76524 - RNA, 21 nt, Human
agaaaacacagaaaauacugc

SEQ ID NO: 76525 - RNA, 21 nt, Human
agaacuacaggugcacccaac

SEQ ID NO: 76526 - RNA, 23 nt, Human
agaacuacaggugcacccaacca

SEQ ID NO: 76527 - RNA, 24 nt, Human
agaaucaaacgcaucacucccaac

SEQ ID NO: 76528 - RNA, 22 nt, Human
agagagagaggagauuguuuua

SEQ ID NO: 76529 - RNA, 26 nt, Human
agagaggagauagagagaggggaccc

SEQ ID NO: 76530 - RNA, 19 nt, Human
aggaagaauggaggauugg

SEQ ID NO: 76531 - RNA, 18 nt, Human
agguaggcuaaguaggau

SEQ ID NO: 76532 - RNA, 18 nt, Human
aguauaggagagagagag

SEQ ID NO: 76533 - RNA, 21 nt, Human
agugggcucugucugaaagcu

SEQ ID NO: 76534 - RNA, 21 nt, Human
auaagaaaggcuguaaauuaa

SEQ ID NO: 76535 - RNA, 18 nt, Human
auguuugucacucccaaa

SEQ ID NO: 76536 - RNA, 22 nt, Human
caacucccauugcagaagaaaa

SEQ ID NO: 76537 - RNA, 22 nt, Human
caauaaacagaacuacaggugc

SEQ ID NO: 76538 - RNA, 21 nt, Human
cacagaaaauacugcucucau

SEQ ID NO: 76539 - RNA, 19 nt, Human
cagaaaauacugcucucau

SEQ ID NO: 76540 - RNA, 20 nt, Human
cagaagaaaagcuauucaac

SEQ ID NO: 76541 - RNA, 23 nt, Human
ccaggacuucuugguaaaguuga

SEQ ID NO: 76542 - RNA, 23 nt, Human
cugaccaauaaacagaacuacag

SEQ ID NO: 76543 - RNA, 21 nt, Human
gaaagcuggcauucauccaca

SEQ ID NO: 76544 - RNA, 18 nt, Human
gagaggagagauaggaga

SEQ ID NO: 76545 - RNA, 21 nt, Human
gagaggagagauaggagagga

SEQ ID NO: 76546 - RNA, 20 nt, Human
ggaggagugcauguggcggc

SEQ ID NO: 76547 - RNA, 19 nt, Human
ggauucucccacccccucc

SEQ ID NO: 76548 - RNA, 20 nt, Human
uaaaaagaaaacacagaaaa

SEQ ID NO: 76549 - RNA, 24 nt, Human
uaaacagaacuacaggugcaccca

SEQ ID NO: 76550 - RNA, 22 nt, Human
uaucuggagaggaagaauggag

SEQ ID NO: 76551 - RNA, 25 nt, Human
uauuuggauucucccacccccuccc

SEQ ID NO: 76552 - RNA, 30 nt, Human
ucaaaauaagaaaggcuguaaauuaaaaaa

SEQ ID NO: 76553 - RNA, 23 nt, Human
ucagcgguggaggagugcaugug

SEQ ID NO: 76554 - RNA, 25 nt, Human
ucagguacaaacgauguacugcacu

SEQ ID NO: 76555 - RNA, 19 nt, Human
ucccacccccucccucccu

SEQ ID NO: 76556 - RNA, 19 nt, Human
ucccacccccucccucccu

SEQ ID NO: 76557 - RNA, 23 nt, Human
ugaccaauaaacagaacuacagg

SEQ ID NO: 76558 - RNA, 22 nt, Human
ugacugaagguauauuagauau

SEQ ID NO: 76559 - RNA, 18 nt, Human
ugagaaaucuagguaggc

SEQ ID NO: 76560 - RNA, 19 nt, Human
uggaggagugcauguggcg

SEQ ID NO: 76561 - RNA, 18 nt, Human
uggaggauuggcauugag

SEQ ID NO: 76562 - RNA, 21 nt, Human
uguggcggcaguuucagguac

SEQ ID NO: 76563 - RNA, 21 nt, Human
uuaaaaagaaaacacagaaaa

SEQ ID NO: 76564 - RNA, 22 nt, Human
uugggcaauacauaucauuacu

SEQ ID NO: 76565 - RNA, 22 nt, Human
aaacaaggggugaagaguaggg

SEQ ID NO: 76566 - RNA, 19 nt, Human
accggaaacagggccuucc

SEQ ID NO: 76567 - RNA, 22 nt, Human
acuuccgguugcaggcuucccu

SEQ ID NO: 76568 - RNA, 21 nt, Human
agaagggaagggggaucugga

SEQ ID NO: 76569 - RNA, 19 nt, Human
agacacauguguuucauuu

SEQ ID NO: 76570 - RNA, 22 nt, Human
agcaacagcgacgaaggaggga

SEQ ID NO: 76571 - RNA, 18 nt, Human
agccauggggugggggcu

SEQ ID NO: 76572 - RNA, 22 nt, Human
agggaagggggaucuggauggg

SEQ ID NO: 76573 - RNA, 22 nt, Human
agggagagcgcguauggcggca

SEQ ID NO: 76574 - RNA, 24 nt, Human
auggcggcagcaacagcgacgaag

SEQ ID NO: 76575 - RNA, 22 nt, Human
caaggggugaagaguaggggau

SEQ ID NO: 76576 - RNA, 22 nt, Human
cagaagagcuaaacagggagag

SEQ ID NO: 76577 - RNA, 23 nt, Human
cagcaacagcgacgaaggaggga

SEQ ID NO: 76578 - RNA, 20 nt, Human
cagggagagcgcguauggcg

SEQ ID NO: 76579 - RNA, 19 nt, Human
caguagugucuccuucacc

SEQ ID NO: 76580 - RNA, 21 nt, Human
caguagugucuccuucacccu

SEQ ID NO: 76581 - RNA, 25 nt, Human
ccauggggugggggcugucaggggu

SEQ ID NO: 76582 - RNA, 26 nt, Human
ccauggggugggggcugucaggggug

SEQ ID NO: 76583 - RNA, 18 nt, Human
ccgguugcaggcuucccu

SEQ ID NO: 76584 - RNA, 20 nt, Human
cgcaaaauaggugaaaacaa

SEQ ID NO: 76585 - RNA, 22 nt, Human
cggcagcaacagcgacgaagga

SEQ ID NO: 76586 - RNA, 23 nt, Human
cggcagcaacagcgacgaaggag

SEQ ID NO: 76587 - RNA, 18 nt, Human
cuccagccucccgccuuc

SEQ ID NO: 76588 - RNA, 23 nt, Human
cucuacuccagccucccgccuuc

SEQ ID NO: 76589 - RNA, 22 nt, Human
cugggccggcaggggaagaagg

SEQ ID NO: 76590 - RNA, 18 nt, Human
cugguguccucuccugaa

SEQ ID NO: 76591 - RNA, 23 nt, Human
gaagggggaucuggauggguucu

SEQ ID NO: 76592 - RNA, 24 nt, Human
gaggaacagcaaaggaaaacaaag

SEQ ID NO: 76593 - RNA, 28 nt, Human
gaggaacagcaaaggaaaaccgguaccc

SEQ ID NO: 76594 - RNA, 22 nt, Human
gcagcaacagcgacgaaggagg

SEQ ID NO: 76595 - RNA, 24 nt, Human
gcaggcuucccucuacuccagccu

SEQ ID NO: 76596 - RNA, 21 nt, Human
gcggcagcaacagcgacgaag

SEQ ID NO: 76597 - RNA, 20 nt, Human
gcugucaggggugggggcag

SEQ ID NO: 76598 - RNA, 18 nt, Human
ggaagaagggaaggggga

SEQ ID NO: 76599 - RNA, 21 nt, Human
gggaagaagggaagggggauc

SEQ ID NO: 76600 - RNA, 21 nt, Human
gggaagggggaucuggauggg

SEQ ID NO: 76601 - RNA, 23 nt, Human
ggggaagaagggaagggggaucu

SEQ ID NO: 76602 - RNA, 18 nt, Human
ggggugggggcugucagg

SEQ ID NO: 76603 - RNA, 18 nt, Human
gguggugaugcaaaagau

SEQ ID NO: 76604 - RNA, 19 nt, Human
gugggggcugucaggggug

SEQ ID NO: 76605 - RNA, 19 nt, Human
ucacuuccgguugcaggcu

SEQ ID NO: 76606 - RNA, 25 nt, Human
ucaggagugguggugaugcaaaagg

SEQ ID NO: 76607 - RNA, 19 nt, Human
uccgguugcaggcuucccu

SEQ ID NO: 76608 - RNA, 21 nt, Human
ucugccuucacuuccgguugc

SEQ ID NO: 76609 - RNA, 21 nt, Human
ugccuuuggaaaaugccuguc

SEQ ID NO: 76610 - RNA, 20 nt, Human
uggggguucaggaguggugg

SEQ ID NO: 76611 - RNA, 23 nt, Human
uggggugggggcugucaggggug

SEQ ID NO: 76612 - RNA, 25 nt, Human
uggggugggggcugucagggguggg

SEQ ID NO: 76613 - RNA, 24 nt, Human
ugguggugaugcaaaagauggaag

SEQ ID NO: 76614 - RNA, 20 nt, Human
uucacuuccgguugcaggcu

SEQ ID NO: 76615 - RNA, 26 nt, Human
aaacagccccagggacaggggaccag

SEQ ID NO: 76616 - RNA, 21 nt, Human
aagugaggccccagccccaca

SEQ ID NO: 76617 - RNA, 26 nt, Human
accaggggaagggggaggaggggaag

SEQ ID NO: 76618 - RNA, 25 nt, Human
agggggaggaggggaagugaggccc

SEQ ID NO: 76619 - RNA, 27 nt, Human
caaacagccccagggacaggggaccag

SEQ ID NO: 76620 - RNA, 21 nt, Human
caaccccuccccgcccacccc

SEQ ID NO: 76621 - RNA, 22 nt, Human
caaccccuccccgcccaccccu

SEQ ID NO: 76622 - RNA, 23 nt, Human
cagggacaggggaccaggggaag

SEQ ID NO: 76623 - RNA, 19 nt, Human
cccacaaccccuccccgcc

SEQ ID NO: 76624 - RNA, 21 nt, Human
cccacaaccccuccccgccca

SEQ ID NO: 76625 - RNA, 19 nt, Human
ccccacaaccccuccccgc

SEQ ID NO: 76626 - RNA, 23 nt, Human
ccccagccccacaaccccucccc

SEQ ID NO: 76627 - RNA, 18 nt, Human
ccccagggacaggggacc

SEQ ID NO: 76628 - RNA, 19 nt, Human
ccccagggacaggggacca

SEQ ID NO: 76629 - RNA, 21 nt, Human
cccccaaaacgugccagagcc

SEQ ID NO: 76630 - RNA, 21 nt, Human
ccccgcccaccccuuuccccc

SEQ ID NO: 76631 - RNA, 18 nt, Human
ccccuccccgcccacccc

SEQ ID NO: 76632 - RNA, 23 nt, Human
cccuccccgcccaccccuuuccc

SEQ ID NO: 76633 - RNA, 21 nt, Human
ccugcaggcaccucccccaaa

SEQ ID NO: 76634 - RNA, 22 nt, Human
gaagugaggccccagccccaca

SEQ ID NO: 76635 - RNA, 21 nt, Human
gaggccccagccccacaaccc

SEQ ID NO: 76636 - RNA, 25 nt, Human
gccccacaaccccuccccgcccacc

SEQ ID NO: 76637 - RNA, 20 nt, Human
gccccagccccacaaccccu

SEQ ID NO: 76638 - RNA, 19 nt, Human
gggauccgggacccgggcc

SEQ ID NO: 76639 - RNA, 21 nt, Human
ggggaagggggaggaggggaa

SEQ ID NO: 76640 - RNA, 20 nt, Human
ggggauccgggacccgggcc

SEQ ID NO: 76641 - RNA, 25 nt, Human
gugaggccccagccccacaaccccu

SEQ ID NO: 76642 - RNA, 19 nt, Human
uauaaucuauauacaagcc

SEQ ID NO: 76643 - RNA, 20 nt, Human
uccccgcccaccccuuuccc

SEQ ID NO: 76644 - RNA, 19 nt, Human
ugcgcuggaagcucauuga

SEQ ID NO: 76645 - RNA, 20 nt, Human
uggccgggugcgcggggauc

SEQ ID NO: 76646 - RNA, 19 nt, Human
uggguccugcaggcaccuc

SEQ ID NO: 76647 - RNA, 22 nt, Human
accugccaccgacggccacuuc

SEQ ID NO: 76648 - RNA, 21 nt, Human
agaaaguccgcagccccaaac

SEQ ID NO: 76649 - RNA, 18 nt, Human
aggaagggccauagagca

SEQ ID NO: 76650 - RNA, 25 nt, Human
agucgggccggggccggccuaggug

SEQ ID NO: 76651 - RNA, 22 nt, Human
cccaaacagugaguuucugagg

SEQ ID NO: 76652 - RNA, 20 nt, Human
ccccaaacagugaguuucug

SEQ ID NO: 76653 - RNA, 20 nt, Human
cccccaaaccugccaccgac

SEQ ID NO: 76654 - RNA, 18 nt, Human
ccccgaggagccgccacc

SEQ ID NO: 76655 - RNA, 18 nt, Human
ccgcagccccaaacagug

SEQ ID NO: 76656 - RNA, 22 nt, Human
cgagaaaguccgcagccccaaa

SEQ ID NO: 76657 - RNA, 22 nt, Human
cgaggagccgccaccgcugucg

SEQ ID NO: 76658 - RNA, 21 nt, Human
gagaaaguccgcagccccaaa

SEQ ID NO: 76659 - RNA, 19 nt, Human
gaggaagggccauagagca

SEQ ID NO: 76660 - RNA, 24 nt, Human
gagucgggccggggccggccuagg

SEQ ID NO: 76661 - RNA, 23 nt, Human
gaguuucugagggcgagucgggc

SEQ ID NO: 76662 - RNA, 21 nt, Human
gccccaaacagugaguuucug

SEQ ID NO: 76663 - RNA, 18 nt, Human
ggccggggccggccuagg

SEQ ID NO: 76664 - RNA, 23 nt, Human
uacuuccggcuccccccaggucc

SEQ ID NO: 76665 - RNA, 27 nt, Human
ucacuuccggucucccccaaaccugcc

SEQ ID NO: 76666 - RNA, 20 nt, Human
ucccccaaaccugccaccga

SEQ ID NO: 76667 - RNA, 23 nt, Human
ugaaggaagaggggggaaacggu

SEQ ID NO: 76668 - RNA, 22 nt, Human
ugccagaaaaauccgacuuuua

SEQ ID NO: 76669 - RNA, 22 nt, Human
ugggagggagccgagcaccccg

SEQ ID NO: 76670 - RNA, 18 nt, Human
uuccggcuccccccaggu

SEQ ID NO: 76671 - RNA, 18 nt, Human
uuuuuuuuuuuuuuuuug

SEQ ID NO: 76672 - RNA, 22 nt, Human
uuuuuuuuuuuuuuuuugccag

SEQ ID NO: 76673 - RNA, 25 nt, Human
aaaaaaaucagccuggcccuuuaag

SEQ ID NO: 76674 - RNA, 22 nt, Human
aaaccacaacccacauuacuug

SEQ ID NO: 76675 - RNA, 22 nt, Human
aaauagccacacggcacgaaga

SEQ ID NO: 76676 - RNA, 19 nt, Human
aacaaaaauagauggguca

SEQ ID NO: 76677 - RNA, 24 nt, Human
aagcccauuuucuggagccaggaa

SEQ ID NO: 76678 - RNA, 20 nt, Human
aagcccauuuucuggagccg

SEQ ID NO: 76679 - RNA, 20 nt, Human
aagggcccaggucagaggcc

SEQ ID NO: 76680 - RNA, 19 nt, Human
aauagaugggucacucccu

SEQ ID NO: 76681 - RNA, 22 nt, Human
acaacaacaaaaaccacaaccc

SEQ ID NO: 76682 - RNA, 22 nt, Human
accacagccucagagaccagua

SEQ ID NO: 76683 - RNA, 18 nt, Human
agaagccguguaaugaaa

SEQ ID NO: 76684 - RNA, 26 nt, Human
agagaccaguaggaaaaaaaaaucag

SEQ ID NO: 76685 - RNA, 23 nt, Human
agaggcccaaguucagacuucag

SEQ ID NO: 76686 - RNA, 22 nt, Human
agcccgucucucacgaagacag

SEQ ID NO: 76687 - RNA, 22 nt, Human
caacaacaaaaaccacaaccca

SEQ ID NO: 76688 - RNA, 23 nt, Human
caacaacaaaaaccacaacccac

SEQ ID NO: 76689 - RNA, 21 nt, Human
caacaacaacaaaaaccacaa

SEQ ID NO: 76690 - RNA, 23 nt, Human
caacaacaacaaaaaccacaacc

SEQ ID NO: 76691 - RNA, 19 nt, Human
cacaacccacauuacuuga

SEQ ID NO: 76692 - RNA, 19 nt, Human
cacaaucaaauagccacac

SEQ ID NO: 76693 - RNA, 25 nt, Human
cacacggcacgaagacgcaugcgug

SEQ ID NO: 76694 - RNA, 19 nt, Human
cacgaagacgcaugcgugg

SEQ ID NO: 76695 - RNA, 27 nt, Human
cagaucccaggaaggggaagucaaagg

SEQ ID NO: 76696 - RNA, 27 nt, Human
ccacaaaugguugauuuauuucugacu

SEQ ID NO: 76697 - RNA, 26 nt, Human
ccacagccucagagaccaguaggaaa

SEQ ID NO: 76698 - RNA, 18 nt, Human
ccaguaggaaaaaaaaau

SEQ ID NO: 76699 - RNA, 18 nt, Human
cccacaaugcccuucgcc

SEQ ID NO: 76700 - RNA, 23 nt, Human
cguggcgacaacaacaacaaaaa

SEQ ID NO: 76701 - RNA, 18 nt, Human
cuggagccaggaauccac

SEQ ID NO: 76702 - RNA, 22 nt, Human
cuuccguaccgcaaaauggcgc

SEQ ID NO: 76703 - RNA, 26 nt, Human
cuuuaagucuuccgcgaucccauuuc

SEQ ID NO: 76704 - RNA, 22 nt, Human
cuuuuacauaacgcccccacaa

SEQ ID NO: 76705 - RNA, 22 nt, Human
gacaacaacaacaaaaaccaca

SEQ ID NO: 76706 - RNA, 23 nt, Human
gacaacaacaacaaaaaccacaa

SEQ ID NO: 76707 - RNA, 18 nt, Human
gcccccacaaugcccuuc

SEQ ID NO: 76708 - RNA, 19 nt, Human
ggaaaaaaaaaucagccug

SEQ ID NO: 76709 - RNA, 18 nt, Human
ggaagucaaagggcccag

SEQ ID NO: 76710 - RNA, 24 nt, Human
ggaucugucgguugggguccuacu

SEQ ID NO: 76711 - RNA, 20 nt, Human
ggcgacaacaacaacaaaaa

SEQ ID NO: 76712 - RNA, 28 nt, Human
ggcgacaacaacaacaaaaaccacaacc

SEQ ID NO: 76713 - RNA, 20 nt, Human
gggaagucaaagggcccagg

SEQ ID NO: 76714 - RNA, 19 nt, Human
guaaacgagcaaagcuccg

SEQ ID NO: 76715 - RNA, 21 nt, Human
guggcgacaacaacaacaaaa

SEQ ID NO: 76716 - RNA, 25 nt, Human
guggugacccuguagcaaccacagc

SEQ ID NO: 76717 - RNA, 22 nt, Human
ucaaauagccacacggcacgaa

SEQ ID NO: 76718 - RNA, 24 nt, Human
ucaauaguaaacgagcaaagcucc

SEQ ID NO: 76719 - RNA, 22 nt, Human
uccguaccgcaaaauggcgcca

SEQ ID NO: 76720 - RNA, 21 nt, Human
ugacacaaucaaauagccaca

SEQ ID NO: 76721 - RNA, 26 nt, Human
ugaccaaaaacuucaggaucugcauc

SEQ ID NO: 76722 - RNA, 18 nt, Human
uggcgacaacaacaacaa

SEQ ID NO: 76723 - RNA, 21 nt, Human
uggcgacaacaacaacaaaaa

SEQ ID NO: 76724 - RNA, 22 nt, Human
ugggagaacugagaaaaugaua

SEQ ID NO: 76725 - RNA, 21 nt, Human
uggugacccuguagcaaccac

SEQ ID NO: 76726 - RNA, 25 nt, Human
uuacauaacgcccccacaaugcccu

SEQ ID NO: 76727 - RNA, 26 nt, Human
uuuacauaacgcccccacaaugcccu

SEQ ID NO: 76728 - RNA, 21 nt, Human
uuuuuaaaccacaaaugguug

SEQ ID NO: 76729 - RNA, 22 nt, Human
uuuuuuaaaccacaaaugguug

SEQ ID NO: 76730 - RNA, 18 nt, Human
aaacuauaaacagcaaca

SEQ ID NO: 76731 - RNA, 25 nt, Human
aaugaggggaaacgugcaagaggaa

SEQ ID NO: 76732 - RNA, 27 nt, Human
agcaacaugaacacagagaaucacaaa

SEQ ID NO: 76733 - RNA, 23 nt, Human
agggucuuuccucaugucuccuc

SEQ ID NO: 76734 - RNA, 20 nt, Human
cauguaaugcaggauguaug

SEQ ID NO: 76735 - RNA, 18 nt, Human
cucgggccgcugcucuuc

SEQ ID NO: 76736 - RNA, 20 nt, Human
ggggauggucccccacuuuc

SEQ ID NO: 76737 - RNA, 18 nt, Human
guaaugcaggauguaugu

SEQ ID NO: 76738 - RNA, 19 nt, Human
gucuccucucaccccauuc

SEQ ID NO: 76739 - RNA, 23 nt, Human
ugaacacagagaaucacaaauaa

SEQ ID NO: 76740 - RNA, 19 nt, Human
ugagaagggggaugguccc

SEQ ID NO: 76741 - RNA, 21 nt, Human
aaaaacacaguccaaggcagc

SEQ ID NO: 76742 - RNA, 21 nt, Human
aaaaacacaguccaaggcagc

SEQ ID NO: 76743 - RNA, 23 nt, Human
aaaaugcccaugucccccaaucc

SEQ ID NO: 76744 - RNA, 23 nt, Human
aaaaugcccaugucccccaaucc

SEQ ID NO: 76745 - RNA, 24 nt, Human
aaaaugcccaugucccccaauccc

SEQ ID NO: 76746 - RNA, 24 nt, Human
aagaccacucuuccccacaccccc

SEQ ID NO: 76747 - RNA, 21 nt, Human
accacucuuccccacaccccc

SEQ ID NO: 76748 - RNA, 21 nt, Human
accacucuuccccacaccccc

SEQ ID NO: 76749 - RNA, 19 nt, Human
agaaaaaugcccauguccc

SEQ ID NO: 76750 - RNA, 19 nt, Human
agaaaaaugcccauguccc

SEQ ID NO: 76751 - RNA, 21 nt, Human
agaaaaaugcccauguccccc

SEQ ID NO: 76752 - RNA, 21 nt, Human
agaaaaaugcccauguccccc

SEQ ID NO: 76753 - RNA, 19 nt, Human
aggaaaaacacaguccaag

SEQ ID NO: 76754 - RNA, 19 nt, Human
aggaaaaacacaguccaag

SEQ ID NO: 76755 - RNA, 20 nt, Human
aggcaguggaggcuccaggg

SEQ ID NO: 76756 - RNA, 23 nt, Human
auggugagcgaggcggugagcac

SEQ ID NO: 76757 - RNA, 20 nt, Human
caagucaaggucacagugag

SEQ ID NO: 76758 - RNA, 21 nt, Human
caauccccaccccucccagaa

SEQ ID NO: 76759 - RNA, 21 nt, Human
caauccccaccccucccagaa

SEQ ID NO: 76760 - RNA, 18 nt, Human
cacaccccccaauaauua

SEQ ID NO: 76761 - RNA, 23 nt, Human
caccgccgcucccgccgccgccu

SEQ ID NO: 76762 - RNA, 18 nt, Human
cacugggaggucagcagg

SEQ ID NO: 76763 - RNA, 20 nt, Human
cacugggaggucagcagggu

SEQ ID NO: 76764 - RNA, 21 nt, Human
cagcccaacagccgcucccgg

SEQ ID NO: 76765 - RNA, 18 nt, Human
ccaccccucccagaaaaa

SEQ ID NO: 76766 - RNA, 19 nt, Human
ccaccccucccagaaaaau

SEQ ID NO: 76767 - RNA, 19 nt, Human
ccaccccucccagaaaaau

SEQ ID NO: 76768 - RNA, 21 nt, Human
ccacucuuccccacacccccc

SEQ ID NO: 76769 - RNA, 21 nt, Human
ccacucuuccccacacccccc

SEQ ID NO: 76770 - RNA, 19 nt, Human
ccagggagggcagaaggca

SEQ ID NO: 76771 - RNA, 20 nt, Human
ccccaauccccaccccuccc

SEQ ID NO: 76772 - RNA, 20 nt, Human
ccccaauccccaccccuccc

SEQ ID NO: 76773 - RNA, 21 nt, Human
ccccaauccccaccccuccca

SEQ ID NO: 76774 - RNA, 21 nt, Human
ccccaauccccaccccuccca

SEQ ID NO: 76775 - RNA, 23 nt, Human
ccccaauccccaccccucccaga

SEQ ID NO: 76776 - RNA, 23 nt, Human
ccccaauccccaccccucccaga

SEQ ID NO: 76777 - RNA, 24 nt, Human
cccccaauccccaccccucccaga

SEQ ID NO: 76778 - RNA, 24 nt, Human
cccccaauccccaccccucccaga

SEQ ID NO: 76779 - RNA, 20 nt, Human
ccgccgcucccgccgccgcc

SEQ ID NO: 76780 - RNA, 20 nt, Human
ccgcucccgccgccgccucu

SEQ ID NO: 76781 - RNA, 20 nt, Human
ccgcucccgccgccgccucu

SEQ ID NO: 76782 - RNA, 20 nt, Human
ccucaagaccacucuucccc

SEQ ID NO: 76783 - RNA, 20 nt, Human
ccucaagaccacucuucccc

SEQ ID NO: 76784 - RNA, 20 nt, Human
ccucaagaccacucuucccc

SEQ ID NO: 76785 - RNA, 20 nt, Human
ccucaagaccacucuucccc

SEQ ID NO: 76786 - RNA, 18 nt, Human
cggaggaaguccaauguc

SEQ ID NO: 76787 - RNA, 21 nt, Human
cuccagggagggcagaaggca

SEQ ID NO: 76788 - RNA, 19 nt, Human
cucccgccgccgccucucg

SEQ ID NO: 76789 - RNA, 20 nt, Human
cuuggauccagcccaacagc

SEQ ID NO: 76790 - RNA, 20 nt, Human
gaaaaaugcccauguccccc

SEQ ID NO: 76791 - RNA, 20 nt, Human
gaaaaaugcccauguccccc

SEQ ID NO: 76792 - RNA, 21 nt, Human
gaccacucuuccccacacccc

SEQ ID NO: 76793 - RNA, 21 nt, Human
gaccacucuuccccacacccc

SEQ ID NO: 76794 - RNA, 19 nt, Human
gagcacucccgccacaaag

SEQ ID NO: 76795 - RNA, 18 nt, Human
gcccaugucccccaaucc

SEQ ID NO: 76796 - RNA, 18 nt, Human
gcccaugucccccaaucc

SEQ ID NO: 76797 - RNA, 21 nt, Human
gcccaugucccccaaucccca

SEQ ID NO: 76798 - RNA, 21 nt, Human
gcccaugucccccaaucccca

SEQ ID NO: 76799 - RNA, 27 nt, Human
ggaaaaacacaguccaaggcagcuggg

SEQ ID NO: 76800 - RNA, 27 nt, Human
ggaaaaacacaguccaaggcagcuggg

SEQ ID NO: 76801 - RNA, 21 nt, Human
ggaggaaaaacacaguccaag

SEQ ID NO: 76802 - RNA, 21 nt, Human
ggaggaaaaacacaguccaag

SEQ ID NO: 76803 - RNA, 24 nt, Human
ggucagagggucaucaaugaacuu

SEQ ID NO: 76804 - RNA, 23 nt, Human
guccaaggcagcugggggccuca

SEQ ID NO: 76805 - RNA, 24 nt, Human
guccaaggcagcugggggccucag

SEQ ID NO: 76806 - RNA, 20 nt, Human
uacaaaaguaagaaaaaugc

SEQ ID NO: 76807 - RNA, 20 nt, Human
uacaaaaguaagaaaaaugc

SEQ ID NO: 76808 - RNA, 19 nt, Human
uccagauggugagcgaggc

SEQ ID NO: 76809 - RNA, 23 nt, Human
ucccaaaguaggagaggaggccg

SEQ ID NO: 76810 - RNA, 26 nt, Human
ugcccaugucccccaauccccacccc

SEQ ID NO: 76811 - RNA, 26 nt, Human
ugcccaugucccccaauccccacccc

SEQ ID NO: 76812 - RNA, 21 nt, Human
ugucccccaauccccaccccu

SEQ ID NO: 76813 - RNA, 21 nt, Human
ugucccccaauccccaccccu

SEQ ID NO: 76814 - RNA, 19 nt, Human
uugagcaauuccagaggca

SEQ ID NO: 76815 - RNA, 19 nt, Human
uuuuuuuuuuuuuuugugu

SEQ ID NO: 76816 - RNA, 18 nt, Human
uuuuuuuuuuuuuuuuug

SEQ ID NO: 76817 - RNA, 19 nt, Human
uuuuuuuuuuuuuuuuugu

SEQ ID NO: 76818 - RNA, 19 nt, Human
uuuuuuuuuuuuuuuuugu

SEQ ID NO: 76819 - RNA, 27 nt, Human
uuuuuuuuuuuuuuuuuuuuuuugggg

SEQ ID NO: 76820 - RNA, 21 nt, Human
auaaacacauggcuaacaaag

SEQ ID NO: 76821 - RNA, 19 nt, Human
ccuucaagucuggcacaga

SEQ ID NO: 76822 - RNA, 22 nt, Human
cuucaagucuggcacagacucu

SEQ ID NO: 76823 - RNA, 22 nt, Human
uaaacacauggcuaacaaagua

SEQ ID NO: 76824 - RNA, 23 nt, Human
aaaaaaaaaaaacaacaacaaac

SEQ ID NO: 76825 - RNA, 28 nt, Human
aaacaacaacaaacaauucaggugucac

SEQ ID NO: 76826 - RNA, 18 nt, Human
aaagaccacaacuguuuu

SEQ ID NO: 76827 - RNA, 18 nt, Human
aaauucuuccugcuuuuc

SEQ ID NO: 76828 - RNA, 24 nt, Human
aacacauuaucauagaaacuguac

SEQ ID NO: 76829 - RNA, 23 nt, Human
aagacaauaaaaaaaaaaaacaa

SEQ ID NO: 76830 - RNA, 24 nt, Human
aaguacaugagguuuauuugaaau

SEQ ID NO: 76831 - RNA, 25 nt, Human
aauaaaaaaaaaaaacaacaacaaa

SEQ ID NO: 76832 - RNA, 23 nt, Human
aaugagccuccaacccaacugcc

SEQ ID NO: 76833 - RNA, 20 nt, Human
acacaauucuguauggcacu

SEQ ID NO: 76834 - RNA, 22 nt, Human
acacagcacugcccugcucccc

SEQ ID NO: 76835 - RNA, 20 nt, Human
acaccgccgcgccucccagc

SEQ ID NO: 76836 - RNA, 24 nt, Human
acagcacugcccugcucccccucc

SEQ ID NO: 76837 - RNA, 22 nt, Human
acuaggccccgcggcccggagc

SEQ ID NO: 76838 - RNA, 19 nt, Human
agaguggaugggcugaagg

SEQ ID NO: 76839 - RNA, 20 nt, Human
aggcaggggaagcuggcggu

SEQ ID NO: 76840 - RNA, 21 nt, Human
aggggaagcuggcgguggugg

SEQ ID NO: 76841 - RNA, 22 nt, Human
aggugauaaaaaagaaaaaccc

SEQ ID NO: 76842 - RNA, 22 nt, Human
auucaaaggugauaaaaaagaa

SEQ ID NO: 76843 - RNA, 26 nt, Human
caacucaaaagaccacaacuguuuua

SEQ ID NO: 76844 - RNA, 21 nt, Human
caagaucaacucaaaagacca

SEQ ID NO: 76845 - RNA, 18 nt, Human
caagcaacuuuuaauaac

SEQ ID NO: 76846 - RNA, 20 nt, Human
caaguacaugagguuuauuu

SEQ ID NO: 76847 - RNA, 23 nt, Human
caaguacaugagguuuauuugaa

SEQ ID NO: 76848 - RNA, 18 nt, Human
cacuaggccccgcggccc

SEQ ID NO: 76849 - RNA, 22 nt, Human
cagcagccccccgccgaccucc

SEQ ID NO: 76850 - RNA, 22 nt, Human
cagccccccgccgaccuccgcu

SEQ ID NO: 76851 - RNA, 27 nt, Human
caucaaaguaaagguuauaugcaugau

SEQ ID NO: 76852 - RNA, 18 nt, Human
cauguucuaggagcugca

SEQ ID NO: 76853 - RNA, 18 nt, Human
ccccccgccgaccuccgc

SEQ ID NO: 76854 - RNA, 22 nt, Human
cccgcgcacaccgccgcgccuc

SEQ ID NO: 76855 - RNA, 24 nt, Human
cccgcgcacaccgccgcgccuccc

SEQ ID NO: 76856 - RNA, 19 nt, Human
cccgcggcccggagcgagc

SEQ ID NO: 76857 - RNA, 22 nt, Human
ccgccgcgccucccagcagccc

SEQ ID NO: 76858 - RNA, 21 nt, Human
ccgcucucuccucccaccccc

SEQ ID NO: 76859 - RNA, 28 nt, Human
ccggcggccggcagucacgacuccuccu

SEQ ID NO: 76860 - RNA, 24 nt, Human
ccucccaccccccaccgacacuga

SEQ ID NO: 76861 - RNA, 28 nt, Human
ccucuuugaagacaauaaaaaaaaaaaa

SEQ ID NO: 76862 - RNA, 23 nt, Human
ccuuuaauggggcccuuccucuu

SEQ ID NO: 76863 - RNA, 18 nt, Human
cgcccggggguggggugg

SEQ ID NO: 76864 - RNA, 21 nt, Human
cgccgcgccucccagcagccc

SEQ ID NO: 76865 - RNA, 24 nt, Human
cggaacgccacggcgcagaguucc

SEQ ID NO: 76866 - RNA, 20 nt, Human
cggaggaagcagaggccaca

SEQ ID NO: 76867 - RNA, 20 nt, Human
cggcccggagcgagcgccag

SEQ ID NO: 76868 - RNA, 19 nt, Human
cggcggcggcggugggacu

SEQ ID NO: 76869 - RNA, 18 nt, Human
cuaaagcaagaugucagg

SEQ ID NO: 76870 - RNA, 18 nt, Human
cucacugauacugucacc

SEQ ID NO: 76871 - RNA, 20 nt, Human
cucccaccccccaccgacac

SEQ ID NO: 76872 - RNA, 23 nt, Human
cucucuccucccaccccccaccg

SEQ ID NO: 76873 - RNA, 19 nt, Human
cugcccugcucccccucca

SEQ ID NO: 76874 - RNA, 19 nt, Human
cugccgcucucuccuccca

SEQ ID NO: 76875 - RNA, 18 nt, Human
cuugaggaguuccaaggc

SEQ ID NO: 76876 - RNA, 24 nt, Human
cuuuaaauagguacagaagagcuu

SEQ ID NO: 76877 - RNA, 19 nt, Human
gaagcuggcgguggugggg

SEQ ID NO: 76878 - RNA, 21 nt, Human
gaagcugugaugucagugcca

SEQ ID NO: 76879 - RNA, 20 nt, Human
gaagggaggggugagagggc

SEQ ID NO: 76880 - RNA, 19 nt, Human
gagaguggaugggcugaag

SEQ ID NO: 76881 - RNA, 22 nt, Human
gagcaaacacauuaucauagaa

SEQ ID NO: 76882 - RNA, 19 nt, Human
gaguucccgcgcacaccgc

SEQ ID NO: 76883 - RNA, 24 nt, Human
gcagccccccgccgaccuccgcuu

SEQ ID NO: 76884 - RNA, 19 nt, Human
gcaggaggacggaggaagc

SEQ ID NO: 76885 - RNA, 23 nt, Human
gccaggcgcccggggguggggug

SEQ ID NO: 76886 - RNA, 18 nt, Human
gccgcgccucccagcagc

SEQ ID NO: 76887 - RNA, 22 nt, Human
gcggcgcagcacuaggccccgc

SEQ ID NO: 76888 - RNA, 23 nt, Human
gcggcggcggcggugggacuggc

SEQ ID NO: 76889 - RNA, 18 nt, Human
gcggugggacuggcggcu

SEQ ID NO: 76890 - RNA, 22 nt, Human
gcucucuccucccaccccccac

SEQ ID NO: 76891 - RNA, 18 nt, Human
ggaaguuagagcaaacac

SEQ ID NO: 76892 - RNA, 19 nt, Human
ggaaucuucagguucuuga

SEQ ID NO: 76893 - RNA, 21 nt, Human
ggagaagccagggaaguuaga

SEQ ID NO: 76894 - RNA, 19 nt, Human
ggccagauccaucaaagua

SEQ ID NO: 76895 - RNA, 21 nt, Human
ggcccggagcgagcgccaggc

SEQ ID NO: 76896 - RNA, 21 nt, Human
ggcgcggccgcgcgacaguca

SEQ ID NO: 76897 - RNA, 19 nt, Human
gggcaugggaggcagcaga

SEQ ID NO: 76898 - RNA, 25 nt, Human
gggcugaaggagaagccagggaagu

SEQ ID NO: 76899 - RNA, 27 nt, Human
gggggggugggaggagcugucacaaag

SEQ ID NO: 76900 - RNA, 19 nt, Human
ggggugggggaagggaggg

SEQ ID NO: 76901 - RNA, 20 nt, Human
gggguggggugggggaaggg

SEQ ID NO: 76902 - RNA, 19 nt, Human
gggugggggaagggagggg

SEQ ID NO: 76903 - RNA, 23 nt, Human
ggguggggugggggaagggaggg

SEQ ID NO: 76904 - RNA, 24 nt, Human
ggguggggugggggaagggagggg

SEQ ID NO: 76905 - RNA, 18 nt, Human
gguaaacuacccagcagc

SEQ ID NO: 76906 - RNA, 18 nt, Human
gucagaacgggcauggga

SEQ ID NO: 76907 - RNA, 23 nt, Human
gucauggagcggaacgccacggc

SEQ ID NO: 76908 - RNA, 22 nt, Human
guuuuguuuuuuuguuuuuugu

SEQ ID NO: 76909 - RNA, 20 nt, Human
uaaauagguacagaagagcu

SEQ ID NO: 76910 - RNA, 23 nt, Human
uacaauaucacugcugaaacaag

SEQ ID NO: 76911 - RNA, 19 nt, Human
uacacaauucuguauggca

SEQ ID NO: 76912 - RNA, 23 nt, Human
uacuguacaugugcuaaagcaag

SEQ ID NO: 76913 - RNA, 19 nt, Human
uaggaggcaggggaagcug

SEQ ID NO: 76914 - RNA, 25 nt, Human
ucaaaagaccacaacuguuuuauga

SEQ ID NO: 76915 - RNA, 22 nt, Human
uccaaauucaaaggugauaaaa

SEQ ID NO: 76916 - RNA, 18 nt, Human
uccaacaccccucuggcc

SEQ ID NO: 76917 - RNA, 23 nt, Human
uccaacaccccucuggccagauc

SEQ ID NO: 76918 - RNA, 24 nt, Human
uccaacaccccucuggccagaucc

SEQ ID NO: 76919 - RNA, 28 nt, Human
uccaaggcugaggucagaaccggggucc

SEQ ID NO: 76920 - RNA, 25 nt, Human
uccuugggcaggaggacggaggaag

SEQ ID NO: 76921 - RNA, 19 nt, Human
ucucacuaugaacaagaac

SEQ ID NO: 76922 - RNA, 28 nt, Human
ucucacuaugaacaagaacagacuggau

SEQ ID NO: 76923 - RNA, 24 nt, Human
ucucuaagugaagugccuuaguuu

SEQ ID NO: 76924 - RNA, 21 nt, Human
ucucugccgcucucuccuccc

SEQ ID NO: 76925 - RNA, 19 nt, Human
ucugccgcucucuccuccc

SEQ ID NO: 76926 - RNA, 23 nt, Human
ugaagacaauaaaaaaaaaaaac

SEQ ID NO: 76927 - RNA, 22 nt, Human
ugaagcugugaugucagugcca

SEQ ID NO: 76928 - RNA, 23 nt, Human
ugacugguaugugggugggcugg

SEQ ID NO: 76929 - RNA, 22 nt, Human
ugagccuccaacccaacugcuc

SEQ ID NO: 76930 - RNA, 25 nt, Human
ugagccuccaacccaacugcucuag

SEQ ID NO: 76931 - RNA, 18 nt, Human
ugaggaguuccaaggcug

SEQ ID NO: 76932 - RNA, 20 nt, Human
ugauuauaagcaggacucca

SEQ ID NO: 76933 - RNA, 18 nt, Human
ugcucaaaauuuccaaau

SEQ ID NO: 76934 - RNA, 19 nt, Human
uggaugggcugaaggagaa

SEQ ID NO: 76935 - RNA, 24 nt, Human
uggaugggcugaaggagaagccag

SEQ ID NO: 76936 - RNA, 18 nt, Human
uggauguaggaggcagga

SEQ ID NO: 76937 - RNA, 21 nt, Human
ugggaggcagcagacacagca

SEQ ID NO: 76938 - RNA, 20 nt, Human
ugggcugaaggagaagccag

SEQ ID NO: 76939 - RNA, 26 nt, Human
ugggcugaaggagaagccagggaagu

SEQ ID NO: 76940 - RNA, 18 nt, Human
ugggggaagggaggggug

SEQ ID NO: 76941 - RNA, 24 nt, Human
ugggggaagggaggggugagaggg

SEQ ID NO: 76942 - RNA, 20 nt, Human
uggggugggggaagggaggg

SEQ ID NO: 76943 - RNA, 18 nt, Human
ugggugggcugggcucca

SEQ ID NO: 76944 - RNA, 22 nt, Human
ugguaugugggugggcugggcu

SEQ ID NO: 76945 - RNA, 26 nt, Human
ugucacaaagaaggggagauucagga

SEQ ID NO: 76946 - RNA, 24 nt, Human
ugucacugaagugggaacacagga

SEQ ID NO: 76947 - RNA, 26 nt, Human
ugugguuuuuuuauuuuuuggggggg

SEQ ID NO: 76948 - RNA, 19 nt, Human
uguugugggggaaggggcu

SEQ ID NO: 76949 - RNA, 19 nt, Human
uuaaauagguacagaagag

SEQ ID NO: 76950 - RNA, 26 nt, Human
uuaguuuuguuuuuuuguuuuuugug

SEQ ID NO: 76951 - RNA, 26 nt, Human
uucaaaggugauaaaaaagaaaaacc

SEQ ID NO: 76952 - RNA, 19 nt, Human
uucccgcgcacaccgccgc

SEQ ID NO: 76953 - RNA, 20 nt, Human
uucucacuaugaacaagaac

SEQ ID NO: 76954 - RNA, 18 nt, Human
uuguugugggggaagggg

SEQ ID NO: 76955 - RNA, 18 nt, Human
uuuuuguuuuuugugguu

SEQ ID NO: 76956 - RNA, 22 nt, Human
aaaaagugaugguuuuaaacaa

SEQ ID NO: 76957 - RNA, 19 nt, Human
aaaauccaccuagcucaag

SEQ ID NO: 76958 - RNA, 24 nt, Human
aaaccugcuuucccuaccaaauac

SEQ ID NO: 76959 - RNA, 21 nt, Human
aaagcaaaaaaaaaucucaaa

SEQ ID NO: 76960 - RNA, 20 nt, Human
aaaggaauaaaggggcugcc

SEQ ID NO: 76961 - RNA, 23 nt, Human
aaauaaccccagaaugcuggggc

SEQ ID NO: 76962 - RNA, 20 nt, Human
aacauuucuuggaugccuca

SEQ ID NO: 76963 - RNA, 23 nt, Human
aaccccuccucccuacucuccug

SEQ ID NO: 76964 - RNA, 20 nt, Human
aaccuggaggauggaaaggu

SEQ ID NO: 76965 - RNA, 26 nt, Human
aagaaagacagcgagaagcagggaag

SEQ ID NO: 76966 - RNA, 20 nt, Human
aagacagggaccucugaacc

SEQ ID NO: 76967 - RNA, 21 nt, Human
aagaugcacagucugaagagg

SEQ ID NO: 76968 - RNA, 18 nt, Human
aagcacuuuucuacagcu

SEQ ID NO: 76969 - RNA, 18 nt, Human
aagcagggaagggacuga

SEQ ID NO: 76970 - RNA, 25 nt, Human
aagcagggggccaagugcccauggc

SEQ ID NO: 76971 - RNA, 22 nt, Human
aaggacuccucucugcaccucu

SEQ ID NO: 76972 - RNA, 22 nt, Human
aaggcagugauggacccagaac

SEQ ID NO: 76973 - RNA, 24 nt, Human
aaucacugaaacccaagaggcaga

SEQ ID NO: 76974 - RNA, 20 nt, Human
aaugcuggggcacguacagg

SEQ ID NO: 76975 - RNA, 19 nt, Human
aauuucacucccccaucca

SEQ ID NO: 76976 - RNA, 23 nt, Human
acaaaaaugaccaggagagagac

SEQ ID NO: 76977 - RNA, 23 nt, Human
acacacacacacacacacacaca

SEQ ID NO: 76978 - RNA, 23 nt, Human
acacacacacacacacacacaca

SEQ ID NO: 76979 - RNA, 23 nt, Human
acacacacacacacacacacaca

SEQ ID NO: 76980 - RNA, 23 nt, Human
acacacacacacacacacacaca

SEQ ID NO: 76981 - RNA, 21 nt, Human
acacacacacacacacacggc

SEQ ID NO: 76982 - RNA, 25 nt, Human
acacacacacacacauacacacaca

SEQ ID NO: 76983 - RNA, 23 nt, Human
acacacacacauacacacacaca

SEQ ID NO: 76984 - RNA, 23 nt, Human
acacacacauacacacacacaca

SEQ ID NO: 76985 - RNA, 20 nt, Human
acccguaaucucugaaggga

SEQ ID NO: 76986 - RNA, 23 nt, Human
accuagcucaagggggcagugag

SEQ ID NO: 76987 - RNA, 18 nt, Human
acucccccauccaccuca

SEQ ID NO: 76988 - RNA, 19 nt, Human
acucccccauccaccucac

SEQ ID NO: 76989 - RNA, 22 nt, Human
agaaaaaucacugaaacccaag

SEQ ID NO: 76990 - RNA, 21 nt, Human
agaaaauccaccuagcucaag

SEQ ID NO: 76991 - RNA, 24 nt, Human
agaaaaucugaaaacuggggggug

SEQ ID NO: 76992 - RNA, 28 nt, Human
agaaagaaauaaauuuaaauucacaaaa

SEQ ID NO: 76993 - RNA, 21 nt, Human
agaaagacagcgagaagcagg

SEQ ID NO: 76994 - RNA, 22 nt, Human
agaagacagggaccucugaaca

SEQ ID NO: 76995 - RNA, 26 nt, Human
agacacacacacacacacacagcgcg

SEQ ID NO: 76996 - RNA, 18 nt, Human
agagaaaauccaccuagc

SEQ ID NO: 76997 - RNA, 22 nt, Human
agagaaaaucugaaaacugggg

SEQ ID NO: 76998 - RNA, 24 nt, Human
agaggagggaagggagaaagggau

SEQ ID NO: 76999 - RNA, 19 nt, Human
agcagcuuuccucucgugu

SEQ ID NO: 77000 - RNA, 22 nt, Human
agcaggaaaagcagggggccaa

SEQ ID NO: 77001 - RNA, 19 nt, Human
agccagcagccaccucccc

SEQ ID NO: 77002 - RNA, 24 nt, Human
agccugggcaauaagaagaaaucu

SEQ ID NO: 77003 - RNA, 19 nt, Human
agcuccaggcugggaccac

SEQ ID NO: 77004 - RNA, 20 nt, Human
agcuggugauggucccauua

SEQ ID NO: 77005 - RNA, 20 nt, Human
aggaagcacggaggaggaag

SEQ ID NO: 77006 - RNA, 20 nt, Human
aggagggaagggagaaaggg

SEQ ID NO: 77007 - RNA, 23 nt, Human
aggcagagguugaguaagcugag

SEQ ID NO: 77008 - RNA, 18 nt, Human
aggcaggaccuggaugca

SEQ ID NO: 77009 - RNA, 20 nt, Human
aggcugggaccacccagcuc

SEQ ID NO: 77010 - RNA, 20 nt, Human
agggggcagugaagaugagg

SEQ ID NO: 77011 - RNA, 18 nt, Human
auccuaucaaacaauaca

SEQ ID NO: 77012 - RNA, 23 nt, Human
augacccuuuccaucccacacag

SEQ ID NO: 77013 - RNA, 20 nt, Human
auucaacaacugacaagcac

SEQ ID NO: 77014 - RNA, 18 nt, Human
auugcacucaagccuggg

SEQ ID NO: 77015 - RNA, 24 nt, Human
auugcacucaagccugggcaauaa

SEQ ID NO: 77016 - RNA, 23 nt, Human
auuuuuuucuuucuuuuuuuggc

SEQ ID NO: 77017 - RNA, 19 nt, Human
caaauaaaacagaaaagaa

SEQ ID NO: 77018 - RNA, 21 nt, Human
caaauaaaacagaaaagaaaa

SEQ ID NO: 77019 - RNA, 18 nt, Human
caacagaaggugcagacc

SEQ ID NO: 77020 - RNA, 19 nt, Human
caacauucuauaacugaua

SEQ ID NO: 77021 - RNA, 21 nt, Human
caagggaaaauugccaggggg

SEQ ID NO: 77022 - RNA, 21 nt, Human
caagggggcagugaagaugag

SEQ ID NO: 77023 - RNA, 21 nt, Human
caauuucacucccccauccac

SEQ ID NO: 77024 - RNA, 18 nt, Human
cacacacacacacacaca

SEQ ID NO: 77025 - RNA, 20 nt, Human
cacacacacacacacacaca

SEQ ID NO: 77026 - RNA, 20 nt, Human
cacacacacacacacacaca

SEQ ID NO: 77027 - RNA, 20 nt, Human
cacacacacacacacacaca

SEQ ID NO: 77028 - RNA, 20 nt, Human
cacacacacacacacacaca

SEQ ID NO: 77029 - RNA, 20 nt, Human
cacacacacacacacacaca

SEQ ID NO: 77030 - RNA, 20 nt, Human
cacacacacacacacacaca

SEQ ID NO: 77031 - RNA, 20 nt, Human
cacacacacacacacacaca

SEQ ID NO: 77032 - RNA, 20 nt, Human
cacacacacacacacacaca

SEQ ID NO: 77033 - RNA, 20 nt, Human
cacacacacacacacacaca

SEQ ID NO: 77034 - RNA, 22 nt, Human
cacacacacacacacacacaca

SEQ ID NO: 77035 - RNA, 22 nt, Human
cacacacacacacacacacaca

SEQ ID NO: 77036 - RNA, 22 nt, Human
cacacacacacacacacacaca

SEQ ID NO: 77037 - RNA, 27 nt, Human
cacacacacacacacacacacugcgcg

SEQ ID NO: 77038 - RNA, 26 nt, Human
cacacacacacacagcgcguugugug

SEQ ID NO: 77039 - RNA, 24 nt, Human
cacacacacacauacacacacaca

SEQ ID NO: 77040 - RNA, 24 nt, Human
cacacacacacugcgcgcugugug

SEQ ID NO: 77041 - RNA, 22 nt, Human
cacacauacacacacacacaca

SEQ ID NO: 77042 - RNA, 20 nt, Human
cacacugcgcgcugugugug

SEQ ID NO: 77043 - RNA, 24 nt, Human
cacagcuccaggcugggaccaccc

SEQ ID NO: 77044 - RNA, 19 nt, Human
cacauggcaaaaacaggag

SEQ ID NO: 77045 - RNA, 19 nt, Human
cacccucuccucuuccacc

SEQ ID NO: 77046 - RNA, 21 nt, Human
caccuggcacccccacccccc

SEQ ID NO: 77047 - RNA, 18 nt, Human
cacugccaagggcaaggu

SEQ ID NO: 77048 - RNA, 18 nt, Human
cagaaacuuguugguguu

SEQ ID NO: 77049 - RNA, 24 nt, Human
cagaaccccuccucccuacucucc

SEQ ID NO: 77050 - RNA, 29 nt, Human
cagaaggugcagaccguguugguggcgac

SEQ ID NO: 77051 - RNA, 22 nt, Human
cagccagcagccaccuccccag

SEQ ID NO: 77052 - RNA, 24 nt, Human
caggaggccgaggcagaaaaauca

SEQ ID NO: 77053 - RNA, 21 nt, Human
caggcuggcacagcuccaggc

SEQ ID NO: 77054 - RNA, 24 nt, Human
cagggaccucugaacauuuuuuuu

SEQ ID NO: 77055 - RNA, 24 nt, Human
cagugauggacccagaaccccucc

SEQ ID NO: 77056 - RNA, 25 nt, Human
cagugcugccagaauacaaggaaug

SEQ ID NO: 77057 - RNA, 23 nt, Human
caugaagagaaaauccaccuagc

SEQ ID NO: 77058 - RNA, 18 nt, Human
cauugcacucaagccugg

SEQ ID NO: 77059 - RNA, 19 nt, Human
cauugcacucaagccuggg

SEQ ID NO: 77060 - RNA, 19 nt, Human
cauugcacucaagccuggg

SEQ ID NO: 77061 - RNA, 19 nt, Human
cauugcacucaagccuggg

SEQ ID NO: 77062 - RNA, 22 nt, Human
cauugcacucaagccugggcaa

SEQ ID NO: 77063 - RNA, 22 nt, Human
cauugcacucaagccugggcaa

SEQ ID NO: 77064 - RNA, 23 nt, Human
cauugcacucaagccugggcaau

SEQ ID NO: 77065 - RNA, 24 nt, Human
cauugcacucaagccugggcaaua

SEQ ID NO: 77066 - RNA, 22 nt, Human
cauuucuuggaugccucagcuc

SEQ ID NO: 77067 - RNA, 24 nt, Human
ccaaccccgcuccagcccccacug

SEQ ID NO: 77068 - RNA, 20 nt, Human
ccaccuagcucaagggggca

SEQ ID NO: 77069 - RNA, 24 nt, Human
ccaccucuuaaaagcaaaaaaaaa

SEQ ID NO: 77070 - RNA, 21 nt, Human
ccagacauuuaggcgggagca

SEQ ID NO: 77071 - RNA, 21 nt, Human
ccauaugagugccuggucccu

SEQ ID NO: 77072 - RNA, 22 nt, Human
ccccaaccccgcuccagccccc

SEQ ID NO: 77073 - RNA, 22 nt, Human
ccccaggaccuacacugccccu

SEQ ID NO: 77074 - RNA, 24 nt, Human
ccccccuuugcuuccagcaacuca

SEQ ID NO: 77075 - RNA, 18 nt, Human
ccccuuccacccucuccu

SEQ ID NO: 77076 - RNA, 21 nt, Human
cccugagccucaagacaccuc

SEQ ID NO: 77077 - RNA, 22 nt, Human
ccucacuguccuugggccucca

SEQ ID NO: 77078 - RNA, 19 nt, Human
ccuccccagugcaaguacc

SEQ ID NO: 77079 - RNA, 23 nt, Human
cgagaagcagggaagggacugaa

SEQ ID NO: 77080 - RNA, 24 nt, Human
cgaggcagaaaaaucacugaaacc

SEQ ID NO: 77081 - RNA, 22 nt, Human
cuaccacccccaaccccgcucc

SEQ ID NO: 77082 - RNA, 22 nt, Human
cuagcaagaaucaaaaagccag

SEQ ID NO: 77083 - RNA, 24 nt, Human
cucaagacuccucccuuagcuacu

SEQ ID NO: 77084 - RNA, 24 nt, Human
cucacaauuucacucccccaucca

SEQ ID NO: 77085 - RNA, 20 nt, Human
cuccaccucaccuggcaccc

SEQ ID NO: 77086 - RNA, 23 nt, Human
cuccagggucucugcugcugggg

SEQ ID NO: 77087 - RNA, 23 nt, Human
cucccaaacugugagcugggaac

SEQ ID NO: 77088 - RNA, 18 nt, Human
cucccugcccucucccca

SEQ ID NO: 77089 - RNA, 18 nt, Human
cuccugugcuccaggguc

SEQ ID NO: 77090 - RNA, 22 nt, Human
cucucugugaggccggccccau

SEQ ID NO: 77091 - RNA, 18 nt, Human
cugccccuacccccuuca

SEQ ID NO: 77092 - RNA, 23 nt, Human
cuguccuugggccuccacuucac

SEQ ID NO: 77093 - RNA, 18 nt, Human
cuugaggagcaagaggag

SEQ ID NO: 77094 - RNA, 19 nt, Human
gaagagagggaguuccugc

SEQ ID NO: 77095 - RNA, 21 nt, Human
gaagaugaauacacagagucu

SEQ ID NO: 77096 - RNA, 19 nt, Human
gaauccccccuuugcuucc

SEQ ID NO: 77097 - RNA, 21 nt, Human
gacccagggcagcaucagcag

SEQ ID NO: 77098 - RNA, 18 nt, Human
gacuccucucugcaccuc

SEQ ID NO: 77099 - RNA, 18 nt, Human
gagaagcagggaagggac

SEQ ID NO: 77100 - RNA, 21 nt, Human
gagaggaagcacggaggagga

SEQ ID NO: 77101 - RNA, 18 nt, Human
gagcauccaacaucauac

SEQ ID NO: 77102 - RNA, 26 nt, Human
gaggggcucugcugagcaggaaaagc

SEQ ID NO: 77103 - RNA, 21 nt, Human
gaguucccaagaggguuuggg

SEQ ID NO: 77104 - RNA, 19 nt, Human
gauuucacucccccaucca

SEQ ID NO: 77105 - RNA, 24 nt, Human
gcaccucuuacuugaggagcaaga

SEQ ID NO: 77106 - RNA, 22 nt, Human
gcagaaaaaucacugaaaccca

SEQ ID NO: 77107 - RNA, 18 nt, Human
gcaggaccuggaugcacu

SEQ ID NO: 77108 - RNA, 24 nt, Human
gccagaauacaaggaaugcuccag

SEQ ID NO: 77109 - RNA, 18 nt, Human
ggaaaagcagggggccaa

SEQ ID NO: 77110 - RNA, 18 nt, Human
ggaaagagauggagcugg

SEQ ID NO: 77111 - RNA, 20 nt, Human
ggaaagagauggagcuggga

SEQ ID NO: 77112 - RNA, 25 nt, Human
ggaaagagauggagcugggagagga

SEQ ID NO: 77113 - RNA, 18 nt, Human
ggaaggagguggggaagg

SEQ ID NO: 77114 - RNA, 23 nt, Human
ggaggaaguagggacgacuuucc

SEQ ID NO: 77115 - RNA, 18 nt, Human
ggcuggaaacucagcaug

SEQ ID NO: 77116 - RNA, 26 nt, Human
gggaaagagauggagcugggagagga

SEQ ID NO: 77117 - RNA, 21 nt, Human
gggaagcaaaagggcaggggg

SEQ ID NO: 77118 - RNA, 19 nt, Human
gggaaggagguggggaagg

SEQ ID NO: 77119 - RNA, 23 nt, Human
gggaaggagguggggaaggaggu

SEQ ID NO: 77120 - RNA, 26 nt, Human
gggaaggagguggggaaggagguugg

SEQ ID NO: 77121 - RNA, 18 nt, Human
ggggaagggguccugggg

SEQ ID NO: 77122 - RNA, 18 nt, Human
gggggugggaggugggaa

SEQ ID NO: 77123 - RNA, 23 nt, Human
gucaggcuggcacagcuccaggc

SEQ ID NO: 77124 - RNA, 24 nt, Human
gucauugcacucaagccugggcaa

SEQ ID NO: 77125 - RNA, 19 nt, Human
gugaaacuuuaaaaaacag

SEQ ID NO: 77126 - RNA, 20 nt, Human
guggaacaucacauggcaaa

SEQ ID NO: 77127 - RNA, 21 nt, Human
uaaaaggaacacagaaacuug

SEQ ID NO: 77128 - RNA, 18 nt, Human
uaaccccagaaugcuggg

SEQ ID NO: 77129 - RNA, 23 nt, Human
uaagaggauguggggcacugcca

SEQ ID NO: 77130 - RNA, 27 nt, Human
uaagaggauguggggcacugccaaggg

SEQ ID NO: 77131 - RNA, 27 nt, Human
uaagcugagaacaggucauugcacuca

SEQ ID NO: 77132 - RNA, 20 nt, Human
uaaucucaagacuccucccu

SEQ ID NO: 77133 - RNA, 20 nt, Human
uacacacacacacacacaca

SEQ ID NO: 77134 - RNA, 19 nt, Human
uacacugccccuacccccu

SEQ ID NO: 77135 - RNA, 24 nt, Human
uacagcgcaguuauuuagauaaaa

SEQ ID NO: 77136 - RNA, 22 nt, Human
uaccgagaagagagggaguucc

SEQ ID NO: 77137 - RNA, 18 nt, Human
uacucuugucaugaagag

SEQ ID NO: 77138 - RNA, 21 nt, Human
uacuucacaggugaaacuuua

SEQ ID NO: 77139 - RNA, 20 nt, Human
uacuuggccuccaucuuugg

SEQ ID NO: 77140 - RNA, 18 nt, Human
uacuuggggaaacugaau

SEQ ID NO: 77141 - RNA, 20 nt, Human
uagcaaauaaaacagaaaag

SEQ ID NO: 77142 - RNA, 20 nt, Human
uagcaagaaucaaaaagcca

SEQ ID NO: 77143 - RNA, 21 nt, Human
uagcaagaaucaaaaagccag

SEQ ID NO: 77144 - RNA, 24 nt, Human
uagcuacucaggaggccgaggcag

SEQ ID NO: 77145 - RNA, 24 nt, Human
uaucccaacgccgucucccccuca

SEQ ID NO: 77146 - RNA, 21 nt, Human
uaugagggagaaggggcauaa

SEQ ID NO: 77147 - RNA, 24 nt, Human
ucaaaaagucacuaaaacaccaca

SEQ ID NO: 77148 - RNA, 26 nt, Human
ucacaaaaaacuguacaacgggggcg

SEQ ID NO: 77149 - RNA, 21 nt, Human
ucacacacacacacacauaca

SEQ ID NO: 77150 - RNA, 21 nt, Human
ucaccuggcacccccaccccc

SEQ ID NO: 77151 - RNA, 24 nt, Human
ucaccuggcacccccaccccccaa

SEQ ID NO: 77152 - RNA, 20 nt, Human
ucaguggcucuucagugcug

SEQ ID NO: 77153 - RNA, 24 nt, Human
ucauugcacucaagccugggcaau

SEQ ID NO: 77154 - RNA, 20 nt, Human
uccacccuccguggaugaua

SEQ ID NO: 77155 - RNA, 19 nt, Human
uccacccucuccucuucca

SEQ ID NO: 77156 - RNA, 22 nt, Human
uccaccucaccuggcaccccca

SEQ ID NO: 77157 - RNA, 18 nt, Human
uccacuuuacuggccguc

SEQ ID NO: 77158 - RNA, 19 nt, Human
uccacuuuacuggccguca

SEQ ID NO: 77159 - RNA, 22 nt, Human
uccagggucucugcugcugggg

SEQ ID NO: 77160 - RNA, 22 nt, Human
ucccaacgccgucucccccuca

SEQ ID NO: 77161 - RNA, 19 nt, Human
ucccccauccaccucacaa

SEQ ID NO: 77162 - RNA, 19 nt, Human
ucccccauccaccucacaa

SEQ ID NO: 77163 - RNA, 20 nt, Human
ucccuaccacccccaacccc

SEQ ID NO: 77164 - RNA, 22 nt, Human
uccggccgcgacacacuuggga

SEQ ID NO: 77165 - RNA, 18 nt, Human
ucggcaguacucagugga

SEQ ID NO: 77166 - RNA, 22 nt, Human
ucuacagcugcacuuguggaac

SEQ ID NO: 77167 - RNA, 25 nt, Human
ucucaagacuccucccuuagcuacu

SEQ ID NO: 77168 - RNA, 18 nt, Human
ucuuggaugccucagcuc

SEQ ID NO: 77169 - RNA, 20 nt, Human
ucuuggaugccucagcucuc

SEQ ID NO: 77170 - RNA, 18 nt, Human
ucuuucuuuuuuuggcuu

SEQ ID NO: 77171 - RNA, 19 nt, Human
ugaaaacauucccuuucuu

SEQ ID NO: 77172 - RNA, 23 nt, Human
ugaaaagaugcacagucugaaga

SEQ ID NO: 77173 - RNA, 20 nt, Human
ugacaggaacacagaggugg

SEQ ID NO: 77174 - RNA, 21 nt, Human
ugacuugagucuggacccagg

SEQ ID NO: 77175 - RNA, 19 nt, Human
ugagaacaggucauugcac

SEQ ID NO: 77176 - RNA, 25 nt, Human
ugagaacaggucauugcacucaagc

SEQ ID NO: 77177 - RNA, 20 nt, Human
ugagacacacacacacacac

SEQ ID NO: 77178 - RNA, 22 nt, Human
ugagagaaaaucugaaaacugg

SEQ ID NO: 77179 - RNA, 22 nt, Human
ugaggagcaagaggagggaagg

SEQ ID NO: 77180 - RNA, 24 nt, Human
ugaggaguucccaagaggguuugg

SEQ ID NO: 77181 - RNA, 23 nt, Human
ugaguaagcugagaacaggucau

SEQ ID NO: 77182 - RNA, 18 nt, Human
ugauggugugguuucuuc

SEQ ID NO: 77183 - RNA, 21 nt, Human
ugcacugaauccccccuuugc

SEQ ID NO: 77184 - RNA, 23 nt, Human
ugccagaauacaaggaaugcucc

SEQ ID NO: 77185 - RNA, 22 nt, Human
ugccccuacccccuucaguggc

SEQ ID NO: 77186 - RNA, 25 nt, Human
ugccucagcucucugcuugggccag

SEQ ID NO: 77187 - RNA, 25 nt, Human
ugcuccaccucaccuggcaccccca

SEQ ID NO: 77188 - RNA, 20 nt, Human
ugcuccagggucucugcugc

SEQ ID NO: 77189 - RNA, 20 nt, Human
ugcuugggccagccagcagc

SEQ ID NO: 77190 - RNA, 25 nt, Human
ugcuugggccagccagcagccaccu

SEQ ID NO: 77191 - RNA, 20 nt, Human
uggaacaucacauggcaaaa

SEQ ID NO: 77192 - RNA, 24 nt, Human
uggaacaucacauggcaaaaacag

SEQ ID NO: 77193 - RNA, 21 nt, Human
uggaagggugauauuaugaca

SEQ ID NO: 77194 - RNA, 24 nt, Human
uggaagguggggggagaugccaca

SEQ ID NO: 77195 - RNA, 24 nt, Human
uggaugagagaaaaucugaaaacu

SEQ ID NO: 77196 - RNA, 22 nt, Human
ugggaaaaaugggaaugaaaac

SEQ ID NO: 77197 - RNA, 20 nt, Human
ugggaacuagcaagaaucaa

SEQ ID NO: 77198 - RNA, 21 nt, Human
ugggaaggagguggggaagga

SEQ ID NO: 77199 - RNA, 22 nt, Human
ugggaaggagguggggaaggag

SEQ ID NO: 77200 - RNA, 23 nt, Human
ugggaccacccagcuccucacug

SEQ ID NO: 77201 - RNA, 19 nt, Human
ugggagaagagaaaaggag

SEQ ID NO: 77202 - RNA, 22 nt, Human
ugggagaagagaaaaggaggga

SEQ ID NO: 77203 - RNA, 25 nt, Human
ugggagaagagaaaaggagggagga

SEQ ID NO: 77204 - RNA, 19 nt, Human
ugggagggaagcaaaaggg

SEQ ID NO: 77205 - RNA, 21 nt, Human
ugggagggaagcaaaagggca

SEQ ID NO: 77206 - RNA, 23 nt, Human
ugggagggaagcaaaagggcagg

SEQ ID NO: 77207 - RNA, 23 nt, Human
uggggaaggagguuggaaggccc

SEQ ID NO: 77208 - RNA, 18 nt, Human
uggggggugggagguggg

SEQ ID NO: 77209 - RNA, 19 nt, Human
uggggggugggagguggga

SEQ ID NO: 77210 - RNA, 20 nt, Human
uguaggaauaagaggaugug

SEQ ID NO: 77211 - RNA, 19 nt, Human
ugucaugaagagaaaaucc

SEQ ID NO: 77212 - RNA, 19 nt, Human
uguccagggcccggugucc

SEQ ID NO: 77213 - RNA, 22 nt, Human
ugucuuauccgugagugggaag

SEQ ID NO: 77214 - RNA, 22 nt, Human
ugugcuccagggucucugcugc

SEQ ID NO: 77215 - RNA, 20 nt, Human
uuaggaagcuggggccacau

SEQ ID NO: 77216 - RNA, 22 nt, Human
uuccugcugaaaagaugcacag

SEQ ID NO: 77217 - RNA, 24 nt, Human
uucuauaacugauaacucccugag

SEQ ID NO: 77218 - RNA, 20 nt, Human
uuggaagguggggggagaua

SEQ ID NO: 77219 - RNA, 20 nt, Human
uugguccuaaaaauauagaa

SEQ ID NO: 77220 - RNA, 21 nt, Human
uugguccuaaaaauauagaaa

SEQ ID NO: 77221 - RNA, 18 nt, Human
uuucuuggaugccucagc

SEQ ID NO: 77222 - RNA, 19 nt, Human
aaaaaagaaugcuaccuuu

SEQ ID NO: 77223 - RNA, 18 nt, Human
aaaaauggaaaacuaaua

SEQ ID NO: 77224 - RNA, 23 nt, Human
aaacuaauauccccuacacccug

SEQ ID NO: 77225 - RNA, 19 nt, Human
aaacuaugaaauugacagg

SEQ ID NO: 77226 - RNA, 20 nt, Human
aaaggcaggcacuaccaaga

SEQ ID NO: 77227 - RNA, 24 nt, Human
aaaugaggcugggugccguggcuc

SEQ ID NO: 77228 - RNA, 23 nt, Human
aacacacaguagauaaaacacag

SEQ ID NO: 77229 - RNA, 18 nt, Human
aacacuccuaaaaaaaga

SEQ ID NO: 77230 - RNA, 18 nt, Human
aacagcaaaugaggcugg

SEQ ID NO: 77231 - RNA, 22 nt, Human
aacaguuuaacuuggcuuuguu

SEQ ID NO: 77232 - RNA, 23 nt, Human
aacuacacaagugaugcagcaac

SEQ ID NO: 77233 - RNA, 23 nt, Human
aacuugaagcaguaguggauagu

SEQ ID NO: 77234 - RNA, 24 nt, Human
aauaaaaugcuacaauccucuaag

SEQ ID NO: 77235 - RNA, 22 nt, Human
acagcaaaugaggcugggugcc

SEQ ID NO: 77236 - RNA, 24 nt, Human
agacgaaaauaaaaugcuacaauc

SEQ ID NO: 77237 - RNA, 18 nt, Human
agacgccacaguguuggu

SEQ ID NO: 77238 - RNA, 23 nt, Human
agauaaaacacagugguuacaaa

SEQ ID NO: 77239 - RNA, 23 nt, Human
agcacuuugggaggccgaggagg

SEQ ID NO: 77240 - RNA, 20 nt, Human
aggaagaaaaaggugacuca

SEQ ID NO: 77241 - RNA, 23 nt, Human
aggagguggaucacaaggucagg

SEQ ID NO: 77242 - RNA, 18 nt, Human
aggcaggcacuaccaaga

SEQ ID NO: 77243 - RNA, 19 nt, Human
aggccgaggagguggauca

SEQ ID NO: 77244 - RNA, 24 nt, Human
agguggaucacaaggucaggagau

SEQ ID NO: 77245 - RNA, 25 nt, Human
augcagcaacauauauauauaaaug

SEQ ID NO: 77246 - RNA, 19 nt, Human
augccuguaaucccagcac

SEQ ID NO: 77247 - RNA, 21 nt, Human
caacacacaguagauaaaaca

SEQ ID NO: 77248 - RNA, 24 nt, Human
caacaggccaccacaacacacagu

SEQ ID NO: 77249 - RNA, 20 nt, Human
caaggcaaaugggagggaaa

SEQ ID NO: 77250 - RNA, 23 nt, Human
cacauagugaaaaauaacacucc

SEQ ID NO: 77251 - RNA, 20 nt, Human
cacccuguuucaaaggcagg

SEQ ID NO: 77252 - RNA, 18 nt, Human
cacuauaacacccuuucc

SEQ ID NO: 77253 - RNA, 28 nt, Human
cagaugauguauuacuuccccugaaagg

SEQ ID NO: 77254 - RNA, 25 nt, Human
cagcacuuugggaggccgaggaggu

SEQ ID NO: 77255 - RNA, 26 nt, Human
cagcacuuugggaggccgaggaggug

SEQ ID NO: 77256 - RNA, 18 nt, Human
caguauauacaugucaau

SEQ ID NO: 77257 - RNA, 24 nt, Human
caugccuguaaucccagcacuuug

SEQ ID NO: 77258 - RNA, 19 nt, Human
ccuaaaaaaagaaugcuac

SEQ ID NO: 77259 - RNA, 22 nt, Human
ccuguaaucccagcacuuuggg

SEQ ID NO: 77260 - RNA, 26 nt, Human
ccuuguauuuucaagauuuaaagcaa

SEQ ID NO: 77261 - RNA, 23 nt, Human
cgaggagguggaucacaagguca

SEQ ID NO: 77262 - RNA, 24 nt, Human
cguggcucaugccuguaaucccag

SEQ ID NO: 77263 - RNA, 24 nt, Human
cucaugccuguaaucccagcacuu

SEQ ID NO: 77264 - RNA, 21 nt, Human
cugaggcaaggcaaaugggag

SEQ ID NO: 77265 - RNA, 22 nt, Human
cuuuuccacaacauuuuauuuu

SEQ ID NO: 77266 - RNA, 23 nt, Human
gaaaauaaaaugcuacaauccuc

SEQ ID NO: 77267 - RNA, 21 nt, Human
gaaaggagaaccauuucccac

SEQ ID NO: 77268 - RNA, 18 nt, Human
gagacgccacaguguugg

SEQ ID NO: 77269 - RNA, 22 nt, Human
gagagggaaaggagaaccauuu

SEQ ID NO: 77270 - RNA, 21 nt, Human
ggcucaugccuguaaucccag

SEQ ID NO: 77271 - RNA, 23 nt, Human
ggcugggugccguggcucaugcc

SEQ ID NO: 77272 - RNA, 23 nt, Human
gggaaaggagaaccauuucccac

SEQ ID NO: 77273 - RNA, 23 nt, Human
ggugccguggcucaugccuguaa

SEQ ID NO: 77274 - RNA, 22 nt, Human
guggcucaugccuguaauccca

SEQ ID NO: 77275 - RNA, 24 nt, Human
guuaggguaaauaaaaacacacaa

SEQ ID NO: 77276 - RNA, 22 nt, Human
uaaaacaagacuuaauauaaac

SEQ ID NO: 77277 - RNA, 18 nt, Human
uaaaaugcuacaauccuc

SEQ ID NO: 77278 - RNA, 23 nt, Human
uaaaucacacaaaccaauaaccg

SEQ ID NO: 77279 - RNA, 24 nt, Human
uaaaucacacaaaccaauaaccga

SEQ ID NO: 77280 - RNA, 21 nt, Human
uaaccgagggccuugguuguc

SEQ ID NO: 77281 - RNA, 21 nt, Human
uacaaaguaaaaaaaugaaaa

SEQ ID NO: 77282 - RNA, 22 nt, Human
uacacccuguuucaaaggcagg

SEQ ID NO: 77283 - RNA, 19 nt, Human
uagaaaaauggaaaacuaa

SEQ ID NO: 77284 - RNA, 18 nt, Human
uagaggauaauuacugua

SEQ ID NO: 77285 - RNA, 21 nt, Human
uagauaaaacacagugguuac

SEQ ID NO: 77286 - RNA, 20 nt, Human
uagguacaaaaaaaaucuga

SEQ ID NO: 77287 - RNA, 24 nt, Human
uauacacauaauacauauuuaaaa

SEQ ID NO: 77288 - RNA, 20 nt, Human
uauauacacauaauacauag

SEQ ID NO: 77289 - RNA, 18 nt, Human
ucacaaggucaggagauc

SEQ ID NO: 77290 - RNA, 24 nt, Human
ucacaaggucaggagaucgagacc

SEQ ID NO: 77291 - RNA, 23 nt, Human
ucacuaaaaaauaaacuacaaag

SEQ ID NO: 77292 - RNA, 22 nt, Human
ucaugccuguaaucccagcacu

SEQ ID NO: 77293 - RNA, 23 nt, Human
ugaaaaauagauauuuauugaga

SEQ ID NO: 77294 - RNA, 23 nt, Human
ugaaauacaauuuaacuacacaa

SEQ ID NO: 77295 - RNA, 19 nt, Human
ugaggcugggugccguggc

SEQ ID NO: 77296 - RNA, 19 nt, Human
ugcagcaacauauauauau

SEQ ID NO: 77297 - RNA, 26 nt, Human
ugcagcaacauauauauauaaaugua

SEQ ID NO: 77298 - RNA, 23 nt, Human
ugccuguaaucccagcacuuugg

SEQ ID NO: 77299 - RNA, 23 nt, Human
ugccuguaaucccagcacuuugg

SEQ ID NO: 77300 - RNA, 19 nt, Human
ugcuaccuuuuccacaaca

SEQ ID NO: 77301 - RNA, 18 nt, Human
uggaaaacuaauaucccc

SEQ ID NO: 77302 - RNA, 22 nt, Human
uggcucaugccuguaaucccag

SEQ ID NO: 77303 - RNA, 24 nt, Human
uggcucaugccuguaaucccagca

SEQ ID NO: 77304 - RNA, 18 nt, Human
ugggaggccgaggaggug

SEQ ID NO: 77305 - RNA, 23 nt, Human
ugggaggccgaggagguggauca

SEQ ID NO: 77306 - RNA, 23 nt, Human
ugggagggaaauguuucuaugaa

SEQ ID NO: 77307 - RNA, 18 nt, Human
uguaaauacaguucacau

SEQ ID NO: 77308 - RNA, 23 nt, Human
ugugaggaagaaaaaggugacuc

SEQ ID NO: 77309 - RNA, 20 nt, Human
uuaaaacauuccuuguauuu

SEQ ID NO: 77310 - RNA, 21 nt, Human
uuaaggaaaaagaaagucauu

SEQ ID NO: 77311 - RNA, 23 nt, Human
uuauacuuaaggaaaaagaaagu

SEQ ID NO: 77312 - RNA, 23 nt, Human
uuauugagagggaaaggagaacc

SEQ ID NO: 77313 - RNA, 21 nt, Human
uucauaaaauuaaauacauuc

SEQ ID NO: 77314 - RNA, 20 nt, Human
uucuaugaaaaaauacugug

SEQ ID NO: 77315 - RNA, 21 nt, Human
uucuuugggugugcuucccug

SEQ ID NO: 77316 - RNA, 24 nt, Human
uugggaggccgaggagguggauca

SEQ ID NO: 77317 - RNA, 25 nt, Human
uuuagaaggaaaaaaauaaagagau

SEQ ID NO: 77318 - RNA, 19 nt, Human
uuucacagaaaacgaagau

SEQ ID NO: 77319 - RNA, 22 nt, Human
uuugaaauacaauuuaacuaca

SEQ ID NO: 77320 - RNA, 20 nt, Human
aaagaguacucuugugagag

SEQ ID NO: 77321 - RNA, 19 nt, Human
aaggcuuauuugaagaaau

SEQ ID NO: 77322 - RNA, 23 nt, Human
agaaaggaugcuuuauuugcaaa

SEQ ID NO: 77323 - RNA, 22 nt, Human
aggaaauuauauguaaaucaca

SEQ ID NO: 77324 - RNA, 25 nt, Human
cuaccugcaaguaaagaaacuguca

SEQ ID NO: 77325 - RNA, 21 nt, Human
cugcaaguaaagaaacuguca

SEQ ID NO: 77326 - RNA, 21 nt, Human
uagagcaggcaugcaacagag

SEQ ID NO: 77327 - RNA, 19 nt, Human
uggagauacucauauaugg

SEQ ID NO: 77328 - RNA, 19 nt, Human
uuuuuuuuuugaagcaugu

SEQ ID NO: 77329 - RNA, 20 nt, Human
aaaagcauucauccuauucc

SEQ ID NO: 77330 - RNA, 18 nt, Human
aagcgcagcggagcuggc

SEQ ID NO: 77331 - RNA, 23 nt, Human
accugcgcggccccagccgccuc

SEQ ID NO: 77332 - RNA, 22 nt, Human
agcaaaauuggacucugaagcc

SEQ ID NO: 77333 - RNA, 19 nt, Human
aggggaggagggcuggaag

SEQ ID NO: 77334 - RNA, 22 nt, Human
auagaaagcaagucuaucuuca

SEQ ID NO: 77335 - RNA, 24 nt, Human
auauaccauaaauaagcaaaauug

SEQ ID NO: 77336 - RNA, 23 nt, Human
caacaguacuacuacugauuuaa

SEQ ID NO: 77337 - RNA, 19 nt, Human
cacccgggguucaccaggg

SEQ ID NO: 77338 - RNA, 18 nt, Human
cagaggcuuccccuucuu

SEQ ID NO: 77339 - RNA, 21 nt, Human
cagcccgggacgaacccgucc

SEQ ID NO: 77340 - RNA, 24 nt, Human
cagggugugauccaaagcaaaccu

SEQ ID NO: 77341 - RNA, 21 nt, Human
ccuacaugcucagcccagagg

SEQ ID NO: 77342 - RNA, 20 nt, Human
ccugcggguugaacucuacu

SEQ ID NO: 77343 - RNA, 18 nt, Human
ccuucuagcaccacaucc

SEQ ID NO: 77344 - RNA, 21 nt, Human
ccuucuguggcugcgcggugg

SEQ ID NO: 77345 - RNA, 24 nt, Human
cgcccgggcaagaagugcagggac

SEQ ID NO: 77346 - RNA, 22 nt, Human
cgccugcuccuccugcggcggc

SEQ ID NO: 77347 - RNA, 22 nt, Human
cggacgcgaaacagcccgggac

SEQ ID NO: 77348 - RNA, 25 nt, Human
cguccgcucuuuuugcggcugcgcg

SEQ ID NO: 77349 - RNA, 20 nt, Human
cugcggcggcgcagacccgu

SEQ ID NO: 77350 - RNA, 25 nt, Human
gaggcuuccccuucuagcaccacau

SEQ ID NO: 77351 - RNA, 26 nt, Human
gccucaggccggacgcgaaacagccc

SEQ ID NO: 77352 - RNA, 18 nt, Human
gcgcggccccagccgccu

SEQ ID NO: 77353 - RNA, 19 nt, Human
gcugcgcgguggagccucg

SEQ ID NO: 77354 - RNA, 19 nt, Human
gcugcgcgguggagccucg

SEQ ID NO: 77355 - RNA, 20 nt, Human
ggcggcggcuuaggggagga

SEQ ID NO: 77356 - RNA, 21 nt, Human
ggcuggaagcuggagacaagc

SEQ ID NO: 77357 - RNA, 23 nt, Human
uagcacccgggguucaccagggu

SEQ ID NO: 77358 - RNA, 23 nt, Human
uauauaccauaaauaagcaaaau

SEQ ID NO: 77359 - RNA, 22 nt, Human
ucagcaacaguacuacuacuga

SEQ ID NO: 77360 - RNA, 24 nt, Human
ucaggccggacgcgaaacagcccg

SEQ ID NO: 77361 - RNA, 18 nt, Human
ucugaagcccuaauacuu

SEQ ID NO: 77362 - RNA, 21 nt, Human
ucuguggcugcgcgguggagc

SEQ ID NO: 77363 - RNA, 24 nt, Human
uggaagcuggagacaagcgcagcg

SEQ ID NO: 77364 - RNA, 27 nt, Human
uggcggcggcuuaggggaggggugcuc

SEQ ID NO: 77365 - RNA, 24 nt, Human
uuauauaccauaaauaagcaaaau

SEQ ID NO: 77366 - RNA, 21 nt, Human
uugccaggaacuucaugaccu

SEQ ID NO: 77367 - RNA, 23 nt, Human
uuuugcggcugcgcaguggaacc

SEQ ID NO: 77368 - RNA, 23 nt, Human
aaaaaggacacauaguguauuga

SEQ ID NO: 77369 - RNA, 25 nt, Human
aaccucacaaccugaggaucaccuc

SEQ ID NO: 77370 - RNA, 18 nt, Human
aagaacaaaauacaggga

SEQ ID NO: 77371 - RNA, 22 nt, Human
acagggagggacuuguucugga

SEQ ID NO: 77372 - RNA, 19 nt, Human
accagguagguagaaggac

SEQ ID NO: 77373 - RNA, 23 nt, Human
accucaguuaaaccaaggcuuug

SEQ ID NO: 77374 - RNA, 19 nt, Human
aggaucaccucaguuaaac

SEQ ID NO: 77375 - RNA, 20 nt, Human
aggaucaccucaguuaaacc

SEQ ID NO: 77376 - RNA, 22 nt, Human
aucacagagcuacucagcagag

SEQ ID NO: 77377 - RNA, 20 nt, Human
auccucgcccaagaaaaccc

SEQ ID NO: 77378 - RNA, 21 nt, Human
augucaccuuuccuaauccag

SEQ ID NO: 77379 - RNA, 19 nt, Human
caagaacaaaauacaggga

SEQ ID NO: 77380 - RNA, 22 nt, Human
caagcccugggcugcugcuccu

SEQ ID NO: 77381 - RNA, 18 nt, Human
cacaaccugaggaucacc

SEQ ID NO: 77382 - RNA, 19 nt, Human
cccugggcugcugcuccuc

SEQ ID NO: 77383 - RNA, 21 nt, Human
cuaauaaaccucacaaccuga

SEQ ID NO: 77384 - RNA, 21 nt, Human
cuaauccagcacauccucgcc

SEQ ID NO: 77385 - RNA, 21 nt, Human
cucagcaggcuuggccucaac

SEQ ID NO: 77386 - RNA, 21 nt, Human
cugaccccucucaagaacaaa

SEQ ID NO: 77387 - RNA, 18 nt, Human
cugacucagcuacauaca

SEQ ID NO: 77388 - RNA, 20 nt, Human
cugcugcuccucauccuggu

SEQ ID NO: 77389 - RNA, 21 nt, Human
cuggcuuauggggcaguagag

SEQ ID NO: 77390 - RNA, 21 nt, Human
cuuggccucaacuuccagggc

SEQ ID NO: 77391 - RNA, 23 nt, Human
gaauaacaauuuuccccaaagga

SEQ ID NO: 77392 - RNA, 28 nt, Human
gggagggacuuguucuggauucccuuug

SEQ ID NO: 77393 - RNA, 19 nt, Human
gugguuaucacugacuauc

SEQ ID NO: 77394 - RNA, 22 nt, Human
uaccagguagguagaaggaccu

SEQ ID NO: 77395 - RNA, 19 nt, Human
uagcaucuggucagugguu

SEQ ID NO: 77396 - RNA, 20 nt, Human
uagcuucuagacugaccccu

SEQ ID NO: 77397 - RNA, 24 nt, Human
uagguagaaggaccuuaggcucaa

SEQ ID NO: 77398 - RNA, 20 nt, Human
ucccuuugggcaaaugcagc

SEQ ID NO: 77399 - RNA, 19 nt, Human
uccgaccucaaaugccaau

SEQ ID NO: 77400 - RNA, 22 nt, Human
uccucgcccaagaaaacccuau

SEQ ID NO: 77401 - RNA, 21 nt, Human
ucguuggugcugauccagaca

SEQ ID NO: 77402 - RNA, 23 nt, Human
ucuagacugaccccucucaagaa

SEQ ID NO: 77403 - RNA, 21 nt, Human
ugaauaacaauuuuccccaaa

SEQ ID NO: 77404 - RNA, 19 nt, Human
ugccaguucuuaaaggaac

SEQ ID NO: 77405 - RNA, 21 nt, Human
ugccaguucuuaaaggaacug

SEQ ID NO: 77406 - RNA, 25 nt, Human
uguucuggauucccuuugggcaaau

SEQ ID NO: 77407 - RNA, 26 nt, Human
uguucuggauucccuuugggcaaaug

SEQ ID NO: 77408 - RNA, 20 nt, Human
uuccagggcuuuuguuuucu

SEQ ID NO: 77409 - RNA, 20 nt, Human
uuccuggcuuauggggcagg

SEQ ID NO: 77410 - RNA, 21 nt, Human
uugauagcaucuggucagugg

SEQ ID NO: 77411 - RNA, 18 nt, Human
uugcugccaguucuuaaa

SEQ ID NO: 77412 - RNA, 23 nt, Human
accccuccccugccucccuccug

SEQ ID NO: 77413 - RNA, 21 nt, Human
acccucacacuccagccccgu

SEQ ID NO: 77414 - RNA, 21 nt, Human
aggcauggccccacacccugc

SEQ ID NO: 77415 - RNA, 24 nt, Human
agucaaaugauuggaaaaccaaua

SEQ ID NO: 77416 - RNA, 22 nt, Human
auggccccacacccugcccggc

SEQ ID NO: 77417 - RNA, 19 nt, Human
caccaaacugcacuggccc

SEQ ID NO: 77418 - RNA, 20 nt, Human
caccgagcugcccgggccgc

SEQ ID NO: 77419 - RNA, 23 nt, Human
ccaauaacgaaaaauaguucuuc

SEQ ID NO: 77420 - RNA, 21 nt, Human
ccacuggccggccccugggcu

SEQ ID NO: 77421 - RNA, 21 nt, Human
ccaggaccgacgcagagcugg

SEQ ID NO: 77422 - RNA, 18 nt, Human
cccacacccugcccggcc

SEQ ID NO: 77423 - RNA, 18 nt, Human
ccccacacccugcccggc

SEQ ID NO: 77424 - RNA, 22 nt, Human
cccucggggcuccgagcgcgcc

SEQ ID NO: 77425 - RNA, 24 nt, Human
ccgcaccccuccccugccuccccc

SEQ ID NO: 77426 - RNA, 18 nt, Human
ccgcagccgccccggugc

SEQ ID NO: 77427 - RNA, 21 nt, Human
ccgccgcaccccuccccugcc

SEQ ID NO: 77428 - RNA, 22 nt, Human
ccgccgcaccccuccccugccu

SEQ ID NO: 77429 - RNA, 19 nt, Human
ccgccgcgcagcugccgcc

SEQ ID NO: 77430 - RNA, 22 nt, Human
ccggccccugggcuucggcucc

SEQ ID NO: 77431 - RNA, 22 nt, Human
ccgggcccguggugcaugcugg

SEQ ID NO: 77432 - RNA, 21 nt, Human
ccggugccgccgcgcagcugc

SEQ ID NO: 77433 - RNA, 21 nt, Human
ccucccuccuggggucaccac

SEQ ID NO: 77434 - RNA, 21 nt, Human
ccugucccuaagccuguggca

SEQ ID NO: 77435 - RNA, 24 nt, Human
cggccauaaauauauacagauucc

SEQ ID NO: 77436 - RNA, 22 nt, Human
cggccccugggcuucggcuccu

SEQ ID NO: 77437 - RNA, 18 nt, Human
cuccagccccgucuggug

SEQ ID NO: 77438 - RNA, 22 nt, Human
cuggugacccaacccgggcccg

SEQ ID NO: 77439 - RNA, 18 nt, Human
gaccaggcucagcccucg

SEQ ID NO: 77440 - RNA, 21 nt, Human
gccccugggcuucggcuccug

SEQ ID NO: 77441 - RNA, 18 nt, Human
ggaaggccacuggccggc

SEQ ID NO: 77442 - RNA, 20 nt, Human
ggaggacacaccaaacugca

SEQ ID NO: 77443 - RNA, 18 nt, Human
ggccuggggccccggcuc

SEQ ID NO: 77444 - RNA, 19 nt, Human
ggcgcacaccgagcugccc

SEQ ID NO: 77445 - RNA, 21 nt, Human
ggcggaggacacaccaaacug

SEQ ID NO: 77446 - RNA, 22 nt, Human
ggcuccgagcgcgccgcagccc

SEQ ID NO: 77447 - RNA, 19 nt, Human
gggaccgccgcaccccucc

SEQ ID NO: 77448 - RNA, 22 nt, Human
uaagccuguggcacagcgacuc

SEQ ID NO: 77449 - RNA, 22 nt, Human
uagucaaaugauuggaaaacca

SEQ ID NO: 77450 - RNA, 18 nt, Human
uccccugccucccuccug

SEQ ID NO: 77451 - RNA, 19 nt, Human
ucccuccuggggucaccac

SEQ ID NO: 77452 - RNA, 19 nt, Human
uccgagcgcgccgcagccg

SEQ ID NO: 77453 - RNA, 20 nt, Human
ugauuggaaaaccaauaacg

SEQ ID NO: 77454 - RNA, 19 nt, Human
uggcacgagguccugcagg

SEQ ID NO: 77455 - RNA, 19 nt, Human
ugggagccagggagcuggg

SEQ ID NO: 77456 - RNA, 23 nt, Human
ugucaggggacacggcacccucg

SEQ ID NO: 77457 - RNA, 19 nt, Human
uguggcacagcgacucuug

SEQ ID NO: 77458 - RNA, 20 nt, Human
aaagugcugagauuacaggc

SEQ ID NO: 77459 - RNA, 22 nt, Human
aaagugcugagauuacaggcga

SEQ ID NO: 77460 - RNA, 26 nt, Human
aagugcugagauuacaggcgagagcc

SEQ ID NO: 77461 - RNA, 23 nt, Human
acaaggacccuauuugaaaaaca

SEQ ID NO: 77462 - RNA, 19 nt, Human
acaggcgagagccaccacg

SEQ ID NO: 77463 - RNA, 18 nt, Human
acgggguuucaugauguu

SEQ ID NO: 77464 - RNA, 19 nt, Human
acgggguuucaugauguug

SEQ ID NO: 77465 - RNA, 20 nt, Human
acgggguuucaugauguugg

SEQ ID NO: 77466 - RNA, 24 nt, Human
acgggguuucaugauguuggccag

SEQ ID NO: 77467 - RNA, 21 nt, Human
acuacaggugugugccaccau

SEQ ID NO: 77468 - RNA, 19 nt, Human
acuguuauuugccagaaaa

SEQ ID NO: 77469 - RNA, 19 nt, Human
agauuacaggcgagagcca

SEQ ID NO: 77470 - RNA, 21 nt, Human
agcugcuccugcacagggucc

SEQ ID NO: 77471 - RNA, 18 nt, Human
agcuuagaggaugagcac

SEQ ID NO: 77472 - RNA, 23 nt, Human
aguagcugggacuacaggugugu

SEQ ID NO: 77473 - RNA, 24 nt, Human
agugcaauggugcaacuucggcuc

SEQ ID NO: 77474 - RNA, 22 nt, Human
aucuuugccguugucacugagc

SEQ ID NO: 77475 - RNA, 19 nt, Human
auguuggccaggcuagucu

SEQ ID NO: 77476 - RNA, 24 nt, Human
auuuuuguauuuuuaguagagacg

SEQ ID NO: 77477 - RNA, 27 nt, Human
caaagugcugagauuacaggcgagagc

SEQ ID NO: 77478 - RNA, 23 nt, Human
caaaucauuuuaagcccucccca

SEQ ID NO: 77479 - RNA, 23 nt, Human
caacacagcccggguucucccuc

SEQ ID NO: 77480 - RNA, 23 nt, Human
caaccuccaccuccuggguacaa

SEQ ID NO: 77481 - RNA, 19 nt, Human
caacuaggugaccugcuaa

SEQ ID NO: 77482 - RNA, 23 nt, Human
caacuaggugaccugcuaaacca

SEQ ID NO: 77483 - RNA, 19 nt, Human
caagcgguucucgugcguu

SEQ ID NO: 77484 - RNA, 20 nt, Human
caauauacaacagcucgggc

SEQ ID NO: 77485 - RNA, 24 nt, Human
caccaugccuggcuaauuuuugua

SEQ ID NO: 77486 - RNA, 23 nt, Human
caccugccucggccucccaaagu

SEQ ID NO: 77487 - RNA, 21 nt, Human
cacugcaaccuccaccuccug

SEQ ID NO: 77488 - RNA, 23 nt, Human
cacugcaaccuccaccuccuggg

SEQ ID NO: 77489 - RNA, 18 nt, Human
cagaaaagacuggaccag

SEQ ID NO: 77490 - RNA, 21 nt, Human
cagaaaagacuggaccagaga

SEQ ID NO: 77491 - RNA, 18 nt, Human
caggcuagucuugaacuc

SEQ ID NO: 77492 - RNA, 22 nt, Human
caggugauccaccugccucggc

SEQ ID NO: 77493 - RNA, 25 nt, Human
caggugugugccaccaugccuggcu

SEQ ID NO: 77494 - RNA, 22 nt, Human
ccaaagugcugagauuacaggc

SEQ ID NO: 77495 - RNA, 23 nt, Human
ccaaagugcugagauuacaggcg

SEQ ID NO: 77496 - RNA, 23 nt, Human
ccaaaucauuuuaagcccucccc

SEQ ID NO: 77497 - RNA, 23 nt, Human
cccgaguagcugggacuacaggu

SEQ ID NO: 77498 - RNA, 24 nt, Human
cccgaguagcugggacuacaggug

SEQ ID NO: 77499 - RNA, 19 nt, Human
ccucuauucccucccuuuc

SEQ ID NO: 77500 - RNA, 20 nt, Human
ccucuauucccucccuuucc

SEQ ID NO: 77501 - RNA, 21 nt, Human
ccugaccucaggugauccacc

SEQ ID NO: 77502 - RNA, 23 nt, Human
ccugaccucaggugauccaccug

SEQ ID NO: 77503 - RNA, 23 nt, Human
ccugaccucaggugauccaccug

SEQ ID NO: 77504 - RNA, 20 nt, Human
cgugucacccggagcugcuc

SEQ ID NO: 77505 - RNA, 24 nt, Human
cucacugcaaccuccaccuccugg

SEQ ID NO: 77506 - RNA, 27 nt, Human
cucacugcaaccuccaccuccugggua

SEQ ID NO: 77507 - RNA, 21 nt, Human
cucccaaagugcugagauuac

SEQ ID NO: 77508 - RNA, 21 nt, Human
cuccuggguacaagcgguucu

SEQ ID NO: 77509 - RNA, 18 nt, Human
cucugucgcccagggugg

SEQ ID NO: 77510 - RNA, 23 nt, Human
cugccucggccucccaaagugcu

SEQ ID NO: 77511 - RNA, 30 nt, Human
cuuacuugccacugccuuuuuuuuuugauu

SEQ ID NO: 77512 - RNA, 22 nt, Human
cuucaagcuuagaggaugagca

SEQ ID NO: 77513 - RNA, 24 nt, Human
gaccucaggugauccaccugccuc

SEQ ID NO: 77514 - RNA, 24 nt, Human
gacuacaggugugugccaccaugc

SEQ ID NO: 77515 - RNA, 26 nt, Human
gaguagcugggacuacaggugugugc

SEQ ID NO: 77516 - RNA, 22 nt, Human
gaucaucgacucuucugaccca

SEQ ID NO: 77517 - RNA, 18 nt, Human
gauuacaggcgagagcca

SEQ ID NO: 77518 - RNA, 20 nt, Human
gcaaccuccaccuccugggu

SEQ ID NO: 77519 - RNA, 23 nt, Human
gccaccacugccauuuucaucac

SEQ ID NO: 77520 - RNA, 23 nt, Human
gcuagucuugaacuccugaccuc

SEQ ID NO: 77521 - RNA, 18 nt, Human
gcugcccagugccuggcu

SEQ ID NO: 77522 - RNA, 24 nt, Human
ggacuacaggugugugccaccaug

SEQ ID NO: 77523 - RNA, 18 nt, Human
ggaggagauggaguaagg

SEQ ID NO: 77524 - RNA, 24 nt, Human
ggcuagucuugaacuccugaccuc

SEQ ID NO: 77525 - RNA, 23 nt, Human
gggguuucaugauguuggccagg

SEQ ID NO: 77526 - RNA, 22 nt, Human
ggguuucaugauguuggccagg

SEQ ID NO: 77527 - RNA, 19 nt, Human
guagagacgggguuucaug

SEQ ID NO: 77528 - RNA, 24 nt, Human
gugauccaccugccucggccuccc

SEQ ID NO: 77529 - RNA, 24 nt, Human
uaaacaaauggauuuucgucuccc

SEQ ID NO: 77530 - RNA, 21 nt, Human
uaauuucuaggcagaauuuca

SEQ ID NO: 77531 - RNA, 24 nt, Human
uaauuuuuguauuuuuaguagaga

SEQ ID NO: 77532 - RNA, 23 nt, Human
uacaggcgagagccaccacgccc

SEQ ID NO: 77533 - RNA, 24 nt, Human
uagaaucuugcucugucgcccagg

SEQ ID NO: 77534 - RNA, 25 nt, Human
uagcagcauuucucuucuauaacuu

SEQ ID NO: 77535 - RNA, 19 nt, Human
uaguagagacgggguuuca

SEQ ID NO: 77536 - RNA, 24 nt, Human
uaguagagacgggguuucaugaug

SEQ ID NO: 77537 - RNA, 23 nt, Human
ucacugcaaccuccaccuccugg

SEQ ID NO: 77538 - RNA, 23 nt, Human
ucacugcaaccuccaccuccugg

SEQ ID NO: 77539 - RNA, 24 nt, Human
ucacugcaaccuccaccuccuggg

SEQ ID NO: 77540 - RNA, 27 nt, Human
ucacugcaaccuccaccuccuggguac

SEQ ID NO: 77541 - RNA, 21 nt, Human
ucaggugauccaccugccucg

SEQ ID NO: 77542 - RNA, 19 nt, Human
ucaguccccucgugucacc

SEQ ID NO: 77543 - RNA, 24 nt, Human
ucccaaagugcugagauuacaggc

SEQ ID NO: 77544 - RNA, 23 nt, Human
ucccgaguagcugggacuacagg

SEQ ID NO: 77545 - RNA, 24 nt, Human
ucccgaguagcugggacuacaggu

SEQ ID NO: 77546 - RNA, 18 nt, Human
ucgcccaggguggagugc

SEQ ID NO: 77547 - RNA, 18 nt, Human
ucggccucccaaagugcu

SEQ ID NO: 77548 - RNA, 21 nt, Human
ucgugucacccggagcugcuc

SEQ ID NO: 77549 - RNA, 24 nt, Human
ucugucgcccaggguggagugcaa

SEQ ID NO: 77550 - RNA, 23 nt, Human
ucuugaacuccugaccucaggug

SEQ ID NO: 77551 - RNA, 20 nt, Human
ucuugcucugucgcccaggg

SEQ ID NO: 77552 - RNA, 24 nt, Human
ucuugcucugucgcccagggugga

SEQ ID NO: 77553 - RNA, 24 nt, Human
ugaccucaggugauccaccugccu

SEQ ID NO: 77554 - RNA, 21 nt, Human
ugagauuacaggcgagagcca

SEQ ID NO: 77555 - RNA, 22 nt, Human
ugagauuacaggcgagagccac

SEQ ID NO: 77556 - RNA, 24 nt, Human
ugagauuacaggcgagagccacca

SEQ ID NO: 77557 - RNA, 20 nt, Human
ugcaauggugcaacuucggc

SEQ ID NO: 77558 - RNA, 19 nt, Human
ugccagaaaagacuggacc

SEQ ID NO: 77559 - RNA, 21 nt, Human
ugccagaaaagacuggaccag

SEQ ID NO: 77560 - RNA, 24 nt, Human
ugcccagugccuggcugguccgag

SEQ ID NO: 77561 - RNA, 25 nt, Human
ugcccagugccuggcugguccgagg

SEQ ID NO: 77562 - RNA, 21 nt, Human
ugccucggccucccaaagugc

SEQ ID NO: 77563 - RNA, 24 nt, Human
ugccucggccucccaaagugcuga

SEQ ID NO: 77564 - RNA, 24 nt, Human
ugcucugucgcccaggguggagug

SEQ ID NO: 77565 - RNA, 24 nt, Human
ugcugagauuacaggcgagagcca

SEQ ID NO: 77566 - RNA, 19 nt, Human
ugcugcccagugccuggcu

SEQ ID NO: 77567 - RNA, 19 nt, Human
uggagugcaauggugcaac

SEQ ID NO: 77568 - RNA, 23 nt, Human
uggagugcaauggugcaacuucg

SEQ ID NO: 77569 - RNA, 24 nt, Human
uggagugcaauggugcaacuucgg

SEQ ID NO: 77570 - RNA, 24 nt, Human
uggccaggcuagucuugaacuccu

SEQ ID NO: 77571 - RNA, 18 nt, Human
ugggacuacaggugugug

SEQ ID NO: 77572 - RNA, 21 nt, Human
ugggacuacaggugugugcca

SEQ ID NO: 77573 - RNA, 22 nt, Human
ugggacuacaggugugugccac

SEQ ID NO: 77574 - RNA, 24 nt, Human
ugggacuacaggugugugccacca

SEQ ID NO: 77575 - RNA, 25 nt, Human
ugggacuacaggugugugccaccau

SEQ ID NO: 77576 - RNA, 21 nt, Human
uggggaggagauggaguaagg

SEQ ID NO: 77577 - RNA, 21 nt, Human
uguauuuuuaguagagacggg

SEQ ID NO: 77578 - RNA, 20 nt, Human
ugugggaguaucuucagucc

SEQ ID NO: 77579 - RNA, 18 nt, Human
uuaguagagacgggguuu

SEQ ID NO: 77580 - RNA, 20 nt, Human
uuaguagagacgggguuuca

SEQ ID NO: 77581 - RNA, 21 nt, Human
uuaguagagacgggguuucau

SEQ ID NO: 77582 - RNA, 24 nt, Human
uuaguagagacgggguuucaugau

SEQ ID NO: 77583 - RNA, 23 nt, Human
uucucgugcguugggcucccgag

SEQ ID NO: 77584 - RNA, 23 nt, Human
uugggcucccgaguagcugggac

SEQ ID NO: 77585 - RNA, 21 nt, Human
uuggggaggagauggaguaag

SEQ ID NO: 77586 - RNA, 23 nt, Human
uuguauuuuuaguagagacgggg

SEQ ID NO: 77587 - RNA, 21 nt, Human
uuucaugauguuggccaggcu

SEQ ID NO: 77588 - RNA, 22 nt, Human
uuuucuauaccccacacauucc

SEQ ID NO: 77589 - RNA, 24 nt, Human
uuuuuaguagagacgggguuucau

SEQ ID NO: 77590 - RNA, 20 nt, Human
uuuuuguauuuuuaguagag

SEQ ID NO: 77591 - RNA, 19 nt, Human
aaagcuuuaaauaaggauc

SEQ ID NO: 77592 - RNA, 20 nt, Human
aagaauguguuuagaacuau

SEQ ID NO: 77593 - RNA, 26 nt, Human
aagaugcuguuguccuucacaguuca

SEQ ID NO: 77594 - RNA, 21 nt, Human
accaaaaauuuccaacuuccu

SEQ ID NO: 77595 - RNA, 21 nt, Human
accaaauaauuuuuauucaca

SEQ ID NO: 77596 - RNA, 24 nt, Human
acgaugaugaugauaaugauaacu

SEQ ID NO: 77597 - RNA, 19 nt, Human
acugucuuucugaaguugu

SEQ ID NO: 77598 - RNA, 21 nt, Human
agacaaagucauaaaccaaaa

SEQ ID NO: 77599 - RNA, 20 nt, Human
agcccaacuuuucuucuacc

SEQ ID NO: 77600 - RNA, 22 nt, Human
agucauaaaccaaaaauuucca

SEQ ID NO: 77601 - RNA, 21 nt, Human
agucauccuuauuuugaaagc

SEQ ID NO: 77602 - RNA, 24 nt, Human
cacaauauuauucuaaagucaucc

SEQ ID NO: 77603 - RNA, 18 nt, Human
cauccuuauuuugaaagc

SEQ ID NO: 77604 - RNA, 25 nt, Human
cauccuuauuuugaaagccuaaaga

SEQ ID NO: 77605 - RNA, 20 nt, Human
ccacagcagccuacaccuuc

SEQ ID NO: 77606 - RNA, 18 nt, Human
cugcguuuucugcgucug

SEQ ID NO: 77607 - RNA, 19 nt, Human
uaaaccaaaaauuuccaac

SEQ ID NO: 77608 - RNA, 18 nt, Human
uaccacagcagccuacac

SEQ ID NO: 77609 - RNA, 21 nt, Human
uaccacagcagccuacaccuu

SEQ ID NO: 77610 - RNA, 24 nt, Human
uaccaccaagcuagacauuuuaau

SEQ ID NO: 77611 - RNA, 21 nt, Human
uagacaaagucauaaaccaaa

SEQ ID NO: 77612 - RNA, 25 nt, Human
ucuaugacacaauauuauucuaaag

SEQ ID NO: 77613 - RNA, 25 nt, Human
uguacagucacugucuuucugaagu

SEQ ID NO: 77614 - RNA, 24 nt, Human
uuuuauggcuauaaaaauaccacc

SEQ ID NO: 77615 - RNA, 20 nt, Human
aaaacacuuucuguggauaa

SEQ ID NO: 77616 - RNA, 23 nt, Human
aaaacagauauuuaccuuaacac

SEQ ID NO: 77617 - RNA, 21 nt, Human
aaacagaguauaaaaaucaga

SEQ ID NO: 77618 - RNA, 18 nt, Human
aaagaacagcuucuccca

SEQ ID NO: 77619 - RNA, 18 nt, Human
aaccugauuccuuaacaa

SEQ ID NO: 77620 - RNA, 20 nt, Human
aaugcacagaguaugcucag

SEQ ID NO: 77621 - RNA, 23 nt, Human
accacaaaggauacaauuuuaac

SEQ ID NO: 77622 - RNA, 24 nt, Human
accauuuacugaguaccuacuaua

SEQ ID NO: 77623 - RNA, 19 nt, Human
acccauaguagcucucccu

SEQ ID NO: 77624 - RNA, 21 nt, Human
agaaaagagcaccugcaaaaa

SEQ ID NO: 77625 - RNA, 18 nt, Human
agacacuaaggcugcucc

SEQ ID NO: 77626 - RNA, 20 nt, Human
agagcaccucaggccugaaa

SEQ ID NO: 77627 - RNA, 26 nt, Human
agagcaccugcaaaaacagcgaaguc

SEQ ID NO: 77628 - RNA, 18 nt, Human
agccagccagcuacaaca

SEQ ID NO: 77629 - RNA, 20 nt, Human
agccccuggccguguggacc

SEQ ID NO: 77630 - RNA, 22 nt, Human
agcgcccagacccgagccucac

SEQ ID NO: 77631 - RNA, 19 nt, Human
aggaagacacuaaggcugc

SEQ ID NO: 77632 - RNA, 23 nt, Human
aggaggaaauaaacagaucagag

SEQ ID NO: 77633 - RNA, 22 nt, Human
aggaggcacuaaaaucauugag

SEQ ID NO: 77634 - RNA, 23 nt, Human
agguagaaaaaaccugauuccuu

SEQ ID NO: 77635 - RNA, 20 nt, Human
aguaugccucuuuguuuucu

SEQ ID NO: 77636 - RNA, 25 nt, Human
auaaaaaucagaguaugccucuuug

SEQ ID NO: 77637 - RNA, 18 nt, Human
auaaggcacaagacccuc

SEQ ID NO: 77638 - RNA, 19 nt, Human
augcugccacugagcugac

SEQ ID NO: 77639 - RNA, 23 nt, Human
caaacacacacaaaaaauugcug

SEQ ID NO: 77640 - RNA, 18 nt, Human
caacauaauguggaaagg

SEQ ID NO: 77641 - RNA, 18 nt, Human
caccugcaaaaacagagu

SEQ ID NO: 77642 - RNA, 20 nt, Human
cacuucuauagaagcaaaau

SEQ ID NO: 77643 - RNA, 21 nt, Human
cagaucaccaauuaaaagccc

SEQ ID NO: 77644 - RNA, 19 nt, Human
cagcaggaagacacuaagg

SEQ ID NO: 77645 - RNA, 21 nt, Human
caggcugugacaucaggaaga

SEQ ID NO: 77646 - RNA, 20 nt, Human
cagucaagagcaccucaggc

SEQ ID NO: 77647 - RNA, 18 nt, Human
ccagacccgagccucacu

SEQ ID NO: 77648 - RNA, 19 nt, Human
cgaaagcacacccuuagaa

SEQ ID NO: 77649 - RNA, 22 nt, Human
cguauccgaguguggggaugcc

SEQ ID NO: 77650 - RNA, 23 nt, Human
cgucaucacuggcuccugcccac

SEQ ID NO: 77651 - RNA, 19 nt, Human
cucuaaugacuuaguagcu

SEQ ID NO: 77652 - RNA, 21 nt, Human
cugagggaaaccaaaauacaa

SEQ ID NO: 77653 - RNA, 24 nt, Human
cugcaauuaaacaaauagugcaca

SEQ ID NO: 77654 - RNA, 21 nt, Human
cuggccguguggaccgggucu

SEQ ID NO: 77655 - RNA, 23 nt, Human
cuuaacaagacuucucagucacu

SEQ ID NO: 77656 - RNA, 22 nt, Human
cuuacauuaauguuuuucuagg

SEQ ID NO: 77657 - RNA, 22 nt, Human
cuuccugcuguguggcccaugg

SEQ ID NO: 77658 - RNA, 18 nt, Human
cuugcucaucaaaucucc

SEQ ID NO: 77659 - RNA, 21 nt, Human
cuuguuucucuuucccuuuca

SEQ ID NO: 77660 - RNA, 22 nt, Human
cuuucccuuucacuuuuccuuu

SEQ ID NO: 77661 - RNA, 22 nt, Human
gaaauaaacagaucagagguca

SEQ ID NO: 77662 - RNA, 19 nt, Human
gaaauuuuuccaaugcauu

SEQ ID NO: 77663 - RNA, 19 nt, Human
gaagcuccucaauggcccu

SEQ ID NO: 77664 - RNA, 18 nt, Human
gacccuauggcuaaaagu

SEQ ID NO: 77665 - RNA, 24 nt, Human
gaccuagcggauugcaucagcagg

SEQ ID NO: 77666 - RNA, 22 nt, Human
gaccuggggcagugcccgaggc

SEQ ID NO: 77667 - RNA, 20 nt, Human
gagccagcgcccagacccga

SEQ ID NO: 77668 - RNA, 21 nt, Human
gaguaugccucuuuguuuucu

SEQ ID NO: 77669 - RNA, 19 nt, Human
gaugaaaagggcuuaaaaa

SEQ ID NO: 77670 - RNA, 25 nt, Human
gauggcaaauaaauaauucucauuu

SEQ ID NO: 77671 - RNA, 19 nt, Human
gcacagguagccaaagaaa

SEQ ID NO: 77672 - RNA, 25 nt, Human
gcggcggcgaguacacguggcgggc

SEQ ID NO: 77673 - RNA, 24 nt, Human
ggaaauaaacagaucagaggucaa

SEQ ID NO: 77674 - RNA, 21 nt, Human
ggaagacaauuuuuccacaga

SEQ ID NO: 77675 - RNA, 22 nt, Human
ggacaauggugggaaaugcacu

SEQ ID NO: 77676 - RNA, 20 nt, Human
ggagacgucaaggaggagga

SEQ ID NO: 77677 - RNA, 23 nt, Human
ggagucucucccagcccgaagau

SEQ ID NO: 77678 - RNA, 18 nt, Human
ggccguguggaccggguc

SEQ ID NO: 77679 - RNA, 19 nt, Human
ggcugcucccccaggccgc

SEQ ID NO: 77680 - RNA, 19 nt, Human
gggcagugcccgaggcggc

SEQ ID NO: 77681 - RNA, 20 nt, Human
gggguugggguccccugcuc

SEQ ID NO: 77682 - RNA, 21 nt, Human
guauccgaguguggggaugcc

SEQ ID NO: 77683 - RNA, 21 nt, Human
gucgccugacagccagccagc

SEQ ID NO: 77684 - RNA, 21 nt, Human
guggaagacaauuuuuccaca

SEQ ID NO: 77685 - RNA, 24 nt, Human
uaaaaaaaagaaaacacuuucugu

SEQ ID NO: 77686 - RNA, 18 nt, Human
uacacguggcgggcugga

SEQ ID NO: 77687 - RNA, 25 nt, Human
uaccagguagaaaaaaccugauucc

SEQ ID NO: 77688 - RNA, 20 nt, Human
uacuacuaccaaguuaugaa

SEQ ID NO: 77689 - RNA, 25 nt, Human
uagccauaaauacagaugaagcucc

SEQ ID NO: 77690 - RNA, 19 nt, Human
uauaaaagacccuauggcu

SEQ ID NO: 77691 - RNA, 20 nt, Human
uauaaaagacccuauggcua

SEQ ID NO: 77692 - RNA, 23 nt, Human
uaugcaaauaucagcaacaauau

SEQ ID NO: 77693 - RNA, 23 nt, Human
uauggcuaaaaguuuuggaaaag

SEQ ID NO: 77694 - RNA, 23 nt, Human
ucaauggcccaccacucaccucu

SEQ ID NO: 77695 - RNA, 20 nt, Human
ucacuggcuccugcccaccu

SEQ ID NO: 77696 - RNA, 22 nt, Human
ucacuggcuccugcccaccucc

SEQ ID NO: 77697 - RNA, 23 nt, Human
ucccggggugcagggcagaggug

SEQ ID NO: 77698 - RNA, 23 nt, Human
uccuaaacuaacuaugcuucaga

SEQ ID NO: 77699 - RNA, 21 nt, Human
uccuaugagaaucuaaugcug

SEQ ID NO: 77700 - RNA, 19 nt, Human
uccucaauggcccaccacu

SEQ ID NO: 77701 - RNA, 18 nt, Human
uccugcccaccucccuac

SEQ ID NO: 77702 - RNA, 21 nt, Human
ucuaacuuucacaauggacaa

SEQ ID NO: 77703 - RNA, 18 nt, Human
ucuaaugacuuaguagcu

SEQ ID NO: 77704 - RNA, 22 nt, Human
ucuaaugcugccacugagccga

SEQ ID NO: 77705 - RNA, 22 nt, Human
ucuaccaaaaaaaaaaaaaaaa

SEQ ID NO: 77706 - RNA, 22 nt, Human
ucuaccaaaaaaaaaaaaaaaa

SEQ ID NO: 77707 - RNA, 28 nt, Human
ucuaccaaaaaaaaaaaaaaaagauuua

SEQ ID NO: 77708 - RNA, 20 nt, Human
ucucccagcccgaagauucg

SEQ ID NO: 77709 - RNA, 22 nt, Human
ucucgccacaauaaauuuggag

SEQ ID NO: 77710 - RNA, 25 nt, Human
ucucugaagucaacucuucuuuugg

SEQ ID NO: 77711 - RNA, 19 nt, Human
ucucuuucccuuucacuuu

SEQ ID NO: 77712 - RNA, 26 nt, Human
ucugcaauuaacacuugacauaaaac

SEQ ID NO: 77713 - RNA, 21 nt, Human
ugaaaagaacagcuucuccca

SEQ ID NO: 77714 - RNA, 19 nt, Human
ugaaacuguuacaccucag

SEQ ID NO: 77715 - RNA, 22 nt, Human
ugaaagaaaugauacaaacaua

SEQ ID NO: 77716 - RNA, 21 nt, Human
ugaaaggaagagaacaugcaa

SEQ ID NO: 77717 - RNA, 22 nt, Human
ugaagaaacaaucacucuugua

SEQ ID NO: 77718 - RNA, 21 nt, Human
ugacaagagguggaguucagg

SEQ ID NO: 77719 - RNA, 20 nt, Human
ugaccucucucuagagcagu

SEQ ID NO: 77720 - RNA, 18 nt, Human
ugacugccacaaagaaaa

SEQ ID NO: 77721 - RNA, 18 nt, Human
ugagaaucuaaugcugcc

SEQ ID NO: 77722 - RNA, 18 nt, Human
ugaggacugagggaaacc

SEQ ID NO: 77723 - RNA, 22 nt, Human
ugaucaacccaauuaaacauua

SEQ ID NO: 77724 - RNA, 22 nt, Human
ugauggcaaauaaauaauucuc

SEQ ID NO: 77725 - RNA, 23 nt, Human
ugcaacuuuuuccuagacuacua

SEQ ID NO: 77726 - RNA, 21 nt, Human
ugcaauuaacacuugacauaa

SEQ ID NO: 77727 - RNA, 22 nt, Human
ugccacaaagaaaauuucuaac

SEQ ID NO: 77728 - RNA, 24 nt, Human
ugccacaaagaaaauuucuaacag

SEQ ID NO: 77729 - RNA, 19 nt, Human
ugcguauccgagugugggg

SEQ ID NO: 77730 - RNA, 21 nt, Human
ugcuguguggcccauggccug

SEQ ID NO: 77731 - RNA, 23 nt, Human
uggcaccagggaccaguuuugug

SEQ ID NO: 77732 - RNA, 25 nt, Human
uggcaccagggaccaguuuugugga

SEQ ID NO: 77733 - RNA, 18 nt, Human
uggcaugaagaaacaauc

SEQ ID NO: 77734 - RNA, 23 nt, Human
ugggaaguagccauaaauacaga

SEQ ID NO: 77735 - RNA, 21 nt, Human
uggggguugggguccccugcu

SEQ ID NO: 77736 - RNA, 22 nt, Human
uggggguugggguccccugcuc

SEQ ID NO: 77737 - RNA, 19 nt, Human
ugguugguaugauaucaug

SEQ ID NO: 77738 - RNA, 21 nt, Human
uguggcccauggccugggggu

SEQ ID NO: 77739 - RNA, 22 nt, Human
uguuauauggcuuacauuaaug

SEQ ID NO: 77740 - RNA, 25 nt, Human
uguucuccuuaucaggagaccucca

SEQ ID NO: 77741 - RNA, 19 nt, Human
uuaacacuugacauaaaac

SEQ ID NO: 77742 - RNA, 18 nt, Human
uucaaagaaaagagcacc

SEQ ID NO: 77743 - RNA, 22 nt, Human
uucaaagaaaagagcaccugca

SEQ ID NO: 77744 - RNA, 18 nt, Human
uucacuuuuccuuugugc

SEQ ID NO: 77745 - RNA, 19 nt, Human
uucacuuuuccuuugugcc

SEQ ID NO: 77746 - RNA, 20 nt, Human
uugauuuaaaaaaaagaaaa

SEQ ID NO: 77747 - RNA, 20 nt, Human
uugcuguauuaauccacugc

SEQ ID NO: 77748 - RNA, 26 nt, Human
uuuccuagacuacuauaugaagaaug

SEQ ID NO: 77749 - RNA, 19 nt, Human
aaaaucaacggcagcacca

SEQ ID NO: 77750 - RNA, 18 nt, Human
aagaugccugggucggcc

SEQ ID NO: 77751 - RNA, 22 nt, Human
agacagagaaaaaaaaaucaac

SEQ ID NO: 77752 - RNA, 20 nt, Human
agcaaagacagagaaaaaaa

SEQ ID NO: 77753 - RNA, 19 nt, Human
cagagacccagacgccgcc

SEQ ID NO: 77754 - RNA, 21 nt, Human
caugggggcgccagagaccca

SEQ ID NO: 77755 - RNA, 22 nt, Human
cccgcgacgaggggcugggggc

SEQ ID NO: 77756 - RNA, 18 nt, Human
ccugaacccgcgacgagg

SEQ ID NO: 77757 - RNA, 21 nt, Human
gaacccgcgacgaggggcugg

SEQ ID NO: 77758 - RNA, 23 nt, Human
gcaaagacagagaaaaaaaaauc

SEQ ID NO: 77759 - RNA, 23 nt, Human
gcaaccacaugggggcgccagag

SEQ ID NO: 77760 - RNA, 20 nt, Human
gcagcaaagacagagaaaaa

SEQ ID NO: 77761 - RNA, 22 nt, Human
uaaugggcggaccugaacccgc

SEQ ID NO: 77762 - RNA, 19 nt, Human
uauugcacuucaggugagu

SEQ ID NO: 77763 - RNA, 20 nt, Human
ucaaaauugcagcaaagaca

SEQ ID NO: 77764 - RNA, 24 nt, Human
ugaacccgcgacgaggggcugggg

SEQ ID NO: 77765 - RNA, 21 nt, Human
ugaccgcacgacaaggaguaa

SEQ ID NO: 77766 - RNA, 22 nt, Human
uggcgugacgagaugcuacggg

SEQ ID NO: 77767 - RNA, 20 nt, Human
ugggggccaagaugccuggg

SEQ ID NO: 77768 - RNA, 27 nt, Human
uugcacuucaggugagucauugguaac

SEQ ID NO: 77769 - RNA, 21 nt, Human
aaaauacacgugacuaaaagc

SEQ ID NO: 77770 - RNA, 22 nt, Human
aaagaaagaaauugaaccaggc

SEQ ID NO: 77771 - RNA, 23 nt, Human
aaagaugguaaaguuugcaagga

SEQ ID NO: 77772 - RNA, 23 nt, Human
aggaaagaaagaaauugaaccag

SEQ ID NO: 77773 - RNA, 20 nt, Human
cgugacuaaaagcagagcac

SEQ ID NO: 77774 - RNA, 25 nt, Human
cuccagccuguaaauuggacugcac

SEQ ID NO: 77775 - RNA, 21 nt, Human
ggaaaauauguucuauaaagg

SEQ ID NO: 77776 - RNA, 18 nt, Human
ggcauuuuuguuucagcu

SEQ ID NO: 77777 - RNA, 18 nt, Human
ggggggaaaaaacuuaaa

SEQ ID NO: 77778 - RNA, 25 nt, Human
uaaauuuauuaaggaaagaaagaaa

SEQ ID NO: 77779 - RNA, 22 nt, Human
uacacgugacuaaaagcagagc

SEQ ID NO: 77780 - RNA, 21 nt, Human
uauuguaaacuaugguguaca

SEQ ID NO: 77781 - RNA, 22 nt, Human
uauuuuugccuugaucuaaagg

SEQ ID NO: 77782 - RNA, 24 nt, Human
ugaaaauacacgugacuaaaagca

SEQ ID NO: 77783 - RNA, 27 nt, Human
uuaacuguagaacuuuauauugugaaa

SEQ ID NO: 77784 - RNA, 27 nt, Human
uucaauucuuauuuuaauuaggaaaca

SEQ ID NO: 77785 - RNA, 19 nt, Human
uuuaauuaggaaacauaau

SEQ ID NO: 77786 - RNA, 20 nt, Human
uuuuggggggaaaaaacuua

SEQ ID NO: 77787 - RNA, 19 nt, Human
acuggggaagacaguggug

SEQ ID NO: 77788 - RNA, 24 nt, Human
agagagccaggcgcagagaugcag

SEQ ID NO: 77789 - RNA, 23 nt, Human
agcugaggauggguggggguggg

SEQ ID NO: 77790 - RNA, 25 nt, Human
agggagcugacuggggaagacagug

SEQ ID NO: 77791 - RNA, 24 nt, Human
cacccagccccugggagaaggcac

SEQ ID NO: 77792 - RNA, 23 nt, Human
caggcugaccugccauguccacc

SEQ ID NO: 77793 - RNA, 18 nt, Human
caggugaagagggggcug

SEQ ID NO: 77794 - RNA, 21 nt, Human
ccacaggcugaccugccaugu

SEQ ID NO: 77795 - RNA, 21 nt, Human
ccauguccaccccaugcccag

SEQ ID NO: 77796 - RNA, 21 nt, Human
ccuuagaguggggcuaccucu

SEQ ID NO: 77797 - RNA, 26 nt, Human
cuucuaguccugaaugugcccucacc

SEQ ID NO: 77798 - RNA, 22 nt, Human
gaccugccauguccaccccuuu

SEQ ID NO: 77799 - RNA, 22 nt, Human
gcccagaggggcuucuaguccu

SEQ ID NO: 77800 - RNA, 23 nt, Human
gcugaguauuuuagagggagcug

SEQ ID NO: 77801 - RNA, 23 nt, Human
ggaagacaguggugugcugucag

SEQ ID NO: 77802 - RNA, 24 nt, Human
gggugggggugggcugagcagguc

SEQ ID NO: 77803 - RNA, 24 nt, Human
uagcugaggauggguggggguggg

SEQ ID NO: 77804 - RNA, 20 nt, Human
uccacaggcugaccugccau

SEQ ID NO: 77805 - RNA, 19 nt, Human
uccaccccaugcccagagg

SEQ ID NO: 77806 - RNA, 23 nt, Human
uccccugacaauguaacagccgg

SEQ ID NO: 77807 - RNA, 22 nt, Human
ugccauguccaccccaugccca

SEQ ID NO: 77808 - RNA, 26 nt, Human
ugcccagaggggcuucuaaccucaag

SEQ ID NO: 77809 - RNA, 19 nt, Human
ugcccagaggggcuucuag

SEQ ID NO: 77810 - RNA, 20 nt, Human
ugggagaaggcacuguaaca

SEQ ID NO: 77811 - RNA, 24 nt, Human
uuuauucgugaccucugcuggcca

SEQ ID NO: 77812 - RNA, 22 nt, Human
aaaaagagguaagucggaggaa

SEQ ID NO: 77813 - RNA, 22 nt, Human
aaacucucuuuucaaaaagagg

SEQ ID NO: 77814 - RNA, 24 nt, Human
agauguaauuaaacagaauuuaua

SEQ ID NO: 77815 - RNA, 26 nt, Human
cacauaauauuuacagauguaauuaa

SEQ ID NO: 77816 - RNA, 22 nt, Human
gaugguucauuuaauaaaaacu

SEQ ID NO: 77817 - RNA, 22 nt, Human
ucacacacauaauauuuacaga

SEQ ID NO: 77818 - RNA, 27 nt, Human
ucucaggcuaugcagccgcacgccgcc

SEQ ID NO: 77819 - RNA, 19 nt, Human
ugaauacuaucacacacau

SEQ ID NO: 77820 - RNA, 26 nt, Human
uuuuuuuuuuuuuuuuuuuuuugggg

SEQ ID NO: 77821 - RNA, 23 nt, Human
aaaaaaaaaaaaagaaaaaagga

SEQ ID NO: 77822 - RNA, 21 nt, Human
aaaaaggaaaaaauaccucau

SEQ ID NO: 77823 - RNA, 20 nt, Human
aaaaauaccucaucaaauua

SEQ ID NO: 77824 - RNA, 18 nt, Human
aaaaaugacaggaggacc

SEQ ID NO: 77825 - RNA, 25 nt, Human
aaaauagaaaauauuuaaaaaagua

SEQ ID NO: 77826 - RNA, 19 nt, Human
aaacaaacagugagagcau

SEQ ID NO: 77827 - RNA, 26 nt, Human
aaaucagucuuaaaauagaaaauauu

SEQ ID NO: 77828 - RNA, 21 nt, Human
aaaugaauuuuggcaaaccga

SEQ ID NO: 77829 - RNA, 20 nt, Human
aacauggcaaaacaccgucu

SEQ ID NO: 77830 - RNA, 21 nt, Human
aagaggcuguuuacaugccua

SEQ ID NO: 77831 - RNA, 23 nt, Human
aagaggcuguuuacaugccuaua

SEQ ID NO: 77832 - RNA, 24 nt, Human
aaugacaggaggaccaaggagaaa

SEQ ID NO: 77833 - RNA, 24 nt, Human
aaugcgccacugcacuccagccug

SEQ ID NO: 77834 - RNA, 21 nt, Human
acaacaaaaagacaaaucugg

SEQ ID NO: 77835 - RNA, 24 nt, Human
acaggaacagcuuaaugcugaaaa

SEQ ID NO: 77836 - RNA, 24 nt, Human
acugcacuccagccugggcgauag

SEQ ID NO: 77837 - RNA, 26 nt, Human
acugcacuccagccugggcgauagag

SEQ ID NO: 77838 - RNA, 22 nt, Human
agaaacgggaaagcaaaaaaaa

SEQ ID NO: 77839 - RNA, 20 nt, Human
agaaguugcagugagccuag

SEQ ID NO: 77840 - RNA, 22 nt, Human
agaaugcgccacugcacuccag

SEQ ID NO: 77841 - RNA, 22 nt, Human
agagaaugaaaaguacagagaa

SEQ ID NO: 77842 - RNA, 23 nt, Human
agaggcugaggugagaggaucac

SEQ ID NO: 77843 - RNA, 21 nt, Human
agcacaaaugcacugaggaaa

SEQ ID NO: 77844 - RNA, 24 nt, Human
agcacuuugggaggccacgcuggg

SEQ ID NO: 77845 - RNA, 18 nt, Human
agccuggccaacauggca

SEQ ID NO: 77846 - RNA, 21 nt, Human
agccuuucggguggcuccgcc

SEQ ID NO: 77847 - RNA, 20 nt, Human
agcgggcguuuccucaagcc

SEQ ID NO: 77848 - RNA, 25 nt, Human
aggaaaaaaagaaauuacuaaaaag

SEQ ID NO: 77849 - RNA, 20 nt, Human
aggaggaccaaggagaaacu

SEQ ID NO: 77850 - RNA, 19 nt, Human
aggcagaaguugcagugag

SEQ ID NO: 77851 - RNA, 21 nt, Human
aggcagaaguugcagugagcc

SEQ ID NO: 77852 - RNA, 23 nt, Human
aggcagaaguugcagugagccua

SEQ ID NO: 77853 - RNA, 22 nt, Human
aggcugaggugagaggaucacg

SEQ ID NO: 77854 - RNA, 24 nt, Human
aguacugaaagaccuuaaaaagga

SEQ ID NO: 77855 - RNA, 19 nt, Human
aguccaggaguucaagacc

SEQ ID NO: 77856 - RNA, 22 nt, Human
aucccagcacuuugggaggcca

SEQ ID NO: 77857 - RNA, 21 nt, Human
augcuuuuuuaauucuaaaaa

SEQ ID NO: 77858 - RNA, 20 nt, Human
caaaaagaggcuguuuacau

SEQ ID NO: 77859 - RNA, 26 nt, Human
caaaccgagaucuuagguggcucaca

SEQ ID NO: 77860 - RNA, 19 nt, Human
caaaugcacugaggaaaaa

SEQ ID NO: 77861 - RNA, 23 nt, Human
caaauguaaacaaaugauuacag

SEQ ID NO: 77862 - RNA, 19 nt, Human
caaauuacauguaauaacu

SEQ ID NO: 77863 - RNA, 24 nt, Human
caacaaaaagacaaaucuggcuaa

SEQ ID NO: 77864 - RNA, 18 nt, Human
cacggcgaggcgcguccc

SEQ ID NO: 77865 - RNA, 23 nt, Human
cacuccagccugggcgauagagc

SEQ ID NO: 77866 - RNA, 19 nt, Human
cacugcacuccagccuggg

SEQ ID NO: 77867 - RNA, 21 nt, Human
cacugcacuccagccugggcg

SEQ ID NO: 77868 - RNA, 22 nt, Human
cacugcacuccagccugggcga

SEQ ID NO: 77869 - RNA, 23 nt, Human
cacugcacuccagccugggcgau

SEQ ID NO: 77870 - RNA, 24 nt, Human
cacugcacuccagccugggcgaua

SEQ ID NO: 77871 - RNA, 27 nt, Human
cacugcacuccagccugggcgauagag

SEQ ID NO: 77872 - RNA, 22 nt, Human
cagaauugucacacacaccaaa

SEQ ID NO: 77873 - RNA, 20 nt, Human
cagcacuuugggaggccacg

SEQ ID NO: 77874 - RNA, 25 nt, Human
cagcacuuugggaggccacgcuggg

SEQ ID NO: 77875 - RNA, 25 nt, Human
caguaucaaaaagaggcuguuuaca

SEQ ID NO: 77876 - RNA, 22 nt, Human
cauuaaaaacagaauugucaca

SEQ ID NO: 77877 - RNA, 30 nt, Human
cauuuuuugucaucauuaaaaauuaaaagg

SEQ ID NO: 77878 - RNA, 20 nt, Human
ccacugcacuccagccuggg

SEQ ID NO: 77879 - RNA, 20 nt, Human
ccacugcacuccagccuggg

SEQ ID NO: 77880 - RNA, 21 nt, Human
ccacugcacuccagccugggc

SEQ ID NO: 77881 - RNA, 21 nt, Human
ccacugcacuccagccugggc

SEQ ID NO: 77882 - RNA, 21 nt, Human
ccacugcacuccagccugggc

SEQ ID NO: 77883 - RNA, 22 nt, Human
ccacugcacuccagccugggcg

SEQ ID NO: 77884 - RNA, 23 nt, Human
ccacugcacuccagccugggcga

SEQ ID NO: 77885 - RNA, 23 nt, Human
ccacugcacuccagccugggcga

SEQ ID NO: 77886 - RNA, 18 nt, Human
cccuggcugggggcuucg

SEQ ID NO: 77887 - RNA, 20 nt, Human
ccgcgggccgauccuguucc

SEQ ID NO: 77888 - RNA, 22 nt, Human
ccgcgggccgauccuguucccg

SEQ ID NO: 77889 - RNA, 18 nt, Human
ccuauacgacaauggagu

SEQ ID NO: 77890 - RNA, 22 nt, Human
ccugagaaguguggaugaaaag

SEQ ID NO: 77891 - RNA, 19 nt, Human
cgacaauggaguggaaaag

SEQ ID NO: 77892 - RNA, 19 nt, Human
cgagaguagauaaaaauga

SEQ ID NO: 77893 - RNA, 22 nt, Human
cgggaaagcaaaaaaaaaaaaa

SEQ ID NO: 77894 - RNA, 23 nt, Human
cgggaaagcaaaaaaaaaaaaaa

SEQ ID NO: 77895 - RNA, 24 nt, Human
cgugucuguaaucccagcacuuug

SEQ ID NO: 77896 - RNA, 19 nt, Human
cuagcacaaaugcacugag

SEQ ID NO: 77897 - RNA, 18 nt, Human
cucaaaaaaaaaaaaaag

SEQ ID NO: 77898 - RNA, 26 nt, Human
cucaaaaaaaaaaaaaagaaaaaagg

SEQ ID NO: 77899 - RNA, 24 nt, Human
cucgugucuguaaucccagcacuu

SEQ ID NO: 77900 - RNA, 26 nt, Human
cugaaaauuugcugcugaaugacugg

SEQ ID NO: 77901 - RNA, 21 nt, Human
cuguaaucccagcacuuuggg

SEQ ID NO: 77902 - RNA, 21 nt, Human
cugucucaaaaaaaaaaaaaa

SEQ ID NO: 77903 - RNA, 22 nt, Human
cugucucaaaaaaaaaaaaaag

SEQ ID NO: 77904 - RNA, 19 nt, Human
cuuccggccccgccucuga

SEQ ID NO: 77905 - RNA, 22 nt, Human
gaagaaggagaggaggcggagc

SEQ ID NO: 77906 - RNA, 21 nt, Human
gacaauggaguggaaaagaga

SEQ ID NO: 77907 - RNA, 18 nt, Human
gaccggagccuuucgggu

SEQ ID NO: 77908 - RNA, 27 nt, Human
gagcaagacugucucaaaaaaaaaaaa

SEQ ID NO: 77909 - RNA, 18 nt, Human
gagcgggucgggagaaag

SEQ ID NO: 77910 - RNA, 19 nt, Human
gagcucgggcugcgccgcc

SEQ ID NO: 77911 - RNA, 23 nt, Human
gauagagcaagacugucucaaaa

SEQ ID NO: 77912 - RNA, 24 nt, Human
gcaaaacaccgucucuacaaaaau

SEQ ID NO: 77913 - RNA, 22 nt, Human
gcaaaauuuccauuucuauguu

SEQ ID NO: 77914 - RNA, 24 nt, Human
gcacuccagccugggcgauagagc

SEQ ID NO: 77915 - RNA, 21 nt, Human
gcaggcaccgccccacggcga

SEQ ID NO: 77916 - RNA, 22 nt, Human
gccacugcacuccagccugggc

SEQ ID NO: 77917 - RNA, 24 nt, Human
gccacugcacuccagccugggcga

SEQ ID NO: 77918 - RNA, 23 nt, Human
gcccacagcgggcguuuccucaa

SEQ ID NO: 77919 - RNA, 19 nt, Human
gcccacuuguucaaauagc

SEQ ID NO: 77920 - RNA, 21 nt, Human
gcgcuucuuccggguccggga

SEQ ID NO: 77921 - RNA, 22 nt, Human
gcugcgccgccccgcccuggcu

SEQ ID NO: 77922 - RNA, 22 nt, Human
gcuugaguccaggaguucaaga

SEQ ID NO: 77923 - RNA, 22 nt, Human
ggaaacagauaaaauuguaauu

SEQ ID NO: 77924 - RNA, 24 nt, Human
ggagccuuucggguggcuccgccc

SEQ ID NO: 77925 - RNA, 18 nt, Human
ggcucaggcgcaggcacc

SEQ ID NO: 77926 - RNA, 19 nt, Human
gggaaagcaaaaaaaaaaa

SEQ ID NO: 77927 - RNA, 18 nt, Human
gggaacagagggacucgg

SEQ ID NO: 77928 - RNA, 24 nt, Human
gggccgauccuguucccgcccccg

SEQ ID NO: 77929 - RNA, 23 nt, Human
gguggcucgugucuguaauccca

SEQ ID NO: 77930 - RNA, 24 nt, Human
gguggcucgugucuguaaucccag

SEQ ID NO: 77931 - RNA, 24 nt, Human
gguugcuugaguccaggaguucaa

SEQ ID NO: 77932 - RNA, 20 nt, Human
gucucaaaaaaaaaaaaaag

SEQ ID NO: 77933 - RNA, 19 nt, Human
gugucuguaaucccagcac

SEQ ID NO: 77934 - RNA, 22 nt, Human
guugcagugagccuagaaugcg

SEQ ID NO: 77935 - RNA, 24 nt, Human
guugcuugaguccaggaguucaag

SEQ ID NO: 77936 - RNA, 23 nt, Human
uaaaaaaguacugaaagaccuua

SEQ ID NO: 77937 - RNA, 24 nt, Human
uaagaaacgggaaagcaaaaaaaa

SEQ ID NO: 77938 - RNA, 28 nt, Human
uaagaaacgggaaagcaaaaaaaaaaaa

SEQ ID NO: 77939 - RNA, 22 nt, Human
uacagguagagcccugggccca

SEQ ID NO: 77940 - RNA, 21 nt, Human
uacgacaauggaguggaaaag

SEQ ID NO: 77941 - RNA, 20 nt, Human
uagaaugcgccacugcacuc

SEQ ID NO: 77942 - RNA, 20 nt, Human
uagcacaaaugcacugagga

SEQ ID NO: 77943 - RNA, 24 nt, Human
uagcauuaaaaacagaauugucac

SEQ ID NO: 77944 - RNA, 24 nt, Human
uagguugcuugaguccaggaguuc

SEQ ID NO: 77945 - RNA, 22 nt, Human
uaguaagggucuauucucaaau

SEQ ID NO: 77946 - RNA, 27 nt, Human
uauuucaacuguacauugguccucauu

SEQ ID NO: 77947 - RNA, 21 nt, Human
ucacguaagcaugggaggcag

SEQ ID NO: 77948 - RNA, 23 nt, Human
ucaggcgcaggcaccgccccacg

SEQ ID NO: 77949 - RNA, 24 nt, Human
uccagccugggcgauagagcaaga

SEQ ID NO: 77950 - RNA, 19 nt, Human
ucccuuagcagagcccgcc

SEQ ID NO: 77951 - RNA, 21 nt, Human
ucgggagaaagacggccgccc

SEQ ID NO: 77952 - RNA, 22 nt, Human
ucgugucuguaaucccagcacu

SEQ ID NO: 77953 - RNA, 21 nt, Human
ugaaagaccuuaaaaaggaaa

SEQ ID NO: 77954 - RNA, 21 nt, Human
ugaacaggaacagcuuaaugc

SEQ ID NO: 77955 - RNA, 21 nt, Human
ugacaggaggaccaaggagaa

SEQ ID NO: 77956 - RNA, 24 nt, Human
ugagagcauaagauuuauaaacau

SEQ ID NO: 77957 - RNA, 24 nt, Human
ugagaggcugaggugagaggauca

SEQ ID NO: 77958 - RNA, 20 nt, Human
ugaggugagaggaucacgua

SEQ ID NO: 77959 - RNA, 24 nt, Human
uggcucgugucuguaaucccagca

SEQ ID NO: 77960 - RNA, 24 nt, Human
ugggaggcagaaguugcagugagc

SEQ ID NO: 77961 - RNA, 23 nt, Human
ugguggcacacacuuguagucuc

SEQ ID NO: 77962 - RNA, 19 nt, Human
uguaaaauuagucaaauuu

SEQ ID NO: 77963 - RNA, 23 nt, Human
ugucuguaaucccagcacuuugg

SEQ ID NO: 77964 - RNA, 23 nt, Human
ugucuguaaucccagcacuuugg

SEQ ID NO: 77965 - RNA, 24 nt, Human
uuaaaagacaugcaucaaauguaa

SEQ ID NO: 77966 - RNA, 20 nt, Human
uuccucaagccacgccugcc

SEQ ID NO: 77967 - RNA, 25 nt, Human
uugagaggcugaggugagaggauca

SEQ ID NO: 77968 - RNA, 22 nt, Human
uugaguccaggaguucaagacc

SEQ ID NO: 77969 - RNA, 20 nt, Human
uuugcaauuaauaauagaaa

SEQ ID NO: 77970 - RNA, 27 nt, Human
uuuuuuuuuuuuuuuuuuuuacuuuaa

SEQ ID NO: 77971 - RNA, 26 nt, Human
aaaaaaacaggugugcuggugacaag

SEQ ID NO: 77972 - RNA, 22 nt, Human
aaaaaaauccuugcacuguaga

SEQ ID NO: 77973 - RNA, 18 nt, Human
aaaaaagaaaaagaaaaa

SEQ ID NO: 77974 - RNA, 18 nt, Human
aaaaagaaaaaagaaaaa

SEQ ID NO: 77975 - RNA, 24 nt, Human
aaaaagccagguuguaaugaccuu

SEQ ID NO: 77976 - RNA, 22 nt, Human
aaaaagguacauugauaccuuu

SEQ ID NO: 77977 - RNA, 24 nt, Human
aaaagaaaaaagaaaaagaaaaag

SEQ ID NO: 77978 - RNA, 23 nt, Human
aaaagaaaaagaaaaagaaaaaa

SEQ ID NO: 77979 - RNA, 20 nt, Human
aaaagacaacauagaaugua

SEQ ID NO: 77980 - RNA, 21 nt, Human
aaaagacaacauagaauguau

SEQ ID NO: 77981 - RNA, 25 nt, Human
aaaagaccauaaauguauuuuagca

SEQ ID NO: 77982 - RNA, 23 nt, Human
aaaagccagguuguaaugaccuu

SEQ ID NO: 77983 - RNA, 24 nt, Human
aaacaaauacaauaaaaagccagg

SEQ ID NO: 77984 - RNA, 18 nt, Human
aaacagguacagaaguac

SEQ ID NO: 77985 - RNA, 20 nt, Human
aaagaacaagcaaacaccac

SEQ ID NO: 77986 - RNA, 19 nt, Human
aaagaacaagcaaacaccc

SEQ ID NO: 77987 - RNA, 21 nt, Human
aaagauggcgcagggaagaug

SEQ ID NO: 77988 - RNA, 28 nt, Human
aaauaaaaaaaaaaauaaaaacaaagaa

SEQ ID NO: 77989 - RNA, 22 nt, Human
aacaaguagaaagaaccaucga

SEQ ID NO: 77990 - RNA, 22 nt, Human
aacugccaaaaaaacacagaca

SEQ ID NO: 77991 - RNA, 19 nt, Human
aagaaggagacuccagaga

SEQ ID NO: 77992 - RNA, 23 nt, Human
aagcaaacaccaccuaaagcucc

SEQ ID NO: 77993 - RNA, 21 nt, Human
aagcauuaaaaauuaaagaac

SEQ ID NO: 77994 - RNA, 26 nt, Human
aagcgggcuuucucuuuaauaugcuu

SEQ ID NO: 77995 - RNA, 20 nt, Human
aaggacucugcaggacucug

SEQ ID NO: 77996 - RNA, 22 nt, Human
aaggggaguggugaaaaagggg

SEQ ID NO: 77997 - RNA, 24 nt, Human
acaaaaaaggauauguacaacccc

SEQ ID NO: 77998 - RNA, 22 nt, Human
acaagcaaacaccaccuaaagc

SEQ ID NO: 77999 - RNA, 18 nt, Human
acaccaccuaaagcucca

SEQ ID NO: 78000 - RNA, 20 nt, Human
acacuacauaacaaaccaac

SEQ ID NO: 78001 - RNA, 19 nt, Human
acagaaaaaagaccauaaa

SEQ ID NO: 78002 - RNA, 18 nt, Human
accuaaagcuccaacauu

SEQ ID NO: 78003 - RNA, 20 nt, Human
agaaaaaaauccuacaggga

SEQ ID NO: 78004 - RNA, 20 nt, Human
agaaaaaagaccauaaaugu

SEQ ID NO: 78005 - RNA, 18 nt, Human
agaaaaagaaaaaaaaca

SEQ ID NO: 78006 - RNA, 19 nt, Human
agaaaaagaaaaaaaacag

SEQ ID NO: 78007 - RNA, 21 nt, Human
agaaaaagaaaaagaaaaaaa

SEQ ID NO: 78008 - RNA, 19 nt, Human
agaaauaauacaaagaugg

SEQ ID NO: 78009 - RNA, 20 nt, Human
agaaauaauacaaagauggc

SEQ ID NO: 78010 - RNA, 24 nt, Human
agaacuuaacaaagaccagaaaca

SEQ ID NO: 78011 - RNA, 19 nt, Human
agaaggaaagggacaaaaa

SEQ ID NO: 78012 - RNA, 22 nt, Human
agacauauauacugcuacucuu

SEQ ID NO: 78013 - RNA, 18 nt, Human
agaccacgcugacgucga

SEQ ID NO: 78014 - RNA, 24 nt, Human
agcacacuacauaacaaaccaacg

SEQ ID NO: 78015 - RNA, 19 nt, Human
agcauggucuuuuucucuc

SEQ ID NO: 78016 - RNA, 23 nt, Human
agccagaagguggauagguagga

SEQ ID NO: 78017 - RNA, 25 nt, Human
aggaaaaaaaaaaaaaaggaaaaag

SEQ ID NO: 78018 - RNA, 22 nt, Human
aggaaaaagaaaaaagaaaaag

SEQ ID NO: 78019 - RNA, 19 nt, Human
aggacauaaugggucaucu

SEQ ID NO: 78020 - RNA, 23 nt, Human
aggcucccccaaaccgccauuau

SEQ ID NO: 78021 - RNA, 24 nt, Human
agggaagaugaauugugggagagc

SEQ ID NO: 78022 - RNA, 25 nt, Human
agggacaaaauggguguaugaacag

SEQ ID NO: 78023 - RNA, 18 nt, Human
agggaguggggcuggagg

SEQ ID NO: 78024 - RNA, 21 nt, Human
aggggaguggugaaaaagggg

SEQ ID NO: 78025 - RNA, 30 nt, Human
auaagcauuaaaaauuaaagaacaagcaag

SEQ ID NO: 78026 - RNA, 22 nt, Human
auagagcauugcugugauuguc

SEQ ID NO: 78027 - RNA, 20 nt, Human
auccaaaauaaauuagaaau

SEQ ID NO: 78028 - RNA, 21 nt, Human
augauauguauuacagaaugu

SEQ ID NO: 78029 - RNA, 24 nt, Human
auguuguuucuaauucucuucugg

SEQ ID NO: 78030 - RNA, 23 nt, Human
auugcuaugauuuauucccaagu

SEQ ID NO: 78031 - RNA, 22 nt, Human
auuugcuauguuguuucuaauu

SEQ ID NO: 78032 - RNA, 25 nt, Human
caaacugagaaaaguucugugcaaa

SEQ ID NO: 78033 - RNA, 20 nt, Human
caaagaccagaaacaaauac

SEQ ID NO: 78034 - RNA, 23 nt, Human
caaauagcacacaguguauggaa

SEQ ID NO: 78035 - RNA, 23 nt, Human
caaauuaaaaaaauauacugugg

SEQ ID NO: 78036 - RNA, 23 nt, Human
caacaguuaaaaauacaagcuuc

SEQ ID NO: 78037 - RNA, 24 nt, Human
caagcaaacaccaccuaaagcucc

SEQ ID NO: 78038 - RNA, 25 nt, Human
caagcaaacaccaccuaaagcuccu

SEQ ID NO: 78039 - RNA, 24 nt, Human
cacccaaugcugaauuaagcuaca

SEQ ID NO: 78040 - RNA, 22 nt, Human
cagacaacugccaaaaaaacac

SEQ ID NO: 78041 - RNA, 22 nt, Human
cagaccacgcugacgucgacug

SEQ ID NO: 78042 - RNA, 25 nt, Human
cagagucaagugcuauuugaacacc

SEQ ID NO: 78043 - RNA, 18 nt, Human
cagcaggaaaaaggaaca

SEQ ID NO: 78044 - RNA, 19 nt, Human
cagcauggucuuuuucucu

SEQ ID NO: 78045 - RNA, 22 nt, Human
cagcauuaauaaacagcaauau

SEQ ID NO: 78046 - RNA, 21 nt, Human
cauccaaaauaaauuagaaau

SEQ ID NO: 78047 - RNA, 21 nt, Human
caugugacauucuagcaggcu

SEQ ID NO: 78048 - RNA, 19 nt, Human
ccaagcaguaaaaaauacc

SEQ ID NO: 78049 - RNA, 21 nt, Human
ccagaaagaauuuuuaccacc

SEQ ID NO: 78050 - RNA, 21 nt, Human
ccccacuuagguucacggccu

SEQ ID NO: 78051 - RNA, 25 nt, Human
cccccaaaccgccauuauauggcuu

SEQ ID NO: 78052 - RNA, 20 nt, Human
cccccucuaaaaucugcccc

SEQ ID NO: 78053 - RNA, 20 nt, Human
cccccucuaaaaucugcccc

SEQ ID NO: 78054 - RNA, 26 nt, Human
ccuaaaaugcaguuccccccuaaaca

SEQ ID NO: 78055 - RNA, 23 nt, Human
ccuaagcuaaauuaaaagacaaa

SEQ ID NO: 78056 - RNA, 25 nt, Human
ccuccuauaauuuccccccucuaaa

SEQ ID NO: 78057 - RNA, 22 nt, Human
ccucuaaaaucugccccaaauu

SEQ ID NO: 78058 - RNA, 21 nt, Human
cgacaaacagcuuucauuaca

SEQ ID NO: 78059 - RNA, 20 nt, Human
cgggcggcggcggcggcggc

SEQ ID NO: 78060 - RNA, 23 nt, Human
cuaacacuagaugaacauuuaau

SEQ ID NO: 78061 - RNA, 22 nt, Human
cuaagcuaaauuaaaagacaaa

SEQ ID NO: 78062 - RNA, 23 nt, Human
cuaguuccccuccuacaucuccu

SEQ ID NO: 78063 - RNA, 23 nt, Human
cuccuacaucuccugcccauuuc

SEQ ID NO: 78064 - RNA, 21 nt, Human
cuuuagagacagacauuuagc

SEQ ID NO: 78065 - RNA, 22 nt, Human
cuuuuuuuuuuccacuaccaaa

SEQ ID NO: 78066 - RNA, 22 nt, Human
gaacaagcaaacaccaccuaaa

SEQ ID NO: 78067 - RNA, 24 nt, Human
gaagagcgguguguauccaaggca

SEQ ID NO: 78068 - RNA, 18 nt, Human
gaaggggaguggugaaaa

SEQ ID NO: 78069 - RNA, 24 nt, Human
gaauccucuuccauguuaacacaa

SEQ ID NO: 78070 - RNA, 21 nt, Human
gacaagcacucucauauucuu

SEQ ID NO: 78071 - RNA, 24 nt, Human
gacaguuaggaaaaccacacuuca

SEQ ID NO: 78072 - RNA, 24 nt, Human
gacauccaaaauaaauuagaaaua

SEQ ID NO: 78073 - RNA, 18 nt, Human
gcaaaaaaaaaaaaaaaa

SEQ ID NO: 78074 - RNA, 19 nt, Human
gcaauaguauugccccaua

SEQ ID NO: 78075 - RNA, 23 nt, Human
gcaguaaaaaauaccaaacugag

SEQ ID NO: 78076 - RNA, 22 nt, Human
gccagaaagaauuuuuaccacc

SEQ ID NO: 78077 - RNA, 23 nt, Human
gccauaacauaccauacaugcug

SEQ ID NO: 78078 - RNA, 19 nt, Human
gccuaggcuggaaggacuc

SEQ ID NO: 78079 - RNA, 20 nt, Human
gcggcggcggcggcggcggc

SEQ ID NO: 78080 - RNA, 20 nt, Human
gcggcggcggcggcggcggc

SEQ ID NO: 78081 - RNA, 20 nt, Human
gcggcggcggcggcggcggc

SEQ ID NO: 78082 - RNA, 20 nt, Human
gcggcggcggcggcggcggc

SEQ ID NO: 78083 - RNA, 23 nt, Human
gcggcggcggcggcggcggcggc

SEQ ID NO: 78084 - RNA, 23 nt, Human
gcggcggcggcggcggcggcggc

SEQ ID NO: 78085 - RNA, 24 nt, Human
gcggcggcggcggcggcggcggcg

SEQ ID NO: 78086 - RNA, 24 nt, Human
gcggcggcggcggcggcggcggcg

SEQ ID NO: 78087 - RNA, 21 nt, Human
gcggcggcggcggcggcgggc

SEQ ID NO: 78088 - RNA, 18 nt, Human
gcuaucuuuucacuaagc

SEQ ID NO: 78089 - RNA, 21 nt, Human
ggaaggggaguggugaaaaag

SEQ ID NO: 78090 - RNA, 20 nt, Human
ggacugauucacuguuccaa

SEQ ID NO: 78091 - RNA, 23 nt, Human
ggcggcggcggcggcggcggcgg

SEQ ID NO: 78092 - RNA, 23 nt, Human
ggcggcggcggcggcggcggcgg

SEQ ID NO: 78093 - RNA, 25 nt, Human
ggcgggcggcggcggcggcggcggg

SEQ ID NO: 78094 - RNA, 24 nt, Human
gggaaggggaguggugaaaaaggg

SEQ ID NO: 78095 - RNA, 19 nt, Human
gggcgauggggaaggggag

SEQ ID NO: 78096 - RNA, 19 nt, Human
gggcggcggcggcggcggc

SEQ ID NO: 78097 - RNA, 24 nt, Human
gggcggcggcggcggcggcggcgg

SEQ ID NO: 78098 - RNA, 18 nt, Human
ggggaguggugaaaaagg

SEQ ID NO: 78099 - RNA, 21 nt, Human
gggugucaggugggagugagg

SEQ ID NO: 78100 - RNA, 23 nt, Human
guaaaaugcaauaguauugcccc

SEQ ID NO: 78101 - RNA, 21 nt, Human
guaaauuauugcacaagagaa

SEQ ID NO: 78102 - RNA, 24 nt, Human
guaugaacagguuaaugcagacaa

SEQ ID NO: 78103 - RNA, 24 nt, Human
guauggcagcaggaaaaaggaaca

SEQ ID NO: 78104 - RNA, 18 nt, Human
gucaaguaaauggcuggc

SEQ ID NO: 78105 - RNA, 22 nt, Human
guccaccccaccccugggggcu

SEQ ID NO: 78106 - RNA, 23 nt, Human
gugacaagcacucucauauucuu

SEQ ID NO: 78107 - RNA, 22 nt, Human
gugcuauuugaacaccaacugg

SEQ ID NO: 78108 - RNA, 21 nt, Human
guuccaaugugggucuguuuu

SEQ ID NO: 78109 - RNA, 20 nt, Human
uaaaagacaaauucaaaucc

SEQ ID NO: 78110 - RNA, 24 nt, Human
uaaaaugcaguuccccccuaaaca

SEQ ID NO: 78111 - RNA, 21 nt, Human
uaaagaacaagcaaacaccac

SEQ ID NO: 78112 - RNA, 22 nt, Human
uaaagaacaagcaaacaccacc

SEQ ID NO: 78113 - RNA, 25 nt, Human
uaaagaacaagcaaacaccaccuaa

SEQ ID NO: 78114 - RNA, 24 nt, Human
uaaagcaaauaucuucauaaaaug

SEQ ID NO: 78115 - RNA, 21 nt, Human
uaacaaaccaacguuauuagc

SEQ ID NO: 78116 - RNA, 22 nt, Human
uaacaagucuuguaacaccacc

SEQ ID NO: 78117 - RNA, 23 nt, Human
uaacaagucuuguaacaccacca

SEQ ID NO: 78118 - RNA, 20 nt, Human
uaagaugcuggaauguaggg

SEQ ID NO: 78119 - RNA, 21 nt, Human
uaauaagaaacuacugacauu

SEQ ID NO: 78120 - RNA, 19 nt, Human
uaaucuuaaaccuuucccc

SEQ ID NO: 78121 - RNA, 22 nt, Human
uaaugguaugcaaauuauaagu

SEQ ID NO: 78122 - RNA, 24 nt, Human
uacaaaaaaguauugacuaaagcg

SEQ ID NO: 78123 - RNA, 21 nt, Human
uacagcacacaggugucugag

SEQ ID NO: 78124 - RNA, 22 nt, Human
uacagcacacaggugucugagg

SEQ ID NO: 78125 - RNA, 20 nt, Human
uaccaaaaaagguacauuga

SEQ ID NO: 78126 - RNA, 21 nt, Human
uacuaaagaaguuuuauguuu

SEQ ID NO: 78127 - RNA, 24 nt, Human
uagaaagaaggagacuccagagaa

SEQ ID NO: 78128 - RNA, 21 nt, Human
uagaaauaauacaaagauggc

SEQ ID NO: 78129 - RNA, 18 nt, Human
uagaagcgaaagcaauca

SEQ ID NO: 78130 - RNA, 24 nt, Human
uagaccuguaaacugggaaaauug

SEQ ID NO: 78131 - RNA, 18 nt, Human
uagcacacaguguaugga

SEQ ID NO: 78132 - RNA, 23 nt, Human
uagcacacaguguauggaaaaga

SEQ ID NO: 78133 - RNA, 22 nt, Human
uagcaggaugacagaccacgcu

SEQ ID NO: 78134 - RNA, 19 nt, Human
uagcaggcucccccaaacc

SEQ ID NO: 78135 - RNA, 20 nt, Human
uagccauaacauaccauaca

SEQ ID NO: 78136 - RNA, 22 nt, Human
uauaaaauaaaacuguacauga

SEQ ID NO: 78137 - RNA, 21 nt, Human
uauaaauaaaauggcgcugca

SEQ ID NO: 78138 - RNA, 21 nt, Human
uauggaaaagaaaugaaguac

SEQ ID NO: 78139 - RNA, 20 nt, Human
uauuacagaauguaugcagc

SEQ ID NO: 78140 - RNA, 19 nt, Human
ucaaugagauuguguucaa

SEQ ID NO: 78141 - RNA, 22 nt, Human
ucaauuuuuuuucagcauucuu

SEQ ID NO: 78142 - RNA, 23 nt, Human
ucaauuuuuuuucagcauucuug

SEQ ID NO: 78143 - RNA, 22 nt, Human
ucacaggcagagucaagugcua

SEQ ID NO: 78144 - RNA, 24 nt, Human
ucagcauuaauaaacagcaauauu

SEQ ID NO: 78145 - RNA, 25 nt, Human
ucagcauuaauaaacagcaauauua

SEQ ID NO: 78146 - RNA, 24 nt, Human
ucagccucuuccuuucaauauggu

SEQ ID NO: 78147 - RNA, 21 nt, Human
uccaccccaccccugggggcu

SEQ ID NO: 78148 - RNA, 18 nt, Human
uccacuaccaaaaaaggu

SEQ ID NO: 78149 - RNA, 18 nt, Human
uccuacagggaguggggc

SEQ ID NO: 78150 - RNA, 21 nt, Human
ucuaaaaucugccccaaauuu

SEQ ID NO: 78151 - RNA, 24 nt, Human
ucuccaagcaguaaaaaauaccaa

SEQ ID NO: 78152 - RNA, 20 nt, Human
ucuccugcccauuucucaaa

SEQ ID NO: 78153 - RNA, 18 nt, Human
ucuucauaaaaugaacuc

SEQ ID NO: 78154 - RNA, 25 nt, Human
ucuucuggaucuccaagcaguaaaa

SEQ ID NO: 78155 - RNA, 18 nt, Human
ugaaaaacaggauucggc

SEQ ID NO: 78156 - RNA, 20 nt, Human
ugaaaaacaggauucggcgu

SEQ ID NO: 78157 - RNA, 24 nt, Human
ugaaucuacagcacacaggugucu

SEQ ID NO: 78158 - RNA, 21 nt, Human
ugacaagcacucucauauucu

SEQ ID NO: 78159 - RNA, 18 nt, Human
ugagaaauacaauauaga

SEQ ID NO: 78160 - RNA, 21 nt, Human
ugauaagcgguaaccuaguuc

SEQ ID NO: 78161 - RNA, 24 nt, Human
ugauagaauaaacuuguucuguuu

SEQ ID NO: 78162 - RNA, 19 nt, Human
ugauauguauuacagaaug

SEQ ID NO: 78163 - RNA, 19 nt, Human
ugccucuguuuugaacagg

SEQ ID NO: 78164 - RNA, 21 nt, Human
uggaauguagggugauagaag

SEQ ID NO: 78165 - RNA, 22 nt, Human
uggaucuauuucuuuuggugcc

SEQ ID NO: 78166 - RNA, 23 nt, Human
uggcagcaggaaaaaggaacaaa

SEQ ID NO: 78167 - RNA, 19 nt, Human
ugggacuagaaaaaaaucc

SEQ ID NO: 78168 - RNA, 22 nt, Human
ugggacuagaaaaaaauccuac

SEQ ID NO: 78169 - RNA, 18 nt, Human
ugugguuuuaauagaucc

SEQ ID NO: 78170 - RNA, 20 nt, Human
ugugguuuuaauagauccaa

SEQ ID NO: 78171 - RNA, 18 nt, Human
uguuccaaugugggucug

SEQ ID NO: 78172 - RNA, 24 nt, Human
uuaacacaaauagcacacagugua

SEQ ID NO: 78173 - RNA, 19 nt, Human
uuaauaaacagcaauauua

SEQ ID NO: 78174 - RNA, 22 nt, Human
uuacuaguguauuuaauugcgu

SEQ ID NO: 78175 - RNA, 19 nt, Human
uuagagacagacauuuagc

SEQ ID NO: 78176 - RNA, 22 nt, Human
uuccuaagcuaaauuaaaagac

SEQ ID NO: 78177 - RNA, 20 nt, Human
uugcuauguuguuucuaauu

SEQ ID NO: 78178 - RNA, 21 nt, Human
uugcugugauugucuguucug

SEQ ID NO: 78179 - RNA, 20 nt, Human
uugucuuauaagcauuaaaa

SEQ ID NO: 78180 - RNA, 19 nt, Human
uuuaccaccuguuuguaga

SEQ ID NO: 78181 - RNA, 19 nt, Human
uuuagagacagacauuuag

SEQ ID NO: 78182 - RNA, 21 nt, Human
uuucagaagggccagggcauc

SEQ ID NO: 78183 - RNA, 24 nt, Human
uuuccccacuuagguucacggccu

SEQ ID NO: 78184 - RNA, 24 nt, Human
uuucuuuuggugccaguauuuuua

SEQ ID NO: 78185 - RNA, 19 nt, Human
uuuuuuccuuuuuuuuucu

SEQ ID NO: 78186 - RNA, 19 nt, Human
uuuuuuccuuuuuuuuucu

SEQ ID NO: 78187 - RNA, 22 nt, Human
aaaaaaaaaauaaaaaccuggg

SEQ ID NO: 78188 - RNA, 21 nt, Human
aaaaaaacaaagaagggaugg

SEQ ID NO: 78189 - RNA, 22 nt, Human
aaaaagaaaaaaaagggaagaa

SEQ ID NO: 78190 - RNA, 24 nt, Human
aaaaagaaaaaaaagggaagaaaa

SEQ ID NO: 78191 - RNA, 28 nt, Human
aaaaagaaaaaaaagggaagaaaagcaa

SEQ ID NO: 78192 - RNA, 23 nt, Human
aaaaaggcagaaaguuguaucua

SEQ ID NO: 78193 - RNA, 27 nt, Human
aaaacaaaaaccaaaaaaaaaauuaaa

SEQ ID NO: 78194 - RNA, 26 nt, Human
aaaagaaaaaaaagggaagaaaagca

SEQ ID NO: 78195 - RNA, 23 nt, Human
aaaaguaccugcacaugccaaaa

SEQ ID NO: 78196 - RNA, 21 nt, Human
aaagcagcaaagcagggaaga

SEQ ID NO: 78197 - RNA, 18 nt, Human
aaaguaccugcacaugcc

SEQ ID NO: 78198 - RNA, 19 nt, Human
aaaguaccugcacaugccc

SEQ ID NO: 78199 - RNA, 21 nt, Human
aaauuuuacugcaacauuuuc

SEQ ID NO: 78200 - RNA, 23 nt, Human
aacaaacuugguuuugaacaagc

SEQ ID NO: 78201 - RNA, 25 nt, Human
aacaagaacaaauuuauagacccac

SEQ ID NO: 78202 - RNA, 23 nt, Human
aagaaaaaaaaaggaccaaugga

SEQ ID NO: 78203 - RNA, 21 nt, Human
aagaaaaaaaagggaagaaaa

SEQ ID NO: 78204 - RNA, 23 nt, Human
aagcagcaccaccccucccccca

SEQ ID NO: 78205 - RNA, 22 nt, Human
aagcagcguugucccaaaaaca

SEQ ID NO: 78206 - RNA, 21 nt, Human
aaggaacaauaaauauuuuac

SEQ ID NO: 78207 - RNA, 18 nt, Human
aaggguauuuuuuuucuu

SEQ ID NO: 78208 - RNA, 22 nt, Human
aagguaauaaaaauauuuugcc

SEQ ID NO: 78209 - RNA, 21 nt, Human
aauaaguaauagaaaagguaa

SEQ ID NO: 78210 - RNA, 20 nt, Human
acaaaacagaagcaaaauuc

SEQ ID NO: 78211 - RNA, 19 nt, Human
acaaaaccuccaaguaaac

SEQ ID NO: 78212 - RNA, 22 nt, Human
acaauaaauauuuuacuaagcc

SEQ ID NO: 78213 - RNA, 21 nt, Human
acaccccccaccccaaaaaca

SEQ ID NO: 78214 - RNA, 20 nt, Human
accaauauauccauuccaga

SEQ ID NO: 78215 - RNA, 27 nt, Human
accccaaaaacaaaaaccaaaaaaaaa

SEQ ID NO: 78216 - RNA, 20 nt, Human
accccagggcacaccaacag

SEQ ID NO: 78217 - RNA, 26 nt, Human
acccucuaaugccaaguggcagguuc

SEQ ID NO: 78218 - RNA, 22 nt, Human
acgcggggugcgggguggcggu

SEQ ID NO: 78219 - RNA, 22 nt, Human
agaaaaauaaguacaggucaga

SEQ ID NO: 78220 - RNA, 20 nt, Human
agaauauaaacuccaaaaag

SEQ ID NO: 78221 - RNA, 23 nt, Human
agaaugcugucgggccauuuccc

SEQ ID NO: 78222 - RNA, 21 nt, Human
agagagaagcccaacacgaac

SEQ ID NO: 78223 - RNA, 21 nt, Human
agcagcaccaccccucccccc

SEQ ID NO: 78224 - RNA, 24 nt, Human
aggaacaauaaauauuuuacuaag

SEQ ID NO: 78225 - RNA, 22 nt, Human
aggccaacacucuccauggcac

SEQ ID NO: 78226 - RNA, 24 nt, Human
aggccaccccaucuccccaaaaag

SEQ ID NO: 78227 - RNA, 18 nt, Human
aggcugauuuccuuacuu

SEQ ID NO: 78228 - RNA, 25 nt, Human
aggucagcauucucucgguuggcaa

SEQ ID NO: 78229 - RNA, 21 nt, Human
agguuagguuggagugccgcc

SEQ ID NO: 78230 - RNA, 24 nt, Human
aguaaacaacaaaagcucauacaa

SEQ ID NO: 78231 - RNA, 23 nt, Human
aguguuggcuucuucacaagaaa

SEQ ID NO: 78232 - RNA, 24 nt, Human
auaaaaaaugaaagaaaaaaaaaa

SEQ ID NO: 78233 - RNA, 23 nt, Human
auaauaauaaaaaguaccugcac

SEQ ID NO: 78234 - RNA, 28 nt, Human
auaauaauaaaaaguaccugcacaugcc

SEQ ID NO: 78235 - RNA, 20 nt, Human
auaauauauacuaaaacccc

SEQ ID NO: 78236 - RNA, 25 nt, Human
auagcagccauggcaccccagggca

SEQ ID NO: 78237 - RNA, 24 nt, Human
auauaauauauacuaaaaccccgu

SEQ ID NO: 78238 - RNA, 24 nt, Human
auccacaccccccaccccaaaaac

SEQ ID NO: 78239 - RNA, 24 nt, Human
augagugaauucaaacagaaaaaa

SEQ ID NO: 78240 - RNA, 23 nt, Human
augccaaaaaaauuacaaaaccc

SEQ ID NO: 78241 - RNA, 18 nt, Human
auucccucauccaaaaga

SEQ ID NO: 78242 - RNA, 21 nt, Human
caaaaagaaaaaaaagggaag

SEQ ID NO: 78243 - RNA, 20 nt, Human
caaaaagguacccucagccc

SEQ ID NO: 78244 - RNA, 18 nt, Human
caaaacagaagcaaaauu

SEQ ID NO: 78245 - RNA, 18 nt, Human
caaaacccaauaaauaca

SEQ ID NO: 78246 - RNA, 30 nt, Human
caaaaccuccaaguaaacaacaaaagcucu

SEQ ID NO: 78247 - RNA, 19 nt, Human
caaacaacccuuuuucucc

SEQ ID NO: 78248 - RNA, 23 nt, Human
caaaggcaacagcagccccugga

SEQ ID NO: 78249 - RNA, 24 nt, Human
caacuaaaugauuugugaaccaaa

SEQ ID NO: 78250 - RNA, 18 nt, Human
caagccagaaaacgccua

SEQ ID NO: 78251 - RNA, 21 nt, Human
caaguuucuauacauuuuuuu

SEQ ID NO: 78252 - RNA, 26 nt, Human
cacaaauaauuucccaucuggucugc

SEQ ID NO: 78253 - RNA, 23 nt, Human
cacaccccccaccccaaaaacaa

SEQ ID NO: 78254 - RNA, 24 nt, Human
cacaccccccaccccaaaaacaaa

SEQ ID NO: 78255 - RNA, 24 nt, Human
cacaugccaaaaaaauuacaaaac

SEQ ID NO: 78256 - RNA, 19 nt, Human
caccauuuaaauuuuacug

SEQ ID NO: 78257 - RNA, 21 nt, Human
caccccaaaaacaaaaaccaa

SEQ ID NO: 78258 - RNA, 20 nt, Human
caccccccaccccaaaaaca

SEQ ID NO: 78259 - RNA, 22 nt, Human
caccccccaccccaaaaacaaa

SEQ ID NO: 78260 - RNA, 19 nt, Human
cacgcggccacuguggcau

SEQ ID NO: 78261 - RNA, 22 nt, Human
cagaaaacgccuaaaagaacac

SEQ ID NO: 78262 - RNA, 24 nt, Human
cagacacagguuagguuggagugc

SEQ ID NO: 78263 - RNA, 23 nt, Human
cagcuuucucucccauucccucc

SEQ ID NO: 78264 - RNA, 20 nt, Human
caggagugaugguagagaag

SEQ ID NO: 78265 - RNA, 24 nt, Human
caguacaaaugcaaacaacuuaaa

SEQ ID NO: 78266 - RNA, 21 nt, Human
caucgaacagaaaagcuucug

SEQ ID NO: 78267 - RNA, 24 nt, Human
caugccaaaaaaauuacaaaaccc

SEQ ID NO: 78268 - RNA, 20 nt, Human
ccaaaagaaaacaauauaca

SEQ ID NO: 78269 - RNA, 19 nt, Human
ccaacacacauacacacaa

SEQ ID NO: 78270 - RNA, 21 nt, Human
ccaagcaauaauaaauaguuc

SEQ ID NO: 78271 - RNA, 19 nt, Human
ccacaccccccaccccaaa

SEQ ID NO: 78272 - RNA, 20 nt, Human
ccacaccccccaccccaaaa

SEQ ID NO: 78273 - RNA, 20 nt, Human
ccacaccccccaccccaaaa

SEQ ID NO: 78274 - RNA, 24 nt, Human
ccacaccccccaccccaaaaacaa

SEQ ID NO: 78275 - RNA, 24 nt, Human
ccaccccaucuccccaaaaaggua

SEQ ID NO: 78276 - RNA, 19 nt, Human
ccauauugaaaugaccucc

SEQ ID NO: 78277 - RNA, 20 nt, Human
cccaccccaaaaacaaaaac

SEQ ID NO: 78278 - RNA, 22 nt, Human
cccagaggagcccuccaaaaac

SEQ ID NO: 78279 - RNA, 24 nt, Human
cccagcaccaccacucaagguuuc

SEQ ID NO: 78280 - RNA, 18 nt, Human
cccagggcacaccaacag

SEQ ID NO: 78281 - RNA, 18 nt, Human
cccaucuggucugcugug

SEQ ID NO: 78282 - RNA, 18 nt, Human
ccccaaaaagguacccuc

SEQ ID NO: 78283 - RNA, 18 nt, Human
ccccaccccacccauccc

SEQ ID NO: 78284 - RNA, 23 nt, Human
ccccaccccacccaucccuacaa

SEQ ID NO: 78285 - RNA, 23 nt, Human
ccccagcaccaccacucaagguu

SEQ ID NO: 78286 - RNA, 21 nt, Human
cccccaccccaaaaacaaaaa

SEQ ID NO: 78287 - RNA, 20 nt, Human
ccccgucaccaaaagaaaac

SEQ ID NO: 78288 - RNA, 27 nt, Human
cccggggacacgcggggugcggggugg

SEQ ID NO: 78289 - RNA, 18 nt, Human
cccgucaccaaaagaaaa

SEQ ID NO: 78290 - RNA, 20 nt, Human
cccucucuuccuccucuucu

SEQ ID NO: 78291 - RNA, 23 nt, Human
ccgccgcaccuccuccucugccc

SEQ ID NO: 78292 - RNA, 21 nt, Human
ccgccgccgcaccuccuccuc

SEQ ID NO: 78293 - RNA, 18 nt, Human
ccgccgccgccgccgccg

SEQ ID NO: 78294 - RNA, 18 nt, Human
ccgccgccgccgccgccg

SEQ ID NO: 78295 - RNA, 23 nt, Human
ccgccgccgcgccgcugccgccg

SEQ ID NO: 78296 - RNA, 19 nt, Human
ccgccgcgccgcugccgcc

SEQ ID NO: 78297 - RNA, 21 nt, Human
ccgccgcgccgcugccgccgc

SEQ ID NO: 78298 - RNA, 18 nt, Human
ccgccgcugccgccgccg

SEQ ID NO: 78299 - RNA, 24 nt, Human
ccgccgcugccgccgccgccgccg

SEQ ID NO: 78300 - RNA, 21 nt, Human
ccgcgccgcugccgccgcugc

SEQ ID NO: 78301 - RNA, 18 nt, Human
ccgcugccgccgccgccg

SEQ ID NO: 78302 - RNA, 24 nt, Human
ccgcugccgccgccgccgccgccg

SEQ ID NO: 78303 - RNA, 18 nt, Human
ccgcugccgccgcugccg

SEQ ID NO: 78304 - RNA, 24 nt, Human
ccgcugccgccgcugccgccgccg

SEQ ID NO: 78305 - RNA, 20 nt, Human
ccggucucaacagcagguca

SEQ ID NO: 78306 - RNA, 20 nt, Human
ccucucuuucccucucuucc

SEQ ID NO: 78307 - RNA, 18 nt, Human
ccucuucuucuucuuuau

SEQ ID NO: 78308 - RNA, 21 nt, Human
cgaacagaaaagcuucugcau

SEQ ID NO: 78309 - RNA, 20 nt, Human
cgcaccuccuccucugcccg

SEQ ID NO: 78310 - RNA, 24 nt, Human
cgccgcugccgccgcugccgccgg

SEQ ID NO: 78311 - RNA, 21 nt, Human
cgcuguacauccacacccccc

SEQ ID NO: 78312 - RNA, 27 nt, Human
cgcuguacauccacaccccccacccca

SEQ ID NO: 78313 - RNA, 19 nt, Human
cggcgcugagucugugggg

SEQ ID NO: 78314 - RNA, 18 nt, Human
cggcugggucacccaugc

SEQ ID NO: 78315 - RNA, 19 nt, Human
cggguugguguuuuuuuuc

SEQ ID NO: 78316 - RNA, 20 nt, Human
cuaaaacuccgacuuuacag

SEQ ID NO: 78317 - RNA, 19 nt, Human
cuauucuggcaucgcccgg

SEQ ID NO: 78318 - RNA, 24 nt, Human
cucauccccugcuuuuucaguaaa

SEQ ID NO: 78319 - RNA, 20 nt, Human
cucccccagcaccaccacuc

SEQ ID NO: 78320 - RNA, 20 nt, Human
cugcagguaggaaacugcag

SEQ ID NO: 78321 - RNA, 25 nt, Human
cuguacauccacaccccccacccca

SEQ ID NO: 78322 - RNA, 23 nt, Human
cuucaccuggacccagcugaauc

SEQ ID NO: 78323 - RNA, 23 nt, Human
cuuccucucuuucccucucuucc

SEQ ID NO: 78324 - RNA, 18 nt, Human
gaaagaaaaaaaaaggac

SEQ ID NO: 78325 - RNA, 19 nt, Human
gaccaauggaggaugaagg

SEQ ID NO: 78326 - RNA, 23 nt, Human
gaccccuuguagcaacauaggaa

SEQ ID NO: 78327 - RNA, 24 nt, Human
gagauggccucuuagagaaaggga

SEQ ID NO: 78328 - RNA, 18 nt, Human
gagugaauucaaacagaa

SEQ ID NO: 78329 - RNA, 21 nt, Human
gauccccaccccacccauccc

SEQ ID NO: 78330 - RNA, 21 nt, Human
gcaaagcagcaaagcagggaa

SEQ ID NO: 78331 - RNA, 24 nt, Human
gcacaaccucagaaugcugucggg

SEQ ID NO: 78332 - RNA, 19 nt, Human
gcacgaaagguccuggcug

SEQ ID NO: 78333 - RNA, 21 nt, Human
gcagggcugaguuacaaggag

SEQ ID NO: 78334 - RNA, 21 nt, Human
gccaguacaaaugcaaacaac

SEQ ID NO: 78335 - RNA, 22 nt, Human
gccgccgccgccgccgccgccg

SEQ ID NO: 78336 - RNA, 22 nt, Human
gccgccgcugccgccgccgccg

SEQ ID NO: 78337 - RNA, 22 nt, Human
gccgcgccgcugccgccgcugc

SEQ ID NO: 78338 - RNA, 19 nt, Human
gcggggcgccggggcccgc

SEQ ID NO: 78339 - RNA, 22 nt, Human
gcugggucacccaugcuagagg

SEQ ID NO: 78340 - RNA, 20 nt, Human
gcuuugggauggcuuagucc

SEQ ID NO: 78341 - RNA, 23 nt, Human
ggagaucaaguuaaauguccaau

SEQ ID NO: 78342 - RNA, 19 nt, Human
ggaggaugaaggauggaga

SEQ ID NO: 78343 - RNA, 23 nt, Human
gggcgggagagguggugguggug

SEQ ID NO: 78344 - RNA, 19 nt, Human
ggggggagccgggggaggg

SEQ ID NO: 78345 - RNA, 21 nt, Human
gggugcgggguggcggugaca

SEQ ID NO: 78346 - RNA, 24 nt, Human
guaauagaaaagguaauaaaaaua

SEQ ID NO: 78347 - RNA, 21 nt, Human
gucaagccagaaaacgccuaa

SEQ ID NO: 78348 - RNA, 23 nt, Human
gucacccaccagaauauaaacuc

SEQ ID NO: 78349 - RNA, 23 nt, Human
guucauugcuguacccagccacu

SEQ ID NO: 78350 - RNA, 18 nt, Human
guugucccaaaaacaaaa

SEQ ID NO: 78351 - RNA, 22 nt, Human
uaaaaaaaaaacugcaugccac

SEQ ID NO: 78352 - RNA, 22 nt, Human
uaaaaaaagagagaagccguca

SEQ ID NO: 78353 - RNA, 19 nt, Human
uaaaauagaggauuagggg

SEQ ID NO: 78354 - RNA, 20 nt, Human
uaaaaugcccaggcauucuc

SEQ ID NO: 78355 - RNA, 19 nt, Human
uaaacacaaaacagaagca

SEQ ID NO: 78356 - RNA, 22 nt, Human
uaaacacaaaacagaagcaaaa

SEQ ID NO: 78357 - RNA, 18 nt, Human
uaaagcagcucaguuugc

SEQ ID NO: 78358 - RNA, 24 nt, Human
uaacaagaacaaauuuauagaccc

SEQ ID NO: 78359 - RNA, 22 nt, Human
uaacuucaauuaauuagggcau

SEQ ID NO: 78360 - RNA, 23 nt, Human
uaaggaaaaaaagaggcccaaaa

SEQ ID NO: 78361 - RNA, 21 nt, Human
uaauaaaaaguaccugcacau

SEQ ID NO: 78362 - RNA, 18 nt, Human
uaauaauaaaaaguaccu

SEQ ID NO: 78363 - RNA, 20 nt, Human
uaauaauaaaaaguaccugc

SEQ ID NO: 78364 - RNA, 21 nt, Human
uacaaaaacugauuuuuuucc

SEQ ID NO: 78365 - RNA, 22 nt, Human
uacaaaacccaauaaauacaga

SEQ ID NO: 78366 - RNA, 21 nt, Human
uacaaggagcaccaaaaucac

SEQ ID NO: 78367 - RNA, 19 nt, Human
uacaaguuucuauacauuu

SEQ ID NO: 78368 - RNA, 26 nt, Human
uacuguaacaagaacaaauuuauaga

SEQ ID NO: 78369 - RNA, 21 nt, Human
uagaacaauaauugccacaga

SEQ ID NO: 78370 - RNA, 22 nt, Human
uagaacaauaauugccacagaa

SEQ ID NO: 78371 - RNA, 20 nt, Human
uagcaauacugacacucaau

SEQ ID NO: 78372 - RNA, 21 nt, Human
uauacuaaaaccccgucacca

SEQ ID NO: 78373 - RNA, 21 nt, Human
uauccgcuguacauccacacc

SEQ ID NO: 78374 - RNA, 23 nt, Human
uaucuuaaagcuacuuggcuuua

SEQ ID NO: 78375 - RNA, 18 nt, Human
ucaaaaaagcagcaccac

SEQ ID NO: 78376 - RNA, 21 nt, Human
ucaaaaaagcagcaccacccc

SEQ ID NO: 78377 - RNA, 20 nt, Human
ucaaauaggaagaucaguuu

SEQ ID NO: 78378 - RNA, 21 nt, Human
ucagcccauuuuauguagccu

SEQ ID NO: 78379 - RNA, 21 nt, Human
ucaggacaaaaaaaaggaagg

SEQ ID NO: 78380 - RNA, 23 nt, Human
ucagucuccuucucuccccauga

SEQ ID NO: 78381 - RNA, 18 nt, Human
uccaaaaacccuaucucu

SEQ ID NO: 78382 - RNA, 26 nt, Human
uccaaaaacccuaucucuggcggcgc

SEQ ID NO: 78383 - RNA, 18 nt, Human
uccacaauuuguacugcc

SEQ ID NO: 78384 - RNA, 24 nt, Human
uccacaccccccaccccaaaaaca

SEQ ID NO: 78385 - RNA, 21 nt, Human
uccauggcacgaaagguccug

SEQ ID NO: 78386 - RNA, 21 nt, Human
ucccaaaaacaaaaggggcug

SEQ ID NO: 78387 - RNA, 19 nt, Human
uccccaccccacccauccc

SEQ ID NO: 78388 - RNA, 21 nt, Human
ucccucauccaaaagaccacc

SEQ ID NO: 78389 - RNA, 20 nt, Human
uccucuucuucuucuuuauu

SEQ ID NO: 78390 - RNA, 21 nt, Human
uccucuucuucuucuuuauuu

SEQ ID NO: 78391 - RNA, 19 nt, Human
ucuacauacuuuuucuaca

SEQ ID NO: 78392 - RNA, 18 nt, Human
ucuauucuggcaucgccc

SEQ ID NO: 78393 - RNA, 22 nt, Human
ucuccuucucuccccaugaaag

SEQ ID NO: 78394 - RNA, 18 nt, Human
ucucucgggaucaucugc

SEQ ID NO: 78395 - RNA, 22 nt, Human
ucugcuguggccacaccaagga

SEQ ID NO: 78396 - RNA, 21 nt, Human
ugaaaaaguaaacaacuuuaa

SEQ ID NO: 78397 - RNA, 21 nt, Human
ugaaaccagaacaaacuuggu

SEQ ID NO: 78398 - RNA, 22 nt, Human
ugaaauggcagacacaugcuga

SEQ ID NO: 78399 - RNA, 19 nt, Human
ugaacaaaguuguggcagu

SEQ ID NO: 78400 - RNA, 21 nt, Human
ugaaugaaugagugaauucaa

SEQ ID NO: 78401 - RNA, 22 nt, Human
ugaaugaaugagugaauucaaa

SEQ ID NO: 78402 - RNA, 21 nt, Human
ugaauuguuuuuguuuugcuu

SEQ ID NO: 78403 - RNA, 22 nt, Human
ugaccuccugucaucucaacau

SEQ ID NO: 78404 - RNA, 19 nt, Human
ugagagaacacuaacuuca

SEQ ID NO: 78405 - RNA, 19 nt, Human
ugagauaggaaaaaaaaaa

SEQ ID NO: 78406 - RNA, 19 nt, Human
ugcaaaaagaaaaaaaagg

SEQ ID NO: 78407 - RNA, 21 nt, Human
ugcaaaaagaaaaaaaaggga

SEQ ID NO: 78408 - RNA, 22 nt, Human
ugcaagauccccaccccaccca

SEQ ID NO: 78409 - RNA, 21 nt, Human
ugcacagaguugugccugaag

SEQ ID NO: 78410 - RNA, 26 nt, Human
ugcaggccaccccaucuccccaaaaa

SEQ ID NO: 78411 - RNA, 19 nt, Human
ugccacagaauuuuaacaa

SEQ ID NO: 78412 - RNA, 20 nt, Human
ugccccggcaucuauucugg

SEQ ID NO: 78413 - RNA, 21 nt, Human
ugcgggguggcggugacacgg

SEQ ID NO: 78414 - RNA, 25 nt, Human
uggagaggaaacgcaggggaaggag

SEQ ID NO: 78415 - RNA, 23 nt, Human
uggaugaccccuuguagcaacau

SEQ ID NO: 78416 - RNA, 19 nt, Human
uggcaaggaggaaagagug

SEQ ID NO: 78417 - RNA, 22 nt, Human
uggcaguagaaaaacuguccuu

SEQ ID NO: 78418 - RNA, 21 nt, Human
ugggacuuugcuuugcagggc

SEQ ID NO: 78419 - RNA, 18 nt, Human
uggggggagccgggggag

SEQ ID NO: 78420 - RNA, 21 nt, Human
ugguaagggcgggagaggugg

SEQ ID NO: 78421 - RNA, 19 nt, Human
ugguagagaaggaagaugu

SEQ ID NO: 78422 - RNA, 22 nt, Human
ugguagagaaggaagauguucu

SEQ ID NO: 78423 - RNA, 21 nt, Human
uguacauccacaccccccacc

SEQ ID NO: 78424 - RNA, 23 nt, Human
uguacauccacaccccccacccc

SEQ ID NO: 78425 - RNA, 23 nt, Human
ugucucaagagacucaaauagga

SEQ ID NO: 78426 - RNA, 24 nt, Human
uuaaaaaaaaaacaaagaagggau

SEQ ID NO: 78427 - RNA, 24 nt, Human
uuaacuacuuccuuuuguuucuuu

SEQ ID NO: 78428 - RNA, 18 nt, Human
uuauacuuucauaaccug

SEQ ID NO: 78429 - RNA, 18 nt, Human
uuccuccucuucuucuuc

SEQ ID NO: 78430 - RNA, 24 nt, Human
uuccuccucuucuucuucuuuaag

SEQ ID NO: 78431 - RNA, 22 nt, Human
uuccugaaauaaaaaauggcuu

SEQ ID NO: 78432 - RNA, 21 nt, Human
uuccugaauuguuuuuguuuu

SEQ ID NO: 78433 - RNA, 20 nt, Human
uuggagugccgccuccccug

SEQ ID NO: 78434 - RNA, 24 nt, Human
uugguuuuuuaaacacaaaacaga

SEQ ID NO: 78435 - RNA, 18 nt, Human
uuguguuuguuucacaau

SEQ ID NO: 78436 - RNA, 24 nt, Human
uuuaacccaccucugggccaaaga

SEQ ID NO: 78437 - RNA, 21 nt, Human
uuucacaauuucucaaggacu

SEQ ID NO: 78438 - RNA, 21 nt, Human
uuucccaucuggucugcugug

SEQ ID NO: 78439 - RNA, 20 nt, Human
uuugcaagauccccacccca

SEQ ID NO: 78440 - RNA, 19 nt, Human
uuugcucuuucuucuaugc

SEQ ID NO: 78441 - RNA, 24 nt, Human
uuugcucuuucuucuaugcuguuu

SEQ ID NO: 78442 - RNA, 21 nt, Human
uuuuacuuuuuuaaaaagucu

SEQ ID NO: 78443 - RNA, 20 nt, Human
aaaaucccugaaagauccaa

SEQ ID NO: 78444 - RNA, 24 nt, Human
aaaaugcuuuucucggcacaauug

SEQ ID NO: 78445 - RNA, 21 nt, Human
aaacaaaaccaccaaaagaaa

SEQ ID NO: 78446 - RNA, 24 nt, Human
aaauaaauaaaucuuuuuuucuua

SEQ ID NO: 78447 - RNA, 20 nt, Human
aaauugcuaaaaugcuuuuc

SEQ ID NO: 78448 - RNA, 27 nt, Human
aacaaaaauaaccccaguaacucaaaa

SEQ ID NO: 78449 - RNA, 18 nt, Human
aacagaagacaaaacagg

SEQ ID NO: 78450 - RNA, 19 nt, Human
aaccagguaacaaaacccc

SEQ ID NO: 78451 - RNA, 20 nt, Human
aaccagguaacaaaacccca

SEQ ID NO: 78452 - RNA, 20 nt, Human
aacugcaaaauaauuagaua

SEQ ID NO: 78453 - RNA, 24 nt, Human
aagucauuuaaagccuugcuuuaa

SEQ ID NO: 78454 - RNA, 19 nt, Human
aagugcagccacaauacug

SEQ ID NO: 78455 - RNA, 23 nt, Human
aaucaagagauaaaaaucucaaa

SEQ ID NO: 78456 - RNA, 20 nt, Human
aaugaaaaaaaagaagagga

SEQ ID NO: 78457 - RNA, 28 nt, Human
aaugcaauccacugucacuuugcgugca

SEQ ID NO: 78458 - RNA, 20 nt, Human
acaaaaauaaccccaguaac

SEQ ID NO: 78459 - RNA, 21 nt, Human
acaaaaccaccaaaagaaagc

SEQ ID NO: 78460 - RNA, 22 nt, Human
acaaaaccccacagcaaaaggc

SEQ ID NO: 78461 - RNA, 20 nt, Human
acaacagaagacaaaacagg

SEQ ID NO: 78462 - RNA, 21 nt, Human
acaacagaagacaaaacaggc

SEQ ID NO: 78463 - RNA, 19 nt, Human
acacagccaacgugccaug

SEQ ID NO: 78464 - RNA, 21 nt, Human
accaggccuccaagcugggac

SEQ ID NO: 78465 - RNA, 23 nt, Human
accccacggcccccagagaaaga

SEQ ID NO: 78466 - RNA, 22 nt, Human
acccccauauuccacaccugga

SEQ ID NO: 78467 - RNA, 18 nt, Human
accuucuccccagccucc

SEQ ID NO: 78468 - RNA, 25 nt, Human
agaaagaagaggaguuauaauccag

SEQ ID NO: 78469 - RNA, 19 nt, Human
agaaagcuuccccaaaaga

SEQ ID NO: 78470 - RNA, 24 nt, Human
agagaaagaagaggaguuauaauc

SEQ ID NO: 78471 - RNA, 21 nt, Human
agaggagaaaaaaaugacuag

SEQ ID NO: 78472 - RNA, 21 nt, Human
aggaaaaugcaacaucaacua

SEQ ID NO: 78473 - RNA, 24 nt, Human
aggaacccucccucuguuaauauc

SEQ ID NO: 78474 - RNA, 23 nt, Human
aggaagacccugaaggacagcca

SEQ ID NO: 78475 - RNA, 19 nt, Human
aggagaaaaaaaugacuag

SEQ ID NO: 78476 - RNA, 23 nt, Human
aggaggccagugagggccccggc

SEQ ID NO: 78477 - RNA, 20 nt, Human
aggagggcaggagggcucug

SEQ ID NO: 78478 - RNA, 19 nt, Human
auaucacagcccccagggc

SEQ ID NO: 78479 - RNA, 26 nt, Human
aucagcuuccagacauucggagacca

SEQ ID NO: 78480 - RNA, 21 nt, Human
auccagcuugaaauuuauacc

SEQ ID NO: 78481 - RNA, 22 nt, Human
auguaaaccuuucauaaaauaa

SEQ ID NO: 78482 - RNA, 25 nt, Human
caaaaauaaccccaguaacucaaaa

SEQ ID NO: 78483 - RNA, 18 nt, Human
caaacagaaaacgaucac

SEQ ID NO: 78484 - RNA, 20 nt, Human
caacaacacaaacaaagugc

SEQ ID NO: 78485 - RNA, 18 nt, Human
caacacaaacaaagugcc

SEQ ID NO: 78486 - RNA, 20 nt, Human
caacacaaacaaagugccau

SEQ ID NO: 78487 - RNA, 20 nt, Human
caagaggcugggcacauuua

SEQ ID NO: 78488 - RNA, 22 nt, Human
cacaagguucuucgcagaggca

SEQ ID NO: 78489 - RNA, 23 nt, Human
cacagcauuaaacauugaacaga

SEQ ID NO: 78490 - RNA, 18 nt, Human
caccccucuacugcucuu

SEQ ID NO: 78491 - RNA, 20 nt, Human
caccccucuacugcucuuuc

SEQ ID NO: 78492 - RNA, 24 nt, Human
caccgaaauguucacuuccucaag

SEQ ID NO: 78493 - RNA, 21 nt, Human
cacugcauuucaggaagaccc

SEQ ID NO: 78494 - RNA, 20 nt, Human
cagaaagccagcuuccccaa

SEQ ID NO: 78495 - RNA, 24 nt, Human
cagaacauccagguggagccacac

SEQ ID NO: 78496 - RNA, 21 nt, Human
cagaauagaauuucaacugac

SEQ ID NO: 78497 - RNA, 18 nt, Human
cagaauaucagccaccuc

SEQ ID NO: 78498 - RNA, 26 nt, Human
cagaaugauucacuggguaagacuaa

SEQ ID NO: 78499 - RNA, 18 nt, Human
cagcagccagaaagccag

SEQ ID NO: 78500 - RNA, 19 nt, Human
cagccacaccccucuacug

SEQ ID NO: 78501 - RNA, 24 nt, Human
cagccagaaagccagcuuccccaa

SEQ ID NO: 78502 - RNA, 28 nt, Human
cagccucccauugcccaggagcccaccc

SEQ ID NO: 78503 - RNA, 22 nt, Human
caggaccaggccuccaagcugg

SEQ ID NO: 78504 - RNA, 22 nt, Human
ccaaggccacacagccaacgug

SEQ ID NO: 78505 - RNA, 19 nt, Human
ccacaccccucuacugcuc

SEQ ID NO: 78506 - RNA, 24 nt, Human
ccacacugcccuguugaucauccc

SEQ ID NO: 78507 - RNA, 24 nt, Human
ccacccgcacuccaacccccgauc

SEQ ID NO: 78508 - RNA, 19 nt, Human
ccacugcauuucaggaaga

SEQ ID NO: 78509 - RNA, 19 nt, Human
ccagcagccagaaagccag

SEQ ID NO: 78510 - RNA, 20 nt, Human
ccagccuccagcagccagaa

SEQ ID NO: 78511 - RNA, 23 nt, Human
cccacaggaacccucccucuguu

SEQ ID NO: 78512 - RNA, 22 nt, Human
cccaccccacggcccccagaga

SEQ ID NO: 78513 - RNA, 27 nt, Human
cccauugcccaggagcccacccgcacu

SEQ ID NO: 78514 - RNA, 20 nt, Human
ccccaaaagaaaugcaaucc

SEQ ID NO: 78515 - RNA, 23 nt, Human
ccccaauacagguccuucauacc

SEQ ID NO: 78516 - RNA, 21 nt, Human
ccccacaggaacccucccucu

SEQ ID NO: 78517 - RNA, 19 nt, Human
ccccagccuccagcagccg

SEQ ID NO: 78518 - RNA, 18 nt, Human
cccucuacugcucuuucc

SEQ ID NO: 78519 - RNA, 21 nt, Human
cccucuguuaauaucacagcc

SEQ ID NO: 78520 - RNA, 21 nt, Human
ccgauggccauagacccuguc

SEQ ID NO: 78521 - RNA, 19 nt, Human
ccucccaccccuccaacaa

SEQ ID NO: 78522 - RNA, 19 nt, Human
ccucccauugcccaggagc

SEQ ID NO: 78523 - RNA, 23 nt, Human
ccucccauugcccaggagcccac

SEQ ID NO: 78524 - RNA, 18 nt, Human
ccucccucccaccccucc

SEQ ID NO: 78525 - RNA, 18 nt, Human
ccuggagggccccagggu

SEQ ID NO: 78526 - RNA, 25 nt, Human
cgccccagcucccaccccacggccc

SEQ ID NO: 78527 - RNA, 19 nt, Human
cggaaggagggcaggaggg

SEQ ID NO: 78528 - RNA, 20 nt, Human
cggcccccagagaaagaaga

SEQ ID NO: 78529 - RNA, 20 nt, Human
cgggaagcaacaacucugau

SEQ ID NO: 78530 - RNA, 24 nt, Human
cguaaagcaacucucuaaagguca

SEQ ID NO: 78531 - RNA, 18 nt, Human
cguaagcaccacugcauu

SEQ ID NO: 78532 - RNA, 18 nt, Human
cguggcucccaugcucca

SEQ ID NO: 78533 - RNA, 23 nt, Human
cguucuucauuguuacuucuaaa

SEQ ID NO: 78534 - RNA, 21 nt, Human
cucaaacagaaaacgaucacc

SEQ ID NO: 78535 - RNA, 19 nt, Human
cucacaggugggccaaggc

SEQ ID NO: 78536 - RNA, 21 nt, Human
cuccacagccucccauugccc

SEQ ID NO: 78537 - RNA, 23 nt, Human
cucccaccccuccaacaaauguc

SEQ ID NO: 78538 - RNA, 19 nt, Human
cuccccagccuccagcagc

SEQ ID NO: 78539 - RNA, 28 nt, Human
cucccucccaccccuccaacaaaugucc

SEQ ID NO: 78540 - RNA, 24 nt, Human
cucccucuguuaauaucacagccc

SEQ ID NO: 78541 - RNA, 20 nt, Human
cucgccccagcucccacccc

SEQ ID NO: 78542 - RNA, 21 nt, Human
cucgccccagcucccaccccc

SEQ ID NO: 78543 - RNA, 18 nt, Human
cugaaaacuuccaacucc

SEQ ID NO: 78544 - RNA, 19 nt, Human
cugaaggacagccaugaga

SEQ ID NO: 78545 - RNA, 19 nt, Human
cugccccugccaaaucuuc

SEQ ID NO: 78546 - RNA, 24 nt, Human
cuuagguagcugagacucagggcu

SEQ ID NO: 78547 - RNA, 23 nt, Human
cuuauuuuuauuuaaaacaaaaa

SEQ ID NO: 78548 - RNA, 23 nt, Human
gaaaagcaacgggggccaacggc

SEQ ID NO: 78549 - RNA, 20 nt, Human
gaaaaguaacgggggccaac

SEQ ID NO: 78550 - RNA, 21 nt, Human
gaaaugagcuaucuggagggc

SEQ ID NO: 78551 - RNA, 18 nt, Human
gaaggagggcaggagggc

SEQ ID NO: 78552 - RNA, 21 nt, Human
gacaagauaauguuuuacaug

SEQ ID NO: 78553 - RNA, 18 nt, Human
gacacaggcagguucugc

SEQ ID NO: 78554 - RNA, 20 nt, Human
gacccugucagcugucauuc

SEQ ID NO: 78555 - RNA, 18 nt, Human
gagaauguuggcgucuug

SEQ ID NO: 78556 - RNA, 21 nt, Human
gagcccacccgcacuccaacc

SEQ ID NO: 78557 - RNA, 24 nt, Human
gaggucuggcuucauaccacaggu

SEQ ID NO: 78558 - RNA, 19 nt, Human
gauuuauaaucacuuccua

SEQ ID NO: 78559 - RNA, 26 nt, Human
gcaggagggcucugggugggucugug

SEQ ID NO: 78560 - RNA, 18 nt, Human
gcagguucugcggacuuc

SEQ ID NO: 78561 - RNA, 21 nt, Human
gccccagcucccaccccacgg

SEQ ID NO: 78562 - RNA, 21 nt, Human
gccguggccauugccucuccu

SEQ ID NO: 78563 - RNA, 19 nt, Human
ggagccacacgaagcggug

SEQ ID NO: 78564 - RNA, 22 nt, Human
ggagggcucugggugggucugu

SEQ ID NO: 78565 - RNA, 24 nt, Human
ggauugcccugauuauuuacauuu

SEQ ID NO: 78566 - RNA, 24 nt, Human
ggcaggagggcucugggugggucu

SEQ ID NO: 78567 - RNA, 18 nt, Human
ggcuuaucucaccuucuc

SEQ ID NO: 78568 - RNA, 18 nt, Human
gggcaggagggcucuggg

SEQ ID NO: 78569 - RNA, 18 nt, Human
guggagcauacugcaaac

SEQ ID NO: 78570 - RNA, 24 nt, Human
guugaucaucccuggaggaggcca

SEQ ID NO: 78571 - RNA, 21 nt, Human
uaaaaacaaaaaaacgcugag

SEQ ID NO: 78572 - RNA, 25 nt, Human
uaaaaacaaaaaaacgcugagaugc

SEQ ID NO: 78573 - RNA, 19 nt, Human
uaaaaagagccauggaagg

SEQ ID NO: 78574 - RNA, 27 nt, Human
uaaaaccaaacuacagugacaagauaa

SEQ ID NO: 78575 - RNA, 23 nt, Human
uaaaaguaucaaucuuaaaaaga

SEQ ID NO: 78576 - RNA, 18 nt, Human
uaaacaaaaccaccaaaa

SEQ ID NO: 78577 - RNA, 18 nt, Human
uaaagagcaguuaagaug

SEQ ID NO: 78578 - RNA, 25 nt, Human
uaaaugguauauaaugcaauaaugc

SEQ ID NO: 78579 - RNA, 21 nt, Human
uaacaaaaccccacagcaaaa

SEQ ID NO: 78580 - RNA, 24 nt, Human
uaacaauaaggaaaaugcaacauc

SEQ ID NO: 78581 - RNA, 22 nt, Human
uaagaugcagaugugaaucccu

SEQ ID NO: 78582 - RNA, 21 nt, Human
uacaauuaaaaacaaaaaaac

SEQ ID NO: 78583 - RNA, 23 nt, Human
uaccaugaauuaaaugcggaauu

SEQ ID NO: 78584 - RNA, 21 nt, Human
uagaaacagaugucccuacca

SEQ ID NO: 78585 - RNA, 24 nt, Human
uagauauaaugaaaaaaaagaaga

SEQ ID NO: 78586 - RNA, 26 nt, Human
uagcuuaaaaaaauacuuuccuauga

SEQ ID NO: 78587 - RNA, 25 nt, Human
uaggugcauggauuuacucaguauc

SEQ ID NO: 78588 - RNA, 24 nt, Human
uaguuccccaccauugauuuuuuu

SEQ ID NO: 78589 - RNA, 19 nt, Human
ucaaauaaaaccaaacuac

SEQ ID NO: 78590 - RNA, 21 nt, Human
ucaaccacagcauuaaacauu

SEQ ID NO: 78591 - RNA, 19 nt, Human
ucaaucuuaaaaagagcca

SEQ ID NO: 78592 - RNA, 19 nt, Human
ucacuuccucaaguuccag

SEQ ID NO: 78593 - RNA, 18 nt, Human
ucagauggugauccggcc

SEQ ID NO: 78594 - RNA, 19 nt, Human
ucaggccagggaggcaugg

SEQ ID NO: 78595 - RNA, 19 nt, Human
ucagguccuuuuuccaucc

SEQ ID NO: 78596 - RNA, 22 nt, Human
ucauggguuuaaccaaacaugc

SEQ ID NO: 78597 - RNA, 23 nt, Human
uccaaagacaggaguuuugaugg

SEQ ID NO: 78598 - RNA, 24 nt, Human
uccaaggucaugguuguccaaaga

SEQ ID NO: 78599 - RNA, 18 nt, Human
uccagaggauucuguuuc

SEQ ID NO: 78600 - RNA, 23 nt, Human
uccauccuccaccaguguuccca

SEQ ID NO: 78601 - RNA, 21 nt, Human
ucccaccccacggcccccaga

SEQ ID NO: 78602 - RNA, 18 nt, Human
ucccauugcccaggagcc

SEQ ID NO: 78603 - RNA, 19 nt, Human
ucccugaggcccgccgggg

SEQ ID NO: 78604 - RNA, 19 nt, Human
uccucaguggccagugaca

SEQ ID NO: 78605 - RNA, 19 nt, Human
uccugaugcggaagucacc

SEQ ID NO: 78606 - RNA, 21 nt, Human
ucucgccccagcucccacccc

SEQ ID NO: 78607 - RNA, 18 nt, Human
ucugacccuggccagugu

SEQ ID NO: 78608 - RNA, 24 nt, Human
ucugauaggaagggcccagggccu

SEQ ID NO: 78609 - RNA, 26 nt, Human
ucugugugugugauguuuauaugugu

SEQ ID NO: 78610 - RNA, 23 nt, Human
ucuuagguagcugagacucaggg

SEQ ID NO: 78611 - RNA, 22 nt, Human
ugaaaaaaaagaagaggagaaa

SEQ ID NO: 78612 - RNA, 23 nt, Human
ugaacaccuucuccccagccucc

SEQ ID NO: 78613 - RNA, 23 nt, Human
ugaaccuuuugcauauuuguuug

SEQ ID NO: 78614 - RNA, 19 nt, Human
ugacaggcccagccacacc

SEQ ID NO: 78615 - RNA, 18 nt, Human
ugacuccauuaaaaugau

SEQ ID NO: 78616 - RNA, 19 nt, Human
ugagaugcauauuucauga

SEQ ID NO: 78617 - RNA, 20 nt, Human
ugaggcccgccggggagguc

SEQ ID NO: 78618 - RNA, 22 nt, Human
ugaugcggaagucaccgaaaug

SEQ ID NO: 78619 - RNA, 22 nt, Human
ugcaagugaaugaacaccuucu

SEQ ID NO: 78620 - RNA, 23 nt, Human
ugccaaacggagcugcacuuuga

SEQ ID NO: 78621 - RNA, 21 nt, Human
ugcccaggagcccacccgcac

SEQ ID NO: 78622 - RNA, 18 nt, Human
ugcccugauuauuuacau

SEQ ID NO: 78623 - RNA, 21 nt, Human
ugcggaauugcccagggacga

SEQ ID NO: 78624 - RNA, 20 nt, Human
ugcuuuagugaaccuuuugc

SEQ ID NO: 78625 - RNA, 26 nt, Human
uggcaaugugacuuuuuccaacaacc

SEQ ID NO: 78626 - RNA, 19 nt, Human
ugggacacaggcagguucu

SEQ ID NO: 78627 - RNA, 22 nt, Human
uguacaguucuggggccaagag

SEQ ID NO: 78628 - RNA, 21 nt, Human
uguccagaggaggagguaggg

SEQ ID NO: 78629 - RNA, 22 nt, Human
ugugugauguuuauaugugugu

SEQ ID NO: 78630 - RNA, 21 nt, Human
ugugugugucugucugugugu

SEQ ID NO: 78631 - RNA, 19 nt, Human
ugugugugugugucugucu

SEQ ID NO: 78632 - RNA, 27 nt, Human
ugugugugugugugucugucugugugu

SEQ ID NO: 78633 - RNA, 21 nt, Human
uuaaaaaguguguaaccacau

SEQ ID NO: 78634 - RNA, 22 nt, Human
uuaaaaccagguaacaaaaccc

SEQ ID NO: 78635 - RNA, 24 nt, Human
uuaaauauccuguuaguuaaaacu

SEQ ID NO: 78636 - RNA, 21 nt, Human
uucaaugcuucuuuuaggauu

SEQ ID NO: 78637 - RNA, 18 nt, Human
uuccaaaguuaauacaga

SEQ ID NO: 78638 - RNA, 21 nt, Human
uucccagaggaaaagcaacgg

SEQ ID NO: 78639 - RNA, 21 nt, Human
uucccagaggaaaaguaacgg

SEQ ID NO: 78640 - RNA, 24 nt, Human
uucccagccuucaccauguccuuc

SEQ ID NO: 78641 - RNA, 24 nt, Human
uucuucacaauauuaacuagacag

SEQ ID NO: 78642 - RNA, 21 nt, Human
uugaacaacaacagaagacaa

SEQ ID NO: 78643 - RNA, 19 nt, Human
uugcugaagaugucacuuc

SEQ ID NO: 78644 - RNA, 24 nt, Human
uuggcaguaaauagcugauucgac

SEQ ID NO: 78645 - RNA, 19 nt, Human
uuuccuguuuuucucugau

SEQ ID NO: 78646 - RNA, 18 nt, Human
uuugaacaacaacagaag

SEQ ID NO: 78647 - RNA, 23 nt, Human
uuuguuuggggcaggcauguuga

SEQ ID NO: 78648 - RNA, 18 nt, Human
uuuuccauccgucugcuc

SEQ ID NO: 78649 - RNA, 23 nt, Human
uuuucugccccugccaaaucuuc

SEQ ID NO: 78650 - RNA, 21 nt, Human
aaguauguguuggcaaucguu

SEQ ID NO: 78651 - RNA, 23 nt, Human
aucaaaguuguuuauuuaaaagu

SEQ ID NO: 78652 - RNA, 19 nt, Human
cacaauauggaguguccuu

SEQ ID NO: 78653 - RNA, 19 nt, Human
gucaaguuacaucaucaaa

SEQ ID NO: 78654 - RNA, 21 nt, Human
uacauggaggcugguggaauu

SEQ ID NO: 78655 - RNA, 28 nt, Human
uagaaguauguguuggcaaucguuucca

SEQ ID NO: 78656 - RNA, 27 nt, Human
uggagagcaaagucuugagcuggcuca

SEQ ID NO: 78657 - RNA, 23 nt, Human
uggggacaaaauuuccauaacuc

SEQ ID NO: 78658 - RNA, 18 nt, Human
uuaugacacaugaugaua

SEQ ID NO: 78659 - RNA, 20 nt, Human
uucuguuugcaucacuuuau

SEQ ID NO: 78660 - RNA, 21 nt, Human
uuucacaauauggaguguccu

SEQ ID NO: 78661 - RNA, 23 nt, Human
uuugcaucacuuuauaauauccu

SEQ ID NO: 78662 - RNA, 22 nt, Human
aacacuggccaaaucaccaccu

SEQ ID NO: 78663 - RNA, 18 nt, Human
aaggaagagccauuugca

SEQ ID NO: 78664 - RNA, 22 nt, Human
acaaguuaaaacacuggccaaa

SEQ ID NO: 78665 - RNA, 24 nt, Human
cuggggggccgggccuucgcuggu

SEQ ID NO: 78666 - RNA, 23 nt, Human
gugggggaaggugcuuucccuca

SEQ ID NO: 78667 - RNA, 22 nt, Human
ucacaaguuaaaacacuggcca

SEQ ID NO: 78668 - RNA, 19 nt, Human
ucgcugguuuucuuggccc

SEQ ID NO: 78669 - RNA, 19 nt, Human
uggggggccgggccuucgc

SEQ ID NO: 78670 - RNA, 20 nt, Human
uggggggccgggccuucgcu

SEQ ID NO: 78671 - RNA, 21 nt, Human
cacagcuccgucucaaacgcu

SEQ ID NO: 78672 - RNA, 18 nt, Human
ccucucucaccuccuccu

SEQ ID NO: 78673 - RNA, 19 nt, Human
cucaaacgcuuccccacug

SEQ ID NO: 78674 - RNA, 18 nt, Human
cucauggaagcuggguga

SEQ ID NO: 78675 - RNA, 20 nt, Human
cugcagguucagccugccuc

SEQ ID NO: 78676 - RNA, 20 nt, Human
cugcagguucagccugccuc

SEQ ID NO: 78677 - RNA, 22 nt, Human
ggaagcugggugauggagcugu

SEQ ID NO: 78678 - RNA, 20 nt, Human
uccccacugcccuuaagugg

SEQ ID NO: 78679 - RNA, 22 nt, Human
uccccacugcccuuaaguggac

SEQ ID NO: 78680 - RNA, 19 nt, Human
ucguaagauaaccauucgu

SEQ ID NO: 78681 - RNA, 19 nt, Human
ucguaagauaaccauucgu

SEQ ID NO: 78682 - RNA, 19 nt, Human
ucguaagauaaccauucgu

SEQ ID NO: 78683 - RNA, 19 nt, Human
ucguaagauaaccauucgu

SEQ ID NO: 78684 - RNA, 24 nt, Human
ucucaaacgcuuccccacugcccu

SEQ ID NO: 78685 - RNA, 20 nt, Human
ucucucaccuccuccuucaa

SEQ ID NO: 78686 - RNA, 21 nt, Human
ugaauacaugacaacuacacg

SEQ ID NO: 78687 - RNA, 22 nt, Human
uggguggucuucggcugcuugg

SEQ ID NO: 78688 - RNA, 22 nt, Human
uggguggucuucggcugcuugg

SEQ ID NO: 78689 - RNA, 22 nt, Human
uggguggucuucggcugcuugg

SEQ ID NO: 78690 - RNA, 22 nt, Human
uggguggucuucggcugcuugg

SEQ ID NO: 78691 - RNA, 20 nt, Human
aacaaggccagcugcagaac

SEQ ID NO: 78692 - RNA, 23 nt, Human
aaccccucuccuccuacuuaauc

SEQ ID NO: 78693 - RNA, 22 nt, Human
aaccuggccauggucccugcag

SEQ ID NO: 78694 - RNA, 20 nt, Human
aagaaaaagccauaaucuga

SEQ ID NO: 78695 - RNA, 18 nt, Human
aagaaaccccucuccucc

SEQ ID NO: 78696 - RNA, 21 nt, Human
aagcagaagucuggacucaac

SEQ ID NO: 78697 - RNA, 22 nt, Human
aagcagaagucuggacucaaca

SEQ ID NO: 78698 - RNA, 24 nt, Human
aagcagcagagcccucggucugga

SEQ ID NO: 78699 - RNA, 18 nt, Human
aaggcaucaacagucuca

SEQ ID NO: 78700 - RNA, 24 nt, Human
aaguuccaggucguuucaugugcc

SEQ ID NO: 78701 - RNA, 18 nt, Human
acaccuagccccaccugg

SEQ ID NO: 78702 - RNA, 19 nt, Human
acagaagagucucuggggu

SEQ ID NO: 78703 - RNA, 22 nt, Human
acagacaaguaacacccaugca

SEQ ID NO: 78704 - RNA, 18 nt, Human
acaggcaggguucuagag

SEQ ID NO: 78705 - RNA, 24 nt, Human
accaagugaaaaucuccaagaaga

SEQ ID NO: 78706 - RNA, 18 nt, Human
accccccaccccaacugc

SEQ ID NO: 78707 - RNA, 19 nt, Human
accuauaggcgugaucccu

SEQ ID NO: 78708 - RNA, 18 nt, Human
agaaccccuaagcuucca

SEQ ID NO: 78709 - RNA, 24 nt, Human
agccuccacccauccaggcucaac

SEQ ID NO: 78710 - RNA, 19 nt, Human
agccucucuuuccacccag

SEQ ID NO: 78711 - RNA, 19 nt, Human
agcuaaucccaaggaacua

SEQ ID NO: 78712 - RNA, 24 nt, Human
agcuccucuuggcuaaaggucccg

SEQ ID NO: 78713 - RNA, 23 nt, Human
aggaaacuucagggcucugccaa

SEQ ID NO: 78714 - RNA, 19 nt, Human
aggagcugggagggaggga

SEQ ID NO: 78715 - RNA, 23 nt, Human
agggccccaauuuagaguuucag

SEQ ID NO: 78716 - RNA, 22 nt, Human
agugcucaggaccacaggcagg

SEQ ID NO: 78717 - RNA, 22 nt, Human
auaaaaucuuacccugaacccc

SEQ ID NO: 78718 - RNA, 24 nt, Human
aucacccucacacccaugggauuc

SEQ ID NO: 78719 - RNA, 19 nt, Human
aucccucccaccuccccca

SEQ ID NO: 78720 - RNA, 24 nt, Human
aucccucccaccucccccagcccu

SEQ ID NO: 78721 - RNA, 19 nt, Human
aucuaauggaauacagcug

SEQ ID NO: 78722 - RNA, 18 nt, Human
augcacaccagcaugcgu

SEQ ID NO: 78723 - RNA, 19 nt, Human
augcccacccauccaccaa

SEQ ID NO: 78724 - RNA, 21 nt, Human
caaggcaucaacagucucacu

SEQ ID NO: 78725 - RNA, 23 nt, Human
caagugcauaaugcacaaggaag

SEQ ID NO: 78726 - RNA, 19 nt, Human
cacaaaaauaaaagucaaa

SEQ ID NO: 78727 - RNA, 23 nt, Human
cacaccuagccccaccuggcccu

SEQ ID NO: 78728 - RNA, 21 nt, Human
cacccauccaccaacuccacu

SEQ ID NO: 78729 - RNA, 21 nt, Human
cacccccuucaucuccccaag

SEQ ID NO: 78730 - RNA, 18 nt, Human
cacccucacacccauggg

SEQ ID NO: 78731 - RNA, 24 nt, Human
caccuuggaaagugcagcagugag

SEQ ID NO: 78732 - RNA, 22 nt, Human
cacguucuggcgagcacaacua

SEQ ID NO: 78733 - RNA, 23 nt, Human
cacuuaugcccacaaccucaaaa

SEQ ID NO: 78734 - RNA, 24 nt, Human
cagaaaacagccucucuuuccagu

SEQ ID NO: 78735 - RNA, 23 nt, Human
cagaaaguuagcauuggagagca

SEQ ID NO: 78736 - RNA, 18 nt, Human
cagacaaguaacacccau

SEQ ID NO: 78737 - RNA, 20 nt, Human
cagagaacugccccuaguuc

SEQ ID NO: 78738 - RNA, 18 nt, Human
cagccacaccuagcccca

SEQ ID NO: 78739 - RNA, 20 nt, Human
cagcccacuguuaacagcca

SEQ ID NO: 78740 - RNA, 19 nt, Human
cagccuaccaccuccccua

SEQ ID NO: 78741 - RNA, 18 nt, Human
cagccugcucagcucccc

SEQ ID NO: 78742 - RNA, 24 nt, Human
cagcuccccacccccuucaucucc

SEQ ID NO: 78743 - RNA, 22 nt, Human
caggugucaaggcuucagagca

SEQ ID NO: 78744 - RNA, 21 nt, Human
cagugugggacccagacugua

SEQ ID NO: 78745 - RNA, 19 nt, Human
cauacucacaacaagacca

SEQ ID NO: 78746 - RNA, 19 nt, Human
caucucaaggcaucaacag

SEQ ID NO: 78747 - RNA, 21 nt, Human
caugguagguacucuagaacc

SEQ ID NO: 78748 - RNA, 24 nt, Human
ccaaucgccuaccuggccuacuca

SEQ ID NO: 78749 - RNA, 19 nt, Human
ccacccauccaggcucaac

SEQ ID NO: 78750 - RNA, 22 nt, Human
ccagccacaccuagccccaccu

SEQ ID NO: 78751 - RNA, 21 nt, Human
cccacccauccaccaacucca

SEQ ID NO: 78752 - RNA, 21 nt, Human
cccacccccuucaucucccca

SEQ ID NO: 78753 - RNA, 22 nt, Human
cccacguucuggcgagcacaac

SEQ ID NO: 78754 - RNA, 22 nt, Human
cccacucaucuaauggaauaca

SEQ ID NO: 78755 - RNA, 18 nt, Human
cccagccugcucagcucc

SEQ ID NO: 78756 - RNA, 20 nt, Human
cccaugcaaacaguguggcu

SEQ ID NO: 78757 - RNA, 19 nt, Human
ccccaaggacuccugaggc

SEQ ID NO: 78758 - RNA, 25 nt, Human
ccccaaggacuccugaggcaacccc

SEQ ID NO: 78759 - RNA, 23 nt, Human
ccccacccccuucaucuccccaa

SEQ ID NO: 78760 - RNA, 22 nt, Human
ccccagccacaccuagccccac

SEQ ID NO: 78761 - RNA, 20 nt, Human
ccccagcccuggaacgacua

SEQ ID NO: 78762 - RNA, 25 nt, Human
cccccaccccaacugcuugccacaa

SEQ ID NO: 78763 - RNA, 24 nt, Human
cccccagccacaccuagccccacc

SEQ ID NO: 78764 - RNA, 27 nt, Human
ccccccaccccaacugccggguccuuc

SEQ ID NO: 78765 - RNA, 18 nt, Human
ccccuccccucugugucc

SEQ ID NO: 78766 - RNA, 25 nt, Human
ccccucuccuccuacuuaaucuuug

SEQ ID NO: 78767 - RNA, 25 nt, Human
cccuaaacuugccaaaacauucccc

SEQ ID NO: 78768 - RNA, 21 nt, Human
cccuaaaucccacucaucuaa

SEQ ID NO: 78769 - RNA, 22 nt, Human
cccuacuuccgcuccuuccuug

SEQ ID NO: 78770 - RNA, 18 nt, Human
cccucuccuccuacuuaa

SEQ ID NO: 78771 - RNA, 20 nt, Human
cccucuguguccugcucacu

SEQ ID NO: 78772 - RNA, 19 nt, Human
ccgaaccaaagcccacaac

SEQ ID NO: 78773 - RNA, 24 nt, Human
ccucagggcugugaagcaaguucc

SEQ ID NO: 78774 - RNA, 23 nt, Human
ccucccaccucccccagcccugg

SEQ ID NO: 78775 - RNA, 20 nt, Human
ccucucccuaucaccugaga

SEQ ID NO: 78776 - RNA, 21 nt, Human
ccucucccuaucaccugagaa

SEQ ID NO: 78777 - RNA, 19 nt, Human
ccugagugggagaggaggg

SEQ ID NO: 78778 - RNA, 23 nt, Human
ccugcucacucuuccaaucgccu

SEQ ID NO: 78779 - RNA, 18 nt, Human
ccugcucagcuccccacc

SEQ ID NO: 78780 - RNA, 23 nt, Human
ccuggcccccagccacaccuagc

SEQ ID NO: 78781 - RNA, 19 nt, Human
cgugaucccucccaccucc

SEQ ID NO: 78782 - RNA, 21 nt, Human
cgugaucccucccaccucccc

SEQ ID NO: 78783 - RNA, 24 nt, Human
cuccacuucuuccaagggcauuuc

SEQ ID NO: 78784 - RNA, 22 nt, Human
cucccuaucaccugagaacccc

SEQ ID NO: 78785 - RNA, 24 nt, Human
cucuagaacccauaugccuggccc

SEQ ID NO: 78786 - RNA, 18 nt, Human
cucugcccauccuguucc

SEQ ID NO: 78787 - RNA, 22 nt, Human
cucuguguccugcucacucuuc

SEQ ID NO: 78788 - RNA, 22 nt, Human
cucuguucuguuccugcucucc

SEQ ID NO: 78789 - RNA, 23 nt, Human
cuggaguacccaucacccucaca

SEQ ID NO: 78790 - RNA, 24 nt, Human
cuggcccccagccacaccuagccc

SEQ ID NO: 78791 - RNA, 19 nt, Human
cugguggcaaggagccccc

SEQ ID NO: 78792 - RNA, 24 nt, Human
cuuacccugaaccccaaagguuuc

SEQ ID NO: 78793 - RNA, 21 nt, Human
cuucagagcagggcauuuugg

SEQ ID NO: 78794 - RNA, 25 nt, Human
cuucuuggccaagagcuaaucccaa

SEQ ID NO: 78795 - RNA, 18 nt, Human
cuugccaaaacauucccc

SEQ ID NO: 78796 - RNA, 21 nt, Human
gaaaccccucuccuccuacuu

SEQ ID NO: 78797 - RNA, 20 nt, Human
gaaaggagggguugggagga

SEQ ID NO: 78798 - RNA, 22 nt, Human
gaccaagugaaaaucuccaaga

SEQ ID NO: 78799 - RNA, 21 nt, Human
gaccaaguggcacaugcagcc

SEQ ID NO: 78800 - RNA, 19 nt, Human
gacuguauucuagaucagc

SEQ ID NO: 78801 - RNA, 22 nt, Human
gagcaagucagagaccccccac

SEQ ID NO: 78802 - RNA, 21 nt, Human
gagcccaggaggcagcagcaa

SEQ ID NO: 78803 - RNA, 24 nt, Human
gagugugcuccauaccuggggaag

SEQ ID NO: 78804 - RNA, 26 nt, Human
gcagaacugcucuucucuccaaagga

SEQ ID NO: 78805 - RNA, 27 nt, Human
gcagaacugcucuucucuccaaaggaa

SEQ ID NO: 78806 - RNA, 19 nt, Human
gcagccuaccaccuccccu

SEQ ID NO: 78807 - RNA, 21 nt, Human
gcccacccauccaccaacucc

SEQ ID NO: 78808 - RNA, 24 nt, Human
gccgaaccaaagcccacaacacag

SEQ ID NO: 78809 - RNA, 18 nt, Human
gccuacucagcucccuca

SEQ ID NO: 78810 - RNA, 19 nt, Human
gccugcucagcuccccacc

SEQ ID NO: 78811 - RNA, 18 nt, Human
ggaaacacuuuaggcacc

SEQ ID NO: 78812 - RNA, 20 nt, Human
ggacuccugaggcaaccccu

SEQ ID NO: 78813 - RNA, 19 nt, Human
ggagcugggagggagggag

SEQ ID NO: 78814 - RNA, 21 nt, Human
ggagggagggagagagggagc

SEQ ID NO: 78815 - RNA, 19 nt, Human
ggagggguugggaggaggg

SEQ ID NO: 78816 - RNA, 24 nt, Human
ggcgugaucccucccaccuccccc

SEQ ID NO: 78817 - RNA, 20 nt, Human
ggguagggugaagagugugc

SEQ ID NO: 78818 - RNA, 18 nt, Human
ggugcaggagcugggagg

SEQ ID NO: 78819 - RNA, 19 nt, Human
ggugcaggagcugggaggg

SEQ ID NO: 78820 - RNA, 21 nt, Human
gucccagagauuggaaacacu

SEQ ID NO: 78821 - RNA, 19 nt, Human
gugcaggagcugggaggga

SEQ ID NO: 78822 - RNA, 19 nt, Human
guuugagggcaaauugccc

SEQ ID NO: 78823 - RNA, 19 nt, Human
uaaaagucaaaugaacuug

SEQ ID NO: 78824 - RNA, 22 nt, Human
uaaagccgaaccaaagcccaca

SEQ ID NO: 78825 - RNA, 23 nt, Human
uaagacacagcacugguggcaag

SEQ ID NO: 78826 - RNA, 19 nt, Human
uaagacagcuacaagggga

SEQ ID NO: 78827 - RNA, 19 nt, Human
uaagccuccacccauccag

SEQ ID NO: 78828 - RNA, 23 nt, Human
uaauacgaucauuacauauuaca

SEQ ID NO: 78829 - RNA, 23 nt, Human
uaccaccuccccuagaaauacca

SEQ ID NO: 78830 - RNA, 24 nt, Human
uaccuggccuacucagcucccuca

SEQ ID NO: 78831 - RNA, 18 nt, Human
uagccccaccuggcccug

SEQ ID NO: 78832 - RNA, 18 nt, Human
ucaaaagaaaaagccaua

SEQ ID NO: 78833 - RNA, 25 nt, Human
ucaaaagcagaagucuggacucaac

SEQ ID NO: 78834 - RNA, 25 nt, Human
ucaacagcccugcccuucuaucaga

SEQ ID NO: 78835 - RNA, 21 nt, Human
ucacaacaagaccaaguggca

SEQ ID NO: 78836 - RNA, 21 nt, Human
ucagccuucuuggccaagagc

SEQ ID NO: 78837 - RNA, 18 nt, Human
ucaugugcccacaccuau

SEQ ID NO: 78838 - RNA, 25 nt, Human
uccaaagccuugccaaucacuuucu

SEQ ID NO: 78839 - RNA, 21 nt, Human
uccaccaacuccacuucuucc

SEQ ID NO: 78840 - RNA, 19 nt, Human
uccaccuuccucagggcug

SEQ ID NO: 78841 - RNA, 23 nt, Human
uccaggcucaacagcccugcccu

SEQ ID NO: 78842 - RNA, 21 nt, Human
uccauaccuggggaaggaagc

SEQ ID NO: 78843 - RNA, 24 nt, Human
ucccaccaccaccagauuugccag

SEQ ID NO: 78844 - RNA, 30 nt, Human
ucccagagauuggaaacacuuuaggcaccu

SEQ ID NO: 78845 - RNA, 22 nt, Human
uccccacccccuucaucucccc

SEQ ID NO: 78846 - RNA, 28 nt, Human
uccccuagaaauaccaugaaaaagugca

SEQ ID NO: 78847 - RNA, 21 nt, Human
ucccugacagaagagucucug

SEQ ID NO: 78848 - RNA, 19 nt, Human
ucccugcagcuccucuugg

SEQ ID NO: 78849 - RNA, 19 nt, Human
uccuggaguacccaucacc

SEQ ID NO: 78850 - RNA, 18 nt, Human
ucuagaggacugcgaguu

SEQ ID NO: 78851 - RNA, 23 nt, Human
ucucuaagccuugaggcaucagg

SEQ ID NO: 78852 - RNA, 19 nt, Human
ucucuccaaagccuugcca

SEQ ID NO: 78853 - RNA, 20 nt, Human
ucugaaauggucaucucaag

SEQ ID NO: 78854 - RNA, 20 nt, Human
ucugggguuucccuucaagc

SEQ ID NO: 78855 - RNA, 22 nt, Human
ugaaggaacaaggccagcugca

SEQ ID NO: 78856 - RNA, 23 nt, Human
ugagacacagugugggacccaga

SEQ ID NO: 78857 - RNA, 21 nt, Human
ugaucagugcucaggaccaca

SEQ ID NO: 78858 - RNA, 23 nt, Human
ugcagcccucucucaaaagcaga

SEQ ID NO: 78859 - RNA, 23 nt, Human
ugcagccuaccaccuccccuaga

SEQ ID NO: 78860 - RNA, 23 nt, Human
ugcauaaugcacaaggaaggggg

SEQ ID NO: 78861 - RNA, 21 nt, Human
ugccaagcaguuugaaaacca

SEQ ID NO: 78862 - RNA, 19 nt, Human
ugcucaggaccacaggcag

SEQ ID NO: 78863 - RNA, 19 nt, Human
uggaaagaagcagcagagc

SEQ ID NO: 78864 - RNA, 19 nt, Human
uggaaagugcagcagugag

SEQ ID NO: 78865 - RNA, 19 nt, Human
uggcaaggagcccccagcu

SEQ ID NO: 78866 - RNA, 21 nt, Human
uggcaaggagcccccagcugg

SEQ ID NO: 78867 - RNA, 18 nt, Human
uggccaagagcuaauccc

SEQ ID NO: 78868 - RNA, 18 nt, Human
uggcccccagccacaccu

SEQ ID NO: 78869 - RNA, 19 nt, Human
uggccuaaacaaagucccu

SEQ ID NO: 78870 - RNA, 20 nt, Human
uggcucuagaagagaguccc

SEQ ID NO: 78871 - RNA, 23 nt, Human
uggcuucaaauaaaucauaaaug

SEQ ID NO: 78872 - RNA, 18 nt, Human
ugggaaccauacucagcc

SEQ ID NO: 78873 - RNA, 20 nt, Human
ugggagggagggagagaggg

SEQ ID NO: 78874 - RNA, 21 nt, Human
uggggaaggaagcacagacuc

SEQ ID NO: 78875 - RNA, 22 nt, Human
uggggagugggauuaauaaucg

SEQ ID NO: 78876 - RNA, 19 nt, Human
uggggccuuucauccuccu

SEQ ID NO: 78877 - RNA, 18 nt, Human
uggugcaggagcugggag

SEQ ID NO: 78878 - RNA, 18 nt, Human
uguaagacagcuacaagg

SEQ ID NO: 78879 - RNA, 23 nt, Human
uguaagacagcuacaaggggagc

SEQ ID NO: 78880 - RNA, 19 nt, Human
ugugccccuaaacuugcca

SEQ ID NO: 78881 - RNA, 20 nt, Human
ugugccccuaaacuugccaa

SEQ ID NO: 78882 - RNA, 22 nt, Human
uuccaacuuuuuuucagcagca

SEQ ID NO: 78883 - RNA, 23 nt, Human
uucccugacagaagagucucugg

SEQ ID NO: 78884 - RNA, 24 nt, Human
uucuagaucagcacuuaugcccac

SEQ ID NO: 78885 - RNA, 19 nt, Human
uugccaaaacauuccccuc

SEQ ID NO: 78886 - RNA, 21 nt, Human
uuuaggcaccauugugccuga

SEQ ID NO: 78887 - RNA, 23 nt, Human
uuugucccuuugggcucuggaga

SEQ ID NO: 78888 - RNA, 19 nt, Human
uuuugguaaccuggccaug

SEQ ID NO: 78889 - RNA, 22 nt, Human
uuuuucagcagcaaaccccuua

SEQ ID NO: 78890 - RNA, 21 nt, Human
aagaggggguguauggguagg

SEQ ID NO: 78891 - RNA, 19 nt, Human
aauccaaccaaaaugcuua

SEQ ID NO: 78892 - RNA, 26 nt, Human
agaaugcuggggucagaguccuggga

SEQ ID NO: 78893 - RNA, 19 nt, Human
aucugcccccccauccccc

SEQ ID NO: 78894 - RNA, 23 nt, Human
augguacaaaaauaguuuauuac

SEQ ID NO: 78895 - RNA, 23 nt, Human
caaaaugcuuaauaauuuacauc

SEQ ID NO: 78896 - RNA, 23 nt, Human
caugaguccaagaucugcccccc

SEQ ID NO: 78897 - RNA, 19 nt, Human
ccccucugggcaggggggc

SEQ ID NO: 78898 - RNA, 21 nt, Human
cccucugggcaggggggcccc

SEQ ID NO: 78899 - RNA, 18 nt, Human
cccuggguccaccagcuc

SEQ ID NO: 78900 - RNA, 20 nt, Human
cccuggguccaccagcucug

SEQ ID NO: 78901 - RNA, 19 nt, Human
cggcccaccucuccccucc

SEQ ID NO: 78902 - RNA, 23 nt, Human
cggcccaccucuccccuccucag

SEQ ID NO: 78903 - RNA, 18 nt, Human
ggaggggaguggcuguuc

SEQ ID NO: 78904 - RNA, 25 nt, Human
ggcccaccucuccccuccucaguua

SEQ ID NO: 78905 - RNA, 20 nt, Human
gggcauggggccgccgggga

SEQ ID NO: 78906 - RNA, 18 nt, Human
gggcgaagucagaucuuc

SEQ ID NO: 78907 - RNA, 24 nt, Human
ggggggggggggggcgaagucaga

SEQ ID NO: 78908 - RNA, 19 nt, Human
gguagagaguggaggggag

SEQ ID NO: 78909 - RNA, 19 nt, Human
guggcuguucccugggucc

SEQ ID NO: 78910 - RNA, 19 nt, Human
ucagaguccugggagggag

SEQ ID NO: 78911 - RNA, 21 nt, Human
uccaagaucugcccccccauc

SEQ ID NO: 78912 - RNA, 22 nt, Human
uccaagaucugcccccccaucc

SEQ ID NO: 78913 - RNA, 19 nt, Human
uccuggucccgaagauggg

SEQ ID NO: 78914 - RNA, 22 nt, Human
ugagaaugcuggggucagaguc

SEQ ID NO: 78915 - RNA, 23 nt, Human
ugcucagaagaggggguguaugg

SEQ ID NO: 78916 - RNA, 22 nt, Human
uggcauuccggacagggacugg

SEQ ID NO: 78917 - RNA, 18 nt, Human
uucccuggguccaccagc

SEQ ID NO: 78918 - RNA, 25 nt, Human
aaaaaaauacaaauacacugaggca

SEQ ID NO: 78919 - RNA, 21 nt, Human
aaaaaaggcaccgugaggaca

SEQ ID NO: 78920 - RNA, 19 nt, Human
aaaagaaagcugaagacac

SEQ ID NO: 78921 - RNA, 18 nt, Human
aaaagaaccuaucuccuc

SEQ ID NO: 78922 - RNA, 25 nt, Human
aaacauauacauuccucauuuugca

SEQ ID NO: 78923 - RNA, 22 nt, Human
aaagaaccuaucuccuccucuc

SEQ ID NO: 78924 - RNA, 19 nt, Human
aaagccacaagauuuuuuc

SEQ ID NO: 78925 - RNA, 25 nt, Human
aaccaaacacucugacauuucucug

SEQ ID NO: 78926 - RNA, 26 nt, Human
aaccaaaugagcacucuaaaaugaga

SEQ ID NO: 78927 - RNA, 21 nt, Human
aaccuaucuccuccucucccc

SEQ ID NO: 78928 - RNA, 22 nt, Human
aaccuaucuccuccucucccca

SEQ ID NO: 78929 - RNA, 24 nt, Human
aagacaaaagaaccuaucuccucc

SEQ ID NO: 78930 - RNA, 22 nt, Human
aagcaugacgcagaaugggaug

SEQ ID NO: 78931 - RNA, 21 nt, Human
acccccaccacccccaacccc

SEQ ID NO: 78932 - RNA, 22 nt, Human
accuaucuccuccucuccccag

SEQ ID NO: 78933 - RNA, 22 nt, Human
acuuaaaaacuuuccucucuuc

SEQ ID NO: 78934 - RNA, 18 nt, Human
agaaaaagacaaaagaac

SEQ ID NO: 78935 - RNA, 19 nt, Human
agcgucucggauuuggagg

SEQ ID NO: 78936 - RNA, 24 nt, Human
agcuaugauuugcacuaguggaug

SEQ ID NO: 78937 - RNA, 18 nt, Human
agcugcugcggcucccag

SEQ ID NO: 78938 - RNA, 25 nt, Human
agggagaagacagaaaaagacaaaa

SEQ ID NO: 78939 - RNA, 20 nt, Human
agggauggugcacgcucgcc

SEQ ID NO: 78940 - RNA, 19 nt, Human
agguccucauaagcagagc

SEQ ID NO: 78941 - RNA, 22 nt, Human
aguccaaaauuuugcucaaaac

SEQ ID NO: 78942 - RNA, 22 nt, Human
aguccaaaauuuugcucaaaac

SEQ ID NO: 78943 - RNA, 22 nt, Human
agucccccaggccccgaccccc

SEQ ID NO: 78944 - RNA, 22 nt, Human
auacagaugcaauacuuaaaau

SEQ ID NO: 78945 - RNA, 18 nt, Human
aucuccuccucuccccag

SEQ ID NO: 78946 - RNA, 21 nt, Human
auggaagggauccucaaacac

SEQ ID NO: 78947 - RNA, 23 nt, Human
auuuggagguuccgguucgaggc

SEQ ID NO: 78948 - RNA, 19 nt, Human
auuuuauauauauauauau

SEQ ID NO: 78949 - RNA, 25 nt, Human
auuuucuccuuugcaaaagaaagcu

SEQ ID NO: 78950 - RNA, 26 nt, Human
caaaaaaauacaaauacacugaggca

SEQ ID NO: 78951 - RNA, 22 nt, Human
caaaagaaacaucuguucccac

SEQ ID NO: 78952 - RNA, 19 nt, Human
caaaagaaccuaucuccuc

SEQ ID NO: 78953 - RNA, 24 nt, Human
caacucgagauaggcaaagagaga

SEQ ID NO: 78954 - RNA, 18 nt, Human
cacagccaaacccugucu

SEQ ID NO: 78955 - RNA, 25 nt, Human
cacauaggagaagaagcaauaugau

SEQ ID NO: 78956 - RNA, 25 nt, Human
cacccccaacccccagcuaugauuu

SEQ ID NO: 78957 - RNA, 19 nt, Human
cacuacaucaugggaugaa

SEQ ID NO: 78958 - RNA, 23 nt, Human
cagucccccaggccccgaccccc

SEQ ID NO: 78959 - RNA, 26 nt, Human
ccaaccaaaagcccucaaagccacaa

SEQ ID NO: 78960 - RNA, 21 nt, Human
ccaccacccccaacccccagc

SEQ ID NO: 78961 - RNA, 29 nt, Human
ccaggccccgacccccaccacccccaacc

SEQ ID NO: 78962 - RNA, 23 nt, Human
cccaagugccagucacucaaucc

SEQ ID NO: 78963 - RNA, 26 nt, Human
cccacaaaacauauacauuccucauu

SEQ ID NO: 78964 - RNA, 21 nt, Human
cccagucccccaggccccgac

SEQ ID NO: 78965 - RNA, 21 nt, Human
ccccaccacccccaaccccca

SEQ ID NO: 78966 - RNA, 23 nt, Human
ccccaccacccccaacccccagc

SEQ ID NO: 78967 - RNA, 21 nt, Human
cccccaggccccgacccccac

SEQ ID NO: 78968 - RNA, 26 nt, Human
cccccaggccccgacccccaccaccu

SEQ ID NO: 78969 - RNA, 18 nt, Human
ccccgacccccaccaccc

SEQ ID NO: 78970 - RNA, 25 nt, Human
ccccgacccccaccacccccaaccc

SEQ ID NO: 78971 - RNA, 21 nt, Human
ccccuggccaaccaaaagccc

SEQ ID NO: 78972 - RNA, 24 nt, Human
cccgacccccaccacccccaaccc

SEQ ID NO: 78973 - RNA, 27 nt, Human
cccgacccccaccacccccaaccccca

SEQ ID NO: 78974 - RNA, 23 nt, Human
ccgacccccaccacccccaaccc

SEQ ID NO: 78975 - RNA, 20 nt, Human
ccgugaaaaaaggcaccgug

SEQ ID NO: 78976 - RNA, 21 nt, Human
cgacccccaccacccccaacc

SEQ ID NO: 78977 - RNA, 22 nt, Human
cgacccccaccacccccaaccc

SEQ ID NO: 78978 - RNA, 23 nt, Human
cgacccccaccacccccaacccc

SEQ ID NO: 78979 - RNA, 19 nt, Human
cgagauaggcaaagagaga

SEQ ID NO: 78980 - RNA, 23 nt, Human
cggcucccagucccccaggcccc

SEQ ID NO: 78981 - RNA, 19 nt, Human
cguuguacggguauauaca

SEQ ID NO: 78982 - RNA, 21 nt, Human
cucaaacacuucuggaauacc

SEQ ID NO: 78983 - RNA, 18 nt, Human
cuccuccucuccccagcc

SEQ ID NO: 78984 - RNA, 21 nt, Human
cucgagauaggcaaagagaga

SEQ ID NO: 78985 - RNA, 19 nt, Human
cucuuugacaacauacuga

SEQ ID NO: 78986 - RNA, 27 nt, Human
cuggagggaaggaaguggggaagggag

SEQ ID NO: 78987 - RNA, 23 nt, Human
cuggccaaccaaaagcccucaaa

SEQ ID NO: 78988 - RNA, 18 nt, Human
cugguguccggccuuucc

SEQ ID NO: 78989 - RNA, 22 nt, Human
cuuaaaaacuuuccucucuucc

SEQ ID NO: 78990 - RNA, 23 nt, Human
cuuaaaaacuuuccucucuuccu

SEQ ID NO: 78991 - RNA, 24 nt, Human
cuucuugcaucaccacuucuaaga

SEQ ID NO: 78992 - RNA, 23 nt, Human
gaaacaucuguucccacaaaaca

SEQ ID NO: 78993 - RNA, 21 nt, Human
gacacagccaaacccugucuc

SEQ ID NO: 78994 - RNA, 18 nt, Human
gacacaugggagugggag

SEQ ID NO: 78995 - RNA, 22 nt, Human
gacccccaccacccccaacccc

SEQ ID NO: 78996 - RNA, 21 nt, Human
gacgcagaaugggaugagaca

SEQ ID NO: 78997 - RNA, 20 nt, Human
gagcacucuaaaaugagagg

SEQ ID NO: 78998 - RNA, 22 nt, Human
gaggacuuggugucagcucucc

SEQ ID NO: 78999 - RNA, 21 nt, Human
gaguaguuauaacacaagcau

SEQ ID NO: 79000 - RNA, 19 nt, Human
gccccgacccccaccaccc

SEQ ID NO: 79001 - RNA, 21 nt, Human
gcgguaaugcaguuuagacac

SEQ ID NO: 79002 - RNA, 23 nt, Human
ggagaagacagaaaaagacaaaa

SEQ ID NO: 79003 - RNA, 21 nt, Human
gggagcugcugcggcucccag

SEQ ID NO: 79004 - RNA, 22 nt, Human
ggucuuuaccaaacuucaagga

SEQ ID NO: 79005 - RNA, 18 nt, Human
guggcaggggaggacuug

SEQ ID NO: 79006 - RNA, 21 nt, Human
guggcaggggaggacuuggug

SEQ ID NO: 79007 - RNA, 22 nt, Human
guuagugugugcaugugaguga

SEQ ID NO: 79008 - RNA, 23 nt, Human
uaaaaacuuuccucucuuccuuc

SEQ ID NO: 79009 - RNA, 24 nt, Human
uaaaauauucucuuaagugcucuu

SEQ ID NO: 79010 - RNA, 26 nt, Human
uaacacaagcaugacgcagaauggga

SEQ ID NO: 79011 - RNA, 27 nt, Human
uaacacaagcaugacgcagaaugggau

SEQ ID NO: 79012 - RNA, 23 nt, Human
uaaccaaacacucugacauuucu

SEQ ID NO: 79013 - RNA, 25 nt, Human
uaacucggucuuuaccaaacuucaa

SEQ ID NO: 79014 - RNA, 25 nt, Human
uaagaaccccaguucuaagaaucaa

SEQ ID NO: 79015 - RNA, 22 nt, Human
uacaaacugaaaacuagaacaa

SEQ ID NO: 79016 - RNA, 24 nt, Human
uacaacucugccauauauuccuuc

SEQ ID NO: 79017 - RNA, 22 nt, Human
uacacauaggagaagaagcaau

SEQ ID NO: 79018 - RNA, 21 nt, Human
uacaguauccuuuggguagau

SEQ ID NO: 79019 - RNA, 20 nt, Human
uauaacacaagcaugacgca

SEQ ID NO: 79020 - RNA, 26 nt, Human
uauauuuauuuuauauauauauauau

SEQ ID NO: 79021 - RNA, 21 nt, Human
uaucuccuccucuccccagcc

SEQ ID NO: 79022 - RNA, 22 nt, Human
uaucuccuccucuccccagccc

SEQ ID NO: 79023 - RNA, 23 nt, Human
ucaacagagcucaauucucggaa

SEQ ID NO: 79024 - RNA, 20 nt, Human
ucacucaaucccaucggcuc

SEQ ID NO: 79025 - RNA, 19 nt, Human
ucccaaagagaguuuaguu

SEQ ID NO: 79026 - RNA, 20 nt, Human
ucccugugucugccuacacu

SEQ ID NO: 79027 - RNA, 25 nt, Human
uccucauaagcagagcgucucggau

SEQ ID NO: 79028 - RNA, 22 nt, Human
ucugccauauauuccuucaccu

SEQ ID NO: 79029 - RNA, 18 nt, Human
ugaaaaaaggcaccguga

SEQ ID NO: 79030 - RNA, 18 nt, Human
ugaagacacaugggagug

SEQ ID NO: 79031 - RNA, 21 nt, Human
ugaagucuugucuuuuaaaag

SEQ ID NO: 79032 - RNA, 18 nt, Human
ugagaaggggcuggagac

SEQ ID NO: 79033 - RNA, 21 nt, Human
ugcacuaguggaugaaagagg

SEQ ID NO: 79034 - RNA, 21 nt, Human
ugccccuggccaaccaaaagc

SEQ ID NO: 79035 - RNA, 23 nt, Human
ugcuuugacauauaaaaugauuu

SEQ ID NO: 79036 - RNA, 23 nt, Human
uggagggaaggaaguggggaagg

SEQ ID NO: 79037 - RNA, 20 nt, Human
uggugcacgcucgcccauca

SEQ ID NO: 79038 - RNA, 22 nt, Human
uggugucagcucuccgagauuu

SEQ ID NO: 79039 - RNA, 19 nt, Human
ugucagcucuccgagauuu

SEQ ID NO: 79040 - RNA, 19 nt, Human
ugugagugaguggggacug

SEQ ID NO: 79041 - RNA, 22 nt, Human
uguuacaguauccuuuggguag

SEQ ID NO: 79042 - RNA, 22 nt, Human
uguucccacaaaacauauacau

SEQ ID NO: 79043 - RNA, 21 nt, Human
uucacaguccaaaauuuugcu

SEQ ID NO: 79044 - RNA, 21 nt, Human
uucacaguccaaaauuuugcu

SEQ ID NO: 79045 - RNA, 23 nt, Human
uuccgguucgaggcucgaggggc

SEQ ID NO: 79046 - RNA, 24 nt, Human
uugcaaaagaaagcugaagacaca

SEQ ID NO: 79047 - RNA, 23 nt, Human
uuguacagcuauauuuuacaacg

SEQ ID NO: 79048 - RNA, 22 nt, Human
uuuuuuuguucuuuuuguuuuu

SEQ ID NO: 79049 - RNA, 23 nt, Human
aaaaacaacaaaacccaugaccc

SEQ ID NO: 79050 - RNA, 25 nt, Human
aaaaacaacaaaacccaugacccca

SEQ ID NO: 79051 - RNA, 22 nt, Human
aaaaauucuugaaaggggaaaa

SEQ ID NO: 79052 - RNA, 22 nt, Human
aaaacaacaaaacccaugaccc

SEQ ID NO: 79053 - RNA, 20 nt, Human
aaaacccaugaccccacccc

SEQ ID NO: 79054 - RNA, 21 nt, Human
aaaacccaugaccccaccccc

SEQ ID NO: 79055 - RNA, 19 nt, Human
aaaaggucuuuaugccucu

SEQ ID NO: 79056 - RNA, 25 nt, Human
aaacagagaaggaaauaaauaucca

SEQ ID NO: 79057 - RNA, 24 nt, Human
aaaccauaucuacugauggaauaa

SEQ ID NO: 79058 - RNA, 24 nt, Human
aaacccaugaccccaccccacccc

SEQ ID NO: 79059 - RNA, 18 nt, Human
aaacuugaaacguuagua

SEQ ID NO: 79060 - RNA, 23 nt, Human
aacccaugaccccaccccacccc

SEQ ID NO: 79061 - RNA, 21 nt, Human
aacugacugccuaaggggcaa

SEQ ID NO: 79062 - RNA, 21 nt, Human
aagauggaguuucgcugcaaa

SEQ ID NO: 79063 - RNA, 19 nt, Human
aagcagugauggggguggu

SEQ ID NO: 79064 - RNA, 22 nt, Human
aaggcacaaaaaaagaaagcgg

SEQ ID NO: 79065 - RNA, 18 nt, Human
aagggcuuugcacgucca

SEQ ID NO: 79066 - RNA, 28 nt, Human
aauaaauaagugaaaaauuauacugcug

SEQ ID NO: 79067 - RNA, 21 nt, Human
aauaugcaccaauuagccccc

SEQ ID NO: 79068 - RNA, 19 nt, Human
aaugaaacaauuguacauu

SEQ ID NO: 79069 - RNA, 24 nt, Human
acaaaacccaugaccccaccccuu

SEQ ID NO: 79070 - RNA, 23 nt, Human
acacacacacacacacacacaca

SEQ ID NO: 79071 - RNA, 23 nt, Human
acacacacacacacacacacaca

SEQ ID NO: 79072 - RNA, 23 nt, Human
acacacacacacacacacacagu

SEQ ID NO: 79073 - RNA, 23 nt, Human
acacacacacacacacacacaua

SEQ ID NO: 79074 - RNA, 23 nt, Human
acacacacacacacacacauaca

SEQ ID NO: 79075 - RNA, 23 nt, Human
acacacacacacacauacacaca

SEQ ID NO: 79076 - RNA, 25 nt, Human
acacacacacacacauacacacaca

SEQ ID NO: 79077 - RNA, 23 nt, Human
acacacacacauacacacacaca

SEQ ID NO: 79078 - RNA, 29 nt, Human
acacaguucucaacaaaacugacugccuu

SEQ ID NO: 79079 - RNA, 29 nt, Human
acacgcacacacucucacacacacacaca

SEQ ID NO: 79080 - RNA, 33 nt, Human
acacgcacacacucucacacacacacacacagu

SEQ ID NO: 79081 - RNA, 21 nt, Human
acagccuuccggguugugggu

SEQ ID NO: 79082 - RNA, 21 nt, Human
acaguggaaagccccgccaaa

SEQ ID NO: 79083 - RNA, 22 nt, Human
accaauuagcccccaaaaacaa

SEQ ID NO: 79084 - RNA, 18 nt, Human
accacagagacucucgac

SEQ ID NO: 79085 - RNA, 22 nt, Human
accccaccccacccccaguaac

SEQ ID NO: 79086 - RNA, 22 nt, Human
accccacccccaguaacacaca

SEQ ID NO: 79087 - RNA, 24 nt, Human
accccacccccaguaacacacaac

SEQ ID NO: 79088 - RNA, 23 nt, Human
acccucagaaacucuuagaaaau

SEQ ID NO: 79089 - RNA, 18 nt, Human
accugcgccaacuccccu

SEQ ID NO: 79090 - RNA, 23 nt, Human
acgcacacacucucacacacaca

SEQ ID NO: 79091 - RNA, 31 nt, Human
acgcacacacucucacacacacacacacaca

SEQ ID NO: 79092 - RNA, 22 nt, Human
agaaaauuccaagggcuuugca

SEQ ID NO: 79093 - RNA, 22 nt, Human
agcagcaacacaaauggaaucc

SEQ ID NO: 79094 - RNA, 18 nt, Human
agcccuugaggccacggg

SEQ ID NO: 79095 - RNA, 19 nt, Human
agccugagaauaggaaagc

SEQ ID NO: 79096 - RNA, 18 nt, Human
aggaaggugcuggugcca

SEQ ID NO: 79097 - RNA, 19 nt, Human
aggcugcaggugccgaggg

SEQ ID NO: 79098 - RNA, 22 nt, Human
aggcuggggcgucgggggaggc

SEQ ID NO: 79099 - RNA, 21 nt, Human
agggaaggaagcacaucggau

SEQ ID NO: 79100 - RNA, 23 nt, Human
agggaaggaagcacaucggauuu

SEQ ID NO: 79101 - RNA, 22 nt, Human
agggaggagagcggugaguagg

SEQ ID NO: 79102 - RNA, 19 nt, Human
auauccaaauucaucucuc

SEQ ID NO: 79103 - RNA, 19 nt, Human
augaccccaccccaccccc

SEQ ID NO: 79104 - RNA, 27 nt, Human
caaaaacaacaaaacccaugaccccac

SEQ ID NO: 79105 - RNA, 23 nt, Human
caaaacccaugaccccaccccac

SEQ ID NO: 79106 - RNA, 21 nt, Human
caacaaaacccaugaccccac

SEQ ID NO: 79107 - RNA, 22 nt, Human
caacacaccaaaaaaaaaaaaa

SEQ ID NO: 79108 - RNA, 23 nt, Human
caacacaccaaaaaaaaaaaaaa

SEQ ID NO: 79109 - RNA, 18 nt, Human
caacucaaagggagucag

SEQ ID NO: 79110 - RNA, 24 nt, Human
cacaaaaaaagaaagcggaaggaa

SEQ ID NO: 79111 - RNA, 24 nt, Human
cacaaauggaauccuggcuuccga

SEQ ID NO: 79112 - RNA, 20 nt, Human
cacacacaaagcccggggcc

SEQ ID NO: 79113 - RNA, 20 nt, Human
cacacacacacacacacaca

SEQ ID NO: 79114 - RNA, 20 nt, Human
cacacacacacacacacaca

SEQ ID NO: 79115 - RNA, 20 nt, Human
cacacacacacacacacaca

SEQ ID NO: 79116 - RNA, 20 nt, Human
cacacacacacacacacaca

SEQ ID NO: 79117 - RNA, 20 nt, Human
cacacacacacacacacaca

SEQ ID NO: 79118 - RNA, 22 nt, Human
cacacacacacacacacacaca

SEQ ID NO: 79119 - RNA, 22 nt, Human
cacacacacacacacacacaca

SEQ ID NO: 79120 - RNA, 26 nt, Human
cacacacacacacacacacacacaca

SEQ ID NO: 79121 - RNA, 26 nt, Human
cacacacacacacacacacacacaca

SEQ ID NO: 79122 - RNA, 25 nt, Human
cacacacacacacacacacacauac

SEQ ID NO: 79123 - RNA, 22 nt, Human
cacacacacacacacacacaua

SEQ ID NO: 79124 - RNA, 26 nt, Human
cacacacacacacacacacauacaca

SEQ ID NO: 79125 - RNA, 20 nt, Human
cacacacacacacacacaua

SEQ ID NO: 79126 - RNA, 19 nt, Human
cacacacacacacacauac

SEQ ID NO: 79127 - RNA, 24 nt, Human
cacacacacacauacacacacaca

SEQ ID NO: 79128 - RNA, 32 nt, Human
cacacacacauacacacacacaaagcccggug

SEQ ID NO: 79129 - RNA, 22 nt, Human
cacacacucucacacacacaca

SEQ ID NO: 79130 - RNA, 19 nt, Human
cacacgcacacacucucac

SEQ ID NO: 79131 - RNA, 19 nt, Human
cacacgcacacacucucac

SEQ ID NO: 79132 - RNA, 23 nt, Human
caccaauuagcccccaaaaacaa

SEQ ID NO: 79133 - RNA, 18 nt, Human
caccacccuagaggaauc

SEQ ID NO: 79134 - RNA, 23 nt, Human
cacccccaguaacacacaacuca

SEQ ID NO: 79135 - RNA, 23 nt, Human
caccugcgccaacuccccuugcc

SEQ ID NO: 79136 - RNA, 21 nt, Human
cacuccugagcugucagcccc

SEQ ID NO: 79137 - RNA, 31 nt, Human
cacucucacacacacacacacacacacacag

SEQ ID NO: 79138 - RNA, 21 nt, Human
cagaggucaccucaagggcac

SEQ ID NO: 79139 - RNA, 22 nt, Human
cagccgccgcccgaaccaaacc

SEQ ID NO: 79140 - RNA, 18 nt, Human
cagccuuccggguugugg

SEQ ID NO: 79141 - RNA, 20 nt, Human
cagcugccccugcccagccc

SEQ ID NO: 79142 - RNA, 20 nt, Human
caggacacaguucucaacaa

SEQ ID NO: 79143 - RNA, 22 nt, Human
cagggacucuuccucccgcccc

SEQ ID NO: 79144 - RNA, 18 nt, Human
cagucagccagagaagcc

SEQ ID NO: 79145 - RNA, 21 nt, Human
cagucccuuaaagguuugagu

SEQ ID NO: 79146 - RNA, 22 nt, Human
cagugauggggguggugguggu

SEQ ID NO: 79147 - RNA, 27 nt, Human
cauacacacacacaaagcccggggccg

SEQ ID NO: 79148 - RNA, 20 nt, Human
caucggauuuuugcagucuu

SEQ ID NO: 79149 - RNA, 21 nt, Human
caucggauuuuugcagucuug

SEQ ID NO: 79150 - RNA, 23 nt, Human
caugaccccaccccacccccagu

SEQ ID NO: 79151 - RNA, 25 nt, Human
cauuccaaaccaugacaccguuugc

SEQ ID NO: 79152 - RNA, 25 nt, Human
ccaaaaacaacaaaacccaugaccc

SEQ ID NO: 79153 - RNA, 24 nt, Human
ccaauuagcccccaaaaacaacaa

SEQ ID NO: 79154 - RNA, 21 nt, Human
ccagaggaccacgauuucacc

SEQ ID NO: 79155 - RNA, 20 nt, Human
ccagcccagcugccccugcc

SEQ ID NO: 79156 - RNA, 22 nt, Human
ccagccugauccaaggggccga

SEQ ID NO: 79157 - RNA, 18 nt, Human
ccagcugccccugcccag

SEQ ID NO: 79158 - RNA, 18 nt, Human
ccaggcagaccacagaga

SEQ ID NO: 79159 - RNA, 19 nt, Human
ccaguccuaaacgccccaa

SEQ ID NO: 79160 - RNA, 19 nt, Human
cccaaaaacaacaaaaccc

SEQ ID NO: 79161 - RNA, 21 nt, Human
cccaaaaacaacaaaacccau

SEQ ID NO: 79162 - RNA, 23 nt, Human
cccaaaaacaacaaaacccauga

SEQ ID NO: 79163 - RNA, 20 nt, Human
cccaaaaacagagaaggaaa

SEQ ID NO: 79164 - RNA, 22 nt, Human
cccaccccacccccaguaacac

SEQ ID NO: 79165 - RNA, 23 nt, Human
cccaccccacccccaguaacaca

SEQ ID NO: 79166 - RNA, 23 nt, Human
cccaccccacccccaguaacacc

SEQ ID NO: 79167 - RNA, 22 nt, Human
cccacccccaguaacacacaac

SEQ ID NO: 79168 - RNA, 21 nt, Human
cccagccugauccaaggggcc

SEQ ID NO: 79169 - RNA, 18 nt, Human
cccagcugccccugccca

SEQ ID NO: 79170 - RNA, 23 nt, Human
cccaugaccccaccccaccccca

SEQ ID NO: 79171 - RNA, 18 nt, Human
ccccaaaaacaacaaaac

SEQ ID NO: 79172 - RNA, 19 nt, Human
ccccaacaccugcgcgucc

SEQ ID NO: 79173 - RNA, 30 nt, Human
ccccaacaccugcgcguccuugggcccugg

SEQ ID NO: 79174 - RNA, 20 nt, Human
ccccaccccacccccaguaa

SEQ ID NO: 79175 - RNA, 19 nt, Human
cccccaaaaacaacaaaac

SEQ ID NO: 79176 - RNA, 23 nt, Human
cccccaaaaacaacaaaacccau

SEQ ID NO: 79177 - RNA, 21 nt, Human
cccccgggccucgcgucgccc

SEQ ID NO: 79178 - RNA, 20 nt, Human
ccccgccaaaaagcguuccu

SEQ ID NO: 79179 - RNA, 25 nt, Human
ccccgcccccuggcucgaagcugaa

SEQ ID NO: 79180 - RNA, 20 nt, Human
ccccgggccucgcgucgccc

SEQ ID NO: 79181 - RNA, 19 nt, Human
cccgccugccuccccaagg

SEQ ID NO: 79182 - RNA, 21 nt, Human
cccuggugccuggugcuuggg

SEQ ID NO: 79183 - RNA, 23 nt, Human
cccuugaggccacggggccugau

SEQ ID NO: 79184 - RNA, 19 nt, Human
ccgcagcgcccccgggccu

SEQ ID NO: 79185 - RNA, 18 nt, Human
ccgccgccgccggagugc

SEQ ID NO: 79186 - RNA, 18 nt, Human
ccgccgccggagugcggc

SEQ ID NO: 79187 - RNA, 23 nt, Human
ccgcgcgccuggcccagcgcaag

SEQ ID NO: 79188 - RNA, 24 nt, Human
ccgcggccaccgcagcgcccccgg

SEQ ID NO: 79189 - RNA, 21 nt, Human
ccggccacacucgcgcccgcc

SEQ ID NO: 79190 - RNA, 21 nt, Human
ccggucugcggggcgcggggg

SEQ ID NO: 79191 - RNA, 23 nt, Human
ccuagaggaaucgguccacagcc

SEQ ID NO: 79192 - RNA, 23 nt, Human
ccucaccugcgccaacuccccuu

SEQ ID NO: 79193 - RNA, 24 nt, Human
ccucaccugcgccaacuccccuug

SEQ ID NO: 79194 - RNA, 18 nt, Human
cgccccggacgcccuccc

SEQ ID NO: 79195 - RNA, 20 nt, Human
cgccggguccaugcucgcgc

SEQ ID NO: 79196 - RNA, 20 nt, Human
cgcgcacagacacucgcacu

SEQ ID NO: 79197 - RNA, 18 nt, Human
cgcgcggugggggcgggg

SEQ ID NO: 79198 - RNA, 21 nt, Human
cggcggggagacggaggcugg

SEQ ID NO: 79199 - RNA, 19 nt, Human
cgggccucgcgucgcccag

SEQ ID NO: 79200 - RNA, 18 nt, Human
cgggucucuugacuucuc

SEQ ID NO: 79201 - RNA, 19 nt, Human
cgucgggggaggcaaaggg

SEQ ID NO: 79202 - RNA, 21 nt, Human
cucacacacacacacacacac

SEQ ID NO: 79203 - RNA, 22 nt, Human
cucacccucagaaacucuuaga

SEQ ID NO: 79204 - RNA, 18 nt, Human
cucccagccuccccggcc

SEQ ID NO: 79205 - RNA, 18 nt, Human
cuccgcgccgcggccacc

SEQ ID NO: 79206 - RNA, 18 nt, Human
cuggccccaggcuuuucc

SEQ ID NO: 79207 - RNA, 19 nt, Human
cuggccccaggcuuuuccu

SEQ ID NO: 79208 - RNA, 21 nt, Human
cuggccccaggcuuuuccuuu

SEQ ID NO: 79209 - RNA, 18 nt, Human
cuguacaacacaccaaaa

SEQ ID NO: 79210 - RNA, 21 nt, Human
gaacaguggaaagccccgcca

SEQ ID NO: 79211 - RNA, 21 nt, Human
gacgcccaguccuaaacgccc

SEQ ID NO: 79212 - RNA, 21 nt, Human
gagaagugacgccguucuggg

SEQ ID NO: 79213 - RNA, 20 nt, Human
gagcacagcgagugcccagc

SEQ ID NO: 79214 - RNA, 20 nt, Human
gaggccggccaucaaggcca

SEQ ID NO: 79215 - RNA, 20 nt, Human
gaggggugcagggugggugg

SEQ ID NO: 79216 - RNA, 19 nt, Human
gauccugccucuccggggc

SEQ ID NO: 79217 - RNA, 22 nt, Human
gauguaagaaccaccaggauac

SEQ ID NO: 79218 - RNA, 23 nt, Human
gcaagcccgggcggcagcugcac

SEQ ID NO: 79219 - RNA, 22 nt, Human
gcaauagagaggaagugccaga

SEQ ID NO: 79220 - RNA, 18 nt, Human
gcacagacacucgcacuc

SEQ ID NO: 79221 - RNA, 23 nt, Human
gcaggacacaguucucaacaaaa

SEQ ID NO: 79222 - RNA, 20 nt, Human
gcaguaaagaaagcuuagga

SEQ ID NO: 79223 - RNA, 19 nt, Human
gcagugauggggguggugg

SEQ ID NO: 79224 - RNA, 18 nt, Human
gcccaguccuaaacgccc

SEQ ID NO: 79225 - RNA, 22 nt, Human
gcccgaaccaaaccaagagggc

SEQ ID NO: 79226 - RNA, 20 nt, Human
gcccuggugccuggugcuuc

SEQ ID NO: 79227 - RNA, 20 nt, Human
gccgccgcccgaaccaaacc

SEQ ID NO: 79228 - RNA, 21 nt, Human
gccggucugcggggcgcgggg

SEQ ID NO: 79229 - RNA, 18 nt, Human
gccgugguggggcccagc

SEQ ID NO: 79230 - RNA, 18 nt, Human
gccgugguggggcccagc

SEQ ID NO: 79231 - RNA, 22 nt, Human
gcggggagacggaggcugggga

SEQ ID NO: 79232 - RNA, 20 nt, Human
ggagaaagcagugauggggg

SEQ ID NO: 79233 - RNA, 20 nt, Human
ggagcuccuucgcuccaccc

SEQ ID NO: 79234 - RNA, 25 nt, Human
ggagcuccuucgcuccacccugccu

SEQ ID NO: 79235 - RNA, 19 nt, Human
ggagggaggggagauugcg

SEQ ID NO: 79236 - RNA, 18 nt, Human
ggcagggaggagagcggu

SEQ ID NO: 79237 - RNA, 19 nt, Human
ggcauguucuggggaugag

SEQ ID NO: 79238 - RNA, 21 nt, Human
ggcgauaaugaacauuccaaa

SEQ ID NO: 79239 - RNA, 19 nt, Human
ggcgcuuugccuggcgugg

SEQ ID NO: 79240 - RNA, 21 nt, Human
gggagaaagcagugauggggg

SEQ ID NO: 79241 - RNA, 18 nt, Human
gggggugguggugguggg

SEQ ID NO: 79242 - RNA, 18 nt, Human
gggguggugguggugggg

SEQ ID NO: 79243 - RNA, 23 nt, Human
gggugcaggguggguggggggca

SEQ ID NO: 79244 - RNA, 23 nt, Human
gggugcggacacgcgcgcugacc

SEQ ID NO: 79245 - RNA, 21 nt, Human
guagguucugcgccaggaugc

SEQ ID NO: 79246 - RNA, 21 nt, Human
gugcagggcugcuggcgcuuu

SEQ ID NO: 79247 - RNA, 22 nt, Human
gugcccagccugauccaagggg

SEQ ID NO: 79248 - RNA, 22 nt, Human
guggaaggccuucuuggccagc

SEQ ID NO: 79249 - RNA, 20 nt, Human
guggggggcagcggcucgag

SEQ ID NO: 79250 - RNA, 20 nt, Human
guggugggggcaauagagag

SEQ ID NO: 79251 - RNA, 22 nt, Human
uaaaaaaaaaauaagagccuca

SEQ ID NO: 79252 - RNA, 25 nt, Human
uaaagaguuuucucagcaaaagcuc

SEQ ID NO: 79253 - RNA, 23 nt, Human
uacaaaccauaucuacugaugga

SEQ ID NO: 79254 - RNA, 23 nt, Human
uacagcagcaacacaaauggaau

SEQ ID NO: 79255 - RNA, 19 nt, Human
uagcccccaaaaacaacaa

SEQ ID NO: 79256 - RNA, 23 nt, Human
uaggaaggugcuggugccaggca

SEQ ID NO: 79257 - RNA, 22 nt, Human
uaguucuguucgcacccaagag

SEQ ID NO: 79258 - RNA, 21 nt, Human
ucacacacacacacacacaca

SEQ ID NO: 79259 - RNA, 22 nt, Human
ucagagucagaacagccugaga

SEQ ID NO: 79260 - RNA, 21 nt, Human
uccaagggcuuugcacgucca

SEQ ID NO: 79261 - RNA, 21 nt, Human
ucccuuaaaaaaaaaauaaga

SEQ ID NO: 79262 - RNA, 21 nt, Human
uccgcgccgcggccaccgcag

SEQ ID NO: 79263 - RNA, 22 nt, Human
uccugagcugucagccccgccu

SEQ ID NO: 79264 - RNA, 18 nt, Human
uccuggggcagggaggag

SEQ ID NO: 79265 - RNA, 19 nt, Human
uccuugggcccuggugccu

SEQ ID NO: 79266 - RNA, 21 nt, Human
ucuacugauggaauaaauaag

SEQ ID NO: 79267 - RNA, 19 nt, Human
ucucaacaaaacugacugc

SEQ ID NO: 79268 - RNA, 21 nt, Human
ucucacacacacacacacaca

SEQ ID NO: 79269 - RNA, 21 nt, Human
ucucugguggcccgcggcccu

SEQ ID NO: 79270 - RNA, 19 nt, Human
ucugcgccaggaugcagga

SEQ ID NO: 79271 - RNA, 21 nt, Human
ucugcggggcgcggggggguc

SEQ ID NO: 79272 - RNA, 20 nt, Human
ucuggagguaacgccgccuc

SEQ ID NO: 79273 - RNA, 21 nt, Human
ucuggagguaacgccgccucg

SEQ ID NO: 79274 - RNA, 22 nt, Human
ucugggucuucuuggauuugca

SEQ ID NO: 79275 - RNA, 19 nt, Human
ucuguggugggggggaggg

SEQ ID NO: 79276 - RNA, 23 nt, Human
ucuguucgcacccaagaggaauc

SEQ ID NO: 79277 - RNA, 24 nt, Human
ugaaaugaaacaauuguacauugu

SEQ ID NO: 79278 - RNA, 19 nt, Human
ugacaccguuugcuaaugg

SEQ ID NO: 79279 - RNA, 19 nt, Human
ugacucuaacucuacggaa

SEQ ID NO: 79280 - RNA, 24 nt, Human
ugacucuaacucuacggaaucugg

SEQ ID NO: 79281 - RNA, 19 nt, Human
ugagcugucagccccgccu

SEQ ID NO: 79282 - RNA, 18 nt, Human
ugaguguuuugcuucaca

SEQ ID NO: 79283 - RNA, 20 nt, Human
ugaugggggugguggugguc

SEQ ID NO: 79284 - RNA, 23 nt, Human
ugauggggguggugguggugggg

SEQ ID NO: 79285 - RNA, 21 nt, Human
ugauuugaaauuuuuauuuuc

SEQ ID NO: 79286 - RNA, 19 nt, Human
ugcaaguuucuugcggguc

SEQ ID NO: 79287 - RNA, 21 nt, Human
ugcacuugguaaacuugaaac

SEQ ID NO: 79288 - RNA, 21 nt, Human
ugcccagccugauccaagggg

SEQ ID NO: 79289 - RNA, 21 nt, Human
ugccccugcccagcccccagc

SEQ ID NO: 79290 - RNA, 21 nt, Human
ugcccugggagcccuugaggc

SEQ ID NO: 79291 - RNA, 24 nt, Human
ugcccugggagcccuugaggccac

SEQ ID NO: 79292 - RNA, 20 nt, Human
ugccuaaggucccccugcac

SEQ ID NO: 79293 - RNA, 19 nt, Human
ugcgccaacuccccuugcc

SEQ ID NO: 79294 - RNA, 21 nt, Human
ugcgucucuccuuucuggagg

SEQ ID NO: 79295 - RNA, 24 nt, Human
ugcguggagaggaaccgcaucagg

SEQ ID NO: 79296 - RNA, 23 nt, Human
ugcucuuggaaagaguugggcau

SEQ ID NO: 79297 - RNA, 18 nt, Human
uggaaggccuucuuggcc

SEQ ID NO: 79298 - RNA, 22 nt, Human
uggaaggccuucuuggccagcg

SEQ ID NO: 79299 - RNA, 26 nt, Human
uggagggugugcaaaucuuuccaauu

SEQ ID NO: 79300 - RNA, 19 nt, Human
uggcucagagucagaacag

SEQ ID NO: 79301 - RNA, 19 nt, Human
uggcucgaagcugaaaggu

SEQ ID NO: 79302 - RNA, 21 nt, Human
ugggagaaagcagugaugggg

SEQ ID NO: 79303 - RNA, 23 nt, Human
ugggagcccuugaggccacgggg

SEQ ID NO: 79304 - RNA, 20 nt, Human
ugggagggaggggagauugc

SEQ ID NO: 79305 - RNA, 21 nt, Human
ugggcccuggugccuggugcu

SEQ ID NO: 79306 - RNA, 18 nt, Human
uggggcccagcugguccc

SEQ ID NO: 79307 - RNA, 22 nt, Human
ugggggcggggugcggacacgc

SEQ ID NO: 79308 - RNA, 20 nt, Human
uggggguggugguggugggg

SEQ ID NO: 79309 - RNA, 22 nt, Human
uggggguggugguggugggggc

SEQ ID NO: 79310 - RNA, 22 nt, Human
ugguggugggggcaauagagag

SEQ ID NO: 79311 - RNA, 21 nt, Human
ugguuuuuuuuuuuuuucccu

SEQ ID NO: 79312 - RNA, 21 nt, Human
uguagccucucguuucccaaa

SEQ ID NO: 79313 - RNA, 21 nt, Human
uguggugggggggagggcgag

SEQ ID NO: 79314 - RNA, 24 nt, Human
uguggugggggggagggcgagggg

SEQ ID NO: 79315 - RNA, 24 nt, Human
ugugguuuuuuuuuuuuuucccuu

SEQ ID NO: 79316 - RNA, 24 nt, Human
uguuuugcuucacagcagaguucu

SEQ ID NO: 79317 - RNA, 20 nt, Human
uuagcccccaaaaacaacaa

SEQ ID NO: 79318 - RNA, 19 nt, Human
uucauucuccuucagcugu

SEQ ID NO: 79319 - RNA, 24 nt, Human
uucgcugaguucaccagaggacca

SEQ ID NO: 79320 - RNA, 20 nt, Human
uucuuggccagcguggagug

SEQ ID NO: 79321 - RNA, 20 nt, Human
uugauucuucucgaagugca

SEQ ID NO: 79322 - RNA, 24 nt, Human
uuucaccuuaagccauuccugacu

SEQ ID NO: 79323 - RNA, 23 nt, Human
uuuccaauuccucgacgccuugu

SEQ ID NO: 79324 - RNA, 22 nt, Human
aagaaaagggagcuuucuagaa

SEQ ID NO: 79325 - RNA, 18 nt, Human
aagcccuucccuucccuc

SEQ ID NO: 79326 - RNA, 18 nt, Human
aaguagacacaggugcca

SEQ ID NO: 79327 - RNA, 19 nt, Human
aauagaggcagggccagga

SEQ ID NO: 79328 - RNA, 24 nt, Human
accucaaauucuugcuggggcagu

SEQ ID NO: 79329 - RNA, 23 nt, Human
aggcagggccaggaggcggaggg

SEQ ID NO: 79330 - RNA, 19 nt, Human
aggcucuugaccccagugc

SEQ ID NO: 79331 - RNA, 24 nt, Human
aggugccuuccacaucucucucuu

SEQ ID NO: 79332 - RNA, 22 nt, Human
caaauucuugcuggggcaguuu

SEQ ID NO: 79333 - RNA, 23 nt, Human
caacagcagccuacagggccccc

SEQ ID NO: 79334 - RNA, 25 nt, Human
caacagcagccuacagggcccccag

SEQ ID NO: 79335 - RNA, 23 nt, Human
caacaugcagauuucaaagaaaa

SEQ ID NO: 79336 - RNA, 24 nt, Human
caaguaaccugaggcacgcucucu

SEQ ID NO: 79337 - RNA, 23 nt, Human
caaguucaaguaaccugaggcac

SEQ ID NO: 79338 - RNA, 22 nt, Human
cagaaugcaauaaauagaggca

SEQ ID NO: 79339 - RNA, 22 nt, Human
cagcaacgcggcgcggccagaa

SEQ ID NO: 79340 - RNA, 19 nt, Human
cagggccaggaggcggagg

SEQ ID NO: 79341 - RNA, 20 nt, Human
cagggccaggaggcggaggg

SEQ ID NO: 79342 - RNA, 23 nt, Human
ccaaugucucuacccaguccucc

SEQ ID NO: 79343 - RNA, 22 nt, Human
ccacaucucucucuucucgcag

SEQ ID NO: 79344 - RNA, 18 nt, Human
ccagcccggaaggcucau

SEQ ID NO: 79345 - RNA, 21 nt, Human
ccccagcaacgcggcgcggcc

SEQ ID NO: 79346 - RNA, 21 nt, Human
cccuuguguggagaaaagccc

SEQ ID NO: 79347 - RNA, 26 nt, Human
ccgcagcgucacagcggccgucgccc

SEQ ID NO: 79348 - RNA, 19 nt, Human
ccguccagagauucuggag

SEQ ID NO: 79349 - RNA, 22 nt, Human
ccuacagggcccccaguccuag

SEQ ID NO: 79350 - RNA, 21 nt, Human
ccuccaacagcagccuacagg

SEQ ID NO: 79351 - RNA, 23 nt, Human
ccuccaaugucucuacccagucc

SEQ ID NO: 79352 - RNA, 23 nt, Human
ccuuccacaucucucucuucucg

SEQ ID NO: 79353 - RNA, 25 nt, Human
cgccgccgcccgcccgccgccgccg

SEQ ID NO: 79354 - RNA, 18 nt, Human
cuacagggcccccagucc

SEQ ID NO: 79355 - RNA, 18 nt, Human
cuagaaacugagcugaag

SEQ ID NO: 79356 - RNA, 20 nt, Human
cucuugaccccagugcuugc

SEQ ID NO: 79357 - RNA, 23 nt, Human
cuuucuagaaacugagcugaagg

SEQ ID NO: 79358 - RNA, 22 nt, Human
gagcuggcaggacagcaagaaa

SEQ ID NO: 79359 - RNA, 24 nt, Human
gaggugagaacaaagcugcgugug

SEQ ID NO: 79360 - RNA, 22 nt, Human
gcaggacagcaagaaaucuagg

SEQ ID NO: 79361 - RNA, 19 nt, Human
gcucaugugugcaggcucu

SEQ ID NO: 79362 - RNA, 20 nt, Human
gggcaggggauggggacggc

SEQ ID NO: 79363 - RNA, 23 nt, Human
ggggauggggacggcggccacaa

SEQ ID NO: 79364 - RNA, 20 nt, Human
gguagaggugagaacaaagc

SEQ ID NO: 79365 - RNA, 20 nt, Human
guccagagauucuggagcag

SEQ ID NO: 79366 - RNA, 21 nt, Human
gugcagaugugugugcugagg

SEQ ID NO: 79367 - RNA, 18 nt, Human
uacagccccaaguccuac

SEQ ID NO: 79368 - RNA, 20 nt, Human
uagacggacucucugcccuu

SEQ ID NO: 79369 - RNA, 20 nt, Human
uagaggcagggccaggaggc

SEQ ID NO: 79370 - RNA, 21 nt, Human
uagaggcagggccaggaggcg

SEQ ID NO: 79371 - RNA, 19 nt, Human
uccacaucucucucuucuc

SEQ ID NO: 79372 - RNA, 21 nt, Human
uccacaucucucucuucucgc

SEQ ID NO: 79373 - RNA, 22 nt, Human
uccuaggggaaaguccgggagu

SEQ ID NO: 79374 - RNA, 20 nt, Human
ucgggagcaaguagacacag

SEQ ID NO: 79375 - RNA, 18 nt, Human
ugaagggguacugugggg

SEQ ID NO: 79376 - RNA, 24 nt, Human
ugacaagaggcagggaugcuggaa

SEQ ID NO: 79377 - RNA, 18 nt, Human
ugacagguagaggugaga

SEQ ID NO: 79378 - RNA, 18 nt, Human
ugcccauuuccauuuucu

SEQ ID NO: 79379 - RNA, 18 nt, Human
ugcccuuaccccagcaac

SEQ ID NO: 79380 - RNA, 22 nt, Human
ugcgugugugcagaugugugug

SEQ ID NO: 79381 - RNA, 24 nt, Human
ugcugccuggaggucacagaugaa

SEQ ID NO: 79382 - RNA, 18 nt, Human
ugcuugcccuuaccccag

SEQ ID NO: 79383 - RNA, 19 nt, Human
uggaaugacagguagaggu

SEQ ID NO: 79384 - RNA, 24 nt, Human
uggcaggacagcaagaaaucuaga

SEQ ID NO: 79385 - RNA, 22 nt, Human
ugggcagagcuggcaggacagc

SEQ ID NO: 79386 - RNA, 22 nt, Human
ugggggauggguacuguuguca

SEQ ID NO: 79387 - RNA, 22 nt, Human
uggguacuguugucagaaccuc

SEQ ID NO: 79388 - RNA, 26 nt, Human
uguggagaaaagcccuucccuucccu

SEQ ID NO: 79389 - RNA, 22 nt, Human
uucacucacuguugcccauuuc

SEQ ID NO: 79390 - RNA, 25 nt, Human
uuuucauauuucaaacaguuuaauu

SEQ ID NO: 79391 - RNA, 24 nt, Human
uuuuuuuuuuuuuuuuucauauuu

SEQ ID NO: 79392 - RNA, 26 nt, Human
aaaaagccaaaggggccccuggggca

SEQ ID NO: 79393 - RNA, 23 nt, Human
aaaagggucuuuauuuguaaaaa

SEQ ID NO: 79394 - RNA, 18 nt, Human
aaaggggccccuggggca

SEQ ID NO: 79395 - RNA, 18 nt, Human
caggacaggcaggccggc

SEQ ID NO: 79396 - RNA, 18 nt, Human
ccaggcccgggcgccgcg

SEQ ID NO: 79397 - RNA, 19 nt, Human
ccgcgccaggcccgggcgc

SEQ ID NO: 79398 - RNA, 24 nt, Human
cgccgcgcucucggccugccgucc

SEQ ID NO: 79399 - RNA, 22 nt, Human
cgcggcggggccgccucccguc

SEQ ID NO: 79400 - RNA, 21 nt, Human
cugccguccccccuggaguug

SEQ ID NO: 79401 - RNA, 21 nt, Human
gagcccgcggcggggccgccu

SEQ ID NO: 79402 - RNA, 25 nt, Human
gcgccgcgcucucggccugccgucc

SEQ ID NO: 79403 - RNA, 22 nt, Human
gcgggcucaggcuccgcgccag

SEQ ID NO: 79404 - RNA, 19 nt, Human
ggccggggccgagcccgcg

SEQ ID NO: 79405 - RNA, 23 nt, Human
ggccggggccgagcccgcggcgg

SEQ ID NO: 79406 - RNA, 19 nt, Human
ggucuuuauuuguaaaaag

SEQ ID NO: 79407 - RNA, 19 nt, Human
uaaaaagccaaaggggccc

SEQ ID NO: 79408 - RNA, 19 nt, Human
ucaggcuccgcgccaggcc

SEQ ID NO: 79409 - RNA, 21 nt, Human
ucaggcuccgcgccaggcccg

SEQ ID NO: 79410 - RNA, 26 nt, Human
uuuuuuuuuuuuuuuuuacaaaaggg

SEQ ID NO: 79411 - RNA, 27 nt, Human
uuuuuuuuuuuuuuuuuuuuuacaaaa

SEQ ID NO: 79412 - RNA, 24 nt, Human
aaaaaagacagagaagcaucccag

SEQ ID NO: 79413 - RNA, 26 nt, Human
aaaaaucuccccccuccccccacccc

SEQ ID NO: 79414 - RNA, 19 nt, Human
aaaacaaacagaaacaaaa

SEQ ID NO: 79415 - RNA, 23 nt, Human
aaaagacccuuuucccgcaaucc

SEQ ID NO: 79416 - RNA, 20 nt, Human
aaacaaaaacagaaaagaau

SEQ ID NO: 79417 - RNA, 25 nt, Human
aaacaaaaacagaaaagaauccugg

SEQ ID NO: 79418 - RNA, 23 nt, Human
aaacacuuaacugaggagacaga

SEQ ID NO: 79419 - RNA, 19 nt, Human
aaacagaaacaaaauccug

SEQ ID NO: 79420 - RNA, 22 nt, Human
aaacagaaacaaaauccuggaa

SEQ ID NO: 79421 - RNA, 19 nt, Human
aaagcagcucucaggaccu

SEQ ID NO: 79422 - RNA, 22 nt, Human
aaagcagcucucaggaccugga

SEQ ID NO: 79423 - RNA, 23 nt, Human
aacccccuucucaaagaugaccc

SEQ ID NO: 79424 - RNA, 18 nt, Human
aacugggcccacauucag

SEQ ID NO: 79425 - RNA, 25 nt, Human
aagacaccaggacaacaucaaagca

SEQ ID NO: 79426 - RNA, 19 nt, Human
aagagagagggaagcagag

SEQ ID NO: 79427 - RNA, 26 nt, Human
aagcagaaugacgccaacugggccca

SEQ ID NO: 79428 - RNA, 25 nt, Human
aagcagagggucaccagcggggggc

SEQ ID NO: 79429 - RNA, 18 nt, Human
aagcagcccucgggucuc

SEQ ID NO: 79430 - RNA, 26 nt, Human
aaggaaccacaaaauuuaaaacaaac

SEQ ID NO: 79431 - RNA, 26 nt, Human
aaguggguccuuuccccuugcagcuc

SEQ ID NO: 79432 - RNA, 20 nt, Human
aaucuccccccuccccccac

SEQ ID NO: 79433 - RNA, 20 nt, Human
acacggaagaacuuuccaaa

SEQ ID NO: 79434 - RNA, 23 nt, Human
acagauucccaaaaguaggugcc

SEQ ID NO: 79435 - RNA, 23 nt, Human
accacaaaauuuaaaacaaacag

SEQ ID NO: 79436 - RNA, 24 nt, Human
acccaaguccacaaaaauaauuuu

SEQ ID NO: 79437 - RNA, 20 nt, Human
agacaagacagugcugaaga

SEQ ID NO: 79438 - RNA, 25 nt, Human
agacaccaggacaacaucaaagcaa

SEQ ID NO: 79439 - RNA, 21 nt, Human
agacagagaagcaucccagga

SEQ ID NO: 79440 - RNA, 25 nt, Human
agagagggaagcagagggucaccag

SEQ ID NO: 79441 - RNA, 23 nt, Human
agcccucgggucucuguucuccu

SEQ ID NO: 79442 - RNA, 19 nt, Human
aggaacccccuucucaaag

SEQ ID NO: 79443 - RNA, 25 nt, Human
aggaacccccuucucaaagaugacc

SEQ ID NO: 79444 - RNA, 21 nt, Human
agggcauacaaaaccccaagg

SEQ ID NO: 79445 - RNA, 22 nt, Human
agugcugaagagcacuugaacu

SEQ ID NO: 79446 - RNA, 23 nt, Human
auaaaucuuaaaaaaaacacacc

SEQ ID NO: 79447 - RNA, 20 nt, Human
auacaaaaccccaaggguca

SEQ ID NO: 79448 - RNA, 19 nt, Human
auagcuuuuagcaucuguu

SEQ ID NO: 79449 - RNA, 27 nt, Human
augacgccaacugggcccacauucagu

SEQ ID NO: 79450 - RNA, 23 nt, Human
augcccacgucagcagccaugcc

SEQ ID NO: 79451 - RNA, 21 nt, Human
augggaaagagaaagacuuag

SEQ ID NO: 79452 - RNA, 25 nt, Human
auucucgaguuccccccucccccaa

SEQ ID NO: 79453 - RNA, 23 nt, Human
caaaaccccaagggucacgacac

SEQ ID NO: 79454 - RNA, 24 nt, Human
caaaaccccaagggucacgacacu

SEQ ID NO: 79455 - RNA, 18 nt, Human
caaagcagcucucaggac

SEQ ID NO: 79456 - RNA, 28 nt, Human
caacaucaaagcaacuuagggggaacac

SEQ ID NO: 79457 - RNA, 22 nt, Human
caagacagugcugaagagcacu

SEQ ID NO: 79458 - RNA, 22 nt, Human
cacaaaauuuaaaacaaacaga

SEQ ID NO: 79459 - RNA, 23 nt, Human
cacagaaaaaaauaaagcccaaa

SEQ ID NO: 79460 - RNA, 19 nt, Human
cagaaaacaagguggggca

SEQ ID NO: 79461 - RNA, 19 nt, Human
cagaaaacaagguggggca

SEQ ID NO: 79462 - RNA, 21 nt, Human
cagaaaacaagguggggcagg

SEQ ID NO: 79463 - RNA, 26 nt, Human
cagaaaagaauccugggagaagccag

SEQ ID NO: 79464 - RNA, 24 nt, Human
cagagggucaccagcggggggcac

SEQ ID NO: 79465 - RNA, 24 nt, Human
caucaaagcaacuuagggggaaca

SEQ ID NO: 79466 - RNA, 22 nt, Human
ccaaagggaaagagagagggaa

SEQ ID NO: 79467 - RNA, 21 nt, Human
ccacaaaauuuaaaacaaaca

SEQ ID NO: 79468 - RNA, 23 nt, Human
ccagggcauacaaaaccccaagg

SEQ ID NO: 79469 - RNA, 24 nt, Human
ccaugcccacgucagcagccaugc

SEQ ID NO: 79470 - RNA, 24 nt, Human
cccaugcccacgucagcagccaug

SEQ ID NO: 79471 - RNA, 21 nt, Human
ccccaaagacuaaagucucug

SEQ ID NO: 79472 - RNA, 23 nt, Human
ccccaaagacuaaagucucugcu

SEQ ID NO: 79473 - RNA, 26 nt, Human
cccccaaagcagcccucgggucucug

SEQ ID NO: 79474 - RNA, 22 nt, Human
ccccccucccccaaagcagccc

SEQ ID NO: 79475 - RNA, 19 nt, Human
cccccuccccccaccccuc

SEQ ID NO: 79476 - RNA, 18 nt, Human
cccgcaaucccuggccuc

SEQ ID NO: 79477 - RNA, 20 nt, Human
ccggggccucaucugugggg

SEQ ID NO: 79478 - RNA, 23 nt, Human
ccucaaagcagcucucaggaccc

SEQ ID NO: 79479 - RNA, 23 nt, Human
ccuccugcugccagaggaaaauc

SEQ ID NO: 79480 - RNA, 18 nt, Human
ccucgggucucuguucuc

SEQ ID NO: 79481 - RNA, 22 nt, Human
ccucucggguugcagcagaaac

SEQ ID NO: 79482 - RNA, 20 nt, Human
ccucuugcugcggugacacu

SEQ ID NO: 79483 - RNA, 18 nt, Human
cggcacaucccaucuuag

SEQ ID NO: 79484 - RNA, 18 nt, Human
cuaaauccacccaugccc

SEQ ID NO: 79485 - RNA, 18 nt, Human
cucgcugccuguaugccu

SEQ ID NO: 79486 - RNA, 21 nt, Human
cucuugccccaaagacuaaag

SEQ ID NO: 79487 - RNA, 24 nt, Human
cugccaaagggaaagagagaggga

SEQ ID NO: 79488 - RNA, 22 nt, Human
cugccuguaugccuuuuuccuu

SEQ ID NO: 79489 - RNA, 20 nt, Human
cugggugcgugccuccugcu

SEQ ID NO: 79490 - RNA, 24 nt, Human
cuuagggggaaaaaagacagagaa

SEQ ID NO: 79491 - RNA, 24 nt, Human
gaaaaaucuccccccuccccccac

SEQ ID NO: 79492 - RNA, 20 nt, Human
gaaagagagagggaagcaga

SEQ ID NO: 79493 - RNA, 21 nt, Human
gaaugaagacaaaaaagaccc

SEQ ID NO: 79494 - RNA, 19 nt, Human
gaggagaaauucuggagaa

SEQ ID NO: 79495 - RNA, 19 nt, Human
gaggagaaauucuggagaa

SEQ ID NO: 79496 - RNA, 21 nt, Human
gaggagaaauucuggagaauc

SEQ ID NO: 79497 - RNA, 23 nt, Human
gcacagcuacagauucccaaaag

SEQ ID NO: 79498 - RNA, 23 nt, Human
gcaugggagggggaggaaaggga

SEQ ID NO: 79499 - RNA, 21 nt, Human
gcucgcugccuguaugccuuu

SEQ ID NO: 79500 - RNA, 23 nt, Human
gcuuggucugaucuguuuuucuu

SEQ ID NO: 79501 - RNA, 21 nt, Human
ggaagcagagggucaccagcg

SEQ ID NO: 79502 - RNA, 21 nt, Human
ggacaggcucaccgaguuccu

SEQ ID NO: 79503 - RNA, 26 nt, Human
ggagaagccaguccaaaggacguaaa

SEQ ID NO: 79504 - RNA, 22 nt, Human
ggcccaggcauucaugccaagu

SEQ ID NO: 79505 - RNA, 19 nt, Human
ggcucaccgaguuccucuc

SEQ ID NO: 79506 - RNA, 20 nt, Human
gggaagcagagggucaccag

SEQ ID NO: 79507 - RNA, 26 nt, Human
gggaagcagagggucaccagcggggg

SEQ ID NO: 79508 - RNA, 21 nt, Human
ggggcagggaaggguaugaug

SEQ ID NO: 79509 - RNA, 21 nt, Human
guaugaugggaaagagaaaga

SEQ ID NO: 79510 - RNA, 23 nt, Human
gucugaagauggauucuccaccu

SEQ ID NO: 79511 - RNA, 25 nt, Human
guggaaguggguccuuuccccacug

SEQ ID NO: 79512 - RNA, 23 nt, Human
uaaaacaaacagaaacaaaaucc

SEQ ID NO: 79513 - RNA, 30 nt, Human
uaaaacaaacagaaacaaaauccuggauag

SEQ ID NO: 79514 - RNA, 23 nt, Human
uaaagcccaaaucaaaaaaacaa

SEQ ID NO: 79515 - RNA, 23 nt, Human
uaaaguaaacagcccagcauucc

SEQ ID NO: 79516 - RNA, 22 nt, Human
uacacagaaaaaaauaaagccc

SEQ ID NO: 79517 - RNA, 23 nt, Human
uacacagaaaaaaauaaagccuu

SEQ ID NO: 79518 - RNA, 21 nt, Human
uacagagaacggugcaacaca

SEQ ID NO: 79519 - RNA, 23 nt, Human
uacaguacacagaaaaaaauaaa

SEQ ID NO: 79520 - RNA, 25 nt, Human
uacaguacacagaaaaaaauaaagc

SEQ ID NO: 79521 - RNA, 21 nt, Human
uaggucaaagcagaaugacgc

SEQ ID NO: 79522 - RNA, 25 nt, Human
ucaaaagaaaaaucuccccccuccc

SEQ ID NO: 79523 - RNA, 31 nt, Human
ucaaaagaaaaaucuccccccuccccccaau

SEQ ID NO: 79524 - RNA, 25 nt, Human
ucaccagcggggggcacaaaggaag

SEQ ID NO: 79525 - RNA, 18 nt, Human
ucacuugggaauuccuaa

SEQ ID NO: 79526 - RNA, 22 nt, Human
ucagaugggaauguuuagguca

SEQ ID NO: 79527 - RNA, 21 nt, Human
ucagcagccaugccccggggc

SEQ ID NO: 79528 - RNA, 18 nt, Human
ucccaaaaguaggugccu

SEQ ID NO: 79529 - RNA, 19 nt, Human
uccccaaaauaacacugug

SEQ ID NO: 79530 - RNA, 18 nt, Human
uccccccucccccaaagc

SEQ ID NO: 79531 - RNA, 19 nt, Human
uccccccuccccccacccc

SEQ ID NO: 79532 - RNA, 20 nt, Human
ucccuuagcgcucgcugccu

SEQ ID NO: 79533 - RNA, 19 nt, Human
uccugggagaagccagucc

SEQ ID NO: 79534 - RNA, 23 nt, Human
uccugggagaagccaguccaaag

SEQ ID NO: 79535 - RNA, 19 nt, Human
uccuggguugccagguccu

SEQ ID NO: 79536 - RNA, 23 nt, Human
ucgggacacggaagaacuuucca

SEQ ID NO: 79537 - RNA, 23 nt, Human
ucuacaucgggacacggaagaac

SEQ ID NO: 79538 - RNA, 21 nt, Human
ucuccagggcauacaaaaccc

SEQ ID NO: 79539 - RNA, 19 nt, Human
ucucugcuguggaaguggg

SEQ ID NO: 79540 - RNA, 24 nt, Human
ucucugggugcgugccuccugcug

SEQ ID NO: 79541 - RNA, 18 nt, Human
ucuugccccaaagacuaa

SEQ ID NO: 79542 - RNA, 19 nt, Human
ugaaagaaaauaguccaaa

SEQ ID NO: 79543 - RNA, 24 nt, Human
ugacgccaacugggcccacauuca

SEQ ID NO: 79544 - RNA, 19 nt, Human
ugaucucugccacccaauc

SEQ ID NO: 79545 - RNA, 20 nt, Human
ugcagcuccagcauucucug

SEQ ID NO: 79546 - RNA, 21 nt, Human
ugcagugcucauccuggaggu

SEQ ID NO: 79547 - RNA, 23 nt, Human
ugcagugcucauccuggagguga

SEQ ID NO: 79548 - RNA, 24 nt, Human
ugccuguaugccuuuuuccucuuu

SEQ ID NO: 79549 - RNA, 18 nt, Human
ugcuaaaaucccuuuuac

SEQ ID NO: 79550 - RNA, 18 nt, Human
ugcuauuucuucuacauc

SEQ ID NO: 79551 - RNA, 23 nt, Human
ugcugggggcaguggcacuggcc

SEQ ID NO: 79552 - RNA, 24 nt, Human
ugcuuggucugaucuguuuuucuu

SEQ ID NO: 79553 - RNA, 18 nt, Human
uggccuccugguaucaag

SEQ ID NO: 79554 - RNA, 23 nt, Human
ugggagggggaggaaagggaagg

SEQ ID NO: 79555 - RNA, 21 nt, Human
uggggcagggaaggguaugau

SEQ ID NO: 79556 - RNA, 18 nt, Human
ugugcuuuucauuaauac

SEQ ID NO: 79557 - RNA, 21 nt, Human
ugugcuuuucauuaauacucu

SEQ ID NO: 79558 - RNA, 24 nt, Human
uuagcagcuuaaaacaucauguuu

SEQ ID NO: 79559 - RNA, 21 nt, Human
uuaguuccuuuuuuugugcuu

SEQ ID NO: 79560 - RNA, 23 nt, Human
uuccaaaaaugaucucugccacc

SEQ ID NO: 79561 - RNA, 23 nt, Human
uuccucuuuguuuuucucugcug

SEQ ID NO: 79562 - RNA, 24 nt, Human
uucuucugacucccccucuugcug

SEQ ID NO: 79563 - RNA, 23 nt, Human
uugggagacaagacagugcugaa

SEQ ID NO: 79564 - RNA, 21 nt, Human
uuugcuagauuuauuucccca

SEQ ID NO: 79565 - RNA, 22 nt, Human
uuuucugacaccacagcucugg

SEQ ID NO: 79566 - RNA, 21 nt, Human
aaaauaaauaguacuagaaac

SEQ ID NO: 79567 - RNA, 21 nt, Human
aaaauaaauaguacuagaaac

SEQ ID NO: 79568 - RNA, 18 nt, Human
aaacaacaucaccacuua

SEQ ID NO: 79569 - RNA, 18 nt, Human
aaacaacaucaccacuua

SEQ ID NO: 79570 - RNA, 22 nt, Human
aaacacaugcacaguuuaucuu

SEQ ID NO: 79571 - RNA, 22 nt, Human
aaacacaugcacaguuuaucuu

SEQ ID NO: 79572 - RNA, 21 nt, Human
aaacggaaguggaaacaggga

SEQ ID NO: 79573 - RNA, 21 nt, Human
aaacggaaguggaaacaggga

SEQ ID NO: 79574 - RNA, 22 nt, Human
aaccaggaauucccaugcuggc

SEQ ID NO: 79575 - RNA, 19 nt, Human
aagacucagguaguuuaga

SEQ ID NO: 79576 - RNA, 20 nt, Human
aagcccugagcuuugaccuc

SEQ ID NO: 79577 - RNA, 22 nt, Human
acaacaguuaccucuccaaaca

SEQ ID NO: 79578 - RNA, 19 nt, Human
acaguuaccucuccaaaca

SEQ ID NO: 79579 - RNA, 18 nt, Human
accacaaagaaugaggaa

SEQ ID NO: 79580 - RNA, 22 nt, Human
accccaaguguaguuuaaaaau

SEQ ID NO: 79581 - RNA, 22 nt, Human
accccaaguguaguuuaaaaau

SEQ ID NO: 79582 - RNA, 19 nt, Human
accugagucucucuccacg

SEQ ID NO: 79583 - RNA, 24 nt, Human
agacaacaguuaccucuccaaaca

SEQ ID NO: 79584 - RNA, 24 nt, Human
agacaacaguuaccucuccaaaca

SEQ ID NO: 79585 - RNA, 22 nt, Human
agacagaaguucauucuuuagc

SEQ ID NO: 79586 - RNA, 21 nt, Human
aggaauaaugguuuugaaaac

SEQ ID NO: 79587 - RNA, 21 nt, Human
aggaauaaugguuuugaaaac

SEQ ID NO: 79588 - RNA, 21 nt, Human
aggacucugaucucaaaccag

SEQ ID NO: 79589 - RNA, 18 nt, Human
aggcacagacaacaguua

SEQ ID NO: 79590 - RNA, 18 nt, Human
aggcacagacaacaguua

SEQ ID NO: 79591 - RNA, 19 nt, Human
aggcaggaugaugguaucu

SEQ ID NO: 79592 - RNA, 19 nt, Human
aggcaggaugaugguaucu

SEQ ID NO: 79593 - RNA, 23 nt, Human
aggcaggaugaugguaucuguuc

SEQ ID NO: 79594 - RNA, 23 nt, Human
aggcaggaugaugguaucuguuc

SEQ ID NO: 79595 - RNA, 21 nt, Human
agguaguuuagagccccaggc

SEQ ID NO: 79596 - RNA, 28 nt, Human
auaccugagucucucuccaaccggaggg

SEQ ID NO: 79597 - RNA, 20 nt, Human
aucuguaacgcacuuucccu

SEQ ID NO: 79598 - RNA, 20 nt, Human
aucuguaacgcacuuucccu

SEQ ID NO: 79599 - RNA, 19 nt, Human
augaugcugcuacauuuua

SEQ ID NO: 79600 - RNA, 19 nt, Human
augaugcugcuacauuuua

SEQ ID NO: 79601 - RNA, 22 nt, Human
auuucuucugcuucaggucagg

SEQ ID NO: 79602 - RNA, 21 nt, Human
caaaagaauaagcacucagua

SEQ ID NO: 79603 - RNA, 22 nt, Human
caaaagaauaagcacucaguac

SEQ ID NO: 79604 - RNA, 28 nt, Human
caaagaguauuccugaugaccggggccc

SEQ ID NO: 79605 - RNA, 28 nt, Human
caaagaguauuccugaugaccggggccc

SEQ ID NO: 79606 - RNA, 25 nt, Human
caaagcccaggacccuguuccgagg

SEQ ID NO: 79607 - RNA, 21 nt, Human
caaggaauucucugggggucu

SEQ ID NO: 79608 - RNA, 19 nt, Human
cacgaggcagacagaaguu

SEQ ID NO: 79609 - RNA, 25 nt, Human
cagcuguguacaaaagaauaagcaa

SEQ ID NO: 79610 - RNA, 26 nt, Human
ccaucugccuuguacguuguaaucuc

SEQ ID NO: 79611 - RNA, 26 nt, Human
ccaucugccuuguacguuguaaucuc

SEQ ID NO: 79612 - RNA, 23 nt, Human
cccaaguauuuuuucccauccac

SEQ ID NO: 79613 - RNA, 19 nt, Human
ccucuccaaacaaauggau

SEQ ID NO: 79614 - RNA, 19 nt, Human
ccucuccaaacaaauggau

SEQ ID NO: 79615 - RNA, 18 nt, Human
ccucuccagucacaggaa

SEQ ID NO: 79616 - RNA, 18 nt, Human
ccucuccagucacaggaa

SEQ ID NO: 79617 - RNA, 18 nt, Human
ccuguaguccaucugagg

SEQ ID NO: 79618 - RNA, 18 nt, Human
ccuguaguccaucugagg

SEQ ID NO: 79619 - RNA, 19 nt, Human
ccuguaguccaucugaggc

SEQ ID NO: 79620 - RNA, 19 nt, Human
ccuguaguccaucugaggc

SEQ ID NO: 79621 - RNA, 21 nt, Human
ccuugggaagaagaggugugg

SEQ ID NO: 79622 - RNA, 22 nt, Human
ccuugggaagaagagguguggu

SEQ ID NO: 79623 - RNA, 18 nt, Human
cguuuggaaagacucagg

SEQ ID NO: 79624 - RNA, 18 nt, Human
cuagguauuaggccaccu

SEQ ID NO: 79625 - RNA, 19 nt, Human
cucaggacucugaucucaa

SEQ ID NO: 79626 - RNA, 21 nt, Human
cuccagcuugggcaguggugu

SEQ ID NO: 79627 - RNA, 19 nt, Human
cugaacguuugaaacaaca

SEQ ID NO: 79628 - RNA, 20 nt, Human
cugaacguuugaaacaacaa

SEQ ID NO: 79629 - RNA, 20 nt, Human
cugaacguuugaaacaacaa

SEQ ID NO: 79630 - RNA, 21 nt, Human
cugaucucaaaccaggaauuc

SEQ ID NO: 79631 - RNA, 25 nt, Human
cugauucuccccugggguccacacu

SEQ ID NO: 79632 - RNA, 18 nt, Human
cuguaguccaucugaggc

SEQ ID NO: 79633 - RNA, 28 nt, Human
cuuucagguacuuggugccaaagcccag

SEQ ID NO: 79634 - RNA, 24 nt, Human
gaccacaguagacaaagaguauuc

SEQ ID NO: 79635 - RNA, 25 nt, Human
gaccacaguagacaaagaguauucc

SEQ ID NO: 79636 - RNA, 25 nt, Human
gaccacaguagacaaagaguauucc

SEQ ID NO: 79637 - RNA, 18 nt, Human
gagguacucaggacucug

SEQ ID NO: 79638 - RNA, 23 nt, Human
gauggucuugaaaacagaguagg

SEQ ID NO: 79639 - RNA, 18 nt, Human
gcaaacaaugaaaaagca

SEQ ID NO: 79640 - RNA, 22 nt, Human
gcaaacaaugaaaaagcagugc

SEQ ID NO: 79641 - RNA, 24 nt, Human
gcagccuuaaagcccugagcuuug

SEQ ID NO: 79642 - RNA, 19 nt, Human
gcugcuacauuuuaugagc

SEQ ID NO: 79643 - RNA, 19 nt, Human
gcugcuacauuuuaugagc

SEQ ID NO: 79644 - RNA, 23 nt, Human
gcugugaguccagagaugguagu

SEQ ID NO: 79645 - RNA, 19 nt, Human
ggaccuugggaagaagagg

SEQ ID NO: 79646 - RNA, 19 nt, Human
ggaccuugggaagaagagg

SEQ ID NO: 79647 - RNA, 19 nt, Human
ggccuggucuggaagcugu

SEQ ID NO: 79648 - RNA, 18 nt, Human
gguggaagcugugagucc

SEQ ID NO: 79649 - RNA, 19 nt, Human
gguggaagcugugagucca

SEQ ID NO: 79650 - RNA, 23 nt, Human
gguggcaguaaggauauuucuau

SEQ ID NO: 79651 - RNA, 20 nt, Human
ggugucccuggccacggaau

SEQ ID NO: 79652 - RNA, 24 nt, Human
gucccugagaaaaggguugagggg

SEQ ID NO: 79653 - RNA, 24 nt, Human
gucccugagaaaaggguugagggg

SEQ ID NO: 79654 - RNA, 20 nt, Human
gugcucucucucugccgggu

SEQ ID NO: 79655 - RNA, 20 nt, Human
guguacaaaagaauaagcac

SEQ ID NO: 79656 - RNA, 27 nt, Human
uaccacaaagaaugaggaagucccaac

SEQ ID NO: 79657 - RNA, 27 nt, Human
uaccacaaagaaugaggaagucccaac

SEQ ID NO: 79658 - RNA, 23 nt, Human
uaccugagucucucuccacgaaa

SEQ ID NO: 79659 - RNA, 18 nt, Human
uagcaacaucuuccuagg

SEQ ID NO: 79660 - RNA, 18 nt, Human
uagcaacaucuuccuagg

SEQ ID NO: 79661 - RNA, 22 nt, Human
uagcaguaaaccuaagaguuuc

SEQ ID NO: 79662 - RNA, 22 nt, Human
uagcaguaaaccuaagaguuuc

SEQ ID NO: 79663 - RNA, 26 nt, Human
uaucccaaguauuuuuucccauccac

SEQ ID NO: 79664 - RNA, 18 nt, Human
ucaaaaaggcacagacaa

SEQ ID NO: 79665 - RNA, 18 nt, Human
ucaaaaaggcacagacaa

SEQ ID NO: 79666 - RNA, 19 nt, Human
ucaaaccaggaauucccau

SEQ ID NO: 79667 - RNA, 18 nt, Human
ucaaugcuccaucugccu

SEQ ID NO: 79668 - RNA, 18 nt, Human
ucaaugcuccaucugccu

SEQ ID NO: 79669 - RNA, 21 nt, Human
uccacgaggcagacagaaguu

SEQ ID NO: 79670 - RNA, 18 nt, Human
uccccugggguccacacc

SEQ ID NO: 79671 - RNA, 23 nt, Human
ucccuacagcagcuaacaaaggc

SEQ ID NO: 79672 - RNA, 23 nt, Human
ucccuacagcagcuaacaaaggc

SEQ ID NO: 79673 - RNA, 23 nt, Human
ucccugaauccucguggucucca

SEQ ID NO: 79674 - RNA, 20 nt, Human
uccuguaguccaucugaggc

SEQ ID NO: 79675 - RNA, 25 nt, Human
ucuacuucuucaugugauaucccaa

SEQ ID NO: 79676 - RNA, 21 nt, Human
ucuccagcuugggcaguggug

SEQ ID NO: 79677 - RNA, 18 nt, Human
ucuccugaugccucucca

SEQ ID NO: 79678 - RNA, 18 nt, Human
ucuccugaugccucucca

SEQ ID NO: 79679 - RNA, 18 nt, Human
ucuguaacgcacuuuccc

SEQ ID NO: 79680 - RNA, 22 nt, Human
ucuguaacgcacuuucccuaca

SEQ ID NO: 79681 - RNA, 22 nt, Human
ucuguaacgcacuuucccuaca

SEQ ID NO: 79682 - RNA, 23 nt, Human
ucuguaacgcacuuucccuacag

SEQ ID NO: 79683 - RNA, 23 nt, Human
ucuguaacgcacuuucccuacag

SEQ ID NO: 79684 - RNA, 18 nt, Human
ucuuggcuugucguuugg

SEQ ID NO: 79685 - RNA, 21 nt, Human
ugaaaacagaguaggacagcc

SEQ ID NO: 79686 - RNA, 19 nt, Human
ugaauagcaacaucuuccu

SEQ ID NO: 79687 - RNA, 19 nt, Human
ugaauagcaacaucuuccu

SEQ ID NO: 79688 - RNA, 18 nt, Human
ugaauccucguggucucc

SEQ ID NO: 79689 - RNA, 23 nt, Human
ugacagcagugcaaacaaugaaa

SEQ ID NO: 79690 - RNA, 18 nt, Human
ugaccucugauucucccc

SEQ ID NO: 79691 - RNA, 19 nt, Human
ugaccucugauucuccccu

SEQ ID NO: 79692 - RNA, 18 nt, Human
ugcaaacaaugaaaaagc

SEQ ID NO: 79693 - RNA, 21 nt, Human
uggaaguuuuucaaaaaggca

SEQ ID NO: 79694 - RNA, 21 nt, Human
uggaaguuuuucaaaaaggca

SEQ ID NO: 79695 - RNA, 22 nt, Human
uggaaguuuuucaaaaaggcac

SEQ ID NO: 79696 - RNA, 22 nt, Human
uggaaguuuuucaaaaaggcac

SEQ ID NO: 79697 - RNA, 22 nt, Human
uggagacgaacgagaccucucc

SEQ ID NO: 79698 - RNA, 22 nt, Human
uggagacgaacgagaccucucc

SEQ ID NO: 79699 - RNA, 18 nt, Human
uggauguagcaguaaacc

SEQ ID NO: 79700 - RNA, 18 nt, Human
uggauguagcaguaaacc

SEQ ID NO: 79701 - RNA, 27 nt, Human
uggcuccacgaggcagacaggggaacc

SEQ ID NO: 79702 - RNA, 21 nt, Human
ugggccuggucuggaagcugu

SEQ ID NO: 79703 - RNA, 21 nt, Human
uguacaaaagaauaagcacuc

SEQ ID NO: 79704 - RNA, 20 nt, Human
ugugauggucuugaaaacag

SEQ ID NO: 79705 - RNA, 23 nt, Human
ugugccuuagacucaaggaauuc

SEQ ID NO: 79706 - RNA, 25 nt, Human
uuaaagccuaaucuacuuucucugu

SEQ ID NO: 79707 - RNA, 24 nt, Human
uucccuacagcagcuaacaaaggc

SEQ ID NO: 79708 - RNA, 23 nt, Human
uucucugggggucuagaccuccu

SEQ ID NO: 79709 - RNA, 18 nt, Human
uugaccucugauucuccc

SEQ ID NO: 79710 - RNA, 18 nt, Human
uugaggggguguuggagu

SEQ ID NO: 79711 - RNA, 18 nt, Human
uugaggggguguuggagu

SEQ ID NO: 79712 - RNA, 22 nt, Human
uugggcaguggugucccuggcc

SEQ ID NO: 79713 - RNA, 23 nt, Human
uuggggcuuuuggacaccuuggg

SEQ ID NO: 79714 - RNA, 24 nt, Human
uuucaaaaaggcacagacaacagu

SEQ ID NO: 79715 - RNA, 24 nt, Human
uuucaaaaaggcacagacaacagu

SEQ ID NO: 79716 - RNA, 24 nt, Human
uuugaaaacgucaaugcuccaucu

SEQ ID NO: 79717 - RNA, 24 nt, Human
uuugaaaacgucaaugcuccaucu

SEQ ID NO: 79718 - RNA, 23 nt, Human
uuuuuuucuuuucacuucuauua

SEQ ID NO: 79719 - RNA, 22 nt, Human
uuuuuuuuuuuuuuuuugacag

SEQ ID NO: 79720 - RNA, 27 nt, Human
uuuuuuuuuuuuuuuuuuuuuuugggg

SEQ ID NO: 79721 - RNA, 20 nt, Human
aagcagcagcguuuauucaa

SEQ ID NO: 79722 - RNA, 20 nt, Human
aagcagcagcguuuauucaa

SEQ ID NO: 79723 - RNA, 24 nt, Human
aaugcccgcccacucccugguggc

SEQ ID NO: 79724 - RNA, 24 nt, Human
aaugcccgcccacucccugguggc

SEQ ID NO: 79725 - RNA, 20 nt, Human
acauaaaaaaccacagucug

SEQ ID NO: 79726 - RNA, 18 nt, Human
agagguuuccaggccauc

SEQ ID NO: 79727 - RNA, 22 nt, Human
agggcgggggggcccccugggg

SEQ ID NO: 79728 - RNA, 24 nt, Human
auaaaaaaccacagucugaggcca

SEQ ID NO: 79729 - RNA, 21 nt, Human
caccgccccaccagccccgcc

SEQ ID NO: 79730 - RNA, 21 nt, Human
cagcguuuauucaagauacaa

SEQ ID NO: 79731 - RNA, 21 nt, Human
cagcguuuauucaagauacaa

SEQ ID NO: 79732 - RNA, 25 nt, Human
cauaaaaaaccacagucugaggcca

SEQ ID NO: 79733 - RNA, 22 nt, Human
ccacauaaaaaaccacagucug

SEQ ID NO: 79734 - RNA, 18 nt, Human
ccaucugucugccuccag

SEQ ID NO: 79735 - RNA, 23 nt, Human
cccacagccccgccgccgccgcu

SEQ ID NO: 79736 - RNA, 21 nt, Human
ccccacagccccgccgccgcc

SEQ ID NO: 79737 - RNA, 19 nt, Human
ccccaccagccccgccgcc

SEQ ID NO: 79738 - RNA, 18 nt, Human
ccccauggccccgcgcgg

SEQ ID NO: 79739 - RNA, 18 nt, Human
ccccauggccccgcgcgg

SEQ ID NO: 79740 - RNA, 24 nt, Human
cccccaucgagccgccacccuccc

SEQ ID NO: 79741 - RNA, 18 nt, Human
ccccgccgccgccgcugc

SEQ ID NO: 79742 - RNA, 18 nt, Human
ccccgccgccgccgcugc

SEQ ID NO: 79743 - RNA, 19 nt, Human
ccccgccgccgccgcugcc

SEQ ID NO: 79744 - RNA, 19 nt, Human
ccccgccgccgccgcugcc

SEQ ID NO: 79745 - RNA, 21 nt, Human
ccccgccgccgccgcugccgc

SEQ ID NO: 79746 - RNA, 21 nt, Human
ccccgccgccgccgcugccgc

SEQ ID NO: 79747 - RNA, 21 nt, Human
ccccgcgcggcggcggcggcg

SEQ ID NO: 79748 - RNA, 21 nt, Human
ccccgcgcggcggcggcggcg

SEQ ID NO: 79749 - RNA, 20 nt, Human
ccccgggcgccgggcggccc

SEQ ID NO: 79750 - RNA, 20 nt, Human
ccccgggcgccgggcggccc

SEQ ID NO: 79751 - RNA, 21 nt, Human
ccccgggcgccgggcggcccc

SEQ ID NO: 79752 - RNA, 21 nt, Human
ccccgggcgccgggcggcccc

SEQ ID NO: 79753 - RNA, 18 nt, Human
ccgcaccgccccaccagc

SEQ ID NO: 79754 - RNA, 24 nt, Human
ccgcccggcccacacucaucgccc

SEQ ID NO: 79755 - RNA, 20 nt, Human
ccgccgccgccgccgccucc

SEQ ID NO: 79756 - RNA, 20 nt, Human
ccgccgccgccgccgccucc

SEQ ID NO: 79757 - RNA, 18 nt, Human
ccgccgccgccgcugccg

SEQ ID NO: 79758 - RNA, 18 nt, Human
ccgccgccgccgcugccg

SEQ ID NO: 79759 - RNA, 21 nt, Human
ccgccgccgccgcugccgccg

SEQ ID NO: 79760 - RNA, 24 nt, Human
ccgccgccgccgcugccgccgccg

SEQ ID NO: 79761 - RNA, 24 nt, Human
ccgccgccgccgcugccgccgccg

SEQ ID NO: 79762 - RNA, 22 nt, Human
ccgccgccgccgcugccgccgg

SEQ ID NO: 79763 - RNA, 18 nt, Human
ccgccgccgcugccgccg

SEQ ID NO: 79764 - RNA, 18 nt, Human
ccgccgccgcugccgccg

SEQ ID NO: 79765 - RNA, 24 nt, Human
ccgccgccgcugccgccgccgccg

SEQ ID NO: 79766 - RNA, 24 nt, Human
ccgccgccgcugccgccgccgccg

SEQ ID NO: 79767 - RNA, 18 nt, Human
ccgccgcugccgccgccg

SEQ ID NO: 79768 - RNA, 18 nt, Human
ccgccgcugccgccgccg

SEQ ID NO: 79769 - RNA, 24 nt, Human
ccgccgcugccgccgccgccgccg

SEQ ID NO: 79770 - RNA, 24 nt, Human
ccgccgcugccgccgccgccgccg

SEQ ID NO: 79771 - RNA, 18 nt, Human
ccgcgccgugggcacagg

SEQ ID NO: 79772 - RNA, 24 nt, Human
ccgcgcggcggcggcggcggcuuu

SEQ ID NO: 79773 - RNA, 18 nt, Human
ccgcugccgccgccgccg

SEQ ID NO: 79774 - RNA, 18 nt, Human
ccgcugccgccgccgccg

SEQ ID NO: 79775 - RNA, 24 nt, Human
ccgcugccgccgccgccgccgccg

SEQ ID NO: 79776 - RNA, 24 nt, Human
ccgcugccgccgccgccgccgccg

SEQ ID NO: 79777 - RNA, 27 nt, Human
ccgcugccgccgccgccgccgccgccu

SEQ ID NO: 79778 - RNA, 27 nt, Human
ccgcugccgccgccgccgccgccgccu

SEQ ID NO: 79779 - RNA, 18 nt, Human
ccggcccgcacucugcgc

SEQ ID NO: 79780 - RNA, 18 nt, Human
cgcaccgccccaccagcc

SEQ ID NO: 79781 - RNA, 23 nt, Human
cgcaggaagggagggccgggggg

SEQ ID NO: 79782 - RNA, 21 nt, Human
cgccaggccgccgccagacuc

SEQ ID NO: 79783 - RNA, 21 nt, Human
cgccaggccgccgccagacuc

SEQ ID NO: 79784 - RNA, 21 nt, Human
cgcccggcccacacucaucgc

SEQ ID NO: 79785 - RNA, 21 nt, Human
cgcgcgccgcuauugugugcg

SEQ ID NO: 79786 - RNA, 21 nt, Human
cgcggcggccucgccaggccc

SEQ ID NO: 79787 - RNA, 21 nt, Human
cgcggcggccucgccaggccc

SEQ ID NO: 79788 - RNA, 22 nt, Human
cgcggcggcggcggcggcgaac

SEQ ID NO: 79789 - RNA, 23 nt, Human
cgcggggcccgucucagcggcgg

SEQ ID NO: 79790 - RNA, 23 nt, Human
cgcggggcccgucucagcggcgg

SEQ ID NO: 79791 - RNA, 19 nt, Human
cgcuaagccagccggcucg

SEQ ID NO: 79792 - RNA, 21 nt, Human
cggagcggggcgcucggcgcg

SEQ ID NO: 79793 - RNA, 21 nt, Human
cggagcggggcgcucggcgcg

SEQ ID NO: 79794 - RNA, 21 nt, Human
cggcggcggcggcgaacaaug

SEQ ID NO: 79795 - RNA, 21 nt, Human
cggcggcggcggcgaacaaug

SEQ ID NO: 79796 - RNA, 22 nt, Human
cggguggccacauaaaaaacca

SEQ ID NO: 79797 - RNA, 22 nt, Human
cggguggccacauaaaaaacca

SEQ ID NO: 79798 - RNA, 21 nt, Human
cucccuucacccugucuccca

SEQ ID NO: 79799 - RNA, 21 nt, Human
cucccuucacccugucuccca

SEQ ID NO: 79800 - RNA, 18 nt, Human
cucgccaggcccggcccc

SEQ ID NO: 79801 - RNA, 18 nt, Human
cucgccaggcccggcccc

SEQ ID NO: 79802 - RNA, 19 nt, Human
cugaggccagccuggggcu

SEQ ID NO: 79803 - RNA, 19 nt, Human
cugaggccagcuuggggcu

SEQ ID NO: 79804 - RNA, 21 nt, Human
cugccgccgccgccgccgccg

SEQ ID NO: 79805 - RNA, 21 nt, Human
cugccgccgccgccgccgccg

SEQ ID NO: 79806 - RNA, 18 nt, Human
cuguccuucggcuuuggg

SEQ ID NO: 79807 - RNA, 18 nt, Human
gacucuggccacggcccg

SEQ ID NO: 79808 - RNA, 18 nt, Human
gacucuggccacggcccg

SEQ ID NO: 79809 - RNA, 18 nt, Human
gagccgccacccuccccc

SEQ ID NO: 79810 - RNA, 21 nt, Human
gccgccgccgccgccgccgcc

SEQ ID NO: 79811 - RNA, 21 nt, Human
gccgccgccgccgccgccgcc

SEQ ID NO: 79812 - RNA, 18 nt, Human
gccgccgccgccuccucg

SEQ ID NO: 79813 - RNA, 20 nt, Human
gcgcgccgcuauugugugcg

SEQ ID NO: 79814 - RNA, 18 nt, Human
gcuuggggcgcccucggg

SEQ ID NO: 79815 - RNA, 18 nt, Human
gcuuggggcgcccucggg

SEQ ID NO: 79816 - RNA, 23 nt, Human
ggccacggcccgcgcgcuccucg

SEQ ID NO: 79817 - RNA, 23 nt, Human
ggccacggcccgcgcgcuccucg

SEQ ID NO: 79818 - RNA, 24 nt, Human
ggccccgcgcggcggcggcggcgg

SEQ ID NO: 79819 - RNA, 24 nt, Human
ggccccgcgcggcggcggcggcgg

SEQ ID NO: 79820 - RNA, 18 nt, Human
ggcccgucucagcggcgg

SEQ ID NO: 79821 - RNA, 22 nt, Human
ggccggggggaggcggccgcga

SEQ ID NO: 79822 - RNA, 22 nt, Human
ggcggcggcggcgaacaaugcc

SEQ ID NO: 79823 - RNA, 22 nt, Human
ggcggcggcggcgaacaaugcc

SEQ ID NO: 79824 - RNA, 19 nt, Human
gggcccgucucagcggcgg

SEQ ID NO: 79825 - RNA, 18 nt, Human
gggcgccgggcggccccc

SEQ ID NO: 79826 - RNA, 18 nt, Human
gggcgccgggcggccccc

SEQ ID NO: 79827 - RNA, 25 nt, Human
uacaacagugagggaauccggucac

SEQ ID NO: 79828 - RNA, 25 nt, Human
uacaacagugagggaauccggucac

SEQ ID NO: 79829 - RNA, 19 nt, Human
uagccagagguuuccaggc

SEQ ID NO: 79830 - RNA, 26 nt, Human
uauucaagauacaacagugagggaau

SEQ ID NO: 79831 - RNA, 26 nt, Human
uauucaagauacaacagugagggaau

SEQ ID NO: 79832 - RNA, 18 nt, Human
ucagcggcggcgcggcgg

SEQ ID NO: 79833 - RNA, 22 nt, Human
ucagcggcggcgcggcggccuc

SEQ ID NO: 79834 - RNA, 23 nt, Human
ucauaaaaaucacucccuucacc

SEQ ID NO: 79835 - RNA, 23 nt, Human
ucauaaaaaucacucccuucacc

SEQ ID NO: 79836 - RNA, 21 nt, Human
uccaggagauggacugggacc

SEQ ID NO: 79837 - RNA, 24 nt, Human
uccuucggcuuugggucgcugucu

SEQ ID NO: 79838 - RNA, 20 nt, Human
ucggcuuugggucgcugucu

SEQ ID NO: 79839 - RNA, 30 nt, Human
ucggcuuugggucgcugucucuuggcagaa

SEQ ID NO: 79840 - RNA, 20 nt, Human
ucucuuggcagauggcccaa

SEQ ID NO: 79841 - RNA, 23 nt, Human
ugaacuggcuuggggcgcccucg

SEQ ID NO: 79842 - RNA, 23 nt, Human
ugaacuggcuuggggcgcccucg

SEQ ID NO: 79843 - RNA, 23 nt, Human
ugaggccagccuggggcucccag

SEQ ID NO: 79844 - RNA, 21 nt, Human
uggagcggagccaggcgggcc

SEQ ID NO: 79845 - RNA, 19 nt, Human
uggccacauaaaaaaccac

SEQ ID NO: 79846 - RNA, 19 nt, Human
uggccacauaaaaaaccac

SEQ ID NO: 79847 - RNA, 19 nt, Human
uggcccaaggacaccucag

SEQ ID NO: 79848 - RNA, 21 nt, Human
uggcuuggggcgcccucgggu

SEQ ID NO: 79849 - RNA, 21 nt, Human
uggcuuggggcgcccucgggu

SEQ ID NO: 79850 - RNA, 25 nt, Human
uuccaggccaucugucugccuccag

SEQ ID NO: 79851 - RNA, 18 nt, Human
uugaagcagcagcguuua

SEQ ID NO: 79852 - RNA, 19 nt, Human
uuuccaggccaucugucug

SEQ ID NO: 79853 - RNA, 24 nt, Human
aaaaauucuuuuuuauaguauguc

SEQ ID NO: 79854 - RNA, 19 nt, Human
aaaagaguuuaggcaaagg

SEQ ID NO: 79855 - RNA, 20 nt, Human
aacacagcacaagccaaugg

SEQ ID NO: 79856 - RNA, 21 nt, Human
aacaccuauggcauguaaaca

SEQ ID NO: 79857 - RNA, 18 nt, Human
aacaggcacccaucaucc

SEQ ID NO: 79858 - RNA, 22 nt, Human
aacccccccacccccagugccu

SEQ ID NO: 79859 - RNA, 21 nt, Human
aacuaccaaguagcuaguucc

SEQ ID NO: 79860 - RNA, 21 nt, Human
aagaaucuguuaccuugagau

SEQ ID NO: 79861 - RNA, 24 nt, Human
aagagaaacacacacugagugauc

SEQ ID NO: 79862 - RNA, 20 nt, Human
aagcaaauguaaaaugacua

SEQ ID NO: 79863 - RNA, 19 nt, Human
aagcauagucacaaacuuc

SEQ ID NO: 79864 - RNA, 18 nt, Human
aagugcuaaaccucucau

SEQ ID NO: 79865 - RNA, 22 nt, Human
acaacccuucauagauaaccga

SEQ ID NO: 79866 - RNA, 22 nt, Human
acaacucacuggcagcacaacc

SEQ ID NO: 79867 - RNA, 19 nt, Human
acacacacuccuucaucuc

SEQ ID NO: 79868 - RNA, 22 nt, Human
acacacccccaugcuacacaca

SEQ ID NO: 79869 - RNA, 22 nt, Human
accaaguucugcauuugggaau

SEQ ID NO: 79870 - RNA, 23 nt, Human
accccagccgcauuacacacacc

SEQ ID NO: 79871 - RNA, 23 nt, Human
acccgguaagcugagccuaggau

SEQ ID NO: 79872 - RNA, 22 nt, Human
acuugccccaagccaacaacuu

SEQ ID NO: 79873 - RNA, 21 nt, Human
acuuuuguagcuuuuuguuuu

SEQ ID NO: 79874 - RNA, 18 nt, Human
agaaaggagucacuuggg

SEQ ID NO: 79875 - RNA, 25 nt, Human
agacaaacaagagacucucagcuua

SEQ ID NO: 79876 - RNA, 18 nt, Human
agagaaaacauggaagau

SEQ ID NO: 79877 - RNA, 26 nt, Human
agcuggaaaauagagagaaaugauuu

SEQ ID NO: 79878 - RNA, 19 nt, Human
aggaaaaaaacauaagagg

SEQ ID NO: 79879 - RNA, 24 nt, Human
aggcacccaucauccagaccagaa

SEQ ID NO: 79880 - RNA, 25 nt, Human
aggcaccuugacagacaaacaagag

SEQ ID NO: 79881 - RNA, 23 nt, Human
agugguuccugccagguuuccag

SEQ ID NO: 79882 - RNA, 20 nt, Human
auauacacaagagaagaguu

SEQ ID NO: 79883 - RNA, 21 nt, Human
augcaggaaaaaaacauaaga

SEQ ID NO: 79884 - RNA, 23 nt, Human
auuaaggcuuuuaacaugaaaag

SEQ ID NO: 79885 - RNA, 22 nt, Human
caaaaucucuggagaugagggu

SEQ ID NO: 79886 - RNA, 19 nt, Human
caaaauuucaggcccuggu

SEQ ID NO: 79887 - RNA, 27 nt, Human
caaacaagagacucucagcuuauuaaa

SEQ ID NO: 79888 - RNA, 21 nt, Human
caacccuucauagauaaccga

SEQ ID NO: 79889 - RNA, 24 nt, Human
caagauaucuggucauucccagac

SEQ ID NO: 79890 - RNA, 18 nt, Human
caccaggcacaucuucuc

SEQ ID NO: 79891 - RNA, 26 nt, Human
cacccaucauccagaccagaacaccu

SEQ ID NO: 79892 - RNA, 26 nt, Human
caccuauaacaacuacuuuaguagcc

SEQ ID NO: 79893 - RNA, 27 nt, Human
cagaagacuuaagacuaaugggaacca

SEQ ID NO: 79894 - RNA, 20 nt, Human
cagcaggacaggccuuccuc

SEQ ID NO: 79895 - RNA, 22 nt, Human
cagcauaaaucuacaacucacu

SEQ ID NO: 79896 - RNA, 18 nt, Human
cagcgcagccaaugggcu

SEQ ID NO: 79897 - RNA, 19 nt, Human
caggagucauaagccagag

SEQ ID NO: 79898 - RNA, 21 nt, Human
caguguuuucauaccccagcc

SEQ ID NO: 79899 - RNA, 20 nt, Human
cauuaaaugcucaauaaaga

SEQ ID NO: 79900 - RNA, 22 nt, Human
cauuucuugccaguauucugcc

SEQ ID NO: 79901 - RNA, 21 nt, Human
ccaaucugauuacaaauccaa

SEQ ID NO: 79902 - RNA, 22 nt, Human
ccacaaccauagacacaaaauc

SEQ ID NO: 79903 - RNA, 20 nt, Human
ccagacccacaaccauagac

SEQ ID NO: 79904 - RNA, 21 nt, Human
ccaguuccagcaggacaggcc

SEQ ID NO: 79905 - RNA, 22 nt, Human
ccauagacacaaaaucucugga

SEQ ID NO: 79906 - RNA, 22 nt, Human
cccaacaccuucugacuccuaa

SEQ ID NO: 79907 - RNA, 30 nt, Human
cccaacaccuucugacuccuaauagaccuu

SEQ ID NO: 79908 - RNA, 19 nt, Human
cccaucauccagaccagaa

SEQ ID NO: 79909 - RNA, 19 nt, Human
ccccaacaccuucugacuc

SEQ ID NO: 79910 - RNA, 24 nt, Human
ccccaacaccuucugacuccuaau

SEQ ID NO: 79911 - RNA, 21 nt, Human
ccccaagccaacaacuuaacu

SEQ ID NO: 79912 - RNA, 23 nt, Human
ccccaugcuacacacacuccuuc

SEQ ID NO: 79913 - RNA, 22 nt, Human
cccccacccccagugccugaau

SEQ ID NO: 79914 - RNA, 23 nt, Human
cccccacccccagugccugaauu

SEQ ID NO: 79915 - RNA, 18 nt, Human
ccccccacccccagugcc

SEQ ID NO: 79916 - RNA, 21 nt, Human
cccucccuacaccaaucccag

SEQ ID NO: 79917 - RNA, 21 nt, Human
ccgcauuacacacaccaggca

SEQ ID NO: 79918 - RNA, 20 nt, Human
ccgccgccccucccucggcc

SEQ ID NO: 79919 - RNA, 27 nt, Human
ccgccgccgccgccgcucgcgccgccg

SEQ ID NO: 79920 - RNA, 19 nt, Human
ccgccgccgccgcucgcgc

SEQ ID NO: 79921 - RNA, 27 nt, Human
ccgccgccgccgcucgcgccgccgccc

SEQ ID NO: 79922 - RNA, 23 nt, Human
ccgccgcucgcgccgccgccccu

SEQ ID NO: 79923 - RNA, 19 nt, Human
ccugaauucauccacaucu

SEQ ID NO: 79924 - RNA, 20 nt, Human
ccuuugagaagucagaagag

SEQ ID NO: 79925 - RNA, 22 nt, Human
cgcacacgugccauugugcgua

SEQ ID NO: 79926 - RNA, 24 nt, Human
cuagcucuauuuuauggccuucau

SEQ ID NO: 79927 - RNA, 21 nt, Human
cucacuggcagcacaaccuga

SEQ ID NO: 79928 - RNA, 22 nt, Human
cuccccaacaccuucugacucc

SEQ ID NO: 79929 - RNA, 19 nt, Human
cuccucacuaagcuucuuc

SEQ ID NO: 79930 - RNA, 18 nt, Human
cuccuucaucuccuucuc

SEQ ID NO: 79931 - RNA, 24 nt, Human
cucucucuuccucauuucuugcca

SEQ ID NO: 79932 - RNA, 18 nt, Human
cuucauaggcagccuccc

SEQ ID NO: 79933 - RNA, 23 nt, Human
cuugagaugccuacugcucugca

SEQ ID NO: 79934 - RNA, 21 nt, Human
cuugggcuuauaaaaccagca

SEQ ID NO: 79935 - RNA, 22 nt, Human
gaagauauguauccgauugucc

SEQ ID NO: 79936 - RNA, 20 nt, Human
gacaaacaagagacucucag

SEQ ID NO: 79937 - RNA, 20 nt, Human
gaccugccacuuaaaacuuu

SEQ ID NO: 79938 - RNA, 18 nt, Human
gacugcaacgcugaaaau

SEQ ID NO: 79939 - RNA, 20 nt, Human
gcccucccuacaccaauccc

SEQ ID NO: 79940 - RNA, 18 nt, Human
gcugaaggccuguuucca

SEQ ID NO: 79941 - RNA, 22 nt, Human
gcuggaaccgccgccgccgccg

SEQ ID NO: 79942 - RNA, 19 nt, Human
ggcacaucuucucuuucac

SEQ ID NO: 79943 - RNA, 18 nt, Human
gggaaccaggagucauaa

SEQ ID NO: 79944 - RNA, 21 nt, Human
uaaaaggaaggucuuaugaga

SEQ ID NO: 79945 - RNA, 21 nt, Human
uaaauaacccccccaccccca

SEQ ID NO: 79946 - RNA, 21 nt, Human
uaaaucaagcauagucacaaa

SEQ ID NO: 79947 - RNA, 19 nt, Human
uaacaugaaaagaccaagu

SEQ ID NO: 79948 - RNA, 27 nt, Human
uaaccagaauaaacucugauuucucuu

SEQ ID NO: 79949 - RNA, 22 nt, Human
uaacccccccacccccagugcc

SEQ ID NO: 79950 - RNA, 20 nt, Human
uaagccagagacuccucccc

SEQ ID NO: 79951 - RNA, 24 nt, Human
uaauacauuuuggaaaagcaaaug

SEQ ID NO: 79952 - RNA, 19 nt, Human
uacacacaccaggcacauc

SEQ ID NO: 79953 - RNA, 22 nt, Human
uaccaaguagcuaguucccaag

SEQ ID NO: 79954 - RNA, 19 nt, Human
uacccaaaugagauuaagg

SEQ ID NO: 79955 - RNA, 22 nt, Human
uaccuugagaugccuacugcuc

SEQ ID NO: 79956 - RNA, 24 nt, Human
uagaauaaaauaaaggacugggug

SEQ ID NO: 79957 - RNA, 22 nt, Human
uagaccuacucaauaagaaucu

SEQ ID NO: 79958 - RNA, 19 nt, Human
uagagaaucauuaacaaaa

SEQ ID NO: 79959 - RNA, 25 nt, Human
uaucuccuuuuggcuuaaaccaacc

SEQ ID NO: 79960 - RNA, 21 nt, Human
uauuguuuuucucucucuucc

SEQ ID NO: 79961 - RNA, 21 nt, Human
ucaggcccugguuucaugugc

SEQ ID NO: 79962 - RNA, 21 nt, Human
ucauccagaccagaacaccua

SEQ ID NO: 79963 - RNA, 24 nt, Human
ucaugugugugucuuauggggccu

SEQ ID NO: 79964 - RNA, 19 nt, Human
uccaaauaguucuugaucu

SEQ ID NO: 79965 - RNA, 21 nt, Human
uccacagagccuugcgcggca

SEQ ID NO: 79966 - RNA, 23 nt, Human
ucuacaacucacuggcagcacaa

SEQ ID NO: 79967 - RNA, 21 nt, Human
ucuccagcgcagccaaugggc

SEQ ID NO: 79968 - RNA, 20 nt, Human
ucuggagaugaggguggagg

SEQ ID NO: 79969 - RNA, 19 nt, Human
ucuuccagcauaaaucuac

SEQ ID NO: 79970 - RNA, 19 nt, Human
ugacugcaacgcugaaaau

SEQ ID NO: 79971 - RNA, 21 nt, Human
ugagaacaccacagccucuau

SEQ ID NO: 79972 - RNA, 24 nt, Human
ugagaacaccacagccucuaucaa

SEQ ID NO: 79973 - RNA, 27 nt, Human
ugagaacaccacagccucuaucaacug

SEQ ID NO: 79974 - RNA, 19 nt, Human
ugagaaggagguaaggcuu

SEQ ID NO: 79975 - RNA, 18 nt, Human
ugaggccacacuagucag

SEQ ID NO: 79976 - RNA, 26 nt, Human
ugccauugugcguacacaagaacaag

SEQ ID NO: 79977 - RNA, 21 nt, Human
ugcuaaaccucucauuagcau

SEQ ID NO: 79978 - RNA, 21 nt, Human
uggaaaauagagagaaaugau

SEQ ID NO: 79979 - RNA, 22 nt, Human
uggcaaaaaguacaaauucaua

SEQ ID NO: 79980 - RNA, 20 nt, Human
uggccagcuagacauucaga

SEQ ID NO: 79981 - RNA, 18 nt, Human
uggcuucucaaguuaacc

SEQ ID NO: 79982 - RNA, 19 nt, Human
ugguuaaagucuguuaucc

SEQ ID NO: 79983 - RNA, 24 nt, Human
uguguuuauaaauaacccccccac

SEQ ID NO: 79984 - RNA, 24 nt, Human
uguuaaguuguacacacccccaug

SEQ ID NO: 79985 - RNA, 18 nt, Human
uguuuugcacaacccuuc

SEQ ID NO: 79986 - RNA, 18 nt, Human
uuacagaaucacuuuccc

SEQ ID NO: 79987 - RNA, 23 nt, Human
uuaggaucuagcaccuaacuggu

SEQ ID NO: 79988 - RNA, 24 nt, Human
uucucaguguuuucauacccccuu

SEQ ID NO: 79989 - RNA, 18 nt, Human
uucucuuucacagagcuu

SEQ ID NO: 79990 - RNA, 23 nt, Human
uugccccaagccaacaacuuaac

SEQ ID NO: 79991 - RNA, 20 nt, Human
uuguaacuaccaaguagcua

SEQ ID NO: 79992 - RNA, 20 nt, Human
uuuaacaggcacccaucauc

SEQ ID NO: 79993 - RNA, 22 nt, Human
uuuaguagccugagcacaaagc

SEQ ID NO: 79994 - RNA, 24 nt, Human
uuuauaaauaacccccccaccccc

SEQ ID NO: 79995 - RNA, 18 nt, Human
uuucaggcccugguuuca

SEQ ID NO: 79996 - RNA, 20 nt, Human
uuucucacccugcucaugug

SEQ ID NO: 79997 - RNA, 21 nt, Human
uuugcaaacagugaaauuuau

SEQ ID NO: 79998 - RNA, 21 nt, Human
aacaaguaagcaaccucccaa

SEQ ID NO: 79999 - RNA, 18 nt, Human
aagcaaccucccaacucc

SEQ ID NO: 80000 - RNA, 23 nt, Human
agacaauaagauccgccgugacc

SEQ ID NO: 80001 - RNA, 22 nt, Human
caccaaaccuuacaggcccugg

SEQ ID NO: 80002 - RNA, 25 nt, Human
cccguucuuuucucccucauucucc

SEQ ID NO: 80003 - RNA, 24 nt, Human
ccuaacacuaccuguuuagcaaau

SEQ ID NO: 80004 - RNA, 19 nt, Human
cuccccaaaugaaaaucug

SEQ ID NO: 80005 - RNA, 23 nt, Human
gaaaaccuuucauggauuagcuc

SEQ ID NO: 80006 - RNA, 21 nt, Human
gagagcugagcugagcccagc

SEQ ID NO: 80007 - RNA, 23 nt, Human
gcagugcucuuggcucggaaugc

SEQ ID NO: 80008 - RNA, 18 nt, Human
uagcuccuaacacuaccu

SEQ ID NO: 80009 - RNA, 19 nt, Human
uauugagcuagaggaggag

SEQ ID NO: 80010 - RNA, 22 nt, Human
ucauucuccccaaaugaaaauc

SEQ ID NO: 80011 - RNA, 21 nt, Human
uccccaaaugaaaaucugccc

SEQ ID NO: 80012 - RNA, 23 nt, Human
uccccaaaugaaaaucugcccau

SEQ ID NO: 80013 - RNA, 22 nt, Human
ugagcuagaggaggagagcuga

SEQ ID NO: 80014 - RNA, 22 nt, Human
ugagcuagaggaggagagcugg

SEQ ID NO: 80015 - RNA, 21 nt, Human
ugcccguucuuuucucccuca

SEQ ID NO: 80016 - RNA, 18 nt, Human
uucucccucauucucccc

SEQ ID NO: 80017 - RNA, 19 nt, Human
uucucccucauucucccca

SEQ ID NO: 80018 - RNA, 18 nt, Human
acugcacuucagucuggg

SEQ ID NO: 80019 - RNA, 25 nt, Human
acugcacuucagucugggccgacgg

SEQ ID NO: 80020 - RNA, 24 nt, Human
agcaacucgagaggcugagguggg

SEQ ID NO: 80021 - RNA, 24 nt, Human
agcugcuuuuggaggaguuuucuc

SEQ ID NO: 80022 - RNA, 20 nt, Human
aggcugaggugggagaaucg

SEQ ID NO: 80023 - RNA, 19 nt, Human
aggucgaggcugcagcgag

SEQ ID NO: 80024 - RNA, 24 nt, Human
aggugggagaaucguuuaagccug

SEQ ID NO: 80025 - RNA, 24 nt, Human
auugugccacugcacuucagucug

SEQ ID NO: 80026 - RNA, 18 nt, Human
cacugcacuucagucugg

SEQ ID NO: 80027 - RNA, 19 nt, Human
cacugcacuucagucuggg

SEQ ID NO: 80028 - RNA, 22 nt, Human
cacugcacuucagucugggccg

SEQ ID NO: 80029 - RNA, 21 nt, Human
cagcaacucgagaggcugagg

SEQ ID NO: 80030 - RNA, 24 nt, Human
cagcaacucgagaggcugaggugg

SEQ ID NO: 80031 - RNA, 18 nt, Human
ccacugcacuucagucug

SEQ ID NO: 80032 - RNA, 20 nt, Human
ccacugcacuucagucuggg

SEQ ID NO: 80033 - RNA, 20 nt, Human
ccacugcacuucagucuggg

SEQ ID NO: 80034 - RNA, 21 nt, Human
ccacugcacuucagucugggc

SEQ ID NO: 80035 - RNA, 21 nt, Human
ccacugcacuucagucugggc

SEQ ID NO: 80036 - RNA, 25 nt, Human
ccacugcacuucagucugggccgac

SEQ ID NO: 80037 - RNA, 21 nt, Human
cugauagugagagcugcuuuu

SEQ ID NO: 80038 - RNA, 23 nt, Human
ggacugagaccucaggcagaaaa

SEQ ID NO: 80039 - RNA, 24 nt, Human
uaugauugugccacugcacuucag

SEQ ID NO: 80040 - RNA, 18 nt, Human
ugaccuguggucccagca

SEQ ID NO: 80041 - RNA, 24 nt, Human
uggucccagcaacucgagaggcug

SEQ ID NO: 80042 - RNA, 18 nt, Human
uuuuuuuuuuuuuucuug

SEQ ID NO: 80043 - RNA, 21 nt, Human
uuuuuuuuuuuuuucuugguu

SEQ ID NO: 80044 - RNA, 25 nt, Human
uuuuuuuuuuuuuuuuuucuugguu

SEQ ID NO: 80045 - RNA, 23 nt, Human
uuuuuuuuuuuuuuuuuuuucuu

SEQ ID NO: 80046 - RNA, 24 nt, Human
aaaugcuagagcuaugcaaaaacc

SEQ ID NO: 80047 - RNA, 18 nt, Human
aaccuuggucucccccuu

SEQ ID NO: 80048 - RNA, 19 nt, Human
aacucauuucccaaggucg

SEQ ID NO: 80049 - RNA, 23 nt, Human
aagaaacccagggcaacaacuca

SEQ ID NO: 80050 - RNA, 21 nt, Human
aagcuuggagaccacugaucu

SEQ ID NO: 80051 - RNA, 18 nt, Human
aaggagcaggcuggcuca

SEQ ID NO: 80052 - RNA, 19 nt, Human
acaggaacaaucccuuggu

SEQ ID NO: 80053 - RNA, 22 nt, Human
acaugccagaagccuguuaaca

SEQ ID NO: 80054 - RNA, 25 nt, Human
acauggccuucucuccaaaugcucc

SEQ ID NO: 80055 - RNA, 21 nt, Human
acugcggggcagccugauguc

SEQ ID NO: 80056 - RNA, 21 nt, Human
agacaggaacagucccugagc

SEQ ID NO: 80057 - RNA, 23 nt, Human
agcaggcuggcucaggucggacc

SEQ ID NO: 80058 - RNA, 21 nt, Human
agcccuccagguucuagcccu

SEQ ID NO: 80059 - RNA, 30 nt, Human
agcuucuagcucagguuuuagcuucucuag

SEQ ID NO: 80060 - RNA, 18 nt, Human
aggcagaggagagugggu

SEQ ID NO: 80061 - RNA, 18 nt, Human
aggcagggacaggugguu

SEQ ID NO: 80062 - RNA, 27 nt, Human
agggaccaaacucggggguuucgggag

SEQ ID NO: 80063 - RNA, 27 nt, Human
aggguggugggaaugacagguggaaaa

SEQ ID NO: 80064 - RNA, 20 nt, Human
agguucuagcccuucuuggu

SEQ ID NO: 80065 - RNA, 23 nt, Human
aguauacauacuggguaugcaua

SEQ ID NO: 80066 - RNA, 22 nt, Human
augcuuccuguuuacaacauaa

SEQ ID NO: 80067 - RNA, 25 nt, Human
caacauaacagcucauugagucuuu

SEQ ID NO: 80068 - RNA, 24 nt, Human
cacacucuucuagggcucauacug

SEQ ID NO: 80069 - RNA, 25 nt, Human
caccccuucccaaaggcuucugagu

SEQ ID NO: 80070 - RNA, 23 nt, Human
cacgugcucuggugcugaaugac

SEQ ID NO: 80071 - RNA, 22 nt, Human
cacuccucucccugcccccaac

SEQ ID NO: 80072 - RNA, 21 nt, Human
cacugugauccucugggcaag

SEQ ID NO: 80073 - RNA, 22 nt, Human
cagcaaauaagaacaguaaugc

SEQ ID NO: 80074 - RNA, 22 nt, Human
cagcagcccugcuggcguuugc

SEQ ID NO: 80075 - RNA, 19 nt, Human
cagccaugcucccugcaaa

SEQ ID NO: 80076 - RNA, 22 nt, Human
cagcccuccagguucuagcccu

SEQ ID NO: 80077 - RNA, 22 nt, Human
cagcccuccagguucuaguccu

SEQ ID NO: 80078 - RNA, 23 nt, Human
cagggaccaaacucggggguuuc

SEQ ID NO: 80079 - RNA, 18 nt, Human
caggguggugggaaugac

SEQ ID NO: 80080 - RNA, 18 nt, Human
cauaucacccacagcacc

SEQ ID NO: 80081 - RNA, 19 nt, Human
caucuacaccaugcauagg

SEQ ID NO: 80082 - RNA, 20 nt, Human
cauggccuucucuccaaaug

SEQ ID NO: 80083 - RNA, 26 nt, Human
ccaaugagcaccuacugugugccaga

SEQ ID NO: 80084 - RNA, 20 nt, Human
ccacagcacccugcucgacu

SEQ ID NO: 80085 - RNA, 23 nt, Human
ccagguucuagccugccggguuc

SEQ ID NO: 80086 - RNA, 23 nt, Human
ccagguucuagcuugccagguuc

SEQ ID NO: 80087 - RNA, 20 nt, Human
ccauaucacccacagcaccc

SEQ ID NO: 80088 - RNA, 21 nt, Human
cccacagcacccugcucgacc

SEQ ID NO: 80089 - RNA, 19 nt, Human
cccaggccuccuccacucc

SEQ ID NO: 80090 - RNA, 20 nt, Human
ccccacauggccauugcggc

SEQ ID NO: 80091 - RNA, 26 nt, Human
ccccacauggccauugcggcagagcu

SEQ ID NO: 80092 - RNA, 20 nt, Human
cccccaggccuccuccacuc

SEQ ID NO: 80093 - RNA, 21 nt, Human
cccuccagguucuagcccuuc

SEQ ID NO: 80094 - RNA, 21 nt, Human
cccuccagguucuagcccuuc

SEQ ID NO: 80095 - RNA, 21 nt, Human
cccuccagguucuagcccuuc

SEQ ID NO: 80096 - RNA, 21 nt, Human
cccuccagguucuagcccuuc

SEQ ID NO: 80097 - RNA, 21 nt, Human
cccuccagguucuggcucucc

SEQ ID NO: 80098 - RNA, 20 nt, Human
ccuccuccacuccugggaag

SEQ ID NO: 80099 - RNA, 22 nt, Human
ccugccagguucuagcccucca

SEQ ID NO: 80100 - RNA, 22 nt, Human
ccugccggguucuagcucucca

SEQ ID NO: 80101 - RNA, 22 nt, Human
ccuguguguguggcgguugggg

SEQ ID NO: 80102 - RNA, 19 nt, Human
cgcagacucaguugccccu

SEQ ID NO: 80103 - RNA, 22 nt, Human
cggcaugggcacuucaagucgc

SEQ ID NO: 80104 - RNA, 25 nt, Human
cuagcucuccagauuccagcccucc

SEQ ID NO: 80105 - RNA, 19 nt, Human
cucacauguacguagcacc

SEQ ID NO: 80106 - RNA, 21 nt, Human
cucaguugccccucagaccag

SEQ ID NO: 80107 - RNA, 18 nt, Human
cuccagauuccagcccuc

SEQ ID NO: 80108 - RNA, 18 nt, Human
cuccagauuccagcccuc

SEQ ID NO: 80109 - RNA, 18 nt, Human
cuccagauuccagcccuc

SEQ ID NO: 80110 - RNA, 18 nt, Human
cuccagauucuagcccuc

SEQ ID NO: 80111 - RNA, 18 nt, Human
cuccagauucuagcccuc

SEQ ID NO: 80112 - RNA, 19 nt, Human
cucccugcccccaggccuc

SEQ ID NO: 80113 - RNA, 21 nt, Human
cucuccagguucuagcccuuc

SEQ ID NO: 80114 - RNA, 18 nt, Human
cucuuucuucccucuugc

SEQ ID NO: 80115 - RNA, 23 nt, Human
cugauucugcuccacggagcuau

SEQ ID NO: 80116 - RNA, 25 nt, Human
cugcccccaggccuccuccacuccu

SEQ ID NO: 80117 - RNA, 19 nt, Human
cuggaaccuuggucucccc

SEQ ID NO: 80118 - RNA, 19 nt, Human
cugugcgugaguucacccc

SEQ ID NO: 80119 - RNA, 20 nt, Human
cuguguguguggcgguuggg

SEQ ID NO: 80120 - RNA, 22 nt, Human
cuucccagguaccggcuggugg

SEQ ID NO: 80121 - RNA, 20 nt, Human
cuuccuccagauacuuacug

SEQ ID NO: 80122 - RNA, 18 nt, Human
cuucucccgcagacucag

SEQ ID NO: 80123 - RNA, 19 nt, Human
cuuggucucccccuucugg

SEQ ID NO: 80124 - RNA, 18 nt, Human
gacagauguucuuuauca

SEQ ID NO: 80125 - RNA, 18 nt, Human
gcaccccuucccaaaggc

SEQ ID NO: 80126 - RNA, 22 nt, Human
gcccagucguucccacuugagu

SEQ ID NO: 80127 - RNA, 21 nt, Human
gcggggcagccugaugucccc

SEQ ID NO: 80128 - RNA, 23 nt, Human
ggaacugaggcagggacaggugg

SEQ ID NO: 80129 - RNA, 22 nt, Human
ggaccguccccaccccuccucg

SEQ ID NO: 80130 - RNA, 21 nt, Human
ggccaccuuccaauaaaccau

SEQ ID NO: 80131 - RNA, 19 nt, Human
ggguggugggaaaaaagag

SEQ ID NO: 80132 - RNA, 18 nt, Human
ggguuggggguaaggagg

SEQ ID NO: 80133 - RNA, 21 nt, Human
gguggaagggagccaaugagc

SEQ ID NO: 80134 - RNA, 19 nt, Human
gguugagcuggaaccuugg

SEQ ID NO: 80135 - RNA, 21 nt, Human
gucugcguaaugaugccucac

SEQ ID NO: 80136 - RNA, 25 nt, Human
gugcugcccuggcacugccgauggu

SEQ ID NO: 80137 - RNA, 24 nt, Human
guguguguggcgguuggggccuca

SEQ ID NO: 80138 - RNA, 20 nt, Human
guuacagaagagggaacuga

SEQ ID NO: 80139 - RNA, 21 nt, Human
uaaaauucagaguuggauugg

SEQ ID NO: 80140 - RNA, 24 nt, Human
uaacaaaugcuagagcuaugcaaa

SEQ ID NO: 80141 - RNA, 22 nt, Human
uaaccugccagguucuagcccu

SEQ ID NO: 80142 - RNA, 20 nt, Human
uaaugaugccucacauguac

SEQ ID NO: 80143 - RNA, 24 nt, Human
uacagaagagggaacugaggcagg

SEQ ID NO: 80144 - RNA, 21 nt, Human
uagcccuccagguucauuccc

SEQ ID NO: 80145 - RNA, 22 nt, Human
uagcccuccagguucuagcccu

SEQ ID NO: 80146 - RNA, 22 nt, Human
uagcccuccagguucuagcccu

SEQ ID NO: 80147 - RNA, 22 nt, Human
uagcccuccagguucuagcccu

SEQ ID NO: 80148 - RNA, 22 nt, Human
uagcccuccagguucuagcccu

SEQ ID NO: 80149 - RNA, 22 nt, Human
uagcucuccagauuccagcccu

SEQ ID NO: 80150 - RNA, 22 nt, Human
uagcucuccagauuccagcccu

SEQ ID NO: 80151 - RNA, 22 nt, Human
uagcucuccagauuccagcccu

SEQ ID NO: 80152 - RNA, 24 nt, Human
uagcucuccagauuccagcccucc

SEQ ID NO: 80153 - RNA, 24 nt, Human
uagcucuccagauuccagcccucc

SEQ ID NO: 80154 - RNA, 22 nt, Human
uagcucuccagauucuagcccu

SEQ ID NO: 80155 - RNA, 22 nt, Human
uagcucuccagauucuagcccu

SEQ ID NO: 80156 - RNA, 22 nt, Human
uagcucuccagguucuagcccu

SEQ ID NO: 80157 - RNA, 21 nt, Human
uagcuugccagguucuagccu

SEQ ID NO: 80158 - RNA, 20 nt, Human
uaucagggaccccucagggc

SEQ ID NO: 80159 - RNA, 21 nt, Human
uauucauuuaucaagugaaug

SEQ ID NO: 80160 - RNA, 20 nt, Human
ucacuccucucccugccccc

SEQ ID NO: 80161 - RNA, 24 nt, Human
ucagaccagguguggauccccaca

SEQ ID NO: 80162 - RNA, 19 nt, Human
ucagaccaucacgugcucu

SEQ ID NO: 80163 - RNA, 21 nt, Human
ucaggguggugggaaugacag

SEQ ID NO: 80164 - RNA, 22 nt, Human
ucagucacuccucucccugccc

SEQ ID NO: 80165 - RNA, 20 nt, Human
ucccucaauccuuacacaaa

SEQ ID NO: 80166 - RNA, 19 nt, Human
ucccugcaaaauugggcag

SEQ ID NO: 80167 - RNA, 22 nt, Human
ucccugguacugcggggcagcc

SEQ ID NO: 80168 - RNA, 22 nt, Human
uccuccagcuucuagcucaggu

SEQ ID NO: 80169 - RNA, 25 nt, Human
ucuagcccuccagguucuagcucuc

SEQ ID NO: 80170 - RNA, 25 nt, Human
ucuagcccuccagguucuagcucuc

SEQ ID NO: 80171 - RNA, 25 nt, Human
ucuagcccuccagguucuagcucuc

SEQ ID NO: 80172 - RNA, 25 nt, Human
ucuagcccuccagguucuagcucuc

SEQ ID NO: 80173 - RNA, 25 nt, Human
ucuagcccuccagguucuagcucuc

SEQ ID NO: 80174 - RNA, 25 nt, Human
ucuagcccuccagguucuaguucuc

SEQ ID NO: 80175 - RNA, 25 nt, Human
ucuagcccuccagguucuggcucuc

SEQ ID NO: 80176 - RNA, 26 nt, Human
ucuagcccuucuagguucuagcucuc

SEQ ID NO: 80177 - RNA, 24 nt, Human
ucuagguucuaaccugccagguuc

SEQ ID NO: 80178 - RNA, 19 nt, Human
ucuccagguucuagccucu

SEQ ID NO: 80179 - RNA, 18 nt, Human
ucuccagguucuagcucu

SEQ ID NO: 80180 - RNA, 18 nt, Human
ucucccggagcaagcggc

SEQ ID NO: 80181 - RNA, 25 nt, Human
ucuuucuuaaauuucuacugguuga

SEQ ID NO: 80182 - RNA, 21 nt, Human
ugaaaagcaacugucccucag

SEQ ID NO: 80183 - RNA, 24 nt, Human
ugaauagcaccccuucccaaaggc

SEQ ID NO: 80184 - RNA, 22 nt, Human
ugaggcagaggagagugggugg

SEQ ID NO: 80185 - RNA, 25 nt, Human
ugaggggagccauaaaauccugguc

SEQ ID NO: 80186 - RNA, 23 nt, Human
ugauuuuggaguccuuggcugug

SEQ ID NO: 80187 - RNA, 21 nt, Human
ugccagguucuagcccuccag

SEQ ID NO: 80188 - RNA, 19 nt, Human
ugccagguucuagccugcc

SEQ ID NO: 80189 - RNA, 19 nt, Human
ugcccccaggccuccucca

SEQ ID NO: 80190 - RNA, 20 nt, Human
ugcccccaggccuccuccac

SEQ ID NO: 80191 - RNA, 27 nt, Human
ugcguaaugaugccucacauguacgua

SEQ ID NO: 80192 - RNA, 18 nt, Human
ugcugcccuggcacugcc

SEQ ID NO: 80193 - RNA, 20 nt, Human
ugcuggggcagggacggaga

SEQ ID NO: 80194 - RNA, 18 nt, Human
uggaagggagccaaugag

SEQ ID NO: 80195 - RNA, 20 nt, Human
uggcucagguguggcagcaa

SEQ ID NO: 80196 - RNA, 22 nt, Human
uggcucuccagguucuagcccu

SEQ ID NO: 80197 - RNA, 23 nt, Human
ugggaaugacagguggaagggag

SEQ ID NO: 80198 - RNA, 20 nt, Human
uggggguaaggagggaaucu

SEQ ID NO: 80199 - RNA, 19 nt, Human
uggguuggggguaaggagg

SEQ ID NO: 80200 - RNA, 20 nt, Human
ugguggggggucucagcacu

SEQ ID NO: 80201 - RNA, 22 nt, Human
ugguggggggucucagcacugu

SEQ ID NO: 80202 - RNA, 19 nt, Human
uggugguggggggucucag

SEQ ID NO: 80203 - RNA, 19 nt, Human
ugugauuuuggaguccuug

SEQ ID NO: 80204 - RNA, 20 nt, Human
uguggcgguuggggccucag

SEQ ID NO: 80205 - RNA, 18 nt, Human
uguguggcacaguuugac

SEQ ID NO: 80206 - RNA, 19 nt, Human
uuacugccuuuaacccuca

SEQ ID NO: 80207 - RNA, 22 nt, Human
uucaccccauccucacagccau

SEQ ID NO: 80208 - RNA, 24 nt, Human
uuccuccagauacuuacugaggca

SEQ ID NO: 80209 - RNA, 24 nt, Human
uucuaguucuccagguucuagccu

SEQ ID NO: 80210 - RNA, 24 nt, Human
uucuggcucuccagguucuagccc

SEQ ID NO: 80211 - RNA, 19 nt, Human
uugaguuccuucaagaugg

SEQ ID NO: 80212 - RNA, 24 nt, Human
uugccagguucuagccugccgggu

SEQ ID NO: 80213 - RNA, 18 nt, Human
uuggcacagaccuccuug

SEQ ID NO: 80214 - RNA, 24 nt, Human
uuuacaugauuuucucguuuggau

SEQ ID NO: 80215 - RNA, 21 nt, Human
uuuuugacgcuuuugcuuuaa

SEQ ID NO: 80216 - RNA, 19 nt, Human
agcaggagguggagggggg

SEQ ID NO: 80217 - RNA, 21 nt, Human
agcgggcgggugcgcccgggc

SEQ ID NO: 80218 - RNA, 22 nt, Human
caacauuaucaaggaauguaau

SEQ ID NO: 80219 - RNA, 20 nt, Human
cacaaaccucacgggucccc

SEQ ID NO: 80220 - RNA, 21 nt, Human
cacaaaccucacggguccccg

SEQ ID NO: 80221 - RNA, 26 nt, Human
caccgggcuggcuccucucccccugg

SEQ ID NO: 80222 - RNA, 18 nt, Human
caccugguggaacucggg

SEQ ID NO: 80223 - RNA, 29 nt, Human
cccagccccgguccccgucgccgguuccg

SEQ ID NO: 80224 - RNA, 20 nt, Human
ccccccgagcaggaggugga

SEQ ID NO: 80225 - RNA, 19 nt, Human
ccccgccggccccacagca

SEQ ID NO: 80226 - RNA, 22 nt, Human
ccccgucgcggugcugcucccc

SEQ ID NO: 80227 - RNA, 18 nt, Human
cccgccggccccacagca

SEQ ID NO: 80228 - RNA, 20 nt, Human
ccgauucuggcuccagcgcc

SEQ ID NO: 80229 - RNA, 18 nt, Human
ccggccccacagcagcgg

SEQ ID NO: 80230 - RNA, 18 nt, Human
gagcccgaggcgcuacgg

SEQ ID NO: 80231 - RNA, 19 nt, Human
gaggggcgcaccgggcugg

SEQ ID NO: 80232 - RNA, 23 nt, Human
gcgggacagcgagcgggcgggug

SEQ ID NO: 80233 - RNA, 18 nt, Human
gggacagcgagcgggcgg

SEQ ID NO: 80234 - RNA, 22 nt, Human
gugggugucucauuaaagcccc

SEQ ID NO: 80235 - RNA, 26 nt, Human
uagaaccacuguacuguauaaacuuc

SEQ ID NO: 80236 - RNA, 18 nt, Human
uauguauauauacaaaua

SEQ ID NO: 80237 - RNA, 24 nt, Human
ucaguucuuggcaacggcaacaaa

SEQ ID NO: 80238 - RNA, 22 nt, Human
uccacacaaaccucacgggucc

SEQ ID NO: 80239 - RNA, 20 nt, Human
ucuggucauggacaugucca

SEQ ID NO: 80240 - RNA, 22 nt, Human
uggcaacggcaacaaaccacaa

SEQ ID NO: 80241 - RNA, 23 nt, Human
ugucucaauauaaucuaaucuau

SEQ ID NO: 80242 - RNA, 24 nt, Human
aaaaaaaaaagaagaaauaaagaa

SEQ ID NO: 80243 - RNA, 25 nt, Human
aaaaaaaagaagaaauaaagaaaaa

SEQ ID NO: 80244 - RNA, 25 nt, Human
aaaggggauuaggaacuacgcccuc

SEQ ID NO: 80245 - RNA, 23 nt, Human
aacuacgcccuccccacaaagcc

SEQ ID NO: 80246 - RNA, 21 nt, Human
aagaagaaauaaagaaaaaug

SEQ ID NO: 80247 - RNA, 23 nt, Human
aagauaaaagaggugaaguuuau

SEQ ID NO: 80248 - RNA, 24 nt, Human
acugcacucuugccugggcaacag

SEQ ID NO: 80249 - RNA, 23 nt, Human
agaacaagacugucuccaaaaaa

SEQ ID NO: 80250 - RNA, 23 nt, Human
agaggcugcagugagcugagauc

SEQ ID NO: 80251 - RNA, 24 nt, Human
agaggcugcagugagcugagauca

SEQ ID NO: 80252 - RNA, 24 nt, Human
agccucacggccgcucacagcccc

SEQ ID NO: 80253 - RNA, 19 nt, Human
aggagaaucuguugaaucu

SEQ ID NO: 80254 - RNA, 20 nt, Human
aggcaggagaaucuguugaa

SEQ ID NO: 80255 - RNA, 24 nt, Human
aggcaggagaaucuguugaaucug

SEQ ID NO: 80256 - RNA, 24 nt, Human
agggggcccggggaggcagccuca

SEQ ID NO: 80257 - RNA, 24 nt, Human
aucauaccacugcacucuugccug

SEQ ID NO: 80258 - RNA, 24 nt, Human
caacagaacaagacugucuccaaa

SEQ ID NO: 80259 - RNA, 20 nt, Human
cacagccccgagccccggcc

SEQ ID NO: 80260 - RNA, 23 nt, Human
cacugcacucuugccugggcaac

SEQ ID NO: 80261 - RNA, 24 nt, Human
cacugcacucuugccugggcaaca

SEQ ID NO: 80262 - RNA, 18 nt, Human
cacugccccgccgccgcc

SEQ ID NO: 80263 - RNA, 23 nt, Human
cagccucacggccgcucacagcc

SEQ ID NO: 80264 - RNA, 24 nt, Human
caggccgaggcaggagaaucuguu

SEQ ID NO: 80265 - RNA, 23 nt, Human
ccacaccaccagcucagggggca

SEQ ID NO: 80266 - RNA, 20 nt, Human
ccacugcacucuugccuggg

SEQ ID NO: 80267 - RNA, 21 nt, Human
ccacugcacucuugccugggc

SEQ ID NO: 80268 - RNA, 24 nt, Human
ccacugcacucuugccugggcaac

SEQ ID NO: 80269 - RNA, 19 nt, Human
ccccacaaagccacaccac

SEQ ID NO: 80270 - RNA, 22 nt, Human
ccccgagccccggcggcugccc

SEQ ID NO: 80271 - RNA, 25 nt, Human
cccgagccccggcggcugcccggaa

SEQ ID NO: 80272 - RNA, 19 nt, Human
cccgccgccgccuccuccu

SEQ ID NO: 80273 - RNA, 19 nt, Human
ccgccgccgccuccuccuc

SEQ ID NO: 80274 - RNA, 20 nt, Human
ccucacggccgcucacagcc

SEQ ID NO: 80275 - RNA, 21 nt, Human
ccuguagucccagcuacccgg

SEQ ID NO: 80276 - RNA, 24 nt, Human
ccuguagucccagcuacccggcag

SEQ ID NO: 80277 - RNA, 23 nt, Human
cuccccacaaagccacaccacca

SEQ ID NO: 80278 - RNA, 26 nt, Human
cucucccgccgccgccgcuuuuucau

SEQ ID NO: 80279 - RNA, 19 nt, Human
cugcagugagcugagauca

SEQ ID NO: 80280 - RNA, 20 nt, Human
cugcagugagcugagaucau

SEQ ID NO: 80281 - RNA, 19 nt, Human
cugccccgccgccgccucc

SEQ ID NO: 80282 - RNA, 18 nt, Human
cuggguggcagaggcugc

SEQ ID NO: 80283 - RNA, 19 nt, Human
gaacaagacugucuccaaa

SEQ ID NO: 80284 - RNA, 28 nt, Human
gaacaagacugucuccaaaaaaaaaaga

SEQ ID NO: 80285 - RNA, 25 nt, Human
gcaacagaacaagacugucuccaaa

SEQ ID NO: 80286 - RNA, 24 nt, Human
gccccgagccccggcggcugcccg

SEQ ID NO: 80287 - RNA, 20 nt, Human
gcugagaucauaccacugca

SEQ ID NO: 80288 - RNA, 19 nt, Human
ggcagaggcugcagugagc

SEQ ID NO: 80289 - RNA, 18 nt, Human
ggccgaggcaggagaauc

SEQ ID NO: 80290 - RNA, 18 nt, Human
gguggcagaggcugcagu

SEQ ID NO: 80291 - RNA, 20 nt, Human
gguggcagaggcugcaguga

SEQ ID NO: 80292 - RNA, 22 nt, Human
gucuccaaaaaaaaaagaagaa

SEQ ID NO: 80293 - RNA, 18 nt, Human
uaaaagaggugaaguuua

SEQ ID NO: 80294 - RNA, 28 nt, Human
uaccuuuuuuuuuuuuaaauggaggaaa

SEQ ID NO: 80295 - RNA, 18 nt, Human
uaggaacuacgcccuccc

SEQ ID NO: 80296 - RNA, 23 nt, Human
uaggaacuacgcccuccccacaa

SEQ ID NO: 80297 - RNA, 22 nt, Human
ucacggccgcucacagccccga

SEQ ID NO: 80298 - RNA, 22 nt, Human
uccaaaaaaaaaagaagaaaua

SEQ ID NO: 80299 - RNA, 26 nt, Human
uccaaaaaaaaaagaagaaauaaaga

SEQ ID NO: 80300 - RNA, 22 nt, Human
ucuccaaaaaaaaaagaagaaa

SEQ ID NO: 80301 - RNA, 20 nt, Human
ugcccggaaaggggauuagg

SEQ ID NO: 80302 - RNA, 23 nt, Human
ugccuguagucccagcuacccgg

SEQ ID NO: 80303 - RNA, 19 nt, Human
uucacugccccgccgccgc

SEQ ID NO: 80304 - RNA, 23 nt, Human
aaaagaaaagcaaauuuaaauua

SEQ ID NO: 80305 - RNA, 22 nt, Human
aaacaaaacaaaauuaaaagcc

SEQ ID NO: 80306 - RNA, 21 nt, Human
aaauuaguuuuuuucagagaa

SEQ ID NO: 80307 - RNA, 18 nt, Human
aaugucucaaacaguauc

SEQ ID NO: 80308 - RNA, 22 nt, Human
acaaaacaaaauuaaaagccuu

SEQ ID NO: 80309 - RNA, 18 nt, Human
agagaagaaagggaaagg

SEQ ID NO: 80310 - RNA, 20 nt, Human
agcaucugaucacaucacau

SEQ ID NO: 80311 - RNA, 18 nt, Human
agcccggagcccgucacc

SEQ ID NO: 80312 - RNA, 20 nt, Human
agcccgucacccaaguccgg

SEQ ID NO: 80313 - RNA, 18 nt, Human
aggcacuguggccucggg

SEQ ID NO: 80314 - RNA, 21 nt, Human
agugcaggaaguugagagaga

SEQ ID NO: 80315 - RNA, 22 nt, Human
caaacaaaacaaaauuaaaagc

SEQ ID NO: 80316 - RNA, 22 nt, Human
cagcccccgaugcucuucaccu

SEQ ID NO: 80317 - RNA, 27 nt, Human
caguaaagacaaaaguuucuauuucau

SEQ ID NO: 80318 - RNA, 20 nt, Human
ccuccagaacuaccaucgcu

SEQ ID NO: 80319 - RNA, 21 nt, Human
cuccagaacuaccaucgcucu

SEQ ID NO: 80320 - RNA, 22 nt, Human
cuuuuguggauuuuuucuuuuu

SEQ ID NO: 80321 - RNA, 21 nt, Human
gugaccagguaaagcuuagau

SEQ ID NO: 80322 - RNA, 23 nt, Human
uaagaaccaagugaaaaguguua

SEQ ID NO: 80323 - RNA, 24 nt, Human
uaagaaccaagugaaaaguguuaa

SEQ ID NO: 80324 - RNA, 24 nt, Human
ucaacucaguuaaaaaaaagaaaa

SEQ ID NO: 80325 - RNA, 18 nt, Human
ucagagaagaaagggaaa

SEQ ID NO: 80326 - RNA, 20 nt, Human
ucaguuaaaaaaaagaaaag

SEQ ID NO: 80327 - RNA, 23 nt, Human
ucaguuaaaaaaaagaaaagcaa

SEQ ID NO: 80328 - RNA, 23 nt, Human
ucggccccggagcgaggccucca

SEQ ID NO: 80329 - RNA, 21 nt, Human
ucucaaacaguaucaaacacc

SEQ ID NO: 80330 - RNA, 24 nt, Human
ugaaaacacaucaaucucaauuca

SEQ ID NO: 80331 - RNA, 22 nt, Human
ugagagagauaaaaauccagug

SEQ ID NO: 80332 - RNA, 22 nt, Human
uucagagaagaaagggaaagga

SEQ ID NO: 80333 - RNA, 24 nt, Human
uuuuuuuuuuuuuuuuucaguuuu

SEQ ID NO: 80334 - RNA, 22 nt, Human
uuuuuuuuuuuuuuuuuuucag

SEQ ID NO: 80335 - RNA, 22 nt, Human
acuccagaccuagaccugguca

SEQ ID NO: 80336 - RNA, 21 nt, Human
aggcaggagagaagcugggcc

SEQ ID NO: 80337 - RNA, 23 nt, Human
aggcaggagagaagcugggccug

SEQ ID NO: 80338 - RNA, 24 nt, Human
aggcaggagagaagcugggccugg

SEQ ID NO: 80339 - RNA, 21 nt, Human
ccagaccuagaccuggucaca

SEQ ID NO: 80340 - RNA, 21 nt, Human
cccacgccccuguccagcagg

SEQ ID NO: 80341 - RNA, 22 nt, Human
ggcaggaugguguguccuggcu

SEQ ID NO: 80342 - RNA, 19 nt, Human
ggcucaguguccaagcuga

SEQ ID NO: 80343 - RNA, 22 nt, Human
ucaguguccaagcugaaacucc

SEQ ID NO: 80344 - RNA, 19 nt, Human
uccaagcugaaacuccaga

SEQ ID NO: 80345 - RNA, 21 nt, Human
ugcuuugcuugucugcuuggc

SEQ ID NO: 80346 - RNA, 19 nt, Human
uggaaggcaggagagaagc

SEQ ID NO: 80347 - RNA, 18 nt, Human
uggcuugcuuugcuuguc

SEQ ID NO: 80348 - RNA, 18 nt, Human
uggcuugcuuugcuuguc

SEQ ID NO: 80349 - RNA, 22 nt, Human
uguccaagcugaaacuccagac

SEQ ID NO: 80350 - RNA, 23 nt, Human
aagaaaacauuuuaaugaaggcu

SEQ ID NO: 80351 - RNA, 18 nt, Human
aagcaaagaaaacauuuu

SEQ ID NO: 80352 - RNA, 24 nt, Human
caagcaaagaaaacauuuuaauga

SEQ ID NO: 80353 - RNA, 22 nt, Human
cauuuuaucccaucaagccugg

SEQ ID NO: 80354 - RNA, 21 nt, Human
uaccccuacaguggccccaaa

SEQ ID NO: 80355 - RNA, 23 nt, Human
ucuaauccaaacaggaacccuca

SEQ ID NO: 80356 - RNA, 24 nt, Human
uuaccccuacaguggccccaaaua

SEQ ID NO: 80357 - RNA, 20 nt, Human
uucguuggcaaugccagaug

SEQ ID NO: 80358 - RNA, 18 nt, Human
aagcaacuucuuggguca

SEQ ID NO: 80359 - RNA, 22 nt, Human
cagcagggacuggagcucagga

SEQ ID NO: 80360 - RNA, 24 nt, Human
cccuguggccuggucacgggccuc

SEQ ID NO: 80361 - RNA, 19 nt, Human
gagauugcucaagcuacag

SEQ ID NO: 80362 - RNA, 25 nt, Human
uaaacuggacgcugcgcacaaagca

SEQ ID NO: 80363 - RNA, 22 nt, Human
uaaagcagaaggauccucucca

SEQ ID NO: 80364 - RNA, 19 nt, Human
uaaccagggaauccagcag

SEQ ID NO: 80365 - RNA, 21 nt, Human
ucacgggccucucuggaaucu

SEQ ID NO: 80366 - RNA, 24 nt, Human
ucccuguggccuggucacgggccu

SEQ ID NO: 80367 - RNA, 20 nt, Human
uucaugaaaaagaggaaguu

SEQ ID NO: 80368 - RNA, 22 nt, Human
uuuuuuuuuuuuuuaaacugga

SEQ ID NO: 80369 - RNA, 23 nt, Human
uuuuuuuuuuuuuuuuaaacugg

SEQ ID NO: 80370 - RNA, 22 nt, Human
aagaggaaagaagggugccugg

SEQ ID NO: 80371 - RNA, 25 nt, Human
agaggaaagaagggugccuggagag

SEQ ID NO: 80372 - RNA, 20 nt, Human
aggagcagaacugggguugc

SEQ ID NO: 80373 - RNA, 19 nt, Human
ccggccaggccagcagagc

SEQ ID NO: 80374 - RNA, 23 nt, Human
cuggagaggagcagaacuggggu

SEQ ID NO: 80375 - RNA, 20 nt, Human
ggagaggagcagaacugggg

SEQ ID NO: 80376 - RNA, 19 nt, Human
ugccuggagaggagcagaa

SEQ ID NO: 80377 - RNA, 21 nt, Human
ugccuggagaggagcagaacu

SEQ ID NO: 80378 - RNA, 21 nt, Human
uggagaggagcagaacugggg

SEQ ID NO: 80379 - RNA, 22 nt, Human
uggagaggagcagaacuggggu

SEQ ID NO: 80380 - RNA, 22 nt, Human
uggggaccccacauccauaggg

SEQ ID NO: 80381 - RNA, 24 nt, Human
aaaaagcuucauggggugccucuu

SEQ ID NO: 80382 - RNA, 19 nt, Human
aagacacacacacacacac

SEQ ID NO: 80383 - RNA, 19 nt, Human
aagcacaagacacacacac

SEQ ID NO: 80384 - RNA, 19 nt, Human
aagggaacaugugaugggg

SEQ ID NO: 80385 - RNA, 31 nt, Human
acaagacacacacacacacacacacacacag

SEQ ID NO: 80386 - RNA, 19 nt, Human
acacacacacacacacaca

SEQ ID NO: 80387 - RNA, 23 nt, Human
acacacacacacacacacacaca

SEQ ID NO: 80388 - RNA, 23 nt, Human
acacacacacacacacacacaca

SEQ ID NO: 80389 - RNA, 23 nt, Human
acacacacacacacacacacaca

SEQ ID NO: 80390 - RNA, 23 nt, Human
acacacacacacacacacacaca

SEQ ID NO: 80391 - RNA, 23 nt, Human
acacacacacacacacacacaca

SEQ ID NO: 80392 - RNA, 23 nt, Human
acacacacacacacacacacaca

SEQ ID NO: 80393 - RNA, 23 nt, Human
acacacacacacacacacacaca

SEQ ID NO: 80394 - RNA, 23 nt, Human
acacacacacacacacacacaca

SEQ ID NO: 80395 - RNA, 23 nt, Human
acacacacacacacacacacaca

SEQ ID NO: 80396 - RNA, 23 nt, Human
acacacacacacacacacacaca

SEQ ID NO: 80397 - RNA, 23 nt, Human
acacacacacacacacacacaca

SEQ ID NO: 80398 - RNA, 23 nt, Human
acacacacacacacacacacaca

SEQ ID NO: 80399 - RNA, 24 nt, Human
acaggccaccaagcucagaagcga

SEQ ID NO: 80400 - RNA, 19 nt, Human
agaaagcagucccagcuca

SEQ ID NO: 80401 - RNA, 19 nt, Human
agagaggaaggacggggaa

SEQ ID NO: 80402 - RNA, 21 nt, Human
agaggaaggacggggaaagag

SEQ ID NO: 80403 - RNA, 30 nt, Human
agcacaagacacacacacacacacacacag

SEQ ID NO: 80404 - RNA, 18 nt, Human
agcagccccuccuugcgc

SEQ ID NO: 80405 - RNA, 24 nt, Human
agcagcuacucacuccugggcagu

SEQ ID NO: 80406 - RNA, 25 nt, Human
agccaccgaccucagaagcagcccc

SEQ ID NO: 80407 - RNA, 20 nt, Human
agccuuggacacuuggguuu

SEQ ID NO: 80408 - RNA, 22 nt, Human
aggcgaagccagguucggagag

SEQ ID NO: 80409 - RNA, 29 nt, Human
aggcggugauggggcaucgagcugggguc

SEQ ID NO: 80410 - RNA, 18 nt, Human
agggacccgagguggggg

SEQ ID NO: 80411 - RNA, 19 nt, Human
agggagaggcggugauggg

SEQ ID NO: 80412 - RNA, 21 nt, Human
agucggggaggguugaaaggc

SEQ ID NO: 80413 - RNA, 21 nt, Human
auggagggaacaggccaccaa

SEQ ID NO: 80414 - RNA, 20 nt, Human
cacacacacacacacacaca

SEQ ID NO: 80415 - RNA, 20 nt, Human
cacacacacacacacacaca

SEQ ID NO: 80416 - RNA, 20 nt, Human
cacacacacacacacacaca

SEQ ID NO: 80417 - RNA, 20 nt, Human
cacacacacacacacacaca

SEQ ID NO: 80418 - RNA, 20 nt, Human
cacacacacacacacacaca

SEQ ID NO: 80419 - RNA, 20 nt, Human
cacacacacacacacacaca

SEQ ID NO: 80420 - RNA, 20 nt, Human
cacacacacacacacacaca

SEQ ID NO: 80421 - RNA, 20 nt, Human
cacacacacacacacacaca

SEQ ID NO: 80422 - RNA, 20 nt, Human
cacacacacacacacacaca

SEQ ID NO: 80423 - RNA, 20 nt, Human
cacacacacacacacacaca

SEQ ID NO: 80424 - RNA, 20 nt, Human
cacacacacacacacacaca

SEQ ID NO: 80425 - RNA, 20 nt, Human
cacacacacacacacacaca

SEQ ID NO: 80426 - RNA, 20 nt, Human
cacacacacacacacacaca

SEQ ID NO: 80427 - RNA, 20 nt, Human
cacacacacacacacacaca

SEQ ID NO: 80428 - RNA, 20 nt, Human
cacacacacacacacacaca

SEQ ID NO: 80429 - RNA, 20 nt, Human
cacacacacacacacacaca

SEQ ID NO: 80430 - RNA, 22 nt, Human
cacacacacacacacacacaca

SEQ ID NO: 80431 - RNA, 22 nt, Human
cacacacacacacacacacaca

SEQ ID NO: 80432 - RNA, 22 nt, Human
cacacacacacacacacacaca

SEQ ID NO: 80433 - RNA, 22 nt, Human
cacacacacacacacacacaca

SEQ ID NO: 80434 - RNA, 22 nt, Human
cacacacacacacacacacaca

SEQ ID NO: 80435 - RNA, 22 nt, Human
cacacacacacacacacacaca

SEQ ID NO: 80436 - RNA, 22 nt, Human
cacacacacacacacacacaca

SEQ ID NO: 80437 - RNA, 22 nt, Human
cacacacacacacacacacaca

SEQ ID NO: 80438 - RNA, 26 nt, Human
cacacacacacacacacacacacaca

SEQ ID NO: 80439 - RNA, 26 nt, Human
cacacacacacacacacacacacaca

SEQ ID NO: 80440 - RNA, 26 nt, Human
cacacacacacacacacacacacaca

SEQ ID NO: 80441 - RNA, 26 nt, Human
cacacacacacacacacacacacaca

SEQ ID NO: 80442 - RNA, 26 nt, Human
cacacacacacacacacacacacaca

SEQ ID NO: 80443 - RNA, 26 nt, Human
cacacacacacacacacacacacaca

SEQ ID NO: 80444 - RNA, 26 nt, Human
cacacacacacacacacacacacaca

SEQ ID NO: 80445 - RNA, 23 nt, Human
cacacacacacacacacacacag

SEQ ID NO: 80446 - RNA, 22 nt, Human
caccucccaaccuccuccggga

SEQ ID NO: 80447 - RNA, 21 nt, Human
cagagacccccacugaggccc

SEQ ID NO: 80448 - RNA, 21 nt, Human
cagcucaaggcagaaggccag

SEQ ID NO: 80449 - RNA, 20 nt, Human
ccaccaagcucagaagcgag

SEQ ID NO: 80450 - RNA, 24 nt, Human
ccaccaagcucagaagcgagaaag

SEQ ID NO: 80451 - RNA, 19 nt, Human
ccaucaggaugucuggcug

SEQ ID NO: 80452 - RNA, 19 nt, Human
cccaccugcacccuuggga

SEQ ID NO: 80453 - RNA, 22 nt, Human
cccagagacccccacugaggcc

SEQ ID NO: 80454 - RNA, 19 nt, Human
cccagcucaaggcagaagg

SEQ ID NO: 80455 - RNA, 18 nt, Human
ccccacugaggccccgcg

SEQ ID NO: 80456 - RNA, 20 nt, Human
ccccagagacccccacugag

SEQ ID NO: 80457 - RNA, 21 nt, Human
ccccagagacccccacugagg

SEQ ID NO: 80458 - RNA, 25 nt, Human
ccccagagacccccacugaggcccc

SEQ ID NO: 80459 - RNA, 27 nt, Human
cccgcgguggcugcagcugccguacac

SEQ ID NO: 80460 - RNA, 18 nt, Human
cccuugggagccagggag

SEQ ID NO: 80461 - RNA, 21 nt, Human
ccgccuccuggcugcugaccc

SEQ ID NO: 80462 - RNA, 18 nt, Human
ccucagaagcagccccuc

SEQ ID NO: 80463 - RNA, 18 nt, Human
ccuggcugcugacccagg

SEQ ID NO: 80464 - RNA, 18 nt, Human
ccuggcugcugacccagg

SEQ ID NO: 80465 - RNA, 19 nt, Human
ccuggcugcugacccaggg

SEQ ID NO: 80466 - RNA, 20 nt, Human
ccuggcuuagcuuccuggcc

SEQ ID NO: 80467 - RNA, 19 nt, Human
ccugggcaguuuguggaga

SEQ ID NO: 80468 - RNA, 22 nt, Human
ccuuggacacuuggguuuggga

SEQ ID NO: 80469 - RNA, 24 nt, Human
cggacagacagaaagcagucccag

SEQ ID NO: 80470 - RNA, 21 nt, Human
cggaccgaaagcagcuacuca

SEQ ID NO: 80471 - RNA, 21 nt, Human
cggugauggggcaucgagcug

SEQ ID NO: 80472 - RNA, 23 nt, Human
cggugauggggcaucgagcuggg

SEQ ID NO: 80473 - RNA, 18 nt, Human
cuggguuggacgcagcug

SEQ ID NO: 80474 - RNA, 19 nt, Human
cuguggugggagagcaggg

SEQ ID NO: 80475 - RNA, 21 nt, Human
cuuccuggcucugccucccca

SEQ ID NO: 80476 - RNA, 20 nt, Human
cuucuaggaaaaccgguguc

SEQ ID NO: 80477 - RNA, 20 nt, Human
gaaaggcuggaaaugcauga

SEQ ID NO: 80478 - RNA, 20 nt, Human
gacacuuggguuugggagug

SEQ ID NO: 80479 - RNA, 22 nt, Human
gaccuagccaccagugggccag

SEQ ID NO: 80480 - RNA, 18 nt, Human
gaccuggagaggggaggc

SEQ ID NO: 80481 - RNA, 19 nt, Human
gagaacagaagggaggacc

SEQ ID NO: 80482 - RNA, 22 nt, Human
gagaccuagccaccagugggcc

SEQ ID NO: 80483 - RNA, 21 nt, Human
gagaggggaggcgccaggcgc

SEQ ID NO: 80484 - RNA, 18 nt, Human
gagccuuggacacuuggg

SEQ ID NO: 80485 - RNA, 18 nt, Human
gagcuggggucagggacc

SEQ ID NO: 80486 - RNA, 27 nt, Human
gagcuggggucagggacccgagguggg

SEQ ID NO: 80487 - RNA, 19 nt, Human
gaggaacagaacaugugug

SEQ ID NO: 80488 - RNA, 23 nt, Human
gaggguugaaaggcuggaaaugc

SEQ ID NO: 80489 - RNA, 31 nt, Human
gcacaagacacacacacacacacacacacag

SEQ ID NO: 80490 - RNA, 19 nt, Human
gcacccuugggagccaggg

SEQ ID NO: 80491 - RNA, 22 nt, Human
gcagcucugaggccaagggaac

SEQ ID NO: 80492 - RNA, 21 nt, Human
gcaggggcagcucugaggcca

SEQ ID NO: 80493 - RNA, 24 nt, Human
gccaagggaacaugugaugggggc

SEQ ID NO: 80494 - RNA, 18 nt, Human
gccuccaccucccaaccu

SEQ ID NO: 80495 - RNA, 27 nt, Human
gccuccaccucccaaccuccuccggga

SEQ ID NO: 80496 - RNA, 23 nt, Human
gccuuggacacuuggguuuggga

SEQ ID NO: 80497 - RNA, 20 nt, Human
gcuguggugggagagcaggg

SEQ ID NO: 80498 - RNA, 22 nt, Human
gcuuagcuuccuggcucugccu

SEQ ID NO: 80499 - RNA, 23 nt, Human
ggacaggugcggcagcccuggca

SEQ ID NO: 80500 - RNA, 20 nt, Human
ggaccuggagaggggaggcg

SEQ ID NO: 80501 - RNA, 22 nt, Human
ggagagcaggggcagcucugag

SEQ ID NO: 80502 - RNA, 21 nt, Human
ggagccgcagagucggggagg

SEQ ID NO: 80503 - RNA, 24 nt, Human
ggaggguugaaaggcuggaaaugc

SEQ ID NO: 80504 - RNA, 20 nt, Human
ggcaggcuggggagaccgcu

SEQ ID NO: 80505 - RNA, 23 nt, Human
ggcaggggcugggugcaggccgg

SEQ ID NO: 80506 - RNA, 20 nt, Human
ggccuccaccucccaaccuc

SEQ ID NO: 80507 - RNA, 21 nt, Human
ggcgggcugggguggugggcc

SEQ ID NO: 80508 - RNA, 20 nt, Human
ggcuggguuggacgcagcug

SEQ ID NO: 80509 - RNA, 18 nt, Human
gggaacaugugauggggg

SEQ ID NO: 80510 - RNA, 21 nt, Human
gggcagcucugaggccaaggg

SEQ ID NO: 80511 - RNA, 22 nt, Human
gggcaggggcugggugcaggcc

SEQ ID NO: 80512 - RNA, 19 nt, Human
gggcugggguggugggccg

SEQ ID NO: 80513 - RNA, 23 nt, Human
gggcuggguuggacgcagcuggg

SEQ ID NO: 80514 - RNA, 18 nt, Human
ggggggcuggguuggacg

SEQ ID NO: 80515 - RNA, 19 nt, Human
ggucugggagggacaggcc

SEQ ID NO: 80516 - RNA, 21 nt, Human
gugaacgagaaaaaagcuuca

SEQ ID NO: 80517 - RNA, 22 nt, Human
uagcuuccuggcucugccuccc

SEQ ID NO: 80518 - RNA, 19 nt, Human
uaggaaaaccggugucugg

SEQ ID NO: 80519 - RNA, 19 nt, Human
ucacguugcacgguguuuc

SEQ ID NO: 80520 - RNA, 26 nt, Human
uccccagagacccccacugaggcccc

SEQ ID NO: 80521 - RNA, 20 nt, Human
uccuggcugcugacccaggg

SEQ ID NO: 80522 - RNA, 19 nt, Human
ucuggcuguguuccccaga

SEQ ID NO: 80523 - RNA, 18 nt, Human
ugaaaggcuggaaaugca

SEQ ID NO: 80524 - RNA, 24 nt, Human
ugaaaggcuggaaaugcaugagga

SEQ ID NO: 80525 - RNA, 20 nt, Human
ugacccagggacuguucucc

SEQ ID NO: 80526 - RNA, 24 nt, Human
ugacuaguuggcgggccgucaccg

SEQ ID NO: 80527 - RNA, 22 nt, Human
ugaggccaagggaacaugugau

SEQ ID NO: 80528 - RNA, 22 nt, Human
ugaggggagccgcagagucggg

SEQ ID NO: 80529 - RNA, 19 nt, Human
ugauggggcaucgagcugg

SEQ ID NO: 80530 - RNA, 24 nt, Human
ugcaugaggaggaggaacagaaca

SEQ ID NO: 80531 - RNA, 19 nt, Human
uggaaagacagccaccgac

SEQ ID NO: 80532 - RNA, 18 nt, Human
uggcgggcugggguggug

SEQ ID NO: 80533 - RNA, 19 nt, Human
uggcgggcugggguggugg

SEQ ID NO: 80534 - RNA, 19 nt, Human
uggcuguguuccccagaga

SEQ ID NO: 80535 - RNA, 18 nt, Human
ugggagggacaggccaug

SEQ ID NO: 80536 - RNA, 21 nt, Human
ugggccagugggggugagggg

SEQ ID NO: 80537 - RNA, 18 nt, Human
ugggccuccaccucccaa

SEQ ID NO: 80538 - RNA, 18 nt, Human
ugggggcaaggccugagc

SEQ ID NO: 80539 - RNA, 23 nt, Human
uggggggcuggguuggacgcagc

SEQ ID NO: 80540 - RNA, 18 nt, Human
uggguggcugugguggga

SEQ ID NO: 80541 - RNA, 22 nt, Human
uuccuggcucugccuccccauc

SEQ ID NO: 80542 - RNA, 21 nt, Human
uucuccuaggacuggagccuu

SEQ ID NO: 80543 - RNA, 20 nt, Human
uuuuuuuuuuuuuuuuucac

SEQ ID NO: 80544 - RNA, 23 nt, Human
uuuuuuuuuuuuuuuuucacguu

SEQ ID NO: 80545 - RNA, 29 nt, Human
uuuuuuuuuuuuuuuuuucacguugauua

SEQ ID NO: 80546 - RNA, 20 nt, Human
aaacaggaacuccgaaugua

SEQ ID NO: 80547 - RNA, 19 nt, Human
aaagcugaacauuagaaaa

SEQ ID NO: 80548 - RNA, 24 nt, Human
aacagcagcagcaaaugcaccaaa

SEQ ID NO: 80549 - RNA, 20 nt, Human
aacuauguacauaagagcca

SEQ ID NO: 80550 - RNA, 22 nt, Human
aagaaauuaagaugaguccauu

SEQ ID NO: 80551 - RNA, 18 nt, Human
aagagccaccuuguaggc

SEQ ID NO: 80552 - RNA, 28 nt, Human
aagccagagccuggaggcuugcaagaga

SEQ ID NO: 80553 - RNA, 20 nt, Human
aagcuuucuuugugauuauc

SEQ ID NO: 80554 - RNA, 21 nt, Human
aagcuuucuuugugauuaucu

SEQ ID NO: 80555 - RNA, 22 nt, Human
aaugacaaaaaaaagguguaaa

SEQ ID NO: 80556 - RNA, 19 nt, Human
acaaaaauagcaugucaga

SEQ ID NO: 80557 - RNA, 24 nt, Human
acaguagcaacagcagcagcaaaa

SEQ ID NO: 80558 - RNA, 23 nt, Human
accugcuguuccaugucaacucc

SEQ ID NO: 80559 - RNA, 24 nt, Human
acuagaauauaaagguaauuucua

SEQ ID NO: 80560 - RNA, 19 nt, Human
agaaacugcauccucacuu

SEQ ID NO: 80561 - RNA, 18 nt, Human
agcaacagcagcagcaaa

SEQ ID NO: 80562 - RNA, 18 nt, Human
agcugguuucucacagac

SEQ ID NO: 80563 - RNA, 21 nt, Human
aggauauaucaguuuggacuu

SEQ ID NO: 80564 - RNA, 19 nt, Human
aggaucuuuuacagcuggu

SEQ ID NO: 80565 - RNA, 26 nt, Human
aggcaaacaguagcaacagcagcagc

SEQ ID NO: 80566 - RNA, 23 nt, Human
auccaucuccuucccugacuuag

SEQ ID NO: 80567 - RNA, 21 nt, Human
auucuggccuucucauccauc

SEQ ID NO: 80568 - RNA, 20 nt, Human
caaaacaggaacuccgaaug

SEQ ID NO: 80569 - RNA, 23 nt, Human
caccaaacugacgaaaagaccca

SEQ ID NO: 80570 - RNA, 23 nt, Human
cagagccuggaggcuugcaagag

SEQ ID NO: 80571 - RNA, 21 nt, Human
cauggccuaaaagggggcaaa

SEQ ID NO: 80572 - RNA, 20 nt, Human
caugucaacuccaaagacgu

SEQ ID NO: 80573 - RNA, 20 nt, Human
ccccgggguucaccuagcuc

SEQ ID NO: 80574 - RNA, 24 nt, Human
ccuauaguuauagauaucuuaaaa

SEQ ID NO: 80575 - RNA, 20 nt, Human
ccucccuuaaagaccuuaag

SEQ ID NO: 80576 - RNA, 18 nt, Human
cucacagacaguauuuaa

SEQ ID NO: 80577 - RNA, 22 nt, Human
cucauagucagacuguuguguc

SEQ ID NO: 80578 - RNA, 22 nt, Human
cucuguacaauaaucuguggga

SEQ ID NO: 80579 - RNA, 27 nt, Human
cugaaaauacuagaauauaaagguaau

SEQ ID NO: 80580 - RNA, 21 nt, Human
cugaacauuagaaaauacuga

SEQ ID NO: 80581 - RNA, 24 nt, Human
gacaaaaaaaagguguaaaucuga

SEQ ID NO: 80582 - RNA, 18 nt, Human
gacccagauauuuuccuc

SEQ ID NO: 80583 - RNA, 26 nt, Human
gacuuagaagaaauuaagaugagucc

SEQ ID NO: 80584 - RNA, 22 nt, Human
gcugaacauuagaaaauacuga

SEQ ID NO: 80585 - RNA, 19 nt, Human
gcuugaaccuccguccuuc

SEQ ID NO: 80586 - RNA, 19 nt, Human
ggaucugugcgucuccagu

SEQ ID NO: 80587 - RNA, 21 nt, Human
ggcagcuuugagaacuagcuc

SEQ ID NO: 80588 - RNA, 21 nt, Human
gggggaucugugcgucuccag

SEQ ID NO: 80589 - RNA, 19 nt, Human
gguggggggaagaaaggga

SEQ ID NO: 80590 - RNA, 21 nt, Human
uaaaaagagccucaaucuguu

SEQ ID NO: 80591 - RNA, 22 nt, Human
uaagagauaccauuuaaaccac

SEQ ID NO: 80592 - RNA, 18 nt, Human
uaagagccaccuuguagg

SEQ ID NO: 80593 - RNA, 20 nt, Human
uacauugggaacgagcaggu

SEQ ID NO: 80594 - RNA, 23 nt, Human
uaccaagcauaagcauuguaaca

SEQ ID NO: 80595 - RNA, 22 nt, Human
uagaaaauacugaagaguaaau

SEQ ID NO: 80596 - RNA, 23 nt, Human
uagaugcacuugagauguguaug

SEQ ID NO: 80597 - RNA, 22 nt, Human
uagguaauagaauuuauggagu

SEQ ID NO: 80598 - RNA, 23 nt, Human
ucaacugcuguucguuuccucug

SEQ ID NO: 80599 - RNA, 20 nt, Human
ucuagacaaggucuugguuu

SEQ ID NO: 80600 - RNA, 21 nt, Human
ucucucgcucucccucuucag

SEQ ID NO: 80601 - RNA, 24 nt, Human
ugaaaauacuagaauauaaaggua

SEQ ID NO: 80602 - RNA, 21 nt, Human
ugacgaaaagacccagauauu

SEQ ID NO: 80603 - RNA, 24 nt, Human
ugcaccaaacugacgaaaagaccc

SEQ ID NO: 80604 - RNA, 19 nt, Human
uggagggugggguggugcg

SEQ ID NO: 80605 - RNA, 24 nt, Human
ugggggauuaaaaaaaagagccag

SEQ ID NO: 80606 - RNA, 19 nt, Human
ugggguggugcgggaugag

SEQ ID NO: 80607 - RNA, 21 nt, Human
ugguaucugguuuggucucca

SEQ ID NO: 80608 - RNA, 20 nt, Human
uguaaaucugagaacuguag

SEQ ID NO: 80609 - RNA, 22 nt, Human
uguauguauagauaccuaucua

SEQ ID NO: 80610 - RNA, 23 nt, Human
uguuguucuuguuuaugccuguc

SEQ ID NO: 80611 - RNA, 20 nt, Human
uguuguuguuuuuuguuuuc

SEQ ID NO: 80612 - RNA, 24 nt, Human
uguuucgauuuuuggggcucugua

SEQ ID NO: 80613 - RNA, 20 nt, Human
uuagaaaauacugaagagua

SEQ ID NO: 80614 - RNA, 19 nt, Human
uuaguguguggaggguggg

SEQ ID NO: 80615 - RNA, 18 nt, Human
uucauggucaauuucuca

SEQ ID NO: 80616 - RNA, 19 nt, Human
uucauggucaauuucucaa

SEQ ID NO: 80617 - RNA, 22 nt, Human
uuggggcucuguacaauaaucu

SEQ ID NO: 80618 - RNA, 21 nt, Human
uugguuuaagccuuauuaaaa

SEQ ID NO: 80619 - RNA, 19 nt, Human
uuguuuuuuguuuuguuuu

SEQ ID NO: 80620 - RNA, 24 nt, Human
uuuaaacacagcguuugaggcaaa

SEQ ID NO: 80621 - RNA, 24 nt, Human
uuuucagcaaauccuccccaaaag

SEQ ID NO: 80622 - RNA, 24 nt, Human
uuuuuuuuuuuuuuuuuuaauugg

SEQ ID NO: 80623 - RNA, 19 nt, Human
aaagugcugggauugcagg

SEQ ID NO: 80624 - RNA, 20 nt, Human
aaagugcugggauugcaggu

SEQ ID NO: 80625 - RNA, 24 nt, Human
aaagugcugggauugcagguguga

SEQ ID NO: 80626 - RNA, 18 nt, Human
aacgguuccaggucaggc

SEQ ID NO: 80627 - RNA, 18 nt, Human
aagugcugggauugcagg

SEQ ID NO: 80628 - RNA, 19 nt, Human
aagugcugggauugcaggu

SEQ ID NO: 80629 - RNA, 24 nt, Human
aauuuuuguauuuugguagagaca

SEQ ID NO: 80630 - RNA, 20 nt, Human
acaggguuucaccauguugg

SEQ ID NO: 80631 - RNA, 21 nt, Human
acaggguuucaccauguuggu

SEQ ID NO: 80632 - RNA, 24 nt, Human
acaggguuucaccauguuggucag

SEQ ID NO: 80633 - RNA, 24 nt, Human
accauguuggucaggcuggucuug

SEQ ID NO: 80634 - RNA, 22 nt, Human
accucagcugcucagcagcugg

SEQ ID NO: 80635 - RNA, 18 nt, Human
acucugucacccaggcug

SEQ ID NO: 80636 - RNA, 26 nt, Human
acucugucacccaggcugaagugcaa

SEQ ID NO: 80637 - RNA, 20 nt, Human
acugcaagcuccgccuccug

SEQ ID NO: 80638 - RNA, 24 nt, Human
agcgauucuccugccucagccucc

SEQ ID NO: 80639 - RNA, 18 nt, Human
agcuccgccuccuggguu

SEQ ID NO: 80640 - RNA, 24 nt, Human
aggcugaagugcaauggccugauc

SEQ ID NO: 80641 - RNA, 24 nt, Human
aggugauccgcccgccucggccuc

SEQ ID NO: 80642 - RNA, 23 nt, Human
aggugugagucacuucgccuggc

SEQ ID NO: 80643 - RNA, 18 nt, Human
aguagcugggauuacagg

SEQ ID NO: 80644 - RNA, 24 nt, Human
agugcaauggccugaucucggcuc

SEQ ID NO: 80645 - RNA, 22 nt, Human
auuucaggguuuucuuucacua

SEQ ID NO: 80646 - RNA, 24 nt, Human
auuuugguagagacaggguuucac

SEQ ID NO: 80647 - RNA, 24 nt, Human
caaagugcugggauugcaggugug

SEQ ID NO: 80648 - RNA, 22 nt, Human
caagcgauucuccugccucagc

SEQ ID NO: 80649 - RNA, 19 nt, Human
caaguaucuagcuuaguca

SEQ ID NO: 80650 - RNA, 21 nt, Human
caccauguuggucaggcuggu

SEQ ID NO: 80651 - RNA, 24 nt, Human
caccauguuggucaggcuggucuu

SEQ ID NO: 80652 - RNA, 23 nt, Human
cacccaggcugaagugcaauggc

SEQ ID NO: 80653 - RNA, 23 nt, Human
cacucugucacccaggcugaagu

SEQ ID NO: 80654 - RNA, 24 nt, Human
cacucugucacccaggcugaagug

SEQ ID NO: 80655 - RNA, 23 nt, Human
cagcaggagcucaauaugcacag

SEQ ID NO: 80656 - RNA, 24 nt, Human
caggguuucaccauguuggucagg

SEQ ID NO: 80657 - RNA, 21 nt, Human
caugcccggcuaauuuuugua

SEQ ID NO: 80658 - RNA, 24 nt, Human
cauguuggucaggcuggucuugaa

SEQ ID NO: 80659 - RNA, 20 nt, Human
ccaaagugcugggauugcag

SEQ ID NO: 80660 - RNA, 21 nt, Human
ccaaagugcugggauugcagg

SEQ ID NO: 80661 - RNA, 24 nt, Human
ccaaagugcugggauugcaggugu

SEQ ID NO: 80662 - RNA, 23 nt, Human
cccgaguagcugggauuacaggc

SEQ ID NO: 80663 - RNA, 24 nt, Human
cccgaguagcugggauuacaggca

SEQ ID NO: 80664 - RNA, 23 nt, Human
ccgaguagcugggauuacaggca

SEQ ID NO: 80665 - RNA, 24 nt, Human
ccgccuccuggguucaagcgauuc

SEQ ID NO: 80666 - RNA, 23 nt, Human
ccuggguucaagcgauucuccug

SEQ ID NO: 80667 - RNA, 23 nt, Human
cucagccucccgaguagcuggga

SEQ ID NO: 80668 - RNA, 21 nt, Human
cuccuggguucaagcgauucu

SEQ ID NO: 80669 - RNA, 22 nt, Human
cucucgcuucucuuugcaucuc

SEQ ID NO: 80670 - RNA, 21 nt, Human
cugaccucaggugauccgccc

SEQ ID NO: 80671 - RNA, 23 nt, Human
cugccucagccucccgaguagcu

SEQ ID NO: 80672 - RNA, 26 nt, Human
cugcugaccucaggugauccgcccgc

SEQ ID NO: 80673 - RNA, 20 nt, Human
cuggaagggaaggggcugca

SEQ ID NO: 80674 - RNA, 24 nt, Human
gaccucaggugauccgcccgccuc

SEQ ID NO: 80675 - RNA, 25 nt, Human
gaguagcugggauuacaggcacccg

SEQ ID NO: 80676 - RNA, 22 nt, Human
gauuacaggcacccgccaucau

SEQ ID NO: 80677 - RNA, 24 nt, Human
gauugcaggugugagucacuucgc

SEQ ID NO: 80678 - RNA, 20 nt, Human
gcacacacuugugggcugga

SEQ ID NO: 80679 - RNA, 21 nt, Human
gcagcaccucagcugcucagc

SEQ ID NO: 80680 - RNA, 22 nt, Human
gcccggcuaauuuuuguauuuu

SEQ ID NO: 80681 - RNA, 20 nt, Human
gccucagccucccgaguagc

SEQ ID NO: 80682 - RNA, 25 nt, Human
gccuccuggguucaagcgauucucc

SEQ ID NO: 80683 - RNA, 23 nt, Human
gccucggccucccaaagugcugg

SEQ ID NO: 80684 - RNA, 24 nt, Human
gcgauucuccugccucagccuccc

SEQ ID NO: 80685 - RNA, 19 nt, Human
gcugaagugcaauggccug

SEQ ID NO: 80686 - RNA, 24 nt, Human
ggauuacaggcacccgccaucaug

SEQ ID NO: 80687 - RNA, 18 nt, Human
ggauugccuuuggaguca

SEQ ID NO: 80688 - RNA, 19 nt, Human
ggcauggugaggaugaagg

SEQ ID NO: 80689 - RNA, 24 nt, Human
ggcuggucuugaacugcugaccuc

SEQ ID NO: 80690 - RNA, 18 nt, Human
gggcauggugaggaugaa

SEQ ID NO: 80691 - RNA, 18 nt, Human
gggcuggaagggaagggg

SEQ ID NO: 80692 - RNA, 22 nt, Human
ggguuucaccauguuggucagg

SEQ ID NO: 80693 - RNA, 19 nt, Human
ggucuugaacugcugaccu

SEQ ID NO: 80694 - RNA, 21 nt, Human
guagagacaggguuucaccau

SEQ ID NO: 80695 - RNA, 22 nt, Human
guagagacaggguuucaccaug

SEQ ID NO: 80696 - RNA, 23 nt, Human
gugaggaacgguuccaggucagg

SEQ ID NO: 80697 - RNA, 24 nt, Human
gugauccgcccgccucggccuccc

SEQ ID NO: 80698 - RNA, 18 nt, Human
uaaaaaaagcagacucau

SEQ ID NO: 80699 - RNA, 23 nt, Human
uaauuuuuguauuuugguagaga

SEQ ID NO: 80700 - RNA, 23 nt, Human
uacaggcacccgccaucaugccc

SEQ ID NO: 80701 - RNA, 22 nt, Human
uagagacaggguuucaccaugu

SEQ ID NO: 80702 - RNA, 18 nt, Human
uagcagggcauggugagg

SEQ ID NO: 80703 - RNA, 18 nt, Human
uauuuugguagagacagg

SEQ ID NO: 80704 - RNA, 19 nt, Human
ucaagcgauucuccugccu

SEQ ID NO: 80705 - RNA, 18 nt, Human
ucacugcaagcuccgccu

SEQ ID NO: 80706 - RNA, 23 nt, Human
ucacugcaagcuccgccuccugg

SEQ ID NO: 80707 - RNA, 24 nt, Human
ucacugcaagcuccgccuccuggg

SEQ ID NO: 80708 - RNA, 27 nt, Human
ucacugcaagcuccgccuccuggguuc

SEQ ID NO: 80709 - RNA, 23 nt, Human
ucagcagcuggagauagcagggc

SEQ ID NO: 80710 - RNA, 20 nt, Human
ucagccucccgaguagcugg

SEQ ID NO: 80711 - RNA, 23 nt, Human
ucccaaagugcugggauugcagg

SEQ ID NO: 80712 - RNA, 24 nt, Human
ucccgaguagcugggauuacaggc

SEQ ID NO: 80713 - RNA, 21 nt, Human
uccuggguucaagcgauucuc

SEQ ID NO: 80714 - RNA, 24 nt, Human
uccuggguucaagcgauucuccug

SEQ ID NO: 80715 - RNA, 18 nt, Human
ucggccucccaaagugcu

SEQ ID NO: 80716 - RNA, 19 nt, Human
ucucacucugucacccagg

SEQ ID NO: 80717 - RNA, 24 nt, Human
ucucacucugucacccaggcugaa

SEQ ID NO: 80718 - RNA, 26 nt, Human
ucucacucugucacccaggcugaagu

SEQ ID NO: 80719 - RNA, 27 nt, Human
ucucacucugucacccaggcugaagug

SEQ ID NO: 80720 - RNA, 24 nt, Human
ucuccugccucagccucccgagua

SEQ ID NO: 80721 - RNA, 24 nt, Human
ucugucacccaggcugaagugcaa

SEQ ID NO: 80722 - RNA, 22 nt, Human
ucuuuucuuugggauugccuuu

SEQ ID NO: 80723 - RNA, 19 nt, Human
ugaagugcaauggccugau

SEQ ID NO: 80724 - RNA, 18 nt, Human
ugaccucaggugauccgc

SEQ ID NO: 80725 - RNA, 20 nt, Human
ugaccucaggugauccgccc

SEQ ID NO: 80726 - RNA, 24 nt, Human
ugaccucaggugauccgcccgccu

SEQ ID NO: 80727 - RNA, 22 nt, Human
ugagauggagucucacucuguc

SEQ ID NO: 80728 - RNA, 23 nt, Human
ugcccggcuaauuuuuguauuuu

SEQ ID NO: 80729 - RNA, 24 nt, Human
ugccucagccucccgaguagcugg

SEQ ID NO: 80730 - RNA, 19 nt, Human
ugcuaccauugcucaaaac

SEQ ID NO: 80731 - RNA, 19 nt, Human
ugggauuacaggcacccgc

SEQ ID NO: 80732 - RNA, 21 nt, Human
ugggauuacaggcacccgcca

SEQ ID NO: 80733 - RNA, 21 nt, Human
ugggauuacaggcacccgcca

SEQ ID NO: 80734 - RNA, 22 nt, Human
ugggauuacaggcacccgccau

SEQ ID NO: 80735 - RNA, 24 nt, Human
ugggauuacaggcacccgccauca

SEQ ID NO: 80736 - RNA, 18 nt, Human
ugggauugcaggugugag

SEQ ID NO: 80737 - RNA, 21 nt, Human
ugggauugcaggugugaguca

SEQ ID NO: 80738 - RNA, 23 nt, Human
uggguucaagcgauucuccugcc

SEQ ID NO: 80739 - RNA, 24 nt, Human
uggguucaagcgauucuccugccu

SEQ ID NO: 80740 - RNA, 23 nt, Human
ugguagagacaggguuucaccau

SEQ ID NO: 80741 - RNA, 24 nt, Human
ugguagagacaggguuucaccaug

SEQ ID NO: 80742 - RNA, 24 nt, Human
uggucaggcuggucuugaacugcu

SEQ ID NO: 80743 - RNA, 22 nt, Human
ugugggcuggaagggaaggggc

SEQ ID NO: 80744 - RNA, 19 nt, Human
uuacaggcacccgccauca

SEQ ID NO: 80745 - RNA, 21 nt, Human
uucaagcgauucuccugccuc

SEQ ID NO: 80746 - RNA, 23 nt, Human
uucaagcgauucuccugccucag

SEQ ID NO: 80747 - RNA, 24 nt, Human
uucaagcgauucuccugccucagc

SEQ ID NO: 80748 - RNA, 21 nt, Human
uugaaaguaaucacuuuggau

SEQ ID NO: 80749 - RNA, 24 nt, Human
uugguagagacaggguuucaccau

SEQ ID NO: 80750 - RNA, 24 nt, Human
uuucaccauguuggucaggcuggu

SEQ ID NO: 80751 - RNA, 19 nt, Human
uuuuuguauuuugguagag

SEQ ID NO: 80752 - RNA, 26 nt, Human
uuuuuuuuuuuugagauggagucuca

SEQ ID NO: 80753 - RNA, 22 nt, Human
uuuuuuuuuuuuuugagaugga

SEQ ID NO: 80754 - RNA, 19 nt, Human
aggcaggaggggguuacgg

SEQ ID NO: 80755 - RNA, 20 nt, Human
aggcaggaggggguuacggg

SEQ ID NO: 80756 - RNA, 21 nt, Human
aggcaggaggggguuacgggg

SEQ ID NO: 80757 - RNA, 21 nt, Human
aggcaggaggggguuacgggg

SEQ ID NO: 80758 - RNA, 23 nt, Human
aggcaggaggggguuacggggug

SEQ ID NO: 80759 - RNA, 24 nt, Human
aggcaggaggggguuacggggugg

SEQ ID NO: 80760 - RNA, 21 nt, Human
aucugugacucagagaaacca

SEQ ID NO: 80761 - RNA, 22 nt, Human
augcgaagcuggcggggaaagg

SEQ ID NO: 80762 - RNA, 22 nt, Human
caaccgagaagaaaacacccgc

SEQ ID NO: 80763 - RNA, 23 nt, Human
cacaucagggucugugcuucgug

SEQ ID NO: 80764 - RNA, 20 nt, Human
gcgaagcuggcggggaaagg

SEQ ID NO: 80765 - RNA, 22 nt, Human
gcuacaaaacuuccaccccaga

SEQ ID NO: 80766 - RNA, 21 nt, Human
ggaggcaggaggggguuacgg

SEQ ID NO: 80767 - RNA, 21 nt, Human
gggcaguauccuguguguggc

SEQ ID NO: 80768 - RNA, 18 nt, Human
ggggaaagggagaaggaa

SEQ ID NO: 80769 - RNA, 23 nt, Human
guacaucuaacaaccgagaagaa

SEQ ID NO: 80770 - RNA, 21 nt, Human
uaacaaccgagaagaaaacac

SEQ ID NO: 80771 - RNA, 19 nt, Human
ugacucagagaaaccacaa

SEQ ID NO: 80772 - RNA, 21 nt, Human
uuugauggcagaaguuuaucu

SEQ ID NO: 80773 - RNA, 18 nt, Human
aacgcuguugacaugcca

SEQ ID NO: 80774 - RNA, 19 nt, Human
accacccuccagccgcggg

SEQ ID NO: 80775 - RNA, 22 nt, Human
agaagucacagcuaucuuccag

SEQ ID NO: 80776 - RNA, 22 nt, Human
aggcagcgucucccaggcgcgc

SEQ ID NO: 80777 - RNA, 19 nt, Human
caagcuuuagccagucaca

SEQ ID NO: 80778 - RNA, 19 nt, Human
cacacuucuggaacugucc

SEQ ID NO: 80779 - RNA, 23 nt, Human
cacuccugguucacaguguccca

SEQ ID NO: 80780 - RNA, 20 nt, Human
cagcgcggcagcuccgacuc

SEQ ID NO: 80781 - RNA, 22 nt, Human
cagcuauacagcugugaccaca

SEQ ID NO: 80782 - RNA, 23 nt, Human
cagcuccgacucacuccugguuc

SEQ ID NO: 80783 - RNA, 24 nt, Human
cccaguggcgaccacccuccagcc

SEQ ID NO: 80784 - RNA, 18 nt, Human
ccgggccgaggcagcguc

SEQ ID NO: 80785 - RNA, 22 nt, Human
cugcacaguggaaauaaaggca

SEQ ID NO: 80786 - RNA, 22 nt, Human
cugcuuuccaauuuaauuuuua

SEQ ID NO: 80787 - RNA, 22 nt, Human
gaagcagcuauacagcugugac

SEQ ID NO: 80788 - RNA, 22 nt, Human
ggccugggcagcgcggcagcuc

SEQ ID NO: 80789 - RNA, 22 nt, Human
gucacagcuaucuuccagccug

SEQ ID NO: 80790 - RNA, 21 nt, Human
ucauguguggaugauaugaag

SEQ ID NO: 80791 - RNA, 19 nt, Human
uccgggccgaggcagcguc

SEQ ID NO: 80792 - RNA, 21 nt, Human
ugaccacaucaagcuuuagcc

SEQ ID NO: 80793 - RNA, 21 nt, Human
uggaaauaaaggcaccgugug

SEQ ID NO: 80794 - RNA, 23 nt, Human
uggacauuuucauucaaguauau

SEQ ID NO: 80795 - RNA, 18 nt, Human
ugguucacagugucccag

SEQ ID NO: 80796 - RNA, 19 nt, Human
uguaaauggacauuuucau

SEQ ID NO: 80797 - RNA, 24 nt, Human
uguguagauuuacagaugugcaga

SEQ ID NO: 80798 - RNA, 18 nt, Human
uguguggaugauaugaag

SEQ ID NO: 80799 - RNA, 20 nt, Human
uguuucuacuuccuugaaac

SEQ ID NO: 80800 - RNA, 22 nt, Human
uuaaaauagaagucacagcuau

SEQ ID NO: 80801 - RNA, 18 nt, Human
aaaaagaaaguuccaccc

SEQ ID NO: 80802 - RNA, 24 nt, Human
aaaaagggcaaaacuaaaaauccc

SEQ ID NO: 80803 - RNA, 23 nt, Human
aaaagaaaagaaaaugacagcaa

SEQ ID NO: 80804 - RNA, 20 nt, Human
aaaccucagcuccagcgucc

SEQ ID NO: 80805 - RNA, 23 nt, Human
aacacacaaaauccaccagcacu

SEQ ID NO: 80806 - RNA, 21 nt, Human
aagccccaccacccaaaagaa

SEQ ID NO: 80807 - RNA, 25 nt, Human
aauaaagaaaacagugcaggaagaa

SEQ ID NO: 80808 - RNA, 24 nt, Human
aaucaccaccuaccaaaaagggca

SEQ ID NO: 80809 - RNA, 24 nt, Human
acaaucuugucuuuuaaccaucag

SEQ ID NO: 80810 - RNA, 23 nt, Human
accacccaaaagaaaagaaaaug

SEQ ID NO: 80811 - RNA, 19 nt, Human
accaccuaccaaaaagggc

SEQ ID NO: 80812 - RNA, 19 nt, Human
acccaaaagaaaagaaaau

SEQ ID NO: 80813 - RNA, 22 nt, Human
acccaaaagaaaagaaaaugac

SEQ ID NO: 80814 - RNA, 21 nt, Human
acuuccacaccugccaaaaac

SEQ ID NO: 80815 - RNA, 18 nt, Human
agaagagagaaaggagag

SEQ ID NO: 80816 - RNA, 22 nt, Human
agaggggguggaggugggggau

SEQ ID NO: 80817 - RNA, 22 nt, Human
agggcaaaacuaaaaaucccua

SEQ ID NO: 80818 - RNA, 21 nt, Human
aucccuauaaaauaaaaaaga

SEQ ID NO: 80819 - RNA, 25 nt, Human
caaaaagggcaaaacuaaaaauccc

SEQ ID NO: 80820 - RNA, 22 nt, Human
caaaagaaaagaaaaugacagc

SEQ ID NO: 80821 - RNA, 20 nt, Human
caaaauccaccagcacuaaa

SEQ ID NO: 80822 - RNA, 22 nt, Human
caaaauccaccagcacuaaaag

SEQ ID NO: 80823 - RNA, 24 nt, Human
caacaugaggccaauauaacacac

SEQ ID NO: 80824 - RNA, 24 nt, Human
caagccccaccacccaaaagaaaa

SEQ ID NO: 80825 - RNA, 25 nt, Human
cacacaaaauccaccagcacuaaaa

SEQ ID NO: 80826 - RNA, 21 nt, Human
caucaagccccaccacccaaa

SEQ ID NO: 80827 - RNA, 19 nt, Human
caucuuuaccaguaacuca

SEQ ID NO: 80828 - RNA, 26 nt, Human
ccaucugaaaaaauuuucuacaucca

SEQ ID NO: 80829 - RNA, 25 nt, Human
ccucaaaaucaccaccuaccaaaaa

SEQ ID NO: 80830 - RNA, 19 nt, Human
cucaaaaucaccaccuacc

SEQ ID NO: 80831 - RNA, 20 nt, Human
cucguccgacccgcggcucc

SEQ ID NO: 80832 - RNA, 28 nt, Human
gaaaacagugcaggaagaaccgguaccc

SEQ ID NO: 80833 - RNA, 24 nt, Human
gacacuguuuaaacaggcuuucug

SEQ ID NO: 80834 - RNA, 19 nt, Human
gagaagagagaaaggagag

SEQ ID NO: 80835 - RNA, 22 nt, Human
gagaagagagaaaggagagggg

SEQ ID NO: 80836 - RNA, 22 nt, Human
gagaagagagaaaggagagggg

SEQ ID NO: 80837 - RNA, 23 nt, Human
gagaagagagaaaggagaggggg

SEQ ID NO: 80838 - RNA, 24 nt, Human
gagcacaauucacaguaugaauac

SEQ ID NO: 80839 - RNA, 23 nt, Human
gagugugcaaaaaucuucagaau

SEQ ID NO: 80840 - RNA, 24 nt, Human
gcaaaaaucuucagaauaagaaua

SEQ ID NO: 80841 - RNA, 20 nt, Human
ggcuggaggggaggaggagg

SEQ ID NO: 80842 - RNA, 27 nt, Human
ggcuggaggggaggaggaggagaggaa

SEQ ID NO: 80843 - RNA, 20 nt, Human
gggaggaggaggagaggaag

SEQ ID NO: 80844 - RNA, 19 nt, Human
ggggauuggaggcguggag

SEQ ID NO: 80845 - RNA, 21 nt, Human
guaaaaucuacaucaagcccc

SEQ ID NO: 80846 - RNA, 23 nt, Human
guggaggugggggauuggaggcg

SEQ ID NO: 80847 - RNA, 22 nt, Human
uaacucagacacugcaauccag

SEQ ID NO: 80848 - RNA, 19 nt, Human
uaagaaaauaaagaaaaca

SEQ ID NO: 80849 - RNA, 22 nt, Human
uaagaauaccauaguugcuaaa

SEQ ID NO: 80850 - RNA, 24 nt, Human
uaccaaaaagggcaaaacuaaaaa

SEQ ID NO: 80851 - RNA, 28 nt, Human
uaccaaaaagggcaaaacuaaaaauccc

SEQ ID NO: 80852 - RNA, 23 nt, Human
ucaaaaucaccaccuaccaaaaa

SEQ ID NO: 80853 - RNA, 21 nt, Human
ucaagccccaccacccaaaag

SEQ ID NO: 80854 - RNA, 18 nt, Human
ucagacacugcaauccag

SEQ ID NO: 80855 - RNA, 18 nt, Human
ucagagcacaauucacag

SEQ ID NO: 80856 - RNA, 26 nt, Human
uccaccagcacuaaaagggacuggag

SEQ ID NO: 80857 - RNA, 24 nt, Human
uccuucaaaauacagcucucccug

SEQ ID NO: 80858 - RNA, 22 nt, Human
ucggccacaacagcuucugggc

SEQ ID NO: 80859 - RNA, 22 nt, Human
ucuaaccuccgcaaaccaugcc

SEQ ID NO: 80860 - RNA, 19 nt, Human
ucuaagcaucuuuaccagu

SEQ ID NO: 80861 - RNA, 22 nt, Human
ucuacaucaagccccaccaccc

SEQ ID NO: 80862 - RNA, 24 nt, Human
ugaacaauaauuucuucuucucuc

SEQ ID NO: 80863 - RNA, 23 nt, Human
ugccaaaaacguggggcuuuucc

SEQ ID NO: 80864 - RNA, 24 nt, Human
ugccaaaaacguggggcuuuuccu

SEQ ID NO: 80865 - RNA, 22 nt, Human
uggaggugggggauuggaggcg

SEQ ID NO: 80866 - RNA, 23 nt, Human
uguacagaauuuuuuacauagaa

SEQ ID NO: 80867 - RNA, 24 nt, Human
uuacagccucaaaaucaccaccua

SEQ ID NO: 80868 - RNA, 20 nt, Human
uuacaucuguaccauauaca

SEQ ID NO: 80869 - RNA, 19 nt, Human
uuauaaacauuuuauccuu

SEQ ID NO: 80870 - RNA, 18 nt, Human
uucaaguuuugguccaua

SEQ ID NO: 80871 - RNA, 20 nt, Human
uuucuucuucucuccccacu

SEQ ID NO: 80872 - RNA, 20 nt, Human
uuuucuacauccacuguuaa

SEQ ID NO: 80873 - RNA, 19 nt, Human
uuuuuauauuacagaccug

SEQ ID NO: 80874 - RNA, 18 nt, Human
uuuuuuauaauucaaaaa

SEQ ID NO: 80875 - RNA, 22 nt, Human
aaaagaugaaaaacgaaaacaa

SEQ ID NO: 80876 - RNA, 19 nt, Human
aacaaaacaaaaaaaagaa

SEQ ID NO: 80877 - RNA, 23 nt, Human
aacgaaaacaaaacaaaaaaaag

SEQ ID NO: 80878 - RNA, 21 nt, Human
aagcaugguggcucggcagcc

SEQ ID NO: 80879 - RNA, 20 nt, Human
acaaaacaaaaaaaagaacc

SEQ ID NO: 80880 - RNA, 21 nt, Human
acaaaacaaaaaaaagaacca

SEQ ID NO: 80881 - RNA, 23 nt, Human
acaaaacaaaaaaaagaaccaca

SEQ ID NO: 80882 - RNA, 22 nt, Human
acccgacagcggagccaacuga

SEQ ID NO: 80883 - RNA, 24 nt, Human
agagggagggagaggggaggggcc

SEQ ID NO: 80884 - RNA, 22 nt, Human
agauuuauuuucaaacagcaca

SEQ ID NO: 80885 - RNA, 20 nt, Human
agcaugguggcucggcagcc

SEQ ID NO: 80886 - RNA, 18 nt, Human
agcccccagccccgcccu

SEQ ID NO: 80887 - RNA, 23 nt, Human
agcuucaggcaagcaugguggcu

SEQ ID NO: 80888 - RNA, 19 nt, Human
aggaacacuggugaauucc

SEQ ID NO: 80889 - RNA, 18 nt, Human
aggcaagcaugguggcuc

SEQ ID NO: 80890 - RNA, 18 nt, Human
agggagaggggaggggcc

SEQ ID NO: 80891 - RNA, 21 nt, Human
agggagaggggaggggccggg

SEQ ID NO: 80892 - RNA, 23 nt, Human
agggagaggggaggggccgggcc

SEQ ID NO: 80893 - RNA, 28 nt, Human
augaaaaacgaaaacaaaacaaaaaaaa

SEQ ID NO: 80894 - RNA, 22 nt, Human
caaaacaaaaaaaagaaccaca

SEQ ID NO: 80895 - RNA, 19 nt, Human
cacagcagcugccaggaaa

SEQ ID NO: 80896 - RNA, 18 nt, Human
cagcagcugccaggaaaa

SEQ ID NO: 80897 - RNA, 19 nt, Human
cagcccccagccccgcccu

SEQ ID NO: 80898 - RNA, 20 nt, Human
cagcccccagccccgcccug

SEQ ID NO: 80899 - RNA, 26 nt, Human
cagcccccagccccggccgcgcgucc

SEQ ID NO: 80900 - RNA, 22 nt, Human
ccagaccggcugccgcuccacg

SEQ ID NO: 80901 - RNA, 23 nt, Human
ccagcccccagccccggccgcgc

SEQ ID NO: 80902 - RNA, 22 nt, Human
ccagccccgcccugcggccagg

SEQ ID NO: 80903 - RNA, 22 nt, Human
ccaggcacacaugcgggcacag

SEQ ID NO: 80904 - RNA, 18 nt, Human
ccaggcuaggcugguguc

SEQ ID NO: 80905 - RNA, 24 nt, Human
cccacccacagcagcugccaggaa

SEQ ID NO: 80906 - RNA, 22 nt, Human
cccagcccccagccccggccgc

SEQ ID NO: 80907 - RNA, 20 nt, Human
cccagccccgcccugcggcc

SEQ ID NO: 80908 - RNA, 26 nt, Human
cccagccccggccgcgcguccagacc

SEQ ID NO: 80909 - RNA, 22 nt, Human
ccccccgcccgcccccuccgga

SEQ ID NO: 80910 - RNA, 19 nt, Human
cccccgcccgcccccuccc

SEQ ID NO: 80911 - RNA, 20 nt, Human
cccccuccggacaauaagcu

SEQ ID NO: 80912 - RNA, 21 nt, Human
cccuugcccggguggcgcggc

SEQ ID NO: 80913 - RNA, 23 nt, Human
cccuugcccggguggcgcggccg

SEQ ID NO: 80914 - RNA, 21 nt, Human
ccgguggcaggggccgcucuc

SEQ ID NO: 80915 - RNA, 25 nt, Human
ccugcggccaggcacacaugcgggc

SEQ ID NO: 80916 - RNA, 23 nt, Human
cgaaaacaaaacaaaaaaaagaa

SEQ ID NO: 80917 - RNA, 21 nt, Human
cgacgcggggacagagggagg

SEQ ID NO: 80918 - RNA, 21 nt, Human
cgagcgacgcggggacagagg

SEQ ID NO: 80919 - RNA, 19 nt, Human
cgcggucggcgccccccgc

SEQ ID NO: 80920 - RNA, 18 nt, Human
cgggcgccggcaccgcca

SEQ ID NO: 80921 - RNA, 21 nt, Human
cggggcagagccaggcuaggc

SEQ ID NO: 80922 - RNA, 21 nt, Human
cguccagaccggcugccgcuc

SEQ ID NO: 80923 - RNA, 18 nt, Human
cucccagcccccagcccc

SEQ ID NO: 80924 - RNA, 18 nt, Human
cucugccugggggucucc

SEQ ID NO: 80925 - RNA, 23 nt, Human
cuucaggaacacuggugaauucc

SEQ ID NO: 80926 - RNA, 21 nt, Human
gacacagcagcuucaggaaca

SEQ ID NO: 80927 - RNA, 22 nt, Human
gacgcggggacagagggaggga

SEQ ID NO: 80928 - RNA, 20 nt, Human
gagaggggaggggccgggcc

SEQ ID NO: 80929 - RNA, 19 nt, Human
gcccugcggccaggcacac

SEQ ID NO: 80930 - RNA, 19 nt, Human
gccgcgcguccagaccggc

SEQ ID NO: 80931 - RNA, 18 nt, Human
gcggccaggcacacaugc

SEQ ID NO: 80932 - RNA, 18 nt, Human
gcggucggcgccccccgc

SEQ ID NO: 80933 - RNA, 22 nt, Human
gcucccagcccccagccccggc

SEQ ID NO: 80934 - RNA, 20 nt, Human
gcugccaggaaaagaggacc

SEQ ID NO: 80935 - RNA, 18 nt, Human
ggaacacuggugaauucc

SEQ ID NO: 80936 - RNA, 20 nt, Human
ggcaccgccagguccgcgag

SEQ ID NO: 80937 - RNA, 20 nt, Human
ggcucggcagcccccagccc

SEQ ID NO: 80938 - RNA, 23 nt, Human
gggcgccagaaacucaacuagag

SEQ ID NO: 80939 - RNA, 19 nt, Human
ggggaggggccgggccuca

SEQ ID NO: 80940 - RNA, 20 nt, Human
gugucugggccccacccaca

SEQ ID NO: 80941 - RNA, 22 nt, Human
ucaggcaagcaugguggcucgg

SEQ ID NO: 80942 - RNA, 23 nt, Human
ucaggcaagcaugguggcucggc

SEQ ID NO: 80943 - RNA, 21 nt, Human
ucccuuugcucuucaaaagau

SEQ ID NO: 80944 - RNA, 21 nt, Human
ugauuucccuuugcucuucaa

SEQ ID NO: 80945 - RNA, 20 nt, Human
ugcggccaggcacacaugcg

SEQ ID NO: 80946 - RNA, 24 nt, Human
ugggccccacccacagcagcugcc

SEQ ID NO: 80947 - RNA, 22 nt, Human
uucaaaagaugaaaaacgaaaa

SEQ ID NO: 80948 - RNA, 23 nt, Human
uugcgcgccgcgcucccagcccc

SEQ ID NO: 80949 - RNA, 23 nt, Human
uuuuuuuuugagaguuuuuauca

SEQ ID NO: 80950 - RNA, 18 nt, Human
uuuuuuuuuuuuuuuuug

SEQ ID NO: 80951 - RNA, 25 nt, Human
agccugccucccuccaucccucccg

SEQ ID NO: 80952 - RNA, 19 nt, Human
auccucugagugugugugg

SEQ ID NO: 80953 - RNA, 23 nt, Human
cccucccguaaggcugcuccucc

SEQ ID NO: 80954 - RNA, 23 nt, Human
ccuacugagaacccagggaugga

SEQ ID NO: 80955 - RNA, 22 nt, Human
cuccccagccugccucccucca

SEQ ID NO: 80956 - RNA, 20 nt, Human
cucccguaaggcugcuccuc

SEQ ID NO: 80957 - RNA, 22 nt, Human
cuggcgagguuuggggcaggag

SEQ ID NO: 80958 - RNA, 18 nt, Human
gagugugugugguuaugu

SEQ ID NO: 80959 - RNA, 23 nt, Human
gguuuggggcaggaggagucuug

SEQ ID NO: 80960 - RNA, 24 nt, Human
uacuuuugcuuuuuauagugauua

SEQ ID NO: 80961 - RNA, 18 nt, Human
ucccucugaccuauaccc

SEQ ID NO: 80962 - RNA, 18 nt, Human
ucccugggggccgccgcc

SEQ ID NO: 80963 - RNA, 19 nt, Human
ucccugggggccgccgccc

SEQ ID NO: 80964 - RNA, 25 nt, Human
ucccugggggccgccgcccuggccc

SEQ ID NO: 80965 - RNA, 19 nt, Human
uccuacugagaacccaggg

SEQ ID NO: 80966 - RNA, 21 nt, Human
ucuaauguucucuucucccca

SEQ ID NO: 80967 - RNA, 21 nt, Human
uggggcaggaggagucuuggu

SEQ ID NO: 80968 - RNA, 21 nt, Human
uucccugagucuaauguucuc

SEQ ID NO: 80969 - RNA, 19 nt, Human
uucucuggcgagguuuggg

SEQ ID NO: 80970 - RNA, 22 nt, Human
uuuggggcaggaggagucuugg

SEQ ID NO: 80971 - RNA, 22 nt, Human
uuuuuuuuuagucagaaucaga

SEQ ID NO: 80972 - RNA, 25 nt, Human
aaacaaacugagaguguguccucca

SEQ ID NO: 80973 - RNA, 21 nt, Human
aaaccaaagucaaaaacaaac

SEQ ID NO: 80974 - RNA, 24 nt, Human
aaacugagaguguguccuccacag

SEQ ID NO: 80975 - RNA, 19 nt, Human
aaccaaagucaaaaacaaa

SEQ ID NO: 80976 - RNA, 21 nt, Human
accaaagucaaaaacaaacug

SEQ ID NO: 80977 - RNA, 19 nt, Human
agaaaaaagagguuuugaa

SEQ ID NO: 80978 - RNA, 20 nt, Human
cacagcucuuccuacucucc

SEQ ID NO: 80979 - RNA, 19 nt, Human
cacaggguucagggccucu

SEQ ID NO: 80980 - RNA, 18 nt, Human
caccccuggcaugcuggg

SEQ ID NO: 80981 - RNA, 25 nt, Human
caccucuguccccagccugugagag

SEQ ID NO: 80982 - RNA, 24 nt, Human
cagagggcuccccaggaugggucu

SEQ ID NO: 80983 - RNA, 25 nt, Human
caggaagagucauucauugcaaagg

SEQ ID NO: 80984 - RNA, 22 nt, Human
caggaugggucuuuuggaggua

SEQ ID NO: 80985 - RNA, 19 nt, Human
caggcccaggaagggguuu

SEQ ID NO: 80986 - RNA, 24 nt, Human
cagggccaccucuguccccagccu

SEQ ID NO: 80987 - RNA, 18 nt, Human
ccaaccacuuagguccca

SEQ ID NO: 80988 - RNA, 19 nt, Human
ccaacgaagcccauggccu

SEQ ID NO: 80989 - RNA, 23 nt, Human
ccagauacucaggugagacacaa

SEQ ID NO: 80990 - RNA, 18 nt, Human
cccugagaagggcaagga

SEQ ID NO: 80991 - RNA, 22 nt, Human
ccgcacaggguucagggccucu

SEQ ID NO: 80992 - RNA, 21 nt, Human
ccuagggcuccuggugccagg

SEQ ID NO: 80993 - RNA, 23 nt, Human
ccucgggaaccccaaccacuuag

SEQ ID NO: 80994 - RNA, 21 nt, Human
ccugcuggagggugcugcugc

SEQ ID NO: 80995 - RNA, 21 nt, Human
cgcuccagaaggugggccagg

SEQ ID NO: 80996 - RNA, 22 nt, Human
cugccagggcuggaggaccagc

SEQ ID NO: 80997 - RNA, 18 nt, Human
gaggggccagagggcucc

SEQ ID NO: 80998 - RNA, 23 nt, Human
gcaaagggccggcaagugaacca

SEQ ID NO: 80999 - RNA, 21 nt, Human
gcccauggccucagaagggcu

SEQ ID NO: 81000 - RNA, 19 nt, Human
gccggcaagugaaccaggg

SEQ ID NO: 81001 - RNA, 19 nt, Human
gccucagaagggcugcagc

SEQ ID NO: 81002 - RNA, 18 nt, Human
gcuccuggugccaggcuc

SEQ ID NO: 81003 - RNA, 20 nt, Human
ggccagggccggggaggugc

SEQ ID NO: 81004 - RNA, 20 nt, Human
ggccggcaagugaaccaggg

SEQ ID NO: 81005 - RNA, 20 nt, Human
ggccucagaagggcugcagc

SEQ ID NO: 81006 - RNA, 23 nt, Human
gggaaccccaaccacuuaggucc

SEQ ID NO: 81007 - RNA, 20 nt, Human
gggccaggaugcaugcugga

SEQ ID NO: 81008 - RNA, 21 nt, Human
gggcuggaggaccagcucucc

SEQ ID NO: 81009 - RNA, 18 nt, Human
ggggcugugaguggggag

SEQ ID NO: 81010 - RNA, 25 nt, Human
gugcugcugcuccguggagggcagc

SEQ ID NO: 81011 - RNA, 20 nt, Human
uaagacccccaacuuagcca

SEQ ID NO: 81012 - RNA, 21 nt, Human
uaagacccccaacuuagccaa

SEQ ID NO: 81013 - RNA, 24 nt, Human
uaagacccccaacuuagccaacga

SEQ ID NO: 81014 - RNA, 18 nt, Human
uaaguuacagcacaauac

SEQ ID NO: 81015 - RNA, 23 nt, Human
uacucaggugagacacaaaccca

SEQ ID NO: 81016 - RNA, 20 nt, Human
uaggucccaaagccacaagg

SEQ ID NO: 81017 - RNA, 21 nt, Human
uaggucccaaagccacaaggg

SEQ ID NO: 81018 - RNA, 22 nt, Human
ucaggugagacacaaacccacu

SEQ ID NO: 81019 - RNA, 19 nt, Human
ucccgagguaccaguccuc

SEQ ID NO: 81020 - RNA, 23 nt, Human
ucccgagguaccaguccucagug

SEQ ID NO: 81021 - RNA, 21 nt, Human
uccucagugaccucgggaacc

SEQ ID NO: 81022 - RNA, 21 nt, Human
ugaauucuugugggacaguuc

SEQ ID NO: 81023 - RNA, 23 nt, Human
ugaauucuugugggacaguucca

SEQ ID NO: 81024 - RNA, 21 nt, Human
ugccaggcucaggaagaguca

SEQ ID NO: 81025 - RNA, 19 nt, Human
ugccagggcuggaggacca

SEQ ID NO: 81026 - RNA, 27 nt, Human
ugccagggcuggaggaccagcucuccc

SEQ ID NO: 81027 - RNA, 19 nt, Human
ugccuagggcuccuggugc

SEQ ID NO: 81028 - RNA, 19 nt, Human
ugccugcuggagggugcug

SEQ ID NO: 81029 - RNA, 22 nt, Human
uggacguuucauugaaaauuuu

SEQ ID NO: 81030 - RNA, 18 nt, Human
uggaggaccagcucuccc

SEQ ID NO: 81031 - RNA, 22 nt, Human
uggagggcagcaggcccaggaa

SEQ ID NO: 81032 - RNA, 21 nt, Human
uggcaugcugggcugccugcu

SEQ ID NO: 81033 - RNA, 18 nt, Human
uugcccgcgugcccuccc

SEQ ID NO: 81034 - RNA, 24 nt, Human
uuuuaaauaaaccaaagucaaaaa

SEQ ID NO: 81035 - RNA, 26 nt, Human
uuuuuuuuuuuuuuuggcuuguuuuu

SEQ ID NO: 81036 - RNA, 20 nt, Human
uuuuuuuuuuuuuuuuuugg

SEQ ID NO: 81037 - RNA, 28 nt, Human
aaacagguacaguuaagccaucccccac

SEQ ID NO: 81038 - RNA, 22 nt, Human
aaucucagaauaugcccagcug

SEQ ID NO: 81039 - RNA, 21 nt, Human
accagguuugcagcagaaaug

SEQ ID NO: 81040 - RNA, 21 nt, Human
acucugcagcccaccuggccg

SEQ ID NO: 81041 - RNA, 21 nt, Human
agaacacaguccagaacaggc

SEQ ID NO: 81042 - RNA, 22 nt, Human
agaacacaguccagaacaggca

SEQ ID NO: 81043 - RNA, 23 nt, Human
agaacaggcagagaggggcaggg

SEQ ID NO: 81044 - RNA, 19 nt, Human
agacacccugggaggggag

SEQ ID NO: 81045 - RNA, 23 nt, Human
agaggggcagggagcccacucug

SEQ ID NO: 81046 - RNA, 21 nt, Human
agcaggcccagaacacagucc

SEQ ID NO: 81047 - RNA, 21 nt, Human
aucucagaauaugcccagcug

SEQ ID NO: 81048 - RNA, 21 nt, Human
cacaggccugccaccagacac

SEQ ID NO: 81049 - RNA, 19 nt, Human
cacccuggggacagcaggg

SEQ ID NO: 81050 - RNA, 21 nt, Human
cacucugcagcccaccuggcc

SEQ ID NO: 81051 - RNA, 19 nt, Human
cagcagaaaugggggcuga

SEQ ID NO: 81052 - RNA, 19 nt, Human
cagcagggauaggcacagg

SEQ ID NO: 81053 - RNA, 21 nt, Human
cagcuggcccuucuggagcuc

SEQ ID NO: 81054 - RNA, 19 nt, Human
caggccugccaccagacac

SEQ ID NO: 81055 - RNA, 23 nt, Human
cccccggggcccacccuggggac

SEQ ID NO: 81056 - RNA, 24 nt, Human
cccccggggcccacccuggggacc

SEQ ID NO: 81057 - RNA, 19 nt, Human
ccccggggcccacccuggg

SEQ ID NO: 81058 - RNA, 21 nt, Human
cccggggcccacccuggggac

SEQ ID NO: 81059 - RNA, 20 nt, Human
ccuccagggaaaacccacuu

SEQ ID NO: 81060 - RNA, 19 nt, Human
ccuccuucuccacccuggg

SEQ ID NO: 81061 - RNA, 23 nt, Human
ccuccuucuccacccugggcggu

SEQ ID NO: 81062 - RNA, 25 nt, Human
ccugacccccggggcccacccuggg

SEQ ID NO: 81063 - RNA, 26 nt, Human
ccugacccccggggcccacccugggg

SEQ ID NO: 81064 - RNA, 22 nt, Human
cgccaagcaagggccuccuucu

SEQ ID NO: 81065 - RNA, 20 nt, Human
ggauggacaccagcucugcc

SEQ ID NO: 81066 - RNA, 20 nt, Human
ggcagagaggggcagggagc

SEQ ID NO: 81067 - RNA, 19 nt, Human
uacaguuaagccauccccc

SEQ ID NO: 81068 - RNA, 20 nt, Human
ucagcaggcccagaacacag

SEQ ID NO: 81069 - RNA, 23 nt, Human
ucagcaggcccagaacacagucc

SEQ ID NO: 81070 - RNA, 22 nt, Human
ucagugcuggauggacaccagc

SEQ ID NO: 81071 - RNA, 21 nt, Human
ucccccacgccaagcaagggc

SEQ ID NO: 81072 - RNA, 23 nt, Human
ugacccccggggcccacccuggg

SEQ ID NO: 81073 - RNA, 18 nt, Human
uggagcuccugacccccg

SEQ ID NO: 81074 - RNA, 18 nt, Human
uugcagcagaaauggggg

SEQ ID NO: 81075 - RNA, 18 nt, Human
aacagggaaccucugagc

SEQ ID NO: 81076 - RNA, 22 nt, Human
aaccauggguugucaaccaucc

SEQ ID NO: 81077 - RNA, 21 nt, Human
aagagaaaccccuguccccca

SEQ ID NO: 81078 - RNA, 23 nt, Human
aagagccaggauaugagaagaug

SEQ ID NO: 81079 - RNA, 22 nt, Human
aagccagguuaccaacagggaa

SEQ ID NO: 81080 - RNA, 24 nt, Human
aauaaaaaguuugauggagucaga

SEQ ID NO: 81081 - RNA, 18 nt, Human
aauacuccagagcuuuuc

SEQ ID NO: 81082 - RNA, 19 nt, Human
aauccagaaccucccaggc

SEQ ID NO: 81083 - RNA, 18 nt, Human
aaucuugggggaagguga

SEQ ID NO: 81084 - RNA, 19 nt, Human
acagccaaaauccagaacc

SEQ ID NO: 81085 - RNA, 19 nt, Human
accacugucgaaaugaggu

SEQ ID NO: 81086 - RNA, 19 nt, Human
agagaaaccccuguccccc

SEQ ID NO: 81087 - RNA, 22 nt, Human
agagggaagguccuuggacagg

SEQ ID NO: 81088 - RNA, 23 nt, Human
agcacuuuguguuuuuuuggugg

SEQ ID NO: 81089 - RNA, 20 nt, Human
agccaaaauccagaaccucc

SEQ ID NO: 81090 - RNA, 22 nt, Human
agcugcuuugaucugagguggg

SEQ ID NO: 81091 - RNA, 20 nt, Human
aggaccauggugauuuccag

SEQ ID NO: 81092 - RNA, 22 nt, Human
aggaucugggaacaaucgagug

SEQ ID NO: 81093 - RNA, 23 nt, Human
aggcaccaguuaugucccagagc

SEQ ID NO: 81094 - RNA, 22 nt, Human
aggcagggaggaucugggaaca

SEQ ID NO: 81095 - RNA, 20 nt, Human
aggcauguggccugacugua

SEQ ID NO: 81096 - RNA, 22 nt, Human
agggaggaucugggaacaaucg

SEQ ID NO: 81097 - RNA, 18 nt, Human
agguggggcccuggagau

SEQ ID NO: 81098 - RNA, 20 nt, Human
agugaucaauacuccagagc

SEQ ID NO: 81099 - RNA, 20 nt, Human
aucaagacuggauugaggcc

SEQ ID NO: 81100 - RNA, 24 nt, Human
aucauucaggggcagaauguauuu

SEQ ID NO: 81101 - RNA, 23 nt, Human
augcagcgcccucaaucaauauu

SEQ ID NO: 81102 - RNA, 19 nt, Human
auggagucagagugaccuc

SEQ ID NO: 81103 - RNA, 23 nt, Human
augggugacucagaguuccucua

SEQ ID NO: 81104 - RNA, 20 nt, Human
caaaacggugcccaucucaa

SEQ ID NO: 81105 - RNA, 25 nt, Human
caaaauccagaaccucccaggccga

SEQ ID NO: 81106 - RNA, 24 nt, Human
caagaaauguacccagcacaugca

SEQ ID NO: 81107 - RNA, 24 nt, Human
cacccuggggaaaauaguacuuca

SEQ ID NO: 81108 - RNA, 27 nt, Human
cagaaagagaaaccccugucccccacu

SEQ ID NO: 81109 - RNA, 23 nt, Human
cagggaacugggggagaagaggg

SEQ ID NO: 81110 - RNA, 21 nt, Human
cagucucaaugcucauuagca

SEQ ID NO: 81111 - RNA, 20 nt, Human
ccagaaaaaauccaguuaca

SEQ ID NO: 81112 - RNA, 24 nt, Human
cccacaaauccaccagggcucauu

SEQ ID NO: 81113 - RNA, 23 nt, Human
cccagaaaaaauccaguuacacc

SEQ ID NO: 81114 - RNA, 19 nt, Human
cccaggcugcuccuucgag

SEQ ID NO: 81115 - RNA, 22 nt, Human
ccccaccucucacuuucaccua

SEQ ID NO: 81116 - RNA, 23 nt, Human
ccccagaaaaaauccaguuacac

SEQ ID NO: 81117 - RNA, 20 nt, Human
ccucaguacccuuucucuca

SEQ ID NO: 81118 - RNA, 23 nt, Human
ccugagcugagcugcuuuucuug

SEQ ID NO: 81119 - RNA, 20 nt, Human
ccugcuguugggcugugggg

SEQ ID NO: 81120 - RNA, 23 nt, Human
ccuuaggccagaaagagaaaccc

SEQ ID NO: 81121 - RNA, 21 nt, Human
ccuuggacuauuaaugucccc

SEQ ID NO: 81122 - RNA, 20 nt, Human
cucaguacccuuucucucca

SEQ ID NO: 81123 - RNA, 21 nt, Human
cuccacccucacucccagauc

SEQ ID NO: 81124 - RNA, 21 nt, Human
cugacauccuagguggggaga

SEQ ID NO: 81125 - RNA, 21 nt, Human
cuggggcugaagcugaugcug

SEQ ID NO: 81126 - RNA, 21 nt, Human
cugugcugauccuuuguccaa

SEQ ID NO: 81127 - RNA, 20 nt, Human
gaaaccccugucccccaccu

SEQ ID NO: 81128 - RNA, 18 nt, Human
gacagccaaaauccagaa

SEQ ID NO: 81129 - RNA, 20 nt, Human
gaccuuuucuuacagcaaug

SEQ ID NO: 81130 - RNA, 22 nt, Human
gagaacuuccaguguccuggau

SEQ ID NO: 81131 - RNA, 19 nt, Human
gaggccccagaaaaaaucc

SEQ ID NO: 81132 - RNA, 21 nt, Human
gaggccccagaaaaaauccag

SEQ ID NO: 81133 - RNA, 24 nt, Human
gauggcugcccaggcugcuccuuc

SEQ ID NO: 81134 - RNA, 27 nt, Human
gccaggauaugagaagaugggagaggg

SEQ ID NO: 81135 - RNA, 19 nt, Human
gcccaggcugcuccuucga

SEQ ID NO: 81136 - RNA, 20 nt, Human
gcugcccaggcugcuccuuc

SEQ ID NO: 81137 - RNA, 20 nt, Human
gcugcccaggcugcuccuuc

SEQ ID NO: 81138 - RNA, 20 nt, Human
gcuggagcgugaggaaagac

SEQ ID NO: 81139 - RNA, 20 nt, Human
ggaagacucauccugagcug

SEQ ID NO: 81140 - RNA, 22 nt, Human
ggagaacuuccaguguccugga

SEQ ID NO: 81141 - RNA, 23 nt, Human
ggagauugaagccacccugggga

SEQ ID NO: 81142 - RNA, 19 nt, Human
ggaggugugaaacgugcug

SEQ ID NO: 81143 - RNA, 20 nt, Human
ggaucuggauccuggagaac

SEQ ID NO: 81144 - RNA, 25 nt, Human
ggccagaaagagaaaccccuguccc

SEQ ID NO: 81145 - RNA, 19 nt, Human
ggccgaguggaugcacggg

SEQ ID NO: 81146 - RNA, 21 nt, Human
ggccugacuguagguggcagg

SEQ ID NO: 81147 - RNA, 23 nt, Human
gggugagagaaacugugaaccuu

SEQ ID NO: 81148 - RNA, 19 nt, Human
guacuucaaacccaccccu

SEQ ID NO: 81149 - RNA, 22 nt, Human
guccaaggugaagugauugccc

SEQ ID NO: 81150 - RNA, 20 nt, Human
gucucacagaagcacuuugu

SEQ ID NO: 81151 - RNA, 21 nt, Human
gugaaacgugcuggugcuucc

SEQ ID NO: 81152 - RNA, 19 nt, Human
uaaguguuuuuccaguagu

SEQ ID NO: 81153 - RNA, 22 nt, Human
uacaaaccacugucgaaaugag

SEQ ID NO: 81154 - RNA, 19 nt, Human
uaccuuugagggcccauga

SEQ ID NO: 81155 - RNA, 19 nt, Human
uacuucaaacccaccccug

SEQ ID NO: 81156 - RNA, 24 nt, Human
uagagccuaggacucaggcuggag

SEQ ID NO: 81157 - RNA, 20 nt, Human
uagagugccucaguacccuu

SEQ ID NO: 81158 - RNA, 23 nt, Human
uaguccaggcaucaguucauauu

SEQ ID NO: 81159 - RNA, 26 nt, Human
uauccagaccauaaacucucaaaggc

SEQ ID NO: 81160 - RNA, 23 nt, Human
uccaguguccuggauggaauguu

SEQ ID NO: 81161 - RNA, 24 nt, Human
ucccaagugccaagaaauguaccc

SEQ ID NO: 81162 - RNA, 20 nt, Human
ucccccaccucucacuuuca

SEQ ID NO: 81163 - RNA, 22 nt, Human
ucucuggagaggcaggcaaacu

SEQ ID NO: 81164 - RNA, 24 nt, Human
ucuggauccuggagaacuuccagu

SEQ ID NO: 81165 - RNA, 22 nt, Human
ucuuacagcaaugccuuggccc

SEQ ID NO: 81166 - RNA, 23 nt, Human
ugaacucugauuaccugaaaguc

SEQ ID NO: 81167 - RNA, 23 nt, Human
ugacagguugaguggccauggac

SEQ ID NO: 81168 - RNA, 19 nt, Human
ugagagaaacugugaaccu

SEQ ID NO: 81169 - RNA, 22 nt, Human
ugaggccccagaaaaaagggag

SEQ ID NO: 81170 - RNA, 20 nt, Human
ugagguggggcccuggagau

SEQ ID NO: 81171 - RNA, 23 nt, Human
ugaucaauacuccagagcuuuuc

SEQ ID NO: 81172 - RNA, 23 nt, Human
ugcaagaacguccuguuggcugg

SEQ ID NO: 81173 - RNA, 24 nt, Human
ugcaauuuaccuuugagggcccau

SEQ ID NO: 81174 - RNA, 21 nt, Human
ugcagcgcccucaaucaauau

SEQ ID NO: 81175 - RNA, 19 nt, Human
ugcccagagaagagccagg

SEQ ID NO: 81176 - RNA, 19 nt, Human
ugcuuggcucaucuugccc

SEQ ID NO: 81177 - RNA, 20 nt, Human
ugcuuuucuugaaguuguga

SEQ ID NO: 81178 - RNA, 18 nt, Human
uggacuauuaaugucccc

SEQ ID NO: 81179 - RNA, 22 nt, Human
uggagaacuuccaguguccugg

SEQ ID NO: 81180 - RNA, 24 nt, Human
uggagggagagcugcaggucccau

SEQ ID NO: 81181 - RNA, 23 nt, Human
uggcccucaggaagcaucagauc

SEQ ID NO: 81182 - RNA, 18 nt, Human
ugggagagggaaggggga

SEQ ID NO: 81183 - RNA, 19 nt, Human
ugggagagggaagggggag

SEQ ID NO: 81184 - RNA, 20 nt, Human
ugggagagggaagggggagg

SEQ ID NO: 81185 - RNA, 19 nt, Human
ugggcuguggggucuuugu

SEQ ID NO: 81186 - RNA, 18 nt, Human
ugggggagaagagggaag

SEQ ID NO: 81187 - RNA, 19 nt, Human
ugggugacucagaguuccu

SEQ ID NO: 81188 - RNA, 19 nt, Human
uguggagggagagcugcag

SEQ ID NO: 81189 - RNA, 18 nt, Human
ugugggaaagggaugaga

SEQ ID NO: 81190 - RNA, 18 nt, Human
uguucugcuuggcucauc

SEQ ID NO: 81191 - RNA, 18 nt, Human
uguuguggugugacuuac

SEQ ID NO: 81192 - RNA, 22 nt, Human
uuaucaagacuggauugaggcc

SEQ ID NO: 81193 - RNA, 18 nt, Human
uucaauaccucuuuccuc

SEQ ID NO: 81194 - RNA, 22 nt, Human
uuccaggcaccaguuauguccc

SEQ ID NO: 81195 - RNA, 24 nt, Human
uuccaguguccuggauggaauguu

SEQ ID NO: 81196 - RNA, 18 nt, Human
uuccuuggugccaguugg

SEQ ID NO: 81197 - RNA, 19 nt, Human
uuccuuggugccaguuggu

SEQ ID NO: 81198 - RNA, 21 nt, Human
uugaaaaugaauguggcagau

SEQ ID NO: 81199 - RNA, 19 nt, Human
uugaaguugugcaagaacg

SEQ ID NO: 81200 - RNA, 23 nt, Human
uugaguggccauggacccuguuc

SEQ ID NO: 81201 - RNA, 20 nt, Human
uuuccuggccacugugcugg

SEQ ID NO: 81202 - RNA, 26 nt, Human
uuucuagacagaaucauucaggggca

SEQ ID NO: 81203 - RNA, 20 nt, Human
uuucucuggagaggcaggca

SEQ ID NO: 81204 - RNA, 22 nt, Human
aacgagcaacuuccaacaccau

SEQ ID NO: 81205 - RNA, 19 nt, Human
aagccccgcagugcuggag

SEQ ID NO: 81206 - RNA, 24 nt, Human
aagcugccucugcccacuggauuc

SEQ ID NO: 81207 - RNA, 23 nt, Human
acaccauccuaaagcaaaagcca

SEQ ID NO: 81208 - RNA, 25 nt, Human
acgcagggcgcagaggcggggacgg

SEQ ID NO: 81209 - RNA, 21 nt, Human
agaggugggcacggggcgcag

SEQ ID NO: 81210 - RNA, 26 nt, Human
aggcuccuagcgacaacgagcaacuu

SEQ ID NO: 81211 - RNA, 23 nt, Human
auccuaaagcaaaagccaguccc

SEQ ID NO: 81212 - RNA, 21 nt, Human
auggcacggaagucggggucg

SEQ ID NO: 81213 - RNA, 20 nt, Human
caacaccauccuaaagcaaa

SEQ ID NO: 81214 - RNA, 19 nt, Human
caccccgccuucgcggccc

SEQ ID NO: 81215 - RNA, 23 nt, Human
cacuguuacagcccucuacaaau

SEQ ID NO: 81216 - RNA, 21 nt, Human
cagccuaggcugggguugccc

SEQ ID NO: 81217 - RNA, 23 nt, Human
ccgcgggacccagucuggcuucu

SEQ ID NO: 81218 - RNA, 18 nt, Human
ccgcguaacucgcccggg

SEQ ID NO: 81219 - RNA, 18 nt, Human
ccugaacaccuuacuggg

SEQ ID NO: 81220 - RNA, 19 nt, Human
ccugaacaccuuacugggg

SEQ ID NO: 81221 - RNA, 20 nt, Human
cgaggucacuguuacagccc

SEQ ID NO: 81222 - RNA, 23 nt, Human
cgcagccuaggcugggguugccc

SEQ ID NO: 81223 - RNA, 22 nt, Human
cgcggccagcacggggggugcc

SEQ ID NO: 81224 - RNA, 22 nt, Human
cggcacagagaggccgcguaac

SEQ ID NO: 81225 - RNA, 21 nt, Human
cggggggugcccagcacgggg

SEQ ID NO: 81226 - RNA, 22 nt, Human
cuagcgacaacgagcaacuucc

SEQ ID NO: 81227 - RNA, 27 nt, Human
cuagcgacaacgagcaacuuccaacac

SEQ ID NO: 81228 - RNA, 21 nt, Human
cuccuagcgacaacgagcaac

SEQ ID NO: 81229 - RNA, 19 nt, Human
cuucagaucccgacacccu

SEQ ID NO: 81230 - RNA, 18 nt, Human
gcaaaagccagucccaga

SEQ ID NO: 81231 - RNA, 24 nt, Human
gcagugcuggagcgcagccuaggc

SEQ ID NO: 81232 - RNA, 20 nt, Human
gcguccgcgggacccagucu

SEQ ID NO: 81233 - RNA, 19 nt, Human
ggcacaggcgacaccccgc

SEQ ID NO: 81234 - RNA, 19 nt, Human
ggcgcaggcgggcgcggcc

SEQ ID NO: 81235 - RNA, 24 nt, Human
ggcuuguggcuuucugccggcagc

SEQ ID NO: 81236 - RNA, 20 nt, Human
gggcgcaggcgggcgcggcc

SEQ ID NO: 81237 - RNA, 22 nt, Human
gggggccuuacuugaugacagu

SEQ ID NO: 81238 - RNA, 23 nt, Human
gguguuucaccauagcucuucag

SEQ ID NO: 81239 - RNA, 19 nt, Human
guagcggggcagggcgggg

SEQ ID NO: 81240 - RNA, 20 nt, Human
guccugaacaccuuacuggg

SEQ ID NO: 81241 - RNA, 19 nt, Human
gucgcuuaccaguccugaa

SEQ ID NO: 81242 - RNA, 25 nt, Human
gugguguuucaccauagcucuucag

SEQ ID NO: 81243 - RNA, 19 nt, Human
ucaaucaguuuucauggcu

SEQ ID NO: 81244 - RNA, 23 nt, Human
uggcaaugcuucagugguguuuc

SEQ ID NO: 81245 - RNA, 22 nt, Human
uggcagcacccccggucugcga

SEQ ID NO: 81246 - RNA, 25 nt, Human
uggcagcacccccggucugcgauug

SEQ ID NO: 81247 - RNA, 20 nt, Human
ugggcacggggcgcaggcgg

SEQ ID NO: 81248 - RNA, 19 nt, Human
uuacuggggcuuaguacuc

SEQ ID NO: 81249 - RNA, 18 nt, Human
aaacaagaaagagggucu

SEQ ID NO: 81250 - RNA, 18 nt, Human
aaacaagaaagagggucu

SEQ ID NO: 81251 - RNA, 21 nt, Human
cccgcgccgcaaccacggccg

SEQ ID NO: 81252 - RNA, 21 nt, Human
cggaaccaggauccaaacuuc

SEQ ID NO: 81253 - RNA, 27 nt, Human
cuuuauagucacagauggucagaugcu

SEQ ID NO: 81254 - RNA, 20 nt, Human
gagggucuauguacauugag

SEQ ID NO: 81255 - RNA, 18 nt, Human
gccgcaaccacggccgcc

SEQ ID NO: 81256 - RNA, 23 nt, Human
uuuauagucacagauggucagau

SEQ ID NO: 81257 - RNA, 20 nt, Human
uuuuuuuuuuuuuuuuuggu

SEQ ID NO: 81258 - RNA, 25 nt, Human
uuuuuuuuuuuuuuuuuuuuugggg

SEQ ID NO: 81259 - RNA, 20 nt, Human
aaaacacagacacagaacca

SEQ ID NO: 81260 - RNA, 21 nt, Human
aaaacacagacacagaaccaa

SEQ ID NO: 81261 - RNA, 21 nt, Human
acacagacacagaaccaaacu

SEQ ID NO: 81262 - RNA, 27 nt, Human
acucuuaggccacccucccuccacucu

SEQ ID NO: 81263 - RNA, 22 nt, Human
aggaaagagcuggagggcagua

SEQ ID NO: 81264 - RNA, 19 nt, Human
auccugagcuguuagagau

SEQ ID NO: 81265 - RNA, 22 nt, Human
ccacucuacucuaggaacaagg

SEQ ID NO: 81266 - RNA, 20 nt, Human
cccuccacucuacucuagga

SEQ ID NO: 81267 - RNA, 23 nt, Human
ccggcgggguaacgguagcuucc

SEQ ID NO: 81268 - RNA, 24 nt, Human
ccucccuccacucuacucuaggaa

SEQ ID NO: 81269 - RNA, 24 nt, Human
ccugaucuuccccccucuuuuuuu

SEQ ID NO: 81270 - RNA, 19 nt, Human
cgccgggauugcgcugcgg

SEQ ID NO: 81271 - RNA, 20 nt, Human
cugaucuuccccccucuuuu

SEQ ID NO: 81272 - RNA, 18 nt, Human
cuuuuuuuuccuuuaaca

SEQ ID NO: 81273 - RNA, 23 nt, Human
gagcauuaggucuguuuucucuc

SEQ ID NO: 81274 - RNA, 23 nt, Human
gccacccucccuccacucuacuc

SEQ ID NO: 81275 - RNA, 18 nt, Human
gcgccgggauugcgcugc

SEQ ID NO: 81276 - RNA, 21 nt, Human
gguccuugggcgagcgccggg

SEQ ID NO: 81277 - RNA, 18 nt, Human
uaaaacacagacacagaa

SEQ ID NO: 81278 - RNA, 21 nt, Human
uaaaacacagacacagaacca

SEQ ID NO: 81279 - RNA, 22 nt, Human
uaaaacacagacacagaaccaa

SEQ ID NO: 81280 - RNA, 20 nt, Human
uaacaguauucuguuucagc

SEQ ID NO: 81281 - RNA, 19 nt, Human
uaggaaagacagugauacu

SEQ ID NO: 81282 - RNA, 21 nt, Human
uaggaaagacagugauacugu

SEQ ID NO: 81283 - RNA, 18 nt, Human
uaggccacccucccucca

SEQ ID NO: 81284 - RNA, 22 nt, Human
uccacucuacucuaggaacaag

SEQ ID NO: 81285 - RNA, 18 nt, Human
ucccuccacucuacucua

SEQ ID NO: 81286 - RNA, 27 nt, Human
uccuuuaacaguauucuguuucagcau

SEQ ID NO: 81287 - RNA, 19 nt, Human
ucugaagagguuccuggug

SEQ ID NO: 81288 - RNA, 23 nt, Human
ugaccugaucuuccccccucuuu

SEQ ID NO: 81289 - RNA, 25 nt, Human
ugaccugaucuuccccccucuuuuu

SEQ ID NO: 81290 - RNA, 19 nt, Human
ugcauaacuuuggcuucag

SEQ ID NO: 81291 - RNA, 23 nt, Human
uuaggccacccucccuccacucu

SEQ ID NO: 81292 - RNA, 19 nt, Human
uucucuccauacaccucaa

SEQ ID NO: 81293 - RNA, 21 nt, Human
uugcauaacuuuggcuucagu

SEQ ID NO: 81294 - RNA, 19 nt, Human
aagagacacgaauaacugu

SEQ ID NO: 81295 - RNA, 19 nt, Human
aaggagaaacuuugggaaa

SEQ ID NO: 81296 - RNA, 20 nt, Human
aaggagaaacuuugggaaag

SEQ ID NO: 81297 - RNA, 21 nt, Human
aaggagaaacuuugggaaagu

SEQ ID NO: 81298 - RNA, 19 nt, Human
aggcaauagaacaagucca

SEQ ID NO: 81299 - RNA, 21 nt, Human
caccagauauuaacaguucau

SEQ ID NO: 81300 - RNA, 18 nt, Human
cagcaugguaagccucug

SEQ ID NO: 81301 - RNA, 21 nt, Human
caguucaucaggucaggcaau

SEQ ID NO: 81302 - RNA, 21 nt, Human
caugauaacucaaccucacca

SEQ ID NO: 81303 - RNA, 26 nt, Human
cugaagcaaugguauugaucuuuuuu

SEQ ID NO: 81304 - RNA, 23 nt, Human
gaacaaguccacaugagcuucuu

SEQ ID NO: 81305 - RNA, 24 nt, Human
guccaguggucacgucagcaguuc

SEQ ID NO: 81306 - RNA, 19 nt, Human
ucaaaaggagaaacuuugg

SEQ ID NO: 81307 - RNA, 18 nt, Human
ucaaggguuccggccacu

SEQ ID NO: 81308 - RNA, 19 nt, Human
ucagcaguuccuggcccuc

SEQ ID NO: 81309 - RNA, 20 nt, Human
ucagcaguuccuggcccucc

SEQ ID NO: 81310 - RNA, 23 nt, Human
uuaguagcaugauaacucaaccu

SEQ ID NO: 81311 - RNA, 18 nt, Human
uuccuggcccuccuaggg

SEQ ID NO: 81312 - RNA, 23 nt, Human
uuugggacuuuuucucaaaagga

SEQ ID NO: 81313 - RNA, 22 nt, Human
aaacagcacaagcugaaguggg

SEQ ID NO: 81314 - RNA, 18 nt, Human
aaacaggcauaaaguccu

SEQ ID NO: 81315 - RNA, 19 nt, Human
aaacaggcauaaaguccuc

SEQ ID NO: 81316 - RNA, 20 nt, Human
aaaguccucaccccaggcug

SEQ ID NO: 81317 - RNA, 22 nt, Human
aacacaacuccuucuuggaacc

SEQ ID NO: 81318 - RNA, 18 nt, Human
aaccaugaagaggcccca

SEQ ID NO: 81319 - RNA, 23 nt, Human
aagacaagaaaggaaaggaugag

SEQ ID NO: 81320 - RNA, 19 nt, Human
aagcagagcuugagcuaag

SEQ ID NO: 81321 - RNA, 26 nt, Human
aagcagagcuugagcuaagggcuugg

SEQ ID NO: 81322 - RNA, 23 nt, Human
aagcagcccucuccucuuggaaa

SEQ ID NO: 81323 - RNA, 18 nt, Human
aagcaggauugggggccu

SEQ ID NO: 81324 - RNA, 21 nt, Human
acacaacuccuucuuggaacc

SEQ ID NO: 81325 - RNA, 22 nt, Human
agacaagaaaggaaaggaugag

SEQ ID NO: 81326 - RNA, 21 nt, Human
agagcugggggaagggaaaag

SEQ ID NO: 81327 - RNA, 19 nt, Human
agaggguaagacaagaaug

SEQ ID NO: 81328 - RNA, 23 nt, Human
agccagaacuugagguugcuugg

SEQ ID NO: 81329 - RNA, 21 nt, Human
agccccuggccuccuaccucc

SEQ ID NO: 81330 - RNA, 18 nt, Human
aggcauaaaguccucacc

SEQ ID NO: 81331 - RNA, 18 nt, Human
aguaacagccagaacuug

SEQ ID NO: 81332 - RNA, 19 nt, Human
aucccucccccagcucugg

SEQ ID NO: 81333 - RNA, 21 nt, Human
auccugguccugcuucuguuc

SEQ ID NO: 81334 - RNA, 18 nt, Human
caaaacuggauggugggg

SEQ ID NO: 81335 - RNA, 19 nt, Human
caacagacagugagagaga

SEQ ID NO: 81336 - RNA, 19 nt, Human
caagaugaggcucauccug

SEQ ID NO: 81337 - RNA, 18 nt, Human
cacagaucuacuuaccaa

SEQ ID NO: 81338 - RNA, 21 nt, Human
cacuccacccucagggcucuc

SEQ ID NO: 81339 - RNA, 24 nt, Human
cacuccacccucagggcucucacc

SEQ ID NO: 81340 - RNA, 19 nt, Human
cagagcuugagcuaagggc

SEQ ID NO: 81341 - RNA, 27 nt, Human
cagcucuggccccaauccucccagccc

SEQ ID NO: 81342 - RNA, 19 nt, Human
ccaauccucccagcccacc

SEQ ID NO: 81343 - RNA, 21 nt, Human
ccaggcugcaccaggauacaa

SEQ ID NO: 81344 - RNA, 22 nt, Human
cccaccugccuuauccuugccu

SEQ ID NO: 81345 - RNA, 27 nt, Human
cccagcucuggccccaauccucccagc

SEQ ID NO: 81346 - RNA, 21 nt, Human
ccccaggcugucacuaucucu

SEQ ID NO: 81347 - RNA, 19 nt, Human
ccccauucuagcacaucug

SEQ ID NO: 81348 - RNA, 18 nt, Human
ccccuccuucuuugucca

SEQ ID NO: 81349 - RNA, 19 nt, Human
cccugcucccagucaguug

SEQ ID NO: 81350 - RNA, 22 nt, Human
ccuaccuccucccaccucuugc

SEQ ID NO: 81351 - RNA, 23 nt, Human
ccucagggcucucaccgggcugu

SEQ ID NO: 81352 - RNA, 21 nt, Human
ccuccuuacuucccugcagcc

SEQ ID NO: 81353 - RNA, 22 nt, Human
ccuccuucccagagcucagugg

SEQ ID NO: 81354 - RNA, 18 nt, Human
ccugcagccugccucuuu

SEQ ID NO: 81355 - RNA, 22 nt, Human
ccugccucuuuucugccuggga

SEQ ID NO: 81356 - RNA, 19 nt, Human
ccugggccucuccuggggc

SEQ ID NO: 81357 - RNA, 21 nt, Human
ccuggggccccucccucaccc

SEQ ID NO: 81358 - RNA, 21 nt, Human
ccuucaguaggccuugggaac

SEQ ID NO: 81359 - RNA, 22 nt, Human
ccuugccaggaaacagcacaag

SEQ ID NO: 81360 - RNA, 19 nt, Human
cgcacccaggcguccaggc

SEQ ID NO: 81361 - RNA, 19 nt, Human
cucauccugggccucuccu

SEQ ID NO: 81362 - RNA, 18 nt, Human
cucccagcccaccuucug

SEQ ID NO: 81363 - RNA, 19 nt, Human
cucccagucaguugaccug

SEQ ID NO: 81364 - RNA, 19 nt, Human
cucccccagcucuggcccc

SEQ ID NO: 81365 - RNA, 24 nt, Human
cucccccagcucuggccccaaucc

SEQ ID NO: 81366 - RNA, 22 nt, Human
cuccucccaccucuugccucag

SEQ ID NO: 81367 - RNA, 18 nt, Human
cuccucuagucuggcccc

SEQ ID NO: 81368 - RNA, 22 nt, Human
cuccuggggccccucccucacc

SEQ ID NO: 81369 - RNA, 24 nt, Human
cuccuucccaucaccaacgcaccc

SEQ ID NO: 81370 - RNA, 21 nt, Human
cuggagaagcugaaagguuaa

SEQ ID NO: 81371 - RNA, 20 nt, Human
cuggccuccuucccagagcu

SEQ ID NO: 81372 - RNA, 18 nt, Human
gaaauaggaggacucugc

SEQ ID NO: 81373 - RNA, 20 nt, Human
gaauccugguccugcuucug

SEQ ID NO: 81374 - RNA, 21 nt, Human
gaggacccagaccccaccucu

SEQ ID NO: 81375 - RNA, 24 nt, Human
gauggauagagcugggggaaggga

SEQ ID NO: 81376 - RNA, 18 nt, Human
gcaguaagauucccuggu

SEQ ID NO: 81377 - RNA, 21 nt, Human
gcauggugcuagguuccagga

SEQ ID NO: 81378 - RNA, 21 nt, Human
gccagaacuugagguugcuug

SEQ ID NO: 81379 - RNA, 21 nt, Human
gcucuggccccaauccuccca

SEQ ID NO: 81380 - RNA, 21 nt, Human
gcugcaccaggauacaagaca

SEQ ID NO: 81381 - RNA, 23 nt, Human
ggaaaagucaagcaaaacuugga

SEQ ID NO: 81382 - RNA, 22 nt, Human
ggauggugggguguaaagggac

SEQ ID NO: 81383 - RNA, 20 nt, Human
ggcagauggauagagcuggg

SEQ ID NO: 81384 - RNA, 21 nt, Human
ggccuggcagauggauagagc

SEQ ID NO: 81385 - RNA, 22 nt, Human
gggccccucccucacccugcuc

SEQ ID NO: 81386 - RNA, 18 nt, Human
gggcugucaaugacagcu

SEQ ID NO: 81387 - RNA, 21 nt, Human
ggugcuagguuccaggaggaa

SEQ ID NO: 81388 - RNA, 21 nt, Human
guaaaacaagagagaggaaag

SEQ ID NO: 81389 - RNA, 21 nt, Human
uaaaacaagagagaggaaagc

SEQ ID NO: 81390 - RNA, 22 nt, Human
uaaacaggcauaaaguccucac

SEQ ID NO: 81391 - RNA, 21 nt, Human
uaagggcuuggguacagguga

SEQ ID NO: 81392 - RNA, 21 nt, Human
uaagggcuuggguacagguga

SEQ ID NO: 81393 - RNA, 21 nt, Human
uaagguaaaacaagagagagg

SEQ ID NO: 81394 - RNA, 19 nt, Human
uacagcguauccucacaac

SEQ ID NO: 81395 - RNA, 21 nt, Human
uaccaagcugggagcaagcag

SEQ ID NO: 81396 - RNA, 18 nt, Human
uacuaagaagcagcccuc

SEQ ID NO: 81397 - RNA, 21 nt, Human
uacuucccugcagccugccuc

SEQ ID NO: 81398 - RNA, 22 nt, Human
uacuucccugcagccugccucu

SEQ ID NO: 81399 - RNA, 23 nt, Human
uaggaggacucugcugaauccug

SEQ ID NO: 81400 - RNA, 23 nt, Human
uaucucuaccaccacuccucuag

SEQ ID NO: 81401 - RNA, 21 nt, Human
uauuugguucagggccagggc

SEQ ID NO: 81402 - RNA, 21 nt, Human
ucaguaggccuugggaaccuc

SEQ ID NO: 81403 - RNA, 19 nt, Human
uccaaagcauuuauuagga

SEQ ID NO: 81404 - RNA, 20 nt, Human
uccacgaggacccagacccc

SEQ ID NO: 81405 - RNA, 22 nt, Human
ucccagagcucagugguaaaca

SEQ ID NO: 81406 - RNA, 18 nt, Human
ucccugcagccugccucu

SEQ ID NO: 81407 - RNA, 23 nt, Human
ucccuucaguaggccuugggaac

SEQ ID NO: 81408 - RNA, 22 nt, Human
uccugggccucuccuggggccc

SEQ ID NO: 81409 - RNA, 23 nt, Human
uccugggccucuccuggggcccc

SEQ ID NO: 81410 - RNA, 26 nt, Human
uccugggccucuccuggggccccucc

SEQ ID NO: 81411 - RNA, 22 nt, Human
uccuggggccccucccucaccc

SEQ ID NO: 81412 - RNA, 19 nt, Human
uccugguccggcugagccc

SEQ ID NO: 81413 - RNA, 18 nt, Human
ucucuggccugcagaggu

SEQ ID NO: 81414 - RNA, 21 nt, Human
ugaauccugguccugcuucug

SEQ ID NO: 81415 - RNA, 20 nt, Human
ugacacacaaccaugaagag

SEQ ID NO: 81416 - RNA, 21 nt, Human
ugacacacaaccaugaagagg

SEQ ID NO: 81417 - RNA, 24 nt, Human
ugagaaaaguauagauugcccaag

SEQ ID NO: 81418 - RNA, 20 nt, Human
ugccaggaaacagcacaagc

SEQ ID NO: 81419 - RNA, 22 nt, Human
ugccuuauccuugccuguuucc

SEQ ID NO: 81420 - RNA, 18 nt, Human
uggaaaugaagagauuug

SEQ ID NO: 81421 - RNA, 21 nt, Human
uggaacccagauccccugcuc

SEQ ID NO: 81422 - RNA, 18 nt, Human
uggaaggaaauaggagga

SEQ ID NO: 81423 - RNA, 19 nt, Human
uggcagauggauagagcug

SEQ ID NO: 81424 - RNA, 19 nt, Human
ugggcaaaacuggauggug

SEQ ID NO: 81425 - RNA, 21 nt, Human
uggggagggacaagaugaggc

SEQ ID NO: 81426 - RNA, 22 nt, Human
ugggggaagggaaaagaaaggc

SEQ ID NO: 81427 - RNA, 21 nt, Human
ugguccggcugagccccuggc

SEQ ID NO: 81428 - RNA, 19 nt, Human
uggugcuagguuccaggag

SEQ ID NO: 81429 - RNA, 18 nt, Human
uggugggguguaaaggga

SEQ ID NO: 81430 - RNA, 23 nt, Human
uucccagagcucagugguaaaca

SEQ ID NO: 81431 - RNA, 21 nt, Human
uucugcaguguguauguugcc

SEQ ID NO: 81432 - RNA, 22 nt, Human
uucuguucucaucccuccccca

SEQ ID NO: 81433 - RNA, 24 nt, Human
uugcccaagacaaaagacuggcag

SEQ ID NO: 81434 - RNA, 19 nt, Human
uuggggagggcaccaggag

SEQ ID NO: 81435 - RNA, 20 nt, Human
agaaccaaaugcuggugcca

SEQ ID NO: 81436 - RNA, 18 nt, Human
cuuggucucuuccuucgg

SEQ ID NO: 81437 - RNA, 24 nt, Human
gagaagaaccaaaugcuggugcca

SEQ ID NO: 81438 - RNA, 22 nt, Human
gucaacucuugagaagaaccaa

SEQ ID NO: 81439 - RNA, 22 nt, Human
ugagaagaaccaaaugcuggug

SEQ ID NO: 81440 - RNA, 24 nt, Human
uggaagugcuacaucaccuccucc

SEQ ID NO: 81441 - RNA, 23 nt, Human
cauguccagaaugccacccuccc

SEQ ID NO: 81442 - RNA, 18 nt, Human
ccacuggcugcugggcgg

SEQ ID NO: 81443 - RNA, 19 nt, Human
ccucagagucucggcacgc

SEQ ID NO: 81444 - RNA, 19 nt, Human
ccucccagauggggacaga

SEQ ID NO: 81445 - RNA, 20 nt, Human
cucauguccagaaugccacc

SEQ ID NO: 81446 - RNA, 21 nt, Human
cucucugcccccaucugggag

SEQ ID NO: 81447 - RNA, 18 nt, Human
cucugcccccaucuggga

SEQ ID NO: 81448 - RNA, 20 nt, Human
gaagcucuuggcucaacauu

SEQ ID NO: 81449 - RNA, 19 nt, Human
ugcccccuuccuuugcucc

SEQ ID NO: 81450 - RNA, 24 nt, Human
ugggcggugcucucugcccccauc

SEQ ID NO: 81451 - RNA, 19 nt, Human
uuugcuccucauguccaga

SEQ ID NO: 81452 - RNA, 19 nt, Human
aaagaagucaaacugcagg

SEQ ID NO: 81453 - RNA, 19 nt, Human
aaagaagucaaacugcagg

SEQ ID NO: 81454 - RNA, 21 nt, Human
aaagcaguucagggaggggcg

SEQ ID NO: 81455 - RNA, 19 nt, Human
aagcagcugcggggacaag

SEQ ID NO: 81456 - RNA, 21 nt, Human
aagcagcugcggggacaagga

SEQ ID NO: 81457 - RNA, 21 nt, Human
aagcggccugaagucucgcag

SEQ ID NO: 81458 - RNA, 19 nt, Human
acaagcagccucacagcgg

SEQ ID NO: 81459 - RNA, 20 nt, Human
acagcugcacuuguagcugc

SEQ ID NO: 81460 - RNA, 21 nt, Human
acaguggggagaagagagcac

SEQ ID NO: 81461 - RNA, 21 nt, Human
acaguggggagaagagagcac

SEQ ID NO: 81462 - RNA, 19 nt, Human
acccaauugcugcugcugc

SEQ ID NO: 81463 - RNA, 19 nt, Human
accucauacuuggggacaa

SEQ ID NO: 81464 - RNA, 28 nt, Human
acuggaaugugaggcccacguggaagcc

SEQ ID NO: 81465 - RNA, 20 nt, Human
acugggaggugaugaccucg

SEQ ID NO: 81466 - RNA, 20 nt, Human
acugggaggugaugaccucg

SEQ ID NO: 81467 - RNA, 21 nt, Human
acugugguggaaugggggcuc

SEQ ID NO: 81468 - RNA, 19 nt, Human
agaaccacagaacuugcca

SEQ ID NO: 81469 - RNA, 19 nt, Human
agaaccacagaacuugcca

SEQ ID NO: 81470 - RNA, 21 nt, Human
agacacuugugccccaggaaa

SEQ ID NO: 81471 - RNA, 19 nt, Human
agagaggaaugaugacuuc

SEQ ID NO: 81472 - RNA, 18 nt, Human
agccauugggguauucag

SEQ ID NO: 81473 - RNA, 21 nt, Human
agccauugggguauucaggag

SEQ ID NO: 81474 - RNA, 20 nt, Human
agcucugcucccuggcccca

SEQ ID NO: 81475 - RNA, 23 nt, Human
aggaaacugugguggaauggggg

SEQ ID NO: 81476 - RNA, 21 nt, Human
aggaaaugucacagacaccau

SEQ ID NO: 81477 - RNA, 21 nt, Human
aggaaaugucacagacaccau

SEQ ID NO: 81478 - RNA, 23 nt, Human
aggaagaugccccuggagaaugu

SEQ ID NO: 81479 - RNA, 18 nt, Human
aggagugggggagcuaag

SEQ ID NO: 81480 - RNA, 23 nt, Human
aggggugggccuguagggaggag

SEQ ID NO: 81481 - RNA, 20 nt, Human
agucauaggucucccccagg

SEQ ID NO: 81482 - RNA, 22 nt, Human
aucggcuccccacgguggcucc

SEQ ID NO: 81483 - RNA, 21 nt, Human
caaaugaacaggccaaggucc

SEQ ID NO: 81484 - RNA, 21 nt, Human
caacccagaggcggcugucag

SEQ ID NO: 81485 - RNA, 19 nt, Human
caccgaagcccccauccca

SEQ ID NO: 81486 - RNA, 19 nt, Human
caccgaagcccccauccca

SEQ ID NO: 81487 - RNA, 21 nt, Human
caccuccuauggacagucuca

SEQ ID NO: 81488 - RNA, 22 nt, Human
cacguggaagcccucagacacc

SEQ ID NO: 81489 - RNA, 20 nt, Human
cacugcgcaccuccacgaag

SEQ ID NO: 81490 - RNA, 20 nt, Human
cacugcgcaccuccacgaag

SEQ ID NO: 81491 - RNA, 22 nt, Human
cagaagccaucucggaccucca

SEQ ID NO: 81492 - RNA, 18 nt, Human
cagacaccaucaaaaugg

SEQ ID NO: 81493 - RNA, 18 nt, Human
cagacaccaucaaaaugg

SEQ ID NO: 81494 - RNA, 27 nt, Human
cagccccuugcugguggggguuugugg

SEQ ID NO: 81495 - RNA, 19 nt, Human
cagcucgggggcacagcag

SEQ ID NO: 81496 - RNA, 22 nt, Human
caggaaaugucacagacaccau

SEQ ID NO: 81497 - RNA, 22 nt, Human
caggaaaugucacagacaccau

SEQ ID NO: 81498 - RNA, 18 nt, Human
caggccauuggcccugca

SEQ ID NO: 81499 - RNA, 20 nt, Human
caggccucacuggggggucc

SEQ ID NO: 81500 - RNA, 20 nt, Human
cagggaccugugucuggucc

SEQ ID NO: 81501 - RNA, 18 nt, Human
caggggaggagaaguugc

SEQ ID NO: 81502 - RNA, 21 nt, Human
cagguccuggggccuggggga

SEQ ID NO: 81503 - RNA, 19 nt, Human
cagugcaugugagcagagu

SEQ ID NO: 81504 - RNA, 18 nt, Human
caguucagggaggggcgg

SEQ ID NO: 81505 - RNA, 19 nt, Human
caguucuguccggccagag

SEQ ID NO: 81506 - RNA, 19 nt, Human
caguucuguccggccagag

SEQ ID NO: 81507 - RNA, 20 nt, Human
caucggcuccccacgguggc

SEQ ID NO: 81508 - RNA, 21 nt, Human
caugcacagacacuugugccc

SEQ ID NO: 81509 - RNA, 19 nt, Human
ccaaaucgaggcuggagca

SEQ ID NO: 81510 - RNA, 20 nt, Human
ccagcacaggcggcugcggu

SEQ ID NO: 81511 - RNA, 20 nt, Human
ccaggcagggcccccuaaga

SEQ ID NO: 81512 - RNA, 18 nt, Human
ccccaaggcucagggacc

SEQ ID NO: 81513 - RNA, 19 nt, Human
ccccagggacuccaccucc

SEQ ID NO: 81514 - RNA, 23 nt, Human
ccccagggacuccaccuccugag

SEQ ID NO: 81515 - RNA, 22 nt, Human
cccccagggacuccaccuccug

SEQ ID NO: 81516 - RNA, 19 nt, Human
ccccggaagguggcagggg

SEQ ID NO: 81517 - RNA, 20 nt, Human
ccccuugcugagccgugucc

SEQ ID NO: 81518 - RNA, 19 nt, Human
cccgcgguugggccgagag

SEQ ID NO: 81519 - RNA, 20 nt, Human
cccugcagguccuggggccu

SEQ ID NO: 81520 - RNA, 19 nt, Human
cccuugcugguggggguuu

SEQ ID NO: 81521 - RNA, 22 nt, Human
ccgaagcccccaucccauuccg

SEQ ID NO: 81522 - RNA, 23 nt, Human
ccgaagcccccaucccauuccgu

SEQ ID NO: 81523 - RNA, 23 nt, Human
ccgaagcccccaucccauuccgu

SEQ ID NO: 81524 - RNA, 23 nt, Human
ccgaagcccccaucccauuccgu

SEQ ID NO: 81525 - RNA, 19 nt, Human
ccgcccacccccacuaucc

SEQ ID NO: 81526 - RNA, 21 nt, Human
ccggaguccaguucccccacc

SEQ ID NO: 81527 - RNA, 25 nt, Human
ccggugauacacaauacagcgugua

SEQ ID NO: 81528 - RNA, 24 nt, Human
ccgucagagacgaacuugagccag

SEQ ID NO: 81529 - RNA, 23 nt, Human
ccuacagguccaaaugccccgga

SEQ ID NO: 81530 - RNA, 22 nt, Human
ccuccagaagccaucucggacc

SEQ ID NO: 81531 - RNA, 22 nt, Human
ccuggcaggccucacugggggg

SEQ ID NO: 81532 - RNA, 22 nt, Human
ccuggccaguguugggcccucg

SEQ ID NO: 81533 - RNA, 20 nt, Human
ccuggccccagccccuugcc

SEQ ID NO: 81534 - RNA, 20 nt, Human
cgcauguuguuguacuggga

SEQ ID NO: 81535 - RNA, 20 nt, Human
cgcauguuguuguacuggga

SEQ ID NO: 81536 - RNA, 23 nt, Human
cgcccacccccacuauccagucu

SEQ ID NO: 81537 - RNA, 24 nt, Human
cgcccacccccacuauccagucua

SEQ ID NO: 81538 - RNA, 21 nt, Human
cggcuccccacgguggcuccu

SEQ ID NO: 81539 - RNA, 18 nt, Human
cggcuggacgugcucuug

SEQ ID NO: 81540 - RNA, 19 nt, Human
cgggaggaggcaggguggc

SEQ ID NO: 81541 - RNA, 21 nt, Human
cuaggcgaccaagggcagcug

SEQ ID NO: 81542 - RNA, 22 nt, Human
cucauagccacaguagcgccuu

SEQ ID NO: 81543 - RNA, 21 nt, Human
cuccaccuccugaggcuccau

SEQ ID NO: 81544 - RNA, 24 nt, Human
cuccagaagccaucucggaccucc

SEQ ID NO: 81545 - RNA, 23 nt, Human
cuccccaaggcucagggaccugu

SEQ ID NO: 81546 - RNA, 18 nt, Human
cucccuggccccagcccc

SEQ ID NO: 81547 - RNA, 22 nt, Human
cuccuggcucccauaccagguu

SEQ ID NO: 81548 - RNA, 19 nt, Human
cuccuugggccagcccggg

SEQ ID NO: 81549 - RNA, 19 nt, Human
cuccuugggccagcccggg

SEQ ID NO: 81550 - RNA, 20 nt, Human
cuccuugggccagcccgggc

SEQ ID NO: 81551 - RNA, 20 nt, Human
cuccuugggccagcccgggc

SEQ ID NO: 81552 - RNA, 26 nt, Human
cugcaaaugaacaggccaagguccuc

SEQ ID NO: 81553 - RNA, 19 nt, Human
cugcagagcuggccucuuu

SEQ ID NO: 81554 - RNA, 19 nt, Human
cugcagagcuggccucuuu

SEQ ID NO: 81555 - RNA, 20 nt, Human
cugcagguccuggggccugg

SEQ ID NO: 81556 - RNA, 21 nt, Human
cugggggguccgguuucuuuu

SEQ ID NO: 81557 - RNA, 21 nt, Human
cugggggguccgguuucuuuu

SEQ ID NO: 81558 - RNA, 24 nt, Human
cuggugauggagccguugagcuug

SEQ ID NO: 81559 - RNA, 24 nt, Human
cuggugauggagccguugagcuug

SEQ ID NO: 81560 - RNA, 21 nt, Human
cugguggggguuuguggggaa

SEQ ID NO: 81561 - RNA, 25 nt, Human
cugucuuguuucuccauccccuccc

SEQ ID NO: 81562 - RNA, 19 nt, Human
cuugcugagccguguccuu

SEQ ID NO: 81563 - RNA, 19 nt, Human
cuugugccccaggaaacug

SEQ ID NO: 81564 - RNA, 20 nt, Human
cuuguggaagcucugcuccc

SEQ ID NO: 81565 - RNA, 20 nt, Human
cuuguggaagcucugcuccc

SEQ ID NO: 81566 - RNA, 26 nt, Human
gaagaugccccuggagaauguguucc

SEQ ID NO: 81567 - RNA, 20 nt, Human
gacuggaaugugaggcccac

SEQ ID NO: 81568 - RNA, 26 nt, Human
gagaauguguuccgagcguaaugcau

SEQ ID NO: 81569 - RNA, 19 nt, Human
gaggcuggagcaggggugg

SEQ ID NO: 81570 - RNA, 18 nt, Human
gaguaacaagggguccgg

SEQ ID NO: 81571 - RNA, 18 nt, Human
gaguaacaagggguccgg

SEQ ID NO: 81572 - RNA, 21 nt, Human
gcaaaugaacaggccaagguc

SEQ ID NO: 81573 - RNA, 19 nt, Human
gcaccgaagcccccauccc

SEQ ID NO: 81574 - RNA, 19 nt, Human
gcaccgaagcccccauccc

SEQ ID NO: 81575 - RNA, 22 nt, Human
gcacucggaauuugagcuggug

SEQ ID NO: 81576 - RNA, 22 nt, Human
gcacucggaauuugagcuggug

SEQ ID NO: 81577 - RNA, 22 nt, Human
gcacucggaauuugagcuggug

SEQ ID NO: 81578 - RNA, 22 nt, Human
gcacucggaauuugagcuggug

SEQ ID NO: 81579 - RNA, 25 nt, Human
gcagugcaugugagcagaagggccc

SEQ ID NO: 81580 - RNA, 20 nt, Human
gccaugggcugagagaagcc

SEQ ID NO: 81581 - RNA, 20 nt, Human
gcccaggguguugaggcacc

SEQ ID NO: 81582 - RNA, 20 nt, Human
gcccccuaagagaggaauga

SEQ ID NO: 81583 - RNA, 18 nt, Human
gccccuugcugguggggg

SEQ ID NO: 81584 - RNA, 24 nt, Human
gccccuugcugguggggguuugug

SEQ ID NO: 81585 - RNA, 21 nt, Human
gcccgggcuggugauggagcc

SEQ ID NO: 81586 - RNA, 21 nt, Human
gcccgggcuggugauggagcc

SEQ ID NO: 81587 - RNA, 20 nt, Human
gccucuuuucugagaagaag

SEQ ID NO: 81588 - RNA, 22 nt, Human
gcgccuuccuccagaagccauc

SEQ ID NO: 81589 - RNA, 18 nt, Human
gcggugcccugguguggc

SEQ ID NO: 81590 - RNA, 18 nt, Human
gcuccaguccccgccccu

SEQ ID NO: 81591 - RNA, 18 nt, Human
gcucuuucuucuccuucu

SEQ ID NO: 81592 - RNA, 22 nt, Human
ggaaaugaacauuacaaugaaa

SEQ ID NO: 81593 - RNA, 20 nt, Human
ggaauggcagaguggaggug

SEQ ID NO: 81594 - RNA, 20 nt, Human
ggaauggcagaguggaggug

SEQ ID NO: 81595 - RNA, 19 nt, Human
ggacgggaggaggcagggu

SEQ ID NO: 81596 - RNA, 18 nt, Human
ggacgggcacagugggga

SEQ ID NO: 81597 - RNA, 18 nt, Human
ggacuccccaaggcucag

SEQ ID NO: 81598 - RNA, 24 nt, Human
ggagaagagagcaccaguucuguc

SEQ ID NO: 81599 - RNA, 24 nt, Human
ggagaagagagcaccaguucuguc

SEQ ID NO: 81600 - RNA, 24 nt, Human
ggagcagcucgggggcacagcagg

SEQ ID NO: 81601 - RNA, 20 nt, Human
ggaggagugggggagcuaag

SEQ ID NO: 81602 - RNA, 22 nt, Human
ggaggggcgguccugggaggug

SEQ ID NO: 81603 - RNA, 20 nt, Human
ggaggggguagggcacgggg

SEQ ID NO: 81604 - RNA, 20 nt, Human
ggaggggguagggcacgggg

SEQ ID NO: 81605 - RNA, 20 nt, Human
ggaggugcaggaaagggagc

SEQ ID NO: 81606 - RNA, 20 nt, Human
ggccaaugggagguuucacc

SEQ ID NO: 81607 - RNA, 20 nt, Human
ggccaguguugggcccucgg

SEQ ID NO: 81608 - RNA, 20 nt, Human
ggccuggguguccucagggg

SEQ ID NO: 81609 - RNA, 24 nt, Human
gggaaagcaguucagggaggggcg

SEQ ID NO: 81610 - RNA, 21 nt, Human
gggaagggcugagaugugggc

SEQ ID NO: 81611 - RNA, 18 nt, Human
gggccgagagcacucguc

SEQ ID NO: 81612 - RNA, 21 nt, Human
gggccugggggagagggaugg

SEQ ID NO: 81613 - RNA, 22 nt, Human
ggggccugggggagagggaugg

SEQ ID NO: 81614 - RNA, 19 nt, Human
ggggguagggcacggggaa

SEQ ID NO: 81615 - RNA, 18 nt, Human
gggguagggcacggggaa

SEQ ID NO: 81616 - RNA, 26 nt, Human
gggguccgguuucuuuucugcacucg

SEQ ID NO: 81617 - RNA, 26 nt, Human
gggguccgguuucuuuucugcacucg

SEQ ID NO: 81618 - RNA, 21 nt, Human
gguggcuccugggggacaugc

SEQ ID NO: 81619 - RNA, 21 nt, Human
guagggcacggggaagggucc

SEQ ID NO: 81620 - RNA, 21 nt, Human
guagggcacggggaagggucc

SEQ ID NO: 81621 - RNA, 19 nt, Human
guccucaggggugggccug

SEQ ID NO: 81622 - RNA, 19 nt, Human
gugaguccacugcgcaccu

SEQ ID NO: 81623 - RNA, 19 nt, Human
gugaguccacugcgcaccu

SEQ ID NO: 81624 - RNA, 21 nt, Human
guuccgcccacccccacuauc

SEQ ID NO: 81625 - RNA, 21 nt, Human
uacaaugaaaauaaugccccc

SEQ ID NO: 81626 - RNA, 20 nt, Human
uagcugcccaggguguugag

SEQ ID NO: 81627 - RNA, 21 nt, Human
uaggcgaccaagggcagcagg

SEQ ID NO: 81628 - RNA, 23 nt, Human
ucaggaugaucuucuccccgggu

SEQ ID NO: 81629 - RNA, 20 nt, Human
ucauaggucucccccaggga

SEQ ID NO: 81630 - RNA, 20 nt, Human
uccccaaggcucagggaccu

SEQ ID NO: 81631 - RNA, 18 nt, Human
uccccaucggcuccccac

SEQ ID NO: 81632 - RNA, 19 nt, Human
ucccccagggacuccaccu

SEQ ID NO: 81633 - RNA, 22 nt, Human
ucccuggccaguguugggcccu

SEQ ID NO: 81634 - RNA, 24 nt, Human
uccgccacaagcagcugcggggac

SEQ ID NO: 81635 - RNA, 19 nt, Human
uccuccaagagggagugag

SEQ ID NO: 81636 - RNA, 18 nt, Human
uccugaggcuccaucuuc

SEQ ID NO: 81637 - RNA, 20 nt, Human
uccuugggccagcccgggcu

SEQ ID NO: 81638 - RNA, 20 nt, Human
uccuugggccagcccgggcu

SEQ ID NO: 81639 - RNA, 21 nt, Human
uccuugggccagcccgggcug

SEQ ID NO: 81640 - RNA, 21 nt, Human
uccuugggccagcccgggcug

SEQ ID NO: 81641 - RNA, 21 nt, Human
uccuuuggccaaugggagguu

SEQ ID NO: 81642 - RNA, 20 nt, Human
ucggccuagugagcuggagc

SEQ ID NO: 81643 - RNA, 21 nt, Human
ucucauagccacaguagcgcc

SEQ ID NO: 81644 - RNA, 24 nt, Human
ucuccccgggugugacagagauug

SEQ ID NO: 81645 - RNA, 22 nt, Human
ucucuccacaggcugggcacuu

SEQ ID NO: 81646 - RNA, 21 nt, Human
ucucugcaaaugaacaggcca

SEQ ID NO: 81647 - RNA, 19 nt, Human
ucugcggggagccccugcc

SEQ ID NO: 81648 - RNA, 20 nt, Human
ucuugaugucaucaggcuuc

SEQ ID NO: 81649 - RNA, 18 nt, Human
ugagcagaguagccauug

SEQ ID NO: 81650 - RNA, 18 nt, Human
ugaugacuucgaaauguu

SEQ ID NO: 81651 - RNA, 23 nt, Human
ugcaguaaggagaagauggggag

SEQ ID NO: 81652 - RNA, 24 nt, Human
ugccugugcugucuugcagggucu

SEQ ID NO: 81653 - RNA, 22 nt, Human
ugcgccacacgcagugcaugug

SEQ ID NO: 81654 - RNA, 21 nt, Human
ugcggaauucaacccagaggc

SEQ ID NO: 81655 - RNA, 20 nt, Human
ugcggggacaaggaaggugg

SEQ ID NO: 81656 - RNA, 21 nt, Human
ugcugagccguguccuuuggc

SEQ ID NO: 81657 - RNA, 22 nt, Human
ugcugcggaauucaacccagag

SEQ ID NO: 81658 - RNA, 23 nt, Human
uggacagucucaccaggccauug

SEQ ID NO: 81659 - RNA, 22 nt, Human
uggaggugggggguuggugggc

SEQ ID NO: 81660 - RNA, 22 nt, Human
uggaggugggggguuggugggc

SEQ ID NO: 81661 - RNA, 18 nt, Human
uggcagaguggagguggg

SEQ ID NO: 81662 - RNA, 18 nt, Human
uggcagaguggagguggg

SEQ ID NO: 81663 - RNA, 25 nt, Human
uggccaguguugggcccucggaggg

SEQ ID NO: 81664 - RNA, 22 nt, Human
uggccucuuuucugagaagaag

SEQ ID NO: 81665 - RNA, 20 nt, Human
ugggaggggguagggcacgg

SEQ ID NO: 81666 - RNA, 20 nt, Human
ugggaggggguagggcacgg

SEQ ID NO: 81667 - RNA, 24 nt, Human
uggggagaagagagcaccaguucu

SEQ ID NO: 81668 - RNA, 24 nt, Human
uggggagaagagagcaccaguucu

SEQ ID NO: 81669 - RNA, 20 nt, Human
uggggccagcucguacccgg

SEQ ID NO: 81670 - RNA, 23 nt, Human
uggggccagcucguacccggggu

SEQ ID NO: 81671 - RNA, 22 nt, Human
uggggggguacuccuugggcca

SEQ ID NO: 81672 - RNA, 22 nt, Human
uggggggguacuccuugggcca

SEQ ID NO: 81673 - RNA, 22 nt, Human
uguagcugcccaggguguugag

SEQ ID NO: 81674 - RNA, 24 nt, Human
ugucacagacaccaucaaaauggg

SEQ ID NO: 81675 - RNA, 24 nt, Human
ugucacagacaccaucaaaauggg

SEQ ID NO: 81676 - RNA, 22 nt, Human
ugucccccuugcugagccgugu

SEQ ID NO: 81677 - RNA, 22 nt, Human
ugugccccaggaaacuguggug

SEQ ID NO: 81678 - RNA, 18 nt, Human
uguuucuccauccccucc

SEQ ID NO: 81679 - RNA, 21 nt, Human
uucuccauccccuccccaucg

SEQ ID NO: 81680 - RNA, 20 nt, Human
uugccugugcugucuugcag

SEQ ID NO: 81681 - RNA, 21 nt, Human
uugccugugcugucuugcagg

SEQ ID NO: 81682 - RNA, 21 nt, Human
uuuuacuucacaacaggaaau

SEQ ID NO: 81683 - RNA, 21 nt, Human
uuuuacuucacaacaggaaau

SEQ ID NO: 81684 - RNA, 22 nt, Human
aggcuccgcuggggcaaaggca

SEQ ID NO: 81685 - RNA, 19 nt, Human
caaaggcaccggcgcaaag

SEQ ID NO: 81686 - RNA, 21 nt, Human
ccgcuggggcaaaggcaccgg

SEQ ID NO: 81687 - RNA, 19 nt, Human
ccggccgcgcagucucucu

SEQ ID NO: 81688 - RNA, 21 nt, Human
ccguuccuuuucuuugccucc

SEQ ID NO: 81689 - RNA, 21 nt, Human
cgcaaguuauucucccugcaa

SEQ ID NO: 81690 - RNA, 18 nt, Human
cguccacauggaaaaacu

SEQ ID NO: 81691 - RNA, 25 nt, Human
cguccauugaaagagcguccacaug

SEQ ID NO: 81692 - RNA, 18 nt, Human
cucccugcaaguucaaga

SEQ ID NO: 81693 - RNA, 19 nt, Human
cucccugcaaguucaagaa

SEQ ID NO: 81694 - RNA, 21 nt, Human
ggaguggaggggcgguggggc

SEQ ID NO: 81695 - RNA, 19 nt, Human
gucuaagaagcacgcgggg

SEQ ID NO: 81696 - RNA, 21 nt, Human
uccacauggaaaaacucuggu

SEQ ID NO: 81697 - RNA, 21 nt, Human
uccuuuucuuugccuccuccu

SEQ ID NO: 81698 - RNA, 19 nt, Human
acuccgaaggcgcaaggag

SEQ ID NO: 81699 - RNA, 19 nt, Human
agagcuguaggucgcggcg

SEQ ID NO: 81700 - RNA, 21 nt, Human
agccggcggcggagccgaggg

SEQ ID NO: 81701 - RNA, 23 nt, Human
cacccgcgcagggcgcugcgggc

SEQ ID NO: 81702 - RNA, 18 nt, Human
cagccccacuugcugcgc

SEQ ID NO: 81703 - RNA, 18 nt, Human
ccggcggcggagccgagg

SEQ ID NO: 81704 - RNA, 22 nt, Human
cgagauagcggccagccccacu

SEQ ID NO: 81705 - RNA, 22 nt, Human
cgcggaccucacccgcgcaggg

SEQ ID NO: 81706 - RNA, 20 nt, Human
cggccagccccacuugcugc

SEQ ID NO: 81707 - RNA, 23 nt, Human
cgucuccacuccaacgcugagaa

SEQ ID NO: 81708 - RNA, 24 nt, Human
gagccggcggcggagccgaggguu

SEQ ID NO: 81709 - RNA, 20 nt, Human
ggcguguguggcccgggugu

SEQ ID NO: 81710 - RNA, 23 nt, Human
gggcgccgucuccacuccaacgc

SEQ ID NO: 81711 - RNA, 23 nt, Human
uccccagcagcugcgcggaccuc

SEQ ID NO: 81712 - RNA, 22 nt, Human
ugacaggugggcucuuccccag

SEQ ID NO: 81713 - RNA, 21 nt, Human
ugacccagcgcagccugacag

SEQ ID NO: 81714 - RNA, 25 nt, Human
ugagaaagagcuguaggucgcggcg

SEQ ID NO: 81715 - RNA, 20 nt, Human
uugcugcgcugacccagcgc

SEQ ID NO: 81716 - RNA, 22 nt, Human
aagcugcagcagugcguugcuc

SEQ ID NO: 81717 - RNA, 22 nt, Human
aagcugcagcagugcguugcuc

SEQ ID NO: 81718 - RNA, 22 nt, Human
aagcugcagcagugcguugcuc

SEQ ID NO: 81719 - RNA, 24 nt, Human
accaccaccacacuccuucccccg

SEQ ID NO: 81720 - RNA, 18 nt, Human
acucagccggagcagcag

SEQ ID NO: 81721 - RNA, 18 nt, Human
agcuuccgggccgggcuc

SEQ ID NO: 81722 - RNA, 20 nt, Human
aggcucagggaagcugcagc

SEQ ID NO: 81723 - RNA, 21 nt, Human
agucgagaaaacggugaacag

SEQ ID NO: 81724 - RNA, 18 nt, Human
auuuuuuccauuuuuuuu

SEQ ID NO: 81725 - RNA, 20 nt, Human
caccacacuccuucccccgc

SEQ ID NO: 81726 - RNA, 19 nt, Human
cagcuuucggccugcgcuc

SEQ ID NO: 81727 - RNA, 18 nt, Human
ccccggcggccccucccu

SEQ ID NO: 81728 - RNA, 26 nt, Human
cccucagcucggaugccacacucacc

SEQ ID NO: 81729 - RNA, 21 nt, Human
ccggagcagcagcggcgucuc

SEQ ID NO: 81730 - RNA, 19 nt, Human
ccuccucuuucccucccuc

SEQ ID NO: 81731 - RNA, 19 nt, Human
ccucgcuuucuuucuuucc

SEQ ID NO: 81732 - RNA, 21 nt, Human
ccuucccccgccacuuccuuc

SEQ ID NO: 81733 - RNA, 18 nt, Human
ccuuccuccuccucuucc

SEQ ID NO: 81734 - RNA, 23 nt, Human
ccuucucgcaucuuccuuccucc

SEQ ID NO: 81735 - RNA, 18 nt, Human
cgggcucgccagcagcag

SEQ ID NO: 81736 - RNA, 23 nt, Human
cugcgucugcgucucucucgccu

SEQ ID NO: 81737 - RNA, 22 nt, Human
gagcagcagcggcgucucaggc

SEQ ID NO: 81738 - RNA, 24 nt, Human
gcagcagcggcgucucaggcucgc

SEQ ID NO: 81739 - RNA, 19 nt, Human
gcgucucucucgccucggc

SEQ ID NO: 81740 - RNA, 22 nt, Human
ggccggggacuguggcgcugca

SEQ ID NO: 81741 - RNA, 18 nt, Human
ggcucagggaagcugcag

SEQ ID NO: 81742 - RNA, 18 nt, Human
ggcucagggaagcugcag

SEQ ID NO: 81743 - RNA, 20 nt, Human
gggccggggacuguggcgcu

SEQ ID NO: 81744 - RNA, 20 nt, Human
gggcucgccagcagcagcuc

SEQ ID NO: 81745 - RNA, 19 nt, Human
ggugaguggaugggaacgu

SEQ ID NO: 81746 - RNA, 23 nt, Human
gguguauguggugugugugugug

SEQ ID NO: 81747 - RNA, 19 nt, Human
gguguguguguguggugug

SEQ ID NO: 81748 - RNA, 20 nt, Human
gguguguguguguggugugu

SEQ ID NO: 81749 - RNA, 22 nt, Human
guggcgcugcaggcucgagaua

SEQ ID NO: 81750 - RNA, 19 nt, Human
guguauguggugugugugu

SEQ ID NO: 81751 - RNA, 21 nt, Human
guguguauaucugucuauccu

SEQ ID NO: 81752 - RNA, 20 nt, Human
guguguguguguggugugua

SEQ ID NO: 81753 - RNA, 22 nt, Human
uaaauaaaaguccagcuauaag

SEQ ID NO: 81754 - RNA, 18 nt, Human
uauggucaaaacauuugc

SEQ ID NO: 81755 - RNA, 20 nt, Human
uauggucaaaacauuugcac

SEQ ID NO: 81756 - RNA, 26 nt, Human
uauuuuuuucuuuuaauacguaguua

SEQ ID NO: 81757 - RNA, 18 nt, Human
uccccggagucgagaaaa

SEQ ID NO: 81758 - RNA, 18 nt, Human
uccccggcggccccuccc

SEQ ID NO: 81759 - RNA, 20 nt, Human
uccccggcggccccucccuc

SEQ ID NO: 81760 - RNA, 21 nt, Human
ucccuccuccucugccuucuc

SEQ ID NO: 81761 - RNA, 20 nt, Human
uccuccucugccuucucgca

SEQ ID NO: 81762 - RNA, 20 nt, Human
ucugccuucucgcaucuucc

SEQ ID NO: 81763 - RNA, 22 nt, Human
ugaacagcuuucggccugcgcu

SEQ ID NO: 81764 - RNA, 19 nt, Human
ugcagugaaccugggcgag

SEQ ID NO: 81765 - RNA, 18 nt, Human
uggacgggaaucccaucg

SEQ ID NO: 81766 - RNA, 20 nt, Human
uggcuccuagcuuccgggcc

SEQ ID NO: 81767 - RNA, 21 nt, Human
ugggugaguggaugggaacgu

SEQ ID NO: 81768 - RNA, 21 nt, Human
ugguguauguggugugugugu

SEQ ID NO: 81769 - RNA, 20 nt, Human
uguauguggugugugugugu

SEQ ID NO: 81770 - RNA, 19 nt, Human
ugucuauccucaaggacug

SEQ ID NO: 81771 - RNA, 26 nt, Human
ugugguguauguggugugugugugug

SEQ ID NO: 81772 - RNA, 22 nt, Human
ugugguguguguguguggugug

SEQ ID NO: 81773 - RNA, 20 nt, Human
ugugugguguguauaucugu

SEQ ID NO: 81774 - RNA, 19 nt, Human
ugugugugugguguguaua

SEQ ID NO: 81775 - RNA, 19 nt, Human
uuccccggcggccccuccc

SEQ ID NO: 81776 - RNA, 21 nt, Human
uugaacaaacuugcuggaaag

SEQ ID NO: 81777 - RNA, 21 nt, Human
uugaacaaacuugcuggaaag

SEQ ID NO: 81778 - RNA, 21 nt, Human
uugaacaaacuugcuggaaag

SEQ ID NO: 81779 - RNA, 21 nt, Human
uuuccuuccuccuccucuucc

SEQ ID NO: 81780 - RNA, 26 nt, Human
uuuuuuccauuuuuuuuuuuuuuuuu

SEQ ID NO: 81781 - RNA, 27 nt, Human
aaaaaaaaaaaaccuaagguucuagga

SEQ ID NO: 81782 - RNA, 25 nt, Human
aaaaaaccuaagguucuaggaggua

SEQ ID NO: 81783 - RNA, 23 nt, Human
aaucacagaucuaugcugaucug

SEQ ID NO: 81784 - RNA, 23 nt, Human
aucccuuucuccuucuuacuguu

SEQ ID NO: 81785 - RNA, 23 nt, Human
augacagugacauuucugagcac

SEQ ID NO: 81786 - RNA, 22 nt, Human
caaaacaaauccugauuucuga

SEQ ID NO: 81787 - RNA, 23 nt, Human
cacagaucuaugcugaucugcac

SEQ ID NO: 81788 - RNA, 24 nt, Human
cagccauaaaccuuaauacagauc

SEQ ID NO: 81789 - RNA, 23 nt, Human
cucuuaaaaaaaaaaaaaccuaa

SEQ ID NO: 81790 - RNA, 24 nt, Human
cuuaaaaaaaaaaaaaccuaaggu

SEQ ID NO: 81791 - RNA, 20 nt, Human
cuuccuguaaguccauucaa

SEQ ID NO: 81792 - RNA, 20 nt, Human
cuuuccaaaacaaauccuga

SEQ ID NO: 81793 - RNA, 27 nt, Human
cuuuuuauugcagccauaaaccuuaau

SEQ ID NO: 81794 - RNA, 21 nt, Human
guccucuuaaaaaaaaaaaaa

SEQ ID NO: 81795 - RNA, 19 nt, Human
uaguccuucuuguccucuu

SEQ ID NO: 81796 - RNA, 24 nt, Human
ucaacccuugagcucuuuccaaaa

SEQ ID NO: 81797 - RNA, 20 nt, Human
ucagauuuccaauuauccac

SEQ ID NO: 81798 - RNA, 21 nt, Human
ucccugaauuuacuugaaauc

SEQ ID NO: 81799 - RNA, 23 nt, Human
ucccuuucuccuucuuacuguua

SEQ ID NO: 81800 - RNA, 20 nt, Human
uccucuuaaaaaaaaaaaaa

SEQ ID NO: 81801 - RNA, 19 nt, Human
ucuaugcugaucugcaccu

SEQ ID NO: 81802 - RNA, 21 nt, Human
ucugagcacaacauccucacc

SEQ ID NO: 81803 - RNA, 22 nt, Human
ucuucacuugcuuuugaguucu

SEQ ID NO: 81804 - RNA, 30 nt, Human
ucuuuuuguuauuaucaauauuauuuaauu

SEQ ID NO: 81805 - RNA, 21 nt, Human
ugaaauccuuccuguaagucc

SEQ ID NO: 81806 - RNA, 21 nt, Human
ugacagugacauuucugagca

SEQ ID NO: 81807 - RNA, 19 nt, Human
ugagcacaacauccucacc

SEQ ID NO: 81808 - RNA, 20 nt, Human
ugagcacaacauccucaccg

SEQ ID NO: 81809 - RNA, 24 nt, Human
ugagcucuuuccaaaacaaauccu

SEQ ID NO: 81810 - RNA, 26 nt, Human
ugaucagaugaccuaugcuguaauga

SEQ ID NO: 81811 - RNA, 20 nt, Human
ugcugaucugcaccuuggug

SEQ ID NO: 81812 - RNA, 18 nt, Human
uggaauaugucaagagua

SEQ ID NO: 81813 - RNA, 23 nt, Human
uguuaagaguuuuugcugcauug

SEQ ID NO: 81814 - RNA, 22 nt, Human
uucaaucccuuucuccuucuua

SEQ ID NO: 81815 - RNA, 23 nt, Human
uucaaucccuuucuccuucuuac

SEQ ID NO: 81816 - RNA, 19 nt, Human
uucccugaauuuacuugaa

SEQ ID NO: 81817 - RNA, 22 nt, Human
uugaguucuucucaacccuuga

SEQ ID NO: 81818 - RNA, 23 nt, Human
uugguguuggaauauauaucugu

SEQ ID NO: 81819 - RNA, 25 nt, Human
uuguccucuuaaaaaaaaaaaaacc

SEQ ID NO: 81820 - RNA, 24 nt, Human
uuuugaguucuucucaacccuuga

SEQ ID NO: 81821 - RNA, 19 nt, Human
uuuuuuuucuguuugucug

SEQ ID NO: 81822 - RNA, 18 nt, Human
aaacaaaccccccccccc

SEQ ID NO: 81823 - RNA, 23 nt, Human
aaacaaacccccccccccaaaag

SEQ ID NO: 81824 - RNA, 27 nt, Human
aaacaaacccccccccccaaaagcccg

SEQ ID NO: 81825 - RNA, 26 nt, Human
aaacagauauaaaauagacaauaaau

SEQ ID NO: 81826 - RNA, 28 nt, Human
aaagcccggccccccccccaacgccacu

SEQ ID NO: 81827 - RNA, 24 nt, Human
aacaaacccccccccccaaaagcc

SEQ ID NO: 81828 - RNA, 20 nt, Human
aacagcaaugacugagacaa

SEQ ID NO: 81829 - RNA, 22 nt, Human
aacccccccccccaaaagcccg

SEQ ID NO: 81830 - RNA, 26 nt, Human
aagcccggccccccccccaacgccac

SEQ ID NO: 81831 - RNA, 25 nt, Human
acaccacgacaccccccaaacaaac

SEQ ID NO: 81832 - RNA, 18 nt, Human
acaccccccaaacaaacc

SEQ ID NO: 81833 - RNA, 19 nt, Human
acaccccccaaacaaaccc

SEQ ID NO: 81834 - RNA, 18 nt, Human
auguuucugcaguuacca

SEQ ID NO: 81835 - RNA, 19 nt, Human
caaacaaaccccccccccc

SEQ ID NO: 81836 - RNA, 19 nt, Human
caaacaaaccccccccccc

SEQ ID NO: 81837 - RNA, 18 nt, Human
caaacccccccccccaaa

SEQ ID NO: 81838 - RNA, 20 nt, Human
caaacccccccccccaaaag

SEQ ID NO: 81839 - RNA, 26 nt, Human
caaacccccccccccaaaagcccggc

SEQ ID NO: 81840 - RNA, 20 nt, Human
caacaaaacuccagcacgaa

SEQ ID NO: 81841 - RNA, 22 nt, Human
caacaaaacuccagcacgaaca

SEQ ID NO: 81842 - RNA, 20 nt, Human
caacagcaaugacugagaca

SEQ ID NO: 81843 - RNA, 21 nt, Human
caacagcaaugacugagacaa

SEQ ID NO: 81844 - RNA, 24 nt, Human
caagggcgccccguggagcccuuc

SEQ ID NO: 81845 - RNA, 21 nt, Human
cacaccacgacaccccccaaa

SEQ ID NO: 81846 - RNA, 21 nt, Human
caccuccaacugugcuuccgu

SEQ ID NO: 81847 - RNA, 25 nt, Human
cacgacaccccccaaacaaaccccc

SEQ ID NO: 81848 - RNA, 23 nt, Human
cagaggcguuccccccacuuccc

SEQ ID NO: 81849 - RNA, 21 nt, Human
cagcaaauggaggauugaggu

SEQ ID NO: 81850 - RNA, 22 nt, Human
cagcacgaacauacaacagcaa

SEQ ID NO: 81851 - RNA, 20 nt, Human
caguccuuaucucucauggu

SEQ ID NO: 81852 - RNA, 21 nt, Human
cagucuacuuuugguacuagc

SEQ ID NO: 81853 - RNA, 21 nt, Human
cauacaacagcaaugacugag

SEQ ID NO: 81854 - RNA, 18 nt, Human
caugauugugaaaaagac

SEQ ID NO: 81855 - RNA, 19 nt, Human
ccaacgccacagcaaaaca

SEQ ID NO: 81856 - RNA, 22 nt, Human
ccacaccacgacaccccccaaa

SEQ ID NO: 81857 - RNA, 24 nt, Human
ccacaccacgacaccccccaaaca

SEQ ID NO: 81858 - RNA, 20 nt, Human
cccaaaagcccggccccccc

SEQ ID NO: 81859 - RNA, 25 nt, Human
cccaaacaaacccccccccccaaaa

SEQ ID NO: 81860 - RNA, 22 nt, Human
cccacaccacgacaccccccaa

SEQ ID NO: 81861 - RNA, 23 nt, Human
cccacaccacgacaccccccaaa

SEQ ID NO: 81862 - RNA, 21 nt, Human
ccccaaaagcccggccccccc

SEQ ID NO: 81863 - RNA, 23 nt, Human
ccccaaaagcccggccccccccc

SEQ ID NO: 81864 - RNA, 20 nt, Human
ccccaaacaaaccccccccc

SEQ ID NO: 81865 - RNA, 23 nt, Human
ccccaaacaaaccccccccccca

SEQ ID NO: 81866 - RNA, 24 nt, Human
ccccaaacaaacccccccccccaa

SEQ ID NO: 81867 - RNA, 21 nt, Human
ccccaacgccacagcaaaaca

SEQ ID NO: 81868 - RNA, 19 nt, Human
cccccaaaagcccggcccc

SEQ ID NO: 81869 - RNA, 25 nt, Human
cccccaaaagcccggcccccccccc

SEQ ID NO: 81870 - RNA, 24 nt, Human
ccccccaaaagcccggcccccccc

SEQ ID NO: 81871 - RNA, 18 nt, Human
ccccccaaacaaaccccc

SEQ ID NO: 81872 - RNA, 23 nt, Human
ccccccaaacaaacccccccccc

SEQ ID NO: 81873 - RNA, 24 nt, Human
cccccccccccaaaagcccggccc

SEQ ID NO: 81874 - RNA, 20 nt, Human
cccgcccacaccacgacacc

SEQ ID NO: 81875 - RNA, 20 nt, Human
cccgcccggccgggcugccc

SEQ ID NO: 81876 - RNA, 18 nt, Human
ccgcccggccgggcugcc

SEQ ID NO: 81877 - RNA, 22 nt, Human
ccuguggacuucugggaaugaa

SEQ ID NO: 81878 - RNA, 24 nt, Human
cgacaccccccaaacaaacccccc

SEQ ID NO: 81879 - RNA, 25 nt, Human
cgcccacaccacgacaccccccaaa

SEQ ID NO: 81880 - RNA, 19 nt, Human
cgcgaggcguggagcggcg

SEQ ID NO: 81881 - RNA, 18 nt, Human
cggcgggcucgcuucccc

SEQ ID NO: 81882 - RNA, 23 nt, Human
cuacagaccaacaacuacucacg

SEQ ID NO: 81883 - RNA, 24 nt, Human
cuagagccggcaguccagaaguua

SEQ ID NO: 81884 - RNA, 19 nt, Human
cugcccccgcggaucccgc

SEQ ID NO: 81885 - RNA, 27 nt, Human
cuucacgguuauguuucugcaguuacc

SEQ ID NO: 81886 - RNA, 23 nt, Human
cuuccguguuuuuuuaaggcaga

SEQ ID NO: 81887 - RNA, 21 nt, Human
gaacagaggcguuccccccac

SEQ ID NO: 81888 - RNA, 23 nt, Human
gaccuuaugcuacagacauccaa

SEQ ID NO: 81889 - RNA, 20 nt, Human
gagcggcggagcgaggccgg

SEQ ID NO: 81890 - RNA, 20 nt, Human
gcagagaaccacuuuacuga

SEQ ID NO: 81891 - RNA, 18 nt, Human
gccccccccccaacgcca

SEQ ID NO: 81892 - RNA, 20 nt, Human
gcccgcccacaccacgacac

SEQ ID NO: 81893 - RNA, 21 nt, Human
ggcccuuggcgugagcagucc

SEQ ID NO: 81894 - RNA, 20 nt, Human
ggguuuuugggggaggaggg

SEQ ID NO: 81895 - RNA, 18 nt, Human
gucaaagaaccguucugg

SEQ ID NO: 81896 - RNA, 19 nt, Human
guccccagcaucugguuuc

SEQ ID NO: 81897 - RNA, 22 nt, Human
guggagcccuggcuguggccug

SEQ ID NO: 81898 - RNA, 23 nt, Human
uacaacagcaaugacugagacaa

SEQ ID NO: 81899 - RNA, 24 nt, Human
uacaacagcaaugacugagacaag

SEQ ID NO: 81900 - RNA, 20 nt, Human
uacauuuaacuccuuugaga

SEQ ID NO: 81901 - RNA, 20 nt, Human
uccuguggacuucugggaau

SEQ ID NO: 81902 - RNA, 19 nt, Human
ucggcgggcucgcuucccc

SEQ ID NO: 81903 - RNA, 23 nt, Human
ucguccggggcgcccccaguugc

SEQ ID NO: 81904 - RNA, 22 nt, Human
ucucauggucguccggggcgcc

SEQ ID NO: 81905 - RNA, 22 nt, Human
ugaaaagguacuagagccggca

SEQ ID NO: 81906 - RNA, 20 nt, Human
ugagcaguccccgccaccuc

SEQ ID NO: 81907 - RNA, 20 nt, Human
uggagcccuggcuguggccu

SEQ ID NO: 81908 - RNA, 21 nt, Human
uggagcccuggcuguggccug

SEQ ID NO: 81909 - RNA, 22 nt, Human
uggccugggcugugcguccugu

SEQ ID NO: 81910 - RNA, 21 nt, Human
ugggcacccucauuuuauuuu

SEQ ID NO: 81911 - RNA, 24 nt, Human
ugguggguuuuugggggaggaggg

SEQ ID NO: 81912 - RNA, 19 nt, Human
ugugcuggucaaagaaccg

SEQ ID NO: 81913 - RNA, 22 nt, Human
uguggcgugguaugcuguauag

SEQ ID NO: 81914 - RNA, 22 nt, Human
uuagaaaauauucuaaaauuua

SEQ ID NO: 81915 - RNA, 23 nt, Human
uucaaagucucaucgucccaccu

SEQ ID NO: 81916 - RNA, 24 nt, Human
uucaaagucucaucgucccaccuc

SEQ ID NO: 81917 - RNA, 20 nt, Human
uucauaaacagcaugcucau

SEQ ID NO: 81918 - RNA, 24 nt, Human
uuggcugaaauaaguguauuuuca

SEQ ID NO: 81919 - RNA, 25 nt, Human
uuucacaccaacaaaacuccagcac

SEQ ID NO: 81920 - RNA, 23 nt, Human
uuugguggguuuuugggggagga

SEQ ID NO: 81921 - RNA, 21 nt, Human
aacuuccgggucaauuuuccu

SEQ ID NO: 81922 - RNA, 21 nt, Human
aaggcgagcaauggaggaucc

SEQ ID NO: 81923 - RNA, 19 nt, Human
agaaaaacuuggccccaaa

SEQ ID NO: 81924 - RNA, 22 nt, Human
agaaaaacuuggccccaaaggg

SEQ ID NO: 81925 - RNA, 22 nt, Human
agcaauggaggauccagaaaaa

SEQ ID NO: 81926 - RNA, 20 nt, Human
aggcggccgucccggccguc

SEQ ID NO: 81927 - RNA, 19 nt, Human
cccaccccuugccacgccc

SEQ ID NO: 81928 - RNA, 19 nt, Human
ccccagguggcagaggggg

SEQ ID NO: 81929 - RNA, 23 nt, Human
ccgggcccgcaccgccccaggug

SEQ ID NO: 81930 - RNA, 22 nt, Human
ccuggcccggccauuuuucuuu

SEQ ID NO: 81931 - RNA, 22 nt, Human
ccuugccacgcccccuuccucc

SEQ ID NO: 81932 - RNA, 20 nt, Human
ccuuuaaaguuggggauagg

SEQ ID NO: 81933 - RNA, 24 nt, Human
cgggcuccgggcccgcaccgcccc

SEQ ID NO: 81934 - RNA, 21 nt, Human
cgggcuccgggcuccgggccc

SEQ ID NO: 81935 - RNA, 19 nt, Human
cuaauacucucacaccuuu

SEQ ID NO: 81936 - RNA, 21 nt, Human
cuagguuuugccugcacagcu

SEQ ID NO: 81937 - RNA, 21 nt, Human
cuucccagccaaugaccuggc

SEQ ID NO: 81938 - RNA, 18 nt, Human
gagcaauggaggauccag

SEQ ID NO: 81939 - RNA, 21 nt, Human
gcuggguggccuggcugguag

SEQ ID NO: 81940 - RNA, 23 nt, Human
gcuggguggccuggcugguaggc

SEQ ID NO: 81941 - RNA, 19 nt, Human
ggcuccgggcuccgggccc

SEQ ID NO: 81942 - RNA, 21 nt, Human
gggcaggcggccgucccggcc

SEQ ID NO: 81943 - RNA, 20 nt, Human
gggcuccgggcuccgggccc

SEQ ID NO: 81944 - RNA, 22 nt, Human
ggguggccuggcugguaggcgc

SEQ ID NO: 81945 - RNA, 21 nt, Human
ucaauuuuccuuucgcacaga

SEQ ID NO: 81946 - RNA, 23 nt, Human
uccagaaaaacuuggccccaaag

SEQ ID NO: 81947 - RNA, 21 nt, Human
ugaaaaacugaucaaaagcca

SEQ ID NO: 81948 - RNA, 22 nt, Human
ugaccuggcccggccauuuuuc

SEQ ID NO: 81949 - RNA, 21 nt, Human
ugccugcacagcuuguaggau

SEQ ID NO: 81950 - RNA, 19 nt, Human
uggccaaggcgagcaaugg

SEQ ID NO: 81951 - RNA, 22 nt, Human
uuaugcguuguuuuuuuuuccu

SEQ ID NO: 81952 - RNA, 24 nt, Human
uuguuuuuuuuuccugcuagguuu

SEQ ID NO: 81953 - RNA, 26 nt, Human
uuucgcacagacaccaaugugcccac

SEQ ID NO: 81954 - RNA, 19 nt, Human
uuuucuuuaugcguuguuu

SEQ ID NO: 81955 - RNA, 21 nt, Human
acagcuccuccagccacuccu

SEQ ID NO: 81956 - RNA, 21 nt, Human
cagcgcaggggcgaugggcga

SEQ ID NO: 81957 - RNA, 23 nt, Human
cagggccuggggacgccccgacg

SEQ ID NO: 81958 - RNA, 23 nt, Human
cauuuaaggguuuucugccucug

SEQ ID NO: 81959 - RNA, 20 nt, Human
ccaauccgucugucgccgcc

SEQ ID NO: 81960 - RNA, 18 nt, Human
ccccgccgcgcgacaccu

SEQ ID NO: 81961 - RNA, 25 nt, Human
ccuccagccacuccugcucugccgg

SEQ ID NO: 81962 - RNA, 22 nt, Human
cgcggccgacccagggccuggg

SEQ ID NO: 81963 - RNA, 20 nt, Human
cucucggccaauccgucugu

SEQ ID NO: 81964 - RNA, 23 nt, Human
cuguugcuccagcgccuccuggg

SEQ ID NO: 81965 - RNA, 18 nt, Human
gacaccuguccuggcucc

SEQ ID NO: 81966 - RNA, 20 nt, Human
gacaggaaguaggcacagag

SEQ ID NO: 81967 - RNA, 23 nt, Human
gauccagaugagaaggguggcug

SEQ ID NO: 81968 - RNA, 18 nt, Human
ggacggagaggaccggga

SEQ ID NO: 81969 - RNA, 18 nt, Human
ggcggcgggcggcggggc

SEQ ID NO: 81970 - RNA, 19 nt, Human
ggcgggcggcgggcggcgg

SEQ ID NO: 81971 - RNA, 24 nt, Human
ggcuguggccgcgguccgagcagc

SEQ ID NO: 81972 - RNA, 19 nt, Human
gggacgccaccgccucgag

SEQ ID NO: 81973 - RNA, 19 nt, Human
gggccccugacacuccugc

SEQ ID NO: 81974 - RNA, 23 nt, Human
gggcggggcgggacgggcgggca

SEQ ID NO: 81975 - RNA, 23 nt, Human
gggcucggcgggcggcgggcggc

SEQ ID NO: 81976 - RNA, 25 nt, Human
uccaaccacagcuccuccagccacu

SEQ ID NO: 81977 - RNA, 18 nt, Human
uccgcggccgacccaggg

SEQ ID NO: 81978 - RNA, 20 nt, Human
uccugcucugccggcgccac

SEQ ID NO: 81979 - RNA, 21 nt, Human
ucggcgggcggcgggcggcgg

SEQ ID NO: 81980 - RNA, 20 nt, Human
ugagaaggguggcugcagua

SEQ ID NO: 81981 - RNA, 27 nt, Human
ugcuccaaccacagcuccuccagccac

SEQ ID NO: 81982 - RNA, 18 nt, Human
ugcuccagcgccuccugg

SEQ ID NO: 81983 - RNA, 18 nt, Human
uggccgcgguccgagcaa

SEQ ID NO: 81984 - RNA, 19 nt, Human
uggcugcaguagggcuggg

SEQ ID NO: 81985 - RNA, 20 nt, Human
uggcugcaguagggcugggc

SEQ ID NO: 81986 - RNA, 19 nt, Human
uugcuccagcgccuccugg

SEQ ID NO: 81987 - RNA, 21 nt, Human
aaaauaagcaguaucccaaac

SEQ ID NO: 81988 - RNA, 21 nt, Human
aaauggcagcagaggaauccc

SEQ ID NO: 81989 - RNA, 25 nt, Human
aagcaugguucauggcaauagaagc

SEQ ID NO: 81990 - RNA, 19 nt, Human
aaggcuuucacagaaagca

SEQ ID NO: 81991 - RNA, 18 nt, Human
acaaaaccaccggccacc

SEQ ID NO: 81992 - RNA, 23 nt, Human
acagaaagcaccguuuuaugaac

SEQ ID NO: 81993 - RNA, 23 nt, Human
acaggcaauucaguacccagagc

SEQ ID NO: 81994 - RNA, 23 nt, Human
accaaguuaacauccuuauucca

SEQ ID NO: 81995 - RNA, 22 nt, Human
agcacaaaaccaccggccacca

SEQ ID NO: 81996 - RNA, 21 nt, Human
aggcaauucaguacccagagc

SEQ ID NO: 81997 - RNA, 24 nt, Human
aggcacuuacauugcuaucaaaug

SEQ ID NO: 81998 - RNA, 20 nt, Human
augcaguucauaaaaaccca

SEQ ID NO: 81999 - RNA, 24 nt, Human
auuuucuccaaacagcuuugaccu

SEQ ID NO: 82000 - RNA, 21 nt, Human
caaacagcuuugaccuaugcu

SEQ ID NO: 82001 - RNA, 26 nt, Human
caagacaguauuaaacugaugcauau

SEQ ID NO: 82002 - RNA, 24 nt, Human
cacacacacaucacuaaggacaca

SEQ ID NO: 82003 - RNA, 22 nt, Human
cacacacaucacuaaggacaca

SEQ ID NO: 82004 - RNA, 20 nt, Human
cacaucacuaaggacacagg

SEQ ID NO: 82005 - RNA, 22 nt, Human
cacauuuaaaauaaagcugucc

SEQ ID NO: 82006 - RNA, 20 nt, Human
cacuaaggacacaggacaaa

SEQ ID NO: 82007 - RNA, 21 nt, Human
cauugcuaucaaaugcaggaa

SEQ ID NO: 82008 - RNA, 18 nt, Human
ccacauuuaaaauaaagc

SEQ ID NO: 82009 - RNA, 22 nt, Human
ccaccggccaccaauaucuucc

SEQ ID NO: 82010 - RNA, 20 nt, Human
ccccagggaacgcauccucc

SEQ ID NO: 82011 - RNA, 18 nt, Human
ccggccaccaauaucuuc

SEQ ID NO: 82012 - RNA, 23 nt, Human
ccuccaagauguggcuagauaaa

SEQ ID NO: 82013 - RNA, 22 nt, Human
cuacuucaccaauuuaaaugac

SEQ ID NO: 82014 - RNA, 19 nt, Human
cucuaauuccacccaugcc

SEQ ID NO: 82015 - RNA, 21 nt, Human
cuuguaaaagaucgcaagcac

SEQ ID NO: 82016 - RNA, 21 nt, Human
cuuuuggccuuggcaucagcu

SEQ ID NO: 82017 - RNA, 19 nt, Human
gaacaugguuauaggcacu

SEQ ID NO: 82018 - RNA, 19 nt, Human
gaauauagaacaugguuau

SEQ ID NO: 82019 - RNA, 19 nt, Human
gauugaagucuugaugcag

SEQ ID NO: 82020 - RNA, 21 nt, Human
gcaguaucccaaacacaucau

SEQ ID NO: 82021 - RNA, 27 nt, Human
gcaugugcauggagacacacacacagu

SEQ ID NO: 82022 - RNA, 26 nt, Human
gcucauuuaucuucuuaaggcuuuca

SEQ ID NO: 82023 - RNA, 21 nt, Human
ggaacgcauccuccagcccuc

SEQ ID NO: 82024 - RNA, 19 nt, Human
uaaaaacaguucuugcagu

SEQ ID NO: 82025 - RNA, 24 nt, Human
uaaaauaagcaguaucccaaacac

SEQ ID NO: 82026 - RNA, 24 nt, Human
uacaaagguagaauacaaacgaac

SEQ ID NO: 82027 - RNA, 22 nt, Human
uacccagagcuugacuggagac

SEQ ID NO: 82028 - RNA, 25 nt, Human
uagaacaugguuauaggcacuuaca

SEQ ID NO: 82029 - RNA, 23 nt, Human
uauaaauaacuucccuuuuaaaa

SEQ ID NO: 82030 - RNA, 19 nt, Human
uauuucuccaucucugcug

SEQ ID NO: 82031 - RNA, 24 nt, Human
uccacccaugccauggguaaaaac

SEQ ID NO: 82032 - RNA, 22 nt, Human
ugacaaaaauaauaaccacaaa

SEQ ID NO: 82033 - RNA, 22 nt, Human
ugagauuggcgaaucuugguca

SEQ ID NO: 82034 - RNA, 24 nt, Human
ugaugcaguucauaaaaacccacu

SEQ ID NO: 82035 - RNA, 21 nt, Human
ugccauggguaaaaacaguuc

SEQ ID NO: 82036 - RNA, 21 nt, Human
ugcuuucuuacgacuccucca

SEQ ID NO: 82037 - RNA, 21 nt, Human
uucaguacccagagcuugacu

SEQ ID NO: 82038 - RNA, 19 nt, Human
uugaaggaaaacaguccaa

SEQ ID NO: 82039 - RNA, 24 nt, Human
uuggcaucagcuuucauguuaaaa

SEQ ID NO: 82040 - RNA, 25 nt, Human
uuuccuguguacugucaccuuuaau

SEQ ID NO: 82041 - RNA, 21 nt, Human
uuucuuacgacuccuccaaga

SEQ ID NO: 82042 - RNA, 20 nt, Human
uuuuaugaacaggcaauuca

SEQ ID NO: 82043 - RNA, 22 nt, Human
aaaggugaggucugaacccacu

SEQ ID NO: 82044 - RNA, 21 nt, Human
acugcccgcgucccgcgaggc

SEQ ID NO: 82045 - RNA, 20 nt, Human
aggcaugaaaugaucuuccu

SEQ ID NO: 82046 - RNA, 21 nt, Human
augaaucagcagaagucugaa

SEQ ID NO: 82047 - RNA, 21 nt, Human
ccccgccgacuccgcgccccg

SEQ ID NO: 82048 - RNA, 19 nt, Human
ccccgcgcgugcgcucccg

SEQ ID NO: 82049 - RNA, 21 nt, Human
cccgcgucccgcgaggccccg

SEQ ID NO: 82050 - RNA, 22 nt, Human
ccgccuacaaacagacacggau

SEQ ID NO: 82051 - RNA, 23 nt, Human
ccgcgcgugcgcucccggcuccc

SEQ ID NO: 82052 - RNA, 25 nt, Human
ccuacaaacagacacggaucaaucu

SEQ ID NO: 82053 - RNA, 19 nt, Human
ccucagcgccgcggucucc

SEQ ID NO: 82054 - RNA, 18 nt, Human
ccugaaaggugaggucug

SEQ ID NO: 82055 - RNA, 22 nt, Human
ccuuuccuuucacaucuaagaa

SEQ ID NO: 82056 - RNA, 19 nt, Human
cgcacugcccgcgucccgc

SEQ ID NO: 82057 - RNA, 19 nt, Human
cgcucccggcucccgcguc

SEQ ID NO: 82058 - RNA, 22 nt, Human
cggcucccgcguccucagcgcc

SEQ ID NO: 82059 - RNA, 21 nt, Human
cugcccacaaacagaagagua

SEQ ID NO: 82060 - RNA, 19 nt, Human
cuuccuuuccuuucacauc

SEQ ID NO: 82061 - RNA, 24 nt, Human
cuuccuuuccuuucacaucuaaga

SEQ ID NO: 82062 - RNA, 19 nt, Human
gaucuuccuuuccuuucac

SEQ ID NO: 82063 - RNA, 18 nt, Human
gcgcucccggcucccgcg

SEQ ID NO: 82064 - RNA, 20 nt, Human
gcucccggcucccgcguccu

SEQ ID NO: 82065 - RNA, 18 nt, Human
guaggcugaacuccaccc

SEQ ID NO: 82066 - RNA, 22 nt, Human
gucauagcucagagccaaaugg

SEQ ID NO: 82067 - RNA, 18 nt, Human
guuuaacuuuuuguuucc

SEQ ID NO: 82068 - RNA, 18 nt, Human
uaucaacaaggcaugaaa

SEQ ID NO: 82069 - RNA, 18 nt, Human
uaucaaggaaguuugcuu

SEQ ID NO: 82070 - RNA, 22 nt, Human
uccucagcgccgcggucuccga

SEQ ID NO: 82071 - RNA, 21 nt, Human
ucugcccacaaacagaagagu

SEQ ID NO: 82072 - RNA, 21 nt, Human
ucuuccuuuccuuucacaucu

SEQ ID NO: 82073 - RNA, 20 nt, Human
ugggagcuucucugucuuug

SEQ ID NO: 82074 - RNA, 21 nt, Human
aaacauuucacagacaguuca

SEQ ID NO: 82075 - RNA, 18 nt, Human
aaagaaaagaaauauggg

SEQ ID NO: 82076 - RNA, 24 nt, Human
aaauggcugaugagaggaccuagc

SEQ ID NO: 82077 - RNA, 21 nt, Human
aauaauuucacuccauaggcu

SEQ ID NO: 82078 - RNA, 21 nt, Human
aauaauuucacuccauaggcu

SEQ ID NO: 82079 - RNA, 23 nt, Human
agaaauaugggaaguagaccggc

SEQ ID NO: 82080 - RNA, 18 nt, Human
agguggaggggcgccacc

SEQ ID NO: 82081 - RNA, 28 nt, Human
auacaguuugaaaggacaaauggcugau

SEQ ID NO: 82082 - RNA, 21 nt, Human
augagaggaccuagcugcaga

SEQ ID NO: 82083 - RNA, 22 nt, Human
augaugcaaaaaauaauuucac

SEQ ID NO: 82084 - RNA, 22 nt, Human
augaugcaaaaaauaauuucac

SEQ ID NO: 82085 - RNA, 24 nt, Human
caguucauuccuauaucuuuagac

SEQ ID NO: 82086 - RNA, 25 nt, Human
cauuucucucccucgcggcuggggg

SEQ ID NO: 82087 - RNA, 21 nt, Human
ccagggugcggagggcgggga

SEQ ID NO: 82088 - RNA, 20 nt, Human
cccugggccagccaagaauc

SEQ ID NO: 82089 - RNA, 20 nt, Human
cccugggccagccaagaauc

SEQ ID NO: 82090 - RNA, 21 nt, Human
ccguggacugauccugcccgu

SEQ ID NO: 82091 - RNA, 23 nt, Human
ccguggacugauccugcccguau

SEQ ID NO: 82092 - RNA, 23 nt, Human
ccuccaaacggaaggcaugucug

SEQ ID NO: 82093 - RNA, 24 nt, Human
cugauccugcccguaucacaauac

SEQ ID NO: 82094 - RNA, 28 nt, Human
cugcccuguuacugccauuauuguugac

SEQ ID NO: 82095 - RNA, 18 nt, Human
cuuuagacaccaugguug

SEQ ID NO: 82096 - RNA, 22 nt, Human
gauaucaaaaaaauauccaggu

SEQ ID NO: 82097 - RNA, 19 nt, Human
gcugcagaaauucccuuca

SEQ ID NO: 82098 - RNA, 20 nt, Human
ggaaggcaugucugugggga

SEQ ID NO: 82099 - RNA, 24 nt, Human
uagggaguuuucacacguuucuug

SEQ ID NO: 82100 - RNA, 18 nt, Human
uaucacaauacaguuuga

SEQ ID NO: 82101 - RNA, 18 nt, Human
ucaguggagaugacccag

SEQ ID NO: 82102 - RNA, 20 nt, Human
ucaguggagaugacccaggu

SEQ ID NO: 82103 - RNA, 22 nt, Human
ucaguggagaugacccaggugg

SEQ ID NO: 82104 - RNA, 29 nt, Human
ucaugccgcugcagaaauucccuucauuu

SEQ ID NO: 82105 - RNA, 19 nt, Human
ucccguggacugauccugc

SEQ ID NO: 82106 - RNA, 19 nt, Human
ucggacggggugccgcggc

SEQ ID NO: 82107 - RNA, 20 nt, Human
ucuuuagacaccaugguugu

SEQ ID NO: 82108 - RNA, 18 nt, Human
ugagaggaccuagcugca

SEQ ID NO: 82109 - RNA, 20 nt, Human
ugagaggaccuagcugcaga

SEQ ID NO: 82110 - RNA, 21 nt, Human
uguagcagugccuccuucugc

SEQ ID NO: 82111 - RNA, 20 nt, Human
uuucacagacaguucauucc

SEQ ID NO: 82112 - RNA, 22 nt, Human
cagcauaaacaaaauuacuaau

SEQ ID NO: 82113 - RNA, 23 nt, Human
cuaaauuacauuaugccuugcua

SEQ ID NO: 82114 - RNA, 18 nt, Human
cuucugcuauaggcugga

SEQ ID NO: 82115 - RNA, 22 nt, Human
cuuuuguuuccugccuuguuca

SEQ ID NO: 82116 - RNA, 25 nt, Human
gacgcgugggucgcccacgcguccg

SEQ ID NO: 82117 - RNA, 21 nt, Human
gcucuaagcaaaaaguuacug

SEQ ID NO: 82118 - RNA, 22 nt, Human
uauaucaggagcagcauaaaca

SEQ ID NO: 82119 - RNA, 19 nt, Human
uauugcagucugaaaaugu

SEQ ID NO: 82120 - RNA, 20 nt, Human
ucugcuauaggcuggaaagu

SEQ ID NO: 82121 - RNA, 23 nt, Human
ugaaaaugcuggccagcaucuau

SEQ ID NO: 82122 - RNA, 19 nt, Human
ugaaaaugugcuucugcua

SEQ ID NO: 82123 - RNA, 26 nt, Human
ugacaaugacaauauaaagaaaagaa

SEQ ID NO: 82124 - RNA, 18 nt, Human
ugaggcaccaucaccgga

SEQ ID NO: 82125 - RNA, 22 nt, Human
uggaaaguguuauaucaggagc

SEQ ID NO: 82126 - RNA, 23 nt, Human
uggaaaguguuauaucaggagca

SEQ ID NO: 82127 - RNA, 25 nt, Human
uuaaaaugaaugaaaaugcuggcca

SEQ ID NO: 82128 - RNA, 20 nt, Human
uuucaguucugcucagucuu

SEQ ID NO: 82129 - RNA, 22 nt, Human
uuuuuuuuuuuuuuuuacuugg

SEQ ID NO: 82130 - RNA, 18 nt, Human
aacccagcaggcaccaag

SEQ ID NO: 82131 - RNA, 21 nt, Human
aacccagcaggcaccaagaga

SEQ ID NO: 82132 - RNA, 20 nt, Human
aagacauaaauacaaaaaua

SEQ ID NO: 82133 - RNA, 21 nt, Human
aaugucuggagcaggcagcag

SEQ ID NO: 82134 - RNA, 24 nt, Human
acacagacccuccccaucuacccu

SEQ ID NO: 82135 - RNA, 20 nt, Human
accagcagaagcugcagucc

SEQ ID NO: 82136 - RNA, 24 nt, Human
aggaagcccugggggaccuggaac

SEQ ID NO: 82137 - RNA, 23 nt, Human
aggaggacggggggagcaccagc

SEQ ID NO: 82138 - RNA, 18 nt, Human
aggcaccaagagaagccg

SEQ ID NO: 82139 - RNA, 23 nt, Human
agugggccccuucugggucucac

SEQ ID NO: 82140 - RNA, 19 nt, Human
caagaacaaaaugucugga

SEQ ID NO: 82141 - RNA, 19 nt, Human
caagagaagccggccccuu

SEQ ID NO: 82142 - RNA, 21 nt, Human
cagaaccaggaacuggcaagc

SEQ ID NO: 82143 - RNA, 18 nt, Human
cagccgugggcacaggcg

SEQ ID NO: 82144 - RNA, 23 nt, Human
cagccuucggucuccgcgccggg

SEQ ID NO: 82145 - RNA, 25 nt, Human
ccagcagcaaggaugugccaucucc

SEQ ID NO: 82146 - RNA, 21 nt, Human
ccccugcaacccagcaggcac

SEQ ID NO: 82147 - RNA, 22 nt, Human
ccccugcaacccagcaggcacc

SEQ ID NO: 82148 - RNA, 21 nt, Human
cccuccccaucuacccuugga

SEQ ID NO: 82149 - RNA, 23 nt, Human
cccugggggaccuggaacaaugg

SEQ ID NO: 82150 - RNA, 24 nt, Human
cccugggggaccuggaacaauggu

SEQ ID NO: 82151 - RNA, 18 nt, Human
ccuauacugccuccagga

SEQ ID NO: 82152 - RNA, 22 nt, Human
ccugcugguucuggccuugugc

SEQ ID NO: 82153 - RNA, 22 nt, Human
ccuucacacagacccuccccau

SEQ ID NO: 82154 - RNA, 26 nt, Human
cugugccauucacagcugcuguggga

SEQ ID NO: 82155 - RNA, 19 nt, Human
cuucacacagacccucccc

SEQ ID NO: 82156 - RNA, 19 nt, Human
cuucugggucucacagauu

SEQ ID NO: 82157 - RNA, 22 nt, Human
gagcaggcagcagccgugggca

SEQ ID NO: 82158 - RNA, 23 nt, Human
gagugggcucagugggccccuuc

SEQ ID NO: 82159 - RNA, 21 nt, Human
gccagccuucggucuccgcgc

SEQ ID NO: 82160 - RNA, 24 nt, Human
gccauucacagcugcugugggagg

SEQ ID NO: 82161 - RNA, 20 nt, Human
gcugcaggaaggucacugug

SEQ ID NO: 82162 - RNA, 18 nt, Human
gcuggagugagugggcuc

SEQ ID NO: 82163 - RNA, 18 nt, Human
ggagcaggcagcagccgu

SEQ ID NO: 82164 - RNA, 19 nt, Human
ggagcaggcagcagccgug

SEQ ID NO: 82165 - RNA, 24 nt, Human
ggaggaagcccugggggaccugga

SEQ ID NO: 82166 - RNA, 19 nt, Human
gggccaaguccccagcagc

SEQ ID NO: 82167 - RNA, 21 nt, Human
gugggcucagugggccccuuc

SEQ ID NO: 82168 - RNA, 22 nt, Human
uaagacauaaauacaaaaauaa

SEQ ID NO: 82169 - RNA, 20 nt, Human
uaagucucagacucaauccu

SEQ ID NO: 82170 - RNA, 20 nt, Human
uagcccaugaauccucacgc

SEQ ID NO: 82171 - RNA, 19 nt, Human
ucacacagacccuccccau

SEQ ID NO: 82172 - RNA, 22 nt, Human
ucacgccaacccuggagguagg

SEQ ID NO: 82173 - RNA, 18 nt, Human
ucaucuauaauagcccau

SEQ ID NO: 82174 - RNA, 20 nt, Human
uccaggaggacggggggagg

SEQ ID NO: 82175 - RNA, 18 nt, Human
ucucacagauucaagaac

SEQ ID NO: 82176 - RNA, 19 nt, Human
ucuccgcgccgggcggaag

SEQ ID NO: 82177 - RNA, 19 nt, Human
ugaauccucacgccaaccc

SEQ ID NO: 82178 - RNA, 18 nt, Human
ugagugccugcugguucu

SEQ ID NO: 82179 - RNA, 26 nt, Human
ugagugccugcugguucuggccuugu

SEQ ID NO: 82180 - RNA, 23 nt, Human
ugccccugcaacccagcaggcac

SEQ ID NO: 82181 - RNA, 22 nt, Human
ugggcucagugggccccuucug

SEQ ID NO: 82182 - RNA, 19 nt, Human
ugucggaugagguauagga

SEQ ID NO: 82183 - RNA, 19 nt, Human
ugucuggagcaggcagcag

SEQ ID NO: 82184 - RNA, 18 nt, Human
uucacagcugcuguggga

SEQ ID NO: 82185 - RNA, 18 nt, Human
uuccugccccugcaaccc

SEQ ID NO: 82186 - RNA, 23 nt, Human
uuucaucuauaauagcccaugaa

SEQ ID NO: 82187 - RNA, 21 nt, Human
aaaaauaauaggaagggcugc

SEQ ID NO: 82188 - RNA, 24 nt, Human
aaauacacaacaaccaucagaacc

SEQ ID NO: 82189 - RNA, 18 nt, Human
aacagaguuugaaguuca

SEQ ID NO: 82190 - RNA, 23 nt, Human
aacccucaacuuuaagaauguuu

SEQ ID NO: 82191 - RNA, 19 nt, Human
acaaccaucagaaccacau

SEQ ID NO: 82192 - RNA, 24 nt, Human
acacaacaaccaucagaaccacau

SEQ ID NO: 82193 - RNA, 20 nt, Human
acagaaauaaucucucuuau

SEQ ID NO: 82194 - RNA, 18 nt, Human
accaaacaccacauaagc

SEQ ID NO: 82195 - RNA, 21 nt, Human
accacauaagcacaaauuaaa

SEQ ID NO: 82196 - RNA, 22 nt, Human
acucgccccaaaugauaugaaa

SEQ ID NO: 82197 - RNA, 24 nt, Human
acugaaaaugcuguuuuggggacc

SEQ ID NO: 82198 - RNA, 18 nt, Human
agaaaaauaauaggaagg

SEQ ID NO: 82199 - RNA, 22 nt, Human
agaccuuuaacacugcaagccu

SEQ ID NO: 82200 - RNA, 19 nt, Human
agggcugaggggagggaca

SEQ ID NO: 82201 - RNA, 21 nt, Human
agugaaagaccucuugggcua

SEQ ID NO: 82202 - RNA, 21 nt, Human
auaggaagggcugccccagug

SEQ ID NO: 82203 - RNA, 19 nt, Human
aucaugcuugcauucauuc

SEQ ID NO: 82204 - RNA, 24 nt, Human
auucaaaaguucauccuaaucuua

SEQ ID NO: 82205 - RNA, 27 nt, Human
caaaaaaagcugaaauaauugguaaca

SEQ ID NO: 82206 - RNA, 30 nt, Human
caaggaacauguuagaggccaacccagcuu

SEQ ID NO: 82207 - RNA, 20 nt, Human
cacaacaaccaucagaacca

SEQ ID NO: 82208 - RNA, 21 nt, Human
cacaacaaccaucagaaccac

SEQ ID NO: 82209 - RNA, 20 nt, Human
cacauuaucuacggcagaau

SEQ ID NO: 82210 - RNA, 19 nt, Human
cacucacaccaaacaccac

SEQ ID NO: 82211 - RNA, 23 nt, Human
cagguccugggcccacugguguc

SEQ ID NO: 82212 - RNA, 20 nt, Human
cagugauuuugacauuuagg

SEQ ID NO: 82213 - RNA, 24 nt, Human
cauaagcacaaauuaaauauuguc

SEQ ID NO: 82214 - RNA, 23 nt, Human
cauuuaaagccacccccaggucc

SEQ ID NO: 82215 - RNA, 21 nt, Human
cauuuaggucaucacuuguuc

SEQ ID NO: 82216 - RNA, 23 nt, Human
ccaaaugauaugaaacagaaaca

SEQ ID NO: 82217 - RNA, 22 nt, Human
cccagggaacauguaaacaaau

SEQ ID NO: 82218 - RNA, 18 nt, Human
cccccagguccugggccc

SEQ ID NO: 82219 - RNA, 20 nt, Human
cccccagguccugggcccac

SEQ ID NO: 82220 - RNA, 22 nt, Human
ccggcgaagugggcggcucccc

SEQ ID NO: 82221 - RNA, 23 nt, Human
ccugaauuaugaaaaaagcuuau

SEQ ID NO: 82222 - RNA, 20 nt, Human
cgaagugggcggcuccccaa

SEQ ID NO: 82223 - RNA, 20 nt, Human
cgacccggcgaagugggcgg

SEQ ID NO: 82224 - RNA, 19 nt, Human
cgaucugcagaccuggauc

SEQ ID NO: 82225 - RNA, 18 nt, Human
cgauggccgcccccgccg

SEQ ID NO: 82226 - RNA, 24 nt, Human
cggcagaauauguacaaauguucc

SEQ ID NO: 82227 - RNA, 24 nt, Human
cucucuuauaacccucaacuuuaa

SEQ ID NO: 82228 - RNA, 20 nt, Human
cucuugggcuaagaaaaaua

SEQ ID NO: 82229 - RNA, 21 nt, Human
cugaaaauacacaacaaccau

SEQ ID NO: 82230 - RNA, 19 nt, Human
cugcacucacaccaaacac

SEQ ID NO: 82231 - RNA, 20 nt, Human
cuggaucugucccagggaac

SEQ ID NO: 82232 - RNA, 18 nt, Human
cuggugcagggcugaggg

SEQ ID NO: 82233 - RNA, 21 nt, Human
gaaaaauaauaggaagggccg

SEQ ID NO: 82234 - RNA, 20 nt, Human
gcgcagcacgauggccgccc

SEQ ID NO: 82235 - RNA, 23 nt, Human
ggacaauuauccacuccaaacac

SEQ ID NO: 82236 - RNA, 23 nt, Human
gggauccagugauacugaaaaua

SEQ ID NO: 82237 - RNA, 21 nt, Human
ggucuggauuucaaacuaauu

SEQ ID NO: 82238 - RNA, 22 nt, Human
ggugcagggcugaggggaggga

SEQ ID NO: 82239 - RNA, 18 nt, Human
guccugggcccacuggug

SEQ ID NO: 82240 - RNA, 18 nt, Human
gucuggauuucaaacuaa

SEQ ID NO: 82241 - RNA, 26 nt, Human
uaaccuuuagaccacagaaauaaucu

SEQ ID NO: 82242 - RNA, 24 nt, Human
uaauugaagaaggaacugaaaaug

SEQ ID NO: 82243 - RNA, 22 nt, Human
uaccauggaaaauguauguaac

SEQ ID NO: 82244 - RNA, 21 nt, Human
ucagaaccacauuaucuacgg

SEQ ID NO: 82245 - RNA, 20 nt, Human
ucagugaaagaccucuuggg

SEQ ID NO: 82246 - RNA, 22 nt, Human
ucagugaaagaccucuugggcu

SEQ ID NO: 82247 - RNA, 18 nt, Human
uccacagagucuucuucc

SEQ ID NO: 82248 - RNA, 21 nt, Human
uccacagagucuucuucccca

SEQ ID NO: 82249 - RNA, 24 nt, Human
uccacagagucuucuuccccagga

SEQ ID NO: 82250 - RNA, 21 nt, Human
uccuaccaaguaaauucaaaa

SEQ ID NO: 82251 - RNA, 20 nt, Human
ucugcagaccuggaucuguc

SEQ ID NO: 82252 - RNA, 20 nt, Human
ucugucccagggaacaugua

SEQ ID NO: 82253 - RNA, 22 nt, Human
ucuuauacguuuauaaaacggu

SEQ ID NO: 82254 - RNA, 19 nt, Human
ugaaaauacacaacaacca

SEQ ID NO: 82255 - RNA, 21 nt, Human
ugaagaaggaacugaaaaugc

SEQ ID NO: 82256 - RNA, 21 nt, Human
ugaauuaugaaaaaagcuuau

SEQ ID NO: 82257 - RNA, 23 nt, Human
ugaauuaugaaaaaagcuuaucu

SEQ ID NO: 82258 - RNA, 21 nt, Human
ugagcagagauccagagguga

SEQ ID NO: 82259 - RNA, 24 nt, Human
ugccugacucgccccaaaugauau

SEQ ID NO: 82260 - RNA, 21 nt, Human
ugcugaauuuuaggagauggu

SEQ ID NO: 82261 - RNA, 23 nt, Human
uggaaaacuauaaagucaaauca

SEQ ID NO: 82262 - RNA, 21 nt, Human
uggugcagggcugaggggagg

SEQ ID NO: 82263 - RNA, 23 nt, Human
uguaucagugaaagaccucuugg

SEQ ID NO: 82264 - RNA, 19 nt, Human
uguauguaacaguguggaa

SEQ ID NO: 82265 - RNA, 19 nt, Human
ugucacacuuauuaaaaca

SEQ ID NO: 82266 - RNA, 18 nt, Human
uguuacagaacaagaauu

SEQ ID NO: 82267 - RNA, 23 nt, Human
uuauuaaaacaaaaaaagcugaa

SEQ ID NO: 82268 - RNA, 24 nt, Human
uuccacaggacugacugaacuucc

SEQ ID NO: 82269 - RNA, 23 nt, Human
uuccccaggacccuucuuaucca

SEQ ID NO: 82270 - RNA, 18 nt, Human
uugcauucauuccacagg

SEQ ID NO: 82271 - RNA, 20 nt, Human
uuuaacacugcaagccucau

SEQ ID NO: 82272 - RNA, 24 nt, Human
uuucaaacuaauugaagaaggaac

SEQ ID NO: 82273 - RNA, 22 nt, Human
uuuucacuuugggaagacugga

SEQ ID NO: 82274 - RNA, 24 nt, Human
agcauugccgacaaaauuauaauc

SEQ ID NO: 82275 - RNA, 22 nt, Human
agcuacugugacaauacaccac

SEQ ID NO: 82276 - RNA, 19 nt, Human
aggcagcaacacaacaagc

SEQ ID NO: 82277 - RNA, 30 nt, Human
caacaguaaacucuguuaggaaauucuaaa

SEQ ID NO: 82278 - RNA, 19 nt, Human
cagcaacacaacaagccga

SEQ ID NO: 82279 - RNA, 18 nt, Human
caggacugcggcagcagc

SEQ ID NO: 82280 - RNA, 22 nt, Human
caguaaacucuguuaggaaauu

SEQ ID NO: 82281 - RNA, 21 nt, Human
gacaaaauuauaaucugcugg

SEQ ID NO: 82282 - RNA, 20 nt, Human
gggaaaaaaaacaacuagac

SEQ ID NO: 82283 - RNA, 23 nt, Human
ggggaaaaaaaacaacuagacaa

SEQ ID NO: 82284 - RNA, 22 nt, Human
guuuuaagagagagaugguagu

SEQ ID NO: 82285 - RNA, 24 nt, Human
uaaaaugccucaacagaguuugaa

SEQ ID NO: 82286 - RNA, 21 nt, Human
uaaaaugucuucaggccaaaa

SEQ ID NO: 82287 - RNA, 22 nt, Human
ucacaggucacacgcauuucca

SEQ ID NO: 82288 - RNA, 21 nt, Human
ucuaaaaugucuucaggccaa

SEQ ID NO: 82289 - RNA, 18 nt, Human
ugcggaaaagaagcccuu

SEQ ID NO: 82290 - RNA, 24 nt, Human
uggcaggacugcggcagcagcagg

SEQ ID NO: 82291 - RNA, 24 nt, Human
uggcauuugcggaaaagaagcccu

SEQ ID NO: 82292 - RNA, 22 nt, Human
uuugucuugggggaaaaaaaac

SEQ ID NO: 82293 - RNA, 18 nt, Human
uuuguugugccuugccuu

SEQ ID NO: 82294 - RNA, 22 nt, Human
aaaaaaacauuuuaguguggcc

SEQ ID NO: 82295 - RNA, 19 nt, Human
aaaacuuacucuauuuuga

SEQ ID NO: 82296 - RNA, 20 nt, Human
aaagguaccauagaaggcug

SEQ ID NO: 82297 - RNA, 25 nt, Human
aaccagccugcaucaccccuugcac

SEQ ID NO: 82298 - RNA, 24 nt, Human
aagaaaauccuuccccuccuccaa

SEQ ID NO: 82299 - RNA, 19 nt, Human
aaggucacuauauacagaa

SEQ ID NO: 82300 - RNA, 18 nt, Human
aaguggcaugaaccagcc

SEQ ID NO: 82301 - RNA, 22 nt, Human
aauccuuccccuccuccaacac

SEQ ID NO: 82302 - RNA, 22 nt, Human
aauugcucugauacaaaaugag

SEQ ID NO: 82303 - RNA, 18 nt, Human
acagacugcauauguagc

SEQ ID NO: 82304 - RNA, 20 nt, Human
acauaugaugugacuuuaac

SEQ ID NO: 82305 - RNA, 18 nt, Human
agaaaauccuuccccucc

SEQ ID NO: 82306 - RNA, 23 nt, Human
agaaauguuaguucauguuaaac

SEQ ID NO: 82307 - RNA, 21 nt, Human
agaauuuuaaacucgccucuu

SEQ ID NO: 82308 - RNA, 22 nt, Human
agacaaauacacaaauaaggcc

SEQ ID NO: 82309 - RNA, 20 nt, Human
aggaggucuggaaaaagcuc

SEQ ID NO: 82310 - RNA, 25 nt, Human
aggcaaaacuuuuucauuuuuugaa

SEQ ID NO: 82311 - RNA, 24 nt, Human
agggcauuaaaucuuauguaauuu

SEQ ID NO: 82312 - RNA, 19 nt, Human
auagaaggcugauagaaua

SEQ ID NO: 82313 - RNA, 21 nt, Human
aucuuucucuuugauuccaug

SEQ ID NO: 82314 - RNA, 21 nt, Human
augaaccagccugcaucaccc

SEQ ID NO: 82315 - RNA, 23 nt, Human
caaaaaaccauucucaaggcuaa

SEQ ID NO: 82316 - RNA, 20 nt, Human
caaugaaggggaguucugaa

SEQ ID NO: 82317 - RNA, 22 nt, Human
cacauaauauucauaauguuag

SEQ ID NO: 82318 - RNA, 22 nt, Human
cacuauauacagaaaaaggcaa

SEQ ID NO: 82319 - RNA, 23 nt, Human
cacuauauacagaaaaaggcaaa

SEQ ID NO: 82320 - RNA, 24 nt, Human
cacuauauacagaaaaaggcaaaa

SEQ ID NO: 82321 - RNA, 20 nt, Human
caugacgugcucuuucagcg

SEQ ID NO: 82322 - RNA, 20 nt, Human
ccacucaagcaaaagaaaac

SEQ ID NO: 82323 - RNA, 19 nt, Human
ccagccugcaucaccccuu

SEQ ID NO: 82324 - RNA, 24 nt, Human
ccauaaaaacaggaaaaugucaug

SEQ ID NO: 82325 - RNA, 23 nt, Human
ccccagaauaucugacaaaaaaa

SEQ ID NO: 82326 - RNA, 19 nt, Human
cccggcacguuacagugca

SEQ ID NO: 82327 - RNA, 23 nt, Human
ccucuugcaauauuucacaagaa

SEQ ID NO: 82328 - RNA, 27 nt, Human
ccucuugcaauauuucacaagaauugg

SEQ ID NO: 82329 - RNA, 20 nt, Human
ccugacaaaaagguaccaua

SEQ ID NO: 82330 - RNA, 22 nt, Human
cggaaaauacacagaaugaaga

SEQ ID NO: 82331 - RNA, 21 nt, Human
cuacguaaaaaaaaaaacauu

SEQ ID NO: 82332 - RNA, 18 nt, Human
cucaagcaaaagaaaacc

SEQ ID NO: 82333 - RNA, 23 nt, Human
cucagaguuuccauaaaaacagg

SEQ ID NO: 82334 - RNA, 18 nt, Human
cugcagcuugaaggcugu

SEQ ID NO: 82335 - RNA, 18 nt, Human
cugcaucaccccuugcac

SEQ ID NO: 82336 - RNA, 21 nt, Human
cugcaucaccccuugcacagu

SEQ ID NO: 82337 - RNA, 22 nt, Human
cuuucagcgagugcaauuuauc

SEQ ID NO: 82338 - RNA, 19 nt, Human
gacaaaaagguaccauaga

SEQ ID NO: 82339 - RNA, 22 nt, Human
gauaaaauaaaaagacaaauac

SEQ ID NO: 82340 - RNA, 23 nt, Human
gauuggucuaaccucccagcugu

SEQ ID NO: 82341 - RNA, 19 nt, Human
gcgagugcaauuuaucauu

SEQ ID NO: 82342 - RNA, 21 nt, Human
ggaaaauacacagaaugaaga

SEQ ID NO: 82343 - RNA, 19 nt, Human
ggucuaaccucccagcugu

SEQ ID NO: 82344 - RNA, 25 nt, Human
gucuuuuugucuuccaucuuuuggu

SEQ ID NO: 82345 - RNA, 22 nt, Human
uaaaaagacaaauacacaaaua

SEQ ID NO: 82346 - RNA, 21 nt, Human
uacaguauaauaggucuaaua

SEQ ID NO: 82347 - RNA, 24 nt, Human
uacuguccacucaagcaaaagaaa

SEQ ID NO: 82348 - RNA, 21 nt, Human
uauacagaaaaaggcaaaacu

SEQ ID NO: 82349 - RNA, 25 nt, Human
uauacagauaaaauaaaaagacaaa

SEQ ID NO: 82350 - RNA, 26 nt, Human
uauacagauaaaauaaaaagacaaau

SEQ ID NO: 82351 - RNA, 27 nt, Human
uaugguagcaaagaaagcuauggcaua

SEQ ID NO: 82352 - RNA, 22 nt, Human
ucaagcaaaagaaaaccucaca

SEQ ID NO: 82353 - RNA, 20 nt, Human
ucaaggaagggccuugguag

SEQ ID NO: 82354 - RNA, 20 nt, Human
ucagauacugcaaagacugc

SEQ ID NO: 82355 - RNA, 21 nt, Human
uccaaaauguuuaugguagca

SEQ ID NO: 82356 - RNA, 20 nt, Human
ucuaacggugaaaaguggca

SEQ ID NO: 82357 - RNA, 21 nt, Human
ucuaacggugaaaaguggcag

SEQ ID NO: 82358 - RNA, 23 nt, Human
ucugacaaaaaaaauuauacaga

SEQ ID NO: 82359 - RNA, 20 nt, Human
ucuuuugguuuacauuuaaa

SEQ ID NO: 82360 - RNA, 21 nt, Human
ugaaagcaauggcagagaaau

SEQ ID NO: 82361 - RNA, 23 nt, Human
ugaaagcaauggcagagaaaugc

SEQ ID NO: 82362 - RNA, 20 nt, Human
ugaaagcaauggcagagaag

SEQ ID NO: 82363 - RNA, 24 nt, Human
ugagcacuuagcaauuugcagccc

SEQ ID NO: 82364 - RNA, 19 nt, Human
ugcaaagacugcguguggg

SEQ ID NO: 82365 - RNA, 21 nt, Human
uggcaugaaccagccugcauc

SEQ ID NO: 82366 - RNA, 18 nt, Human
ugucacauagcagaugca

SEQ ID NO: 82367 - RNA, 19 nt, Human
uuaagggacguguuuuauu

SEQ ID NO: 82368 - RNA, 22 nt, Human
uuacaauccuaauuguccugac

SEQ ID NO: 82369 - RNA, 25 nt, Human
uuauaucuuucucuuugauuccaug

SEQ ID NO: 82370 - RNA, 18 nt, Human
uuccugugaguucucugu

SEQ ID NO: 82371 - RNA, 22 nt, Human
aaauaccuuuaacuucaucucu

SEQ ID NO: 82372 - RNA, 24 nt, Human
aacuuaugaccuucauuaagcccc

SEQ ID NO: 82373 - RNA, 19 nt, Human
aaugaaggaugucucuaaa

SEQ ID NO: 82374 - RNA, 21 nt, Human
acaaaccaaaaugagaaccuc

SEQ ID NO: 82375 - RNA, 26 nt, Human
accuucauuaagccccacuaguuacu

SEQ ID NO: 82376 - RNA, 22 nt, Human
agcagcagcagcagcagcagcc

SEQ ID NO: 82377 - RNA, 21 nt, Human
agccauaguuguuuauuugcu

SEQ ID NO: 82378 - RNA, 21 nt, Human
agccuagcucuggaaaaucgg

SEQ ID NO: 82379 - RNA, 19 nt, Human
aggaacuuuauuuuuaaac

SEQ ID NO: 82380 - RNA, 22 nt, Human
auacaucugcaaaggggccacc

SEQ ID NO: 82381 - RNA, 19 nt, Human
aucucuacuuguugcucuc

SEQ ID NO: 82382 - RNA, 21 nt, Human
cacagccuagcucuggaaaau

SEQ ID NO: 82383 - RNA, 25 nt, Human
cacccauaacacacuccuaugccac

SEQ ID NO: 82384 - RNA, 23 nt, Human
cagcagcagcagcagcagcagca

SEQ ID NO: 82385 - RNA, 23 nt, Human
cagcagcagcagcagcagcagcc

SEQ ID NO: 82386 - RNA, 18 nt, Human
cagcagcagcagcagccg

SEQ ID NO: 82387 - RNA, 19 nt, Human
cagcagcagcagcagccgc

SEQ ID NO: 82388 - RNA, 22 nt, Human
cagcagcagcagccgcuccucc

SEQ ID NO: 82389 - RNA, 24 nt, Human
cagucacuuuauuaucaggaacuu

SEQ ID NO: 82390 - RNA, 22 nt, Human
cauaaggcuaugacauaagcac

SEQ ID NO: 82391 - RNA, 24 nt, Human
cccaaaguucaaaaaauuaaaaca

SEQ ID NO: 82392 - RNA, 18 nt, Human
ccuuguugucauuucugu

SEQ ID NO: 82393 - RNA, 20 nt, Human
cuaaagccuuaucugggcca

SEQ ID NO: 82394 - RNA, 24 nt, Human
cucaucacugccgccggcaucgac

SEQ ID NO: 82395 - RNA, 20 nt, Human
cugcaaaggggccaccagca

SEQ ID NO: 82396 - RNA, 25 nt, Human
cuuacuguuaucccagaagguuuuc

SEQ ID NO: 82397 - RNA, 23 nt, Human
gccaaagagccagcgccuccuag

SEQ ID NO: 82398 - RNA, 23 nt, Human
gcuaugacauaagcacugaggca

SEQ ID NO: 82399 - RNA, 20 nt, Human
gucacuuuauuaucaggaac

SEQ ID NO: 82400 - RNA, 20 nt, Human
uaagccccacuaguuacuag

SEQ ID NO: 82401 - RNA, 18 nt, Human
uaaggcuaugacauaagc

SEQ ID NO: 82402 - RNA, 18 nt, Human
uaguaauaaauacauacg

SEQ ID NO: 82403 - RNA, 24 nt, Human
ucaucucuacuuguugcucuccca

SEQ ID NO: 82404 - RNA, 23 nt, Human
ugacauaagcacugaggcauccu

SEQ ID NO: 82405 - RNA, 19 nt, Human
ugacuuucucaacuaaugg

SEQ ID NO: 82406 - RNA, 19 nt, Human
uggcugaacuucccaggcg

SEQ ID NO: 82407 - RNA, 23 nt, Human
ugucaaaugaaggaugucucuaa

SEQ ID NO: 82408 - RNA, 19 nt, Human
uucaaggacagcaauacau

SEQ ID NO: 82409 - RNA, 25 nt, Human
uucaaggacagcaauacaucugcaa

SEQ ID NO: 82410 - RNA, 26 nt, Human
uucaaggacagcaauacaucugcaaa

SEQ ID NO: 82411 - RNA, 18 nt, Human
uucauuaagccccacuag

SEQ ID NO: 82412 - RNA, 23 nt, Human
uuucucaacuaaugggccucugg

SEQ ID NO: 82413 - RNA, 20 nt, Human
uuuuuuuuuuuuuuuugcca

SEQ ID NO: 82414 - RNA, 18 nt, Human
uuuuuuuuuuuuuuuuug

SEQ ID NO: 82415 - RNA, 24 nt, Human
uuuuuuuuuuuuuuuuugccauuu

SEQ ID NO: 82416 - RNA, 24 nt, Human
aaagugcugagauuauagcuguga

SEQ ID NO: 82417 - RNA, 19 nt, Human
aacacgaucaagccccacc

SEQ ID NO: 82418 - RNA, 25 nt, Human
aagugauccucccaccucagcuucc

SEQ ID NO: 82419 - RNA, 26 nt, Human
aagugcugagauuauagcugugagcc

SEQ ID NO: 82420 - RNA, 25 nt, Human
acacgaaggaaccaccaagacugga

SEQ ID NO: 82421 - RNA, 22 nt, Human
acaggcagcaacacgaucaagc

SEQ ID NO: 82422 - RNA, 22 nt, Human
accgugcccagccugaagcuag

SEQ ID NO: 82423 - RNA, 25 nt, Human
acucuguugcccagguuggagugca

SEQ ID NO: 82424 - RNA, 22 nt, Human
agauuauagcugugagccaccg

SEQ ID NO: 82425 - RNA, 18 nt, Human
agcuggucuugaacuccu

SEQ ID NO: 82426 - RNA, 24 nt, Human
agcuggucuugaacuccugggcuc

SEQ ID NO: 82427 - RNA, 21 nt, Human
agcugugagccaccgugccca

SEQ ID NO: 82428 - RNA, 24 nt, Human
aggcaucauguuaacaggcagcaa

SEQ ID NO: 82429 - RNA, 21 nt, Human
agugcagugaugcaauuacag

SEQ ID NO: 82430 - RNA, 23 nt, Human
agugcagugaugcaauuacagcu

SEQ ID NO: 82431 - RNA, 20 nt, Human
auugggcucaagugauccuc

SEQ ID NO: 82432 - RNA, 24 nt, Human
caaagugcugagauuauagcugug

SEQ ID NO: 82433 - RNA, 21 nt, Human
caagccccacacgaaggaacc

SEQ ID NO: 82434 - RNA, 24 nt, Human
caaggucuuacucuguugcccagg

SEQ ID NO: 82435 - RNA, 27 nt, Human
caagugauccucccaccucagcuuccu

SEQ ID NO: 82436 - RNA, 24 nt, Human
caccucagccucccaaagugcuga

SEQ ID NO: 82437 - RNA, 24 nt, Human
caccucagcuuccugagcaccugg

SEQ ID NO: 82438 - RNA, 22 nt, Human
cacgaaggaaccaccaagacug

SEQ ID NO: 82439 - RNA, 24 nt, Human
cacugcagcuuugaauugggcuca

SEQ ID NO: 82440 - RNA, 19 nt, Human
cagcaacacgaucaagccc

SEQ ID NO: 82441 - RNA, 20 nt, Human
cagcuuccugagcaccuggg

SEQ ID NO: 82442 - RNA, 19 nt, Human
caggcucaggcugauuucc

SEQ ID NO: 82443 - RNA, 19 nt, Human
caggcugauuuccgaacgc

SEQ ID NO: 82444 - RNA, 18 nt, Human
ccaaagugcugagauuau

SEQ ID NO: 82445 - RNA, 23 nt, Human
ccaaagugcugagauuauagcug

SEQ ID NO: 82446 - RNA, 20 nt, Human
cccagguuggagugcaguga

SEQ ID NO: 82447 - RNA, 22 nt, Human
ccggagucucccuauauugcac

SEQ ID NO: 82448 - RNA, 18 nt, Human
ccugaagcuagaggcugu

SEQ ID NO: 82449 - RNA, 22 nt, Human
ccugagcaccugggaccacaga

SEQ ID NO: 82450 - RNA, 19 nt, Human
cgaaggaaccaccaagacu

SEQ ID NO: 82451 - RNA, 24 nt, Human
cucaagugauccucccaccucagc

SEQ ID NO: 82452 - RNA, 24 nt, Human
cucaggcaauucucccaccucagc

SEQ ID NO: 82453 - RNA, 21 nt, Human
cucaggcugauuuccgaacgc

SEQ ID NO: 82454 - RNA, 21 nt, Human
cuccugggcucaggcaauucu

SEQ ID NO: 82455 - RNA, 19 nt, Human
cuggucuugaacuccuggg

SEQ ID NO: 82456 - RNA, 21 nt, Human
cuuacucuguugcccagguug

SEQ ID NO: 82457 - RNA, 25 nt, Human
cuuccugagcaccugggaccacaga

SEQ ID NO: 82458 - RNA, 20 nt, Human
cuugaacuccugggcucagg

SEQ ID NO: 82459 - RNA, 19 nt, Human
gagcaccugggaccacaga

SEQ ID NO: 82460 - RNA, 18 nt, Human
gauuauagcugugagcca

SEQ ID NO: 82461 - RNA, 24 nt, Human
gauuauagcugugagccaccgugc

SEQ ID NO: 82462 - RNA, 22 nt, Human
gcaacacgaucaagccccacac

SEQ ID NO: 82463 - RNA, 23 nt, Human
gcaauucucccaccucagccucc

SEQ ID NO: 82464 - RNA, 18 nt, Human
gcaccugggaccacagau

SEQ ID NO: 82465 - RNA, 18 nt, Human
gcucaagugauccuccca

SEQ ID NO: 82466 - RNA, 21 nt, Human
ggagugaggcccaggauucug

SEQ ID NO: 82467 - RNA, 19 nt, Human
gggagugaggcccaggauu

SEQ ID NO: 82468 - RNA, 22 nt, Human
gggcucaagugauccucccacc

SEQ ID NO: 82469 - RNA, 24 nt, Human
gggguagaaaguuucaaaggcgga

SEQ ID NO: 82470 - RNA, 24 nt, Human
gugauccucccaccucagcuuccu

SEQ ID NO: 82471 - RNA, 19 nt, Human
gugcagugaugcaauuaca

SEQ ID NO: 82472 - RNA, 21 nt, Human
uaacaggcagcaacacgauca

SEQ ID NO: 82473 - RNA, 22 nt, Human
uaagacaaggucuuacucuguu

SEQ ID NO: 82474 - RNA, 18 nt, Human
uagggcucucgggacccg

SEQ ID NO: 82475 - RNA, 24 nt, Human
uauauugcacaagcuggucuugaa

SEQ ID NO: 82476 - RNA, 19 nt, Human
ucaagccccacacgaagga

SEQ ID NO: 82477 - RNA, 20 nt, Human
ucacugcagcuuugaauugg

SEQ ID NO: 82478 - RNA, 21 nt, Human
ucacugcagcuuugaauuggg

SEQ ID NO: 82479 - RNA, 24 nt, Human
ucacugcagcuuugaauugggcuc

SEQ ID NO: 82480 - RNA, 18 nt, Human
ucagccucccaaagugcu

SEQ ID NO: 82481 - RNA, 20 nt, Human
uccacacauguagaucagau

SEQ ID NO: 82482 - RNA, 23 nt, Human
ucccaaagugcugagauuauagc

SEQ ID NO: 82483 - RNA, 19 nt, Human
ucccuauauugcacaagcu

SEQ ID NO: 82484 - RNA, 21 nt, Human
uccugggcucaggcaauucuc

SEQ ID NO: 82485 - RNA, 22 nt, Human
uccugggcucaggcaauucucc

SEQ ID NO: 82486 - RNA, 23 nt, Human
uccugggcucaggcaauucuccc

SEQ ID NO: 82487 - RNA, 26 nt, Human
ucucccaccucagccucccaaagugc

SEQ ID NO: 82488 - RNA, 24 nt, Human
ucuguugcccagguuggagugcag

SEQ ID NO: 82489 - RNA, 23 nt, Human
ucuuacucuguugcccagguugg

SEQ ID NO: 82490 - RNA, 24 nt, Human
ucuuacucuguugcccagguugga

SEQ ID NO: 82491 - RNA, 23 nt, Human
ucuugaacuccugggcucaggca

SEQ ID NO: 82492 - RNA, 20 nt, Human
ugaagcuagaggcuguuuuc

SEQ ID NO: 82493 - RNA, 22 nt, Human
ugagauuauagcugugagccac

SEQ ID NO: 82494 - RNA, 23 nt, Human
ugagauuauagcugugagccacc

SEQ ID NO: 82495 - RNA, 24 nt, Human
ugagauuauagcugugagccaccg

SEQ ID NO: 82496 - RNA, 24 nt, Human
ugaugcaauuacagcucacugcag

SEQ ID NO: 82497 - RNA, 24 nt, Human
ugcacaagcuggucuugaacuccu

SEQ ID NO: 82498 - RNA, 18 nt, Human
ugcagcuuugaauugggc

SEQ ID NO: 82499 - RNA, 18 nt, Human
ugcccagguuggagugca

SEQ ID NO: 82500 - RNA, 24 nt, Human
ugcccagguuggagugcagugaug

SEQ ID NO: 82501 - RNA, 19 nt, Human
uggagugcagugaugcaau

SEQ ID NO: 82502 - RNA, 28 nt, Human
uggagugcagugaugcaauucuagcacg

SEQ ID NO: 82503 - RNA, 24 nt, Human
uggcuaauuuugaaaaacucuuuu

SEQ ID NO: 82504 - RNA, 21 nt, Human
ugggaccacagaugugugcca

SEQ ID NO: 82505 - RNA, 20 nt, Human
ugggagugaggcccaggauu

SEQ ID NO: 82506 - RNA, 24 nt, Human
ugggcucaagugauccucccaccu

SEQ ID NO: 82507 - RNA, 24 nt, Human
uggucuugaacuccugggcucagg

SEQ ID NO: 82508 - RNA, 24 nt, Human
uugcccagguuggagugcagugau

SEQ ID NO: 82509 - RNA, 24 nt, Human
uuugaaaaacucuuuuuuguagag

SEQ ID NO: 82510 - RNA, 21 nt, Human
uuuuuuuuuaagacaaggucu

SEQ ID NO: 82511 - RNA, 22 nt, Human
aaauaucucugcagccuuagcc

SEQ ID NO: 82512 - RNA, 18 nt, Human
agaagcucauaaucccua

SEQ ID NO: 82513 - RNA, 23 nt, Human
aggugcggcugacagcccccggc

SEQ ID NO: 82514 - RNA, 18 nt, Human
augaagcacaaauggaaa

SEQ ID NO: 82515 - RNA, 22 nt, Human
augaagcacaaauggaaauuuc

SEQ ID NO: 82516 - RNA, 23 nt, Human
caaggggcucuugguuaagaucu

SEQ ID NO: 82517 - RNA, 19 nt, Human
cacagcccaucaggaacag

SEQ ID NO: 82518 - RNA, 23 nt, Human
cagcccaucaggaacaggugcgg

SEQ ID NO: 82519 - RNA, 19 nt, Human
cagcccccggcaccccugg

SEQ ID NO: 82520 - RNA, 19 nt, Human
cccccggcaccccuggugc

SEQ ID NO: 82521 - RNA, 19 nt, Human
cccuggggaaaggcagccg

SEQ ID NO: 82522 - RNA, 20 nt, Human
cuccagagcugccaaaaccu

SEQ ID NO: 82523 - RNA, 22 nt, Human
cugacagcccccggcaccccug

SEQ ID NO: 82524 - RNA, 22 nt, Human
gaaaggcagccggugccccaca

SEQ ID NO: 82525 - RNA, 19 nt, Human
gagcugccaaaaccucaag

SEQ ID NO: 82526 - RNA, 21 nt, Human
ucccuggggaaaggcagccgg

SEQ ID NO: 82527 - RNA, 19 nt, Human
ccuuuuguugcuacucucc

SEQ ID NO: 82528 - RNA, 22 nt, Human
cuccugaacucucucacucauu

SEQ ID NO: 82529 - RNA, 20 nt, Human
gagccggggcccgagcggcc

SEQ ID NO: 82530 - RNA, 18 nt, Human
ggguuuuuuuuuuuuuuu

SEQ ID NO: 82531 - RNA, 27 nt, Human
uuuccuuuuguugcuacucuccugaac

SEQ ID NO: 82532 - RNA, 30 nt, Human
uuuuuuuuccaccuuaaaaaaaaagagagu

SEQ ID NO: 82533 - RNA, 19 nt, Human
uuuuuuuuuuuuccaccuu

SEQ ID NO: 82534 - RNA, 24 nt, Human
uuuuuuuuuuuuuuuuuccaccuu

SEQ ID NO: 82535 - RNA, 26 nt, Human
uuuuuuuuuuuuuuuuuuuccaccuu

SEQ ID NO: 82536 - RNA, 23 nt, Human
uuuuuuuuuuuuuuuuuuuucca

SEQ ID NO: 82537 - RNA, 24 nt, Human
uuuuuuuuuuuuuuuuuuuuuccu

SEQ ID NO: 82538 - RNA, 18 nt, Human
aaacagcagaacuuuccu

SEQ ID NO: 82539 - RNA, 18 nt, Human
aaaccuuuccuaguuuca

SEQ ID NO: 82540 - RNA, 18 nt, Human
aaaccuuuccuaguuuca

SEQ ID NO: 82541 - RNA, 18 nt, Human
aaaccuuuccuaguuuca

SEQ ID NO: 82542 - RNA, 18 nt, Human
aaaccuuuccuaguuuca

SEQ ID NO: 82543 - RNA, 24 nt, Human
aaagugcugggauuacaggcguga

SEQ ID NO: 82544 - RNA, 24 nt, Human
aaagugcugggauuacaggcguga

SEQ ID NO: 82545 - RNA, 24 nt, Human
aaagugcugggauuacaggcguga

SEQ ID NO: 82546 - RNA, 24 nt, Human
aaagugcugggauuacaggcguga

SEQ ID NO: 82547 - RNA, 22 nt, Human
aacagggagcaaaggaaaaaaa

SEQ ID NO: 82548 - RNA, 22 nt, Human
aacagggagcaaaggaaaaaaa

SEQ ID NO: 82549 - RNA, 22 nt, Human
aacagggagcaaaggaaaaaaa

SEQ ID NO: 82550 - RNA, 23 nt, Human
aaccgguucuugaaaaucuucug

SEQ ID NO: 82551 - RNA, 23 nt, Human
aaccgguucuugaaaaucuucug

SEQ ID NO: 82552 - RNA, 23 nt, Human
aaccgguucuugaaaaucuucug

SEQ ID NO: 82553 - RNA, 23 nt, Human
aaccgguucuugaaaaucuucug

SEQ ID NO: 82554 - RNA, 22 nt, Human
aagaaaacaagcuagcagaaca

SEQ ID NO: 82555 - RNA, 19 nt, Human
aagcuccuucaccacagaa

SEQ ID NO: 82556 - RNA, 19 nt, Human
aagcuccuucaccacagaa

SEQ ID NO: 82557 - RNA, 19 nt, Human
aaggaaaaaaaucaccuca

SEQ ID NO: 82558 - RNA, 19 nt, Human
aaggaaaaaaaucaccuca

SEQ ID NO: 82559 - RNA, 19 nt, Human
aaggaaaaaaaucaccuca

SEQ ID NO: 82560 - RNA, 21 nt, Human
aagugauucuccugccuuagc

SEQ ID NO: 82561 - RNA, 21 nt, Human
aagugauucuccugccuuagc

SEQ ID NO: 82562 - RNA, 21 nt, Human
aagugauucuccugccuuagc

SEQ ID NO: 82563 - RNA, 21 nt, Human
aagugauucuccugccuuagc

SEQ ID NO: 82564 - RNA, 19 nt, Human
aagugcugggauuacaggc

SEQ ID NO: 82565 - RNA, 19 nt, Human
aagugcugggauuacaggc

SEQ ID NO: 82566 - RNA, 19 nt, Human
aagugcugggauuacaggc

SEQ ID NO: 82567 - RNA, 19 nt, Human
aagugcugggauuacaggc

SEQ ID NO: 82568 - RNA, 19 nt, Human
aagugcugggauuacaggc

SEQ ID NO: 82569 - RNA, 19 nt, Human
aagugcugggauuacaggc

SEQ ID NO: 82570 - RNA, 19 nt, Human
aagugcugggauuacaggc

SEQ ID NO: 82571 - RNA, 19 nt, Human
aagugcugggauuacaggc

SEQ ID NO: 82572 - RNA, 26 nt, Human
aagugcugggauuacaggcgugagcc

SEQ ID NO: 82573 - RNA, 26 nt, Human
aagugcugggauuacaggcgugagcc

SEQ ID NO: 82574 - RNA, 26 nt, Human
aagugcugggauuacaggcgugagcc

SEQ ID NO: 82575 - RNA, 19 nt, Human
aauagggcugauaaauaau

SEQ ID NO: 82576 - RNA, 19 nt, Human
aauagggcugauaaauaau

SEQ ID NO: 82577 - RNA, 19 nt, Human
aauagggcugauaaauaau

SEQ ID NO: 82578 - RNA, 19 nt, Human
aauagggcugauaaauaau

SEQ ID NO: 82579 - RNA, 23 nt, Human
acaagcagcuuuacccagagcag

SEQ ID NO: 82580 - RNA, 18 nt, Human
acaucagcuacuuuggca

SEQ ID NO: 82581 - RNA, 24 nt, Human
accacaucuccucugacuucaaaa

SEQ ID NO: 82582 - RNA, 24 nt, Human
accacaucuccucugacuucaaaa

SEQ ID NO: 82583 - RNA, 18 nt, Human
accacguuggucaggcug

SEQ ID NO: 82584 - RNA, 19 nt, Human
accaucaucuaacagguca

SEQ ID NO: 82585 - RNA, 24 nt, Human
accauguuggccaggcugguuucg

SEQ ID NO: 82586 - RNA, 24 nt, Human
accauguuggccaggcugguuucg

SEQ ID NO: 82587 - RNA, 24 nt, Human
accauguuggccaggcugguuucg

SEQ ID NO: 82588 - RNA, 24 nt, Human
accauguuggccaggcugguuucg

SEQ ID NO: 82589 - RNA, 24 nt, Human
acccaggcuggagugccgugguau

SEQ ID NO: 82590 - RNA, 24 nt, Human
acccaggcuggagugccgugguau

SEQ ID NO: 82591 - RNA, 24 nt, Human
acccaggcuggagugccgugguau

SEQ ID NO: 82592 - RNA, 24 nt, Human
acccauuuuccucccgcaauuccu

SEQ ID NO: 82593 - RNA, 24 nt, Human
acccauuuuccucccgcaauuccu

SEQ ID NO: 82594 - RNA, 24 nt, Human
accugaguagcugggauuacaggu

SEQ ID NO: 82595 - RNA, 24 nt, Human
accugaguagcugggauuacaggu

SEQ ID NO: 82596 - RNA, 24 nt, Human
accugaguagcugggauuacaggu

SEQ ID NO: 82597 - RNA, 24 nt, Human
accugaguagcugggauuacaggu

SEQ ID NO: 82598 - RNA, 23 nt, Human
accugugucaagcugaaaagcac

SEQ ID NO: 82599 - RNA, 20 nt, Human
acggaguuucaccacguugg

SEQ ID NO: 82600 - RNA, 21 nt, Human
acggaguuucaccacguuggu

SEQ ID NO: 82601 - RNA, 24 nt, Human
acggaguuucaccacguuggucag

SEQ ID NO: 82602 - RNA, 20 nt, Human
acuugaugggaaaaaguggu

SEQ ID NO: 82603 - RNA, 19 nt, Human
agaaaauucacaagcagcc

SEQ ID NO: 82604 - RNA, 18 nt, Human
agaaggcuggcucccaug

SEQ ID NO: 82605 - RNA, 18 nt, Human
agaauauucaucuaccuc

SEQ ID NO: 82606 - RNA, 18 nt, Human
agacucauucuuuccuug

SEQ ID NO: 82607 - RNA, 24 nt, Human
agacugaggugauaggaucgcuug

SEQ ID NO: 82608 - RNA, 24 nt, Human
agacuuuaagaaaccuuuccuagu

SEQ ID NO: 82609 - RNA, 24 nt, Human
agacuuuaagaaaccuuuccuagu

SEQ ID NO: 82610 - RNA, 24 nt, Human
agacuuuaagaaaccuuuccuagu

SEQ ID NO: 82611 - RNA, 24 nt, Human
agacuuuaagaaaccuuuccuagu

SEQ ID NO: 82612 - RNA, 18 nt, Human
agaggagcucccagggcc

SEQ ID NO: 82613 - RNA, 22 nt, Human
agaggagcucccagggccugga

SEQ ID NO: 82614 - RNA, 22 nt, Human
agaggagcucccagggccugga

SEQ ID NO: 82615 - RNA, 22 nt, Human
agaggagcucccagggccugga

SEQ ID NO: 82616 - RNA, 22 nt, Human
agaggagcucccagggccugga

SEQ ID NO: 82617 - RNA, 22 nt, Human
agagugagaggagcucccaggg

SEQ ID NO: 82618 - RNA, 22 nt, Human
agagugagaggagcucccaggg

SEQ ID NO: 82619 - RNA, 22 nt, Human
agagugagaggagcucccaggg

SEQ ID NO: 82620 - RNA, 23 nt, Human
agaugauagacaaaaccuagagc

SEQ ID NO: 82621 - RNA, 23 nt, Human
agcaacagggagcaaaggaaaaa

SEQ ID NO: 82622 - RNA, 23 nt, Human
agcaacagggagcaaaggaaaaa

SEQ ID NO: 82623 - RNA, 23 nt, Human
agcaacagggagcaaaggaaaaa

SEQ ID NO: 82624 - RNA, 19 nt, Human
agcacaaaugauuuucaau

SEQ ID NO: 82625 - RNA, 20 nt, Human
agcgauucuccugccucagc

SEQ ID NO: 82626 - RNA, 24 nt, Human
agcgauucuccugccucagccucc

SEQ ID NO: 82627 - RNA, 23 nt, Human
agcucauucuugggguccugugc

SEQ ID NO: 82628 - RNA, 23 nt, Human
aggaaaaaaaucaccucaaagaa

SEQ ID NO: 82629 - RNA, 23 nt, Human
aggaaaaaaaucaccucaaagaa

SEQ ID NO: 82630 - RNA, 23 nt, Human
aggaaaaaaaucaccucaaagaa

SEQ ID NO: 82631 - RNA, 23 nt, Human
aggaaaaaaaucaccucaaagaa

SEQ ID NO: 82632 - RNA, 20 nt, Human
aggaauuagaagacugucuu

SEQ ID NO: 82633 - RNA, 20 nt, Human
aggaauuagaagacugucuu

SEQ ID NO: 82634 - RNA, 20 nt, Human
aggaauuagaagacugucuu

SEQ ID NO: 82635 - RNA, 20 nt, Human
aggaauuagaagacugucuu

SEQ ID NO: 82636 - RNA, 24 nt, Human
agggaaaccagcuauucucuugag

SEQ ID NO: 82637 - RNA, 24 nt, Human
agggaaaccagcuauucucuugag

SEQ ID NO: 82638 - RNA, 24 nt, Human
agggaaaccagcuauucucuugag

SEQ ID NO: 82639 - RNA, 26 nt, Human
aggggacgcucuuguauuaucugugg

SEQ ID NO: 82640 - RNA, 19 nt, Human
agguuucugcugugccuga

SEQ ID NO: 82641 - RNA, 22 nt, Human
aguagagaugggguuucaccau

SEQ ID NO: 82642 - RNA, 18 nt, Human
aguagcugggauuacagg

SEQ ID NO: 82643 - RNA, 18 nt, Human
aguagcugggauuacagg

SEQ ID NO: 82644 - RNA, 18 nt, Human
aguagcugggauuacagg

SEQ ID NO: 82645 - RNA, 18 nt, Human
aguagcugggauuacagg

SEQ ID NO: 82646 - RNA, 21 nt, Human
aguagcugggauuacaggugu

SEQ ID NO: 82647 - RNA, 21 nt, Human
aguagcugggauuacaggugu

SEQ ID NO: 82648 - RNA, 21 nt, Human
aguagcugggauuacaggugu

SEQ ID NO: 82649 - RNA, 23 nt, Human
aguagcugggauuacaggugucc

SEQ ID NO: 82650 - RNA, 23 nt, Human
aguagcugggauuacaggugucc

SEQ ID NO: 82651 - RNA, 25 nt, Human
agucaucagaaccuaacaguucauc

SEQ ID NO: 82652 - RNA, 23 nt, Human
agugaucugcccaccuuggccuc

SEQ ID NO: 82653 - RNA, 23 nt, Human
agugaucugcccaccuuggccuc

SEQ ID NO: 82654 - RNA, 23 nt, Human
agugaucugcccaccuuggccuc

SEQ ID NO: 82655 - RNA, 23 nt, Human
agugaucugcccaccuuggccuc

SEQ ID NO: 82656 - RNA, 20 nt, Human
agugcaauggcgcgaucucg

SEQ ID NO: 82657 - RNA, 24 nt, Human
agugcaauggcgcgaucucggcuc

SEQ ID NO: 82658 - RNA, 18 nt, Human
agugcugggauuacaggc

SEQ ID NO: 82659 - RNA, 18 nt, Human
agugcugggauuacaggc

SEQ ID NO: 82660 - RNA, 20 nt, Human
aguuacauggcuuaaguugg

SEQ ID NO: 82661 - RNA, 18 nt, Human
auaaucaguaccagguac

SEQ ID NO: 82662 - RNA, 18 nt, Human
aucucuucacugcuagaa

SEQ ID NO: 82663 - RNA, 18 nt, Human
augggguuucaccauguu

SEQ ID NO: 82664 - RNA, 18 nt, Human
augggguuucaccauguu

SEQ ID NO: 82665 - RNA, 18 nt, Human
augggguuucaccauguu

SEQ ID NO: 82666 - RNA, 22 nt, Human
augggguuucaccauguuggcc

SEQ ID NO: 82667 - RNA, 22 nt, Human
augggguuucaccauguuggcc

SEQ ID NO: 82668 - RNA, 22 nt, Human
augggguuucaccauguuggcc

SEQ ID NO: 82669 - RNA, 22 nt, Human
augggguuucaccauguuggcc

SEQ ID NO: 82670 - RNA, 23 nt, Human
augggguuucaccauguuggcca

SEQ ID NO: 82671 - RNA, 23 nt, Human
augggguuucaccauguuggcca

SEQ ID NO: 82672 - RNA, 24 nt, Human
augggguuucaccauguuggccag

SEQ ID NO: 82673 - RNA, 24 nt, Human
augggguuucaccauguuggccag

SEQ ID NO: 82674 - RNA, 24 nt, Human
augggguuucaccauguuggccag

SEQ ID NO: 82675 - RNA, 19 nt, Human
augguaucccucugcugag

SEQ ID NO: 82676 - RNA, 23 nt, Human
auucucuugaggccaagccacuc

SEQ ID NO: 82677 - RNA, 23 nt, Human
auucucuugaggccaagccacuc

SEQ ID NO: 82678 - RNA, 23 nt, Human
auucucuugaggccaagccacuc

SEQ ID NO: 82679 - RNA, 23 nt, Human
auucucuugaggccaagccacuc

SEQ ID NO: 82680 - RNA, 24 nt, Human
auuucuguauuuuuaguagagaug

SEQ ID NO: 82681 - RNA, 24 nt, Human
auuucuguauuuuuaguagagaug

SEQ ID NO: 82682 - RNA, 24 nt, Human
auuucuguauuuuuaguagagaug

SEQ ID NO: 82683 - RNA, 24 nt, Human
auuucuguauuuuuaguagagaug

SEQ ID NO: 82684 - RNA, 24 nt, Human
auuuuuguauuuuuaguagagacg

SEQ ID NO: 82685 - RNA, 21 nt, Human
caaaaccuagagccuccuuug

SEQ ID NO: 82686 - RNA, 20 nt, Human
caaaggaaaaaaaucaccuc

SEQ ID NO: 82687 - RNA, 20 nt, Human
caaaggaaaaaaaucaccuc

SEQ ID NO: 82688 - RNA, 20 nt, Human
caaaggaaaaaaaucaccuc

SEQ ID NO: 82689 - RNA, 24 nt, Human
caaagugcugggauuacaggcgug

SEQ ID NO: 82690 - RNA, 24 nt, Human
caaagugcugggauuacaggcgug

SEQ ID NO: 82691 - RNA, 24 nt, Human
caaagugcugggauuacaggcgug

SEQ ID NO: 82692 - RNA, 24 nt, Human
caaagugcugggauuacaggcgug

SEQ ID NO: 82693 - RNA, 24 nt, Human
caacacccacucucgggucaccac

SEQ ID NO: 82694 - RNA, 24 nt, Human
caacacccacucucgggucaccac

SEQ ID NO: 82695 - RNA, 23 nt, Human
caacagggagcaaaggaaaaaaa

SEQ ID NO: 82696 - RNA, 20 nt, Human
caaccuccaccucccgggcu

SEQ ID NO: 82697 - RNA, 24 nt, Human
caaccuccaccucccgggcugaag

SEQ ID NO: 82698 - RNA, 24 nt, Human
caaccuccaccucccgggcugaag

SEQ ID NO: 82699 - RNA, 24 nt, Human
caaccuccaccucccgggcugaag

SEQ ID NO: 82700 - RNA, 24 nt, Human
caaccuccaccucccgggcugaag

SEQ ID NO: 82701 - RNA, 21 nt, Human
caagcugaaaagcacaaauga

SEQ ID NO: 82702 - RNA, 23 nt, Human
caagucuuccaauucacugcacu

SEQ ID NO: 82703 - RNA, 22 nt, Human
caaguugacuaaaucucguacu

SEQ ID NO: 82704 - RNA, 20 nt, Human
caauagcucuucaacaaguu

SEQ ID NO: 82705 - RNA, 22 nt, Human
cacaagcagcuuuacccagagc

SEQ ID NO: 82706 - RNA, 22 nt, Human
cacacccagaugcugcuucacc

SEQ ID NO: 82707 - RNA, 24 nt, Human
caccacgcccggcuaauuuuugua

SEQ ID NO: 82708 - RNA, 21 nt, Human
caccacguuggucaggcuggu

SEQ ID NO: 82709 - RNA, 22 nt, Human
caccacguuggucaggcugguc

SEQ ID NO: 82710 - RNA, 21 nt, Human
caccauguuggccaggcuggu

SEQ ID NO: 82711 - RNA, 21 nt, Human
caccauguuggccaggcuggu

SEQ ID NO: 82712 - RNA, 21 nt, Human
caccauguuggccaggcuggu

SEQ ID NO: 82713 - RNA, 21 nt, Human
caccauguuggccaggcuggu

SEQ ID NO: 82714 - RNA, 21 nt, Human
caccauguuggccaggcuggu

SEQ ID NO: 82715 - RNA, 21 nt, Human
caccauguuggccaggcuggu

SEQ ID NO: 82716 - RNA, 24 nt, Human
caccauguuggccaggcugguuuc

SEQ ID NO: 82717 - RNA, 24 nt, Human
caccauguuggccaggcugguuuc

SEQ ID NO: 82718 - RNA, 24 nt, Human
caccauguuggccaggcugguuuc

SEQ ID NO: 82719 - RNA, 24 nt, Human
caccauguuggccaggcugguuuc

SEQ ID NO: 82720 - RNA, 31 nt, Human
caccauguuggccaggcugguuucgaacucc

SEQ ID NO: 82721 - RNA, 31 nt, Human; identical to SEQ ID NO: 82720

SEQ ID NO: 82722 - RNA, 31 nt, Human; identical to SEQ ID NO: 82720

SEQ ID NO: 82723 - RNA, 31 nt, Human; identical to SEQ ID NO: 82720

SEQ ID NO: 82724 - RNA, 21 nt, Human
cacccacucucgggucaccac

SEQ ID NO: 82725 - RNA, 21 nt, Human
cacccacucucgggucaccac

SEQ ID NO: 82726 - RNA, 25 nt, Human
cacccagaaauagcuaacuacccau

SEQ ID NO: 82727 - RNA, 20 nt, Human
caccucaaagaaagcaacag

SEQ ID NO: 82728 - RNA, 20 nt, Human
caccucaaagaaagcaacag

SEQ ID NO: 82729 - RNA, 20 nt, Human
caccucaaagaaagcaacag

SEQ ID NO: 82730 - RNA, 19 nt, Human
cacucuccuuccauugaag

SEQ ID NO: 82731 - RNA, 19 nt, Human
cacucuccuuccauugaag

SEQ ID NO: 82732 - RNA, 19 nt, Human
cacucuccuuccauugaag

SEQ ID NO: 82733 - RNA, 21 nt, Human
cacugcaaccuccaccucccg

SEQ ID NO: 82734 - RNA, 21 nt, Human
cacugcaaccuccaccucccg

SEQ ID NO: 82735 - RNA, 21 nt, Human
cacugcaaccuccaccucccg

SEQ ID NO: 82736 - RNA, 21 nt, Human
cacugcaaccuccaccucccg

SEQ ID NO: 82737 - RNA, 23 nt, Human
cacugcaaccuccaccucccggg

SEQ ID NO: 82738 - RNA, 23 nt, Human
cacugcaaccuccaccucccggg

SEQ ID NO: 82739 - RNA, 23 nt, Human
cacugcaaccuccaccucccggg

SEQ ID NO: 82740 - RNA, 23 nt, Human
cacugcaaccuccaccucccggg

SEQ ID NO: 82741 - RNA, 21 nt, Human
cacugcaaccuccgccucccg

SEQ ID NO: 82742 - RNA, 23 nt, Human
cacugcaaccuccgccucccggg

SEQ ID NO: 82743 - RNA, 20 nt, Human
cacugcacugugaagaaaac

SEQ ID NO: 82744 - RNA, 19 nt, Human
cacuuuguaagcucaucuu

SEQ ID NO: 82745 - RNA, 25 nt, Human
cacuuuguaagcucaucuugggguc

SEQ ID NO: 82746 - RNA, 18 nt, Human
cacuuuguaagcucauuc

SEQ ID NO: 82747 - RNA, 18 nt, Human
cacuuuguaagcucauuc

SEQ ID NO: 82748 - RNA, 18 nt, Human
cacuuuguaagcucauuc

SEQ ID NO: 82749 - RNA, 25 nt, Human
cacuuuguaagcucauucuuggggu

SEQ ID NO: 82750 - RNA, 25 nt, Human
cacuuuguaagcucauucuuggggu

SEQ ID NO: 82751 - RNA, 25 nt, Human
cacuuuguaagcucauucuuggggu

SEQ ID NO: 82752 - RNA, 25 nt, Human
cacuuuguaagcucauucuuggguc

SEQ ID NO: 82753 - RNA, 20 nt, Human
cagaaccuaacaguucauca

SEQ ID NO: 82754 - RNA, 22 nt, Human
cagaacuacccugauacuuuuc

SEQ ID NO: 82755 - RNA, 22 nt, Human
cagaacuacccugauacuuuuc

SEQ ID NO: 82756 - RNA, 19 nt, Human
cagcaacagggagcaaagg

SEQ ID NO: 82757 - RNA, 19 nt, Human
cagcaacagggagcaaagg

SEQ ID NO: 82758 - RNA, 19 nt, Human
cagcaacagggagcaaagg

SEQ ID NO: 82759 - RNA, 23 nt, Human
cagcaacagggagcaaaggaaaa

SEQ ID NO: 82760 - RNA, 23 nt, Human
cagcaacagggagcaaaggaaaa

SEQ ID NO: 82761 - RNA, 23 nt, Human
cagcaacagggagcaaaggaaaa

SEQ ID NO: 82762 - RNA, 23 nt, Human
cagcaacagggagcaaaggaaaa

SEQ ID NO: 82763 - RNA, 24 nt, Human
cagcaacagggagcaaaggaaaaa

SEQ ID NO: 82764 - RNA, 22 nt, Human
cagcaacagggagcaaaggaag

SEQ ID NO: 82765 - RNA, 22 nt, Human
cagcaacagggagcaaaggaag

SEQ ID NO: 82766 - RNA, 20 nt, Human
cagcagaaaggccuucugga

SEQ ID NO: 82767 - RNA, 18 nt, Human
cagcagcuggacucuggg

SEQ ID NO: 82768 - RNA, 21 nt, Human
cagcccuaagccaacaacagc

SEQ ID NO: 82769 - RNA, 21 nt, Human
cagcccuaagccaacaacagc

SEQ ID NO: 82770 - RNA, 21 nt, Human
cagcccuaagccaacaacagc

SEQ ID NO: 82771 - RNA, 21 nt, Human
cagccgguguuuuuuguuuug

SEQ ID NO: 82772 - RNA, 21 nt, Human
cagccuccugaguagcuggag

SEQ ID NO: 82773 - RNA, 20 nt, Human
cagcuuccuuccugguggga

SEQ ID NO: 82774 - RNA, 20 nt, Human
cagcuuccuuccugguggga

SEQ ID NO: 82775 - RNA, 20 nt, Human
cagcuuccuuccugguggga

SEQ ID NO: 82776 - RNA, 20 nt, Human
cagcuuccuuccugguggga

SEQ ID NO: 82777 - RNA, 23 nt, Human
cagguguccaccaccaugaccgg

SEQ ID NO: 82778 - RNA, 23 nt, Human
cagguguccaccaccaugaccgg

SEQ ID NO: 82779 - RNA, 23 nt, Human
cagguguccaccaccaugaccgg

SEQ ID NO: 82780 - RNA, 23 nt, Human
cagguguccaccaccaugaccgg

SEQ ID NO: 82781 - RNA, 19 nt, Human
cagguugcaaaaccccuaa

SEQ ID NO: 82782 - RNA, 19 nt, Human
caguaccagguaccaauga

SEQ ID NO: 82783 - RNA, 26 nt, Human
cagugaucugcccaccuuggccuccc

SEQ ID NO: 82784 - RNA, 21 nt, Human
caguuugcaaaacccuuucuc

SEQ ID NO: 82785 - RNA, 20 nt, Human
cauaauuuugugcucauggc

SEQ ID NO: 82786 - RNA, 19 nt, Human
caucacuggaaccuauuuc

SEQ ID NO: 82787 - RNA, 24 nt, Human
cauguuggccaggcugguuucgaa

SEQ ID NO: 82788 - RNA, 24 nt, Human
cauguuggccaggcugguuucgaa

SEQ ID NO: 82789 - RNA, 24 nt, Human
cauguuggccaggcugguuucgaa

SEQ ID NO: 82790 - RNA, 24 nt, Human
cauguuggccaggcugguuucgaa

SEQ ID NO: 82791 - RNA, 22 nt, Human
ccaaagugcugggauuacaggc

SEQ ID NO: 82792 - RNA, 22 nt, Human
ccaaagugcugggauuacaggc

SEQ ID NO: 82793 - RNA, 22 nt, Human
ccaaagugcugggauuacaggc

SEQ ID NO: 82794 - RNA, 22 nt, Human
ccaaagugcugggauuacaggc

SEQ ID NO: 82795 - RNA, 22 nt, Human
ccaaagugcugggauuacaggc

SEQ ID NO: 82796 - RNA, 22 nt, Human
ccaaagugcugggauuacaggc

SEQ ID NO: 82797 - RNA, 22 nt, Human
ccaaagugcugggauuacaggc

SEQ ID NO: 82798 - RNA, 24 nt, Human
ccaaagugcugggauuacaggcgu

SEQ ID NO: 82799 - RNA, 24 nt, Human
ccaaagugcugggauuacaggcgu

SEQ ID NO: 82800 - RNA, 24 nt, Human
ccaaagugcugggauuacaggcgu

SEQ ID NO: 82801 - RNA, 24 nt, Human
ccaaagugcugggauuacaggcgu

SEQ ID NO: 82802 - RNA, 26 nt, Human
ccaagcccguuccucuuucuucauca

SEQ ID NO: 82803 - RNA, 25 nt, Human
ccacaucuccucugacuucaaaauc

SEQ ID NO: 82804 - RNA, 25 nt, Human
ccacaucuccucugacuucaaaauc

SEQ ID NO: 82805 - RNA, 24 nt, Human
ccaccucccgggcugaagugauuc

SEQ ID NO: 82806 - RNA, 24 nt, Human
ccaccucccgggcugaagugauuc

SEQ ID NO: 82807 - RNA, 24 nt, Human
ccaccucccgggcugaagugauuc

SEQ ID NO: 82808 - RNA, 24 nt, Human
ccaccucccgggcugaagugauuc

SEQ ID NO: 82809 - RNA, 18 nt, Human
ccacuccaacauuugaga

SEQ ID NO: 82810 - RNA, 26 nt, Human
ccaggcaucuggcugcacaaccacaa

SEQ ID NO: 82811 - RNA, 27 nt, Human
ccagugaucugcccaccuuggccuccc

SEQ ID NO: 82812 - RNA, 27 nt, Human
ccagugaucugcccaccuuggccuccc

SEQ ID NO: 82813 - RNA, 27 nt, Human
ccagugaucugcccaccuuggccuccc

SEQ ID NO: 82814 - RNA, 27 nt, Human
ccagugaucugcccaccuuggccuccc

SEQ ID NO: 82815 - RNA, 19 nt, Human
cccagaaauagcuaacuac

SEQ ID NO: 82816 - RNA, 19 nt, Human
cccagaaauagcuaacuac

SEQ ID NO: 82817 - RNA, 23 nt, Human
cccagaaauagcuaacuacccau

SEQ ID NO: 82818 - RNA, 20 nt, Human
cccaggcuggagugccgugg

SEQ ID NO: 82819 - RNA, 20 nt, Human
cccaggcuggagugccgugg

SEQ ID NO: 82820 - RNA, 20 nt, Human
cccgggcugaagugauucuc

SEQ ID NO: 82821 - RNA, 20 nt, Human
cccgggcugaagugauucuc

SEQ ID NO: 82822 - RNA, 20 nt, Human
cccgggcugaagugauucuc

SEQ ID NO: 82823 - RNA, 23 nt, Human
cccggguucuagcgauucuccug

SEQ ID NO: 82824 - RNA, 21 nt, Human
cccugagcagucuucagagac

SEQ ID NO: 82825 - RNA, 28 nt, Human
cccugguuccuugaggggucggaaagcc

SEQ ID NO: 82826 - RNA, 18 nt, Human
ccuaaucuaagcauagca

SEQ ID NO: 82827 - RNA, 19 nt, Human
ccucaaagaaagcaacagc

SEQ ID NO: 82828 - RNA, 18 nt, Human
ccuccagugaucugccca

SEQ ID NO: 82829 - RNA, 18 nt, Human
ccuccagugaucugccca

SEQ ID NO: 82830 - RNA, 18 nt, Human
ccuccagugaucugccca

SEQ ID NO: 82831 - RNA, 18 nt, Human
ccuccagugaucugccca

SEQ ID NO: 82832 - RNA, 21 nt, Human
ccucccgcaauuccuagaaaa

SEQ ID NO: 82833 - RNA, 24 nt, Human
ccucccgggcugaagugauucucc

SEQ ID NO: 82834 - RNA, 24 nt, Human
ccucccgggcugaagugauucucc

SEQ ID NO: 82835 - RNA, 24 nt, Human
ccucccgggcugaagugauucucc

SEQ ID NO: 82836 - RNA, 24 nt, Human
ccucccgggcugaagugauucucc

SEQ ID NO: 82837 - RNA, 24 nt, Human
ccucccggguucuagcgauucucc

SEQ ID NO: 82838 - RNA, 18 nt, Human
ccuccugagcgcaggggc

SEQ ID NO: 82839 - RNA, 26 nt, Human
ccucugacuucaaaaucaugcucauu

SEQ ID NO: 82840 - RNA, 21 nt, Human
ccugagaugcaugacuacuuc

SEQ ID NO: 82841 - RNA, 22 nt, Human
ccugaguagcugggauuacagg

SEQ ID NO: 82842 - RNA, 22 nt, Human
ccugaguagcugggauuacagg

SEQ ID NO: 82843 - RNA, 22 nt, Human
ccugaguagcugggauuacagg

SEQ ID NO: 82844 - RNA, 22 nt, Human
ccugaguagcugggauuacagg

SEQ ID NO: 82845 - RNA, 22 nt, Human
ccugaguagcugggauuacagg

SEQ ID NO: 82846 - RNA, 23 nt, Human
ccugaguagcugggauuacaggu

SEQ ID NO: 82847 - RNA, 23 nt, Human
ccugaguagcugggauuacaggu

SEQ ID NO: 82848 - RNA, 23 nt, Human
ccugaguagcugggauuacaggu

SEQ ID NO: 82849 - RNA, 23 nt, Human
ccugaguagcugggauuacaggu

SEQ ID NO: 82850 - RNA, 24 nt, Human
ccugaguagcugggauuacaggug

SEQ ID NO: 82851 - RNA, 24 nt, Human
ccugaguagcugggauuacaggug

SEQ ID NO: 82852 - RNA, 24 nt, Human
ccugaguagcugggauuacaggug

SEQ ID NO: 82853 - RNA, 24 nt, Human
ccugaguagcugggauuacaggug

SEQ ID NO: 82854 - RNA, 23 nt, Human
ccugccucagccuccugaguagc

SEQ ID NO: 82855 - RNA, 24 nt, Human
ccugccuuagccaccugaguagcu

SEQ ID NO: 82856 - RNA, 24 nt, Human
ccugccuuagccaccugaguagcu

SEQ ID NO: 82857 - RNA, 24 nt, Human
ccugccuuagccaccugaguagcu

SEQ ID NO: 82858 - RNA, 22 nt, Human
ccuuagccaccugaguagcugg

SEQ ID NO: 82859 - RNA, 22 nt, Human
ccuuagccaccugaguagcugg

SEQ ID NO: 82860 - RNA, 23 nt, Human
ccuucuggauucuggcuuauagg

SEQ ID NO: 82861 - RNA, 18 nt, Human
ccuuugugaacacagggu

SEQ ID NO: 82862 - RNA, 18 nt, Human
ccuuugugaacacagggu

SEQ ID NO: 82863 - RNA, 24 nt, Human
ccuuugugaacacaggguuuuaga

SEQ ID NO: 82864 - RNA, 24 nt, Human
ccuuugugaacacaggguuuuaga

SEQ ID NO: 82865 - RNA, 24 nt, Human
ccuuugugaacacaggguuuuaga

SEQ ID NO: 82866 - RNA, 24 nt, Human
ccuuugugaacacaggguuuuaga

SEQ ID NO: 82867 - RNA, 19 nt, Human
ccuuuuuuucugugcuggg

SEQ ID NO: 82868 - RNA, 20 nt, Human
cgaucccaagcacucuccuu

SEQ ID NO: 82869 - RNA, 20 nt, Human
cgaucccaagcacucuccuu

SEQ ID NO: 82870 - RNA, 20 nt, Human
cgaucccaagcacucuccuu

SEQ ID NO: 82871 - RNA, 20 nt, Human
cgaucccaagcacucuccuu

SEQ ID NO: 82872 - RNA, 24 nt, Human
cgcucugucgcccaggcuggagug

SEQ ID NO: 82873 - RNA, 18 nt, Human
cggacacucagugccccc

SEQ ID NO: 82874 - RNA, 24 nt, Human
cggaguuucaccacguuggucagg

SEQ ID NO: 82875 - RNA, 18 nt, Human
cggcaccacgcccggcua

SEQ ID NO: 82876 - RNA, 24 nt, Human
cgugguaugaucuuggcucacugc

SEQ ID NO: 82877 - RNA, 21 nt, Human
cuaaaaacagcagaacuuucc

SEQ ID NO: 82878 - RNA, 22 nt, Human
cuaaaaacagcagaacuuuccc

SEQ ID NO: 82879 - RNA, 21 nt, Human
cuaagccaacaacagccugaa

SEQ ID NO: 82880 - RNA, 21 nt, Human
cuaagccaacaacagccugaa

SEQ ID NO: 82881 - RNA, 21 nt, Human
cuaagccaacaacagccugaa

SEQ ID NO: 82882 - RNA, 21 nt, Human
cuaagccaacaacagccugaa

SEQ ID NO: 82883 - RNA, 22 nt, Human
cuaccaaguuuauuugcagugu

SEQ ID NO: 82884 - RNA, 22 nt, Human
cuaccaaguuuauuugcagugu

SEQ ID NO: 82885 - RNA, 22 nt, Human
cuaccaaguuuauuugcagugu

SEQ ID NO: 82886 - RNA, 22 nt, Human
cuaccaaguuuauuugcagugu

SEQ ID NO: 82887 - RNA, 27 nt, Human
cuagcgauucuccugccucagccuccu

SEQ ID NO: 82888 - RNA, 23 nt, Human
cucaaacuugucagcagaaaggc

SEQ ID NO: 82889 - RNA, 18 nt, Human
cucaaagaaagcaacagc

SEQ ID NO: 82890 - RNA, 18 nt, Human
cucaaagaaagcaacagc

SEQ ID NO: 82891 - RNA, 18 nt, Human
cucaaagaaagcaacagc

SEQ ID NO: 82892 - RNA, 18 nt, Human
cucaaagaaagcaacagc

SEQ ID NO: 82893 - RNA, 18 nt, Human
cucaagggcagaagaguc

SEQ ID NO: 82894 - RNA, 20 nt, Human
cucaagggcagaagagucac

SEQ ID NO: 82895 - RNA, 21 nt, Human
cucaagggcagaagagucacu

SEQ ID NO: 82896 - RNA, 18 nt, Human
cucacacccagaugcugc

SEQ ID NO: 82897 - RNA, 24 nt, Human
cucacugcaaccuccaccucccgg

SEQ ID NO: 82898 - RNA, 24 nt, Human
cucacugcaaccuccaccucccgg

SEQ ID NO: 82899 - RNA, 24 nt, Human
cucacugcaaccuccaccucccgg

SEQ ID NO: 82900 - RNA, 24 nt, Human
cucacugcaaccuccaccucccgg

SEQ ID NO: 82901 - RNA, 24 nt, Human
cucacugcaaccuccgccucccgg

SEQ ID NO: 82902 - RNA, 21 nt, Human
cucagaauuuccuccccaaug

SEQ ID NO: 82903 - RNA, 21 nt, Human
cucagaauuuccuccccaaug

SEQ ID NO: 82904 - RNA, 21 nt, Human
cucagaauuuccuccccaaug

SEQ ID NO: 82905 - RNA, 21 nt, Human
cucagaauuuccuccccaaug

SEQ ID NO: 82906 - RNA, 24 nt, Human
cuccagugaucugcccaccuuggc

SEQ ID NO: 82907 - RNA, 24 nt, Human
cuccagugaucugcccaccuuggc

SEQ ID NO: 82908 - RNA, 24 nt, Human
cuccagugaucugcccaccuuggc

SEQ ID NO: 82909 - RNA, 24 nt, Human
cuccagugaucugcccaccuuggc

SEQ ID NO: 82910 - RNA, 21 nt, Human
cucccacacugcaauaaguug

SEQ ID NO: 82911 - RNA, 20 nt, Human
cucccgcaauuccuagaaaa

SEQ ID NO: 82912 - RNA, 18 nt, Human
cucccgggcugaagugau

SEQ ID NO: 82913 - RNA, 18 nt, Human
cucccgggcugaagugau

SEQ ID NO: 82914 - RNA, 19 nt, Human
cucccgggcugaagugauu

SEQ ID NO: 82915 - RNA, 19 nt, Human
cucccgggcugaagugauu

SEQ ID NO: 82916 - RNA, 19 nt, Human
cucccgggcugaagugauu

SEQ ID NO: 82917 - RNA, 25 nt, Human
cucccgggcugaagugauucuccug

SEQ ID NO: 82918 - RNA, 25 nt, Human
cucccgggcugaagugauucuccug

SEQ ID NO: 82919 - RNA, 25 nt, Human
cucccgggcugaagugauucuccug

SEQ ID NO: 82920 - RNA, 25 nt, Human
cucccgggcugaagugauucuccug

SEQ ID NO: 82921 - RNA, 21 nt, Human
cucccggguucuagcgauucu

SEQ ID NO: 82922 - RNA, 23 nt, Human
cuccuccacaucaacaaccuuaa

SEQ ID NO: 82923 - RNA, 25 nt, Human
cuccucugacuucaaaaucaugcuc

SEQ ID NO: 82924 - RNA, 24 nt, Human
cucgcucugucgcccaggcuggag

SEQ ID NO: 82925 - RNA, 25 nt, Human
cucugucgcccaggcuggagugcaa

SEQ ID NO: 82926 - RNA, 18 nt, Human
cucuucuuuuucuucucu

SEQ ID NO: 82927 - RNA, 27 nt, Human
cugaccaaccacaggaaagccugcagu

SEQ ID NO: 82928 - RNA, 21 nt, Human
cugaguagcugggauuacagg

SEQ ID NO: 82929 - RNA, 21 nt, Human
cugaguagcugggauuacagg

SEQ ID NO: 82930 - RNA, 21 nt, Human
cugaguagcugggauuacagg

SEQ ID NO: 82931 - RNA, 21 nt, Human
cugaguagcugggauuacagg

SEQ ID NO: 82932 - RNA, 23 nt, Human
cugaguagcugggauuacaggug

SEQ ID NO: 82933 - RNA, 23 nt, Human
cugaguagcugggauuacaggug

SEQ ID NO: 82934 - RNA, 24 nt, Human
cugaguagcugggauuacaggugu

SEQ ID NO: 82935 - RNA, 24 nt, Human
cugaguagcugggauuacaggugu

SEQ ID NO: 82936 - RNA, 24 nt, Human
cugaguagcugggauuacaggugu

SEQ ID NO: 82937 - RNA, 24 nt, Human
cugaguagcugggauuacaggugu

SEQ ID NO: 82938 - RNA, 18 nt, Human
cugcaaccuccaccuccc

SEQ ID NO: 82939 - RNA, 18 nt, Human
cugcaaccuccaccuccc

SEQ ID NO: 82940 - RNA, 22 nt, Human
cugcaaccuccaccucccgggc

SEQ ID NO: 82941 - RNA, 22 nt, Human
cugcaaccuccaccucccgggc

SEQ ID NO: 82942 - RNA, 22 nt, Human
cugcaaccuccaccucccgggc

SEQ ID NO: 82943 - RNA, 23 nt, Human
cugcaaccuccaccucccgggcu

SEQ ID NO: 82944 - RNA, 23 nt, Human
cugcaaccuccaccucccgggcu

SEQ ID NO: 82945 - RNA, 23 nt, Human
cugcaaccuccaccucccgggcu

SEQ ID NO: 82946 - RNA, 23 nt, Human
cugcaaccuccaccucccgggcu

SEQ ID NO: 82947 - RNA, 23 nt, Human
cugcaaccuccgccucccggguu

SEQ ID NO: 82948 - RNA, 23 nt, Human
cugccucagccuccugaguagcu

SEQ ID NO: 82949 - RNA, 23 nt, Human
cugccuuagccaccugaguagcu

SEQ ID NO: 82950 - RNA, 23 nt, Human
cugccuuagccaccugaguagcu

SEQ ID NO: 82951 - RNA, 24 nt, Human
cuggaaccuacuucauuaauauug

SEQ ID NO: 82952 - RNA, 22 nt, Human
cuggagcccacuucauuaguac

SEQ ID NO: 82953 - RNA, 20 nt, Human
cuggagcggcaccacgcccg

SEQ ID NO: 82954 - RNA, 19 nt, Human
cugggcagauucugcaacu

SEQ ID NO: 82955 - RNA, 20 nt, Human
cugggguaucagguaggugu

SEQ ID NO: 82956 - RNA, 20 nt, Human
cugggguaucagguaggugu

SEQ ID NO: 82957 - RNA, 22 nt, Human
cuguauuuuuaguagagauggg

SEQ ID NO: 82958 - RNA, 22 nt, Human
cuguauuuuuaguagagauggg

SEQ ID NO: 82959 - RNA, 23 nt, Human
cuguauuuuuaguagagaugggg

SEQ ID NO: 82960 - RNA, 23 nt, Human
cuguauuuuuaguagagaugggg

SEQ ID NO: 82961 - RNA, 23 nt, Human
cuguauuuuuaguagagaugggg

SEQ ID NO: 82962 - RNA, 18 nt, Human
cugucacccaggcuggag

SEQ ID NO: 82963 - RNA, 19 nt, Human
cugucgcccaggcuggagu

SEQ ID NO: 82964 - RNA, 20 nt, Human
cuguuuuugccuucccuaga

SEQ ID NO: 82965 - RNA, 23 nt, Human
cuuaaagccuucugugucauuuc

SEQ ID NO: 82966 - RNA, 23 nt, Human
cuuagccaccugaguagcuggga

SEQ ID NO: 82967 - RNA, 24 nt, Human
cuuagccaccugaguagcugggau

SEQ ID NO: 82968 - RNA, 24 nt, Human
cuuagccaccugaguagcugggau

SEQ ID NO: 82969 - RNA, 24 nt, Human
cuuagccaccugaguagcugggau

SEQ ID NO: 82970 - RNA, 24 nt, Human
cuuagccaccugaguagcugggau

SEQ ID NO: 82971 - RNA, 19 nt, Human
cuuccagcccaucuguuau

SEQ ID NO: 82972 - RNA, 19 nt, Human
cuucucccugcucacacuu

SEQ ID NO: 82973 - RNA, 20 nt, Human
cuugcauagccagaaguccu

SEQ ID NO: 82974 - RNA, 20 nt, Human
cuugcauagccagaaguccu

SEQ ID NO: 82975 - RNA, 20 nt, Human
cuugcauagccagaaguccu

SEQ ID NO: 82976 - RNA, 20 nt, Human
cuugcauagccagaaguccu

SEQ ID NO: 82977 - RNA, 19 nt, Human
cuuuaauuuauuugugagg

SEQ ID NO: 82978 - RNA, 22 nt, Human
cuuucuggacgcuuuugcuaaa

SEQ ID NO: 82979 - RNA, 21 nt, Human
cuuuuuuuuuuuuuuuuuugg

SEQ ID NO: 82980 - RNA, 21 nt, Human
gaagaaucagaucccaauuca

SEQ ID NO: 82981 - RNA, 22 nt, Human
gacucuggggcucugucuucag

SEQ ID NO: 82982 - RNA, 18 nt, Human
gagaugggguuucaccau

SEQ ID NO: 82983 - RNA, 18 nt, Human
gagaugggguuucaccau

SEQ ID NO: 82984 - RNA, 18 nt, Human
gagaugggguuucaccau

SEQ ID NO: 82985 - RNA, 20 nt, Human
gagaugggguuucaccaugu

SEQ ID NO: 82986 - RNA, 20 nt, Human
gagaugggguuucaccaugu

SEQ ID NO: 82987 - RNA, 24 nt, Human
gagaugggguuucaccauguuggc

SEQ ID NO: 82988 - RNA, 24 nt, Human
gagaugggguuucaccauguuggc

SEQ ID NO: 82989 - RNA, 24 nt, Human
gagaugggguuucaccauguuggc

SEQ ID NO: 82990 - RNA, 24 nt, Human
gagaugggguuucaccauguuggc

SEQ ID NO: 82991 - RNA, 23 nt, Human
gagcagcagcuggacucugggca

SEQ ID NO: 82992 - RNA, 24 nt, Human
gagcagcagcuggacucugggcag

SEQ ID NO: 82993 - RNA, 19 nt, Human
gaguagcugggauuacagg

SEQ ID NO: 82994 - RNA, 19 nt, Human
gaguagcugggauuacagg

SEQ ID NO: 82995 - RNA, 19 nt, Human
gaguagcugggauuacagg

SEQ ID NO: 82996 - RNA, 19 nt, Human
gaguagcugggauuacagg

SEQ ID NO: 82997 - RNA, 25 nt, Human
gaguagcugggauuacaggugucca

SEQ ID NO: 82998 - RNA, 25 nt, Human
gaguagcugggauuacaggugucca

SEQ ID NO: 82999 - RNA, 25 nt, Human
gaguagcugggauuacaggugucca

SEQ ID NO: 83000 - RNA, 18 nt, Human
gauuacaggcgugagcca

SEQ ID NO: 83001 - RNA, 18 nt, Human
gauuacaggcgugagcca

SEQ ID NO: 83002 - RNA, 18 nt, Human
gauuacaggcgugagcca

SEQ ID NO: 83003 - RNA, 18 nt, Human
gauuacaggcgugagcca

SEQ ID NO: 83004 - RNA, 21 nt, Human
gauuacaggcgugagccacca

SEQ ID NO: 83005 - RNA, 21 nt, Human
gauuacaggcgugagccacca

SEQ ID NO: 83006 - RNA, 21 nt, Human
gauuacaggcgugagccacca

SEQ ID NO: 83007 - RNA, 21 nt, Human
gauuacaggcgugagccacca

SEQ ID NO: 83008 - RNA, 22 nt, Human
gauuacaggcgugagccaccau

SEQ ID NO: 83009 - RNA, 22 nt, Human
gauuacaggcgugagccaccau

SEQ ID NO: 83010 - RNA, 24 nt, Human
gauuacaggcgugagccaccaugc

SEQ ID NO: 83011 - RNA, 24 nt, Human
gauuacaggcgugagccaccaugc

SEQ ID NO: 83012 - RNA, 24 nt, Human
gauuacaggcgugagccaccaugc

SEQ ID NO: 83013 - RNA, 21 nt, Human
gcaaaacuaguaucuuccuuu

SEQ ID NO: 83014 - RNA, 24 nt, Human
gcaaaauagucccagcuacuuggg

SEQ ID NO: 83015 - RNA, 20 nt, Human
gcaaccuccaccucccgggc

SEQ ID NO: 83016 - RNA, 20 nt, Human
gcaaccuccaccucccgggc

SEQ ID NO: 83017 - RNA, 22 nt, Human
gcaaccuccgccucccggguuc

SEQ ID NO: 83018 - RNA, 18 nt, Human
gcaacggugcuaugccua

SEQ ID NO: 83019 - RNA, 19 nt, Human
gcacauuccucuucugcau

SEQ ID NO: 83020 - RNA, 19 nt, Human
gcccaggcuggagugcaau

SEQ ID NO: 83021 - RNA, 20 nt, Human
gcccaggcuggagugcaaug

SEQ ID NO: 83022 - RNA, 22 nt, Human
gcccggcuaauuuuuguauuuu

SEQ ID NO: 83023 - RNA, 19 nt, Human
gcccuaagccaacaacagc

SEQ ID NO: 83024 - RNA, 19 nt, Human
gcccuaagccaacaacagc

SEQ ID NO: 83025 - RNA, 22 nt, Human
gccuaggaggucaaggcaacag

SEQ ID NO: 83026 - RNA, 23 nt, Human
gcgauucuccugccucagccucc

SEQ ID NO: 83027 - RNA, 19 nt, Human
gcucuuguauuaucugugg

SEQ ID NO: 83028 - RNA, 19 nt, Human
gcuggagugcaauggcgcg

SEQ ID NO: 83029 - RNA, 23 nt, Human
gcuggucuggaacuccugaccuc

SEQ ID NO: 83030 - RNA, 23 nt, Human
gcugguuucgaacuccugaccuc

SEQ ID NO: 83031 - RNA, 23 nt, Human
gcugguuucgaacuccugaccuc

SEQ ID NO: 83032 - RNA, 23 nt, Human
gcugguuucgaacuccugaccuc

SEQ ID NO: 83033 - RNA, 23 nt, Human
gcugguuucgaacuccugaccuc

SEQ ID NO: 83034 - RNA, 18 nt, Human
ggaaaaccacucauuaac

SEQ ID NO: 83035 - RNA, 23 nt, Human
ggauacuuaaagccuucuguguc

SEQ ID NO: 83036 - RNA, 24 nt, Human
ggauuacaggcgugagccaccaug

SEQ ID NO: 83037 - RNA, 24 nt, Human
ggauuacaggcgugagccaccaug

SEQ ID NO: 83038 - RNA, 24 nt, Human
ggauuacaggcgugagccaccaug

SEQ ID NO: 83039 - RNA, 24 nt, Human
ggauuacaggcgugagccaccaug

SEQ ID NO: 83040 - RNA, 25 nt, Human
ggccagacaccaccauggacauucu

SEQ ID NO: 83041 - RNA, 24 nt, Human
ggcguuuaaaugguuuuaaaaucu

SEQ ID NO: 83042 - RNA, 24 nt, Human
ggcguuuaaaugguuuuaaaaucu

SEQ ID NO: 83043 - RNA, 24 nt, Human
ggcguuuaaaugguuuuaaaaucu

SEQ ID NO: 83044 - RNA, 24 nt, Human
ggcguuuaaaugguuuuaaaaucu

SEQ ID NO: 83045 - RNA, 19 nt, Human
ggcucuguaccuguggcug

SEQ ID NO: 83046 - RNA, 24 nt, Human
ggcuggucuggaacuccugaccuc

SEQ ID NO: 83047 - RNA, 24 nt, Human
ggcugguuucgaacuccugaccuc

SEQ ID NO: 83048 - RNA, 24 nt, Human
ggcugguuucgaacuccugaccuc

SEQ ID NO: 83049 - RNA, 24 nt, Human
ggcugguuucgaacuccugaccuc

SEQ ID NO: 83050 - RNA, 24 nt, Human
ggcugguuucgaacuccugaccuc

SEQ ID NO: 83051 - RNA, 23 nt, Human
gggaaaccagcuauucucuugag

SEQ ID NO: 83052 - RNA, 23 nt, Human
gggaaaccagcuauucucuugag

SEQ ID NO: 83053 - RNA, 19 nt, Human
gggguccaggaagucucag

SEQ ID NO: 83054 - RNA, 26 nt, Human
gggguccguggcucuguaccuguggc

SEQ ID NO: 83055 - RNA, 22 nt, Human
gggguuucaccauguuggccag

SEQ ID NO: 83056 - RNA, 22 nt, Human
gggguuucaccauguuggccag

SEQ ID NO: 83057 - RNA, 22 nt, Human
gggguuucaccauguuggccag

SEQ ID NO: 83058 - RNA, 22 nt, Human
gggguuucaccauguuggccag

SEQ ID NO: 83059 - RNA, 23 nt, Human
gggguuucaccauguuggccagg

SEQ ID NO: 83060 - RNA, 18 nt, Human
ggguuucaccauguuggc

SEQ ID NO: 83061 - RNA, 18 nt, Human
ggguuucaccauguuggc

SEQ ID NO: 83062 - RNA, 18 nt, Human
ggguuucaccauguuggc

SEQ ID NO: 83063 - RNA, 22 nt, Human
ggguuucaccauguuggccagg

SEQ ID NO: 83064 - RNA, 22 nt, Human
ggguuucaccauguuggccagg

SEQ ID NO: 83065 - RNA, 21 nt, Human
ggugguuucuuccauugacca

SEQ ID NO: 83066 - RNA, 21 nt, Human
ggugguuucuuccauugacca

SEQ ID NO: 83067 - RNA, 19 nt, Human
gguuucgaacuccugaccu

SEQ ID NO: 83068 - RNA, 19 nt, Human
gguuucgaacuccugaccu

SEQ ID NO: 83069 - RNA, 19 nt, Human
gguuucgaacuccugaccu

SEQ ID NO: 83070 - RNA, 19 nt, Human
gguuucgaacuccugaccu

SEQ ID NO: 83071 - RNA, 23 nt, Human
guagagaugggguuucaccaugu

SEQ ID NO: 83072 - RNA, 23 nt, Human
guagagaugggguuucaccaugu

SEQ ID NO: 83073 - RNA, 23 nt, Human
guagagaugggguuucaccaugu

SEQ ID NO: 83074 - RNA, 23 nt, Human
guagagaugggguuucaccaugu

SEQ ID NO: 83075 - RNA, 18 nt, Human
guagcugggauuacaggu

SEQ ID NO: 83076 - RNA, 18 nt, Human
guagcugggauuacaggu

SEQ ID NO: 83077 - RNA, 18 nt, Human
guagcugggauuacaggu

SEQ ID NO: 83078 - RNA, 24 nt, Human
guccuguggccuguaccuguggcu

SEQ ID NO: 83079 - RNA, 24 nt, Human
guccuguggcuuguaccuguggcu

SEQ ID NO: 83080 - RNA, 23 nt, Human
gucucacugucacccaggcugga

SEQ ID NO: 83081 - RNA, 23 nt, Human
gucucacugucacccaggcugga

SEQ ID NO: 83082 - RNA, 23 nt, Human
gucucacugucacccaggcugga

SEQ ID NO: 83083 - RNA, 23 nt, Human
gucucacugucacccaggcugga

SEQ ID NO: 83084 - RNA, 23 nt, Human
gugguaugaucuuggcucacugc

SEQ ID NO: 83085 - RNA, 23 nt, Human
gugguaugaucuuggcucacugc

SEQ ID NO: 83086 - RNA, 23 nt, Human
gugguaugaucuuggcucacugc

SEQ ID NO: 83087 - RNA, 23 nt, Human
gugguaugaucuuggcucacugc

SEQ ID NO: 83088 - RNA, 19 nt, Human
guuaguucccugauuuauc

SEQ ID NO: 83089 - RNA, 20 nt, Human
guuugcaaaacccuuucucc

SEQ ID NO: 83090 - RNA, 22 nt, Human
uaacagcacaacauuuacaaaa

SEQ ID NO: 83091 - RNA, 22 nt, Human
uaacagcacaacauuuacaaaa

SEQ ID NO: 83092 - RNA, 22 nt, Human
uaacagcacaacauuuacaaaa

SEQ ID NO: 83093 - RNA, 22 nt, Human
uaacagcacaacauuuacaaaa

SEQ ID NO: 83094 - RNA, 19 nt, Human
uaacaggucaucagguguc

SEQ ID NO: 83095 - RNA, 18 nt, Human
uaagccaacaacagccug

SEQ ID NO: 83096 - RNA, 22 nt, Human
uaagccaacaacagccugaaua

SEQ ID NO: 83097 - RNA, 22 nt, Human
uaagccaacaacagccugaaua

SEQ ID NO: 83098 - RNA, 22 nt, Human
uaagccaacaacagccugaaua

SEQ ID NO: 83099 - RNA, 22 nt, Human
uaagccaacaacagccugaaua

SEQ ID NO: 83100 - RNA, 21 nt, Human
uaagggacccuugcauagcca

SEQ ID NO: 83101 - RNA, 21 nt, Human
uaagggacccuugcauagcca

SEQ ID NO: 83102 - RNA, 21 nt, Human
uaagggacccuugcauagcca

SEQ ID NO: 83103 - RNA, 21 nt, Human
uaagggacccuugcauagcca

SEQ ID NO: 83104 - RNA, 23 nt, Human
uaaggugauguuccugagaugcc

SEQ ID NO: 83105 - RNA, 24 nt, Human
uaauuucuguauuuuuaguagaga

SEQ ID NO: 83106 - RNA, 24 nt, Human
uaauuucuguauuuuuaguagaga

SEQ ID NO: 83107 - RNA, 24 nt, Human
uaauuucuguauuuuuaguagaga

SEQ ID NO: 83108 - RNA, 24 nt, Human
uaauuucuguauuuuuaguagaga

SEQ ID NO: 83109 - RNA, 24 nt, Human
uaauuuuuguauuuuuaguagaga

SEQ ID NO: 83110 - RNA, 20 nt, Human
uacaauuaggugggcuuaga

SEQ ID NO: 83111 - RNA, 23 nt, Human
uacagaauucagccuuuucuaca

SEQ ID NO: 83112 - RNA, 24 nt, Human
uacaggcgugagccaccaugccca

SEQ ID NO: 83113 - RNA, 24 nt, Human
uacaggcgugagccaccaugccca

SEQ ID NO: 83114 - RNA, 24 nt, Human
uacaggcgugagccaccaugccca

SEQ ID NO: 83115 - RNA, 24 nt, Human
uacaggcgugagccaccaugccca

SEQ ID NO: 83116 - RNA, 23 nt, Human
uaccagagcuacaacaauaaaca

SEQ ID NO: 83117 - RNA, 23 nt, Human
uaccagagcuacaacaauaaaca

SEQ ID NO: 83118 - RNA, 23 nt, Human
uaccagagcuacaacaauaaaca

SEQ ID NO: 83119 - RNA, 23 nt, Human
uaccagagcuacaacaauaaaca

SEQ ID NO: 83120 - RNA, 23 nt, Human
uaccauaauuuugugcucauggc

SEQ ID NO: 83121 - RNA, 23 nt, Human
uaccauaauuuugugcucauggc

SEQ ID NO: 83122 - RNA, 23 nt, Human
uaccauaauuuugugcucauggc

SEQ ID NO: 83123 - RNA, 23 nt, Human
uaccauaauuuugugcucauggc

SEQ ID NO: 83124 - RNA, 19 nt, Human
uacccauuuuccucccgca

SEQ ID NO: 83125 - RNA, 19 nt, Human
uacccauuuuccucccgca

SEQ ID NO: 83126 - RNA, 22 nt, Human
uacuaaugaggaauuagaagac

SEQ ID NO: 83127 - RNA, 22 nt, Human
uacuaaugaggaauuagaagac

SEQ ID NO: 83128 - RNA, 22 nt, Human
uacuaaugaggaauuagaagac

SEQ ID NO: 83129 - RNA, 22 nt, Human
uacuaaugaggaauuagaagac

SEQ ID NO: 83130 - RNA, 24 nt, Human
uagaaagaauagggcugauaaaua

SEQ ID NO: 83131 - RNA, 24 nt, Human
uagaaagaauagggcugauaaaua

SEQ ID NO: 83132 - RNA, 24 nt, Human
uagaaagaauagggcugauaaaua

SEQ ID NO: 83133 - RNA, 24 nt, Human
uagaaagaauagggcugauaaaua

SEQ ID NO: 83134 - RNA, 18 nt, Human
uagaaggacugaagagug

SEQ ID NO: 83135 - RNA, 18 nt, Human
uagaaggacugaagagug

SEQ ID NO: 83136 - RNA, 18 nt, Human
uagaaggacugaagagug

SEQ ID NO: 83137 - RNA, 25 nt, Human
uagaaggcuggcucccaugcuguuc

SEQ ID NO: 83138 - RNA, 22 nt, Human
uagagaugggguuucaccaugu

SEQ ID NO: 83139 - RNA, 22 nt, Human
uagagaugggguuucaccaugu

SEQ ID NO: 83140 - RNA, 22 nt, Human
uagagaugggguuucaccaugu

SEQ ID NO: 83141 - RNA, 22 nt, Human
uagagaugggguuucaccaugu

SEQ ID NO: 83142 - RNA, 19 nt, Human
uagcuggagcggcaccacg

SEQ ID NO: 83143 - RNA, 19 nt, Human
uaguagagacggaguuuca

SEQ ID NO: 83144 - RNA, 25 nt, Human
uaguagagacggaguuucaccacgu

SEQ ID NO: 83145 - RNA, 24 nt, Human
uaguagagaugggguuucaccaug

SEQ ID NO: 83146 - RNA, 24 nt, Human
uaguagagaugggguuucaccaug

SEQ ID NO: 83147 - RNA, 24 nt, Human
uaguagagaugggguuucaccaug

SEQ ID NO: 83148 - RNA, 24 nt, Human
uaguagagaugggguuucaccaug

SEQ ID NO: 83149 - RNA, 25 nt, Human
uaguagagaugggguuucaccaugu

SEQ ID NO: 83150 - RNA, 25 nt, Human
uaguagagaugggguuucaccaugu

SEQ ID NO: 83151 - RNA, 26 nt, Human
uaguagagaugggguuucaccauguu

SEQ ID NO: 83152 - RNA, 26 nt, Human
uaguagagaugggguuucaccauguu

SEQ ID NO: 83153 - RNA, 26 nt, Human
uaguagagaugggguuucaccauguu

SEQ ID NO: 83154 - RNA, 18 nt, Human
uagugaguaauaaacugc

SEQ ID NO: 83155 - RNA, 18 nt, Human
uagugaguaauaaacugc

SEQ ID NO: 83156 - RNA, 21 nt, Human
uaguuucucuucuuuuucuuc

SEQ ID NO: 83157 - RNA, 22 nt, Human
uauccaaggaacaucuucagua

SEQ ID NO: 83158 - RNA, 19 nt, Human
uauuccauucuuuucucuc

SEQ ID NO: 83159 - RNA, 25 nt, Human
ucaauagcucuucaacaaguugacu

SEQ ID NO: 83160 - RNA, 18 nt, Human
ucaauguagacagacguc

SEQ ID NO: 83161 - RNA, 21 nt, Human
ucacauaaucgaucccaagca

SEQ ID NO: 83162 - RNA, 21 nt, Human
ucacauaaucgaucccaagca

SEQ ID NO: 83163 - RNA, 21 nt, Human
ucacauaaucgaucccaagca

SEQ ID NO: 83164 - RNA, 21 nt, Human
ucacauaaucgaucccaagca

SEQ ID NO: 83165 - RNA, 18 nt, Human
ucacccaggcuggagugc

SEQ ID NO: 83166 - RNA, 18 nt, Human
ucacccaggcuggagugc

SEQ ID NO: 83167 - RNA, 18 nt, Human
ucacccaggcuggagugc

SEQ ID NO: 83168 - RNA, 18 nt, Human
ucacccaggcuggagugc

SEQ ID NO: 83169 - RNA, 22 nt, Human
ucacucagaccaacucccuggc

SEQ ID NO: 83170 - RNA, 23 nt, Human
ucacugcaaccuccaccucccgg

SEQ ID NO: 83171 - RNA, 23 nt, Human
ucacugcaaccuccaccucccgg

SEQ ID NO: 83172 - RNA, 23 nt, Human
ucacugcaaccuccaccucccgg

SEQ ID NO: 83173 - RNA, 23 nt, Human
ucacugcaaccuccaccucccgg

SEQ ID NO: 83174 - RNA, 23 nt, Human
ucacugcaaccuccaccucccgg

SEQ ID NO: 83175 - RNA, 24 nt, Human
ucacugcaaccuccaccucccggg

SEQ ID NO: 83176 - RNA, 24 nt, Human
ucacugcaaccuccaccucccggg

SEQ ID NO: 83177 - RNA, 24 nt, Human
ucacugcaaccuccaccucccggg

SEQ ID NO: 83178 - RNA, 24 nt, Human
ucacugcaaccuccaccucccggg

SEQ ID NO: 83179 - RNA, 25 nt, Human
ucacugcaaccuccaccucccgggc

SEQ ID NO: 83180 - RNA, 25 nt, Human
ucacugcaaccuccaccucccgggc

SEQ ID NO: 83181 - RNA, 25 nt, Human
ucacugcaaccuccaccucccgggc

SEQ ID NO: 83182 - RNA, 26 nt, Human
ucacugcaaccuccaccucccgggcu

SEQ ID NO: 83183 - RNA, 27 nt, Human
ucacugcaaccuccaccucccgggcug

SEQ ID NO: 83184 - RNA, 27 nt, Human
ucacugcaaccuccaccucccgggcug

SEQ ID NO: 83185 - RNA, 27 nt, Human
ucacugcaaccuccaccucccgggcug

SEQ ID NO: 83186 - RNA, 23 nt, Human
ucacugcaaccuccgccucccgg

SEQ ID NO: 83187 - RNA, 24 nt, Human
ucacugcaaccuccgccucccggg

SEQ ID NO: 83188 - RNA, 25 nt, Human
ucacugcaaccuccgccucccgggu

SEQ ID NO: 83189 - RNA, 27 nt, Human
ucacugcaaccuccgccucccggguuc

SEQ ID NO: 83190 - RNA, 23 nt, Human
ucacugucacccaggcuggagug

SEQ ID NO: 83191 - RNA, 23 nt, Human
ucacugucacccaggcuggagug

SEQ ID NO: 83192 - RNA, 23 nt, Human
ucacugucacccaggcuggagug

SEQ ID NO: 83193 - RNA, 23 nt, Human
ucacugucacccaggcuggagug

SEQ ID NO: 83194 - RNA, 23 nt, Human
ucagcaacagggagcaaaggaaa

SEQ ID NO: 83195 - RNA, 23 nt, Human
ucagcaacagggagcaaaggaaa

SEQ ID NO: 83196 - RNA, 23 nt, Human
ucagcaacagggagcaaaggaaa

SEQ ID NO: 83197 - RNA, 21 nt, Human
ucagccauuuccugcuggagc

SEQ ID NO: 83198 - RNA, 23 nt, Human
ucagccuccugaguagcuggagc

SEQ ID NO: 83199 - RNA, 22 nt, Human
ucagcuacuuuggcauuugauu

SEQ ID NO: 83200 - RNA, 21 nt, Human
ucagcugcacgcuucucagga

SEQ ID NO: 83201 - RNA, 21 nt, Human
ucagcugcacgcuucucagga

SEQ ID NO: 83202 - RNA, 20 nt, Human
ucagcugcacgcuucucagu

SEQ ID NO: 83203 - RNA, 20 nt, Human
ucagcugcacgcuucucagu

SEQ ID NO: 83204 - RNA, 19 nt, Human
ucaggccagacaccaccau

SEQ ID NO: 83205 - RNA, 24 nt, Human
ucaggugucucagaacaaaccuga

SEQ ID NO: 83206 - RNA, 22 nt, Human
ucagugcccccuuccugauccu

SEQ ID NO: 83207 - RNA, 19 nt, Human
ucauucuugggguccuggg

SEQ ID NO: 83208 - RNA, 23 nt, Human
uccaaacugauuucaucccuggu

SEQ ID NO: 83209 - RNA, 20 nt, Human
uccaaugaacuuuacccaga

SEQ ID NO: 83210 - RNA, 26 nt, Human
uccacaugcaaguuugaaacagaacu

SEQ ID NO: 83211 - RNA, 26 nt, Human
uccacaugcaaguuugaaacagaacu

SEQ ID NO: 83212 - RNA, 19 nt, Human
uccacuccaacauuugaga

SEQ ID NO: 83213 - RNA, 19 nt, Human
uccacuccaacauuugaga

SEQ ID NO: 83214 - RNA, 19 nt, Human
uccacuccaacauuugaga

SEQ ID NO: 83215 - RNA, 19 nt, Human
uccacuccaacauuugaga

SEQ ID NO: 83216 - RNA, 19 nt, Human
uccacuuaacaugagaucu

SEQ ID NO: 83217 - RNA, 23 nt, Human
uccagugaucugcccaccuuggc

SEQ ID NO: 83218 - RNA, 23 nt, Human
uccauugaccacaucuccucuga

SEQ ID NO: 83219 - RNA, 23 nt, Human
uccauugaccacaucuccucuga

SEQ ID NO: 83220 - RNA, 24 nt, Human
ucccaaagugcugggauuacaggc

SEQ ID NO: 83221 - RNA, 24 nt, Human
ucccaaagugcugggauuacaggc

SEQ ID NO: 83222 - RNA, 24 nt, Human
ucccaaagugcugggauuacaggc

SEQ ID NO: 83223 - RNA, 24 nt, Human
ucccaaagugcugggauuacaggc

SEQ ID NO: 83224 - RNA, 26 nt, Human
ucccacacugcaauaaguugccuuau

SEQ ID NO: 83225 - RNA, 18 nt, Human
ucccagagcaacugugca

SEQ ID NO: 83226 - RNA, 24 nt, Human
ucccgggcugaagugauucuccug

SEQ ID NO: 83227 - RNA, 24 nt, Human
ucccgggcugaagugauucuccug

SEQ ID NO: 83228 - RNA, 24 nt, Human
ucccgggcugaagugauucuccug

SEQ ID NO: 83229 - RNA, 24 nt, Human
ucccgggcugaagugauucuccug

SEQ ID NO: 83230 - RNA, 21 nt, Human
ucccggguucuagcgauucuc

SEQ ID NO: 83231 - RNA, 24 nt, Human
ucccggguucuagcgauucuccug

SEQ ID NO: 83232 - RNA, 18 nt, Human
uccugagcgcaggggccc

SEQ ID NO: 83233 - RNA, 18 nt, Human
uccuuuuuuuuuuuuuuu

SEQ ID NO: 83234 - RNA, 18 nt, Human
uccuuuuuuuuuuuuuuu

SEQ ID NO: 83235 - RNA, 18 nt, Human
uccuuuuuuuuuuuuuuu

SEQ ID NO: 83236 - RNA, 18 nt, Human
uccuuuuuuuuuuuuuuu

SEQ ID NO: 83237 - RNA, 18 nt, Human
uccuuuuuuuuuuuuuuu

SEQ ID NO: 83238 - RNA, 18 nt, Human
uccuuuuuuuuuuuuuuu

SEQ ID NO: 83239 - RNA, 18 nt, Human
ucgcccaggcuggagugc

SEQ ID NO: 83240 - RNA, 18 nt, Human
ucgcuugagccuaggagg

SEQ ID NO: 83241 - RNA, 25 nt, Human
ucgguagcaacggugcuaugccuag

SEQ ID NO: 83242 - RNA, 22 nt, Human
ucuaaguuaucugaaaucagau

SEQ ID NO: 83243 - RNA, 22 nt, Human
ucuacagaucuuucaguuugca

SEQ ID NO: 83244 - RNA, 23 nt, Human
ucuagcgauucuccugccucagc

SEQ ID NO: 83245 - RNA, 23 nt, Human
ucuaguucagccauuuccugcug

SEQ ID NO: 83246 - RNA, 22 nt, Human
ucuaguuucucuucuuuuucuu

SEQ ID NO: 83247 - RNA, 22 nt, Human
ucucacugucacccaggcugga

SEQ ID NO: 83248 - RNA, 22 nt, Human
ucucacugucacccaggcugga

SEQ ID NO: 83249 - RNA, 22 nt, Human
ucucacugucacccaggcugga

SEQ ID NO: 83250 - RNA, 22 nt, Human
ucucacugucacccaggcugga

SEQ ID NO: 83251 - RNA, 24 nt, Human
ucucacugucacccaggcuggagu

SEQ ID NO: 83252 - RNA, 24 nt, Human
ucucacugucacccaggcuggagu

SEQ ID NO: 83253 - RNA, 24 nt, Human
ucucacugucacccaggcuggagu

SEQ ID NO: 83254 - RNA, 24 nt, Human
ucucacugucacccaggcuggagu

SEQ ID NO: 83255 - RNA, 18 nt, Human
ucucaugcuguaaugagc

SEQ ID NO: 83256 - RNA, 18 nt, Human
ucucaugcuguaaugagc

SEQ ID NO: 83257 - RNA, 23 nt, Human
ucucauuucccauuucucuuuca

SEQ ID NO: 83258 - RNA, 24 nt, Human
ucuccugccucagccuccugagua

SEQ ID NO: 83259 - RNA, 19 nt, Human
ucucgcucugucgcccagg

SEQ ID NO: 83260 - RNA, 22 nt, Human
ucucgcucugucgcccaggcug

SEQ ID NO: 83261 - RNA, 23 nt, Human
ucucgcucugucgcccaggcugg

SEQ ID NO: 83262 - RNA, 24 nt, Human
ucucgcucugucgcccaggcugga

SEQ ID NO: 83263 - RNA, 26 nt, Human
ucucgcucugucgcccaggcuggagu

SEQ ID NO: 83264 - RNA, 21 nt, Human
ucucuugaggccaagccacuc

SEQ ID NO: 83265 - RNA, 23 nt, Human
ucugaugugcuuuguucuggauu

SEQ ID NO: 83266 - RNA, 23 nt, Human
ucugcagacaccucaaacuuguc

SEQ ID NO: 83267 - RNA, 20 nt, Human
ucugcauuuccuggauuuga

SEQ ID NO: 83268 - RNA, 24 nt, Human
ucugucgcccaggcuggagugcaa

SEQ ID NO: 83269 - RNA, 24 nt, Human
ucugucuuuagugaguaauaaacu

SEQ ID NO: 83270 - RNA, 24 nt, Human
ucugucuuuagugaguaauaaacu

SEQ ID NO: 83271 - RNA, 25 nt, Human
ucuuagacagacacucgguagcaac

SEQ ID NO: 83272 - RNA, 21 nt, Human
ucuuuaucucuucacugcuag

SEQ ID NO: 83273 - RNA, 23 nt, Human
ugaaaaacacuuuuucuuccuuc

SEQ ID NO: 83274 - RNA, 23 nt, Human
ugaaaaacacuuuuucuuccuuc

SEQ ID NO: 83275 - RNA, 23 nt, Human
ugaaaaacacuuuuucuuccuuc

SEQ ID NO: 83276 - RNA, 18 nt, Human
ugaaagcuccuucaccac

SEQ ID NO: 83277 - RNA, 18 nt, Human
ugaaagcuccuucaccac

SEQ ID NO: 83278 - RNA, 21 nt, Human
ugaaauacugcuacucucuac

SEQ ID NO: 83279 - RNA, 22 nt, Human
ugaaauauucaugccagagguc

SEQ ID NO: 83280 - RNA, 22 nt, Human
ugaaauauucaugccagagguc

SEQ ID NO: 83281 - RNA, 22 nt, Human
ugaaauauucaugccagagguc

SEQ ID NO: 83282 - RNA, 23 nt, Human
ugaaauauucaugccagaggucc

SEQ ID NO: 83283 - RNA, 23 nt, Human
ugaaauauucaugccagaggucc

SEQ ID NO: 83284 - RNA, 23 nt, Human
ugaacacuuaguaaaagaaccag

SEQ ID NO: 83285 - RNA, 26 nt, Human
ugaagacucccagagcaacugugcau

SEQ ID NO: 83286 - RNA, 19 nt, Human
ugaagcugucaauucuggc

SEQ ID NO: 83287 - RNA, 20 nt, Human
ugaaggcccuuucuucuggu

SEQ ID NO: 83288 - RNA, 21 nt, Human
ugaauguuuucaucacuggaa

SEQ ID NO: 83289 - RNA, 20 nt, Human
ugacuggcauuugguuguac

SEQ ID NO: 83290 - RNA, 18 nt, Human
ugagacugguuuccugca

SEQ ID NO: 83291 - RNA, 21 nt, Human
ugagaggagcucccagggccu

SEQ ID NO: 83292 - RNA, 21 nt, Human
ugagaggagcucccagggccu

SEQ ID NO: 83293 - RNA, 21 nt, Human
ugagaggagcucccagggccu

SEQ ID NO: 83294 - RNA, 21 nt, Human
ugagaggagcucccagggccu

SEQ ID NO: 83295 - RNA, 23 nt, Human
ugagcagcagcuggacucugggc

SEQ ID NO: 83296 - RNA, 20 nt, Human
ugagccuaggaggucaaggc

SEQ ID NO: 83297 - RNA, 21 nt, Human
ugaggugauaggaucgcuuga

SEQ ID NO: 83298 - RNA, 19 nt, Human
ugaguccaguuucguugcc

SEQ ID NO: 83299 - RNA, 18 nt, Human
ugagugguuaaaauguca

SEQ ID NO: 83300 - RNA, 20 nt, Human
ugagugguuaaaaugucacu

SEQ ID NO: 83301 - RNA, 25 nt, Human
ugauagacaaaaccuagagccuccu

SEQ ID NO: 83302 - RNA, 20 nt, Human
ugauccucagcgcuucccuc

SEQ ID NO: 83303 - RNA, 24 nt, Human
ugaucugcccaccuuggccuccca

SEQ ID NO: 83304 - RNA, 24 nt, Human
ugaucugcccaccuuggccuccca

SEQ ID NO: 83305 - RNA, 24 nt, Human
ugaucugcccaccuuggccuccca

SEQ ID NO: 83306 - RNA, 24 nt, Human
ugaucugcccaccuuggccuccca

SEQ ID NO: 83307 - RNA, 18 nt, Human
ugauuucaucccugguuc

SEQ ID NO: 83308 - RNA, 20 nt, Human
ugauuuggagugaacucuuu

SEQ ID NO: 83309 - RNA, 21 nt, Human
ugauuuucaauagcucuucaa

SEQ ID NO: 83310 - RNA, 21 nt, Human
ugcaaaaccccuaaucuaagc

SEQ ID NO: 83311 - RNA, 24 nt, Human
ugcaaaacccuuucuccacuuaac

SEQ ID NO: 83312 - RNA, 18 nt, Human
ugcccuugcacacugggg

SEQ ID NO: 83313 - RNA, 18 nt, Human
ugcccuugcacacugggg

SEQ ID NO: 83314 - RNA, 18 nt, Human
ugcccuugcacacugggg

SEQ ID NO: 83315 - RNA, 18 nt, Human
ugcccuugcacacugggg

SEQ ID NO: 83316 - RNA, 24 nt, Human
ugccucagccuccugaguagcugg

SEQ ID NO: 83317 - RNA, 18 nt, Human
ugccugacuggcauuugg

SEQ ID NO: 83318 - RNA, 21 nt, Human
ugccuuagccaccugaguagc

SEQ ID NO: 83319 - RNA, 21 nt, Human
ugccuuagccaccugaguagc

SEQ ID NO: 83320 - RNA, 21 nt, Human
ugccuuagccaccugaguagc

SEQ ID NO: 83321 - RNA, 21 nt, Human
ugccuuagccaccugaguagc

SEQ ID NO: 83322 - RNA, 24 nt, Human
ugccuuagccaccugaguagcugg

SEQ ID NO: 83323 - RNA, 24 nt, Human
ugccuuagccaccugaguagcugg

SEQ ID NO: 83324 - RNA, 24 nt, Human
ugccuuagccaccugaguagcugg

SEQ ID NO: 83325 - RNA, 20 nt, Human
ugcuaccaaguuuauuugca

SEQ ID NO: 83326 - RNA, 20 nt, Human
ugcuaccaaguuuauuugca

SEQ ID NO: 83327 - RNA, 20 nt, Human
ugcuaccaaguuuauuugca

SEQ ID NO: 83328 - RNA, 20 nt, Human
ugcuaccaaguuuauuugca

SEQ ID NO: 83329 - RNA, 24 nt, Human
ugcugggauuacaggcgugagcca

SEQ ID NO: 83330 - RNA, 24 nt, Human
ugcugggauuacaggcgugagcca

SEQ ID NO: 83331 - RNA, 24 nt, Human
ugcugggauuacaggcgugagcca

SEQ ID NO: 83332 - RNA, 24 nt, Human
ugcugggauuacaggcgugagcca

SEQ ID NO: 83333 - RNA, 21 nt, Human
ugcuuuguccucagaguucuc

SEQ ID NO: 83334 - RNA, 23 nt, Human
uggaaccuacuucauuaauauug

SEQ ID NO: 83335 - RNA, 23 nt, Human
uggaaccuauuucauuaauacug

SEQ ID NO: 83336 - RNA, 19 nt, Human
uggaauguucucauuuccc

SEQ ID NO: 83337 - RNA, 23 nt, Human
uggaauguucucauuucccauuu

SEQ ID NO: 83338 - RNA, 21 nt, Human
uggacacugagacugguuucc

SEQ ID NO: 83339 - RNA, 23 nt, Human
uggagcccacuucauuaguacug

SEQ ID NO: 83340 - RNA, 23 nt, Human
uggagugcaauggcgcgaucucg

SEQ ID NO: 83341 - RNA, 24 nt, Human
uggagugcaauggcgcgaucucgg

SEQ ID NO: 83342 - RNA, 24 nt, Human
uggagugccgugguaugaucuugg

SEQ ID NO: 83343 - RNA, 24 nt, Human
uggagugccgugguaugaucuugg

SEQ ID NO: 83344 - RNA, 24 nt, Human
uggagugccgugguaugaucuugg

SEQ ID NO: 83345 - RNA, 24 nt, Human
uggagugccgugguaugaucuugg

SEQ ID NO: 83346 - RNA, 18 nt, Human
uggauacuuaaagccuuc

SEQ ID NO: 83347 - RNA, 25 nt, Human
uggaugccucucagcugcacgcuuc

SEQ ID NO: 83348 - RNA, 25 nt, Human
uggaugccucucagcugcacgcuuc

SEQ ID NO: 83349 - RNA, 25 nt, Human
uggcacugguagagugcuacacugu

SEQ ID NO: 83350 - RNA, 25 nt, Human
uggcacugguagagugcuacacugu

SEQ ID NO: 83351 - RNA, 24 nt, Human
uggccaggcugguuucgaacuccu

SEQ ID NO: 83352 - RNA, 24 nt, Human
uggccaggcugguuucgaacuccu

SEQ ID NO: 83353 - RNA, 24 nt, Human
uggccaggcugguuucgaacuccu

SEQ ID NO: 83354 - RNA, 24 nt, Human
uggccaggcugguuucgaacuccu

SEQ ID NO: 83355 - RNA, 21 nt, Human
uggcccagacucuuccagcug

SEQ ID NO: 83356 - RNA, 19 nt, Human
uggccuguaccuguggcug

SEQ ID NO: 83357 - RNA, 27 nt, Human
uggcuccacaugcaaguuuggggaacc

SEQ ID NO: 83358 - RNA, 27 nt, Human
uggcuccacaugcaaguuuggggaacc

SEQ ID NO: 83359 - RNA, 20 nt, Human
uggcucuguaccuguggcug

SEQ ID NO: 83360 - RNA, 20 nt, Human
uggcucuguaccuguggcug

SEQ ID NO: 83361 - RNA, 20 nt, Human
uggcucuguaccuguggcug

SEQ ID NO: 83362 - RNA, 22 nt, Human
uggcugcagucaguaguggcug

SEQ ID NO: 83363 - RNA, 22 nt, Human
uggcugcagucaguaguggcug

SEQ ID NO: 83364 - RNA, 23 nt, Human
ugggagacugaggugauaggauc

SEQ ID NO: 83365 - RNA, 22 nt, Human
ugggaucugucauuuuauagau

SEQ ID NO: 83366 - RNA, 22 nt, Human
ugggaucugucauuuuauagau

SEQ ID NO: 83367 - RNA, 22 nt, Human
ugggaucugucauuuuauagau

SEQ ID NO: 83368 - RNA, 22 nt, Human
ugggaucugucauuuuauagau

SEQ ID NO: 83369 - RNA, 18 nt, Human
ugggauuacaggcgugag

SEQ ID NO: 83370 - RNA, 18 nt, Human
ugggauuacaggcgugag

SEQ ID NO: 83371 - RNA, 18 nt, Human
ugggauuacaggcgugag

SEQ ID NO: 83372 - RNA, 18 nt, Human
ugggauuacaggcgugag

SEQ ID NO: 83373 - RNA, 22 nt, Human
ugggauuacaggcgugagccac

SEQ ID NO: 83374 - RNA, 22 nt, Human
ugggauuacaggcgugagccac

SEQ ID NO: 83375 - RNA, 22 nt, Human
ugggauuacaggcgugagccac

SEQ ID NO: 83376 - RNA, 22 nt, Human
ugggauuacaggcgugagccac

SEQ ID NO: 83377 - RNA, 23 nt, Human
ugggauuacaggcgugagccacc

SEQ ID NO: 83378 - RNA, 23 nt, Human
ugggauuacaggcgugagccacc

SEQ ID NO: 83379 - RNA, 23 nt, Human
ugggauuacaggcgugagccacc

SEQ ID NO: 83380 - RNA, 23 nt, Human
ugggauuacaggcgugagccacc

SEQ ID NO: 83381 - RNA, 24 nt, Human
ugggauuacaggcgugagccacca

SEQ ID NO: 83382 - RNA, 24 nt, Human
ugggauuacaggcgugagccacca

SEQ ID NO: 83383 - RNA, 24 nt, Human
ugggauuacaggcgugagccacca

SEQ ID NO: 83384 - RNA, 24 nt, Human
ugggauuacaggcgugagccacca

SEQ ID NO: 83385 - RNA, 25 nt, Human
ugggauuacaggcgugagccaccau

SEQ ID NO: 83386 - RNA, 25 nt, Human
ugggauuacaggcgugagccaccau

SEQ ID NO: 83387 - RNA, 25 nt, Human
ugggauuacaggcgugagccaccau

SEQ ID NO: 83388 - RNA, 25 nt, Human
ugggauuacaggcgugagccaccau

SEQ ID NO: 83389 - RNA, 21 nt, Human
ugggauuacagguguccacca

SEQ ID NO: 83390 - RNA, 21 nt, Human
ugggauuacagguguccacca

SEQ ID NO: 83391 - RNA, 21 nt, Human
ugggauuacagguguccacca

SEQ ID NO: 83392 - RNA, 21 nt, Human
ugggauuacagguguccacca

SEQ ID NO: 83393 - RNA, 24 nt, Human
ugggauuacagguguccaccacca

SEQ ID NO: 83394 - RNA, 24 nt, Human
ugggauuacagguguccaccacca

SEQ ID NO: 83395 - RNA, 24 nt, Human
ugggauuacagguguccaccacca

SEQ ID NO: 83396 - RNA, 24 nt, Human
ugggauuacagguguccaccacca

SEQ ID NO: 83397 - RNA, 25 nt, Human
ugggauuacagguguccaccaccau

SEQ ID NO: 83398 - RNA, 25 nt, Human
ugggauuacagguguccaccaccau

SEQ ID NO: 83399 - RNA, 25 nt, Human
ugggauuacagguguccaccaccau

SEQ ID NO: 83400 - RNA, 25 nt, Human
ugggauuacagguguccaccaccau

SEQ ID NO: 83401 - RNA, 18 nt, Human
uggggaacuuucaaugca

SEQ ID NO: 83402 - RNA, 24 nt, Human
ugggguuucaccauguuggccagg

SEQ ID NO: 83403 - RNA, 24 nt, Human
ugggguuucaccauguuggccagg

SEQ ID NO: 83404 - RNA, 24 nt, Human
ugggguuucaccauguuggccagg

SEQ ID NO: 83405 - RNA, 24 nt, Human
ugggguuucaccauguuggccagg

SEQ ID NO: 83406 - RNA, 23 nt, Human
uggguggacaccugugccaaggg

SEQ ID NO: 83407 - RNA, 23 nt, Human
uggguggacaccugugccaaggg

SEQ ID NO: 83408 - RNA, 22 nt, Human
ugguagaagacuuccuccucag

SEQ ID NO: 83409 - RNA, 24 nt, Human
uggucaggcuggucuggaacuccu

SEQ ID NO: 83410 - RNA, 21 nt, Human
uggugcgggguccaggaaguc

SEQ ID NO: 83411 - RNA, 20 nt, Human
ugguguuuucuggcaaacuu

SEQ ID NO: 83412 - RNA, 20 nt, Human
ugucgcccaggcuggagugc

SEQ ID NO: 83413 - RNA, 21 nt, Human
ugugccacauggcuccacaug

SEQ ID NO: 83414 - RNA, 21 nt, Human
ugugccacauggcuccacaug

SEQ ID NO: 83415 - RNA, 23 nt, Human
ugugccacauggcuccacaugca

SEQ ID NO: 83416 - RNA, 24 nt, Human
ugugccacauggcuccacaugcag

SEQ ID NO: 83417 - RNA, 20 nt, Human
ugugccugacuggcauuugg

SEQ ID NO: 83418 - RNA, 19 nt, Human
ugugcuuuguucuggauuu

SEQ ID NO: 83419 - RNA, 20 nt, Human
uguggcuuguaccuguggcu

SEQ ID NO: 83420 - RNA, 21 nt, Human
uguuugcuuuuauuacagaau

SEQ ID NO: 83421 - RNA, 25 nt, Human
uguuuuguuuuguuuuguuuugauu

SEQ ID NO: 83422 - RNA, 25 nt, Human
uguuuuguuuuguuuuguuuugauu

SEQ ID NO: 83423 - RNA, 27 nt, Human
uuaacaaaugacuugaugggaaaaagu

SEQ ID NO: 83424 - RNA, 19 nt, Human
uuaagaaaccuuuccuagu

SEQ ID NO: 83425 - RNA, 19 nt, Human
uuaagaaaccuuuccuagu

SEQ ID NO: 83426 - RNA, 19 nt, Human
uuaagaaaccuuuccuagu

SEQ ID NO: 83427 - RNA, 19 nt, Human
uuaagaaaccuuuccuagu

SEQ ID NO: 83428 - RNA, 20 nt, Human
uuacuuuaccaaauaacaag

SEQ ID NO: 83429 - RNA, 18 nt, Human
uuaguagagacggaguuu

SEQ ID NO: 83430 - RNA, 18 nt, Human
uuaguagagaugggguuu

SEQ ID NO: 83431 - RNA, 18 nt, Human
uuaguagagaugggguuu

SEQ ID NO: 83432 - RNA, 18 nt, Human
uuaguagagaugggguuu

SEQ ID NO: 83433 - RNA, 18 nt, Human
uuaguagagaugggguuu

SEQ ID NO: 83434 - RNA, 22 nt, Human
uuaguagagaugggguuucacc

SEQ ID NO: 83435 - RNA, 22 nt, Human
uuaguagagaugggguuucacc

SEQ ID NO: 83436 - RNA, 22 nt, Human
uuaguagagaugggguuucacc

SEQ ID NO: 83437 - RNA, 22 nt, Human
uuaguagagaugggguuucacc

SEQ ID NO: 83438 - RNA, 24 nt, Human
uuaguagagaugggguuucaccau

SEQ ID NO: 83439 - RNA, 24 nt, Human
uuaguagagaugggguuucaccau

SEQ ID NO: 83440 - RNA, 24 nt, Human
uuaguagagaugggguuucaccau

SEQ ID NO: 83441 - RNA, 24 nt, Human
uuaguagagaugggguuucaccau

SEQ ID NO: 83442 - RNA, 21 nt, Human
uuaguuuuaacaaaugacuug

SEQ ID NO: 83443 - RNA, 21 nt, Human
uucaauuggggaacuuucaau

SEQ ID NO: 83444 - RNA, 22 nt, Human
uucacugcccuugcacacuggg

SEQ ID NO: 83445 - RNA, 22 nt, Human
uucacugcccuugcacacuggg

SEQ ID NO: 83446 - RNA, 22 nt, Human
uucacugcccuugcacacuggg

SEQ ID NO: 83447 - RNA, 22 nt, Human
uucacugcccuugcacacuggg

SEQ ID NO: 83448 - RNA, 19 nt, Human
uucccccacggacacucag

SEQ ID NO: 83449 - RNA, 20 nt, Human
uuccuggauuugaaaacgga

SEQ ID NO: 83450 - RNA, 18 nt, Human
uucuagcgauucuccugc

SEQ ID NO: 83451 - RNA, 20 nt, Human
uucucauucugaauagaauc

SEQ ID NO: 83452 - RNA, 20 nt, Human
uucugcuuauuccauucuuu

SEQ ID NO: 83453 - RNA, 21 nt, Human
uucuuuagaaaucuagcaaau

SEQ ID NO: 83454 - RNA, 21 nt, Human
uucuuuagaaaucuagcaaau

SEQ ID NO: 83455 - RNA, 21 nt, Human
uucuuuagaaaucuagcaaau

SEQ ID NO: 83456 - RNA, 21 nt, Human
uucuuuagaaaucuagcaaau

SEQ ID NO: 83457 - RNA, 23 nt, Human
uugagacagucucgcucugucgc

SEQ ID NO: 83458 - RNA, 20 nt, Human
uugcaugguaucccucugcc

SEQ ID NO: 83459 - RNA, 19 nt, Human
uuggaccuuggugguuucu

SEQ ID NO: 83460 - RNA, 19 nt, Human
uuggaccuuggugguuucu

SEQ ID NO: 83461 - RNA, 18 nt, Human
uuggccucccaaagugcu

SEQ ID NO: 83462 - RNA, 18 nt, Human
uuggccucccaaagugcu

SEQ ID NO: 83463 - RNA, 18 nt, Human
uuggccucccaaagugcu

SEQ ID NO: 83464 - RNA, 18 nt, Human
uuggccucccaaagugcu

SEQ ID NO: 83465 - RNA, 24 nt, Human
uugggagacugaggugauaggauc

SEQ ID NO: 83466 - RNA, 25 nt, Human
uuguaagcucauucuugggguccgu

SEQ ID NO: 83467 - RNA, 23 nt, Human
uuguauuuuuaguagagacggag

SEQ ID NO: 83468 - RNA, 21 nt, Human
uuuaucucuucacugcuagaa

SEQ ID NO: 83469 - RNA, 22 nt, Human
uuucaauuggggaacuuucaau

SEQ ID NO: 83470 - RNA, 21 nt, Human
uuucaccacguuggucaggcu

SEQ ID NO: 83471 - RNA, 24 nt, Human
uuucaccauguuggccaggcuggu

SEQ ID NO: 83472 - RNA, 24 nt, Human
uuucaccauguuggccaggcuggu

SEQ ID NO: 83473 - RNA, 24 nt, Human
uuucaccauguuggccaggcuggu

SEQ ID NO: 83474 - RNA, 24 nt, Human
uuucaccauguuggccaggcuggu

SEQ ID NO: 83475 - RNA, 24 nt, Human
uuucugcuuauuccauucuuuucu

SEQ ID NO: 83476 - RNA, 18 nt, Human
uuucuggacgcuuuugcu

SEQ ID NO: 83477 - RNA, 20 nt, Human
uuucuguauuuuuaguagag

SEQ ID NO: 83478 - RNA, 20 nt, Human
uuucuguauuuuuaguagag

SEQ ID NO: 83479 - RNA, 20 nt, Human
uuucuguauuuuuaguagag

SEQ ID NO: 83480 - RNA, 20 nt, Human
uuucuguauuuuuaguagag

SEQ ID NO: 83481 - RNA, 21 nt, Human
uuugaaacagaacuacccuga

SEQ ID NO: 83482 - RNA, 20 nt, Human
uuugcaaaacccuuucucca

SEQ ID NO: 83483 - RNA, 24 nt, Human
uuugcaauucaguacaauuaggug

SEQ ID NO: 83484 - RNA, 21 nt, Human
uuugccaauauuaccugguua

SEQ ID NO: 83485 - RNA, 22 nt, Human
uuuggggucuucagcauuauua

SEQ ID NO: 83486 - RNA, 23 nt, Human
uuuggggucuucagcauuauuag

SEQ ID NO: 83487 - RNA, 21 nt, Human
uuuguucacauucaaaaguga

SEQ ID NO: 83488 - RNA, 19 nt, Human
uuuguuuuguuuuguuuug

SEQ ID NO: 83489 - RNA, 24 nt, Human
uuuuaaaaucuucucaggugaaaa

SEQ ID NO: 83490 - RNA, 24 nt, Human
uuuuaaaaucuucucaggugaaaa

SEQ ID NO: 83491 - RNA, 24 nt, Human
uuuuaaaaucuucucaggugaaaa

SEQ ID NO: 83492 - RNA, 24 nt, Human
uuuuaaaaucuucucaggugaaaa

SEQ ID NO: 83493 - RNA, 22 nt, Human
uuuugaacugccaaaucugcuu

SEQ ID NO: 83494 - RNA, 24 nt, Human
uuuuuaguagagacggaguuucac

SEQ ID NO: 83495 - RNA, 24 nt, Human
uuuuuaguagagaugggguuucac

SEQ ID NO: 83496 - RNA, 24 nt, Human
uuuuuaguagagaugggguuucac

SEQ ID NO: 83497 - RNA, 24 nt, Human
uuuuuaguagagaugggguuucac

SEQ ID NO: 83498 - RNA, 24 nt, Human
uuuuuaguagagaugggguuucac

SEQ ID NO: 83499 - RNA, 20 nt, Human
uuuuuguauuuuuaguagag

SEQ ID NO: 83500 - RNA, 27 nt, Human
uuuuuuuuuuuuugagccacagucuca

SEQ ID NO: 83501 - RNA, 27 nt, Human
uuuuuuuuuuuuugagccacagucuca

SEQ ID NO: 83502 - RNA, 27 nt, Human
uuuuuuuuuuuuugagccacagucuca

SEQ ID NO: 83503 - RNA, 18 nt, Human
uuuuuuuuuuuuuuuuug

SEQ ID NO: 83504 - RNA, 18 nt, Human
uuuuuuuuuuuuuuuuug

SEQ ID NO: 83505 - RNA, 18 nt, Human
uuuuuuuuuuuuuuuuug

SEQ ID NO: 83506 - RNA, 22 nt, Human
aaaagacacccgaggcgcagca

SEQ ID NO: 83507 - RNA, 24 nt, Human
aaaguguugggauuacaggcauga

SEQ ID NO: 83508 - RNA, 22 nt, Human
aacugaagcaaaaguauaccaa

SEQ ID NO: 83509 - RNA, 25 nt, Human
aagcacuccucccaccucagcuucu

SEQ ID NO: 83510 - RNA, 18 nt, Human
aaguauaccaauacggaa

SEQ ID NO: 83511 - RNA, 21 nt, Human
aaguguugggauuacaggcau

SEQ ID NO: 83512 - RNA, 26 nt, Human
aaguguugggauuacaggcaugagcc

SEQ ID NO: 83513 - RNA, 25 nt, Human
aaucuguccccucacgcuucucccg

SEQ ID NO: 83514 - RNA, 23 nt, Human
accucagcuucucaaaguguugg

SEQ ID NO: 83515 - RNA, 18 nt, Human
aggcaugagccaccgagc

SEQ ID NO: 83516 - RNA, 21 nt, Human
caaaagacacccgaggcgcag

SEQ ID NO: 83517 - RNA, 23 nt, Human
caaaguguugggauuacaggcau

SEQ ID NO: 83518 - RNA, 24 nt, Human
caaaguguugggauuacaggcaug

SEQ ID NO: 83519 - RNA, 21 nt, Human
cacccgaggcgcagcagaggc

SEQ ID NO: 83520 - RNA, 24 nt, Human
caccgccgcaaaagacacccgagg

SEQ ID NO: 83521 - RNA, 24 nt, Human
cacuccucccaccucagcuucuca

SEQ ID NO: 83522 - RNA, 23 nt, Human
cagcagaggcgcagcagugccac

SEQ ID NO: 83523 - RNA, 18 nt, Human
cagcagugccacagcggc

SEQ ID NO: 83524 - RNA, 25 nt, Human
cagugccacagcggcuccgccucug

SEQ ID NO: 83525 - RNA, 20 nt, Human
cauugugcaacauaaguacu

SEQ ID NO: 83526 - RNA, 20 nt, Human
ccaccgccgcaaaagacacc

SEQ ID NO: 83527 - RNA, 24 nt, Human
cccuauguugcccaggcuggucuu

SEQ ID NO: 83528 - RNA, 22 nt, Human
ccuauguugcccaggcuggucu

SEQ ID NO: 83529 - RNA, 18 nt, Human
ccucaagcacuccucccc

SEQ ID NO: 83530 - RNA, 19 nt, Human
ccucccaccucagcuucuc

SEQ ID NO: 83531 - RNA, 19 nt, Human
cgauacacaaacgcugagg

SEQ ID NO: 83532 - RNA, 23 nt, Human
cgccggucacaaaucuguccccu

SEQ ID NO: 83533 - RNA, 19 nt, Human
cucaagcacuccucccacc

SEQ ID NO: 83534 - RNA, 24 nt, Human
cucaagcacuccucccaccucagc

SEQ ID NO: 83535 - RNA, 24 nt, Human
cuccucccaccucagcuucucaaa

SEQ ID NO: 83536 - RNA, 27 nt, Human
cuccuggccucaagcacuccucccacc

SEQ ID NO: 83537 - RNA, 20 nt, Human
cuuuuccccuuuuuuuuuuu

SEQ ID NO: 83538 - RNA, 22 nt, Human
cuuuuccccuuuuuuuuuuucu

SEQ ID NO: 83539 - RNA, 20 nt, Human
gagcucagccaaagauguuu

SEQ ID NO: 83540 - RNA, 18 nt, Human
gauuacaggcaugagcca

SEQ ID NO: 83541 - RNA, 21 nt, Human
gauuacaggcaugagccaccg

SEQ ID NO: 83542 - RNA, 24 nt, Human
gauuacaggcaugagccaccgagc

SEQ ID NO: 83543 - RNA, 24 nt, Human
gcgccggucacaaaucuguccccu

SEQ ID NO: 83544 - RNA, 23 nt, Human
gcuggucuugaacuccuggccuc

SEQ ID NO: 83545 - RNA, 22 nt, Human
ggauuacaggcaugagccaccg

SEQ ID NO: 83546 - RNA, 19 nt, Human
ggcaugagccaccgagcuc

SEQ ID NO: 83547 - RNA, 24 nt, Human
ggcuggucuugaacuccuggccuc

SEQ ID NO: 83548 - RNA, 24 nt, Human
gggggucucccuauguugcccagg

SEQ ID NO: 83549 - RNA, 23 nt, Human
uaaacuggaaagguuaagcguca

SEQ ID NO: 83550 - RNA, 23 nt, Human
uauguugcccaggcuggucuuga

SEQ ID NO: 83551 - RNA, 24 nt, Human
uauguugcccaggcuggucuugaa

SEQ ID NO: 83552 - RNA, 23 nt, Human
ucaaaguguugggauuacaggca

SEQ ID NO: 83553 - RNA, 24 nt, Human
ucaaaguguugggauuacaggcau

SEQ ID NO: 83554 - RNA, 27 nt, Human
uccccuuuuuuuuuuucuucguaaaga

SEQ ID NO: 83555 - RNA, 24 nt, Human
ucucaaaguguugggauuacaggc

SEQ ID NO: 83556 - RNA, 23 nt, Human
ucucccuauguugcccaggcugg

SEQ ID NO: 83557 - RNA, 24 nt, Human
ucucccuauguugcccaggcuggu

SEQ ID NO: 83558 - RNA, 22 nt, Human
ucuguccccucacgcuucuccc

SEQ ID NO: 83559 - RNA, 21 nt, Human
ucuugaacuccuggccucaag

SEQ ID NO: 83560 - RNA, 22 nt, Human
ugaagcaaaaguauaccaauac

SEQ ID NO: 83561 - RNA, 18 nt, Human
ugagguaaauuugaaacu

SEQ ID NO: 83562 - RNA, 24 nt, Human
ugcccaggcuggucuugaacuccu

SEQ ID NO: 83563 - RNA, 21 nt, Human
uggccucaagcacuccuccca

SEQ ID NO: 83564 - RNA, 18 nt, Human
ugggauuacaggcaugag

SEQ ID NO: 83565 - RNA, 19 nt, Human
ugggauuacaggcaugagc

SEQ ID NO: 83566 - RNA, 21 nt, Human
ugggauuacaggcaugagcca

SEQ ID NO: 83567 - RNA, 22 nt, Human
ugggauuacaggcaugagccac

SEQ ID NO: 83568 - RNA, 23 nt, Human
ugggauuacaggcaugagccacc

SEQ ID NO: 83569 - RNA, 24 nt, Human
ugggauuacaggcaugagccaccg

SEQ ID NO: 83570 - RNA, 26 nt, Human
ugggauuacaggcaugagccaccgag

SEQ ID NO: 83571 - RNA, 20 nt, Human
ugguaaauaaguccgcuccu

SEQ ID NO: 83572 - RNA, 22 nt, Human
ugugguuugaaauuauauucca

SEQ ID NO: 83573 - RNA, 21 nt, Human
uuugaaauuauauuccagucu

SEQ ID NO: 83574 - RNA, 20 nt, Human
uuuuccccuuuuuuuuuuuc

SEQ ID NO: 83575 - RNA, 23 nt, Human
aaucuaaugaauuauuuuugacu

SEQ ID NO: 83576 - RNA, 24 nt, Human
cauuuugaucuuuuaccauucauu

SEQ ID NO: 83577 - RNA, 20 nt, Human
cugaaagcaaucauuuuacc

SEQ ID NO: 83578 - RNA, 22 nt, Human
cugaaagcaaucauuuuaccau

SEQ ID NO: 83579 - RNA, 19 nt, Human
cuuaacuugaccucccagg

SEQ ID NO: 83580 - RNA, 22 nt, Human
uaacuugaccucccaggaacau

SEQ ID NO: 83581 - RNA, 20 nt, Human
uacaaguacauguccaugcu

SEQ ID NO: 83582 - RNA, 24 nt, Human
ucuacaaguacauguccaugcuaa

SEQ ID NO: 83583 - RNA, 23 nt, Human
ugacucuuaacuugaccucccag

SEQ ID NO: 83584 - RNA, 18 nt, Human
uuaaguggaugguuaauu

SEQ ID NO: 83585 - RNA, 23 nt, Human
uuuuuuuuuguaagugaaaacug

SEQ ID NO: 83586 - RNA, 21 nt, Human
aaguggcccuggagcaggggu

SEQ ID NO: 83587 - RNA, 19 nt, Human
acacacaugcagacgcuug

SEQ ID NO: 83588 - RNA, 19 nt, Human
acacccggcccacaucuga

SEQ ID NO: 83589 - RNA, 21 nt, Human
accacacugccagccuuggga

SEQ ID NO: 83590 - RNA, 19 nt, Human
acccagcccugcacacacc

SEQ ID NO: 83591 - RNA, 18 nt, Human
acugagcucugggcgggg

SEQ ID NO: 83592 - RNA, 21 nt, Human
acugcccucuggcucugucca

SEQ ID NO: 83593 - RNA, 24 nt, Human
agcaacaccacacugccagccuug

SEQ ID NO: 83594 - RNA, 20 nt, Human
agcccgcgccgcccgcccag

SEQ ID NO: 83595 - RNA, 20 nt, Human
agcggggaggggggucugga

SEQ ID NO: 83596 - RNA, 20 nt, Human
aggaggcaggggugggggug

SEQ ID NO: 83597 - RNA, 19 nt, Human
aggcagcggggaggggggu

SEQ ID NO: 83598 - RNA, 21 nt, Human
aggcagcggggaggggggucu

SEQ ID NO: 83599 - RNA, 23 nt, Human
aggcagcggggaggggggucugg

SEQ ID NO: 83600 - RNA, 23 nt, Human
aggcuggcuacugagcucugggc

SEQ ID NO: 83601 - RNA, 21 nt, Human
caagacucucaagccacccga

SEQ ID NO: 83602 - RNA, 22 nt, Human
caaggccacccccuccuaagga

SEQ ID NO: 83603 - RNA, 21 nt, Human
cacagcuggaggcagaggacc

SEQ ID NO: 83604 - RNA, 19 nt, Human
cacagggugaagcccccuc

SEQ ID NO: 83605 - RNA, 21 nt, Human
cacauccggggcagccaugcc

SEQ ID NO: 83606 - RNA, 19 nt, Human
caccacacugccagccuug

SEQ ID NO: 83607 - RNA, 26 nt, Human
caccacacugccagccuuggaggguu

SEQ ID NO: 83608 - RNA, 24 nt, Human
cacccggcccacaucugaucacac

SEQ ID NO: 83609 - RNA, 23 nt, Human
cacggcggggacgcgaggacugg

SEQ ID NO: 83610 - RNA, 24 nt, Human
cacggcucugccucaaggccaccc

SEQ ID NO: 83611 - RNA, 19 nt, Human
cagcaguggggcugcccca

SEQ ID NO: 83612 - RNA, 18 nt, Human
cagcccgcgccgcccgcc

SEQ ID NO: 83613 - RNA, 20 nt, Human
cagccgcccaggccucgccg

SEQ ID NO: 83614 - RNA, 19 nt, Human
caggacccaggcuggcuac

SEQ ID NO: 83615 - RNA, 21 nt, Human
cagggccagcacacucagccc

SEQ ID NO: 83616 - RNA, 23 nt, Human
cagggcuccugggcccacaacuc

SEQ ID NO: 83617 - RNA, 23 nt, Human
ccacccgagccuccggagcagcc

SEQ ID NO: 83618 - RNA, 19 nt, Human
ccacugcccucuggcucug

SEQ ID NO: 83619 - RNA, 19 nt, Human
ccacugcccucuggcucug

SEQ ID NO: 83620 - RNA, 21 nt, Human
ccaggcuggcuacugagcucu

SEQ ID NO: 83621 - RNA, 21 nt, Human
cccaagacucucaagccaccc

SEQ ID NO: 83622 - RNA, 23 nt, Human
cccaagacucucaagccacccuu

SEQ ID NO: 83623 - RNA, 19 nt, Human
cccagcccugcacacaccc

SEQ ID NO: 83624 - RNA, 24 nt, Human
cccagcccugcacacacccggccg

SEQ ID NO: 83625 - RNA, 21 nt, Human
ccccaagcccucgagaagccc

SEQ ID NO: 83626 - RNA, 22 nt, Human
ccccaagcccucgagaagcccu

SEQ ID NO: 83627 - RNA, 20 nt, Human
cccccaagcccucgagaagc

SEQ ID NO: 83628 - RNA, 20 nt, Human
cccccaugcugcuccaggcg

SEQ ID NO: 83629 - RNA, 18 nt, Human
cccgcgaggcccccugcc

SEQ ID NO: 83630 - RNA, 19 nt, Human
cccgcgccgcccgcccagg

SEQ ID NO: 83631 - RNA, 19 nt, Human
cccgggccgcgccgcccgc

SEQ ID NO: 83632 - RNA, 18 nt, Human
cccugcacacacccggcc

SEQ ID NO: 83633 - RNA, 19 nt, Human
ccgcccgcccaggcccagc

SEQ ID NO: 83634 - RNA, 20 nt, Human
ccgcgaggcccccugccagg

SEQ ID NO: 83635 - RNA, 22 nt, Human
ccgcgccgcccgcaacggccgc

SEQ ID NO: 83636 - RNA, 26 nt, Human
ccgcgcgcgcccgggccgcgccgccc

SEQ ID NO: 83637 - RNA, 28 nt, Human
ccggagccucccaagacucucaagccaa

SEQ ID NO: 83638 - RNA, 19 nt, Human
ccggcagccgcagggcucc

SEQ ID NO: 83639 - RNA, 18 nt, Human
ccucaaggccacccccuc

SEQ ID NO: 83640 - RNA, 19 nt, Human
ccucaaggccacccccucc

SEQ ID NO: 83641 - RNA, 24 nt, Human
ccuccggagcagcccgcgccgccc

SEQ ID NO: 83642 - RNA, 23 nt, Human
ccugccugcugcgguccuggaag

SEQ ID NO: 83643 - RNA, 18 nt, Human
cgcccaggcccagccgcc

SEQ ID NO: 83644 - RNA, 18 nt, Human
cgcccaggccucgccgcu

SEQ ID NO: 83645 - RNA, 22 nt, Human
cgcccggagccucccaagacuc

SEQ ID NO: 83646 - RNA, 18 nt, Human
cgcccgggccgcgccgcc

SEQ ID NO: 83647 - RNA, 24 nt, Human
cggaacccgagcggggccuaccgg

SEQ ID NO: 83648 - RNA, 20 nt, Human
cggaggggcgaccugcgggg

SEQ ID NO: 83649 - RNA, 19 nt, Human
cggcagccgcagggcuccu

SEQ ID NO: 83650 - RNA, 21 nt, Human
cuccacacacuuggaccagca

SEQ ID NO: 83651 - RNA, 23 nt, Human
cugcacacacccggcccacaucu

SEQ ID NO: 83652 - RNA, 23 nt, Human
cugccugcugcgguccuggaagc

SEQ ID NO: 83653 - RNA, 20 nt, Human
cugcgguccuggaagcccgu

SEQ ID NO: 83654 - RNA, 22 nt, Human
cuggaagcccgucugaugcuga

SEQ ID NO: 83655 - RNA, 23 nt, Human
cuggaggaggcaggggugggggu

SEQ ID NO: 83656 - RNA, 24 nt, Human
cuggaggaggcaggggugggggug

SEQ ID NO: 83657 - RNA, 20 nt, Human
cugggcggggguaggggggu

SEQ ID NO: 83658 - RNA, 19 nt, Human
gaagcccccucggccacau

SEQ ID NO: 83659 - RNA, 22 nt, Human
gacaggugccaccugucaccag

SEQ ID NO: 83660 - RNA, 18 nt, Human
gagaagcccuggcaggac

SEQ ID NO: 83661 - RNA, 23 nt, Human
gagaagcccuggcaggacccagg

SEQ ID NO: 83662 - RNA, 21 nt, Human
gagcucugggcggggguaggg

SEQ ID NO: 83663 - RNA, 19 nt, Human
gcagccgcagggcuccugg

SEQ ID NO: 83664 - RNA, 18 nt, Human
gccacccccuccuaagga

SEQ ID NO: 83665 - RNA, 19 nt, Human
gcccccugccaggacauca

SEQ ID NO: 83666 - RNA, 23 nt, Human
gccccgcuccagccgauucgcag

SEQ ID NO: 83667 - RNA, 20 nt, Human
gccgcccgcaacggccgcgc

SEQ ID NO: 83668 - RNA, 25 nt, Human
gcgcccggagccucccaagacucuc

SEQ ID NO: 83669 - RNA, 22 nt, Human
gcgccgcccgcccaggcccagc

SEQ ID NO: 83670 - RNA, 18 nt, Human
gcggcgcgccggcgucgg

SEQ ID NO: 83671 - RNA, 19 nt, Human
gcggggacgcgaggacugg

SEQ ID NO: 83672 - RNA, 23 nt, Human
gcucuguccacggggaacuccca

SEQ ID NO: 83673 - RNA, 19 nt, Human
ggagcagcccgcgccgccc

SEQ ID NO: 83674 - RNA, 18 nt, Human
ggcgaccgcgcgggcagc

SEQ ID NO: 83675 - RNA, 22 nt, Human
gggaggggggucuggaggaggc

SEQ ID NO: 83676 - RNA, 19 nt, Human
gggcuccugggcccacaac

SEQ ID NO: 83677 - RNA, 20 nt, Human
gggcuccugggcccacaacu

SEQ ID NO: 83678 - RNA, 18 nt, Human
gggcugccccaagccugu

SEQ ID NO: 83679 - RNA, 21 nt, Human
ggggucuggaggaggcagggg

SEQ ID NO: 83680 - RNA, 24 nt, Human
gggucuggaggaggcagggguggg

SEQ ID NO: 83681 - RNA, 23 nt, Human
ggucuggaggaggcaggggugga

SEQ ID NO: 83682 - RNA, 21 nt, Human
ggugcaggcagcggggagggg

SEQ ID NO: 83683 - RNA, 19 nt, Human
guccacggggaacucccag

SEQ ID NO: 83684 - RNA, 23 nt, Human
gucuggaggaggcaggggugggg

SEQ ID NO: 83685 - RNA, 25 nt, Human
gucuggaggaggcaggggugggggu

SEQ ID NO: 83686 - RNA, 20 nt, Human
gugcaggcagcggggagggg

SEQ ID NO: 83687 - RNA, 24 nt, Human
gugcaggcagcggggagggggguc

SEQ ID NO: 83688 - RNA, 21 nt, Human
gugguacuggggccggggucc

SEQ ID NO: 83689 - RNA, 28 nt, Human
uaauaguagcaacaccacacugccaauc

SEQ ID NO: 83690 - RNA, 24 nt, Human
uagcaacaccacacugccagccuu

SEQ ID NO: 83691 - RNA, 21 nt, Human
ucaaggccacccccuccuaag

SEQ ID NO: 83692 - RNA, 21 nt, Human
ucaaguggcccuggagcaggg

SEQ ID NO: 83693 - RNA, 24 nt, Human
ucagcucccacggcugcgccggac

SEQ ID NO: 83694 - RNA, 18 nt, Human
uccacaugggacgagggc

SEQ ID NO: 83695 - RNA, 21 nt, Human
ucccaagacucucaagccacc

SEQ ID NO: 83696 - RNA, 22 nt, Human
ucccacggcugcgccggacacc

SEQ ID NO: 83697 - RNA, 23 nt, Human
ucgagaagcccuggcaggaccca

SEQ ID NO: 83698 - RNA, 20 nt, Human
ucucaagccacccgagccuc

SEQ ID NO: 83699 - RNA, 21 nt, Human
ucuggaggaggcagggguggg

SEQ ID NO: 83700 - RNA, 24 nt, Human
ucuggaggaggcaggggugggggu

SEQ ID NO: 83701 - RNA, 20 nt, Human
ugaauagaaacacaauccca

SEQ ID NO: 83702 - RNA, 19 nt, Human
ugaggccccugggggucag

SEQ ID NO: 83703 - RNA, 21 nt, Human
ugagucgacggcaggcagcgg

SEQ ID NO: 83704 - RNA, 19 nt, Human
ugauccagcucugacaggg

SEQ ID NO: 83705 - RNA, 18 nt, Human
ugcagggcucuggcuucc

SEQ ID NO: 83706 - RNA, 22 nt, Human
ugccagagcugagaccuccuac

SEQ ID NO: 83707 - RNA, 23 nt, Human
ugccagagcugagaccuccuacg

SEQ ID NO: 83708 - RNA, 18 nt, Human
ugcgggccaaguuggggc

SEQ ID NO: 83709 - RNA, 19 nt, Human
ugcgggggcugggcuucgg

SEQ ID NO: 83710 - RNA, 19 nt, Human
uggaagcccgucugaugcu

SEQ ID NO: 83711 - RNA, 21 nt, Human
uggaggaggcagggguggggg

SEQ ID NO: 83712 - RNA, 23 nt, Human
uggaggcagaggaccuucaagga

SEQ ID NO: 83713 - RNA, 18 nt, Human
uggcagaggcugcuggcg

SEQ ID NO: 83714 - RNA, 20 nt, Human
uggcagaggcugcuggcgcc

SEQ ID NO: 83715 - RNA, 18 nt, Human
uggcaggacccaggcugg

SEQ ID NO: 83716 - RNA, 20 nt, Human
uggccugcugcgggccaagu

SEQ ID NO: 83717 - RNA, 19 nt, Human
ugggacaggugccaccugu

SEQ ID NO: 83718 - RNA, 23 nt, Human
ugggacaggugccaccugucacc

SEQ ID NO: 83719 - RNA, 20 nt, Human
ugggggucagugaggcacgg

SEQ ID NO: 83720 - RNA, 18 nt, Human
ugguacuggggccuuccc

SEQ ID NO: 83721 - RNA, 18 nt, Human
uucccuugcugaauagaa

SEQ ID NO: 83722 - RNA, 22 nt, Human
aaacaagaaaagcaauaccuac

SEQ ID NO: 83723 - RNA, 19 nt, Human
aaaccagcagcaaagagcc

SEQ ID NO: 83724 - RNA, 22 nt, Human
aaagcccuuugagcuacugccu

SEQ ID NO: 83725 - RNA, 22 nt, Human
aagaaaagcaauaccuacggac

SEQ ID NO: 83726 - RNA, 18 nt, Human
acggacugguguacacuu

SEQ ID NO: 83727 - RNA, 24 nt, Human
acuccaggacccaggguccaacua

SEQ ID NO: 83728 - RNA, 21 nt, Human
agaauuccccaguucccgcuc

SEQ ID NO: 83729 - RNA, 22 nt, Human
agggaugggaaucucuccuacc

SEQ ID NO: 83730 - RNA, 23 nt, Human
caacagcaaccgugaggcagcaa

SEQ ID NO: 83731 - RNA, 21 nt, Human
caacuugcucucccacaccaa

SEQ ID NO: 83732 - RNA, 25 nt, Human
cagaauuccccaguucccgcuccuc

SEQ ID NO: 83733 - RNA, 19 nt, Human
cagcaagaaguaggagggg

SEQ ID NO: 83734 - RNA, 20 nt, Human
cagcaagaaguaggagggga

SEQ ID NO: 83735 - RNA, 20 nt, Human
caggaggagccgcagcagug

SEQ ID NO: 83736 - RNA, 24 nt, Human
ccaacuaauggcagagccccucuu

SEQ ID NO: 83737 - RNA, 21 nt, Human
ccacaccaagggaugggaauc

SEQ ID NO: 83738 - RNA, 20 nt, Human
ccuauagucaucccugcacu

SEQ ID NO: 83739 - RNA, 23 nt, Human
cgugaggcagcaagaaguaggag

SEQ ID NO: 83740 - RNA, 21 nt, Human
cuauagucaucccugcacucc

SEQ ID NO: 83741 - RNA, 21 nt, Human
cucacaaccggccccaaagcc

SEQ ID NO: 83742 - RNA, 19 nt, Human
cucucccacaccaagggau

SEQ ID NO: 83743 - RNA, 24 nt, Human
cucuugguuccuucaaacaagaaa

SEQ ID NO: 83744 - RNA, 23 nt, Human
cugcaacagcaaccgugaggcag

SEQ ID NO: 83745 - RNA, 18 nt, Human
cuugcucucccacaccaa

SEQ ID NO: 83746 - RNA, 23 nt, Human
gaaugcacguagggccagaauuc

SEQ ID NO: 83747 - RNA, 22 nt, Human
gaggcagcaagaaguaggaggg

SEQ ID NO: 83748 - RNA, 19 nt, Human
gcagcaagaaguaggaggg

SEQ ID NO: 83749 - RNA, 22 nt, Human
gccccaaagccgcggaagccuu

SEQ ID NO: 83750 - RNA, 24 nt, Human
gccgcggaagccuucagagacucc

SEQ ID NO: 83751 - RNA, 24 nt, Human
ggacugguguacacuuccauccuu

SEQ ID NO: 83752 - RNA, 19 nt, Human
ggccccaaagccgcggaag

SEQ ID NO: 83753 - RNA, 18 nt, Human
uccugggucugcaacagc

SEQ ID NO: 83754 - RNA, 24 nt, Human
ucucccacaccaagggaugggaau

SEQ ID NO: 83755 - RNA, 22 nt, Human
ugacaccauacacacaaaccca

SEQ ID NO: 83756 - RNA, 19 nt, Human
ugaggaaagccaucucaca

SEQ ID NO: 83757 - RNA, 19 nt, Human
ugaggcagcaagaaguagg

SEQ ID NO: 83758 - RNA, 23 nt, Human
ugaggguugauacugcugggaau

SEQ ID NO: 83759 - RNA, 22 nt, Human
ugcaacagcaaccgugaggcag

SEQ ID NO: 83760 - RNA, 22 nt, Human
ugccaaccacuccacaagcaga

SEQ ID NO: 83761 - RNA, 18 nt, Human
ugccuuagucuacccacu

SEQ ID NO: 83762 - RNA, 19 nt, Human
ugcugggaaugccaaccac

SEQ ID NO: 83763 - RNA, 22 nt, Human
uucaaacaagaaaagcaauacc

SEQ ID NO: 83764 - RNA, 19 nt, Human
uucccgcuccucugagggu

SEQ ID NO: 83765 - RNA, 22 nt, Human
uuugcaaagcccuuugagcuac

SEQ ID NO: 83766 - RNA, 20 nt, Human
aaaaaagaaacccaaaaacu

SEQ ID NO: 83767 - RNA, 25 nt, Human
aaaaaagaaacccaaaaacucaaga

SEQ ID NO: 83768 - RNA, 23 nt, Human
aaaaagaaacccaaaaacucaag

SEQ ID NO: 83769 - RNA, 21 nt, Human
aaaacaaauggaugaagagaa

SEQ ID NO: 83770 - RNA, 22 nt, Human
aaaagaaacccaaaaacucaag

SEQ ID NO: 83771 - RNA, 19 nt, Human
aaacaaauggaugaagaga

SEQ ID NO: 83772 - RNA, 19 nt, Human
aaacccaaaaacucaagaa

SEQ ID NO: 83773 - RNA, 24 nt, Human
aacagaccaagacucugucucaaa

SEQ ID NO: 83774 - RNA, 19 nt, Human
aacauggugaaaccccauc

SEQ ID NO: 83775 - RNA, 20 nt, Human
aacauggugaaaccccaucu

SEQ ID NO: 83776 - RNA, 21 nt, Human
aacauggugaaaccccaucuc

SEQ ID NO: 83777 - RNA, 21 nt, Human
aacauggugaaaccccaucuc

SEQ ID NO: 83778 - RNA, 20 nt, Human
aacgcucugagcuccgauuc

SEQ ID NO: 83779 - RNA, 19 nt, Human
aagguugcagugagcccag

SEQ ID NO: 83780 - RNA, 20 nt, Human
acaccacugcauuccagccu

SEQ ID NO: 83781 - RNA, 24 nt, Human
acaccacugcauuccagccugggc

SEQ ID NO: 83782 - RNA, 24 nt, Human
acaccacugcauuccagccugggc

SEQ ID NO: 83783 - RNA, 24 nt, Human
acagaccaagacucugucucaaaa

SEQ ID NO: 83784 - RNA, 22 nt, Human
accacugcauuccagccugggc

SEQ ID NO: 83785 - RNA, 24 nt, Human
accccaucucuacuaaaaauacaa

SEQ ID NO: 83786 - RNA, 19 nt, Human
accgacuucugagagcaaa

SEQ ID NO: 83787 - RNA, 24 nt, Human
acugcauuccagccugggcaacag

SEQ ID NO: 83788 - RNA, 24 nt, Human
agaagggcagaucacgaggccagg

SEQ ID NO: 83789 - RNA, 26 nt, Human
agagcaaauaaagcggagcccuggaa

SEQ ID NO: 83790 - RNA, 22 nt, Human
agagcacaccacugcauuccag

SEQ ID NO: 83791 - RNA, 19 nt, Human
agcaaauaaagcggagccc

SEQ ID NO: 83792 - RNA, 24 nt, Human
agcacaccacugcauuccagccug

SEQ ID NO: 83793 - RNA, 22 nt, Human
agccuggccaacauggugaaac

SEQ ID NO: 83794 - RNA, 24 nt, Human
agccuggccaacauggugaaaccc

SEQ ID NO: 83795 - RNA, 24 nt, Human
agccugggcaacagaccaagacuc

SEQ ID NO: 83796 - RNA, 24 nt, Human
aggcacuguggcucacaccuguaa

SEQ ID NO: 83797 - RNA, 22 nt, Human
aggcaggagaaucacuugaacc

SEQ ID NO: 83798 - RNA, 24 nt, Human
aggcaggagaaucacuugaaccug

SEQ ID NO: 83799 - RNA, 24 nt, Human
aggcugaggcaggagaaucacuug

SEQ ID NO: 83800 - RNA, 19 nt, Human
aggugaagguugcagugag

SEQ ID NO: 83801 - RNA, 24 nt, Human
aggugaagguugcagugagcccag

SEQ ID NO: 83802 - RNA, 21 nt, Human
agguugcagugagcccagagc

SEQ ID NO: 83803 - RNA, 22 nt, Human
agugugaaaacaaauggaugaa

SEQ ID NO: 83804 - RNA, 26 nt, Human
agugugaaaacaaauggaugaagaga

SEQ ID NO: 83805 - RNA, 19 nt, Human
augggccaggcacuguggc

SEQ ID NO: 83806 - RNA, 24 nt, Human
caaaaaaagaaacccaaaaacuca

SEQ ID NO: 83807 - RNA, 21 nt, Human
caacagaccaagacucugucu

SEQ ID NO: 83808 - RNA, 24 nt, Human
caacauggugaaaccccaucucua

SEQ ID NO: 83809 - RNA, 18 nt, Human
caacuuagggaggcagag

SEQ ID NO: 83810 - RNA, 23 nt, Human
caagacucugucucaaaaaaaga

SEQ ID NO: 83811 - RNA, 21 nt, Human
cacaccacugcauuccagccu

SEQ ID NO: 83812 - RNA, 19 nt, Human
cacaccuguaaucccagca

SEQ ID NO: 83813 - RNA, 24 nt, Human
cacaccuguaaucccagcaacuua

SEQ ID NO: 83814 - RNA, 19 nt, Human
cacaccuguagucccagcu

SEQ ID NO: 83815 - RNA, 24 nt, Human
caccacugcauuccagccugggca

SEQ ID NO: 83816 - RNA, 20 nt, Human
caccuguaaucccagcaacu

SEQ ID NO: 83817 - RNA, 25 nt, Human
caccuguaaucccagcaacuuaggg

SEQ ID NO: 83818 - RNA, 19 nt, Human
caccuguagucccagcuac

SEQ ID NO: 83819 - RNA, 24 nt, Human
caccuguagucccagcuacucaga

SEQ ID NO: 83820 - RNA, 18 nt, Human
cacugcauuccagccugg

SEQ ID NO: 83821 - RNA, 19 nt, Human
cacugcauuccagccuggg

SEQ ID NO: 83822 - RNA, 23 nt, Human
cacugcauuccagccugggcaac

SEQ ID NO: 83823 - RNA, 24 nt, Human
cacugcauuccagccugggcaaca

SEQ ID NO: 83824 - RNA, 24 nt, Human
cagaaggcugaggcaggagaauca

SEQ ID NO: 83825 - RNA, 24 nt, Human
cagaccaagacucugucucaaaag

SEQ ID NO: 83826 - RNA, 19 nt, Human
cagagcacaccacugcauu

SEQ ID NO: 83827 - RNA, 24 nt, Human
cagcuacucagaaggcugaggcag

SEQ ID NO: 83828 - RNA, 20 nt, Human
ccacugcauuccagccuggg

SEQ ID NO: 83829 - RNA, 21 nt, Human
ccacugcauuccagccugggc

SEQ ID NO: 83830 - RNA, 23 nt, Human
ccacugcauuccagccugggcaa

SEQ ID NO: 83831 - RNA, 24 nt, Human
ccacugcauuccagccugggcaac

SEQ ID NO: 83832 - RNA, 20 nt, Human
ccaggaguucgagaccagcc

SEQ ID NO: 83833 - RNA, 18 nt, Human
ccaggcacuguggcucac

SEQ ID NO: 83834 - RNA, 23 nt, Human
ccuggccaacauggugaaacccc

SEQ ID NO: 83835 - RNA, 24 nt, Human
ccuggccaacauggugaaacccca

SEQ ID NO: 83836 - RNA, 21 nt, Human
ccuguagucccagcuacucag

SEQ ID NO: 83837 - RNA, 24 nt, Human
cgagaccagccuggccaacauggu

SEQ ID NO: 83838 - RNA, 20 nt, Human
cuagcugggcaugguggugc

SEQ ID NO: 83839 - RNA, 23 nt, Human
cucacaccuguaaucccagcaac

SEQ ID NO: 83840 - RNA, 25 nt, Human
cucacaccuguaaucccagcaacuu

SEQ ID NO: 83841 - RNA, 21 nt, Human
cuccgauucacugaagaaaag

SEQ ID NO: 83842 - RNA, 23 nt, Human
cuggccaacauggugaaacccca

SEQ ID NO: 83843 - RNA, 19 nt, Human
gaagguugcagugagccca

SEQ ID NO: 83844 - RNA, 20 nt, Human
gaagguugcagugagcccag

SEQ ID NO: 83845 - RNA, 27 nt, Human
gaauaauuuuaaauugcauuuagcuaa

SEQ ID NO: 83846 - RNA, 21 nt, Human
gaucacgaggccaggaguucg

SEQ ID NO: 83847 - RNA, 24 nt, Human
gaucacgaggccaggaguucgaga

SEQ ID NO: 83848 - RNA, 20 nt, Human
gcagagaagggcagaucacg

SEQ ID NO: 83849 - RNA, 22 nt, Human
gcaggagaaucacuugaaccug

SEQ ID NO: 83850 - RNA, 24 nt, Human
gccaacauggugaaaccccaucuc

SEQ ID NO: 83851 - RNA, 22 nt, Human
ggcaugguggugcacaccugua

SEQ ID NO: 83852 - RNA, 22 nt, Human
gggcagaucacgaggccaggag

SEQ ID NO: 83853 - RNA, 24 nt, Human
gggcagaucacgaggccaggaguu

SEQ ID NO: 83854 - RNA, 24 nt, Human
gguggugcacaccuguagucccag

SEQ ID NO: 83855 - RNA, 18 nt, Human
gugaaaacaaauggauga

SEQ ID NO: 83856 - RNA, 22 nt, Human
guggcucacaccuguaauccca

SEQ ID NO: 83857 - RNA, 21 nt, Human
uaaaaauacaaaaacuagcug

SEQ ID NO: 83858 - RNA, 19 nt, Human
uaaagcggagcccuggaag

SEQ ID NO: 83859 - RNA, 19 nt, Human
uauuucagauuccuaacug

SEQ ID NO: 83860 - RNA, 24 nt, Human
ucaaaaaaagaaacccaaaaacuc

SEQ ID NO: 83861 - RNA, 24 nt, Human
ucacgaggccaggaguucgagacc

SEQ ID NO: 83862 - RNA, 20 nt, Human
ucucaaaaaaagaaacccaa

SEQ ID NO: 83863 - RNA, 21 nt, Human
ucucuacuaaaaauacaaaaa

SEQ ID NO: 83864 - RNA, 21 nt, Human
ucugagagcaaauaaagcgga

SEQ ID NO: 83865 - RNA, 19 nt, Human
ugaaaccccaucucuacua

SEQ ID NO: 83866 - RNA, 18 nt, Human
ugaaccuggaggugaagg

SEQ ID NO: 83867 - RNA, 20 nt, Human
ugaggcaggagaaucacuug

SEQ ID NO: 83868 - RNA, 24 nt, Human
ugaggcaggagaaucacuugaacc

SEQ ID NO: 83869 - RNA, 24 nt, Human
ugaggcaggagaaucacuugaacc

SEQ ID NO: 83870 - RNA, 20 nt, Human
ugaggugucacuagauuaga

SEQ ID NO: 83871 - RNA, 23 nt, Human
uggaggugaagguugcagugagc

SEQ ID NO: 83872 - RNA, 24 nt, Human
uggccaacauggugaaaccccauc

SEQ ID NO: 83873 - RNA, 21 nt, Human
uggcucacaccuguaauccca

SEQ ID NO: 83874 - RNA, 24 nt, Human
uggcucacaccuguaaucccagca

SEQ ID NO: 83875 - RNA, 18 nt, Human
uggugcacaccuguaguc

SEQ ID NO: 83876 - RNA, 22 nt, Human
uggugcacaccuguagucccag

SEQ ID NO: 83877 - RNA, 24 nt, Human
ugguggugcacaccuguaguccca

SEQ ID NO: 83878 - RNA, 20 nt, Human
ugucuggagggaaaccgaag

SEQ ID NO: 83879 - RNA, 24 nt, Human
uguggcucacaccuguaaucccag

SEQ ID NO: 83880 - RNA, 19 nt, Human
uugcagugagcccagagca

SEQ ID NO: 83881 - RNA, 19 nt, Human
agacuggccccaagaccag

SEQ ID NO: 83882 - RNA, 22 nt, Human
augggaaagagaagggaaaugg

SEQ ID NO: 83883 - RNA, 23 nt, Human
cacccagcuuccccugagacugg

SEQ ID NO: 83884 - RNA, 21 nt, Human
caccucacgaccgguaggggc

SEQ ID NO: 83885 - RNA, 28 nt, Human
cagcccccagucuuuuuuuuuuuuuuuu

SEQ ID NO: 83886 - RNA, 21 nt, Human
caggacagugagcaaagggga

SEQ ID NO: 83887 - RNA, 21 nt, Human
cagucuuuuuuuuuuuuuuuu

SEQ ID NO: 83888 - RNA, 18 nt, Human
ccaccccgcccuacaaug

SEQ ID NO: 83889 - RNA, 22 nt, Human
ccaggacagugagcaaagggga

SEQ ID NO: 83890 - RNA, 19 nt, Human
cccacucaccucacgaccg

SEQ ID NO: 83891 - RNA, 22 nt, Human
cccgcccuacaaugcugugagg

SEQ ID NO: 83892 - RNA, 20 nt, Human
ccuaacuuuggcccaccacc

SEQ ID NO: 83893 - RNA, 23 nt, Human
ccuugcgcugaacugccauuggc

SEQ ID NO: 83894 - RNA, 21 nt, Human
cgcugaacugccauuggcccu

SEQ ID NO: 83895 - RNA, 18 nt, Human
cugaccugugggcccucc

SEQ ID NO: 83896 - RNA, 20 nt, Human
cugugggcccucccucuccu

SEQ ID NO: 83897 - RNA, 20 nt, Human
gacagaugcccacucaccuc

SEQ ID NO: 83898 - RNA, 20 nt, Human
gagguggugggauggccugu

SEQ ID NO: 83899 - RNA, 20 nt, Human
gagucagugcagaggccggu

SEQ ID NO: 83900 - RNA, 18 nt, Human
gccggugccacuccagga

SEQ ID NO: 83901 - RNA, 23 nt, Human
uacaaaccaguuugaaagguggg

SEQ ID NO: 83902 - RNA, 23 nt, Human
uacaacagcaggggagggaguca

SEQ ID NO: 83903 - RNA, 21 nt, Human
uacaguauuuacaacagcagg

SEQ ID NO: 83904 - RNA, 21 nt, Human
uaugggaaagagaagggaaau

SEQ ID NO: 83905 - RNA, 20 nt, Human
uauuuucuuccuuugaaaua

SEQ ID NO: 83906 - RNA, 21 nt, Human
ucuaugggaaagagaagggaa

SEQ ID NO: 83907 - RNA, 24 nt, Human
ucuggagcuuuuucugaccugugg

SEQ ID NO: 83908 - RNA, 18 nt, Human
ugaaaggugggggaaucu

SEQ ID NO: 83909 - RNA, 19 nt, Human
ugaaaggugggggaaucua

SEQ ID NO: 83910 - RNA, 22 nt, Human
ugaacugccauuggcccuugga

SEQ ID NO: 83911 - RNA, 19 nt, Human
ugagacuggccccaagacc

SEQ ID NO: 83912 - RNA, 19 nt, Human
ugagacuggccccaagacc

SEQ ID NO: 83913 - RNA, 22 nt, Human
ugagacuggccccaagaccaga

SEQ ID NO: 83914 - RNA, 18 nt, Human
ugagcaaaggggaggaga

SEQ ID NO: 83915 - RNA, 22 nt, Human
ugagcaaaggggaggagagaag

SEQ ID NO: 83916 - RNA, 21 nt, Human
uggagcuuuuucugaccugug

SEQ ID NO: 83917 - RNA, 19 nt, Human
uuccccugagacuggcccc

SEQ ID NO: 83918 - RNA, 24 nt, Human
gaacagaacagaaugggaagaaaa

SEQ ID NO: 83919 - RNA, 19 nt, Human
guauuaggagaacagaaca

SEQ ID NO: 83920 - RNA, 22 nt, Human
ucuuuaauauuucuucuucuca

SEQ ID NO: 83921 - RNA, 26 nt, Human
ugggaagaaaauccaagacauccaga

SEQ ID NO: 83922 - RNA, 18 nt, Human
ugggaggagaagcagcau

SEQ ID NO: 83923 - RNA, 18 nt, Human
aaacacacacacacaaac

SEQ ID NO: 83924 - RNA, 21 nt, Human
aaacacacacacacaaacgug

SEQ ID NO: 83925 - RNA, 19 nt, Human
aacaggccgaagagggggg

SEQ ID NO: 83926 - RNA, 22 nt, Human
acaaacgugcaacgaagccaag

SEQ ID NO: 83927 - RNA, 23 nt, Human
acacacacacacaaacgugcaac

SEQ ID NO: 83928 - RNA, 22 nt, Human
acgcucaagaggcugcgaagag

SEQ ID NO: 83929 - RNA, 21 nt, Human
acgugaaguggcgauccagac

SEQ ID NO: 83930 - RNA, 22 nt, Human
agaggggggauuuaggggaggg

SEQ ID NO: 83931 - RNA, 29 nt, Human
agcuacugggaggguaaagccccaucagg

SEQ ID NO: 83932 - RNA, 23 nt, Human
aguuuauugaaggaaaaacgagg

SEQ ID NO: 83933 - RNA, 20 nt, Human
auccagagccucaggacagc

SEQ ID NO: 83934 - RNA, 18 nt, Human
auugaaggaaaaacgagg

SEQ ID NO: 83935 - RNA, 27 nt, Human
auugaaggaaaaacgaggggagaggag

SEQ ID NO: 83936 - RNA, 24 nt, Human
caaacacacacacacaaacgugca

SEQ ID NO: 83937 - RNA, 24 nt, Human
caagaggcugcgaagagcaaacac

SEQ ID NO: 83938 - RNA, 23 nt, Human
cacacacacacaaacgugcaacg

SEQ ID NO: 83939 - RNA, 23 nt, Human
cagcagaggaacucuuaggccuc

SEQ ID NO: 83940 - RNA, 23 nt, Human
caucaagcaauagaucugccaua

SEQ ID NO: 83941 - RNA, 23 nt, Human
cauccagagccucaggacagcuc

SEQ ID NO: 83942 - RNA, 23 nt, Human
ccacugagucacuuguggcuaaa

SEQ ID NO: 83943 - RNA, 23 nt, Human
ccuguguuagaauucuugggggg

SEQ ID NO: 83944 - RNA, 25 nt, Human
cgaagagcaaacacacacacacaaa

SEQ ID NO: 83945 - RNA, 18 nt, Human
gaagagcaaacacacaca

SEQ ID NO: 83946 - RNA, 22 nt, Human
gaggggucgggggauggcgggc

SEQ ID NO: 83947 - RNA, 26 nt, Human
gcgaagagcaaacacacacacacaaa

SEQ ID NO: 83948 - RNA, 21 nt, Human
gggaaaagggccaaucaaugc

SEQ ID NO: 83949 - RNA, 19 nt, Human
gggagaggagucagguggg

SEQ ID NO: 83950 - RNA, 20 nt, Human
gugcgggagugcagucguac

SEQ ID NO: 83951 - RNA, 19 nt, Human
ucuuggggggagaggauca

SEQ ID NO: 83952 - RNA, 23 nt, Human
ugaaggaaaaacgaggggagagg

SEQ ID NO: 83953 - RNA, 21 nt, Human
ugaaguggcgauccagacgcu

SEQ ID NO: 83954 - RNA, 22 nt, Human
ugacgagccucuguugacucug

SEQ ID NO: 83955 - RNA, 21 nt, Human
ugccauacccagggaaaaggg

SEQ ID NO: 83956 - RNA, 19 nt, Human
ugggaaagugcuggaaugg

SEQ ID NO: 83957 - RNA, 22 nt, Human
uguguuagaauucuugggggga

SEQ ID NO: 83958 - RNA, 26 nt, Human
uugaaggaaaaacgaggggagaggag

SEQ ID NO: 83959 - RNA, 18 nt, Human
uuuuuuuuuuuuuuuuug

SEQ ID NO: 83960 - RNA, 20 nt, Human
aaagaaggaaguguaugaug

SEQ ID NO: 83961 - RNA, 22 nt, Human
aaccagacagcauuggcuucag

SEQ ID NO: 83962 - RNA, 20 nt, Human
aaucuacgggguggguuuuc

SEQ ID NO: 83963 - RNA, 19 nt, Human
acccagaggcugaaagccu

SEQ ID NO: 83964 - RNA, 18 nt, Human
accgcugccgccgccgcc

SEQ ID NO: 83965 - RNA, 27 nt, Human
agaaggaaaaaaaccuaaggaacagaa

SEQ ID NO: 83966 - RNA, 27 nt, Human
agaaggaaaaaauccuaaggaacagaa

SEQ ID NO: 83967 - RNA, 24 nt, Human
agacaaggagggggcuugggagug

SEQ ID NO: 83968 - RNA, 26 nt, Human
agaggcugaaagccacagacggggcc

SEQ ID NO: 83969 - RNA, 24 nt, Human
agcaaacccccuccagagcugccc

SEQ ID NO: 83970 - RNA, 23 nt, Human
agcacaaaaauggcgcaaccaga

SEQ ID NO: 83971 - RNA, 18 nt, Human
aggguggaggugggggcg

SEQ ID NO: 83972 - RNA, 20 nt, Human
auccugaauggagaaaaccc

SEQ ID NO: 83973 - RNA, 24 nt, Human
auggcgccaguuccccagcaaacc

SEQ ID NO: 83974 - RNA, 23 nt, Human
caaccagacagcauuggcuucag

SEQ ID NO: 83975 - RNA, 23 nt, Human
caacuuuuuuaaaaaagaaggaa

SEQ ID NO: 83976 - RNA, 24 nt, Human
caacuuuuuuaaaaaagaaggaag

SEQ ID NO: 83977 - RNA, 22 nt, Human
cacagacggggccgcagggcag

SEQ ID NO: 83978 - RNA, 19 nt, Human
cacuucagaaggaaaaaaa

SEQ ID NO: 83979 - RNA, 25 nt, Human
cacuucagaaggaaaaaaaccuaag

SEQ ID NO: 83980 - RNA, 21 nt, Human
cagacccguggcccucauaaa

SEQ ID NO: 83981 - RNA, 22 nt, Human
caggcaggacacggggccccuc

SEQ ID NO: 83982 - RNA, 24 nt, Human
cauaaaauuaaacauaaaagcaca

SEQ ID NO: 83983 - RNA, 19 nt, Human
ccaaccgcugccgccgccg

SEQ ID NO: 83984 - RNA, 24 nt, Human
ccacaaagggcaaggaccuggcac

SEQ ID NO: 83985 - RNA, 21 nt, Human
ccagacagcauuggcuucaga

SEQ ID NO: 83986 - RNA, 27 nt, Human
cccacgugagcccuggugcuauagaga

SEQ ID NO: 83987 - RNA, 22 nt, Human
cccagaggcugaaagccacaga

SEQ ID NO: 83988 - RNA, 18 nt, Human
ccccagcaaacccccucc

SEQ ID NO: 83989 - RNA, 20 nt, Human
ccgggcucucgugaaacacu

SEQ ID NO: 83990 - RNA, 23 nt, Human
ccugaauggagaaaacccaacuu

SEQ ID NO: 83991 - RNA, 30 nt, Human
cucgugaaacacuucagaaggaaaaaaacc

SEQ ID NO: 83992 - RNA, 21 nt, Human
gaacacagacccguggcccuc

SEQ ID NO: 83993 - RNA, 22 nt, Human
gaccuggcacugacuccggcca

SEQ ID NO: 83994 - RNA, 20 nt, Human
gagccggccguccuccaggg

SEQ ID NO: 83995 - RNA, 23 nt, Human
gcaaacccccuccagagcugccc

SEQ ID NO: 83996 - RNA, 21 nt, Human
gcagggcagcagcucccgggc

SEQ ID NO: 83997 - RNA, 20 nt, Human
gcgauggcgccaguucccca

SEQ ID NO: 83998 - RNA, 20 nt, Human
gcggcggcgcagacgcggag

SEQ ID NO: 83999 - RNA, 20 nt, Human
gcggcggcgcagacguggag

SEQ ID NO: 84000 - RNA, 22 nt, Human
gcuucugcgguucuggaguccc

SEQ ID NO: 84001 - RNA, 19 nt, Human
ggaaaaaauccuaaggaac

SEQ ID NO: 84002 - RNA, 22 nt, Human
ggaaaaaauccuaaggaacaga

SEQ ID NO: 84003 - RNA, 18 nt, Human
ggagaaaacccaacuuuu

SEQ ID NO: 84004 - RNA, 20 nt, Human
ggcgcagacguggagcaggg

SEQ ID NO: 84005 - RNA, 26 nt, Human
gugaaacacuucagaaggaaaaaaac

SEQ ID NO: 84006 - RNA, 24 nt, Human
uaaaagcacaaaaauggcgcaacc

SEQ ID NO: 84007 - RNA, 25 nt, Human
uaaaagcacaaaaauggcgcaacca

SEQ ID NO: 84008 - RNA, 18 nt, Human
ucagaaggaaaaaauccu

SEQ ID NO: 84009 - RNA, 21 nt, Human
uccaggggugagcuggggagg

SEQ ID NO: 84010 - RNA, 25 nt, Human
uccaggggugagcuggggagggaag

SEQ ID NO: 84011 - RNA, 20 nt, Human
ucccacgugagcccuggugc

SEQ ID NO: 84012 - RNA, 24 nt, Human
ugaaagccacagacggggccgcag

SEQ ID NO: 84013 - RNA, 19 nt, Human
ugagaacuuggaaucuugc

SEQ ID NO: 84014 - RNA, 19 nt, Human
ugaggguggaggugggggc

SEQ ID NO: 84015 - RNA, 19 nt, Human
uggagcagggagcguccuc

SEQ ID NO: 84016 - RNA, 19 nt, Human
uggcggugggugggagggg

SEQ ID NO: 84017 - RNA, 24 nt, Human
ugggagugacuugaggcugugacg

SEQ ID NO: 84018 - RNA, 21 nt, Human
uguaugaugggaaucuacggg

SEQ ID NO: 84019 - RNA, 24 nt, Human
uucagaaggaaaaaaaccuaagga

SEQ ID NO: 84020 - RNA, 24 nt, Human
uucagaaggaaaaaauccuaagga

SEQ ID NO: 84021 - RNA, 21 nt, Human
uugaggcugugacggggucgc

SEQ ID NO: 84022 - RNA, 18 nt, Human
uugaggguggaggugggg

SEQ ID NO: 84023 - RNA, 20 nt, Human
uugaggguggaggugggggc

SEQ ID NO: 84024 - RNA, 22 nt, Human
uuggaaucuugcaagcacuggg

SEQ ID NO: 84025 - RNA, 18 nt, Human
uuuuuuuuuuugagggug

SEQ ID NO: 84026 - RNA, 18 nt, Human
uuuuuuuuuuuuugaggg

SEQ ID NO: 84027 - RNA, 22 nt, Human
uuuuuuuuuuuuuuuuugaggg

SEQ ID NO: 84028 - RNA, 24 nt, Human
aaaagcaugagaaaugcggacccc

SEQ ID NO: 84029 - RNA, 19 nt, Human
aaacugaaugaggcagaaa

SEQ ID NO: 84030 - RNA, 20 nt, Human
aaacugaaugaggcagaaac

SEQ ID NO: 84031 - RNA, 26 nt, Human
aaaguucucccaaccccuggccacau

SEQ ID NO: 84032 - RNA, 20 nt, Human
aacaugccacagacugagaa

SEQ ID NO: 84033 - RNA, 22 nt, Human
aagaaacuuagcuugaagccac

SEQ ID NO: 84034 - RNA, 20 nt, Human
aagaacuccaagcaagaggg

SEQ ID NO: 84035 - RNA, 19 nt, Human
aagcaaaaacaagacauga

SEQ ID NO: 84036 - RNA, 23 nt, Human
aagcaagagggucaagcauuuaa

SEQ ID NO: 84037 - RNA, 19 nt, Human
aagugagcagagagaggag

SEQ ID NO: 84038 - RNA, 20 nt, Human
aauuucaaacucagagggcu

SEQ ID NO: 84039 - RNA, 24 nt, Human
acaauaucucacgacugccauggc

SEQ ID NO: 84040 - RNA, 25 nt, Human
acacacacgcacgcacgcacauaca

SEQ ID NO: 84041 - RNA, 22 nt, Human
acaguccauggaccagaggccu

SEQ ID NO: 84042 - RNA, 23 nt, Human
acaguuccagaugaccacuguca

SEQ ID NO: 84043 - RNA, 20 nt, Human
acugccugccgcacuccugg

SEQ ID NO: 84044 - RNA, 19 nt, Human
acuuuguacagcacucuuc

SEQ ID NO: 84045 - RNA, 29 nt, Human
agaaagggagagagggaggaggaagggga

SEQ ID NO: 84046 - RNA, 24 nt, Human
agaaggacagcacacaaucacaag

SEQ ID NO: 84047 - RNA, 23 nt, Human
agacagauauccuacagcaaacc

SEQ ID NO: 84048 - RNA, 19 nt, Human
agagagaaacaaaagaaaa

SEQ ID NO: 84049 - RNA, 22 nt, Human
agagagggaggaggaaggggaa

SEQ ID NO: 84050 - RNA, 19 nt, Human
agagcuggggucccucggg

SEQ ID NO: 84051 - RNA, 18 nt, Human
agaggaaaccaaaccauc

SEQ ID NO: 84052 - RNA, 21 nt, Human
agagggcaugugacgggcagg

SEQ ID NO: 84053 - RNA, 21 nt, Human
agauuugcuauugagaaacuu

SEQ ID NO: 84054 - RNA, 19 nt, Human
agcaaaaacaagacaugaa

SEQ ID NO: 84055 - RNA, 21 nt, Human
agcauccauugacccccuagc

SEQ ID NO: 84056 - RNA, 22 nt, Human
aggaaagaaagggagagaggga

SEQ ID NO: 84057 - RNA, 19 nt, Human
aggcaagggagugagccaa

SEQ ID NO: 84058 - RNA, 24 nt, Human
aggcauaguugccaccacugcugu

SEQ ID NO: 84059 - RNA, 21 nt, Human
agggaagagcccuggggagga

SEQ ID NO: 84060 - RNA, 18 nt, Human
agggagagagggaggagg

SEQ ID NO: 84061 - RNA, 19 nt, Human
agggagagagggaggagga

SEQ ID NO: 84062 - RNA, 20 nt, Human
agggagugagccaagagaag

SEQ ID NO: 84063 - RNA, 20 nt, Human
aggggugggguggggagggg

SEQ ID NO: 84064 - RNA, 26 nt, Human
aggggugggguggggagggguggggg

SEQ ID NO: 84065 - RNA, 18 nt, Human
aggguugggguaggaagg

SEQ ID NO: 84066 - RNA, 19 nt, Human
agucaagagcugggguccc

SEQ ID NO: 84067 - RNA, 20 nt, Human
agucacaacugcauccaugc

SEQ ID NO: 84068 - RNA, 21 nt, Human
auggaccagaggccugcucca

SEQ ID NO: 84069 - RNA, 18 nt, Human
caaaaacaagacaugaaa

SEQ ID NO: 84070 - RNA, 20 nt, Human
caacugaggccugccugcca

SEQ ID NO: 84071 - RNA, 22 nt, Human
caagggaagagcccuggggagg

SEQ ID NO: 84072 - RNA, 20 nt, Human
caaggguuugccagauugua

SEQ ID NO: 84073 - RNA, 21 nt, Human
caagucccagaaaggcaaggg

SEQ ID NO: 84074 - RNA, 20 nt, Human
cacacacacacacacacaca

SEQ ID NO: 84075 - RNA, 18 nt, Human
cacauccccacacagacc

SEQ ID NO: 84076 - RNA, 19 nt, Human
cacauccccacacagaccu

SEQ ID NO: 84077 - RNA, 22 nt, Human
caccacaagugccaaaggccca

SEQ ID NO: 84078 - RNA, 20 nt, Human
cacgcugcuuuucggugcua

SEQ ID NO: 84079 - RNA, 21 nt, Human
cacguccucaacugaggccug

SEQ ID NO: 84080 - RNA, 21 nt, Human
cacugcaggacaggcggugac

SEQ ID NO: 84081 - RNA, 21 nt, Human
cacugugggcccucagaccac

SEQ ID NO: 84082 - RNA, 19 nt, Human
cagaaacacacacacacac

SEQ ID NO: 84083 - RNA, 24 nt, Human
cagaggcgggcugggaggccuccc

SEQ ID NO: 84084 - RNA, 23 nt, Human
cagaggugagcgaggagcccucu

SEQ ID NO: 84085 - RNA, 22 nt, Human
cagcccagaucucccggcucac

SEQ ID NO: 84086 - RNA, 23 nt, Human
cagcgaguccugccacaggucaa

SEQ ID NO: 84087 - RNA, 25 nt, Human
cagcgaguccugccacaggucaaac

SEQ ID NO: 84088 - RNA, 20 nt, Human
cagguacugccugccgcacu

SEQ ID NO: 84089 - RNA, 18 nt, Human
cauccccuggccuguagu

SEQ ID NO: 84090 - RNA, 21 nt, Human
caugaugcuggggagaggggu

SEQ ID NO: 84091 - RNA, 18 nt, Human
caugcaagggccaggaag

SEQ ID NO: 84092 - RNA, 24 nt, Human
cauggcagcagggcugcuggcacc

SEQ ID NO: 84093 - RNA, 20 nt, Human
ccaccccagugaacauggca

SEQ ID NO: 84094 - RNA, 19 nt, Human
ccacgcugcuuuucggugc

SEQ ID NO: 84095 - RNA, 18 nt, Human
ccagaugaccacugucaa

SEQ ID NO: 84096 - RNA, 24 nt, Human
ccagcccagaucucccggcucaca

SEQ ID NO: 84097 - RNA, 20 nt, Human
ccagggcccccagcccucag

SEQ ID NO: 84098 - RNA, 23 nt, Human
ccagugccaccccagugaacaug

SEQ ID NO: 84099 - RNA, 21 nt, Human
cccaaccccuggccacaugga

SEQ ID NO: 84100 - RNA, 24 nt, Human
cccaaccccuggccacauggaggu

SEQ ID NO: 84101 - RNA, 18 nt, Human
cccauccccuggccugua

SEQ ID NO: 84102 - RNA, 19 nt, Human
ccccacacagaccuggucc

SEQ ID NO: 84103 - RNA, 23 nt, Human
ccccagcccucagucaaagccuu

SEQ ID NO: 84104 - RNA, 18 nt, Human
cccccaagggaagagccc

SEQ ID NO: 84105 - RNA, 23 nt, Human
cccccagcccucagucaaagccc

SEQ ID NO: 84106 - RNA, 20 nt, Human
cccccuauugcuucuaaguc

SEQ ID NO: 84107 - RNA, 19 nt, Human
cccgggccggcggcucccg

SEQ ID NO: 84108 - RNA, 19 nt, Human
cccucagaccacaugcucu

SEQ ID NO: 84109 - RNA, 18 nt, Human
cccuggccagugguccga

SEQ ID NO: 84110 - RNA, 24 nt, Human
ccucgggcacagccuggcucugcu

SEQ ID NO: 84111 - RNA, 19 nt, Human
ccucugggaaagggcuguc

SEQ ID NO: 84112 - RNA, 19 nt, Human
ccugaaggagagguucuga

SEQ ID NO: 84113 - RNA, 24 nt, Human
ccuggccacauggaggucugcucc

SEQ ID NO: 84114 - RNA, 23 nt, Human
cgcuugggcuuuggagaaggggg

SEQ ID NO: 84115 - RNA, 20 nt, Human
cguaaaucaaacuggaauga

SEQ ID NO: 84116 - RNA, 24 nt, Human
cguccucaacugaggccugccugc

SEQ ID NO: 84117 - RNA, 21 nt, Human
cuagcacgcugccacccacgg

SEQ ID NO: 84118 - RNA, 21 nt, Human
cuccugaaggagagguucuga

SEQ ID NO: 84119 - RNA, 23 nt, Human
cucugaguacacccacuggugau

SEQ ID NO: 84120 - RNA, 19 nt, Human
cucugcucuugccucugcc

SEQ ID NO: 84121 - RNA, 21 nt, Human
cucuugguggccugcugcccc

SEQ ID NO: 84122 - RNA, 22 nt, Human
cugcucugaguacacccacugg

SEQ ID NO: 84123 - RNA, 18 nt, Human
cuggaaugauuaaggcug

SEQ ID NO: 84124 - RNA, 20 nt, Human
cugggaggccuccccagacc

SEQ ID NO: 84125 - RNA, 22 nt, Human
cugggguugugcucuugguggc

SEQ ID NO: 84126 - RNA, 19 nt, Human
cuggucccucagcuucugg

SEQ ID NO: 84127 - RNA, 20 nt, Human
cuggucccucagcuucuggc

SEQ ID NO: 84128 - RNA, 24 nt, Human
cuuccugucccauccauagcuacc

SEQ ID NO: 84129 - RNA, 18 nt, Human
cuugcucaugaugcuggg

SEQ ID NO: 84130 - RNA, 19 nt, Human
gaagugagugcacugggcc

SEQ ID NO: 84131 - RNA, 20 nt, Human
gacucaccuggcagcagcga

SEQ ID NO: 84132 - RNA, 19 nt, Human
gagaagccucagccggcgc

SEQ ID NO: 84133 - RNA, 19 nt, Human
gagagaaggaaagaaaggg

SEQ ID NO: 84134 - RNA, 19 nt, Human
gagcagcaucucuggaaag

SEQ ID NO: 84135 - RNA, 20 nt, Human
gagcagcgggacgcuugggc

SEQ ID NO: 84136 - RNA, 22 nt, Human
gagcagggagcauagguccugg

SEQ ID NO: 84137 - RNA, 20 nt, Human
gagcagggguggggugggga

SEQ ID NO: 84138 - RNA, 18 nt, Human
gagccggcugguugagac

SEQ ID NO: 84139 - RNA, 21 nt, Human
gagccuccuagccacagagga

SEQ ID NO: 84140 - RNA, 24 nt, Human
gaggagagaaggaaagaaagggag

SEQ ID NO: 84141 - RNA, 20 nt, Human
gagggggagaggcaagggag

SEQ ID NO: 84142 - RNA, 22 nt, Human
gagggguauggagaaggccugg

SEQ ID NO: 84143 - RNA, 19 nt, Human
gauggcaucuccgaggagu

SEQ ID NO: 84144 - RNA, 20 nt, Human
gcaaaaagaacuccaagcaa

SEQ ID NO: 84145 - RNA, 22 nt, Human
gcaggggugggguggggagggg

SEQ ID NO: 84146 - RNA, 20 nt, Human
gccaccuucacagaggggcg

SEQ ID NO: 84147 - RNA, 21 nt, Human
gccuguucccuacuucuuguc

SEQ ID NO: 84148 - RNA, 19 nt, Human
gcgcugcgcccgggccggc

SEQ ID NO: 84149 - RNA, 24 nt, Human
gcgggcgggcggggucggggucgc

SEQ ID NO: 84150 - RNA, 23 nt, Human
gcucugggccuuucccuuggcug

SEQ ID NO: 84151 - RNA, 18 nt, Human
gcugcgcccaggccucug

SEQ ID NO: 84152 - RNA, 20 nt, Human
ggaaagggcugucagaugcc

SEQ ID NO: 84153 - RNA, 22 nt, Human
ggaaugauuaaggcuguucuug

SEQ ID NO: 84154 - RNA, 18 nt, Human
ggagagagggaggaggaa

SEQ ID NO: 84155 - RNA, 18 nt, Human
ggaggaggaaggggaaag

SEQ ID NO: 84156 - RNA, 18 nt, Human
ggcaggcgggcgggcggg

SEQ ID NO: 84157 - RNA, 19 nt, Human
ggcccagcucuuccugagc

SEQ ID NO: 84158 - RNA, 18 nt, Human
ggccugggcugcaugcua

SEQ ID NO: 84159 - RNA, 25 nt, Human
ggccugggcugcaugcuagagacuc

SEQ ID NO: 84160 - RNA, 22 nt, Human
ggccugucccucuaacccuguu

SEQ ID NO: 84161 - RNA, 24 nt, Human
ggcucccgggcggugcucacacuc

SEQ ID NO: 84162 - RNA, 21 nt, Human
ggcugggagaagccucagccg

SEQ ID NO: 84163 - RNA, 22 nt, Human
gggaagccuggccggccaggcc

SEQ ID NO: 84164 - RNA, 23 nt, Human
gggagaagccucagccggcgccc

SEQ ID NO: 84165 - RNA, 22 nt, Human
gggagagggguauggagaaggc

SEQ ID NO: 84166 - RNA, 18 nt, Human
gggcaggcgggcgggcgg

SEQ ID NO: 84167 - RNA, 20 nt, Human
gggcugcuggcacccaggga

SEQ ID NO: 84168 - RNA, 20 nt, Human
ggggacagaugcagagaggg

SEQ ID NO: 84169 - RNA, 19 nt, Human
gggguggggguuuuaugag

SEQ ID NO: 84170 - RNA, 23 nt, Human
ggguaagaggagagcagacggga

SEQ ID NO: 84171 - RNA, 18 nt, Human
ggguaggaagggaaaaug

SEQ ID NO: 84172 - RNA, 21 nt, Human
ggguauggagaaggccugggc

SEQ ID NO: 84173 - RNA, 19 nt, Human
ggguggggagggguggggg

SEQ ID NO: 84174 - RNA, 19 nt, Human
ggguggggugaggccaagu

SEQ ID NO: 84175 - RNA, 18 nt, Human
gguccuggguggccagag

SEQ ID NO: 84176 - RNA, 21 nt, Human
gguccuggguggccagaggug

SEQ ID NO: 84177 - RNA, 18 nt, Human
gguggccugcugcccccu

SEQ ID NO: 84178 - RNA, 19 nt, Human
ggugguggagggggagagg

SEQ ID NO: 84179 - RNA, 19 nt, Human
gucacaauacagggggagg

SEQ ID NO: 84180 - RNA, 18 nt, Human
uaaaguucucccaacccc

SEQ ID NO: 84181 - RNA, 25 nt, Human
uaaaucaaacuggaaugauuaagaa

SEQ ID NO: 84182 - RNA, 19 nt, Human
uaacaguugucauugaggg

SEQ ID NO: 84183 - RNA, 25 nt, Human
uacacacaugaucaugugcauacac

SEQ ID NO: 84184 - RNA, 20 nt, Human
uagcuugugcagaagucagc

SEQ ID NO: 84185 - RNA, 22 nt, Human
uauugccuuggucuccaaggca

SEQ ID NO: 84186 - RNA, 20 nt, Human
uauuucauugcauagaacgu

SEQ ID NO: 84187 - RNA, 21 nt, Human
ucaaauaaaggaggagagaag

SEQ ID NO: 84188 - RNA, 18 nt, Human
ucacaaggucauguggag

SEQ ID NO: 84189 - RNA, 21 nt, Human
ucacaaggucauguggaggac

SEQ ID NO: 84190 - RNA, 20 nt, Human
ucacaagguggugguggagg

SEQ ID NO: 84191 - RNA, 19 nt, Human
ucagaccacaugcucugcc

SEQ ID NO: 84192 - RNA, 23 nt, Human
ucagucacaagguggugguggag

SEQ ID NO: 84193 - RNA, 24 nt, Human
uccaaggcacauccccacacagac

SEQ ID NO: 84194 - RNA, 19 nt, Human
uccccacacagaccugguc

SEQ ID NO: 84195 - RNA, 22 nt, Human
ucccuacuucuugucccauccc

SEQ ID NO: 84196 - RNA, 22 nt, Human
ucccucgggcacagccuggcuc

SEQ ID NO: 84197 - RNA, 19 nt, Human
uccuagccacagaggagag

SEQ ID NO: 84198 - RNA, 20 nt, Human
uccuggguggccagaggugu

SEQ ID NO: 84199 - RNA, 21 nt, Human
ucggcgccgccgcugccgccg

SEQ ID NO: 84200 - RNA, 23 nt, Human
ucugcuccgaugucacccagagg

SEQ ID NO: 84201 - RNA, 21 nt, Human
ugacagacagacagauauccu

SEQ ID NO: 84202 - RNA, 20 nt, Human
ugacccccuagcuccagccc

SEQ ID NO: 84203 - RNA, 22 nt, Human
ugacccccuagcuccagcccag

SEQ ID NO: 84204 - RNA, 18 nt, Human
ugagaaaacaucacgucc

SEQ ID NO: 84205 - RNA, 24 nt, Human
ugagacaguguuagguccuaaugu

SEQ ID NO: 84206 - RNA, 23 nt, Human
ugagcagagagaggaggcaaugc

SEQ ID NO: 84207 - RNA, 18 nt, Human
ugagccuccuagccacag

SEQ ID NO: 84208 - RNA, 23 nt, Human
ugcagagagggucacacaggaaa

SEQ ID NO: 84209 - RNA, 18 nt, Human
ugcagucaagagcugggg

SEQ ID NO: 84210 - RNA, 23 nt, Human
ugccacagacugagaauuucaca

SEQ ID NO: 84211 - RNA, 21 nt, Human
ugccacaggucaaacaugcca

SEQ ID NO: 84212 - RNA, 21 nt, Human
ugccaccacugcuguucuuuc

SEQ ID NO: 84213 - RNA, 23 nt, Human
ugcccaaacucuguguauaacgc

SEQ ID NO: 84214 - RNA, 24 nt, Human
ugcucugcccaaggauuguagggg

SEQ ID NO: 84215 - RNA, 22 nt, Human
ugcucuugccucugccucucug

SEQ ID NO: 84216 - RNA, 18 nt, Human
uggaaaaacuucuggcau

SEQ ID NO: 84217 - RNA, 18 nt, Human
uggagaagggggugagca

SEQ ID NO: 84218 - RNA, 22 nt, Human
uggagagaaggagcugauuuga

SEQ ID NO: 84219 - RNA, 18 nt, Human
uggcacgcucaggcaaca

SEQ ID NO: 84220 - RNA, 22 nt, Human
uggccucuuauuucagcgauga

SEQ ID NO: 84221 - RNA, 22 nt, Human
uggcucugcucuugccucugcc

SEQ ID NO: 84222 - RNA, 21 nt, Human
uggcuucccucagcccuugcu

SEQ ID NO: 84223 - RNA, 19 nt, Human
ugggggaugaggaguggca

SEQ ID NO: 84224 - RNA, 20 nt, Human
ugggggaugaggaguggcag

SEQ ID NO: 84225 - RNA, 24 nt, Human
uggggguggguaagaggagagcag

SEQ ID NO: 84226 - RNA, 20 nt, Human
ugggguaggaagggaaaaug

SEQ ID NO: 84227 - RNA, 18 nt, Human
ugggguggggaggggugg

SEQ ID NO: 84228 - RNA, 20 nt, Human
ugguaaaaaagcugaugagc

SEQ ID NO: 84229 - RNA, 21 nt, Human
uggugcaaaccagagcacucu

SEQ ID NO: 84230 - RNA, 18 nt, Human
uguaaaguucucccaacc

SEQ ID NO: 84231 - RNA, 24 nt, Human
ugucagaauuucaaacucagaggg

SEQ ID NO: 84232 - RNA, 21 nt, Human
uguccauacacacacauccug

SEQ ID NO: 84233 - RNA, 22 nt, Human
uucauuucuucaagagccaugc

SEQ ID NO: 84234 - RNA, 20 nt, Human
uucugaggcaaaaagaacuc

SEQ ID NO: 84235 - RNA, 19 nt, Human
uugcucagauggcugcauu

SEQ ID NO: 84236 - RNA, 24 nt, Human
uugcucaugaugcuggggagaggg

SEQ ID NO: 84237 - RNA, 24 nt, Human
uugcuucuaagucaacauucuccc

SEQ ID NO: 84238 - RNA, 21 nt, Human
uuggagaagggggugagcagg

SEQ ID NO: 84239 - RNA, 21 nt, Human
uuuuccacagcaaugauaccu

SEQ ID NO: 84240 - RNA, 22 nt, Human
aacggacccacacccagccacc

SEQ ID NO: 84241 - RNA, 18 nt, Human
aaucgcugcaacucaagg

SEQ ID NO: 84242 - RNA, 22 nt, Human
agacacugaaaucgcugcaacu

SEQ ID NO: 84243 - RNA, 22 nt, Human
agacaggcuuacacagggagag

SEQ ID NO: 84244 - RNA, 22 nt, Human
aggggucagcagcaguuccaga

SEQ ID NO: 84245 - RNA, 26 nt, Human
caaaaugccaccaucucauugaaccu

SEQ ID NO: 84246 - RNA, 19 nt, Human
caguuccagacuagaagcu

SEQ ID NO: 84247 - RNA, 21 nt, Human
ccagucccuggccugcacacc

SEQ ID NO: 84248 - RNA, 24 nt, Human
ccauaucaucccauuuugcagaua

SEQ ID NO: 84249 - RNA, 24 nt, Human
cuaaacaccgagacaggcuuacac

SEQ ID NO: 84250 - RNA, 19 nt, Human
cuccagucccugggcccac

SEQ ID NO: 84251 - RNA, 22 nt, Human
cugaggcccugugaugucacac

SEQ ID NO: 84252 - RNA, 19 nt, Human
cuggaggcggcucgcuuca

SEQ ID NO: 84253 - RNA, 22 nt, Human
gcuucaagggagagcaagaucc

SEQ ID NO: 84254 - RNA, 24 nt, Human
uagggaaacugaggcccugugaug

SEQ ID NO: 84255 - RNA, 22 nt, Human
uccagacuagaagcuacggagc

SEQ ID NO: 84256 - RNA, 23 nt, Human
ucccugggcccaccaguucaaca

SEQ ID NO: 84257 - RNA, 20 nt, Human
ugccuggccagucccuggcc

SEQ ID NO: 84258 - RNA, 21 nt, Human
uucaacggacccacacccagc

SEQ ID NO: 84259 - RNA, 19 nt, Human
uucaacggacccacacccg

SEQ ID NO: 84260 - RNA, 23 nt, Human
uuuuuagucaucauccccucccu

SEQ ID NO: 84261 - RNA, 26 nt, Human
aagcagucugacucccaaugcuuugu

SEQ ID NO: 84262 - RNA, 21 nt, Human
aaggggaggcugcagggcugg

SEQ ID NO: 84263 - RNA, 25 nt, Human
cagucugacucccaaugcuuugugu

SEQ ID NO: 84264 - RNA, 26 nt, Human
ccacuccccuucucuccuucuaccaa

SEQ ID NO: 84265 - RNA, 24 nt, Human
cccgugcuuccuccacuccccuuc

SEQ ID NO: 84266 - RNA, 24 nt, Human
cuccccuucucuccuucuaccaag

SEQ ID NO: 84267 - RNA, 21 nt, Human
gacugcaaggggaggcugcag

SEQ ID NO: 84268 - RNA, 22 nt, Human
gcuggaggaggguuagagcaac

SEQ ID NO: 84269 - RNA, 23 nt, Human
ggaggcugcagggcuggaggagg

SEQ ID NO: 84270 - RNA, 21 nt, Human
gugcuuccuccacuccccuuc

SEQ ID NO: 84271 - RNA, 24 nt, Human
uauacaagcagucugacucccaau

SEQ ID NO: 84272 - RNA, 22 nt, Human
ucccgugcuuccuccacucccc

SEQ ID NO: 84273 - RNA, 19 nt, Human
ugacugcaaggggaggcug

SEQ ID NO: 84274 - RNA, 22 nt, Human
ugacugcaaggggaggcugcag

SEQ ID NO: 84275 - RNA, 21 nt, Human
ugaugacugcaaggggaggcu

SEQ ID NO: 84276 - RNA, 21 nt, Human
uuucaggacaucguuuuccca

SEQ ID NO: 84277 - RNA, 21 nt, Human
aaaaaacccauaacaacaggc

SEQ ID NO: 84278 - RNA, 21 nt, Human
aaaaaagcaaccccccccgca

SEQ ID NO: 84279 - RNA, 20 nt, Human
aacaggcagcacaugccccc

SEQ ID NO: 84280 - RNA, 23 nt, Human
aacaggcagcacaugccccccac

SEQ ID NO: 84281 - RNA, 21 nt, Human
aaccguguugccccaugaccc

SEQ ID NO: 84282 - RNA, 18 nt, Human
aagcaaccccccccgcaa

SEQ ID NO: 84283 - RNA, 21 nt, Human
aagcaaccccccccgcaaaaa

SEQ ID NO: 84284 - RNA, 22 nt, Human
aagcaaccccccccgcaaaaaa

SEQ ID NO: 84285 - RNA, 22 nt, Human
acaacaggcagcacaugccccc

SEQ ID NO: 84286 - RNA, 21 nt, Human
acaccgcaccccaugcccaau

SEQ ID NO: 84287 - RNA, 23 nt, Human
accccccccgcaaaaaaaaccca

SEQ ID NO: 84288 - RNA, 20 nt, Human
agaaaaaagcaacccccccc

SEQ ID NO: 84289 - RNA, 21 nt, Human
agaaaaaagcaaccccccccg

SEQ ID NO: 84290 - RNA, 26 nt, Human
agaaaaaagcaaccccccccgcaaaa

SEQ ID NO: 84291 - RNA, 18 nt, Human
agcaggacggaccuucca

SEQ ID NO: 84292 - RNA, 21 nt, Human
aggcucuggagggagacagcc

SEQ ID NO: 84293 - RNA, 21 nt, Human
agggugggagacaagaggggg

SEQ ID NO: 84294 - RNA, 22 nt, Human
auaacaacaggcagcacaugcc

SEQ ID NO: 84295 - RNA, 23 nt, Human
caaaaaaaacccauaacaacagg

SEQ ID NO: 84296 - RNA, 22 nt, Human
caaagaccccagaaaaaagcaa

SEQ ID NO: 84297 - RNA, 23 nt, Human
caacccgacuguguccccacacc

SEQ ID NO: 84298 - RNA, 22 nt, Human
cacaccgcaccccaugcccaau

SEQ ID NO: 84299 - RNA, 24 nt, Human
caccgcaccccaugcccaaucuca

SEQ ID NO: 84300 - RNA, 21 nt, Human
cagaaaaaagcaacccccccc

SEQ ID NO: 84301 - RNA, 20 nt, Human
cagaggcccuucuccggcua

SEQ ID NO: 84302 - RNA, 24 nt, Human
cagcacaugccccccacaccgcac

SEQ ID NO: 84303 - RNA, 20 nt, Human
cagggugggagacaagaggg

SEQ ID NO: 84304 - RNA, 22 nt, Human
cagggugggagacaagaggggg

SEQ ID NO: 84305 - RNA, 18 nt, Human
caugacccgcucagaacu

SEQ ID NO: 84306 - RNA, 22 nt, Human
caugccccccacaccgcacccc

SEQ ID NO: 84307 - RNA, 18 nt, Human
cccacaccgcaccccaug

SEQ ID NO: 84308 - RNA, 20 nt, Human
cccaggacugccccauggcc

SEQ ID NO: 84309 - RNA, 22 nt, Human
cccaggacugccccauggcccc

SEQ ID NO: 84310 - RNA, 21 nt, Human
ccccacacccaggacugcccc

SEQ ID NO: 84311 - RNA, 22 nt, Human
ccccacaccgcaccccaugccc

SEQ ID NO: 84312 - RNA, 24 nt, Human
ccccagaaaaaagcaacccccccc

SEQ ID NO: 84313 - RNA, 18 nt, Human
ccccaugacccgcucaga

SEQ ID NO: 84314 - RNA, 18 nt, Human
ccccauggccccuccaga

SEQ ID NO: 84315 - RNA, 18 nt, Human
cccccgcaaaaaaaaccc

SEQ ID NO: 84316 - RNA, 23 nt, Human
cccccgcaaaaaaaacccauaac

SEQ ID NO: 84317 - RNA, 26 nt, Human
ccccgcaaaaaaaacccauaacaaca

SEQ ID NO: 84318 - RNA, 24 nt, Human
ccccuccagaccugcuccagaggc

SEQ ID NO: 84319 - RNA, 25 nt, Human
cccgcaaaaaaaacccauaacaaca

SEQ ID NO: 84320 - RNA, 22 nt, Human
cccugggucaacccgacugugu

SEQ ID NO: 84321 - RNA, 21 nt, Human
ccgcaccccaugcccaaucuu

SEQ ID NO: 84322 - RNA, 18 nt, Human
ccuccagaccugcuccag

SEQ ID NO: 84323 - RNA, 18 nt, Human
cgcaccccaugcccaauc

SEQ ID NO: 84324 - RNA, 22 nt, Human
cuccggcuaccccgugcucucc

SEQ ID NO: 84325 - RNA, 19 nt, Human
gagacagcccugggucaac

SEQ ID NO: 84326 - RNA, 21 nt, Human
gcacaugccccccacaccgca

SEQ ID NO: 84327 - RNA, 18 nt, Human
gccccccacaccgcaccc

SEQ ID NO: 84328 - RNA, 21 nt, Human
uaaccguguugccccaugacc

SEQ ID NO: 84329 - RNA, 19 nt, Human
uccagaccugcuccagagg

SEQ ID NO: 84330 - RNA, 21 nt, Human
uccccgcuaaccguguugccc

SEQ ID NO: 84331 - RNA, 24 nt, Human
uccggagggaggcucuggagggag

SEQ ID NO: 84332 - RNA, 22 nt, Human
ucuccggcuaccccgugcucuc

SEQ ID NO: 84333 - RNA, 18 nt, Human
uggagcucaaagacccca

SEQ ID NO: 84334 - RNA, 23 nt, Human
uggagcucaaagaccccagaaaa

SEQ ID NO: 84335 - RNA, 18 nt, Human
uggagggagacagcccug

SEQ ID NO: 84336 - RNA, 19 nt, Human
uuuuuuuuuuuuuuuugcu

SEQ ID NO: 84337 - RNA, 18 nt, Human
uuuuuuuuuuuuuuuuug

SEQ ID NO: 84338 - RNA, 20 nt, Human
uuuuuuuuuuuuuuuuugcu

SEQ ID NO: 84339 - RNA, 25 nt, Human
aaccacccucuaaauaggauguuau

SEQ ID NO: 84340 - RNA, 18 nt, Human
aacuuguuucccccagug

SEQ ID NO: 84341 - RNA, 21 nt, Human
acaaguucuauuuaaaagaaa

SEQ ID NO: 84342 - RNA, 24 nt, Human
acacauacaugcacaucuaucuac

SEQ ID NO: 84343 - RNA, 20 nt, Human
acagugcaaauauuugagaa

SEQ ID NO: 84344 - RNA, 25 nt, Human
acauacaugcacaucuaucuacaua

SEQ ID NO: 84345 - RNA, 20 nt, Human
accacccucuaaauaggaug

SEQ ID NO: 84346 - RNA, 18 nt, Human
acccgagcucguccccgc

SEQ ID NO: 84347 - RNA, 19 nt, Human
acccucuaaauaggauguu

SEQ ID NO: 84348 - RNA, 19 nt, Human
acgguagcggaggcggcag

SEQ ID NO: 84349 - RNA, 21 nt, Human
acuaaagauaggaggccuguu

SEQ ID NO: 84350 - RNA, 20 nt, Human
agcauguaaaauuuaaacca

SEQ ID NO: 84351 - RNA, 28 nt, Human
agccagcauuaugcugaauaacaggggu

SEQ ID NO: 84352 - RNA, 22 nt, Human
agcuuuucagcauguaaaauuu

SEQ ID NO: 84353 - RNA, 18 nt, Human
aggcccucgggcaucugc

SEQ ID NO: 84354 - RNA, 21 nt, Human
aguacauauguuauuugaauc

SEQ ID NO: 84355 - RNA, 23 nt, Human
auaaagaaauucucucucccuuu

SEQ ID NO: 84356 - RNA, 18 nt, Human
auaguuacaaaaaauaua

SEQ ID NO: 84357 - RNA, 27 nt, Human
caaacacauacaugcacaucuaucuac

SEQ ID NO: 84358 - RNA, 24 nt, Human
caaaugucuaaaugcugcagaaca

SEQ ID NO: 84359 - RNA, 20 nt, Human
cagcaauugcauuuacaaua

SEQ ID NO: 84360 - RNA, 23 nt, Human
cagccacaaaccuuggggauguu

SEQ ID NO: 84361 - RNA, 24 nt, Human
cauauagauaugcauauucaugua

SEQ ID NO: 84362 - RNA, 22 nt, Human
cauauucauguauguuugugua

SEQ ID NO: 84363 - RNA, 20 nt, Human
caugcacaucuaucuacaua

SEQ ID NO: 84364 - RNA, 22 nt, Human
cccaggccgcggagcacagggg

SEQ ID NO: 84365 - RNA, 18 nt, Human
cccauacauauguaugca

SEQ ID NO: 84366 - RNA, 24 nt, Human
ccuccgacccgcacgacuucaaac

SEQ ID NO: 84367 - RNA, 19 nt, Human
cggccggugcggcgugggg

SEQ ID NO: 84368 - RNA, 22 nt, Human
cucguccccgcggcggccggua

SEQ ID NO: 84369 - RNA, 18 nt, Human
cucuaaauaggauguuau

SEQ ID NO: 84370 - RNA, 23 nt, Human
cugcucugcagcuuuucagcaug

SEQ ID NO: 84371 - RNA, 18 nt, Human
gagcacaggggagcggcc

SEQ ID NO: 84372 - RNA, 24 nt, Human
gagcucguccccgcggcggccggu

SEQ ID NO: 84373 - RNA, 20 nt, Human
gauaugcauauucauguaug

SEQ ID NO: 84374 - RNA, 23 nt, Human
gccagccacaaaccuuggggaug

SEQ ID NO: 84375 - RNA, 19 nt, Human
gcggcgcaggcccaggccg

SEQ ID NO: 84376 - RNA, 21 nt, Human
gcugaauauucuccagaucua

SEQ ID NO: 84377 - RNA, 22 nt, Human
gcugaggcgcuaguuuccagag

SEQ ID NO: 84378 - RNA, 24 nt, Human
uaaaagaaaaaacauauacaaaca

SEQ ID NO: 84379 - RNA, 18 nt, Human
uaaauuaaaaaaaaccac

SEQ ID NO: 84380 - RNA, 23 nt, Human
uacacauugaguuaaaaguucac

SEQ ID NO: 84381 - RNA, 21 nt, Human
uaccuacccucaccauugagu

SEQ ID NO: 84382 - RNA, 24 nt, Human
uagaaaaaaagcccuauuuuaaau

SEQ ID NO: 84383 - RNA, 20 nt, Human
uagcacaaauaaaccugguu

SEQ ID NO: 84384 - RNA, 20 nt, Human
uagguacaucuaugcauaua

SEQ ID NO: 84385 - RNA, 24 nt, Human
uauaaaauuauauauacaaacaca

SEQ ID NO: 84386 - RNA, 18 nt, Human
uaucuuaaaaguugaaaa

SEQ ID NO: 84387 - RNA, 31 nt, Human
uaugcacacaggcauguauuaauuuaugcgg

SEQ ID NO: 84388 - RNA, 20 nt, Human
uaugcauauagauaugcaua

SEQ ID NO: 84389 - RNA, 19 nt, Human
uauguuauuugaaucuggc

SEQ ID NO: 84390 - RNA, 20 nt, Human
ucagcagaaauguaacugaa

SEQ ID NO: 84391 - RNA, 20 nt, Human
ucccccagugaaacaagagc

SEQ ID NO: 84392 - RNA, 18 nt, Human
ucgggcaucugcccugcc

SEQ ID NO: 84393 - RNA, 23 nt, Human
ugaacuagcagcaauugcauuua

SEQ ID NO: 84394 - RNA, 23 nt, Human
ugcauuacuacaauaaacagucu

SEQ ID NO: 84395 - RNA, 18 nt, Human
ugguuugguuccucugcu

SEQ ID NO: 84396 - RNA, 24 nt, Human
uguacagcugaggucugaugguuu

SEQ ID NO: 84397 - RNA, 20 nt, Human
uguaugcacacaggcaugua

SEQ ID NO: 84398 - RNA, 27 nt, Human
uguaugcacacaggcauguauuaauuu

SEQ ID NO: 84399 - RNA, 18 nt, Human
uguauggccagccacaaa

SEQ ID NO: 84400 - RNA, 24 nt, Human
ugugacaaaugucuaaaugcugca

SEQ ID NO: 84401 - RNA, 27 nt, Human
uuauauauacaaacacauacaugcagu

SEQ ID NO: 84402 - RNA, 22 nt, Human
uuuccacuguagguguuggaag

SEQ ID NO: 84403 - RNA, 21 nt, Human
aauaaaaacuaccauaacugc

SEQ ID NO: 84404 - RNA, 20 nt, Human
aauaauaaaaacuaccauaa

SEQ ID NO: 84405 - RNA, 20 nt, Human
acaagucaacucucucacac

SEQ ID NO: 84406 - RNA, 19 nt, Human
acgaagcggcaucucccuu

SEQ ID NO: 84407 - RNA, 19 nt, Human
aggaaauaauauauuucaa

SEQ ID NO: 84408 - RNA, 21 nt, Human
aucuguccucugucuccucuu

SEQ ID NO: 84409 - RNA, 24 nt, Human
caaaauaauaaaaacuaccauaac

SEQ ID NO: 84410 - RNA, 19 nt, Human
cacuuugcagcuugccacc

SEQ ID NO: 84411 - RNA, 23 nt, Human
cacuuugcagcuugccaccaacc

SEQ ID NO: 84412 - RNA, 19 nt, Human
cuucuucuuucuucuuucu

SEQ ID NO: 84413 - RNA, 22 nt, Human
gaccaaaauaauaaaaacuacc

SEQ ID NO: 84414 - RNA, 21 nt, Human
gguaaaacaagucaacucucu

SEQ ID NO: 84415 - RNA, 24 nt, Human
uaaaaacuaccauaacugcuauca

SEQ ID NO: 84416 - RNA, 23 nt, Human
uacuagcuguuuuccugagacac

SEQ ID NO: 84417 - RNA, 18 nt, Human
uagguaaaacaagucaac

SEQ ID NO: 84418 - RNA, 19 nt, Human
uccucugucuccucuuagg

SEQ ID NO: 84419 - RNA, 23 nt, Human
ucuacuagcuguuuuccugagac

SEQ ID NO: 84420 - RNA, 24 nt, Human
ucucucacaccuugcuccaaugua

SEQ ID NO: 84421 - RNA, 19 nt, Human
ucuucuucuuucuucuuuc

SEQ ID NO: 84422 - RNA, 22 nt, Human
ugaccaaaauaauaaaaacuac

SEQ ID NO: 84423 - RNA, 27 nt, Human
ugaccaaaauaauaaaaacuaccauaa

SEQ ID NO: 84424 - RNA, 22 nt, Human
ugcuugauaaaugguagcuuua

SEQ ID NO: 84425 - RNA, 22 nt, Human
uucuuucuucuuucuuuuacga

SEQ ID NO: 84426 - RNA, 19 nt, Human
uuucuuuuacgacguuucc

SEQ ID NO: 84427 - RNA, 22 nt, Human
aaaaagauaaaugugaacagaa

SEQ ID NO: 84428 - RNA, 20 nt, Human
aacagaaaauacccccuaau

SEQ ID NO: 84429 - RNA, 25 nt, Human
aaucugccucuccuacuuuuuccac

SEQ ID NO: 84430 - RNA, 20 nt, Human
agaguccgccccacagacca

SEQ ID NO: 84431 - RNA, 23 nt, Human
aggaagauguggcuugaaaaaga

SEQ ID NO: 84432 - RNA, 22 nt, Human
aggcagaaagauggucccaggg

SEQ ID NO: 84433 - RNA, 24 nt, Human
aucugccucuccuacuuuuuccac

SEQ ID NO: 84434 - RNA, 19 nt, Human
cccacagaccacacacuuc

SEQ ID NO: 84435 - RNA, 20 nt, Human
ccucuccuacuuuuuccaca

SEQ ID NO: 84436 - RNA, 25 nt, Human
cuugaaaaagauaaaugugaacaga

SEQ ID NO: 84437 - RNA, 22 nt, Human
gaugauugagguuuaagaggaa

SEQ ID NO: 84438 - RNA, 21 nt, Human
uaaaugugaacagaaaauacc

SEQ ID NO: 84439 - RNA, 20 nt, Human
ucccagggcuuguagccugu

SEQ ID NO: 84440 - RNA, 21 nt, Human
ucugccucuccuacuuuuucc

SEQ ID NO: 84441 - RNA, 20 nt, Human
ugaaaaagauaaaugugaac

SEQ ID NO: 84442 - RNA, 21 nt, Human
ugauugagguuuaagaggaag

SEQ ID NO: 84443 - RNA, 21 nt, Human
ugcaaggcugucaacaugaug

SEQ ID NO: 84444 - RNA, 25 nt, Human
ugcccuuaaggcagaaagauggucc

SEQ ID NO: 84445 - RNA, 24 nt, Human
uggaagugcaaggcugucaacaug

SEQ ID NO: 84446 - RNA, 20 nt, Human
uggaaucuggugccacagaa

SEQ ID NO: 84447 - RNA, 18 nt, Human
uguggaagugcaaggcug

SEQ ID NO: 84448 - RNA, 23 nt, Human
uguguaaaauauaaacugacauu

SEQ ID NO: 84449 - RNA, 24 nt, Human
uuagaggaagauguggcuugaaaa

SEQ ID NO: 84450 - RNA, 19 nt, Human
uucccaggguggaaucugg

SEQ ID NO: 84451 - RNA, 18 nt, Human
uuuuuuuuuuuuuuuuug

SEQ ID NO: 84452 - RNA, 18 nt, Human
uuuuuuuuuuuuuuuuug

SEQ ID NO: 84453 - RNA, 28 nt, Human
aaaaaaaaacaaaaacaaaaaccaaagc

SEQ ID NO: 84454 - RNA, 23 nt, Human
aaaaaaacaaaaacaaaaaccaa

SEQ ID NO: 84455 - RNA, 21 nt, Human
aaaaaacccaaaagcauuugc

SEQ ID NO: 84456 - RNA, 21 nt, Human
aaaacaaaaaccaaaaaaccc

SEQ ID NO: 84457 - RNA, 22 nt, Human
aaaaggagaaaaaaaaacaaaa

SEQ ID NO: 84458 - RNA, 23 nt, Human
aaaaggagaaaaaaaaacaaaaa

SEQ ID NO: 84459 - RNA, 26 nt, Human
aaaaggagaaaaaaaaacaaaaacaa

SEQ ID NO: 84460 - RNA, 24 nt, Human
aaaaggcagcgugcagaguaucau

SEQ ID NO: 84461 - RNA, 18 nt, Human
aaaaguacaacucauaca

SEQ ID NO: 84462 - RNA, 20 nt, Human
aaaauguaaacauuuccccc

SEQ ID NO: 84463 - RNA, 18 nt, Human
aaacaaaaacaaaaacca

SEQ ID NO: 84464 - RNA, 21 nt, Human
aaacaaaaacaaaaaccaaaa

SEQ ID NO: 84465 - RNA, 26 nt, Human
aaacaaaaacaaaaaccaaaaaaccc

SEQ ID NO: 84466 - RNA, 24 nt, Human
aaacaaaaaccaaaaaacccaaaa

SEQ ID NO: 84467 - RNA, 22 nt, Human
aaaccaaaaaacccaaaagcau

SEQ ID NO: 84468 - RNA, 23 nt, Human
aaaccaaacccccuccaauuggc

SEQ ID NO: 84469 - RNA, 25 nt, Human
aaacccaacagagucaaaagcucuc

SEQ ID NO: 84470 - RNA, 22 nt, Human
aaaguacaacucauacaaagca

SEQ ID NO: 84471 - RNA, 23 nt, Human
aaaguguucuuuauuuuuccuga

SEQ ID NO: 84472 - RNA, 21 nt, Human
aaauagguguuuccagaucuc

SEQ ID NO: 84473 - RNA, 22 nt, Human
aaaucauugugguauuuucccu

SEQ ID NO: 84474 - RNA, 22 nt, Human
aacaaaaaccaaaaaacccaaa

SEQ ID NO: 84475 - RNA, 19 nt, Human
aacagcugggaggcaggga

SEQ ID NO: 84476 - RNA, 24 nt, Human
aacucaguucacuuuucuggccuc

SEQ ID NO: 84477 - RNA, 21 nt, Human
aagagaacuucagcuucgguu

SEQ ID NO: 84478 - RNA, 21 nt, Human
aagcagauuauaacguggugc

SEQ ID NO: 84479 - RNA, 21 nt, Human
aagcaguucucuuuauagaac

SEQ ID NO: 84480 - RNA, 22 nt, Human
aagcgcucgacacuuguaaacg

SEQ ID NO: 84481 - RNA, 21 nt, Human
aagggcguuccgaaagcaagc

SEQ ID NO: 84482 - RNA, 22 nt, Human
aagugcuaggcaaccccaaacu

SEQ ID NO: 84483 - RNA, 22 nt, Human
aaguguuucaaaaaucugaaac

SEQ ID NO: 84484 - RNA, 19 nt, Human
acaaagcaagguuuaaaag

SEQ ID NO: 84485 - RNA, 20 nt, Human
acaaagcaagguuuaaaagu

SEQ ID NO: 84486 - RNA, 23 nt, Human
acacauucaaauaaaacccaaca

SEQ ID NO: 84487 - RNA, 21 nt, Human
acagccucgaacacugacauu

SEQ ID NO: 84488 - RNA, 18 nt, Human
accaaaaaacccaaaagc

SEQ ID NO: 84489 - RNA, 19 nt, Human
accaaacccccuccaauug

SEQ ID NO: 84490 - RNA, 23 nt, Human
acccccucccccccacccacucc

SEQ ID NO: 84491 - RNA, 23 nt, Human
acccuauguuuacacauuucaga

SEQ ID NO: 84492 - RNA, 19 nt, Human
acgggcgcgccggccccuc

SEQ ID NO: 84493 - RNA, 18 nt, Human
acucaguucacuuuucug

SEQ ID NO: 84494 - RNA, 24 nt, Human
acuuauucauccucugcauuagaa

SEQ ID NO: 84495 - RNA, 23 nt, Human
agaccaacaaaccuuuuucccca

SEQ ID NO: 84496 - RNA, 22 nt, Human
agagagugguuuugcuaaacaa

SEQ ID NO: 84497 - RNA, 27 nt, Human
agaggacaggggugauggucucaccag

SEQ ID NO: 84498 - RNA, 18 nt, Human
agaguaucauaagcagaa

SEQ ID NO: 84499 - RNA, 18 nt, Human
agcugggaggcagggaag

SEQ ID NO: 84500 - RNA, 19 nt, Human
agcugggaggcagggaagg

SEQ ID NO: 84501 - RNA, 18 nt, Human
aggaaggagaccaacaaa

SEQ ID NO: 84502 - RNA, 25 nt, Human
aggagaaaaaaaaacaaaaacaaaa

SEQ ID NO: 84503 - RNA, 26 nt, Human
aggagaaaaaaaaacaaaaacaaaaa

SEQ ID NO: 84504 - RNA, 22 nt, Human
aggcggcgcggacaaacuuggc

SEQ ID NO: 84505 - RNA, 19 nt, Human
agggggcgggggcgcgggg

SEQ ID NO: 84506 - RNA, 18 nt, Human
agugauggcuguuguauu

SEQ ID NO: 84507 - RNA, 21 nt, Human
auagggguugauuuuucuguu

SEQ ID NO: 84508 - RNA, 22 nt, Human
auggaagaacagauguccuuaa

SEQ ID NO: 84509 - RNA, 21 nt, Human
caaaaaccaaaaaacccaaaa

SEQ ID NO: 84510 - RNA, 24 nt, Human
caaaaaguacaacucauacaaagc

SEQ ID NO: 84511 - RNA, 27 nt, Human
caaccccaaacuccucacucacuaaaa

SEQ ID NO: 84512 - RNA, 23 nt, Human
cacaggaaggagaccaacaaacc

SEQ ID NO: 84513 - RNA, 21 nt, Human
cacauucaaauaaaacccaac

SEQ ID NO: 84514 - RNA, 21 nt, Human
cacccacucccuacccucccc

SEQ ID NO: 84515 - RNA, 22 nt, Human
cacccacucccuacccuccccc

SEQ ID NO: 84516 - RNA, 22 nt, Human
caccccgacgcggguggcgagg

SEQ ID NO: 84517 - RNA, 20 nt, Human
caccugagagugggaguuuu

SEQ ID NO: 84518 - RNA, 20 nt, Human
cacugugcgaggccacaggu

SEQ ID NO: 84519 - RNA, 19 nt, Human
cacuugaaaaggcaaguaa

SEQ ID NO: 84520 - RNA, 22 nt, Human
cagaacaucugcuucuauccuc

SEQ ID NO: 84521 - RNA, 24 nt, Human
cagcaucuguuguguauauucugc

SEQ ID NO: 84522 - RNA, 18 nt, Human
cagcccaggcggcgcgga

SEQ ID NO: 84523 - RNA, 18 nt, Human
cagucagaacggcuucgg

SEQ ID NO: 84524 - RNA, 23 nt, Human
caguuaagugacuuccugcaaac

SEQ ID NO: 84525 - RNA, 23 nt, Human
caucacgucacaaaccaaacccc

SEQ ID NO: 84526 - RNA, 18 nt, Human
ccaaaagcauuugccuuc

SEQ ID NO: 84527 - RNA, 22 nt, Human
ccaaacccccuccaauuggcca

SEQ ID NO: 84528 - RNA, 22 nt, Human
ccagaucucauuacuguuaugc

SEQ ID NO: 84529 - RNA, 21 nt, Human
ccagcggacauauguacacca

SEQ ID NO: 84530 - RNA, 26 nt, Human
ccagcucccaaacaguuaagugacuu

SEQ ID NO: 84531 - RNA, 19 nt, Human
ccagucccuaauguuaaaa

SEQ ID NO: 84532 - RNA, 23 nt, Human
ccaucacgucacaaaccaaaccc

SEQ ID NO: 84533 - RNA, 19 nt, Human
cccaggacauucacccgau

SEQ ID NO: 84534 - RNA, 19 nt, Human
cccaucacgucacaaacca

SEQ ID NO: 84535 - RNA, 23 nt, Human
cccaucacgucacaaaccaaacc

SEQ ID NO: 84536 - RNA, 21 nt, Human
cccaugaucacugcugacucc

SEQ ID NO: 84537 - RNA, 27 nt, Human
cccaugaucacugcugacuccccucau

SEQ ID NO: 84538 - RNA, 23 nt, Human
ccccacccacucccuacccuccc

SEQ ID NO: 84539 - RNA, 21 nt, Human
ccccccacccacucccuaccc

SEQ ID NO: 84540 - RNA, 24 nt, Human
ccccccacccacucccuacccucc

SEQ ID NO: 84541 - RNA, 21 nt, Human
cccccccacccacucccuacc

SEQ ID NO: 84542 - RNA, 22 nt, Human
cccccucccccccacccacucc

SEQ ID NO: 84543 - RNA, 22 nt, Human
ccccgcgccggccgcgaucccc

SEQ ID NO: 84544 - RNA, 25 nt, Human
ccccuccaauuggccaguggggagg

SEQ ID NO: 84545 - RNA, 21 nt, Human
ccccucccccccacccacucc

SEQ ID NO: 84546 - RNA, 18 nt, Human
ccccucugagccggcucc

SEQ ID NO: 84547 - RNA, 18 nt, Human
ccccucugagccggcucc

SEQ ID NO: 84548 - RNA, 19 nt, Human
cccuaauguuaaaagcagu

SEQ ID NO: 84549 - RNA, 21 nt, Human
cccuccuucuccuucagcauc

SEQ ID NO: 84550 - RNA, 19 nt, Human
cccucggccgccucgccgu

SEQ ID NO: 84551 - RNA, 22 nt, Human
ccgccgccucuagccgccgccc

SEQ ID NO: 84552 - RNA, 22 nt, Human
ccgcgaucccccgacgggcgcg

SEQ ID NO: 84553 - RNA, 20 nt, Human
ccgcgccgccgccucuagcc

SEQ ID NO: 84554 - RNA, 20 nt, Human
ccgcgccggccgcgaucccc

SEQ ID NO: 84555 - RNA, 18 nt, Human
ccuauggcaaaagagaac

SEQ ID NO: 84556 - RNA, 22 nt, Human
ccucccccccacccacucccua

SEQ ID NO: 84557 - RNA, 20 nt, Human
ccuccuggcucacguuccag

SEQ ID NO: 84558 - RNA, 21 nt, Human
cgacacuuguaaacgcgaaga

SEQ ID NO: 84559 - RNA, 24 nt, Human
cgagccaaagccccaggacauuca

SEQ ID NO: 84560 - RNA, 25 nt, Human
cgccggccccucugagccggcuccc

SEQ ID NO: 84561 - RNA, 21 nt, Human
cggagguucggcucgcccucc

SEQ ID NO: 84562 - RNA, 20 nt, Human
cggcuucgguggagaggugc

SEQ ID NO: 84563 - RNA, 25 nt, Human
cggcuucugaaccccugcuccggcc

SEQ ID NO: 84564 - RNA, 23 nt, Human
cgucacaaaccaaacccccucca

SEQ ID NO: 84565 - RNA, 21 nt, Human
cguuccggcauucucuugcuc

SEQ ID NO: 84566 - RNA, 26 nt, Human
cguuucgcugccucgugcuaccccua

SEQ ID NO: 84567 - RNA, 21 nt, Human
cuagagugcaccauagcuccc

SEQ ID NO: 84568 - RNA, 24 nt, Human
cucccccccacccacucccuaccc

SEQ ID NO: 84569 - RNA, 19 nt, Human
cuccgccgcgccgccgccu

SEQ ID NO: 84570 - RNA, 21 nt, Human
cuccuucuccuucagcaucug

SEQ ID NO: 84571 - RNA, 20 nt, Human
cugagagacagcaagcauaa

SEQ ID NO: 84572 - RNA, 22 nt, Human
cugguuccuguuuugugacauu

SEQ ID NO: 84573 - RNA, 18 nt, Human
cuuuuucuuuugcaaaac

SEQ ID NO: 84574 - RNA, 20 nt, Human
gaugacagaucaugcuggag

SEQ ID NO: 84575 - RNA, 20 nt, Human
gcaaaacacuacccuccuuc

SEQ ID NO: 84576 - RNA, 20 nt, Human
gccccaggacauucacccga

SEQ ID NO: 84577 - RNA, 21 nt, Human
gccuuacccccucccccccac

SEQ ID NO: 84578 - RNA, 19 nt, Human
gcgcggcggccaagggggc

SEQ ID NO: 84579 - RNA, 23 nt, Human
gcggcggccaagggggcgggggc

SEQ ID NO: 84580 - RNA, 22 nt, Human
gcgguggcugcggagguucggc

SEQ ID NO: 84581 - RNA, 28 nt, Human
ggaaacugcaagagaggugccgguaccc

SEQ ID NO: 84582 - RNA, 21 nt, Human
ggcgcggcggccaagggggcg

SEQ ID NO: 84583 - RNA, 18 nt, Human
ggcgggggcgcggggcgc

SEQ ID NO: 84584 - RNA, 23 nt, Human
ggcgguggcugcggagguucggc

SEQ ID NO: 84585 - RNA, 20 nt, Human
guaguaaauuugaguuaugg

SEQ ID NO: 84586 - RNA, 19 nt, Human
guuaaaaaaguaaacaaaa

SEQ ID NO: 84587 - RNA, 23 nt, Human
guugguucuuuucuuuuucuuuu

SEQ ID NO: 84588 - RNA, 18 nt, Human
guugguugaugucacugg

SEQ ID NO: 84589 - RNA, 18 nt, Human
uaaaacaaguugcugcau

SEQ ID NO: 84590 - RNA, 22 nt, Human
uaaaacccaacagagucaaaag

SEQ ID NO: 84591 - RNA, 25 nt, Human
uaaaacccaacagagucaaaagcuc

SEQ ID NO: 84592 - RNA, 22 nt, Human
uaaaacuauuaaauuuuccaga

SEQ ID NO: 84593 - RNA, 20 nt, Human
uaaaaggguaacagcuggga

SEQ ID NO: 84594 - RNA, 21 nt, Human
uaaaaucaucagaaagcguua

SEQ ID NO: 84595 - RNA, 20 nt, Human
uaaauuuuccagaauaugac

SEQ ID NO: 84596 - RNA, 19 nt, Human
uaaccaaagagaggagaua

SEQ ID NO: 84597 - RNA, 23 nt, Human
uaaguugguugaugucacugauc

SEQ ID NO: 84598 - RNA, 21 nt, Human
uaccccuacagccucgaacac

SEQ ID NO: 84599 - RNA, 22 nt, Human
uaggaaaauuuggaaaaguuaa

SEQ ID NO: 84600 - RNA, 21 nt, Human
uaggaacacaggaaggagacc

SEQ ID NO: 84601 - RNA, 22 nt, Human
uaggaacacaggaaggagacca

SEQ ID NO: 84602 - RNA, 19 nt, Human
uaguauuccauguugccug

SEQ ID NO: 84603 - RNA, 18 nt, Human
uagucuuucaaaaauuca

SEQ ID NO: 84604 - RNA, 20 nt, Human
uauuccauguugccugcauu

SEQ ID NO: 84605 - RNA, 23 nt, Human
uauuggaaguuggagucagccgu

SEQ ID NO: 84606 - RNA, 24 nt, Human
ucaacucacccagcggacauaugu

SEQ ID NO: 84607 - RNA, 19 nt, Human
ucaguucacuuuucuggcc

SEQ ID NO: 84608 - RNA, 20 nt, Human
ucauuccacaauggugaagg

SEQ ID NO: 84609 - RNA, 25 nt, Human
uccauggucuuuuuaauauaaaaag

SEQ ID NO: 84610 - RNA, 20 nt, Human
ucccagcaaccagccuucca

SEQ ID NO: 84611 - RNA, 23 nt, Human
ucccaucacgucacaaaccaaac

SEQ ID NO: 84612 - RNA, 19 nt, Human
ucccauggacugcucccag

SEQ ID NO: 84613 - RNA, 24 nt, Human
uccccuaguggcauuaggauacaa

SEQ ID NO: 84614 - RNA, 22 nt, Human
ucccguggccgguccgggccuc

SEQ ID NO: 84615 - RNA, 20 nt, Human
ucccuacccucccccgcaaa

SEQ ID NO: 84616 - RNA, 21 nt, Human
uccgccgcgccgccgccucua

SEQ ID NO: 84617 - RNA, 25 nt, Human
uccgccgcgccgccgccucuagccg

SEQ ID NO: 84618 - RNA, 21 nt, Human
ucgugagaaaacacuuuccuu

SEQ ID NO: 84619 - RNA, 19 nt, Human
ucuauaauuaaaaaaaccc

SEQ ID NO: 84620 - RNA, 18 nt, Human
ucuguuuacuuucucccc

SEQ ID NO: 84621 - RNA, 18 nt, Human
ucuuaacuacaaaacuca

SEQ ID NO: 84622 - RNA, 24 nt, Human
ugaaauagguaggcacccuauguu

SEQ ID NO: 84623 - RNA, 18 nt, Human
ugaauaaaugcaguguga

SEQ ID NO: 84624 - RNA, 24 nt, Human
ugaaucagaaacgaguauggguca

SEQ ID NO: 84625 - RNA, 18 nt, Human
ugacccgcgcccacugca

SEQ ID NO: 84626 - RNA, 19 nt, Human
ugacccgcgcccacugcag

SEQ ID NO: 84627 - RNA, 19 nt, Human
ugagaggacaggggugaug

SEQ ID NO: 84628 - RNA, 25 nt, Human
ugagcucagugagaaauaggcagcc

SEQ ID NO: 84629 - RNA, 21 nt, Human
ugaucacugcugacuccccuc

SEQ ID NO: 84630 - RNA, 24 nt, Human
ugauguuaacuaaaagcauaggaa

SEQ ID NO: 84631 - RNA, 19 nt, Human
ugcagugugaaucuauaau

SEQ ID NO: 84632 - RNA, 22 nt, Human
uggaaagaugccacacguggcg

SEQ ID NO: 84633 - RNA, 18 nt, Human
uggagucagccgugaccc

SEQ ID NO: 84634 - RNA, 20 nt, Human
uggcgagggccccgccgagc

SEQ ID NO: 84635 - RNA, 24 nt, Human
uggcgguggcugcggagguucggc

SEQ ID NO: 84636 - RNA, 18 nt, Human
uggcuguuguauuggaag

SEQ ID NO: 84637 - RNA, 20 nt, Human
ugggaaguaaaugugcauuu

SEQ ID NO: 84638 - RNA, 20 nt, Human
ugggaguacuuuuguccuuu

SEQ ID NO: 84639 - RNA, 19 nt, Human
ugguauuuucccuuggugu

SEQ ID NO: 84640 - RNA, 21 nt, Human
ugguguucacuaguuauaggg

SEQ ID NO: 84641 - RNA, 20 nt, Human
uguagugaaacuggacacau

SEQ ID NO: 84642 - RNA, 20 nt, Human
ugugcuauggcguuuuuuuu

SEQ ID NO: 84643 - RNA, 22 nt, Human
uuaaaauaaguguuucaaaaau

SEQ ID NO: 84644 - RNA, 21 nt, Human
uuaaucucaaaaguuaacgug

SEQ ID NO: 84645 - RNA, 20 nt, Human
uucagguaaauggcauagau

SEQ ID NO: 84646 - RNA, 25 nt, Human
uuggcgguggcugcggagguucggc

SEQ ID NO: 84647 - RNA, 22 nt, Human
uugguuuaaaauaaguguuuca

SEQ ID NO: 84648 - RNA, 18 nt, Human
uuuaaaaguucuguacuu

SEQ ID NO: 84649 - RNA, 24 nt, Human
uuuucuguuccuauuucagcuccc

SEQ ID NO: 84650 - RNA, 22 nt, Human
accuccacuuucuaaaaauaag

SEQ ID NO: 84651 - RNA, 18 nt, Human
agaagaaaaauuucucau

SEQ ID NO: 84652 - RNA, 20 nt, Human
agaggaagagagggcgugag

SEQ ID NO: 84653 - RNA, 23 nt, Human
agauaagaaacgauuuauuauag

SEQ ID NO: 84654 - RNA, 22 nt, Human
agccuguugccauggcagauuc

SEQ ID NO: 84655 - RNA, 19 nt, Human
aggaagagacgagcgaugg

SEQ ID NO: 84656 - RNA, 19 nt, Human
aggaggcggcaggagagag

SEQ ID NO: 84657 - RNA, 23 nt, Human
caaaaacacaauacaaggucuga

SEQ ID NO: 84658 - RNA, 18 nt, Human
cacaucgcucggaccucc

SEQ ID NO: 84659 - RNA, 24 nt, Human
cacccaaagcaaaaaucaaauuua

SEQ ID NO: 84660 - RNA, 24 nt, Human
cauccccaagaggagcccacccaa

SEQ ID NO: 84661 - RNA, 22 nt, Human
ccaaagcaaaaaucaaauuuau

SEQ ID NO: 84662 - RNA, 19 nt, Human
ccauccccaagaggagccc

SEQ ID NO: 84663 - RNA, 21 nt, Human
ccauccccaagaggagcccac

SEQ ID NO: 84664 - RNA, 25 nt, Human
cccaggucaugcuuacuaguuuguc

SEQ ID NO: 84665 - RNA, 21 nt, Human
ccccagcugccuccgccucca

SEQ ID NO: 84666 - RNA, 22 nt, Human
ccgcagcauucgaagaucucaa

SEQ ID NO: 84667 - RNA, 20 nt, Human
cgacacaggaggcggcagga

SEQ ID NO: 84668 - RNA, 19 nt, Human
cggaaggcugagaggaaga

SEQ ID NO: 84669 - RNA, 19 nt, Human
cggaccuccccagcugccu

SEQ ID NO: 84670 - RNA, 22 nt, Human
cggcgugcgggggcggcccggg

SEQ ID NO: 84671 - RNA, 23 nt, Human
cggcgugcgggggcggcccgggg

SEQ ID NO: 84672 - RNA, 20 nt, Human
cuucacagcugugacauggu

SEQ ID NO: 84673 - RNA, 24 nt, Human
gagaaagauucuuugaaauacaga

SEQ ID NO: 84674 - RNA, 18 nt, Human
gagauuuacugcagagaa

SEQ ID NO: 84675 - RNA, 22 nt, Human
gcaaaaaucaaauuuauggauc

SEQ ID NO: 84676 - RNA, 23 nt, Human
gcaaaaaucaaauuuauggauca

SEQ ID NO: 84677 - RNA, 18 nt, Human
gccaaaaacacaauacaa

SEQ ID NO: 84678 - RNA, 19 nt, Human
gcgugcgggggcggcccgg

SEQ ID NO: 84679 - RNA, 24 nt, Human
ggaccuccccagcugccuccgccu

SEQ ID NO: 84680 - RNA, 21 nt, Human
ggccccgacggcggagcagcc

SEQ ID NO: 84681 - RNA, 22 nt, Human
ggcggcaggagagaggaagaga

SEQ ID NO: 84682 - RNA, 23 nt, Human
gggcggcgugcgggggcggcccg

SEQ ID NO: 84683 - RNA, 20 nt, Human
gugcgggggcggcccggggc

SEQ ID NO: 84684 - RNA, 21 nt, Human
uaaaauuuccaguacuaccau

SEQ ID NO: 84685 - RNA, 23 nt, Human
uaauuuaccaaauaaaagaugac

SEQ ID NO: 84686 - RNA, 23 nt, Human
uagaaaacuacaagcuagcaaau

SEQ ID NO: 84687 - RNA, 21 nt, Human
uauagagagaagaaaaauuuc

SEQ ID NO: 84688 - RNA, 24 nt, Human
uauggcacugucacuuaaaauuuu

SEQ ID NO: 84689 - RNA, 26 nt, Human
ucaccgggcggaaggcugagaggaag

SEQ ID NO: 84690 - RNA, 18 nt, Human
ucauccaaaauauagaaa

SEQ ID NO: 84691 - RNA, 19 nt, Human
ucauccaaaauauagaaau

SEQ ID NO: 84692 - RNA, 18 nt, Human
uccccagcugccuccgcc

SEQ ID NO: 84693 - RNA, 22 nt, Human
ucgcucggaccuccccagcugc

SEQ ID NO: 84694 - RNA, 25 nt, Human
ucuaaaaauaagaaguuuacucagu

SEQ ID NO: 84695 - RNA, 19 nt, Human
ugacuaacaaaguucacaa

SEQ ID NO: 84696 - RNA, 25 nt, Human
ugagaggaagagagggcgugagggg

SEQ ID NO: 84697 - RNA, 22 nt, Human
ugcaaauuccccugcgagauuu

SEQ ID NO: 84698 - RNA, 21 nt, Human
ugcgagauuuacugcagagaa

SEQ ID NO: 84699 - RNA, 22 nt, Human
uggcacugucacuuaaaauuuu

SEQ ID NO: 84700 - RNA, 21 nt, Human
ugggagaaacugaaaccaccc

SEQ ID NO: 84701 - RNA, 23 nt, Human
ugggagaaacugaaaccacccua

SEQ ID NO: 84702 - RNA, 18 nt, Human
uggggcucggcggcgcgg

SEQ ID NO: 84703 - RNA, 23 nt, Human
uguacagagagcuggcuggugcu

SEQ ID NO: 84704 - RNA, 23 nt, Human
ugucacuuaaaauuuuuuuuuuu

SEQ ID NO: 84705 - RNA, 20 nt, Human
uuccucaccgggcggaaggc

SEQ ID NO: 84706 - RNA, 19 nt, Human
uuggacucacaggcuauua

SEQ ID NO: 84707 - RNA, 24 nt, Human
uuuuuuuuuuuaccauucuaucuu

SEQ ID NO: 84708 - RNA, 22 nt, Human
aaaaggaggcagagcuggcagg

SEQ ID NO: 84709 - RNA, 20 nt, Human
aaagcagcacuagcaaagca

SEQ ID NO: 84710 - RNA, 21 nt, Human
aaauacgguagcucuaugacc

SEQ ID NO: 84711 - RNA, 22 nt, Human
aaccuugcuugcucccucucac

SEQ ID NO: 84712 - RNA, 23 nt, Human
aacuuuugguuucuuuuccuccu

SEQ ID NO: 84713 - RNA, 19 nt, Human
aagaagagaagagagacaa

SEQ ID NO: 84714 - RNA, 22 nt, Human
aagcaauaaagacuggaagcag

SEQ ID NO: 84715 - RNA, 21 nt, Human
aagcccaccagggcaucagga

SEQ ID NO: 84716 - RNA, 20 nt, Human
aagggaagggggaggggagg

SEQ ID NO: 84717 - RNA, 23 nt, Human
aauaaccuccaguucccuccucc

SEQ ID NO: 84718 - RNA, 21 nt, Human
aauguggagaguugaaaagga

SEQ ID NO: 84719 - RNA, 23 nt, Human
acaaagcagcacuagcaaagcaa

SEQ ID NO: 84720 - RNA, 22 nt, Human
acagacagcaaccuuucccaca

SEQ ID NO: 84721 - RNA, 18 nt, Human
acagacucaagcacgcac

SEQ ID NO: 84722 - RNA, 22 nt, Human
accccaauaaccuccaguuccc

SEQ ID NO: 84723 - RNA, 20 nt, Human
accuggaguucccuguagcu

SEQ ID NO: 84724 - RNA, 26 nt, Human
agaaaagauaacauaguauuguuuaa

SEQ ID NO: 84725 - RNA, 21 nt, Human
agaagggaagggggaggggag

SEQ ID NO: 84726 - RNA, 19 nt, Human
agacucaagcacgcaacag

SEQ ID NO: 84727 - RNA, 21 nt, Human
agagacaagauuaagcaugag

SEQ ID NO: 84728 - RNA, 19 nt, Human
agagacaggccugcucaac

SEQ ID NO: 84729 - RNA, 20 nt, Human
agaggaaguggggugaagau

SEQ ID NO: 84730 - RNA, 19 nt, Human
agaggagaguugugcuuuu

SEQ ID NO: 84731 - RNA, 23 nt, Human
agaggccuuuucacucucugccc

SEQ ID NO: 84732 - RNA, 18 nt, Human
agaguugaaaaggaggca

SEQ ID NO: 84733 - RNA, 22 nt, Human
agcaggaggguggccauccugg

SEQ ID NO: 84734 - RNA, 18 nt, Human
agccaaggaauacaugca

SEQ ID NO: 84735 - RNA, 22 nt, Human
aggaagggaguuucuucccagu

SEQ ID NO: 84736 - RNA, 21 nt, Human
aggagagacaggccugcucaa

SEQ ID NO: 84737 - RNA, 21 nt, Human
aggcaauacaaaauguggaga

SEQ ID NO: 84738 - RNA, 24 nt, Human
aggcagacacuggcucacagacuc

SEQ ID NO: 84739 - RNA, 21 nt, Human
agggaugcaggugucuggcug

SEQ ID NO: 84740 - RNA, 20 nt, Human
aguaauagaggagccaggga

SEQ ID NO: 84741 - RNA, 20 nt, Human
caaagcagcacuagcaaagc

SEQ ID NO: 84742 - RNA, 19 nt, Human
caagaauaccaaguagucu

SEQ ID NO: 84743 - RNA, 19 nt, Human
cacaaaccagaaaauuagc

SEQ ID NO: 84744 - RNA, 19 nt, Human
cacagacucaagcacgcaa

SEQ ID NO: 84745 - RNA, 24 nt, Human
caccagggagaaaaaacagugccc

SEQ ID NO: 84746 - RNA, 18 nt, Human
cacuagcaaagcaaaggu

SEQ ID NO: 84747 - RNA, 20 nt, Human
cacucucccauucagccaag

SEQ ID NO: 84748 - RNA, 21 nt, Human
cagaauagcuuacaaacauac

SEQ ID NO: 84749 - RNA, 22 nt, Human
cagacagcaaccuuucccacag

SEQ ID NO: 84750 - RNA, 21 nt, Human
cagcagcaucaagacuuucau

SEQ ID NO: 84751 - RNA, 20 nt, Human
cagcaggaggguggccaucc

SEQ ID NO: 84752 - RNA, 18 nt, Human
caggaggguggccauccu

SEQ ID NO: 84753 - RNA, 25 nt, Human
cagggcaaaucccgaccucucuguu

SEQ ID NO: 84754 - RNA, 20 nt, Human
caguucccuccucccccccu

SEQ ID NO: 84755 - RNA, 19 nt, Human
ccaagcagcucccuugaag

SEQ ID NO: 84756 - RNA, 21 nt, Human
ccacuuccaagcagcucccuu

SEQ ID NO: 84757 - RNA, 24 nt, Human
cccaauaaccuccaguucccuccu

SEQ ID NO: 84758 - RNA, 22 nt, Human
cccacaaaccagaaaauuagcu

SEQ ID NO: 84759 - RNA, 19 nt, Human
ccccaauaaccuccaguuc

SEQ ID NO: 84760 - RNA, 20 nt, Human
ccccagggcaaaucccgacc

SEQ ID NO: 84761 - RNA, 22 nt, Human
cccccagggcaaaucccgaccu

SEQ ID NO: 84762 - RNA, 21 nt, Human
cccccuaacagcucccccucc

SEQ ID NO: 84763 - RNA, 22 nt, Human
ccccucagaaaacccaaagcuu

SEQ ID NO: 84764 - RNA, 18 nt, Human
cccuaacagcucccccuc

SEQ ID NO: 84765 - RNA, 21 nt, Human
ccucccccccucagaaaaccc

SEQ ID NO: 84766 - RNA, 24 nt, Human
ccucucuuccucccccagggcaaa

SEQ ID NO: 84767 - RNA, 20 nt, Human
ccuggccaaaugcccuagcc

SEQ ID NO: 84768 - RNA, 21 nt, Human
ccuggccaaaugcccuagccc

SEQ ID NO: 84769 - RNA, 22 nt, Human
ccuggccaaaugcccuagcccu

SEQ ID NO: 84770 - RNA, 23 nt, Human
ccuuccauccuaaccccaauaac

SEQ ID NO: 84771 - RNA, 18 nt, Human
ccuugcuugcucccucuc

SEQ ID NO: 84772 - RNA, 20 nt, Human
ccuuggcuaggucuaccccc

SEQ ID NO: 84773 - RNA, 18 nt, Human
cgcccagggcgggggcgg

SEQ ID NO: 84774 - RNA, 18 nt, Human
cucccucucacaucuucc

SEQ ID NO: 84775 - RNA, 23 nt, Human
cugaacuuggccucucuuccucc

SEQ ID NO: 84776 - RNA, 27 nt, Human
cuuacaaacauacuacuacuauuuauu

SEQ ID NO: 84777 - RNA, 24 nt, Human
cuuccauauaaaaacacuaucaua

SEQ ID NO: 84778 - RNA, 18 nt, Human
cuugcagaacauggggca

SEQ ID NO: 84779 - RNA, 20 nt, Human
cuugcucccucucacaucuu

SEQ ID NO: 84780 - RNA, 22 nt, Human
cuugggucugugggcccaaagu

SEQ ID NO: 84781 - RNA, 23 nt, Human
gaaaagaaggcaguaauaaagga

SEQ ID NO: 84782 - RNA, 21 nt, Human
gaaagcaacaucuacaggccc

SEQ ID NO: 84783 - RNA, 22 nt, Human
gaagggaagggggaggggaggg

SEQ ID NO: 84784 - RNA, 19 nt, Human
gagaaaaaacagugcccaa

SEQ ID NO: 84785 - RNA, 19 nt, Human
gaguaauagaggagccagg

SEQ ID NO: 84786 - RNA, 24 nt, Human
gcaaagcaaagguuuugugcagag

SEQ ID NO: 84787 - RNA, 18 nt, Human
gcaacagcaggagggugg

SEQ ID NO: 84788 - RNA, 18 nt, Human
gcaggagagaugguuccc

SEQ ID NO: 84789 - RNA, 23 nt, Human
gccaaaugcccuagcccuguccu

SEQ ID NO: 84790 - RNA, 20 nt, Human
gccuuuucacucucugccca

SEQ ID NO: 84791 - RNA, 18 nt, Human
gcucugagcaccagggag

SEQ ID NO: 84792 - RNA, 23 nt, Human
gcuguggggaggagaaccugggg

SEQ ID NO: 84793 - RNA, 18 nt, Human
ggaaagcaacaucuacag

SEQ ID NO: 84794 - RNA, 23 nt, Human
ggaaggcaauacaaaauguggag

SEQ ID NO: 84795 - RNA, 18 nt, Human
ggaagggggaggggaggg

SEQ ID NO: 84796 - RNA, 22 nt, Human
ggcugggggagacagagagcuc

SEQ ID NO: 84797 - RNA, 18 nt, Human
gggaagggggaggggagg

SEQ ID NO: 84798 - RNA, 18 nt, Human
gggcaaaucccgaccucu

SEQ ID NO: 84799 - RNA, 20 nt, Human
gggcaacagcaggagggugg

SEQ ID NO: 84800 - RNA, 19 nt, Human
ggggacuggcuguggggag

SEQ ID NO: 84801 - RNA, 27 nt, Human
gucuacccccuaacagcucccccuccu

SEQ ID NO: 84802 - RNA, 21 nt, Human
gugguggccuguugucacggc

SEQ ID NO: 84803 - RNA, 20 nt, Human
guucccuccucccccccuca

SEQ ID NO: 84804 - RNA, 23 nt, Human
uaaagcaauaaagacuggaagca

SEQ ID NO: 84805 - RNA, 21 nt, Human
uaaaggaccuggaguucccug

SEQ ID NO: 84806 - RNA, 23 nt, Human
uaaauagcaccuuugagucaaaa

SEQ ID NO: 84807 - RNA, 19 nt, Human
uaaccuccaguucccuccu

SEQ ID NO: 84808 - RNA, 20 nt, Human
uaaguccaggcaugaaugcc

SEQ ID NO: 84809 - RNA, 23 nt, Human
uacaagaauaccaaguagucuug

SEQ ID NO: 84810 - RNA, 21 nt, Human
uagaaaauacgguagcucuau

SEQ ID NO: 84811 - RNA, 18 nt, Human
uagccagccaucauccca

SEQ ID NO: 84812 - RNA, 26 nt, Human
uagugucggcccuacaagaauaccaa

SEQ ID NO: 84813 - RNA, 24 nt, Human
uauuaaaguaacaaaaagguguac

SEQ ID NO: 84814 - RNA, 21 nt, Human
ucacucucugcccaggaccuc

SEQ ID NO: 84815 - RNA, 19 nt, Human
ucacugagaaauugaagga

SEQ ID NO: 84816 - RNA, 20 nt, Human
uccaagcagcucccuugaag

SEQ ID NO: 84817 - RNA, 24 nt, Human
ucccuccucccccccucagaaaac

SEQ ID NO: 84818 - RNA, 18 nt, Human
uccugggacccagggggc

SEQ ID NO: 84819 - RNA, 20 nt, Human
ucgggcucagugagaggucu

SEQ ID NO: 84820 - RNA, 22 nt, Human
ucuacaggccccugaggguaga

SEQ ID NO: 84821 - RNA, 25 nt, Human
ugaaaaggaggcagagcuggcagga

SEQ ID NO: 84822 - RNA, 21 nt, Human
ugagacagacagcaaccuuuc

SEQ ID NO: 84823 - RNA, 22 nt, Human
ugagacagacagcaaccuuucc

SEQ ID NO: 84824 - RNA, 27 nt, Human
uggauacucuuugggucccaaaauuuc

SEQ ID NO: 84825 - RNA, 19 nt, Human
uggcaggaauggguaggag

SEQ ID NO: 84826 - RNA, 21 nt, Human
uggcaggaauggguagggaga

SEQ ID NO: 84827 - RNA, 19 nt, Human
uggccaaaaaacaucccca

SEQ ID NO: 84828 - RNA, 26 nt, Human
uggccaaaaaacauccccaguggaua

SEQ ID NO: 84829 - RNA, 21 nt, Human
uggcuggaaagcaacaucuac

SEQ ID NO: 84830 - RNA, 24 nt, Human
ugggaaggcaauacaaaaugugga

SEQ ID NO: 84831 - RNA, 20 nt, Human
ugucacggcagcaugagcac

SEQ ID NO: 84832 - RNA, 23 nt, Human
uuagaaaaauaaaagaaaagaua

SEQ ID NO: 84833 - RNA, 24 nt, Human
uuaggacaguaggaaucaggagag

SEQ ID NO: 84834 - RNA, 25 nt, Human
uuauuaaaguaacaaaaagguguac

SEQ ID NO: 84835 - RNA, 22 nt, Human
uucaacccacaaaccagaaaau

SEQ ID NO: 84836 - RNA, 20 nt, Human
uucacaguugcuaaccuugc

SEQ ID NO: 84837 - RNA, 19 nt, Human
uugaaaaggaggcagagcu

SEQ ID NO: 84838 - RNA, 21 nt, Human
uuugccacacauacacacaaa

SEQ ID NO: 84839 - RNA, 20 nt, Human
uuugguuucuuuuccuccuu

SEQ ID NO: 84840 - RNA, 20 nt, Human
aaauagauuuccuuguauau

SEQ ID NO: 84841 - RNA, 21 nt, Human
aacaugacaccaacacaauca

SEQ ID NO: 84842 - RNA, 24 nt, Human
aauuucucaaacuauaucaauauc

SEQ ID NO: 84843 - RNA, 21 nt, Human
caacuacaugauuucacacaa

SEQ ID NO: 84844 - RNA, 26 nt, Human
caacuacaugauuucacacaauucuc

SEQ ID NO: 84845 - RNA, 19 nt, Human
caugacaccaacacaauca

SEQ ID NO: 84846 - RNA, 19 nt, Human
cccagaccguguccuggcc

SEQ ID NO: 84847 - RNA, 19 nt, Human
cccgcgcugggcaacaggg

SEQ ID NO: 84848 - RNA, 18 nt, Human
ccgccgcugccgccgccg

SEQ ID NO: 84849 - RNA, 19 nt, Human
ccgccgcugccgccgccgc

SEQ ID NO: 84850 - RNA, 22 nt, Human
ccgccgcugccgccgccgcucu

SEQ ID NO: 84851 - RNA, 18 nt, Human
ccgcucuucggccggaga

SEQ ID NO: 84852 - RNA, 23 nt, Human
ccggcgcgugcggcucccgcguc

SEQ ID NO: 84853 - RNA, 21 nt, Human
cgacauaaaauagauuuccuu

SEQ ID NO: 84854 - RNA, 18 nt, Human
cgccgcugccgccgccgc

SEQ ID NO: 84855 - RNA, 19 nt, Human
cugccgccgccgcucuucg

SEQ ID NO: 84856 - RNA, 22 nt, Human
gacaccaacacaaucaaaaacg

SEQ ID NO: 84857 - RNA, 20 nt, Human
ggcaacagggagcgcagcga

SEQ ID NO: 84858 - RNA, 22 nt, Human
ggccggagauucggcggcccag

SEQ ID NO: 84859 - RNA, 19 nt, Human
ggccgggaacugagggcuc

SEQ ID NO: 84860 - RNA, 23 nt, Human
uaaaacaaaucguccacuucuac

SEQ ID NO: 84861 - RNA, 24 nt, Human
uauuugcaacuacaugauuucaca

SEQ ID NO: 84862 - RNA, 24 nt, Human
ucaaaggggcuaaaacaaaucguc

SEQ ID NO: 84863 - RNA, 20 nt, Human
ucccgccgcugccgccgccg

SEQ ID NO: 84864 - RNA, 20 nt, Human
uccggcgcgugcggcucccg

SEQ ID NO: 84865 - RNA, 21 nt, Human
uccuggccgggaacugagggc

SEQ ID NO: 84866 - RNA, 24 nt, Human
ugccucaaacuauuuuuuauuugc

SEQ ID NO: 84867 - RNA, 20 nt, Human
uggcccaucuaacuucacua

SEQ ID NO: 84868 - RNA, 23 nt, Human
uuucccgccgcugccgccgccgc

SEQ ID NO: 84869 - RNA, 21 nt, Human
uuuucccgccgcugccgccgc

SEQ ID NO: 84870 - RNA, 22 nt, Human
uuuuuucccgccgcugccgcua

SEQ ID NO: 84871 - RNA, 23 nt, Human
uuuuuuuuuuuuuuuugccucaa

SEQ ID NO: 84872 - RNA, 18 nt, Human
uuuuuuuuuuuuuuuuug

SEQ ID NO: 84873 - RNA, 21 nt, Human
uuuuuuuuuuuuuuuuugccu

SEQ ID NO: 84874 - RNA, 19 nt, Human
aaggugccuucuucuacca

SEQ ID NO: 84875 - RNA, 22 nt, Human
aggcagugccuuccaaggugcc

SEQ ID NO: 84876 - RNA, 22 nt, Human
auuucuucucaucuuccugcca

SEQ ID NO: 84877 - RNA, 19 nt, Human
cagugccuuccaaggugcc

SEQ ID NO: 84878 - RNA, 21 nt, Human
cagugccuuccaaggugccuu

SEQ ID NO: 84879 - RNA, 25 nt, Human
ccugaagauuucuucucaucuuccu

SEQ ID NO: 84880 - RNA, 20 nt, Human
cuucucaucuuccugccaug

SEQ ID NO: 84881 - RNA, 24 nt, Human
uaccaggugcugcaaauucauucc

SEQ ID NO: 84882 - RNA, 26 nt, Human
ucacccugaagauuucuucucaucuu

SEQ ID NO: 84883 - RNA, 23 nt, Human
uccaaggugccuucuucuaccag

SEQ ID NO: 84884 - RNA, 23 nt, Human
uuuuuuauucuuuucaggcucca

SEQ ID NO: 84885 - RNA, 24 nt, Human
aaaacacccuccccucccaucuuu

SEQ ID NO: 84886 - RNA, 24 nt, Human
aaaacacccuccccucccaucuuu

SEQ ID NO: 84887 - RNA, 23 nt, Human
aauuuuuuggccuuugcucagaa

SEQ ID NO: 84888 - RNA, 19 nt, Human
acacacccccaagcucuac

SEQ ID NO: 84889 - RNA, 21 nt, Human
acacccccaagcucuaccaaa

SEQ ID NO: 84890 - RNA, 20 nt, Human
acuuggaaggugggacucga

SEQ ID NO: 84891 - RNA, 26 nt, Human
cacacacacccccaagcucuaccaaa

SEQ ID NO: 84892 - RNA, 18 nt, Human
cacccccaagcucuacca

SEQ ID NO: 84893 - RNA, 19 nt, Human
cacccccaagcucuaccaa

SEQ ID NO: 84894 - RNA, 20 nt, Human
cacccuccccucccaucuuu

SEQ ID NO: 84895 - RNA, 24 nt, Human
cacccuccccucccaucuuuauga

SEQ ID NO: 84896 - RNA, 22 nt, Human
cagaagccacuaucccagggaa

SEQ ID NO: 84897 - RNA, 19 nt, Human
cccacacacacacccccaa

SEQ ID NO: 84898 - RNA, 20 nt, Human
cccagauguagagaggggcc

SEQ ID NO: 84899 - RNA, 21 nt, Human
cccccaagcucuaccaaaugc

SEQ ID NO: 84900 - RNA, 21 nt, Human
cccccacacacacacccccaa

SEQ ID NO: 84901 - RNA, 19 nt, Human
cccuccccucccaucuuua

SEQ ID NO: 84902 - RNA, 22 nt, Human
cuggaguucaccugugugcuca

SEQ ID NO: 84903 - RNA, 24 nt, Human
cuugccaaauucgguccaccccca

SEQ ID NO: 84904 - RNA, 22 nt, Human
gcuuguggagaagagaaguaga

SEQ ID NO: 84905 - RNA, 28 nt, Human
uauuuuaucaaaacacccuccccuccca

SEQ ID NO: 84906 - RNA, 22 nt, Human
uccacccccacacacacacccc

SEQ ID NO: 84907 - RNA, 24 nt, Human
uccacccccacacacacaccccca

SEQ ID NO: 84908 - RNA, 18 nt, Human
ugagaugccaggacuugg

SEQ ID NO: 84909 - RNA, 23 nt, Human
ugccaaauucgguccacccccac

SEQ ID NO: 84910 - RNA, 18 nt, Human
ugcucaguccugacuuaa

SEQ ID NO: 84911 - RNA, 20 nt, Human
uuggaaggugggacucgauc

SEQ ID NO: 84912 - RNA, 20 nt, Human
uuuacauccucccuccuaaa

SEQ ID NO: 84913 - RNA, 19 nt, Human
uuugcucagaagccacuau

SEQ ID NO: 84914 - RNA, 18 nt, Human
uuuggccuuugcucagaa

SEQ ID NO: 84915 - RNA, 23 nt, Human
uuuuuuaagcuuucuagaauuua

SEQ ID NO: 84916 - RNA, 23 nt, Human
uuuuuuuuuuuuuuuuaagcuuu

SEQ ID NO: 84917 - RNA, 22 nt, Human
uuuuuuuuuuuuuuuuuuuaag

SEQ ID NO: 84918 - RNA, 23 nt, Human
aaacuaaaccuaaugugagucua

SEQ ID NO: 84919 - RNA, 21 nt, Human
aacacaucauuagcaaacacu

SEQ ID NO: 84920 - RNA, 25 nt, Human
aaccucagcgcagaagaacuucagc

SEQ ID NO: 84921 - RNA, 25 nt, Human
acacugugcccucaaaccugcaagc

SEQ ID NO: 84922 - RNA, 21 nt, Human
aggcaggaaucacuguccgug

SEQ ID NO: 84923 - RNA, 25 nt, Human
cacaaacuaaaccuaaugugagucu

SEQ ID NO: 84924 - RNA, 24 nt, Human
caggcuccggagaggaagcugggg

SEQ ID NO: 84925 - RNA, 22 nt, Human
cagggguggauggaugauuugg

SEQ ID NO: 84926 - RNA, 23 nt, Human
cagggucaggccaauccccccuc

SEQ ID NO: 84927 - RNA, 24 nt, Human
ccaauccccccucaucuggaagcu

SEQ ID NO: 84928 - RNA, 23 nt, Human
ccugugaggcaggaaucacuguc

SEQ ID NO: 84929 - RNA, 19 nt, Human
cucccuaaaggagaguggg

SEQ ID NO: 84930 - RNA, 19 nt, Human
cuggggccaccugucggga

SEQ ID NO: 84931 - RNA, 18 nt, Human
ggaauaagcaaacagagu

SEQ ID NO: 84932 - RNA, 18 nt, Human
ggagccugggagguugug

SEQ ID NO: 84933 - RNA, 23 nt, Human
gugaggcaggaaucacuguccgu

SEQ ID NO: 84934 - RNA, 19 nt, Human
guggagaggcucuucauga

SEQ ID NO: 84935 - RNA, 27 nt, Human
uaaaaacacaucauuagcaaacacugu

SEQ ID NO: 84936 - RNA, 22 nt, Human
uaaaggagaguggggggcguga

SEQ ID NO: 84937 - RNA, 23 nt, Human
uagcaaacacugugcccucaaac

SEQ ID NO: 84938 - RNA, 19 nt, Human
ucaccugugaggcaggaau

SEQ ID NO: 84939 - RNA, 24 nt, Human
ucaggccagcugucucaggcgcag

SEQ ID NO: 84940 - RNA, 21 nt, Human
ucaucuggaagcugugacugc

SEQ ID NO: 84941 - RNA, 18 nt, Human
uccggagaggaagcuggg

SEQ ID NO: 84942 - RNA, 23 nt, Human
uccgugacuagcaaaugaggagc

SEQ ID NO: 84943 - RNA, 18 nt, Human
ucugugcgcaggcuccgg

SEQ ID NO: 84944 - RNA, 24 nt, Human
ucugugguguggggcccuuuaagc

SEQ ID NO: 84945 - RNA, 26 nt, Human
ugcccucaaaccugcaagcaugauuc

SEQ ID NO: 84946 - RNA, 22 nt, Human
uggauggaugauuuggagguca

SEQ ID NO: 84947 - RNA, 22 nt, Human
uggcuucugacucccacagggu

SEQ ID NO: 84948 - RNA, 19 nt, Human
ugugacugccgcugcugca

SEQ ID NO: 84949 - RNA, 21 nt, Human
uucaagaucgcuuagcuggau

SEQ ID NO: 84950 - RNA, 22 nt, Human
aagucaccuuugucuggaacca

SEQ ID NO: 84951 - RNA, 23 nt, Human
aagucaccuuugucuggaaccaa

SEQ ID NO: 84952 - RNA, 23 nt, Human
agaggugaaaggaggagaggagg

SEQ ID NO: 84953 - RNA, 18 nt, Human
aggaggagaggaggggag

SEQ ID NO: 84954 - RNA, 20 nt, Human
caguaguuugauuguuacug

SEQ ID NO: 84955 - RNA, 20 nt, Human
ccacuggguccgcucuccgc

SEQ ID NO: 84956 - RNA, 24 nt, Human
cccugcuccucggcuaguccaggg

SEQ ID NO: 84957 - RNA, 19 nt, Human
ccguccugggccgacugca

SEQ ID NO: 84958 - RNA, 22 nt, Human
gacaucuucugauagcagcacu

SEQ ID NO: 84959 - RNA, 25 nt, Human
gcagcacugaagcagucaguugugc

SEQ ID NO: 84960 - RNA, 21 nt, Human
gcugaguagaccguccugggc

SEQ ID NO: 84961 - RNA, 27 nt, Human
ggaaccaaugggaaaaaaccgguaccc

SEQ ID NO: 84962 - RNA, 18 nt, Human
ggugaaaggaggagagga

SEQ ID NO: 84963 - RNA, 23 nt, Human
gugaaaggaggagaggaggggag

SEQ ID NO: 84964 - RNA, 20 nt, Human
uaaaaguuccaaucauucac

SEQ ID NO: 84965 - RNA, 28 nt, Human
uccugggccgacugcagaccaacugugu

SEQ ID NO: 84966 - RNA, 18 nt, Human
ugaaaggaggagaggagg

SEQ ID NO: 84967 - RNA, 19 nt, Human
ugggaaaaaacuaggugca

SEQ ID NO: 84968 - RNA, 23 nt, Human
ugggaaaaaacuaggugcagagg

SEQ ID NO: 84969 - RNA, 18 nt, Human
ugucuggaaccaauggga

SEQ ID NO: 84970 - RNA, 24 nt, Human
ugucuggaaccaaugggaaaaaac

SEQ ID NO: 84971 - RNA, 19 nt, Human
uuuucuggcaaaacacuaa

SEQ ID NO: 84972 - RNA, 20 nt, Human
aaaccugaaccgcaaacuag

SEQ ID NO: 84973 - RNA, 20 nt, Human
aacaaacauuuacauaaaca

SEQ ID NO: 84974 - RNA, 21 nt, Human
cagcggcaaaccugaaccgca

SEQ ID NO: 84975 - RNA, 18 nt, Human
cagugugauuuuuaagga

SEQ ID NO: 84976 - RNA, 24 nt, Human
gaaaaaaaaacagguuuaaaguga

SEQ ID NO: 84977 - RNA, 24 nt, Human
ggccggcagcggcaaaccugaacc

SEQ ID NO: 84978 - RNA, 18 nt, Human
uacauaaacaauaaauga

SEQ ID NO: 84979 - RNA, 22 nt, Human
uacauaaacaauaaaugaaaaa

SEQ ID NO: 84980 - RNA, 23 nt, Human
uggccggcagcggcaaaccugaa

SEQ ID NO: 84981 - RNA, 20 nt, Human
uuuacauaaacaauaaauga

SEQ ID NO: 84982 - RNA, 18 nt, Human
acagcaaugguagugcau

SEQ ID NO: 84983 - RNA, 30 nt, Human
acagcaaugguagugcaucuaaaugugucc

SEQ ID NO: 84984 - RNA, 19 nt, Human
accaaaaaguagaacagca

SEQ ID NO: 84985 - RNA, 20 nt, Human
accgccugggcuuucuuccg

SEQ ID NO: 84986 - RNA, 21 nt, Human
agagacaaauggguuaaauaa

SEQ ID NO: 84987 - RNA, 18 nt, Human
aggcacgcacacgacucc

SEQ ID NO: 84988 - RNA, 20 nt, Human
cacuguauaaaaaauaucag

SEQ ID NO: 84989 - RNA, 24 nt, Human
cauugcucugaggcagcaaucugu

SEQ ID NO: 84990 - RNA, 21 nt, Human
ccucguccugcugcaggccuu

SEQ ID NO: 84991 - RNA, 20 nt, Human
cgaccaaggcacgcacacga

SEQ ID NO: 84992 - RNA, 22 nt, Human
cugcugcaggccuuuccucugg

SEQ ID NO: 84993 - RNA, 21 nt, Human
cugggcuuucuuccgcaaccu

SEQ ID NO: 84994 - RNA, 20 nt, Human
gcaaugguagugcaucuaaa

SEQ ID NO: 84995 - RNA, 19 nt, Human
uacaaaugggaaaaguaca

SEQ ID NO: 84996 - RNA, 22 nt, Human
uacaaccauugcucugaggcag

SEQ ID NO: 84997 - RNA, 23 nt, Human
uacagggaaaaguagagacaaau

SEQ ID NO: 84998 - RNA, 21 nt, Human
uaccaaaaaguagaacagcaa

SEQ ID NO: 84999 - RNA, 18 nt, Human
ucagguccucguccugcu

SEQ ID NO: 85000 - RNA, 23 nt, Human
uccugcugcaggccuuuccucug

SEQ ID NO: 85001 - RNA, 24 nt, Human
ugaguaaguauaucacuguauaaa

SEQ ID NO: 85002 - RNA, 18 nt, Human
ugcugcaggccuuuccuc

SEQ ID NO: 85003 - RNA, 23 nt, Human
uuuuuuuuuuuuuuuuuuaacag

SEQ ID NO: 85004 - RNA, 24 nt, Human
aaaaaaagacccuucucuguauca

SEQ ID NO: 85005 - RNA, 20 nt, Human
aaaaaaauucaaaaaccucu

SEQ ID NO: 85006 - RNA, 20 nt, Human
aaaagagcucaaacuguuca

SEQ ID NO: 85007 - RNA, 22 nt, Human
aaaauacaucacggauaaaaua

SEQ ID NO: 85008 - RNA, 24 nt, Human
aaacaaaaaaucaucaaggucaaa

SEQ ID NO: 85009 - RNA, 18 nt, Human
aaacaaauggcucacgag

SEQ ID NO: 85010 - RNA, 22 nt, Human
aaauaaaucucaggaaaggucc

SEQ ID NO: 85011 - RNA, 22 nt, Human
aaauagaugccugucuaaaugc

SEQ ID NO: 85012 - RNA, 22 nt, Human
aaaucaucaaggucaaaacuga

SEQ ID NO: 85013 - RNA, 24 nt, Human
aaaugucagagaaauauguaaacc

SEQ ID NO: 85014 - RNA, 22 nt, Human
aauaauggacggccaagaggaa

SEQ ID NO: 85015 - RNA, 21 nt, Human
aaucaucaaggucaaaacuga

SEQ ID NO: 85016 - RNA, 25 nt, Human
aaugaagaaaauacauuucaaaaga

SEQ ID NO: 85017 - RNA, 23 nt, Human
acaaagacuccucauccuaaaca

SEQ ID NO: 85018 - RNA, 22 nt, Human
acagaaaacagagaaauccaca

SEQ ID NO: 85019 - RNA, 21 nt, Human
accucauuaauguuuccaaaa

SEQ ID NO: 85020 - RNA, 23 nt, Human
acugcaauuacguuacaauuauu

SEQ ID NO: 85021 - RNA, 21 nt, Human
agaaauaacagguuuagagua

SEQ ID NO: 85022 - RNA, 19 nt, Human
agacagaaaacagagaaau

SEQ ID NO: 85023 - RNA, 21 nt, Human
agauagaaacagguccaaaua

SEQ ID NO: 85024 - RNA, 21 nt, Human
aggaagcaaacaaagcuuucc

SEQ ID NO: 85025 - RNA, 19 nt, Human
aggagguuuucuuauuagu

SEQ ID NO: 85026 - RNA, 22 nt, Human
aguggaaacaaaaaaucaucaa

SEQ ID NO: 85027 - RNA, 21 nt, Human
auacuuaaaaaaaaaaagacc

SEQ ID NO: 85028 - RNA, 24 nt, Human
auucaaaaaccucuuuuccauuau

SEQ ID NO: 85029 - RNA, 20 nt, Human
caaaagaaacaaauggcuca

SEQ ID NO: 85030 - RNA, 19 nt, Human
caaacaaagcuuuccauag

SEQ ID NO: 85031 - RNA, 18 nt, Human
cacugaaauacuuaaaaa

SEQ ID NO: 85032 - RNA, 22 nt, Human
cagaaaacagagaaauccacag

SEQ ID NO: 85033 - RNA, 19 nt, Human
cagauacagcaacugggcu

SEQ ID NO: 85034 - RNA, 23 nt, Human
cagcaaaagaaacaaauggcuca

SEQ ID NO: 85035 - RNA, 18 nt, Human
cagcaaaccaucaaacca

SEQ ID NO: 85036 - RNA, 20 nt, Human
caggaaagguccaaguccua

SEQ ID NO: 85037 - RNA, 23 nt, Human
cauaagaacuauauaaaugucag

SEQ ID NO: 85038 - RNA, 20 nt, Human
ccauagagaaaccacuuuca

SEQ ID NO: 85039 - RNA, 19 nt, Human
cccaagagucuaaccuuaa

SEQ ID NO: 85040 - RNA, 18 nt, Human
ccgccgccgccuccuugc

SEQ ID NO: 85041 - RNA, 18 nt, Human
cgcucggccgccgccgcc

SEQ ID NO: 85042 - RNA, 23 nt, Human
cguuuccacuacucgccacucgc

SEQ ID NO: 85043 - RNA, 20 nt, Human
cucgcucggccgccgccgcc

SEQ ID NO: 85044 - RNA, 21 nt, Human
cugacucaaacaauuugcccu

SEQ ID NO: 85045 - RNA, 22 nt, Human
gaagaaaauacauuucaaaaga

SEQ ID NO: 85046 - RNA, 20 nt, Human
gcaaaagaaacaaauggcuc

SEQ ID NO: 85047 - RNA, 18 nt, Human
gcaaaccaucaaaccauc

SEQ ID NO: 85048 - RNA, 22 nt, Human
ggaaauauuguuuaauuguaga

SEQ ID NO: 85049 - RNA, 25 nt, Human
ggaacuaccuagaauaggccaagcu

SEQ ID NO: 85050 - RNA, 20 nt, Human
ggaagcaaacaaagcuuucc

SEQ ID NO: 85051 - RNA, 21 nt, Human
ggaagcaaacaaagcuuucca

SEQ ID NO: 85052 - RNA, 23 nt, Human
gguccagaaagaaugcaaaggga

SEQ ID NO: 85053 - RNA, 20 nt, Human
gguucagacuuacaccaagu

SEQ ID NO: 85054 - RNA, 24 nt, Human
guaagacagaaaacagagaaaucc

SEQ ID NO: 85055 - RNA, 25 nt, Human
uaacacaucccuuaaggaauaagca

SEQ ID NO: 85056 - RNA, 19 nt, Human
uaagacagaaaacagagaa

SEQ ID NO: 85057 - RNA, 21 nt, Human
uaaggaauaagcauguauuug

SEQ ID NO: 85058 - RNA, 27 nt, Human
uaauaguaauaaauccaccauugggga

SEQ ID NO: 85059 - RNA, 23 nt, Human
uaaugcagcaaaccaucaaacca

SEQ ID NO: 85060 - RNA, 21 nt, Human
uagcaacuauaaccagcaaaa

SEQ ID NO: 85061 - RNA, 21 nt, Human
ucacugaaauacuuaaaaaaa

SEQ ID NO: 85062 - RNA, 19 nt, Human
ucagagacauacauuugca

SEQ ID NO: 85063 - RNA, 21 nt, Human
ucagauacagcaacugggcuu

SEQ ID NO: 85064 - RNA, 21 nt, Human
ucaggaaagguccaaguccua

SEQ ID NO: 85065 - RNA, 22 nt, Human
ucccugguuucuuuaauaguaa

SEQ ID NO: 85066 - RNA, 25 nt, Human
ucuaaccuuaaccucgcuuuguuua

SEQ ID NO: 85067 - RNA, 22 nt, Human
ucucaggaaagguccaaguccu

SEQ ID NO: 85068 - RNA, 22 nt, Human
ugaugaaccaucugcuucagaa

SEQ ID NO: 85069 - RNA, 23 nt, Human
ugcuucagaaaauaauggacggc

SEQ ID NO: 85070 - RNA, 23 nt, Human
uguaagacagaaaacagagaaau

SEQ ID NO: 85071 - RNA, 27 nt, Human
uguacagggacacaaagacuccucauc

SEQ ID NO: 85072 - RNA, 22 nt, Human
uguuuauuuaaaaaaaaaaauu

SEQ ID NO: 85073 - RNA, 21 nt, Human
uuaauaguaauaaauccacca

SEQ ID NO: 85074 - RNA, 21 nt, Human
uuagaauuagcaacuauaacc

SEQ ID NO: 85075 - RNA, 27 nt, Human
uucacugaaauacuuaaaaaaaaaaag

SEQ ID NO: 85076 - RNA, 22 nt, Human
uuguuuaauuguagauuaaccc

SEQ ID NO: 85077 - RNA, 21 nt, Human
uuucaaggguucugcaucucg

SEQ ID NO: 85078 - RNA, 18 nt, Human
uuucucagcucauuacug

SEQ ID NO: 85079 - RNA, 22 nt, Human
uuuuuuuuuuuucaaggguucu

SEQ ID NO: 85080 - RNA, 24 nt, Human
uuuuuuuuuuuuuuuuuuucaagg

SEQ ID NO: 85081 - RNA, 23 nt, Human
auaaccaacccaacugcaaaaca

SEQ ID NO: 85082 - RNA, 18 nt, Human
aucuggaggcacacggag

SEQ ID NO: 85083 - RNA, 19 nt, Human
ccagaugauguaucucucu

SEQ ID NO: 85084 - RNA, 22 nt, Human
cccuaagaaauaucauaugaag

SEQ ID NO: 85085 - RNA, 21 nt, Human
ccuauggcaguugauucucuc

SEQ ID NO: 85086 - RNA, 18 nt, Human
gcuacaugaaaaaccaga

SEQ ID NO: 85087 - RNA, 23 nt, Human
ggaauaaccaacccaacugcaaa

SEQ ID NO: 85088 - RNA, 29 nt, Human
ggagguugcggguggguggcggcuagagc

SEQ ID NO: 85089 - RNA, 21 nt, Human
gggaaggagguugcggguggg

SEQ ID NO: 85090 - RNA, 22 nt, Human
ggguccccagccaucggcgcuc

SEQ ID NO: 85091 - RNA, 20 nt, Human
gugaagaguaguuggaauaa

SEQ ID NO: 85092 - RNA, 23 nt, Human
uaacauuccccuaagaaauauca

SEQ ID NO: 85093 - RNA, 21 nt, Human
uccccagccaucggcgcucuc

SEQ ID NO: 85094 - RNA, 18 nt, Human
ucuaacucagguguaaaa

SEQ ID NO: 85095 - RNA, 23 nt, Human
ucuggccaacaacccguucccaa

SEQ ID NO: 85096 - RNA, 19 nt, Human
ucuucugaacaaaucugga

SEQ ID NO: 85097 - RNA, 20 nt, Human
ugaaaauucauugcuaagag

SEQ ID NO: 85098 - RNA, 22 nt, Human
ugaacaaaucuggaggcacacg

SEQ ID NO: 85099 - RNA, 24 nt, Human
ugaacaaaucuggaggcacacgga

SEQ ID NO: 85100 - RNA, 24 nt, Human
ugaguugaucuaaauucaggagaa

SEQ ID NO: 85101 - RNA, 22 nt, Human
uguccucgauaggagaccuuca

SEQ ID NO: 85102 - RNA, 23 nt, Human
uucaagagaauacucagacgguc

SEQ ID NO: 85103 - RNA, 23 nt, Human
uucaggagaaucuauaaaggcac

SEQ ID NO: 85104 - RNA, 21 nt, Human
aaaaguacucacaccaagccc

SEQ ID NO: 85105 - RNA, 18 nt, Human
aaacagggauaagggccu

SEQ ID NO: 85106 - RNA, 20 nt, Human
aagccccagcuggggacugg

SEQ ID NO: 85107 - RNA, 22 nt, Human
accccccaccccacgggccgcc

SEQ ID NO: 85108 - RNA, 21 nt, Human
acucuuccuccgcuucuccug

SEQ ID NO: 85109 - RNA, 23 nt, Human
cacaccaagccccagcuggggac

SEQ ID NO: 85110 - RNA, 18 nt, Human
caccucugcaugauggcc

SEQ ID NO: 85111 - RNA, 19 nt, Human
cacugcccugaucuggguc

SEQ ID NO: 85112 - RNA, 26 nt, Human
cagccagacccucaguccuuccuguc

SEQ ID NO: 85113 - RNA, 18 nt, Human
caggacagcugacuguuu

SEQ ID NO: 85114 - RNA, 21 nt, Human
ccaggggcgcauguuuuuccu

SEQ ID NO: 85115 - RNA, 25 nt, Human
cccgcccgcaccgcauucccagcca

SEQ ID NO: 85116 - RNA, 22 nt, Human
cccgccgcuucucccggacccc

SEQ ID NO: 85117 - RNA, 19 nt, Human
cccggacccccgcccgcac

SEQ ID NO: 85118 - RNA, 25 nt, Human
ccgcaccgcauucccagccaggauc

SEQ ID NO: 85119 - RNA, 22 nt, Human
ccuagaauggaagagggaaccc

SEQ ID NO: 85120 - RNA, 18 nt, Human
ccuccgcuucuccugucc

SEQ ID NO: 85121 - RNA, 23 nt, Human
ccuccuguugcugccgugcuugc

SEQ ID NO: 85122 - RNA, 19 nt, Human
ccugucccgcgaccccgcc

SEQ ID NO: 85123 - RNA, 22 nt, Human
ccuuccuguccuggacugggag

SEQ ID NO: 85124 - RNA, 21 nt, Human
ccuuuggccaggacagcugac

SEQ ID NO: 85125 - RNA, 22 nt, Human
cucccggacccccgcccgcacc

SEQ ID NO: 85126 - RNA, 22 nt, Human
cuccucguccucgucaucugau

SEQ ID NO: 85127 - RNA, 20 nt, Human
cuccuguugcugccgugcuu

SEQ ID NO: 85128 - RNA, 26 nt, Human
cugcugucauuguggcagccuucucc

SEQ ID NO: 85129 - RNA, 22 nt, Human
cuucucccggacccccgcccgc

SEQ ID NO: 85130 - RNA, 22 nt, Human
gcccugaucugggucuucagcc

SEQ ID NO: 85131 - RNA, 23 nt, Human
gccgcgggcuuguccccaguccc

SEQ ID NO: 85132 - RNA, 18 nt, Human
gccggggccccacauacu

SEQ ID NO: 85133 - RNA, 18 nt, Human
gguguccuuccaaacccc

SEQ ID NO: 85134 - RNA, 20 nt, Human
uacucacaccaagccccagc

SEQ ID NO: 85135 - RNA, 22 nt, Human
ucagccauuaaagcucaguguc

SEQ ID NO: 85136 - RNA, 20 nt, Human
uccagggugggccacuccuc

SEQ ID NO: 85137 - RNA, 22 nt, Human
uccccagucccaugcucggccu

SEQ ID NO: 85138 - RNA, 22 nt, Human
ucccugugaucugucacugccc

SEQ ID NO: 85139 - RNA, 20 nt, Human
uccuccuguugcugccgugc

SEQ ID NO: 85140 - RNA, 24 nt, Human
uccuguugcugccgugcuugcugc

SEQ ID NO: 85141 - RNA, 19 nt, Human
ucggccucgaguuccuccu

SEQ ID NO: 85142 - RNA, 26 nt, Human
ucucagaacuaaacagggauaagggc

SEQ ID NO: 85143 - RNA, 22 nt, Human
ucucuauggcacgcucauccuc

SEQ ID NO: 85144 - RNA, 18 nt, Human
ucugucacugcccugauc

SEQ ID NO: 85145 - RNA, 21 nt, Human
ugaccccccaccccacgggcc

SEQ ID NO: 85146 - RNA, 19 nt, Human
ugcuugcugcaaaauccgu

SEQ ID NO: 85147 - RNA, 25 nt, Human
uggcacgcucauccucaggguccac

SEQ ID NO: 85148 - RNA, 21 nt, Human
ugggaaugcuagcauauggua

SEQ ID NO: 85149 - RNA, 23 nt, Human
ugggucuucagccauuaaagcuc

SEQ ID NO: 85150 - RNA, 20 nt, Human
uucuccugucccgcgacccc

SEQ ID NO: 85151 - RNA, 21 nt, Human
aacaugcucuaagcaugcaga

SEQ ID NO: 85152 - RNA, 21 nt, Human
aacaugcucuaagcaugcaga

SEQ ID NO: 85153 - RNA, 18 nt, Human
agaacaugcucuaagcau

SEQ ID NO: 85154 - RNA, 18 nt, Human
agaacaugcucuaagcau

SEQ ID NO: 85155 - RNA, 24 nt, Human
agccguaccagcggcgagggcacg

SEQ ID NO: 85156 - RNA, 27 nt, Human
caaccucugaagcucugcugaccccuu

SEQ ID NO: 85157 - RNA, 27 nt, Human
caaccucugaagcucugcugaccccuu

SEQ ID NO: 85158 - RNA, 21 nt, Human
caccacaucacaagcgugaug

SEQ ID NO: 85159 - RNA, 26 nt, Human
ccacagccuucucugugaagccuccc

SEQ ID NO: 85160 - RNA, 22 nt, Human
ccacaucacaagcgugauggca

SEQ ID NO: 85161 - RNA, 22 nt, Human
ccagaccagguaggagccguac

SEQ ID NO: 85162 - RNA, 21 nt, Human
ccagcggcgagggcacgcucc

SEQ ID NO: 85163 - RNA, 23 nt, Human
ccaggggaaccacagccuucucu

SEQ ID NO: 85164 - RNA, 22 nt, Human
cccaguucagggccagcugccc

SEQ ID NO: 85165 - RNA, 25 nt, Human
ccccugggccaaggcccugacagac

SEQ ID NO: 85166 - RNA, 18 nt, Human
cccugacagacuagcagg

SEQ ID NO: 85167 - RNA, 18 nt, Human
cccugacagacuagcagg

SEQ ID NO: 85168 - RNA, 18 nt, Human
ccucugaagcucugcuga

SEQ ID NO: 85169 - RNA, 18 nt, Human
ccucugaagcucugcuga

SEQ ID NO: 85170 - RNA, 19 nt, Human
ccugcuggugcagcugcag

SEQ ID NO: 85171 - RNA, 22 nt, Human
ccugggccaaggcccugacaga

SEQ ID NO: 85172 - RNA, 23 nt, Human
ccugggccaaggcccugacagac

SEQ ID NO: 85173 - RNA, 23 nt, Human
ccugggccaaggcccugacagac

SEQ ID NO: 85174 - RNA, 21 nt, Human
cgggaagggcacugccuggca

SEQ ID NO: 85175 - RNA, 21 nt, Human
cucccgggugggggcucaggu

SEQ ID NO: 85176 - RNA, 21 nt, Human
cucccgggugggggcucaggu

SEQ ID NO: 85177 - RNA, 20 nt, Human
cugaccccugggccaaggcc

SEQ ID NO: 85178 - RNA, 19 nt, Human
gcccaguucagggccagcu

SEQ ID NO: 85179 - RNA, 19 nt, Human
ggcccaggggaaccacagc

SEQ ID NO: 85180 - RNA, 18 nt, Human
ggcccugacagacuagca

SEQ ID NO: 85181 - RNA, 18 nt, Human
ggcccugacagacuagca

SEQ ID NO: 85182 - RNA, 20 nt, Human
gggaagggcacugccuggca

SEQ ID NO: 85183 - RNA, 21 nt, Human
gggcucagguggggcaaccuc

SEQ ID NO: 85184 - RNA, 24 nt, Human
gugcagcugcagucccuggugggc

SEQ ID NO: 85185 - RNA, 21 nt, Human
guggggcaaccucugaagcuc

SEQ ID NO: 85186 - RNA, 21 nt, Human
guggggcaaccucugaagcuc

SEQ ID NO: 85187 - RNA, 24 nt, Human
uagcaggcccaguggucaugaaag

SEQ ID NO: 85188 - RNA, 21 nt, Human
ucagcggcgagggcacgcucc

SEQ ID NO: 85189 - RNA, 28 nt, Human
uccauguuccaagaacaugcucuaagca

SEQ ID NO: 85190 - RNA, 28 nt, Human
uccauguuccaagaacaugcucuaagca

SEQ ID NO: 85191 - RNA, 18 nt, Human
ucccuggugggccgggca

SEQ ID NO: 85192 - RNA, 24 nt, Human
uccgggaagggcacugccuggcag

SEQ ID NO: 85193 - RNA, 24 nt, Human
ugaagccucccagcucuuuccaga

SEQ ID NO: 85194 - RNA, 19 nt, Human
ugaccccugggccaaggcc

SEQ ID NO: 85195 - RNA, 21 nt, Human
ugaccccugggccaaggcccu

SEQ ID NO: 85196 - RNA, 21 nt, Human
ugaccccugggccaaggcccu

SEQ ID NO: 85197 - RNA, 23 nt, Human
uggcaggaguuagccaggccgcu

SEQ ID NO: 85198 - RNA, 21 nt, Human
uggggcaaccucugaagcucu

SEQ ID NO: 85199 - RNA, 21 nt, Human
uggggcaaccucugaagcucu

SEQ ID NO: 85200 - RNA, 24 nt, Human
uguuccaagaacaugcucuaagca

SEQ ID NO: 85201 - RNA, 24 nt, Human
uguuccaagaacaugcucuaagca

SEQ ID NO: 85202 - RNA, 19 nt, Human
aagcaacccagcccgaggc

SEQ ID NO: 85203 - RNA, 24 nt, Human
acacaguaguuucucaguagucug

SEQ ID NO: 85204 - RNA, 20 nt, Human
acaggaccucaaacaaagcc

SEQ ID NO: 85205 - RNA, 22 nt, Human
accacuuaucuacacuagccug

SEQ ID NO: 85206 - RNA, 21 nt, Human
accucaugcuaggcucuacaa

SEQ ID NO: 85207 - RNA, 26 nt, Human
acuuugaaagccuaggcuggaguuuc

SEQ ID NO: 85208 - RNA, 19 nt, Human
caaaguggggagcagagga

SEQ ID NO: 85209 - RNA, 19 nt, Human
caccucaugcuaggcucua

SEQ ID NO: 85210 - RNA, 20 nt, Human
cacuagccugccagcacucu

SEQ ID NO: 85211 - RNA, 18 nt, Human
cagcacacaauggcauca

SEQ ID NO: 85212 - RNA, 19 nt, Human
cagcugaaccuccuccuga

SEQ ID NO: 85213 - RNA, 22 nt, Human
ccagcccgaggcagcucccacc

SEQ ID NO: 85214 - RNA, 22 nt, Human
cccagcccgaggcagcucccac

SEQ ID NO: 85215 - RNA, 20 nt, Human
cccuuugacuuugaaagccu

SEQ ID NO: 85216 - RNA, 23 nt, Human
cccuuugacuuugaaagccuagg

SEQ ID NO: 85217 - RNA, 23 nt, Human
ccgauuccccuccagguucaugc

SEQ ID NO: 85218 - RNA, 18 nt, Human
ccucaugcuaggcucuac

SEQ ID NO: 85219 - RNA, 19 nt, Human
cgcaugaaguccccgauuc

SEQ ID NO: 85220 - RNA, 19 nt, Human
cuaaaacuagguuuucugc

SEQ ID NO: 85221 - RNA, 19 nt, Human
cuccagcagucuugaggca

SEQ ID NO: 85222 - RNA, 19 nt, Human
gaccucaaacaaagccuga

SEQ ID NO: 85223 - RNA, 19 nt, Human
gcccugauauugcagggcu

SEQ ID NO: 85224 - RNA, 21 nt, Human
gccuaggcuggaguuucgcau

SEQ ID NO: 85225 - RNA, 22 nt, Human
ggauuuccuuuucucucugccu

SEQ ID NO: 85226 - RNA, 21 nt, Human
uaaaauguccugacuccagca

SEQ ID NO: 85227 - RNA, 27 nt, Human
uacaggaccucaaacaaagggacauac

SEQ ID NO: 85228 - RNA, 19 nt, Human
uaugaccaagcaacccagc

SEQ ID NO: 85229 - RNA, 21 nt, Human
uaugaccaagcaacccagccc

SEQ ID NO: 85230 - RNA, 23 nt, Human
uauggcucuaugaccaagcaacc

SEQ ID NO: 85231 - RNA, 22 nt, Human
uccaauucuaguacaugccacc

SEQ ID NO: 85232 - RNA, 22 nt, Human
uccccgauuccccuccagguuc

SEQ ID NO: 85233 - RNA, 24 nt, Human
uccccgauuccccuccagguucau

SEQ ID NO: 85234 - RNA, 21 nt, Human
ucgcaugaaguccccgauucc

SEQ ID NO: 85235 - RNA, 29 nt, Human
ucuaugaccaagcaacccagcccgaggcc

SEQ ID NO: 85236 - RNA, 19 nt, Human
ugcagaguuuuaugcucca

SEQ ID NO: 85237 - RNA, 23 nt, Human
ugccagcacucuaucgcauuucu

SEQ ID NO: 85238 - RNA, 22 nt, Human
ugcccucggcucagagacaccu

SEQ ID NO: 85239 - RNA, 18 nt, Human
ugccuggguccccuucgc

SEQ ID NO: 85240 - RNA, 18 nt, Human
ugcuaggcucuacaaagu

SEQ ID NO: 85241 - RNA, 23 nt, Human
uggggagcagaggagcuugguac

SEQ ID NO: 85242 - RNA, 23 nt, Human
uguucacguggcucucuccuucu

SEQ ID NO: 85243 - RNA, 23 nt, Human
uuccgccagaaugcaugcaggca

SEQ ID NO: 85244 - RNA, 22 nt, Human
uucuaguuguuuaggccccagc

SEQ ID NO: 85245 - RNA, 22 nt, Human
uuuuuuuuuuuuuuuucaaugg

SEQ ID NO: 85246 - RNA, 20 nt, Human
acacaugcucuugcugugua

SEQ ID NO: 85247 - RNA, 24 nt, Human
acccagggcuucccacugccuggc

SEQ ID NO: 85248 - RNA, 19 nt, Human
aggauggucuugcagcccu

SEQ ID NO: 85249 - RNA, 19 nt, Human
agggugcugggcgaccugg

SEQ ID NO: 85250 - RNA, 21 nt, Human
caagcacaugcccacagcuug

SEQ ID NO: 85251 - RNA, 23 nt, Human
cacacacaugcucuugcugugua

SEQ ID NO: 85252 - RNA, 23 nt, Human
cacacacaugcucuugcugugua

SEQ ID NO: 85253 - RNA, 21 nt, Human
cacagcuugagcacacugucc

SEQ ID NO: 85254 - RNA, 26 nt, Human
cacaugcccacagcuugagcacacug

SEQ ID NO: 85255 - RNA, 20 nt, Human
cagcuccugaggccaaaccc

SEQ ID NO: 85256 - RNA, 18 nt, Human
caggcaagcacaugccca

SEQ ID NO: 85257 - RNA, 22 nt, Human
cagugaaggaccucucccgcag

SEQ ID NO: 85258 - RNA, 21 nt, Human
ccagggcuucccacugccugg

SEQ ID NO: 85259 - RNA, 24 nt, Human
ccccacugcacccccagcuccuga

SEQ ID NO: 85260 - RNA, 21 nt, Human
ccuggcaaguuccgagcuggc

SEQ ID NO: 85261 - RNA, 19 nt, Human
cggaggacacugcccccuc

SEQ ID NO: 85262 - RNA, 22 nt, Human
cuccuguccccaacaggcaguc

SEQ ID NO: 85263 - RNA, 19 nt, Human
gagcuggcuacgccccaug

SEQ ID NO: 85264 - RNA, 18 nt, Human
ggaggacacugcccccuc

SEQ ID NO: 85265 - RNA, 20 nt, Human
gggcagucccccacugcacc

SEQ ID NO: 85266 - RNA, 22 nt, Human
ucucccgcaggcaagcacaugc

SEQ ID NO: 85267 - RNA, 18 nt, Human
ugaccgccaacucuccuu

SEQ ID NO: 85268 - RNA, 25 nt, Human
ugaggccaaacccagggcuucccac

SEQ ID NO: 85269 - RNA, 24 nt, Human
ugcuguguacacacagugaaggac

SEQ ID NO: 85270 - RNA, 26 nt, Human
uggcacacacaugcucuugcugugua

SEQ ID NO: 85271 - RNA, 21 nt, Human
uguccaugcaucuccuguccc

SEQ ID NO: 85272 - RNA, 19 nt, Human
uguccuggcucggaggaca

SEQ ID NO: 85273 - RNA, 19 nt, Human
uugcagcccucacuaggcu

SEQ ID NO: 85274 - RNA, 25 nt, Human
cagcuuuauuaaugaccaggguaac

SEQ ID NO: 85275 - RNA, 24 nt, Human
ugaccaggguaacccgucgcggac

SEQ ID NO: 85276 - RNA, 23 nt, Human
ugaccaggguaacccgucgcggc

SEQ ID NO: 85277 - RNA, 25 nt, Human
aaaaagaacucacaggguuuguaaa

SEQ ID NO: 85278 - RNA, 21 nt, Human
aaaagaagucuuuuccaugcc

SEQ ID NO: 85279 - RNA, 19 nt, Human
aaaaugggagaggggagag

SEQ ID NO: 85280 - RNA, 25 nt, Human
aaacaacaacaacaaaacauugaaa

SEQ ID NO: 85281 - RNA, 27 nt, Human
aaacaacaacaacaaaaccccaguagg

SEQ ID NO: 85282 - RNA, 23 nt, Human
aaacaacugcuuuccuaaauuuc

SEQ ID NO: 85283 - RNA, 24 nt, Human
aaauaccugcucuugacagauucc

SEQ ID NO: 85284 - RNA, 22 nt, Human
aacguagucauaauacacaaaa

SEQ ID NO: 85285 - RNA, 27 nt, Human
aagaaaacaacaacaacaaaacauuga

SEQ ID NO: 85286 - RNA, 19 nt, Human
acacagugcaaaaugggag

SEQ ID NO: 85287 - RNA, 20 nt, Human
acagagcaaaagauggaagc

SEQ ID NO: 85288 - RNA, 19 nt, Human
agcaaaagauggaagcagg

SEQ ID NO: 85289 - RNA, 22 nt, Human
auaaaauaagaagcacaaccuc

SEQ ID NO: 85290 - RNA, 20 nt, Human
auaaccacaauaggaaucuc

SEQ ID NO: 85291 - RNA, 19 nt, Human
auaauuagaaaaauggcag

SEQ ID NO: 85292 - RNA, 22 nt, Human
auuuuuuuuucuuucagcuuaa

SEQ ID NO: 85293 - RNA, 22 nt, Human
caaugagaccuuguauaaccac

SEQ ID NO: 85294 - RNA, 19 nt, Human
caauuuacaaaaagaacuc

SEQ ID NO: 85295 - RNA, 18 nt, Human
cagagcaaaagauggaag

SEQ ID NO: 85296 - RNA, 20 nt, Human
caguuuauagaccuucccuc

SEQ ID NO: 85297 - RNA, 22 nt, Human
caguuuauagaccuucccucac

SEQ ID NO: 85298 - RNA, 20 nt, Human
cccucacauuccaauagggc

SEQ ID NO: 85299 - RNA, 21 nt, Human
cugcaaaaaagaagcauuacc

SEQ ID NO: 85300 - RNA, 19 nt, Human
gaacacuaacaauuuacaa

SEQ ID NO: 85301 - RNA, 20 nt, Human
guuuauagaccuucccucac

SEQ ID NO: 85302 - RNA, 22 nt, Human
uaaaauaagaagcacaaccucu

SEQ ID NO: 85303 - RNA, 27 nt, Human
uaaaauagaauaaagcucaacagcauu

SEQ ID NO: 85304 - RNA, 24 nt, Human
uaaaugacagccauuuucuucuca

SEQ ID NO: 85305 - RNA, 23 nt, Human
uaacauaaaauagaauaaagcuc

SEQ ID NO: 85306 - RNA, 23 nt, Human
uaaguaagagaauguaaguuuau

SEQ ID NO: 85307 - RNA, 22 nt, Human
uacaaaaagaacucacaggguu

SEQ ID NO: 85308 - RNA, 21 nt, Human
uacagagcaaaagauggaagc

SEQ ID NO: 85309 - RNA, 23 nt, Human
uacagagcaaaagauggaagcag

SEQ ID NO: 85310 - RNA, 21 nt, Human
uaccaagaaaacaacaacaac

SEQ ID NO: 85311 - RNA, 24 nt, Human
uaccaagaaaacaacaacaacaaa

SEQ ID NO: 85312 - RNA, 25 nt, Human
uaccaagaaaacaacaacaacaaaa

SEQ ID NO: 85313 - RNA, 19 nt, Human
uagaaaggacaacuaagcc

SEQ ID NO: 85314 - RNA, 22 nt, Human
uauaaauugggaccacaucugc

SEQ ID NO: 85315 - RNA, 19 nt, Human
uauaaccacaauaggaauc

SEQ ID NO: 85316 - RNA, 24 nt, Human
uauagaccuucccucacauuccaa

SEQ ID NO: 85317 - RNA, 26 nt, Human
uauuagcgacaauauuuugugcuagc

SEQ ID NO: 85318 - RNA, 21 nt, Human
ucagccaaccucugaauccaa

SEQ ID NO: 85319 - RNA, 25 nt, Human
ucaguuccuuccgacuucugaugug

SEQ ID NO: 85320 - RNA, 22 nt, Human
ucccuuugcaguuguacugucc

SEQ ID NO: 85321 - RNA, 24 nt, Human
uccuugacaauauuaaacuccuaa

SEQ ID NO: 85322 - RNA, 19 nt, Human
ucucaaugcagcuuucuuu

SEQ ID NO: 85323 - RNA, 22 nt, Human
ucugauuucaaauggaugcccc

SEQ ID NO: 85324 - RNA, 21 nt, Human
ucuguauuuuuaaagcugaaa

SEQ ID NO: 85325 - RNA, 20 nt, Human
ugacaauauuaaacuccuaa

SEQ ID NO: 85326 - RNA, 23 nt, Human
ugagcaauucacaacuuuacaga

SEQ ID NO: 85327 - RNA, 22 nt, Human
ugcaucgacacacagugcaaaa

SEQ ID NO: 85328 - RNA, 18 nt, Human
ugccuguuucuuauuuuu

SEQ ID NO: 85329 - RNA, 21 nt, Human
uuaaauagaaaggacaacuaa

SEQ ID NO: 85330 - RNA, 24 nt, Human
uuaucacuuuuuaaaagaaagcuu

SEQ ID NO: 85331 - RNA, 19 nt, Human
uuccucugauuucaaaugg

SEQ ID NO: 85332 - RNA, 23 nt, Human
uugagaaaacagaagucauuuua

SEQ ID NO: 85333 - RNA, 22 nt, Human
uuuauaauuagaaaaauggcag

SEQ ID NO: 85334 - RNA, 22 nt, Human
uuuccaugccuacuucuguuga

SEQ ID NO: 85335 - RNA, 18 nt, Human
uuugcaguuguacugucc

SEQ ID NO: 85336 - RNA, 21 nt, Human
aaaaaaaaauccaucuccuca

SEQ ID NO: 85337 - RNA, 19 nt, Human
aaaaaaacaaaaaaaaauc

SEQ ID NO: 85338 - RNA, 22 nt, Human
aaaguacaagaacugaucagag

SEQ ID NO: 85339 - RNA, 19 nt, Human
aacauaguaagaccccauc

SEQ ID NO: 85340 - RNA, 20 nt, Human
aacauaguaagaccccaucu

SEQ ID NO: 85341 - RNA, 21 nt, Human
aacauaguaagaccccaucuc

SEQ ID NO: 85342 - RNA, 18 nt, Human
aagaaucuguuucuucuu

SEQ ID NO: 85343 - RNA, 20 nt, Human
aagacauuuaacuccugggc

SEQ ID NO: 85344 - RNA, 22 nt, Human
aagauggccaagguggaaaacg

SEQ ID NO: 85345 - RNA, 22 nt, Human
aaggggaaggcuggaaaaggga

SEQ ID NO: 85346 - RNA, 21 nt, Human
aauaaaagggcagaugaugga

SEQ ID NO: 85347 - RNA, 23 nt, Human
acaaaaaaaaauccaucuccuca

SEQ ID NO: 85348 - RNA, 25 nt, Human
acaaaaaaaaauccaucuccucagg

SEQ ID NO: 85349 - RNA, 19 nt, Human
acagagugaaaccccgucu

SEQ ID NO: 85350 - RNA, 20 nt, Human
acagagugaaaccccgucuc

SEQ ID NO: 85351 - RNA, 23 nt, Human
acagcugcucugggugggcagca

SEQ ID NO: 85352 - RNA, 22 nt, Human
accccaucucuucccaccccca

SEQ ID NO: 85353 - RNA, 23 nt, Human
accccaucucuucccacccccaa

SEQ ID NO: 85354 - RNA, 20 nt, Human
accccgucucuaaaaaaaca

SEQ ID NO: 85355 - RNA, 18 nt, Human
acuucaagaauacaagag

SEQ ID NO: 85356 - RNA, 21 nt, Human
acuugggaagcugaugcagga

SEQ ID NO: 85357 - RNA, 27 nt, Human
agaaaaaagaagauuugacuucaagaa

SEQ ID NO: 85358 - RNA, 19 nt, Human
agaaggucuaaaaacagcc

SEQ ID NO: 85359 - RNA, 23 nt, Human
agaaggucuaaaaacagcccaga

SEQ ID NO: 85360 - RNA, 23 nt, Human
agaccccaucucuucccaccccc

SEQ ID NO: 85361 - RNA, 21 nt, Human
agcccagacucuuccaacccu

SEQ ID NO: 85362 - RNA, 22 nt, Human
agccuggacaacauaguaagac

SEQ ID NO: 85363 - RNA, 24 nt, Human
agccuggacaacauaguaagaccc

SEQ ID NO: 85364 - RNA, 22 nt, Human
agccugggugacagagugaaac

SEQ ID NO: 85365 - RNA, 24 nt, Human
agccugggugacagagugaaaccc

SEQ ID NO: 85366 - RNA, 22 nt, Human
agcuggauguggugguacacac

SEQ ID NO: 85367 - RNA, 22 nt, Human
aggcagcccuuggucacagcug

SEQ ID NO: 85368 - RNA, 26 nt, Human
aggcuaaaagugaauaaaagggaccc

SEQ ID NO: 85369 - RNA, 21 nt, Human
aggcuggaaaagggagccugg

SEQ ID NO: 85370 - RNA, 21 nt, Human
agggaaaaaggggaaggcugg

SEQ ID NO: 85371 - RNA, 21 nt, Human
aggguccagcugggggaggcc

SEQ ID NO: 85372 - RNA, 21 nt, Human
agugaaaccccgucucuaaaa

SEQ ID NO: 85373 - RNA, 19 nt, Human
aucuaugcugccuaguucu

SEQ ID NO: 85374 - RNA, 21 nt, Human
augcaggagggucacuugagc

SEQ ID NO: 85375 - RNA, 24 nt, Human
auucccagccugggugacagagug

SEQ ID NO: 85376 - RNA, 26 nt, Human
auugugccacugcaauucccagccug

SEQ ID NO: 85377 - RNA, 19 nt, Human
caaaaaaaaauccaucucc

SEQ ID NO: 85378 - RNA, 18 nt, Human
caaaauaccuuguguuug

SEQ ID NO: 85379 - RNA, 20 nt, Human
caaaguacaagaacugauca

SEQ ID NO: 85380 - RNA, 24 nt, Human
caacauaguaagaccccaucucuu

SEQ ID NO: 85381 - RNA, 23 nt, Human
caagguggaaaacgagaaagucc

SEQ ID NO: 85382 - RNA, 21 nt, Human
caagucucagcucaaauccca

SEQ ID NO: 85383 - RNA, 21 nt, Human
caaucaggcauaaagcuguga

SEQ ID NO: 85384 - RNA, 21 nt, Human
cacauguucccaccacacaag

SEQ ID NO: 85385 - RNA, 23 nt, Human
cacuugcagucccagcuacuugg

SEQ ID NO: 85386 - RNA, 24 nt, Human
cacuugcagucccagcuacuuggg

SEQ ID NO: 85387 - RNA, 22 nt, Human
cagacucuugaaggugagaaaa

SEQ ID NO: 85388 - RNA, 22 nt, Human
cagcagagaggagcccaaccug

SEQ ID NO: 85389 - RNA, 22 nt, Human
cagcugcucugggugggcagca

SEQ ID NO: 85390 - RNA, 19 nt, Human
cauaguaagaccccaucuc

SEQ ID NO: 85391 - RNA, 26 nt, Human
ccacugcaauucccagccugggugac

SEQ ID NO: 85392 - RNA, 21 nt, Human
ccacugcccaccccacauucc

SEQ ID NO: 85393 - RNA, 19 nt, Human
ccagcugggggaggcccuc

SEQ ID NO: 85394 - RNA, 20 nt, Human
ccaucucuucccacccccaa

SEQ ID NO: 85395 - RNA, 22 nt, Human
ccaucucuucccacccccaaaa

SEQ ID NO: 85396 - RNA, 23 nt, Human
cccaccucuuagccuggacaaca

SEQ ID NO: 85397 - RNA, 19 nt, Human
cccagccugggugacagag

SEQ ID NO: 85398 - RNA, 24 nt, Human
ccuggacaacauaguaagacccca

SEQ ID NO: 85399 - RNA, 19 nt, Human
ccuggaggugauaaugcug

SEQ ID NO: 85400 - RNA, 20 nt, Human
ccugggugacagagugaaac

SEQ ID NO: 85401 - RNA, 23 nt, Human
ccugggugacagagugaaacccc

SEQ ID NO: 85402 - RNA, 24 nt, Human
ccugggugacagagugaaaccccg

SEQ ID NO: 85403 - RNA, 22 nt, Human
cgagaaaguccuggaggugaua

SEQ ID NO: 85404 - RNA, 24 nt, Human
cgucucuaaaaaaacaaaaaaaaa

SEQ ID NO: 85405 - RNA, 23 nt, Human
cugcucucucaagaaucuguuuc

SEQ ID NO: 85406 - RNA, 19 nt, Human
cuggaagagguugcaggua

SEQ ID NO: 85407 - RNA, 18 nt, Human
cuucaagaauacaagagg

SEQ ID NO: 85408 - RNA, 21 nt, Human
cuugcagucccagcuacuugg

SEQ ID NO: 85409 - RNA, 22 nt, Human
cuugcagucccagcuacuuggg

SEQ ID NO: 85410 - RNA, 21 nt, Human
gaaggaagaagauggccaagg

SEQ ID NO: 85411 - RNA, 20 nt, Human
gaccccaucucuucccaccc

SEQ ID NO: 85412 - RNA, 21 nt, Human
gaccccaucucuucccacccc

SEQ ID NO: 85413 - RNA, 18 nt, Human
gagaagcuggcaauuucu

SEQ ID NO: 85414 - RNA, 22 nt, Human
gaggguccagcugggggaggcc

SEQ ID NO: 85415 - RNA, 18 nt, Human
gaugauggaauagaaaag

SEQ ID NO: 85416 - RNA, 19 nt, Human
gaugauggaauagaaaaga

SEQ ID NO: 85417 - RNA, 21 nt, Human
gcagccaggcugaccuguguc

SEQ ID NO: 85418 - RNA, 20 nt, Human
gccuggacaacauaguaaga

SEQ ID NO: 85419 - RNA, 24 nt, Human
gcuuccgagaagcuggcaauuucu

SEQ ID NO: 85420 - RNA, 18 nt, Human
ggagccuggaagagguug

SEQ ID NO: 85421 - RNA, 18 nt, Human
ggcaugaaaauaaaaggg

SEQ ID NO: 85422 - RNA, 21 nt, Human
ggcccacagggcaggggcauu

SEQ ID NO: 85423 - RNA, 20 nt, Human
gggaaggagacacagugggc

SEQ ID NO: 85424 - RNA, 19 nt, Human
gggaaggcuggaaaaggga

SEQ ID NO: 85425 - RNA, 25 nt, Human
gggauugugccacugcaauucccag

SEQ ID NO: 85426 - RNA, 19 nt, Human
gggcccccagcacagcagu

SEQ ID NO: 85427 - RNA, 24 nt, Human
gguaggggaaggagacacaguggg

SEQ ID NO: 85428 - RNA, 22 nt, Human
gguccagcagcagagaggagcc

SEQ ID NO: 85429 - RNA, 22 nt, Human
gucaaaguacaagaacugauca

SEQ ID NO: 85430 - RNA, 19 nt, Human
guggagggcuuuuugccug

SEQ ID NO: 85431 - RNA, 22 nt, Human
uaaaagggcagaugauggaaua

SEQ ID NO: 85432 - RNA, 21 nt, Human
uaaagcugugauucuccuagg

SEQ ID NO: 85433 - RNA, 19 nt, Human
uaacuccugggcauucaag

SEQ ID NO: 85434 - RNA, 22 nt, Human
uaggaggaaauaagaaagggca

SEQ ID NO: 85435 - RNA, 20 nt, Human
uaggggaaggagacacagug

SEQ ID NO: 85436 - RNA, 22 nt, Human
uaggggaaggagacacaguggg

SEQ ID NO: 85437 - RNA, 20 nt, Human
ucacuuccuaacucuucacc

SEQ ID NO: 85438 - RNA, 22 nt, Human
ucacuuccuaacucuucaccau

SEQ ID NO: 85439 - RNA, 22 nt, Human
ucagggaggacuuucugaugau

SEQ ID NO: 85440 - RNA, 20 nt, Human
uccccacugcccaccccaca

SEQ ID NO: 85441 - RNA, 18 nt, Human
ucccuuggaagguucaga

SEQ ID NO: 85442 - RNA, 18 nt, Human
uccggcauggagaaguac

SEQ ID NO: 85443 - RNA, 27 nt, Human
ucucuaaaaaaacaaaaaaaaauccau

SEQ ID NO: 85444 - RNA, 21 nt, Human
ugaaggugagaaaaaagaaga

SEQ ID NO: 85445 - RNA, 24 nt, Human
ugacagagugaaaccccgucucua

SEQ ID NO: 85446 - RNA, 19 nt, Human
ugaccaaaauaccuugugu

SEQ ID NO: 85447 - RNA, 21 nt, Human
ugccuggcgaccgggccccca

SEQ ID NO: 85448 - RNA, 25 nt, Human
ugccuggcgaccgggcccccagcac

SEQ ID NO: 85449 - RNA, 25 nt, Human
ugccugugucguucauuucucuuuc

SEQ ID NO: 85450 - RNA, 18 nt, Human
uggaagagguugcaggua

SEQ ID NO: 85451 - RNA, 22 nt, Human
uggaagagguugcagguagggg

SEQ ID NO: 85452 - RNA, 24 nt, Human
uggaauagaaaagaaauuaaagag

SEQ ID NO: 85453 - RNA, 22 nt, Human
uggacaacauaguaagacccca

SEQ ID NO: 85454 - RNA, 21 nt, Human
uggauacacacacuguguaug

SEQ ID NO: 85455 - RNA, 19 nt, Human
uggauggaguuacguagua

SEQ ID NO: 85456 - RNA, 21 nt, Human
ugggaagcugaugcaggaggg

SEQ ID NO: 85457 - RNA, 24 nt, Human
ugggaagcugaugcaggaggguca

SEQ ID NO: 85458 - RNA, 18 nt, Human
ugggcauucaagucucag

SEQ ID NO: 85459 - RNA, 23 nt, Human
uggugguacacacuugcaguccc

SEQ ID NO: 85460 - RNA, 23 nt, Human
uguaugaggguccagcuggggga

SEQ ID NO: 85461 - RNA, 18 nt, Human
uuagcuggaugugguggu

SEQ ID NO: 85462 - RNA, 25 nt, Human
uugggaagcugaugcaggaggguca

SEQ ID NO: 85463 - RNA, 23 nt, Human
uuuaaguuacguuccccacugcc

SEQ ID NO: 85464 - RNA, 19 nt, Human
uuuaggaggaaauaagaaa

SEQ ID NO: 85465 - RNA, 21 nt, Human
uuucauaguucacauguuccc

SEQ ID NO: 85466 - RNA, 19 nt, Human
uuuguuagaguucuuaucc

SEQ ID NO: 85467 - RNA, 21 nt, Human
uuuucacuuccuaacucuuca

SEQ ID NO: 85468 - RNA, 18 nt, Human
uuuugucucugcucucuc

SEQ ID NO: 85469 - RNA, 19 nt, Human
uuuuuuuuuuuuucacuuc

SEQ ID NO: 85470 - RNA, 22 nt, Human
uuuuuuuuuuuuucacuuccua

SEQ ID NO: 85471 - RNA, 21 nt, Human
aaguaaacgguacuuauacaa

SEQ ID NO: 85472 - RNA, 18 nt, Human
acacacugaaagcaguac

SEQ ID NO: 85473 - RNA, 24 nt, Human
agcaguagaauacaagugagugcc

SEQ ID NO: 85474 - RNA, 21 nt, Human
aggacagacggcucagaacgc

SEQ ID NO: 85475 - RNA, 25 nt, Human
caugaaguaaacgguacuuauacaa

SEQ ID NO: 85476 - RNA, 19 nt, Human
cauuuauucaugccaugaa

SEQ ID NO: 85477 - RNA, 24 nt, Human
ccacaaaucugcagccaacucgga

SEQ ID NO: 85478 - RNA, 20 nt, Human
cggcucagaacgcaccacaa

SEQ ID NO: 85479 - RNA, 21 nt, Human
cuccccaucuaacacggcuug

SEQ ID NO: 85480 - RNA, 20 nt, Human
gcaccacaaaucugcagcca

SEQ ID NO: 85481 - RNA, 19 nt, Human
uauacaaguguacagugac

SEQ ID NO: 85482 - RNA, 19 nt, Human
ucacaaugauggguggcuc

SEQ ID NO: 85483 - RNA, 18 nt, Human
uggcgcaggacagacggc

SEQ ID NO: 85484 - RNA, 20 nt, Human
uggcgcaggacagacggcuc

SEQ ID NO: 85485 - RNA, 21 nt, Human
uuucacaaugauggguggcuc

SEQ ID NO: 85486 - RNA, 27 nt, Human
aaaaaugugcacuuuucacuguugccc

SEQ ID NO: 85487 - RNA, 19 nt, Human
aaaagaaaaaggcacagag

SEQ ID NO: 85488 - RNA, 21 nt, Human
aaaagaaaaaggcacagagag

SEQ ID NO: 85489 - RNA, 24 nt, Human
aaaaggcacagagagacuuggaca

SEQ ID NO: 85490 - RNA, 19 nt, Human
aaacaaacaaacaaaaacc

SEQ ID NO: 85491 - RNA, 20 nt, Human
aaacaaacaaacaaaaacca

SEQ ID NO: 85492 - RNA, 21 nt, Human
aaacaaacaaacaaaaaccag

SEQ ID NO: 85493 - RNA, 21 nt, Human
aaacaagcagugcagcaagcc

SEQ ID NO: 85494 - RNA, 22 nt, Human
aaaccaccacccacaccacucc

SEQ ID NO: 85495 - RNA, 22 nt, Human
aaacuaauucauuacagagccc

SEQ ID NO: 85496 - RNA, 21 nt, Human
aaaggaugcccacacccaaga

SEQ ID NO: 85497 - RNA, 18 nt, Human
aaagucuccaaaagcuuc

SEQ ID NO: 85498 - RNA, 19 nt, Human
aaaugcagaggucacaauc

SEQ ID NO: 85499 - RNA, 24 nt, Human
aacacaaaaguuaacagaaaccaa

SEQ ID NO: 85500 - RNA, 24 nt, Human
aacacauucauauacucacaguua

SEQ ID NO: 85501 - RNA, 27 nt, Human
aacacuguuugcggucagaccagaugg

SEQ ID NO: 85502 - RNA, 21 nt, Human
aacauaccaacaagcacauua

SEQ ID NO: 85503 - RNA, 19 nt, Human
aacuaugcagccuaagagu

SEQ ID NO: 85504 - RNA, 24 nt, Human
aacuauugaaaaguucaaauacag

SEQ ID NO: 85505 - RNA, 18 nt, Human
aagaaaaaggcacagaga

SEQ ID NO: 85506 - RNA, 23 nt, Human
aagaaaagacagacaacugaaaa

SEQ ID NO: 85507 - RNA, 21 nt, Human
aagaaaccaccacccacacca

SEQ ID NO: 85508 - RNA, 20 nt, Human
aagagccgcuggauggaaga

SEQ ID NO: 85509 - RNA, 22 nt, Human
aagcaaacguaugcuggaagau

SEQ ID NO: 85510 - RNA, 26 nt, Human
aagcaaacguaugcuggaagauugug

SEQ ID NO: 85511 - RNA, 21 nt, Human
aagcagaagggaacagacuag

SEQ ID NO: 85512 - RNA, 22 nt, Human
aagcagcagcagcagcagcagc

SEQ ID NO: 85513 - RNA, 25 nt, Human
aagcagugcagcaagcccccgagau

SEQ ID NO: 85514 - RNA, 22 nt, Human
aagcuaaaaaaaggguucuuga

SEQ ID NO: 85515 - RNA, 19 nt, Human
aaggaagacauugcuuucu

SEQ ID NO: 85516 - RNA, 19 nt, Human
aaggcuaagagugcuuucc

SEQ ID NO: 85517 - RNA, 23 nt, Human
aaugaugugguaacaaauuuuag

SEQ ID NO: 85518 - RNA, 20 nt, Human
aauuacugaagaaauugcac

SEQ ID NO: 85519 - RNA, 21 nt, Human
aauuauguaauuaucucgcca

SEQ ID NO: 85520 - RNA, 19 nt, Human
aauucauuacagagcccca

SEQ ID NO: 85521 - RNA, 27 nt, Human
aauugcacugcuggaggaugagggcag

SEQ ID NO: 85522 - RNA, 21 nt, Human
acaaaggcaguucucuagggu

SEQ ID NO: 85523 - RNA, 25 nt, Human
acaacacucgaaaggaugcccacac

SEQ ID NO: 85524 - RNA, 21 nt, Human
acaaggacacgcagagggaag

SEQ ID NO: 85525 - RNA, 22 nt, Human
acacaaaaguuaacagaaacca

SEQ ID NO: 85526 - RNA, 19 nt, Human
acaccauggagcaaauaaa

SEQ ID NO: 85527 - RNA, 23 nt, Human
acagacaacugaaaaaagcacca

SEQ ID NO: 85528 - RNA, 22 nt, Human
acagacacaaacacacacacgc

SEQ ID NO: 85529 - RNA, 25 nt, Human
acagaggaagagaggcuaaucugga

SEQ ID NO: 85530 - RNA, 20 nt, Human
acagaugccucuggagcuga

SEQ ID NO: 85531 - RNA, 18 nt, Human
acagcacagagccaccgc

SEQ ID NO: 85532 - RNA, 23 nt, Human
acagcaggagauagaugcaggag

SEQ ID NO: 85533 - RNA, 24 nt, Human
acagguuguaagcaugagcugaca

SEQ ID NO: 85534 - RNA, 18 nt, Human
acccccaucccaaccccu

SEQ ID NO: 85535 - RNA, 22 nt, Human
acgaaguucuguguaggcugga

SEQ ID NO: 85536 - RNA, 19 nt, Human
acgcagagggaagaaagaa

SEQ ID NO: 85537 - RNA, 19 nt, Human
acuagccaugaggcgacac

SEQ ID NO: 85538 - RNA, 21 nt, Human
acuggaacaagacugaaucca

SEQ ID NO: 85539 - RNA, 20 nt, Human
agaaaccaaguaucuuuccc

SEQ ID NO: 85540 - RNA, 21 nt, Human
agacaacugaaaaaagcacca

SEQ ID NO: 85541 - RNA, 22 nt, Human
agacaacugaaaaaagcaccau

SEQ ID NO: 85542 - RNA, 22 nt, Human
agacagacaacugaaaaaagca

SEQ ID NO: 85543 - RNA, 25 nt, Human
agacggucacagaugccucuggagc

SEQ ID NO: 85544 - RNA, 19 nt, Human
agacucuacucugguggca

SEQ ID NO: 85545 - RNA, 23 nt, Human
agagccccagccucgaagaccuu

SEQ ID NO: 85546 - RNA, 20 nt, Human
agaggccuuccaacugucac

SEQ ID NO: 85547 - RNA, 19 nt, Human
agaggucacaaucagacac

SEQ ID NO: 85548 - RNA, 21 nt, Human
agcaaaugacugucugacccu

SEQ ID NO: 85549 - RNA, 18 nt, Human
agcaaugaugugguaaca

SEQ ID NO: 85550 - RNA, 22 nt, Human
agcagcagcagcagcagcagca

SEQ ID NO: 85551 - RNA, 20 nt, Human
agcauaagaaaccaccaccc

SEQ ID NO: 85552 - RNA, 20 nt, Human
agcggugcuggcagcuggcg

SEQ ID NO: 85553 - RNA, 18 nt, Human
agcuggugucucuccagc

SEQ ID NO: 85554 - RNA, 18 nt, Human
agcuguggggugcaucuc

SEQ ID NO: 85555 - RNA, 23 nt, Human
aggaaagggggagaggcaauggg

SEQ ID NO: 85556 - RNA, 25 nt, Human
aggaagccgccgggcgaggcucagg

SEQ ID NO: 85557 - RNA, 21 nt, Human
aggaaggcagggauuuggaug

SEQ ID NO: 85558 - RNA, 22 nt, Human
agucacauauuucaacaguaug

SEQ ID NO: 85559 - RNA, 23 nt, Human
aguuggacuaguucuguggaugu

SEQ ID NO: 85560 - RNA, 21 nt, Human
auaaaacaugccauucuggcc

SEQ ID NO: 85561 - RNA, 19 nt, Human
auagugcaacuuuuaaaac

SEQ ID NO: 85562 - RNA, 22 nt, Human
aucaccuuuuccuucugcugaa

SEQ ID NO: 85563 - RNA, 23 nt, Human
aucacucguuacuaaacuggacc

SEQ ID NO: 85564 - RNA, 20 nt, Human
auccaaaagucuccaaaagc

SEQ ID NO: 85565 - RNA, 19 nt, Human
aucccaaccccugucccca

SEQ ID NO: 85566 - RNA, 21 nt, Human
aucccguucucuguuuucccc

SEQ ID NO: 85567 - RNA, 25 nt, Human
augaaaaauagcaacauaccaacaa

SEQ ID NO: 85568 - RNA, 23 nt, Human
augaacaggucagccacaaccuu

SEQ ID NO: 85569 - RNA, 20 nt, Human
augauagggguauaucuaca

SEQ ID NO: 85570 - RNA, 18 nt, Human
augaugggacaugaaugg

SEQ ID NO: 85571 - RNA, 21 nt, Human
augcagccuaagaguagcaga

SEQ ID NO: 85572 - RNA, 21 nt, Human
auguagaccacugcaaggcua

SEQ ID NO: 85573 - RNA, 23 nt, Human
auuauaaaccuaucauugauugc

SEQ ID NO: 85574 - RNA, 26 nt, Human
auugcacugcuggaggaugagggcag

SEQ ID NO: 85575 - RNA, 18 nt, Human
caaaacaaacaaacaaaa

SEQ ID NO: 85576 - RNA, 25 nt, Human
caaaagaggacaaagcacauaggca

SEQ ID NO: 85577 - RNA, 21 nt, Human
caaaagucuccaaaagcuuca

SEQ ID NO: 85578 - RNA, 20 nt, Human
caaaauuccacgaacugcuc

SEQ ID NO: 85579 - RNA, 26 nt, Human
caaacaaacaaaaaccagugaccuau

SEQ ID NO: 85580 - RNA, 23 nt, Human
caaaggacacagcgugccgggua

SEQ ID NO: 85581 - RNA, 19 nt, Human
caaaggugggagcaucaag

SEQ ID NO: 85582 - RNA, 24 nt, Human
caacaagcacauuaaaaugaacca

SEQ ID NO: 85583 - RNA, 18 nt, Human
caacauacagaacuucac

SEQ ID NO: 85584 - RNA, 24 nt, Human
caacuuauauacagcaccuuacaa

SEQ ID NO: 85585 - RNA, 21 nt, Human
caaggggugcacccuacagua

SEQ ID NO: 85586 - RNA, 19 nt, Human
caaguaucuuucccaguuu

SEQ ID NO: 85587 - RNA, 22 nt, Human
cacaaucagacacuaaaaacua

SEQ ID NO: 85588 - RNA, 20 nt, Human
cacaccacucccacacgaag

SEQ ID NO: 85589 - RNA, 21 nt, Human
cacaccacucccacacgaagg

SEQ ID NO: 85590 - RNA, 22 nt, Human
caccaaaacugcaggugagaac

SEQ ID NO: 85591 - RNA, 22 nt, Human
cacccacaccacucccacacga

SEQ ID NO: 85592 - RNA, 22 nt, Human
cacccccaucccaaccccuguc

SEQ ID NO: 85593 - RNA, 21 nt, Human
caccugucauucaauuguccu

SEQ ID NO: 85594 - RNA, 18 nt, Human
cacucaccucgccuccgc

SEQ ID NO: 85595 - RNA, 24 nt, Human
cacugccgagcuuuggaaaauuuu

SEQ ID NO: 85596 - RNA, 20 nt, Human
cagaagggaacagacuagga

SEQ ID NO: 85597 - RNA, 20 nt, Human
cagaauaaccaccuugcauu

SEQ ID NO: 85598 - RNA, 24 nt, Human
cagacaacugaaaaaagcaccauu

SEQ ID NO: 85599 - RNA, 20 nt, Human
cagacagacacaaacacaca

SEQ ID NO: 85600 - RNA, 23 nt, Human
cagaccagauggaaguuuguauc

SEQ ID NO: 85601 - RNA, 21 nt, Human
cagcaaagaugcaacuuucca

SEQ ID NO: 85602 - RNA, 21 nt, Human
cagcagcagcaaaugacuguc

SEQ ID NO: 85603 - RNA, 25 nt, Human
cagcagcagcagcagcagcaaauga

SEQ ID NO: 85604 - RNA, 21 nt, Human
cagcaggagauagaugcagga

SEQ ID NO: 85605 - RNA, 23 nt, Human
cagcugagcauuacuaaaaugau

SEQ ID NO: 85606 - RNA, 22 nt, Human
caggaggggcccagcggccgcu

SEQ ID NO: 85607 - RNA, 26 nt, Human
caggauccacaacaacaaaaguguca

SEQ ID NO: 85608 - RNA, 22 nt, Human
cagggcccgaugggaacacggg

SEQ ID NO: 85609 - RNA, 18 nt, Human
caguucgagaagcagcag

SEQ ID NO: 85610 - RNA, 23 nt, Human
cauaaaauaagguauguauuuga

SEQ ID NO: 85611 - RNA, 20 nt, Human
cauaagaaaagacagacaac

SEQ ID NO: 85612 - RNA, 22 nt, Human
cauaagaaaagacagacaacug

SEQ ID NO: 85613 - RNA, 22 nt, Human
caucccaaccccuguccccaaa

SEQ ID NO: 85614 - RNA, 21 nt, Human
caugugcaacacauucauaua

SEQ ID NO: 85615 - RNA, 24 nt, Human
cauuacagagccccagccucgaag

SEQ ID NO: 85616 - RNA, 22 nt, Human
ccaaaacugcaggugagaacug

SEQ ID NO: 85617 - RNA, 18 nt, Human
ccacacccaagauucaac

SEQ ID NO: 85618 - RNA, 22 nt, Human
ccacaccuuaggagaaaaagcg

SEQ ID NO: 85619 - RNA, 20 nt, Human
ccacagacagacacaaacac

SEQ ID NO: 85620 - RNA, 19 nt, Human
ccaccacccacaccacucc

SEQ ID NO: 85621 - RNA, 22 nt, Human
ccacugugacucucaacuguau

SEQ ID NO: 85622 - RNA, 20 nt, Human
ccaggguuggggaggguccu

SEQ ID NO: 85623 - RNA, 24 nt, Human
cccaagccaaucucugcccugaga

SEQ ID NO: 85624 - RNA, 19 nt, Human
cccacacccccaucccaac

SEQ ID NO: 85625 - RNA, 21 nt, Human
cccacacccccaucccaaccc

SEQ ID NO: 85626 - RNA, 22 nt, Human
cccacacccccaucccaacccc

SEQ ID NO: 85627 - RNA, 19 nt, Human
cccacagacagacacaaac

SEQ ID NO: 85628 - RNA, 18 nt, Human
ccccaaauaaacacuguu

SEQ ID NO: 85629 - RNA, 27 nt, Human
ccccaagccaaucucugcccugagagc

SEQ ID NO: 85630 - RNA, 21 nt, Human
ccccagccucgaagaccuuuc

SEQ ID NO: 85631 - RNA, 19 nt, Human
ccgcauuacacaaaaacaa

SEQ ID NO: 85632 - RNA, 20 nt, Human
ccuaagaguagcagaguaac

SEQ ID NO: 85633 - RNA, 22 nt, Human
ccuaagaguagcagaguaacuc

SEQ ID NO: 85634 - RNA, 18 nt, Human
ccuauaucugcugaacuc

SEQ ID NO: 85635 - RNA, 24 nt, Human
ccuaucuuaucuuccauccaaaag

SEQ ID NO: 85636 - RNA, 26 nt, Human
ccucaaaacaaacaaacaaaaaccag

SEQ ID NO: 85637 - RNA, 21 nt, Human
ccucugcuggugucaggaggc

SEQ ID NO: 85638 - RNA, 21 nt, Human
ccuggggggugggagcuuugu

SEQ ID NO: 85639 - RNA, 19 nt, Human
ccuguccccaaauaaacac

SEQ ID NO: 85640 - RNA, 21 nt, Human
cgacggaucaccuucgagacc

SEQ ID NO: 85641 - RNA, 24 nt, Human
cgccacacuagccaugaggcgaca

SEQ ID NO: 85642 - RNA, 18 nt, Human
cgccuggguacaaaauuc

SEQ ID NO: 85643 - RNA, 21 nt, Human
cggucagaccagauggaaguu

SEQ ID NO: 85644 - RNA, 20 nt, Human
cguaagugguaaaauguuag

SEQ ID NO: 85645 - RNA, 21 nt, Human
cuacucuuucaacgccacacu

SEQ ID NO: 85646 - RNA, 23 nt, Human
cuagugacauacaauaacccaca

SEQ ID NO: 85647 - RNA, 23 nt, Human
cucaaaacaaacaaacaaaaacc

SEQ ID NO: 85648 - RNA, 20 nt, Human
cucaaaauaacaagucagaa

SEQ ID NO: 85649 - RNA, 24 nt, Human
cucccgcauuacacaaaaacaagg

SEQ ID NO: 85650 - RNA, 18 nt, Human
cuccgcaucugugggcac

SEQ ID NO: 85651 - RNA, 26 nt, Human
cugaaaaagcaaacguaugcuggaag

SEQ ID NO: 85652 - RNA, 25 nt, Human
cugacauuuucaaagucagaacaua

SEQ ID NO: 85653 - RNA, 21 nt, Human
cugaccaagaauccacugcaa

SEQ ID NO: 85654 - RNA, 21 nt, Human
cugcagauaagcccuucuccu

SEQ ID NO: 85655 - RNA, 24 nt, Human
cugcugcucuuauaaaagccagug

SEQ ID NO: 85656 - RNA, 24 nt, Human
cuggagagccagugaaccuucagg

SEQ ID NO: 85657 - RNA, 18 nt, Human
cugugcuccaacucuugc

SEQ ID NO: 85658 - RNA, 23 nt, Human
cuguggggugcaucuccugcuuc

SEQ ID NO: 85659 - RNA, 24 nt, Human
cuguuggccccuauuuccugccuc

SEQ ID NO: 85660 - RNA, 19 nt, Human
cuuaagcaagcaacacaaa

SEQ ID NO: 85661 - RNA, 20 nt, Human
cuuauagaugggauucaaga

SEQ ID NO: 85662 - RNA, 25 nt, Human
cuucccuaucuuaucuuccauccaa

SEQ ID NO: 85663 - RNA, 21 nt, Human
cuucccuucuugguuucuuuc

SEQ ID NO: 85664 - RNA, 20 nt, Human
cuuccuaacaaugcaaucca

SEQ ID NO: 85665 - RNA, 21 nt, Human
cuugguuucuuucuccagcug

SEQ ID NO: 85666 - RNA, 19 nt, Human
cuuuccucgcaccaagaag

SEQ ID NO: 85667 - RNA, 20 nt, Human
cuuuuuacccggugcucuuc

SEQ ID NO: 85668 - RNA, 24 nt, Human
gaaaaaggcacagagagacuugga

SEQ ID NO: 85669 - RNA, 21 nt, Human
gaaccuggggggugggagcuu

SEQ ID NO: 85670 - RNA, 20 nt, Human
gaaguucucccuugcccacc

SEQ ID NO: 85671 - RNA, 18 nt, Human
gaaguucuguguaggcug

SEQ ID NO: 85672 - RNA, 23 nt, Human
gaccuuucaaagucaugguuuga

SEQ ID NO: 85673 - RNA, 23 nt, Human
gacggucacagaugccucuggag

SEQ ID NO: 85674 - RNA, 18 nt, Human
gaggagccucuuucuuga

SEQ ID NO: 85675 - RNA, 18 nt, Human
gagguccuucacuuggcu

SEQ ID NO: 85676 - RNA, 22 nt, Human
gaugugggguggcugcugggag

SEQ ID NO: 85677 - RNA, 20 nt, Human
gauugcuuuauaauaaaaau

SEQ ID NO: 85678 - RNA, 23 nt, Human
gcaccagagccuuccuaaaaaga

SEQ ID NO: 85679 - RNA, 21 nt, Human
gcacucaucuaacuucuccac

SEQ ID NO: 85680 - RNA, 26 nt, Human
gcagaguguacugcagauaagccccc

SEQ ID NO: 85681 - RNA, 18 nt, Human
gcccacacccccauccca

SEQ ID NO: 85682 - RNA, 20 nt, Human
gcgcagugucugcuaaacgu

SEQ ID NO: 85683 - RNA, 22 nt, Human
gcuuggguguguguccaugugu

SEQ ID NO: 85684 - RNA, 18 nt, Human
gggaacacgggcuccuca

SEQ ID NO: 85685 - RNA, 21 nt, Human
gggaacacgggcuccucaucu

SEQ ID NO: 85686 - RNA, 22 nt, Human
gggggugggagcuuuguuucug

SEQ ID NO: 85687 - RNA, 21 nt, Human
ggggugggagcuuuguuucug

SEQ ID NO: 85688 - RNA, 24 nt, Human
ggguauuugaagauaaaugcagag

SEQ ID NO: 85689 - RNA, 18 nt, Human
ggguggcugcugggagcc

SEQ ID NO: 85690 - RNA, 18 nt, Human
gguagguuuugagcacug

SEQ ID NO: 85691 - RNA, 24 nt, Human
gguaugaacaggucagccacaacc

SEQ ID NO: 85692 - RNA, 21 nt, Human
ggucagaugggcaaaauucca

SEQ ID NO: 85693 - RNA, 23 nt, Human
gguugaaugggaggagccucuuu

SEQ ID NO: 85694 - RNA, 18 nt, Human
guaauuaucucgccaaua

SEQ ID NO: 85695 - RNA, 19 nt, Human
guacaaaauuccucugcug

SEQ ID NO: 85696 - RNA, 19 nt, Human
gucagcgguaugcccagga

SEQ ID NO: 85697 - RNA, 22 nt, Human
gugaggcacaacaaagguggga

SEQ ID NO: 85698 - RNA, 20 nt, Human
gugguaaaauguuaggcuac

SEQ ID NO: 85699 - RNA, 24 nt, Human
guucuuauagaugggauucaagau

SEQ ID NO: 85700 - RNA, 23 nt, Human
uaaaacuaacaauauuuaaaauu

SEQ ID NO: 85701 - RNA, 21 nt, Human
uaaaauagccuuaaacuagac

SEQ ID NO: 85702 - RNA, 22 nt, Human
uaaaauguuaggcuacgucccc

SEQ ID NO: 85703 - RNA, 23 nt, Human
uaaacaagcagugcagcaagccc

SEQ ID NO: 85704 - RNA, 21 nt, Human
uaaaugcagaggucacaauca

SEQ ID NO: 85705 - RNA, 24 nt, Human
uaagaaaagacagacaacugaaaa

SEQ ID NO: 85706 - RNA, 19 nt, Human
uaagaaaccaccacccaca

SEQ ID NO: 85707 - RNA, 23 nt, Human
uaagaaaccaccacccacaccac

SEQ ID NO: 85708 - RNA, 18 nt, Human
uaagccucaauucguccu

SEQ ID NO: 85709 - RNA, 23 nt, Human
uaauaaagaaugcugaaauauug

SEQ ID NO: 85710 - RNA, 23 nt, Human
uaauauauaauaaugcuuccuuc

SEQ ID NO: 85711 - RNA, 24 nt, Human
uaaugugcacggauaguguauaua

SEQ ID NO: 85712 - RNA, 23 nt, Human
uacaaauaaaaacauaagaaaag

SEQ ID NO: 85713 - RNA, 19 nt, Human
uacacaaaaacaaggacac

SEQ ID NO: 85714 - RNA, 22 nt, Human
uacaccgggaacaagggacaaa

SEQ ID NO: 85715 - RNA, 21 nt, Human
uacagaacuucacguaaaaca

SEQ ID NO: 85716 - RNA, 24 nt, Human
uacagcacagagccaccgcaccga

SEQ ID NO: 85717 - RNA, 20 nt, Human
uacaguauuaacaacuuuuu

SEQ ID NO: 85718 - RNA, 22 nt, Human
uacauagacuuuaaucuguaug

SEQ ID NO: 85719 - RNA, 22 nt, Human
uaccaacaagcacauuaaaaug

SEQ ID NO: 85720 - RNA, 20 nt, Human
uaccuuggcacacaacacag

SEQ ID NO: 85721 - RNA, 18 nt, Human
uagaggauggccccuguc

SEQ ID NO: 85722 - RNA, 18 nt, Human
uagcucacaaacaacuau

SEQ ID NO: 85723 - RNA, 21 nt, Human
uaggguauuugaagauaaaug

SEQ ID NO: 85724 - RNA, 19 nt, Human
uaguggcaaccaaaaagcu

SEQ ID NO: 85725 - RNA, 24 nt, Human
uaguuugcaugcaauuccccuaaa

SEQ ID NO: 85726 - RNA, 21 nt, Human
uauaaagcaaguugaaaaaca

SEQ ID NO: 85727 - RNA, 25 nt, Human
uaucuacauauauauaaugugcacg

SEQ ID NO: 85728 - RNA, 27 nt, Human
uaucuuaucuuccauccaaaagucucc

SEQ ID NO: 85729 - RNA, 25 nt, Human
uaucuuccauccaaaagucuccaaa

SEQ ID NO: 85730 - RNA, 20 nt, Human
uauugaaauacauaauuugc

SEQ ID NO: 85731 - RNA, 24 nt, Human
uauugaugcaaacuccugcaacaa

SEQ ID NO: 85732 - RNA, 23 nt, Human
uauuugaagauaaaugcagaggu

SEQ ID NO: 85733 - RNA, 22 nt, Human
ucaaaacaaacaaacaaaaacc

SEQ ID NO: 85734 - RNA, 28 nt, Human
ucacaaacaacuauugaaaaguucaaau

SEQ ID NO: 85735 - RNA, 19 nt, Human
ucacuggaacaagacugaa

SEQ ID NO: 85736 - RNA, 19 nt, Human
ucacuuccaucuuagccug

SEQ ID NO: 85737 - RNA, 23 nt, Human
ucacuuccaucuuagccugucca

SEQ ID NO: 85738 - RNA, 22 nt, Human
ucagaaccuccacugugacucu

SEQ ID NO: 85739 - RNA, 21 nt, Human
ucagagaggaaggcagggauu

SEQ ID NO: 85740 - RNA, 19 nt, Human
ucaugcucaacaguucucc

SEQ ID NO: 85741 - RNA, 23 nt, Human
ucauuuguuuccuggauguuagg

SEQ ID NO: 85742 - RNA, 20 nt, Human
uccaaagcauaagaaaccac

SEQ ID NO: 85743 - RNA, 21 nt, Human
uccaaagcauaagaaaccacc

SEQ ID NO: 85744 - RNA, 21 nt, Human
uccauccaaaagucuccaaaa

SEQ ID NO: 85745 - RNA, 21 nt, Human
ucccaaccccuguccccaaau

SEQ ID NO: 85746 - RNA, 19 nt, Human
ucccaccaaauguucuucc

SEQ ID NO: 85747 - RNA, 23 nt, Human
uccccggacaagccugugcucca

SEQ ID NO: 85748 - RNA, 27 nt, Human
uccccggacaagccugugcuccaacuc

SEQ ID NO: 85749 - RNA, 19 nt, Human
ucccugcgcccacagcaga

SEQ ID NO: 85750 - RNA, 23 nt, Human
uccuacaccgggaacaagggaca

SEQ ID NO: 85751 - RNA, 24 nt, Human
uccucaaaacaaacaaacaaaaac

SEQ ID NO: 85752 - RNA, 21 nt, Human
uccugcaacaauaaugacuuu

SEQ ID NO: 85753 - RNA, 21 nt, Human
ucuacagagguaagaagcaga

SEQ ID NO: 85754 - RNA, 18 nt, Human
ucucaugcucaacaguuc

SEQ ID NO: 85755 - RNA, 21 nt, Human
ucucuagggugguugaauggg

SEQ ID NO: 85756 - RNA, 20 nt, Human
ucugacccuggcaguaacau

SEQ ID NO: 85757 - RNA, 23 nt, Human
ucugacuguccaguucuugccuu

SEQ ID NO: 85758 - RNA, 22 nt, Human
ucugcaaaggacacagcgugcc

SEQ ID NO: 85759 - RNA, 18 nt, Human
ucugcuggugucaggagg

SEQ ID NO: 85760 - RNA, 26 nt, Human
ucuguguaggcuggaugugggguggc

SEQ ID NO: 85761 - RNA, 18 nt, Human
ucuugaaagaacaauagg

SEQ ID NO: 85762 - RNA, 25 nt, Human
ugaaaaaaaucuaaauuacugaaga

SEQ ID NO: 85763 - RNA, 26 nt, Human
ugaaaaaagcaccauuuuaagugagg

SEQ ID NO: 85764 - RNA, 22 nt, Human
ugaaaaacaacauuuuucugac

SEQ ID NO: 85765 - RNA, 25 nt, Human
ugaaaaacaacauuuuucugacuca

SEQ ID NO: 85766 - RNA, 18 nt, Human
ugaaaaauagcaacauac

SEQ ID NO: 85767 - RNA, 21 nt, Human
ugaaaagacaacauacagaac

SEQ ID NO: 85768 - RNA, 18 nt, Human
ugaaagaacaauaggccc

SEQ ID NO: 85769 - RNA, 20 nt, Human
ugaaagagaucaaacggaga

SEQ ID NO: 85770 - RNA, 21 nt, Human
ugaaagagaucaaacggagau

SEQ ID NO: 85771 - RNA, 22 nt, Human
ugaaagagaucaaacggagaua

SEQ ID NO: 85772 - RNA, 20 nt, Human
ugaaagcuaugaaaugaaaa

SEQ ID NO: 85773 - RNA, 21 nt, Human
ugaaaugaaaaauagcaacag

SEQ ID NO: 85774 - RNA, 18 nt, Human
ugaaccugggggguggga

SEQ ID NO: 85775 - RNA, 19 nt, Human
ugaaccuggggggugggag

SEQ ID NO: 85776 - RNA, 23 nt, Human
ugaagugcucugcaccagagccu

SEQ ID NO: 85777 - RNA, 18 nt, Human
ugaaugggaauggaugag

SEQ ID NO: 85778 - RNA, 21 nt, Human
ugacacaguuucugcaacaac

SEQ ID NO: 85779 - RNA, 23 nt, Human
ugagaacugaaaugauggaauca

SEQ ID NO: 85780 - RNA, 18 nt, Human
ugagagcuagagcugugg

SEQ ID NO: 85781 - RNA, 22 nt, Human
ugagcacugcauuccuuuaaga

SEQ ID NO: 85782 - RNA, 22 nt, Human
ugaggcaccuuaguugcugaaa

SEQ ID NO: 85783 - RNA, 22 nt, Human
ugauagggguauaucuacauau

SEQ ID NO: 85784 - RNA, 24 nt, Human
ugcagaacugaacuaagcugucga

SEQ ID NO: 85785 - RNA, 21 nt, Human
ugcccacacccccaucccaac

SEQ ID NO: 85786 - RNA, 21 nt, Human
ugcccccuccacuguucucug

SEQ ID NO: 85787 - RNA, 18 nt, Human
ugcgcccacagcagaaug

SEQ ID NO: 85788 - RNA, 21 nt, Human
ugcuaacccauaacuaaacac

SEQ ID NO: 85789 - RNA, 23 nt, Human
ugcucugagccccuucuugaggc

SEQ ID NO: 85790 - RNA, 22 nt, Human
ugcucugcaccagagccuuccu

SEQ ID NO: 85791 - RNA, 25 nt, Human
ugcucugcaccagagccuuccuaaa

SEQ ID NO: 85792 - RNA, 19 nt, Human
ugcuggaggaugagggcag

SEQ ID NO: 85793 - RNA, 18 nt, Human
uggaacaagacugaaucc

SEQ ID NO: 85794 - RNA, 18 nt, Human
uggaagauagaggauggc

SEQ ID NO: 85795 - RNA, 22 nt, Human
uggacacagacggucacagaug

SEQ ID NO: 85796 - RNA, 18 nt, Human
uggagagccagugaaccu

SEQ ID NO: 85797 - RNA, 24 nt, Human
uggcagaguguacugcagauaagc

SEQ ID NO: 85798 - RNA, 19 nt, Human
uggcagcuggcgguggugg

SEQ ID NO: 85799 - RNA, 18 nt, Human
uggcaguaacauaaacuu

SEQ ID NO: 85800 - RNA, 23 nt, Human
ugggagcaucaagugcaggaggg

SEQ ID NO: 85801 - RNA, 24 nt, Human
ugggaggagccucuuucuugaaag

SEQ ID NO: 85802 - RNA, 21 nt, Human
ugggagucauggaaucaucau

SEQ ID NO: 85803 - RNA, 20 nt, Human
ugggauuucuuguggcuugg

SEQ ID NO: 85804 - RNA, 19 nt, Human
ugggcuggaagcaacauuu

SEQ ID NO: 85805 - RNA, 20 nt, Human
ugggguuuggaacagucucu

SEQ ID NO: 85806 - RNA, 19 nt, Human
uggugucaggaggccuccc

SEQ ID NO: 85807 - RNA, 18 nt, Human
uguaaaagaaaaaggcac

SEQ ID NO: 85808 - RNA, 23 nt, Human
uguagaccacugcaaggcuaauc

SEQ ID NO: 85809 - RNA, 22 nt, Human
ugucugacccuggcaguaacau

SEQ ID NO: 85810 - RNA, 21 nt, Human
ugugcacggauaguguauaua

SEQ ID NO: 85811 - RNA, 21 nt, Human
ugugcuuuuuacccggugcuc

SEQ ID NO: 85812 - RNA, 21 nt, Human
ugugguggggagggugaggac

SEQ ID NO: 85813 - RNA, 19 nt, Human
uguguccauguguuuaugu

SEQ ID NO: 85814 - RNA, 24 nt, Human
uguugccauucuaaguagcaaaau

SEQ ID NO: 85815 - RNA, 23 nt, Human
uuaaauaacuauuuaacaaaggc

SEQ ID NO: 85816 - RNA, 21 nt, Human
uuagacucuacucugguggca

SEQ ID NO: 85817 - RNA, 24 nt, Human
uucaaagcaucccguucucuguuu

SEQ ID NO: 85818 - RNA, 20 nt, Human
uucacacuucuuucucuugu

SEQ ID NO: 85819 - RNA, 22 nt, Human
uucacguaaaacaguucccuug

SEQ ID NO: 85820 - RNA, 23 nt, Human
uucagagaggaaggcagggauuu

SEQ ID NO: 85821 - RNA, 23 nt, Human
uuccaauccucaaaacaaacaaa

SEQ ID NO: 85822 - RNA, 19 nt, Human
uuccacacagguuguaagc

SEQ ID NO: 85823 - RNA, 18 nt, Human
uuccccugcccacacccc

SEQ ID NO: 85824 - RNA, 20 nt, Human
uucuuaaugaugaaucccaa

SEQ ID NO: 85825 - RNA, 21 nt, Human
uucuuggaugcuucuggggac

SEQ ID NO: 85826 - RNA, 21 nt, Human
uugaaccuggggggugggagc

SEQ ID NO: 85827 - RNA, 23 nt, Human
uugcacugcuggaggaugagggc

SEQ ID NO: 85828 - RNA, 20 nt, Human
uugggguuuggaacagucuc

SEQ ID NO: 85829 - RNA, 22 nt, Human
uugggguuuggaacagucucuc

SEQ ID NO: 85830 - RNA, 20 nt, Human
uuguaucauuucagucuagu

SEQ ID NO: 85831 - RNA, 22 nt, Human
uugucuguucacaucucuguga

SEQ ID NO: 85832 - RNA, 26 nt, Human
uuuacuuauuccucugacacaguuuc

SEQ ID NO: 85833 - RNA, 23 nt, Human
uuucuaagaacagggucuucuug

SEQ ID NO: 85834 - RNA, 18 nt, Human
uuucuuggaugcuucugg

SEQ ID NO: 85835 - RNA, 21 nt, Human
aaacacaaaaucuguaccagu

SEQ ID NO: 85836 - RNA, 24 nt, Human
aaacacaaaaucuguaccaguuau

SEQ ID NO: 85837 - RNA, 23 nt, Human
aaauggcauuguuuaauaagaac

SEQ ID NO: 85838 - RNA, 20 nt, Human
aacgcuuuugcaaagacaac

SEQ ID NO: 85839 - RNA, 22 nt, Human
aagaaugaggaugaaauaaaga

SEQ ID NO: 85840 - RNA, 19 nt, Human
accacaauuccuaaaaaca

SEQ ID NO: 85841 - RNA, 18 nt, Human
acccagggcucccuccac

SEQ ID NO: 85842 - RNA, 28 nt, Human
agagaagaaaagcauaagcacuugagag

SEQ ID NO: 85843 - RNA, 19 nt, Human
aggaaaguugggggguggg

SEQ ID NO: 85844 - RNA, 27 nt, Human
agggaggaaaguuggggggugggcggg

SEQ ID NO: 85845 - RNA, 28 nt, Human
caccaugacucagauaccacaauuccua

SEQ ID NO: 85846 - RNA, 25 nt, Human
cccuccaccaccauaucucagguuc

SEQ ID NO: 85847 - RNA, 20 nt, Human
ccuuuaagaaugaggaugaa

SEQ ID NO: 85848 - RNA, 23 nt, Human
cgcaguaaaucucccacagucuc

SEQ ID NO: 85849 - RNA, 22 nt, Human
cuccccuucaagacauuuguca

SEQ ID NO: 85850 - RNA, 19 nt, Human
cugcauuuucugucuccuu

SEQ ID NO: 85851 - RNA, 21 nt, Human
gcauaagcacuugagagacca

SEQ ID NO: 85852 - RNA, 19 nt, Human
ggaaaguuggggggugggc

SEQ ID NO: 85853 - RNA, 19 nt, Human
ggagacauaaauuccaaac

SEQ ID NO: 85854 - RNA, 23 nt, Human
ggagcucugaccacucgacccag

SEQ ID NO: 85855 - RNA, 20 nt, Human
gggaauguggguggcagaga

SEQ ID NO: 85856 - RNA, 18 nt, Human
gggggugggcgggaugug

SEQ ID NO: 85857 - RNA, 18 nt, Human
ggguggcagagagaagaa

SEQ ID NO: 85858 - RNA, 22 nt, Human
guaaaucucccacagucucaca

SEQ ID NO: 85859 - RNA, 20 nt, Human
guccggagcucugaccacuc

SEQ ID NO: 85860 - RNA, 21 nt, Human
gucuucagcagguaauuucuu

SEQ ID NO: 85861 - RNA, 27 nt, Human
uaaauuccaaacucgaggggccucaca

SEQ ID NO: 85862 - RNA, 19 nt, Human
uaagaaugaggaugaaaua

SEQ ID NO: 85863 - RNA, 21 nt, Human
uauaaacacaaaaucuguacc

SEQ ID NO: 85864 - RNA, 19 nt, Human
uauggugaucaggagggug

SEQ ID NO: 85865 - RNA, 22 nt, Human
ucacaguacagaggaaauacaa

SEQ ID NO: 85866 - RNA, 26 nt, Human
ucacaugcacugucuguuuuucccuc

SEQ ID NO: 85867 - RNA, 18 nt, Human
ucaucugcaugccaaucu

SEQ ID NO: 85868 - RNA, 20 nt, Human
uccaugggaaggugaaggga

SEQ ID NO: 85869 - RNA, 21 nt, Human
uccggagcucugaccacucga

SEQ ID NO: 85870 - RNA, 19 nt, Human
ugaaguugcauggggcugg

SEQ ID NO: 85871 - RNA, 20 nt, Human
ugaggaugaaauaaagacau

SEQ ID NO: 85872 - RNA, 18 nt, Human
ugggaauguggguggcag

SEQ ID NO: 85873 - RNA, 19 nt, Human
uggggggugggcgggaugu

SEQ ID NO: 85874 - RNA, 20 nt, Human
uggggggugggcgggaugug

SEQ ID NO: 85875 - RNA, 20 nt, Human
ugucagaagucagagccugu

SEQ ID NO: 85876 - RNA, 21 nt, Human
ugucuccuuguuuauaaacac

SEQ ID NO: 85877 - RNA, 21 nt, Human
uguuggcgagagggccuuccu

SEQ ID NO: 85878 - RNA, 18 nt, Human
uuugucauauuuugaagu

SEQ ID NO: 85879 - RNA, 18 nt, Human
uuuuuuuuuuuuuuuuug

SEQ ID NO: 85880 - RNA, 18 nt, Human
aaacagauguaccuauaa

SEQ ID NO: 85881 - RNA, 18 nt, Human
aacauuuaagucauuuca

SEQ ID NO: 85882 - RNA, 21 nt, Human
aaugguacuugcaagacugac

SEQ ID NO: 85883 - RNA, 23 nt, Human
acacuuugaauaucaacaaagca

SEQ ID NO: 85884 - RNA, 24 nt, Human
agacugaccuauauaaagaaauaa

SEQ ID NO: 85885 - RNA, 20 nt, Human
agcauacuucauaaggucau

SEQ ID NO: 85886 - RNA, 21 nt, Human
auagaggcaacaugccaagaa

SEQ ID NO: 85887 - RNA, 18 nt, Human
gaaaauacucacggccuu

SEQ ID NO: 85888 - RNA, 25 nt, Human
gccaagaauuaaaguacaaccauaa

SEQ ID NO: 85889 - RNA, 21 nt, Human
gcuuagaaaauacucacggcc

SEQ ID NO: 85890 - RNA, 18 nt, Human
gugcuaaucaauaaagau

SEQ ID NO: 85891 - RNA, 24 nt, Human
uaaaauaguacaaauguuuacaaa

SEQ ID NO: 85892 - RNA, 21 nt, Human
uaaaauccucagugcuaauca

SEQ ID NO: 85893 - RNA, 19 nt, Human
uaaacuuuuaguuucacac

SEQ ID NO: 85894 - RNA, 21 nt, Human
uaaacuuuuaguuucacacuu

SEQ ID NO: 85895 - RNA, 19 nt, Human
uaaaguacaaccauaaacu

SEQ ID NO: 85896 - RNA, 23 nt, Human
uaaaguacaaccauaaacuuuua

SEQ ID NO: 85897 - RNA, 18 nt, Human
uaaaugggacauagaggc

SEQ ID NO: 85898 - RNA, 18 nt, Human
uauacagaaaaaaaugaa

SEQ ID NO: 85899 - RNA, 22 nt, Human
uaucacaauguuaaaauccuca

SEQ ID NO: 85900 - RNA, 27 nt, Human
ucauccaucaacauacaaccuuauuuc

SEQ ID NO: 85901 - RNA, 19 nt, Human
ucuaaacacuggcuuagaa

SEQ ID NO: 85902 - RNA, 23 nt, Human
ugccaaaauucauccaucaacau

SEQ ID NO: 85903 - RNA, 25 nt, Human
ugccaagaauuaaaguacaaccaua

SEQ ID NO: 85904 - RNA, 19 nt, Human
uguguacaucaaaaccaaa

SEQ ID NO: 85905 - RNA, 26 nt, Human
uuaaaguacaaccauaaacuuuuagu

SEQ ID NO: 85906 - RNA, 27 nt, Human
uuucacagcugcuuauaaaaugguacu

SEQ ID NO: 85907 - RNA, 23 nt, Human
aaaguguugggauuacaggugua

SEQ ID NO: 85908 - RNA, 22 nt, Human
aacuccuaggcucaagcaaucc

SEQ ID NO: 85909 - RNA, 19 nt, Human
aagcacacaccaccaugcc

SEQ ID NO: 85910 - RNA, 20 nt, Human
aagcacacaccaccaugccc

SEQ ID NO: 85911 - RNA, 20 nt, Human
aaguagcugggacuacaagc

SEQ ID NO: 85912 - RNA, 24 nt, Human
aaguagcugggacuacaagcacac

SEQ ID NO: 85913 - RNA, 21 nt, Human
aaguguugggauuacaggugu

SEQ ID NO: 85914 - RNA, 26 nt, Human
aaguguugggauuacagguguaagcc

SEQ ID NO: 85915 - RNA, 20 nt, Human
aaucauucaggacuagucug

SEQ ID NO: 85916 - RNA, 18 nt, Human
acagguguaagccaccgc

SEQ ID NO: 85917 - RNA, 25 nt, Human
acuauuauuacuauauuagacauau

SEQ ID NO: 85918 - RNA, 21 nt, Human
acucaauaagggaugcaauuu

SEQ ID NO: 85919 - RNA, 25 nt, Human
acucugucgccuaggcuggaaugca

SEQ ID NO: 85920 - RNA, 20 nt, Human
agacgauaacucacauccuc

SEQ ID NO: 85921 - RNA, 19 nt, Human
agagagaggauuuugccau

SEQ ID NO: 85922 - RNA, 20 nt, Human
agccaccgcacccaccccug

SEQ ID NO: 85923 - RNA, 21 nt, Human
agcugggacuacaagcacaca

SEQ ID NO: 85924 - RNA, 21 nt, Human
aggacauucacaaauggcaaa

SEQ ID NO: 85925 - RNA, 25 nt, Human
agguaauucucccaccucagccucc

SEQ ID NO: 85926 - RNA, 25 nt, Human
aucugucucugccucucucuccauc

SEQ ID NO: 85927 - RNA, 18 nt, Human
augucuucagggaucugu

SEQ ID NO: 85928 - RNA, 18 nt, Human
auucaucuggccucaaac

SEQ ID NO: 85929 - RNA, 23 nt, Human
caaaacaaccaaaaggcguuacc

SEQ ID NO: 85930 - RNA, 20 nt, Human
caaaguguugggauuacagg

SEQ ID NO: 85931 - RNA, 20 nt, Human
caaaguguugggauuacagg

SEQ ID NO: 85932 - RNA, 24 nt, Human
caaaguguugggauuacaggugua

SEQ ID NO: 85933 - RNA, 28 nt, Human
caacuccuaggcucaagcaauccucccu

SEQ ID NO: 85934 - RNA, 23 nt, Human
cacacaccaccaugcccggcuaa

SEQ ID NO: 85935 - RNA, 24 nt, Human
cacaccaccaugcccggcuaauuu

SEQ ID NO: 85936 - RNA, 24 nt, Human
caccaugcccggcuaauuuuugua

SEQ ID NO: 85937 - RNA, 24 nt, Human
caccucagccuccuaaguagcugg

SEQ ID NO: 85938 - RNA, 20 nt, Human
cacuccagcuucuauuucca

SEQ ID NO: 85939 - RNA, 24 nt, Human
cacucugucgccuaggcuggaaug

SEQ ID NO: 85940 - RNA, 20 nt, Human
caggccuggcugucugucau

SEQ ID NO: 85941 - RNA, 22 nt, Human
cauguuucccaggcuggccuuc

SEQ ID NO: 85942 - RNA, 30 nt, Human
cauuuugcuuucuuggguguacagucuuaa

SEQ ID NO: 85943 - RNA, 24 nt, Human
ccaccccuggauguauuucuuaac

SEQ ID NO: 85944 - RNA, 23 nt, Human
cccaccucagccuccuaaguagc

SEQ ID NO: 85945 - RNA, 19 nt, Human
ccuaaguagcugggacuac

SEQ ID NO: 85946 - RNA, 21 nt, Human
ccuaggcuggaaugcaggggc

SEQ ID NO: 85947 - RNA, 18 nt, Human
ccuggcuggcuggaagcu

SEQ ID NO: 85948 - RNA, 20 nt, Human
cucaagcaauccucccaccu

SEQ ID NO: 85949 - RNA, 27 nt, Human
cucaagcaauccucccaccuuggccuc

SEQ ID NO: 85950 - RNA, 24 nt, Human
cucagccuccuaaguagcugggac

SEQ ID NO: 85951 - RNA, 24 nt, Human
cucagguaauucucccaccucagc

SEQ ID NO: 85952 - RNA, 22 nt, Human
cucccgguaccccaaauuucau

SEQ ID NO: 85953 - RNA, 25 nt, Human
cuccuaggcucaagcaauccuccca

SEQ ID NO: 85954 - RNA, 26 nt, Human
cuucagggaucugucucugccucucu

SEQ ID NO: 85955 - RNA, 24 nt, Human
cuuccugggcucagguaauucucc

SEQ ID NO: 85956 - RNA, 20 nt, Human
gagacagggucucacucugu

SEQ ID NO: 85957 - RNA, 21 nt, Human
gagccaggacucaauaaggga

SEQ ID NO: 85958 - RNA, 18 nt, Human
gauuacagguguaagcca

SEQ ID NO: 85959 - RNA, 23 nt, Human
gauuacagguguaagccaccgca

SEQ ID NO: 85960 - RNA, 24 nt, Human
gcaaaguguugggauuacaggugu

SEQ ID NO: 85961 - RNA, 22 nt, Human
gcccggcuaauuuuuguauuuu

SEQ ID NO: 85962 - RNA, 22 nt, Human
gccuaggcuggaaugcaggggc

SEQ ID NO: 85963 - RNA, 25 nt, Human
gcuggaaugcaggggcaugaucuca

SEQ ID NO: 85964 - RNA, 22 nt, Human
ggauuacagguguaagccaccg

SEQ ID NO: 85965 - RNA, 19 nt, Human
ggcacaggugaauucggga

SEQ ID NO: 85966 - RNA, 23 nt, Human
gggcaugaucucaacucacugga

SEQ ID NO: 85967 - RNA, 20 nt, Human
gggguugggcuuuguuuucc

SEQ ID NO: 85968 - RNA, 23 nt, Human
guccuggcucuguaaggcaacuu

SEQ ID NO: 85969 - RNA, 21 nt, Human
guccuugagaugggaggaagu

SEQ ID NO: 85970 - RNA, 24 nt, Human
uaaaguguagauaacaauuuuuaa

SEQ ID NO: 85971 - RNA, 23 nt, Human
uaaaucauucaggacuagucugg

SEQ ID NO: 85972 - RNA, 19 nt, Human
uaagggguugggcuuuguu

SEQ ID NO: 85973 - RNA, 20 nt, Human
uaauucucccaccucagccu

SEQ ID NO: 85974 - RNA, 24 nt, Human
uacagguguaagccaccgcaccca

SEQ ID NO: 85975 - RNA, 21 nt, Human
uagagagaggauuuugccaug

SEQ ID NO: 85976 - RNA, 22 nt, Human
uagagagaggauuuugccaugu

SEQ ID NO: 85977 - RNA, 24 nt, Human
ucaagcaauccucccaccuuggcc

SEQ ID NO: 85978 - RNA, 20 nt, Human
ucauucaggacuagucuggc

SEQ ID NO: 85979 - RNA, 26 nt, Human
uccauagaguaaacaguucuuuuucc

SEQ ID NO: 85980 - RNA, 18 nt, Human
uccuaaguagcugggacu

SEQ ID NO: 85981 - RNA, 18 nt, Human
uccuaggcucaagcaauc

SEQ ID NO: 85982 - RNA, 22 nt, Human
uccucccaccuuggccucgcaa

SEQ ID NO: 85983 - RNA, 23 nt, Human
uccugaaagcuuugguucuucug

SEQ ID NO: 85984 - RNA, 20 nt, Human
uccugggcucagguaauucu

SEQ ID NO: 85985 - RNA, 23 nt, Human
uccugggcucagguaauucuccc

SEQ ID NO: 85986 - RNA, 23 nt, Human
ucgcaaaguguugggauuacagg

SEQ ID NO: 85987 - RNA, 24 nt, Human
ucgcaaaguguugggauuacaggu

SEQ ID NO: 85988 - RNA, 18 nt, Human
ucgccuaggcuggaaugc

SEQ ID NO: 85989 - RNA, 23 nt, Human
ucucacucugucgccuaggcugg

SEQ ID NO: 85990 - RNA, 24 nt, Human
ucucacucugucgccuaggcugga

SEQ ID NO: 85991 - RNA, 24 nt, Human
ucucccaccucagccuccuaagua

SEQ ID NO: 85992 - RNA, 18 nt, Human
ucucugccucucucucca

SEQ ID NO: 85993 - RNA, 21 nt, Human
ucucugcuuccugggcucagg

SEQ ID NO: 85994 - RNA, 22 nt, Human
ucugaaaugucuaauaaaugga

SEQ ID NO: 85995 - RNA, 24 nt, Human
ucugucgccuaggcuggaaugcag

SEQ ID NO: 85996 - RNA, 20 nt, Human
ucugucucugccucucucuc

SEQ ID NO: 85997 - RNA, 20 nt, Human
ugaaaucccugagaugccua

SEQ ID NO: 85998 - RNA, 18 nt, Human
ugacuuauggaaaaaggc

SEQ ID NO: 85999 - RNA, 20 nt, Human
ugagacagggucucacucug

SEQ ID NO: 86000 - RNA, 22 nt, Human
ugagacagggucucacucuguc

SEQ ID NO: 86001 - RNA, 21 nt, Human
ugcagcagaaggaagauuugc

SEQ ID NO: 86002 - RNA, 26 nt, Human
ugccauguuucccaggcuggccuuca

SEQ ID NO: 86003 - RNA, 25 nt, Human
ugcccggcuaauuuuuguauuuuuu

SEQ ID NO: 86004 - RNA, 18 nt, Human
ugcugacugcaacuuggg

SEQ ID NO: 86005 - RNA, 19 nt, Human
uggaaaaaggcauuuauua

SEQ ID NO: 86006 - RNA, 20 nt, Human
uggaaucucugcuuccuggg

SEQ ID NO: 86007 - RNA, 19 nt, Human
uggaaugcaggggcaugau

SEQ ID NO: 86008 - RNA, 23 nt, Human
uggaaugcaggggcaugaucuca

SEQ ID NO: 86009 - RNA, 20 nt, Human
uggcagaucucuacuccgau

SEQ ID NO: 86010 - RNA, 21 nt, Human
uggccuucaacuccuaggcuc

SEQ ID NO: 86011 - RNA, 21 nt, Human
ugggacuacaagcacacacca

SEQ ID NO: 86012 - RNA, 24 nt, Human
ugggacuacaagcacacaccacca

SEQ ID NO: 86013 - RNA, 18 nt, Human
ugggauuacagguguaag

SEQ ID NO: 86014 - RNA, 19 nt, Human
ugggauuacagguguaagc

SEQ ID NO: 86015 - RNA, 21 nt, Human
ugggauuacagguguaagcca

SEQ ID NO: 86016 - RNA, 22 nt, Human
ugggauuacagguguaagccac

SEQ ID NO: 86017 - RNA, 23 nt, Human
ugggauuacagguguaagccacc

SEQ ID NO: 86018 - RNA, 24 nt, Human
ugggauuacagguguaagccaccg

SEQ ID NO: 86019 - RNA, 24 nt, Human
ugucagcauauucaaaacaaccaa

SEQ ID NO: 86020 - RNA, 20 nt, Human
uguguaaagugcugaggagu

SEQ ID NO: 86021 - RNA, 20 nt, Human
uguuuuuccuuuccuguuuc

SEQ ID NO: 86022 - RNA, 21 nt, Human
uuaugugcccauuucugaacc

SEQ ID NO: 86023 - RNA, 27 nt, Human
uucacaaauggcaaauuauaagcccgu

SEQ ID NO: 86024 - RNA, 28 nt, Human
uucacaaauggcaaauuauaagcccguu

SEQ ID NO: 86025 - RNA, 19 nt, Human
uuccaagcaaucuuaacuc

SEQ ID NO: 86026 - RNA, 18 nt, Human
uucuauucaucuggccuc

SEQ ID NO: 86027 - RNA, 19 nt, Human
uugcuaaauugacuugagc

SEQ ID NO: 86028 - RNA, 21 nt, Human
uuggccucgcaaaguguuggg

SEQ ID NO: 86029 - RNA, 21 nt, Human
uugggauuacagguguaagcc

SEQ ID NO: 86030 - RNA, 24 nt, Human
uuguagcacaccuccugugcuccc

SEQ ID NO: 86031 - RNA, 19 nt, Human
uuucuuggguguacagucu

SEQ ID NO: 86032 - RNA, 18 nt, Human
uuuuucuuucuuuuuuga

SEQ ID NO: 86033 - RNA, 18 nt, Human
aaaagugcugaaugaacc

SEQ ID NO: 86034 - RNA, 22 nt, Human
aaaguaaacauaagacaaaacc

SEQ ID NO: 86035 - RNA, 22 nt, Human
aaccagagagcugguuccuccc

SEQ ID NO: 86036 - RNA, 23 nt, Human
aaggaggaacaggaacccccaga

SEQ ID NO: 86037 - RNA, 25 nt, Human
acacgaauuuccucugggcugcucc

SEQ ID NO: 86038 - RNA, 21 nt, Human
acccuggaauuuccaacaguu

SEQ ID NO: 86039 - RNA, 18 nt, Human
acucaggcugucuccccc

SEQ ID NO: 86040 - RNA, 22 nt, Human
agaaggaagagaguuaccaaaa

SEQ ID NO: 86041 - RNA, 20 nt, Human
agacggaagggaggacaagc

SEQ ID NO: 86042 - RNA, 25 nt, Human
agacguagcaguaaaaccauaauuc

SEQ ID NO: 86043 - RNA, 21 nt, Human
agagcugucucaucucccucu

SEQ ID NO: 86044 - RNA, 19 nt, Human
agaggcaggaggcaugggc

SEQ ID NO: 86045 - RNA, 19 nt, Human
agaggguaaggauugacag

SEQ ID NO: 86046 - RNA, 26 nt, Human
agcauugguugggcuagggguugggg

SEQ ID NO: 86047 - RNA, 20 nt, Human
aggaagagaguuaccaaaag

SEQ ID NO: 86048 - RNA, 18 nt, Human
aggaggaggaggggcggg

SEQ ID NO: 86049 - RNA, 19 nt, Human
agggaggacaagcugcaga

SEQ ID NO: 86050 - RNA, 19 nt, Human
agggaggggagaggcagga

SEQ ID NO: 86051 - RNA, 23 nt, Human
agucaaucaaugaaacugugaaa

SEQ ID NO: 86052 - RNA, 18 nt, Human
auagcaguagcagcaugu

SEQ ID NO: 86053 - RNA, 21 nt, Human
aucucauucccuccucuuuca

SEQ ID NO: 86054 - RNA, 26 nt, Human
aucucauucccuccucuuucacacga

SEQ ID NO: 86055 - RNA, 20 nt, Human
auuaccaccuguuucaccug

SEQ ID NO: 86056 - RNA, 21 nt, Human
auucucagacagagcuaaggg

SEQ ID NO: 86057 - RNA, 20 nt, Human
cagaagaaccgaaugcugac

SEQ ID NO: 86058 - RNA, 24 nt, Human
cagaagaaccgaaugcugacaucg

SEQ ID NO: 86059 - RNA, 18 nt, Human
cagaauaggggccgagaa

SEQ ID NO: 86060 - RNA, 23 nt, Human
cagagagcugucucaucucccuc

SEQ ID NO: 86061 - RNA, 22 nt, Human
caggcaucuuccuccuuacccu

SEQ ID NO: 86062 - RNA, 27 nt, Human
cagggagaacaggcaucuuccuccuua

SEQ ID NO: 86063 - RNA, 23 nt, Human
caguaaaaccauaauucucagac

SEQ ID NO: 86064 - RNA, 22 nt, Human
caguaaaccagagagcugguuc

SEQ ID NO: 86065 - RNA, 19 nt, Human
ccacugcuaauuccaacuu

SEQ ID NO: 86066 - RNA, 20 nt, Human
ccccagaacugccacugggc

SEQ ID NO: 86067 - RNA, 22 nt, Human
ccccccggagcagagccggggc

SEQ ID NO: 86068 - RNA, 19 nt, Human
ccccggagcagagccgggg

SEQ ID NO: 86069 - RNA, 20 nt, Human
ccgaggaggaggaggggcgg

SEQ ID NO: 86070 - RNA, 24 nt, Human
ccgccgcaaaggaggaacaggaac

SEQ ID NO: 86071 - RNA, 18 nt, Human
ccggggcgagccgaggcg

SEQ ID NO: 86072 - RNA, 19 nt, Human
ccucuucagacagggagaa

SEQ ID NO: 86073 - RNA, 19 nt, Human
ccuguuucaccugcuccuc

SEQ ID NO: 86074 - RNA, 18 nt, Human
cgaauuuccucugggcug

SEQ ID NO: 86075 - RNA, 21 nt, Human
cgagccgaggcgguacggcgg

SEQ ID NO: 86076 - RNA, 18 nt, Human
cggagcagagccggggcg

SEQ ID NO: 86077 - RNA, 23 nt, Human
cgguacggcggcggcggugggcc

SEQ ID NO: 86078 - RNA, 21 nt, Human
cuucagagcaagaaauucuag

SEQ ID NO: 86079 - RNA, 23 nt, Human
gaacaggcaucuuccuccuuacc

SEQ ID NO: 86080 - RNA, 21 nt, Human
gaacugccacugggcuuaccc

SEQ ID NO: 86081 - RNA, 22 nt, Human
gaagacuauguuccaguaaacc

SEQ ID NO: 86082 - RNA, 25 nt, Human
gaauaaucucauucccuccucuuuc

SEQ ID NO: 86083 - RNA, 19 nt, Human
gagcagagccggggcgagc

SEQ ID NO: 86084 - RNA, 20 nt, Human
gaggaacaggaacccccaga

SEQ ID NO: 86085 - RNA, 23 nt, Human
gaggcgguacggcggcggcggug

SEQ ID NO: 86086 - RNA, 24 nt, Human
gaggcgguacggcggcggcggugg

SEQ ID NO: 86087 - RNA, 23 nt, Human
gaugagggagaagacggaaggga

SEQ ID NO: 86088 - RNA, 21 nt, Human
gcggcggcggugggccggcga

SEQ ID NO: 86089 - RNA, 24 nt, Human
gcgguacggcggcggcggugggcc

SEQ ID NO: 86090 - RNA, 20 nt, Human
ggaagggaggacaagcugca

SEQ ID NO: 86091 - RNA, 21 nt, Human
ggagaacaggcaucuuccucc

SEQ ID NO: 86092 - RNA, 19 nt, Human
ggcgggccgcagcugcgcc

SEQ ID NO: 86093 - RNA, 22 nt, Human
ggcgggccgcagcugcgccggc

SEQ ID NO: 86094 - RNA, 21 nt, Human
gggccgaggaggaggaggggc

SEQ ID NO: 86095 - RNA, 22 nt, Human
ggggguagggagaaaaagaagg

SEQ ID NO: 86096 - RNA, 18 nt, Human
gggguuggagcccaugcc

SEQ ID NO: 86097 - RNA, 18 nt, Human
gguagggagaaaaagaag

SEQ ID NO: 86098 - RNA, 19 nt, Human
guagggagaaaaagaagga

SEQ ID NO: 86099 - RNA, 20 nt, Human
guagggagaaaaagaaggaa

SEQ ID NO: 86100 - RNA, 19 nt, Human
uaagacaaaacccuagugg

SEQ ID NO: 86101 - RNA, 22 nt, Human
uaaguagcacugcucaaggaga

SEQ ID NO: 86102 - RNA, 19 nt, Human
uaauucucagacagagcua

SEQ ID NO: 86103 - RNA, 22 nt, Human
uaccaaaaguaaacauaagaca

SEQ ID NO: 86104 - RNA, 27 nt, Human
uacccuggaauuuccaacaguucccac

SEQ ID NO: 86105 - RNA, 20 nt, Human
uacggcggcggcggugggcc

SEQ ID NO: 86106 - RNA, 30 nt, Human
uagcauugguugggcuagggguuggggggu

SEQ ID NO: 86107 - RNA, 21 nt, Human
uaggauccauggaauagcagu

SEQ ID NO: 86108 - RNA, 22 nt, Human
ucaucucccucuucagacaggg

SEQ ID NO: 86109 - RNA, 23 nt, Human
uccaacaguucccaccaaaaagu

SEQ ID NO: 86110 - RNA, 18 nt, Human
uccaacuuccaagccuuu

SEQ ID NO: 86111 - RNA, 22 nt, Human
uccaagccuuuuacucaggcug

SEQ ID NO: 86112 - RNA, 31 nt, Human
ucccccauucccuuccuccgaauaaucucaa

SEQ ID NO: 86113 - RNA, 22 nt, Human
ucccucuucagacagggagaac

SEQ ID NO: 86114 - RNA, 19 nt, Human
ugaaccagaauaggggccg

SEQ ID NO: 86115 - RNA, 20 nt, Human
ugagggagaagacggaaggg

SEQ ID NO: 86116 - RNA, 21 nt, Human
ugagggagaagacggaaggga

SEQ ID NO: 86117 - RNA, 18 nt, Human
ugccucuaaagucacccu

SEQ ID NO: 86118 - RNA, 22 nt, Human
uggaauuuccaacaguucccac

SEQ ID NO: 86119 - RNA, 20 nt, Human
ugggcuagggguuggggggu

SEQ ID NO: 86120 - RNA, 21 nt, Human
ugggcugcuccagcguuuguu

SEQ ID NO: 86121 - RNA, 23 nt, Human
ugggggguagggagaaaaagaag

SEQ ID NO: 86122 - RNA, 23 nt, Human
ugguguggggcaaggagguagag

SEQ ID NO: 86123 - RNA, 25 nt, Human
ugguguggggcaaggagguagaguc

SEQ ID NO: 86124 - RNA, 19 nt, Human
uguuaauuccuguccagag

SEQ ID NO: 86125 - RNA, 22 nt, Human
uguuucaccugcuccuccuuca

SEQ ID NO: 86126 - RNA, 19 nt, Human
uuccucugggcugcuccag

SEQ ID NO: 86127 - RNA, 24 nt, Human
uucugcuccccacugcuaauucca

SEQ ID NO: 86128 - RNA, 18 nt, Human
uuggagcccaugccucua

SEQ ID NO: 86129 - RNA, 21 nt, Human
uuuguuaauuccuguccagag

SEQ ID NO: 86130 - RNA, 20 nt, Human
agaggucuaagaaacgagcu

SEQ ID NO: 86131 - RNA, 21 nt, Human
agaggugggugggggaggggg

SEQ ID NO: 86132 - RNA, 24 nt, Human
agaggugggugggggagggggucc

SEQ ID NO: 86133 - RNA, 19 nt, Human
agccagagagguggguggg

SEQ ID NO: 86134 - RNA, 19 nt, Human
agccaguccuggggcucuc

SEQ ID NO: 86135 - RNA, 22 nt, Human
cacagauguuuauuccaggaag

SEQ ID NO: 86136 - RNA, 18 nt, Human
cagagccagcccccuccc

SEQ ID NO: 86137 - RNA, 21 nt, Human
cagcccccucccuucagcagc

SEQ ID NO: 86138 - RNA, 19 nt, Human
cugaagcaauagcgccccc

SEQ ID NO: 86139 - RNA, 19 nt, Human
ggugggugggggagggggu

SEQ ID NO: 86140 - RNA, 18 nt, Human
ucacggggcagccagucc

SEQ ID NO: 86141 - RNA, 28 nt, Human
ucagcagcugaagcaauagccggggucc

SEQ ID NO: 86142 - RNA, 21 nt, Human
uggaagccagagaggugggug

SEQ ID NO: 86143 - RNA, 18 nt, Human
uggggcucucagagccag

SEQ ID NO: 86144 - RNA, 20 nt, Human
ugggugggggaggggguccu

SEQ ID NO: 86145 - RNA, 19 nt, Human
ugugucacggggcagccag

SEQ ID NO: 86146 - RNA, 31 nt, Human
uuccaggaagaggucuaagaaacgagcuucc

SEQ ID NO: 86147 - RNA, 21 nt, Human
uuuuuuuuuuuuuuuuuucag

SEQ ID NO: 86148 - RNA, 18 nt, Human
agggggagccggggugga

SEQ ID NO: 86149 - RNA, 23 nt, Human
auuggcugggcaagggguggugu

SEQ ID NO: 86150 - RNA, 24 nt, Human
cagcagcauucaccaagcccuacu

SEQ ID NO: 86151 - RNA, 20 nt, Human
ccuccuguggagaagacaau

SEQ ID NO: 86152 - RNA, 22 nt, Human
cgccuccuguggagaagacaau

SEQ ID NO: 86153 - RNA, 22 nt, Human
gggcaaggggugguguuggggg

SEQ ID NO: 86154 - RNA, 20 nt, Human
gugcugggacacagaguuga

SEQ ID NO: 86155 - RNA, 25 nt, Human
uaaccaacauuucugagcauggcac

SEQ ID NO: 86156 - RNA, 26 nt, Human
ucauucauucauguaaccaacauuuc

SEQ ID NO: 86157 - RNA, 22 nt, Human
ugagcguugcuggcagggggga

SEQ ID NO: 86158 - RNA, 18 nt, Human
uggugugccagugcuggg

SEQ ID NO: 86159 - RNA, 18 nt, Human
ugucagacgccuccugug

SEQ ID NO: 86160 - RNA, 22 nt, Human
ugugccagugcugggacacaga

SEQ ID NO: 86161 - RNA, 25 nt, Human
uugcuggcagggggagccggggugg

SEQ ID NO: 86162 - RNA, 21 nt, Human
uuggcugggcaagggguggug

SEQ ID NO: 86163 - RNA, 23 nt, Human
aacacgugcagaugcaaaggaca

SEQ ID NO: 86164 - RNA, 22 nt, Human
agaaaaaaaugauaauaaauga

SEQ ID NO: 86165 - RNA, 19 nt, Human
augauaauaaaugagaaca

SEQ ID NO: 86166 - RNA, 23 nt, Human
caaaggacaacccaggccuaggc

SEQ ID NO: 86167 - RNA, 19 nt, Human
cacaugucuagcuucagag

SEQ ID NO: 86168 - RNA, 25 nt, Human
cacuggccaaagccugccaugaaac

SEQ ID NO: 86169 - RNA, 22 nt, Human
cgugcagaugcaaaggacaacc

SEQ ID NO: 86170 - RNA, 21 nt, Human
gacugcgaacacgugcagaug

SEQ ID NO: 86171 - RNA, 21 nt, Human
gcaaaggacaacccaggccua

SEQ ID NO: 86172 - RNA, 20 nt, Human
ggaggagauaaaccaauuuu

SEQ ID NO: 86173 - RNA, 23 nt, Human
ucaaagcacaugucuagcuucag

SEQ ID NO: 86174 - RNA, 18 nt, Human
ugcaaaggacaacccagg

SEQ ID NO: 86175 - RNA, 19 nt, Human
uuaggaugauaaucauuuc

SEQ ID NO: 86176 - RNA, 20 nt, Human
uucacuggccaaagccugcc

SEQ ID NO: 86177 - RNA, 24 nt, Human
aaaaaaaaaaaaaagaauggcagg

SEQ ID NO: 86178 - RNA, 28 nt, Human
aaaaaaaaaaaagaauggcaguaccaga

SEQ ID NO: 86179 - RNA, 20 nt, Human
aagcagugacuccuaaagaa

SEQ ID NO: 86180 - RNA, 19 nt, Human
agaacccauggggaggggg

SEQ ID NO: 86181 - RNA, 19 nt, Human
agaaguccaucuggugggg

SEQ ID NO: 86182 - RNA, 18 nt, Human
aggaaggagagaacccau

SEQ ID NO: 86183 - RNA, 25 nt, Human
aggaaggagagaacccauggggagg

SEQ ID NO: 86184 - RNA, 26 nt, Human
aggaaggagagaacccauggggaggg

SEQ ID NO: 86185 - RNA, 18 nt, Human
aguaccagaaggcauugg

SEQ ID NO: 86186 - RNA, 19 nt, Human
cagaggaaggagagaaccc

SEQ ID NO: 86187 - RNA, 21 nt, Human
cagugacuccuaaagaaguuc

SEQ ID NO: 86188 - RNA, 25 nt, Human
cauggggagggggugcagugggggu

SEQ ID NO: 86189 - RNA, 20 nt, Human
ccuaaagaaguucagaggaa

SEQ ID NO: 86190 - RNA, 20 nt, Human
ccucucccaggcaagaggac

SEQ ID NO: 86191 - RNA, 24 nt, Human
ggagaaguccaucugguggggaaa

SEQ ID NO: 86192 - RNA, 22 nt, Human
ggagagaacccauggggagggg

SEQ ID NO: 86193 - RNA, 20 nt, Human
ggggagggggugcagugggg

SEQ ID NO: 86194 - RNA, 23 nt, Human
ggggagggggugcagugggggug

SEQ ID NO: 86195 - RNA, 21 nt, Human
gggggugggucagggugggcu

SEQ ID NO: 86196 - RNA, 24 nt, Human
gggugggcucccuggaggagaagu

SEQ ID NO: 86197 - RNA, 24 nt, Human
gugggcucccuggaggagaagucc

SEQ ID NO: 86198 - RNA, 26 nt, Human
uccaauacuugaaaaaaaaaaaaaag

SEQ ID NO: 86199 - RNA, 28 nt, Human
uccaauacuugaaaaaaaaaaaaaagaa

SEQ ID NO: 86200 - RNA, 19 nt, Human
ucugcuuccccucuccccc

SEQ ID NO: 86201 - RNA, 20 nt, Human
ucugguggggagaauggucu

SEQ ID NO: 86202 - RNA, 22 nt, Human
ucugguggggagaauggucuag

SEQ ID NO: 86203 - RNA, 22 nt, Human
ugagggagguggaaggcccgug

SEQ ID NO: 86204 - RNA, 21 nt, Human
uggcaguaccagaaggcauug

SEQ ID NO: 86205 - RNA, 19 nt, Human
uggggagggggugcagugg

SEQ ID NO: 86206 - RNA, 22 nt, Human
uggggagggggugcaguggggg

SEQ ID NO: 86207 - RNA, 23 nt, Human
uuauuuauauaucuccccacccc

SEQ ID NO: 86208 - RNA, 18 nt, Human
uucagaggaaggagagaa

SEQ ID NO: 86209 - RNA, 22 nt, Human
aagaaagaaaggggcccuuugg

SEQ ID NO: 86210 - RNA, 21 nt, Human
aggaaagagaauuucacacac

SEQ ID NO: 86211 - RNA, 23 nt, Human
ccacacugcucucuggauucgaa

SEQ ID NO: 86212 - RNA, 28 nt, Human
cuggucaguuguuuuuuguuuuuuuuuu

SEQ ID NO: 86213 - RNA, 18 nt, Human
gaaccuagugaauucugg

SEQ ID NO: 86214 - RNA, 19 nt, Human
ggcccuuugguuguuucag

SEQ ID NO: 86215 - RNA, 22 nt, Human
uccucugcaauccucagaagaa

SEQ ID NO: 86216 - RNA, 21 nt, Human
uuccacacugcucucuggauu

SEQ ID NO: 86217 - RNA, 19 nt, Human
agagaggauggaucacagg

SEQ ID NO: 86218 - RNA, 24 nt, Human
agagaggauggaucacagggucua

SEQ ID NO: 86219 - RNA, 18 nt, Human
aggccaaggagcgggagg

SEQ ID NO: 86220 - RNA, 19 nt, Human
aggguggccauucagaggu

SEQ ID NO: 86221 - RNA, 21 nt, Human
caggccaaggagcgggaggug

SEQ ID NO: 86222 - RNA, 19 nt, Human
cuaggagagaggauggauc

SEQ ID NO: 86223 - RNA, 24 nt, Human
gaucacagggucuaaggguggcca

SEQ ID NO: 86224 - RNA, 21 nt, Human
gggaaggaaucuggggacagg

SEQ ID NO: 86225 - RNA, 22 nt, Human
gggagguggggcagcgaggcag

SEQ ID NO: 86226 - RNA, 21 nt, Human
gggcagcagagggcucagugg

SEQ ID NO: 86227 - RNA, 20 nt, Human
uagaagauggaggggcggca

SEQ ID NO: 86228 - RNA, 19 nt, Human
uauuaauuucauaacuggg

SEQ ID NO: 86229 - RNA, 23 nt, Human
ucuggcagggcagcagagggcuc

SEQ ID NO: 86230 - RNA, 23 nt, Human
ugaaacaagcaugagucaaguca

SEQ ID NO: 86231 - RNA, 24 nt, Human
ugugaaagugaaacaagcaugagu

SEQ ID NO: 86232 - RNA, 25 nt, Human
uugugugcgcugccucuggcauccu

SEQ ID NO: 86233 - RNA, 23 nt, Human
uuucccagcuugugugcgcugcc

SEQ ID NO: 86234 - RNA, 24 nt, Human
uuucccagcuugugugcgcugccu

SEQ ID NO: 86235 - RNA, 23 nt, Human
aaaacaauucucaacaaaacugg

SEQ ID NO: 86236 - RNA, 21 nt, Human
aaauggguucucuccaugccc

SEQ ID NO: 86237 - RNA, 18 nt, Human
aacggcagccccacccag

SEQ ID NO: 86238 - RNA, 24 nt, Human
aagaaaacaauucucaacaaaacu

SEQ ID NO: 86239 - RNA, 21 nt, Human
aagccccugcucgcacccugc

SEQ ID NO: 86240 - RNA, 19 nt, Human
agagaagcguggcccgaag

SEQ ID NO: 86241 - RNA, 24 nt, Human
agcaaagggauccuuaacuauaaa

SEQ ID NO: 86242 - RNA, 21 nt, Human
agccccugcucgcacccugcc

SEQ ID NO: 86243 - RNA, 19 nt, Human
aggggcuggaaggugaacu

SEQ ID NO: 86244 - RNA, 21 nt, Human
aggucaccuucugugguuuaa

SEQ ID NO: 86245 - RNA, 20 nt, Human
caacaaaacuggaguccaca

SEQ ID NO: 86246 - RNA, 20 nt, Human
caagacgguccuagguuuga

SEQ ID NO: 86247 - RNA, 22 nt, Human
caagagaagcguggcccgaagc

SEQ ID NO: 86248 - RNA, 24 nt, Human
caaucuucucuuucaccccuuuuc

SEQ ID NO: 86249 - RNA, 18 nt, Human
cacaguugucaaguaugc

SEQ ID NO: 86250 - RNA, 21 nt, Human
caccgcaaccgccucagaagc

SEQ ID NO: 86251 - RNA, 19 nt, Human
cacugugcugacacagaga

SEQ ID NO: 86252 - RNA, 23 nt, Human
cagcaggucaccuucugugguuu

SEQ ID NO: 86253 - RNA, 22 nt, Human
caugaauccacgcagucuucuu

SEQ ID NO: 86254 - RNA, 18 nt, Human
caugacuuaaucucuauc

SEQ ID NO: 86255 - RNA, 24 nt, Human
ccacccagagccugcugcguggcu

SEQ ID NO: 86256 - RNA, 21 nt, Human
cccgaagccccugcucgcacc

SEQ ID NO: 86257 - RNA, 18 nt, Human
ccguuccaaacuccggga

SEQ ID NO: 86258 - RNA, 22 nt, Human
ccucacagcaaagggauccuua

SEQ ID NO: 86259 - RNA, 18 nt, Human
ccugcugcguggcugcug

SEQ ID NO: 86260 - RNA, 22 nt, Human
cgacagccucccgcaacucuuu

SEQ ID NO: 86261 - RNA, 20 nt, Human
cucaaaguugcaaucuucuc

SEQ ID NO: 86262 - RNA, 20 nt, Human
cucaacaaaacuggagucca

SEQ ID NO: 86263 - RNA, 25 nt, Human
cucuuucaccccuuuucugaaaucu

SEQ ID NO: 86264 - RNA, 19 nt, Human
cugaaaucuugaagucugg

SEQ ID NO: 86265 - RNA, 21 nt, Human
cugcugugaggcuccccauga

SEQ ID NO: 86266 - RNA, 24 nt, Human
gaagccccugcucgcacccugccc

SEQ ID NO: 86267 - RNA, 19 nt, Human
gagcaccgcaaccgccuca

SEQ ID NO: 86268 - RNA, 24 nt, Human
gcagguuuuucccaguauuuguac

SEQ ID NO: 86269 - RNA, 21 nt, Human
gcccgaagccccugcucgcac

SEQ ID NO: 86270 - RNA, 22 nt, Human
gcgaccgagcaccgcaaccgcc

SEQ ID NO: 86271 - RNA, 24 nt, Human
ggaaagacaaaacguauuuauucc

SEQ ID NO: 86272 - RNA, 20 nt, Human
ggacggacuucagcaaaauc

SEQ ID NO: 86273 - RNA, 23 nt, Human
ggcgaccgagcaccgcaaccgcc

SEQ ID NO: 86274 - RNA, 23 nt, Human
ggggagagggugagagucguaag

SEQ ID NO: 86275 - RNA, 19 nt, Human
gugccuuaacggcagcccc

SEQ ID NO: 86276 - RNA, 26 nt, Human
uaacuacauggagucuaaucgagaca

SEQ ID NO: 86277 - RNA, 23 nt, Human
uagcaauagagauuacacugugc

SEQ ID NO: 86278 - RNA, 18 nt, Human
uagccgacagccucccgc

SEQ ID NO: 86279 - RNA, 26 nt, Human
uagccuuaguaauguaagaaaacaau

SEQ ID NO: 86280 - RNA, 18 nt, Human
ucagcaggucaccuucug

SEQ ID NO: 86281 - RNA, 19 nt, Human
uccaugcccaaugacaaag

SEQ ID NO: 86282 - RNA, 20 nt, Human
ucugaaaucuugaagucugg

SEQ ID NO: 86283 - RNA, 20 nt, Human
ucuuuuuuuccuccguuucc

SEQ ID NO: 86284 - RNA, 23 nt, Human
ugaagacccauauaaaaggccgg

SEQ ID NO: 86285 - RNA, 22 nt, Human
ugacaaagcaagacgguccuag

SEQ ID NO: 86286 - RNA, 19 nt, Human
ugagguuaagagcaggucc

SEQ ID NO: 86287 - RNA, 24 nt, Human
ugcaguuggugagguuucgggcgu

SEQ ID NO: 86288 - RNA, 23 nt, Human
uggggagagggugagagucguaa

SEQ ID NO: 86289 - RNA, 20 nt, Human
ugucaaguaugcuuucucag

SEQ ID NO: 86290 - RNA, 18 nt, Human
uucccuguuguuaucagc

SEQ ID NO: 86291 - RNA, 21 nt, Human
uuccucacuggugcaguuggu

SEQ ID NO: 86292 - RNA, 21 nt, Human
uuguaccacuuuucucagcag

SEQ ID NO: 86293 - RNA, 22 nt, Human
uuuaaaccaugacuuaaucucu

SEQ ID NO: 86294 - RNA, 18 nt, Human
uuucucagcaggucaccu

SEQ ID NO: 86295 - RNA, 23 nt, Human
uuuuuuuuuuuugagggaaagac

SEQ ID NO: 86296 - RNA, 19 nt, Human
uuuuuuuuuuuuugaggga

SEQ ID NO: 86297 - RNA, 28 nt, Human
uuuuuuuuuuuuuuuuuuuuuuugaggg

SEQ ID NO: 86298 - RNA, 22 nt, Human
aaacgucaccuccagaucaacc

SEQ ID NO: 86299 - RNA, 25 nt, Human
aaauccucccuuuaagagcccaggc

SEQ ID NO: 86300 - RNA, 22 nt, Human
aacaggccuguucauccacaac

SEQ ID NO: 86301 - RNA, 19 nt, Human
aagaaaacaaaacucucuc

SEQ ID NO: 86302 - RNA, 21 nt, Human
aagaaaacaaaacucucuccc

SEQ ID NO: 86303 - RNA, 22 nt, Human
aaggaggcagacacaggccuga

SEQ ID NO: 86304 - RNA, 18 nt, Human
accauuccaacaaagcgc

SEQ ID NO: 86305 - RNA, 23 nt, Human
accuccucauucuguggagaaac

SEQ ID NO: 86306 - RNA, 21 nt, Human
agacacaggccugaacugucc

SEQ ID NO: 86307 - RNA, 19 nt, Human
agccuagaaccuccagacc

SEQ ID NO: 86308 - RNA, 19 nt, Human
aggaagacugucacaacca

SEQ ID NO: 86309 - RNA, 20 nt, Human
aggccuguucauccacaacc

SEQ ID NO: 86310 - RNA, 23 nt, Human
agugacugucuucacccugggcu

SEQ ID NO: 86311 - RNA, 18 nt, Human
auccgugaagaccuccuc

SEQ ID NO: 86312 - RNA, 22 nt, Human
caagaaaacaaaacucucuccc

SEQ ID NO: 86313 - RNA, 23 nt, Human
cacacggucacgcaucaccgcuc

SEQ ID NO: 86314 - RNA, 23 nt, Human
cacagcugagggcccuccugcag

SEQ ID NO: 86315 - RNA, 23 nt, Human
cacaggccugaacuguccacccu

SEQ ID NO: 86316 - RNA, 19 nt, Human
cacagucccaaggaggcag

SEQ ID NO: 86317 - RNA, 18 nt, Human
cacagucccaaggaggcg

SEQ ID NO: 86318 - RNA, 18 nt, Human
cacggcauggccccgagc

SEQ ID NO: 86319 - RNA, 21 nt, Human
cagaugcuccaaggacucccc

SEQ ID NO: 86320 - RNA, 20 nt, Human
cagcucccgggggcugggga

SEQ ID NO: 86321 - RNA, 21 nt, Human
caggaagacugucacaaccau

SEQ ID NO: 86322 - RNA, 21 nt, Human
caguggcugccccagugcugc

SEQ ID NO: 86323 - RNA, 18 nt, Human
cauggcagccacccucca

SEQ ID NO: 86324 - RNA, 24 nt, Human
ccacuccacagucccaaggaggca

SEQ ID NO: 86325 - RNA, 21 nt, Human
ccaggcccgaccggcgggcgc

SEQ ID NO: 86326 - RNA, 18 nt, Human
ccaguaccuaacacccac

SEQ ID NO: 86327 - RNA, 18 nt, Human
cccacaugggacaagggc

SEQ ID NO: 86328 - RNA, 21 nt, Human
cccacuccacagucccaagga

SEQ ID NO: 86329 - RNA, 22 nt, Human
cccacugcucagagaucacacc

SEQ ID NO: 86330 - RNA, 20 nt, Human
ccccacaugggacaagggcu

SEQ ID NO: 86331 - RNA, 23 nt, Human
cccccggccuccugaucccgggc

SEQ ID NO: 86332 - RNA, 22 nt, Human
ccuagaaccuccagaccacaga

SEQ ID NO: 86333 - RNA, 20 nt, Human
ccugcaaaauccucccuuua

SEQ ID NO: 86334 - RNA, 22 nt, Human
ccugcaguucuucacaggagag

SEQ ID NO: 86335 - RNA, 21 nt, Human
ccugcccagcccggccaagaa

SEQ ID NO: 86336 - RNA, 30 nt, Human
ccuugguuuuggggggcacuaggaaggucc

SEQ ID NO: 86337 - RNA, 27 nt, Human
ccuuuaagagcccaggccagccuagaa

SEQ ID NO: 86338 - RNA, 20 nt, Human
cgcccccggccuccugaucc

SEQ ID NO: 86339 - RNA, 21 nt, Human
cgcucggcggaggaugggaau

SEQ ID NO: 86340 - RNA, 19 nt, Human
cgugaagaccuccucauuc

SEQ ID NO: 86341 - RNA, 21 nt, Human
cucaaccccacaugggacaag

SEQ ID NO: 86342 - RNA, 28 nt, Human
cuccccaucucacgugaaugcuuccuug

SEQ ID NO: 86343 - RNA, 19 nt, Human
cucgaagucucccuugccc

SEQ ID NO: 86344 - RNA, 18 nt, Human
cugcccagauuguggcau

SEQ ID NO: 86345 - RNA, 18 nt, Human
cugcugccugccugcuga

SEQ ID NO: 86346 - RNA, 23 nt, Human
cugcugccugccugcugagcagc

SEQ ID NO: 86347 - RNA, 21 nt, Human
gaggcuggagcggcguucagg

SEQ ID NO: 86348 - RNA, 19 nt, Human
gaguggugacuccacuccc

SEQ ID NO: 86349 - RNA, 26 nt, Human
gcccaacagaaaucuauccaaggacc

SEQ ID NO: 86350 - RNA, 19 nt, Human
gcccagauuguggcauccu

SEQ ID NO: 86351 - RNA, 18 nt, Human
gcccggaccccagggcga

SEQ ID NO: 86352 - RNA, 20 nt, Human
gccuagaaccuccagaccac

SEQ ID NO: 86353 - RNA, 25 nt, Human
gccugcacacacggucacgcaucac

SEQ ID NO: 86354 - RNA, 23 nt, Human
gcggccugcacacacggucacgc

SEQ ID NO: 86355 - RNA, 18 nt, Human
ggccggggcugcggccau

SEQ ID NO: 86356 - RNA, 24 nt, Human
gggaguccuggggacaggacuggu

SEQ ID NO: 86357 - RNA, 22 nt, Human
gggggcuggggaagacgcuggg

SEQ ID NO: 86358 - RNA, 19 nt, Human
gugcugcagcuggcucugg

SEQ ID NO: 86359 - RNA, 23 nt, Human
uaagacuugcgacucuucccaga

SEQ ID NO: 86360 - RNA, 20 nt, Human
uagaaccuccagaccacaga

SEQ ID NO: 86361 - RNA, 21 nt, Human
uauuagggaggacagccugca

SEQ ID NO: 86362 - RNA, 23 nt, Human
uauuagggaggacagccugcaaa

SEQ ID NO: 86363 - RNA, 18 nt, Human
ucacaaccaugccuuggg

SEQ ID NO: 86364 - RNA, 26 nt, Human
uccaaggacuccccuagucuagcugc

SEQ ID NO: 86365 - RNA, 21 nt, Human
uccacagucccaaggaggcag

SEQ ID NO: 86366 - RNA, 26 nt, Human
ucccaugggugcgggaggcugcugcc

SEQ ID NO: 86367 - RNA, 22 nt, Human
uccugugccaggcccggacccc

SEQ ID NO: 86368 - RNA, 19 nt, Human
ucucauggagaucuggauc

SEQ ID NO: 86369 - RNA, 23 nt, Human
ucucccuugcccaacagaaauug

SEQ ID NO: 86370 - RNA, 25 nt, Human
ugagcagcucagggcagaugucgcu

SEQ ID NO: 86371 - RNA, 25 nt, Human
ugcaaaauccucccuuuaagagccc

SEQ ID NO: 86372 - RNA, 23 nt, Human
ugcacggaugagugacugucuuc

SEQ ID NO: 86373 - RNA, 23 nt, Human
ugcugagcagcucagggcagaug

SEQ ID NO: 86374 - RNA, 20 nt, Human
uggaggcuggagcggcguuc

SEQ ID NO: 86375 - RNA, 18 nt, Human
uggaucucaaccccacau

SEQ ID NO: 86376 - RNA, 21 nt, Human
uggcaaaccggggaggcuuuu

SEQ ID NO: 86377 - RNA, 21 nt, Human
ugggacaagggcccagggacc

SEQ ID NO: 86378 - RNA, 20 nt, Human
uguggcaaaccggggaggcu

SEQ ID NO: 86379 - RNA, 20 nt, Human
uguucauccacaaccucaca

SEQ ID NO: 86380 - RNA, 18 nt, Human
uucccagaggaaagaaaa

SEQ ID NO: 86381 - RNA, 21 nt, Human
uucccagaggaaagaaaaccc

SEQ ID NO: 86382 - RNA, 24 nt, Human
uucccagaggaaagaaaaccccuc

SEQ ID NO: 86383 - RNA, 21 nt, Human
uucuguggagaaacggcccuu

SEQ ID NO: 86384 - RNA, 18 nt, Human
uuuuuuuuuuaccauucc

SEQ ID NO: 86385 - RNA, 20 nt, Human
aaaaaaaaaagggccugcca

SEQ ID NO: 86386 - RNA, 23 nt, Human
aaacaucccccaugcacugcagg

SEQ ID NO: 86387 - RNA, 22 nt, Human
aaagucccuucagagucaagaa

SEQ ID NO: 86388 - RNA, 24 nt, Human
aacuaaccugaaguauaaaaccuc

SEQ ID NO: 86389 - RNA, 18 nt, Human
aagaaaccucacugccau

SEQ ID NO: 86390 - RNA, 19 nt, Human
aagcagccgacagcuccuc

SEQ ID NO: 86391 - RNA, 24 nt, Human
acacccaggaagaaacauccccca

SEQ ID NO: 86392 - RNA, 21 nt, Human
acccaggaagaaacauccccc

SEQ ID NO: 86393 - RNA, 19 nt, Human
accugaacccacggccugg

SEQ ID NO: 86394 - RNA, 24 nt, Human
accugaacccacggccuggcacca

SEQ ID NO: 86395 - RNA, 19 nt, Human
acgcuaccaucacucccca

SEQ ID NO: 86396 - RNA, 25 nt, Human
agaaaaaaaaaaaagggccugccag

SEQ ID NO: 86397 - RNA, 22 nt, Human
agagggugaggccaaguccugg

SEQ ID NO: 86398 - RNA, 20 nt, Human
agcgugcgcacccaccccuc

SEQ ID NO: 86399 - RNA, 21 nt, Human
aggacagcggggucggaaggu

SEQ ID NO: 86400 - RNA, 22 nt, Human
aggccaaguccuggcgccuagc

SEQ ID NO: 86401 - RNA, 21 nt, Human
cacccaggaagaaacaucccc

SEQ ID NO: 86402 - RNA, 18 nt, Human
caccccucuacaaacgcg

SEQ ID NO: 86403 - RNA, 18 nt, Human
cacugcagcacauccucc

SEQ ID NO: 86404 - RNA, 28 nt, Human
cacugccauuccucacucagcagucuca

SEQ ID NO: 86405 - RNA, 24 nt, Human
cagcacauccuccuuagagagaga

SEQ ID NO: 86406 - RNA, 30 nt, Human
caugcacugcagcacauccuccuuagagag

SEQ ID NO: 86407 - RNA, 19 nt, Human
cccaccccucuacaaacgc

SEQ ID NO: 86408 - RNA, 22 nt, Human
cccagaggucaauccugggggc

SEQ ID NO: 86409 - RNA, 21 nt, Human
cccagccacacccaggaagaa

SEQ ID NO: 86410 - RNA, 29 nt, Human
ccccaugcacugcagcacauccuccuuag

SEQ ID NO: 86411 - RNA, 27 nt, Human
ccuaaaaauguucuuccuuccaaaaac

SEQ ID NO: 86412 - RNA, 18 nt, Human
ccucuacaaacgcguugc

SEQ ID NO: 86413 - RNA, 19 nt, Human
ccucuacaaacgcguugcu

SEQ ID NO: 86414 - RNA, 18 nt, Human
cgcaucugcaagcuucug

SEQ ID NO: 86415 - RNA, 22 nt, Human
cugaacccacggccuggcacca

SEQ ID NO: 86416 - RNA, 18 nt, Human
cugcagcacauccuccuu

SEQ ID NO: 86417 - RNA, 22 nt, Human
cuuccaaaaacuaacuaaccug

SEQ ID NO: 86418 - RNA, 20 nt, Human
gaacccacggccuggcacca

SEQ ID NO: 86419 - RNA, 18 nt, Human
gagagcagcccagccaca

SEQ ID NO: 86420 - RNA, 19 nt, Human
gagggugaggccaaguccu

SEQ ID NO: 86421 - RNA, 20 nt, Human
gagggugaggccaaguccug

SEQ ID NO: 86422 - RNA, 21 nt, Human
gagggugaggccaaguccugg

SEQ ID NO: 86423 - RNA, 22 nt, Human
gcaagcuucugccacaccugaa

SEQ ID NO: 86424 - RNA, 19 nt, Human
gcacugcagcacauccucc

SEQ ID NO: 86425 - RNA, 21 nt, Human
gcaucugcaagcuucugccac

SEQ ID NO: 86426 - RNA, 21 nt, Human
gcugcaauuucccuuucuucc

SEQ ID NO: 86427 - RNA, 21 nt, Human
guuuauucucugcggcuacag

SEQ ID NO: 86428 - RNA, 18 nt, Human
uaaaaauguucuuccuuc

SEQ ID NO: 86429 - RNA, 22 nt, Human
uaagagaacugagacuaauuga

SEQ ID NO: 86430 - RNA, 24 nt, Human
uaauugaagaaaccucacugccau

SEQ ID NO: 86431 - RNA, 20 nt, Human
ucacugccauuccucacuca

SEQ ID NO: 86432 - RNA, 18 nt, Human
ucaugguccauaaaugug

SEQ ID NO: 86433 - RNA, 18 nt, Human
uccuggcgccuagcuggg

SEQ ID NO: 86434 - RNA, 20 nt, Human
ucggcaaagaaaaaaaaaaa

SEQ ID NO: 86435 - RNA, 21 nt, Human
ucggcaaagaaaaaaaaaaaa

SEQ ID NO: 86436 - RNA, 20 nt, Human
ucucugcggcuacagggauu

SEQ ID NO: 86437 - RNA, 24 nt, Human
ucucugcggcuacagggauugccu

SEQ ID NO: 86438 - RNA, 19 nt, Human
ucugguuuccugaucagga

SEQ ID NO: 86439 - RNA, 22 nt, Human
ugagacuaauugaagaaaccuc

SEQ ID NO: 86440 - RNA, 19 nt, Human
ugaggccaaguccuggcgc

SEQ ID NO: 86441 - RNA, 25 nt, Human
ugggggcugaggagcugcaauuucc

SEQ ID NO: 86442 - RNA, 21 nt, Human
uuagaaauccccuuacgcuga

SEQ ID NO: 86443 - RNA, 19 nt, Human
aaacauauucucucucaca

SEQ ID NO: 86444 - RNA, 24 nt, Human
aaagugcugagauuacagguguga

SEQ ID NO: 86445 - RNA, 19 nt, Human
aaguagcugggauuacagg

SEQ ID NO: 86446 - RNA, 25 nt, Human
aaguagcugggauuacaggcgccgc

SEQ ID NO: 86447 - RNA, 24 nt, Human
aagugaucugccugccuuggccuc

SEQ ID NO: 86448 - RNA, 26 nt, Human
aagugcugagauuacaggugugagcc

SEQ ID NO: 86449 - RNA, 24 nt, Human
acagggucucaccauguuggucag

SEQ ID NO: 86450 - RNA, 24 nt, Human
accauguuggucaggcuggucucg

SEQ ID NO: 86451 - RNA, 19 nt, Human
acuauccugccuucuuucu

SEQ ID NO: 86452 - RNA, 24 nt, Human
agauuacaggugugagccaccgca

SEQ ID NO: 86453 - RNA, 19 nt, Human
agccaccgcaccuagccug

SEQ ID NO: 86454 - RNA, 24 nt, Human
auuuuuguauuuuuaguagagaca

SEQ ID NO: 86455 - RNA, 24 nt, Human
caaagugcugagauuacaggugug

SEQ ID NO: 86456 - RNA, 22 nt, Human
caagugaucugccugccuuggc

SEQ ID NO: 86457 - RNA, 24 nt, Human
caccacacccagcuaauuuuugua

SEQ ID NO: 86458 - RNA, 21 nt, Human
caccauguuggucaggcuggu

SEQ ID NO: 86459 - RNA, 24 nt, Human
caccauguuggucaggcuggucuc

SEQ ID NO: 86460 - RNA, 24 nt, Human
cagggucucaccauguuggucagg

SEQ ID NO: 86461 - RNA, 20 nt, Human
ccaaagugcugagauuacag

SEQ ID NO: 86462 - RNA, 21 nt, Human
ccaaagugcugagauuacagg

SEQ ID NO: 86463 - RNA, 21 nt, Human
ccaaagugcugagauuacagg

SEQ ID NO: 86464 - RNA, 24 nt, Human
ccaaagugcugagauuacaggugu

SEQ ID NO: 86465 - RNA, 22 nt, Human
ccaaguagcugggauuacaggc

SEQ ID NO: 86466 - RNA, 23 nt, Human
cccaaguagcugggauuacaggc

SEQ ID NO: 86467 - RNA, 23 nt, Human
cccaaguagcugggauuacaggc

SEQ ID NO: 86468 - RNA, 21 nt, Human
ccugaccucaagugaucugcc

SEQ ID NO: 86469 - RNA, 23 nt, Human
ccugaccucaagugaucugccug

SEQ ID NO: 86470 - RNA, 22 nt, Human
ccugccuuggccucccaaagug

SEQ ID NO: 86471 - RNA, 23 nt, Human
cuaauuuuuguauuuuuaguaga

SEQ ID NO: 86472 - RNA, 20 nt, Human
cucaagugaucugccugccu

SEQ ID NO: 86473 - RNA, 21 nt, Human
cucacagcagaaaaguauugg

SEQ ID NO: 86474 - RNA, 21 nt, Human
cucccaaagugcugagauuac

SEQ ID NO: 86475 - RNA, 26 nt, Human
cuccugaccucaagugaucugccugc

SEQ ID NO: 86476 - RNA, 23 nt, Human
cugccuuggccucccaaagugcu

SEQ ID NO: 86477 - RNA, 21 nt, Human
cugggauuacaggcgccgcca

SEQ ID NO: 86478 - RNA, 24 nt, Human
gaccucaagugaucugccugccuu

SEQ ID NO: 86479 - RNA, 18 nt, Human
gauuacaggugugagcca

SEQ ID NO: 86480 - RNA, 22 nt, Human
gauuacaggugugagccaccgc

SEQ ID NO: 86481 - RNA, 22 nt, Human
gccuuggccucccaaagugcug

SEQ ID NO: 86482 - RNA, 23 nt, Human
gcuggucucgaacuccugaccuc

SEQ ID NO: 86483 - RNA, 22 nt, Human
ggaaauaggcuuguucaaaagc

SEQ ID NO: 86484 - RNA, 24 nt, Human
ggcuggucucgaacuccugaccuc

SEQ ID NO: 86485 - RNA, 22 nt, Human
gggucucaccauguuggucagg

SEQ ID NO: 86486 - RNA, 19 nt, Human
ggucucgaacuccugaccu

SEQ ID NO: 86487 - RNA, 18 nt, Human
guagcugggauuacaggc

SEQ ID NO: 86488 - RNA, 19 nt, Human
uaaacauauucucucucac

SEQ ID NO: 86489 - RNA, 18 nt, Human
uaaccugguuuucaguaa

SEQ ID NO: 86490 - RNA, 24 nt, Human
uaauuuuuguauuuuuaguagaga

SEQ ID NO: 86491 - RNA, 23 nt, Human
uacaggcgccgccaccacaccca

SEQ ID NO: 86492 - RNA, 22 nt, Human
uacaggugugagccaccgcacc

SEQ ID NO: 86493 - RNA, 23 nt, Human
uacaggugugagccaccgcaccu

SEQ ID NO: 86494 - RNA, 22 nt, Human
uagagacagggucucaccaugu

SEQ ID NO: 86495 - RNA, 19 nt, Human
uagcaaggcuucugggcca

SEQ ID NO: 86496 - RNA, 24 nt, Human
uaguagagacagggucucaccaug

SEQ ID NO: 86497 - RNA, 26 nt, Human
uaguagagacagggucucaccauguu

SEQ ID NO: 86498 - RNA, 23 nt, Human
ucccaaagugcugagauuacagg

SEQ ID NO: 86499 - RNA, 24 nt, Human
ucucaccauguuggucaggcuggu

SEQ ID NO: 86500 - RNA, 21 nt, Human
ucucgaacuccugaccucaag

SEQ ID NO: 86501 - RNA, 18 nt, Human
ugaccucaagugaucugc

SEQ ID NO: 86502 - RNA, 24 nt, Human
ugaccucaagugaucugccugccu

SEQ ID NO: 86503 - RNA, 19 nt, Human
ugagauuacaggugugagc

SEQ ID NO: 86504 - RNA, 21 nt, Human
ugagauuacaggugugagcca

SEQ ID NO: 86505 - RNA, 22 nt, Human
ugagauuacaggugugagccac

SEQ ID NO: 86506 - RNA, 23 nt, Human
ugagauuacaggugugagccacc

SEQ ID NO: 86507 - RNA, 24 nt, Human
ugagauuacaggugugagccaccg

SEQ ID NO: 86508 - RNA, 18 nt, Human
ugccugccuuggccuccc

SEQ ID NO: 86509 - RNA, 24 nt, Human
ugcugagauuacaggugugagcca

SEQ ID NO: 86510 - RNA, 18 nt, Human
ugggauuacaggcgccgc

SEQ ID NO: 86511 - RNA, 19 nt, Human
ugggauuacaggcgccgcc

SEQ ID NO: 86512 - RNA, 20 nt, Human
ugggauuacaggcgccgcca

SEQ ID NO: 86513 - RNA, 23 nt, Human
ugggauuacaggcgccgccacca

SEQ ID NO: 86514 - RNA, 24 nt, Human
uggucaggcuggucucgaacuccu

SEQ ID NO: 86515 - RNA, 22 nt, Human
uuagaauauaaccugguuuuca

SEQ ID NO: 86516 - RNA, 24 nt, Human
uuaguagagacagggucucaccau

SEQ ID NO: 86517 - RNA, 18 nt, Human
uuggccucccaaagugcu

SEQ ID NO: 86518 - RNA, 20 nt, Human
uuuuuguauuuuuaguagag

SEQ ID NO: 86519 - RNA, 19 nt, Human
aaacaaaggaacugagugu

SEQ ID NO: 86520 - RNA, 18 nt, Human
aaagcacgggggaauaca

SEQ ID NO: 86521 - RNA, 22 nt, Human
agagagaggcaccagcuccagu

SEQ ID NO: 86522 - RNA, 22 nt, Human
augaugccagaagguaaagcac

SEQ ID NO: 86523 - RNA, 23 nt, Human
caccacagaaucauggcagcuuu

SEQ ID NO: 86524 - RNA, 24 nt, Human
cagaaucauggcagcuuuucauga

SEQ ID NO: 86525 - RNA, 19 nt, Human
cuagaacccgcugaaccgc

SEQ ID NO: 86526 - RNA, 18 nt, Human
gaauacagagguggaguc

SEQ ID NO: 86527 - RNA, 24 nt, Human
gggaauaaagaagagagaggccgg

SEQ ID NO: 86528 - RNA, 23 nt, Human
uacagagguggaguccugcuuuu

SEQ ID NO: 86529 - RNA, 24 nt, Human
uauuacagggaauaaagaagagag

SEQ ID NO: 86530 - RNA, 18 nt, Human
agggacagagggagagga

SEQ ID NO: 86531 - RNA, 18 nt, Human
aaagcggacacagcagug

SEQ ID NO: 86532 - RNA, 21 nt, Human
cacuuugcugccaaaagccuu

SEQ ID NO: 86533 - RNA, 25 nt, Human
cacuuugcugccaaaagccuuuaau

SEQ ID NO: 86534 - RNA, 23 nt, Human
gaaagcggacacagcagugcuuc

SEQ ID NO: 86535 - RNA, 24 nt, Human
guucccagguucagguuccuccca

SEQ ID NO: 86536 - RNA, 24 nt, Human
ugccaaaagccuuuaauaugcccu

SEQ ID NO: 86537 - RNA, 19 nt, Human
ugcccuggucccaggcugu

SEQ ID NO: 86538 - RNA, 25 nt, Human
ugguucccagguucagguuccuccc

SEQ ID NO: 86539 - RNA, 24 nt, Human
uuccagcuucaugguucccagguu

SEQ ID NO: 86540 - RNA, 20 nt, Human
aaagcacuaaacuuuagcaa

SEQ ID NO: 86541 - RNA, 24 nt, Human
aagacaccuuuuccuccuucuuuu

SEQ ID NO: 86542 - RNA, 24 nt, Human
aagcaaaaacaugagccacacaga

SEQ ID NO: 86543 - RNA, 24 nt, Human
acacagaggaugauuaauaauuuc

SEQ ID NO: 86544 - RNA, 25 nt, Human
acaccuuuuccuccuucuuuugaga

SEQ ID NO: 86545 - RNA, 20 nt, Human
agcagaagacucuaugauga

SEQ ID NO: 86546 - RNA, 22 nt, Human
auacauuuuuaaucgaaaaaaa

SEQ ID NO: 86547 - RNA, 20 nt, Human
cagcaagacaccuuuuccuc

SEQ ID NO: 86548 - RNA, 23 nt, Human
caguagauuugcuaaacugaucu

SEQ ID NO: 86549 - RNA, 22 nt, Human
cuauguaguccugguuccuccc

SEQ ID NO: 86550 - RNA, 23 nt, Human
cuccccagaucagaguuuaucau

SEQ ID NO: 86551 - RNA, 18 nt, Human
gaaaagcaaaaacaugag

SEQ ID NO: 86552 - RNA, 22 nt, Human
gcaagacaccuuuuccuccuuc

SEQ ID NO: 86553 - RNA, 22 nt, Human
gcuccaccaaagagucccugaa

SEQ ID NO: 86554 - RNA, 22 nt, Human
uagcaaauuaucauuucuagau

SEQ ID NO: 86555 - RNA, 18 nt, Human
uaugaugaauaucacugc

SEQ ID NO: 86556 - RNA, 20 nt, Human
ucagaguuuaucauaauacc

SEQ ID NO: 86557 - RNA, 18 nt, Human
ucuuugguaguugaggaa

SEQ ID NO: 86558 - RNA, 24 nt, Human
uguuuuucuuugguaguugaggaa

SEQ ID NO: 86559 - RNA, 25 nt, Human
uuaauaauuucacaaucucaaagca

SEQ ID NO: 86560 - RNA, 18 nt, Human
uuuucuuugguaguugag

SEQ ID NO: 86561 - RNA, 19 nt, Human
caccugucucugucccucc

SEQ ID NO: 86562 - RNA, 24 nt, Human
caccugucucugucccuccagagu

SEQ ID NO: 86563 - RNA, 21 nt, Human
ccaggcuggaauucacccagc

SEQ ID NO: 86564 - RNA, 19 nt, Human
cccagcaaggaacuggucu

SEQ ID NO: 86565 - RNA, 23 nt, Human
ccccaggcuggaauucacccagc

SEQ ID NO: 86566 - RNA, 22 nt, Human
ccugcuuuuuuauuuuucuuuu

SEQ ID NO: 86567 - RNA, 18 nt, Human
cucacucagaagcaacag

SEQ ID NO: 86568 - RNA, 20 nt, Human
cuccaaaggccugcuuuuuu

SEQ ID NO: 86569 - RNA, 21 nt, Human
cucugucccuccagaguuagg

SEQ ID NO: 86570 - RNA, 21 nt, Human
cuggugaucaaaguccucucc

SEQ ID NO: 86571 - RNA, 21 nt, Human
cuucccagcaaggaacugguc

SEQ ID NO: 86572 - RNA, 20 nt, Human
gcuucccagcaaggaacugg

SEQ ID NO: 86573 - RNA, 23 nt, Human
uauuuuucuuuuugccuuugcuu

SEQ ID NO: 86574 - RNA, 18 nt, Human
ucagaaccaagaagaaaa

SEQ ID NO: 86575 - RNA, 25 nt, Human
ucagaaccaagaagaaaauuuauuc

SEQ ID NO: 86576 - RNA, 26 nt, Human
uccccaggcuggaauucacccagcuc

SEQ ID NO: 86577 - RNA, 21 nt, Human
ucucuaaggcugucauuaccc

SEQ ID NO: 86578 - RNA, 20 nt, Human
ucucugucccuccagaguua

SEQ ID NO: 86579 - RNA, 18 nt, Human
ucucuuuuauguaucucu

SEQ ID NO: 86580 - RNA, 20 nt, Human
ugccuuugcuuuuuguuuug

SEQ ID NO: 86581 - RNA, 23 nt, Human
ugucacagcccgucuggguuggu

SEQ ID NO: 86582 - RNA, 25 nt, Human
uuagggcuucccagcaaggaacugg

SEQ ID NO: 86583 - RNA, 19 nt, Human
uucacccagcucagacacc

SEQ ID NO: 86584 - RNA, 24 nt, Human
uucagaaccaagaagaaaauuuau

SEQ ID NO: 86585 - RNA, 22 nt, Human
uuucuuuuugccuuugcuuuuu

SEQ ID NO: 86586 - RNA, 24 nt, Human
uuuuauguaucucuaaggcuguca

SEQ ID NO: 86587 - RNA, 22 nt, Human
aaaaaaaggcuucugcauggca

SEQ ID NO: 86588 - RNA, 19 nt, Human
aaaaaucaugauccuaugg

SEQ ID NO: 86589 - RNA, 25 nt, Human
aaagaagaaaaaagaaauuuuacaa

SEQ ID NO: 86590 - RNA, 23 nt, Human
aacugacuccauagacuggacau

SEQ ID NO: 86591 - RNA, 21 nt, Human
aagcaaagaagaaaaaagaaa

SEQ ID NO: 86592 - RNA, 24 nt, Human
acuauauuauacaaaaucaugacc

SEQ ID NO: 86593 - RNA, 22 nt, Human
acuguuuaaaaaccacauacca

SEQ ID NO: 86594 - RNA, 25 nt, Human
agaagaaaaaagaaauuuuacaaaa

SEQ ID NO: 86595 - RNA, 19 nt, Human
aggaaagacagacuuugaa

SEQ ID NO: 86596 - RNA, 24 nt, Human
aggagaggaggaaacuuuguagag

SEQ ID NO: 86597 - RNA, 19 nt, Human
aggcaacaaauuaaaaauc

SEQ ID NO: 86598 - RNA, 21 nt, Human
agugacuguuuaaaaaccaca

SEQ ID NO: 86599 - RNA, 25 nt, Human
auaaaauauuuccuucaucuuaaaa

SEQ ID NO: 86600 - RNA, 23 nt, Human
augcccauuuguaacugaagaaa

SEQ ID NO: 86601 - RNA, 20 nt, Human
caaauuaaaaaucaugaucc

SEQ ID NO: 86602 - RNA, 18 nt, Human
caauauaacuauacuaaa

SEQ ID NO: 86603 - RNA, 21 nt, Human
caauauaacuauacuaaaugc

SEQ ID NO: 86604 - RNA, 19 nt, Human
caccgccuucugccuccgc

SEQ ID NO: 86605 - RNA, 20 nt, Human
caucuuaaaaaaaaggcuuc

SEQ ID NO: 86606 - RNA, 22 nt, Human
ccaacugacuccauagacugga

SEQ ID NO: 86607 - RNA, 19 nt, Human
ccgccaccgguaccaacug

SEQ ID NO: 86608 - RNA, 22 nt, Human
cgguaccaacugacuccauaga

SEQ ID NO: 86609 - RNA, 22 nt, Human
cucggacaccgccuucugccuc

SEQ ID NO: 86610 - RNA, 27 nt, Human
cucggacaccgccuucugccucccccc

SEQ ID NO: 86611 - RNA, 22 nt, Human
gaccuaaaagaguguacugaga

SEQ ID NO: 86612 - RNA, 23 nt, Human
gcccauggaaauaucuaggacuc

SEQ ID NO: 86613 - RNA, 22 nt, Human
gcgaacaccgauggcuucgccg

SEQ ID NO: 86614 - RNA, 20 nt, Human
ggaaaaaagcaaagaagaaa

SEQ ID NO: 86615 - RNA, 21 nt, Human
ggacaccgccuucugccuccg

SEQ ID NO: 86616 - RNA, 26 nt, Human
ggcacugagucuuucaggaccacggu

SEQ ID NO: 86617 - RNA, 21 nt, Human
ggucaguagaaagcuauuuac

SEQ ID NO: 86618 - RNA, 20 nt, Human
uaaaauauuuccuucaucuu

SEQ ID NO: 86619 - RNA, 22 nt, Human
uaaaugcauuaucuuccaguaa

SEQ ID NO: 86620 - RNA, 21 nt, Human
uaaaugcccauuuguaacuga

SEQ ID NO: 86621 - RNA, 19 nt, Human
uaacuauacuaaaugcccc

SEQ ID NO: 86622 - RNA, 22 nt, Human
uaacugaagaaacucacagaca

SEQ ID NO: 86623 - RNA, 23 nt, Human
uaacugaagaaacucacagacac

SEQ ID NO: 86624 - RNA, 25 nt, Human
uaaguuuuaagacacagaucucaca

SEQ ID NO: 86625 - RNA, 20 nt, Human
uacaaaaucaugaccaugag

SEQ ID NO: 86626 - RNA, 28 nt, Human
uacaaaauggcaacuacuaugaccuaaa

SEQ ID NO: 86627 - RNA, 21 nt, Human
uacauaaguagugccgccuuu

SEQ ID NO: 86628 - RNA, 26 nt, Human
uacuaugaccuaaaagaguguacuga

SEQ ID NO: 86629 - RNA, 23 nt, Human
uagacuggacaucagcgaacacc

SEQ ID NO: 86630 - RNA, 23 nt, Human
uagauaacuagguaaggagagug

SEQ ID NO: 86631 - RNA, 25 nt, Human
uauaaggaaagacagacuuugaaac

SEQ ID NO: 86632 - RNA, 24 nt, Human
uaucccacagcucagauuuacaua

SEQ ID NO: 86633 - RNA, 27 nt, Human
uaugaacaaugcucacugcuaccugaa

SEQ ID NO: 86634 - RNA, 21 nt, Human
uccgcgccgccaccgguacca

SEQ ID NO: 86635 - RNA, 20 nt, Human
ucucacacaggcaguugggu

SEQ ID NO: 86636 - RNA, 18 nt, Human
ucucuuaaagcaagaaau

SEQ ID NO: 86637 - RNA, 27 nt, Human
ugaagaaacucacagacacaguaugaa

SEQ ID NO: 86638 - RNA, 18 nt, Human
ugaagaaacucacagacc

SEQ ID NO: 86639 - RNA, 21 nt, Human
uggaaugaacauuuguagaua

SEQ ID NO: 86640 - RNA, 19 nt, Human
uggcacugagucuuucagu

SEQ ID NO: 86641 - RNA, 22 nt, Human
uuccaguaaauaaacauuaugg

SEQ ID NO: 86642 - RNA, 22 nt, Human
uucucauaugaacaaugcucac

SEQ ID NO: 86643 - RNA, 23 nt, Human
uuuguaacugaagaaacucacag

SEQ ID NO: 86644 - RNA, 22 nt, Human
uuuuaccaaugugaaaaaagga

SEQ ID NO: 86645 - RNA, 24 nt, Human
aaaaaaacgaacuucaacaacagg

SEQ ID NO: 86646 - RNA, 18 nt, Human
aagaagaaaacaaaaaaa

SEQ ID NO: 86647 - RNA, 19 nt, Human
aagaagaaaacaaaaaaac

SEQ ID NO: 86648 - RNA, 22 nt, Human
auuuucuuucaagcaaaggcca

SEQ ID NO: 86649 - RNA, 21 nt, Human
caaaaaaacgaacuucaacaa

SEQ ID NO: 86650 - RNA, 18 nt, Human
ccaauaaccuuggaggag

SEQ ID NO: 86651 - RNA, 22 nt, Human
cgaacuucaacaacaggagucc

SEQ ID NO: 86652 - RNA, 20 nt, Human
cggccccagcaaacauuccu

SEQ ID NO: 86653 - RNA, 19 nt, Human
cuaauucuaaguaaaguga

SEQ ID NO: 86654 - RNA, 20 nt, Human
cugucuucaugcccuccaag

SEQ ID NO: 86655 - RNA, 18 nt, Human
cuucaacaacaggagucc

SEQ ID NO: 86656 - RNA, 24 nt, Human
gaagaaaacaaaaaaacgaacuuc

SEQ ID NO: 86657 - RNA, 22 nt, Human
gagcuuuacaaauaagaccagc

SEQ ID NO: 86658 - RNA, 19 nt, Human
gguagguuugaggaggugu

SEQ ID NO: 86659 - RNA, 21 nt, Human
uacaaauaagaccagcuauga

SEQ ID NO: 86660 - RNA, 19 nt, Human
uccaauaaccuuggaggag

SEQ ID NO: 86661 - RNA, 24 nt, Human
ugaauguuuaaaaaaagaagaaaa

SEQ ID NO: 86662 - RNA, 25 nt, Human
uuccugagugguagguuugaggagg

SEQ ID NO: 86663 - RNA, 21 nt, Human
uucuuucggccccagcaaaca

SEQ ID NO: 86664 - RNA, 20 nt, Human
uuuuguaauacucccuuuca

SEQ ID NO: 86665 - RNA, 21 nt, Human
aaacaaaguacaaacaaaacu

SEQ ID NO: 86666 - RNA, 22 nt, Human
aaacaagagggagaauggccgg

SEQ ID NO: 86667 - RNA, 24 nt, Human
aaaguucugggauuacaggcguga

SEQ ID NO: 86668 - RNA, 18 nt, Human
aacaaaguacaaacaaaa

SEQ ID NO: 86669 - RNA, 18 nt, Human
aagccugggauggaaaga

SEQ ID NO: 86670 - RNA, 19 nt, Human
aaguagcugggauuacagg

SEQ ID NO: 86671 - RNA, 25 nt, Human
aaguagcugggauuacaggcaccca

SEQ ID NO: 86672 - RNA, 19 nt, Human
acagagccucccucgguca

SEQ ID NO: 86673 - RNA, 23 nt, Human
accuuagccucccaaaguucugg

SEQ ID NO: 86674 - RNA, 19 nt, Human
acgggguuucaccaugcug

SEQ ID NO: 86675 - RNA, 20 nt, Human
acgggguuucaccaugcugg

SEQ ID NO: 86676 - RNA, 24 nt, Human
acgggguuucaccaugcuggccag

SEQ ID NO: 86677 - RNA, 25 nt, Human
agccuggucuggaacucuugaccuc

SEQ ID NO: 86678 - RNA, 18 nt, Human
aggaaggaugagaagagu

SEQ ID NO: 86679 - RNA, 19 nt, Human
aggaaggaugagaagaguc

SEQ ID NO: 86680 - RNA, 22 nt, Human
agggacaagucugggaaagaca

SEQ ID NO: 86681 - RNA, 24 nt, Human
aggugauccacccaccuuagccuc

SEQ ID NO: 86682 - RNA, 20 nt, Human
agugcaguggugcgaucaug

SEQ ID NO: 86683 - RNA, 23 nt, Human
agugcaguggugcgaucauggcu

SEQ ID NO: 86684 - RNA, 24 nt, Human
agugcaguggugcgaucauggcuc

SEQ ID NO: 86685 - RNA, 22 nt, Human
aguuaguuagcuaagguaacac

SEQ ID NO: 86686 - RNA, 24 nt, Human
aucaaugucaauauccugguuaug

SEQ ID NO: 86687 - RNA, 27 nt, Human
aucaaugucaauauccugguuaugaga

SEQ ID NO: 86688 - RNA, 22 nt, Human
augagaagagucccgcuggaaa

SEQ ID NO: 86689 - RNA, 23 nt, Human
augaucucaaaauagaaagcaua

SEQ ID NO: 86690 - RNA, 24 nt, Human
caaaguucugggauuacaggcgug

SEQ ID NO: 86691 - RNA, 21 nt, Human
caccacaaccuccaccuccaa

SEQ ID NO: 86692 - RNA, 21 nt, Human
caccaugcuggccagccuggu

SEQ ID NO: 86693 - RNA, 22 nt, Human
cacccaccuuagccucccaaag

SEQ ID NO: 86694 - RNA, 23 nt, Human
cacccaccuuagccucccaaagu

SEQ ID NO: 86695 - RNA, 24 nt, Human
caccucagccucccaaguagcugg

SEQ ID NO: 86696 - RNA, 20 nt, Human
caggcacccacuaccaugcc

SEQ ID NO: 86697 - RNA, 22 nt, Human
ccaaaguucugggauuacaggc

SEQ ID NO: 86698 - RNA, 24 nt, Human
ccaaaguucugggauuacaggcgu

SEQ ID NO: 86699 - RNA, 23 nt, Human
ccaaguagcugggauuacaggca

SEQ ID NO: 86700 - RNA, 19 nt, Human
ccacaaccuccaccuccaa

SEQ ID NO: 86701 - RNA, 24 nt, Human
ccacaaccuccaccuccaagguuc

SEQ ID NO: 86702 - RNA, 19 nt, Human
ccacccaccuuagccuccc

SEQ ID NO: 86703 - RNA, 18 nt, Human
ccacugcucucagccuaa

SEQ ID NO: 86704 - RNA, 23 nt, Human
ccauauggaaauaucccagauac

SEQ ID NO: 86705 - RNA, 24 nt, Human
ccaucccacgaaaagugaagugaa

SEQ ID NO: 86706 - RNA, 23 nt, Human
cccaaguagcugggauuacaggc

SEQ ID NO: 86707 - RNA, 24 nt, Human
cccaaguagcugggauuacaggca

SEQ ID NO: 86708 - RNA, 20 nt, Human
cccaccucagccucccaagu

SEQ ID NO: 86709 - RNA, 23 nt, Human
cccaccucagccucccaaguagc

SEQ ID NO: 86710 - RNA, 20 nt, Human
cccacgaaaagugaagugaa

SEQ ID NO: 86711 - RNA, 24 nt, Human
cccucggucacccaggcuagagug

SEQ ID NO: 86712 - RNA, 24 nt, Human
ccuccaagguucgagcaauucucc

SEQ ID NO: 86713 - RNA, 24 nt, Human
ccucccucggucacccaggcuaga

SEQ ID NO: 86714 - RNA, 21 nt, Human
cgaaaagugaagugaaaacaa

SEQ ID NO: 86715 - RNA, 27 nt, Human
cgagcaauucucccaccucagccuccc

SEQ ID NO: 86716 - RNA, 28 nt, Human
cucaccacaaccuccaccuccaagguuc

SEQ ID NO: 86717 - RNA, 24 nt, Human
cucagccucccaaguagcugggau

SEQ ID NO: 86718 - RNA, 25 nt, Human
cuuagccucccaaaguucugggauu

SEQ ID NO: 86719 - RNA, 21 nt, Human
gaaaacaagagggagaauggc

SEQ ID NO: 86720 - RNA, 21 nt, Human
gaaucuuucuacuugucugua

SEQ ID NO: 86721 - RNA, 23 nt, Human
gaccucaggugauccacccaccu

SEQ ID NO: 86722 - RNA, 25 nt, Human
gagcaauucucccaccucagccucc

SEQ ID NO: 86723 - RNA, 22 nt, Human
gagggagaauggccgggaagga

SEQ ID NO: 86724 - RNA, 23 nt, Human
gaucauggcucaccacaaccucc

SEQ ID NO: 86725 - RNA, 24 nt, Human
gauuacaggcacccacuaccaugc

SEQ ID NO: 86726 - RNA, 18 nt, Human
gauuacaggcgugagcca

SEQ ID NO: 86727 - RNA, 21 nt, Human
gauuacaggcgugagccacug

SEQ ID NO: 86728 - RNA, 22 nt, Human
gauuacaggcgugagccacugc

SEQ ID NO: 86729 - RNA, 23 nt, Human
gcccaguuaauuuuuuguauuuu

SEQ ID NO: 86730 - RNA, 18 nt, Human
ggaagugggcauccuggg

SEQ ID NO: 86731 - RNA, 19 nt, Human
ggcacccacuaccaugccc

SEQ ID NO: 86732 - RNA, 23 nt, Human
ggcugggguguggggguggaggg

SEQ ID NO: 86733 - RNA, 19 nt, Human
gggggguggggggugggag

SEQ ID NO: 86734 - RNA, 24 nt, Human
gggguggggggugggagggugcuu

SEQ ID NO: 86735 - RNA, 20 nt, Human
ggguguggggguggagggaa

SEQ ID NO: 86736 - RNA, 23 nt, Human
ggugugugggggggggugggggg

SEQ ID NO: 86737 - RNA, 18 nt, Human
guagcugggauuacaggc

SEQ ID NO: 86738 - RNA, 24 nt, Human
gugauccacccaccuuagccuccc

SEQ ID NO: 86739 - RNA, 20 nt, Human
guggagggaagugggcaucc

SEQ ID NO: 86740 - RNA, 21 nt, Human
guggagggaagugggcauccu

SEQ ID NO: 86741 - RNA, 24 nt, Human
uaaaaacaaaguacaaacaaaacu

SEQ ID NO: 86742 - RNA, 19 nt, Human
uaagcgagaaucuuucuac

SEQ ID NO: 86743 - RNA, 24 nt, Human
uaauuuuuuguauuuuuaguacag

SEQ ID NO: 86744 - RNA, 22 nt, Human
uacaggcgugagccacugcucu

SEQ ID NO: 86745 - RNA, 22 nt, Human
uacuugucuguauucugaguuc

SEQ ID NO: 86746 - RNA, 21 nt, Human
uagagugcaguggugcgauca

SEQ ID NO: 86747 - RNA, 24 nt, Human
uagagugcaguggugcgaucaugg

SEQ ID NO: 86748 - RNA, 24 nt, Human
uaguacagacgggguuucaccaug

SEQ ID NO: 86749 - RNA, 21 nt, Human
ucaauauccugguuaugagac

SEQ ID NO: 86750 - RNA, 24 nt, Human
ucaauauucauuuuuauuuuccuc

SEQ ID NO: 86751 - RNA, 27 nt, Human
ucaccacaaccuccaccuccaagguuc

SEQ ID NO: 86752 - RNA, 20 nt, Human
ucagccucccaaguagcugg

SEQ ID NO: 86753 - RNA, 21 nt, Human
uccaagguucgagcaauucuc

SEQ ID NO: 86754 - RNA, 23 nt, Human
uccaagguucgagcaauucuccc

SEQ ID NO: 86755 - RNA, 24 nt, Human
ucccaaaguucugggauuacaggc

SEQ ID NO: 86756 - RNA, 24 nt, Human
ucccaaguagcugggauuacaggc

SEQ ID NO: 86757 - RNA, 21 nt, Human
ucccagauacacggguuucug

SEQ ID NO: 86758 - RNA, 19 nt, Human
ucgggccacaguggcccau

SEQ ID NO: 86759 - RNA, 22 nt, Human
ucgggccacaguggcccaugag

SEQ ID NO: 86760 - RNA, 24 nt, Human
ucggucacccaggcuagagugcag

SEQ ID NO: 86761 - RNA, 26 nt, Human
ucucccaccucagccucccaaguagc

SEQ ID NO: 86762 - RNA, 21 nt, Human
ugaccucaggugauccaccca

SEQ ID NO: 86763 - RNA, 22 nt, Human
ugaccucaggugauccacccac

SEQ ID NO: 86764 - RNA, 24 nt, Human
ugaccucaggugauccacccaccu

SEQ ID NO: 86765 - RNA, 18 nt, Human
ugagaauguccuguaucu

SEQ ID NO: 86766 - RNA, 19 nt, Human
ugagacagagccucccucg

SEQ ID NO: 86767 - RNA, 24 nt, Human
ugauccacccaccuuagccuccca

SEQ ID NO: 86768 - RNA, 22 nt, Human
ugaucucaaaauagaaagcaua

SEQ ID NO: 86769 - RNA, 22 nt, Human
ugcaguggugcgaucauggcuc

SEQ ID NO: 86770 - RNA, 23 nt, Human
ugcaguggugcgaucauggcuca

SEQ ID NO: 86771 - RNA, 23 nt, Human
uggaaaaggagggacaagucugg

SEQ ID NO: 86772 - RNA, 18 nt, Human
uggagaguggauuccugg

SEQ ID NO: 86773 - RNA, 24 nt, Human
uggagggaagugggcauccugggg

SEQ ID NO: 86774 - RNA, 24 nt, Human
uggccagccuggucuggaacucuu

SEQ ID NO: 86775 - RNA, 21 nt, Human
ugggaaagacaggcaacaugg

SEQ ID NO: 86776 - RNA, 19 nt, Human
ugggauuacaggcacccac

SEQ ID NO: 86777 - RNA, 19 nt, Human
ugggauuacaggcacccac

SEQ ID NO: 86778 - RNA, 21 nt, Human
ugggauuacaggcacccacua

SEQ ID NO: 86779 - RNA, 24 nt, Human
ugggauuacaggcacccacuacca

SEQ ID NO: 86780 - RNA, 25 nt, Human
ugggauuacaggcacccacuaccau

SEQ ID NO: 86781 - RNA, 18 nt, Human
ugggauuacaggcgugag

SEQ ID NO: 86782 - RNA, 19 nt, Human
ugggauuacaggcgugagc

SEQ ID NO: 86783 - RNA, 21 nt, Human
ugggauuacaggcgugagcca

SEQ ID NO: 86784 - RNA, 22 nt, Human
ugggauuacaggcgugagccac

SEQ ID NO: 86785 - RNA, 22 nt, Human
ugggauuacaggcgugagccac

SEQ ID NO: 86786 - RNA, 24 nt, Human
ugggauuacaggcgugagccacug

SEQ ID NO: 86787 - RNA, 26 nt, Human
ugggauuacaggcgugagccacugcu

SEQ ID NO: 86788 - RNA, 18 nt, Human
uggggggggguggggggu

SEQ ID NO: 86789 - RNA, 21 nt, Human
ugggggggggugggggguggg

SEQ ID NO: 86790 - RNA, 25 nt, Human
uggggggggguggggggugggaggg

SEQ ID NO: 86791 - RNA, 23 nt, Human
uggucuggaacucuugaccucag

SEQ ID NO: 86792 - RNA, 19 nt, Human
uggugaugagaauguccug

SEQ ID NO: 86793 - RNA, 24 nt, Human
uggugcgaucauggcucaccacaa

SEQ ID NO: 86794 - RNA, 18 nt, Human
ugucccaaagaacuuuug

SEQ ID NO: 86795 - RNA, 20 nt, Human
uguggggguggagggaagug

SEQ ID NO: 86796 - RNA, 21 nt, Human
ugugugggggggggugggggg

SEQ ID NO: 86797 - RNA, 24 nt, Human
uguguggggggggguggggggugg

SEQ ID NO: 86798 - RNA, 23 nt, Human
uguuuuuguuuuuguuuuugcuu

SEQ ID NO: 86799 - RNA, 24 nt, Human
uuaguacagacgggguuucaccau

SEQ ID NO: 86800 - RNA, 24 nt, Human
uucgagcaauucucccaccucagc

SEQ ID NO: 86801 - RNA, 21 nt, Human
uugcaaugaucucaaaauaga

SEQ ID NO: 86802 - RNA, 19 nt, Human
uugccagggguuagggaca

SEQ ID NO: 86803 - RNA, 22 nt, Human
uugccagggguuagggacacgg

SEQ ID NO: 86804 - RNA, 18 nt, Human
uugcuuugcuuuugagac

SEQ ID NO: 86805 - RNA, 23 nt, Human
uugcuuugcuuuugagacagagc

SEQ ID NO: 86806 - RNA, 23 nt, Human
uuguauuuuuaguacagacgggg

SEQ ID NO: 86807 - RNA, 23 nt, Human
uuuaaaaacaaaguacaaacaaa

SEQ ID NO: 86808 - RNA, 21 nt, Human
uuucaccaugcuggccagccu

SEQ ID NO: 86809 - RNA, 22 nt, Human
uuuguuuuuguuuuugcuuugc

SEQ ID NO: 86810 - RNA, 24 nt, Human
uuuuuaguacagacgggguuucac

SEQ ID NO: 86811 - RNA, 21 nt, Human
uuuuuguauuuuuaguacaga

SEQ ID NO: 86812 - RNA, 24 nt, Human
uuuuuuguauuuuuaguacagacg

SEQ ID NO: 86813 - RNA, 19 nt, Human
aagcugggcuucaagaaug

SEQ ID NO: 86814 - RNA, 23 nt, Human
acagaaaauaauuuuugucagua

SEQ ID NO: 86815 - RNA, 22 nt, Human
accaugguccaaaaucucccag

SEQ ID NO: 86816 - RNA, 22 nt, Human
acugggacgcaagacagaucua

SEQ ID NO: 86817 - RNA, 24 nt, Human
acuuaucuacuacuauuugucugu

SEQ ID NO: 86818 - RNA, 19 nt, Human
agacaugcccaaacaggag

SEQ ID NO: 86819 - RNA, 18 nt, Human
agauaugaaagcugggcu

SEQ ID NO: 86820 - RNA, 19 nt, Human
agcuggaacugaauaagac

SEQ ID NO: 86821 - RNA, 19 nt, Human
aggcgcagugcauggcugu

SEQ ID NO: 86822 - RNA, 19 nt, Human
agggcgucaugagcuggaa

SEQ ID NO: 86823 - RNA, 21 nt, Human
auaagacaugcccaaacagga

SEQ ID NO: 86824 - RNA, 20 nt, Human
augaucucaaacuaacagaa

SEQ ID NO: 86825 - RNA, 23 nt, Human
cagcggccacugucacagcgaaa

SEQ ID NO: 86826 - RNA, 18 nt, Human
cauugugcugggccuagc

SEQ ID NO: 86827 - RNA, 22 nt, Human
ccaaaaucucccaggaggcagu

SEQ ID NO: 86828 - RNA, 24 nt, Human
ccgugugcauacugccuuuguccu

SEQ ID NO: 86829 - RNA, 23 nt, Human
cugccuuuguccucccacagucc

SEQ ID NO: 86830 - RNA, 22 nt, Human
cuugcugcaaaucuguucacaa

SEQ ID NO: 86831 - RNA, 25 nt, Human
cuugcugcaaaucuguucacaaaag

SEQ ID NO: 86832 - RNA, 19 nt, Human
cuuucuggcaaugcagcgg

SEQ ID NO: 86833 - RNA, 19 nt, Human
gaccaugguccaaaaucuc

SEQ ID NO: 86834 - RNA, 21 nt, Human
gaguugguucuucgggauggu

SEQ ID NO: 86835 - RNA, 20 nt, Human
uaagacaugcccaaacagga

SEQ ID NO: 86836 - RNA, 21 nt, Human
uacaagggucacagucugacc

SEQ ID NO: 86837 - RNA, 21 nt, Human
uauuucauuuuuugugugucu

SEQ ID NO: 86838 - RNA, 22 nt, Human
ucaugagcuggaacugaauaag

SEQ ID NO: 86839 - RNA, 23 nt, Human
ucccccaaacugacugggacgca

SEQ ID NO: 86840 - RNA, 26 nt, Human
ucuccacagucauuuucuccauugca

SEQ ID NO: 86841 - RNA, 19 nt, Human
ugaucucaaacuaacagaa

SEQ ID NO: 86842 - RNA, 25 nt, Human
ugcauucuaacuuuccuggcuaacc

SEQ ID NO: 86843 - RNA, 22 nt, Human
ugccuuuguccucccacagucc

SEQ ID NO: 86844 - RNA, 22 nt, Human
ugguccaaaaucucccaggagg

SEQ ID NO: 86845 - RNA, 20 nt, Human
ugucacagcgaaauuuauuc

SEQ ID NO: 86846 - RNA, 22 nt, Human
uguccucccacagucccuuuca

SEQ ID NO: 86847 - RNA, 19 nt, Human
uucacaaaaguuuuccugg

SEQ ID NO: 86848 - RNA, 24 nt, Human
uuuguaggaguugguucuucggga

SEQ ID NO: 86849 - RNA, 24 nt, Human
aaaagaaaaaagaacaggggcaaa

SEQ ID NO: 86850 - RNA, 18 nt, Human
aaaauuagcugggcgugg

SEQ ID NO: 86851 - RNA, 24 nt, Human
aacaaagugagacucugucuuaaa

SEQ ID NO: 86852 - RNA, 18 nt, Human
aacauggugaaacccauc

SEQ ID NO: 86853 - RNA, 19 nt, Human
aacauggugaaacccaucu

SEQ ID NO: 86854 - RNA, 20 nt, Human
aacauggugaaacccaucuc

SEQ ID NO: 86855 - RNA, 27 nt, Human
aaggcagacggauuaccugaggucagg

SEQ ID NO: 86856 - RNA, 19 nt, Human
acaaagugagacucugucu

SEQ ID NO: 86857 - RNA, 24 nt, Human
acaaagugagacucugucuuaaaa

SEQ ID NO: 86858 - RNA, 22 nt, Human
acaagacaccccugugaccacu

SEQ ID NO: 86859 - RNA, 22 nt, Human
acagauggcugggaguugagga

SEQ ID NO: 86860 - RNA, 18 nt, Human
acugcgcuccagccuggg

SEQ ID NO: 86861 - RNA, 23 nt, Human
acugcgcuccagccugggcaaca

SEQ ID NO: 86862 - RNA, 21 nt, Human
agaagguaacaccuauuucaa

SEQ ID NO: 86863 - RNA, 26 nt, Human
agacggauuaccugaggucaggaguu

SEQ ID NO: 86864 - RNA, 24 nt, Human
agcauggccaacauggugaaaccc

SEQ ID NO: 86865 - RNA, 23 nt, Human
agccccagcugccugcuggauuc

SEQ ID NO: 86866 - RNA, 24 nt, Human
agccugggcaacaaagugagacuc

SEQ ID NO: 86867 - RNA, 26 nt, Human
aggcagacggauuaccugaggucagg

SEQ ID NO: 86868 - RNA, 19 nt, Human
aggcggagguugcagggag

SEQ ID NO: 86869 - RNA, 26 nt, Human
aggucaggaguuggagacgagcaugg

SEQ ID NO: 86870 - RNA, 24 nt, Human
aucaccccacugcgcuccagccug

SEQ ID NO: 86871 - RNA, 21 nt, Human
augggcugugucaaucauacu

SEQ ID NO: 86872 - RNA, 19 nt, Human
auuucauuuaagcccucuc

SEQ ID NO: 86873 - RNA, 23 nt, Human
caaaagaaaaaagaacaggggca

SEQ ID NO: 86874 - RNA, 23 nt, Human
caacauggugaaacccaucucua

SEQ ID NO: 86875 - RNA, 24 nt, Human
caagaacacgcagccagccugugc

SEQ ID NO: 86876 - RNA, 24 nt, Human
caaggcagacggauuaccugaggu

SEQ ID NO: 86877 - RNA, 20 nt, Human
caccuguaaucccagcugcu

SEQ ID NO: 86878 - RNA, 24 nt, Human
caccuguaaucccagcugcuuggg

SEQ ID NO: 86879 - RNA, 19 nt, Human
cacugcgcuccagccuggg

SEQ ID NO: 86880 - RNA, 20 nt, Human
cacugcgcuccagccugggc

SEQ ID NO: 86881 - RNA, 21 nt, Human
cacugcgcuccagccugggca

SEQ ID NO: 86882 - RNA, 22 nt, Human
cacugcgcuccagccugggcaa

SEQ ID NO: 86883 - RNA, 23 nt, Human
cacugcgcuccagccugggcaac

SEQ ID NO: 86884 - RNA, 24 nt, Human
cacugcgcuccagccugggcaaca

SEQ ID NO: 86885 - RNA, 24 nt, Human
cagacggauuaccugaggucagga

SEQ ID NO: 86886 - RNA, 20 nt, Human
cagcauuugggaggccaagg

SEQ ID NO: 86887 - RNA, 23 nt, Human
cagcauuugggaggccaaggcag

SEQ ID NO: 86888 - RNA, 24 nt, Human
cagccaggcguggugguucauguc

SEQ ID NO: 86889 - RNA, 18 nt, Human
cagccccagcugccugcu

SEQ ID NO: 86890 - RNA, 19 nt, Human
cagccccagcugccugcug

SEQ ID NO: 86891 - RNA, 23 nt, Human
cagugcccaguugugcagauguu

SEQ ID NO: 86892 - RNA, 23 nt, Human
cauggccaacauggugaaaccca

SEQ ID NO: 86893 - RNA, 23 nt, Human
caugucuguaaucccagcauuug

SEQ ID NO: 86894 - RNA, 27 nt, Human
ccaaggcagacggauuaccugagguca

SEQ ID NO: 86895 - RNA, 20 nt, Human
ccacugcgcuccagccuggg

SEQ ID NO: 86896 - RNA, 20 nt, Human
ccacugcgcuccagccuggg

SEQ ID NO: 86897 - RNA, 21 nt, Human
ccacugcgcuccagccugggc

SEQ ID NO: 86898 - RNA, 23 nt, Human
ccacugcgcuccagccugggcaa

SEQ ID NO: 86899 - RNA, 24 nt, Human
ccacugcgcuccagccugggcaac

SEQ ID NO: 86900 - RNA, 23 nt, Human
ccagggucagaacaauacagaga

SEQ ID NO: 86901 - RNA, 21 nt, Human
ccccaaagagaagacugaauu

SEQ ID NO: 86902 - RNA, 20 nt, Human
ccccacugcgcuccagccug

SEQ ID NO: 86903 - RNA, 24 nt, Human
ccccacugcgcuccagccugggca

SEQ ID NO: 86904 - RNA, 20 nt, Human
ccugaggucaggaguuggag

SEQ ID NO: 86905 - RNA, 21 nt, Human
ccuguaaucccagcugcuugg

SEQ ID NO: 86906 - RNA, 23 nt, Human
cggauuaccugaggucaggaguu

SEQ ID NO: 86907 - RNA, 24 nt, Human
cuaaaaccccaaagagaagacuga

SEQ ID NO: 86908 - RNA, 19 nt, Human
cucaggauagaaauaguuu

SEQ ID NO: 86909 - RNA, 20 nt, Human
cucucauuucuccucccaca

SEQ ID NO: 86910 - RNA, 20 nt, Human
cuguaaucccagcauuuggg

SEQ ID NO: 86911 - RNA, 21 nt, Human
cuguaaucccagcugcuuggg

SEQ ID NO: 86912 - RNA, 21 nt, Human
cuguccagugcccaguugugc

SEQ ID NO: 86913 - RNA, 22 nt, Human
cuuucuguuauccuagucauuu

SEQ ID NO: 86914 - RNA, 23 nt, Human
gagacgagcauggccaacauggu

SEQ ID NO: 86915 - RNA, 23 nt, Human
gagaucaccccacugcgcuccag

SEQ ID NO: 86916 - RNA, 19 nt, Human
gagcauucaaguuucucua

SEQ ID NO: 86917 - RNA, 18 nt, Human
gauuaccugaggucagga

SEQ ID NO: 86918 - RNA, 23 nt, Human
gauuaccugaggucaggaguugg

SEQ ID NO: 86919 - RNA, 28 nt, Human
gcugaggcacaagaaucgcuucaaccca

SEQ ID NO: 86920 - RNA, 18 nt, Human
gcugcuguuuuguuuuga

SEQ ID NO: 86921 - RNA, 20 nt, Human
ggaaaaccacccucucuaau

SEQ ID NO: 86922 - RNA, 24 nt, Human
ggagguugcagggagaugagauca

SEQ ID NO: 86923 - RNA, 22 nt, Human
ggauuaccugaggucaggaguu

SEQ ID NO: 86924 - RNA, 24 nt, Human
ggccaacauggugaaacccaucuc

SEQ ID NO: 86925 - RNA, 21 nt, Human
ggcgggcaccuguaaucccag

SEQ ID NO: 86926 - RNA, 24 nt, Human
gggcgugguggcgggcaccuguaa

SEQ ID NO: 86927 - RNA, 24 nt, Human
gguggcgggcaccuguaaucccag

SEQ ID NO: 86928 - RNA, 24 nt, Human
ggugguucaugucuguaaucccag

SEQ ID NO: 86929 - RNA, 21 nt, Human
gguucaugucuguaaucccag

SEQ ID NO: 86930 - RNA, 22 nt, Human
guucuggcccaugggcuguguc

SEQ ID NO: 86931 - RNA, 18 nt, Human
uaaaaaaccaaggcccag

SEQ ID NO: 86932 - RNA, 19 nt, Human
uaaaaaaccaaggcccaga

SEQ ID NO: 86933 - RNA, 20 nt, Human
uaaaaaggaggcaaaagagu

SEQ ID NO: 86934 - RNA, 18 nt, Human
uacagauuuuaaaaaacc

SEQ ID NO: 86935 - RNA, 22 nt, Human
uaccuguguacucccugaaaac

SEQ ID NO: 86936 - RNA, 23 nt, Human
uagcuuauuuuaaauuucauuua

SEQ ID NO: 86937 - RNA, 20 nt, Human
ucaugucuguaaucccagca

SEQ ID NO: 86938 - RNA, 20 nt, Human
ucaugucuguaaucccagca

SEQ ID NO: 86939 - RNA, 18 nt, Human
uccacagaauagggaaaa

SEQ ID NO: 86940 - RNA, 24 nt, Human
uccagccaggcguggugguucaug

SEQ ID NO: 86941 - RNA, 24 nt, Human
uccagccugggcaacaaagugaga

SEQ ID NO: 86942 - RNA, 19 nt, Human
uccauugaggaaaaccacc

SEQ ID NO: 86943 - RNA, 22 nt, Human
ucuaaucaggagaucacguucu

SEQ ID NO: 86944 - RNA, 21 nt, Human
ucucuacuaaaaaugcaaaaa

SEQ ID NO: 86945 - RNA, 18 nt, Human
ugaaaacucugggacugu

SEQ ID NO: 86946 - RNA, 19 nt, Human
ugaaaacucugggacugua

SEQ ID NO: 86947 - RNA, 19 nt, Human
ugaaagagaaauaaggaau

SEQ ID NO: 86948 - RNA, 22 nt, Human
ugagaucaccccacugcgcucc

SEQ ID NO: 86949 - RNA, 23 nt, Human
ugaggaggaagguagacacugga

SEQ ID NO: 86950 - RNA, 18 nt, Human
ugcaaaaauuagcugggc

SEQ ID NO: 86951 - RNA, 24 nt, Human
ugcaaaaauuagcugggcguggug

SEQ ID NO: 86952 - RNA, 18 nt, Human
ugcccaguugugcagaug

SEQ ID NO: 86953 - RNA, 22 nt, Human
ugcuucaaacuaaucuaccugu

SEQ ID NO: 86954 - RNA, 23 nt, Human
uggauuccaagcaagcugaccau

SEQ ID NO: 86955 - RNA, 20 nt, Human
uggccaacauggugaaaccc

SEQ ID NO: 86956 - RNA, 23 nt, Human
uggccaacauggugaaacccauc

SEQ ID NO: 86957 - RNA, 22 nt, Human
uggcgggcaccuguaaucccag

SEQ ID NO: 86958 - RNA, 26 nt, Human
ugggaagcugaggcacaagaaucgcu

SEQ ID NO: 86959 - RNA, 18 nt, Human
ugggaggccaaggcagac

SEQ ID NO: 86960 - RNA, 24 nt, Human
ugggcaacaaagugagacucuguc

SEQ ID NO: 86961 - RNA, 24 nt, Human
ugguggcgggcaccuguaauccca

SEQ ID NO: 86962 - RNA, 24 nt, Human
uggugguucaugucuguaauccca

SEQ ID NO: 86963 - RNA, 22 nt, Human
ugguucaugucuguaaucccag

SEQ ID NO: 86964 - RNA, 24 nt, Human
ugguucaugucuguaaucccagca

SEQ ID NO: 86965 - RNA, 23 nt, Human
ugucuguaaucccagcauuuggg

SEQ ID NO: 86966 - RNA, 20 nt, Human
uuaaaaaaagaauaaggaau

SEQ ID NO: 86967 - RNA, 24 nt, Human
uuaaaaaaccaaggcccagagaag

SEQ ID NO: 86968 - RNA, 22 nt, Human
uuacagauuuuaaaaaaccaag

SEQ ID NO: 86969 - RNA, 18 nt, Human
uuagcugggcgugguggc

SEQ ID NO: 86970 - RNA, 24 nt, Human
uuagcugggcgugguggcgggcac

SEQ ID NO: 86971 - RNA, 26 nt, Human
uucaaaagaaaaaagaacaggggcaa

SEQ ID NO: 86972 - RNA, 24 nt, Human
uucaacccaggaggcggagguugc

SEQ ID NO: 86973 - RNA, 19 nt, Human
uucacucagccccagcugc

SEQ ID NO: 86974 - RNA, 20 nt, Human
uuccauugaggaaaaccacc

SEQ ID NO: 86975 - RNA, 24 nt, Human
uugggaagcugaggcacaagaauc

SEQ ID NO: 86976 - RNA, 24 nt, Human
uuuacagauuuuaaaaaaccaagg

SEQ ID NO: 86977 - RNA, 24 nt, Human
aaaaaugcauuuucugaauaagcu

SEQ ID NO: 86978 - RNA, 23 nt, Human
aaacuacaggguccaucagaaag

SEQ ID NO: 86979 - RNA, 25 nt, Human
accacagcuuauuagacuguacaac

SEQ ID NO: 86980 - RNA, 23 nt, Human
aggaugccuuucaagucagcuuc

SEQ ID NO: 86981 - RNA, 19 nt, Human
aguaccaaggaugccuuuc

SEQ ID NO: 86982 - RNA, 20 nt, Human
auuacagcuccaacauacac

SEQ ID NO: 86983 - RNA, 19 nt, Human
caaaugucuacagaagaau

SEQ ID NO: 86984 - RNA, 24 nt, Human
cagaagauauuccuguggcucucu

SEQ ID NO: 86985 - RNA, 24 nt, Human
cccgccgcaggggcucggacagcc

SEQ ID NO: 86986 - RNA, 19 nt, Human
cccgcguccgcgugcuccg

SEQ ID NO: 86987 - RNA, 24 nt, Human
ccgccacaccaucguccgcccgcc

SEQ ID NO: 86988 - RNA, 23 nt, Human
ccgcccgcguccgcgugcuccgc

SEQ ID NO: 86989 - RNA, 20 nt, Human
ccgccgcgccgcccgcgucc

SEQ ID NO: 86990 - RNA, 22 nt, Human
ccuuucaagucagcuucuacau

SEQ ID NO: 86991 - RNA, 18 nt, Human
cgggcccgcgagccgugu

SEQ ID NO: 86992 - RNA, 19 nt, Human
cguccgcccgccgcagggg

SEQ ID NO: 86993 - RNA, 23 nt, Human
cguguuggaacagguaccgcgac

SEQ ID NO: 86994 - RNA, 24 nt, Human
cuacaagcaguugccauugcauuu

SEQ ID NO: 86995 - RNA, 22 nt, Human
cuucacuuaguaccaaggaugc

SEQ ID NO: 86996 - RNA, 24 nt, Human
cuucaugcccgccgccgcgccgcc

SEQ ID NO: 86997 - RNA, 21 nt, Human
gacaggaaugucgugaaucug

SEQ ID NO: 86998 - RNA, 18 nt, Human
gacuguacaacagaagau

SEQ ID NO: 86999 - RNA, 24 nt, Human
gaugccuuucaagucagcuucuac

SEQ ID NO: 87000 - RNA, 23 nt, Human
ggaccggagccggcacgggcccg

SEQ ID NO: 87001 - RNA, 23 nt, Human
ggaggcuucaaauggcauaugca

SEQ ID NO: 87002 - RNA, 23 nt, Human
gggcucggacagccgcgccgggg

SEQ ID NO: 87003 - RNA, 22 nt, Human
guagauuaugaaaaaaaaaugg

SEQ ID NO: 87004 - RNA, 21 nt, Human
uaaaagcuggaggcuucaaau

SEQ ID NO: 87005 - RNA, 21 nt, Human
uaaacugucauuaaacuguga

SEQ ID NO: 87006 - RNA, 22 nt, Human
uaagaaacauaauugcaaccau

SEQ ID NO: 87007 - RNA, 20 nt, Human
uaagguaaaaauccaaguuu

SEQ ID NO: 87008 - RNA, 21 nt, Human
uaaucaguaucauucuauaac

SEQ ID NO: 87009 - RNA, 21 nt, Human
uacaaguguauuaaacacugg

SEQ ID NO: 87010 - RNA, 22 nt, Human
uacaccaugaaugcugaugcug

SEQ ID NO: 87011 - RNA, 21 nt, Human
uaccgcgaccacgacaccggc

SEQ ID NO: 87012 - RNA, 23 nt, Human
uauuagacuguacaacagaagau

SEQ ID NO: 87013 - RNA, 21 nt, Human
ucaguggacuuaaagccaaga

SEQ ID NO: 87014 - RNA, 22 nt, Human
uccaaguuacaaguguauuaaa

SEQ ID NO: 87015 - RNA, 19 nt, Human
uccgccacaccaucguccg

SEQ ID NO: 87016 - RNA, 20 nt, Human
ucuacagaagaaugcgcugu

SEQ ID NO: 87017 - RNA, 21 nt, Human
uggaaacuacaggguccauca

SEQ ID NO: 87018 - RNA, 28 nt, Human
uggcagaagacgccgucugguccagcga

SEQ ID NO: 87019 - RNA, 21 nt, Human
ugggacaggaaugucgugaau

SEQ ID NO: 87020 - RNA, 22 nt, Human
uuaaaaaagaucagccauagcc

SEQ ID NO: 87021 - RNA, 20 nt, Human
uuuuuuuuuuuuuuuugcaa

SEQ ID NO: 87022 - RNA, 22 nt, Human
uuuuuuuuuuuuuuuugcaauu

SEQ ID NO: 87023 - RNA, 18 nt, Human
acagagcuucuaguuaac

SEQ ID NO: 87024 - RNA, 22 nt, Human
acagcaucugguccagccugug

SEQ ID NO: 87025 - RNA, 18 nt, Human
accuagucuuaggccugg

SEQ ID NO: 87026 - RNA, 26 nt, Human
acgcccaauaaaacaaaguaggauga

SEQ ID NO: 87027 - RNA, 19 nt, Human
acucaagucaauuuuuagu

SEQ ID NO: 87028 - RNA, 23 nt, Human
agccaccgcacuauauuaccuug

SEQ ID NO: 87029 - RNA, 18 nt, Human
aggaauaaagcuaucuau

SEQ ID NO: 87030 - RNA, 24 nt, Human
aggggucgacauccacagcaucug

SEQ ID NO: 87031 - RNA, 18 nt, Human
agugcaggggucgacauc

SEQ ID NO: 87032 - RNA, 21 nt, Human
auccacagcaucugguccagc

SEQ ID NO: 87033 - RNA, 22 nt, Human
cacuauauuaccuugaaggaau

SEQ ID NO: 87034 - RNA, 19 nt, Human
cagcaucugguccagccug

SEQ ID NO: 87035 - RNA, 19 nt, Human
gcagaacaaagaaaaaagu

SEQ ID NO: 87036 - RNA, 19 nt, Human
gcugauuugcaucuucucu

SEQ ID NO: 87037 - RNA, 21 nt, Human
ggaguaaaagaugucuacagg

SEQ ID NO: 87038 - RNA, 20 nt, Human
ggcagaacaaagaaaaaagu

SEQ ID NO: 87039 - RNA, 21 nt, Human
gugcaggggucgacauccaca

SEQ ID NO: 87040 - RNA, 23 nt, Human
uaaaacaaaguaggaugaaaaaa

SEQ ID NO: 87041 - RNA, 25 nt, Human
uaaaagaugucuacaggcugggacu

SEQ ID NO: 87042 - RNA, 23 nt, Human
uaacucaagucaauuuuuaguau

SEQ ID NO: 87043 - RNA, 18 nt, Human
ucaaagaacuaagagaau

SEQ ID NO: 87044 - RNA, 25 nt, Human
ucaacgcccaauaaaacaaaguagg

SEQ ID NO: 87045 - RNA, 22 nt, Human
ucagugcaggggucgacaucca

SEQ ID NO: 87046 - RNA, 24 nt, Human
uccacagcaucugguccagccugu

SEQ ID NO: 87047 - RNA, 21 nt, Human
ucugcuuguuuugucucuaac

SEQ ID NO: 87048 - RNA, 25 nt, Human
ugaauaaaaugauugaguuuuguaa

SEQ ID NO: 87049 - RNA, 18 nt, Human
ugcuuacccuaccaauua

SEQ ID NO: 87050 - RNA, 21 nt, Human
uggcagaacaaagaaaaaagu

SEQ ID NO: 87051 - RNA, 25 nt, Human
uggcagaacaaagaaaaaagugugc

SEQ ID NO: 87052 - RNA, 20 nt, Human
uggcuguagacagcaaaacc

SEQ ID NO: 87053 - RNA, 20 nt, Human
ugucugcuuguuuugucucu

SEQ ID NO: 87054 - RNA, 23 nt, Human
uuaguauuuuucucauuguuuca

SEQ ID NO: 87055 - RNA, 24 nt, Human
acuugcauuuuacaagguaacauc

SEQ ID NO: 87056 - RNA, 19 nt, Human
cacugccuuuugcccuugc

SEQ ID NO: 87057 - RNA, 19 nt, Human
cagguggaaacugguguag

SEQ ID NO: 87058 - RNA, 27 nt, Human
caucuuuauuuuaaacagcuugcaugg

SEQ ID NO: 87059 - RNA, 18 nt, Human
cauggcacugccuuuugc

SEQ ID NO: 87060 - RNA, 18 nt, Human
uagcccacugcuguauca

SEQ ID NO: 87061 - RNA, 21 nt, Human
ugaacuccagguggaaacugg

SEQ ID NO: 87062 - RNA, 19 nt, Human
ugguguagggcugagcugg

SEQ ID NO: 87063 - RNA, 20 nt, Human
aagauccccugcccugggug

SEQ ID NO: 87064 - RNA, 22 nt, Human
aggguagcaccaccaaaguccc

SEQ ID NO: 87065 - RNA, 21 nt, Human
cacuggagcugugugccggcc

SEQ ID NO: 87066 - RNA, 18 nt, Human
cccacuguccucuggggc

SEQ ID NO: 87067 - RNA, 23 nt, Human
ccccugcccuggguggcagggcc

SEQ ID NO: 87068 - RNA, 18 nt, Human
cccuggguggcagggccc

SEQ ID NO: 87069 - RNA, 24 nt, Human
cccuggguggcagggcccugaucu

SEQ ID NO: 87070 - RNA, 21 nt, Human
cggaggacaggcagcgggcac

SEQ ID NO: 87071 - RNA, 27 nt, Human
gaucugaggcugguuucaaccuugugg

SEQ ID NO: 87072 - RNA, 18 nt, Human
gcagcaggguggcaggac

SEQ ID NO: 87073 - RNA, 18 nt, Human
guagguaccacuccaccc

SEQ ID NO: 87074 - RNA, 20 nt, Human
guggcggcagcaggguggca

SEQ ID NO: 87075 - RNA, 25 nt, Human
uagguaccacuccacccacuguccu

SEQ ID NO: 87076 - RNA, 20 nt, Human
ugaggcugguuucacggagg

SEQ ID NO: 87077 - RNA, 19 nt, Human
aaaacacuggaagcuguaa

SEQ ID NO: 87078 - RNA, 24 nt, Human
aaaagaaaagaaaaugacugaaaa

SEQ ID NO: 87079 - RNA, 19 nt, Human
aaacaguauuacaauuuuc

SEQ ID NO: 87080 - RNA, 19 nt, Human
aaacugguuugaaaaaagu

SEQ ID NO: 87081 - RNA, 22 nt, Human
aaaugaacagaaaaacccacau

SEQ ID NO: 87082 - RNA, 21 nt, Human
aaaugccuccuacccucaccc

SEQ ID NO: 87083 - RNA, 22 nt, Human
aacacugucauuuucuauuuag

SEQ ID NO: 87084 - RNA, 24 nt, Human
aacagaaaaacccacauuaaucca

SEQ ID NO: 87085 - RNA, 25 nt, Human
aagcauuuaauacugcaauaaaaug

SEQ ID NO: 87086 - RNA, 22 nt, Human
aauaaaaugaacagaaaaaccc

SEQ ID NO: 87087 - RNA, 22 nt, Human
aaugccuccuacccucacccca

SEQ ID NO: 87088 - RNA, 21 nt, Human
aauucaauuugccauggagaa

SEQ ID NO: 87089 - RNA, 24 nt, Human
acaaguguaggaauuaccagcacg

SEQ ID NO: 87090 - RNA, 20 nt, Human
accacacccaaauaccucag

SEQ ID NO: 87091 - RNA, 24 nt, Human
acucucaucacaaaaaaagccauu

SEQ ID NO: 87092 - RNA, 18 nt, Human
agaaaagaaaaugacuga

SEQ ID NO: 87093 - RNA, 21 nt, Human
agaaaagaaaaugacugaaaa

SEQ ID NO: 87094 - RNA, 24 nt, Human
agaaauuuauagaacaugagagua

SEQ ID NO: 87095 - RNA, 18 nt, Human
agaauuacgggacagaaa

SEQ ID NO: 87096 - RNA, 20 nt, Human
agcaaagaaaaaauguaaag

SEQ ID NO: 87097 - RNA, 19 nt, Human
aguuugugugaaaacacag

SEQ ID NO: 87098 - RNA, 27 nt, Human
auacuaauagagaucucuaaguacacc

SEQ ID NO: 87099 - RNA, 20 nt, Human
auagucaaaacacuggaagc

SEQ ID NO: 87100 - RNA, 22 nt, Human
auccuccccucuucaugucucu

SEQ ID NO: 87101 - RNA, 23 nt, Human
auuaaaaaucucuccuucaguuu

SEQ ID NO: 87102 - RNA, 19 nt, Human
caaaacacuggaagcugua

SEQ ID NO: 87103 - RNA, 21 nt, Human
cacagggauaaguaguucaac

SEQ ID NO: 87104 - RNA, 19 nt, Human
cacaguuaccuggaggacu

SEQ ID NO: 87105 - RNA, 18 nt, Human
cacccuuugaacagcaag

SEQ ID NO: 87106 - RNA, 21 nt, Human
caguaagaaaaacaucuaauc

SEQ ID NO: 87107 - RNA, 21 nt, Human
caucacaguuaccuggaggac

SEQ ID NO: 87108 - RNA, 22 nt, Human
caugcagaggucaaaaacaggc

SEQ ID NO: 87109 - RNA, 23 nt, Human
ccaaauaccucaguuucagugac

SEQ ID NO: 87110 - RNA, 22 nt, Human
ccaagccaggcaucgagggaua

SEQ ID NO: 87111 - RNA, 22 nt, Human
ccacaauuuauugaacuacaaa

SEQ ID NO: 87112 - RNA, 20 nt, Human
ccacauuaauccacuuuuaa

SEQ ID NO: 87113 - RNA, 26 nt, Human
ccacccuuugaacagcaaggugaccc

SEQ ID NO: 87114 - RNA, 20 nt, Human
cccccgcaucacaguuaccu

SEQ ID NO: 87115 - RNA, 21 nt, Human
cccgcccaccacgcuucuuuu

SEQ ID NO: 87116 - RNA, 19 nt, Human
ccgggugccucucccgcug

SEQ ID NO: 87117 - RNA, 20 nt, Human
ccucaccccacccccaguua

SEQ ID NO: 87118 - RNA, 24 nt, Human
cgagaauaaaucucugaaaaacau

SEQ ID NO: 87119 - RNA, 19 nt, Human
cgucuuaacauuaaaaauu

SEQ ID NO: 87120 - RNA, 23 nt, Human
cgucuuaacauuaaaaauucuag

SEQ ID NO: 87121 - RNA, 19 nt, Human
cuacccucaccccaccccc

SEQ ID NO: 87122 - RNA, 19 nt, Human
cucacaucaugcuauaacu

SEQ ID NO: 87123 - RNA, 22 nt, Human
cucaccccacccccaguuauac

SEQ ID NO: 87124 - RNA, 18 nt, Human
cucaggaaaugggagauu

SEQ ID NO: 87125 - RNA, 22 nt, Human
cuuugggcauuuccucgcgcug

SEQ ID NO: 87126 - RNA, 22 nt, Human
cuuuuaaaaaugaaguuacuau

SEQ ID NO: 87127 - RNA, 22 nt, Human
gaaaaacaucuaauccaacuca

SEQ ID NO: 87128 - RNA, 22 nt, Human
gaaguaaguuguggggccugag

SEQ ID NO: 87129 - RNA, 19 nt, Human
gacagugacaccuuugaaa

SEQ ID NO: 87130 - RNA, 23 nt, Human
gacuuuugagacacaaggggaug

SEQ ID NO: 87131 - RNA, 21 nt, Human
gagcuuccgggugccucuccc

SEQ ID NO: 87132 - RNA, 20 nt, Human
gccagacaccaagccaggca

SEQ ID NO: 87133 - RNA, 18 nt, Human
ggucaaaaacaggcaggc

SEQ ID NO: 87134 - RNA, 22 nt, Human
gugaaaacacagacaguaaaca

SEQ ID NO: 87135 - RNA, 20 nt, Human
gugcagacgccgggagcuuc

SEQ ID NO: 87136 - RNA, 20 nt, Human
uaaaaugaacagaaaaaccc

SEQ ID NO: 87137 - RNA, 23 nt, Human
uaaaaugaacagaaaaacccaca

SEQ ID NO: 87138 - RNA, 23 nt, Human
uaaauccaauaaacaaccaugau

SEQ ID NO: 87139 - RNA, 25 nt, Human
uaaauccaauaaacaaccaugauau

SEQ ID NO: 87140 - RNA, 21 nt, Human
uaagaaaaacaucuaauccaa

SEQ ID NO: 87141 - RNA, 21 nt, Human
uaagaaaaacaucuaauccag

SEQ ID NO: 87142 - RNA, 24 nt, Human
uaauccaacucaugcagaggucaa

SEQ ID NO: 87143 - RNA, 24 nt, Human
uacaaucaacuaaaauuugaugcc

SEQ ID NO: 87144 - RNA, 23 nt, Human
uaccaaaaaaagaaaagaaaaug

SEQ ID NO: 87145 - RNA, 25 nt, Human
uaccaaaaaaagaaaagaaaaugac

SEQ ID NO: 87146 - RNA, 22 nt, Human
uaccaaagaugaaauuauucag

SEQ ID NO: 87147 - RNA, 23 nt, Human
uaguuugaggcucuccuucaguu

SEQ ID NO: 87148 - RNA, 22 nt, Human
uauauacuacacaggacagcuu

SEQ ID NO: 87149 - RNA, 23 nt, Human
uauuuagugauucuucccuucca

SEQ ID NO: 87150 - RNA, 20 nt, Human
ucaaaaacaggcaggcaaga

SEQ ID NO: 87151 - RNA, 21 nt, Human
ucagugucacuauaguuucuu

SEQ ID NO: 87152 - RNA, 21 nt, Human
ucaucugaagcaauuauuuga

SEQ ID NO: 87153 - RNA, 22 nt, Human
uccagaaaauucaagccaguac

SEQ ID NO: 87154 - RNA, 22 nt, Human
uccuacccucaccccaccccca

SEQ ID NO: 87155 - RNA, 24 nt, Human
ucuaguaacuuuuaaaaaugaagu

SEQ ID NO: 87156 - RNA, 24 nt, Human
ucugacagugacaccuuugaaaca

SEQ ID NO: 87157 - RNA, 20 nt, Human
ucuuggugaguucuuggaug

SEQ ID NO: 87158 - RNA, 22 nt, Human
ugaaaaauaaguuuugcaagaa

SEQ ID NO: 87159 - RNA, 23 nt, Human
ugaaaacacagacaguaaacaca

SEQ ID NO: 87160 - RNA, 18 nt, Human
ugacagugacaccuuuga

SEQ ID NO: 87161 - RNA, 18 nt, Human
ugauagcaaagaaaaaau

SEQ ID NO: 87162 - RNA, 25 nt, Human
ugccacagaaauauauuacauagaa

SEQ ID NO: 87163 - RNA, 20 nt, Human
ugccauggagaacuucagau

SEQ ID NO: 87164 - RNA, 22 nt, Human
uggaauggaaaagaaaaauucu

SEQ ID NO: 87165 - RNA, 21 nt, Human
uggaggacucaccaaaccaca

SEQ ID NO: 87166 - RNA, 20 nt, Human
uguaagaugcugcaggaccu

SEQ ID NO: 87167 - RNA, 18 nt, Human
uuaaaugaaagcuuaagu

SEQ ID NO: 87168 - RNA, 23 nt, Human
uuaauaauuuagacaaugcccaa

SEQ ID NO: 87169 - RNA, 22 nt, Human
uuaccacacccaaauaccucag

SEQ ID NO: 87170 - RNA, 22 nt, Human
uuagaacagauaaauccaauaa

SEQ ID NO: 87171 - RNA, 24 nt, Human
uucaacaucugcuaauuauggacu

SEQ ID NO: 87172 - RNA, 22 nt, Human
uugcacuaaggaauuaaaaauc

SEQ ID NO: 87173 - RNA, 18 nt, Human
uuggacuguuuaaauuau

SEQ ID NO: 87174 - RNA, 27 nt, Human
uuguaccaaaaaaagaaaagaaaauga

SEQ ID NO: 87175 - RNA, 24 nt, Human
uuuagaaauuuuccaccacuuccu

SEQ ID NO: 87176 - RNA, 20 nt, Human
uuuauccuucccuuuuuuau

SEQ ID NO: 87177 - RNA, 24 nt, Human
uuugccagacaccaagccaggcau

SEQ ID NO: 87178 - RNA, 21 nt, Human
uuuuaaaaaugaaguuacuau

SEQ ID NO: 87179 - RNA, 19 nt, Human
aaggaagaaaaauuaaaaa

SEQ ID NO: 87180 - RNA, 22 nt, Human
aaggaagaaaaauuaaaaaaaa

SEQ ID NO: 87181 - RNA, 19 nt, Human
acuggagcucagagaagcc

SEQ ID NO: 87182 - RNA, 20 nt, Human
agagagaagagacuucagag

SEQ ID NO: 87183 - RNA, 21 nt, Human
aggaagaaaaauuaaaaaaaa

SEQ ID NO: 87184 - RNA, 22 nt, Human
ccacuggagcucagagaagcca

SEQ ID NO: 87185 - RNA, 25 nt, Human
cuucagggguaggagucugaaggua

SEQ ID NO: 87186 - RNA, 26 nt, Human
gaacaaaaaauggaaacaucacagga

SEQ ID NO: 87187 - RNA, 20 nt, Human
gagcucagagaagccaacag

SEQ ID NO: 87188 - RNA, 20 nt, Human
gcucagagaagccaacagcu

SEQ ID NO: 87189 - RNA, 25 nt, Human
uaaaaaaaaaauuauagaccuaaga

SEQ ID NO: 87190 - RNA, 25 nt, Human
uagggaacaaaaaauggaaacauca

SEQ ID NO: 87191 - RNA, 23 nt, Human
uaguguuuucuucuuccacugga

SEQ ID NO: 87192 - RNA, 23 nt, Human
uugaaguuuuuuaaaccaacauu

SEQ ID NO: 87193 - RNA, 22 nt, Human
uuugaaguuuuuuaaaccaaca

SEQ ID NO: 87194 - RNA, 25 nt, Human
uuuuuuuuuuuucuuugaaguuuuu

SEQ ID NO: 87195 - RNA, 18 nt, Human
uuuuuuuuuuuuucuuug

SEQ ID NO: 87196 - RNA, 18 nt, Human
uuuuuuuuuuuuucuuug

SEQ ID NO: 87197 - RNA, 22 nt, Human
aaaaaaauagacauacaaauca

SEQ ID NO: 87198 - RNA, 23 nt, Human
aagcaguaagaacuaaaauuuaa

SEQ ID NO: 87199 - RNA, 20 nt, Human
acauacaaaucacuuaguug

SEQ ID NO: 87200 - RNA, 25 nt, Human
aggaaggacaaguuucuucucagaa

SEQ ID NO: 87201 - RNA, 22 nt, Human
aggcugccacagaggaccacgc

SEQ ID NO: 87202 - RNA, 22 nt, Human
cuaccucuguggaaaacagcuc

SEQ ID NO: 87203 - RNA, 19 nt, Human
cugaguuuucuuuuucucu

SEQ ID NO: 87204 - RNA, 25 nt, Human
uaaacugaaaaaaauagacauacaa

SEQ ID NO: 87205 - RNA, 21 nt, Human
uacugaguuuucuuuuucucu

SEQ ID NO: 87206 - RNA, 21 nt, Human
ucuguggaaaacagcucugaa

SEQ ID NO: 87207 - RNA, 19 nt, Human
ugaaaaaaauagacauaca

SEQ ID NO: 87208 - RNA, 24 nt, Human
ugaaaaaaauagacauacaaauca

SEQ ID NO: 87209 - RNA, 19 nt, Human
ugcaaagugaacuugaaaa

SEQ ID NO: 87210 - RNA, 18 nt, Human
aacccacaccuccucucc

SEQ ID NO: 87211 - RNA, 24 nt, Human
aacccacucuucuucucucucccg

SEQ ID NO: 87212 - RNA, 19 nt, Human
aagcagccagggacugaga

SEQ ID NO: 87213 - RNA, 22 nt, Human
acccacucuucuucucucuccc

SEQ ID NO: 87214 - RNA, 23 nt, Human
acccugucccuccaggacuucca

SEQ ID NO: 87215 - RNA, 21 nt, Human
acuccucucagccuucugcug

SEQ ID NO: 87216 - RNA, 18 nt, Human
agcuccucuguccccucc

SEQ ID NO: 87217 - RNA, 18 nt, Human
agcuuuccucuccucccc

SEQ ID NO: 87218 - RNA, 19 nt, Human
aggccuccgagggaccccu

SEQ ID NO: 87219 - RNA, 26 nt, Human
aggccuccgagggaccccugcccaag

SEQ ID NO: 87220 - RNA, 21 nt, Human
cacucuucuucucucucccgu

SEQ ID NO: 87221 - RNA, 21 nt, Human
cagccuucugcugcccccagg

SEQ ID NO: 87222 - RNA, 21 nt, Human
ccaaaugccaaagcagccagg

SEQ ID NO: 87223 - RNA, 19 nt, Human
ccacucuucuucucucucc

SEQ ID NO: 87224 - RNA, 19 nt, Human
cccaaaugccaaagcagcc

SEQ ID NO: 87225 - RNA, 20 nt, Human
cccacaccuccucuccguuc

SEQ ID NO: 87226 - RNA, 20 nt, Human
ccccaaaugccaaagcagcc

SEQ ID NO: 87227 - RNA, 20 nt, Human
ccccagggcuaccucuuggu

SEQ ID NO: 87228 - RNA, 18 nt, Human
ccccccucucucagcucc

SEQ ID NO: 87229 - RNA, 27 nt, Human
cccugcccaacgcccugccccccucuc

SEQ ID NO: 87230 - RNA, 21 nt, Human
ccucucagccuucugcugccc

SEQ ID NO: 87231 - RNA, 23 nt, Human
ccucuuuccucugcucuuuuccc

SEQ ID NO: 87232 - RNA, 19 nt, Human
ccugccccccucucucagc

SEQ ID NO: 87233 - RNA, 23 nt, Human
ccuucugggacccugucccucca

SEQ ID NO: 87234 - RNA, 19 nt, Human
cucagcuccucuguccccu

SEQ ID NO: 87235 - RNA, 21 nt, Human
cucagcuccucuguccccucc

SEQ ID NO: 87236 - RNA, 18 nt, Human
cucccgucucucuguguc

SEQ ID NO: 87237 - RNA, 19 nt, Human
cuccuccccacagggaguc

SEQ ID NO: 87238 - RNA, 22 nt, Human
cucuugguuccuaacccacacc

SEQ ID NO: 87239 - RNA, 18 nt, Human
cugccccccucucucagc

SEQ ID NO: 87240 - RNA, 21 nt, Human
cugccccccucucucagcucc

SEQ ID NO: 87241 - RNA, 24 nt, Human
cuuuccucuuuccucugcucuuuu

SEQ ID NO: 87242 - RNA, 19 nt, Human
gcccugccccccucucuca

SEQ ID NO: 87243 - RNA, 21 nt, Human
gcccugccccccucucucagc

SEQ ID NO: 87244 - RNA, 20 nt, Human
gucccaguuccccaaaugcc

SEQ ID NO: 87245 - RNA, 20 nt, Human
uaacccacaccuccucuccg

SEQ ID NO: 87246 - RNA, 23 nt, Human
uagcuccugaucuuccuacuccu

SEQ ID NO: 87247 - RNA, 21 nt, Human
uagcuuuguuuuagggguaac

SEQ ID NO: 87248 - RNA, 27 nt, Human
uauucugucccuuuaauagcuuuguuu

SEQ ID NO: 87249 - RNA, 21 nt, Human
ucccaguuccccaaaugccaa

SEQ ID NO: 87250 - RNA, 23 nt, Human
uccgcccuucaaacccacucuuc

SEQ ID NO: 87251 - RNA, 23 nt, Human
uccucuccguucucuuuucauua

SEQ ID NO: 87252 - RNA, 18 nt, Human
ucucagccuucugcugcc

SEQ ID NO: 87253 - RNA, 20 nt, Human
ucucccgucucucugugucu

SEQ ID NO: 87254 - RNA, 20 nt, Human
ucucucagcuccucuguccc

SEQ ID NO: 87255 - RNA, 23 nt, Human
ucugcucuuuucccggaacccuc

SEQ ID NO: 87256 - RNA, 18 nt, Human
ucugggacccugucccuc

SEQ ID NO: 87257 - RNA, 18 nt, Human
ucuguccccuccuucugg

SEQ ID NO: 87258 - RNA, 23 nt, Human
ucuguccccuccuucugggaccc

SEQ ID NO: 87259 - RNA, 20 nt, Human
ucugugucuuuccucuuucc

SEQ ID NO: 87260 - RNA, 21 nt, Human
ucuucuucucucucccgucuc

SEQ ID NO: 87261 - RNA, 21 nt, Human
ugggacccugucccuccagga

SEQ ID NO: 87262 - RNA, 20 nt, Human
ugguuccuaacccacaccuc

SEQ ID NO: 87263 - RNA, 24 nt, Human
uuuguuuuagggguaacuccccuc

SEQ ID NO: 87264 - RNA, 22 nt, Human
uuuuuuuuuuuuuuaaacagga

SEQ ID NO: 87265 - RNA, 25 nt, Human
uuuuuuuuuuuuuuuuuuaaacagg

SEQ ID NO: 87266 - RNA, 24 nt, Human
aacuaggggucgguuccuucucag

SEQ ID NO: 87267 - RNA, 21 nt, Human
aacugcaaggugcucucaacu

SEQ ID NO: 87268 - RNA, 23 nt, Human
aagcaaaaccuaagcagagagug

SEQ ID NO: 87269 - RNA, 21 nt, Human
aaggaaaaagauauuuaaaaa

SEQ ID NO: 87270 - RNA, 24 nt, Human
acccaggcuagagugcaguggcau

SEQ ID NO: 87271 - RNA, 21 nt, Human
acugcaaccuccgccuccugg

SEQ ID NO: 87272 - RNA, 21 nt, Human
acugcaaccuccgccuccugg

SEQ ID NO: 87273 - RNA, 22 nt, Human
acugcaaccuccgccuccuggg

SEQ ID NO: 87274 - RNA, 18 nt, Human
agaagcagcagacuuucc

SEQ ID NO: 87275 - RNA, 20 nt, Human
agaaggaaaaagauauuuaa

SEQ ID NO: 87276 - RNA, 22 nt, Human
agaaggaaaaagauauuuaaaa

SEQ ID NO: 87277 - RNA, 18 nt, Human
agagggaggaguagaagg

SEQ ID NO: 87278 - RNA, 24 nt, Human
agcuuugaauuccugcugcuuggu

SEQ ID NO: 87279 - RNA, 20 nt, Human
aggaaaaagauauuuaaaaa

SEQ ID NO: 87280 - RNA, 23 nt, Human
aggaaaaagauauuuaaaaagcu

SEQ ID NO: 87281 - RNA, 19 nt, Human
aggaaaauggaggaguugc

SEQ ID NO: 87282 - RNA, 21 nt, Human
aggaaaucagagggagaugcc

SEQ ID NO: 87283 - RNA, 19 nt, Human
aggcaaggaggcacccagc

SEQ ID NO: 87284 - RNA, 25 nt, Human
aggcaaggaggcacccagcagagga

SEQ ID NO: 87285 - RNA, 20 nt, Human
aggggucgguuccuucucag

SEQ ID NO: 87286 - RNA, 20 nt, Human
agugcaguggcaugaccuug

SEQ ID NO: 87287 - RNA, 23 nt, Human
agugcaguggcaugaccuuggcu

SEQ ID NO: 87288 - RNA, 23 nt, Human
agugcaguggcaugaccuuggcu

SEQ ID NO: 87289 - RNA, 21 nt, Human
caacuugauccuuccuguccc

SEQ ID NO: 87290 - RNA, 20 nt, Human
cacaggguucucaccugcgg

SEQ ID NO: 87291 - RNA, 20 nt, Human
caccaagaaguggaacuuga

SEQ ID NO: 87292 - RNA, 19 nt, Human
cagaaggaaaucagaggga

SEQ ID NO: 87293 - RNA, 20 nt, Human
cagaucauccaugucuucuc

SEQ ID NO: 87294 - RNA, 23 nt, Human
cagauugagcuacagagaacacc

SEQ ID NO: 87295 - RNA, 22 nt, Human
cagcaagcagcuuugaauuccu

SEQ ID NO: 87296 - RNA, 19 nt, Human
cauccccaccaagaagugg

SEQ ID NO: 87297 - RNA, 26 nt, Human
cauggucccaaggcaaggaggcaccc

SEQ ID NO: 87298 - RNA, 21 nt, Human
cauguuugcagauugagcuac

SEQ ID NO: 87299 - RNA, 24 nt, Human
cauucuugucugaaagcuuggaga

SEQ ID NO: 87300 - RNA, 25 nt, Human
ccaaagcaagguccuucuccuacgg

SEQ ID NO: 87301 - RNA, 21 nt, Human
ccagcagaggaucccugaggc

SEQ ID NO: 87302 - RNA, 18 nt, Human
ccaugucuucucauucuc

SEQ ID NO: 87303 - RNA, 21 nt, Human
cccagcagaggaucccugagg

SEQ ID NO: 87304 - RNA, 25 nt, Human
ccccuaaauacaugaugccagcccu

SEQ ID NO: 87305 - RNA, 24 nt, Human
ccgccuccuggguucaagcgauuc

SEQ ID NO: 87306 - RNA, 21 nt, Human
ccgcucgcucuccagcugcac

SEQ ID NO: 87307 - RNA, 19 nt, Human
ccuauuuccuccagauuca

SEQ ID NO: 87308 - RNA, 21 nt, Human
ccuccaggacacagcaacaac

SEQ ID NO: 87309 - RNA, 19 nt, Human
ccuccgccuccuggguuca

SEQ ID NO: 87310 - RNA, 22 nt, Human
ccuccuggguucaagcgauucc

SEQ ID NO: 87311 - RNA, 19 nt, Human
ccuggguucaagcgauucc

SEQ ID NO: 87312 - RNA, 20 nt, Human
ccuggguucaagcgauuccc

SEQ ID NO: 87313 - RNA, 22 nt, Human
ccuuccuguccccauuuguccc

SEQ ID NO: 87314 - RNA, 21 nt, Human
cgcgggcuccugcggggcggg

SEQ ID NO: 87315 - RNA, 20 nt, Human
cgcucgcucuccagcugcac

SEQ ID NO: 87316 - RNA, 18 nt, Human
cgcucuggcaaagccccg

SEQ ID NO: 87317 - RNA, 19 nt, Human
cgcucuggcaaagccccgg

SEQ ID NO: 87318 - RNA, 24 nt, Human
cgcucugucacccaggcuagagug

SEQ ID NO: 87319 - RNA, 18 nt, Human
cgguggccgcucgcucuc

SEQ ID NO: 87320 - RNA, 21 nt, Human
cuaaaccacgauuugacaucu

SEQ ID NO: 87321 - RNA, 21 nt, Human
cuagcucucucucccuucuca

SEQ ID NO: 87322 - RNA, 24 nt, Human
cucacacaguuacagcaagcagcu

SEQ ID NO: 87323 - RNA, 19 nt, Human
cucauccccaccaagaagu

SEQ ID NO: 87324 - RNA, 23 nt, Human
cuccuggguucaagcgauuccag

SEQ ID NO: 87325 - RNA, 23 nt, Human
cucucccuucucauccccaccaa

SEQ ID NO: 87326 - RNA, 19 nt, Human
cucucucccuucucauccc

SEQ ID NO: 87327 - RNA, 23 nt, Human
cugcaaccuccgccuccuggguu

SEQ ID NO: 87328 - RNA, 26 nt, Human
cugcacaccgggaccgcgugcgcgca

SEQ ID NO: 87329 - RNA, 21 nt, Human
gaaguggaacuugaaccugcc

SEQ ID NO: 87330 - RNA, 19 nt, Human
gaccuuggcuuacugcaac

SEQ ID NO: 87331 - RNA, 22 nt, Human
gaguugcgccugucagaaacug

SEQ ID NO: 87332 - RNA, 22 nt, Human
gcaaccuccgccuccuggguuc

SEQ ID NO: 87333 - RNA, 19 nt, Human
gcacagauaaccuccugcu

SEQ ID NO: 87334 - RNA, 24 nt, Human
gcauggcuugguuugugauuccag

SEQ ID NO: 87335 - RNA, 22 nt, Human
gcgggcgcgggcugugccgggg

SEQ ID NO: 87336 - RNA, 27 nt, Human
gcggggcgggcgcgggcuguugacggc

SEQ ID NO: 87337 - RNA, 19 nt, Human
gcuagagugcaguggcaug

SEQ ID NO: 87338 - RNA, 18 nt, Human
gcucgcucuccagcugca

SEQ ID NO: 87339 - RNA, 18 nt, Human
gcucuggcaaagccccgg

SEQ ID NO: 87340 - RNA, 25 nt, Human
gcucugucacccaggcuagagugca

SEQ ID NO: 87341 - RNA, 22 nt, Human
ggagaagcagcagacuuuccag

SEQ ID NO: 87342 - RNA, 22 nt, Human
ggagguuggauuuggacuuaau

SEQ ID NO: 87343 - RNA, 19 nt, Human
gggcgcgggcugugccggg

SEQ ID NO: 87344 - RNA, 24 nt, Human
uaaaaagcuaugcuucaagaggac

SEQ ID NO: 87345 - RNA, 24 nt, Human
uaaaaucuguagaguauaaaacau

SEQ ID NO: 87346 - RNA, 19 nt, Human
uaaagguuuugucauagca

SEQ ID NO: 87347 - RNA, 21 nt, Human
uacugcaaccuccgccuccug

SEQ ID NO: 87348 - RNA, 23 nt, Human
uacugcaaccuccgccuccuggg

SEQ ID NO: 87349 - RNA, 23 nt, Human
uagagugcaguggcaugaccuug

SEQ ID NO: 87350 - RNA, 24 nt, Human
uagagugcaguggcaugaccuugg

SEQ ID NO: 87351 - RNA, 19 nt, Human
uccagaggaaagaaguuga

SEQ ID NO: 87352 - RNA, 20 nt, Human
ucccaaggcaaggaggcacc

SEQ ID NO: 87353 - RNA, 19 nt, Human
uccuggguucaagcgauuc

SEQ ID NO: 87354 - RNA, 19 nt, Human
ucuaaaccacgauuugaca

SEQ ID NO: 87355 - RNA, 23 nt, Human
ucuaaaccacgauuugacaucuu

SEQ ID NO: 87356 - RNA, 19 nt, Human
ucucauccccaccaagaag

SEQ ID NO: 87357 - RNA, 19 nt, Human
ucucgcucugucacccagg

SEQ ID NO: 87358 - RNA, 23 nt, Human
ucucgcucugucacccaggcuag

SEQ ID NO: 87359 - RNA, 26 nt, Human
ucucgcucugucacccaggcuagagu

SEQ ID NO: 87360 - RNA, 27 nt, Human
ucucgcucugucacccaggcuagagug

SEQ ID NO: 87361 - RNA, 24 nt, Human
ucugucacccaggcuagagugcag

SEQ ID NO: 87362 - RNA, 22 nt, Human
ucugugauccagaggacaggac

SEQ ID NO: 87363 - RNA, 20 nt, Human
ucuuuuuucucucuacaacu

SEQ ID NO: 87364 - RNA, 24 nt, Human
ugaaagcacgcucuggcaaagccc

SEQ ID NO: 87365 - RNA, 23 nt, Human
ugaaagcuuggagaagcagcaga

SEQ ID NO: 87366 - RNA, 24 nt, Human
ugaaauauauuugaucuaaaccac

SEQ ID NO: 87367 - RNA, 19 nt, Human
ugaaccugccauucccuaa

SEQ ID NO: 87368 - RNA, 22 nt, Human
ugagauggagucucgcucuguc

SEQ ID NO: 87369 - RNA, 21 nt, Human
ugcagauugagcuacagagaa

SEQ ID NO: 87370 - RNA, 20 nt, Human
ugcaguggcaugaccuuggc

SEQ ID NO: 87371 - RNA, 24 nt, Human
ugcugcuuggucugagagugcauc

SEQ ID NO: 87372 - RNA, 21 nt, Human
uggcacugacucaucuccaca

SEQ ID NO: 87373 - RNA, 21 nt, Human
uggcaugaccuuggcuuacug

SEQ ID NO: 87374 - RNA, 23 nt, Human
ugggguggccauggucccaaggc

SEQ ID NO: 87375 - RNA, 18 nt, Human
uggucccaaggcaaggag

SEQ ID NO: 87376 - RNA, 18 nt, Human
uguccagagagccgaagu

SEQ ID NO: 87377 - RNA, 20 nt, Human
ugucugugauccagaggaca

SEQ ID NO: 87378 - RNA, 24 nt, Human
uuacugcaaccuccgccuccuggg

SEQ ID NO: 87379 - RNA, 25 nt, Human
uuacugcaaccuccgccuccugggu

SEQ ID NO: 87380 - RNA, 27 nt, Human
uuacugcaaccuccgccuccuggguuc

SEQ ID NO: 87381 - RNA, 24 nt, Human
uuagagucagagggaggaguagaa

SEQ ID NO: 87382 - RNA, 20 nt, Human
uucaaaggcagauuggguca

SEQ ID NO: 87383 - RNA, 22 nt, Human
uucaaaggcagauugggucauc

SEQ ID NO: 87384 - RNA, 18 nt, Human
uuccagaauucagaccac

SEQ ID NO: 87385 - RNA, 21 nt, Human
uucccaagcaaaaccuaagca

SEQ ID NO: 87386 - RNA, 24 nt, Human
uucuacagucauuuuguuucugcc

SEQ ID NO: 87387 - RNA, 21 nt, Human
uuguauuauucuguccuuaca

SEQ ID NO: 87388 - RNA, 25 nt, Human
uuuuuuuuuuuugagauggagucuc

SEQ ID NO: 87389 - RNA, 22 nt, Human
uuuuuuuuuuuuuugagaugga

SEQ ID NO: 87390 - RNA, 25 nt, Human
aaacuuccccugcaacuaaacagag

SEQ ID NO: 87391 - RNA, 21 nt, Human
aacaacacagcgauuuccuca

SEQ ID NO: 87392 - RNA, 19 nt, Human
aacacagcgauuuccucau

SEQ ID NO: 87393 - RNA, 20 nt, Human
aacacagcgauuuccucauu

SEQ ID NO: 87394 - RNA, 19 nt, Human
agagagagggagggaggag

SEQ ID NO: 87395 - RNA, 22 nt, Human
agaggacuuugggguauauccc

SEQ ID NO: 87396 - RNA, 18 nt, Human
aggagagaucccgcagua

SEQ ID NO: 87397 - RNA, 20 nt, Human
aggcaugaagggaagucauc

SEQ ID NO: 87398 - RNA, 18 nt, Human
agggaaagggccauaaaa

SEQ ID NO: 87399 - RNA, 18 nt, Human
agugagagagagagagag

SEQ ID NO: 87400 - RNA, 20 nt, Human
augaagggaagucauccaca

SEQ ID NO: 87401 - RNA, 21 nt, Human
caguaggguaucauggguuuc

SEQ ID NO: 87402 - RNA, 24 nt, Human
caguaggguaucauggguuucugg

SEQ ID NO: 87403 - RNA, 23 nt, Human
cccucucucuuuaucucccucug

SEQ ID NO: 87404 - RNA, 18 nt, Human
ccuacaccccauuuuaga

SEQ ID NO: 87405 - RNA, 18 nt, Human
ccucucuaggagaugucc

SEQ ID NO: 87406 - RNA, 23 nt, Human
cugaaggcucugcaguucuuccu

SEQ ID NO: 87407 - RNA, 18 nt, Human
cugucucugucucugugg

SEQ ID NO: 87408 - RNA, 21 nt, Human
cuuccuggaaugacagccugg

SEQ ID NO: 87409 - RNA, 24 nt, Human
ggcagagagagagggagggaggag

SEQ ID NO: 87410 - RNA, 20 nt, Human
gggaaagggccauaaaagug

SEQ ID NO: 87411 - RNA, 19 nt, Human
gggaaggaggacaucugcu

SEQ ID NO: 87412 - RNA, 22 nt, Human
gggaaggaggacaucugcuuac

SEQ ID NO: 87413 - RNA, 18 nt, Human
ggggacugggaauuugag

SEQ ID NO: 87414 - RNA, 23 nt, Human
uauaucccaaacuuccccugcaa

SEQ ID NO: 87415 - RNA, 23 nt, Human
ucaaaaauauacaacuucaacag

SEQ ID NO: 87416 - RNA, 22 nt, Human
ucucugucucugugggcuucca

SEQ ID NO: 87417 - RNA, 22 nt, Human
ucucugugggcuuccaggggau

SEQ ID NO: 87418 - RNA, 19 nt, Human
ucugcagucuccacuccac

SEQ ID NO: 87419 - RNA, 19 nt, Human
ucugcagucuccacuccac

SEQ ID NO: 87420 - RNA, 21 nt, Human
ugagagagagagagagagagc

SEQ ID NO: 87421 - RNA, 20 nt, Human
ugcuuuucuugcugucucug

SEQ ID NO: 87422 - RNA, 22 nt, Human
uggccagauccuacaccccauu

SEQ ID NO: 87423 - RNA, 23 nt, Human
uugaucaaaaauauacaacuuca

SEQ ID NO: 87424 - RNA, 18 nt, Human
uuggagaggcugaaggcu

SEQ ID NO: 87425 - RNA, 23 nt, Human
uuucuugcugucucugucucugu

SEQ ID NO: 87426 - RNA, 24 nt, Human
uuuuuuuuuuaaagucagaaacuu

SEQ ID NO: 87427 - RNA, 21 nt, Human
uuuuuuuuuuuuuuuuuaaag

SEQ ID NO: 87428 - RNA, 20 nt, Human
aaagcaccaaccagccacag

SEQ ID NO: 87429 - RNA, 22 nt, Human
aagcaccaaccagccacagcag

SEQ ID NO: 87430 - RNA, 26 nt, Human
aaucaugacuauuuuaccugauuugg

SEQ ID NO: 87431 - RNA, 22 nt, Human
acaaagcaaccaggguccaaau

SEQ ID NO: 87432 - RNA, 24 nt, Human
acuaccauaaacaaagcaccaacc

SEQ ID NO: 87433 - RNA, 23 nt, Human
agacacaaagcaaccagggucca

SEQ ID NO: 87434 - RNA, 22 nt, Human
agagaauauaucuaaaauacaa

SEQ ID NO: 87435 - RNA, 22 nt, Human
caaagcaccaaccagccacagg

SEQ ID NO: 87436 - RNA, 18 nt, Human
ccauaaacaaagcaccaa

SEQ ID NO: 87437 - RNA, 21 nt, Human
cuggcggcggcggcuugggcg

SEQ ID NO: 87438 - RNA, 18 nt, Human
uaaauuacaacagaauuc

SEQ ID NO: 87439 - RNA, 19 nt, Human
uaccauaaacaaagcacca

SEQ ID NO: 87440 - RNA, 21 nt, Human
uagaaaacuagacacaaagca

SEQ ID NO: 87441 - RNA, 25 nt, Human
uagaaaacuagacacaaagcaacca

SEQ ID NO: 87442 - RNA, 20 nt, Human
uagaucugugcuuagcuaaa

SEQ ID NO: 87443 - RNA, 22 nt, Human
uaguaagucuaucaaguaagag

SEQ ID NO: 87444 - RNA, 20 nt, Human
uaucaaguaagagaugaagg

SEQ ID NO: 87445 - RNA, 22 nt, Human
ucacaacucuaauuauaacaau

SEQ ID NO: 87446 - RNA, 20 nt, Human
ucuguaauucaaaagucauu

SEQ ID NO: 87447 - RNA, 23 nt, Human
ugcacucaaccauucuacuuucc

SEQ ID NO: 87448 - RNA, 19 nt, Human
ugcuauggauuugcacuca

SEQ ID NO: 87449 - RNA, 21 nt, Human
ugugcuauggauuugcacuca

SEQ ID NO: 87450 - RNA, 22 nt, Human
ugugucaagcaugacaauuggu

SEQ ID NO: 87451 - RNA, 20 nt, Human
uugaaaucaugaacauuuau

SEQ ID NO: 87452 - RNA, 20 nt, Human
aaauuaaaaauaaauggccc

SEQ ID NO: 87453 - RNA, 25 nt, Human
aacucguuuguuugccugcccccua

SEQ ID NO: 87454 - RNA, 22 nt, Human
accugcuuccucucuccuuccu

SEQ ID NO: 87455 - RNA, 18 nt, Human
agaaacacaacagaggca

SEQ ID NO: 87456 - RNA, 22 nt, Human
agcaccagaaggaggcaaggaa

SEQ ID NO: 87457 - RNA, 18 nt, Human
agcgauccgguuacagag

SEQ ID NO: 87458 - RNA, 23 nt, Human
aggcaaggaaccaagcucuccaa

SEQ ID NO: 87459 - RNA, 22 nt, Human
aggugacgggggcggagguggg

SEQ ID NO: 87460 - RNA, 19 nt, Human
auuguguuuucuuuucacu

SEQ ID NO: 87461 - RNA, 21 nt, Human
caaaugugaaaucuaugcuuu

SEQ ID NO: 87462 - RNA, 21 nt, Human
caacuacauuuaugaagaaga

SEQ ID NO: 87463 - RNA, 26 nt, Human
caccugcuuccucucuccuuccucca

SEQ ID NO: 87464 - RNA, 18 nt, Human
caggcaacauguaaaauc

SEQ ID NO: 87465 - RNA, 24 nt, Human
caucuccucuucuucucucucaaa

SEQ ID NO: 87466 - RNA, 25 nt, Human
caucuccucuucuucucucucaaaa

SEQ ID NO: 87467 - RNA, 22 nt, Human
cauguaaaauccuaggagcaaa

SEQ ID NO: 87468 - RNA, 21 nt, Human
cauucacucuuuuguguucua

SEQ ID NO: 87469 - RNA, 22 nt, Human
cauucauuccagccuccaguga

SEQ ID NO: 87470 - RNA, 24 nt, Human
cauucauuccagccuccagugaga

SEQ ID NO: 87471 - RNA, 20 nt, Human
ccaaguaaucuuaguagcua

SEQ ID NO: 87472 - RNA, 21 nt, Human
ccaaugaauuccaagagcggg

SEQ ID NO: 87473 - RNA, 19 nt, Human
ccccucccugcgcucuccc

SEQ ID NO: 87474 - RNA, 24 nt, Human
cccuuugcaggcaacauguaaaau

SEQ ID NO: 87475 - RNA, 23 nt, Human
ccugcuuccucucuccuuccucc

SEQ ID NO: 87476 - RNA, 25 nt, Human
ccuggccccuccaucuccucuucuu

SEQ ID NO: 87477 - RNA, 24 nt, Human
ccuucagguaaagaaaaauacuag

SEQ ID NO: 87478 - RNA, 24 nt, Human
cuaaaaucuacaucccggcggcuc

SEQ ID NO: 87479 - RNA, 20 nt, Human
cuaggagcaaaggaugggaa

SEQ ID NO: 87480 - RNA, 19 nt, Human
cucaguguggaaaaaugaa

SEQ ID NO: 87481 - RNA, 24 nt, Human
cucauaauauaaaaauaaaaacau

SEQ ID NO: 87482 - RNA, 25 nt, Human
cuccagugagaaacacaagguaccc

SEQ ID NO: 87483 - RNA, 19 nt, Human
cuccgugcuggacggcucc

SEQ ID NO: 87484 - RNA, 21 nt, Human
cucuggacacuugugcgaguu

SEQ ID NO: 87485 - RNA, 22 nt, Human
cuggccccuccaucuccucuuc

SEQ ID NO: 87486 - RNA, 18 nt, Human
cuucuucuuugaaacuuu

SEQ ID NO: 87487 - RNA, 18 nt, Human
gagaaacacaacagaggc

SEQ ID NO: 87488 - RNA, 19 nt, Human
gaggugacgggggcggagg

SEQ ID NO: 87489 - RNA, 22 nt, Human
gcuuccucucuccuuccuccau

SEQ ID NO: 87490 - RNA, 22 nt, Human
gggcggaggugggcgaaggggc

SEQ ID NO: 87491 - RNA, 18 nt, Human
ggggaugggguggggcag

SEQ ID NO: 87492 - RNA, 20 nt, Human
ggggaugggguggggcaggg

SEQ ID NO: 87493 - RNA, 23 nt, Human
ggggcggaggugggcgaaggggc

SEQ ID NO: 87494 - RNA, 21 nt, Human
gguuacagaggcuggaaagaa

SEQ ID NO: 87495 - RNA, 22 nt, Human
guggcuccuggccccuccaucu

SEQ ID NO: 87496 - RNA, 18 nt, Human
guucuagugaucauucau

SEQ ID NO: 87497 - RNA, 21 nt, Human
uaaaaauaaaaacaugaaguu

SEQ ID NO: 87498 - RNA, 22 nt, Human
uaaaaauaaauggcccuccuuc

SEQ ID NO: 87499 - RNA, 25 nt, Human
uaacagaaaaacuggugcccaauua

SEQ ID NO: 87500 - RNA, 19 nt, Human
uaagagcaccagaaggagg

SEQ ID NO: 87501 - RNA, 23 nt, Human
uaagauggacaacucauaauaua

SEQ ID NO: 87502 - RNA, 19 nt, Human
uacauuuaugaagaagaaa

SEQ ID NO: 87503 - RNA, 24 nt, Human
uacuaggauaaauuccaacuacau

SEQ ID NO: 87504 - RNA, 20 nt, Human
uaggaaagaugauuauuaca

SEQ ID NO: 87505 - RNA, 18 nt, Human
uaggucagcgaggguggg

SEQ ID NO: 87506 - RNA, 26 nt, Human
uaguagcuaaaacuucaauaaaugac

SEQ ID NO: 87507 - RNA, 23 nt, Human
uauuguguuuucuuuucacuggu

SEQ ID NO: 87508 - RNA, 21 nt, Human
uccaucucuguuucuucuucu

SEQ ID NO: 87509 - RNA, 20 nt, Human
ucccggcggcucuugcagcc

SEQ ID NO: 87510 - RNA, 18 nt, Human
uccuaggagcaaaggaug

SEQ ID NO: 87511 - RNA, 22 nt, Human
uccucucuccuuccuccaugca

SEQ ID NO: 87512 - RNA, 23 nt, Human
ucuauagucauuuuaauuucugg

SEQ ID NO: 87513 - RNA, 21 nt, Human
ucuucucucucaaaacugcag

SEQ ID NO: 87514 - RNA, 19 nt, Human
ucuuggggauggggugggg

SEQ ID NO: 87515 - RNA, 22 nt, Human
ugaaauuaaaaauaaauggccc

SEQ ID NO: 87516 - RNA, 27 nt, Human
ugaagaagaaauucaaauacugaauca

SEQ ID NO: 87517 - RNA, 19 nt, Human
ugaucaguacaacugcuuu

SEQ ID NO: 87518 - RNA, 19 nt, Human
ugcaaagaaaaauguagug

SEQ ID NO: 87519 - RNA, 21 nt, Human
ugcccccuaaguuugacuccc

SEQ ID NO: 87520 - RNA, 19 nt, Human
ugcgcucucccgggagucg

SEQ ID NO: 87521 - RNA, 30 nt, Human
ugcuuugacuucaagugucaucauucacuu

SEQ ID NO: 87522 - RNA, 21 nt, Human
uggacaacucauaauauaaaa

SEQ ID NO: 87523 - RNA, 18 nt, Human
uggacacuugugcgaguu

SEQ ID NO: 87524 - RNA, 24 nt, Human
uggaguaagagcaccagaaggagg

SEQ ID NO: 87525 - RNA, 24 nt, Human
uggccacgaacuaaaaucuacauc

SEQ ID NO: 87526 - RNA, 24 nt, Human
uggcuccuggccccuccaucuccu

SEQ ID NO: 87527 - RNA, 18 nt, Human
ugggaagaaaggguccgg

SEQ ID NO: 87528 - RNA, 19 nt, Human
ugggaagaaaggguccgga

SEQ ID NO: 87529 - RNA, 18 nt, Human
ugguagguuuccuuuccu

SEQ ID NO: 87530 - RNA, 22 nt, Human
uggugcccaauagcuagccauu

SEQ ID NO: 87531 - RNA, 21 nt, Human
uuaauuucuggcuuauguuua

SEQ ID NO: 87532 - RNA, 20 nt, Human
uuaggucagcgagggugggg

SEQ ID NO: 87533 - RNA, 24 nt, Human
uucagguaaagaaaaauacuagga

SEQ ID NO: 87534 - RNA, 22 nt, Human
uuccuccgugcuggacggcucc

SEQ ID NO: 87535 - RNA, 27 nt, Human
uuuaaaaauaucuuuacucuuccaucu

SEQ ID NO: 87536 - RNA, 19 nt, Human
aaggaccggaagccuggaa

SEQ ID NO: 87537 - RNA, 21 nt, Human
aaggaccggaagccuggaacu

SEQ ID NO: 87538 - RNA, 21 nt, Human
cuugcgggacagcaaagaguc

SEQ ID NO: 87539 - RNA, 24 nt, Human
gaagccuggaacuuggagagcuga

SEQ ID NO: 87540 - RNA, 21 nt, Human
ugccuaaagucccaccuggga

SEQ ID NO: 87541 - RNA, 22 nt, Human
ugggaaggcuaaggaccggaag

SEQ ID NO: 87542 - RNA, 28 nt, Human
uuggagagcugaggcaacagagaggcug

SEQ ID NO: 87543 - RNA, 26 nt, Human
aaagcaaaagcaaaauacugccuaga

SEQ ID NO: 87544 - RNA, 23 nt, Human
aagcaaaagcaaaauacugccua

SEQ ID NO: 87545 - RNA, 24 nt, Human
aagcaaaauacugccuagauaugg

SEQ ID NO: 87546 - RNA, 23 nt, Human
agcgucucuccagaucacgaacc

SEQ ID NO: 87547 - RNA, 22 nt, Human
cuccagaucacgaaccuagccg

SEQ ID NO: 87548 - RNA, 18 nt, Human
uaaagcaaaagcaaaaua

SEQ ID NO: 87549 - RNA, 23 nt, Human
uaaagcaaaagcaaaauacugcc

SEQ ID NO: 87550 - RNA, 22 nt, Human
uaagcuaguauauauuaaagca

SEQ ID NO: 87551 - RNA, 20 nt, Human
ucaguucccaguuaaguugc

SEQ ID NO: 87552 - RNA, 18 nt, Human
ucccaguuaaguugcagg

SEQ ID NO: 87553 - RNA, 23 nt, Human
aaggaaaggucaggcugguuuau

SEQ ID NO: 87554 - RNA, 18 nt, Human
acugaagccaucucacuu

SEQ ID NO: 87555 - RNA, 21 nt, Human
aggggagcagcguguuccaga

SEQ ID NO: 87556 - RNA, 21 nt, Human
caggggagcagcguguuccag

SEQ ID NO: 87557 - RNA, 19 nt, Human
ccaggaugaucguuucccc

SEQ ID NO: 87558 - RNA, 18 nt, Human
ccauuuccuuuaaguuuc

SEQ ID NO: 87559 - RNA, 20 nt, Human
cucaugaacugaagccaucu

SEQ ID NO: 87560 - RNA, 18 nt, Human
ggggagcagcguguucca

SEQ ID NO: 87561 - RNA, 23 nt, Human
gggugcggcugcagcggacaggc

SEQ ID NO: 87562 - RNA, 24 nt, Human
ucaauuuccacuggugaugucuaa

SEQ ID NO: 87563 - RNA, 19 nt, Human
ucagaaucccaacagcugc

SEQ ID NO: 87564 - RNA, 22 nt, Human
ugcggcugcagcggacaggcac

SEQ ID NO: 87565 - RNA, 24 nt, Human
uggugaugucuaacucagaucccg

SEQ ID NO: 87566 - RNA, 21 nt, Human
agagcagaggcagccccaggc

SEQ ID NO: 87567 - RNA, 19 nt, Human
agagggcagcucugcccac

SEQ ID NO: 87568 - RNA, 18 nt, Human
agccagggccugcccgug

SEQ ID NO: 87569 - RNA, 19 nt, Human
aggugcgugcauggcagag

SEQ ID NO: 87570 - RNA, 19 nt, Human
agguggcuuuggugacugg

SEQ ID NO: 87571 - RNA, 19 nt, Human
cagguggcuggagggagaa

SEQ ID NO: 87572 - RNA, 19 nt, Human
cccauccagaagccuccag

SEQ ID NO: 87573 - RNA, 21 nt, Human
cccuaguggccggcuaggcag

SEQ ID NO: 87574 - RNA, 22 nt, Human
ccugcagaagagguaaugccga

SEQ ID NO: 87575 - RNA, 23 nt, Human
ccugcagaagagguaaugccgag

SEQ ID NO: 87576 - RNA, 19 nt, Human
gagccugcagaagagguaa

SEQ ID NO: 87577 - RNA, 18 nt, Human
gagggagaaggccacguc

SEQ ID NO: 87578 - RNA, 21 nt, Human
gagguucccagggucuuuggg

SEQ ID NO: 87579 - RNA, 22 nt, Human
gccagggccugcccguggcagc

SEQ ID NO: 87580 - RNA, 18 nt, Human
ggacaaggggagauacug

SEQ ID NO: 87581 - RNA, 23 nt, Human
ggagagcagaggcagccccaggc

SEQ ID NO: 87582 - RNA, 22 nt, Human
ggcagccccaggcuuggacccu

SEQ ID NO: 87583 - RNA, 19 nt, Human
ggcagcucugcccaccucu

SEQ ID NO: 87584 - RNA, 18 nt, Human
ggcuuuggugacugggug

SEQ ID NO: 87585 - RNA, 20 nt, Human
ggggcugcugccacugccag

SEQ ID NO: 87586 - RNA, 24 nt, Human
gggucuuggagagcagaggcagcc

SEQ ID NO: 87587 - RNA, 18 nt, Human
uauagccagggccugccc

SEQ ID NO: 87588 - RNA, 22 nt, Human
ucaagggucccauccagaagcc

SEQ ID NO: 87589 - RNA, 25 nt, Human
uccccagcaccccccagggaggaag

SEQ ID NO: 87590 - RNA, 20 nt, Human
ugaccaaggagcaaacuggc

SEQ ID NO: 87591 - RNA, 23 nt, Human
ugccccagacucaagggucccau

SEQ ID NO: 87592 - RNA, 23 nt, Human
ugcgugcauggcagagccugcag

SEQ ID NO: 87593 - RNA, 22 nt, Human
ugcuuagcuccuguccuuccug

SEQ ID NO: 87594 - RNA, 21 nt, Human
uggaagcccuugagaagaugg

SEQ ID NO: 87595 - RNA, 21 nt, Human
uggacccugcuuagcuccugu

SEQ ID NO: 87596 - RNA, 22 nt, Human
uggcuuuggugacugggugggg

SEQ ID NO: 87597 - RNA, 24 nt, Human
ugggucuuggagagcagaggcagc

SEQ ID NO: 87598 - RNA, 21 nt, Human
uggugcccuaguggccggcua

SEQ ID NO: 87599 - RNA, 20 nt, Human
ugucauguagguggcuuugg

SEQ ID NO: 87600 - RNA, 21 nt, Human
ccccucagaugccucuggcug

SEQ ID NO: 87601 - RNA, 23 nt, Human
ccggcucccccucagaugccucu

SEQ ID NO: 87602 - RNA, 20 nt, Human
ccucagaugccucuggcugg

SEQ ID NO: 87603 - RNA, 21 nt, Human
cuuggcaguuaaaaggaagug

SEQ ID NO: 87604 - RNA, 20 nt, Human
gcuucucacauucuccaaga

SEQ ID NO: 87605 - RNA, 19 nt, Human
guuaccggcucccccucag

SEQ ID NO: 87606 - RNA, 24 nt, Human
uauaaauauuuauuuuaaaaaauu

SEQ ID NO: 87607 - RNA, 22 nt, Human
uuucuuggcaguuaaaaggaag

SEQ ID NO: 87608 - RNA, 24 nt, Human
aaaaauucacagcgccugugagga

SEQ ID NO: 87609 - RNA, 26 nt, Human
aagaaccuucgcugaaagcccauggc

SEQ ID NO: 87610 - RNA, 18 nt, Human
aagagcaucaccacgacc

SEQ ID NO: 87611 - RNA, 19 nt, Human
acugguuuuuggccugucu

SEQ ID NO: 87612 - RNA, 21 nt, Human
agaaaacaaaguugcccuuuc

SEQ ID NO: 87613 - RNA, 22 nt, Human
agaaaccguggaaagcgcuggc

SEQ ID NO: 87614 - RNA, 20 nt, Human
agaccuccgaaguuggccag

SEQ ID NO: 87615 - RNA, 23 nt, Human
agagccucccguuggcccugccc

SEQ ID NO: 87616 - RNA, 19 nt, Human
agcaacagaaaccguggaa

SEQ ID NO: 87617 - RNA, 22 nt, Human
agccggccaauccucgucacag

SEQ ID NO: 87618 - RNA, 21 nt, Human
aggaaaaagaagaaaacaaag

SEQ ID NO: 87619 - RNA, 23 nt, Human
aggaaggaagucccaccccgccu

SEQ ID NO: 87620 - RNA, 22 nt, Human
aggaggccuggccggggaaccc

SEQ ID NO: 87621 - RNA, 21 nt, Human
aggaguuaaaaagagcaucac

SEQ ID NO: 87622 - RNA, 21 nt, Human
agggguccucggagcgcaggc

SEQ ID NO: 87623 - RNA, 23 nt, Human
aucaccacgaccucgcuacuggu

SEQ ID NO: 87624 - RNA, 23 nt, Human
aucagcuccccuccgaugcccaa

SEQ ID NO: 87625 - RNA, 19 nt, Human
auggcagagaaugagucuc

SEQ ID NO: 87626 - RNA, 19 nt, Human
caccacgaccucgcuacug

SEQ ID NO: 87627 - RNA, 20 nt, Human
caccacgcaccuugcagagc

SEQ ID NO: 87628 - RNA, 26 nt, Human
cacgcaccuugcagagcgugcgcacg

SEQ ID NO: 87629 - RNA, 25 nt, Human
cacggccagaccuccgaaguuggcc

SEQ ID NO: 87630 - RNA, 19 nt, Human
cagaaaacacaaaucucac

SEQ ID NO: 87631 - RNA, 28 nt, Human
cagcacggccuucuucccugaggggucc

SEQ ID NO: 87632 - RNA, 19 nt, Human
cagcaguucuuuaggaaca

SEQ ID NO: 87633 - RNA, 24 nt, Human
cagccaccccccuuauugggcaaa

SEQ ID NO: 87634 - RNA, 23 nt, Human
cauacacacaccuacuacacaga

SEQ ID NO: 87635 - RNA, 20 nt, Human
caugacccagggaugggggc

SEQ ID NO: 87636 - RNA, 19 nt, Human
ccaaucugcuccacagccg

SEQ ID NO: 87637 - RNA, 20 nt, Human
ccaccccgccuuccagcagc

SEQ ID NO: 87638 - RNA, 19 nt, Human
ccaccgcgcugacgcccgc

SEQ ID NO: 87639 - RNA, 21 nt, Human
ccagcagcagcgagccugugu

SEQ ID NO: 87640 - RNA, 25 nt, Human
ccccaagaacaugccaaucugcucc

SEQ ID NO: 87641 - RNA, 18 nt, Human
ccccgaagcccaggccca

SEQ ID NO: 87642 - RNA, 20 nt, Human
ccccuuauugggcaaaggag

SEQ ID NO: 87643 - RNA, 22 nt, Human
cccgaagcccaggcccacggcc

SEQ ID NO: 87644 - RNA, 18 nt, Human
cccugcaccuuccccaag

SEQ ID NO: 87645 - RNA, 20 nt, Human
ccgaagcccaggcccacggc

SEQ ID NO: 87646 - RNA, 18 nt, Human
ccgaugcccaagugcugc

SEQ ID NO: 87647 - RNA, 20 nt, Human
ccggaucuguuuaccaaccc

SEQ ID NO: 87648 - RNA, 18 nt, Human
ccguggacugcagggccc

SEQ ID NO: 87649 - RNA, 18 nt, Human
ccucccguuggcccugcc

SEQ ID NO: 87650 - RNA, 24 nt, Human
ccucuccggacagaggaaggaagu

SEQ ID NO: 87651 - RNA, 26 nt, Human
ccugcaccuuccccaagaacaugcca

SEQ ID NO: 87652 - RNA, 19 nt, Human
ccuucagggcuggcugcag

SEQ ID NO: 87653 - RNA, 18 nt, Human
cgcggagccggccugggc

SEQ ID NO: 87654 - RNA, 22 nt, Human
cgcuggccaccgcgcugacgcc

SEQ ID NO: 87655 - RNA, 25 nt, Human
cuccacagccguggacugcagggcc

SEQ ID NO: 87656 - RNA, 20 nt, Human
cuccaggcagccaccccccu

SEQ ID NO: 87657 - RNA, 22 nt, Human
cucccagcuccagcccauuggc

SEQ ID NO: 87658 - RNA, 22 nt, Human
cugaacagagauuggaagggag

SEQ ID NO: 87659 - RNA, 20 nt, Human
cugaagagaagucuguggag

SEQ ID NO: 87660 - RNA, 21 nt, Human
cugcaccuuccccaagaacau

SEQ ID NO: 87661 - RNA, 22 nt, Human
cugccagugccccgaagcccag

SEQ ID NO: 87662 - RNA, 21 nt, Human
cugggguuugcaaagagccuc

SEQ ID NO: 87663 - RNA, 18 nt, Human
cuguuugugcugcuuguu

SEQ ID NO: 87664 - RNA, 20 nt, Human
cuucgcugaaagcccauggc

SEQ ID NO: 87665 - RNA, 18 nt, Human
cuucuuggcgaccucugc

SEQ ID NO: 87666 - RNA, 22 nt, Human
cuugacaaggccuuuagccacc

SEQ ID NO: 87667 - RNA, 20 nt, Human
cuuguucucggggcgagccu

SEQ ID NO: 87668 - RNA, 24 nt, Human
gaaaacacaaaucucacucuagaa

SEQ ID NO: 87669 - RNA, 21 nt, Human
gaaccagccccacaggccugg

SEQ ID NO: 87670 - RNA, 23 nt, Human
gaagagaagucuguggaggcucc

SEQ ID NO: 87671 - RNA, 22 nt, Human
gacaggaaaggacuggaaccca

SEQ ID NO: 87672 - RNA, 23 nt, Human
gacaggaaaggacuggaacccag

SEQ ID NO: 87673 - RNA, 20 nt, Human
gagcaucaccacgaccucgc

SEQ ID NO: 87674 - RNA, 24 nt, Human
gagccucccguuggcccugcccag

SEQ ID NO: 87675 - RNA, 20 nt, Human
gagggguccucggagcgcag

SEQ ID NO: 87676 - RNA, 21 nt, Human
gcaaaauauucuucauguuua

SEQ ID NO: 87677 - RNA, 19 nt, Human
gcaccuuccccaagaacau

SEQ ID NO: 87678 - RNA, 24 nt, Human
gccccacaggccugggccucgcag

SEQ ID NO: 87679 - RNA, 21 nt, Human
gccccgaagcccaggcccacg

SEQ ID NO: 87680 - RNA, 22 nt, Human
gccucggacaggaaaggacugg

SEQ ID NO: 87681 - RNA, 19 nt, Human
gccugggcguggcccgcag

SEQ ID NO: 87682 - RNA, 23 nt, Human
gcgcuggccaccgcgcugacgcc

SEQ ID NO: 87683 - RNA, 21 nt, Human
ggaaaggacuggaacccagca

SEQ ID NO: 87684 - RNA, 20 nt, Human
ggacucucucccuucugcuu

SEQ ID NO: 87685 - RNA, 24 nt, Human
ggaggaggccuggccggggaaccc

SEQ ID NO: 87686 - RNA, 20 nt, Human
ggcauucccuguuccgcugc

SEQ ID NO: 87687 - RNA, 20 nt, Human
ggccaauccucgucacaggc

SEQ ID NO: 87688 - RNA, 21 nt, Human
guggacugcagggcccuggcc

SEQ ID NO: 87689 - RNA, 20 nt, Human
uaaaaagagcaucaccacga

SEQ ID NO: 87690 - RNA, 23 nt, Human
uaacauucacaucaggaaaaaga

SEQ ID NO: 87691 - RNA, 24 nt, Human
uacaagacuuguacaaaaggacau

SEQ ID NO: 87692 - RNA, 18 nt, Human
uagcaacagaaaccgugg

SEQ ID NO: 87693 - RNA, 21 nt, Human
uagcaacagaaaccgugggac

SEQ ID NO: 87694 - RNA, 19 nt, Human
uaggcaggagcugggcccu

SEQ ID NO: 87695 - RNA, 21 nt, Human
uauuucagaggacacacggag

SEQ ID NO: 87696 - RNA, 21 nt, Human
ucacccuacaaccauuuagca

SEQ ID NO: 87697 - RNA, 20 nt, Human
ucaggaaaaagaagaaaaca

SEQ ID NO: 87698 - RNA, 24 nt, Human
ucaucuucauucuugcacuucuca

SEQ ID NO: 87699 - RNA, 23 nt, Human
uccacagccguggacugcagggc

SEQ ID NO: 87700 - RNA, 25 nt, Human
uccacagccguggacugcagggccc

SEQ ID NO: 87701 - RNA, 18 nt, Human
ucccacaaucguaucugu

SEQ ID NO: 87702 - RNA, 18 nt, Human
ucccaccccgccuuccag

SEQ ID NO: 87703 - RNA, 22 nt, Human
uccccaagaacaugccaaucug

SEQ ID NO: 87704 - RNA, 24 nt, Human
ucccuguuccgcugcucccacccu

SEQ ID NO: 87705 - RNA, 22 nt, Human
uccgcgcccgccucugcgcgcu

SEQ ID NO: 87706 - RNA, 21 nt, Human
uccugguggaagaaccuucgc

SEQ ID NO: 87707 - RNA, 19 nt, Human
ucggagcgcaggcucuucu

SEQ ID NO: 87708 - RNA, 22 nt, Human
ucucccaauauggcagccaucc

SEQ ID NO: 87709 - RNA, 22 nt, Human
ucucggggcgagccuuagccuu

SEQ ID NO: 87710 - RNA, 21 nt, Human
ucugccagugccccgaagccc

SEQ ID NO: 87711 - RNA, 20 nt, Human
ucuuuaggaacauucagcug

SEQ ID NO: 87712 - RNA, 18 nt, Human
ugaaacaaguuguugauu

SEQ ID NO: 87713 - RNA, 27 nt, Human
ugaaagcccauggcagagaaugagucu

SEQ ID NO: 87714 - RNA, 18 nt, Human
ugacaccugugccucucc

SEQ ID NO: 87715 - RNA, 18 nt, Human
ugagggagagaguucccg

SEQ ID NO: 87716 - RNA, 22 nt, Human
ugcaggaagcugggauccgcgg

SEQ ID NO: 87717 - RNA, 22 nt, Human
ugcuccacagccguggacugca

SEQ ID NO: 87718 - RNA, 18 nt, Human
uggaaagcgcuggcuacg

SEQ ID NO: 87719 - RNA, 21 nt, Human
uggaagaaccuucgcugaaag

SEQ ID NO: 87720 - RNA, 18 nt, Human
uggaagggaguaaggacu

SEQ ID NO: 87721 - RNA, 21 nt, Human
uggcagagaaugagucucugg

SEQ ID NO: 87722 - RNA, 22 nt, Human
uggcagagaaugagucucuggg

SEQ ID NO: 87723 - RNA, 22 nt, Human
uggcuggaacuggugacaccug

SEQ ID NO: 87724 - RNA, 24 nt, Human
uggggcuucaucuucauucuugca

SEQ ID NO: 87725 - RNA, 20 nt, Human
uggucgggagcggaggcuga

SEQ ID NO: 87726 - RNA, 23 nt, Human
uguccucggcugugaggccccca

SEQ ID NO: 87727 - RNA, 22 nt, Human
uguggaggcuccggcugcaugc

SEQ ID NO: 87728 - RNA, 20 nt, Human
uguucauguuucuggguuuu

SEQ ID NO: 87729 - RNA, 19 nt, Human
uguuucuggguuuugcacu

SEQ ID NO: 87730 - RNA, 20 nt, Human
uuagcucagcaccucuccca

SEQ ID NO: 87731 - RNA, 22 nt, Human
uucauguuucuggguuuugcac

SEQ ID NO: 87732 - RNA, 24 nt, Human
uucccuguuccgcugcucccaccc

SEQ ID NO: 87733 - RNA, 25 nt, Human
uuugcaaagagccucccguuggccc

SEQ ID NO: 87734 - RNA, 24 nt, Human
uuuuuuuuuuuuucacuucccaug

SEQ ID NO: 87735 - RNA, 22 nt, Human
uuuuuuuuuuuuuuuuucacuu

SEQ ID NO: 87736 - RNA, 21 nt, Human
acucgcuccgggccgggccug

SEQ ID NO: 87737 - RNA, 22 nt, Human
agaaggaggggcggaaggaggg

SEQ ID NO: 87738 - RNA, 23 nt, Human
aggccgggcccgaggcccgggga

SEQ ID NO: 87739 - RNA, 20 nt, Human
aggcugccggggcugggagc

SEQ ID NO: 87740 - RNA, 22 nt, Human
agggggucugggggagcuggcg

SEQ ID NO: 87741 - RNA, 18 nt, Human
cacguguggccggggggu

SEQ ID NO: 87742 - RNA, 27 nt, Human
ccaccgccugcugcugcugcugcugcc

SEQ ID NO: 87743 - RNA, 19 nt, Human
ccagcccaucgggcggcgg

SEQ ID NO: 87744 - RNA, 22 nt, Human
ccauggccuccucgccgccccc

SEQ ID NO: 87745 - RNA, 18 nt, Human
ccccccgugggcggccga

SEQ ID NO: 87746 - RNA, 20 nt, Human
ccccggagaaggaggggcgg

SEQ ID NO: 87747 - RNA, 21 nt, Human
ccccggagaaggaggggcgga

SEQ ID NO: 87748 - RNA, 22 nt, Human
ccccgugggcggccgaucuccg

SEQ ID NO: 87749 - RNA, 19 nt, Human
ccgcccccgcugcccgggc

SEQ ID NO: 87750 - RNA, 18 nt, Human
ccgccgccgccgccgccg

SEQ ID NO: 87751 - RNA, 22 nt, Human
ccgccgccgccgccgccgccgc

SEQ ID NO: 87752 - RNA, 24 nt, Human
ccgccgccgccgccgccgccgccg

SEQ ID NO: 87753 - RNA, 23 nt, Human
ccgccgccgccgccgccgccgcu

SEQ ID NO: 87754 - RNA, 20 nt, Human
ccgccgccgccgccgcugau

SEQ ID NO: 87755 - RNA, 19 nt, Human
ccgccggccuuacggauca

SEQ ID NO: 87756 - RNA, 20 nt, Human
ccgccugcugcugcugcugc

SEQ ID NO: 87757 - RNA, 26 nt, Human
ccgccugcugcugcugcugcugcugc

SEQ ID NO: 87758 - RNA, 18 nt, Human
ccgcugcccgggccaucg

SEQ ID NO: 87759 - RNA, 19 nt, Human
ccggccagaggcucggccg

SEQ ID NO: 87760 - RNA, 19 nt, Human
ccugcugcugcugcugcug

SEQ ID NO: 87761 - RNA, 22 nt, Human
ccugcugcugcugcuggggagc

SEQ ID NO: 87762 - RNA, 21 nt, Human
cgcaggccgggcccgaggccc

SEQ ID NO: 87763 - RNA, 24 nt, Human
cgccgccgccgccgccgccgccgg

SEQ ID NO: 87764 - RNA, 23 nt, Human
cgcugcuguggccccccgugggc

SEQ ID NO: 87765 - RNA, 18 nt, Human
cggccaccgggccccgcc

SEQ ID NO: 87766 - RNA, 25 nt, Human
cggccagaggcucggccguggggcc

SEQ ID NO: 87767 - RNA, 20 nt, Human
cggcccagcccaucgggcgg

SEQ ID NO: 87768 - RNA, 22 nt, Human
cuccgggccgggccugggaccc

SEQ ID NO: 87769 - RNA, 20 nt, Human
cuccucgccgcccccgcugc

SEQ ID NO: 87770 - RNA, 18 nt, Human
gagcccggcccgcggggc

SEQ ID NO: 87771 - RNA, 18 nt, Human
gagcgcggcggcuggagc

SEQ ID NO: 87772 - RNA, 20 nt, Human
gaggggcggaaggagggugc

SEQ ID NO: 87773 - RNA, 20 nt, Human
gcaggcccuuccuggagccc

SEQ ID NO: 87774 - RNA, 18 nt, Human
gccaccgccugcugcugc

SEQ ID NO: 87775 - RNA, 26 nt, Human
gccaccgccugcugcugcugcugccg

SEQ ID NO: 87776 - RNA, 19 nt, Human
gccgggcccgaggcccggg

SEQ ID NO: 87777 - RNA, 23 nt, Human
gcugcugcugcugcugcugcggg

SEQ ID NO: 87778 - RNA, 23 nt, Human
gcugcugcugcugcugcugcugc

SEQ ID NO: 87779 - RNA, 18 nt, Human
gcugguaccagauguuga

SEQ ID NO: 87780 - RNA, 21 nt, Human
ggaggggcggaaggagggugc

SEQ ID NO: 87781 - RNA, 26 nt, Human
ggaguccugggcgagcgcccgguggc

SEQ ID NO: 87782 - RNA, 20 nt, Human
ggccagaggcucggccgugg

SEQ ID NO: 87783 - RNA, 20 nt, Human
ggcggcggcggcucggcgcc

SEQ ID NO: 87784 - RNA, 19 nt, Human
gggcgagcggccgcugcug

SEQ ID NO: 87785 - RNA, 19 nt, Human
gggcggcggcggcucggcg

SEQ ID NO: 87786 - RNA, 18 nt, Human
ggggauagcagcucggga

SEQ ID NO: 87787 - RNA, 23 nt, Human
gggggccccgagccgccggccuu

SEQ ID NO: 87788 - RNA, 21 nt, Human
ggggguggcgcgucguaggcc

SEQ ID NO: 87789 - RNA, 19 nt, Human
ggggucugggggagcuggc

SEQ ID NO: 87790 - RNA, 23 nt, Human
ggguggcgcgucguaggccccgg

SEQ ID NO: 87791 - RNA, 22 nt, Human
gguggcgcgucguaggccccgg

SEQ ID NO: 87792 - RNA, 22 nt, Human
gguucgugcaggcccuuccugg

SEQ ID NO: 87793 - RNA, 23 nt, Human
guggggccuggguaccuccgagg

SEQ ID NO: 87794 - RNA, 18 nt, Human
uaggacacguguggccgg

SEQ ID NO: 87795 - RNA, 23 nt, Human
uccgugcgccggguaguagccgu

SEQ ID NO: 87796 - RNA, 18 nt, Human
ucgccgcccccgcugccc

SEQ ID NO: 87797 - RNA, 19 nt, Human
ucgccgcccccgcugcccg

SEQ ID NO: 87798 - RNA, 21 nt, Human
ucggagccccgguaguagcca

SEQ ID NO: 87799 - RNA, 21 nt, Human
ucgggucgggggcucagaagg

SEQ ID NO: 87800 - RNA, 19 nt, Human
ucugggggagcuggcggcg

SEQ ID NO: 87801 - RNA, 24 nt, Human
ucuuccuggcugaccccggagaag

SEQ ID NO: 87802 - RNA, 19 nt, Human
ugcaaagagcaaagggcuc

SEQ ID NO: 87803 - RNA, 22 nt, Human
ugccggggcugggagcgcggcg

SEQ ID NO: 87804 - RNA, 22 nt, Human
ugcgggccagaugccggccacc

SEQ ID NO: 87805 - RNA, 20 nt, Human
ugcugcugcgggggccccga

SEQ ID NO: 87806 - RNA, 21 nt, Human
ugcugcugcugcugcugcugc

SEQ ID NO: 87807 - RNA, 21 nt, Human
ugcugcugcugcugcugcugc

SEQ ID NO: 87808 - RNA, 21 nt, Human
ugcugcugcugcugcugcugc

SEQ ID NO: 87809 - RNA, 21 nt, Human
ugcugcugcugcugcugcugc

SEQ ID NO: 87810 - RNA, 21 nt, Human
ugcugcugcugcugcugcugc

SEQ ID NO: 87811 - RNA, 24 nt, Human
ugcugcugcugcugcugcugcugc

SEQ ID NO: 87812 - RNA, 23 nt, Human
uggagggggucugggggagcugg

SEQ ID NO: 87813 - RNA, 21 nt, Human
uggccaccgccugcugcugcu

SEQ ID NO: 87814 - RNA, 26 nt, Human
uggccaccgccugcugcugcugcugc

SEQ ID NO: 87815 - RNA, 26 nt, Human
uggccccccgugggcggccgaucucc

SEQ ID NO: 87816 - RNA, 18 nt, Human
ugggagcgcggcggcugg

SEQ ID NO: 87817 - RNA, 23 nt, Human
uguggccgggggguggagggggu

SEQ ID NO: 87818 - RNA, 22 nt, Human
uuagcaccaaucaucgucacuc

SEQ ID NO: 87819 - RNA, 21 nt, Human
uucgugcaggcccuuccugga

SEQ ID NO: 87820 - RNA, 18 nt, Human
acguacacucaagcaaca

SEQ ID NO: 87821 - RNA, 21 nt, Human
agaggggaggagggggaggga

SEQ ID NO: 87822 - RNA, 27 nt, Human
agaggggaggagggggagggaggggcc

SEQ ID NO: 87823 - RNA, 19 nt, Human
agaguaaaagaggggagga

SEQ ID NO: 87824 - RNA, 21 nt, Human
agaguaaaagaggggaggagg

SEQ ID NO: 87825 - RNA, 24 nt, Human
agaguaaaagaggggaggaggggg

SEQ ID NO: 87826 - RNA, 23 nt, Human
agcagccacggagccgccgggac

SEQ ID NO: 87827 - RNA, 19 nt, Human
aggagggggagggaggggc

SEQ ID NO: 87828 - RNA, 24 nt, Human
agggaggggccacaggagccucac

SEQ ID NO: 87829 - RNA, 23 nt, Human
aggggaggagggggagggagggg

SEQ ID NO: 87830 - RNA, 25 nt, Human
aggggaggagggggagggaggggcc

SEQ ID NO: 87831 - RNA, 23 nt, Human
agggggagggaggggccacagga

SEQ ID NO: 87832 - RNA, 25 nt, Human
agggggagggaggggccacaggagc

SEQ ID NO: 87833 - RNA, 18 nt, Human
caaggugggcaaggccuc

SEQ ID NO: 87834 - RNA, 18 nt, Human
cagccacggagccgccgg

SEQ ID NO: 87835 - RNA, 19 nt, Human
cagcggaccucgcccggcc

SEQ ID NO: 87836 - RNA, 24 nt, Human
caggagccucaccaaggugggcaa

SEQ ID NO: 87837 - RNA, 23 nt, Human
ccaaggugggcaaggccuccccc

SEQ ID NO: 87838 - RNA, 21 nt, Human
cccccgagggccgacugcccc

SEQ ID NO: 87839 - RNA, 21 nt, Human
ccccgcgugcauccccggccc

SEQ ID NO: 87840 - RNA, 21 nt, Human
ccccggcccagcggccccggc

SEQ ID NO: 87841 - RNA, 22 nt, Human
cccggccccaccgccgcagccg

SEQ ID NO: 87842 - RNA, 19 nt, Human
ccgccgggaccgcagcgga

SEQ ID NO: 87843 - RNA, 20 nt, Human
cggcagggagggcgcggggc

SEQ ID NO: 87844 - RNA, 20 nt, Human
cggcccagcggccccggcag

SEQ ID NO: 87845 - RNA, 25 nt, Human
cuagaguaaaagaggggaggagggg

SEQ ID NO: 87846 - RNA, 22 nt, Human
cucagagcggagcagccacgga

SEQ ID NO: 87847 - RNA, 21 nt, Human
cucccgggccccgcgugcauc

SEQ ID NO: 87848 - RNA, 22 nt, Human
cuggaacacacgccugcugcau

SEQ ID NO: 87849 - RNA, 19 nt, Human
gaggagggggagggagggg

SEQ ID NO: 87850 - RNA, 21 nt, Human
gagggggagggaggggccaca

SEQ ID NO: 87851 - RNA, 18 nt, Human
gaguaaaagaggggagga

SEQ ID NO: 87852 - RNA, 23 nt, Human
gccccguguggaugauaaaacuc

SEQ ID NO: 87853 - RNA, 22 nt, Human
ggagggggagggaggggccaca

SEQ ID NO: 87854 - RNA, 22 nt, Human
ggcgcggggcgcgccaggcgcu

SEQ ID NO: 87855 - RNA, 20 nt, Human
ggggagggaggggccacagg

SEQ ID NO: 87856 - RNA, 20 nt, Human
gggggagggaggggccacag

SEQ ID NO: 87857 - RNA, 21 nt, Human
uaaaagaggggaggaggggga

SEQ ID NO: 87858 - RNA, 18 nt, Human
uccccggcccagcggccc

SEQ ID NO: 87859 - RNA, 24 nt, Human
ucuagaguaaaagaggggaggagg

SEQ ID NO: 87860 - RNA, 21 nt, Human
ugauaaaacucauccacugga

SEQ ID NO: 87861 - RNA, 21 nt, Human
aaaaccaaaaccgaaaagaaa

SEQ ID NO: 87862 - RNA, 20 nt, Human
aaaagcccgcaucuggcagc

SEQ ID NO: 87863 - RNA, 23 nt, Human
aaacagcugaagagaaagacucu

SEQ ID NO: 87864 - RNA, 26 nt, Human
aaacauuuaaaaaaaaccaaaaccga

SEQ ID NO: 87865 - RNA, 18 nt, Human
aaaccacaaaacaaaaga

SEQ ID NO: 87866 - RNA, 24 nt, Human
aaauaaaaaaaagcccgcaucugg

SEQ ID NO: 87867 - RNA, 26 nt, Human
aaaugaaaauuagaaacaaauaucuc

SEQ ID NO: 87868 - RNA, 21 nt, Human
aagaagacuaguaaacagcug

SEQ ID NO: 87869 - RNA, 18 nt, Human
aagagaugugauaagaaa

SEQ ID NO: 87870 - RNA, 31 nt, Human
aagcaaaauaaaacauuuaaaaaaaaccaag

SEQ ID NO: 87871 - RNA, 22 nt, Human
aagcauugacauugaguccaug

SEQ ID NO: 87872 - RNA, 22 nt, Human
aagcugaaaacacacccugacc

SEQ ID NO: 87873 - RNA, 18 nt, Human
aauucuugggagcaggaa

SEQ ID NO: 87874 - RNA, 26 nt, Human
acaaaacaaaagagcgcucagcggaa

SEQ ID NO: 87875 - RNA, 18 nt, Human
acaugagaagcauugaca

SEQ ID NO: 87876 - RNA, 20 nt, Human
acaugagaagcauugacauu

SEQ ID NO: 87877 - RNA, 18 nt, Human
acuuuguaaacacucuuc

SEQ ID NO: 87878 - RNA, 22 nt, Human
agaggcgcggccggcccggggc

SEQ ID NO: 87879 - RNA, 25 nt, Human
aggaacaaaucuuaccuauuucaau

SEQ ID NO: 87880 - RNA, 22 nt, Human
aggaauaacaguagaaccuauc

SEQ ID NO: 87881 - RNA, 20 nt, Human
aggcgcggccggcccggggc

SEQ ID NO: 87882 - RNA, 24 nt, Human
agugaaaacaggaaaggugagggg

SEQ ID NO: 87883 - RNA, 19 nt, Human
agugucaaaccacaaaaca

SEQ ID NO: 87884 - RNA, 24 nt, Human
aucacauuuaccucccaucaugaa

SEQ ID NO: 87885 - RNA, 18 nt, Human
augagaagcauugacauu

SEQ ID NO: 87886 - RNA, 23 nt, Human
caaaaccgaaaagaaacugcaac

SEQ ID NO: 87887 - RNA, 19 nt, Human
caaaccacaaaacaaaaga

SEQ ID NO: 87888 - RNA, 20 nt, Human
caaaccacaaaacaaaagag

SEQ ID NO: 87889 - RNA, 22 nt, Human
caaauaaaaaaaagcccgcauc

SEQ ID NO: 87890 - RNA, 24 nt, Human
caacucuaucugaaaaaaaacuua

SEQ ID NO: 87891 - RNA, 18 nt, Human
cacaaaacaaaagagcgc

SEQ ID NO: 87892 - RNA, 22 nt, Human
cacaaaacaaaagagcgcucag

SEQ ID NO: 87893 - RNA, 23 nt, Human
cacaaaacaaaagagcgcucagc

SEQ ID NO: 87894 - RNA, 18 nt, Human
caccacugccggcccgac

SEQ ID NO: 87895 - RNA, 22 nt, Human
cagagcuccgcgccccuggagg

SEQ ID NO: 87896 - RNA, 22 nt, Human
cagccaugcucauuugcuccuu

SEQ ID NO: 87897 - RNA, 21 nt, Human
cagcuccucccucgcgcugcc

SEQ ID NO: 87898 - RNA, 24 nt, Human
cagugaauuaauggggguagacac

SEQ ID NO: 87899 - RNA, 23 nt, Human
ccaaaaccgaaaagaaacugcaa

SEQ ID NO: 87900 - RNA, 25 nt, Human
ccaaaaccgaaaagaaacugcaaca

SEQ ID NO: 87901 - RNA, 22 nt, Human
cccauccccagagcuccgcgcc

SEQ ID NO: 87902 - RNA, 22 nt, Human
ccccuggaggccuccuccuccc

SEQ ID NO: 87903 - RNA, 23 nt, Human
cccucgccgccuccucuccccgc

SEQ ID NO: 87904 - RNA, 23 nt, Human
ccgcgucuggucccaacagaaau

SEQ ID NO: 87905 - RNA, 21 nt, Human
ccggcccgacgcccaucccca

SEQ ID NO: 87906 - RNA, 18 nt, Human
ccgggagcucggcguggc

SEQ ID NO: 87907 - RNA, 19 nt, Human
ccuccucccucuccgggcc

SEQ ID NO: 87908 - RNA, 18 nt, Human
ccuccucuccccgccucu

SEQ ID NO: 87909 - RNA, 21 nt, Human
ccucgccgccuccucuccccg

SEQ ID NO: 87910 - RNA, 19 nt, Human
ccugcgagcugggagaggg

SEQ ID NO: 87911 - RNA, 20 nt, Human
ccugcgggccggcggcuggc

SEQ ID NO: 87912 - RNA, 19 nt, Human
cgaaaagaaacugcaacau

SEQ ID NO: 87913 - RNA, 22 nt, Human
cggcccgacgcccauccccaga

SEQ ID NO: 87914 - RNA, 19 nt, Human
cgggacccucgccgccucc

SEQ ID NO: 87915 - RNA, 21 nt, Human
cuaaaaauaaacacauucaac

SEQ ID NO: 87916 - RNA, 23 nt, Human
cuacaggacuuuguaaacacucu

SEQ ID NO: 87917 - RNA, 21 nt, Human
cuaguaaacagcugaagagaa

SEQ ID NO: 87918 - RNA, 18 nt, Human
cucagcaccaccugguug

SEQ ID NO: 87919 - RNA, 19 nt, Human
cucccgcagaggcgcggcc

SEQ ID NO: 87920 - RNA, 22 nt, Human
cuccgcgucuggucccaacaga

SEQ ID NO: 87921 - RNA, 26 nt, Human
cuggaggccuccuccucccucuccgg

SEQ ID NO: 87922 - RNA, 21 nt, Human
gaaaacacacccugaccagga

SEQ ID NO: 87923 - RNA, 27 nt, Human
gaaaacaggaaaggugagggggccggu

SEQ ID NO: 87924 - RNA, 24 nt, Human
gaaaagaaacugcaacaaccccgg

SEQ ID NO: 87925 - RNA, 20 nt, Human
gacgcccauccccagagcuc

SEQ ID NO: 87926 - RNA, 23 nt, Human
gacucucugugaaggcuggauuc

SEQ ID NO: 87927 - RNA, 19 nt, Human
gccccgggacccucgccgc

SEQ ID NO: 87928 - RNA, 21 nt, Human
gcccggggccugcgagcuggg

SEQ ID NO: 87929 - RNA, 20 nt, Human
gccugcgggccggcggcugg

SEQ ID NO: 87930 - RNA, 23 nt, Human
ggauucagcaaagcugaaaacac

SEQ ID NO: 87931 - RNA, 18 nt, Human
ggcagcgccuuccucgcg

SEQ ID NO: 87932 - RNA, 21 nt, Human
ggcccgacgcccauccccaga

SEQ ID NO: 87933 - RNA, 19 nt, Human
ggccgggagcucggcgugg

SEQ ID NO: 87934 - RNA, 22 nt, Human
ggcgcagcuccucccucgcgcu

SEQ ID NO: 87935 - RNA, 24 nt, Human
gggagacagcaggcucguacagaa

SEQ ID NO: 87936 - RNA, 18 nt, Human
gggcagggacggagugag

SEQ ID NO: 87937 - RNA, 22 nt, Human
gguaaaacucuccugcagcggc

SEQ ID NO: 87938 - RNA, 24 nt, Human
gucuucuuuggucacugauaucuc

SEQ ID NO: 87939 - RNA, 24 nt, Human
uaaaaaaaaccaaaaccgaaaaga

SEQ ID NO: 87940 - RNA, 19 nt, Human
uaaaaaaaagcccgcaucu

SEQ ID NO: 87941 - RNA, 22 nt, Human
uaaaaaaaagcccgcaucuggc

SEQ ID NO: 87942 - RNA, 23 nt, Human
uaaaaaaaagcccgcaucuggca

SEQ ID NO: 87943 - RNA, 23 nt, Human
uaauucuugggagcaggaacaaa

SEQ ID NO: 87944 - RNA, 19 nt, Human
uaauuuccaucgugacuga

SEQ ID NO: 87945 - RNA, 18 nt, Human
uacaagaaaaccaaaccc

SEQ ID NO: 87946 - RNA, 23 nt, Human
uaggaauaacaguagaaccuauc

SEQ ID NO: 87947 - RNA, 25 nt, Human
uaugaaaaauaagaguauucauuau

SEQ ID NO: 87948 - RNA, 22 nt, Human
uaugauauugcucucaaaggaa

SEQ ID NO: 87949 - RNA, 23 nt, Human
ucaaaccacaaaacaaaagagcg

SEQ ID NO: 87950 - RNA, 18 nt, Human
ucaacaaaagugucaaac

SEQ ID NO: 87951 - RNA, 19 nt, Human
ucacugauaucuccaguga

SEQ ID NO: 87952 - RNA, 26 nt, Human
ucagcaaagcugaaaacacacccuga

SEQ ID NO: 87953 - RNA, 19 nt, Human
ucauuauugcuaaagggag

SEQ ID NO: 87954 - RNA, 22 nt, Human
ucccaacagaaaugaaugaaga

SEQ ID NO: 87955 - RNA, 28 nt, Human
ucccaucaugaacauuuaggacaaaaau

SEQ ID NO: 87956 - RNA, 19 nt, Human
ucccgcagaggcgcggccg

SEQ ID NO: 87957 - RNA, 23 nt, Human
ucccggagggcggcucgcgcacc

SEQ ID NO: 87958 - RNA, 22 nt, Human
ucccgucgcaggugggcaggga

SEQ ID NO: 87959 - RNA, 22 nt, Human
ucuccagugaauuaaugggggu

SEQ ID NO: 87960 - RNA, 18 nt, Human
ucugcucuucccuccuuu

SEQ ID NO: 87961 - RNA, 23 nt, Human
ucuuccagccaugcucauuugcu

SEQ ID NO: 87962 - RNA, 22 nt, Human
ucuucuuccuccccucccgcug

SEQ ID NO: 87963 - RNA, 20 nt, Human
ugaaacaaauaaaaaaaagc

SEQ ID NO: 87964 - RNA, 23 nt, Human
ugaagagaaagacucugucauua

SEQ ID NO: 87965 - RNA, 19 nt, Human
ugaccagaaauauuccugg

SEQ ID NO: 87966 - RNA, 24 nt, Human
ugaccagaaauauuccugggagca

SEQ ID NO: 87967 - RNA, 18 nt, Human
ugacuaaaaauaaacaca

SEQ ID NO: 87968 - RNA, 18 nt, Human
ugccccgcucccuucucc

SEQ ID NO: 87969 - RNA, 21 nt, Human
ugccccgcucccuucuccaaa

SEQ ID NO: 87970 - RNA, 21 nt, Human
ugcuccuuuagucuacaucuc

SEQ ID NO: 87971 - RNA, 23 nt, Human
ugcucuucccuccuuuaauuucc

SEQ ID NO: 87972 - RNA, 20 nt, Human
uggaaaaaggaaaccacaac

SEQ ID NO: 87973 - RNA, 22 nt, Human
uggaaguccugccccgcucccu

SEQ ID NO: 87974 - RNA, 24 nt, Human
uggauucagcaaagcugaaaacac

SEQ ID NO: 87975 - RNA, 18 nt, Human
uggccgggagcucggcgu

SEQ ID NO: 87976 - RNA, 23 nt, Human
ugggaaagcaaaauaaaacauuu

SEQ ID NO: 87977 - RNA, 22 nt, Human
ugggagcauguaagaacugagg

SEQ ID NO: 87978 - RNA, 22 nt, Human
ugggcggagccggcggccccgg

SEQ ID NO: 87979 - RNA, 23 nt, Human
ugguguguguccaugacucucug

SEQ ID NO: 87980 - RNA, 25 nt, Human
uguaaacacucuucuuccuccccuc

SEQ ID NO: 87981 - RNA, 23 nt, Human
uguguguccaugacucucuguga

SEQ ID NO: 87982 - RNA, 20 nt, Human
uuacuaucuuccagccaugc

SEQ ID NO: 87983 - RNA, 25 nt, Human
uuccacaauuuugcuucugcucuuc

SEQ ID NO: 87984 - RNA, 24 nt, Human
uuccuccccucccgcugggaaagc

SEQ ID NO: 87985 - RNA, 24 nt, Human
uuuuuuccauuaagauauuuuuuc

SEQ ID NO: 87986 - RNA, 18 nt, Human
uuuuuuuuuuuuuuuuug

SEQ ID NO: 87987 - RNA, 20 nt, Human
uuuuuuuuuuuuuuuuuggu

SEQ ID NO: 87988 - RNA, 18 nt, Human
acagcagugcccaucugg

SEQ ID NO: 87989 - RNA, 19 nt, Human
cagaacagcuaaacaggaa

SEQ ID NO: 87990 - RNA, 23 nt, Human
cagaacagcuaaacaggaaccag

SEQ ID NO: 87991 - RNA, 19 nt, Human
cagagccagucugccccuc

SEQ ID NO: 87992 - RNA, 21 nt, Human
cagagccagucugccccucgc

SEQ ID NO: 87993 - RNA, 21 nt, Human
caggcucaaccgcuugggacc

SEQ ID NO: 87994 - RNA, 24 nt, Human
ccaacuagugccuaaacuuuccua

SEQ ID NO: 87995 - RNA, 23 nt, Human
ccacagcagugcccaucuggaca

SEQ ID NO: 87996 - RNA, 23 nt, Human
ccccugcaccccgccgccaugcc

SEQ ID NO: 87997 - RNA, 21 nt, Human
ccugcagcuggggccgagccg

SEQ ID NO: 87998 - RNA, 18 nt, Human
ccugcgccccaccugagg

SEQ ID NO: 87999 - RNA, 23 nt, Human
ccugcgccccaccugaggccaga

SEQ ID NO: 88000 - RNA, 21 nt, Human
ccugcuguuuccugcagcugg

SEQ ID NO: 88001 - RNA, 25 nt, Human
cuaccagguuuauggcuuucuugag

SEQ ID NO: 88002 - RNA, 19 nt, Human
cuccacagcagugcccauc

SEQ ID NO: 88003 - RNA, 18 nt, Human
cuccucacccauccucug

SEQ ID NO: 88004 - RNA, 24 nt, Human
cugaggccagagccagucugcccc

SEQ ID NO: 88005 - RNA, 21 nt, Human
cugcagcuggggccgagcgca

SEQ ID NO: 88006 - RNA, 22 nt, Human
cugcgccccaccugaggccaga

SEQ ID NO: 88007 - RNA, 22 nt, Human
cuggacaauggggcagggcagg

SEQ ID NO: 88008 - RNA, 18 nt, Human
gccugcuguuuccugcag

SEQ ID NO: 88009 - RNA, 22 nt, Human
gcugggcguugaggcgggggcg

SEQ ID NO: 88010 - RNA, 18 nt, Human
ggcagggcaggucuggcc

SEQ ID NO: 88011 - RNA, 23 nt, Human
uaaacaggaaccaggacgcagug

SEQ ID NO: 88012 - RNA, 18 nt, Human
uaacuuuccccugcaccc

SEQ ID NO: 88013 - RNA, 19 nt, Human
uaacuuuccccugcacccc

SEQ ID NO: 88014 - RNA, 19 nt, Human
uaccagguuuauggcuuuc

SEQ ID NO: 88015 - RNA, 19 nt, Human
uacugugugcagggcacug

SEQ ID NO: 88016 - RNA, 18 nt, Human
uccccuggcucuccugcg

SEQ ID NO: 88017 - RNA, 24 nt, Human
uccucugugagagggcggggccug

SEQ ID NO: 88018 - RNA, 26 nt, Human
ucuggccuccucacccauccucugug

SEQ ID NO: 88019 - RNA, 18 nt, Human
ugagguaacgacacgagg

SEQ ID NO: 88020 - RNA, 23 nt, Human
ugggagaagcagacuccacagca

SEQ ID NO: 88021 - RNA, 20 nt, Human
uggggaaggggaucaccaag

SEQ ID NO: 88022 - RNA, 20 nt, Human
ugugcagggcacugugcugg

SEQ ID NO: 88023 - RNA, 22 nt, Human
ugugcugggcguugaggcgggg

SEQ ID NO: 88024 - RNA, 22 nt, Human
ugugugcagggcacugugcugg

SEQ ID NO: 88025 - RNA, 23 nt, Human
uuaaaaauggauauguugggccc

SEQ ID NO: 88026 - RNA, 21 nt, Human
uugaauauuacucccaacuag

SEQ ID NO: 88027 - RNA, 25 nt, Human
uugggcccagugacugauaugcuag

SEQ ID NO: 88028 - RNA, 21 nt, Human
aaagacacacggagacucaga

SEQ ID NO: 88029 - RNA, 18 nt, Human
acacagcaacaagcagaa

SEQ ID NO: 88030 - RNA, 20 nt, Human
agacaagcacggggaccacc

SEQ ID NO: 88031 - RNA, 22 nt, Human
agagaagagcaugcaucggagg

SEQ ID NO: 88032 - RNA, 19 nt, Human
cacccgcacacagcaacaa

SEQ ID NO: 88033 - RNA, 24 nt, Human
caccgccucuggggagcuccgcga

SEQ ID NO: 88034 - RNA, 22 nt, Human
ccagacaagcacggggaccacc

SEQ ID NO: 88035 - RNA, 20 nt, Human
ccuuuucccucuuccucccc

SEQ ID NO: 88036 - RNA, 22 nt, Human
cuggcuucccaauucugucuug

SEQ ID NO: 88037 - RNA, 19 nt, Human
gccgcacuggcuucccaau

SEQ ID NO: 88038 - RNA, 21 nt, Human
uaaacagacagaagacacaca

SEQ ID NO: 88039 - RNA, 22 nt, Human
uaaacagacagaagacacacaa

SEQ ID NO: 88040 - RNA, 25 nt, Human
uccccgcggggccgcacuggcuucc

SEQ ID NO: 88041 - RNA, 23 nt, Human
uucccaauucugucuugguuuuc

SEQ ID NO: 88042 - RNA, 18 nt, Human
aaccccccucucuucccc

SEQ ID NO: 88043 - RNA, 22 nt, Human
aagggccaucugcacacaaccc

SEQ ID NO: 88044 - RNA, 21 nt, Human
acaaccccccucucuuccccc

SEQ ID NO: 88045 - RNA, 22 nt, Human
acaaccccccucucuuccccca

SEQ ID NO: 88046 - RNA, 22 nt, Human
acacaaccccccucucuucccc

SEQ ID NO: 88047 - RNA, 19 nt, Human
accccccucucuuccccca

SEQ ID NO: 88048 - RNA, 19 nt, Human
aucugcacacaaccccccu

SEQ ID NO: 88049 - RNA, 25 nt, Human
cacacaaccccccucucuuccccca

SEQ ID NO: 88050 - RNA, 22 nt, Human
caugccugccuccugcugggga

SEQ ID NO: 88051 - RNA, 19 nt, Human
gggaggggagggcaggagg

SEQ ID NO: 88052 - RNA, 20 nt, Human
ugcuggggaggggagggcag

SEQ ID NO: 88053 - RNA, 23 nt, Human
aauauacauagagauucugcaca

SEQ ID NO: 88054 - RNA, 22 nt, Human
aggaauauagcccaggaggagg

SEQ ID NO: 88055 - RNA, 19 nt, Human
aguagaaggaaacaagucu

SEQ ID NO: 88056 - RNA, 24 nt, Human
auaaaauagaauauacauagagau

SEQ ID NO: 88057 - RNA, 22 nt, Human
caccgggccucuccuucugccu

SEQ ID NO: 88058 - RNA, 22 nt, Human
cagcuucuggugucgggaaccu

SEQ ID NO: 88059 - RNA, 19 nt, Human
cccaggaggaggagcuagg

SEQ ID NO: 88060 - RNA, 19 nt, Human
ccucagcugcaccgggccu

SEQ ID NO: 88061 - RNA, 23 nt, Human
ccuggagccagaguugccggggc

SEQ ID NO: 88062 - RNA, 22 nt, Human
cgccuucgccucaaaaauauuc

SEQ ID NO: 88063 - RNA, 27 nt, Human
cgccuucgccucaaaaauauucugaga

SEQ ID NO: 88064 - RNA, 24 nt, Human
cuugcagguacccagagccacuga

SEQ ID NO: 88065 - RNA, 22 nt, Human
gaggaggagcuaggacuuggca

SEQ ID NO: 88066 - RNA, 18 nt, Human
gauucugcacaaacguau

SEQ ID NO: 88067 - RNA, 24 nt, Human
gccacugaggcagggaggagcgcc

SEQ ID NO: 88068 - RNA, 19 nt, Human
gcugcaccgggccucuccu

SEQ ID NO: 88069 - RNA, 21 nt, Human
ggggcugcaaugugcucgcgg

SEQ ID NO: 88070 - RNA, 24 nt, Human
ggugagugggaaaguggggcagga

SEQ ID NO: 88071 - RNA, 25 nt, Human
guugccggggcugcugcuuuuaacu

SEQ ID NO: 88072 - RNA, 21 nt, Human
uacccagagccacugaggcag

SEQ ID NO: 88073 - RNA, 20 nt, Human
uauagcccaggaggaggagc

SEQ ID NO: 88074 - RNA, 22 nt, Human
ucagcugcaccgggccucuccu

SEQ ID NO: 88075 - RNA, 23 nt, Human
ucagucacaaaaugucguacauc

SEQ ID NO: 88076 - RNA, 20 nt, Human
ucugcuugcagguacccaga

SEQ ID NO: 88077 - RNA, 18 nt, Human
ugagacacauaaaaguag

SEQ ID NO: 88078 - RNA, 22 nt, Human
ugaggcagggaggagcgccucc

SEQ ID NO: 88079 - RNA, 20 nt, Human
ugcaccgggccucuccuucu

SEQ ID NO: 88080 - RNA, 23 nt, Human
ugccggggcugcugcuuuuaacu

SEQ ID NO: 88081 - RNA, 21 nt, Human
uucugcuugcagguacccaga

SEQ ID NO: 88082 - RNA, 23 nt, Human
uugccggggcugcugcuuuuaac

SEQ ID NO: 88083 - RNA, 21 nt, Human
uuucucccaacagcuucuggu

SEQ ID NO: 88084 - RNA, 19 nt, Human
uuugucaggaauauagccc

SEQ ID NO: 88085 - RNA, 21 nt, Human
uuuuagguuaaaauagccaag

SEQ ID NO: 88086 - RNA, 19 nt, Human
aacuuccccacccccauug

SEQ ID NO: 88087 - RNA, 23 nt, Human
aaugcccccgccuuggggacuag

SEQ ID NO: 88088 - RNA, 19 nt, Human
accccagcaacuuccccac

SEQ ID NO: 88089 - RNA, 22 nt, Human
agggagggaggcugcugcggug

SEQ ID NO: 88090 - RNA, 24 nt, Human
agggagggaggcugcugcgguggg

SEQ ID NO: 88091 - RNA, 22 nt, Human
agggccuguccagcuacuuccu

SEQ ID NO: 88092 - RNA, 24 nt, Human
agggccuguccagcuacuuccucc

SEQ ID NO: 88093 - RNA, 19 nt, Human
aggugggaguggcccuagg

SEQ ID NO: 88094 - RNA, 21 nt, Human
aggugggaguggcccuaggga

SEQ ID NO: 88095 - RNA, 21 nt, Human
caccccagcaacuuccccacc

SEQ ID NO: 88096 - RNA, 23 nt, Human
caccccagcaacuuccccacccc

SEQ ID NO: 88097 - RNA, 18 nt, Human
cagugucacaggccugga

SEQ ID NO: 88098 - RNA, 19 nt, Human
ccacccugccucaggcaug

SEQ ID NO: 88099 - RNA, 22 nt, Human
cccagcaacuuccccaccccca

SEQ ID NO: 88100 - RNA, 18 nt, Human
ccccaaugcccccgccuu

SEQ ID NO: 88101 - RNA, 22 nt, Human
ccccagugcuuucccuucccug

SEQ ID NO: 88102 - RNA, 23 nt, Human
cccccaccccagugcuuucccuu

SEQ ID NO: 88103 - RNA, 19 nt, Human
ccuccacucggcuccccgc

SEQ ID NO: 88104 - RNA, 20 nt, Human
ccuggagauuuuaauguccu

SEQ ID NO: 88105 - RNA, 22 nt, Human
cugcggugggcuagcccuucuc

SEQ ID NO: 88106 - RNA, 19 nt, Human
cugggaaucuggcuuucuc

SEQ ID NO: 88107 - RNA, 20 nt, Human
gaggugguuccugaccaccc

SEQ ID NO: 88108 - RNA, 19 nt, Human
gccagggggcggggcagga

SEQ ID NO: 88109 - RNA, 22 nt, Human
gcggggcaggaguggggggcag

SEQ ID NO: 88110 - RNA, 22 nt, Human
gcuuucccuucccugugucccc

SEQ ID NO: 88111 - RNA, 19 nt, Human
gcuuucuccugcuccccca

SEQ ID NO: 88112 - RNA, 21 nt, Human
ggacaggcacugaccaggccu

SEQ ID NO: 88113 - RNA, 22 nt, Human
ggcaggaggauuacucuccucg

SEQ ID NO: 88114 - RNA, 19 nt, Human
ggcaggaguggggggcagg

SEQ ID NO: 88115 - RNA, 20 nt, Human
ggcaggaguggggggcagga

SEQ ID NO: 88116 - RNA, 23 nt, Human
ggcaggaguggggggcaggagga

SEQ ID NO: 88117 - RNA, 23 nt, Human
ggcuuucuccugcucccccaccc

SEQ ID NO: 88118 - RNA, 20 nt, Human
gggaggcugcugcggugggc

SEQ ID NO: 88119 - RNA, 20 nt, Human
gggcaggaguggggggcagg

SEQ ID NO: 88120 - RNA, 22 nt, Human
gggcggggcaggaguggggggc

SEQ ID NO: 88121 - RNA, 24 nt, Human
gggcggggcaggaguggggggcag

SEQ ID NO: 88122 - RNA, 25 nt, Human
ggggcggggcaggaguggggggcag

SEQ ID NO: 88123 - RNA, 31 nt, Human
uagcccuucuccaccccagcaacuucccccc

SEQ ID NO: 88124 - RNA, 23 nt, Human
uccaccccagcaacuuccccacc

SEQ ID NO: 88125 - RNA, 23 nt, Human
uccagcuacuuccuccgcacuuu

SEQ ID NO: 88126 - RNA, 18 nt, Human
ucccugggaaucuggcuu

SEQ ID NO: 88127 - RNA, 19 nt, Human
ucuccugcucccccacccc

SEQ ID NO: 88128 - RNA, 20 nt, Human
ucuccugcucccccacccca

SEQ ID NO: 88129 - RNA, 23 nt, Human
ucuggcuuucuccugcucccccc

SEQ ID NO: 88130 - RNA, 24 nt, Human
ucuugcuggugaggggcagggccu

SEQ ID NO: 88131 - RNA, 19 nt, Human
uggugaggggcagggccug

SEQ ID NO: 88132 - RNA, 19 nt, Human
uucccugggaaucuggcuu

SEQ ID NO: 88133 - RNA, 21 nt, Human
uugaggugguuccugaccacc

SEQ ID NO: 88134 - RNA, 21 nt, Human
uuuugaaugacauuagaagcu

SEQ ID NO: 88135 - RNA, 21 nt, Human
aaaugaccagaaugaauggug

SEQ ID NO: 88136 - RNA, 28 nt, Human
aacaacaaaaaaagggcagagaaaagga

SEQ ID NO: 88137 - RNA, 21 nt, Human
aacccucccaccaaccccucg

SEQ ID NO: 88138 - RNA, 24 nt, Human
aagaggccgggugaggugggagug

SEQ ID NO: 88139 - RNA, 23 nt, Human
aagcagggaguguguguguaggg

SEQ ID NO: 88140 - RNA, 19 nt, Human
aaggauggcccagccagga

SEQ ID NO: 88141 - RNA, 24 nt, Human
acagaaaccaaguuugggcuuggg

SEQ ID NO: 88142 - RNA, 19 nt, Human
accagacucucagggccug

SEQ ID NO: 88143 - RNA, 19 nt, Human
acuacacuacaguuacacg

SEQ ID NO: 88144 - RNA, 20 nt, Human
acuacaguuacacgcacgcc

SEQ ID NO: 88145 - RNA, 23 nt, Human
agagaaaaggaaauggcccccca

SEQ ID NO: 88146 - RNA, 21 nt, Human
agagacaaagucaccccugcu

SEQ ID NO: 88147 - RNA, 19 nt, Human
agcauuuggcacuguuuga

SEQ ID NO: 88148 - RNA, 19 nt, Human
agcccaaggugaggggcag

SEQ ID NO: 88149 - RNA, 18 nt, Human
aggagagacaaagucacc

SEQ ID NO: 88150 - RNA, 18 nt, Human
aggagauggagugugcag

SEQ ID NO: 88151 - RNA, 21 nt, Human
aggagcccaugggggcugccc

SEQ ID NO: 88152 - RNA, 24 nt, Human
aggagggugggaaaggcgaagagg

SEQ ID NO: 88153 - RNA, 22 nt, Human
aggauggcccagccaggagaga

SEQ ID NO: 88154 - RNA, 21 nt, Human
aggcacaggcuucaaacuggc

SEQ ID NO: 88155 - RNA, 23 nt, Human
aggcagggucccccccaacauag

SEQ ID NO: 88156 - RNA, 18 nt, Human
aggcagguggugagcagg

SEQ ID NO: 88157 - RNA, 18 nt, Human
agggagugggcacaggcc

SEQ ID NO: 88158 - RNA, 19 nt, Human
agggagugggcacaggccu

SEQ ID NO: 88159 - RNA, 24 nt, Human
agggccuggccagcucagguccuu

SEQ ID NO: 88160 - RNA, 24 nt, Human
agggcggcagcagaggccugguuu

SEQ ID NO: 88161 - RNA, 19 nt, Human
aggugaggggcagccaggu

SEQ ID NO: 88162 - RNA, 18 nt, Human
aggugggaguggaggugg

SEQ ID NO: 88163 - RNA, 25 nt, Human
auagaacaacaaaaaaagggcagag

SEQ ID NO: 88164 - RNA, 23 nt, Human
aucccaaggcgcagaccagacuc

SEQ ID NO: 88165 - RNA, 19 nt, Human
caacccucccaccaacccc

SEQ ID NO: 88166 - RNA, 22 nt, Human
caccagcagugggcauggaccc

SEQ ID NO: 88167 - RNA, 25 nt, Human
cacccccugccccagcauuuggcac

SEQ ID NO: 88168 - RNA, 19 nt, Human
caccugcggcgucccgcuu

SEQ ID NO: 88169 - RNA, 24 nt, Human
caccuggagaggugagggggcacu

SEQ ID NO: 88170 - RNA, 22 nt, Human
cacgcacgcccccgaaggacac

SEQ ID NO: 88171 - RNA, 23 nt, Human
cacgcccccgaaggacacagcug

SEQ ID NO: 88172 - RNA, 21 nt, Human
cacuacaguuacacgcacgcc

SEQ ID NO: 88173 - RNA, 20 nt, Human
cacugguggcuagggguggg

SEQ ID NO: 88174 - RNA, 23 nt, Human
cacuugaacaguucggaggugag

SEQ ID NO: 88175 - RNA, 19 nt, Human
cagcucagauuagaggcag

SEQ ID NO: 88176 - RNA, 22 nt, Human
cagcugaggcaggguccccccc

SEQ ID NO: 88177 - RNA, 23 nt, Human
caggccgggugcacauggacacc

SEQ ID NO: 88178 - RNA, 19 nt, Human
caguggcauguggucccac

SEQ ID NO: 88179 - RNA, 22 nt, Human
caucugagccccaucacuauau

SEQ ID NO: 88180 - RNA, 19 nt, Human
ccaccaaccccucgcccug

SEQ ID NO: 88181 - RNA, 26 nt, Human
ccagagccucucuccugcuaggaaag

SEQ ID NO: 88182 - RNA, 22 nt, Human
ccaggccgggugcacauggaca

SEQ ID NO: 88183 - RNA, 19 nt, Human
ccagucccccagcccaagg

SEQ ID NO: 88184 - RNA, 21 nt, Human
ccagucccccagcccaaggug

SEQ ID NO: 88185 - RNA, 21 nt, Human
ccauugagcaccugacuacac

SEQ ID NO: 88186 - RNA, 25 nt, Human
cccagccaggagagacaaagucacc

SEQ ID NO: 88187 - RNA, 20 nt, Human
cccaugggggcugccccaga

SEQ ID NO: 88188 - RNA, 24 nt, Human
ccccaucccaaggcgcagaccaga

SEQ ID NO: 88189 - RNA, 25 nt, Human
cccccagucccccagcccaagguug

SEQ ID NO: 88190 - RNA, 21 nt, Human
ccccccaacauaggcagccuc

SEQ ID NO: 88191 - RNA, 26 nt, Human
cccccgaaggacacagcuggcaucca

SEQ ID NO: 88192 - RNA, 21 nt, Human
cccccugccccagcauuuggc

SEQ ID NO: 88193 - RNA, 21 nt, Human
ccccuugcccucaguucccca

SEQ ID NO: 88194 - RNA, 22 nt, Human
cccucaguuccccacuggcccc

SEQ ID NO: 88195 - RNA, 19 nt, Human
ccgccgccgccuucuccgc

SEQ ID NO: 88196 - RNA, 25 nt, Human
ccucccugucccaucccacuggggg

SEQ ID NO: 88197 - RNA, 21 nt, Human
ccucgcccuguguaaggcuuu

SEQ ID NO: 88198 - RNA, 21 nt, Human
ccucugcgggcugcgcugccc

SEQ ID NO: 88199 - RNA, 19 nt, Human
ccugaguguguaagggcca

SEQ ID NO: 88200 - RNA, 24 nt, Human
ccugucccaucccacuggggggag

SEQ ID NO: 88201 - RNA, 27 nt, Human
ccuuccuccacuauucucacagaaacc

SEQ ID NO: 88202 - RNA, 22 nt, Human
ccuugcccucaguuccccacug

SEQ ID NO: 88203 - RNA, 23 nt, Human
cggggagggggggcaguggcggc

SEQ ID NO: 88204 - RNA, 18 nt, Human
cgggucagcugaggcagg

SEQ ID NO: 88205 - RNA, 19 nt, Human
cuacacccaccccacccca

SEQ ID NO: 88206 - RNA, 19 nt, Human
cuaggggugggacagaggg

SEQ ID NO: 88207 - RNA, 24 nt, Human
cucucagggccuggccagcucagg

SEQ ID NO: 88208 - RNA, 23 nt, Human
cucuccuccgccgccgccuucuc

SEQ ID NO: 88209 - RNA, 22 nt, Human
cuggcccccaggcugggaugcc

SEQ ID NO: 88210 - RNA, 20 nt, Human
gaaaggugcaggcaguggca

SEQ ID NO: 88211 - RNA, 27 nt, Human
gaaauggccccccagucccccagccca

SEQ ID NO: 88212 - RNA, 18 nt, Human
gaaaugguuacaaugagc

SEQ ID NO: 88213 - RNA, 20 nt, Human
gacauucagcuuuagaaaug

SEQ ID NO: 88214 - RNA, 22 nt, Human
gagaaaugguuacaaugagcac

SEQ ID NO: 88215 - RNA, 23 nt, Human
gagaaggauuagacccagcuggg

SEQ ID NO: 88216 - RNA, 18 nt, Human
gagauagggagugggcac

SEQ ID NO: 88217 - RNA, 19 nt, Human
gagugggcacaggccugag

SEQ ID NO: 88218 - RNA, 24 nt, Human
gauagggagugggcacaggccuga

SEQ ID NO: 88219 - RNA, 20 nt, Human
gcaccagcagugggcaugga

SEQ ID NO: 88220 - RNA, 23 nt, Human
gcacuuggaggacacugguggcu

SEQ ID NO: 88221 - RNA, 24 nt, Human
gcagagaaaaggaaauggcccccc

SEQ ID NO: 88222 - RNA, 20 nt, Human
gcaggugccaacccucccac

SEQ ID NO: 88223 - RNA, 22 nt, Human
gcaguggcggcggcggcggcuu

SEQ ID NO: 88224 - RNA, 25 nt, Human
gccaacccucccaccaaccccucgc

SEQ ID NO: 88225 - RNA, 26 nt, Human
gccccagagccucucuccugcuagga

SEQ ID NO: 88226 - RNA, 20 nt, Human
gccucuccuccgccgccgcc

SEQ ID NO: 88227 - RNA, 20 nt, Human
gccucuccuccgccgccgcc

SEQ ID NO: 88228 - RNA, 19 nt, Human
gcgccgcggggaggggggg

SEQ ID NO: 88229 - RNA, 18 nt, Human
gcggcagcagaggccugg

SEQ ID NO: 88230 - RNA, 20 nt, Human
gcggcggcggcggcggcggc

SEQ ID NO: 88231 - RNA, 23 nt, Human
gcggcggcggcggcggcgggguu

SEQ ID NO: 88232 - RNA, 18 nt, Human
gcggcggcggcggcgggg

SEQ ID NO: 88233 - RNA, 23 nt, Human
gcggggaguguggggcaggaggg

SEQ ID NO: 88234 - RNA, 23 nt, Human
gcuaggggugggacagaggguuc

SEQ ID NO: 88235 - RNA, 21 nt, Human
ggaaaggcgaagaggccgggu

SEQ ID NO: 88236 - RNA, 23 nt, Human
ggagugugcaggugccaacccuc

SEQ ID NO: 88237 - RNA, 25 nt, Human
ggcaggagggugggaaagggggacc

SEQ ID NO: 88238 - RNA, 19 nt, Human
ggcggcggcggcggcggcg

SEQ ID NO: 88239 - RNA, 20 nt, Human
ggcggcggcggcggcggcgg

SEQ ID NO: 88240 - RNA, 23 nt, Human
ggcggcggcggcggcggcggcgg

SEQ ID NO: 88241 - RNA, 18 nt, Human
ggcggcgggguugggggg

SEQ ID NO: 88242 - RNA, 21 nt, Human
ggcgguaacucggccucuccu

SEQ ID NO: 88243 - RNA, 24 nt, Human
ggcuaggggugggacagaggguuc

SEQ ID NO: 88244 - RNA, 20 nt, Human
gggaaggagauagggagugg

SEQ ID NO: 88245 - RNA, 22 nt, Human
gggaaggagauagggagugggc

SEQ ID NO: 88246 - RNA, 22 nt, Human
gggaguggaggugggguggggc

SEQ ID NO: 88247 - RNA, 21 nt, Human
gggcagagaggccgggucagc

SEQ ID NO: 88248 - RNA, 19 nt, Human
gggcaguggcggcggcggc

SEQ ID NO: 88249 - RNA, 18 nt, Human
gggcgcgggcggcgggcg

SEQ ID NO: 88250 - RNA, 22 nt, Human
gggcggcagcagaggccugguu

SEQ ID NO: 88251 - RNA, 28 nt, Human
gggggcaguggcggcggcggcggcgggg

SEQ ID NO: 88252 - RNA, 24 nt, Human
gggggcaguggcggcggcggcggg

SEQ ID NO: 88253 - RNA, 19 nt, Human
gggugaggugggaguggag

SEQ ID NO: 88254 - RNA, 18 nt, Human
ggguugggggggcgcggg

SEQ ID NO: 88255 - RNA, 18 nt, Human
gguggggcagagaggccg

SEQ ID NO: 88256 - RNA, 22 nt, Human
gguggugagcaggagauggagu

SEQ ID NO: 88257 - RNA, 20 nt, Human
guggcggcggcggcggcggc

SEQ ID NO: 88258 - RNA, 20 nt, Human
guggcggcggcggcggcggc

SEQ ID NO: 88259 - RNA, 23 nt, Human
guggcggcggcggcggcggcggc

SEQ ID NO: 88260 - RNA, 18 nt, Human
guggggcaggaggguggg

SEQ ID NO: 88261 - RNA, 21 nt, Human
gugugugugugugugugugug

SEQ ID NO: 88262 - RNA, 29 nt, Human
uaagccccuacacccaccccaccccauaa

SEQ ID NO: 88263 - RNA, 21 nt, Human
uaaggcaaagggugaugucug

SEQ ID NO: 88264 - RNA, 26 nt, Human
uagaacaacaaaaaaagggcagagaa

SEQ ID NO: 88265 - RNA, 18 nt, Human
uagaggcagguggugagc

SEQ ID NO: 88266 - RNA, 20 nt, Human
uaucacugugacuauccuga

SEQ ID NO: 88267 - RNA, 25 nt, Human
uauccugacaccuggugggcuuggg

SEQ ID NO: 88268 - RNA, 22 nt, Human
uauucuccauugagcaccugac

SEQ ID NO: 88269 - RNA, 18 nt, Human
ucacccccugccccagca

SEQ ID NO: 88270 - RNA, 19 nt, Human
ucacccucccccuccuccc

SEQ ID NO: 88271 - RNA, 25 nt, Human
ucagggccuggccagcucagguccu

SEQ ID NO: 88272 - RNA, 23 nt, Human
ucagugagggagggacgaggcuc

SEQ ID NO: 88273 - RNA, 22 nt, Human
uccacuauucucacagaaacca

SEQ ID NO: 88274 - RNA, 21 nt, Human
uccaggccgggugcacauggu

SEQ ID NO: 88275 - RNA, 23 nt, Human
uccuccgccgccgccuucuccgc

SEQ ID NO: 88276 - RNA, 24 nt, Human
ucggccucuccuccgccgccgccu

SEQ ID NO: 88277 - RNA, 23 nt, Human
ugacacuagugagaaaugguuac

SEQ ID NO: 88278 - RNA, 21 nt, Human
ugagaaagcgacaagcaacau

SEQ ID NO: 88279 - RNA, 21 nt, Human
ugagcaggagauggagugugc

SEQ ID NO: 88280 - RNA, 24 nt, Human
ugagcaggagauggagugugcagg

SEQ ID NO: 88281 - RNA, 19 nt, Human
ugaggugggaguggaggug

SEQ ID NO: 88282 - RNA, 22 nt, Human
ugaguguguaagggccagauug

SEQ ID NO: 88283 - RNA, 23 nt, Human
ugaguguguaagggccagauugg

SEQ ID NO: 88284 - RNA, 18 nt, Human
ugccccagagccucucuc

SEQ ID NO: 88285 - RNA, 18 nt, Human
ugccccagagccucucuc

SEQ ID NO: 88286 - RNA, 19 nt, Human
ugccccagagccucucucc

SEQ ID NO: 88287 - RNA, 22 nt, Human
ugccccagcauuuggcacuguu

SEQ ID NO: 88288 - RNA, 23 nt, Human
ugcccucaguuccccacuggccc

SEQ ID NO: 88289 - RNA, 21 nt, Human
uggacacccacccuggcacca

SEQ ID NO: 88290 - RNA, 19 nt, Human
uggaggugggguggggcag

SEQ ID NO: 88291 - RNA, 18 nt, Human
uggcaccagcagugggca

SEQ ID NO: 88292 - RNA, 20 nt, Human
uggcauguggucccacuggg

SEQ ID NO: 88293 - RNA, 22 nt, Human
uggccccccagucccccagccc

SEQ ID NO: 88294 - RNA, 24 nt, Human
uggccccccagucccccagcccaa

SEQ ID NO: 88295 - RNA, 18 nt, Human
uggcggcggcggcggcgg

SEQ ID NO: 88296 - RNA, 19 nt, Human
ugggaaaggcgaagaggcc

SEQ ID NO: 88297 - RNA, 25 nt, Human
ugggaaaggcgaagaggccggguga

SEQ ID NO: 88298 - RNA, 19 nt, Human
ugggaaggagauagggagu

SEQ ID NO: 88299 - RNA, 20 nt, Human
ugggaggaccagccaggcug

SEQ ID NO: 88300 - RNA, 21 nt, Human
ugggaggaccagccaggcugc

SEQ ID NO: 88301 - RNA, 20 nt, Human
ugggaugccuuugggggaaa

SEQ ID NO: 88302 - RNA, 20 nt, Human
ugggcuuggggauguggcug

SEQ ID NO: 88303 - RNA, 20 nt, Human
ugggcuuggggauguggcug

SEQ ID NO: 88304 - RNA, 19 nt, Human
uggggauuguuuugucugu

SEQ ID NO: 88305 - RNA, 21 nt, Human
ugggggcugccccagagccuc

SEQ ID NO: 88306 - RNA, 18 nt, Human
ugggugccaaacaccugc

SEQ ID NO: 88307 - RNA, 22 nt, Human
ugucgaaugugaguccaguuuc

SEQ ID NO: 88308 - RNA, 21 nt, Human
ugucugaacugguaucacugu

SEQ ID NO: 88309 - RNA, 18 nt, Human
ugugcgugugcccagugg

SEQ ID NO: 88310 - RNA, 18 nt, Human
ugugugugugugugugug

SEQ ID NO: 88311 - RNA, 18 nt, Human
ugugugugugugugugug

SEQ ID NO: 88312 - RNA, 18 nt, Human
ugugugugugugugugug

SEQ ID NO: 88313 - RNA, 18 nt, Human
ugugugugugugugugug

SEQ ID NO: 88314 - RNA, 20 nt, Human
ugugugugugugugugugug

SEQ ID NO: 88315 - RNA, 21 nt, Human
ugugugugugugugugugugu

SEQ ID NO: 88316 - RNA, 21 nt, Human
ugugugugugugugugugugu

SEQ ID NO: 88317 - RNA, 21 nt, Human
ugugugugugugugugugugu

SEQ ID NO: 88318 - RNA, 21 nt, Human
ugugugugugugugugugugu

SEQ ID NO: 88319 - RNA, 21 nt, Human
ugugugugugugugugugugu

SEQ ID NO: 88320 - RNA, 22 nt, Human
ugugugugugugugugugugug

SEQ ID NO: 88321 - RNA, 21 nt, Human
uguguguguguucagcaaggg

SEQ ID NO: 88322 - RNA, 20 nt, Human
uguguguguuugugcgugug

SEQ ID NO: 88323 - RNA, 22 nt, Human
uguuguuuuuccaacuugucug

SEQ ID NO: 88324 - RNA, 19 nt, Human
uuaagcugggaggcacagg

SEQ ID NO: 88325 - RNA, 24 nt, Human
uugggacuccccaucccaaggcgc

SEQ ID NO: 88326 - RNA, 21 nt, Human
uuuguaagccccuacacccac

SEQ ID NO: 88327 - RNA, 21 nt, Human
acuugcggucccauuucugau

SEQ ID NO: 88328 - RNA, 19 nt, Human
agaugcugaugguuggacu

SEQ ID NO: 88329 - RNA, 18 nt, Human
aggcccagagcuucaccc

SEQ ID NO: 88330 - RNA, 18 nt, Human
caccaaaagccgaggccc

SEQ ID NO: 88331 - RNA, 21 nt, Human
cagcaauggauuuuaucuccc

SEQ ID NO: 88332 - RNA, 22 nt, Human
ccaccaaaagccgaggcccaga

SEQ ID NO: 88333 - RNA, 23 nt, Human
ccccaccaaaagccgaggcccag

SEQ ID NO: 88334 - RNA, 21 nt, Human
cgcacaguuuaaaaucaugau

SEQ ID NO: 88335 - RNA, 25 nt, Human
cuaccacuugcggucccauuucuga

SEQ ID NO: 88336 - RNA, 20 nt, Human
cuugcggucccauuucugau

SEQ ID NO: 88337 - RNA, 21 nt, Human
guugcaccauauuuugguuca

SEQ ID NO: 88338 - RNA, 18 nt, Human
uacacaguuuuaaauugg

SEQ ID NO: 88339 - RNA, 19 nt, Human
uauuucuuuugcagaagcu

SEQ ID NO: 88340 - RNA, 23 nt, Human
ucaacauaucuuuaagaguuuau

SEQ ID NO: 88341 - RNA, 21 nt, Human
ucacaguuuauccaugauuua

SEQ ID NO: 88342 - RNA, 21 nt, Human
ucauguggcaaacucacauuu

SEQ ID NO: 88343 - RNA, 22 nt, Human
uccccaccaaaagccgaggccc

SEQ ID NO: 88344 - RNA, 24 nt, Human
uccccaccaaaagccgaggcccag

SEQ ID NO: 88345 - RNA, 19 nt, Human
ucuuuugcagaagcuggga

SEQ ID NO: 88346 - RNA, 21 nt, Human
uggaggccaucgauuucuucu

SEQ ID NO: 88347 - RNA, 25 nt, Human
ugguuggacuauauucaugucucgu

SEQ ID NO: 88348 - RNA, 26 nt, Human
uuagcagcaauggauuuuaucucccc

SEQ ID NO: 88349 - RNA, 21 nt, Human
aaacagaaucacgagaggcaa

SEQ ID NO: 88350 - RNA, 21 nt, Human
aagaaucuguggccuccuuuc

SEQ ID NO: 88351 - RNA, 19 nt, Human
aagccccccagaggagauc

SEQ ID NO: 88352 - RNA, 19 nt, Human
aagcugcaccccaccccca

SEQ ID NO: 88353 - RNA, 20 nt, Human
aaggagggagacagcgcccc

SEQ ID NO: 88354 - RNA, 21 nt, Human
acaaacagaaucacgagaggc

SEQ ID NO: 88355 - RNA, 20 nt, Human
acaaagaagcaggcuuggga

SEQ ID NO: 88356 - RNA, 22 nt, Human
acagagcagcaacagcagcagc

SEQ ID NO: 88357 - RNA, 25 nt, Human
acagagcagcaacagcagcagccaa

SEQ ID NO: 88358 - RNA, 21 nt, Human
acccagaacccuccccaagac

SEQ ID NO: 88359 - RNA, 18 nt, Human
accccacccccaggguag

SEQ ID NO: 88360 - RNA, 24 nt, Human
agacaggcaugaggugccaucccu

SEQ ID NO: 88361 - RNA, 26 nt, Human
agacagguaagugaaggggcucaggg

SEQ ID NO: 88362 - RNA, 26 nt, Human
agcaacagcagcagccaagcccccca

SEQ ID NO: 88363 - RNA, 24 nt, Human
aggaaggggcaggcagggugaggg

SEQ ID NO: 88364 - RNA, 19 nt, Human
aggcaaaggcugaggcaug

SEQ ID NO: 88365 - RNA, 21 nt, Human
aggcaaagggaugccccaggg

SEQ ID NO: 88366 - RNA, 24 nt, Human
aggcaaauacagagcagcaacagc

SEQ ID NO: 88367 - RNA, 24 nt, Human
aggcaagggauguuggaggccaag

SEQ ID NO: 88368 - RNA, 24 nt, Human
aggcaugaggugccaucccugagg

SEQ ID NO: 88369 - RNA, 20 nt, Human
aggcugaggcauggaggugg

SEQ ID NO: 88370 - RNA, 21 nt, Human
aggcugaggcauggagguggg

SEQ ID NO: 88371 - RNA, 25 nt, Human
aggcugaggcauggagguggggggu

SEQ ID NO: 88372 - RNA, 20 nt, Human
agggaccuuggaucuggggu

SEQ ID NO: 88373 - RNA, 19 nt, Human
aggggggaagggagggcag

SEQ ID NO: 88374 - RNA, 21 nt, Human
aggugcacagggauggggggc

SEQ ID NO: 88375 - RNA, 19 nt, Human
aggugggggguggggagca

SEQ ID NO: 88376 - RNA, 20 nt, Human
aggugggggguggggagcag

SEQ ID NO: 88377 - RNA, 18 nt, Human
aucucacccacugagcaa

SEQ ID NO: 88378 - RNA, 22 nt, Human
augaggcggaccagaguguucc

SEQ ID NO: 88379 - RNA, 24 nt, Human
augguaacaccaaagaaaccccaa

SEQ ID NO: 88380 - RNA, 23 nt, Human
caacagcagcagccaagcccccc

SEQ ID NO: 88381 - RNA, 24 nt, Human
caacagcagcagccaagcccccca

SEQ ID NO: 88382 - RNA, 24 nt, Human
caacagcagcagccaagcccccca

SEQ ID NO: 88383 - RNA, 27 nt, Human
caacagcagcagccaagccccccagag

SEQ ID NO: 88384 - RNA, 20 nt, Human
caaccccugggcaccauccc

SEQ ID NO: 88385 - RNA, 21 nt, Human
caaccccugggcaccauccca

SEQ ID NO: 88386 - RNA, 23 nt, Human
caagacaagcuccaugggguguc

SEQ ID NO: 88387 - RNA, 22 nt, Human
cacacucggcucucucuggccc

SEQ ID NO: 88388 - RNA, 23 nt, Human
cacccagaacccuccccaagaca

SEQ ID NO: 88389 - RNA, 21 nt, Human
cacccagcucggccuucggcu

SEQ ID NO: 88390 - RNA, 25 nt, Human
cacgggcaggccccaguccuuguug

SEQ ID NO: 88391 - RNA, 23 nt, Human
cacuccuggcucuagcaauacau

SEQ ID NO: 88392 - RNA, 18 nt, Human
cagaacccuccccaagac

SEQ ID NO: 88393 - RNA, 24 nt, Human
cagacagggaggggggaagggagg

SEQ ID NO: 88394 - RNA, 20 nt, Human
cagacgaugcugcaggaagc

SEQ ID NO: 88395 - RNA, 19 nt, Human
cagcaacagcagcagccaa

SEQ ID NO: 88396 - RNA, 19 nt, Human
cagcaacagcagcagccaa

SEQ ID NO: 88397 - RNA, 19 nt, Human
cagcacccgguccagccac

SEQ ID NO: 88398 - RNA, 19 nt, Human
cagcagccaagccccccag

SEQ ID NO: 88399 - RNA, 19 nt, Human
cagcuggggcuuaagggcu

SEQ ID NO: 88400 - RNA, 25 nt, Human
cagggcacaacaucuucaggcaccc

SEQ ID NO: 88401 - RNA, 18 nt, Human
caggugccuacgcugacg

SEQ ID NO: 88402 - RNA, 28 nt, Human
ccacccagaacccuccccaagacaagcu

SEQ ID NO: 88403 - RNA, 24 nt, Human
ccacccagcucggccuucggcugc

SEQ ID NO: 88404 - RNA, 25 nt, Human
ccacugagcaacauugagcuuccca

SEQ ID NO: 88405 - RNA, 22 nt, Human
ccagaacccuccccaagacaag

SEQ ID NO: 88406 - RNA, 20 nt, Human
ccaguacugcagcuugggag

SEQ ID NO: 88407 - RNA, 20 nt, Human
ccaucccacggguccucucc

SEQ ID NO: 88408 - RNA, 18 nt, Human
cccagcucggccuucggc

SEQ ID NO: 88409 - RNA, 24 nt, Human
cccagcucggccuucggcugccuc

SEQ ID NO: 88410 - RNA, 18 nt, Human
ccccuggggccucagggu

SEQ ID NO: 88411 - RNA, 21 nt, Human
cccgccgccggcccgcagccg

SEQ ID NO: 88412 - RNA, 20 nt, Human
cccucccgccgccggcccgc

SEQ ID NO: 88413 - RNA, 22 nt, Human
ccgacagcuggggcuuaagggc

SEQ ID NO: 88414 - RNA, 21 nt, Human
ccuaggggaguacagacaaau

SEQ ID NO: 88415 - RNA, 25 nt, Human
ccucccgccgccggcccgcagccgg

SEQ ID NO: 88416 - RNA, 22 nt, Human
ccugccagcuuccacccagaac

SEQ ID NO: 88417 - RNA, 18 nt, Human
ccugggguaggcaaaggc

SEQ ID NO: 88418 - RNA, 20 nt, Human
ccugggguaggcaaaggcug

SEQ ID NO: 88419 - RNA, 27 nt, Human
cgaaagcagcgcgcgcagccagcaccc

SEQ ID NO: 88420 - RNA, 23 nt, Human
cgcagccagcacccgguccagcc

SEQ ID NO: 88421 - RNA, 18 nt, Human
cgcugacgacuauguggc

SEQ ID NO: 88422 - RNA, 20 nt, Human
cuacuuguggagagacaggu

SEQ ID NO: 88423 - RNA, 20 nt, Human
cuccccucccgccgccggcc

SEQ ID NO: 88424 - RNA, 19 nt, Human
cucccgccgccggcccgca

SEQ ID NO: 88425 - RNA, 25 nt, Human
cuccuggcucuagcaauacaucuua

SEQ ID NO: 88426 - RNA, 18 nt, Human
cugcaccccacccccagg

SEQ ID NO: 88427 - RNA, 19 nt, Human
cugcaccccacccccaggg

SEQ ID NO: 88428 - RNA, 24 nt, Human
cugggacugcccaaggcacuccug

SEQ ID NO: 88429 - RNA, 22 nt, Human
cugggcccuggacguugccaug

SEQ ID NO: 88430 - RNA, 20 nt, Human
cugggggaagugaacauggg

SEQ ID NO: 88431 - RNA, 21 nt, Human
gaagcugcaccccacccccag

SEQ ID NO: 88432 - RNA, 21 nt, Human
gacaaagaagcaggcuuggga

SEQ ID NO: 88433 - RNA, 19 nt, Human
gacaagcuccauggggugu

SEQ ID NO: 88434 - RNA, 21 nt, Human
gacagcuggggcuuaagggcu

SEQ ID NO: 88435 - RNA, 19 nt, Human
gagaggggguaccaaggcc

SEQ ID NO: 88436 - RNA, 24 nt, Human
gagcugggaugguaacaccaaaga

SEQ ID NO: 88437 - RNA, 18 nt, Human
gaggggggaagggagggc

SEQ ID NO: 88438 - RNA, 20 nt, Human
gaggggggaagggagggcag

SEQ ID NO: 88439 - RNA, 23 nt, Human
gaggggguaccaaggccucuccu

SEQ ID NO: 88440 - RNA, 18 nt, Human
gaggugccaucccugagg

SEQ ID NO: 88441 - RNA, 18 nt, Human
gaugccccaggggagagg

SEQ ID NO: 88442 - RNA, 21 nt, Human
gcagcaggcaagggauguugg

SEQ ID NO: 88443 - RNA, 22 nt, Human
gcagccagcacccgguccagcc

SEQ ID NO: 88444 - RNA, 22 nt, Human
gcccgcagccgggcucccucag

SEQ ID NO: 88445 - RNA, 21 nt, Human
gccuuuggcucuacuugugga

SEQ ID NO: 88446 - RNA, 18 nt, Human
gcgcagccagcacccggu

SEQ ID NO: 88447 - RNA, 18 nt, Human
gcugaggcauggaggugg

SEQ ID NO: 88448 - RNA, 21 nt, Human
ggaggggggaagggagggcag

SEQ ID NO: 88449 - RNA, 22 nt, Human
ggaggggggaagggagggcagu

SEQ ID NO: 88450 - RNA, 20 nt, Human
ggcagccacaaaggacagga

SEQ ID NO: 88451 - RNA, 24 nt, Human
gggagaggggguaccaaggccucu

SEQ ID NO: 88452 - RNA, 22 nt, Human
gggcaggcagggugagggaccu

SEQ ID NO: 88453 - RNA, 19 nt, Human
ggggaagggagggcagugg

SEQ ID NO: 88454 - RNA, 18 nt, Human
ggggagaggggguaccaa

SEQ ID NO: 88455 - RNA, 18 nt, Human
ggggggcucagaugcaga

SEQ ID NO: 88456 - RNA, 18 nt, Human
ggguaucccccauccauc

SEQ ID NO: 88457 - RNA, 22 nt, Human
gguaagugaaggggcucagggc

SEQ ID NO: 88458 - RNA, 21 nt, Human
ggugugagccccucgcucccu

SEQ ID NO: 88459 - RNA, 19 nt, Human
guagagggugcuguaugcc

SEQ ID NO: 88460 - RNA, 18 nt, Human
gucuggaucucacccacu

SEQ ID NO: 88461 - RNA, 22 nt, Human
uacagacaaauauagacagaca

SEQ ID NO: 88462 - RNA, 18 nt, Human
uaccaaggccucuccugg

SEQ ID NO: 88463 - RNA, 23 nt, Human
ucagggcaguguggagcugggac

SEQ ID NO: 88464 - RNA, 21 nt, Human
uccacaacaggcagguaaaaa

SEQ ID NO: 88465 - RNA, 22 nt, Human
uccacacccaggugcacaggga

SEQ ID NO: 88466 - RNA, 23 nt, Human
uccacacccaggugcacagggau

SEQ ID NO: 88467 - RNA, 19 nt, Human
uccacccagaacccucccc

SEQ ID NO: 88468 - RNA, 22 nt, Human
uccacccagaacccuccccaag

SEQ ID NO: 88469 - RNA, 18 nt, Human
uccccuggcucagagccc

SEQ ID NO: 88470 - RNA, 20 nt, Human
ucccugaggcgggcacgggc

SEQ ID NO: 88471 - RNA, 21 nt, Human
uccgaggucccaaggcaaccc

SEQ ID NO: 88472 - RNA, 22 nt, Human
uccuuguuggcacacucggcuc

SEQ ID NO: 88473 - RNA, 19 nt, Human
ucucacccacugagcaaca

SEQ ID NO: 88474 - RNA, 24 nt, Human
ucucuggcccagcugggaugcugg

SEQ ID NO: 88475 - RNA, 20 nt, Human
ugacucagggcacaacaucu

SEQ ID NO: 88476 - RNA, 22 nt, Human
ugaggcgggcacgggcaggccc

SEQ ID NO: 88477 - RNA, 18 nt, Human
ugagggaccuuggaucug

SEQ ID NO: 88478 - RNA, 20 nt, Human
ugagggaggagagccccuua

SEQ ID NO: 88479 - RNA, 19 nt, Human
ugcagcuugggagaaggag

SEQ ID NO: 88480 - RNA, 22 nt, Human
ugccaaggcaaagggaugcccc

SEQ ID NO: 88481 - RNA, 19 nt, Human
uggagcugggacugcccaa

SEQ ID NO: 88482 - RNA, 18 nt, Human
uggagguggggggugggg

SEQ ID NO: 88483 - RNA, 19 nt, Human
uggagguggggggugggga

SEQ ID NO: 88484 - RNA, 24 nt, Human
uggaucucacccacugagcaacau

SEQ ID NO: 88485 - RNA, 25 nt, Human
uggcagcaggcaagggauguuggag

SEQ ID NO: 88486 - RNA, 19 nt, Human
uggcgaggacaaagaagca

SEQ ID NO: 88487 - RNA, 20 nt, Human
uggcgaggacaaagaagcag

SEQ ID NO: 88488 - RNA, 20 nt, Human
ugggagaggccgugggagcc

SEQ ID NO: 88489 - RNA, 18 nt, Human
ugggagccgaaagcagcg

SEQ ID NO: 88490 - RNA, 22 nt, Human
ugggaggaaggggcaggcaggg

SEQ ID NO: 88491 - RNA, 22 nt, Human
ugggaggaaggggcaggcaggg

SEQ ID NO: 88492 - RNA, 21 nt, Human
ugggaugcuggggaggggcag

SEQ ID NO: 88493 - RNA, 21 nt, Human
ugggcccuggacguugccaug

SEQ ID NO: 88494 - RNA, 22 nt, Human
uggggaggggcaggguugcugg

SEQ ID NO: 88495 - RNA, 26 nt, Human
uggggaggggcaggguugcugggccg

SEQ ID NO: 88496 - RNA, 20 nt, Human
uggguaucccccauccaucc

SEQ ID NO: 88497 - RNA, 23 nt, Human
uguggcgaggacaaagaagcagg

SEQ ID NO: 88498 - RNA, 22 nt, Human
uucccauugccuuuggcucuac

SEQ ID NO: 88499 - RNA, 20 nt, Human
uuccucccgccgugugcccc

SEQ ID NO: 88500 - RNA, 21 nt, Human
uuccugggguaggcaaaggcu

SEQ ID NO: 88501 - RNA, 23 nt, Human
aaaaaaaaaaaaaaacacaaaag

SEQ ID NO: 88502 - RNA, 32 nt, Human
aaaaaaaaaaaaaacacaaaagggcaaaagag

SEQ ID NO: 88503 - RNA, 22 nt, Human
aaaaaaaaaaaacacaaaaggg

SEQ ID NO: 88504 - RNA, 24 nt, Human
aaaaaaaaaaaacacaaaagggca

SEQ ID NO: 88505 - RNA, 25 nt, Human
aaaaaaaaaaacacaaaagggcaag

SEQ ID NO: 88506 - RNA, 23 nt, Human
aaaaaaaaaacacaaaagggcaa

SEQ ID NO: 88507 - RNA, 19 nt, Human
aaguggcagcuacccaaaa

SEQ ID NO: 88508 - RNA, 29 nt, Human
acuucaaaaaaaaaaaaaaaaaaacacaa

SEQ ID NO: 88509 - RNA, 21 nt, Human
agagggggcagaacgcaguca

SEQ ID NO: 88510 - RNA, 22 nt, Human
agcacuuacaaaagaaaaagua

SEQ ID NO: 88511 - RNA, 21 nt, Human
agguacaagcaagaaacagug

SEQ ID NO: 88512 - RNA, 22 nt, Human
caaccggaggacugcagccaua

SEQ ID NO: 88513 - RNA, 21 nt, Human
caaguggcagcuacccaaaac

SEQ ID NO: 88514 - RNA, 19 nt, Human
cacagccucgguccauuuc

SEQ ID NO: 88515 - RNA, 18 nt, Human
caccuggguggcaacaga

SEQ ID NO: 88516 - RNA, 21 nt, Human
cagaaauaacauuuacaaacu

SEQ ID NO: 88517 - RNA, 20 nt, Human
cagaguuaggacuguccaga

SEQ ID NO: 88518 - RNA, 21 nt, Human
cagaugccugcguauuaacgu

SEQ ID NO: 88519 - RNA, 21 nt, Human
cagcguguggcuucaccaagc

SEQ ID NO: 88520 - RNA, 18 nt, Human
caggaggccuacuccugc

SEQ ID NO: 88521 - RNA, 21 nt, Human
cauaccaggccaauuuaugua

SEQ ID NO: 88522 - RNA, 23 nt, Human
cauaccaggccaauuuauguagc

SEQ ID NO: 88523 - RNA, 21 nt, Human
cauaugauugcaguguagacc

SEQ ID NO: 88524 - RNA, 18 nt, Human
ccaccuucuacucccagg

SEQ ID NO: 88525 - RNA, 21 nt, Human
ccaugaaugaauaugcaaauc

SEQ ID NO: 88526 - RNA, 24 nt, Human
cccuguuugucuuuuuuugggggu

SEQ ID NO: 88527 - RNA, 25 nt, Human
ccuguuugucuuuuuuugggggugg

SEQ ID NO: 88528 - RNA, 21 nt, Human
cguauuaacguauuaaaaauu

SEQ ID NO: 88529 - RNA, 22 nt, Human
cugcacugugccuugucuucuc

SEQ ID NO: 88530 - RNA, 19 nt, Human
cugcaguacucugcuuuug

SEQ ID NO: 88531 - RNA, 24 nt, Human
cugcugcuguuuaugugacugcuu

SEQ ID NO: 88532 - RNA, 19 nt, Human
ggacuguccagaucgucag

SEQ ID NO: 88533 - RNA, 24 nt, Human
gucuuuuuuuggggguggggggcg

SEQ ID NO: 88534 - RNA, 23 nt, Human
uaacaucaccuggguggcaacag

SEQ ID NO: 88535 - RNA, 21 nt, Human
uaaggcaagacugaaucuguc

SEQ ID NO: 88536 - RNA, 23 nt, Human
uaaggcaagacugaaucuguccc

SEQ ID NO: 88537 - RNA, 23 nt, Human
uacauagaaaauagauucuaacu

SEQ ID NO: 88538 - RNA, 24 nt, Human
uacuccugcugcuguuuaugugac

SEQ ID NO: 88539 - RNA, 18 nt, Human
uagcacuuacaaaagaaa

SEQ ID NO: 88540 - RNA, 25 nt, Human
uauacaagacuucaaaaaaaaaaaa

SEQ ID NO: 88541 - RNA, 21 nt, Human
ucaaaaaaaaaaaaaaaaaaa

SEQ ID NO: 88542 - RNA, 21 nt, Human
ucaaaaaaaaaaaaaaaaaaa

SEQ ID NO: 88543 - RNA, 21 nt, Human
ucaaacaucugagugucuugc

SEQ ID NO: 88544 - RNA, 23 nt, Human
ucaaacaucugagugucuugcau

SEQ ID NO: 88545 - RNA, 24 nt, Human
ucaaacugauauauauauauauau

SEQ ID NO: 88546 - RNA, 22 nt, Human
ucaccaagcugcacugugccuu

SEQ ID NO: 88547 - RNA, 23 nt, Human
ucacuuagcuucugccuccuagg

SEQ ID NO: 88548 - RNA, 18 nt, Human
ucagaguuucuuggugac

SEQ ID NO: 88549 - RNA, 21 nt, Human
ucagccagagguacaagcaag

SEQ ID NO: 88550 - RNA, 22 nt, Human
ugaauaugcaaaucagaugccu

SEQ ID NO: 88551 - RNA, 25 nt, Human
ugagugucuugcauuucgcgacccu

SEQ ID NO: 88552 - RNA, 22 nt, Human
ugauauauauauauauauuaua

SEQ ID NO: 88553 - RNA, 23 nt, Human
ugcaguacucugcuuuugaaaag

SEQ ID NO: 88554 - RNA, 18 nt, Human
ugccuugucuucucguca

SEQ ID NO: 88555 - RNA, 24 nt, Human
uggggguggggggcguaauuugag

SEQ ID NO: 88556 - RNA, 23 nt, Human
ugucuuuuuuugggggugggggg

SEQ ID NO: 88557 - RNA, 24 nt, Human
uucaagcaacagcaauaauacaaa

SEQ ID NO: 88558 - RNA, 19 nt, Human
uucccaccuucuacuccca

SEQ ID NO: 88559 - RNA, 19 nt, Human
uugaaaagcaggaggccua

SEQ ID NO: 88560 - RNA, 22 nt, Human
uuuacaguagccauucucaacu

SEQ ID NO: 88561 - RNA, 21 nt, Human
uuuguucaaguggcagcuacc

SEQ ID NO: 88562 - RNA, 22 nt, Human
ugaguccugggcuagaagccgg

SEQ ID NO: 88563 - RNA, 19 nt, Human
agccaaguuaagaugauug

SEQ ID NO: 88564 - RNA, 25 nt, Human
caucuaauauccaucuagacucaag

SEQ ID NO: 88565 - RNA, 21 nt, Human
ggcggagggggcuggcccccg

SEQ ID NO: 88566 - RNA, 21 nt, Human
ggcuggcccccgaggcugggc

SEQ ID NO: 88567 - RNA, 22 nt, Human
uagcauaaaaugacagcagccc

SEQ ID NO: 88568 - RNA, 20 nt, Human
uauggcaaauugucaacaga

SEQ ID NO: 88569 - RNA, 20 nt, Human
uauggcaaauugucaacaga

SEQ ID NO: 88570 - RNA, 21 nt, Human
uauggcaaauugucaacagau

SEQ ID NO: 88571 - RNA, 24 nt, Human
uguuagccaaguuaagaugauugg

SEQ ID NO: 88572 - RNA, 23 nt, Human
acgcugggcucaccagagagggu

SEQ ID NO: 88573 - RNA, 20 nt, Human
agaaagagacaggcuggcua

SEQ ID NO: 88574 - RNA, 24 nt, Human
aggcgugggugcccugggcagggu

SEQ ID NO: 88575 - RNA, 18 nt, Human
aggcugguacagugggga

SEQ ID NO: 88576 - RNA, 23 nt, Human
cacggaacacccagcuggcaaac

SEQ ID NO: 88577 - RNA, 23 nt, Human
cagcuuaucagaggcugguacag

SEQ ID NO: 88578 - RNA, 19 nt, Human
caggggaaguugggccccu

SEQ ID NO: 88579 - RNA, 21 nt, Human
cauaaaggacaacuggaggca

SEQ ID NO: 88580 - RNA, 18 nt, Human
ccagcuggcaaacacagg

SEQ ID NO: 88581 - RNA, 18 nt, Human
ccggcggcugcgucuccu

SEQ ID NO: 88582 - RNA, 25 nt, Human
ccucugagcuccaggggaaguuggg

SEQ ID NO: 88583 - RNA, 21 nt, Human
ccugcaaacaccuguccaccu

SEQ ID NO: 88584 - RNA, 25 nt, Human
ccugcaauguucauaaaggacaacu

SEQ ID NO: 88585 - RNA, 19 nt, Human
ccugcggcagcccagagga

SEQ ID NO: 88586 - RNA, 22 nt, Human
ccugcuggcucugccuccccca

SEQ ID NO: 88587 - RNA, 21 nt, Human
cgaggcgugggugcccugggc

SEQ ID NO: 88588 - RNA, 28 nt, Human
cggcagcccagaggaacucagagagagg

SEQ ID NO: 88589 - RNA, 22 nt, Human
cucacgucuugcucuauuccca

SEQ ID NO: 88590 - RNA, 21 nt, Human
cucccccaacuguggccaggu

SEQ ID NO: 88591 - RNA, 24 nt, Human
cugagcuccaggggaaguugggcc

SEQ ID NO: 88592 - RNA, 19 nt, Human
gaacacccagcuggcaaac

SEQ ID NO: 88593 - RNA, 20 nt, Human
gagcaggguggggcuaaaau

SEQ ID NO: 88594 - RNA, 20 nt, Human
gccaaggaggggacgcuggg

SEQ ID NO: 88595 - RNA, 21 nt, Human
gggcaggguccggcggcugcg

SEQ ID NO: 88596 - RNA, 18 nt, Human
uauuucaagccacaguca

SEQ ID NO: 88597 - RNA, 18 nt, Human
ucccagggcuccuggaag

SEQ ID NO: 88598 - RNA, 22 nt, Human
ucccagggcuccuggaagccaa

SEQ ID NO: 88599 - RNA, 22 nt, Human
ucuccuagggcaggugacaagc

SEQ ID NO: 88600 - RNA, 22 nt, Human
ugcgacuguugcaggggggcag

SEQ ID NO: 88601 - RNA, 19 nt, Human
uugggccccugcaaacacc

SEQ ID NO: 88602 - RNA, 22 nt, Human
uuucaagccacagucagauucu

SEQ ID NO: 88603 - RNA, 19 nt, Human
aaaaaaagggagguaagaa

SEQ ID NO: 88604 - RNA, 24 nt, Human
aagaggcuugccuuuugagaucag

SEQ ID NO: 88605 - RNA, 21 nt, Human
aauuauaaagaucacacggga

SEQ ID NO: 88606 - RNA, 20 nt, Human
agagugugugugagggugca

SEQ ID NO: 88607 - RNA, 20 nt, Human
ccccgccccgccccgccccc

SEQ ID NO: 88608 - RNA, 22 nt, Human
cuaaagccaaaaaaaauaaaua

SEQ ID NO: 88609 - RNA, 21 nt, Human
ggagaguuauaaaaaaaggga

SEQ ID NO: 88610 - RNA, 23 nt, Human
gguaagaaagcucacggaaaaga

SEQ ID NO: 88611 - RNA, 18 nt, Human
guuuauauuuucccacau

SEQ ID NO: 88612 - RNA, 30 nt, Human
guuuuuuuuguuuuuuguuuuugcuuuugg

SEQ ID NO: 88613 - RNA, 18 nt, Human
uauaaacacccaaccgac

SEQ ID NO: 88614 - RNA, 25 nt, Human
uauauaaacacccaaccgacuucug

SEQ ID NO: 88615 - RNA, 20 nt, Human
uccccgccccgccccgcccc

SEQ ID NO: 88616 - RNA, 22 nt, Human
ucucuuuuuuugugugugugug

SEQ ID NO: 88617 - RNA, 18 nt, Human
ugcaguguuuuuuuuuua

SEQ ID NO: 88618 - RNA, 22 nt, Human
uggagaguuauaaaaaaaggga

SEQ ID NO: 88619 - RNA, 24 nt, Human
uguaugaauagagaauauggagag

SEQ ID NO: 88620 - RNA, 22 nt, Human
uguguguguuuuuuuguuuuuu

SEQ ID NO: 88621 - RNA, 19 nt, Human
uguguuuuuuuguuuuuug

SEQ ID NO: 88622 - RNA, 23 nt, Human
uguuauguuuuuucucuuuuuuu

SEQ ID NO: 88623 - RNA, 24 nt, Human
uguuuugcuucuuuguuccucuua

SEQ ID NO: 88624 - RNA, 19 nt, Human
uuccaguugcaguguuuuu

SEQ ID NO: 88625 - RNA, 19 nt, Human
uucuuuguuccucuuauau

SEQ ID NO: 88626 - RNA, 26 nt, Human
uuguuuuuuguuuuuuuguuuuuuuu

SEQ ID NO: 88627 - RNA, 24 nt, Human
uuguuuuuuuuguuuuuuguuuuu

SEQ ID NO: 88628 - RNA, 24 nt, Human
uuuauauuuucccacauuuccugu

SEQ ID NO: 88629 - RNA, 21 nt, Human
uuuccuguuguuuugcuucuu

SEQ ID NO: 88630 - RNA, 22 nt, Human
uuuccuguuguuuugcuucuuu

SEQ ID NO: 88631 - RNA, 20 nt, Human
uuugagaucagaaacuguuc

SEQ ID NO: 88632 - RNA, 19 nt, Human
uuugcuucuuuguuccucu

SEQ ID NO: 88633 - RNA, 23 nt, Human
uuuuguuuuuuguuuuugcuuuu

SEQ ID NO: 88634 - RNA, 21 nt, Human
uuuuuguuuuuuguuuuugcu

SEQ ID NO: 88635 - RNA, 24 nt, Human
uuuuuuuguuuuuuguuuuugcuu

SEQ ID NO: 88636 - RNA, 22 nt, Human
uuuuuuuguuuuuuuuguuuuu

SEQ ID NO: 88637 - RNA, 19 nt, Human
aaaaagaagacccgaaaga

SEQ ID NO: 88638 - RNA, 21 nt, Human
aaacccagagaggucucugug

SEQ ID NO: 88639 - RNA, 18 nt, Human
aaagacgaggguccgugc

SEQ ID NO: 88640 - RNA, 20 nt, Human
aaagcucuccgccugcuccc

SEQ ID NO: 88641 - RNA, 24 nt, Human
aaaguuagagaggauggagggguu

SEQ ID NO: 88642 - RNA, 23 nt, Human
aacaucuggcacagauacacaga

SEQ ID NO: 88643 - RNA, 22 nt, Human
aaccucagagacaucucuguac

SEQ ID NO: 88644 - RNA, 21 nt, Human
acaucuuugauuucuggucau

SEQ ID NO: 88645 - RNA, 24 nt, Human
acauuaagggauuggcuugaaaag

SEQ ID NO: 88646 - RNA, 18 nt, Human
agacaauggggacaacua

SEQ ID NO: 88647 - RNA, 21 nt, Human
agacccgaaagaccgagucuu

SEQ ID NO: 88648 - RNA, 22 nt, Human
aggaagaaaggaaaacaucugg

SEQ ID NO: 88649 - RNA, 18 nt, Human
aggaaggguuaaggaaag

SEQ ID NO: 88650 - RNA, 23 nt, Human
aggcaaaaccuuuaauaacauga

SEQ ID NO: 88651 - RNA, 21 nt, Human
aggcaaagaaacccagagagg

SEQ ID NO: 88652 - RNA, 23 nt, Human
agggacuuugggaaagcugggau

SEQ ID NO: 88653 - RNA, 19 nt, Human
aguaaagaaggaagaaagg

SEQ ID NO: 88654 - RNA, 21 nt, Human
agucagcgcccuggcuccugg

SEQ ID NO: 88655 - RNA, 20 nt, Human
aguccuggggcgggggccgg

SEQ ID NO: 88656 - RNA, 18 nt, Human
auccccccuggccaccag

SEQ ID NO: 88657 - RNA, 21 nt, Human
aucuggcacagauacacagag

SEQ ID NO: 88658 - RNA, 19 nt, Human
caaacuggagaaaagacaa

SEQ ID NO: 88659 - RNA, 21 nt, Human
caaagaaacccagagaggucu

SEQ ID NO: 88660 - RNA, 20 nt, Human
caaggcaaagaaacccagag

SEQ ID NO: 88661 - RNA, 18 nt, Human
cacagagagaggaaugac

SEQ ID NO: 88662 - RNA, 26 nt, Human
cacagccccgggagacucaaggcaaa

SEQ ID NO: 88663 - RNA, 21 nt, Human
cacccccgcucaaacuggaga

SEQ ID NO: 88664 - RNA, 19 nt, Human
caccggcagcucuggagac

SEQ ID NO: 88665 - RNA, 24 nt, Human
caccggcagcucuggagacggcuc

SEQ ID NO: 88666 - RNA, 19 nt, Human
cacugcugggaggcgagcc

SEQ ID NO: 88667 - RNA, 21 nt, Human
ccaccaccugugacuuuuagu

SEQ ID NO: 88668 - RNA, 18 nt, Human
ccccccuggccaccaccu

SEQ ID NO: 88669 - RNA, 25 nt, Human
cccccgcucaaacuggagaaaagac

SEQ ID NO: 88670 - RNA, 19 nt, Human
cccgcccuucccccguucc

SEQ ID NO: 88671 - RNA, 20 nt, Human
cccugggucgccuauggccc

SEQ ID NO: 88672 - RNA, 20 nt, Human
cccuucccccguuccuuccc

SEQ ID NO: 88673 - RNA, 23 nt, Human
ccgccuccgucgucuuaacgccu

SEQ ID NO: 88674 - RNA, 18 nt, Human
ccucaccccgcccuuccc

SEQ ID NO: 88675 - RNA, 21 nt, Human
ccuccgucgucuuaacgccua

SEQ ID NO: 88676 - RNA, 19 nt, Human
ccugggcggugguugguuu

SEQ ID NO: 88677 - RNA, 18 nt, Human
ccuggggcgggggccggc

SEQ ID NO: 88678 - RNA, 21 nt, Human
cgcccgggcuagaaacccggg

SEQ ID NO: 88679 - RNA, 19 nt, Human
cgcccuggcuccugggcgc

SEQ ID NO: 88680 - RNA, 19 nt, Human
cggauggcaaaaaauagca

SEQ ID NO: 88681 - RNA, 19 nt, Human
cgugcagggcauggcuccg

SEQ ID NO: 88682 - RNA, 21 nt, Human
cgugugcugggggugagggcg

SEQ ID NO: 88683 - RNA, 21 nt, Human
cuaaagggucuuucuucccuc

SEQ ID NO: 88684 - RNA, 21 nt, Human
cucaaggcaaagaaacccaga

SEQ ID NO: 88685 - RNA, 21 nt, Human
cugacaucuuugauuucuggu

SEQ ID NO: 88686 - RNA, 20 nt, Human
cugcacaccgccgcccgggc

SEQ ID NO: 88687 - RNA, 21 nt, Human
cugcucccgacacccccgcuc

SEQ ID NO: 88688 - RNA, 23 nt, Human
cugggcguggggcagaggucaga

SEQ ID NO: 88689 - RNA, 24 nt, Human
cuggggguuggagggggagaguca

SEQ ID NO: 88690 - RNA, 20 nt, Human
gaaaaagaagacccgaaaga

SEQ ID NO: 88691 - RNA, 23 nt, Human
gaaauccccccuggccaccaccu

SEQ ID NO: 88692 - RNA, 20 nt, Human
gacaauggggacaacuauga

SEQ ID NO: 88693 - RNA, 20 nt, Human
gacacccccgcucaaacugg

SEQ ID NO: 88694 - RNA, 22 nt, Human
gacuuugggaaagcugggauuu

SEQ ID NO: 88695 - RNA, 18 nt, Human
gagcugccagcucgguuu

SEQ ID NO: 88696 - RNA, 18 nt, Human
gauucggaaauccccccu

SEQ ID NO: 88697 - RNA, 21 nt, Human
gcaaagaaacccagagagguc

SEQ ID NO: 88698 - RNA, 19 nt, Human
gccuguugccccgccuccg

SEQ ID NO: 88699 - RNA, 18 nt, Human
gcuaaagggucuuucuuc

SEQ ID NO: 88700 - RNA, 23 nt, Human
gcucaaacuggagaaaagacaga

SEQ ID NO: 88701 - RNA, 19 nt, Human
ggaaaaagaagacccgaaa

SEQ ID NO: 88702 - RNA, 20 nt, Human
ggagaaaagacagaguccug

SEQ ID NO: 88703 - RNA, 21 nt, Human
ggagcgugguaaagacgaggg

SEQ ID NO: 88704 - RNA, 22 nt, Human
ggcgcucccucagcacccaccc

SEQ ID NO: 88705 - RNA, 23 nt, Human
ggcgggggccggcugguuucccu

SEQ ID NO: 88706 - RNA, 20 nt, Human
gggcagaggucagaggucag

SEQ ID NO: 88707 - RNA, 19 nt, Human
gggcgcugcagcacgaccc

SEQ ID NO: 88708 - RNA, 18 nt, Human
ggggagcgaagcccguag

SEQ ID NO: 88709 - RNA, 21 nt, Human
gguuucauucuuuguaaaaag

SEQ ID NO: 88710 - RNA, 26 nt, Human
guaaaguccucuuccaaggagggaag

SEQ ID NO: 88711 - RNA, 19 nt, Human
gugaaugccucccucaggg

SEQ ID NO: 88712 - RNA, 20 nt, Human
gugcgagcgcgugugcuggg

SEQ ID NO: 88713 - RNA, 21 nt, Human
gugugugcgugcgugcgugug

SEQ ID NO: 88714 - RNA, 20 nt, Human
gugugugugugugugugugu

SEQ ID NO: 88715 - RNA, 25 nt, Human
uaaaggcaccggcagcucuggagac

SEQ ID NO: 88716 - RNA, 22 nt, Human
uaagggauuggcuugaaaaguu

SEQ ID NO: 88717 - RNA, 21 nt, Human
uagagaggauggagggguuag

SEQ ID NO: 88718 - RNA, 19 nt, Human
uagcugcuucggggcucug

SEQ ID NO: 88719 - RNA, 21 nt, Human
uaggaaggguuaaggaaaggg

SEQ ID NO: 88720 - RNA, 22 nt, Human
uaguaaaguccucuuccaagga

SEQ ID NO: 88721 - RNA, 18 nt, Human
ucaagcccacucuccgcg

SEQ ID NO: 88722 - RNA, 18 nt, Human
ucagcacccacccaacgc

SEQ ID NO: 88723 - RNA, 22 nt, Human
uccaaggagggaagaaugugga

SEQ ID NO: 88724 - RNA, 19 nt, Human
ucccccguuccuucccggg

SEQ ID NO: 88725 - RNA, 22 nt, Human
ucccucaccccgcccuuccccc

SEQ ID NO: 88726 - RNA, 21 nt, Human
ucccugggucgccuauggccc

SEQ ID NO: 88727 - RNA, 19 nt, Human
uccuggggcgggggccggc

SEQ ID NO: 88728 - RNA, 20 nt, Human
ucuauggcucgcuuaggcgg

SEQ ID NO: 88729 - RNA, 23 nt, Human
ucucuccaguucccugggucgcc

SEQ ID NO: 88730 - RNA, 18 nt, Human
ucugugugagugugugug

SEQ ID NO: 88731 - RNA, 18 nt, Human
ugagaagaguguucacug

SEQ ID NO: 88732 - RNA, 22 nt, Human
ugaggggaaaaugugggagagg

SEQ ID NO: 88733 - RNA, 25 nt, Human
ugagugugugugugugugugugugg

SEQ ID NO: 88734 - RNA, 22 nt, Human
ugcgccuggcuucucacagccc

SEQ ID NO: 88735 - RNA, 18 nt, Human
ugcucccgacacccccgc

SEQ ID NO: 88736 - RNA, 18 nt, Human
ugcugggaggcgagccgc

SEQ ID NO: 88737 - RNA, 18 nt, Human
ugcuucggggcucugaca

SEQ ID NO: 88738 - RNA, 18 nt, Human
uggagcccauuggggaaa

SEQ ID NO: 88739 - RNA, 21 nt, Human
uggcgcucccucagcacccac

SEQ ID NO: 88740 - RNA, 18 nt, Human
uggggcgggggccggcug

SEQ ID NO: 88741 - RNA, 20 nt, Human
uggggcgggggccggcugga

SEQ ID NO: 88742 - RNA, 18 nt, Human
uggggguuggagggggag

SEQ ID NO: 88743 - RNA, 24 nt, Human
uggggguuggagggggagagucag

SEQ ID NO: 88744 - RNA, 22 nt, Human
uggugccgaagggacagcuccc

SEQ ID NO: 88745 - RNA, 22 nt, Human
uggugcugaagggacagcuccc

SEQ ID NO: 88746 - RNA, 19 nt, Human
ugugcgagcgcgugugcug

SEQ ID NO: 88747 - RNA, 21 nt, Human
ugugcgugcgugcgugugugu

SEQ ID NO: 88748 - RNA, 18 nt, Human
ugugcugggggugagggc

SEQ ID NO: 88749 - RNA, 22 nt, Human
ugugugagugugugugugugug

SEQ ID NO: 88750 - RNA, 18 nt, Human
ugugugcgagcgcgugug

SEQ ID NO: 88751 - RNA, 22 nt, Human
ugugugcgugcgugcgugugug

SEQ ID NO: 88752 - RNA, 24 nt, Human
ugugugcgugcgugcgugugugug

SEQ ID NO: 88753 - RNA, 19 nt, Human
ugugugugugugcgugcgu

SEQ ID NO: 88754 - RNA, 20 nt, Human
ugugugugugugcgugcgug

SEQ ID NO: 88755 - RNA, 22 nt, Human
ugugugugugugcgugcgugcg

SEQ ID NO: 88756 - RNA, 18 nt, Human
ugugugugugugugugug

SEQ ID NO: 88757 - RNA, 19 nt, Human
ugugugugugugugugugc

SEQ ID NO: 88758 - RNA, 19 nt, Human
ugugugugugugugugugu

SEQ ID NO: 88759 - RNA, 21 nt, Human
ugugugugugugugugugugc

SEQ ID NO: 88760 - RNA, 24 nt, Human
ugugugugugugugugugugcgug

SEQ ID NO: 88761 - RNA, 18 nt, Human
uuaaggaaaggggaaggg

SEQ ID NO: 88762 - RNA, 26 nt, Human
uucggaaauccccccuggccaccacc

SEQ ID NO: 88763 - RNA, 21 nt, Human
uucuggagcucucuccaguuc

SEQ ID NO: 88764 - RNA, 24 nt, Human
uugaaaaguuagagaggauggagg

SEQ ID NO: 88765 - RNA, 26 nt, Human
uugaaaaguuagagaggauggagggg

SEQ ID NO: 88766 - RNA, 28 nt, Human
uugaaaaguuagagaggauggagggguu

SEQ ID NO: 88767 - RNA, 19 nt, Human
aaaacaugggcccccgagc

SEQ ID NO: 88768 - RNA, 19 nt, Human
aaagaagacggggcccaga

SEQ ID NO: 88769 - RNA, 22 nt, Human
aaagagggagagccgaguccug

SEQ ID NO: 88770 - RNA, 19 nt, Human
aaaggauaaggggacagga

SEQ ID NO: 88771 - RNA, 22 nt, Human
aaccccacaccccagcuacccc

SEQ ID NO: 88772 - RNA, 18 nt, Human
aaccgcacccggagcugc

SEQ ID NO: 88773 - RNA, 19 nt, Human
aacucccacccaagacccc

SEQ ID NO: 88774 - RNA, 24 nt, Human
aagaacuuggcaaagaagacgggg

SEQ ID NO: 88775 - RNA, 20 nt, Human
aagacccccugaccucaucc

SEQ ID NO: 88776 - RNA, 20 nt, Human
aagcaacccacauacagcca

SEQ ID NO: 88777 - RNA, 21 nt, Human
acagagaaaaacguauuuaca

SEQ ID NO: 88778 - RNA, 23 nt, Human
acagagaaaaacguauuuacaga

SEQ ID NO: 88779 - RNA, 18 nt, Human
accccagcuaccccauca

SEQ ID NO: 88780 - RNA, 23 nt, Human
accccaucagguccccgccaguc

SEQ ID NO: 88781 - RNA, 19 nt, Human
acccuucgcuaucuccccc

SEQ ID NO: 88782 - RNA, 19 nt, Human
agaaaaacguauuuacaga

SEQ ID NO: 88783 - RNA, 24 nt, Human
agccggcgaagggccucgaggggc

SEQ ID NO: 88784 - RNA, 30 nt, Human
agccucuucccaucccacccccaagcaacc

SEQ ID NO: 88785 - RNA, 22 nt, Human
agcggccuggggucuugaaggg

SEQ ID NO: 88786 - RNA, 18 nt, Human
agggaccugagguccugu

SEQ ID NO: 88787 - RNA, 22 nt, Human
aucccacccccaagcaacccac

SEQ ID NO: 88788 - RNA, 22 nt, Human
caaaccuuuaaucccaaaucag

SEQ ID NO: 88789 - RNA, 21 nt, Human
caaccccacaccccagcuacc

SEQ ID NO: 88790 - RNA, 25 nt, Human
caagcaacccacauacagccacaga

SEQ ID NO: 88791 - RNA, 24 nt, Human
cacauacagccacagagaaaaacg

SEQ ID NO: 88792 - RNA, 26 nt, Human
cacccccaagcaacccacauacagcc

SEQ ID NO: 88793 - RNA, 19 nt, Human
cacccugagguuuagagau

SEQ ID NO: 88794 - RNA, 22 nt, Human
cacccugagguuuagagauaga

SEQ ID NO: 88795 - RNA, 22 nt, Human
caggaagggaccugagguccug

SEQ ID NO: 88796 - RNA, 19 nt, Human
caucccccaaccccacacc

SEQ ID NO: 88797 - RNA, 25 nt, Human
ccaaccccacaccccagcuacccca

SEQ ID NO: 88798 - RNA, 22 nt, Human
ccacauacagccacagagaaaa

SEQ ID NO: 88799 - RNA, 22 nt, Human
ccacauacagccacagagaaaa

SEQ ID NO: 88800 - RNA, 19 nt, Human
ccacccccaagcaacccac

SEQ ID NO: 88801 - RNA, 21 nt, Human
ccagacccuucgcuaucuccc

SEQ ID NO: 88802 - RNA, 24 nt, Human
ccagacccuucgcuaucuccccca

SEQ ID NO: 88803 - RNA, 22 nt, Human
ccaucccacccccaagcaaccc

SEQ ID NO: 88804 - RNA, 18 nt, Human
cccaagacccccugaccu

SEQ ID NO: 88805 - RNA, 28 nt, Human
cccaagacccccugaccucaucccccaa

SEQ ID NO: 88806 - RNA, 21 nt, Human
cccaagagcuccagaggaaug

SEQ ID NO: 88807 - RNA, 24 nt, Human
cccaagcaacccacauacagccac

SEQ ID NO: 88808 - RNA, 19 nt, Human
cccacauacagccacagag

SEQ ID NO: 88809 - RNA, 23 nt, Human
cccacauacagccacagagaaaa

SEQ ID NO: 88810 - RNA, 25 nt, Human
cccacccccaagcaacccacauaca

SEQ ID NO: 88811 - RNA, 31 nt, Human
cccacccccaagcaacccacauacagccacc

SEQ ID NO: 88812 - RNA, 23 nt, Human
cccagaggaaaaacaaggccccc

SEQ ID NO: 88813 - RNA, 20 nt, Human
cccagggcuggggaagccuc

SEQ ID NO: 88814 - RNA, 24 nt, Human
cccaucccacccccaagcaaccca

SEQ ID NO: 88815 - RNA, 21 nt, Human
ccccaaccccacaccccagcu

SEQ ID NO: 88816 - RNA, 26 nt, Human
ccccaaccccacaccccagcuacccc

SEQ ID NO: 88817 - RNA, 18 nt, Human
ccccaacucccacccaag

SEQ ID NO: 88818 - RNA, 25 nt, Human
ccccaagcaacccacauacagccac

SEQ ID NO: 88819 - RNA, 26 nt, Human
ccccagcuaccccaucagguccccgc

SEQ ID NO: 88820 - RNA, 21 nt, Human
cccccaaccccacaccccagc

SEQ ID NO: 88821 - RNA, 23 nt, Human
cccccaacucccacccaagaccc

SEQ ID NO: 88822 - RNA, 22 nt, Human
cccccaagagcuccagaggaau

SEQ ID NO: 88823 - RNA, 25 nt, Human
cccccaagagcuccagaggaaugag

SEQ ID NO: 88824 - RNA, 24 nt, Human
ccccugaccucaucccccaacccc

SEQ ID NO: 88825 - RNA, 18 nt, Human
ccgagcagggagaacaca

SEQ ID NO: 88826 - RNA, 21 nt, Human
ccgcacccggagcugcagaug

SEQ ID NO: 88827 - RNA, 22 nt, Human
ccggcaagugaaucgauccaga

SEQ ID NO: 88828 - RNA, 20 nt, Human
ccucgaggggcgggagcgag

SEQ ID NO: 88829 - RNA, 19 nt, Human
ccugaccucaucccccaac

SEQ ID NO: 88830 - RNA, 18 nt, Human
ccugcagcuccaaggggc

SEQ ID NO: 88831 - RNA, 20 nt, Human
cgaguccugucuggaaucuc

SEQ ID NO: 88832 - RNA, 21 nt, Human
cgcuaucucccccaaccgcac

SEQ ID NO: 88833 - RNA, 21 nt, Human
cggcaagugaaucgauccaga

SEQ ID NO: 88834 - RNA, 23 nt, Human
cucccccaaccgcacccggagcu

SEQ ID NO: 88835 - RNA, 21 nt, Human
cucuucccaucccacccccaa

SEQ ID NO: 88836 - RNA, 25 nt, Human
cuuggcaaagaagacggggcccaga

SEQ ID NO: 88837 - RNA, 20 nt, Human
gaagacggggcccagaggaa

SEQ ID NO: 88838 - RNA, 19 nt, Human
gacccccugaccucauccc

SEQ ID NO: 88839 - RNA, 19 nt, Human
gaccucaucccccaacccc

SEQ ID NO: 88840 - RNA, 21 nt, Human
gaccucaucccccaaccccac

SEQ ID NO: 88841 - RNA, 20 nt, Human
gaccugggaaaugaaggggc

SEQ ID NO: 88842 - RNA, 18 nt, Human
gagccucuucccauccca

SEQ ID NO: 88843 - RNA, 21 nt, Human
gaucacagcgaggccagaccc

SEQ ID NO: 88844 - RNA, 21 nt, Human
gcaaagaagacggggcccaga

SEQ ID NO: 88845 - RNA, 23 nt, Human
gcccgcugaagcucccugcagcu

SEQ ID NO: 88846 - RNA, 22 nt, Human
gccucgaggggcgggagcgagg

SEQ ID NO: 88847 - RNA, 21 nt, Human
ggaagggggaggaggcagagc

SEQ ID NO: 88848 - RNA, 20 nt, Human
ggccuggggucuugaagggg

SEQ ID NO: 88849 - RNA, 21 nt, Human
ggccuggggucuugaaggggg

SEQ ID NO: 88850 - RNA, 21 nt, Human
gggcccccaacucccacccaa

SEQ ID NO: 88851 - RNA, 24 nt, Human
gggguucccuugggcucagaguuu

SEQ ID NO: 88852 - RNA, 22 nt, Human
gggucgggaagggggaggaggc

SEQ ID NO: 88853 - RNA, 21 nt, Human
gggucuugaagggggugaggg

SEQ ID NO: 88854 - RNA, 19 nt, Human
guguaaaaaaacaugggcc

SEQ ID NO: 88855 - RNA, 23 nt, Human
guguaaaaaaacaugggcccccg

SEQ ID NO: 88856 - RNA, 18 nt, Human
uacaauggagaaggucaa

SEQ ID NO: 88857 - RNA, 19 nt, Human
ucccaucccacccccaagc

SEQ ID NO: 88858 - RNA, 19 nt, Human
uccccagggcuggggaagc

SEQ ID NO: 88859 - RNA, 24 nt, Human
uccccagggcuggggaagccucug

SEQ ID NO: 88860 - RNA, 19 nt, Human
ucccccaaccccacacccc

SEQ ID NO: 88861 - RNA, 19 nt, Human
ucccccaaccgcacccgga

SEQ ID NO: 88862 - RNA, 22 nt, Human
ucgcuaucucccccaaccgcac

SEQ ID NO: 88863 - RNA, 25 nt, Human
ucucccggcaagugaaucgauccag

SEQ ID NO: 88864 - RNA, 24 nt, Human
ugaaagagggagagccgaguccug

SEQ ID NO: 88865 - RNA, 22 nt, Human
ugaagcucccugcagcuccaag

SEQ ID NO: 88866 - RNA, 19 nt, Human
ugaccucaucccccaaccc

SEQ ID NO: 88867 - RNA, 21 nt, Human
ugagcaccccacuagggcuaa

SEQ ID NO: 88868 - RNA, 21 nt, Human
ugagggacucaguuuccccug

SEQ ID NO: 88869 - RNA, 22 nt, Human
ugagguccuguguguguuugga

SEQ ID NO: 88870 - RNA, 24 nt, Human
ugagguuuagagauagaauucggc

SEQ ID NO: 88871 - RNA, 23 nt, Human
uggaaucucaaaugcgaaagucg

SEQ ID NO: 88872 - RNA, 26 nt, Human
ugggguacccaggaagggagggaguc

SEQ ID NO: 88873 - RNA, 25 nt, Human
ugggguucagaagagaaaaaugauc

SEQ ID NO: 88874 - RNA, 19 nt, Human
ugggguucagaggaggguc

SEQ ID NO: 88875 - RNA, 23 nt, Human
ugucuggaaucucaaaugcgaaa

SEQ ID NO: 88876 - RNA, 18 nt, Human
uucagaagagaaaaauga

SEQ ID NO: 88877 - RNA, 23 nt, Human
uuccaaaccuuuaaucccaaauc

SEQ ID NO: 88878 - RNA, 24 nt, Human
uuuccugagagaucugagcacccc

SEQ ID NO: 88879 - RNA, 20 nt, Human
uuugcaaagagccucuuccc

SEQ ID NO: 88880 - RNA, 24 nt, Human
uuugcaaagagccucuucccaucc

SEQ ID NO: 88881 - RNA, 23 nt, Human
uuuuuuuaaauuuccaaaccuuu

SEQ ID NO: 88882 - RNA, 18 nt, Human
aaccugcucuccagccca

SEQ ID NO: 88883 - RNA, 19 nt, Human
aagggagaagaggaugguc

SEQ ID NO: 88884 - RNA, 22 nt, Human
accuucaggaagcagaaaagag

SEQ ID NO: 88885 - RNA, 21 nt, Human
acugcaccggaggacccagca

SEQ ID NO: 88886 - RNA, 18 nt, Human
aggaagcagaaaagagcc

SEQ ID NO: 88887 - RNA, 18 nt, Human
aggaagcagaaaagagcc

SEQ ID NO: 88888 - RNA, 22 nt, Human
aggagucauuugggagugagag

SEQ ID NO: 88889 - RNA, 25 nt, Human
aggcagggaaaaaggaagcccaggu

SEQ ID NO: 88890 - RNA, 19 nt, Human
aggcagguaaccuucagga

SEQ ID NO: 88891 - RNA, 24 nt, Human
agggaaguaggggagauggggagg

SEQ ID NO: 88892 - RNA, 18 nt, Human
agguccgagguuggggag

SEQ ID NO: 88893 - RNA, 19 nt, Human
agucauuugggagugagag

SEQ ID NO: 88894 - RNA, 24 nt, Human
agugagagggaccaaugaaaagga

SEQ ID NO: 88895 - RNA, 20 nt, Human
auuaggcagggaaaaaggaa

SEQ ID NO: 88896 - RNA, 21 nt, Human
cagaaaagagcccagccggug

SEQ ID NO: 88897 - RNA, 21 nt, Human
ccccggggcugcggguggagc

SEQ ID NO: 88898 - RNA, 22 nt, Human
cccuaagacgaggaggaggagg

SEQ ID NO: 88899 - RNA, 20 nt, Human
ccucuggcugcucccagcuc

SEQ ID NO: 88900 - RNA, 20 nt, Human
cgaggaggaggaggaggcag

SEQ ID NO: 88901 - RNA, 22 nt, Human
cgccucuggcugcucccagcuc

SEQ ID NO: 88902 - RNA, 19 nt, Human
cggggcugcggguggagca

SEQ ID NO: 88903 - RNA, 19 nt, Human
cggugagaaagaaugggac

SEQ ID NO: 88904 - RNA, 25 nt, Human
cucagagcagguggagaacgaggga

SEQ ID NO: 88905 - RNA, 18 nt, Human
cucuggggagcugggcgc

SEQ ID NO: 88906 - RNA, 19 nt, Human
cugcccgaaccugcucucc

SEQ ID NO: 88907 - RNA, 23 nt, Human
gaaaagagggcgcggccauugaa

SEQ ID NO: 88908 - RNA, 20 nt, Human
gcauugcagggagacccccc

SEQ ID NO: 88909 - RNA, 20 nt, Human
gccggcccucccacugcacc

SEQ ID NO: 88910 - RNA, 21 nt, Human
gcggagccauugggaggaggg

SEQ ID NO: 88911 - RNA, 19 nt, Human
ggaaguaggggagaugggg

SEQ ID NO: 88912 - RNA, 24 nt, Human
ggaaguaggggagauggggaggga

SEQ ID NO: 88913 - RNA, 19 nt, Human
ggaggaggaggaggcaggg

SEQ ID NO: 88914 - RNA, 23 nt, Human
ggaggaggaggcagggggagcuc

SEQ ID NO: 88915 - RNA, 19 nt, Human
ggaggagggcggggccuaa

SEQ ID NO: 88916 - RNA, 22 nt, Human
ggaggagggcggggccuaaagc

SEQ ID NO: 88917 - RNA, 20 nt, Human
ggaggagucauuugggagug

SEQ ID NO: 88918 - RNA, 24 nt, Human
ggaggagucauuugggagugagag

SEQ ID NO: 88919 - RNA, 20 nt, Human
gggaaguaggggagaugggg

SEQ ID NO: 88920 - RNA, 20 nt, Human
gggcggagccauugggagga

SEQ ID NO: 88921 - RNA, 23 nt, Human
gggcggagccauugggaggaggg

SEQ ID NO: 88922 - RNA, 20 nt, Human
gggcgggccaacgaagggga

SEQ ID NO: 88923 - RNA, 20 nt, Human
gucccgaggacggaaggggg

SEQ ID NO: 88924 - RNA, 19 nt, Human
guggagcaagccggcccuc

SEQ ID NO: 88925 - RNA, 23 nt, Human
uaaccuucaggaagcagaaaaga

SEQ ID NO: 88926 - RNA, 21 nt, Human
ucccgaggacggaagggggcg

SEQ ID NO: 88927 - RNA, 25 nt, Human
ucccgaggacggaagggggcgcugc

SEQ ID NO: 88928 - RNA, 19 nt, Human
uccuccgggugggagcgag

SEQ ID NO: 88929 - RNA, 18 nt, Human
ugagagggaccaaugaaa

SEQ ID NO: 88930 - RNA, 27 nt, Human
uggagaggaggggccagaggaaagggg

SEQ ID NO: 88931 - RNA, 20 nt, Human
uggcuuccagcccccuuccc

SEQ ID NO: 88932 - RNA, 19 nt, Human
ugggagcgaggagucccga

SEQ ID NO: 88933 - RNA, 19 nt, Human
uugcaccgccucuggcugc

SEQ ID NO: 88934 - RNA, 21 nt, Human
agccggggggccgugggccac

SEQ ID NO: 88935 - RNA, 24 nt, Human
cacccccuucucgcaccagaggcc

SEQ ID NO: 88936 - RNA, 20 nt, Human
caccggggcagcgggggcgg

SEQ ID NO: 88937 - RNA, 21 nt, Human
cagcgcuucagcgacuccagu

SEQ ID NO: 88938 - RNA, 22 nt, Human
ccugcacccccuucucgcacca

SEQ ID NO: 88939 - RNA, 24 nt, Human
cucgcaccagaggccccgcucuuc

SEQ ID NO: 88940 - RNA, 21 nt, Human
cugcacccccuucucgcacca

SEQ ID NO: 88941 - RNA, 23 nt, Human
cugcacccccuucucgcaccaga

SEQ ID NO: 88942 - RNA, 23 nt, Human
ggacacgccccucggcucccccg

SEQ ID NO: 88943 - RNA, 18 nt, Human
gggcagcgggggcggggc

SEQ ID NO: 88944 - RNA, 18 nt, Human
aagggacagcucggcugu

SEQ ID NO: 88945 - RNA, 23 nt, Human
agagcuccaguccagagccugaa

SEQ ID NO: 88946 - RNA, 21 nt, Human
agcaucugaggccccaccccc

SEQ ID NO: 88947 - RNA, 18 nt, Human
cagagccugaaguguggu

SEQ ID NO: 88948 - RNA, 21 nt, Human
ccccagcaucugaggccccac

SEQ ID NO: 88949 - RNA, 18 nt, Human
ccccaugccagagagcuc

SEQ ID NO: 88950 - RNA, 22 nt, Human
cccccaugccagagagcuccag

SEQ ID NO: 88951 - RNA, 18 nt, Human
gaagauggggcagacugg

SEQ ID NO: 88952 - RNA, 19 nt, Human
gagcaaucuggauguccag

SEQ ID NO: 88953 - RNA, 20 nt, Human
gagcuccaguccagagccug

SEQ ID NO: 88954 - RNA, 22 nt, Human
ggaagggagcucagaggcgggg

SEQ ID NO: 88955 - RNA, 20 nt, Human
gggaagggagcucagaggcg

SEQ ID NO: 88956 - RNA, 18 nt, Human
ugccagagagcuccaguc

SEQ ID NO: 88957 - RNA, 23 nt, Human
ugccagagagcuccaguccagag

SEQ ID NO: 88958 - RNA, 23 nt, Human
ugggccuaaagagaagaggcuga

SEQ ID NO: 88959 - RNA, 22 nt, Human
uggggcagacugggccccagca

SEQ ID NO: 88960 - RNA, 22 nt, Human
aaaaaacaguguggaacaaaau

SEQ ID NO: 88961 - RNA, 24 nt, Human
aaaaacacaaagcagaucuaugug

SEQ ID NO: 88962 - RNA, 22 nt, Human
aaaagcaaaauaacauuuaaga

SEQ ID NO: 88963 - RNA, 21 nt, Human
aaaauaaaaacacaaagcaga

SEQ ID NO: 88964 - RNA, 19 nt, Human
aaacaguguggaacaaaau

SEQ ID NO: 88965 - RNA, 22 nt, Human
aaauaaaaacacaaagcagauc

SEQ ID NO: 88966 - RNA, 22 nt, Human
aaauagcucugcagcaaacccc

SEQ ID NO: 88967 - RNA, 23 nt, Human
aagaggagaaaacuuugacagaa

SEQ ID NO: 88968 - RNA, 20 nt, Human
aagcgcgaagggaggagggg

SEQ ID NO: 88969 - RNA, 19 nt, Human
acacuuccauaacuguagg

SEQ ID NO: 88970 - RNA, 26 nt, Human
agaaaauuccuaauggguuuaacuaa

SEQ ID NO: 88971 - RNA, 24 nt, Human
agaggagaaaacuuugacagaaga

SEQ ID NO: 88972 - RNA, 18 nt, Human
agauauaaaaaacagugu

SEQ ID NO: 88973 - RNA, 23 nt, Human
agccauccuuuuuuuuuuggcua

SEQ ID NO: 88974 - RNA, 22 nt, Human
aggcaaaagcaagauggaucca

SEQ ID NO: 88975 - RNA, 21 nt, Human
aguaaaugaaaggauggguua

SEQ ID NO: 88976 - RNA, 18 nt, Human
auaguacaugaaugaagc

SEQ ID NO: 88977 - RNA, 21 nt, Human
augacagauauaaaaaacagu

SEQ ID NO: 88978 - RNA, 22 nt, Human
caaaaugcaauguacaugacag

SEQ ID NO: 88979 - RNA, 20 nt, Human
caaugcauacauaguacaug

SEQ ID NO: 88980 - RNA, 19 nt, Human
cagcagacucuaggaccaa

SEQ ID NO: 88981 - RNA, 24 nt, Human
caguauuuaaagaauggugcucca

SEQ ID NO: 88982 - RNA, 18 nt, Human
caucuuauuauaaacaca

SEQ ID NO: 88983 - RNA, 23 nt, Human
cauuuaccaccaaugcauacaua

SEQ ID NO: 88984 - RNA, 21 nt, Human
cccaggucagggagcgagagc

SEQ ID NO: 88985 - RNA, 20 nt, Human
cgagccccgagcccgcagcc

SEQ ID NO: 88986 - RNA, 23 nt, Human
cucacauccauuuaccaccaaug

SEQ ID NO: 88987 - RNA, 21 nt, Human
cucagccucggccgccgcgac

SEQ ID NO: 88988 - RNA, 22 nt, Human
cugcagcaaaccccaggguugu

SEQ ID NO: 88989 - RNA, 18 nt, Human
cugcggcugcugaaggag

SEQ ID NO: 88990 - RNA, 20 nt, Human
gaagggaggaggggaaggga

SEQ ID NO: 88991 - RNA, 20 nt, Human
gaauguacuugauguacuug

SEQ ID NO: 88992 - RNA, 19 nt, Human
gaggaggggaagggagagg

SEQ ID NO: 88993 - RNA, 18 nt, Human
gccacaguuuuccacacu

SEQ ID NO: 88994 - RNA, 18 nt, Human
ggcgccuggggagcgggg

SEQ ID NO: 88995 - RNA, 21 nt, Human
ggcgcuggaggcagccgggga

SEQ ID NO: 88996 - RNA, 18 nt, Human
uaaaaaacaguguggaac

SEQ ID NO: 88997 - RNA, 23 nt, Human
uaacaacgacacaagggguucau

SEQ ID NO: 88998 - RNA, 23 nt, Human
uaaggcaaaagcaagauggaucc

SEQ ID NO: 88999 - RNA, 24 nt, Human
uaaggcaaaagcaagauggaucca

SEQ ID NO: 89000 - RNA, 23 nt, Human
uacaugacagauauaaaaaacag

SEQ ID NO: 89001 - RNA, 23 nt, Human
ucaaaaguuaauuguuggagacu

SEQ ID NO: 89002 - RNA, 21 nt, Human
ucaguggauaugaaggucauu

SEQ ID NO: 89003 - RNA, 21 nt, Human
uccacauacgugaaacagagu

SEQ ID NO: 89004 - RNA, 27 nt, Human
uccauaacuguaggcuuuauauaaggc

SEQ ID NO: 89005 - RNA, 23 nt, Human
uccccaggucagggagcgagagc

SEQ ID NO: 89006 - RNA, 25 nt, Human
ucuccaugaacaguauuuaaagaau

SEQ ID NO: 89007 - RNA, 18 nt, Human
ugaacaguauuuaaagaa

SEQ ID NO: 89008 - RNA, 23 nt, Human
ugaagcaucauugaucuuugcug

SEQ ID NO: 89009 - RNA, 25 nt, Human
ugacagauauaaaaaacagugugga

SEQ ID NO: 89010 - RNA, 25 nt, Human
ugcaaaagguggggggcgcuggagg

SEQ ID NO: 89011 - RNA, 24 nt, Human
ugcguccguggacucgaggugggc

SEQ ID NO: 89012 - RNA, 23 nt, Human
uggaaagaaauagcucugcagca

SEQ ID NO: 89013 - RNA, 21 nt, Human
uggggagcggggucucuggag

SEQ ID NO: 89014 - RNA, 23 nt, Human
uggggagcggggucucuggagcc

SEQ ID NO: 89015 - RNA, 19 nt, Human
uggggggcgcuggaggcag

SEQ ID NO: 89016 - RNA, 24 nt, Human
ugguauguagccauccuuuuuuuu

SEQ ID NO: 89017 - RNA, 23 nt, Human
uucaaaaaauaaaaauaaaaaca

SEQ ID NO: 89018 - RNA, 24 nt, Human
aaagaaaucuaaaaucaccaacug

SEQ ID NO: 89019 - RNA, 19 nt, Human
aagcugaaaagaaugagcc

SEQ ID NO: 89020 - RNA, 19 nt, Human
aauacagccuacucccuua

SEQ ID NO: 89021 - RNA, 18 nt, Human
acacgcuaaaggcaaagc

SEQ ID NO: 89022 - RNA, 20 nt, Human
acacgcuaaaggcaaagcca

SEQ ID NO: 89023 - RNA, 18 nt, Human
agaaacaagcugaaaaga

SEQ ID NO: 89024 - RNA, 18 nt, Human
agaaagaaaauccaggaa

SEQ ID NO: 89025 - RNA, 24 nt, Human
aguauagaaacaagcugaaaagaa

SEQ ID NO: 89026 - RNA, 22 nt, Human
aucaaagaaaucuaaaaucacc

SEQ ID NO: 89027 - RNA, 21 nt, Human
caacuauauuugugaaagcaa

SEQ ID NO: 89028 - RNA, 22 nt, Human
cacgcuaaaggcaaagccaauc

SEQ ID NO: 89029 - RNA, 25 nt, Human
cagaacgaucauuaacuccuaggca

SEQ ID NO: 89030 - RNA, 23 nt, Human
cagaauacacaaaaguauugaug

SEQ ID NO: 89031 - RNA, 19 nt, Human
caguuuagaaaauggauuu

SEQ ID NO: 89032 - RNA, 20 nt, Human
cauagaaucagacagauuua

SEQ ID NO: 89033 - RNA, 22 nt, Human
cauuccuccuaauaguuagaaa

SEQ ID NO: 89034 - RNA, 22 nt, Human
cguuucuguuuguucuugaggg

SEQ ID NO: 89035 - RNA, 21 nt, Human
cuaaaggcaaagccaaucucc

SEQ ID NO: 89036 - RNA, 20 nt, Human
cucaacaucauuuguugaaa

SEQ ID NO: 89037 - RNA, 19 nt, Human
cucagcucagcguuccucc

SEQ ID NO: 89038 - RNA, 24 nt, Human
cucauagcucccuguuucacaauc

SEQ ID NO: 89039 - RNA, 22 nt, Human
cucccuguuucacaaucaaaga

SEQ ID NO: 89040 - RNA, 20 nt, Human
cugcggagggagaccugggc

SEQ ID NO: 89041 - RNA, 20 nt, Human
cugcucagcucagcguuccu

SEQ ID NO: 89042 - RNA, 21 nt, Human
cuguuuguucuugagggaaac

SEQ ID NO: 89043 - RNA, 18 nt, Human
gaaagaaaauccaggaag

SEQ ID NO: 89044 - RNA, 18 nt, Human
gaaagcaagaauauguua

SEQ ID NO: 89045 - RNA, 24 nt, Human
gaacuauuuugaaugcugaucuca

SEQ ID NO: 89046 - RNA, 21 nt, Human
gauacaguguaucacuagcaa

SEQ ID NO: 89047 - RNA, 19 nt, Human
gcgcuguccucggugcugc

SEQ ID NO: 89048 - RNA, 21 nt, Human
ggaaaagcacauuccuccuaa

SEQ ID NO: 89049 - RNA, 27 nt, Human
ggaaauacaggcauagaaucagacaga

SEQ ID NO: 89050 - RNA, 19 nt, Human
gggcgcgggcgcugccggg

SEQ ID NO: 89051 - RNA, 22 nt, Human
ggggugugugucugggugugug

SEQ ID NO: 89052 - RNA, 20 nt, Human
ggugugugucugggugugug

SEQ ID NO: 89053 - RNA, 24 nt, Human
uaaauuuaaucagagauuacacag

SEQ ID NO: 89054 - RNA, 18 nt, Human
uaaauuuacagauauaaa

SEQ ID NO: 89055 - RNA, 18 nt, Human
uacaaacaguauagaaac

SEQ ID NO: 89056 - RNA, 18 nt, Human
uacccuugguggaaauga

SEQ ID NO: 89057 - RNA, 19 nt, Human
uagaaagaaaauccaggaa

SEQ ID NO: 89058 - RNA, 19 nt, Human
uagaauccacagaauacac

SEQ ID NO: 89059 - RNA, 23 nt, Human
uaguaaaaaauagaguuguuaua

SEQ ID NO: 89060 - RNA, 20 nt, Human
uauagaauggggacauucaa

SEQ ID NO: 89061 - RNA, 21 nt, Human
ucaaagaaaucuaaaaucacc

SEQ ID NO: 89062 - RNA, 23 nt, Human
ucaacuauaaccaguauaggaua

SEQ ID NO: 89063 - RNA, 19 nt, Human
uccacagaauacacaaaag

SEQ ID NO: 89064 - RNA, 20 nt, Human
uccacagaauacacaaaagu

SEQ ID NO: 89065 - RNA, 26 nt, Human
uccaggaaguaugcaaacuagacacc

SEQ ID NO: 89066 - RNA, 22 nt, Human
ucuguuuguucuugagggaaac

SEQ ID NO: 89067 - RNA, 20 nt, Human
ugaaauauagaauccacaga

SEQ ID NO: 89068 - RNA, 22 nt, Human
ugaaccgauaguuuuguaugga

SEQ ID NO: 89069 - RNA, 20 nt, Human
ugacccagaacgaucauuaa

SEQ ID NO: 89070 - RNA, 21 nt, Human
ugagggaaacauuauagcuca

SEQ ID NO: 89071 - RNA, 21 nt, Human
ugauugguaaacuaaaucugu

SEQ ID NO: 89072 - RNA, 20 nt, Human
ugcauuugcaaaucagagac

SEQ ID NO: 89073 - RNA, 22 nt, Human
uggaaauacaggcauagaauca

SEQ ID NO: 89074 - RNA, 24 nt, Human
uggaauuuuuagggaaaucuuguu

SEQ ID NO: 89075 - RNA, 21 nt, Human
uguaaauuucacauggacaca

SEQ ID NO: 89076 - RNA, 18 nt, Human
ugugugaauaugcgugug

SEQ ID NO: 89077 - RNA, 22 nt, Human
uguuggaaauacaggcauagaa

SEQ ID NO: 89078 - RNA, 23 nt, Human
uguuuuagaaucuucuugcuaga

SEQ ID NO: 89079 - RNA, 22 nt, Human
uuaugugucaucuggugcuccc

SEQ ID NO: 89080 - RNA, 25 nt, Human
uucacaaucaaagaaaucuaaaauc

SEQ ID NO: 89081 - RNA, 21 nt, Human
aaacaagaaacccaaagagaa

SEQ ID NO: 89082 - RNA, 19 nt, Human
aacaagaaacccaaagaga

SEQ ID NO: 89083 - RNA, 22 nt, Human
aagaaacccaaagagaaaagga

SEQ ID NO: 89084 - RNA, 24 nt, Human
aagccuaaaucauacagcgaggga

SEQ ID NO: 89085 - RNA, 21 nt, Human
accucagccugcaccgcuccc

SEQ ID NO: 89086 - RNA, 22 nt, Human
agacugccugggcagggguggg

SEQ ID NO: 89087 - RNA, 19 nt, Human
agagggaagaguccacucu

SEQ ID NO: 89088 - RNA, 24 nt, Human
agcgagagggaagaguccacucug

SEQ ID NO: 89089 - RNA, 20 nt, Human
agcuacaccauuggcaaggu

SEQ ID NO: 89090 - RNA, 19 nt, Human
aggcaaggaaagggcgggu

SEQ ID NO: 89091 - RNA, 20 nt, Human
aggggugggggcggggcgcu

SEQ ID NO: 89092 - RNA, 20 nt, Human
aggugguggauggaaccugg

SEQ ID NO: 89093 - RNA, 23 nt, Human
aucaccuuccaugugugugaucc

SEQ ID NO: 89094 - RNA, 24 nt, Human
aucucucguuuccugcucugcagg

SEQ ID NO: 89095 - RNA, 24 nt, Human
cacagcgaagagaauuagggaccc

SEQ ID NO: 89096 - RNA, 18 nt, Human
cagcagaagcaggguuug

SEQ ID NO: 89097 - RNA, 22 nt, Human
cagccccccagcugcccauccu

SEQ ID NO: 89098 - RNA, 21 nt, Human
cagcugcccauccucuaucuc

SEQ ID NO: 89099 - RNA, 23 nt, Human
cagcugcccauccucuaucucuc

SEQ ID NO: 89100 - RNA, 25 nt, Human
cagcugcccauccucuaucucucgu

SEQ ID NO: 89101 - RNA, 23 nt, Human
caggacagccccccagcugccca

SEQ ID NO: 89102 - RNA, 23 nt, Human
cauacagcgagggagcucaugca

SEQ ID NO: 89103 - RNA, 21 nt, Human
caucagggcagcagaagcagg

SEQ ID NO: 89104 - RNA, 19 nt, Human
cccaaagagaaaaggagca

SEQ ID NO: 89105 - RNA, 25 nt, Human
ccccaucaccuuccaugugugugau

SEQ ID NO: 89106 - RNA, 22 nt, Human
ccgcgccggcugggcucuggca

SEQ ID NO: 89107 - RNA, 18 nt, Human
cgcuccgcgccggcuggg

SEQ ID NO: 89108 - RNA, 27 nt, Human
cgggugccuuccacacacaggaguucu

SEQ ID NO: 89109 - RNA, 23 nt, Human
cucaugcaucacagcgaagagaa

SEQ ID NO: 89110 - RNA, 18 nt, Human
cuccacccaugcccccau

SEQ ID NO: 89111 - RNA, 19 nt, Human
cuccgcgccggcugggcuc

SEQ ID NO: 89112 - RNA, 27 nt, Human
cugagcaaagacugccugggcaggggu

SEQ ID NO: 89113 - RNA, 21 nt, Human
cugcaccgcucccgcuccgcg

SEQ ID NO: 89114 - RNA, 18 nt, Human
cugccugggcaggggugg

SEQ ID NO: 89115 - RNA, 19 nt, Human
cuguaggggugggggcggg

SEQ ID NO: 89116 - RNA, 19 nt, Human
gaagcagcccccgucccca

SEQ ID NO: 89117 - RNA, 20 nt, Human
gcaaggugguggauggaacc

SEQ ID NO: 89118 - RNA, 23 nt, Human
gcaggggugggugcagggggcuc

SEQ ID NO: 89119 - RNA, 21 nt, Human
ggauggaaccuggaaguuugg

SEQ ID NO: 89120 - RNA, 21 nt, Human
ggauggaaccuggaaguuugg

SEQ ID NO: 89121 - RNA, 20 nt, Human
ggcagaggggagcgagaggg

SEQ ID NO: 89122 - RNA, 22 nt, Human
ggcaggggugggugcagggggc

SEQ ID NO: 89123 - RNA, 18 nt, Human
gggacccuccacccaugc

SEQ ID NO: 89124 - RNA, 23 nt, Human
gggcagcagaagcaggguuuggg

SEQ ID NO: 89125 - RNA, 25 nt, Human
gggcagcagaagcaggguuuggggg

SEQ ID NO: 89126 - RNA, 21 nt, Human
gggcaggggugggugcagggg

SEQ ID NO: 89127 - RNA, 24 nt, Human
gggcaggggugggugcagggggcu

SEQ ID NO: 89128 - RNA, 22 nt, Human
gggugguggcaugggggaccgg

SEQ ID NO: 89129 - RNA, 19 nt, Human
gguagacgcaucagggcag

SEQ ID NO: 89130 - RNA, 18 nt, Human
gguggagaagcagccccc

SEQ ID NO: 89131 - RNA, 22 nt, Human
ggugggugcagggggcucagga

SEQ ID NO: 89132 - RNA, 24 nt, Human
uaaagaaggcaaggaaagggcggg

SEQ ID NO: 89133 - RNA, 24 nt, Human
uacaccauuggcaaggugguggau

SEQ ID NO: 89134 - RNA, 23 nt, Human
uagggacccuccacccaugcccc

SEQ ID NO: 89135 - RNA, 21 nt, Human
uccacccaugcccccaucacc

SEQ ID NO: 89136 - RNA, 21 nt, Human
ugagcaaagacugccugggca

SEQ ID NO: 89137 - RNA, 23 nt, Human
ugagcaaagacugccugggcagg

SEQ ID NO: 89138 - RNA, 19 nt, Human
ugcaccgcucccgcuccgc

SEQ ID NO: 89139 - RNA, 19 nt, Human
ugccugggcaggggugggu

SEQ ID NO: 89140 - RNA, 18 nt, Human
uggaaccuggaaguuugg

SEQ ID NO: 89141 - RNA, 20 nt, Human
uggaaccuggaaguuugggg

SEQ ID NO: 89142 - RNA, 24 nt, Human
ugggcaggggugggugcagggggc

SEQ ID NO: 89143 - RNA, 26 nt, Human
ugggcaggggugggugcagggggcuc

SEQ ID NO: 89144 - RNA, 18 nt, Human
ugggugcagggggcucag

SEQ ID NO: 89145 - RNA, 18 nt, Human
ugggugguggcauggggg

SEQ ID NO: 89146 - RNA, 22 nt, Human
ugguggauggaaccuggaaguu

SEQ ID NO: 89147 - RNA, 18 nt, Human
uguaggggugggggcggg

SEQ ID NO: 89148 - RNA, 19 nt, Human
ugugcaggcuguaggggug

SEQ ID NO: 89149 - RNA, 22 nt, Human
uuagggacccuccacccaugcc

SEQ ID NO: 89150 - RNA, 18 nt, Human
uuccacagcaggaccuuc

SEQ ID NO: 89151 - RNA, 25 nt, Human
uugguaaacaagaaacccaaagaga

SEQ ID NO: 89152 - RNA, 21 nt, Human
cacagcacaggcgcucuuccu

SEQ ID NO: 89153 - RNA, 20 nt, Human
cauaggauaagaccacagca

SEQ ID NO: 89154 - RNA, 21 nt, Human
cuccagugcucaggguucuau

SEQ ID NO: 89155 - RNA, 19 nt, Human
gauaagaccacagcacagg

SEQ ID NO: 89156 - RNA, 18 nt, Human
gcgcucuuccuccagugc

SEQ ID NO: 89157 - RNA, 24 nt, Human
gugaaacagcuagaagaaucaaag

SEQ ID NO: 89158 - RNA, 18 nt, Human
uaagaccacagcacaggc

SEQ ID NO: 89159 - RNA, 19 nt, Human
ugaaacagcuagaagaauc

SEQ ID NO: 89160 - RNA, 25 nt, Human
ugaaacagcuagaagaaucaaagag

SEQ ID NO: 89161 - RNA, 22 nt, Human
ugaaccucacagccaggacccu

SEQ ID NO: 89162 - RNA, 22 nt, Human
ugcccaauagugaaacagcuag

SEQ ID NO: 89163 - RNA, 24 nt, Human
uugggggauuccacauaggauaag

SEQ ID NO: 89164 - RNA, 24 nt, Human
aaagagccaccagagaggaaccaa

SEQ ID NO: 89165 - RNA, 23 nt, Human
aaaugaucagcacauucagaagc

SEQ ID NO: 89166 - RNA, 19 nt, Human
aaauuaggaaggaaaggga

SEQ ID NO: 89167 - RNA, 23 nt, Human
aagagccaccagagaggaaccaa

SEQ ID NO: 89168 - RNA, 26 nt, Human
aagagccaccagagaggaaccaaacc

SEQ ID NO: 89169 - RNA, 22 nt, Human
aagcaggacagaggagcucuga

SEQ ID NO: 89170 - RNA, 21 nt, Human
agacauccucugccacaagga

SEQ ID NO: 89171 - RNA, 19 nt, Human
agcaggacagaggagcucu

SEQ ID NO: 89172 - RNA, 23 nt, Human
agccaccagagaggaaccaaacc

SEQ ID NO: 89173 - RNA, 24 nt, Human
aggcgguggcagcggcggcggcgg

SEQ ID NO: 89174 - RNA, 18 nt, Human
augacaucucugggggac

SEQ ID NO: 89175 - RNA, 19 nt, Human
caaagagccaccagagagg

SEQ ID NO: 89176 - RNA, 24 nt, Human
caaagagccaccagagaggaacca

SEQ ID NO: 89177 - RNA, 27 nt, Human
caaagagccaccagagaggaaccaaac

SEQ ID NO: 89178 - RNA, 19 nt, Human
caaaugaucagcacauuca

SEQ ID NO: 89179 - RNA, 21 nt, Human
caggacagaggagcucugaug

SEQ ID NO: 89180 - RNA, 23 nt, Human
cccaaagagccaccagagaggaa

SEQ ID NO: 89181 - RNA, 20 nt, Human
ccucugccacaaggaaagcc

SEQ ID NO: 89182 - RNA, 19 nt, Human
ccugcucucuuuccuccca

SEQ ID NO: 89183 - RNA, 27 nt, Human
cugguauuuucccaggugauucucuuc

SEQ ID NO: 89184 - RNA, 23 nt, Human
cuuggaucagaggcgguggcagc

SEQ ID NO: 89185 - RNA, 18 nt, Human
gcucugaugacaucucug

SEQ ID NO: 89186 - RNA, 22 nt, Human
ggaaagccaccaauaccagccc

SEQ ID NO: 89187 - RNA, 20 nt, Human
ggaaggaugcaagaagggaa

SEQ ID NO: 89188 - RNA, 18 nt, Human
ggcagcggcggcggcggc

SEQ ID NO: 89189 - RNA, 19 nt, Human
ggcggcggcggcguccagc

SEQ ID NO: 89190 - RNA, 21 nt, Human
guccugcucucuuuccuccca

SEQ ID NO: 89191 - RNA, 20 nt, Human
guggcagcggcggcggcggc

SEQ ID NO: 89192 - RNA, 25 nt, Human
uauuuucccaggugauucucuucca

SEQ ID NO: 89193 - RNA, 23 nt, Human
ugauucucuuccaaccugugagu

SEQ ID NO: 89194 - RNA, 18 nt, Human
uggcagcggcggcggcgg

SEQ ID NO: 89195 - RNA, 18 nt, Human
aaacaaauguacccaaaa

SEQ ID NO: 89196 - RNA, 25 nt, Human
aaacaaauuauacaaucauguucuu

SEQ ID NO: 89197 - RNA, 18 nt, Human
aaacauguguaucuucca

SEQ ID NO: 89198 - RNA, 19 nt, Human
acaaggcacagcaucacca

SEQ ID NO: 89199 - RNA, 25 nt, Human
acagcaucaccauuaccaugugucc

SEQ ID NO: 89200 - RNA, 18 nt, Human
accaagguuuugaaacaa

SEQ ID NO: 89201 - RNA, 19 nt, Human
agcaaauauggaauuagcu

SEQ ID NO: 89202 - RNA, 21 nt, Human
agugacaaaggugcccuuuuu

SEQ ID NO: 89203 - RNA, 19 nt, Human
augagagaugccaucacuu

SEQ ID NO: 89204 - RNA, 19 nt, Human
auggcacaauauugacauu

SEQ ID NO: 89205 - RNA, 26 nt, Human
cacagcaucaccauuaccaugugucc

SEQ ID NO: 89206 - RNA, 19 nt, Human
cagaaauuaauagaaaugg

SEQ ID NO: 89207 - RNA, 22 nt, Human
cagcaaauauggaauuagcuua

SEQ ID NO: 89208 - RNA, 19 nt, Human
cagggcagcgcgagcggcc

SEQ ID NO: 89209 - RNA, 27 nt, Human
cagugauuucacgucccccuaagguuu

SEQ ID NO: 89210 - RNA, 18 nt, Human
ccaucacuuuuacuggac

SEQ ID NO: 89211 - RNA, 23 nt, Human
ccggucgacccgggaugaacacc

SEQ ID NO: 89212 - RNA, 22 nt, Human
cgacccgggaugaacaccacac

SEQ ID NO: 89213 - RNA, 23 nt, Human
gaaagaaccaguuugcuaccaga

SEQ ID NO: 89214 - RNA, 28 nt, Human
uaaacaaauuauacaaucauguucuuag

SEQ ID NO: 89215 - RNA, 18 nt, Human
uacauaagaaaacaaguu

SEQ ID NO: 89216 - RNA, 18 nt, Human
uaccauguguccucggag

SEQ ID NO: 89217 - RNA, 18 nt, Human
uagcuuauuuugcauuca

SEQ ID NO: 89218 - RNA, 19 nt, Human
uaugcuuuuaaucuugaug

SEQ ID NO: 89219 - RNA, 18 nt, Human
ucaguaucuuaggaugca

SEQ ID NO: 89220 - RNA, 19 nt, Human
ucuuaggaugcaaacaugu

SEQ ID NO: 89221 - RNA, 23 nt, Human
ugaaacaaauguacccaaaauau

SEQ ID NO: 89222 - RNA, 22 nt, Human
ugagagaugccaucacuuuuac

SEQ ID NO: 89223 - RNA, 18 nt, Human
ugcacagcaaauauggaa

SEQ ID NO: 89224 - RNA, 24 nt, Human
ugcacagcaaauauggaauuagcu

SEQ ID NO: 89225 - RNA, 24 nt, Human
uggaauuagcuuauuuugcauuca

SEQ ID NO: 89226 - RNA, 24 nt, Human
uguguaucuuccacggggcauucu

SEQ ID NO: 89227 - RNA, 20 nt, Human
uuaauagaaauggugaguuc

SEQ ID NO: 89228 - RNA, 24 nt, Human
uuucaugauaaccuucuuccugga

SEQ ID NO: 89229 - RNA, 20 nt, Human
aaaauuaaaaaucagaucca

SEQ ID NO: 89230 - RNA, 23 nt, Human
aaacaagcggucaaccacaaggg

SEQ ID NO: 89231 - RNA, 18 nt, Human
aaagggaguauugucuuc

SEQ ID NO: 89232 - RNA, 18 nt, Human
aagcauacaucuuccugc

SEQ ID NO: 89233 - RNA, 18 nt, Human
aauggacaaauucacuga

SEQ ID NO: 89234 - RNA, 20 nt, Human
acaagcauaagcauuucaca

SEQ ID NO: 89235 - RNA, 21 nt, Human
acaauggacaaauucacugaa

SEQ ID NO: 89236 - RNA, 21 nt, Human
agaugagacuggagauuugga

SEQ ID NO: 89237 - RNA, 21 nt, Human
aggcaguggcaaaauaugaca

SEQ ID NO: 89238 - RNA, 21 nt, Human
aguuaauuuuuuccccuccug

SEQ ID NO: 89239 - RNA, 19 nt, Human
auacauauacacaagcaua

SEQ ID NO: 89240 - RNA, 23 nt, Human
caaagcaacaguaccaagaauaa

SEQ ID NO: 89241 - RNA, 22 nt, Human
caagaaacaagcggucaaccac

SEQ ID NO: 89242 - RNA, 24 nt, Human
caagaaacaagcggucaaccacaa

SEQ ID NO: 89243 - RNA, 22 nt, Human
caagggcaagagguaaucugcu

SEQ ID NO: 89244 - RNA, 21 nt, Human
caauauauuaucacauuugua

SEQ ID NO: 89245 - RNA, 27 nt, Human
cacaacuaaaucacuucugaaaggcag

SEQ ID NO: 89246 - RNA, 20 nt, Human
cacuucugaaaggcaguggc

SEQ ID NO: 89247 - RNA, 18 nt, Human
caguggcaaaauaugaca

SEQ ID NO: 89248 - RNA, 24 nt, Human
cagugggagacuccauuccuagac

SEQ ID NO: 89249 - RNA, 18 nt, Human
ccaaaaccaagcugagca

SEQ ID NO: 89250 - RNA, 24 nt, Human
cuaauuagcccuccuggaucuucc

SEQ ID NO: 89251 - RNA, 18 nt, Human
cugaauaauucuucacaa

SEQ ID NO: 89252 - RNA, 22 nt, Human
cuggaaaagccugagcucuuuu

SEQ ID NO: 89253 - RNA, 18 nt, Human
cuugcagaggucacguag

SEQ ID NO: 89254 - RNA, 24 nt, Human
cuugcagaggucacguaguucaug

SEQ ID NO: 89255 - RNA, 24 nt, Human
cuuuacaacagcuagguccugccc

SEQ ID NO: 89256 - RNA, 22 nt, Human
gacaggcuuguccaaaaccaag

SEQ ID NO: 89257 - RNA, 18 nt, Human
gagacuggagauuuggag

SEQ ID NO: 89258 - RNA, 21 nt, Human
gccaaauacagaaauaaucua

SEQ ID NO: 89259 - RNA, 23 nt, Human
ggcaaaauaugacauagaugaga

SEQ ID NO: 89260 - RNA, 22 nt, Human
guuuucagcaaauugacucuaa

SEQ ID NO: 89261 - RNA, 26 nt, Human
uaaaaaaauuaaaaaucagauccaua

SEQ ID NO: 89262 - RNA, 21 nt, Human
uaaacaucagcaaccaaaaua

SEQ ID NO: 89263 - RNA, 22 nt, Human
uaauuaccaauauucaacaaau

SEQ ID NO: 89264 - RNA, 24 nt, Human
uacaauggacaaauucacugaaua

SEQ ID NO: 89265 - RNA, 20 nt, Human
uaccaagaauaacuuucuuc

SEQ ID NO: 89266 - RNA, 22 nt, Human
uaccaagaauaacuuucuucag

SEQ ID NO: 89267 - RNA, 20 nt, Human
uagaacaauacuacauaaca

SEQ ID NO: 89268 - RNA, 18 nt, Human
uagauucuuugugaccuc

SEQ ID NO: 89269 - RNA, 22 nt, Human
ucaaagcauacaucuuccugcc

SEQ ID NO: 89270 - RNA, 20 nt, Human
ucagcaaauugacucuaaau

SEQ ID NO: 89271 - RNA, 18 nt, Human
ucaggauuuucaaaaauc

SEQ ID NO: 89272 - RNA, 26 nt, Human
uccacaacuaaaucacuucugaaagg

SEQ ID NO: 89273 - RNA, 25 nt, Human
uccagaguuaaaaauaaaaauauug

SEQ ID NO: 89274 - RNA, 25 nt, Human
ucuuuacaacagcuagguccugccc

SEQ ID NO: 89275 - RNA, 19 nt, Human
ugaagcuggguggaaagca

SEQ ID NO: 89276 - RNA, 18 nt, Human
ugacauuugcaucucagu

SEQ ID NO: 89277 - RNA, 21 nt, Human
ugacauuugcaucucaguccu

SEQ ID NO: 89278 - RNA, 20 nt, Human
ugagaaacguuaaacaugaa

SEQ ID NO: 89279 - RNA, 18 nt, Human
ugauauguucgguuccug

SEQ ID NO: 89280 - RNA, 24 nt, Human
ugcaaauauacaucuuuuugcuuu

SEQ ID NO: 89281 - RNA, 18 nt, Human
ugcagugggagacuccau

SEQ ID NO: 89282 - RNA, 18 nt, Human
ugcauuacugugacauuu

SEQ ID NO: 89283 - RNA, 22 nt, Human
uggaaagcaguuaauggacuua

SEQ ID NO: 89284 - RNA, 22 nt, Human
uggacaggcuuguccaaaacca

SEQ ID NO: 89285 - RNA, 18 nt, Human
uggcaaacucucuuuaaa

SEQ ID NO: 89286 - RNA, 18 nt, Human
uggcaaacucucuuuaaa

SEQ ID NO: 89287 - RNA, 27 nt, Human
uguaaacaaaaauagaacaauacuaca

SEQ ID NO: 89288 - RNA, 21 nt, Human
uguuuuucuuugauacuuugc

SEQ ID NO: 89289 - RNA, 22 nt, Human
uuaaaugcauggucuuucuccc

SEQ ID NO: 89290 - RNA, 22 nt, Human
uuagcaauauauuaucacauuu

SEQ ID NO: 89291 - RNA, 25 nt, Human
uuuauaaauccuggaguuuagggga

SEQ ID NO: 89292 - RNA, 25 nt, Human
uuugaagaucucuuuguccuggaau

SEQ ID NO: 89293 - RNA, 22 nt, Human
uuuguaaacaaaaauagaacaa

SEQ ID NO: 89294 - RNA, 22 nt, Human
uuuguaccacagcugccagaaa

SEQ ID NO: 89295 - RNA, 19 nt, Human
uuuuaagcuuugaagcugg

SEQ ID NO: 89296 - RNA, 19 nt, Human
aaaaaaucagcccagauac

SEQ ID NO: 89297 - RNA, 19 nt, Human
aaaguugauugugcuuuuc

SEQ ID NO: 89298 - RNA, 25 nt, Human
aagaaaauaagaaauccuucauuga

SEQ ID NO: 89299 - RNA, 24 nt, Human
aagagugaaagcuuugcaauguga

SEQ ID NO: 89300 - RNA, 18 nt, Human
aauuucuuuuuacaaaau

SEQ ID NO: 89301 - RNA, 19 nt, Human
acaccagcucagaaaaguu

SEQ ID NO: 89302 - RNA, 23 nt, Human
acccacaagcaaggugggaaaga

SEQ ID NO: 89303 - RNA, 22 nt, Human
agacaggaagagguugacaagg

SEQ ID NO: 89304 - RNA, 18 nt, Human
aggaauucccucccacug

SEQ ID NO: 89305 - RNA, 22 nt, Human
auauugaagucuucuggcuaca

SEQ ID NO: 89306 - RNA, 21 nt, Human
auccuguucauccaguuucca

SEQ ID NO: 89307 - RNA, 21 nt, Human
caguagaaauggaagggcaaa

SEQ ID NO: 89308 - RNA, 19 nt, Human
cagugagacaaccauccuu

SEQ ID NO: 89309 - RNA, 19 nt, Human
cauagagaaaagaaagcca

SEQ ID NO: 89310 - RNA, 19 nt, Human
cccacaagcaaggugggaa

SEQ ID NO: 89311 - RNA, 21 nt, Human
cggcacucugggaaaaaaaaa

SEQ ID NO: 89312 - RNA, 18 nt, Human
cucugggaaaaaaaaaaa

SEQ ID NO: 89313 - RNA, 20 nt, Human
gcagaagagauuuacccaca

SEQ ID NO: 89314 - RNA, 24 nt, Human
uaaaaaaucagcccagauacagua

SEQ ID NO: 89315 - RNA, 20 nt, Human
uaaugauauagaaguaagau

SEQ ID NO: 89316 - RNA, 24 nt, Human
uaauggaguauuuacaagcucauu

SEQ ID NO: 89317 - RNA, 19 nt, Human
uaauuuguuuauacaguag

SEQ ID NO: 89318 - RNA, 19 nt, Human
uacaaaaaggacuacggca

SEQ ID NO: 89319 - RNA, 21 nt, Human
uagaaucaugcccaacaugua

SEQ ID NO: 89320 - RNA, 23 nt, Human
uagcaaucuuguuuuauagcaac

SEQ ID NO: 89321 - RNA, 26 nt, Human
uagcaaucuuucaaauauuguuuucu

SEQ ID NO: 89322 - RNA, 18 nt, Human
uagcagagcuugaugguc

SEQ ID NO: 89323 - RNA, 24 nt, Human
uaggagaagcaccaaacagugaga

SEQ ID NO: 89324 - RNA, 20 nt, Human
uauacaguagaaauggaagg

SEQ ID NO: 89325 - RNA, 22 nt, Human
uauacaguagaaauggaagggc

SEQ ID NO: 89326 - RNA, 18 nt, Human
uaucagauauuaacauac

SEQ ID NO: 89327 - RNA, 18 nt, Human
ucagauauuaacauacac

SEQ ID NO: 89328 - RNA, 22 nt, Human
ucagcccagauacaguaucaga

SEQ ID NO: 89329 - RNA, 21 nt, Human
uccugcaauuaggaugagauu

SEQ ID NO: 89330 - RNA, 24 nt, Human
ucuauaggcuaguauggguuuuua

SEQ ID NO: 89331 - RNA, 24 nt, Human
ucuauaggcuaguauggguuuuua

SEQ ID NO: 89332 - RNA, 22 nt, Human
ucugguauuguccauuugagaa

SEQ ID NO: 89333 - RNA, 20 nt, Human
uggaacuggcuuacaccagc

SEQ ID NO: 89334 - RNA, 27 nt, Human
ugggaaagagugaaagcuuugcaaugg

SEQ ID NO: 89335 - RNA, 19 nt, Human
uggugugcuggaacuggcu

SEQ ID NO: 89336 - RNA, 25 nt, Human
uguauuugauuugagacuauaaaau

SEQ ID NO: 89337 - RNA, 21 nt, Human
uuacaaaauuccaagaaaaua

SEQ ID NO: 89338 - RNA, 20 nt, Human
uuccaggggucaagacccag

SEQ ID NO: 89339 - RNA, 25 nt, Human
uugucaaguuguaguaguuuucuuu

SEQ ID NO: 89340 - RNA, 24 nt, Human
uuuaagaauuucuuaaauuccagg

SEQ ID NO: 89341 - RNA, 20 nt, Human
uuuagugguagcaaucuuuc

SEQ ID NO: 89342 - RNA, 18 nt, Human
uuuauacaguagaaaugg

SEQ ID NO: 89343 - RNA, 18 nt, Human
aaacaacaugacuucugu

SEQ ID NO: 89344 - RNA, 18 nt, Human
aaacaacaugacuucugu

SEQ ID NO: 89345 - RNA, 22 nt, Human
aaagaaauccacaaaacaacca

SEQ ID NO: 89346 - RNA, 18 nt, Human
aaagagcgaauuagcccu

SEQ ID NO: 89347 - RNA, 23 nt, Human
aaaucaguaccacugucagcuaa

SEQ ID NO: 89348 - RNA, 22 nt, Human
aacaguucuaaucucucuucuu

SEQ ID NO: 89349 - RNA, 24 nt, Human
aacaguucuaaucucucuucuuuu

SEQ ID NO: 89350 - RNA, 21 nt, Human
aaccaaccuaaaaaaucagua

SEQ ID NO: 89351 - RNA, 20 nt, Human
aacuccuucuaacaguucua

SEQ ID NO: 89352 - RNA, 25 nt, Human
aacuccuucuaacaguucuaaucuc

SEQ ID NO: 89353 - RNA, 19 nt, Human
aagcaggagcacagccaga

SEQ ID NO: 89354 - RNA, 19 nt, Human
aagcaggcgggcaggcagg

SEQ ID NO: 89355 - RNA, 23 nt, Human
acaaaacagagcgaauuagcccu

SEQ ID NO: 89356 - RNA, 22 nt, Human
acuaaagaaauccacaaaacaa

SEQ ID NO: 89357 - RNA, 20 nt, Human
acuuucaaaaaguguuacaa

SEQ ID NO: 89358 - RNA, 23 nt, Human
agaaauccacaaaacaaccaacc

SEQ ID NO: 89359 - RNA, 25 nt, Human
agaaauccacaaaacaaccaacccc

SEQ ID NO: 89360 - RNA, 22 nt, Human
aggcauugaaaacauauugaua

SEQ ID NO: 89361 - RNA, 24 nt, Human
aggcauugaaaacauauugauacc

SEQ ID NO: 89362 - RNA, 19 nt, Human
aggucaucaggcauugaaa

SEQ ID NO: 89363 - RNA, 22 nt, Human
aggucaucaggcauugaaaaca

SEQ ID NO: 89364 - RNA, 25 nt, Human
auuucaacuccuucuaacaguucua

SEQ ID NO: 89365 - RNA, 18 nt, Human
caaaacaaccaaccuaaa

SEQ ID NO: 89366 - RNA, 19 nt, Human
caaaacaaccaaccuaaaa

SEQ ID NO: 89367 - RNA, 21 nt, Human
caguauuucaaaucugaaaug

SEQ ID NO: 89368 - RNA, 21 nt, Human
caguauuucaaaucugaaaug

SEQ ID NO: 89369 - RNA, 25 nt, Human
cauggguuucuuuagaaacaggcuc

SEQ ID NO: 89370 - RNA, 24 nt, Human
ccacaaaacaaccaaccuaaaaaa

SEQ ID NO: 89371 - RNA, 18 nt, Human
cuaaagaaauccacaaaa

SEQ ID NO: 89372 - RNA, 24 nt, Human
cuacuaagauaauuucuuccaugc

SEQ ID NO: 89373 - RNA, 24 nt, Human
cuacuaagauaauuucuuccaugc

SEQ ID NO: 89374 - RNA, 24 nt, Human
cuguugacuucagaugugguuggu

SEQ ID NO: 89375 - RNA, 24 nt, Human
cuguugacuucagaugugguuggu

SEQ ID NO: 89376 - RNA, 22 nt, Human
cuuuuuuuuuuuaaagacaacc

SEQ ID NO: 89377 - RNA, 21 nt, Human
gcaaaggcaguacuuuuacca

SEQ ID NO: 89378 - RNA, 18 nt, Human
gcucguccugcgucuuga

SEQ ID NO: 89379 - RNA, 23 nt, Human
ggacuaagucggaaaggaaggac

SEQ ID NO: 89380 - RNA, 18 nt, Human
ggagcacagccagagagc

SEQ ID NO: 89381 - RNA, 20 nt, Human
uaaaaaaacaaaaacuacgg

SEQ ID NO: 89382 - RNA, 21 nt, Human
uaaagugcagaaacaacauga

SEQ ID NO: 89383 - RNA, 21 nt, Human
uaaagugcagaaacaacauga

SEQ ID NO: 89384 - RNA, 22 nt, Human
uaagucggaaaggaaggacuga

SEQ ID NO: 89385 - RNA, 18 nt, Human
uaccaugaacaucucuag

SEQ ID NO: 89386 - RNA, 24 nt, Human
uacuaaauauaauagucuagcaca

SEQ ID NO: 89387 - RNA, 22 nt, Human
uaugcacauacauacauaauug

SEQ ID NO: 89388 - RNA, 27 nt, Human
uaugcacauacauacauaauugaguua

SEQ ID NO: 89389 - RNA, 20 nt, Human
uaugcacauacauacauagu

SEQ ID NO: 89390 - RNA, 22 nt, Human
ucagguucagggagaccagaug

SEQ ID NO: 89391 - RNA, 24 nt, Human
ucaguaccacugucagcuaacaua

SEQ ID NO: 89392 - RNA, 30 nt, Human
ucuaaucucucuucuuuucaauacuuucuu

SEQ ID NO: 89393 - RNA, 22 nt, Human
ucucuagcugugauuauuaaau

SEQ ID NO: 89394 - RNA, 20 nt, Human
ucucucuucuuuucaauacu

SEQ ID NO: 89395 - RNA, 22 nt, Human
ucucucuucuuuucaauacuuu

SEQ ID NO: 89396 - RNA, 20 nt, Human
ucugaaacuucuucccgagg

SEQ ID NO: 89397 - RNA, 21 nt, Human
ucugaaauggguuacuuucaa

SEQ ID NO: 89398 - RNA, 21 nt, Human
ucugaaauggguuacuuucaa

SEQ ID NO: 89399 - RNA, 22 nt, Human
ucugguuggucaccaaucccug

SEQ ID NO: 89400 - RNA, 18 nt, Human
ucuuuucaauacuuucuu

SEQ ID NO: 89401 - RNA, 20 nt, Human
ucuuuuuuuuuuuaaagaca

SEQ ID NO: 89402 - RNA, 18 nt, Human
ugaaauggguuacuuuca

SEQ ID NO: 89403 - RNA, 22 nt, Human
ugaaauggguuacuuucaaaaa

SEQ ID NO: 89404 - RNA, 22 nt, Human
ugaaauggguuacuuucaaaaa

SEQ ID NO: 89405 - RNA, 20 nt, Human
ugaaauguuccaaugauacc

SEQ ID NO: 89406 - RNA, 20 nt, Human
ugaaucaucagcaugaaaaa

SEQ ID NO: 89407 - RNA, 22 nt, Human
ugacuucagaugugguugguau

SEQ ID NO: 89408 - RNA, 22 nt, Human
ugacuucagaugugguugguau

SEQ ID NO: 89409 - RNA, 18 nt, Human
ugagcuuggguucuuucu

SEQ ID NO: 89410 - RNA, 23 nt, Human
ugcaaaggcaguacuuuuaccau

SEQ ID NO: 89411 - RNA, 22 nt, Human
ugcucagauacagaguuaugau

SEQ ID NO: 89412 - RNA, 22 nt, Human
ugcucagauacagaguuaugau

SEQ ID NO: 89413 - RNA, 19 nt, Human
uggacaggucagcaaucag

SEQ ID NO: 89414 - RNA, 23 nt, Human
uguauauguguaugcacauacau

SEQ ID NO: 89415 - RNA, 19 nt, Human
uguguuuguauauguguau

SEQ ID NO: 89416 - RNA, 23 nt, Human
uguguuuguauauguguaugcac

SEQ ID NO: 89417 - RNA, 23 nt, Human
uuaccaugaacaucucuagcugu

SEQ ID NO: 89418 - RNA, 23 nt, Human
uuagaaaauuucaacuccuucua

SEQ ID NO: 89419 - RNA, 22 nt, Human
uucaaaaaguguuacaauugcc

SEQ ID NO: 89420 - RNA, 22 nt, Human
uucaaaaaguguuacaauugcc

SEQ ID NO: 89421 - RNA, 24 nt, Human
uucaacuccuucuaacaguucuaa

SEQ ID NO: 89422 - RNA, 19 nt, Human
uugagcuuggguucuuucu

SEQ ID NO: 89423 - RNA, 21 nt, Human
uuuuuuuuuuaaagacaacca

SEQ ID NO: 89424 - RNA, 23 nt, Human
aaaccagcuaugacaauuuauac

SEQ ID NO: 89425 - RNA, 22 nt, Human
aacauacacgggcaugccacca

SEQ ID NO: 89426 - RNA, 22 nt, Human
acacgaaguacaagaggaccag

SEQ ID NO: 89427 - RNA, 19 nt, Human
agaaugaauaaaugaacuu

SEQ ID NO: 89428 - RNA, 24 nt, Human
agaugcucccuugguaaauguuuc

SEQ ID NO: 89429 - RNA, 25 nt, Human
aggaagagcagagggagccgguacc

SEQ ID NO: 89430 - RNA, 23 nt, Human
caagagguaaguaaaagauucaa

SEQ ID NO: 89431 - RNA, 26 nt, Human
caauacaugcagauuuugugugugug

SEQ ID NO: 89432 - RNA, 18 nt, Human
caccaugggucggagcac

SEQ ID NO: 89433 - RNA, 24 nt, Human
caccaugggucggagcacacgaag

SEQ ID NO: 89434 - RNA, 18 nt, Human
cagacaacgcuaaaccaa

SEQ ID NO: 89435 - RNA, 23 nt, Human
caugcagauuuugugugugugga

SEQ ID NO: 89436 - RNA, 20 nt, Human
caugccaccaggguguguca

SEQ ID NO: 89437 - RNA, 21 nt, Human
ccacgacacucccagcaccac

SEQ ID NO: 89438 - RNA, 19 nt, Human
ccgccgccgccgccugcgc

SEQ ID NO: 89439 - RNA, 26 nt, Human
ccgccgccgccgccugcgccgccgcc

SEQ ID NO: 89440 - RNA, 27 nt, Human
ccgccgccgccgccugcgccgccgccu

SEQ ID NO: 89441 - RNA, 23 nt, Human
ccgccgccugcgccgccgccuga

SEQ ID NO: 89442 - RNA, 21 nt, Human
cgcuaugccgccgccgccgcc

SEQ ID NO: 89443 - RNA, 26 nt, Human
cgcugugcgcuaugccgccgccgccg

SEQ ID NO: 89444 - RNA, 22 nt, Human
cucaaucgucaagcugcaugca

SEQ ID NO: 89445 - RNA, 18 nt, Human
cugcuaaggcgcgcugug

SEQ ID NO: 89446 - RNA, 19 nt, Human
cugcugcugcugcugcugc

SEQ ID NO: 89447 - RNA, 27 nt, Human
cugugcgcuaugccgccgccgccgccu

SEQ ID NO: 89448 - RNA, 21 nt, Human
gaauuuguuuuuucauuuuuc

SEQ ID NO: 89449 - RNA, 18 nt, Human
gccagcccaaacagugua

SEQ ID NO: 89450 - RNA, 25 nt, Human
gccgccgccgccgccugcgccgccg

SEQ ID NO: 89451 - RNA, 18 nt, Human
gcuaaaccaacauacacg

SEQ ID NO: 89452 - RNA, 21 nt, Human
ggagcacacgaaguacaagag

SEQ ID NO: 89453 - RNA, 19 nt, Human
gggcaugccaccagggugu

SEQ ID NO: 89454 - RNA, 28 nt, Human
uaccuccgaugcugcugcugcugcugcc

SEQ ID NO: 89455 - RNA, 19 nt, Human
ugacaauuuauacuaaaca

SEQ ID NO: 89456 - RNA, 21 nt, Human
ugacagccugacaccuguuuc

SEQ ID NO: 89457 - RNA, 20 nt, Human
ugcuaaggcgcgcugugcgc

SEQ ID NO: 89458 - RNA, 18 nt, Human
ugcugcugcugcuaaggc

SEQ ID NO: 89459 - RNA, 21 nt, Human
ugcugcugcugcugcugcugc

SEQ ID NO: 89460 - RNA, 18 nt, Human
uggcugcaccagcgcggg

SEQ ID NO: 89461 - RNA, 19 nt, Human
uggcugcaccagcgcgggg

SEQ ID NO: 89462 - RNA, 19 nt, Human
uggcugcaccagcgcgggg

SEQ ID NO: 89463 - RNA, 22 nt, Human
uguggacagaagguacuuuuga

SEQ ID NO: 89464 - RNA, 24 nt, Human
aaugacaguaagauaagggaagaa

SEQ ID NO: 89465 - RNA, 24 nt, Human
acuuuaaaaaaggcauaacccagg

SEQ ID NO: 89466 - RNA, 18 nt, Human
agacgcgaccacacaacc

SEQ ID NO: 89467 - RNA, 19 nt, Human
agggaagaaaacauggagg

SEQ ID NO: 89468 - RNA, 22 nt, Human
caaaaaaauaguguacgaguac

SEQ ID NO: 89469 - RNA, 23 nt, Human
caaagaaaaggcaaauaaacaau

SEQ ID NO: 89470 - RNA, 20 nt, Human
caaguaacaauaaaagaaaa

SEQ ID NO: 89471 - RNA, 23 nt, Human
caauagugcaacuuuuaaguaca

SEQ ID NO: 89472 - RNA, 18 nt, Human
cucagcucgcucucucca

SEQ ID NO: 89473 - RNA, 24 nt, Human
gagacgcgaccacacaaccacuca

SEQ ID NO: 89474 - RNA, 22 nt, Human
gaguuacaacuccacacuucaa

SEQ ID NO: 89475 - RNA, 23 nt, Human
ggcauaacccagauguucccuca

SEQ ID NO: 89476 - RNA, 22 nt, Human
uaaaaaaggcauaacccagaug

SEQ ID NO: 89477 - RNA, 20 nt, Human
uaaaaagcaaguaacaauaa

SEQ ID NO: 89478 - RNA, 22 nt, Human
uaaacaaaguuuaaaaagcaag

SEQ ID NO: 89479 - RNA, 21 nt, Human
uaaagaaaacuacuuuaaaaa

SEQ ID NO: 89480 - RNA, 26 nt, Human
uacaaacaaagaaaaggcaaauaaac

SEQ ID NO: 89481 - RNA, 25 nt, Human
uacuuuaaaaaaggcauaacccaga

SEQ ID NO: 89482 - RNA, 25 nt, Human
uagggagaaaccuuuuacagauaag

SEQ ID NO: 89483 - RNA, 24 nt, Human
uccgagacgcgaccacacaaccac

SEQ ID NO: 89484 - RNA, 18 nt, Human
ugcaacauguuacuugau

SEQ ID NO: 89485 - RNA, 24 nt, Human
ugcaauagugcaacuuuuaaguac

SEQ ID NO: 89486 - RNA, 22 nt, Human
uggaaaacaaauauacaacuug

SEQ ID NO: 89487 - RNA, 25 nt, Human
uggcuaaacaaaguuuaaaaagcaa

SEQ ID NO: 89488 - RNA, 19 nt, Human
ugugcagaagggcuuagau

SEQ ID NO: 89489 - RNA, 22 nt, Human
uguuucugguacaggaccagca

SEQ ID NO: 89490 - RNA, 19 nt, Human
uuacaaacaaagaaaaggc

SEQ ID NO: 89491 - RNA, 30 nt, Human
uuaggacaaugacaguaagauaagggaagg

SEQ ID NO: 89492 - RNA, 23 nt, Human
uugacaguagggagaaaccuuuu

SEQ ID NO: 89493 - RNA, 23 nt, Human
aaaaaacccagacgacugguggg

SEQ ID NO: 89494 - RNA, 22 nt, Human
aaacaaaaccaaaacauuccga

SEQ ID NO: 89495 - RNA, 19 nt, Human
aaacaagaggaaacaaacc

SEQ ID NO: 89496 - RNA, 22 nt, Human
aaacaagaggaaacaaaccaaa

SEQ ID NO: 89497 - RNA, 23 nt, Human
aaacaagaggaaacaaaccaaaa

SEQ ID NO: 89498 - RNA, 24 nt, Human
aacagaaaaggggaaaaaacccag

SEQ ID NO: 89499 - RNA, 23 nt, Human
aacugaacacaauauugcccggu

SEQ ID NO: 89500 - RNA, 20 nt, Human
aagaaaaaaaaagagaacca

SEQ ID NO: 89501 - RNA, 18 nt, Human
aagcaggggguggggggu

SEQ ID NO: 89502 - RNA, 22 nt, Human
aagcaggggguggggggugggg

SEQ ID NO: 89503 - RNA, 19 nt, Human
aauguccacagccucacgc

SEQ ID NO: 89504 - RNA, 20 nt, Human
acaauuccucaacgcccccu

SEQ ID NO: 89505 - RNA, 23 nt, Human
acacucacugcccgcagcgcgcg

SEQ ID NO: 89506 - RNA, 24 nt, Human
acagaaaaggggaaaaaacccaga

SEQ ID NO: 89507 - RNA, 24 nt, Human
accaaaauggaggagagccauccg

SEQ ID NO: 89508 - RNA, 22 nt, Human
accauccccacauccauuccua

SEQ ID NO: 89509 - RNA, 23 nt, Human
acccaaaauaagaugacaaacaa

SEQ ID NO: 89510 - RNA, 24 nt, Human
acccaaaauaagaugacaaacaag

SEQ ID NO: 89511 - RNA, 18 nt, Human
acgccacaauuccucaac

SEQ ID NO: 89512 - RNA, 23 nt, Human
acuguauuuuauuggaaaacauu

SEQ ID NO: 89513 - RNA, 24 nt, Human
agagaugaggggcauggagagaga

SEQ ID NO: 89514 - RNA, 21 nt, Human
agaugacaaacaagaggaaac

SEQ ID NO: 89515 - RNA, 20 nt, Human
agcuaaaccucagaaagcca

SEQ ID NO: 89516 - RNA, 27 nt, Human
aggcagggaagagggcacggagcacag

SEQ ID NO: 89517 - RNA, 18 nt, Human
aggcaggugggcgaggga

SEQ ID NO: 89518 - RNA, 19 nt, Human
aggcaggugggcgagggaa

SEQ ID NO: 89519 - RNA, 18 nt, Human
agggaagaaggagaaaga

SEQ ID NO: 89520 - RNA, 18 nt, Human
aggggaaaaaacccagac

SEQ ID NO: 89521 - RNA, 23 nt, Human
aggggaagcaggggguggggggu

SEQ ID NO: 89522 - RNA, 20 nt, Human
agguauuuacagaacagcuc

SEQ ID NO: 89523 - RNA, 19 nt, Human
caaaaugaaagucuuaagg

SEQ ID NO: 89524 - RNA, 25 nt, Human
caaagcgaccauccccacauccauu

SEQ ID NO: 89525 - RNA, 18 nt, Human
caaggggaucuggggagg

SEQ ID NO: 89526 - RNA, 23 nt, Human
caccccugccccaacaggcugcu

SEQ ID NO: 89527 - RNA, 27 nt, Human
caccccugccccaacaggcugcuggga

SEQ ID NO: 89528 - RNA, 20 nt, Human
cagcagccagugggauguga

SEQ ID NO: 89529 - RNA, 22 nt, Human
cagcuaaaccucagaaagccaa

SEQ ID NO: 89530 - RNA, 21 nt, Human
cagcuugaacugaacacaaua

SEQ ID NO: 89531 - RNA, 18 nt, Human
cagcuugggacaaaucuu

SEQ ID NO: 89532 - RNA, 19 nt, Human
cagcuugggacaaaucuuu

SEQ ID NO: 89533 - RNA, 21 nt, Human
caugcaacggcaaagggcaug

SEQ ID NO: 89534 - RNA, 23 nt, Human
ccaaaacauuccgaaaaugucca

SEQ ID NO: 89535 - RNA, 24 nt, Human
ccaaaacauuccgaaaauguccac

SEQ ID NO: 89536 - RNA, 22 nt, Human
ccagcuaaaccucagaaagcca

SEQ ID NO: 89537 - RNA, 23 nt, Human
cccacccagcuaaaccucagaaa

SEQ ID NO: 89538 - RNA, 21 nt, Human
cccccucgaccccuccugggc

SEQ ID NO: 89539 - RNA, 18 nt, Human
ccgccgcgcguccgcgcc

SEQ ID NO: 89540 - RNA, 19 nt, Human
ccgccgcgcguccgcgccu

SEQ ID NO: 89541 - RNA, 19 nt, Human
ccucagaggcugggugccu

SEQ ID NO: 89542 - RNA, 20 nt, Human
ccuccacacucacugcccgc

SEQ ID NO: 89543 - RNA, 21 nt, Human
ccuucuggaaugccucucuug

SEQ ID NO: 89544 - RNA, 19 nt, Human
cgaaaauguccacagccuc

SEQ ID NO: 89545 - RNA, 19 nt, Human
cgagaagagagagaucaag

SEQ ID NO: 89546 - RNA, 22 nt, Human
cggagcacagaugugaggaagc

SEQ ID NO: 89547 - RNA, 20 nt, Human
cuccgccgcgcguccgcgcc

SEQ ID NO: 89548 - RNA, 18 nt, Human
gaaagaaaaaaaaagaga

SEQ ID NO: 89549 - RNA, 20 nt, Human
gagagccauccgggcuggag

SEQ ID NO: 89550 - RNA, 23 nt, Human
gagcacagaugugaggaagcggc

SEQ ID NO: 89551 - RNA, 21 nt, Human
gaggggaaagaaaaaaaaaga

SEQ ID NO: 89552 - RNA, 21 nt, Human
gcacggagcacagaugugagg

SEQ ID NO: 89553 - RNA, 23 nt, Human
gccuaccugcccuuacccucagc

SEQ ID NO: 89554 - RNA, 20 nt, Human
gcugcagcaguuccagcucc

SEQ ID NO: 89555 - RNA, 20 nt, Human
gcuggggaguaugggggcag

SEQ ID NO: 89556 - RNA, 25 nt, Human
ggaaaagccacuugaucgaccuggg

SEQ ID NO: 89557 - RNA, 27 nt, Human
ggaaugccucucuuggcaccccugccc

SEQ ID NO: 89558 - RNA, 18 nt, Human
ggagaagcgggaggugcu

SEQ ID NO: 89559 - RNA, 27 nt, Human
ggagaagcgggaggugcuggcggacca

SEQ ID NO: 89560 - RNA, 22 nt, Human
ggaucaagguuccuccggcggc

SEQ ID NO: 89561 - RNA, 18 nt, Human
ggcccccucgaccccucc

SEQ ID NO: 89562 - RNA, 20 nt, Human
ggccuuggaagacguggaug

SEQ ID NO: 89563 - RNA, 22 nt, Human
gggcagugaggggaagcagggg

SEQ ID NO: 89564 - RNA, 20 nt, Human
gggcauggagagagacucag

SEQ ID NO: 89565 - RNA, 26 nt, Human
ggggaaagaaaaaaaaagagaaccag

SEQ ID NO: 89566 - RNA, 21 nt, Human
ggggaagcagggggugggggg

SEQ ID NO: 89567 - RNA, 24 nt, Human
ggggagccagaugaaaugaacaga

SEQ ID NO: 89568 - RNA, 25 nt, Human
ggggaguaugggggcaggcaggugg

SEQ ID NO: 89569 - RNA, 20 nt, Human
gggggugggggguggggugg

SEQ ID NO: 89570 - RNA, 21 nt, Human
gggggugggguggggaggugg

SEQ ID NO: 89571 - RNA, 18 nt, Human
gggguggggagguggugg

SEQ ID NO: 89572 - RNA, 21 nt, Human
gggguggggaggugguggggg

SEQ ID NO: 89573 - RNA, 23 nt, Human
gggguggggagguggugggggga

SEQ ID NO: 89574 - RNA, 24 nt, Human
gggguguccggagcacggggauca

SEQ ID NO: 89575 - RNA, 27 nt, Human
ggguggggaggugguggggggagccag

SEQ ID NO: 89576 - RNA, 24 nt, Human
gguggggggugggguggggaggug

SEQ ID NO: 89577 - RNA, 18 nt, Human
guggggcccaucuucccu

SEQ ID NO: 89578 - RNA, 23 nt, Human
uaaaaaaaacaaaaccaaaacau

SEQ ID NO: 89579 - RNA, 21 nt, Human
uacccucagcucuuggcuggg

SEQ ID NO: 89580 - RNA, 24 nt, Human
uacccucagcucuuggcugggucu

SEQ ID NO: 89581 - RNA, 22 nt, Human
uagcaccagguauuuacagaac

SEQ ID NO: 89582 - RNA, 20 nt, Human
uaggacgggcccucagggcg

SEQ ID NO: 89583 - RNA, 24 nt, Human
ucacagggcugguugcaugcaacg

SEQ ID NO: 89584 - RNA, 19 nt, Human
ucagaagcaagggcacgga

SEQ ID NO: 89585 - RNA, 21 nt, Human
ucagaggcugggugccagagg

SEQ ID NO: 89586 - RNA, 24 nt, Human
ucaggaacgcgggcaaguccaauc

SEQ ID NO: 89587 - RNA, 20 nt, Human
ucaguccccuucugugaguu

SEQ ID NO: 89588 - RNA, 21 nt, Human
ucaguccuucuggaaugccuc

SEQ ID NO: 89589 - RNA, 22 nt, Human
uccgaaaauguccacagccuca

SEQ ID NO: 89590 - RNA, 24 nt, Human
uccgcgccuccacacucacugccc

SEQ ID NO: 89591 - RNA, 23 nt, Human
ugaacagaaaaggggaaaaaacc

SEQ ID NO: 89592 - RNA, 24 nt, Human
ugacaaacaagaggaaacaaaccu

SEQ ID NO: 89593 - RNA, 20 nt, Human
ugagaagagauucucaaagc

SEQ ID NO: 89594 - RNA, 18 nt, Human
ugagcaguccccacccag

SEQ ID NO: 89595 - RNA, 21 nt, Human
ugaggagggagcggcauggga

SEQ ID NO: 89596 - RNA, 28 nt, Human
ugauauauauuuuucuucacagcuugaa

SEQ ID NO: 89597 - RNA, 24 nt, Human
ugcccacauugacuuacuuguccc

SEQ ID NO: 89598 - RNA, 23 nt, Human
ugccccaucccuccuucccucag

SEQ ID NO: 89599 - RNA, 19 nt, Human
ugccucucuuggcaccccu

SEQ ID NO: 89600 - RNA, 23 nt, Human
ugccucucuuggcaccccugccc

SEQ ID NO: 89601 - RNA, 22 nt, Human
uggaagaggcgagggcaaaagg

SEQ ID NO: 89602 - RNA, 21 nt, Human
uggaaugccucucuuggcacc

SEQ ID NO: 89603 - RNA, 24 nt, Human
uggaaugccucucuuggcaccccu

SEQ ID NO: 89604 - RNA, 24 nt, Human
uggcaccccugccccaacaggcug

SEQ ID NO: 89605 - RNA, 22 nt, Human
uggcugggucucccacuaugcc

SEQ ID NO: 89606 - RNA, 20 nt, Human
uggggaggugguggggggag

SEQ ID NO: 89607 - RNA, 23 nt, Human
uggggaggugguggggggagcca

SEQ ID NO: 89608 - RNA, 20 nt, Human
ugggggcaggcaggugggcg

SEQ ID NO: 89609 - RNA, 19 nt, Human
uggggggugggguggggag

SEQ ID NO: 89610 - RNA, 19 nt, Human
ugguggggcccaucuuccc

SEQ ID NO: 89611 - RNA, 27 nt, Human
ugucaguccccuucuguuaccaagugg

SEQ ID NO: 89612 - RNA, 24 nt, Human
ugugaguguugcccacugucaguc

SEQ ID NO: 89613 - RNA, 19 nt, Human
uguuuuauugcaggugcgu

SEQ ID NO: 89614 - RNA, 20 nt, Human
uucugccuggggagggccuc

SEQ ID NO: 89615 - RNA, 24 nt, Human
uugcccgguuuaaaaaaaacaaaa

SEQ ID NO: 89616 - RNA, 26 nt, Human
aaaaaaaaaaaaaaaagggcggggag

SEQ ID NO: 89617 - RNA, 23 nt, Human
aaaaaaaaaaagggcggggaggg

SEQ ID NO: 89618 - RNA, 24 nt, Human
aaauccaccccaaauccgaaccag

SEQ ID NO: 89619 - RNA, 23 nt, Human
aaggggacagaggcaagaaaaga

SEQ ID NO: 89620 - RNA, 20 nt, Human
aauccaccccaaauccgaac

SEQ ID NO: 89621 - RNA, 21 nt, Human
accaguuuaaaaaaaaaaaaa

SEQ ID NO: 89622 - RNA, 21 nt, Human
acccagaaguggcccaguccu

SEQ ID NO: 89623 - RNA, 24 nt, Human
agaugagaaccaggggugagggcu

SEQ ID NO: 89624 - RNA, 24 nt, Human
agccaaucugggacccacugcccc

SEQ ID NO: 89625 - RNA, 19 nt, Human
aggaggggaacaaaaccaa

SEQ ID NO: 89626 - RNA, 19 nt, Human
aggcaagaaaagauguuga

SEQ ID NO: 89627 - RNA, 24 nt, Human
aguggaggaggggaacaaaaccag

SEQ ID NO: 89628 - RNA, 22 nt, Human
aucaagaaagaugagaaccagg

SEQ ID NO: 89629 - RNA, 27 nt, Human
caaaaccaaaauccaccccaaauccga

SEQ ID NO: 89630 - RNA, 21 nt, Human
caaaauccaccccaaauccga

SEQ ID NO: 89631 - RNA, 24 nt, Human
caccacugccccccagguuggagg

SEQ ID NO: 89632 - RNA, 19 nt, Human
caguccagcccuggaggca

SEQ ID NO: 89633 - RNA, 20 nt, Human
cagugcugggggguuggaga

SEQ ID NO: 89634 - RNA, 23 nt, Human
cagugcugggggguuggagacac

SEQ ID NO: 89635 - RNA, 21 nt, Human
cagugugagccaaucugggac

SEQ ID NO: 89636 - RNA, 24 nt, Human
ccaguuuaaaaaaaaaaaaaaaaa

SEQ ID NO: 89637 - RNA, 23 nt, Human
cccaaauccgaaccagccuggaa

SEQ ID NO: 89638 - RNA, 18 nt, Human
ccccuucugcugcccucc

SEQ ID NO: 89639 - RNA, 22 nt, Human
cccuccucugggcuccaggaag

SEQ ID NO: 89640 - RNA, 21 nt, Human
ccgaaccagccuggaaaaaaa

SEQ ID NO: 89641 - RNA, 18 nt, Human
ccuucugcugcccuccuc

SEQ ID NO: 89642 - RNA, 22 nt, Human
cggggagggggugggggagagu

SEQ ID NO: 89643 - RNA, 18 nt, Human
cuccacaccacugccccc

SEQ ID NO: 89644 - RNA, 24 nt, Human
cuccacaccacugccccccagguu

SEQ ID NO: 89645 - RNA, 19 nt, Human
cugcccuccucugggcucc

SEQ ID NO: 89646 - RNA, 19 nt, Human
cugcugcccuccucugggc

SEQ ID NO: 89647 - RNA, 21 nt, Human
gagaguggaggaggggaacaa

SEQ ID NO: 89648 - RNA, 22 nt, Human
gaugagagaaggggacagaggc

SEQ ID NO: 89649 - RNA, 23 nt, Human
gcaggggagaaagggagggguga

SEQ ID NO: 89650 - RNA, 19 nt, Human
gcccaguccugggggcagg

SEQ ID NO: 89651 - RNA, 22 nt, Human
gccuguggcuucuccacaccac

SEQ ID NO: 89652 - RNA, 23 nt, Human
gccuguggcuucuccacaccacu

SEQ ID NO: 89653 - RNA, 21 nt, Human
gcuccaggaaggagagcagau

SEQ ID NO: 89654 - RNA, 18 nt, Human
gcugaaggagaaucaaag

SEQ ID NO: 89655 - RNA, 20 nt, Human
ggacccacugccccacccag

SEQ ID NO: 89656 - RNA, 28 nt, Human
ggagacaccacccccuucugcugcccuc

SEQ ID NO: 89657 - RNA, 23 nt, Human
ggaggaggggaacaaaaccaaaa

SEQ ID NO: 89658 - RNA, 18 nt, Human
ggagggggugggggagag

SEQ ID NO: 89659 - RNA, 20 nt, Human
ggcaggggagaaagggaggg

SEQ ID NO: 89660 - RNA, 18 nt, Human
ggccgagggggcggcaac

SEQ ID NO: 89661 - RNA, 22 nt, Human
gggaacaaaaccaaaauccacc

SEQ ID NO: 89662 - RNA, 21 nt, Human
gggagggggugggggagagug

SEQ ID NO: 89663 - RNA, 21 nt, Human
gggcaggggagaaagggaggg

SEQ ID NO: 89664 - RNA, 20 nt, Human
ggggagggggugggggagag

SEQ ID NO: 89665 - RNA, 23 nt, Human
ggggagggggugggggagagugg

SEQ ID NO: 89666 - RNA, 22 nt, Human
gggggcaggggagaaagggagg

SEQ ID NO: 89667 - RNA, 22 nt, Human
gggggcaggggagaaagggagg

SEQ ID NO: 89668 - RNA, 19 nt, Human
ggggugagggcugaaggag

SEQ ID NO: 89669 - RNA, 21 nt, Human
gugaaaugagaagagccccgu

SEQ ID NO: 89670 - RNA, 20 nt, Human
ucagugugagccaaucuggg

SEQ ID NO: 89671 - RNA, 18 nt, Human
uccaggaaggagagcaga

SEQ ID NO: 89672 - RNA, 22 nt, Human
uccgaaccagccuggaaaaaaa

SEQ ID NO: 89673 - RNA, 20 nt, Human
ucuccacaccacugcccccc

SEQ ID NO: 89674 - RNA, 22 nt, Human
ucugcggcaggagcgcucaggc

SEQ ID NO: 89675 - RNA, 25 nt, Human
ucuuccucagugcugggggguugga

SEQ ID NO: 89676 - RNA, 22 nt, Human
ugagaaccaggggugagggcug

SEQ ID NO: 89677 - RNA, 19 nt, Human
ugagaagagccccguucuu

SEQ ID NO: 89678 - RNA, 18 nt, Human
ugagagaaggggacagag

SEQ ID NO: 89679 - RNA, 19 nt, Human
ugagggcugaaggagaauc

SEQ ID NO: 89680 - RNA, 23 nt, Human
ugagggcugaaggagaaucaaag

SEQ ID NO: 89681 - RNA, 22 nt, Human
uggaaaaaaaugaaaguucucg

SEQ ID NO: 89682 - RNA, 27 nt, Human
ugggggcaggggagaaagggaggggug

SEQ ID NO: 89683 - RNA, 21 nt, Human
uuccucagugcugggggguug

SEQ ID NO: 89684 - RNA, 27 nt, Human
uuuaaaacgacccuccggcagcggcuc

SEQ ID NO: 89685 - RNA, 21 nt, Human
aaaaaaaaaauuucaaaggga

SEQ ID NO: 89686 - RNA, 20 nt, Human
aaaaaggccugguaguaagu

SEQ ID NO: 89687 - RNA, 19 nt, Human
aaaagagaaagggaagaag

SEQ ID NO: 89688 - RNA, 22 nt, Human
aaacaaaaaaaaaauuucaaag

SEQ ID NO: 89689 - RNA, 21 nt, Human
aacauuuguauuuuuccuuua

SEQ ID NO: 89690 - RNA, 20 nt, Human
aagaacacugcaaccaaacu

SEQ ID NO: 89691 - RNA, 19 nt, Human
aagaagaaaaaaaucccca

SEQ ID NO: 89692 - RNA, 21 nt, Human
acaagauaagaacacugcaac

SEQ ID NO: 89693 - RNA, 23 nt, Human
agaaagggacccaaaaggacagu

SEQ ID NO: 89694 - RNA, 21 nt, Human
agagcccucucuguagguccu

SEQ ID NO: 89695 - RNA, 24 nt, Human
agaggaaccggaugggggcauuua

SEQ ID NO: 89696 - RNA, 24 nt, Human
aggaaauggggugugaugggucaa

SEQ ID NO: 89697 - RNA, 22 nt, Human
aggaggaaauggggugugaugg

SEQ ID NO: 89698 - RNA, 21 nt, Human
agucccucagagaggaggagg

SEQ ID NO: 89699 - RNA, 20 nt, Human
aucacccagcaccaccugaa

SEQ ID NO: 89700 - RNA, 27 nt, Human
auguuggacuuuuugacaggcaagacu

SEQ ID NO: 89701 - RNA, 22 nt, Human
caacagaugcacacccagaaaa

SEQ ID NO: 89702 - RNA, 18 nt, Human
caauuucaugugaaaccg

SEQ ID NO: 89703 - RNA, 19 nt, Human
caccuagugaggugugagg

SEQ ID NO: 89704 - RNA, 21 nt, Human
cacucuauaaaaaauaaccaa

SEQ ID NO: 89705 - RNA, 22 nt, Human
cagaagcuguaaaaauaaauua

SEQ ID NO: 89706 - RNA, 20 nt, Human
cagaugcacacccagaaaaa

SEQ ID NO: 89707 - RNA, 21 nt, Human
cagggggaaaaagaagaaaau

SEQ ID NO: 89708 - RNA, 18 nt, Human
ccaaccagagaaaaauac

SEQ ID NO: 89709 - RNA, 24 nt, Human
ccaauauccaaauucaagagagcu

SEQ ID NO: 89710 - RNA, 22 nt, Human
ccagaaaaaaaauguaugcccc

SEQ ID NO: 89711 - RNA, 23 nt, Human
ccagaagcuguaaaaauaaauua

SEQ ID NO: 89712 - RNA, 19 nt, Human
ccaugguccucaaaccaaa

SEQ ID NO: 89713 - RNA, 21 nt, Human
cccagaaaaaaaauguaugcc

SEQ ID NO: 89714 - RNA, 19 nt, Human
cccugguaaauucagcagc

SEQ ID NO: 89715 - RNA, 24 nt, Human
ccuauauuggggcuaaaccggggc

SEQ ID NO: 89716 - RNA, 24 nt, Human
ccucaaaccaaagagcccucucug

SEQ ID NO: 89717 - RNA, 23 nt, Human
ccucagaagcacggcuucccucc

SEQ ID NO: 89718 - RNA, 18 nt, Human
cuacaugugugaguggag

SEQ ID NO: 89719 - RNA, 24 nt, Human
cuauagcucugcaaagagaucaca

SEQ ID NO: 89720 - RNA, 18 nt, Human
cucagagaggaggaggaa

SEQ ID NO: 89721 - RNA, 19 nt, Human
cuguucgcauugcagaaua

SEQ ID NO: 89722 - RNA, 24 nt, Human
cuuuuuuuuuuuuuuggcagcggg

SEQ ID NO: 89723 - RNA, 21 nt, Human
gacacagaaaaaggccuggua

SEQ ID NO: 89724 - RNA, 21 nt, Human
gagaauucccauucagugacc

SEQ ID NO: 89725 - RNA, 18 nt, Human
gagagggaaagaggagga

SEQ ID NO: 89726 - RNA, 22 nt, Human
gagcuagcauucacagaacaca

SEQ ID NO: 89727 - RNA, 28 nt, Human
gagugaauuuuaauuguagugaaaccaa

SEQ ID NO: 89728 - RNA, 19 nt, Human
gaguugggaacaaagggug

SEQ ID NO: 89729 - RNA, 20 nt, Human
gaugcacacccagaaaaaaa

SEQ ID NO: 89730 - RNA, 22 nt, Human
gccaagcuuuccuagagcaaag

SEQ ID NO: 89731 - RNA, 19 nt, Human
gccugggcucucugcaccu

SEQ ID NO: 89732 - RNA, 20 nt, Human
gccugggcucucugcaccua

SEQ ID NO: 89733 - RNA, 18 nt, Human
gcuuuucaagugcaugau

SEQ ID NO: 89734 - RNA, 18 nt, Human
ggacccaaaaggacagug

SEQ ID NO: 89735 - RNA, 18 nt, Human
ggagagggaaagaggagg

SEQ ID NO: 89736 - RNA, 19 nt, Human
ggaucuuuccuugcccagg

SEQ ID NO: 89737 - RNA, 20 nt, Human
gggaaaaagaagaaaaucaa

SEQ ID NO: 89738 - RNA, 21 nt, Human
ggggaaaaagaagaaaaucaa

SEQ ID NO: 89739 - RNA, 24 nt, Human
guaaagagcuaauguuugucuaca

SEQ ID NO: 89740 - RNA, 19 nt, Human
guuucuuuagcucuuucca

SEQ ID NO: 89741 - RNA, 22 nt, Human
uaacuaauacugcuaauuuaac

SEQ ID NO: 89742 - RNA, 19 nt, Human
uaagaacacugcaaccaaa

SEQ ID NO: 89743 - RNA, 20 nt, Human
uagaucuuuccucguagccc

SEQ ID NO: 89744 - RNA, 20 nt, Human
uauccacuaucaagagcuua

SEQ ID NO: 89745 - RNA, 23 nt, Human
ucaaugacaugauuggaaaggag

SEQ ID NO: 89746 - RNA, 18 nt, Human
ucaccagccucaggcuug

SEQ ID NO: 89747 - RNA, 20 nt, Human
ucacuggucuucuuaauagu

SEQ ID NO: 89748 - RNA, 18 nt, Human
uccuagagcaaagggauc

SEQ ID NO: 89749 - RNA, 19 nt, Human
uccucaaaccaaagagccc

SEQ ID NO: 89750 - RNA, 19 nt, Human
uccuuuuuuuuuuuuuugg

SEQ ID NO: 89751 - RNA, 22 nt, Human
ucuacaaacacaaguguacuaa

SEQ ID NO: 89752 - RNA, 19 nt, Human
ucuccaguggacacagaaa

SEQ ID NO: 89753 - RNA, 27 nt, Human
ucuuuagcucuuuccacaucucucuuu

SEQ ID NO: 89754 - RNA, 20 nt, Human
ugaaaccagaagcuguaaaa

SEQ ID NO: 89755 - RNA, 18 nt, Human
ugaaacccuguugauuca

SEQ ID NO: 89756 - RNA, 22 nt, Human
ugaaacccuguugauucaugau

SEQ ID NO: 89757 - RNA, 23 nt, Human
ugaagugagaauuauuaaaauca

SEQ ID NO: 89758 - RNA, 24 nt, Human
ugagaaagaguaaagagcuaaugu

SEQ ID NO: 89759 - RNA, 19 nt, Human
ugagggcuaaaaacgugga

SEQ ID NO: 89760 - RNA, 24 nt, Human
ugcaaccaaacucauaacuaauac

SEQ ID NO: 89761 - RNA, 19 nt, Human
ugcauugugagguaugagg

SEQ ID NO: 89762 - RNA, 19 nt, Human
ugcuugcugcugucuuugc

SEQ ID NO: 89763 - RNA, 24 nt, Human
ugcuugcugcugucuuugcagauu

SEQ ID NO: 89764 - RNA, 26 nt, Human
uggaguugggaacaaagggugguuuc

SEQ ID NO: 89765 - RNA, 21 nt, Human
uggcagcggggagagggaaag

SEQ ID NO: 89766 - RNA, 24 nt, Human
uggcagcggggagagggaaagagg

SEQ ID NO: 89767 - RNA, 19 nt, Human
uggcagguucaguugcugg

SEQ ID NO: 89768 - RNA, 23 nt, Human
uggggugugaugggucaaaggca

SEQ ID NO: 89769 - RNA, 23 nt, Human
uguggaagaccaaaggauauacc

SEQ ID NO: 89770 - RNA, 22 nt, Human
uuaaacaaacaaacaaaaaaaa

SEQ ID NO: 89771 - RNA, 20 nt, Human
uucaaaaggcaaauaauuaa

SEQ ID NO: 89772 - RNA, 21 nt, Human
uucaacagaugcacacccaga

SEQ ID NO: 89773 - RNA, 24 nt, Human
uucaagagagcuagcauucacaga

SEQ ID NO: 89774 - RNA, 25 nt, Human
uucccaccacagcugugcuugacaa

SEQ ID NO: 89775 - RNA, 23 nt, Human
uuccucagaagcacggcuucccu

SEQ ID NO: 89776 - RNA, 19 nt, Human
uuuaccauaccagggagcc

SEQ ID NO: 89777 - RNA, 22 nt, Human
agaauuaccaacugguauauau

SEQ ID NO: 89778 - RNA, 26 nt, Human
agcaaaaacaauuugcuacuauucac

SEQ ID NO: 89779 - RNA, 20 nt, Human
aguaguucaaaggaauuacu

SEQ ID NO: 89780 - RNA, 26 nt, Human
caaagcaaaaacaauuugcuacuauu

SEQ ID NO: 89781 - RNA, 20 nt, Human
caccucaaaaacagaaucac

SEQ ID NO: 89782 - RNA, 22 nt, Human
ccgccgccgccgccgccgccgc

SEQ ID NO: 89783 - RNA, 22 nt, Human
ccgccgccgccgccgccgccgc

SEQ ID NO: 89784 - RNA, 23 nt, Human
ccgccgccgccgccgccgccgcu

SEQ ID NO: 89785 - RNA, 26 nt, Human
ccgccgccgccgccgccgccgcugcc

SEQ ID NO: 89786 - RNA, 26 nt, Human
ccgccgccgccgccgccgcugcccga

SEQ ID NO: 89787 - RNA, 19 nt, Human
ccggccgccagccgccgcc

SEQ ID NO: 89788 - RNA, 22 nt, Human
ccggccgccagccgccgccugc

SEQ ID NO: 89789 - RNA, 19 nt, Human
cgccgccgccgccgcugcc

SEQ ID NO: 89790 - RNA, 20 nt, Human
cuccggaagccgccgccgcc

SEQ ID NO: 89791 - RNA, 23 nt, Human
gccgccgccgccgccgccgccgg

SEQ ID NO: 89792 - RNA, 18 nt, Human
ggacaaaguacauaaaau

SEQ ID NO: 89793 - RNA, 18 nt, Human
uaaaaguuaugggaacau

SEQ ID NO: 89794 - RNA, 21 nt, Human
uacaugccauagaagacacua

SEQ ID NO: 89795 - RNA, 24 nt, Human
uacaugccauagaagacacuauua

SEQ ID NO: 89796 - RNA, 22 nt, Human
uagaagacacuauuauuuucau

SEQ ID NO: 89797 - RNA, 23 nt, Human
uagaauuaccaacugguauauau

SEQ ID NO: 89798 - RNA, 25 nt, Human
uagauuuucaaagcaaaaacaauuu

SEQ ID NO: 89799 - RNA, 24 nt, Human
uagcuaagcaguaguucaaaggaa

SEQ ID NO: 89800 - RNA, 22 nt, Human
ucuccuuguaaacaguuugaac

SEQ ID NO: 89801 - RNA, 20 nt, Human
ugaaggacaaaguacauaaa

SEQ ID NO: 89802 - RNA, 22 nt, Human
ugccuugugaagaaauccaaag

SEQ ID NO: 89803 - RNA, 21 nt, Human
uucaaagcaaaaacaauuugc

SEQ ID NO: 89804 - RNA, 20 nt, Human
uugcugaaaauguaugcuuu

SEQ ID NO: 89805 - RNA, 25 nt, Human
uuuuuuuuuuuuuuuuuuuuagggg

SEQ ID NO: 89806 - RNA, 19 nt, Human
aaaaaucuguaaggaaaug

SEQ ID NO: 89807 - RNA, 18 nt, Human
aaaauuagcugggcgugg

SEQ ID NO: 89808 - RNA, 25 nt, Human
aaccaggaagguggagguugcggug

SEQ ID NO: 89809 - RNA, 24 nt, Human
aaguagcuuuacaaccccuaaagu

SEQ ID NO: 89810 - RNA, 19 nt, Human
acaagaaaaguuacaaugu

SEQ ID NO: 89811 - RNA, 20 nt, Human
acaagagcgaaacucugucu

SEQ ID NO: 89812 - RNA, 21 nt, Human
acaagagcgaaacucugucuc

SEQ ID NO: 89813 - RNA, 23 nt, Human
accaacauggagaaacccugucu

SEQ ID NO: 89814 - RNA, 24 nt, Human
acuuugggaggccgaggugggcag

SEQ ID NO: 89815 - RNA, 20 nt, Human
agaagcagucucuagggcug

SEQ ID NO: 89816 - RNA, 18 nt, Human
agagcgaaacucugucuc

SEQ ID NO: 89817 - RNA, 22 nt, Human
agagcgaaacucugucucaaaa

SEQ ID NO: 89818 - RNA, 24 nt, Human
agcacuuugggaggccgagguggg

SEQ ID NO: 89819 - RNA, 23 nt, Human
agcugggcgugguggugcaugcc

SEQ ID NO: 89820 - RNA, 21 nt, Human
aggaagguggagguugcggug

SEQ ID NO: 89821 - RNA, 24 nt, Human
aggaagguggagguugcggugagc

SEQ ID NO: 89822 - RNA, 22 nt, Human
aggcaggagaaucccuugaacc

SEQ ID NO: 89823 - RNA, 24 nt, Human
aggcaggagaaucccuugaaccag

SEQ ID NO: 89824 - RNA, 21 nt, Human
aggccgaggugggcagaucac

SEQ ID NO: 89825 - RNA, 24 nt, Human
aggcugaggcaggagaaucccuug

SEQ ID NO: 89826 - RNA, 24 nt, Human
aggugcaguggcucacgccuguaa

SEQ ID NO: 89827 - RNA, 21 nt, Human
agguggagguugcggugagcc

SEQ ID NO: 89828 - RNA, 24 nt, Human
agguggagguugcggugagccgag

SEQ ID NO: 89829 - RNA, 22 nt, Human
aggugggcagaucaccugaggg

SEQ ID NO: 89830 - RNA, 22 nt, Human
aggugggcagaucaccugaggu

SEQ ID NO: 89831 - RNA, 24 nt, Human
aguggcucacgccuguaaucccag

SEQ ID NO: 89832 - RNA, 21 nt, Human
auaaaguagcuuuacaacccc

SEQ ID NO: 89833 - RNA, 24 nt, Human
auugcacucuagccugggcaacaa

SEQ ID NO: 89834 - RNA, 25 nt, Human
auugcacucuagccugggcaacaag

SEQ ID NO: 89835 - RNA, 21 nt, Human
auuuuucagaugacuucauuu

SEQ ID NO: 89836 - RNA, 24 nt, Human
caaauguaaaaaguuccaauucug

SEQ ID NO: 89837 - RNA, 23 nt, Human
caacaagagcgaaacucugucuc

SEQ ID NO: 89838 - RNA, 21 nt, Human
caacauggagaaacccugucu

SEQ ID NO: 89839 - RNA, 19 nt, Human
caaccccuaaaguaaaaga

SEQ ID NO: 89840 - RNA, 20 nt, Human
caagaaaaguuacaaugugc

SEQ ID NO: 89841 - RNA, 23 nt, Human
cacaaggauuaaccaaauuagac

SEQ ID NO: 89842 - RNA, 24 nt, Human
cacgccuguaaucccagcacuuug

SEQ ID NO: 89843 - RNA, 27 nt, Human
cagaucaccugaggucagaaguucgag

SEQ ID NO: 89844 - RNA, 24 nt, Human
cagcacuuugggaggccgaggugg

SEQ ID NO: 89845 - RNA, 24 nt, Human
cagccugaccaacauggagaaacc

SEQ ID NO: 89846 - RNA, 24 nt, Human
cagcuacuugggaggcugaggcag

SEQ ID NO: 89847 - RNA, 24 nt, Human
caugccuguaaucccagcuacuug

SEQ ID NO: 89848 - RNA, 27 nt, Human
cauucuauaucuaauaaaguagcuuua

SEQ ID NO: 89849 - RNA, 18 nt, Human
cauugcacucuagccugg

SEQ ID NO: 89850 - RNA, 19 nt, Human
cauugcacucuagccuggg

SEQ ID NO: 89851 - RNA, 21 nt, Human
cauugcacucuagccugggca

SEQ ID NO: 89852 - RNA, 24 nt, Human
cauugcacucuagccugggcaaca

SEQ ID NO: 89853 - RNA, 21 nt, Human
ccaaaagaagaauuacaaauc

SEQ ID NO: 89854 - RNA, 19 nt, Human
ccaggaagguggagguugc

SEQ ID NO: 89855 - RNA, 20 nt, Human
ccauugcacucuagccuggg

SEQ ID NO: 89856 - RNA, 21 nt, Human
ccauugcacucuagccugggc

SEQ ID NO: 89857 - RNA, 22 nt, Human
ccauugcacucuagccugggca

SEQ ID NO: 89858 - RNA, 23 nt, Human
ccauugcacucuagccugggcaa

SEQ ID NO: 89859 - RNA, 24 nt, Human
ccauugcacucuagccugggcaac

SEQ ID NO: 89860 - RNA, 18 nt, Human
cccguccacagucuggga

SEQ ID NO: 89861 - RNA, 21 nt, Human
cccuugaaccaggaaggugga

SEQ ID NO: 89862 - RNA, 22 nt, Human
ccugaccaacauggagaaaccc

SEQ ID NO: 89863 - RNA, 24 nt, Human
ccugaccaacauggagaaacccug

SEQ ID NO: 89864 - RNA, 22 nt, Human
ccugaggucagaaguucgagac

SEQ ID NO: 89865 - RNA, 21 nt, Human
ccuguaaucccagcuacuugg

SEQ ID NO: 89866 - RNA, 22 nt, Human
ccuguaaucccagcuacuuggg

SEQ ID NO: 89867 - RNA, 20 nt, Human
cgaggugggcagaucaccug

SEQ ID NO: 89868 - RNA, 24 nt, Human
cgaggugggcagaucaccugaggu

SEQ ID NO: 89869 - RNA, 23 nt, Human
cgccuguaaucccagcacuuugg

SEQ ID NO: 89870 - RNA, 24 nt, Human
cgccuguaaucccagcacuuuggg

SEQ ID NO: 89871 - RNA, 22 nt, Human
cucacgccuguaaucccagcac

SEQ ID NO: 89872 - RNA, 24 nt, Human
cucacgccuguaaucccagcacuu

SEQ ID NO: 89873 - RNA, 20 nt, Human
cugagaccacauuuaucugu

SEQ ID NO: 89874 - RNA, 23 nt, Human
gaagacaacccaacaaaauaugg

SEQ ID NO: 89875 - RNA, 21 nt, Human
gagaaacccugucuuuacuaa

SEQ ID NO: 89876 - RNA, 23 nt, Human
gagaccagccugaccaacaugga

SEQ ID NO: 89877 - RNA, 19 nt, Human
gagggcgaugacuagaggc

SEQ ID NO: 89878 - RNA, 25 nt, Human
gaggugggcagaucaccugagguca

SEQ ID NO: 89879 - RNA, 21 nt, Human
gagguugcggugagccgagau

SEQ ID NO: 89880 - RNA, 24 nt, Human
gaucaccugaggucagaaguucga

SEQ ID NO: 89881 - RNA, 19 nt, Human
gcagucucuagggcuggcu

SEQ ID NO: 89882 - RNA, 24 nt, Human
gccauugcacucuagccugggcaa

SEQ ID NO: 89883 - RNA, 20 nt, Human
gccuguaaucccagcuacuu

SEQ ID NO: 89884 - RNA, 20 nt, Human
ggaagguggagguugcggug

SEQ ID NO: 89885 - RNA, 19 nt, Human
ggagggguggcaguggcgg

SEQ ID NO: 89886 - RNA, 18 nt, Human
ggagguugcggugagccg

SEQ ID NO: 89887 - RNA, 20 nt, Human
ggagguugcggugagccgag

SEQ ID NO: 89888 - RNA, 22 nt, Human
ggagguugcggugagccgagau

SEQ ID NO: 89889 - RNA, 24 nt, Human
ggagguugcggugagccgagaugg

SEQ ID NO: 89890 - RNA, 23 nt, Human
ggcgugguggugcaugccuguaa

SEQ ID NO: 89891 - RNA, 20 nt, Human
gggaaaaaggacauuuaugc

SEQ ID NO: 89892 - RNA, 21 nt, Human
gguggcaguggcggugauguu

SEQ ID NO: 89893 - RNA, 24 nt, Human
gguggugcaugccuguaaucccag

SEQ ID NO: 89894 - RNA, 23 nt, Human
guauguguuuuuaaugucacaag

SEQ ID NO: 89895 - RNA, 24 nt, Human
guugcggugagccgagauggcgcc

SEQ ID NO: 89896 - RNA, 18 nt, Human
uaaaagcacuagcucagc

SEQ ID NO: 89897 - RNA, 23 nt, Human
uaaaagcacuagcucagcuccca

SEQ ID NO: 89898 - RNA, 21 nt, Human
uaaaguagcuuuacaaccccu

SEQ ID NO: 89899 - RNA, 24 nt, Human
uaagaagacaacccaacaaaauau

SEQ ID NO: 89900 - RNA, 24 nt, Human
uaaggccaggugcaguggcucacg

SEQ ID NO: 89901 - RNA, 22 nt, Human
uacaaccccuaaaguaaaagaa

SEQ ID NO: 89902 - RNA, 18 nt, Human
uacagaauaggaauucug

SEQ ID NO: 89903 - RNA, 23 nt, Human
uaccuuccaauuucacauguaug

SEQ ID NO: 89904 - RNA, 24 nt, Human
uaucaguaauaauacaaacucagc

SEQ ID NO: 89905 - RNA, 23 nt, Human
uaucuaauaaaguagcuuuacaa

SEQ ID NO: 89906 - RNA, 23 nt, Human
uaucuguucuccuaaaagcacua

SEQ ID NO: 89907 - RNA, 19 nt, Human
uauggcaguuacugaguua

SEQ ID NO: 89908 - RNA, 18 nt, Human
ucaggacagaaugacaca

SEQ ID NO: 89909 - RNA, 21 nt, Human
ucucuagggcuggcugagacc

SEQ ID NO: 89910 - RNA, 25 nt, Human
ugaaacucaaauguaaaaaguucca

SEQ ID NO: 89911 - RNA, 24 nt, Human
ugaccaacauggagaaacccuguc

SEQ ID NO: 89912 - RNA, 22 nt, Human
ugagccgagauggcgccauugc

SEQ ID NO: 89913 - RNA, 19 nt, Human
ugaggcaggagaaucccuu

SEQ ID NO: 89914 - RNA, 24 nt, Human
ugaggcaggagaaucccuugaacc

SEQ ID NO: 89915 - RNA, 25 nt, Human
ugaggcaggagaaucccuugaacca

SEQ ID NO: 89916 - RNA, 19 nt, Human
ugcacucuagccugggcaa

SEQ ID NO: 89917 - RNA, 23 nt, Human
ugccuguaaucccagcuacuugg

SEQ ID NO: 89918 - RNA, 24 nt, Human
ugccuguaaucccagcuacuuggg

SEQ ID NO: 89919 - RNA, 24 nt, Human
uggcucacgccuguaaucccagca

SEQ ID NO: 89920 - RNA, 20 nt, Human
ugggaggccgaggugggcag

SEQ ID NO: 89921 - RNA, 24 nt, Human
ugggaggccgaggugggcagauca

SEQ ID NO: 89922 - RNA, 18 nt, Human
ugggaggcugaggcagga

SEQ ID NO: 89923 - RNA, 19 nt, Human
ugggaggcugaggcaggag

SEQ ID NO: 89924 - RNA, 18 nt, Human
ugggagggguggcagugg

SEQ ID NO: 89925 - RNA, 24 nt, Human
ugggcagaucaccugaggucagaa

SEQ ID NO: 89926 - RNA, 21 nt, Human
uggugcaugccuguaauccca

SEQ ID NO: 89927 - RNA, 22 nt, Human
uggugcaugccuguaaucccag

SEQ ID NO: 89928 - RNA, 24 nt, Human
ugguggugcaugccuguaauccca

SEQ ID NO: 89929 - RNA, 18 nt, Human
uuagagacacugcaauau

SEQ ID NO: 89930 - RNA, 22 nt, Human
uuagcugggcgugguggugcau

SEQ ID NO: 89931 - RNA, 24 nt, Human
uuagcugggcgugguggugcaugc

SEQ ID NO: 89932 - RNA, 23 nt, Human
uuauuuuucagaugacuucauuu

SEQ ID NO: 89933 - RNA, 25 nt, Human
uucauuuuauuuuucagaugacuuc

SEQ ID NO: 89934 - RNA, 24 nt, Human
uugaaccaggaagguggagguugc

SEQ ID NO: 89935 - RNA, 18 nt, Human
uugcggugagccgagaug

SEQ ID NO: 89936 - RNA, 22 nt, Human
uugcggugagccgagauggcgc

SEQ ID NO: 89937 - RNA, 25 nt, Human
uugggaggccgaggugggcagauca

SEQ ID NO: 89938 - RNA, 24 nt, Human
uuguaagcuucuccuucucaguuc

SEQ ID NO: 89939 - RNA, 22 nt, Human
uuuauaauaacucaucuagacc

SEQ ID NO: 89940 - RNA, 22 nt, Human
uuugccuccuuuagagacacug

SEQ ID NO: 89941 - RNA, 18 nt, Human
ccagaagccugagccagg

SEQ ID NO: 89942 - RNA, 24 nt, Human
cgguuuuuuuuuuuuuuuuuuuuu

SEQ ID NO: 89943 - RNA, 26 nt, Human
guuuuuuuuuuuuuuuuuuuuugggg

SEQ ID NO: 89944 - RNA, 25 nt, Human
uuuuuuuuuuuugaaauugcucuca

SEQ ID NO: 89945 - RNA, 21 nt, Human
aaaaaaauuugaacaggacug

SEQ ID NO: 89946 - RNA, 20 nt, Human
aaaaaauagauacagccuuc

SEQ ID NO: 89947 - RNA, 24 nt, Human
aaaaagaaaaaaaaauagauacag

SEQ ID NO: 89948 - RNA, 24 nt, Human
aaaacaagauucuaaccacaaaug

SEQ ID NO: 89949 - RNA, 22 nt, Human
aaaagaaagaagaaacauacac

SEQ ID NO: 89950 - RNA, 20 nt, Human
aaaauacaucccauccucag

SEQ ID NO: 89951 - RNA, 22 nt, Human
aaagaaauggauaaaaaucaaa

SEQ ID NO: 89952 - RNA, 19 nt, Human
aaagacuggcaaaguucua

SEQ ID NO: 89953 - RNA, 24 nt, Human
aaauuaagccaagaucuuaaagac

SEQ ID NO: 89954 - RNA, 20 nt, Human
aacccuggaaaggcaaugaa

SEQ ID NO: 89955 - RNA, 20 nt, Human
aagagcugaaagcugcugcu

SEQ ID NO: 89956 - RNA, 23 nt, Human
aagccucuaaagaacaacugaag

SEQ ID NO: 89957 - RNA, 25 nt, Human
aauaauggaagcaaacaaaacaaga

SEQ ID NO: 89958 - RNA, 22 nt, Human
acacagacuaguguucaacugg

SEQ ID NO: 89959 - RNA, 18 nt, Human
acuaccuaaaaagcuguc

SEQ ID NO: 89960 - RNA, 22 nt, Human
acuccucccacaaauacuucua

SEQ ID NO: 89961 - RNA, 24 nt, Human
acugcaacucaucucccuaacauu

SEQ ID NO: 89962 - RNA, 18 nt, Human
acugcagucaauucugua

SEQ ID NO: 89963 - RNA, 21 nt, Human
agaaaaauacaucccauccuc

SEQ ID NO: 89964 - RNA, 19 nt, Human
agaaaccugcagacauauu

SEQ ID NO: 89965 - RNA, 20 nt, Human
agaacaacagaugaaaagga

SEQ ID NO: 89966 - RNA, 18 nt, Human
agaaggccacagccugac

SEQ ID NO: 89967 - RNA, 18 nt, Human
agaucuuaaagacuggca

SEQ ID NO: 89968 - RNA, 23 nt, Human
agauguuuaaaguuacacagacu

SEQ ID NO: 89969 - RNA, 21 nt, Human
agcacugaacagcaagaaaaa

SEQ ID NO: 89970 - RNA, 25 nt, Human
agccucuaaagaacaacugaagcca

SEQ ID NO: 89971 - RNA, 21 nt, Human
agcuacaaaaaaaaucagaua

SEQ ID NO: 89972 - RNA, 20 nt, Human
aggagggagaagaaaucaca

SEQ ID NO: 89973 - RNA, 21 nt, Human
caaaauaacugaaaaaagaac

SEQ ID NO: 89974 - RNA, 23 nt, Human
caaaauaacugaaaaaagaacca

SEQ ID NO: 89975 - RNA, 28 nt, Human
caaauauauuuccuucccaauaucuucc

SEQ ID NO: 89976 - RNA, 20 nt, Human
cacacaguggaagaagugau

SEQ ID NO: 89977 - RNA, 20 nt, Human
cacagacuaguguucaacug

SEQ ID NO: 89978 - RNA, 26 nt, Human
cacaugaagccaccuccuccacuacc

SEQ ID NO: 89979 - RNA, 18 nt, Human
cacccaucugcaucccgc

SEQ ID NO: 89980 - RNA, 21 nt, Human
cacgugccaugcccugcuagc

SEQ ID NO: 89981 - RNA, 22 nt, Human
cacugaacagcaagaaaaauac

SEQ ID NO: 89982 - RNA, 23 nt, Human
cagaacacacacacuuucugguc

SEQ ID NO: 89983 - RNA, 19 nt, Human
cagcaagaaaaauacaucc

SEQ ID NO: 89984 - RNA, 19 nt, Human
caggggaggagggagaaga

SEQ ID NO: 89985 - RNA, 19 nt, Human
ccaccuccuccacuaccua

SEQ ID NO: 89986 - RNA, 20 nt, Human
ccacucuugcaggggaggag

SEQ ID NO: 89987 - RNA, 21 nt, Human
cccaaguggaauauaaaugcc

SEQ ID NO: 89988 - RNA, 21 nt, Human
cccacacauuugcuucaagga

SEQ ID NO: 89989 - RNA, 23 nt, Human
cccgcacaccuugccccgcgccg

SEQ ID NO: 89990 - RNA, 25 nt, Human
cccgcacaccuugccccgcgccgca

SEQ ID NO: 89991 - RNA, 19 nt, Human
cccgcgccgcaguaaagag

SEQ ID NO: 89992 - RNA, 21 nt, Human
cccgugccccuucccgcccgc

SEQ ID NO: 89993 - RNA, 25 nt, Human
ccggagcucacgugccaugcccugc

SEQ ID NO: 89994 - RNA, 18 nt, Human
ccgugccccuucccgccc

SEQ ID NO: 89995 - RNA, 21 nt, Human
ccucccacaaauacuucuagu

SEQ ID NO: 89996 - RNA, 21 nt, Human
ccucccggggaccgcgggggu

SEQ ID NO: 89997 - RNA, 22 nt, Human
ccucuaaagaacaacugaagcu

SEQ ID NO: 89998 - RNA, 23 nt, Human
ccugcagacauauuuucaggucu

SEQ ID NO: 89999 - RNA, 28 nt, Human
ccuucaaaauaacugaaaaaagaaccaa

SEQ ID NO: 90000 - RNA, 19 nt, Human
cgugccaugcccugcuagc

SEQ ID NO: 90001 - RNA, 21 nt, Human
cuaaagaacaacugaagcuaa

SEQ ID NO: 90002 - RNA, 20 nt, Human
cuaaauaacccuggaaaggc

SEQ ID NO: 90003 - RNA, 21 nt, Human
cuagccucccggggaccgcgg

SEQ ID NO: 90004 - RNA, 24 nt, Human
cucagcuagaagaaagugaggcau

SEQ ID NO: 90005 - RNA, 23 nt, Human
cugaagcuaaaauaauaucuaac

SEQ ID NO: 90006 - RNA, 23 nt, Human
cugcuagauguuuaaaguuacac

SEQ ID NO: 90007 - RNA, 19 nt, Human
cuggagccugcugauggug

SEQ ID NO: 90008 - RNA, 22 nt, Human
cugucugggaacugagcuacag

SEQ ID NO: 90009 - RNA, 19 nt, Human
cuucaaaauaacugaaaaa

SEQ ID NO: 90010 - RNA, 18 nt, Human
gaaaaaacaaaccuaaga

SEQ ID NO: 90011 - RNA, 19 nt, Human
gaacucaauaauggaagca

SEQ ID NO: 90012 - RNA, 21 nt, Human
gaagaaaaugcauagcagagg

SEQ ID NO: 90013 - RNA, 22 nt, Human
gaagacaucuauuccggagcuc

SEQ ID NO: 90014 - RNA, 20 nt, Human
gaaggaggcagauuucugga

SEQ ID NO: 90015 - RNA, 23 nt, Human
gaucacuuuuuuaaaaauucuac

SEQ ID NO: 90016 - RNA, 19 nt, Human
gcgggggugcccgugcccc

SEQ ID NO: 90017 - RNA, 23 nt, Human
gggcauuugacaacaauggaaca

SEQ ID NO: 90018 - RNA, 24 nt, Human
ggugaaggaggcagauuucuggaa

SEQ ID NO: 90019 - RNA, 22 nt, Human
uaaaaagcugucugggaacuga

SEQ ID NO: 90020 - RNA, 26 nt, Human
uaaaagaaauggauaaaaaucaacug

SEQ ID NO: 90021 - RNA, 22 nt, Human
uaacaagccaccugcuccagaa

SEQ ID NO: 90022 - RNA, 23 nt, Human
uaagaucacuuuuuuaaaaauuc

SEQ ID NO: 90023 - RNA, 23 nt, Human
uaagccaagaucuuaaagacugg

SEQ ID NO: 90024 - RNA, 23 nt, Human
uaauacaacuuaaacgcaacuuu

SEQ ID NO: 90025 - RNA, 22 nt, Human
uaauggaagcaaacaaaacaag

SEQ ID NO: 90026 - RNA, 19 nt, Human
uacacuauagugguguggg

SEQ ID NO: 90027 - RNA, 18 nt, Human
uagcagaggagaaagcug

SEQ ID NO: 90028 - RNA, 20 nt, Human
uagcagaggagaaagcuggg

SEQ ID NO: 90029 - RNA, 18 nt, Human
uagccucccggggaccgc

SEQ ID NO: 90030 - RNA, 20 nt, Human
uaugacacaacuguuacaug

SEQ ID NO: 90031 - RNA, 20 nt, Human
ucaaaguauuuuucuguacu

SEQ ID NO: 90032 - RNA, 21 nt, Human
uccacuaccuaaaaagcuguc

SEQ ID NO: 90033 - RNA, 25 nt, Human
ucccacacauuugcuucaaggagaa

SEQ ID NO: 90034 - RNA, 22 nt, Human
uccggagcucacgugccaugcc

SEQ ID NO: 90035 - RNA, 18 nt, Human
uccuaggaccacucuugc

SEQ ID NO: 90036 - RNA, 21 nt, Human
ucuaaccacaaaugacugcac

SEQ ID NO: 90037 - RNA, 22 nt, Human
ugaaaaaacaaaccuaagauca

SEQ ID NO: 90038 - RNA, 22 nt, Human
ugaaaaaagaaccaagaaaagg

SEQ ID NO: 90039 - RNA, 24 nt, Human
ugaaagccucuaaagaacaacuga

SEQ ID NO: 90040 - RNA, 22 nt, Human
ugaaggaggcagauuucuggaa

SEQ ID NO: 90041 - RNA, 19 nt, Human
ugaccacagaacaacagau

SEQ ID NO: 90042 - RNA, 22 nt, Human
ugagggacagaggugugaaugu

SEQ ID NO: 90043 - RNA, 19 nt, Human
ugcaggggaggagggagaa

SEQ ID NO: 90044 - RNA, 24 nt, Human
ugcuucaugucacuccucccacaa

SEQ ID NO: 90045 - RNA, 20 nt, Human
uggaaaugcaaugaucccac

SEQ ID NO: 90046 - RNA, 18 nt, Human
uggaauauaaaugcccaa

SEQ ID NO: 90047 - RNA, 19 nt, Human
uggaggaacacaucugaug

SEQ ID NO: 90048 - RNA, 21 nt, Human
ugggaaagucugcuauguagc

SEQ ID NO: 90049 - RNA, 19 nt, Human
ugggucugcuuaaaagaaa

SEQ ID NO: 90050 - RNA, 18 nt, Human
ugucacuccucccacaaa

SEQ ID NO: 90051 - RNA, 22 nt, Human
ugucagacauuuaaucaggaug

SEQ ID NO: 90052 - RNA, 23 nt, Human
ugugaauuagacuucucaagucu

SEQ ID NO: 90053 - RNA, 24 nt, Human
uuacacagacuaguguucaacugg

SEQ ID NO: 90054 - RNA, 23 nt, Human
uuaggaggaacucaauaauggaa

SEQ ID NO: 90055 - RNA, 21 nt, Human
uuauaaaaacugcaacucauc

SEQ ID NO: 90056 - RNA, 24 nt, Human
uuaucaauuuugagggacagaggu

SEQ ID NO: 90057 - RNA, 24 nt, Human
uucaaaauaacugaaaaaagaacc

SEQ ID NO: 90058 - RNA, 23 nt, Human
uucagucccucuccucaauuucc

SEQ ID NO: 90059 - RNA, 24 nt, Human
uuuaagcucuaaugauuuaaagcu

SEQ ID NO: 90060 - RNA, 19 nt, Human
uuuaagugaacaaacuuua

SEQ ID NO: 90061 - RNA, 22 nt, Human
uuucuggucuaacaaacaucuu

SEQ ID NO: 90062 - RNA, 20 nt, Human
uuugaaagccucuaaagaac

SEQ ID NO: 90063 - RNA, 19 nt, Human
uuugacaacaauggaacag

SEQ ID NO: 90064 - RNA, 24 nt, Human
acaccauccuaguugccuccccaa

SEQ ID NO: 90065 - RNA, 21 nt, Human
cauccuaguugccuccccaaa

SEQ ID NO: 90066 - RNA, 24 nt, Human
ccacaccauccuaguugccucccc

SEQ ID NO: 90067 - RNA, 25 nt, Human
cggccacaccauccuaguugccucc

SEQ ID NO: 90068 - RNA, 23 nt, Human
ugcaaauccguggucggccacac

SEQ ID NO: 90069 - RNA, 18 nt, Human
ugcccuggggucccgucc

SEQ ID NO: 90070 - RNA, 26 nt, Human
aagcaggcaggugguggggggcaggg

SEQ ID NO: 90071 - RNA, 19 nt, Human
agaagcaagcaggcaggug

SEQ ID NO: 90072 - RNA, 24 nt, Human
agagaagcaagcaggcagguggug

SEQ ID NO: 90073 - RNA, 19 nt, Human
aggcagccagagaagcaag

SEQ ID NO: 90074 - RNA, 20 nt, Human
aggcaggugguggggggcag

SEQ ID NO: 90075 - RNA, 21 nt, Human
aggcaggugguggggggcagg

SEQ ID NO: 90076 - RNA, 22 nt, Human
aggcaggugguggggggcaggg

SEQ ID NO: 90077 - RNA, 22 nt, Human
aggugguggggggcaggggagc

SEQ ID NO: 90078 - RNA, 23 nt, Human
gcugucuucagaucucugcuucg

SEQ ID NO: 90079 - RNA, 18 nt, Human
gggcaggggagcaugggg

SEQ ID NO: 90080 - RNA, 19 nt, Human
gugguggggggcaggggag

SEQ ID NO: 90081 - RNA, 22 nt, Human
ucguagguucgucuuccuucca

SEQ ID NO: 90082 - RNA, 20 nt, Human
aacacgggaccuccccaccc

SEQ ID NO: 90083 - RNA, 22 nt, Human
aaccaggaagagcgcuccuccc

SEQ ID NO: 90084 - RNA, 21 nt, Human
aaucacuaauauaaaaaagga

SEQ ID NO: 90085 - RNA, 20 nt, Human
acacgggaccuccccacccc

SEQ ID NO: 90086 - RNA, 19 nt, Human
acugugucgagcuaguggg

SEQ ID NO: 90087 - RNA, 22 nt, Human
acuugcagcugggguggccugg

SEQ ID NO: 90088 - RNA, 20 nt, Human
aggagcgaaggagggaaggc

SEQ ID NO: 90089 - RNA, 18 nt, Human
aggaggcgaggcuuggca

SEQ ID NO: 90090 - RNA, 19 nt, Human
aggcacaggcguucccagc

SEQ ID NO: 90091 - RNA, 21 nt, Human
aggccgguggugcugaguggg

SEQ ID NO: 90092 - RNA, 18 nt, Human
agggguguuugggggucg

SEQ ID NO: 90093 - RNA, 26 nt, Human
aguggggagaggggacacaucaggau

SEQ ID NO: 90094 - RNA, 20 nt, Human
aguggguggccucugaagug

SEQ ID NO: 90095 - RNA, 19 nt, Human
cacccccauaaccaguaca

SEQ ID NO: 90096 - RNA, 26 nt, Human
cacuaauauaaaaaaggagcgaagga

SEQ ID NO: 90097 - RNA, 33 nt, Human
cagacagauguggggccuuuuauuauuuggggg

SEQ ID NO: 90098 - RNA, 18 nt, Human
cagcucagggcagggccc

SEQ ID NO: 90099 - RNA, 23 nt, Human
cagcuccuggucggcagcagggc

SEQ ID NO: 90100 - RNA, 19 nt, Human
ccacacaguucugcccgga

SEQ ID NO: 90101 - RNA, 18 nt, Human
ccaggccgguggugcuga

SEQ ID NO: 90102 - RNA, 31 nt, Human
ccaggccgguggugcugaguggguggccucc

SEQ ID NO: 90103 - RNA, 24 nt, Human
cccauggcuggcacaggcaggggc

SEQ ID NO: 90104 - RNA, 23 nt, Human
ccccaccccaagccuagugccuc

SEQ ID NO: 90105 - RNA, 18 nt, Human
ccccauaaccaguacaca

SEQ ID NO: 90106 - RNA, 22 nt, Human
ccccuccgcccuccgcccuccc

SEQ ID NO: 90107 - RNA, 25 nt, Human
cccgccgccccuccgcccuccgccc

SEQ ID NO: 90108 - RNA, 20 nt, Human
ccggagcagaugaacgaugg

SEQ ID NO: 90109 - RNA, 20 nt, Human
ccuccccaccccaagccuag

SEQ ID NO: 90110 - RNA, 18 nt, Human
ccuccccgcccuccuccc

SEQ ID NO: 90111 - RNA, 18 nt, Human
ccuccccgcccuccuccc

SEQ ID NO: 90112 - RNA, 20 nt, Human
ccuccccgcccuccucccgc

SEQ ID NO: 90113 - RNA, 19 nt, Human
ccucccgccgccccuccgc

SEQ ID NO: 90114 - RNA, 24 nt, Human
ccucccgccgccccuccgcccucc

SEQ ID NO: 90115 - RNA, 27 nt, Human
ccucccgccgccccuccgcccuccgcc

SEQ ID NO: 90116 - RNA, 23 nt, Human
ccugaagaguccccuuuaaaauc

SEQ ID NO: 90117 - RNA, 22 nt, Human
ccuggcuuggcaaugggugggg

SEQ ID NO: 90118 - RNA, 26 nt, Human
cgccuggacugcagacugugucgagc

SEQ ID NO: 90119 - RNA, 21 nt, Human
cggcgcaggaaggcacaggcg

SEQ ID NO: 90120 - RNA, 18 nt, Human
cuccgcccuccgcccucc

SEQ ID NO: 90121 - RNA, 24 nt, Human
cuccuccccgcccuccucccgccg

SEQ ID NO: 90122 - RNA, 20 nt, Human
cucugaaguggggagagggg

SEQ ID NO: 90123 - RNA, 25 nt, Human
gaacaagcgaaagcugccuuccugg

SEQ ID NO: 90124 - RNA, 19 nt, Human
gacagagggggcguuggcu

SEQ ID NO: 90125 - RNA, 18 nt, Human
gacgaggagggaggggag

SEQ ID NO: 90126 - RNA, 21 nt, Human
gagccgggaggcggcuccaca

SEQ ID NO: 90127 - RNA, 23 nt, Human
gcacccccauaaccaguacacaa

SEQ ID NO: 90128 - RNA, 21 nt, Human
gccccggggccuccccgagcc

SEQ ID NO: 90129 - RNA, 19 nt, Human
gcccggagcagaugaacga

SEQ ID NO: 90130 - RNA, 19 nt, Human
gcugccucucugcuccaag

SEQ ID NO: 90131 - RNA, 19 nt, Human
ggaaggccgaccgcccaca

SEQ ID NO: 90132 - RNA, 21 nt, Human
ggaaggccgaccgcccacagg

SEQ ID NO: 90133 - RNA, 22 nt, Human
ggaaggccgaccgcccacaggc

SEQ ID NO: 90134 - RNA, 18 nt, Human
ggagaggggacaggagga

SEQ ID NO: 90135 - RNA, 19 nt, Human
ggcacuugcagcuggggug

SEQ ID NO: 90136 - RNA, 22 nt, Human
ggcagcagggccagggaaggac

SEQ ID NO: 90137 - RNA, 20 nt, Human
gggaccuccccaccccaagc

SEQ ID NO: 90138 - RNA, 18 nt, Human
gggggcguuggcuucggc

SEQ ID NO: 90139 - RNA, 22 nt, Human
guucccagccccggggccuccc

SEQ ID NO: 90140 - RNA, 18 nt, Human
ucccagccccggggccuc

SEQ ID NO: 90141 - RNA, 26 nt, Human
ucccagccccggggccuccccgagcc

SEQ ID NO: 90142 - RNA, 21 nt, Human
ucccugaggcuggcuucccgg

SEQ ID NO: 90143 - RNA, 18 nt, Human
uccuccccgcccuccucc

SEQ ID NO: 90144 - RNA, 19 nt, Human
ucgcugcagucccugaggc

SEQ ID NO: 90145 - RNA, 21 nt, Human
ugaggcuggcuucccgguggc

SEQ ID NO: 90146 - RNA, 24 nt, Human
ugaguggguggccucugaaguggg

SEQ ID NO: 90147 - RNA, 22 nt, Human
ugccucuggcacccccauaacc

SEQ ID NO: 90148 - RNA, 18 nt, Human
ugcuggggaaacccgggg

SEQ ID NO: 90149 - RNA, 20 nt, Human
ugcuggggaaacccggggcu

SEQ ID NO: 90150 - RNA, 18 nt, Human
uggcuggcacaggcaggg

SEQ ID NO: 90151 - RNA, 20 nt, Human
uggcuucccgguggcagcuc

SEQ ID NO: 90152 - RNA, 20 nt, Human
ugggaggagaggggacagga

SEQ ID NO: 90153 - RNA, 24 nt, Human
uggguggggcccagggaguccauc

SEQ ID NO: 90154 - RNA, 22 nt, Human
ugguaggaggcgaggcuuggca

SEQ ID NO: 90155 - RNA, 19 nt, Human
ugguguggugugguaggag

SEQ ID NO: 90156 - RNA, 19 nt, Human
ugucccgaggcaggaacaa

SEQ ID NO: 90157 - RNA, 19 nt, Human
uguggugugguaggaggcg

SEQ ID NO: 90158 - RNA, 22 nt, Human
uuauuugggguuccucuauaug

SEQ ID NO: 90159 - RNA, 21 nt, Human
uucccgguggcagcucagggc

SEQ ID NO: 90160 - RNA, 24 nt, Human
uuggcagacgaggagggaggggag

SEQ ID NO: 90161 - RNA, 19 nt, Human
aaauaguuauaaagaagau

SEQ ID NO: 90162 - RNA, 19 nt, Human
aaauaguuauaaagaagau

SEQ ID NO: 90163 - RNA, 18 nt, Human
aagaugccaggaaaacag

SEQ ID NO: 90164 - RNA, 19 nt, Human
aaggcaccguggcccaggc

SEQ ID NO: 90165 - RNA, 24 nt, Human
aaggggaagcagggguuggugggg

SEQ ID NO: 90166 - RNA, 20 nt, Human
aauaaugaaggaagacagaa

SEQ ID NO: 90167 - RNA, 24 nt, Human
acaauaaauaguuauaaagaagau

SEQ ID NO: 90168 - RNA, 24 nt, Human
acaauaaauaguuauaaagaagau

SEQ ID NO: 90169 - RNA, 22 nt, Human
acccaggccccaggcagcgccc

SEQ ID NO: 90170 - RNA, 18 nt, Human
acccgccgcuucucuacc

SEQ ID NO: 90171 - RNA, 20 nt, Human
acccucugggugugaggccu

SEQ ID NO: 90172 - RNA, 20 nt, Human
acccucugggugugaggccu

SEQ ID NO: 90173 - RNA, 20 nt, Human
acccucugggugugaggccu

SEQ ID NO: 90174 - RNA, 20 nt, Human
acccucugggugugaggccu

SEQ ID NO: 90175 - RNA, 21 nt, Human
accugagcuggcacagggggc

SEQ ID NO: 90176 - RNA, 20 nt, Human
agaaggcucagcuacgagga

SEQ ID NO: 90177 - RNA, 20 nt, Human
agaaggcucagcuacgagga

SEQ ID NO: 90178 - RNA, 21 nt, Human
agacccgcagccagaauuugg

SEQ ID NO: 90179 - RNA, 23 nt, Human
agcugcacggucccccacucccc

SEQ ID NO: 90180 - RNA, 18 nt, Human
aggcaaccugggggcugc

SEQ ID NO: 90181 - RNA, 25 nt, Human
agggcacaaccuuguaggugccugc

SEQ ID NO: 90182 - RNA, 25 nt, Human
agggcacaaccuuguaggugccugc

SEQ ID NO: 90183 - RNA, 25 nt, Human
agggcacaaccuuguaggugccugc

SEQ ID NO: 90184 - RNA, 22 nt, Human
agggcugccccggggguggugu

SEQ ID NO: 90185 - RNA, 22 nt, Human
aggggaagcagggguugguggg

SEQ ID NO: 90186 - RNA, 21 nt, Human
agggguuggugggguaugagg

SEQ ID NO: 90187 - RNA, 22 nt, Human
agggguuggugggguaugaggc

SEQ ID NO: 90188 - RNA, 18 nt, Human
aggucuuucaugagucug

SEQ ID NO: 90189 - RNA, 18 nt, Human
aggucuuucaugagucug

SEQ ID NO: 90190 - RNA, 21 nt, Human
agucauuguugaaagaugcca

SEQ ID NO: 90191 - RNA, 24 nt, Human
agucugcaauccaggugucagccg

SEQ ID NO: 90192 - RNA, 27 nt, Human
auaaauaaugaaggaagaccgguaccc

SEQ ID NO: 90193 - RNA, 23 nt, Human
augacggagaccucuuggaggaa

SEQ ID NO: 90194 - RNA, 21 nt, Human
auucacuuccagcucccccag

SEQ ID NO: 90195 - RNA, 21 nt, Human
auucacuuccagcucccccag

SEQ ID NO: 90196 - RNA, 25 nt, Human
caaaggcaccguggcccaggcaacc

SEQ ID NO: 90197 - RNA, 20 nt, Human
caaaguuccugcugcccccc

SEQ ID NO: 90198 - RNA, 21 nt, Human
caacagaagccagcaagcuuc

SEQ ID NO: 90199 - RNA, 21 nt, Human
caacagaagccagcaagcuuc

SEQ ID NO: 90200 - RNA, 21 nt, Human
caacagaagccagcaagcuuc

SEQ ID NO: 90201 - RNA, 21 nt, Human
caacagaagccagcaagcuuc

SEQ ID NO: 90202 - RNA, 21 nt, Human
cacaacgcagguggaccuccc

SEQ ID NO: 90203 - RNA, 21 nt, Human
cacaacgcagguggaccuccc

SEQ ID NO: 90204 - RNA, 23 nt, Human
cacccagaacuccccuuccugga

SEQ ID NO: 90205 - RNA, 24 nt, Human
cacccagaacuccccuuccuggag

SEQ ID NO: 90206 - RNA, 18 nt, Human
cacccucugggaccugga

SEQ ID NO: 90207 - RNA, 19 nt, Human
cacccucugggaccuggaa

SEQ ID NO: 90208 - RNA, 23 nt, Human
cacccuguuagguuuucaucacu

SEQ ID NO: 90209 - RNA, 23 nt, Human
cacccuguuagguuuucaucacu

SEQ ID NO: 90210 - RNA, 23 nt, Human
cacccuguuagguuuucaucacu

SEQ ID NO: 90211 - RNA, 21 nt, Human
caccguggcccaggcaaccug

SEQ ID NO: 90212 - RNA, 22 nt, Human
caccugagcuggcacagggggc

SEQ ID NO: 90213 - RNA, 22 nt, Human
caccugagcuggcacagggggc

SEQ ID NO: 90214 - RNA, 22 nt, Human
caccugagcuggcacagggggc

SEQ ID NO: 90215 - RNA, 22 nt, Human
caccugagcuggcacagggggc

SEQ ID NO: 90216 - RNA, 20 nt, Human
cagcaagcuucccacccuuc

SEQ ID NO: 90217 - RNA, 20 nt, Human
cagcaagcuucccacccuuc

SEQ ID NO: 90218 - RNA, 20 nt, Human
cagcagugggggugcguccu

SEQ ID NO: 90219 - RNA, 20 nt, Human
cagcagugggggugcguccu

SEQ ID NO: 90220 - RNA, 18 nt, Human
cagcccccuggcagggcu

SEQ ID NO: 90221 - RNA, 18 nt, Human
cagcccccuggcagggcu

SEQ ID NO: 90222 - RNA, 18 nt, Human
cagcccccuggcagggcu

SEQ ID NO: 90223 - RNA, 18 nt, Human
cagcccccuggcagggcu

SEQ ID NO: 90224 - RNA, 20 nt, Human
cagcccccuggcagggcugg

SEQ ID NO: 90225 - RNA, 20 nt, Human
cagcccccuggcagggcugg

SEQ ID NO: 90226 - RNA, 20 nt, Human
cagcccccuggcagggcugg

SEQ ID NO: 90227 - RNA, 20 nt, Human
cagcccccuggcagggcugg

SEQ ID NO: 90228 - RNA, 18 nt, Human
cagccgccgccgccuccg

SEQ ID NO: 90229 - RNA, 19 nt, Human
cagccgccgccgccuccgg

SEQ ID NO: 90230 - RNA, 27 nt, Human
cagcucagcagcggcuccugcagcagg

SEQ ID NO: 90231 - RNA, 27 nt, Human
cagcucagcagcggcuccugcagcagg

SEQ ID NO: 90232 - RNA, 26 nt, Human
caggaggcagagccggcucaccuccu

SEQ ID NO: 90233 - RNA, 26 nt, Human
caggaggcagagccggcucaccuccu

SEQ ID NO: 90234 - RNA, 26 nt, Human
caggaggcagagccggcucaccuccu

SEQ ID NO: 90235 - RNA, 23 nt, Human
caguuccugugggucaggaauuc

SEQ ID NO: 90236 - RNA, 25 nt, Human
caucagaaggcucagcuaagaugag

SEQ ID NO: 90237 - RNA, 22 nt, Human
caucagaaggcucagcuacgag

SEQ ID NO: 90238 - RNA, 18 nt, Human
caucagcgcucauguuua

SEQ ID NO: 90239 - RNA, 18 nt, Human
caucagcgcucauguuua

SEQ ID NO: 90240 - RNA, 18 nt, Human
caucagcgcucauguuua

SEQ ID NO: 90241 - RNA, 18 nt, Human
caucagcgcucauguuua

SEQ ID NO: 90242 - RNA, 24 nt, Human
caugacggagaccucuuggaggaa

SEQ ID NO: 90243 - RNA, 24 nt, Human
caugacggagaccucuuggaggaa

SEQ ID NO: 90244 - RNA, 22 nt, Human
ccaaagaguuaaugaaggaaca

SEQ ID NO: 90245 - RNA, 25 nt, Human
ccaccagugcccgggcccggccugc

SEQ ID NO: 90246 - RNA, 27 nt, Human
ccacccagaacuccccuuccuggagcu

SEQ ID NO: 90247 - RNA, 22 nt, Human
ccacugcccugauggcgcuaag

SEQ ID NO: 90248 - RNA, 22 nt, Human
ccagaggugcagacccacagcc

SEQ ID NO: 90249 - RNA, 21 nt, Human
ccagcaagcuucccacccuuc

SEQ ID NO: 90250 - RNA, 21 nt, Human
ccagcaagcuucccacccuuc

SEQ ID NO: 90251 - RNA, 21 nt, Human
ccagcaagcuucccacccuuc

SEQ ID NO: 90252 - RNA, 21 nt, Human
ccagcccccacagugcaaggc

SEQ ID NO: 90253 - RNA, 21 nt, Human
ccagcccccacagugcaaggc

SEQ ID NO: 90254 - RNA, 21 nt, Human
ccagcccccacagugcaaggc

SEQ ID NO: 90255 - RNA, 21 nt, Human
ccagcccccacagugcaaggc

SEQ ID NO: 90256 - RNA, 21 nt, Human
ccaggccccaggcagcgcccg

SEQ ID NO: 90257 - RNA, 21 nt, Human
cccagaacuccccuuccugga

SEQ ID NO: 90258 - RNA, 19 nt, Human
cccagcugcugggaaccug

SEQ ID NO: 90259 - RNA, 19 nt, Human
cccagcugcugggaaccug

SEQ ID NO: 90260 - RNA, 19 nt, Human
cccagcugcugggaaccug

SEQ ID NO: 90261 - RNA, 19 nt, Human
cccagcugcugggaaccug

SEQ ID NO: 90262 - RNA, 22 nt, Human
ccccacagugcaaggcuggccg

SEQ ID NO: 90263 - RNA, 22 nt, Human
ccccacagugcaaggcuggccg

SEQ ID NO: 90264 - RNA, 22 nt, Human
ccccacagugcaaggcuggccg

SEQ ID NO: 90265 - RNA, 22 nt, Human
ccccacagugcaaggcuggccg

SEQ ID NO: 90266 - RNA, 19 nt, Human
ccccacucccccgcaggca

SEQ ID NO: 90267 - RNA, 20 nt, Human
ccccagggcugcgucucucc

SEQ ID NO: 90268 - RNA, 20 nt, Human
ccccagggcugcgucucucc

SEQ ID NO: 90269 - RNA, 20 nt, Human
ccccagggcugcgucucucc

SEQ ID NO: 90270 - RNA, 20 nt, Human
ccccagggcugcgucucucc

SEQ ID NO: 90271 - RNA, 23 nt, Human
ccccagguggcuguugguagagu

SEQ ID NO: 90272 - RNA, 23 nt, Human
ccccagguggcuguugguagagu

SEQ ID NO: 90273 - RNA, 18 nt, Human
cccccagguggcuguugg

SEQ ID NO: 90274 - RNA, 18 nt, Human
cccccagguggcuguugg

SEQ ID NO: 90275 - RNA, 21 nt, Human
cccccgcaggcagggcugccc

SEQ ID NO: 90276 - RNA, 21 nt, Human
cccgcguauggcagagcagcc

SEQ ID NO: 90277 - RNA, 19 nt, Human
cccggcccagcccuccaag

SEQ ID NO: 90278 - RNA, 24 nt, Human
cccggcccagcccuccaagcccga

SEQ ID NO: 90279 - RNA, 23 nt, Human
cccgggcccggccugcccagucc

SEQ ID NO: 90280 - RNA, 18 nt, Human
cccgggcuucacuuggcc

SEQ ID NO: 90281 - RNA, 23 nt, Human
cccgggcuucacuuggcccuggc

SEQ ID NO: 90282 - RNA, 18 nt, Human
cccuccaagcccgagggc

SEQ ID NO: 90283 - RNA, 24 nt, Human
cccucgggcuccagucaccugagc

SEQ ID NO: 90284 - RNA, 24 nt, Human
cccucgggcuccagucaccugagc

SEQ ID NO: 90285 - RNA, 24 nt, Human
cccucgggcuccagucaccugagc

SEQ ID NO: 90286 - RNA, 24 nt, Human
cccucgggcuccagucaccugagc

SEQ ID NO: 90287 - RNA, 19 nt, Human
cccucugggugugaggccu

SEQ ID NO: 90288 - RNA, 19 nt, Human
cccucugggugugaggccu

SEQ ID NO: 90289 - RNA, 19 nt, Human
cccucugggugugaggccu

SEQ ID NO: 90290 - RNA, 19 nt, Human
cccucugggugugaggccu

SEQ ID NO: 90291 - RNA, 22 nt, Human
cccucugggugugaggccucca

SEQ ID NO: 90292 - RNA, 22 nt, Human
cccucugggugugaggccucca

SEQ ID NO: 90293 - RNA, 22 nt, Human
cccucugggugugaggccucca

SEQ ID NO: 90294 - RNA, 22 nt, Human
cccucugggugugaggccucca

SEQ ID NO: 90295 - RNA, 19 nt, Human
cccugaggaacuccuccuc

SEQ ID NO: 90296 - RNA, 20 nt, Human
ccgccgccgccuccggcccg

SEQ ID NO: 90297 - RNA, 22 nt, Human
ccgccgccgccuccggcccgcc

SEQ ID NO: 90298 - RNA, 23 nt, Human
ccgccgccgccuccggcccgccc

SEQ ID NO: 90299 - RNA, 27 nt, Human
ccgccgccuccggcccgccccgcccgu

SEQ ID NO: 90300 - RNA, 22 nt, Human
ccggcccgccccgcccguuccc

SEQ ID NO: 90301 - RNA, 20 nt, Human
ccucaacaugaccaaagagu

SEQ ID NO: 90302 - RNA, 21 nt, Human
ccuccuuguagcugggcccac

SEQ ID NO: 90303 - RNA, 24 nt, Human
ccugcaaguccuccuuguagcugg

SEQ ID NO: 90304 - RNA, 24 nt, Human
ccuggagcugggacaggggucccc

SEQ ID NO: 90305 - RNA, 23 nt, Human
ccuggcuccuuccacccucuggg

SEQ ID NO: 90306 - RNA, 24 nt, Human
ccuggcuccuuccacccucuggga

SEQ ID NO: 90307 - RNA, 26 nt, Human
cgcagcucagcagcggcuccugcagc

SEQ ID NO: 90308 - RNA, 26 nt, Human
cgcagcucagcagcggcuccugcagc

SEQ ID NO: 90309 - RNA, 25 nt, Human
cgcccggcccagcccuccaagcccg

SEQ ID NO: 90310 - RNA, 19 nt, Human
cgcccgguagagaagacuc

SEQ ID NO: 90311 - RNA, 19 nt, Human
cgcccgguagagaagacuc

SEQ ID NO: 90312 - RNA, 24 nt, Human
cggaggcuucccguggaccccuag

SEQ ID NO: 90313 - RNA, 24 nt, Human
cggaggcuucccguggaccccuag

SEQ ID NO: 90314 - RNA, 24 nt, Human
cggaggcuucccguggaccccuag

SEQ ID NO: 90315 - RNA, 24 nt, Human
cggaggcuucccguggaccccuag

SEQ ID NO: 90316 - RNA, 21 nt, Human
cggcagccuccugcugacugg

SEQ ID NO: 90317 - RNA, 20 nt, Human
cggcagugcugaugcagagu

SEQ ID NO: 90318 - RNA, 20 nt, Human
cggcagugcugaugcagagu

SEQ ID NO: 90319 - RNA, 22 nt, Human
cggcccagcccuccaagcccga

SEQ ID NO: 90320 - RNA, 23 nt, Human
cggcuccgcgggcucccaucugc

SEQ ID NO: 90321 - RNA, 20 nt, Human
cguaugcauggcacgcggug

SEQ ID NO: 90322 - RNA, 20 nt, Human
cguaugcauggcacgcggug

SEQ ID NO: 90323 - RNA, 19 nt, Human
cucccccagguggcuguug

SEQ ID NO: 90324 - RNA, 19 nt, Human
cucccccagguggcuguug

SEQ ID NO: 90325 - RNA, 19 nt, Human
cuccuccacccagaacucc

SEQ ID NO: 90326 - RNA, 22 nt, Human
cuccugcagcagcagugggggu

SEQ ID NO: 90327 - RNA, 22 nt, Human
cucugggauccuggggucucug

SEQ ID NO: 90328 - RNA, 22 nt, Human
cucugggauccuggggucucug

SEQ ID NO: 90329 - RNA, 22 nt, Human
cucugggauccuggggucucug

SEQ ID NO: 90330 - RNA, 22 nt, Human
cucugggauccuggggucucug

SEQ ID NO: 90331 - RNA, 18 nt, Human
cuggcccagcaucuccug

SEQ ID NO: 90332 - RNA, 18 nt, Human
cuggcccagcaucuccug

SEQ ID NO: 90333 - RNA, 18 nt, Human
cuggcccagcaucuccug

SEQ ID NO: 90334 - RNA, 20 nt, Human
cugggauccuggggucucug

SEQ ID NO: 90335 - RNA, 20 nt, Human
cugggauccuggggucucug

SEQ ID NO: 90336 - RNA, 21 nt, Human
cugggcccacaaaggcaccgu

SEQ ID NO: 90337 - RNA, 22 nt, Human
cuugacccaggccccaggcagc

SEQ ID NO: 90338 - RNA, 19 nt, Human
cuuggcccuggcgccagua

SEQ ID NO: 90339 - RNA, 23 nt, Human
gaauggauggccugucaauccug

SEQ ID NO: 90340 - RNA, 23 nt, Human
gaauggauggccugucaauccug

SEQ ID NO: 90341 - RNA, 23 nt, Human
gaauggauggccugucaauccug

SEQ ID NO: 90342 - RNA, 24 nt, Human
gacccgccgcuucucuaccaaucc

SEQ ID NO: 90343 - RNA, 21 nt, Human
gacccgccgcuucucuaccuu

SEQ ID NO: 90344 - RNA, 19 nt, Human
gaccgagaaggggaagcag

SEQ ID NO: 90345 - RNA, 19 nt, Human
gagccugcaaguccuccuu

SEQ ID NO: 90346 - RNA, 19 nt, Human
gagggauccugggaagcuc

SEQ ID NO: 90347 - RNA, 19 nt, Human
gagggauccugggaagcuc

SEQ ID NO: 90348 - RNA, 19 nt, Human
gagggauccugggaagcuc

SEQ ID NO: 90349 - RNA, 19 nt, Human
gagggauccugggaagcuc

SEQ ID NO: 90350 - RNA, 23 nt, Human
gagugaugcggacgcagcggggg

SEQ ID NO: 90351 - RNA, 23 nt, Human
gagugaugcggacgcagcggggg

SEQ ID NO: 90352 - RNA, 18 nt, Human
gauccugggaagcucugg

SEQ ID NO: 90353 - RNA, 18 nt, Human
gauccugggaagcucugg

SEQ ID NO: 90354 - RNA, 18 nt, Human
gauccugggaagcucugg

SEQ ID NO: 90355 - RNA, 18 nt, Human
gauccugggaagcucugg

SEQ ID NO: 90356 - RNA, 20 nt, Human
gcagagcagccucucugugu

SEQ ID NO: 90357 - RNA, 19 nt, Human
gcagcagcagugggggugc

SEQ ID NO: 90358 - RNA, 19 nt, Human
gcagcagcagugggggugc

SEQ ID NO: 90359 - RNA, 22 nt, Human
gcagccuggaucucugcaggac

SEQ ID NO: 90360 - RNA, 18 nt, Human
gcagcgggggccagggcc

SEQ ID NO: 90361 - RNA, 18 nt, Human
gcagcgggggccagggcc

SEQ ID NO: 90362 - RNA, 18 nt, Human
gcaggaggcagagccggc

SEQ ID NO: 90363 - RNA, 18 nt, Human
gcaggaggcagagccggc

SEQ ID NO: 90364 - RNA, 18 nt, Human
gcaggaggcagagccggc

SEQ ID NO: 90365 - RNA, 18 nt, Human
gcccacaaaggcaccgug

SEQ ID NO: 90366 - RNA, 20 nt, Human
gcccagcaucuccuggcugu

SEQ ID NO: 90367 - RNA, 20 nt, Human
gcccagcaucuccuggcugu

SEQ ID NO: 90368 - RNA, 22 nt, Human
gcccugccuuuccuaugcaaac

SEQ ID NO: 90369 - RNA, 19 nt, Human
gcccuugacccaggcccca

SEQ ID NO: 90370 - RNA, 18 nt, Human
gccugcccaguccgccgc

SEQ ID NO: 90371 - RNA, 19 nt, Human
gccugucaauccugguugc

SEQ ID NO: 90372 - RNA, 19 nt, Human
gccugucaauccugguugc

SEQ ID NO: 90373 - RNA, 19 nt, Human
gccugucaauccugguugc

SEQ ID NO: 90374 - RNA, 19 nt, Human
gcggcuccugcagcagcag

SEQ ID NO: 90375 - RNA, 23 nt, Human
gcuccugcagcagcagugggggu

SEQ ID NO: 90376 - RNA, 19 nt, Human
gcugcaucuaccuggcucc

SEQ ID NO: 90377 - RNA, 21 nt, Human
ggaacuccuccuccuccaccc

SEQ ID NO: 90378 - RNA, 30 nt, Human
ggaagacagaaguagaauaucacuacuuug

SEQ ID NO: 90379 - RNA, 19 nt, Human
ggacaggagcucagaugcu

SEQ ID NO: 90380 - RNA, 20 nt, Human
ggaccccuaggccgcagccc

SEQ ID NO: 90381 - RNA, 20 nt, Human
ggaccccuaggccgcagccc

SEQ ID NO: 90382 - RNA, 20 nt, Human
ggaccccuaggccgcagccc

SEQ ID NO: 90383 - RNA, 20 nt, Human
ggaccccuaggccgcagccc

SEQ ID NO: 90384 - RNA, 18 nt, Human
ggcaggaggcagagccgg

SEQ ID NO: 90385 - RNA, 18 nt, Human
ggcaggaggcagagccgg

SEQ ID NO: 90386 - RNA, 18 nt, Human
ggcaggaggcagagccgg

SEQ ID NO: 90387 - RNA, 22 nt, Human
ggcaggaggcagagccggcuca

SEQ ID NO: 90388 - RNA, 22 nt, Human
ggcaggaggcagagccggcuca

SEQ ID NO: 90389 - RNA, 22 nt, Human
ggcaggaggcagagccggcuca

SEQ ID NO: 90390 - RNA, 22 nt, Human
ggcccaggcaaccugggggcug

SEQ ID NO: 90391 - RNA, 24 nt, Human
ggcuucacuuggcccuggcgccag

SEQ ID NO: 90392 - RNA, 21 nt, Human
gggcugcagucucaucagaag

SEQ ID NO: 90393 - RNA, 21 nt, Human
gggcugcagucucaucagaag

SEQ ID NO: 90394 - RNA, 21 nt, Human
gggcugcagucucaucagaag

SEQ ID NO: 90395 - RNA, 19 nt, Human
gggggcauggacaggaccc

SEQ ID NO: 90396 - RNA, 19 nt, Human
gggggcauggacaggaccc

SEQ ID NO: 90397 - RNA, 21 nt, Human
ggggugcguccuggcuccuuc

SEQ ID NO: 90398 - RNA, 21 nt, Human
ggggugcguccuggcuccuuc

SEQ ID NO: 90399 - RNA, 18 nt, Human
gggguggaacucgguguc

SEQ ID NO: 90400 - RNA, 19 nt, Human
gguagagaagacucggagc

SEQ ID NO: 90401 - RNA, 19 nt, Human
gguagagaagacucggagc

SEQ ID NO: 90402 - RNA, 19 nt, Human
ggugcuggggacagccagg

SEQ ID NO: 90403 - RNA, 21 nt, Human
ggugcuggggacagccaggua

SEQ ID NO: 90404 - RNA, 21 nt, Human
gguugcugggaaagccgcugu

SEQ ID NO: 90405 - RNA, 23 nt, Human
guggcgcaacagaagccagcaag

SEQ ID NO: 90406 - RNA, 23 nt, Human
guggcgcaacagaagccagcaag

SEQ ID NO: 90407 - RNA, 23 nt, Human
guggcgcaacagaagccagcaag

SEQ ID NO: 90408 - RNA, 23 nt, Human
guggcgcaacagaagccagcaag

SEQ ID NO: 90409 - RNA, 18 nt, Human
uaaaugaggaaaggaagg

SEQ ID NO: 90410 - RNA, 23 nt, Human
uauaaagaagaucugcugcccua

SEQ ID NO: 90411 - RNA, 23 nt, Human
uauaaagaagaucugcugcccua

SEQ ID NO: 90412 - RNA, 23 nt, Human
uauaaagaagaucugcugcccua

SEQ ID NO: 90413 - RNA, 23 nt, Human
uauaaagaagaucugcugcccua

SEQ ID NO: 90414 - RNA, 26 nt, Human
ucaaacucccugaggaaccggguguc

SEQ ID NO: 90415 - RNA, 18 nt, Human
ucaagcauuugcccugcc

SEQ ID NO: 90416 - RNA, 18 nt, Human
ucagccgccgccgccucc

SEQ ID NO: 90417 - RNA, 19 nt, Human
ucagccgccgccgccuccg

SEQ ID NO: 90418 - RNA, 23 nt, Human
ucagggucuuucaugagucugca

SEQ ID NO: 90419 - RNA, 22 nt, Human
uccaagaaccccguagcugcac

SEQ ID NO: 90420 - RNA, 21 nt, Human
uccaggugucagcuggggcug

SEQ ID NO: 90421 - RNA, 22 nt, Human
uccaggugucagcuggggcugc

SEQ ID NO: 90422 - RNA, 18 nt, Human
ucccccagguggcuguug

SEQ ID NO: 90423 - RNA, 18 nt, Human
ucccccagguggcuguug

SEQ ID NO: 90424 - RNA, 20 nt, Human
ucccccagguggcuguuggu

SEQ ID NO: 90425 - RNA, 20 nt, Human
ucccccagguggcuguuggu

SEQ ID NO: 90426 - RNA, 30 nt, Human
ucccccgcaggcagggcugccccggggguu

SEQ ID NO: 90427 - RNA, 22 nt, Human
ucccgggcuucacuuggcccug

SEQ ID NO: 90428 - RNA, 22 nt, Human
ucccugaggaacuccuccuccu

SEQ ID NO: 90429 - RNA, 23 nt, Human
uccuggagcugggacaggagcuc

SEQ ID NO: 90430 - RNA, 22 nt, Human
ucugcaauccaggugucagccg

SEQ ID NO: 90431 - RNA, 22 nt, Human
ucugcaauccaggugucagcug

SEQ ID NO: 90432 - RNA, 26 nt, Human
ucugcaauccaggugucagcuggggc

SEQ ID NO: 90433 - RNA, 18 nt, Human
ucugcagguggccggccu

SEQ ID NO: 90434 - RNA, 20 nt, Human
ugacccaggccccaggcagc

SEQ ID NO: 90435 - RNA, 20 nt, Human
ugaggaacuccuccuccucc

SEQ ID NO: 90436 - RNA, 21 nt, Human
ugaggcaaaguuccugcugcc

SEQ ID NO: 90437 - RNA, 19 nt, Human
ugcaaggcuggccggccca

SEQ ID NO: 90438 - RNA, 19 nt, Human
ugcaaggcuggccggccca

SEQ ID NO: 90439 - RNA, 19 nt, Human
ugcaaggcuggccggccca

SEQ ID NO: 90440 - RNA, 19 nt, Human
ugcaaggcuggccggccca

SEQ ID NO: 90441 - RNA, 22 nt, Human
ugccagccacggggggcaugga

SEQ ID NO: 90442 - RNA, 22 nt, Human
ugccagccacggggggcaugga

SEQ ID NO: 90443 - RNA, 23 nt, Human
ugccaugacggagaccucuugga

SEQ ID NO: 90444 - RNA, 23 nt, Human
ugccaugacggagaccucuugga

SEQ ID NO: 90445 - RNA, 23 nt, Human
ugccaugacggagaccucuugga

SEQ ID NO: 90446 - RNA, 18 nt, Human
ugcccgggaugcucgcug

SEQ ID NO: 90447 - RNA, 21 nt, Human
ugcccgggaugcucgcugggc

SEQ ID NO: 90448 - RNA, 19 nt, Human
ugcccuacccucugggugu

SEQ ID NO: 90449 - RNA, 21 nt, Human
ugcccuacccucuggguguga

SEQ ID NO: 90450 - RNA, 21 nt, Human
ugcccuacccucuggguguga

SEQ ID NO: 90451 - RNA, 21 nt, Human
ugcccuacccucuggguguga

SEQ ID NO: 90452 - RNA, 22 nt, Human
ugcccugccuuuccuaugcaaa

SEQ ID NO: 90453 - RNA, 18 nt, Human
ugcuggggacagccaggu

SEQ ID NO: 90454 - RNA, 18 nt, Human
ugcuggggacagccaggu

SEQ ID NO: 90455 - RNA, 23 nt, Human
uggacagugggccuuccagcaac

SEQ ID NO: 90456 - RNA, 18 nt, Human
uggaccccuaggccgcag

SEQ ID NO: 90457 - RNA, 18 nt, Human
uggaccccuaggccgcag

SEQ ID NO: 90458 - RNA, 18 nt, Human
uggaccccuaggccgcag

SEQ ID NO: 90459 - RNA, 18 nt, Human
uggaccccuaggccgcag

SEQ ID NO: 90460 - RNA, 19 nt, Human
uggaccccuaggccgcagc

SEQ ID NO: 90461 - RNA, 19 nt, Human
uggaccccuaggccgcagc

SEQ ID NO: 90462 - RNA, 19 nt, Human
uggaccccuaggccgcagc

SEQ ID NO: 90463 - RNA, 19 nt, Human
uggaccccuaggccgcagc

SEQ ID NO: 90464 - RNA, 21 nt, Human
uggaccccuaggccgcagccc

SEQ ID NO: 90465 - RNA, 23 nt, Human
uggaccccuaggccgcagccccc

SEQ ID NO: 90466 - RNA, 23 nt, Human
uggaccccuaggccgcagccccc

SEQ ID NO: 90467 - RNA, 23 nt, Human
uggaccccuaggccgcagccccc

SEQ ID NO: 90468 - RNA, 23 nt, Human
uggaccccuaggccgcagccccc

SEQ ID NO: 90469 - RNA, 18 nt, Human
uggcagggcugggaggca

SEQ ID NO: 90470 - RNA, 18 nt, Human
uggcagggcugggaggca

SEQ ID NO: 90471 - RNA, 18 nt, Human
uggcagggcugggaggca

SEQ ID NO: 90472 - RNA, 18 nt, Human
uggcagggcugggaggca

SEQ ID NO: 90473 - RNA, 20 nt, Human
uggcagggcugggaggcagg

SEQ ID NO: 90474 - RNA, 20 nt, Human
uggcagggcugggaggcagg

SEQ ID NO: 90475 - RNA, 20 nt, Human
uggcagggcugggaggcagg

SEQ ID NO: 90476 - RNA, 20 nt, Human
uggcagggcugggaggcagg

SEQ ID NO: 90477 - RNA, 20 nt, Human
uggcccagcaucuccuggcu

SEQ ID NO: 90478 - RNA, 20 nt, Human
uggcccagcaucuccuggcu

SEQ ID NO: 90479 - RNA, 20 nt, Human
uggcccagcaucuccuggcu

SEQ ID NO: 90480 - RNA, 22 nt, Human
uggcccagcaucuccuggcugu

SEQ ID NO: 90481 - RNA, 18 nt, Human
uggcccaggcaaccuggg

SEQ ID NO: 90482 - RNA, 21 nt, Human
uggcccaggcaaccugggggc

SEQ ID NO: 90483 - RNA, 25 nt, Human
uggcccaggcaaccugggggcugcu

SEQ ID NO: 90484 - RNA, 25 nt, Human
uggcccccagggcugcgucucuccu

SEQ ID NO: 90485 - RNA, 25 nt, Human
uggcccccagggcugcgucucuccu

SEQ ID NO: 90486 - RNA, 25 nt, Human
uggcccccagggcugcgucucuccu

SEQ ID NO: 90487 - RNA, 25 nt, Human
uggcccccagggcugcgucucuccu

SEQ ID NO: 90488 - RNA, 23 nt, Human
ugggagggauccugggaagcucu

SEQ ID NO: 90489 - RNA, 23 nt, Human
ugggagggauccugggaagcucu

SEQ ID NO: 90490 - RNA, 23 nt, Human
ugggagggauccugggaagcucu

SEQ ID NO: 90491 - RNA, 23 nt, Human
ugggagggauccugggaagcucu

SEQ ID NO: 90492 - RNA, 28 nt, Human
ugggauccuggggucucugccgucucag

SEQ ID NO: 90493 - RNA, 28 nt, Human
ugggauccuggggucucugccgucucag

SEQ ID NO: 90494 - RNA, 28 nt, Human
ugggauccuggggucucugccgucucag

SEQ ID NO: 90495 - RNA, 28 nt, Human
ugggauccuggggucucugccgucucag

SEQ ID NO: 90496 - RNA, 19 nt, Human
ugggguggaacucgguguc

SEQ ID NO: 90497 - RNA, 19 nt, Human
ugggguugcugggaaagcc

SEQ ID NO: 90498 - RNA, 22 nt, Human
uuaaugaaggaacacuucuuuu

SEQ ID NO: 90499 - RNA, 21 nt, Human
uuagcugugcauugucagcua

SEQ ID NO: 90500 - RNA, 18 nt, Human
uuccugugggucaggaau

SEQ ID NO: 90501 - RNA, 19 nt, Human
uucuuggccacugcccuga

SEQ ID NO: 90502 - RNA, 19 nt, Human
uugcccugccuuuccuaug

SEQ ID NO: 90503 - RNA, 19 nt, Human
agacuggagagcugagggc

SEQ ID NO: 90504 - RNA, 19 nt, Human
agccccgaggcuuauccuc

SEQ ID NO: 90505 - RNA, 24 nt, Human
auccuccugugauccauccaggcu

SEQ ID NO: 90506 - RNA, 19 nt, Human
caagaagcaccccacccuc

SEQ ID NO: 90507 - RNA, 19 nt, Human
caagaagcaccccacccuc

SEQ ID NO: 90508 - RNA, 21 nt, Human
cagcagagacuggagagcuga

SEQ ID NO: 90509 - RNA, 19 nt, Human
ccccacccuccugggcuag

SEQ ID NO: 90510 - RNA, 23 nt, Human
cccuccugggcuagaaccucgcu

SEQ ID NO: 90511 - RNA, 21 nt, Human
ccggaagacucggcccugggg

SEQ ID NO: 90512 - RNA, 24 nt, Human
ccucgcugcugcugcugcugguag

SEQ ID NO: 90513 - RNA, 22 nt, Human
ccugugauccauccaggcucuc

SEQ ID NO: 90514 - RNA, 20 nt, Human
cuccugggcuagaaccucgc

SEQ ID NO: 90515 - RNA, 22 nt, Human
uacaagaagcaccccacccucc

SEQ ID NO: 90516 - RNA, 19 nt, Human
ucagcagagacuggagagc

SEQ ID NO: 90517 - RNA, 18 nt, Human
uccugugauccauccagg

SEQ ID NO: 90518 - RNA, 18 nt, Human
ugcugguagagaugacca

SEQ ID NO: 90519 - RNA, 20 nt, Human
aaaaguguauacuauuuaca

SEQ ID NO: 90520 - RNA, 21 nt, Human
aaacaagcuauaauugugugc

SEQ ID NO: 90521 - RNA, 22 nt, Human
aaacauggcauggugugauugc

SEQ ID NO: 90522 - RNA, 20 nt, Human
aaauaccucccugcauuuuu

SEQ ID NO: 90523 - RNA, 20 nt, Human
aacagcuuauuuuguccuuu

SEQ ID NO: 90524 - RNA, 24 nt, Human
aagggccucguguccuuugagagc

SEQ ID NO: 90525 - RNA, 19 nt, Human
aggaaaguguguaaaagua

SEQ ID NO: 90526 - RNA, 19 nt, Human
auaaggcaacaaggcaaaa

SEQ ID NO: 90527 - RNA, 22 nt, Human
aucauaauugguuuacaaauug

SEQ ID NO: 90528 - RNA, 24 nt, Human
auuuucccaagguaaagccaggaa

SEQ ID NO: 90529 - RNA, 23 nt, Human
caagguaaagccaggaaacaaac

SEQ ID NO: 90530 - RNA, 21 nt, Human
caucaugagaagucuucaggc

SEQ ID NO: 90531 - RNA, 25 nt, Human
ccccucuaacuccauggacagacac

SEQ ID NO: 90532 - RNA, 21 nt, Human
cccggcgcgcugcugcggcca

SEQ ID NO: 90533 - RNA, 25 nt, Human
cccggcgcgcugcugcggccacugc

SEQ ID NO: 90534 - RNA, 23 nt, Human
ccucccugcauuuuuuuuuccug

SEQ ID NO: 90535 - RNA, 22 nt, Human
cgcgcugcugcggccacugcgg

SEQ ID NO: 90536 - RNA, 22 nt, Human
gaacuucuaagugauguccccu

SEQ ID NO: 90537 - RNA, 20 nt, Human
gcgcgcugcugcggccacug

SEQ ID NO: 90538 - RNA, 23 nt, Human
gcgcgcugcugcggccacugcgg

SEQ ID NO: 90539 - RNA, 21 nt, Human
gcuggggcgcggccagggccc

SEQ ID NO: 90540 - RNA, 20 nt, Human
ggaaggaaaacauggcaugg

SEQ ID NO: 90541 - RNA, 21 nt, Human
gugauugcaugggguaacccu

SEQ ID NO: 90542 - RNA, 19 nt, Human
uaaauauucccugccaagg

SEQ ID NO: 90543 - RNA, 21 nt, Human
uaaauauucccugccaagggc

SEQ ID NO: 90544 - RNA, 22 nt, Human
uaacaguacauuuggaagaaga

SEQ ID NO: 90545 - RNA, 19 nt, Human
uaaggagaacgauuuacua

SEQ ID NO: 90546 - RNA, 23 nt, Human
uaauugguuuacaaauuggaugc

SEQ ID NO: 90547 - RNA, 22 nt, Human
uaccauguuucccaguuggcuc

SEQ ID NO: 90548 - RNA, 22 nt, Human
uacccuguuaaaguagaaacaa

SEQ ID NO: 90549 - RNA, 21 nt, Human
uacuucaugauauaccauguu

SEQ ID NO: 90550 - RNA, 25 nt, Human
ucuccuggacucuccagaugccuug

SEQ ID NO: 90551 - RNA, 22 nt, Human
ugacaguaucauuauuuucagc

SEQ ID NO: 90552 - RNA, 18 nt, Human
ugaugugugaaacuucug

SEQ ID NO: 90553 - RNA, 20 nt, Human
ugccaagggccucguguccu

SEQ ID NO: 90554 - RNA, 19 nt, Human
uggcauacugguucaguug

SEQ ID NO: 90555 - RNA, 18 nt, Human
uggcauggugugauugca

SEQ ID NO: 90556 - RNA, 20 nt, Human
uggcauggugugauugcaug

SEQ ID NO: 90557 - RNA, 19 nt, Human
ugggaaaugguaaucuugg

SEQ ID NO: 90558 - RNA, 21 nt, Human
ugguuuuggcauacugguuca

SEQ ID NO: 90559 - RNA, 22 nt, Human
ugucaaggguuaagcgacucau

SEQ ID NO: 90560 - RNA, 19 nt, Human
ugugaaacuucugcuaucu

SEQ ID NO: 90561 - RNA, 23 nt, Human
uguggggcugcccuccaggaagg

SEQ ID NO: 90562 - RNA, 19 nt, Human
uuacagaggcagcauaccc

SEQ ID NO: 90563 - RNA, 21 nt, Human
uugcucagcuguuaaauaccu

SEQ ID NO: 90564 - RNA, 18 nt, Human
agcggaggcugcagccgc

SEQ ID NO: 90565 - RNA, 18 nt, Human
agggaggggagggggaac

SEQ ID NO: 90566 - RNA, 25 nt, Human
agggaggggagggggaacaccggcc

SEQ ID NO: 90567 - RNA, 21 nt, Human
cagcaagucaguggaagagug

SEQ ID NO: 90568 - RNA, 26 nt, Human
cagcagggccuuaggaaaaugugcuc

SEQ ID NO: 90569 - RNA, 18 nt, Human
cagggcacggcgcgggcg

SEQ ID NO: 90570 - RNA, 19 nt, Human
ccccagggaggggaggggg

SEQ ID NO: 90571 - RNA, 24 nt, Human
ccccaguauccuggcucccaggcu

SEQ ID NO: 90572 - RNA, 22 nt, Human
ccuccacgagaauggaaugcuu

SEQ ID NO: 90573 - RNA, 19 nt, Human
ccucgggacacugaggcug

SEQ ID NO: 90574 - RNA, 24 nt, Human
cucccaggcuagacucaggcccag

SEQ ID NO: 90575 - RNA, 18 nt, Human
gacagcagggccuuagga

SEQ ID NO: 90576 - RNA, 18 nt, Human
gaggcugcagccgcccgg

SEQ ID NO: 90577 - RNA, 20 nt, Human
gcacggcgcgggcgcuggag

SEQ ID NO: 90578 - RNA, 19 nt, Human
gcagggcacggcgcgggcg

SEQ ID NO: 90579 - RNA, 20 nt, Human
gccccagggaggggaggggg

SEQ ID NO: 90580 - RNA, 24 nt, Human
uauccuggcucccaggcuagacuc

SEQ ID NO: 90581 - RNA, 22 nt, Human
ucaguggaagagugggaaaagg

SEQ ID NO: 90582 - RNA, 22 nt, Human
uccuggcucccaggcuagacuc

SEQ ID NO: 90583 - RNA, 18 nt, Human
ugaggcugagagaggggc

SEQ ID NO: 90584 - RNA, 20 nt, Human
uggaaugcuucggggcccuc

SEQ ID NO: 90585 - RNA, 19 nt, Human
aaaagccaguaacuugaga

SEQ ID NO: 90586 - RNA, 19 nt, Human
aaaagccaguaacuugaga

SEQ ID NO: 90587 - RNA, 23 nt, Human
aacugauguuugguaaguauaaa

SEQ ID NO: 90588 - RNA, 22 nt, Human
aagccgcgccccucagcccaga

SEQ ID NO: 90589 - RNA, 18 nt, Human
cagacccggcucguagcc

SEQ ID NO: 90590 - RNA, 23 nt, Human
caguggccccgcgccggggcagg

SEQ ID NO: 90591 - RNA, 22 nt, Human
ccccucagcccagacccggcuc

SEQ ID NO: 90592 - RNA, 25 nt, Human
cccgcgccggggcagggaaggaggc

SEQ ID NO: 90593 - RNA, 20 nt, Human
ccgccccacuucgcggcccc

SEQ ID NO: 90594 - RNA, 22 nt, Human
ccgccccacuucgcggccccag

SEQ ID NO: 90595 - RNA, 19 nt, Human
ccuuccguugccgggcugg

SEQ ID NO: 90596 - RNA, 22 nt, Human
cgccccacuucgcggccccagc

SEQ ID NO: 90597 - RNA, 19 nt, Human
cgccccucagcccagaccc

SEQ ID NO: 90598 - RNA, 18 nt, Human
cgcgaagccgcgccccuc

SEQ ID NO: 90599 - RNA, 19 nt, Human
cguugccgggcuggggucc

SEQ ID NO: 90600 - RNA, 19 nt, Human
cucguagcccacccggccg

SEQ ID NO: 90601 - RNA, 18 nt, Human
gcagggaaggaggcccug

SEQ ID NO: 90602 - RNA, 19 nt, Human
gcagggaaggaggcccuga

SEQ ID NO: 90603 - RNA, 20 nt, Human
gccuuccguugccgggcugg

SEQ ID NO: 90604 - RNA, 20 nt, Human
gcggcggcccggcggcggcg

SEQ ID NO: 90605 - RNA, 21 nt, Human
uagcccacccggccgccccag

SEQ ID NO: 90606 - RNA, 21 nt, Human
ugccgggcugggguccaccgc

SEQ ID NO: 90607 - RNA, 23 nt, Human
uucugauuguucugcuuacuguc

SEQ ID NO: 90608 - RNA, 19 nt, Human
aagaaagugaagaagcgag

SEQ ID NO: 90609 - RNA, 23 nt, Human
agaagccaagauucagcugggca

SEQ ID NO: 90610 - RNA, 20 nt, Human
agggagaaggccggacgaug

SEQ ID NO: 90611 - RNA, 20 nt, Human
cagaagccaagauucagcug

SEQ ID NO: 90612 - RNA, 19 nt, Human
cagcucagagggccacugg

SEQ ID NO: 90613 - RNA, 21 nt, Human
uggaaaagaaagugaagaagc

SEQ ID NO: 90614 - RNA, 19 nt, Human
uggcuuggguccggcagug

SEQ ID NO: 90615 - RNA, 18 nt, Human
ugugccggucaagaagga

SEQ ID NO: 90616 - RNA, 19 nt, Human
uucauucuucccagaucaa

SEQ ID NO: 90617 - RNA, 21 nt, Human
accgugaagggugugccaggg

SEQ ID NO: 90618 - RNA, 19 nt, Human
agacaggaucggcccuggg

SEQ ID NO: 90619 - RNA, 18 nt, Human
agggggaacuccaggcag

SEQ ID NO: 90620 - RNA, 21 nt, Human
auggaggcaucacaagugcua

SEQ ID NO: 90621 - RNA, 20 nt, Human
caaaggcacuggggcaccug

SEQ ID NO: 90622 - RNA, 19 nt, Human
caucacaagugcuaggcuu

SEQ ID NO: 90623 - RNA, 20 nt, Human
cauccucccagaacugagag

SEQ ID NO: 90624 - RNA, 18 nt, Human
ccacugccgcucccgggc

SEQ ID NO: 90625 - RNA, 24 nt, Human
ccuauagcaaggcggugagggggc

SEQ ID NO: 90626 - RNA, 20 nt, Human
cuccuggccuggcaggcugg

SEQ ID NO: 90627 - RNA, 22 nt, Human
cuggggcauguuuauuuccucc

SEQ ID NO: 90628 - RNA, 19 nt, Human
cuuggccgccuggguagca

SEQ ID NO: 90629 - RNA, 23 nt, Human
gacuccuauagcaaggcggugag

SEQ ID NO: 90630 - RNA, 21 nt, Human
gagucauccucccagaacuga

SEQ ID NO: 90631 - RNA, 20 nt, Human
gcagggccuggugggaaugg

SEQ ID NO: 90632 - RNA, 20 nt, Human
gggugugugcagggccuggu

SEQ ID NO: 90633 - RNA, 24 nt, Human
ggucuggagcuuggccgccugggu

SEQ ID NO: 90634 - RNA, 26 nt, Human
ggugacuccuauagcaaggcggugag

SEQ ID NO: 90635 - RNA, 18 nt, Human
ggugugugcagggccugg

SEQ ID NO: 90636 - RNA, 20 nt, Human
uagcaaggcggugagggggc

SEQ ID NO: 90637 - RNA, 19 nt, Human
uccacugccgcucccgggc

SEQ ID NO: 90638 - RNA, 19 nt, Human
uccggaguucugggagucg

SEQ ID NO: 90639 - RNA, 18 nt, Human
ugaagggugugccagggc

SEQ ID NO: 90640 - RNA, 21 nt, Human
ugacugcagacaggaucggcc

SEQ ID NO: 90641 - RNA, 20 nt, Human
ugagagaggcccucggggca

SEQ ID NO: 90642 - RNA, 19 nt, Human
ugagggggcgggucugggg

SEQ ID NO: 90643 - RNA, 23 nt, Human
uggagucauccucccagaacuga

SEQ ID NO: 90644 - RNA, 21 nt, Human
uggcacggucuggagcuuggc

SEQ ID NO: 90645 - RNA, 22 nt, Human
ugggagagaccgaggcuccagg

SEQ ID NO: 90646 - RNA, 20 nt, Human
ugggagucgguuccacugcc

SEQ ID NO: 90647 - RNA, 19 nt, Human
uggggcaccugggucuggc

SEQ ID NO: 90648 - RNA, 21 nt, Human
ugggugugugcagggccuggu

SEQ ID NO: 90649 - RNA, 23 nt, Human
ugggugugugcagggccuggugg

SEQ ID NO: 90650 - RNA, 24 nt, Human
ugugugcagggccuggugggaaug

SEQ ID NO: 90651 - RNA, 22 nt, Human
aaacugaccaccacugcccagu

SEQ ID NO: 90652 - RNA, 24 nt, Human
aagguaccgauggcuucccuuccu

SEQ ID NO: 90653 - RNA, 23 nt, Human
acaaaguaccugagaagguaccg

SEQ ID NO: 90654 - RNA, 18 nt, Human
agaaggaauuccucucau

SEQ ID NO: 90655 - RNA, 19 nt, Human
agacaagcuguccuccccc

SEQ ID NO: 90656 - RNA, 24 nt, Human
agaugggcugggcuacaggcagga

SEQ ID NO: 90657 - RNA, 18 nt, Human
agcaagggccuggagaag

SEQ ID NO: 90658 - RNA, 19 nt, Human
aggaaggcagggcaggacu

SEQ ID NO: 90659 - RNA, 26 nt, Human
aggaaggggcuggcgagaccccgggg

SEQ ID NO: 90660 - RNA, 21 nt, Human
aggagguggcggcgggagcgg

SEQ ID NO: 90661 - RNA, 24 nt, Human
aggcagggcaggacuuucaaaaca

SEQ ID NO: 90662 - RNA, 21 nt, Human
agguaaggcugggggcucugg

SEQ ID NO: 90663 - RNA, 21 nt, Human
agguaggggcagguccuccag

SEQ ID NO: 90664 - RNA, 23 nt, Human
agguaggggcagguccuccagca

SEQ ID NO: 90665 - RNA, 25 nt, Human
agguccuccagcagccuggcagucc

SEQ ID NO: 90666 - RNA, 31 nt, Human
auccgauuucuuccccacuuuacccuccaag

SEQ ID NO: 90667 - RNA, 20 nt, Human
auggagacggggagagugag

SEQ ID NO: 90668 - RNA, 18 nt, Human
augggcugggcuacaggc

SEQ ID NO: 90669 - RNA, 19 nt, Human
caagcuguccucccccugg

SEQ ID NO: 90670 - RNA, 25 nt, Human
caaucucuacaaucucagcaagggc

SEQ ID NO: 90671 - RNA, 22 nt, Human
caauguccggcuggagaaaaug

SEQ ID NO: 90672 - RNA, 27 nt, Human
cacuuuacccuccaaagcagaaucuca

SEQ ID NO: 90673 - RNA, 23 nt, Human
cagcagacaagcuguccuccccc

SEQ ID NO: 90674 - RNA, 25 nt, Human
cagcagguaggggcagguccuccag

SEQ ID NO: 90675 - RNA, 24 nt, Human
caggaaggggcuggcgagaccccg

SEQ ID NO: 90676 - RNA, 25 nt, Human
ccaaagcagaaucucaauacuuucc

SEQ ID NO: 90677 - RNA, 23 nt, Human
ccccuccagccacgccgccgccu

SEQ ID NO: 90678 - RNA, 20 nt, Human
cccuggcuggcauucuccuc

SEQ ID NO: 90679 - RNA, 20 nt, Human
ccgccgccuccaucuccucg

SEQ ID NO: 90680 - RNA, 20 nt, Human
ccggccccagagcaguggaa

SEQ ID NO: 90681 - RNA, 18 nt, Human
ccggggaggggagcggug

SEQ ID NO: 90682 - RNA, 26 nt, Human
ccuccagccacgccgccgccuccauc

SEQ ID NO: 90683 - RNA, 24 nt, Human
ccugaaaccucacacucucccggg

SEQ ID NO: 90684 - RNA, 26 nt, Human
cggggccugggagcgcugggcagggg

SEQ ID NO: 90685 - RNA, 22 nt, Human
cucacaccaagggccugaaccc

SEQ ID NO: 90686 - RNA, 23 nt, Human
cucccgggcccuggcuccgaccc

SEQ ID NO: 90687 - RNA, 18 nt, Human
cugcgcggcgccccugcc

SEQ ID NO: 90688 - RNA, 25 nt, Human
cuggaaggccuuaccuccaccaccc

SEQ ID NO: 90689 - RNA, 26 nt, Human
cuuuacccuccaaagcagaaucucaa

SEQ ID NO: 90690 - RNA, 20 nt, Human
gaaggccuuaccuccaccac

SEQ ID NO: 90691 - RNA, 24 nt, Human
gagcggcagcgggcugagcugaug

SEQ ID NO: 90692 - RNA, 21 nt, Human
gagguggcggcgggagcgggc

SEQ ID NO: 90693 - RNA, 23 nt, Human
gauuucuuccccacuuuacccuc

SEQ ID NO: 90694 - RNA, 21 nt, Human
gccugggagcgcugggcaggg

SEQ ID NO: 90695 - RNA, 21 nt, Human
gcgcggcgacgcguggcgggg

SEQ ID NO: 90696 - RNA, 24 nt, Human
gcgcugggcagggggagcccuggc

SEQ ID NO: 90697 - RNA, 21 nt, Human
gcggcugcaggaaggggcugg

SEQ ID NO: 90698 - RNA, 19 nt, Human
gcguggcggggccugggag

SEQ ID NO: 90699 - RNA, 18 nt, Human
gcuggacaggacacaggg

SEQ ID NO: 90700 - RNA, 23 nt, Human
gcuggacaggacacaggggaggu

SEQ ID NO: 90701 - RNA, 18 nt, Human
ggacugggcgcggcgccg

SEQ ID NO: 90702 - RNA, 22 nt, Human
ggagacggggagagugaggggg

SEQ ID NO: 90703 - RNA, 21 nt, Human
ggcagggggagcccuggccgc

SEQ ID NO: 90704 - RNA, 19 nt, Human
ggcgccggccccagagcag

SEQ ID NO: 90705 - RNA, 21 nt, Human
ggcuacaggcaggaggaaggc

SEQ ID NO: 90706 - RNA, 22 nt, Human
gggagagugaggggguaggggg

SEQ ID NO: 90707 - RNA, 24 nt, Human
gggagcgcugggcagggggagccc

SEQ ID NO: 90708 - RNA, 19 nt, Human
gggcagguccuccagcagc

SEQ ID NO: 90709 - RNA, 20 nt, Human
gggcauccccuacccgggca

SEQ ID NO: 90710 - RNA, 20 nt, Human
gggcgcggcgccggccccag

SEQ ID NO: 90711 - RNA, 18 nt, Human
gggcuugcggcccgaagc

SEQ ID NO: 90712 - RNA, 20 nt, Human
ggggaggggagcgguggggc

SEQ ID NO: 90713 - RNA, 23 nt, Human
gguccucuggggcuuucagagag

SEQ ID NO: 90714 - RNA, 24 nt, Human
gguccucuggggcuuucagagagg

SEQ ID NO: 90715 - RNA, 19 nt, Human
gguggcggcgggagcgggc

SEQ ID NO: 90716 - RNA, 18 nt, Human
gugaggggguaggggggc

SEQ ID NO: 90717 - RNA, 21 nt, Human
uacaggcaggaggaaggcagg

SEQ ID NO: 90718 - RNA, 25 nt, Human
uaggggcagguccuccagcagccug

SEQ ID NO: 90719 - RNA, 24 nt, Human
ucaauacuuuccugaaaccucaca

SEQ ID NO: 90720 - RNA, 19 nt, Human
ucaaucucuacaaucucag

SEQ ID NO: 90721 - RNA, 19 nt, Human
ucacugggcauccccuacc

SEQ ID NO: 90722 - RNA, 18 nt, Human
ucaguuccucuaaaagcu

SEQ ID NO: 90723 - RNA, 18 nt, Human
uccagagcacucaaucuc

SEQ ID NO: 90724 - RNA, 22 nt, Human
uccccacuuuacccuccaaagc

SEQ ID NO: 90725 - RNA, 20 nt, Human
uccuccagcagccuggcagu

SEQ ID NO: 90726 - RNA, 20 nt, Human
uccuggucgggaccauggag

SEQ ID NO: 90727 - RNA, 19 nt, Human
ucucccgggcccuggcugg

SEQ ID NO: 90728 - RNA, 22 nt, Human
ucuuuuuuuuuuuuugcaguaa

SEQ ID NO: 90729 - RNA, 19 nt, Human
ugagcugaugcgggcgacg

SEQ ID NO: 90730 - RNA, 21 nt, Human
ugcacauucacugggcauccc

SEQ ID NO: 90731 - RNA, 25 nt, Human
ugcaggaaggggcuggcgagacccc

SEQ ID NO: 90732 - RNA, 19 nt, Human
uggaggggacagguugaga

SEQ ID NO: 90733 - RNA, 21 nt, Human
uggaggggacagguugagagg

SEQ ID NO: 90734 - RNA, 23 nt, Human
ugggagccugacgaugcagcagg

SEQ ID NO: 90735 - RNA, 18 nt, Human
ugggcuacaggcaggagg

SEQ ID NO: 90736 - RNA, 19 nt, Human
uguccucccccugggcucu

SEQ ID NO: 90737 - RNA, 19 nt, Human
uuaaagcuucaaggcuccc

SEQ ID NO: 90738 - RNA, 21 nt, Human
uuccccacuuuacccuccaaa

SEQ ID NO: 90739 - RNA, 24 nt, Human
uucuuccccacuuuacccuccaaa

SEQ ID NO: 90740 - RNA, 24 nt, Human
uuuagaugggcugggcuacaggca

SEQ ID NO: 90741 - RNA, 23 nt, Human
uuuucuuuuuuuuuuuuugcagu

SEQ ID NO: 90742 - RNA, 23 nt, Human
uuuuuucuuuuuuuuuuuuuggg

SEQ ID NO: 90743 - RNA, 22 nt, Human
accuggggucaccuggcuuccu

SEQ ID NO: 90744 - RNA, 23 nt, Human
agggaagggaggucuccggcagg

SEQ ID NO: 90745 - RNA, 20 nt, Human
agggaggucuccggcagggg

SEQ ID NO: 90746 - RNA, 21 nt, Human
caccugccccuccccgcucug

SEQ ID NO: 90747 - RNA, 19 nt, Human
cagccuccauucccccacc

SEQ ID NO: 90748 - RNA, 24 nt, Human
cagggaccuggucuagccaguccu

SEQ ID NO: 90749 - RNA, 24 nt, Human
cauuugccaucuucugauuggggg

SEQ ID NO: 90750 - RNA, 22 nt, Human
ccacaggggcugcaagaccucu

SEQ ID NO: 90751 - RNA, 22 nt, Human
ccauucccccaccugccccucc

SEQ ID NO: 90752 - RNA, 19 nt, Human
cccaccugccccuccccgc

SEQ ID NO: 90753 - RNA, 19 nt, Human
cccccaccugccccucccc

SEQ ID NO: 90754 - RNA, 18 nt, Human
ccccugugccccucgcuc

SEQ ID NO: 90755 - RNA, 20 nt, Human
cccugggguccugagccagu

SEQ ID NO: 90756 - RNA, 23 nt, Human
ccuccacacacagccucccaccu

SEQ ID NO: 90757 - RNA, 18 nt, Human
ccugcagccuccauuccc

SEQ ID NO: 90758 - RNA, 24 nt, Human
ccugcagccuccauucccccaccu

SEQ ID NO: 90759 - RNA, 21 nt, Human
ccuguuaggaccuuuguccca

SEQ ID NO: 90760 - RNA, 25 nt, Human
cgcuccacaccugggcaggucuaaa

SEQ ID NO: 90761 - RNA, 20 nt, Human
cggcagggguggggagugac

SEQ ID NO: 90762 - RNA, 22 nt, Human
cuccacacacagccucccaccu

SEQ ID NO: 90763 - RNA, 20 nt, Human
cucuggucagcauggcgugg

SEQ ID NO: 90764 - RNA, 19 nt, Human
cuuggucugggcucugggc

SEQ ID NO: 90765 - RNA, 21 nt, Human
gagcagcaguccgggugcggg

SEQ ID NO: 90766 - RNA, 18 nt, Human
gcauggcgugggugggga

SEQ ID NO: 90767 - RNA, 19 nt, Human
gcuuggucugggcucuggg

SEQ ID NO: 90768 - RNA, 20 nt, Human
ggacccgcaagggaggggca

SEQ ID NO: 90769 - RNA, 20 nt, Human
ggaccucggcgggggcaucc

SEQ ID NO: 90770 - RNA, 22 nt, Human
ggcagggagcagcaguccgggu

SEQ ID NO: 90771 - RNA, 23 nt, Human
gggaccuggucuagccaguccug

SEQ ID NO: 90772 - RNA, 22 nt, Human
gggagcagcaguccgggugcgg

SEQ ID NO: 90773 - RNA, 24 nt, Human
ggggaucgggggaccucggcgggg

SEQ ID NO: 90774 - RNA, 21 nt, Human
ggggcagggagcagcaguccg

SEQ ID NO: 90775 - RNA, 23 nt, Human
gggggaccucggcgggggcaucc

SEQ ID NO: 90776 - RNA, 21 nt, Human
gguguggcugcccaggagaga

SEQ ID NO: 90777 - RNA, 20 nt, Human
uccacacacagccucccacc

SEQ ID NO: 90778 - RNA, 20 nt, Human
uccacaggggcugcaagacc

SEQ ID NO: 90779 - RNA, 20 nt, Human
uccugagccagugacuccug

SEQ ID NO: 90780 - RNA, 24 nt, Human
uccugagccagugacuccuguuag

SEQ ID NO: 90781 - RNA, 23 nt, Human
ucugugguguggcugcccaggag

SEQ ID NO: 90782 - RNA, 21 nt, Human
uggaaggugccucuggagaug

SEQ ID NO: 90783 - RNA, 22 nt, Human
uggccuccacacacagccuccc

SEQ ID NO: 90784 - RNA, 18 nt, Human
ugggcagcuggccugcgu

SEQ ID NO: 90785 - RNA, 22 nt, Human
ugggcucugggcagcuggccug

SEQ ID NO: 90786 - RNA, 21 nt, Human
uggggucaccuggcuuccugg

SEQ ID NO: 90787 - RNA, 22 nt, Human
ugguggaccggcagggaccugg

SEQ ID NO: 90788 - RNA, 24 nt, Human
ugucccagaguccugccugcgggg

SEQ ID NO: 90789 - RNA, 25 nt, Human
uguguugugccuggggagacuguug

SEQ ID NO: 90790 - RNA, 25 nt, Human
uuacagauuuuuuuuucaaaggcuu

SEQ ID NO: 90791 - RNA, 24 nt, Human
uucaguuucugagguuaggaugcc

SEQ ID NO: 90792 - RNA, 18 nt, Human
uuccaggauggccuccac

SEQ ID NO: 90793 - RNA, 21 nt, Human
aaaaacaaguuccccagagaa

SEQ ID NO: 90794 - RNA, 19 nt, Human
aaaaugcuucuaaaaaaug

SEQ ID NO: 90795 - RNA, 21 nt, Human
aaacaaaaaugcauacacagc

SEQ ID NO: 90796 - RNA, 20 nt, Human
aaacaaaacggaagcacaaa

SEQ ID NO: 90797 - RNA, 22 nt, Human
aaacaaaacggaagcacaaaca

SEQ ID NO: 90798 - RNA, 24 nt, Human
aaacaaguuccccagagaagcugg

SEQ ID NO: 90799 - RNA, 21 nt, Human
aaacaauguaaaugaauccac

SEQ ID NO: 90800 - RNA, 18 nt, Human
aaacggaagcacaaacac

SEQ ID NO: 90801 - RNA, 23 nt, Human
aacugaccuucccuuaaggccug

SEQ ID NO: 90802 - RNA, 23 nt, Human
aagaaagccgagugauggaauca

SEQ ID NO: 90803 - RNA, 18 nt, Human
aagaauccuacauucagc

SEQ ID NO: 90804 - RNA, 18 nt, Human
aagcuuuaagagcugcuc

SEQ ID NO: 90805 - RNA, 22 nt, Human
aaggagacaaugagagaaggga

SEQ ID NO: 90806 - RNA, 21 nt, Human
acaaaguaaugaccauaauac

SEQ ID NO: 90807 - RNA, 23 nt, Human
acaauagaaagauacugccugga

SEQ ID NO: 90808 - RNA, 19 nt, Human
acccaaaaaaaaaaaaaaa

SEQ ID NO: 90809 - RNA, 19 nt, Human
acccaaaaaaaaaaaaaaa

SEQ ID NO: 90810 - RNA, 18 nt, Human
acgacagccgaauccaaa

SEQ ID NO: 90811 - RNA, 23 nt, Human
acggaagcacaaacaccuuucuu

SEQ ID NO: 90812 - RNA, 20 nt, Human
agagaacacaaaagaaucaa

SEQ ID NO: 90813 - RNA, 24 nt, Human
agcagaaacaaaacggaagcacaa

SEQ ID NO: 90814 - RNA, 20 nt, Human
agcgcccgcgcccgcgcccc

SEQ ID NO: 90815 - RNA, 22 nt, Human
aggcagagaacacaaaagaauc

SEQ ID NO: 90816 - RNA, 23 nt, Human
aguaccagaagugcuuggaagga

SEQ ID NO: 90817 - RNA, 20 nt, Human
aguguaaacaauguaaauga

SEQ ID NO: 90818 - RNA, 21 nt, Human
aucucaguccaguuccuccag

SEQ ID NO: 90819 - RNA, 22 nt, Human
augaaugugucuuccauuuagc

SEQ ID NO: 90820 - RNA, 23 nt, Human
caaaaaggaccugaaaaguccca

SEQ ID NO: 90821 - RNA, 22 nt, Human
caacaguauuccaugaggcuag

SEQ ID NO: 90822 - RNA, 22 nt, Human
caaugggucaccuggaacaaac

SEQ ID NO: 90823 - RNA, 20 nt, Human
cacagcucaaugggucaccu

SEQ ID NO: 90824 - RNA, 22 nt, Human
cacgaaagaacagguagcccca

SEQ ID NO: 90825 - RNA, 18 nt, Human
cacuuccuuugcccucca

SEQ ID NO: 90826 - RNA, 19 nt, Human
cagaaacaaaacggaagca

SEQ ID NO: 90827 - RNA, 25 nt, Human
cagagaacacaaaagaaucaagaca

SEQ ID NO: 90828 - RNA, 19 nt, Human
cagguuacaauagaaagau

SEQ ID NO: 90829 - RNA, 19 nt, Human
cauacacagcucaaugggu

SEQ ID NO: 90830 - RNA, 24 nt, Human
ccaaaaaaaaaaaaaaaaaaagaa

SEQ ID NO: 90831 - RNA, 21 nt, Human
cccagcccggcuacgggcgcg

SEQ ID NO: 90832 - RNA, 28 nt, Human
ccccagagaagcuggcacuuccuuugcc

SEQ ID NO: 90833 - RNA, 18 nt, Human
ccccgggggggggggcgg

SEQ ID NO: 90834 - RNA, 21 nt, Human
ccccgggggggggggcggugu

SEQ ID NO: 90835 - RNA, 21 nt, Human
cccgcgcccgcgccccaggaa

SEQ ID NO: 90836 - RNA, 18 nt, Human
ccgcgcccgcgccccagg

SEQ ID NO: 90837 - RNA, 18 nt, Human
ccggcuacgggcgcgagg

SEQ ID NO: 90838 - RNA, 20 nt, Human
cgacagccgaauccaaagcu

SEQ ID NO: 90839 - RNA, 18 nt, Human
cgccgaccaagagggccc

SEQ ID NO: 90840 - RNA, 20 nt, Human
cggcuacgggcgcgaggcag

SEQ ID NO: 90841 - RNA, 18 nt, Human
cuaaaucaguagcagggc

SEQ ID NO: 90842 - RNA, 18 nt, Human
cuggcccagcccggcuac

SEQ ID NO: 90843 - RNA, 25 nt, Human
cuguccgccccuucccugccccacg

SEQ ID NO: 90844 - RNA, 18 nt, Human
cuuauaguacaauccugc

SEQ ID NO: 90845 - RNA, 23 nt, Human
cuuauuuaucauaugaccacacg

SEQ ID NO: 90846 - RNA, 22 nt, Human
cuucccuuaaggccuggucaua

SEQ ID NO: 90847 - RNA, 22 nt, Human
cuugagacacgcuccuccaccu

SEQ ID NO: 90848 - RNA, 24 nt, Human
gagagaagggauaaaagcaaacau

SEQ ID NO: 90849 - RNA, 23 nt, Human
gaugaucaaagcagucagaggga

SEQ ID NO: 90850 - RNA, 31 nt, Human
gcagaauuacccaaaaaaaaaaaaaaaaaaa

SEQ ID NO: 90851 - RNA, 21 nt, Human
gcagagaacacaaaagaauca

SEQ ID NO: 90852 - RNA, 23 nt, Human
gcccguuaucuccacgacagccg

SEQ ID NO: 90853 - RNA, 20 nt, Human
gcgcgggagugacgucuccu

SEQ ID NO: 90854 - RNA, 19 nt, Human
ggagacaaugagagaaggg

SEQ ID NO: 90855 - RNA, 23 nt, Human
ggcgcgaggcaggccgggaagaa

SEQ ID NO: 90856 - RNA, 18 nt, Human
ggguacaaaguaaugacc

SEQ ID NO: 90857 - RNA, 18 nt, Human
gguacuaagaugggaagg

SEQ ID NO: 90858 - RNA, 21 nt, Human
guagcauagccucuuuaggug

SEQ ID NO: 90859 - RNA, 21 nt, Human
uaaaaaaugcagauguuuaua

SEQ ID NO: 90860 - RNA, 22 nt, Human
uacacacauaccugccaauaua

SEQ ID NO: 90861 - RNA, 21 nt, Human
uacccaaaaaaaaaaaaaaaa

SEQ ID NO: 90862 - RNA, 23 nt, Human
uacuaagaugggaaggagacaau

SEQ ID NO: 90863 - RNA, 21 nt, Human
uagcagggcuucauggcuagg

SEQ ID NO: 90864 - RNA, 23 nt, Human
uagcaguaacagaaaauuacaaa

SEQ ID NO: 90865 - RNA, 22 nt, Human
uauaguacaauccugccauaaa

SEQ ID NO: 90866 - RNA, 22 nt, Human
uaucacaguuacacuugaguuc

SEQ ID NO: 90867 - RNA, 19 nt, Human
uaucuggagauagguagga

SEQ ID NO: 90868 - RNA, 23 nt, Human
uaucuuucccaaugaguuacacu

SEQ ID NO: 90869 - RNA, 25 nt, Human
ucaccuggaacaaacuugcuugacu

SEQ ID NO: 90870 - RNA, 23 nt, Human
ucacucucucaccaacauuaaau

SEQ ID NO: 90871 - RNA, 19 nt, Human
ucccgguuccccaggacuc

SEQ ID NO: 90872 - RNA, 24 nt, Human
uccgaccaaauagcuguugcuacu

SEQ ID NO: 90873 - RNA, 18 nt, Human
ucuccuaacgccagcgcc

SEQ ID NO: 90874 - RNA, 19 nt, Human
ugagagaagggauaaaagc

SEQ ID NO: 90875 - RNA, 23 nt, Human
ugagauuacacacauaccugcca

SEQ ID NO: 90876 - RNA, 18 nt, Human
ugaguucuuggcaggcag

SEQ ID NO: 90877 - RNA, 25 nt, Human
ugccauaaaguauuaaagcacaaga

SEQ ID NO: 90878 - RNA, 20 nt, Human
ugcuucuaaaaaaugcagag

SEQ ID NO: 90879 - RNA, 19 nt, Human
ugcuugacuauauuacuga

SEQ ID NO: 90880 - RNA, 19 nt, Human
uggcagaauuacccaaaaa

SEQ ID NO: 90881 - RNA, 26 nt, Human
uggcagaauuacccaaaaaaaaaaaa

SEQ ID NO: 90882 - RNA, 19 nt, Human
uggcuucuggccuccaucc

SEQ ID NO: 90883 - RNA, 23 nt, Human
ugggaaggagacaaugagagaag

SEQ ID NO: 90884 - RNA, 20 nt, Human
ugucuuuccacauacugaag

SEQ ID NO: 90885 - RNA, 25 nt, Human
ugugaaaggugacccucauuucguu

SEQ ID NO: 90886 - RNA, 22 nt, Human
uucuuggcuucuggccuccauc

SEQ ID NO: 90887 - RNA, 24 nt, Human
uuuccacauacugaagaauccuac

SEQ ID NO: 90888 - RNA, 19 nt, Human
uuuuuugacauguaucugg

SEQ ID NO: 90889 - RNA, 21 nt, Human
agaaaggaaucuaacgagugc

SEQ ID NO: 90890 - RNA, 24 nt, Human
agcagaaaacgaguuuucuaagaa

SEQ ID NO: 90891 - RNA, 19 nt, Human
ccgggugaacaaaaaccac

SEQ ID NO: 90892 - RNA, 20 nt, Human
cugguuagcaugaaacagag

SEQ ID NO: 90893 - RNA, 23 nt, Human
ggaaauguggagagacugagagc

SEQ ID NO: 90894 - RNA, 22 nt, Human
ggagggaagggacgagggaagg

SEQ ID NO: 90895 - RNA, 20 nt, Human
ggggagggaagggacgaggg

SEQ ID NO: 90896 - RNA, 20 nt, Human
ucggggagggaagggacgag

SEQ ID NO: 90897 - RNA, 18 nt, Human
ugaacaaaaaccacacgg

SEQ ID NO: 90898 - RNA, 18 nt, Human
ugagagcgagguguggca

SEQ ID NO: 90899 - RNA, 19 nt, Human
uucucagggagagauggcg

SEQ ID NO: 90900 - RNA, 26 nt, Human
aagacacagacacacauaagacccac

SEQ ID NO: 90901 - RNA, 24 nt, Human
aaggagaagacacagacacacaua

SEQ ID NO: 90902 - RNA, 23 nt, Human
acagccuugggggugagaggcca

SEQ ID NO: 90903 - RNA, 19 nt, Human
acaggagagaaccacagac

SEQ ID NO: 90904 - RNA, 19 nt, Human
agaagacacagacacacau

SEQ ID NO: 90905 - RNA, 22 nt, Human
agacacagacacacauaagacc

SEQ ID NO: 90906 - RNA, 25 nt, Human
agcagccgcccuccucggcccccca

SEQ ID NO: 90907 - RNA, 19 nt, Human
aggaaagguggggaggccc

SEQ ID NO: 90908 - RNA, 18 nt, Human
aggagcagaacaggccca

SEQ ID NO: 90909 - RNA, 18 nt, Human
aggagcagaacaggccca

SEQ ID NO: 90910 - RNA, 20 nt, Human
aggcagggagugggcccugu

SEQ ID NO: 90911 - RNA, 21 nt, Human
aggcagggagugggcccugug

SEQ ID NO: 90912 - RNA, 22 nt, Human
aggcagggagugggcccuguga

SEQ ID NO: 90913 - RNA, 23 nt, Human
aggccagagccaagggcccugca

SEQ ID NO: 90914 - RNA, 21 nt, Human
agggucuaggaaggcucaggg

SEQ ID NO: 90915 - RNA, 22 nt, Human
agugggcacucugucccgggac

SEQ ID NO: 90916 - RNA, 20 nt, Human
cagcgggacagaccugagcc

SEQ ID NO: 90917 - RNA, 19 nt, Human
cagcuucaccauagacacc

SEQ ID NO: 90918 - RNA, 21 nt, Human
caggagagaaccacagacacc

SEQ ID NO: 90919 - RNA, 18 nt, Human
cagggguggggcgugaca

SEQ ID NO: 90920 - RNA, 24 nt, Human
caucugagaguccaagggucuagg

SEQ ID NO: 90921 - RNA, 18 nt, Human
ccaagagggaggcauagg

SEQ ID NO: 90922 - RNA, 24 nt, Human
ccaggaaagguggggaggcccaga

SEQ ID NO: 90923 - RNA, 19 nt, Human
cccaagagggaggcauagg

SEQ ID NO: 90924 - RNA, 23 nt, Human
cccacaugaaacagggguggggc

SEQ ID NO: 90925 - RNA, 22 nt, Human
cccagcuucaccauagacacca

SEQ ID NO: 90926 - RNA, 19 nt, Human
cccauaggcucggcagggc

SEQ ID NO: 90927 - RNA, 20 nt, Human
cccuccucggccccccaaga

SEQ ID NO: 90928 - RNA, 22 nt, Human
ccugcaucugagaguccaaggg

SEQ ID NO: 90929 - RNA, 24 nt, Human
cgcacacguguuagugcccacaug

SEQ ID NO: 90930 - RNA, 18 nt, Human
gagaggccagagccaagg

SEQ ID NO: 90931 - RNA, 20 nt, Human
gcagggccagagacagccuu

SEQ ID NO: 90932 - RNA, 19 nt, Human
gccagagacagccuugggg

SEQ ID NO: 90933 - RNA, 25 nt, Human
gccagagccaagggcccugcaucug

SEQ ID NO: 90934 - RNA, 21 nt, Human
gcccagggcagcgggacagac

SEQ ID NO: 90935 - RNA, 20 nt, Human
gcccagguccucaggagacc

SEQ ID NO: 90936 - RNA, 20 nt, Human
gcccaugagaacuugagugu

SEQ ID NO: 90937 - RNA, 18 nt, Human
ggaggcauaggcagggag

SEQ ID NO: 90938 - RNA, 21 nt, Human
ggcccagguccucaggagacc

SEQ ID NO: 90939 - RNA, 22 nt, Human
ggugagaggccagagccaaggg

SEQ ID NO: 90940 - RNA, 20 nt, Human
ucagggugggagggcccagc

SEQ ID NO: 90941 - RNA, 21 nt, Human
uccaagggucuaggaaggcuc

SEQ ID NO: 90942 - RNA, 21 nt, Human
uccagggcgaguguuuaagga

SEQ ID NO: 90943 - RNA, 22 nt, Human
ucucaugacagagcagccgccc

SEQ ID NO: 90944 - RNA, 21 nt, Human
ucuccuaggagcagaacaggc

SEQ ID NO: 90945 - RNA, 19 nt, Human
ugacagagcagccgcccuc

SEQ ID NO: 90946 - RNA, 22 nt, Human
ugaggagacacgaggggcacag

SEQ ID NO: 90947 - RNA, 28 nt, Human
ugcccagggcagcgggacagaccugagc

SEQ ID NO: 90948 - RNA, 26 nt, Human
ugcccgccaggaacgcacacguggug

SEQ ID NO: 90949 - RNA, 22 nt, Human
uggagaccccaggaaagguggg

SEQ ID NO: 90950 - RNA, 23 nt, Human
uggcuuggggagaaggugcaggu

SEQ ID NO: 90951 - RNA, 21 nt, Human
ugggagggcccagcuucacca

SEQ ID NO: 90952 - RNA, 21 nt, Human
uggggaggcccagagcagcaa

SEQ ID NO: 90953 - RNA, 21 nt, Human
ugucccgggacucccauaggc

SEQ ID NO: 90954 - RNA, 19 nt, Human
uucuaagugaaaaaggccc

SEQ ID NO: 90955 - RNA, 24 nt, Human
acaauagaaaauauuauuuccaaa

SEQ ID NO: 90956 - RNA, 22 nt, Human
auauuguccucuuuuuucugua

SEQ ID NO: 90957 - RNA, 22 nt, Human
cacacagggcaaacagaucacc

SEQ ID NO: 90958 - RNA, 22 nt, Human
uaacacaauagaaaauauuauu

SEQ ID NO: 90959 - RNA, 22 nt, Human
uccacuccaccgaugacgcacg

SEQ ID NO: 90960 - RNA, 21 nt, Human
ucccuguaccuugaaucccag

SEQ ID NO: 90961 - RNA, 18 nt, Human
ucucucagucagcagggu

SEQ ID NO: 90962 - RNA, 18 nt, Human
uuuuuuuuuuuuuuuuug

SEQ ID NO: 90963 - RNA, 22 nt, Human
uuuuuuuuuuuuuuuuuggcuu

SEQ ID NO: 90964 - RNA, 22 nt, Human
uuuuuuuuuuuuuuuuuuuggc

SEQ ID NO: 90965 - RNA, 24 nt, Human
aagcauucuggcacaaaugaaaug

SEQ ID NO: 90966 - RNA, 19 nt, Human
aaggcacucaguuaacaag

SEQ ID NO: 90967 - RNA, 21 nt, Human
aauguuuaaaauaauaacauu

SEQ ID NO: 90968 - RNA, 21 nt, Human
acaggcaucaaccagaagccu

SEQ ID NO: 90969 - RNA, 22 nt, Human
acccugggugccaggguugggg

SEQ ID NO: 90970 - RNA, 23 nt, Human
agaaaacaaguucagccuuaggc

SEQ ID NO: 90971 - RNA, 23 nt, Human
agaggaaggagcgugugcaggag

SEQ ID NO: 90972 - RNA, 21 nt, Human
aggaagacauuugcuuugaag

SEQ ID NO: 90973 - RNA, 21 nt, Human
aggaguccaggaggaggggag

SEQ ID NO: 90974 - RNA, 24 nt, Human
aggaguccaggaggaggggaggaa

SEQ ID NO: 90975 - RNA, 24 nt, Human
aggcaggacagggcucauuuugaa

SEQ ID NO: 90976 - RNA, 23 nt, Human
aggcugccaacacaugucaccca

SEQ ID NO: 90977 - RNA, 19 nt, Human
agggcacugaugcucccuc

SEQ ID NO: 90978 - RNA, 18 nt, Human
agugaaauaucaaagcug

SEQ ID NO: 90979 - RNA, 20 nt, Human
augaaauggaacugccucuu

SEQ ID NO: 90980 - RNA, 25 nt, Human
caaaaggcacucaguuaacaagcac

SEQ ID NO: 90981 - RNA, 28 nt, Human
caaacaaacugagacgaacauccucccg

SEQ ID NO: 90982 - RNA, 18 nt, Human
caaaggcuucaacauaca

SEQ ID NO: 90983 - RNA, 20 nt, Human
cacaaacaaacugagacgaa

SEQ ID NO: 90984 - RNA, 23 nt, Human
cacagcaucugacaauuuacaaa

SEQ ID NO: 90985 - RNA, 19 nt, Human
cacaugugaucccagcugg

SEQ ID NO: 90986 - RNA, 23 nt, Human
caggaagacauuugcuuugaagg

SEQ ID NO: 90987 - RNA, 27 nt, Human
caugucacccagccucuggggcccaaa

SEQ ID NO: 90988 - RNA, 22 nt, Human
ccagaaaacaaguucagccuua

SEQ ID NO: 90989 - RNA, 19 nt, Human
ccaugggccccacugaccc

SEQ ID NO: 90990 - RNA, 20 nt, Human
cccuucccacccugggugcc

SEQ ID NO: 90991 - RNA, 18 nt, Human
ccgggccucuccaccaaa

SEQ ID NO: 90992 - RNA, 28 nt, Human
ccucuugugggucuauuucagaaguugg

SEQ ID NO: 90993 - RNA, 22 nt, Human
cgccaaaagcccaguggcacag

SEQ ID NO: 90994 - RNA, 20 nt, Human
gaagaagucaauggcaaaag

SEQ ID NO: 90995 - RNA, 24 nt, Human
ggaggggcuguccuuguacauccu

SEQ ID NO: 90996 - RNA, 19 nt, Human
ggcaggcuaagguguagcc

SEQ ID NO: 90997 - RNA, 25 nt, Human
ggggagcaggcauggcaucugcgac

SEQ ID NO: 90998 - RNA, 21 nt, Human
ggguugggggugcuguaaguc

SEQ ID NO: 90999 - RNA, 20 nt, Human
guucaguucacaggcaucaa

SEQ ID NO: 91000 - RNA, 23 nt, Human
uaaaaguccacaugugaucccag

SEQ ID NO: 91001 - RNA, 26 nt, Human
uaaaauaauaacauuugcacagcauc

SEQ ID NO: 91002 - RNA, 21 nt, Human
uaacaagcacauccaugggcc

SEQ ID NO: 91003 - RNA, 24 nt, Human
uaacugaagaguaacugauuucac

SEQ ID NO: 91004 - RNA, 20 nt, Human
uaacuguacauccuaaagca

SEQ ID NO: 91005 - RNA, 24 nt, Human
uauaagaguauaaacuuaagacag

SEQ ID NO: 91006 - RNA, 23 nt, Human
ucacuggaaauaaaaguccacag

SEQ ID NO: 91007 - RNA, 20 nt, Human
ucagaguucaguucacaggc

SEQ ID NO: 91008 - RNA, 23 nt, Human
uccaaaaaugucuuaaacaccgg

SEQ ID NO: 91009 - RNA, 24 nt, Human
uccaggaagacauuugcuuugaag

SEQ ID NO: 91010 - RNA, 18 nt, Human
uccaggaggaggggagga

SEQ ID NO: 91011 - RNA, 23 nt, Human
uccauaacuguacauccuaaagc

SEQ ID NO: 91012 - RNA, 21 nt, Human
ucccagcuggaguguggucau

SEQ ID NO: 91013 - RNA, 24 nt, Human
ucccuccucugccagaauaaaggu

SEQ ID NO: 91014 - RNA, 19 nt, Human
ucugacaauuuacaaaggc

SEQ ID NO: 91015 - RNA, 18 nt, Human
ucuggcacaaaugaaaug

SEQ ID NO: 91016 - RNA, 19 nt, Human
ugacaauuuacaaaggcuu

SEQ ID NO: 91017 - RNA, 19 nt, Human
ugaccuauaaauauuaacc

SEQ ID NO: 91018 - RNA, 19 nt, Human
ugaccuauaaauauuaacc

SEQ ID NO: 91019 - RNA, 23 nt, Human
ugagaggccgggccucuccacca

SEQ ID NO: 91020 - RNA, 19 nt, Human
ugccagaauaaaggugacc

SEQ ID NO: 91021 - RNA, 20 nt, Human
ugcggguaggccuugugcag

SEQ ID NO: 91022 - RNA, 20 nt, Human
uggcaucugcggguaggccu

SEQ ID NO: 91023 - RNA, 19 nt, Human
uggccuggauggaugaguc

SEQ ID NO: 91024 - RNA, 20 nt, Human
ugggaaaagucuauccugga

SEQ ID NO: 91025 - RNA, 19 nt, Human
ugggaagaagucaauggca

SEQ ID NO: 91026 - RNA, 19 nt, Human
uggggaaagcugcuuccug

SEQ ID NO: 91027 - RNA, 19 nt, Human
ugugcagaacgccaaaagc

SEQ ID NO: 91028 - RNA, 22 nt, Human
uguucccagaaaacaaguucag

SEQ ID NO: 91029 - RNA, 24 nt, Human
uucuggcacaaaugaaauggaacu

SEQ ID NO: 91030 - RNA, 19 nt, Human
uugggggugcuguaaguga

SEQ ID NO: 91031 - RNA, 21 nt, Human
aaaagacugcccagaguggca

SEQ ID NO: 91032 - RNA, 24 nt, Human
aacaacauuguuuaaaucuucaau

SEQ ID NO: 91033 - RNA, 20 nt, Human
aaccccaugaacaggaaagc

SEQ ID NO: 91034 - RNA, 25 nt, Human
aagaagcuuggcaccaacuuugugc

SEQ ID NO: 91035 - RNA, 19 nt, Human
aauugcuucugucucuucc

SEQ ID NO: 91036 - RNA, 22 nt, Human
accauggugggggguguccaac

SEQ ID NO: 91037 - RNA, 19 nt, Human
agacuucgcagccgcugag

SEQ ID NO: 91038 - RNA, 19 nt, Human
agcccugaguggaagcagc

SEQ ID NO: 91039 - RNA, 19 nt, Human
aggaagaaaauauuucagg

SEQ ID NO: 91040 - RNA, 20 nt, Human
aggcaguggacuccugauag

SEQ ID NO: 91041 - RNA, 24 nt, Human
agucaaaucccacacugcacauac

SEQ ID NO: 91042 - RNA, 20 nt, Human
augcccuauuucuuuggagg

SEQ ID NO: 91043 - RNA, 22 nt, Human
auggagcagccaccacaagccc

SEQ ID NO: 91044 - RNA, 20 nt, Human
caaaagacugcccagagugg

SEQ ID NO: 91045 - RNA, 24 nt, Human
caaggccagacacuguagcccaug

SEQ ID NO: 91046 - RNA, 24 nt, Human
cacccuucagcugcuugggaggca

SEQ ID NO: 91047 - RNA, 25 nt, Human
cacugacacaaaagacugcccagag

SEQ ID NO: 91048 - RNA, 24 nt, Human
cagaagggcaaucaggauucaggc

SEQ ID NO: 91049 - RNA, 20 nt, Human
cagaggagaagcccugagug

SEQ ID NO: 91050 - RNA, 20 nt, Human
cagcugcguguguccucuca

SEQ ID NO: 91051 - RNA, 22 nt, Human
cagcuuuauuccucuagcuuca

SEQ ID NO: 91052 - RNA, 22 nt, Human
caggauucaggccgcgcccucc

SEQ ID NO: 91053 - RNA, 19 nt, Human
caguggacuccugauaguc

SEQ ID NO: 91054 - RNA, 24 nt, Human
caucuucagcugcguguguccucu

SEQ ID NO: 91055 - RNA, 19 nt, Human
ccacaaaaccuuggaggag

SEQ ID NO: 91056 - RNA, 18 nt, Human
ccacaaucuccaccucuu

SEQ ID NO: 91057 - RNA, 22 nt, Human
ccagaccuucugcacaggaagc

SEQ ID NO: 91058 - RNA, 22 nt, Human
ccaggauuaaaauuaaaagccc

SEQ ID NO: 91059 - RNA, 25 nt, Human
ccagggccacaggggcaagccaugc

SEQ ID NO: 91060 - RNA, 21 nt, Human
cccacacugcacauacuccgg

SEQ ID NO: 91061 - RNA, 25 nt, Human
ccccugcuacucugcgcagccccuu

SEQ ID NO: 91062 - RNA, 22 nt, Human
ccccuuuaagacacugacacaa

SEQ ID NO: 91063 - RNA, 20 nt, Human
cccgccugcgcaggccccuu

SEQ ID NO: 91064 - RNA, 18 nt, Human
cccugagucuuggcgccc

SEQ ID NO: 91065 - RNA, 18 nt, Human
ccgcgcccuccagggccc

SEQ ID NO: 91066 - RNA, 23 nt, Human
ccguuuagucacccuucagcugc

SEQ ID NO: 91067 - RNA, 21 nt, Human
ccuccagggccccugcuacuc

SEQ ID NO: 91068 - RNA, 23 nt, Human
ccucuucacgagguaagggagac

SEQ ID NO: 91069 - RNA, 24 nt, Human
ccucuugccaucaaaggcagaaac

SEQ ID NO: 91070 - RNA, 26 nt, Human
cgaccagaccuucugcacaggaagcu

SEQ ID NO: 91071 - RNA, 19 nt, Human
cgcaggccccuuuaagaca

SEQ ID NO: 91072 - RNA, 20 nt, Human
cuuggcaccaacuuugugcc

SEQ ID NO: 91073 - RNA, 18 nt, Human
cuugggaggcaggaagag

SEQ ID NO: 91074 - RNA, 20 nt, Human
cuuuccacaaaaccuuggag

SEQ ID NO: 91075 - RNA, 25 nt, Human
cuuugugccacauccucaacucuuc

SEQ ID NO: 91076 - RNA, 18 nt, Human
gaccaguaucaauacaug

SEQ ID NO: 91077 - RNA, 19 nt, Human
gagacuuccccucuucacg

SEQ ID NO: 91078 - RNA, 23 nt, Human
gcagaggagaagcccugagugga

SEQ ID NO: 91079 - RNA, 18 nt, Human
gccacaaucuccaccucu

SEQ ID NO: 91080 - RNA, 18 nt, Human
gcuuggcaccaacuuugu

SEQ ID NO: 91081 - RNA, 23 nt, Human
ggagacaaaagcagccauuugga

SEQ ID NO: 91082 - RNA, 25 nt, Human
gggcaaaaaccccaugaacaggaaa

SEQ ID NO: 91083 - RNA, 26 nt, Human
ggggguguccaacaugcucugcuggc

SEQ ID NO: 91084 - RNA, 22 nt, Human
uaaaaacagcaacuugucuucc

SEQ ID NO: 91085 - RNA, 24 nt, Human
uaaaaacagcaacuugucuuccca

SEQ ID NO: 91086 - RNA, 28 nt, Human
uacuguaacuacaacagcucgcaagaca

SEQ ID NO: 91087 - RNA, 21 nt, Human
ucaaaggcagaaaccgaagga

SEQ ID NO: 91088 - RNA, 21 nt, Human
ucaaaggcagaaaccgaagga

SEQ ID NO: 91089 - RNA, 30 nt, Human
ucauucuuagaccagcuaagagcugagggg

SEQ ID NO: 91090 - RNA, 20 nt, Human
uccacaaaaccuuggaggag

SEQ ID NO: 91091 - RNA, 18 nt, Human
uccagcugugaaguggga

SEQ ID NO: 91092 - RNA, 18 nt, Human
ucugcacaggaagcugga

SEQ ID NO: 91093 - RNA, 20 nt, Human
ucuuagaccagcuaagagcu

SEQ ID NO: 91094 - RNA, 22 nt, Human
ucuucaauuuccaauuuauuuc

SEQ ID NO: 91095 - RNA, 23 nt, Human
ugaaaagagcggugaccaacucg

SEQ ID NO: 91096 - RNA, 18 nt, Human
ugaagugggaccaguauc

SEQ ID NO: 91097 - RNA, 18 nt, Human
ugacacaaaagacugccc

SEQ ID NO: 91098 - RNA, 22 nt, Human
ugacacaaaagacugcccagag

SEQ ID NO: 91099 - RNA, 22 nt, Human
ugagacuccaggauuaaaauua

SEQ ID NO: 91100 - RNA, 18 nt, Human
ugaggcuggccuccucug

SEQ ID NO: 91101 - RNA, 23 nt, Human
ugcccuauuucuuuggagggaca

SEQ ID NO: 91102 - RNA, 19 nt, Human
ugcuggcccaguucccagc

SEQ ID NO: 91103 - RNA, 18 nt, Human
uggaaugaggugaggcug

SEQ ID NO: 91104 - RNA, 21 nt, Human
uggacuccugauagucccgcc

SEQ ID NO: 91105 - RNA, 19 nt, Human
uggaggagucaaaucccac

SEQ ID NO: 91106 - RNA, 21 nt, Human
uggagggacagaaucacuucu

SEQ ID NO: 91107 - RNA, 22 nt, Human
uggcauuugcugcugaggcucc

SEQ ID NO: 91108 - RNA, 22 nt, Human
ugggaggcaggaagagacuucc

SEQ ID NO: 91109 - RNA, 21 nt, Human
ugucuccagcugugaaguggg

SEQ ID NO: 91110 - RNA, 27 nt, Human
uuaaaguagcaagcggcuacuuuuccc

SEQ ID NO: 91111 - RNA, 24 nt, Human
uuaagacacugacacaaaagacug

SEQ ID NO: 91112 - RNA, 18 nt, Human
uuacaaucacuuggccac

SEQ ID NO: 91113 - RNA, 22 nt, Human
uucccagccgauccccugaguc

SEQ ID NO: 91114 - RNA, 23 nt, Human
uucucuguaaucgccgccacaau

SEQ ID NO: 91115 - RNA, 21 nt, Human
uucuuuggagggacagaauca

SEQ ID NO: 91116 - RNA, 22 nt, Human
uugcugcugaggcuccagggca

SEQ ID NO: 91117 - RNA, 19 nt, Human
aaagugcugggauuacagg

SEQ ID NO: 91118 - RNA, 20 nt, Human
aaagugcugggauuacaggc

SEQ ID NO: 91119 - RNA, 22 nt, Human
aaagugcugggauuacaggcgg

SEQ ID NO: 91120 - RNA, 24 nt, Human
aaagugcugggauuacaggcggga

SEQ ID NO: 91121 - RNA, 23 nt, Human
aaccacagaugagccugcugacc

SEQ ID NO: 91122 - RNA, 20 nt, Human
aaccucugccucccgaguuc

SEQ ID NO: 91123 - RNA, 22 nt, Human
aacuuuuccagaaguccauacg

SEQ ID NO: 91124 - RNA, 22 nt, Human
aagaaggccggcacacagcccc

SEQ ID NO: 91125 - RNA, 24 nt, Human
aagaauuuuccauuuaauauuguc

SEQ ID NO: 91126 - RNA, 18 nt, Human
aagcgaaaggagagccug

SEQ ID NO: 91127 - RNA, 20 nt, Human
aaggagagccugggccuaug

SEQ ID NO: 91128 - RNA, 22 nt, Human
aaguaaaaaaagacugaccuga

SEQ ID NO: 91129 - RNA, 18 nt, Human
aagugcugggauuacagg

SEQ ID NO: 91130 - RNA, 19 nt, Human
aagugcugggauuacaggc

SEQ ID NO: 91131 - RNA, 26 nt, Human
aagugcugggauuacaggcgggagcc

SEQ ID NO: 91132 - RNA, 24 nt, Human
acacugcugcacagacaugcuccu

SEQ ID NO: 91133 - RNA, 19 nt, Human
acagaagcacugugauacc

SEQ ID NO: 91134 - RNA, 18 nt, Human
acaggcgggagccaacau

SEQ ID NO: 91135 - RNA, 19 nt, Human
acccaggcuggagugcaau

SEQ ID NO: 91136 - RNA, 18 nt, Human
acccauggaaagugacac

SEQ ID NO: 91137 - RNA, 22 nt, Human
acccgcgcagcuccagucugca

SEQ ID NO: 91138 - RNA, 24 nt, Human
acgggguauccccauguuggucag

SEQ ID NO: 91139 - RNA, 24 nt, Human
acugaacccauggaaagugacacc

SEQ ID NO: 91140 - RNA, 20 nt, Human
acuguuugaagaauuuucca

SEQ ID NO: 91141 - RNA, 19 nt, Human
acuguuuucuucccaucuu

SEQ ID NO: 91142 - RNA, 21 nt, Human
acuucaaccucccaaaccaag

SEQ ID NO: 91143 - RNA, 23 nt, Human
acuucaaccucccaaaccaagcu

SEQ ID NO: 91144 - RNA, 23 nt, Human
agaacuuuuccagaaguccauac

SEQ ID NO: 91145 - RNA, 25 nt, Human
agaaggccggcacacagccggaccc

SEQ ID NO: 91146 - RNA, 21 nt, Human
agcaggcugggcuacugugcu

SEQ ID NO: 91147 - RNA, 21 nt, Human
agcugcacagcaucggucccc

SEQ ID NO: 91148 - RNA, 24 nt, Human
agggcuucuggaaugugcaggggc

SEQ ID NO: 91149 - RNA, 21 nt, Human
aguagcugggauuacaggcau

SEQ ID NO: 91150 - RNA, 19 nt, Human
agugaucaggcauuugcuc

SEQ ID NO: 91151 - RNA, 21 nt, Human
agugcaauggcgcgaucucag

SEQ ID NO: 91152 - RNA, 18 nt, Human
agugcugggauuacaggc

SEQ ID NO: 91153 - RNA, 20 nt, Human
aguucaagugauuuuccugc

SEQ ID NO: 91154 - RNA, 23 nt, Human
caaaaacacugcugcacagacau

SEQ ID NO: 91155 - RNA, 27 nt, Human
caaagugcugggauuacaggcgggagc

SEQ ID NO: 91156 - RNA, 22 nt, Human
caagugauuuuccugccucagc

SEQ ID NO: 91157 - RNA, 22 nt, Human
cacagcagucguuuggcgaaaa

SEQ ID NO: 91158 - RNA, 21 nt, Human
caccccacagccaucccuacc

SEQ ID NO: 91159 - RNA, 18 nt, Human
cacugcaaccucugccuc

SEQ ID NO: 91160 - RNA, 21 nt, Human
cacugcaaccucugccucccg

SEQ ID NO: 91161 - RNA, 19 nt, Human
cacugcuugaaagcugucc

SEQ ID NO: 91162 - RNA, 18 nt, Human
cagccagcggccccacaa

SEQ ID NO: 91163 - RNA, 19 nt, Human
cagccagcggccccacaag

SEQ ID NO: 91164 - RNA, 20 nt, Human
cagccuccugaguagcuggg

SEQ ID NO: 91165 - RNA, 22 nt, Human
caggccugccugagccugggcu

SEQ ID NO: 91166 - RNA, 20 nt, Human
caggcugggcuacugugcuc

SEQ ID NO: 91167 - RNA, 21 nt, Human
caggugauucacccacuuggg

SEQ ID NO: 91168 - RNA, 24 nt, Human
cauguuggucaggcuggucuugaa

SEQ ID NO: 91169 - RNA, 19 nt, Human
ccaaagugcugggauuaca

SEQ ID NO: 91170 - RNA, 22 nt, Human
ccaaagugcugggauuacaggc

SEQ ID NO: 91171 - RNA, 23 nt, Human
ccaaagugcugggauuacaggcg

SEQ ID NO: 91172 - RNA, 19 nt, Human
ccaggacgggcgaucugac

SEQ ID NO: 91173 - RNA, 19 nt, Human
ccauguuggucaggcuggu

SEQ ID NO: 91174 - RNA, 21 nt, Human
ccauguuggucaggcuggucu

SEQ ID NO: 91175 - RNA, 21 nt, Human
ccauguuggucaggcuggucu

SEQ ID NO: 91176 - RNA, 23 nt, Human
cccacagccaucccuaccaauca

SEQ ID NO: 91177 - RNA, 20 nt, Human
cccagagcacuucaaccucc

SEQ ID NO: 91178 - RNA, 24 nt, Human
ccccauguuggucaggcuggucuu

SEQ ID NO: 91179 - RNA, 20 nt, Human
cccgaguucaagugauuuuc

SEQ ID NO: 91180 - RNA, 23 nt, Human
cccgaguucaagugauuuuccug

SEQ ID NO: 91181 - RNA, 22 nt, Human
cccgcaucgucuucugagccug

SEQ ID NO: 91182 - RNA, 25 nt, Human
cccgcgcagcuccagucugcagcca

SEQ ID NO: 91183 - RNA, 24 nt, Human
cccggcuuguauuuuuaguagaga

SEQ ID NO: 91184 - RNA, 22 nt, Human
ccucccaaaccaagcucugcgg

SEQ ID NO: 91185 - RNA, 24 nt, Human
ccugaccucaggugauucacccac

SEQ ID NO: 91186 - RNA, 23 nt, Human
ccugaguagcugggauuacaggc

SEQ ID NO: 91187 - RNA, 24 nt, Human
ccugaguagcugggauuacaggca

SEQ ID NO: 91188 - RNA, 23 nt, Human
ccugccucagccuccugaguagc

SEQ ID NO: 91189 - RNA, 24 nt, Human
ccugccucagccuccugaguagcu

SEQ ID NO: 91190 - RNA, 28 nt, Human
ccuggacguggggaacacagggacgguu

SEQ ID NO: 91191 - RNA, 21 nt, Human
ccuggcccagcuaagcaucug

SEQ ID NO: 91192 - RNA, 27 nt, Human
cgcccaggggggcggggcaggggcggg

SEQ ID NO: 91193 - RNA, 21 nt, Human
cgcucuucgcccaggggggcg

SEQ ID NO: 91194 - RNA, 19 nt, Human
cggccugggugcagcaagc

SEQ ID NO: 91195 - RNA, 18 nt, Human
cggggcaggggcggggag

SEQ ID NO: 91196 - RNA, 24 nt, Human
cgggguauccccauguuggucagg

SEQ ID NO: 91197 - RNA, 20 nt, Human
cguggggaacacagggacgg

SEQ ID NO: 91198 - RNA, 23 nt, Human
cucacugcaaccucugccucccg

SEQ ID NO: 91199 - RNA, 24 nt, Human
cucacugcaaccucugccucccga

SEQ ID NO: 91200 - RNA, 24 nt, Human
cucagccuccugaguagcugggau

SEQ ID NO: 91201 - RNA, 22 nt, Human
cucaugcucucucucucccaca

SEQ ID NO: 91202 - RNA, 18 nt, Human
cucccgaguucaagugau

SEQ ID NO: 91203 - RNA, 21 nt, Human
cucccugacccgcgcagcucc

SEQ ID NO: 91204 - RNA, 26 nt, Human
cuccuggaagccaccccacagccauc

SEQ ID NO: 91205 - RNA, 22 nt, Human
cucugggccaggccugccugag

SEQ ID NO: 91206 - RNA, 19 nt, Human
cugaacccauggaaaguga

SEQ ID NO: 91207 - RNA, 23 nt, Human
cugaguagcugggauuacaggca

SEQ ID NO: 91208 - RNA, 24 nt, Human
cugaguagcugggauuacaggcau

SEQ ID NO: 91209 - RNA, 23 nt, Human
cugcaaccucugccucccgaguu

SEQ ID NO: 91210 - RNA, 24 nt, Human
cugcaaccucugccucccgaguuc

SEQ ID NO: 91211 - RNA, 23 nt, Human
cugccucccgaguucaagugauu

SEQ ID NO: 91212 - RNA, 19 nt, Human
cugggccagcaaagcccac

SEQ ID NO: 91213 - RNA, 20 nt, Human
cugggcuccuuugggagucu

SEQ ID NO: 91214 - RNA, 19 nt, Human
cuuacaacgcucugggauc

SEQ ID NO: 91215 - RNA, 23 nt, Human
cuucugagccugccugcugcauc

SEQ ID NO: 91216 - RNA, 21 nt, Human
cuugcucugucacccaggcug

SEQ ID NO: 91217 - RNA, 24 nt, Human
cuugcucugucacccaggcuggag

SEQ ID NO: 91218 - RNA, 18 nt, Human
cuuguauuuuuaguagag

SEQ ID NO: 91219 - RNA, 19 nt, Human
cuuguauuuuuaguagaga

SEQ ID NO: 91220 - RNA, 20 nt, Human
cuuguauuuuuaguagagac

SEQ ID NO: 91221 - RNA, 23 nt, Human
gaccucaggugauucacccacuu

SEQ ID NO: 91222 - RNA, 23 nt, Human
gagacgggguauccccauguugg

SEQ ID NO: 91223 - RNA, 24 nt, Human
gagacgggguauccccauguuggu

SEQ ID NO: 91224 - RNA, 22 nt, Human
gagagagagagaauacgacugc

SEQ ID NO: 91225 - RNA, 22 nt, Human
gaguagcugggauuacaggcau

SEQ ID NO: 91226 - RNA, 24 nt, Human
gaguagcugggauuacaggcaugc

SEQ ID NO: 91227 - RNA, 22 nt, Human
gaguucaagugauuuuccugcc

SEQ ID NO: 91228 - RNA, 19 nt, Human
gauacugagagagagagag

SEQ ID NO: 91229 - RNA, 19 nt, Human
gaucugcucucugucuaca

SEQ ID NO: 91230 - RNA, 18 nt, Human
gauuacaggcaugcgcca

SEQ ID NO: 91231 - RNA, 18 nt, Human
gauuacaggcgggagcca

SEQ ID NO: 91232 - RNA, 24 nt, Human
gauuacaggcgggagccaacaugc

SEQ ID NO: 91233 - RNA, 21 nt, Human
gauuuuccugccucagccucc

SEQ ID NO: 91234 - RNA, 22 nt, Human
gcaaccucugccucccgaguuc

SEQ ID NO: 91235 - RNA, 20 nt, Human
gcauauccgaacagccagca

SEQ ID NO: 91236 - RNA, 22 nt, Human
gccaccacgcccggcuuguauu

SEQ ID NO: 91237 - RNA, 18 nt, Human
gccaggccugccugagcc

SEQ ID NO: 91238 - RNA, 20 nt, Human
gccauccaccucuccuucuc

SEQ ID NO: 91239 - RNA, 24 nt, Human
gccccacaaguccgcgcucuucgc

SEQ ID NO: 91240 - RNA, 22 nt, Human
gccucccgaguucaagugauuu

SEQ ID NO: 91241 - RNA, 23 nt, Human
gcucugggaucccuacagggaug

SEQ ID NO: 91242 - RNA, 27 nt, Human
gcucugucacccaggcuggagugcaau

SEQ ID NO: 91243 - RNA, 20 nt, Human
gcugacggcuccuggcugca

SEQ ID NO: 91244 - RNA, 19 nt, Human
gcuggagugcaauggcgcg

SEQ ID NO: 91245 - RNA, 23 nt, Human
gcuggucuugaacuccugaccuc

SEQ ID NO: 91246 - RNA, 19 nt, Human
ggauuacaggcaugcgcca

SEQ ID NO: 91247 - RNA, 20 nt, Human
ggcaguucucuuuucccacu

SEQ ID NO: 91248 - RNA, 24 nt, Human
ggcccagcuaagcaucugcagcca

SEQ ID NO: 91249 - RNA, 20 nt, Human
ggccugggugcagcaagcuc

SEQ ID NO: 91250 - RNA, 24 nt, Human
ggcuggucuugaacuccugaccuc

SEQ ID NO: 91251 - RNA, 21 nt, Human
gggcaggggcggggagucgcc

SEQ ID NO: 91252 - RNA, 20 nt, Human
gggcauggggcaguucucuu

SEQ ID NO: 91253 - RNA, 19 nt, Human
gggggcggggcaggggcgg

SEQ ID NO: 91254 - RNA, 23 nt, Human
gggguauccccauguuggucagg

SEQ ID NO: 91255 - RNA, 19 nt, Human
ggucuugaacuccugaccu

SEQ ID NO: 91256 - RNA, 23 nt, Human
guagagacgggguauccccaugu

SEQ ID NO: 91257 - RNA, 18 nt, Human
guagcugggauuacaggc

SEQ ID NO: 91258 - RNA, 20 nt, Human
guagcugggauuacaggcau

SEQ ID NO: 91259 - RNA, 24 nt, Human
gucuugcucugucacccaggcugg

SEQ ID NO: 91260 - RNA, 19 nt, Human
gugacucugggccaggccu

SEQ ID NO: 91261 - RNA, 21 nt, Human
gugauucacccacuugggcuu

SEQ ID NO: 91262 - RNA, 24 nt, Human
gugauuuuccugccucagccuccu

SEQ ID NO: 91263 - RNA, 20 nt, Human
gugccuugucagguucugga

SEQ ID NO: 91264 - RNA, 18 nt, Human
guggcccccuccuggaag

SEQ ID NO: 91265 - RNA, 20 nt, Human
uaaaaaaagacugaccugaa

SEQ ID NO: 91266 - RNA, 25 nt, Human
uaaaaaaagacugaccugaacagaa

SEQ ID NO: 91267 - RNA, 25 nt, Human
uaacugaacccauggaaagugacac

SEQ ID NO: 91268 - RNA, 20 nt, Human
uaauuuguaaaaugacauuu

SEQ ID NO: 91269 - RNA, 23 nt, Human
uacaggcaugcgccaccacgccc

SEQ ID NO: 91270 - RNA, 22 nt, Human
uacaggugaaccacagaugagc

SEQ ID NO: 91271 - RNA, 21 nt, Human
uaccagcaucacuacucuggu

SEQ ID NO: 91272 - RNA, 22 nt, Human
uagagcuuccagauaaucacau

SEQ ID NO: 91273 - RNA, 23 nt, Human
uagcucccaggugggucaauuuc

SEQ ID NO: 91274 - RNA, 24 nt, Human
uaguagagacgggguauccccaug

SEQ ID NO: 91275 - RNA, 18 nt, Human
ucaagugauuuuccugcc

SEQ ID NO: 91276 - RNA, 18 nt, Human
ucaaucccuggcccagcu

SEQ ID NO: 91277 - RNA, 18 nt, Human
ucacccaggcuggagugc

SEQ ID NO: 91278 - RNA, 18 nt, Human
ucacugcaaccucugccu

SEQ ID NO: 91279 - RNA, 19 nt, Human
ucacugcaaccucugccuc

SEQ ID NO: 91280 - RNA, 22 nt, Human
ucacugcaaccucugccucccg

SEQ ID NO: 91281 - RNA, 24 nt, Human
ucacugcaaccucugccucccgag

SEQ ID NO: 91282 - RNA, 24 nt, Human
ucagaacaaugcacaagggaaaac

SEQ ID NO: 91283 - RNA, 20 nt, Human
ucagccuccugaguagcugg

SEQ ID NO: 91284 - RNA, 25 nt, Human
uccagggaaaggaugacccacagau

SEQ ID NO: 91285 - RNA, 21 nt, Human
uccaucacacugcucagaaca

SEQ ID NO: 91286 - RNA, 24 nt, Human
ucccaaagugcugggauuacaggc

SEQ ID NO: 91287 - RNA, 20 nt, Human
ucccacuugggaccaaagcc

SEQ ID NO: 91288 - RNA, 21 nt, Human
ucccgaguucaagugauuuuc

SEQ ID NO: 91289 - RNA, 24 nt, Human
ucccgaguucaagugauuuuccug

SEQ ID NO: 91290 - RNA, 21 nt, Human
uccgcgcucuucgcccagggg

SEQ ID NO: 91291 - RNA, 24 nt, Human
uccugaguagcugggauuacaggc

SEQ ID NO: 91292 - RNA, 18 nt, Human
uccuuugggagucuagaa

SEQ ID NO: 91293 - RNA, 20 nt, Human
ucuacggccuggacgugggg

SEQ ID NO: 91294 - RNA, 19 nt, Human
ucuccaaaaacgauaauca

SEQ ID NO: 91295 - RNA, 20 nt, Human
ucucugucuacaggugaacc

SEQ ID NO: 91296 - RNA, 20 nt, Human
ucucuuuucccacuugggac

SEQ ID NO: 91297 - RNA, 24 nt, Human
ucugcagccaggggaggaugagac

SEQ ID NO: 91298 - RNA, 24 nt, Human
ucugucacccaggcuggagugcaa

SEQ ID NO: 91299 - RNA, 26 nt, Human
ucuucccaucuuuucacuuaaaggaa

SEQ ID NO: 91300 - RNA, 23 nt, Human
ucuugaacuccugaccucaggug

SEQ ID NO: 91301 - RNA, 23 nt, Human
ucuugcucugucacccaggcugg

SEQ ID NO: 91302 - RNA, 24 nt, Human
ucuugcucugucacccaggcugga

SEQ ID NO: 91303 - RNA, 21 nt, Human
ugaauaaacuaccugccccau

SEQ ID NO: 91304 - RNA, 20 nt, Human
ugacauuuggccagagugau

SEQ ID NO: 91305 - RNA, 22 nt, Human
ugaccucaggugauucacccac

SEQ ID NO: 91306 - RNA, 24 nt, Human
ugaccucaggugauucacccacuu

SEQ ID NO: 91307 - RNA, 18 nt, Human
ugacucugggccaggccu

SEQ ID NO: 91308 - RNA, 18 nt, Human
ugagacagagucuugcuc

SEQ ID NO: 91309 - RNA, 22 nt, Human
ugagacagagucuugcucuguc

SEQ ID NO: 91310 - RNA, 26 nt, Human
ugaucaggcauuugcucucaucuuag

SEQ ID NO: 91311 - RNA, 24 nt, Human
ugccucagccuccugaguagcugg

SEQ ID NO: 91312 - RNA, 22 nt, Human
ugccucccgaguucaagugauu

SEQ ID NO: 91313 - RNA, 24 nt, Human
ugcucucaugcucucucucuccca

SEQ ID NO: 91314 - RNA, 24 nt, Human
ugcucugucacccaggcuggagug

SEQ ID NO: 91315 - RNA, 24 nt, Human
ugcugcacagacaugcuccuggca

SEQ ID NO: 91316 - RNA, 26 nt, Human
ugcugggauuacaggcgggagccaac

SEQ ID NO: 91317 - RNA, 20 nt, Human
uggaaugugcaggggcaaaa

SEQ ID NO: 91318 - RNA, 23 nt, Human
uggagugcaauggcgcgaucuca

SEQ ID NO: 91319 - RNA, 24 nt, Human
uggagugcaauggcgcgaucucag

SEQ ID NO: 91320 - RNA, 20 nt, Human
uggauaaggggggacuacug

SEQ ID NO: 91321 - RNA, 18 nt, Human
uggcauauccgaacagcc

SEQ ID NO: 91322 - RNA, 21 nt, Human
uggccgagaugggaccucaca

SEQ ID NO: 91323 - RNA, 24 nt, Human
uggcgcgaucucagcucacugcaa

SEQ ID NO: 91324 - RNA, 18 nt, Human
ugggauuacaggcaugcg

SEQ ID NO: 91325 - RNA, 21 nt, Human
ugggauuacaggcaugcgcca

SEQ ID NO: 91326 - RNA, 22 nt, Human
ugggauuacaggcaugcgccac

SEQ ID NO: 91327 - RNA, 24 nt, Human
ugggauuacaggcaugcgccacca

SEQ ID NO: 91328 - RNA, 18 nt, Human
ugggauuacaggcgggag

SEQ ID NO: 91329 - RNA, 19 nt, Human
ugggauuacaggcgggagc

SEQ ID NO: 91330 - RNA, 21 nt, Human
ugggauuacaggcgggagcca

SEQ ID NO: 91331 - RNA, 25 nt, Human
ugggauuacaggcgggagccaacau

SEQ ID NO: 91332 - RNA, 18 nt, Human
uggggcaguucucuuuuc

SEQ ID NO: 91333 - RNA, 24 nt, Human
uggucaggcuggucuugaacuccu

SEQ ID NO: 91334 - RNA, 20 nt, Human
ugucacccaggcuggagugc

SEQ ID NO: 91335 - RNA, 23 nt, Human
ugucuacaggugaaccacagaug

SEQ ID NO: 91336 - RNA, 18 nt, Human
ugugcaggggcaaaaaca

SEQ ID NO: 91337 - RNA, 18 nt, Human
uguggacagcuuuccugg

SEQ ID NO: 91338 - RNA, 20 nt, Human
uuaaaggaagcaccuuacgg

SEQ ID NO: 91339 - RNA, 18 nt, Human
uuaguagagacgggguau

SEQ ID NO: 91340 - RNA, 20 nt, Human
uuauuuaugagacagagucu

SEQ ID NO: 91341 - RNA, 20 nt, Human
uucaaccucccaaaccaagc

SEQ ID NO: 91342 - RNA, 21 nt, Human
uucaagugauuuuccugccuc

SEQ ID NO: 91343 - RNA, 23 nt, Human
uucaagugauuuuccugccucag

SEQ ID NO: 91344 - RNA, 24 nt, Human
uucaagugauuuuccugccucagc

SEQ ID NO: 91345 - RNA, 20 nt, Human
uucacagauagaagauucag

SEQ ID NO: 91346 - RNA, 23 nt, Human
uucacagauagaagauucagcau

SEQ ID NO: 91347 - RNA, 21 nt, Human
uuccaggcaguugugcuguga

SEQ ID NO: 91348 - RNA, 24 nt, Human
uugcucugucacccaggcuggagu

SEQ ID NO: 91349 - RNA, 23 nt, Human
uuguauuuuuaguagagacgggg

SEQ ID NO: 91350 - RNA, 21 nt, Human
uuuuuaguagagacgggguau

SEQ ID NO: 91351 - RNA, 20 nt, Human
aaaaaaaaauccagccuggg

SEQ ID NO: 91352 - RNA, 24 nt, Human
aaaaaaauccagccuggggguaaa

SEQ ID NO: 91353 - RNA, 20 nt, Human
aaauuuaaacaccuauaacc

SEQ ID NO: 91354 - RNA, 21 nt, Human
aacauuuacugauuaagaguc

SEQ ID NO: 91355 - RNA, 21 nt, Human
aacccugugcuuucucaaaac

SEQ ID NO: 91356 - RNA, 25 nt, Human
aacuuugcucuuucaccugguuuaa

SEQ ID NO: 91357 - RNA, 18 nt, Human
aagcugaagagggagggg

SEQ ID NO: 91358 - RNA, 19 nt, Human
aaggaaauuuaaacaccua

SEQ ID NO: 91359 - RNA, 18 nt, Human
agagggaggggagggaca

SEQ ID NO: 91360 - RNA, 21 nt, Human
agagggaggggagggacaagc

SEQ ID NO: 91361 - RNA, 26 nt, Human
agcuggggccgggugagauaaucuuc

SEQ ID NO: 91362 - RNA, 19 nt, Human
aucacuuuccuuccauugu

SEQ ID NO: 91363 - RNA, 23 nt, Human
augaucaugaaggucugaauauc

SEQ ID NO: 91364 - RNA, 18 nt, Human
auggcuagugucucuucu

SEQ ID NO: 91365 - RNA, 21 nt, Human
cacucccacccccauuaggag

SEQ ID NO: 91366 - RNA, 24 nt, Human
cagaaucagugucugggaagcuga

SEQ ID NO: 91367 - RNA, 24 nt, Human
cauaaaaauaaauaagaguuucac

SEQ ID NO: 91368 - RNA, 24 nt, Human
ccuauaacccugugcuuucucaaa

SEQ ID NO: 91369 - RNA, 25 nt, Human
ccucucuuaaaaacucuuacaugag

SEQ ID NO: 91370 - RNA, 22 nt, Human
cgaaugacacauaaguaggcac

SEQ ID NO: 91371 - RNA, 19 nt, Human
cuuucucaaaacuucauua

SEQ ID NO: 91372 - RNA, 24 nt, Human
gaaccgaaguaacacucccacccc

SEQ ID NO: 91373 - RNA, 22 nt, Human
gaaucagugucugggaagcuga

SEQ ID NO: 91374 - RNA, 18 nt, Human
gcugggccccuccacacc

SEQ ID NO: 91375 - RNA, 24 nt, Human
gggccccuccacaccggucagcuu

SEQ ID NO: 91376 - RNA, 20 nt, Human
guggcaguaaauaaauaaac

SEQ ID NO: 91377 - RNA, 21 nt, Human
uaaaaauaaauaagaguuuca

SEQ ID NO: 91378 - RNA, 23 nt, Human
uacucuguguacucgguaaaaaa

SEQ ID NO: 91379 - RNA, 25 nt, Human
ucacuguccuuuucacagaaucacu

SEQ ID NO: 91380 - RNA, 23 nt, Human
ucagcccucucuuaaaaacucuu

SEQ ID NO: 91381 - RNA, 20 nt, Human
ucagcuuauauagcuggggc

SEQ ID NO: 91382 - RNA, 22 nt, Human
ucagcuuauauagcuggggccg

SEQ ID NO: 91383 - RNA, 19 nt, Human
ucccuggaguuggcccugc

SEQ ID NO: 91384 - RNA, 22 nt, Human
ucccuggaguuggcccugcugg

SEQ ID NO: 91385 - RNA, 23 nt, Human
ucgguaaaaaaaaaaaaaaaaaa

SEQ ID NO: 91386 - RNA, 24 nt, Human
ucguggaaggaaucccuggaguug

SEQ ID NO: 91387 - RNA, 22 nt, Human
ugcugggccccuccacaccggu

SEQ ID NO: 91388 - RNA, 20 nt, Human
uggaguuggcccugcugggc

SEQ ID NO: 91389 - RNA, 21 nt, Human
uggcccugcugggccccucca

SEQ ID NO: 91390 - RNA, 18 nt, Human
ugggaagcugaagaggga

SEQ ID NO: 91391 - RNA, 19 nt, Human
ugggaaggcucugaaagug

SEQ ID NO: 91392 - RNA, 19 nt, Human
ugucucuucuccugggcca

SEQ ID NO: 91393 - RNA, 23 nt, Human
uuaaacaccuauaacccugugcu

SEQ ID NO: 91394 - RNA, 22 nt, Human
uucacagaaucacuuuccuucc

SEQ ID NO: 91395 - RNA, 19 nt, Human
uugcucuuucaccugguuu

SEQ ID NO: 91396 - RNA, 24 nt, Human
uuguauguuuuucugucguggaag

SEQ ID NO: 91397 - RNA, 26 nt, Human
uuguauguuuuucugucguggaagga

SEQ ID NO: 91398 - RNA, 19 nt, Human
uuuuuuuuuuugagcaaau

SEQ ID NO: 91399 - RNA, 21 nt, Human
aaacaagaaacagcaaaugga

SEQ ID NO: 91400 - RNA, 29 nt, Human
aaacaagaaacagcaaauggagggacccc

SEQ ID NO: 91401 - RNA, 22 nt, Human
aaacagaagaaucauaaucuag

SEQ ID NO: 91402 - RNA, 22 nt, Human
aaaugaacaaaacauguagaug

SEQ ID NO: 91403 - RNA, 22 nt, Human
aacagaagaaucauaaucuaga

SEQ ID NO: 91404 - RNA, 20 nt, Human
aaccaaacacagugagugac

SEQ ID NO: 91405 - RNA, 19 nt, Human
aaccgcacuagcagcggcg

SEQ ID NO: 91406 - RNA, 25 nt, Human
aagaagggggacauucuagguuacg

SEQ ID NO: 91407 - RNA, 23 nt, Human
aagcaagaagggggacauucuag

SEQ ID NO: 91408 - RNA, 24 nt, Human
aaugaaugaggcuugggggaaaga

SEQ ID NO: 91409 - RNA, 23 nt, Human
acacacauacacacucgcacaca

SEQ ID NO: 91410 - RNA, 20 nt, Human
acacacuuccgagcgagugc

SEQ ID NO: 91411 - RNA, 24 nt, Human
accucaugugaaugauugagccau

SEQ ID NO: 91412 - RNA, 18 nt, Human
accugaagccaccaacac

SEQ ID NO: 91413 - RNA, 21 nt, Human
acggaugugcgccccagaugu

SEQ ID NO: 91414 - RNA, 22 nt, Human
agaaaacauaccccuuucccag

SEQ ID NO: 91415 - RNA, 21 nt, Human
agaagaggagggagcguagag

SEQ ID NO: 91416 - RNA, 18 nt, Human
agaaugcaguugcaugga

SEQ ID NO: 91417 - RNA, 23 nt, Human
agaccaaagccagaaaaaugaaa

SEQ ID NO: 91418 - RNA, 20 nt, Human
agagaagcaagaagggggac

SEQ ID NO: 91419 - RNA, 23 nt, Human
agcagcggcggcggcggcggcgg

SEQ ID NO: 91420 - RNA, 18 nt, Human
agcauuucacugaggugg

SEQ ID NO: 91421 - RNA, 21 nt, Human
agcccaggcaguccgcggcaa

SEQ ID NO: 91422 - RNA, 23 nt, Human
agcggcggcggcggcggcggcgg

SEQ ID NO: 91423 - RNA, 18 nt, Human
agcugguaacaauaacca

SEQ ID NO: 91424 - RNA, 19 nt, Human
auacaauguguagcucuuc

SEQ ID NO: 91425 - RNA, 18 nt, Human
aucuuggcaaauccuacu

SEQ ID NO: 91426 - RNA, 19 nt, Human
augaagaaagggccaaucc

SEQ ID NO: 91427 - RNA, 23 nt, Human
auucacaguuguagcauuucacu

SEQ ID NO: 91428 - RNA, 21 nt, Human
auuuuguauguacaaaggcug

SEQ ID NO: 91429 - RNA, 22 nt, Human
caaacucaguaaaaacuggcug

SEQ ID NO: 91430 - RNA, 19 nt, Human
caagaaacagcaaauggau

SEQ ID NO: 91431 - RNA, 21 nt, Human
caaggcaaagugcauuccuuc

SEQ ID NO: 91432 - RNA, 18 nt, Human
caagugcuugugugugug

SEQ ID NO: 91433 - RNA, 23 nt, Human
cacacacuuccgagcgagugcac

SEQ ID NO: 91434 - RNA, 21 nt, Human
cacacucgcacucccacccga

SEQ ID NO: 91435 - RNA, 27 nt, Human
cacagugagugaccauuauaaacaaga

SEQ ID NO: 91436 - RNA, 22 nt, Human
cacaguuguagcauuucacuga

SEQ ID NO: 91437 - RNA, 19 nt, Human
caccugcuaccagcacccu

SEQ ID NO: 91438 - RNA, 29 nt, Human
cacggcacacacacauacacacucgcaca

SEQ ID NO: 91439 - RNA, 27 nt, Human
cacucccacccgacagccggccaggga

SEQ ID NO: 91440 - RNA, 21 nt, Human
cacucgcacacacuuccgagc

SEQ ID NO: 91441 - RNA, 19 nt, Human
cagcaaaaacgagaccccg

SEQ ID NO: 91442 - RNA, 24 nt, Human
cagcaaaaacgagaccccgauucg

SEQ ID NO: 91443 - RNA, 18 nt, Human
cagccaccugaagccacc

SEQ ID NO: 91444 - RNA, 25 nt, Human
cagccggccagggacagucaccccc

SEQ ID NO: 91445 - RNA, 23 nt, Human
caggcaguccgcggcaaguugcc

SEQ ID NO: 91446 - RNA, 22 nt, Human
caggggggcauggcaguuuuga

SEQ ID NO: 91447 - RNA, 21 nt, Human
cagugagugaccauuauaaac

SEQ ID NO: 91448 - RNA, 26 nt, Human
cccgacacggcacacacacauacaca

SEQ ID NO: 91449 - RNA, 24 nt, Human
cccucgaaguccgccccccucacc

SEQ ID NO: 91450 - RNA, 19 nt, Human
ccgccccccucaccggggc

SEQ ID NO: 91451 - RNA, 18 nt, Human
ccgccgggcugcgccgug

SEQ ID NO: 91452 - RNA, 21 nt, Human
ccggggcaguucuucuccucu

SEQ ID NO: 91453 - RNA, 19 nt, Human
ccucgaaguccgccccccu

SEQ ID NO: 91454 - RNA, 18 nt, Human
ccugcuaucucaggcuga

SEQ ID NO: 91455 - RNA, 22 nt, Human
cggcggcagcagccaccugaag

SEQ ID NO: 91456 - RNA, 22 nt, Human
cggcggcggcagcagccaccug

SEQ ID NO: 91457 - RNA, 27 nt, Human
cuagcagcggcggcggcggcggcggcg

SEQ ID NO: 91458 - RNA, 21 nt, Human
cucccacccgacagccggcca

SEQ ID NO: 91459 - RNA, 19 nt, Human
cugaagcucaccucaugug

SEQ ID NO: 91460 - RNA, 22 nt, Human
cuugggggaaagaaggagagag

SEQ ID NO: 91461 - RNA, 22 nt, Human
gaagaagaggagggagcguaga

SEQ ID NO: 91462 - RNA, 23 nt, Human
gaagaagaggagggagcguagag

SEQ ID NO: 91463 - RNA, 22 nt, Human
gaagacauagacgauagccccc

SEQ ID NO: 91464 - RNA, 21 nt, Human
gaaugcaguugcauggagccg

SEQ ID NO: 91465 - RNA, 21 nt, Human
gcaaauggaucauuucugauc

SEQ ID NO: 91466 - RNA, 25 nt, Human
gcacacacacauacacacucgcaca

SEQ ID NO: 91467 - RNA, 23 nt, Human
gcaguugcauggagccagggcuu

SEQ ID NO: 91468 - RNA, 18 nt, Human
gcgccccaagaagacaua

SEQ ID NO: 91469 - RNA, 24 nt, Human
gcggcggcggcggcggcggcagca

SEQ ID NO: 91470 - RNA, 24 nt, Human
gcggcggcggcggcggcggcggca

SEQ ID NO: 91471 - RNA, 22 nt, Human
ggcggcggcggcggcagcagcc

SEQ ID NO: 91472 - RNA, 22 nt, Human
guaaauuguugaguaaacagaa

SEQ ID NO: 91473 - RNA, 19 nt, Human
guaacuuguuaaacacauu

SEQ ID NO: 91474 - RNA, 18 nt, Human
guguguguguguguaggu

SEQ ID NO: 91475 - RNA, 19 nt, Human
uaaacagaagaaucauaau

SEQ ID NO: 91476 - RNA, 19 nt, Human
uagacgauagccccccgcc

SEQ ID NO: 91477 - RNA, 21 nt, Human
uagccccccgccgggcugcgc

SEQ ID NO: 91478 - RNA, 21 nt, Human
uauaaacaagaaaagaaaggc

SEQ ID NO: 91479 - RNA, 25 nt, Human
uaucugaaauuacuugaugcaaagg

SEQ ID NO: 91480 - RNA, 24 nt, Human
uaugaaugagacuuuuguuucuga

SEQ ID NO: 91481 - RNA, 24 nt, Human
uaugugcaagugcuugugugugug

SEQ ID NO: 91482 - RNA, 20 nt, Human
ucaaugucuguccuuuuuuu

SEQ ID NO: 91483 - RNA, 20 nt, Human
ucacucgacgggaaaacggg

SEQ ID NO: 91484 - RNA, 19 nt, Human
ucaguaaaaacuggcugca

SEQ ID NO: 91485 - RNA, 22 nt, Human
uccagcaaaaacgagaccccga

SEQ ID NO: 91486 - RNA, 19 nt, Human
ucccugggaagauccagga

SEQ ID NO: 91487 - RNA, 23 nt, Human
uccgcggcaaguugcccucgaag

SEQ ID NO: 91488 - RNA, 23 nt, Human
ucgcaccagcggcggaaaccgca

SEQ ID NO: 91489 - RNA, 24 nt, Human
ucucuucgcaccagcggcggaaac

SEQ ID NO: 91490 - RNA, 25 nt, Human
ucuuccagcaaaaacgagaccccga

SEQ ID NO: 91491 - RNA, 18 nt, Human
ucuuuguaaauuguugag

SEQ ID NO: 91492 - RNA, 19 nt, Human
ugaaaucagguuaacuggu

SEQ ID NO: 91493 - RNA, 25 nt, Human
ugaagaagaggagggagcguagagg

SEQ ID NO: 91494 - RNA, 24 nt, Human
ugaaggaacaagugaaaucaaaga

SEQ ID NO: 91495 - RNA, 24 nt, Human
ugaaugagacuuuuguuucugaaa

SEQ ID NO: 91496 - RNA, 24 nt, Human
ugaccauuauaaacaagaaaagaa

SEQ ID NO: 91497 - RNA, 20 nt, Human
ugagcugguaacaauaacca

SEQ ID NO: 91498 - RNA, 21 nt, Human
ugaguaaacagaagaaucaua

SEQ ID NO: 91499 - RNA, 23 nt, Human
ugcacacucgcacucccacccga

SEQ ID NO: 91500 - RNA, 21 nt, Human
ugcauguguuuguauguaugu

SEQ ID NO: 91501 - RNA, 18 nt, Human
uggaaaacaagaaacagc

SEQ ID NO: 91502 - RNA, 18 nt, Human
ugggauucuucuuggcuu

SEQ ID NO: 91503 - RNA, 19 nt, Human
ugggggaaagaaggagaga

SEQ ID NO: 91504 - RNA, 19 nt, Human
ugggguuauugaagaagag

SEQ ID NO: 91505 - RNA, 23 nt, Human
ugggguuauugaagaagaggagg

SEQ ID NO: 91506 - RNA, 22 nt, Human
uguaagagugugugugugugua

SEQ ID NO: 91507 - RNA, 18 nt, Human
uguccugcucaccugcua

SEQ ID NO: 91508 - RNA, 23 nt, Human
uguccugcucaccugcuaccagc

SEQ ID NO: 91509 - RNA, 21 nt, Human
uguguagcucuucaaugucug

SEQ ID NO: 91510 - RNA, 19 nt, Human
uguguagguauguuugcau

SEQ ID NO: 91511 - RNA, 23 nt, Human
uguguguguuugugaguaugugu

SEQ ID NO: 91512 - RNA, 24 nt, Human
uguuugcauguguuuguauguaug

SEQ ID NO: 91513 - RNA, 22 nt, Human
uucaugaagaaagggccaaucc

SEQ ID NO: 91514 - RNA, 22 nt, Human
uuccauuuccuuauagucugug

SEQ ID NO: 91515 - RNA, 21 nt, Human
uucgucuggcgccccaagaag

SEQ ID NO: 91516 - RNA, 21 nt, Human
uucuagguuacgucaauucac

SEQ ID NO: 91517 - RNA, 18 nt, Human
uugagcugguaacaauaa

SEQ ID NO: 91518 - RNA, 23 nt, Human
uugcuuagcaaaugcauuccuga

SEQ ID NO: 91519 - RNA, 18 nt, Human
uuggaagaauuuuguaug

SEQ ID NO: 91520 - RNA, 22 nt, Human
uuguaagagugugugugugugu

SEQ ID NO: 91521 - RNA, 19 nt, Human
uuguauguaugugcaagug

SEQ ID NO: 91522 - RNA, 21 nt, Human
aacgacgacacgaaccuacau

SEQ ID NO: 91523 - RNA, 21 nt, Human
aacgacgacacgaaccuacau

SEQ ID NO: 91524 - RNA, 18 nt, Human
acgacacgaaccuacaug

SEQ ID NO: 91525 - RNA, 18 nt, Human
acgacacgaaccuacaug

SEQ ID NO: 91526 - RNA, 19 nt, Human
agacagcagccacuagucc

SEQ ID NO: 91527 - RNA, 19 nt, Human
agacagcagccacuagucc

SEQ ID NO: 91528 - RNA, 24 nt, Human
cauugucacugaggcagacagcag

SEQ ID NO: 91529 - RNA, 24 nt, Human
cauugucacugaggcagacagcag

SEQ ID NO: 91530 - RNA, 21 nt, Human
ccaucugcagauauuccuugu

SEQ ID NO: 91531 - RNA, 21 nt, Human
cccgcagcugcggcuacagac

SEQ ID NO: 91532 - RNA, 26 nt, Human
cugggccaucugcagauauuccuugu

SEQ ID NO: 91533 - RNA, 18 nt, Human
ggccaucugcagauauuc

SEQ ID NO: 91534 - RNA, 20 nt, Human
uaauuuaggacccaagggug

SEQ ID NO: 91535 - RNA, 20 nt, Human
uaauuuaggacccaagggug

SEQ ID NO: 91536 - RNA, 22 nt, Human
uaauuuaggacccaagggugac

SEQ ID NO: 91537 - RNA, 22 nt, Human
uaauuuaggacccaagggugac

SEQ ID NO: 91538 - RNA, 18 nt, Human
uccugagccucgaagagc

SEQ ID NO: 91539 - RNA, 20 nt, Human
ucugggccaucugcagauau

SEQ ID NO: 91540 - RNA, 25 nt, Human
ugaggcagacagcagccacuagucc

SEQ ID NO: 91541 - RNA, 25 nt, Human
ugaggcagacagcagccacuagucc

SEQ ID NO: 91542 - RNA, 20 nt, Human
ugucucagagccaacgacga

SEQ ID NO: 91543 - RNA, 20 nt, Human
ugucucagagccaacgacga

SEQ ID NO: 91544 - RNA, 20 nt, Human
uuuuuuuuuuuuuuuuucac

SEQ ID NO: 91545 - RNA, 26 nt, Human
uuuuuuuuuuuuuuuuucacuguuga

SEQ ID NO: 91546 - RNA, 26 nt, Human
uuuuuuuuuuuuuuuuucacuguuga

SEQ ID NO: 91547 - RNA, 24 nt, Human
uuuuuuuuuuuuuuuuuuucacug

SEQ ID NO: 91548 - RNA, 26 nt, Human
acuacaacuagguagucucuagggac

SEQ ID NO: 91549 - RNA, 22 nt, Human
aggcuuuuccacaaaugaggug

SEQ ID NO: 91550 - RNA, 22 nt, Human
ccgauaacaaagaggcuuuucc

SEQ ID NO: 91551 - RNA, 19 nt, Human
guuuuaggggccuuggaaa

SEQ ID NO: 91552 - RNA, 22 nt, Human
uaaaaaagauacugucucuuua

SEQ ID NO: 91553 - RNA, 19 nt, Human
ucucuagggaccaugaccu

SEQ ID NO: 91554 - RNA, 24 nt, Human
ugacaauaauuauaaauguagguc

SEQ ID NO: 91555 - RNA, 24 nt, Human
ugacacaaggccgauaacaaagag

SEQ ID NO: 91556 - RNA, 22 nt, Human
uuaguguguaauuguuuuucuc

SEQ ID NO: 91557 - RNA, 19 nt, Human
agcagacauaauuccaaaa

SEQ ID NO: 91558 - RNA, 19 nt, Human
agcagacauaauuccaaaa

SEQ ID NO: 91559 - RNA, 20 nt, Human
cagcagacauaauuccaaaa

SEQ ID NO: 91560 - RNA, 28 nt, Human
uccaaaaaccuuuuacagaacgaucucu

SEQ ID NO: 91561 - RNA, 28 nt, Human
uccaaaaaccuuuuacagaacgaucucu

SEQ ID NO: 91562 - RNA, 21 nt, Human
uccugcccagcagacauucau

SEQ ID NO: 91563 - RNA, 25 nt, Human
uuccugcccacagacauucauacag

SEQ ID NO: 91564 - RNA, 24 nt, Human
uuuuuuuuuuuuuuuuucauuuuu

SEQ ID NO: 91565 - RNA, 25 nt, Human
uuuuuuuuuuuuuuuuuucauuuuu

SEQ ID NO: 91566 - RNA, 25 nt, Human
uuuuuuuuuuuuuuuuuucauuuuu

SEQ ID NO: 91567 - RNA, 24 nt, Human
aaaaaaaaaaaaaaaaagcucaag

SEQ ID NO: 91568 - RNA, 23 nt, Human
aaaaaaaaaaaaaaaagcucaag

SEQ ID NO: 91569 - RNA, 26 nt, Human
aaaacaaaguuuuaaagaaaguagaa

SEQ ID NO: 91570 - RNA, 18 nt, Human
aaaagaaaaagaaaauca

SEQ ID NO: 91571 - RNA, 18 nt, Human
aaaagaaaaagaaaauca

SEQ ID NO: 91572 - RNA, 19 nt, Human
aaacaagaaagaugacaca

SEQ ID NO: 91573 - RNA, 21 nt, Human
aaaccccaucuccacaaaaaa

SEQ ID NO: 91574 - RNA, 21 nt, Human
aaaccccaucuccacaaaaaa

SEQ ID NO: 91575 - RNA, 23 nt, Human
aaagcaucaaggcguccuuacag

SEQ ID NO: 91576 - RNA, 23 nt, Human
aaagcaucaaggcguccuuacag

SEQ ID NO: 91577 - RNA, 21 nt, Human
aaaguuuuaaagaaaguagaa

SEQ ID NO: 91578 - RNA, 21 nt, Human
aacacaugacucaggaucuca

SEQ ID NO: 91579 - RNA, 19 nt, Human
aacauagugaaaccccauc

SEQ ID NO: 91580 - RNA, 19 nt, Human
aacauagugaaaccccauc

SEQ ID NO: 91581 - RNA, 20 nt, Human
aacauagugaaaccccaucu

SEQ ID NO: 91582 - RNA, 20 nt, Human
aacauagugaaaccccaucu

SEQ ID NO: 91583 - RNA, 21 nt, Human
aacauagugaaaccccaucuc

SEQ ID NO: 91584 - RNA, 21 nt, Human
aacauagugaaaccccaucuc

SEQ ID NO: 91585 - RNA, 21 nt, Human
aacauagugaaaccccaucuc

SEQ ID NO: 91586 - RNA, 21 nt, Human
aacauagugaaaccccaucuc

SEQ ID NO: 91587 - RNA, 18 nt, Human
aagaaaguagaauccucu

SEQ ID NO: 91588 - RNA, 19 nt, Human
aagaaaguagaauccucug

SEQ ID NO: 91589 - RNA, 18 nt, Human
aagaagagcccagugauc

SEQ ID NO: 91590 - RNA, 24 nt, Human
aagcugaggugggaggaucgcuug

SEQ ID NO: 91591 - RNA, 24 nt, Human
aagcugaggugggaggaucgcuug

SEQ ID NO: 91592 - RNA, 20 nt, Human
aagggaacagaagagugcca

SEQ ID NO: 91593 - RNA, 23 nt, Human
aaguacguaaaaaugcucaaaau

SEQ ID NO: 91594 - RNA, 23 nt, Human
aaguacguaaaaaugcucaaaau

SEQ ID NO: 91595 - RNA, 24 nt, Human
aagugaucugccugccuuggcuuc

SEQ ID NO: 91596 - RNA, 24 nt, Human
aagugaucugccugccuuggcuuc

SEQ ID NO: 91597 - RNA, 26 nt, Human
aaugcccuuccacgccccaaggcauu

SEQ ID NO: 91598 - RNA, 23 nt, Human
acacagccucucuccucaugccu

SEQ ID NO: 91599 - RNA, 23 nt, Human
acacagccucucuccucaugccu

SEQ ID NO: 91600 - RNA, 21 nt, Human
acagaacacgaagcagucccc

SEQ ID NO: 91601 - RNA, 19 nt, Human
acagaaugagacuaucucc

SEQ ID NO: 91602 - RNA, 22 nt, Human
acagagaaaaaguuccucuaga

SEQ ID NO: 91603 - RNA, 22 nt, Human
acagagaaaaaguuccucuaga

SEQ ID NO: 91604 - RNA, 27 nt, Human
acugcagucuacugcaucuugcgugca

SEQ ID NO: 91605 - RNA, 23 nt, Human
acuugcugguuguuuaagugaaa

SEQ ID NO: 91606 - RNA, 25 nt, Human
agaaaaaguuccucuagaaauugaa

SEQ ID NO: 91607 - RNA, 25 nt, Human
agaaaaaguuccucuagaaauugaa

SEQ ID NO: 91608 - RNA, 19 nt, Human
agaacacgaagcagucccc

SEQ ID NO: 91609 - RNA, 24 nt, Human
agaacuuugagaagcugagguggg

SEQ ID NO: 91610 - RNA, 24 nt, Human
agaacuuugagaagcugagguggg

SEQ ID NO: 91611 - RNA, 24 nt, Human
agagauucuccugucucagccucc

SEQ ID NO: 91612 - RNA, 24 nt, Human
agagccacucccuucaggcaagcc

SEQ ID NO: 91613 - RNA, 24 nt, Human
agagccacucccuucaggcaagcc

SEQ ID NO: 91614 - RNA, 24 nt, Human
agaguacugggauuacaggcauga

SEQ ID NO: 91615 - RNA, 24 nt, Human
agaguacugggauuacaggcauga

SEQ ID NO: 91616 - RNA, 22 nt, Human
agauucuccugucucagccucc

SEQ ID NO: 91617 - RNA, 19 nt, Human
agcaguaacaaggugggga

SEQ ID NO: 91618 - RNA, 19 nt, Human
agcaguaacaaggugggga

SEQ ID NO: 91619 - RNA, 19 nt, Human
agcccagugauccugagaa

SEQ ID NO: 91620 - RNA, 23 nt, Human
agccugggacaguggccagacca

SEQ ID NO: 91621 - RNA, 24 nt, Human
agcuacuugggaggcugagguggg

SEQ ID NO: 91622 - RNA, 24 nt, Human
agcuacuugggaggcugagguggg

SEQ ID NO: 91623 - RNA, 22 nt, Human
agcuuaggcaacauagugaaac

SEQ ID NO: 91624 - RNA, 22 nt, Human
agcuuaggcaacauagugaaac

SEQ ID NO: 91625 - RNA, 21 nt, Human
aggaagucagccucggcagga

SEQ ID NO: 91626 - RNA, 24 nt, Human
aggaucgcuugagcccaggaguuu

SEQ ID NO: 91627 - RNA, 24 nt, Human
aggaucgcuugagcccaggaguuu

SEQ ID NO: 91628 - RNA, 24 nt, Human
aggcacaguauuucaugccuguag

SEQ ID NO: 91629 - RNA, 24 nt, Human
aggcacaguauuucaugccuguag

SEQ ID NO: 91630 - RNA, 19 nt, Human
aggcagaaggaagccucug

SEQ ID NO: 91631 - RNA, 24 nt, Human
aggcugaggugggaggacagcuug

SEQ ID NO: 91632 - RNA, 24 nt, Human
aggcugaggugggaggacagcuug

SEQ ID NO: 91633 - RNA, 23 nt, Human
agggaagugggugccugcucagg

SEQ ID NO: 91634 - RNA, 23 nt, Human
aggugggaggaucgcuugagccc

SEQ ID NO: 91635 - RNA, 23 nt, Human
aggugggaggaucgcuugagccc

SEQ ID NO: 91636 - RNA, 23 nt, Human
agguuuccgucuugcuguagggc

SEQ ID NO: 91637 - RNA, 20 nt, Human
aguacugggauuacaggcau

SEQ ID NO: 91638 - RNA, 20 nt, Human
aguacugggauuacaggcau

SEQ ID NO: 91639 - RNA, 22 nt, Human
aguacugggauuacaggcauga

SEQ ID NO: 91640 - RNA, 19 nt, Human
aguagcaguaacaaggugg

SEQ ID NO: 91641 - RNA, 19 nt, Human
aguagcaguaacaaggugg

SEQ ID NO: 91642 - RNA, 18 nt, Human
aguagcugggauuacagg

SEQ ID NO: 91643 - RNA, 18 nt, Human
aguagcugggauuacagg

SEQ ID NO: 91644 - RNA, 24 nt, Human
aguauuucaugccuguagucccag

SEQ ID NO: 91645 - RNA, 24 nt, Human
agugcaguugugucaucuuggcuc

SEQ ID NO: 91646 - RNA, 24 nt, Human
agugcaguugugucaucuuggcuc

SEQ ID NO: 91647 - RNA, 22 nt, Human
aguguuauccacuccuggguuu

SEQ ID NO: 91648 - RNA, 22 nt, Human
aguguuauccacuccuggguuu

SEQ ID NO: 91649 - RNA, 18 nt, Human
auaccagcugccuuccuc

SEQ ID NO: 91650 - RNA, 20 nt, Human
aucgcuugagcccaggaguu

SEQ ID NO: 91651 - RNA, 24 nt, Human
aucgcuugagcccaggaguuugag

SEQ ID NO: 91652 - RNA, 24 nt, Human
augagguuuugccguauuggccag

SEQ ID NO: 91653 - RNA, 24 nt, Human
augagguuuugccguauuggccag

SEQ ID NO: 91654 - RNA, 19 nt, Human
augccuguagucccagaac

SEQ ID NO: 91655 - RNA, 19 nt, Human
augccuguagucccagaac

SEQ ID NO: 91656 - RNA, 24 nt, Human
auggacacacaccuguagucucag

SEQ ID NO: 91657 - RNA, 24 nt, Human
auggacacacaccuguagucucag

SEQ ID NO: 91658 - RNA, 23 nt, Human
auggcaacugaaauguuccaacc

SEQ ID NO: 91659 - RNA, 27 nt, Human
auugaaaaaaaaaaaaaaaaaagcuug

SEQ ID NO: 91660 - RNA, 27 nt, Human
auugaaaaaaaaaaaaaaaaaagcuug

SEQ ID NO: 91661 - RNA, 19 nt, Human
auugcacuucugcuucugc

SEQ ID NO: 91662 - RNA, 24 nt, Human
auugccccccugcacuccagucug

SEQ ID NO: 91663 - RNA, 24 nt, Human
auugccccccugcacuccagucug

SEQ ID NO: 91664 - RNA, 24 nt, Human
auuguguauaugcacugugaaccc

SEQ ID NO: 91665 - RNA, 24 nt, Human
auuucuaaauaaagaaaaugggaa

SEQ ID NO: 91666 - RNA, 22 nt, Human
caaaagaaaaagaaaaucagaa

SEQ ID NO: 91667 - RNA, 22 nt, Human
caaaagaaaaagaaaaucagaa

SEQ ID NO: 91668 - RNA, 20 nt, Human
caagaaagaugacacaggua

SEQ ID NO: 91669 - RNA, 19 nt, Human
caagaagagcccagugauc

SEQ ID NO: 91670 - RNA, 22 nt, Human
caagagauucuccugucucagc

SEQ ID NO: 91671 - RNA, 22 nt, Human
caagagauucuccugucucagc

SEQ ID NO: 91672 - RNA, 22 nt, Human
caagccagacauccccucugcc

SEQ ID NO: 91673 - RNA, 22 nt, Human
caagccagacauccccucugcc

SEQ ID NO: 91674 - RNA, 24 nt, Human
caagccagacauccccucugccaa

SEQ ID NO: 91675 - RNA, 24 nt, Human
caagccagacauccccucugccaa

SEQ ID NO: 91676 - RNA, 22 nt, Human
caagugaucugccugccuuggc

SEQ ID NO: 91677 - RNA, 22 nt, Human
caagugaucugccugccuuggc

SEQ ID NO: 91678 - RNA, 24 nt, Human
cacaccuguagucucagcuacuug

SEQ ID NO: 91679 - RNA, 24 nt, Human
cacaccuguagucucagcuacuug

SEQ ID NO: 91680 - RNA, 22 nt, Human
cacaguauuucaugccuguagu

SEQ ID NO: 91681 - RNA, 22 nt, Human
cacaguauuucaugccuguagu

SEQ ID NO: 91682 - RNA, 21 nt, Human
cacauccccaggccucagcug

SEQ ID NO: 91683 - RNA, 21 nt, Human
cacauccccaggccucagcug

SEQ ID NO: 91684 - RNA, 21 nt, Human
caccacagccucugccuccug

SEQ ID NO: 91685 - RNA, 21 nt, Human
caccacagccucugccuccug

SEQ ID NO: 91686 - RNA, 18 nt, Human
caccgcacccaguccaaa

SEQ ID NO: 91687 - RNA, 18 nt, Human
caccgcacccaguccaaa

SEQ ID NO: 91688 - RNA, 23 nt, Human
caccgcacccaguccaaaaugga

SEQ ID NO: 91689 - RNA, 23 nt, Human
caccgcacccaguccaaaaugga

SEQ ID NO: 91690 - RNA, 20 nt, Human
caccuguagucucagcuacu

SEQ ID NO: 91691 - RNA, 23 nt, Human
caccuguagucucagcuacuugg

SEQ ID NO: 91692 - RNA, 24 nt, Human
caccuguagucucagcuacuuggg

SEQ ID NO: 91693 - RNA, 24 nt, Human
caccuguagucucagcuacuuggg

SEQ ID NO: 91694 - RNA, 18 nt, Human
cacgugaaacaguaaggg

SEQ ID NO: 91695 - RNA, 18 nt, Human
cacuccagucugggugac

SEQ ID NO: 91696 - RNA, 18 nt, Human
cacuccagucugggugac

SEQ ID NO: 91697 - RNA, 22 nt, Human
cacuccagucugggugacagaa

SEQ ID NO: 91698 - RNA, 22 nt, Human
cacuccagucugggugacagaa

SEQ ID NO: 91699 - RNA, 24 nt, Human
cacuccagucugggugacagaaug

SEQ ID NO: 91700 - RNA, 24 nt, Human
cacuccagucugggugacagaaug

SEQ ID NO: 91701 - RNA, 23 nt, Human
cacugcagucuacugcaucugcc

SEQ ID NO: 91702 - RNA, 23 nt, Human
cacugcagucuacugcaucugcc

SEQ ID NO: 91703 - RNA, 28 nt, Human
cacugcagucuacugcaucuugcgugca

SEQ ID NO: 91704 - RNA, 24 nt, Human
cacuggaacacaugacucaggauc

SEQ ID NO: 91705 - RNA, 24 nt, Human
cagaacuuugagaagcugaggugg

SEQ ID NO: 91706 - RNA, 24 nt, Human
cagaacuuugagaagcugaggugg

SEQ ID NO: 91707 - RNA, 20 nt, Human
cagaauuauaacuaaggggu

SEQ ID NO: 91708 - RNA, 20 nt, Human
cagaauuauaacuaaggggu

SEQ ID NO: 91709 - RNA, 24 nt, Human
cagaguacugggauuacaggcaug

SEQ ID NO: 91710 - RNA, 24 nt, Human
cagaguacugggauuacaggcaug

SEQ ID NO: 91711 - RNA, 20 nt, Human
cagccucugccuccuggauu

SEQ ID NO: 91712 - RNA, 21 nt, Human
cagcuacuugggaggcugagg

SEQ ID NO: 91713 - RNA, 24 nt, Human
cagcuacuugggaggcugaggugg

SEQ ID NO: 91714 - RNA, 24 nt, Human
cagcuacuugggaggcugaggugg

SEQ ID NO: 91715 - RNA, 19 nt, Human
cagcugaguguaaaugagc

SEQ ID NO: 91716 - RNA, 18 nt, Human
caggcgauguggcuggaa

SEQ ID NO: 91717 - RNA, 20 nt, Human
cauuccaguucaccuggcug

SEQ ID NO: 91718 - RNA, 20 nt, Human
cauuccaguucaccuggcug

SEQ ID NO: 91719 - RNA, 27 nt, Human
ccaacaaaaacucucugcuauauugaa

SEQ ID NO: 91720 - RNA, 21 nt, Human
ccacaccuggcuaauuuuugu

SEQ ID NO: 91721 - RNA, 21 nt, Human
ccacaccuggcuaauuuuugu

SEQ ID NO: 91722 - RNA, 23 nt, Human
ccacagccucugccuccuggauu

SEQ ID NO: 91723 - RNA, 22 nt, Human
ccaccaaucuucuggaaguaaa

SEQ ID NO: 91724 - RNA, 22 nt, Human
ccacguucagaagucucaacuu

SEQ ID NO: 91725 - RNA, 21 nt, Human
ccagaggagcaaaguguagua

SEQ ID NO: 91726 - RNA, 24 nt, Human
ccagaguacugggauuacaggcau

SEQ ID NO: 91727 - RNA, 24 nt, Human
ccagaguacugggauuacaggcau

SEQ ID NO: 91728 - RNA, 24 nt, Human
ccaggccaggcacaguauuucaug

SEQ ID NO: 91729 - RNA, 24 nt, Human
ccaggccaggcacaguauuucaug

SEQ ID NO: 91730 - RNA, 24 nt, Human
ccaggccucagcugccucaucuau

SEQ ID NO: 91731 - RNA, 24 nt, Human
ccaggccucagcugccucaucuau

SEQ ID NO: 91732 - RNA, 20 nt, Human
cccaagccacuggaacacau

SEQ ID NO: 91733 - RNA, 18 nt, Human
cccagaacuuugagaagc

SEQ ID NO: 91734 - RNA, 18 nt, Human
cccagaacuuugagaagc

SEQ ID NO: 91735 - RNA, 24 nt, Human
cccagaguacugggauuacaggca

SEQ ID NO: 91736 - RNA, 24 nt, Human
cccagaguacugggauuacaggca

SEQ ID NO: 91737 - RNA, 19 nt, Human
ccccaaggcauuccaguuc

SEQ ID NO: 91738 - RNA, 19 nt, Human
ccccaaggcauuccaguuc

SEQ ID NO: 91739 - RNA, 19 nt, Human
ccccaggccucagcugccu

SEQ ID NO: 91740 - RNA, 21 nt, Human
ccccugcacuccagucugggu

SEQ ID NO: 91741 - RNA, 21 nt, Human
ccccugcacuccagucugggu

SEQ ID NO: 91742 - RNA, 23 nt, Human
ccccugcacuccagucuggguga

SEQ ID NO: 91743 - RNA, 23 nt, Human
ccccugcacuccagucuggguga

SEQ ID NO: 91744 - RNA, 24 nt, Human
ccccugcacuccagucugggugac

SEQ ID NO: 91745 - RNA, 23 nt, Human
cccgaguagcugggauuacaggu

SEQ ID NO: 91746 - RNA, 23 nt, Human
cccgaguagcugggauuacaggu

SEQ ID NO: 91747 - RNA, 24 nt, Human
cccgaguagcugggauuacaggug

SEQ ID NO: 91748 - RNA, 24 nt, Human
cccgaguagcugggauuacaggug

SEQ ID NO: 91749 - RNA, 19 nt, Human
cccugcacuccagucuggg

SEQ ID NO: 91750 - RNA, 19 nt, Human
cccugcacuccagucuggg

SEQ ID NO: 91751 - RNA, 19 nt, Human
cccugcacuccagucuggg

SEQ ID NO: 91752 - RNA, 19 nt, Human
cccugcacuccagucuggg

SEQ ID NO: 91753 - RNA, 19 nt, Human
cccugcacuccagucuggg

SEQ ID NO: 91754 - RNA, 20 nt, Human
cccugcacuccagucugggu

SEQ ID NO: 91755 - RNA, 20 nt, Human
cccugcacuccagucugggu

SEQ ID NO: 91756 - RNA, 23 nt, Human
cccugcacuccagucugggugac

SEQ ID NO: 91757 - RNA, 23 nt, Human
cccugcacuccagucugggugac

SEQ ID NO: 91758 - RNA, 21 nt, Human
ccgaguagcugggauuacagg

SEQ ID NO: 91759 - RNA, 21 nt, Human
ccgaguagcugggauuacagg

SEQ ID NO: 91760 - RNA, 19 nt, Human
ccguauuggccaggcuggu

SEQ ID NO: 91761 - RNA, 19 nt, Human
ccguauuggccaggcuggu

SEQ ID NO: 91762 - RNA, 22 nt, Human
ccguauuggccaggcuggucuc

SEQ ID NO: 91763 - RNA, 23 nt, Human
ccguauuggccaggcuggucucg

SEQ ID NO: 91764 - RNA, 23 nt, Human
ccguauuggccaggcuggucucg

SEQ ID NO: 91765 - RNA, 24 nt, Human
ccuccuggauucaagagauucucc

SEQ ID NO: 91766 - RNA, 24 nt, Human
ccuccuggauucaagagauucucc

SEQ ID NO: 91767 - RNA, 19 nt, Human
ccucugccaagaagagccc

SEQ ID NO: 91768 - RNA, 19 nt, Human
ccucugccaagaagagccc

SEQ ID NO: 91769 - RNA, 21 nt, Human
ccugaccucaagugaucugcc

SEQ ID NO: 91770 - RNA, 21 nt, Human
ccugaccucaagugaucugcc

SEQ ID NO: 91771 - RNA, 23 nt, Human
ccugaccucaagugaucugccug

SEQ ID NO: 91772 - RNA, 23 nt, Human
ccugaccucaagugaucugccug

SEQ ID NO: 91773 - RNA, 24 nt, Human
ccugcacuccagucugggugacag

SEQ ID NO: 91774 - RNA, 24 nt, Human
ccugcacuccagucugggugacag

SEQ ID NO: 91775 - RNA, 21 nt, Human
ccuguagucucagcuacuugg

SEQ ID NO: 91776 - RNA, 21 nt, Human
ccuguagucucagcuacuugg

SEQ ID NO: 91777 - RNA, 24 nt, Human
cgcccuguugcccaagcuggagug

SEQ ID NO: 91778 - RNA, 24 nt, Human
cgcccuguugcccaagcuggagug

SEQ ID NO: 91779 - RNA, 25 nt, Human
cgcccuguugcccaagcuggagugc

SEQ ID NO: 91780 - RNA, 25 nt, Human
cgcccuguugcccaagcuggagugc

SEQ ID NO: 91781 - RNA, 18 nt, Human
cgugauugccccccugca

SEQ ID NO: 91782 - RNA, 24 nt, Human
cuauauugaaagugcauccagggg

SEQ ID NO: 91783 - RNA, 18 nt, Human
cucaagugaucugccugc

SEQ ID NO: 91784 - RNA, 20 nt, Human
cucaagugaucugccugccu

SEQ ID NO: 91785 - RNA, 23 nt, Human
cucaagugaucugccugccuugg

SEQ ID NO: 91786 - RNA, 24 nt, Human
cucaccacagccucugccuccugg

SEQ ID NO: 91787 - RNA, 24 nt, Human
cucaccacagccucugccuccugg

SEQ ID NO: 91788 - RNA, 24 nt, Human
cucagccucccgaguagcugggau

SEQ ID NO: 91789 - RNA, 24 nt, Human
cucagccucccgaguagcugggau

SEQ ID NO: 91790 - RNA, 21 nt, Human
cucagggaaauugccugaaaa

SEQ ID NO: 91791 - RNA, 26 nt, Human
cuccugaccucaagugaucugccugc

SEQ ID NO: 91792 - RNA, 26 nt, Human
cuccugaccucaagugaucugccugc

SEQ ID NO: 91793 - RNA, 24 nt, Human
cucgcccuguugcccaagcuggag

SEQ ID NO: 91794 - RNA, 24 nt, Human
cucgcccuguugcccaagcuggag

SEQ ID NO: 91795 - RNA, 21 nt, Human
cugcacuccagucugggugac

SEQ ID NO: 91796 - RNA, 21 nt, Human
cugcacuccagucugggugac

SEQ ID NO: 91797 - RNA, 23 nt, Human
cugcacuccagucugggugacag

SEQ ID NO: 91798 - RNA, 23 nt, Human
cugcacuccagucugggugacag

SEQ ID NO: 91799 - RNA, 23 nt, Human
cugcagggcugugaagugagaca

SEQ ID NO: 91800 - RNA, 24 nt, Human
cuggaaggcaggcagaaggaagcc

SEQ ID NO: 91801 - RNA, 23 nt, Human
cugucucagccucccgaguagcu

SEQ ID NO: 91802 - RNA, 23 nt, Human
cugucucagccucccgaguagcu

SEQ ID NO: 91803 - RNA, 25 nt, Human
cuuaggaagggggagaucagagaga

SEQ ID NO: 91804 - RNA, 25 nt, Human
cuuaggaagggggagaucagagaga

SEQ ID NO: 91805 - RNA, 21 nt, Human
gaaaccccaucuccacaaaaa

SEQ ID NO: 91806 - RNA, 21 nt, Human
gaaaccccaucuccacaaaaa

SEQ ID NO: 91807 - RNA, 22 nt, Human
gaaugagggccucauccgaaga

SEQ ID NO: 91808 - RNA, 22 nt, Human
gacagaaugagacuaucuccaa

SEQ ID NO: 91809 - RNA, 23 nt, Human
gaccucaagugaucugccugccu

SEQ ID NO: 91810 - RNA, 23 nt, Human
gaccucaagugaucugccugccu

SEQ ID NO: 91811 - RNA, 22 nt, Human
gacuugcaaaagaaaaagaaaa

SEQ ID NO: 91812 - RNA, 23 nt, Human
gagaccagcuuaggcaacauagu

SEQ ID NO: 91813 - RNA, 22 nt, Human
gagcagcugaguguaaaugagc

SEQ ID NO: 91814 - RNA, 18 nt, Human
gagcauucacauaucaaa

SEQ ID NO: 91815 - RNA, 18 nt, Human
gagcauucacauaucaaa

SEQ ID NO: 91816 - RNA, 21 nt, Human
gaggacagcuugagccuggga

SEQ ID NO: 91817 - RNA, 21 nt, Human
gaggacagcuugagccuggga

SEQ ID NO: 91818 - RNA, 21 nt, Human
gaggcugaggugggaggacag

SEQ ID NO: 91819 - RNA, 21 nt, Human
gaggcugaggugggaggacag

SEQ ID NO: 91820 - RNA, 21 nt, Human
gaggugggaggaucgcuugag

SEQ ID NO: 91821 - RNA, 18 nt, Human
gagguuuugccguauugg

SEQ ID NO: 91822 - RNA, 18 nt, Human
gagguuuugccguauugg

SEQ ID NO: 91823 - RNA, 22 nt, Human
gagguuuugccguauuggccag

SEQ ID NO: 91824 - RNA, 22 nt, Human
gagguuuugccguauuggccag

SEQ ID NO: 91825 - RNA, 23 nt, Human
gaucaagcuccaccaaucuucug

SEQ ID NO: 91826 - RNA, 24 nt, Human
gaucgcuugagcccaggaguuuga

SEQ ID NO: 91827 - RNA, 24 nt, Human
gaucgcuugagcccaggaguuuga

SEQ ID NO: 91828 - RNA, 18 nt, Human
gauuacaggcaugaguca

SEQ ID NO: 91829 - RNA, 18 nt, Human
gauuacaggcaugaguca

SEQ ID NO: 91830 - RNA, 22 nt, Human
gauuacaggcaugagucaccgc

SEQ ID NO: 91831 - RNA, 22 nt, Human
gauuacaggcaugagucaccgc

SEQ ID NO: 91832 - RNA, 23 nt, Human
gauuacaggcaugagucaccgca

SEQ ID NO: 91833 - RNA, 23 nt, Human
gauuacaggcaugagucaccgca

SEQ ID NO: 91834 - RNA, 23 nt, Human
gcaguccccgucggcaugggcug

SEQ ID NO: 91835 - RNA, 18 nt, Human
gcccagugauccugagaa

SEQ ID NO: 91836 - RNA, 22 nt, Human
gccccaaggcauuccaguucac

SEQ ID NO: 91837 - RNA, 22 nt, Human
gccccaaggcauuccaguucac

SEQ ID NO: 91838 - RNA, 22 nt, Human
gcccuguugcccaagcuggagu

SEQ ID NO: 91839 - RNA, 22 nt, Human
gcccuguugcccaagcuggagu

SEQ ID NO: 91840 - RNA, 25 nt, Human
gcccuguugcccaagcuggagugca

SEQ ID NO: 91841 - RNA, 25 nt, Human
gcccuguugcccaagcuggagugca

SEQ ID NO: 91842 - RNA, 22 nt, Human
gcccuuccacgccccaaggcau

SEQ ID NO: 91843 - RNA, 20 nt, Human
gccucaucuauaaaugaagg

SEQ ID NO: 91844 - RNA, 20 nt, Human
gccucaucuauaaaugaagg

SEQ ID NO: 91845 - RNA, 20 nt, Human
gccugaagccaguguuaucc

SEQ ID NO: 91846 - RNA, 20 nt, Human
gccugaagccaguguuaucc

SEQ ID NO: 91847 - RNA, 24 nt, Human
gccugggaggucgagacuacagug

SEQ ID NO: 91848 - RNA, 24 nt, Human
gccugggaggucgagacuacagug

SEQ ID NO: 91849 - RNA, 24 nt, Human
gccuuggcuucccagaguacuggg

SEQ ID NO: 91850 - RNA, 24 nt, Human
gccuuggcuucccagaguacuggg

SEQ ID NO: 91851 - RNA, 21 nt, Human
gcucaccacagccucugccuc

SEQ ID NO: 91852 - RNA, 21 nt, Human
gcucaccacagccucugccuc

SEQ ID NO: 91853 - RNA, 23 nt, Human
gcuggucucgaacuccugaccuc

SEQ ID NO: 91854 - RNA, 23 nt, Human
gcuggucucgaacuccugaccuc

SEQ ID NO: 91855 - RNA, 18 nt, Human
ggacaguggccagaccaa

SEQ ID NO: 91856 - RNA, 23 nt, Human
ggauaagaugucuucaugucuug

SEQ ID NO: 91857 - RNA, 25 nt, Human
ggauaagaugucuucaugucuuggg

SEQ ID NO: 91858 - RNA, 22 nt, Human
ggaucgcuugagcccaggaguu

SEQ ID NO: 91859 - RNA, 22 nt, Human
ggaucgcuugagcccaggaguu

SEQ ID NO: 91860 - RNA, 22 nt, Human
ggauuacaggcaugagucaccg

SEQ ID NO: 91861 - RNA, 22 nt, Human
ggauuacaggcaugagucaccg

SEQ ID NO: 91862 - RNA, 25 nt, Human
ggcaggaggcuggagguuagggacc

SEQ ID NO: 91863 - RNA, 25 nt, Human
ggcaggaggcuggagguuagggacc

SEQ ID NO: 91864 - RNA, 24 nt, Human
ggcuggucucgaacuccugaccuc

SEQ ID NO: 91865 - RNA, 24 nt, Human
ggcuggucucgaacuccugaccuc

SEQ ID NO: 91866 - RNA, 23 nt, Human
gggacaguggccagaccaaguag

SEQ ID NO: 91867 - RNA, 19 nt, Human
gggagguuuccgucuugcu

SEQ ID NO: 91868 - RNA, 19 nt, Human
ggucucgaacuccugaccu

SEQ ID NO: 91869 - RNA, 19 nt, Human
ggucucgaacuccugaccu

SEQ ID NO: 91870 - RNA, 18 nt, Human
guagcugggauuacaggu

SEQ ID NO: 91871 - RNA, 18 nt, Human
guagcugggauuacaggu

SEQ ID NO: 91872 - RNA, 22 nt, Human
guauuucaugccuguaguccca

SEQ ID NO: 91873 - RNA, 22 nt, Human
guauuucaugccuguaguccca

SEQ ID NO: 91874 - RNA, 22 nt, Human
gugaaacaguaagggaacagaa

SEQ ID NO: 91875 - RNA, 23 nt, Human
guguaguagcaguaacaaggugg

SEQ ID NO: 91876 - RNA, 23 nt, Human
guguaguagcaguaacaaggugg

SEQ ID NO: 91877 - RNA, 22 nt, Human
gugucaucuuggcucaccacag

SEQ ID NO: 91878 - RNA, 22 nt, Human
gugucaucuuggcucaccacag

SEQ ID NO: 91879 - RNA, 22 nt, Human
guuaaccacaggacuuuggauc

SEQ ID NO: 91880 - RNA, 22 nt, Human
guuaaccacaggacuuuggauc

SEQ ID NO: 91881 - RNA, 21 nt, Human
guucacauccccaggccucag

SEQ ID NO: 91882 - RNA, 22 nt, Human
guuccaaccccaauauugaauu

SEQ ID NO: 91883 - RNA, 19 nt, Human
uaaaaugcaccuggucccc

SEQ ID NO: 91884 - RNA, 19 nt, Human
uaaaaugcaccuggucccc

SEQ ID NO: 91885 - RNA, 22 nt, Human
uaacagagaaaaaguuccucua

SEQ ID NO: 91886 - RNA, 22 nt, Human
uaacagagaaaaaguuccucua

SEQ ID NO: 91887 - RNA, 21 nt, Human
uaagaugucuucaugucuugg

SEQ ID NO: 91888 - RNA, 18 nt, Human
uaauuuuuguguuuuuag

SEQ ID NO: 91889 - RNA, 18 nt, Human
uaauuuuuguguuuuuag

SEQ ID NO: 91890 - RNA, 24 nt, Human
uaauuuuuguguuuuuaguaauga

SEQ ID NO: 91891 - RNA, 24 nt, Human
uaauuuuuguguuuuuaguaauga

SEQ ID NO: 91892 - RNA, 24 nt, Human
uacaggcaugagucaccgcaccca

SEQ ID NO: 91893 - RNA, 24 nt, Human
uacaggcaugagucaccgcaccca

SEQ ID NO: 91894 - RNA, 19 nt, Human
uacagugagccgugauugc

SEQ ID NO: 91895 - RNA, 19 nt, Human
uacagugagccgugauugc

SEQ ID NO: 91896 - RNA, 24 nt, Human
uacugggauuacaggcaugaguca

SEQ ID NO: 91897 - RNA, 24 nt, Human
uacugggauuacaggcaugaguca

SEQ ID NO: 91898 - RNA, 22 nt, Human
uagaaauugaaaaaaaaaaaaa

SEQ ID NO: 91899 - RNA, 22 nt, Human
uagaaauugaaaaaaaaaaaaa

SEQ ID NO: 91900 - RNA, 20 nt, Human
uagaauccucugugugcucc

SEQ ID NO: 91901 - RNA, 21 nt, Human
uagacuugcaaaagaaaaaga

SEQ ID NO: 91902 - RNA, 24 nt, Human
uagcaguaacaagguggggacugu

SEQ ID NO: 91903 - RNA, 24 nt, Human
uagcaguaacaagguggggacugu

SEQ ID NO: 91904 - RNA, 20 nt, Human
uaggcaacauagugaaaccc

SEQ ID NO: 91905 - RNA, 20 nt, Human
uaggcaacauagugaaaccc

SEQ ID NO: 91906 - RNA, 19 nt, Human
uaguaaugaugagguuuug

SEQ ID NO: 91907 - RNA, 19 nt, Human
uaguaaugaugagguuuug

SEQ ID NO: 91908 - RNA, 20 nt, Human
uagugugaaagcaggcuggg

SEQ ID NO: 91909 - RNA, 21 nt, Human
uaucaaaugaaacacuccuaa

SEQ ID NO: 91910 - RNA, 21 nt, Human
uaucaaaugaaacacuccuaa

SEQ ID NO: 91911 - RNA, 23 nt, Human
ucaccacagccucugccuccugg

SEQ ID NO: 91912 - RNA, 23 nt, Human
ucaccacagccucugccuccugg

SEQ ID NO: 91913 - RNA, 20 nt, Human
ucagccucccgaguagcugg

SEQ ID NO: 91914 - RNA, 20 nt, Human
ucagccucccgaguagcugg

SEQ ID NO: 91915 - RNA, 18 nt, Human
ucaugccuguagucccag

SEQ ID NO: 91916 - RNA, 25 nt, Human
uccacaaaaaaaauaaaaaguuagc

SEQ ID NO: 91917 - RNA, 25 nt, Human
uccacaaaaaaaauaaaaaguuagc

SEQ ID NO: 91918 - RNA, 20 nt, Human
uccaggaauuaacagagaaa

SEQ ID NO: 91919 - RNA, 24 nt, Human
uccagucugggugacagaaugaga

SEQ ID NO: 91920 - RNA, 24 nt, Human
uccagucugggugacagaaugaga

SEQ ID NO: 91921 - RNA, 24 nt, Human
ucccagaguacugggauuacaggc

SEQ ID NO: 91922 - RNA, 24 nt, Human
ucccagaguacugggauuacaggc

SEQ ID NO: 91923 - RNA, 24 nt, Human
uccccaggccaggcacaguauuuc

SEQ ID NO: 91924 - RNA, 24 nt, Human
uccccaggccaggcacaguauuuc

SEQ ID NO: 91925 - RNA, 21 nt, Human
uccccaggccucagcugccuc

SEQ ID NO: 91926 - RNA, 18 nt, Human
uccccauggaccauuugu

SEQ ID NO: 91927 - RNA, 23 nt, Human
ucccgaguagcugggauuacagg

SEQ ID NO: 91928 - RNA, 23 nt, Human
ucccgaguagcugggauuacagg

SEQ ID NO: 91929 - RNA, 24 nt, Human
ucccgaguagcugggauuacaggu

SEQ ID NO: 91930 - RNA, 24 nt, Human
ucccgaguagcugggauuacaggu

SEQ ID NO: 91931 - RNA, 21 nt, Human
uccuggauucaagagauucuc

SEQ ID NO: 91932 - RNA, 21 nt, Human
uccuggauucaagagauucuc

SEQ ID NO: 91933 - RNA, 24 nt, Human
uccuggauucaagagauucuccug

SEQ ID NO: 91934 - RNA, 24 nt, Human
uccuggauucaagagauucuccug

SEQ ID NO: 91935 - RNA, 22 nt, Human
uccuuagugugaaagcaggcug

SEQ ID NO: 91936 - RNA, 24 nt, Human
uccuuagugugaaagcaggcuggg

SEQ ID NO: 91937 - RNA, 19 nt, Human
ucgcuugagcccaggaguu

SEQ ID NO: 91938 - RNA, 21 nt, Human
ucgcuugagcccaggaguuug

SEQ ID NO: 91939 - RNA, 21 nt, Human
ucgcuugagcccaggaguuug

SEQ ID NO: 91940 - RNA, 19 nt, Human
ucgucacauuauuguguau

SEQ ID NO: 91941 - RNA, 24 nt, Human
ucuccugucucagccucccgagua

SEQ ID NO: 91942 - RNA, 24 nt, Human
ucuccugucucagccucccgagua

SEQ ID NO: 91943 - RNA, 21 nt, Human
ucucgaacuccugaccucaag

SEQ ID NO: 91944 - RNA, 21 nt, Human
ucucgaacuccugaccucaag

SEQ ID NO: 91945 - RNA, 22 nt, Human
ucucgcccuguugcccaagcug

SEQ ID NO: 91946 - RNA, 23 nt, Human
ucucgcccuguugcccaagcugg

SEQ ID NO: 91947 - RNA, 23 nt, Human
ucucgcccuguugcccaagcugg

SEQ ID NO: 91948 - RNA, 24 nt, Human
ucucgcccuguugcccaagcugga

SEQ ID NO: 91949 - RNA, 24 nt, Human
ucucgcccuguugcccaagcugga

SEQ ID NO: 91950 - RNA, 26 nt, Human
ucucgcccuguugcccaagcuggagu

SEQ ID NO: 91951 - RNA, 26 nt, Human
ucucgcccuguugcccaagcuggagu

SEQ ID NO: 91952 - RNA, 27 nt, Human
ucucgcccuguugcccaagcuggagug

SEQ ID NO: 91953 - RNA, 20 nt, Human
ucugcaggaccaucuccauu

SEQ ID NO: 91954 - RNA, 22 nt, Human
ugaaaaaaaaaaaaaaaaaagc

SEQ ID NO: 91955 - RNA, 20 nt, Human
ugaaacaagaaagaugacac

SEQ ID NO: 91956 - RNA, 22 nt, Human
ugaaacacuccuaaugcccuuc

SEQ ID NO: 91957 - RNA, 22 nt, Human
ugaaacacuccuaaugcccuuc

SEQ ID NO: 91958 - RNA, 21 nt, Human
ugaaacaguaagggaacagaa

SEQ ID NO: 91959 - RNA, 23 nt, Human
ugaaacaguaagggaacagaaga

SEQ ID NO: 91960 - RNA, 23 nt, Human
ugaaacaguaagggaacagaaga

SEQ ID NO: 91961 - RNA, 19 nt, Human
ugaaagugcauccaggggc

SEQ ID NO: 91962 - RNA, 24 nt, Human
ugacagaaugagacuaucuccaaa

SEQ ID NO: 91963 - RNA, 24 nt, Human
ugacagaaugagacuaucuccaaa

SEQ ID NO: 91964 - RNA, 18 nt, Human
ugaccucaagugaucugc

SEQ ID NO: 91965 - RNA, 18 nt, Human
ugaccucaagugaucugc

SEQ ID NO: 91966 - RNA, 24 nt, Human
ugaccucaagugaucugccugccu

SEQ ID NO: 91967 - RNA, 24 nt, Human
ugaccucaagugaucugccugccu

SEQ ID NO: 91968 - RNA, 18 nt, Human
ugacucaggaucucagca

SEQ ID NO: 91969 - RNA, 24 nt, Human
ugagaccagcuuaggcaacauagu

SEQ ID NO: 91970 - RNA, 23 nt, Human
ugagcccaggaguuugagaccag

SEQ ID NO: 91971 - RNA, 23 nt, Human
ugagcccaggaguuugagaccag

SEQ ID NO: 91972 - RNA, 20 nt, Human
ugagccgugauugccccccu

SEQ ID NO: 91973 - RNA, 20 nt, Human
ugagccgugauugccccccu

SEQ ID NO: 91974 - RNA, 18 nt, Human
ugagccugggaggucgag

SEQ ID NO: 91975 - RNA, 18 nt, Human
ugagccugggaggucgag

SEQ ID NO: 91976 - RNA, 22 nt, Human
ugagccugggaggucgagacua

SEQ ID NO: 91977 - RNA, 22 nt, Human
ugagccugggaggucgagacua

SEQ ID NO: 91978 - RNA, 18 nt, Human
ugaggugggaggacagcu

SEQ ID NO: 91979 - RNA, 18 nt, Human
ugaggugggaggacagcu

SEQ ID NO: 91980 - RNA, 24 nt, Human
ugaggugggaggacagcuugagcc

SEQ ID NO: 91981 - RNA, 24 nt, Human
ugaggugggaggacagcuugagcc

SEQ ID NO: 91982 - RNA, 18 nt, Human
ugaggugggaggaucgcu

SEQ ID NO: 91983 - RNA, 18 nt, Human
ugaggugggaggaucgcu

SEQ ID NO: 91984 - RNA, 20 nt, Human
ugaggugggaggaucgcuug

SEQ ID NO: 91985 - RNA, 20 nt, Human
ugaggugggaggaucgcuug

SEQ ID NO: 91986 - RNA, 23 nt, Human
ugaggugggaggaucgcuugagc

SEQ ID NO: 91987 - RNA, 23 nt, Human
ugaggugggaggaucgcuugagc

SEQ ID NO: 91988 - RNA, 24 nt, Human
ugaggugggaggaucgcuugagcc

SEQ ID NO: 91989 - RNA, 24 nt, Human
ugaggugggaggaucgcuugagcc

SEQ ID NO: 91990 - RNA, 24 nt, Human
ugagguuuugccguauuggccagg

SEQ ID NO: 91991 - RNA, 24 nt, Human
ugagguuuugccguauuggccagg

SEQ ID NO: 91992 - RNA, 30 nt, Human
ugaugagguuuugccguauuggccaggcuu

SEQ ID NO: 91993 - RNA, 30 nt, Human; identical to SEQ ID NO: 91992

SEQ ID NO: 91994 - RNA, 18 nt, Human
ugcaaaagaaaaagaaaa

SEQ ID NO: 91995 - RNA, 18 nt, Human
ugcaaaagaaaaagaaaa

SEQ ID NO: 91996 - RNA, 20 nt, Human
ugcauggacacacaccugua

SEQ ID NO: 91997 - RNA, 20 nt, Human
ugcauggacacacaccugua

SEQ ID NO: 91998 - RNA, 24 nt, Human
ugccguauuggccaggcuggucuc

SEQ ID NO: 91999 - RNA, 24 nt, Human
ugccguauuggccaggcuggucuc

SEQ ID NO: 92000 - RNA, 21 nt, Human
ugccucaucuauaaaugaagg

SEQ ID NO: 92001 - RNA, 21 nt, Human
ugccucaucuauaaaugaagg

SEQ ID NO: 92002 - RNA, 19 nt, Human
ugccuuggcuucccagagu

SEQ ID NO: 92003 - RNA, 19 nt, Human
ugccuuggcuucccagagu

SEQ ID NO: 92004 - RNA, 23 nt, Human
ugcugggcaggaggcuggagguu

SEQ ID NO: 92005 - RNA, 20 nt, Human
ugcuucugcaggaccaucuc

SEQ ID NO: 92006 - RNA, 20 nt, Human
uggagugcaguugugucauc

SEQ ID NO: 92007 - RNA, 20 nt, Human
uggagugcaguugugucauc

SEQ ID NO: 92008 - RNA, 24 nt, Human
uggagugcaguugugucaucuugg

SEQ ID NO: 92009 - RNA, 24 nt, Human
uggagugcaguugugucaucuugg

SEQ ID NO: 92010 - RNA, 22 nt, Human
uggccagaccaaguaggaaguc

SEQ ID NO: 92011 - RNA, 24 nt, Human
uggccagaccaaguaggaagucag

SEQ ID NO: 92012 - RNA, 24 nt, Human
uggccaggcuggucucgaacuccu

SEQ ID NO: 92013 - RNA, 24 nt, Human
uggccaggcuggucucgaacuccu

SEQ ID NO: 92014 - RNA, 21 nt, Human
uggcugcagaaucgcaaggug

SEQ ID NO: 92015 - RNA, 19 nt, Human
ugggaagagacuucaagac

SEQ ID NO: 92016 - RNA, 19 nt, Human
ugggaggcugaggugggag

SEQ ID NO: 92017 - RNA, 19 nt, Human
ugggaggcugaggugggag

SEQ ID NO: 92018 - RNA, 24 nt, Human
ugggaggucgagacuacagugagc

SEQ ID NO: 92019 - RNA, 24 nt, Human
ugggaggucgagacuacagugagc

SEQ ID NO: 92020 - RNA, 18 nt, Human
ugggauuacaggcaugag

SEQ ID NO: 92021 - RNA, 18 nt, Human
ugggauuacaggcaugag

SEQ ID NO: 92022 - RNA, 18 nt, Human
ugggauuacaggcaugag

SEQ ID NO: 92023 - RNA, 18 nt, Human
ugggauuacaggcaugag

SEQ ID NO: 92024 - RNA, 21 nt, Human
ugggauuacaggcaugaguca

SEQ ID NO: 92025 - RNA, 21 nt, Human
ugggauuacaggcaugaguca

SEQ ID NO: 92026 - RNA, 22 nt, Human
ugggauuacaggcaugagucac

SEQ ID NO: 92027 - RNA, 22 nt, Human
ugggauuacaggcaugagucac

SEQ ID NO: 92028 - RNA, 23 nt, Human
ugggauuacaggcaugagucacc

SEQ ID NO: 92029 - RNA, 23 nt, Human
ugggauuacaggcaugagucacc

SEQ ID NO: 92030 - RNA, 24 nt, Human
ugggauuacaggcaugagucaccg

SEQ ID NO: 92031 - RNA, 24 nt, Human
ugggauuacaggcaugagucaccg

SEQ ID NO: 92032 - RNA, 21 nt, Human
ugggauuacaggugcucgccg

SEQ ID NO: 92033 - RNA, 21 nt, Human
ugggauuacaggugcucgccg

SEQ ID NO: 92034 - RNA, 22 nt, Human
ugggauuacaggugcucgccgc

SEQ ID NO: 92035 - RNA, 22 nt, Human
ugggauuacaggugcucgccgc

SEQ ID NO: 92036 - RNA, 24 nt, Human
ugggauuacaggugcucgccgcca

SEQ ID NO: 92037 - RNA, 24 nt, Human
ugggauuacaggugcucgccgcca

SEQ ID NO: 92038 - RNA, 18 nt, Human
ugggcaggaggcuggagg

SEQ ID NO: 92039 - RNA, 19 nt, Human
ugggccuggcauagaccaa

SEQ ID NO: 92040 - RNA, 19 nt, Human
ugggccuggcauagaccaa

SEQ ID NO: 92041 - RNA, 18 nt, Human
ugggucagaauacagaac

SEQ ID NO: 92042 - RNA, 19 nt, Human
ugggugccugcucaggguu

SEQ ID NO: 92043 - RNA, 18 nt, Human
uguaaagggagguuuccg

SEQ ID NO: 92044 - RNA, 23 nt, Human
uguaaaugagccaucaucuuccu

SEQ ID NO: 92045 - RNA, 23 nt, Human
uguaaaugagccaucaucuuccu

SEQ ID NO: 92046 - RNA, 24 nt, Human
ugucucagccucccgaguagcugg

SEQ ID NO: 92047 - RNA, 24 nt, Human
ugucucagccucccgaguagcugg

SEQ ID NO: 92048 - RNA, 21 nt, Human
ugugaaauucacuuuucccca

SEQ ID NO: 92049 - RNA, 23 nt, Human
uuaaagaaaguagaauccucugu

SEQ ID NO: 92050 - RNA, 22 nt, Human
uuaguaaugaugagguuuugcc

SEQ ID NO: 92051 - RNA, 22 nt, Human
uuaguaaugaugagguuuugcc

SEQ ID NO: 92052 - RNA, 19 nt, Human
uuauaaaugcaggcaccac

SEQ ID NO: 92053 - RNA, 23 nt, Human
uucaugucuugggaccaauuucu

SEQ ID NO: 92054 - RNA, 21 nt, Human
uuccaaccccaauauugaauu

SEQ ID NO: 92055 - RNA, 20 nt, Human
uuccuguuucuagaaugaca

SEQ ID NO: 92056 - RNA, 20 nt, Human
uuccuguuucuagaaugaca

SEQ ID NO: 92057 - RNA, 23 nt, Human
uuccuugacauuuuuuuaugagc

SEQ ID NO: 92058 - RNA, 23 nt, Human
uuccuugacauuuuuuuaugagc

SEQ ID NO: 92059 - RNA, 25 nt, Human
uuccuugacauuuuuuuaugagccg

SEQ ID NO: 92060 - RNA, 25 nt, Human
uuccuugacauuuuuuuaugagccg

SEQ ID NO: 92061 - RNA, 21 nt, Human
uucuucagaugauuacacaga

SEQ ID NO: 92062 - RNA, 22 nt, Human
uugagcccaggaguuugagacc

SEQ ID NO: 92063 - RNA, 22 nt, Human
uugagcccaggaguuugagacc

SEQ ID NO: 92064 - RNA, 23 nt, Human
uugaggucuaagaaccaacaaaa

SEQ ID NO: 92065 - RNA, 23 nt, Human
uugaggucuaagaaccaacaaaa

SEQ ID NO: 92066 - RNA, 18 nt, Human
uugcagagcagcugagug

SEQ ID NO: 92067 - RNA, 18 nt, Human
uugcagagcagcugagug

SEQ ID NO: 92068 - RNA, 22 nt, Human
uugcccaagcuggagugcaguu

SEQ ID NO: 92069 - RNA, 22 nt, Human
uugcccaagcuggagugcaguu

SEQ ID NO: 92070 - RNA, 22 nt, Human
uugccccccugcacuccagucu

SEQ ID NO: 92071 - RNA, 24 nt, Human
uugccguauuggccaggcuggucu

SEQ ID NO: 92072 - RNA, 24 nt, Human
uugccguauuggccaggcuggucu

SEQ ID NO: 92073 - RNA, 20 nt, Human
uugggaccaauuucuucaga

SEQ ID NO: 92074 - RNA, 22 nt, Human
uuguguuuuuaguaaugaugag

SEQ ID NO: 92075 - RNA, 22 nt, Human
uuguguuuuuaguaaugaugag

SEQ ID NO: 92076 - RNA, 22 nt, Human
uuuguucccuguuuguccacuc

SEQ ID NO: 92077 - RNA, 18 nt, Human
uuuuuguguuuuuaguaa

SEQ ID NO: 92078 - RNA, 18 nt, Human
uuuuuguguuuuuaguaa

SEQ ID NO: 92079 - RNA, 23 nt, Human
uuuuuguguuuuuaguaaugaug

SEQ ID NO: 92080 - RNA, 23 nt, Human
uuuuuguguuuuuaguaaugaug

SEQ ID NO: 92081 - RNA, 18 nt, Human
uuuuuuuuuuaaacaagg

SEQ ID NO: 92082 - RNA, 18 nt, Human
uuuuuuuuuuaaacaagg

SEQ ID NO: 92083 - RNA, 21 nt, Human
aaaaaaaaaaaaaaaaagucu

SEQ ID NO: 92084 - RNA, 21 nt, Human
aaaaaaaaaaaaaaaaagucu

SEQ ID NO: 92085 - RNA, 21 nt, Human
aaaaaaaaaaaaaaaaagucu

SEQ ID NO: 92086 - RNA, 27 nt, Human
aaacaaccaacgaaagaucuuugagac

SEQ ID NO: 92087 - RNA, 27 nt, Human
aaacaaccaacgaaagaucuuugagac

SEQ ID NO: 92088 - RNA, 27 nt, Human
aaacaaccaacgaaagaucuuugagac

SEQ ID NO: 92089 - RNA, 23 nt, Human
aaagagaaagcaggaacaaagaa

SEQ ID NO: 92090 - RNA, 23 nt, Human
aaagagaaagcaggaacaaagaa

SEQ ID NO: 92091 - RNA, 23 nt, Human
aaagagaaagcaggaacaaagaa

SEQ ID NO: 92092 - RNA, 21 nt, Human
aaaggcagagaugaugggcac

SEQ ID NO: 92093 - RNA, 21 nt, Human
aaaggcagagaugaugggcac

SEQ ID NO: 92094 - RNA, 21 nt, Human
aaaggcagagaugaugggcac

SEQ ID NO: 92095 - RNA, 25 nt, Human
aacaauaacauguauggcacugaaa

SEQ ID NO: 92096 - RNA, 25 nt, Human
aacaauaacauguauggcacugaaa

SEQ ID NO: 92097 - RNA, 23 nt, Human
aacacaaauauggggaauuuaua

SEQ ID NO: 92098 - RNA, 23 nt, Human
aacacaaauauggggaauuuaua

SEQ ID NO: 92099 - RNA, 23 nt, Human
aacacaaauauggggaauuuaua

SEQ ID NO: 92100 - RNA, 18 nt, Human
aacacuuugggaggcuga

SEQ ID NO: 92101 - RNA, 18 nt, Human
aacacuuugggaggcuga

SEQ ID NO: 92102 - RNA, 18 nt, Human
aacacuuugggaggcuga

SEQ ID NO: 92103 - RNA, 24 nt, Human
aacacuuugggaggcugagguggg

SEQ ID NO: 92104 - RNA, 24 nt, Human
aacacuuugggaggcugagguggg

SEQ ID NO: 92105 - RNA, 24 nt, Human
aacacuuugggaggcugagguggg

SEQ ID NO: 92106 - RNA, 18 nt, Human
aacaggaugaaaugaagg

SEQ ID NO: 92107 - RNA, 18 nt, Human
aacaggaugaaaugaagg

SEQ ID NO: 92108 - RNA, 18 nt, Human
aacaggaugaaaugaagg

SEQ ID NO: 92109 - RNA, 19 nt, Human
aacauggugaaacccuguc

SEQ ID NO: 92110 - RNA, 19 nt, Human
aacauggugaaacccuguc

SEQ ID NO: 92111 - RNA, 19 nt, Human
aacauggugaaacccuguc

SEQ ID NO: 92112 - RNA, 20 nt, Human
aacauggugaaacccugucu

SEQ ID NO: 92113 - RNA, 20 nt, Human
aacauggugaaacccugucu

SEQ ID NO: 92114 - RNA, 20 nt, Human
aacauggugaaacccugucu

SEQ ID NO: 92115 - RNA, 21 nt, Human
aacauggugaaacccugucuc

SEQ ID NO: 92116 - RNA, 21 nt, Human
aacauggugaaacccugucuc

SEQ ID NO: 92117 - RNA, 21 nt, Human
aacauggugaaacccugucuc

SEQ ID NO: 92118 - RNA, 23 nt, Human
aaccccacgauuagucucaucuc

SEQ ID NO: 92119 - RNA, 20 nt, Human
aagaccccgcgcucggcgcc

SEQ ID NO: 92120 - RNA, 19 nt, Human
aagcaggaacaaagaacua

SEQ ID NO: 92121 - RNA, 19 nt, Human
aagcaggaacaaagaacua

SEQ ID NO: 92122 - RNA, 19 nt, Human
aagcaggaacaaagaacua

SEQ ID NO: 92123 - RNA, 18 nt, Human
aaggagcuggccuggagg

SEQ ID NO: 92124 - RNA, 18 nt, Human
aaggagcuggccuggagg

SEQ ID NO: 92125 - RNA, 18 nt, Human
aaggagcuggccuggagg

SEQ ID NO: 92126 - RNA, 21 nt, Human
aagguacaaaugcaaggcaau

SEQ ID NO: 92127 - RNA, 21 nt, Human
aagguacaaaugcaaggcaau

SEQ ID NO: 92128 - RNA, 19 nt, Human
aaugaagguaaagaaggga

SEQ ID NO: 92129 - RNA, 19 nt, Human
aaugaagguaaagaaggga

SEQ ID NO: 92130 - RNA, 21 nt, Human
acaaaaagggcggaggauaug

SEQ ID NO: 92131 - RNA, 21 nt, Human
acaaaaagggcggaggauaug

SEQ ID NO: 92132 - RNA, 21 nt, Human
acaaaaagggcggaggauaug

SEQ ID NO: 92133 - RNA, 24 nt, Human
acaauaacauguauggcacugaaa

SEQ ID NO: 92134 - RNA, 19 nt, Human
acagaaaaggagcuggccu

SEQ ID NO: 92135 - RNA, 19 nt, Human
acagaaaaggagcuggccu

SEQ ID NO: 92136 - RNA, 19 nt, Human
acagaaaaggagcuggccu

SEQ ID NO: 92137 - RNA, 22 nt, Human
acagaaaaggagcuggccugga

SEQ ID NO: 92138 - RNA, 22 nt, Human
acagaaaaggagcuggccugga

SEQ ID NO: 92139 - RNA, 22 nt, Human
acagaaaaggagcuggccugga

SEQ ID NO: 92140 - RNA, 23 nt, Human
acagagcgagacucugucucaaa

SEQ ID NO: 92141 - RNA, 24 nt, Human
acagagcgagacucugucucaaaa

SEQ ID NO: 92142 - RNA, 24 nt, Human
acagagcgagacucugucucaaaa

SEQ ID NO: 92143 - RNA, 24 nt, Human
acagagcgagacucugucucaaaa

SEQ ID NO: 92144 - RNA, 21 nt, Human
acagagucuagggaaacacac

SEQ ID NO: 92145 - RNA, 21 nt, Human
acagagucuagggaaacacac

SEQ ID NO: 92146 - RNA, 22 nt, Human
acagagucuagggaaacacacc

SEQ ID NO: 92147 - RNA, 22 nt, Human
acagagucuagggaaacacacc

SEQ ID NO: 92148 - RNA, 19 nt, Human
acaggcaaagggcuucaca

SEQ ID NO: 92149 - RNA, 19 nt, Human
acaggcaaagggcuucaca

SEQ ID NO: 92150 - RNA, 19 nt, Human
acaggcaaagggcuucaca

SEQ ID NO: 92151 - RNA, 18 nt, Human
accaggaaccucguuugg

SEQ ID NO: 92152 - RNA, 18 nt, Human
accaggaaccucguuugg

SEQ ID NO: 92153 - RNA, 24 nt, Human
acccugucucuacuaaaaauacaa

SEQ ID NO: 92154 - RNA, 24 nt, Human
acccugucucuacuaaaaauacaa

SEQ ID NO: 92155 - RNA, 24 nt, Human
acccugucucuacuaaaaauacaa

SEQ ID NO: 92156 - RNA, 19 nt, Human
accgcccacagcccaaaca

SEQ ID NO: 92157 - RNA, 28 nt, Human
acucugucucaaaaaaaaaaaaaaaaaa

SEQ ID NO: 92158 - RNA, 28 nt, Human
acucugucucaaaaaaaaaaaaaaaaaa

SEQ ID NO: 92159 - RNA, 28 nt, Human
acucugucucaaaaaaaaaaaaaaaaaa

SEQ ID NO: 92160 - RNA, 18 nt, Human
acugcccuccagccuggg

SEQ ID NO: 92161 - RNA, 18 nt, Human
acugcccuccagccuggg

SEQ ID NO: 92162 - RNA, 18 nt, Human
acugcccuccagccuggg

SEQ ID NO: 92163 - RNA, 24 nt, Human
acugcccuccagccugggcgacag

SEQ ID NO: 92164 - RNA, 24 nt, Human
acugcccuccagccugggcgacag

SEQ ID NO: 92165 - RNA, 24 nt, Human
acugcccuccagccugggcgacag

SEQ ID NO: 92166 - RNA, 21 nt, Human
agaaaacacuugagcaagagc

SEQ ID NO: 92167 - RNA, 21 nt, Human
agaaaacacuugagcaagagc

SEQ ID NO: 92168 - RNA, 22 nt, Human
agacagagaggugguuacagag

SEQ ID NO: 92169 - RNA, 22 nt, Human
agacagagaggugguuacagag

SEQ ID NO: 92170 - RNA, 22 nt, Human
agacagagaggugguuacagag

SEQ ID NO: 92171 - RNA, 24 nt, Human
agacagauuugguggcagcagcca

SEQ ID NO: 92172 - RNA, 24 nt, Human
agacagauuugguggcagcagcca

SEQ ID NO: 92173 - RNA, 24 nt, Human
agacagauuugguggcagcagcca

SEQ ID NO: 92174 - RNA, 22 nt, Human
agacuuccaugggcaaagauca

SEQ ID NO: 92175 - RNA, 22 nt, Human
agacuuccaugggcaaagauca

SEQ ID NO: 92176 - RNA, 22 nt, Human
agacuuccaugggcaaagauca

SEQ ID NO: 92177 - RNA, 23 nt, Human
agacuuccaugggcaaagaucaa

SEQ ID NO: 92178 - RNA, 23 nt, Human
agauaggagauggucucucaaga

SEQ ID NO: 92179 - RNA, 22 nt, Human
agauaggagauggucucucaga

SEQ ID NO: 92180 - RNA, 22 nt, Human
agauaggagauggucucucaga

SEQ ID NO: 92181 - RNA, 24 nt, Human
agccugggcgacagagcgagacuc

SEQ ID NO: 92182 - RNA, 24 nt, Human
agccugggcgacagagcgagacuc

SEQ ID NO: 92183 - RNA, 24 nt, Human
agccugggcgacagagcgagacuc

SEQ ID NO: 92184 - RNA, 21 nt, Human
aggcaggagaauggcgugaac

SEQ ID NO: 92185 - RNA, 21 nt, Human
aggcaggagaauggcgugaac

SEQ ID NO: 92186 - RNA, 24 nt, Human
aggcaggagaauggcgugaacccg

SEQ ID NO: 92187 - RNA, 24 nt, Human
aggcaggagaauggcgugaacccg

SEQ ID NO: 92188 - RNA, 24 nt, Human
aggcaggagaauggcgugaacccg

SEQ ID NO: 92189 - RNA, 18 nt, Human
aggcugaggcaggagaau

SEQ ID NO: 92190 - RNA, 18 nt, Human
aggcugaggcaggagaau

SEQ ID NO: 92191 - RNA, 19 nt, Human
aggcugaggcaggagaaug

SEQ ID NO: 92192 - RNA, 19 nt, Human
aggcugaggcaggagaaug

SEQ ID NO: 92193 - RNA, 22 nt, Human
aggcugagguggguggaucaug

SEQ ID NO: 92194 - RNA, 22 nt, Human
aggcugagguggguggaucaug

SEQ ID NO: 92195 - RNA, 22 nt, Human
aggcugagguggguggaucaug

SEQ ID NO: 92196 - RNA, 24 nt, Human
agguggguggaucaugaggucagg

SEQ ID NO: 92197 - RNA, 24 nt, Human
agguggguggaucaugaggucagg

SEQ ID NO: 92198 - RNA, 24 nt, Human
agguggguggaucaugaggucagg

SEQ ID NO: 92199 - RNA, 23 nt, Human
aguggcucacgccuguaauccca

SEQ ID NO: 92200 - RNA, 23 nt, Human
aguggcucacgccuguaauccca

SEQ ID NO: 92201 - RNA, 23 nt, Human
aguggcucacgccuguaauccca

SEQ ID NO: 92202 - RNA, 21 nt, Human
aguguccuuccacuggguggc

SEQ ID NO: 92203 - RNA, 21 nt, Human
aguguccuuccacuggguggc

SEQ ID NO: 92204 - RNA, 21 nt, Human
aguguccuuccacuggguggc

SEQ ID NO: 92205 - RNA, 24 nt, Human
aguuggagcuugcagugagcugag

SEQ ID NO: 92206 - RNA, 24 nt, Human
aguuggagcuugcagugagcugag

SEQ ID NO: 92207 - RNA, 24 nt, Human
aguuggagcuugcagugagcugag

SEQ ID NO: 92208 - RNA, 24 nt, Human
aucgugccacugcccuccagccug

SEQ ID NO: 92209 - RNA, 24 nt, Human
aucgugccacugcccuccagccug

SEQ ID NO: 92210 - RNA, 24 nt, Human
aucgugccacugcccuccagccug

SEQ ID NO: 92211 - RNA, 18 nt, Human
augaaaugaagguaaaga

SEQ ID NO: 92212 - RNA, 18 nt, Human
augaaaugaagguaaaga

SEQ ID NO: 92213 - RNA, 18 nt, Human
augaaaugaagguaaaga

SEQ ID NO: 92214 - RNA, 20 nt, Human
auuccuggcaauagguccaa

SEQ ID NO: 92215 - RNA, 20 nt, Human
auuccuggcaauagguccaa

SEQ ID NO: 92216 - RNA, 20 nt, Human
auuccuggcaauagguccaa

SEQ ID NO: 92217 - RNA, 20 nt, Human
caaaagcuggaacugaacac

SEQ ID NO: 92218 - RNA, 20 nt, Human
caaaagcuggaacugaacac

SEQ ID NO: 92219 - RNA, 20 nt, Human
caaaagcuggaacugaacac

SEQ ID NO: 92220 - RNA, 27 nt, Human
caaaagcuggaacugaacacaaauaug

SEQ ID NO: 92221 - RNA, 27 nt, Human
caaaagcuggaacugaacacaaauaug

SEQ ID NO: 92222 - RNA, 27 nt, Human
caaaagcuggaacugaacacaaauaug

SEQ ID NO: 92223 - RNA, 21 nt, Human
caacacuuugggaggcugagg

SEQ ID NO: 92224 - RNA, 24 nt, Human
caacacuuugggaggcugaggugg

SEQ ID NO: 92225 - RNA, 24 nt, Human
caacacuuugggaggcugaggugg

SEQ ID NO: 92226 - RNA, 24 nt, Human
caacacuuugggaggcugaggugg

SEQ ID NO: 92227 - RNA, 24 nt, Human
caagaccaucccggcuaacauggu

SEQ ID NO: 92228 - RNA, 24 nt, Human
caagaccaucccggcuaacauggu

SEQ ID NO: 92229 - RNA, 24 nt, Human
caagaccaucccggcuaacauggu

SEQ ID NO: 92230 - RNA, 21 nt, Human
caagaccccgcgcucggcgcc

SEQ ID NO: 92231 - RNA, 22 nt, Human
cacaagcccgcucagaaaacac

SEQ ID NO: 92232 - RNA, 22 nt, Human
cacaagcccgcucagaaaacac

SEQ ID NO: 92233 - RNA, 20 nt, Human
cacaggccgcuucuggacac

SEQ ID NO: 92234 - RNA, 20 nt, Human
cacaggccgcuucuggacac

SEQ ID NO: 92235 - RNA, 21 nt, Human
cacaucccugagggggcagaa

SEQ ID NO: 92236 - RNA, 21 nt, Human
cacaucccugagggggcagaa

SEQ ID NO: 92237 - RNA, 21 nt, Human
cacaucccugagggggcagaa

SEQ ID NO: 92238 - RNA, 20 nt, Human
caccuguagucccagcuacu

SEQ ID NO: 92239 - RNA, 20 nt, Human
caccuguagucccagcuacu

SEQ ID NO: 92240 - RNA, 20 nt, Human
caccuguagucccagcuacu

SEQ ID NO: 92241 - RNA, 23 nt, Human
caccuguagucccagcuacuugg

SEQ ID NO: 92242 - RNA, 23 nt, Human
caccuguagucccagcuacuugg

SEQ ID NO: 92243 - RNA, 23 nt, Human
caccuguagucccagcuacuugg

SEQ ID NO: 92244 - RNA, 24 nt, Human
cacgccuguaaucccaacacuuug

SEQ ID NO: 92245 - RNA, 24 nt, Human
cacgccuguaaucccaacacuuug

SEQ ID NO: 92246 - RNA, 24 nt, Human
cacgccuguaaucccaacacuuug

SEQ ID NO: 92247 - RNA, 24 nt, Human
cacugcccuccagccugggcgaca

SEQ ID NO: 92248 - RNA, 24 nt, Human
cacugcccuccagccugggcgaca

SEQ ID NO: 92249 - RNA, 24 nt, Human
cacugcccuccagccugggcgaca

SEQ ID NO: 92250 - RNA, 18 nt, Human
cagaaaacacuugagcaa

SEQ ID NO: 92251 - RNA, 18 nt, Human
cagaaaacacuugagcaa

SEQ ID NO: 92252 - RNA, 27 nt, Human
cagaaaaggagcuggccuggaguccca

SEQ ID NO: 92253 - RNA, 20 nt, Human
cagaaaccgugcauccugaa

SEQ ID NO: 92254 - RNA, 20 nt, Human
cagaaaccgugcauccugaa

SEQ ID NO: 92255 - RNA, 20 nt, Human
cagaaaccgugcauccugaa

SEQ ID NO: 92256 - RNA, 23 nt, Human
cagcagauuucuuccauuaguuu

SEQ ID NO: 92257 - RNA, 18 nt, Human
cagcaguccgugacucgg

SEQ ID NO: 92258 - RNA, 24 nt, Human
cagcuacuuggaaggcugaggcag

SEQ ID NO: 92259 - RNA, 24 nt, Human
cagcuacuuggaaggcugaggcag

SEQ ID NO: 92260 - RNA, 24 nt, Human
cagcuacuuggaaggcugaggcag

SEQ ID NO: 92261 - RNA, 20 nt, Human
cagcugaaacauuccuggca

SEQ ID NO: 92262 - RNA, 20 nt, Human
cagcugaaacauuccuggca

SEQ ID NO: 92263 - RNA, 20 nt, Human
cagcugaaacauuccuggca

SEQ ID NO: 92264 - RNA, 18 nt, Human
caugauccuguaaagcag

SEQ ID NO: 92265 - RNA, 18 nt, Human
caugauccuguaaagcag

SEQ ID NO: 92266 - RNA, 18 nt, Human
caugauccuguaaagcag

SEQ ID NO: 92267 - RNA, 25 nt, Human
cauguuugcuucuucagagccaaaa

SEQ ID NO: 92268 - RNA, 25 nt, Human
cauguuugcuucuucagagccaaaa

SEQ ID NO: 92269 - RNA, 25 nt, Human
cauguuugcuucuucagagccaaaa

SEQ ID NO: 92270 - RNA, 26 nt, Human
cauguuugcuucuucagagccaaaag

SEQ ID NO: 92271 - RNA, 26 nt, Human
cauguuugcuucuucagagccaaaag

SEQ ID NO: 92272 - RNA, 24 nt, Human
ccaaacucucacucuaggacaaaa

SEQ ID NO: 92273 - RNA, 24 nt, Human
ccaaacucucacucuaggacaaaa

SEQ ID NO: 92274 - RNA, 24 nt, Human
ccaaacucucacucuaggacaaaa

SEQ ID NO: 92275 - RNA, 22 nt, Human
ccaaccaaggcuggcucuacag

SEQ ID NO: 92276 - RNA, 22 nt, Human
ccaaccaaggcuggcucuacag

SEQ ID NO: 92277 - RNA, 22 nt, Human
ccaaccaaggcuggcucuacag

SEQ ID NO: 92278 - RNA, 20 nt, Human
ccacagcccaaacaaaccgg

SEQ ID NO: 92279 - RNA, 21 nt, Human
ccacgugcauaucacaagccc

SEQ ID NO: 92280 - RNA, 21 nt, Human
ccacgugcauaucacaagccc

SEQ ID NO: 92281 - RNA, 20 nt, Human
ccacugcccuccagccuggg

SEQ ID NO: 92282 - RNA, 20 nt, Human
ccacugcccuccagccuggg

SEQ ID NO: 92283 - RNA, 20 nt, Human
ccacugcccuccagccuggg

SEQ ID NO: 92284 - RNA, 21 nt, Human
ccacugcccuccagccugggc

SEQ ID NO: 92285 - RNA, 21 nt, Human
ccacugcccuccagccugggc

SEQ ID NO: 92286 - RNA, 21 nt, Human
ccacugcccuccagccugggc

SEQ ID NO: 92287 - RNA, 21 nt, Human
ccacugcccuccagccugggc

SEQ ID NO: 92288 - RNA, 21 nt, Human
ccacugcccuccagccugggc

SEQ ID NO: 92289 - RNA, 21 nt, Human
ccacugcccuccagccugggc

SEQ ID NO: 92290 - RNA, 23 nt, Human
ccacugcccuccagccugggcga

SEQ ID NO: 92291 - RNA, 24 nt, Human
ccacugcccuccagccugggcgac

SEQ ID NO: 92292 - RNA, 24 nt, Human
ccacugcccuccagccugggcgac

SEQ ID NO: 92293 - RNA, 24 nt, Human
ccacugcccuccagccugggcgac

SEQ ID NO: 92294 - RNA, 24 nt, Human
ccaguggugcagcagauuucuucc

SEQ ID NO: 92295 - RNA, 25 nt, Human
cccacagcccaaacaaaccgggggc

SEQ ID NO: 92296 - RNA, 22 nt, Human
cccggcuaacauggugaaaccc

SEQ ID NO: 92297 - RNA, 22 nt, Human
cccggcuaacauggugaaaccc

SEQ ID NO: 92298 - RNA, 22 nt, Human
cccggcuaacauggugaaaccc

SEQ ID NO: 92299 - RNA, 22 nt, Human
cccggcuaacauggugaaaccc

SEQ ID NO: 92300 - RNA, 22 nt, Human
cccggcuaacauggugaaaccc

SEQ ID NO: 92301 - RNA, 22 nt, Human
cccggcuaacauggugaaaccc

SEQ ID NO: 92302 - RNA, 24 nt, Human
cccggcuaacauggugaaacccug

SEQ ID NO: 92303 - RNA, 24 nt, Human
cccggcuaacauggugaaacccug

SEQ ID NO: 92304 - RNA, 24 nt, Human
cccggcuaacauggugaaacccug

SEQ ID NO: 92305 - RNA, 23 nt, Human
cccuccagccugggcgacagagc

SEQ ID NO: 92306 - RNA, 23 nt, Human
cccuccagccugggcgacagagc

SEQ ID NO: 92307 - RNA, 23 nt, Human
cccuccagccugggcgacagagc

SEQ ID NO: 92308 - RNA, 19 nt, Human
ccgggcgcaguggcucacg

SEQ ID NO: 92309 - RNA, 22 nt, Human
ccugggcgacagagcgagacuc

SEQ ID NO: 92310 - RNA, 22 nt, Human
ccugggcgacagagcgagacuc

SEQ ID NO: 92311 - RNA, 22 nt, Human
ccugggcgacagagcgagacuc

SEQ ID NO: 92312 - RNA, 22 nt, Human
ccuguaaucccaacacuuuggg

SEQ ID NO: 92313 - RNA, 21 nt, Human
ccuguagucccagcuacuugg

SEQ ID NO: 92314 - RNA, 21 nt, Human
ccuguagucccagcuacuugg

SEQ ID NO: 92315 - RNA, 21 nt, Human
ccuguagucccagcuacuugg

SEQ ID NO: 92316 - RNA, 21 nt, Human
ccuuaaaucguucccucccuc

SEQ ID NO: 92317 - RNA, 23 nt, Human
cgccuguaaucccaacacuuugg

SEQ ID NO: 92318 - RNA, 24 nt, Human
cgccuguaaucccaacacuuuggg

SEQ ID NO: 92319 - RNA, 24 nt, Human
cgccuguaaucccaacacuuuggg

SEQ ID NO: 92320 - RNA, 20 nt, Human
cgcucagaaaacacuugagc

SEQ ID NO: 92321 - RNA, 20 nt, Human
cgcucagaaaacacuugagc

SEQ ID NO: 92322 - RNA, 21 nt, Human
cgggcaccuguagucccagcu

SEQ ID NO: 92323 - RNA, 21 nt, Human
cgggcaccuguagucccagcu

SEQ ID NO: 92324 - RNA, 21 nt, Human
cgggcaccuguagucccagcu

SEQ ID NO: 92325 - RNA, 19 nt, Human
cgugccacugcccuccagc

SEQ ID NO: 92326 - RNA, 19 nt, Human
cgugccacugcccuccagc

SEQ ID NO: 92327 - RNA, 19 nt, Human
cgugccacugcccuccagc

SEQ ID NO: 92328 - RNA, 19 nt, Human
cuaacauggugaaacccug

SEQ ID NO: 92329 - RNA, 19 nt, Human
cuaacauggugaaacccug

SEQ ID NO: 92330 - RNA, 19 nt, Human
cuaacauggugaaacccug

SEQ ID NO: 92331 - RNA, 24 nt, Human
cuacaaaagcuggaacugaacaca

SEQ ID NO: 92332 - RNA, 24 nt, Human
cuacaaaagcuggaacugaacaca

SEQ ID NO: 92333 - RNA, 24 nt, Human
cuacaaaagcuggaacugaacaca

SEQ ID NO: 92334 - RNA, 18 nt, Human
cucaaaaaaaaaaaaaaa

SEQ ID NO: 92335 - RNA, 18 nt, Human
cucaaaaaaaaaaaaaaa

SEQ ID NO: 92336 - RNA, 23 nt, Human
cucaaaaaaaaaaaaaaaaaaaa

SEQ ID NO: 92337 - RNA, 22 nt, Human
cucacgccuguaaucccaacac

SEQ ID NO: 92338 - RNA, 22 nt, Human
cucacgccuguaaucccaacac

SEQ ID NO: 92339 - RNA, 22 nt, Human
cucacgccuguaaucccaacac

SEQ ID NO: 92340 - RNA, 24 nt, Human
cucacgccuguaaucccaacacuu

SEQ ID NO: 92341 - RNA, 24 nt, Human
cucacgccuguaaucccaacacuu

SEQ ID NO: 92342 - RNA, 24 nt, Human
cucacgccuguaaucccaacacuu

SEQ ID NO: 92343 - RNA, 19 nt, Human
cucaucuccacggcaggcc

SEQ ID NO: 92344 - RNA, 19 nt, Human
cucugucucaaaaaaaaaa

SEQ ID NO: 92345 - RNA, 19 nt, Human
cucugucucaaaaaaaaaa

SEQ ID NO: 92346 - RNA, 19 nt, Human
cucugucucaaaaaaaaaa

SEQ ID NO: 92347 - RNA, 18 nt, Human
cucuuggagcuggagcag

SEQ ID NO: 92348 - RNA, 18 nt, Human
cugaacacaaauaugggg

SEQ ID NO: 92349 - RNA, 18 nt, Human
cugaacacaaauaugggg

SEQ ID NO: 92350 - RNA, 18 nt, Human
cugaacacaaauaugggg

SEQ ID NO: 92351 - RNA, 22 nt, Human
cugcaguuucucuugcauuucc

SEQ ID NO: 92352 - RNA, 22 nt, Human
cuggagucccacacucaaaggc

SEQ ID NO: 92353 - RNA, 22 nt, Human
cuggagucccacacucaaaggc

SEQ ID NO: 92354 - RNA, 22 nt, Human
cuggagucccacacucaaaggc

SEQ ID NO: 92355 - RNA, 20 nt, Human
cuguguuuacaacuucacuu

SEQ ID NO: 92356 - RNA, 20 nt, Human
cuguguuuacaacuucacuu

SEQ ID NO: 92357 - RNA, 20 nt, Human
cuguguuuacaacuucacuu

SEQ ID NO: 92358 - RNA, 18 nt, Human
cuuccuggccuucucuga

SEQ ID NO: 92359 - RNA, 18 nt, Human
cuuccuggccuucucuga

SEQ ID NO: 92360 - RNA, 18 nt, Human
cuuccuggccuucucuga

SEQ ID NO: 92361 - RNA, 24 nt, Human
cuugcagugagcugagaucgugcc

SEQ ID NO: 92362 - RNA, 24 nt, Human
cuugcagugagcugagaucgugcc

SEQ ID NO: 92363 - RNA, 24 nt, Human
cuugcagugagcugagaucgugcc

SEQ ID NO: 92364 - RNA, 24 nt, Human
cuugcccgggcgcaguggcucacg

SEQ ID NO: 92365 - RNA, 24 nt, Human
cuugcccgggcgcaguggcucacg

SEQ ID NO: 92366 - RNA, 19 nt, Human
gaaacccugucucuacuaa

SEQ ID NO: 92367 - RNA, 19 nt, Human
gaaacccugucucuacuaa

SEQ ID NO: 92368 - RNA, 21 nt, Human
gaaaugaagguaaagaaggga

SEQ ID NO: 92369 - RNA, 19 nt, Human
gaacauggacgucauagcc

SEQ ID NO: 92370 - RNA, 24 nt, Human
gacagagcgagacucugucucaaa

SEQ ID NO: 92371 - RNA, 24 nt, Human
gacagagcgagacucugucucaaa

SEQ ID NO: 92372 - RNA, 23 nt, Human
gagaucgugccacugcccuccag

SEQ ID NO: 92373 - RNA, 20 nt, Human
gagcauaaccuucccgaucc

SEQ ID NO: 92374 - RNA, 20 nt, Human
gagcauaaccuucccgaucc

SEQ ID NO: 92375 - RNA, 23 nt, Human
gagcuugcagugagcugagaucg

SEQ ID NO: 92376 - RNA, 23 nt, Human
gagcuugcagugagcugagaucg

SEQ ID NO: 92377 - RNA, 20 nt, Human
gaggguguccugggaacagg

SEQ ID NO: 92378 - RNA, 20 nt, Human
gaggguguccugggaacagg

SEQ ID NO: 92379 - RNA, 24 nt, Human
gcaaagaucaauaagguacaaaug

SEQ ID NO: 92380 - RNA, 24 nt, Human
gcaaagaucaauaagguacaaaug

SEQ ID NO: 92381 - RNA, 24 nt, Human
gcaaagaucaauaagguacaaaug

SEQ ID NO: 92382 - RNA, 21 nt, Human
gcacaggccgcuucuggacac

SEQ ID NO: 92383 - RNA, 21 nt, Human
gcacaggccgcuucuggacac

SEQ ID NO: 92384 - RNA, 18 nt, Human
gcaguccgugacucggug

SEQ ID NO: 92385 - RNA, 21 nt, Human
gcaucacucuccucgcaccca

SEQ ID NO: 92386 - RNA, 20 nt, Human
gccaaaagauaaugucuaca

SEQ ID NO: 92387 - RNA, 20 nt, Human
gccaaaagauaaugucuaca

SEQ ID NO: 92388 - RNA, 20 nt, Human
gccaaaagauaaugucuaca

SEQ ID NO: 92389 - RNA, 22 nt, Human
gccacugcccuccagccugggc

SEQ ID NO: 92390 - RNA, 22 nt, Human
gccacugcccuccagccugggc

SEQ ID NO: 92391 - RNA, 22 nt, Human
gccacugcccuccagccugggc

SEQ ID NO: 92392 - RNA, 24 nt, Human
gccacugcccuccagccugggcga

SEQ ID NO: 92393 - RNA, 24 nt, Human
gccacugcccuccagccugggcga

SEQ ID NO: 92394 - RNA, 23 nt, Human
gccgccauuucccgcuuuucccg

SEQ ID NO: 92395 - RNA, 21 nt, Human
gccuucucugaugcuccccac

SEQ ID NO: 92396 - RNA, 21 nt, Human
gccuucucugaugcuccccac

SEQ ID NO: 92397 - RNA, 21 nt, Human
gccuucucugaugcuccccac

SEQ ID NO: 92398 - RNA, 24 nt, Human
gcgacagagcgagacucugucuca

SEQ ID NO: 92399 - RNA, 24 nt, Human
gcgacagagcgagacucugucuca

SEQ ID NO: 92400 - RNA, 24 nt, Human
gcgacagagcgagacucugucuca

SEQ ID NO: 92401 - RNA, 20 nt, Human
gcgcaguggcucacgccugu

SEQ ID NO: 92402 - RNA, 20 nt, Human
gcgcaguggcucacgccugu

SEQ ID NO: 92403 - RNA, 20 nt, Human
gcgcaguggcucacgccugu

SEQ ID NO: 92404 - RNA, 20 nt, Human
gcgggcaccuguagucccag

SEQ ID NO: 92405 - RNA, 18 nt, Human
gcgucucuagucauguuu

SEQ ID NO: 92406 - RNA, 18 nt, Human
gcgucucuagucauguuu

SEQ ID NO: 92407 - RNA, 18 nt, Human
gcgucucuagucauguuu

SEQ ID NO: 92408 - RNA, 24 nt, Human
gcuaacauggugaaacccugucuc

SEQ ID NO: 92409 - RNA, 24 nt, Human
gcuaacauggugaaacccugucuc

SEQ ID NO: 92410 - RNA, 24 nt, Human
gcuaacauggugaaacccugucuc

SEQ ID NO: 92411 - RNA, 22 nt, Human
gcugaggcaggagaauggcgug

SEQ ID NO: 92412 - RNA, 22 nt, Human
gcugaggcaggagaauggcgug

SEQ ID NO: 92413 - RNA, 22 nt, Human
gcugaggcaggagaauggcgug

SEQ ID NO: 92414 - RNA, 23 nt, Human
ggaaaaagacagagaggugguua

SEQ ID NO: 92415 - RNA, 27 nt, Human
ggaaacacaccauucuuccuggccuuc

SEQ ID NO: 92416 - RNA, 27 nt, Human
ggaaacacaccauucuuccuggccuuc

SEQ ID NO: 92417 - RNA, 27 nt, Human
ggaaacacaccauucuuccuggccuuc

SEQ ID NO: 92418 - RNA, 19 nt, Human
ggagaguuuaauacugaaa

SEQ ID NO: 92419 - RNA, 19 nt, Human
ggagaguuuaauacugaaa

SEQ ID NO: 92420 - RNA, 19 nt, Human
ggagaguuuaauacugaaa

SEQ ID NO: 92421 - RNA, 18 nt, Human
ggagcuugcagugagcug

SEQ ID NO: 92422 - RNA, 18 nt, Human
ggagcuugcagugagcug

SEQ ID NO: 92423 - RNA, 18 nt, Human
ggagcuugcagugagcug

SEQ ID NO: 92424 - RNA, 20 nt, Human
ggagcuugcagugagcugag

SEQ ID NO: 92425 - RNA, 24 nt, Human
ggagcuugcagugagcugagaucg

SEQ ID NO: 92426 - RNA, 24 nt, Human
ggagcuugcagugagcugagaucg

SEQ ID NO: 92427 - RNA, 24 nt, Human
ggagcuugcagugagcugagaucg

SEQ ID NO: 92428 - RNA, 20 nt, Human
ggaggugacaucauguggga

SEQ ID NO: 92429 - RNA, 20 nt, Human
ggaggugacaucauguggga

SEQ ID NO: 92430 - RNA, 24 nt, Human
ggcaccuguagucccagcuacuug

SEQ ID NO: 92431 - RNA, 24 nt, Human
ggcaccuguagucccagcuacuug

SEQ ID NO: 92432 - RNA, 24 nt, Human
ggcaccuguagucccagcuacuug

SEQ ID NO: 92433 - RNA, 22 nt, Human
ggcacgguggcgggcaccugua

SEQ ID NO: 92434 - RNA, 22 nt, Human
ggcacgguggcgggcaccugua

SEQ ID NO: 92435 - RNA, 22 nt, Human
ggcacgguggcgggcaccugua

SEQ ID NO: 92436 - RNA, 21 nt, Human
ggcacugaaauaaaagccaca

SEQ ID NO: 92437 - RNA, 24 nt, Human
ggccacgaggccgagacugcaacc

SEQ ID NO: 92438 - RNA, 23 nt, Human
ggcgcaguggcucacgccuguaa

SEQ ID NO: 92439 - RNA, 23 nt, Human
ggcgcaguggcucacgccuguaa

SEQ ID NO: 92440 - RNA, 23 nt, Human
ggcgcaguggcucacgccuguaa

SEQ ID NO: 92441 - RNA, 21 nt, Human
ggcgggcaccuguagucccag

SEQ ID NO: 92442 - RNA, 21 nt, Human
ggcgggcaccuguagucccag

SEQ ID NO: 92443 - RNA, 21 nt, Human
gggaacagguagagguggccg

SEQ ID NO: 92444 - RNA, 26 nt, Human
gggaauaguaagggagagagauggac

SEQ ID NO: 92445 - RNA, 26 nt, Human
gggaauaguaagggagagagauggac

SEQ ID NO: 92446 - RNA, 22 nt, Human
gggcacaggaaacaagucuggg

SEQ ID NO: 92447 - RNA, 22 nt, Human
gggcacaggaaacaagucuggg

SEQ ID NO: 92448 - RNA, 22 nt, Human
gggcacaggaaacaagucuggg

SEQ ID NO: 92449 - RNA, 24 nt, Human
gggcgcaguggcucacgccuguaa

SEQ ID NO: 92450 - RNA, 24 nt, Human
ggguggaucaugaggucaggagau

SEQ ID NO: 92451 - RNA, 19 nt, Human
gguacaaaugcaaggcaau

SEQ ID NO: 92452 - RNA, 19 nt, Human
gguacaaaugcaaggcaau

SEQ ID NO: 92453 - RNA, 21 nt, Human
gguggaucaugaggucaggag

SEQ ID NO: 92454 - RNA, 21 nt, Human
gguggaucaugaggucaggag

SEQ ID NO: 92455 - RNA, 21 nt, Human
gguggaucaugaggucaggag

SEQ ID NO: 92456 - RNA, 23 nt, Human
gguggcgggcaccuguaguccca

SEQ ID NO: 92457 - RNA, 23 nt, Human
gguggcgggcaccuguaguccca

SEQ ID NO: 92458 - RNA, 23 nt, Human
gguggcgggcaccuguaguccca

SEQ ID NO: 92459 - RNA, 24 nt, Human
gguggcgggcaccuguagucccag

SEQ ID NO: 92460 - RNA, 24 nt, Human
gguggcgggcaccuguagucccag

SEQ ID NO: 92461 - RNA, 23 nt, Human
gguggguggaucaugaggucagg

SEQ ID NO: 92462 - RNA, 23 nt, Human
gguggguggaucaugaggucagg

SEQ ID NO: 92463 - RNA, 23 nt, Human
gguggguggaucaugaggucagg

SEQ ID NO: 92464 - RNA, 22 nt, Human
ggugugcagguaacugugcaaa

SEQ ID NO: 92465 - RNA, 22 nt, Human
gguuacagagucuagggaaaca

SEQ ID NO: 92466 - RNA, 22 nt, Human
gguuacagagucuagggaaaca

SEQ ID NO: 92467 - RNA, 21 nt, Human
gugaaacccugucucuacuaa

SEQ ID NO: 92468 - RNA, 21 nt, Human
gugaaacccugucucuacuaa

SEQ ID NO: 92469 - RNA, 25 nt, Human
guuucagauaagcagggauaaaggu

SEQ ID NO: 92470 - RNA, 19 nt, Human
uaaagugccaucuacaaaa

SEQ ID NO: 92471 - RNA, 19 nt, Human
uaaagugccaucuacaaaa

SEQ ID NO: 92472 - RNA, 19 nt, Human
uaaagugccaucuacaaaa

SEQ ID NO: 92473 - RNA, 22 nt, Human
uaacauggugaaacccugucuc

SEQ ID NO: 92474 - RNA, 22 nt, Human
uaacauggugaaacccugucuc

SEQ ID NO: 92475 - RNA, 22 nt, Human
uaacauggugaaacccugucuc

SEQ ID NO: 92476 - RNA, 24 nt, Human
uaacauggugaaacccugucucua

SEQ ID NO: 92477 - RNA, 24 nt, Human
uaacauggugaaacccugucucua

SEQ ID NO: 92478 - RNA, 24 nt, Human
uaacauggugaaacccugucucua

SEQ ID NO: 92479 - RNA, 18 nt, Human
uaccaggaaccucguuug

SEQ ID NO: 92480 - RNA, 18 nt, Human
uaccaggaaccucguuug

SEQ ID NO: 92481 - RNA, 23 nt, Human
uagucucaucuccacggcaggcc

SEQ ID NO: 92482 - RNA, 19 nt, Human
uaugaagcagggagauaag

SEQ ID NO: 92483 - RNA, 19 nt, Human
uaugaagcagggagauaag

SEQ ID NO: 92484 - RNA, 19 nt, Human
uaugaagcagggagauaag

SEQ ID NO: 92485 - RNA, 19 nt, Human
uaugccagcuggaagugug

SEQ ID NO: 92486 - RNA, 24 nt, Human
uauggcacugaaauaaaagccaca

SEQ ID NO: 92487 - RNA, 24 nt, Human
uauggcacugaaauaaaagccaca

SEQ ID NO: 92488 - RNA, 26 nt, Human
uauggcacugaaauaaaagccacaua

SEQ ID NO: 92489 - RNA, 26 nt, Human
uauggcacugaaauaaaagccacaua

SEQ ID NO: 92490 - RNA, 26 nt, Human
uauggcacugaaauaaaagccacaua

SEQ ID NO: 92491 - RNA, 22 nt, Human
ucaaaaaaaaaaaaaaaaaaaa

SEQ ID NO: 92492 - RNA, 22 nt, Human
ucaaaaaaaaaaaaaaaaaaaa

SEQ ID NO: 92493 - RNA, 23 nt, Human
ucaaaaaaaaaaaaaaaaaaaaa

SEQ ID NO: 92494 - RNA, 23 nt, Human
ucaaaaaaaaaaaaaaaaaaaaa

SEQ ID NO: 92495 - RNA, 23 nt, Human
ucaaaaaaaaaaaaaaaaaaaaa

SEQ ID NO: 92496 - RNA, 23 nt, Human
ucagacaucuuaacuaauguaau

SEQ ID NO: 92497 - RNA, 23 nt, Human
ucagacaucuuaacuaauguaau

SEQ ID NO: 92498 - RNA, 18 nt, Human
ucaggaaggaaaaagaca

SEQ ID NO: 92499 - RNA, 18 nt, Human
ucaggaaggaaaaagaca

SEQ ID NO: 92500 - RNA, 18 nt, Human
ucaggaaggaaaaagaca

SEQ ID NO: 92501 - RNA, 18 nt, Human
ucaugaggucaggagauc

SEQ ID NO: 92502 - RNA, 18 nt, Human
ucaugaggucaggagauc

SEQ ID NO: 92503 - RNA, 18 nt, Human
ucaugaggucaggagauc

SEQ ID NO: 92504 - RNA, 24 nt, Human
ucaugaggucaggagaucaagacc

SEQ ID NO: 92505 - RNA, 24 nt, Human
ucaugaggucaggagaucaagacc

SEQ ID NO: 92506 - RNA, 24 nt, Human
ucaugaggucaggagaucaagacc

SEQ ID NO: 92507 - RNA, 22 nt, Human
uccacggcaggccuggaugaag

SEQ ID NO: 92508 - RNA, 19 nt, Human
uccacuuggcguggaugau

SEQ ID NO: 92509 - RNA, 19 nt, Human
uccacuuggcguggaugau

SEQ ID NO: 92510 - RNA, 19 nt, Human
uccacuuggcguggaugau

SEQ ID NO: 92511 - RNA, 23 nt, Human
uccagccugggcgacagagcgag

SEQ ID NO: 92512 - RNA, 23 nt, Human
uccagccugggcgacagagcgag

SEQ ID NO: 92513 - RNA, 23 nt, Human
uccagccugggcgacagagcgag

SEQ ID NO: 92514 - RNA, 24 nt, Human
uccagccugggcgacagagcgaga

SEQ ID NO: 92515 - RNA, 24 nt, Human
uccagccugggcgacagagcgaga

SEQ ID NO: 92516 - RNA, 24 nt, Human
uccagccugggcgacagagcgaga

SEQ ID NO: 92517 - RNA, 22 nt, Human
ucccacacucaaaggcagagau

SEQ ID NO: 92518 - RNA, 27 nt, Human
ucccauccacaccauagauggcgcccu

SEQ ID NO: 92519 - RNA, 21 nt, Human
uccccauaaccacacuguguu

SEQ ID NO: 92520 - RNA, 21 nt, Human
uccccauaaccacacuguguu

SEQ ID NO: 92521 - RNA, 21 nt, Human
uccccauaaccacacuguguu

SEQ ID NO: 92522 - RNA, 24 nt, Human
uccgcugcgcaccgcccacagccc

SEQ ID NO: 92523 - RNA, 25 nt, Human
uccgcugcgcaccgcccacagccca

SEQ ID NO: 92524 - RNA, 21 nt, Human
ucgcacccaggggauccugcg

SEQ ID NO: 92525 - RNA, 21 nt, Human
ucgcacccaggggauccugcg

SEQ ID NO: 92526 - RNA, 20 nt, Human
ucgugccacugcccuccagc

SEQ ID NO: 92527 - RNA, 20 nt, Human
ucgugccacugcccuccagc

SEQ ID NO: 92528 - RNA, 20 nt, Human
ucgugccacugcccuccagc

SEQ ID NO: 92529 - RNA, 23 nt, Human
ucgugccacugcccuccagccug

SEQ ID NO: 92530 - RNA, 23 nt, Human
ucgugccacugcccuccagccug

SEQ ID NO: 92531 - RNA, 23 nt, Human
ucgugccacugcccuccagccug

SEQ ID NO: 92532 - RNA, 20 nt, Human
ucuccacggcaggccuggau

SEQ ID NO: 92533 - RNA, 19 nt, Human
ucuccgcugcgcaccgccc

SEQ ID NO: 92534 - RNA, 22 nt, Human
ucucuacuaaaaauacaaaaaa

SEQ ID NO: 92535 - RNA, 22 nt, Human
ucucuacuaaaaauacaaaaaa

SEQ ID NO: 92536 - RNA, 22 nt, Human
ucucuacuaaaaauacaaaaaa

SEQ ID NO: 92537 - RNA, 25 nt, Human
ucugcaguuucucuugcauuuccug

SEQ ID NO: 92538 - RNA, 23 nt, Human
ucuggacacugcagcaaggugcg

SEQ ID NO: 92539 - RNA, 23 nt, Human
ucuggacacugcagcaaggugcg

SEQ ID NO: 92540 - RNA, 23 nt, Human
ucuggacacugcagcaaggugcg

SEQ ID NO: 92541 - RNA, 23 nt, Human
ucugucucaaaaaaaaaaaaaaa

SEQ ID NO: 92542 - RNA, 23 nt, Human
ucugucucaaaaaaaaaaaaaaa

SEQ ID NO: 92543 - RNA, 23 nt, Human
ucugucucaaaaaaaaaaaaaaa

SEQ ID NO: 92544 - RNA, 20 nt, Human
ucuuugagacuuccaugggc

SEQ ID NO: 92545 - RNA, 20 nt, Human
ucuuugagacuuccaugggc

SEQ ID NO: 92546 - RNA, 20 nt, Human
ucuuugagacuuccaugggc

SEQ ID NO: 92547 - RNA, 20 nt, Human
ugaaaaaccucuuggagcug

SEQ ID NO: 92548 - RNA, 19 nt, Human
ugaagugcacauugcucaa

SEQ ID NO: 92549 - RNA, 24 nt, Human
ugagaucgugccacugcccuccag

SEQ ID NO: 92550 - RNA, 24 nt, Human
ugagaucgugccacugcccuccag

SEQ ID NO: 92551 - RNA, 22 nt, Human
ugagcugagaucgugccacugc

SEQ ID NO: 92552 - RNA, 22 nt, Human
ugagcugagaucgugccacugc

SEQ ID NO: 92553 - RNA, 22 nt, Human
ugagcugagaucgugccacugc

SEQ ID NO: 92554 - RNA, 23 nt, Human
ugaggcaggagaauggcgugaac

SEQ ID NO: 92555 - RNA, 23 nt, Human
ugaggcaggagaauggcgugaac

SEQ ID NO: 92556 - RNA, 24 nt, Human
ugaggcaggagaauggcgugaacc

SEQ ID NO: 92557 - RNA, 24 nt, Human
ugaggcaggagaauggcgugaacc

SEQ ID NO: 92558 - RNA, 24 nt, Human
ugaggcaggagaauggcgugaacc

SEQ ID NO: 92559 - RNA, 25 nt, Human
ugaggcaggagaauggcgugaaccc

SEQ ID NO: 92560 - RNA, 25 nt, Human
ugaggcaggagaauggcgugaaccc

SEQ ID NO: 92561 - RNA, 25 nt, Human
ugaggcaggagaauggcgugaaccc

SEQ ID NO: 92562 - RNA, 21 nt, Human
ugagguggguggaucaugagg

SEQ ID NO: 92563 - RNA, 21 nt, Human
ugagguggguggaucaugagg

SEQ ID NO: 92564 - RNA, 21 nt, Human
ugagguggguggaucaugagg

SEQ ID NO: 92565 - RNA, 22 nt, Human
ugagguggguggaucaugaggu

SEQ ID NO: 92566 - RNA, 22 nt, Human
ugagguggguggaucaugaggu

SEQ ID NO: 92567 - RNA, 22 nt, Human
ugagguggguggaucaugaggu

SEQ ID NO: 92568 - RNA, 24 nt, Human
ugagguggguggaucaugagguca

SEQ ID NO: 92569 - RNA, 24 nt, Human
ugagguggguggaucaugagguca

SEQ ID NO: 92570 - RNA, 24 nt, Human
ugagguggguggaucaugagguca

SEQ ID NO: 92571 - RNA, 19 nt, Human
ugauggggaggugacauca

SEQ ID NO: 92572 - RNA, 22 nt, Human
ugauggggaggugacaucaugu

SEQ ID NO: 92573 - RNA, 20 nt, Human
ugcauuuccugugcagucug

SEQ ID NO: 92574 - RNA, 20 nt, Human
ugccuugagcccaaacgagc

SEQ ID NO: 92575 - RNA, 20 nt, Human
ugccuugagcccaaacgagc

SEQ ID NO: 92576 - RNA, 20 nt, Human
ugccuugagcccaaacgagc

SEQ ID NO: 92577 - RNA, 20 nt, Human
uggaaggcugaggcaggaga

SEQ ID NO: 92578 - RNA, 20 nt, Human
uggaaggcugaggcaggaga

SEQ ID NO: 92579 - RNA, 20 nt, Human
uggaaggcugaggcaggaga

SEQ ID NO: 92580 - RNA, 20 nt, Human
uggaaggcugaggcaggaga

SEQ ID NO: 92581 - RNA, 20 nt, Human
uggaaggcugaggcaggaga

SEQ ID NO: 92582 - RNA, 20 nt, Human
uggaaggcugaggcaggaga

SEQ ID NO: 92583 - RNA, 19 nt, Human
uggagcuugcagugagcug

SEQ ID NO: 92584 - RNA, 19 nt, Human
uggagcuugcagugagcug

SEQ ID NO: 92585 - RNA, 19 nt, Human
uggagcuugcagugagcug

SEQ ID NO: 92586 - RNA, 22 nt, Human
uggcgggcaccuguagucccag

SEQ ID NO: 92587 - RNA, 22 nt, Human
uggcgggcaccuguagucccag

SEQ ID NO: 92588 - RNA, 21 nt, Human
uggcucacgccuguaauccca

SEQ ID NO: 92589 - RNA, 21 nt, Human
uggcucacgccuguaauccca

SEQ ID NO: 92590 - RNA, 21 nt, Human
uggcucacgccuguaauccca

SEQ ID NO: 92591 - RNA, 24 nt, Human
uggcucacgccuguaaucccaaca

SEQ ID NO: 92592 - RNA, 24 nt, Human
uggcucacgccuguaaucccaaca

SEQ ID NO: 92593 - RNA, 24 nt, Human
uggcucacgccuguaaucccaaca

SEQ ID NO: 92594 - RNA, 20 nt, Human
ugggaggcugaggugggugg

SEQ ID NO: 92595 - RNA, 20 nt, Human
ugggaggcugaggugggugg

SEQ ID NO: 92596 - RNA, 20 nt, Human
ugggaggcugaggugggugg

SEQ ID NO: 92597 - RNA, 23 nt, Human
ugggaggcugagguggguggauc

SEQ ID NO: 92598 - RNA, 23 nt, Human
ugggaggcugagguggguggauc

SEQ ID NO: 92599 - RNA, 23 nt, Human
ugggaggcugagguggguggauc

SEQ ID NO: 92600 - RNA, 24 nt, Human
ugggaggcugagguggguggauca

SEQ ID NO: 92601 - RNA, 24 nt, Human
ugggaggcugagguggguggauca

SEQ ID NO: 92602 - RNA, 24 nt, Human
ugggaggcugagguggguggauca

SEQ ID NO: 92603 - RNA, 23 nt, Human
uggggaggugacaucauguggga

SEQ ID NO: 92604 - RNA, 23 nt, Human
uggggaggugacaucauguggga

SEQ ID NO: 92605 - RNA, 19 nt, Human
ugguccacauccccuccag

SEQ ID NO: 92606 - RNA, 20 nt, Human
uguccugggaacagguagag

SEQ ID NO: 92607 - RNA, 20 nt, Human
uguccugggaacagguagag

SEQ ID NO: 92608 - RNA, 18 nt, Human
ugugcaaaauucugcagu

SEQ ID NO: 92609 - RNA, 20 nt, Human
ugugcuggaagguggaccaa

SEQ ID NO: 92610 - RNA, 21 nt, Human
ugugguccacauccccuccag

SEQ ID NO: 92611 - RNA, 21 nt, Human
uuaccggcaucacucuccucg

SEQ ID NO: 92612 - RNA, 21 nt, Human
uuaccggcaucacucuccucg

SEQ ID NO: 92613 - RNA, 23 nt, Human
uuauaugcccucuccccauaacc

SEQ ID NO: 92614 - RNA, 23 nt, Human
uuauaugcccucuccccauaacc

SEQ ID NO: 92615 - RNA, 21 nt, Human
uucacagaaaaggagcuggcc

SEQ ID NO: 92616 - RNA, 21 nt, Human
uucacagaaaaggagcuggcc

SEQ ID NO: 92617 - RNA, 21 nt, Human
uucacagaaaaggagcuggcc

SEQ ID NO: 92618 - RNA, 22 nt, Human
uucccgggcucuccgcugcgca

SEQ ID NO: 92619 - RNA, 23 nt, Human
uucugcaguuucucuugcauuuc

SEQ ID NO: 92620 - RNA, 18 nt, Human
uugcagugagcugagauc

SEQ ID NO: 92621 - RNA, 18 nt, Human
uugcagugagcugagauc

SEQ ID NO: 92622 - RNA, 21 nt, Human
uugcagugagcugagaucgug

SEQ ID NO: 92623 - RNA, 21 nt, Human
uugcagugagcugagaucgug

SEQ ID NO: 92624 - RNA, 21 nt, Human
uugcagugagcugagaucgug

SEQ ID NO: 92625 - RNA, 22 nt, Human
uugcagugagcugagaucgugc

SEQ ID NO: 92626 - RNA, 22 nt, Human
uugcagugagcugagaucgugc

SEQ ID NO: 92627 - RNA, 22 nt, Human
uugcagugagcugagaucgugc

SEQ ID NO: 92628 - RNA, 25 nt, Human
uugggaggcugagguggguggauca

SEQ ID NO: 92629 - RNA, 25 nt, Human
uugggaggcugagguggguggauca

SEQ ID NO: 92630 - RNA, 25 nt, Human
uugggaggcugagguggguggauca

SEQ ID NO: 92631 - RNA, 26 nt, Human
uuggucaaccccacgauuagucucau

SEQ ID NO: 92632 - RNA, 19 nt, Human
uuucccgcuuuucccgggc

SEQ ID NO: 92633 - RNA, 21 nt, Human
uuucccgggcucuccgcugcg

SEQ ID NO: 92634 - RNA, 23 nt, Human
uuucccgggcucuccgcugcgca

SEQ ID NO: 92635 - RNA, 18 nt, Human
uuuuuuuuuaaaaaaagg

SEQ ID NO: 92636 - RNA, 22 nt, Human
uuuuuuuuuuaaaaaaaggucu

SEQ ID NO: 92637 - RNA, 22 nt, Human
uuuuuuuuuuaaaaaaaggucu

SEQ ID NO: 92638 - RNA, 23 nt, Human
uuuuuuuuuuuuaaaaaaagguc

SEQ ID NO: 92639 - RNA, 23 nt, Human
uuuuuuuuuuuuaaaaaaagguc

SEQ ID NO: 92640 - RNA, 23 nt, Human
uuuuuuuuuuuuaaaaaaagguc

SEQ ID NO: 92641 - RNA, 18 nt, Human
aaaaaaccaccaaccaac

SEQ ID NO: 92642 - RNA, 23 nt, Human
aaauaacauacuuaagaauuuug

SEQ ID NO: 92643 - RNA, 21 nt, Human
aacaucacaaaaccauaaucc

SEQ ID NO: 92644 - RNA, 23 nt, Human
aaccgccucacaauagcacccau

SEQ ID NO: 92645 - RNA, 24 nt, Human
aaguacccucugcagcaugagagu

SEQ ID NO: 92646 - RNA, 18 nt, Human
aaguucuuccacaucauc

SEQ ID NO: 92647 - RNA, 19 nt, Human
acaaacuaaaaaaaaccac

SEQ ID NO: 92648 - RNA, 19 nt, Human
acagaaaauaacauacuua

SEQ ID NO: 92649 - RNA, 20 nt, Human
acagucuuaaguggggggaa

SEQ ID NO: 92650 - RNA, 18 nt, Human
acaguuaaaacuccaccc

SEQ ID NO: 92651 - RNA, 21 nt, Human
accgaaaaccagagcgccgag

SEQ ID NO: 92652 - RNA, 21 nt, Human
acuaaaaaaaaccaccaacca

SEQ ID NO: 92653 - RNA, 22 nt, Human
acuaaaaaaaaccaccaaccaa

SEQ ID NO: 92654 - RNA, 19 nt, Human
agaaaaaagaaacugucau

SEQ ID NO: 92655 - RNA, 23 nt, Human
agaggcaggugcagggcacaccc

SEQ ID NO: 92656 - RNA, 24 nt, Human
agaguccuaugugcucauaggucu

SEQ ID NO: 92657 - RNA, 20 nt, Human
aggacaaacaucacaaaacc

SEQ ID NO: 92658 - RNA, 26 nt, Human
aggacaaacaucacaaaaccauaauc

SEQ ID NO: 92659 - RNA, 18 nt, Human
agggcacacccaccgaaa

SEQ ID NO: 92660 - RNA, 24 nt, Human
auagaaacacacuuuaagauacca

SEQ ID NO: 92661 - RNA, 25 nt, Human
auaucauaaaaauucauuacuucaa

SEQ ID NO: 92662 - RNA, 21 nt, Human
aucacaaaaccauaaucccag

SEQ ID NO: 92663 - RNA, 23 nt, Human
auccacacauaccagugcguaug

SEQ ID NO: 92664 - RNA, 20 nt, Human
caaguuucugauuugcuuca

SEQ ID NO: 92665 - RNA, 21 nt, Human
cacaaaaccauaaucccagau

SEQ ID NO: 92666 - RNA, 24 nt, Human
cacaaaaccauaaucccagauaaa

SEQ ID NO: 92667 - RNA, 19 nt, Human
cacagguaugagcugcgag

SEQ ID NO: 92668 - RNA, 25 nt, Human
cacagguaugagcugcgagcacuca

SEQ ID NO: 92669 - RNA, 18 nt, Human
caggcucaaaccaucuac

SEQ ID NO: 92670 - RNA, 19 nt, Human
cagggcucgcuaacuccuc

SEQ ID NO: 92671 - RNA, 24 nt, Human
cauccacacauaccagugcguaug

SEQ ID NO: 92672 - RNA, 23 nt, Human
cauuuccacuucacaaguuucug

SEQ ID NO: 92673 - RNA, 24 nt, Human
cauuuccacuucacaaguuucuga

SEQ ID NO: 92674 - RNA, 24 nt, Human
ccagauaaauggucuaaaaugcag

SEQ ID NO: 92675 - RNA, 25 nt, Human
ccaugcccacagaugccuaaguucu

SEQ ID NO: 92676 - RNA, 18 nt, Human
ccgagugugagcagggcu

SEQ ID NO: 92677 - RNA, 19 nt, Human
ccgcaccugcugaggccug

SEQ ID NO: 92678 - RNA, 22 nt, Human
ccucccgggcugagugcucagc

SEQ ID NO: 92679 - RNA, 20 nt, Human
ccuuuauuaaugagaauggg

SEQ ID NO: 92680 - RNA, 20 nt, Human
cgggcugagugcucagcucu

SEQ ID NO: 92681 - RNA, 21 nt, Human
cgucuagaguccuaugugcuc

SEQ ID NO: 92682 - RNA, 20 nt, Human
cuaugugcucauaggucuuu

SEQ ID NO: 92683 - RNA, 20 nt, Human
cucagcucuggccuccggcc

SEQ ID NO: 92684 - RNA, 21 nt, Human
cuccgcaccugcugaggccug

SEQ ID NO: 92685 - RNA, 24 nt, Human
cucgcuaacuccucacggccuggg

SEQ ID NO: 92686 - RNA, 21 nt, Human
cuuaaaguacccucugcagca

SEQ ID NO: 92687 - RNA, 22 nt, Human
cuuacaguuaaaacuccacccc

SEQ ID NO: 92688 - RNA, 24 nt, Human
gacaaacaucacaaaaccauaauc

SEQ ID NO: 92689 - RNA, 19 nt, Human
gagccuuugaccaugccca

SEQ ID NO: 92690 - RNA, 19 nt, Human
gcugagucaugucucugcu

SEQ ID NO: 92691 - RNA, 18 nt, Human
ggauuucaaggcgacgcc

SEQ ID NO: 92692 - RNA, 21 nt, Human
gggcacacccaccgaaaacca

SEQ ID NO: 92693 - RNA, 23 nt, Human
gggggaagaggcaggugcagggc

SEQ ID NO: 92694 - RNA, 23 nt, Human
ggugcagugacggcuccgcaccu

SEQ ID NO: 92695 - RNA, 22 nt, Human
guaggucaaaaugagagggaaa

SEQ ID NO: 92696 - RNA, 19 nt, Human
gugcagugacggcuccgca

SEQ ID NO: 92697 - RNA, 23 nt, Human
uaaaaaaaaccaccaaccaacca

SEQ ID NO: 92698 - RNA, 19 nt, Human
uaacuuuuucacaauuacu

SEQ ID NO: 92699 - RNA, 19 nt, Human
uaauucaauugcaacuacc

SEQ ID NO: 92700 - RNA, 19 nt, Human
uacaguuaaaacuccaccc

SEQ ID NO: 92701 - RNA, 22 nt, Human
uacaguuaaaacuccaccccuc

SEQ ID NO: 92702 - RNA, 23 nt, Human
uaccaaauauaccaucuucucac

SEQ ID NO: 92703 - RNA, 18 nt, Human
uacuugaaaauucauagc

SEQ ID NO: 92704 - RNA, 21 nt, Human
uagaauacacagucuuaagug

SEQ ID NO: 92705 - RNA, 20 nt, Human
uaucauaaaaauucauuacu

SEQ ID NO: 92706 - RNA, 23 nt, Human
uauuuaugcugguagauccaggg

SEQ ID NO: 92707 - RNA, 21 nt, Human
ucaaaaugagagggaaauaca

SEQ ID NO: 92708 - RNA, 28 nt, Human
ucagcccauucauuuauugcuuuccuua

SEQ ID NO: 92709 - RNA, 22 nt, Human
ucccgggcugagugcucagcuc

SEQ ID NO: 92710 - RNA, 23 nt, Human
ucucacuuggcauacaaacuaaa

SEQ ID NO: 92711 - RNA, 18 nt, Human
ugagagggaaauacagua

SEQ ID NO: 92712 - RNA, 22 nt, Human
ugagccuuugaccaugcccaca

SEQ ID NO: 92713 - RNA, 22 nt, Human
ugauggaaggaguaugucuuaa

SEQ ID NO: 92714 - RNA, 18 nt, Human
ugauuugcuucacuuucu

SEQ ID NO: 92715 - RNA, 27 nt, Human
ugccucaccaccuuuagaacauuucca

SEQ ID NO: 92716 - RNA, 18 nt, Human
ugcucagcucuggccucc

SEQ ID NO: 92717 - RNA, 20 nt, Human
ugcugguagauccaggggca

SEQ ID NO: 92718 - RNA, 23 nt, Human
ugguagauccaggggcauuguag

SEQ ID NO: 92719 - RNA, 22 nt, Human
uguacaaaauugucacauagaa

SEQ ID NO: 92720 - RNA, 21 nt, Human
uguaggcccuuccugcguggu

SEQ ID NO: 92721 - RNA, 18 nt, Human
ugugagcagggcucgcua

SEQ ID NO: 92722 - RNA, 24 nt, Human
uuaguuugcucacacuuucucuca

SEQ ID NO: 92723 - RNA, 20 nt, Human
uuauucacauuaccuggcua

SEQ ID NO: 92724 - RNA, 20 nt, Human
uucacaaguuucugauuugc

SEQ ID NO: 92725 - RNA, 22 nt, Human
uuuaugcugguagauccagggg

SEQ ID NO: 92726 - RNA, 21 nt, Human
uuuauuaacuucuacaaccgc

SEQ ID NO: 92727 - RNA, 22 nt, Human
uuugagccuuugaccaugccca

SEQ ID NO: 92728 - RNA, 19 nt, Human
aaauguuaaauaugcaagc

SEQ ID NO: 92729 - RNA, 21 nt, Human
aacaggugagaucacaaaggc

SEQ ID NO: 92730 - RNA, 18 nt, Human
auguuaaaaaagguuuga

SEQ ID NO: 92731 - RNA, 25 nt, Human
caggugagaucacaaaggcuucugc

SEQ ID NO: 92732 - RNA, 24 nt, Human
cauuuuguuccaccaaguuaucca

SEQ ID NO: 92733 - RNA, 24 nt, Human
cauuuuguuccaccaaguuaucca

SEQ ID NO: 92734 - RNA, 24 nt, Human
ccucugugacccaauuuaucaccu

SEQ ID NO: 92735 - RNA, 23 nt, Human
ccugccauacguugcuucucuug

SEQ ID NO: 92736 - RNA, 24 nt, Human
cugacaguuggugaagagcuucuu

SEQ ID NO: 92737 - RNA, 24 nt, Human
cuuugcccagggauuccaacaccu

SEQ ID NO: 92738 - RNA, 18 nt, Human
gagcuucuuaaaagaaug

SEQ ID NO: 92739 - RNA, 19 nt, Human
ggcucagaaaacauuagug

SEQ ID NO: 92740 - RNA, 22 nt, Human
uagggaacagccucuguccuuu

SEQ ID NO: 92741 - RNA, 19 nt, Human
uauguuaaaaaagguuuga

SEQ ID NO: 92742 - RNA, 18 nt, Human
uauuucuuuuuuuccucu

SEQ ID NO: 92743 - RNA, 18 nt, Human
uauuucuuuuuuuccucu

SEQ ID NO: 92744 - RNA, 22 nt, Human
ucugccucugugacccaauuua

SEQ ID NO: 92745 - RNA, 21 nt, Human
ugaggaaaucuuugcccaggg

SEQ ID NO: 92746 - RNA, 21 nt, Human
ugaggaaaucuuugcccaggg

SEQ ID NO: 92747 - RNA, 21 nt, Human
ugauuucugccucugugaccc

SEQ ID NO: 92748 - RNA, 19 nt, Human
ugcccagggauuccaacac

SEQ ID NO: 92749 - RNA, 19 nt, Human
ugcccagggauuccaacac

SEQ ID NO: 92750 - RNA, 20 nt, Human
uuaaauaugcaagcuguacu

SEQ ID NO: 92751 - RNA, 25 nt, Human
uucugugguugccuucugccauagg

SEQ ID NO: 92752 - RNA, 22 nt, Human
uucuuuuuuuccucuuccuucc

SEQ ID NO: 92753 - RNA, 19 nt, Human
uugccuucugacaguuggu

SEQ ID NO: 92754 - RNA, 24 nt, Human
uuucuuuuuuuccucuuccuuccc

SEQ ID NO: 92755 - RNA, 23 nt, Human
uuugcccagggauuccaacaccu

SEQ ID NO: 92756 - RNA, 22 nt, Human
uuuucugugguugccuucugac

SEQ ID NO: 92757 - RNA, 23 nt, Human
acagaggagggcugggcugccug

SEQ ID NO: 92758 - RNA, 19 nt, Human
agaggagggcugggcugcc

SEQ ID NO: 92759 - RNA, 20 nt, Human
ucuuugauguugacagagga

SEQ ID NO: 92760 - RNA, 24 nt, Human
ucuuugauguugacagaggagggc

SEQ ID NO: 92761 - RNA, 18 nt, Human
ugacagaggagggcuggg

SEQ ID NO: 92762 - RNA, 19 nt, Human
ugacagaggagggcugggc

SEQ ID NO: 92763 - RNA, 24 nt, Human
aaacauuugaaucauuagaccaua

SEQ ID NO: 92764 - RNA, 24 nt, Human
aaagugcugggauuacagguguga

SEQ ID NO: 92765 - RNA, 22 nt, Human
aaguagcugggauugcaggcau

SEQ ID NO: 92766 - RNA, 24 nt, Human
aaguagcugggauugcaggcaugc

SEQ ID NO: 92767 - RNA, 18 nt, Human
aagugcugggauuacagg

SEQ ID NO: 92768 - RNA, 19 nt, Human
aagugcugggauuacaggu

SEQ ID NO: 92769 - RNA, 25 nt, Human
acaugaacuuuuuuuuuuuuuuuuu

SEQ ID NO: 92770 - RNA, 23 nt, Human
acauuuucuuuuuuuugagacgg

SEQ ID NO: 92771 - RNA, 23 nt, Human
acggaguuucacucguugcccag

SEQ ID NO: 92772 - RNA, 24 nt, Human
acggggcuucuccauguuggucag

SEQ ID NO: 92773 - RNA, 25 nt, Human
acucguugcccaggcuggagugcaa

SEQ ID NO: 92774 - RNA, 18 nt, Human
aggaagagaaagacauuu

SEQ ID NO: 92775 - RNA, 22 nt, Human
aggaagagaaagacauuuucuu

SEQ ID NO: 92776 - RNA, 19 nt, Human
aggauuuuguuucuccaua

SEQ ID NO: 92777 - RNA, 24 nt, Human
aggugauccgcccaccuuggacuc

SEQ ID NO: 92778 - RNA, 24 nt, Human
agugauucuccugccucagccuuc

SEQ ID NO: 92779 - RNA, 20 nt, Human
agugcaauggcgcaaucucg

SEQ ID NO: 92780 - RNA, 24 nt, Human
agugcaauggcgcaaucucggcuc

SEQ ID NO: 92781 - RNA, 24 nt, Human
auuacaggugugaguaaccacgcc

SEQ ID NO: 92782 - RNA, 24 nt, Human
caaagugcugggauuacaggugug

SEQ ID NO: 92783 - RNA, 20 nt, Human
caagugauucuccugccuca

SEQ ID NO: 92784 - RNA, 22 nt, Human
caagugauucuccugccucagc

SEQ ID NO: 92785 - RNA, 18 nt, Human
caccuugcccuccucuuc

SEQ ID NO: 92786 - RNA, 21 nt, Human
caccuugcccuccucuuccug

SEQ ID NO: 92787 - RNA, 21 nt, Human
cacucguugcccaggcuggag

SEQ ID NO: 92788 - RNA, 23 nt, Human
cagccuccaccuccuggguucaa

SEQ ID NO: 92789 - RNA, 20 nt, Human
caggcaugcgccgccaugcc

SEQ ID NO: 92790 - RNA, 21 nt, Human
caggcucccgggcccggcccc

SEQ ID NO: 92791 - RNA, 19 nt, Human
cauaucaaacccuuucacc

SEQ ID NO: 92792 - RNA, 26 nt, Human
cauuagaccauaaugcuucacccuaa

SEQ ID NO: 92793 - RNA, 21 nt, Human
ccaaagugcugggauuacagg

SEQ ID NO: 92794 - RNA, 21 nt, Human
ccaaagugcugggauuacagg

SEQ ID NO: 92795 - RNA, 24 nt, Human
ccaaagugcugggauuacaggugu

SEQ ID NO: 92796 - RNA, 22 nt, Human
ccaaguagcugggauugcaggc

SEQ ID NO: 92797 - RNA, 24 nt, Human
ccaaguagcugggauugcaggcau

SEQ ID NO: 92798 - RNA, 24 nt, Human
ccaccuccuggguucaagugauuc

SEQ ID NO: 92799 - RNA, 19 nt, Human
ccauguuggucaggcuggu

SEQ ID NO: 92800 - RNA, 22 nt, Human
ccauguuggucaggcuggucuc

SEQ ID NO: 92801 - RNA, 23 nt, Human
ccauguuggucaggcuggucucg

SEQ ID NO: 92802 - RNA, 19 nt, Human
cccaccuuggacucccaaa

SEQ ID NO: 92803 - RNA, 18 nt, Human
cccaggcuggagugcaau

SEQ ID NO: 92804 - RNA, 24 nt, Human
cccgaccucaggugauccgcccac

SEQ ID NO: 92805 - RNA, 19 nt, Human
cccgggcccggccccgccc

SEQ ID NO: 92806 - RNA, 18 nt, Human
ccgcagccuccaccuccu

SEQ ID NO: 92807 - RNA, 23 nt, Human
ccgcagccuccaccuccuggguu

SEQ ID NO: 92808 - RNA, 24 nt, Human
ccgcagccuccaccuccuggguuc

SEQ ID NO: 92809 - RNA, 18 nt, Human
ccgggcccggccccgccc

SEQ ID NO: 92810 - RNA, 22 nt, Human
ccuccaccuccuggguucaagu

SEQ ID NO: 92811 - RNA, 21 nt, Human
ccuccuggguucaagugauuc

SEQ ID NO: 92812 - RNA, 24 nt, Human
ccuccuggguucaagugauucucc

SEQ ID NO: 92813 - RNA, 23 nt, Human
ccugccucagccuuccaaguagc

SEQ ID NO: 92814 - RNA, 24 nt, Human
ccugccucagccuuccaaguagcu

SEQ ID NO: 92815 - RNA, 23 nt, Human
ccuggguucaagugauucuccuc

SEQ ID NO: 92816 - RNA, 23 nt, Human
ccuggguucaagugauucuccug

SEQ ID NO: 92817 - RNA, 18 nt, Human
ccuugcccuccucuuccu

SEQ ID NO: 92818 - RNA, 18 nt, Human
cgaccucaggugauccgc

SEQ ID NO: 92819 - RNA, 20 nt, Human
cgcgcagccagacaccuugc

SEQ ID NO: 92820 - RNA, 23 nt, Human
cggaguuucacucguugcccagg

SEQ ID NO: 92821 - RNA, 24 nt, Human
cggggcuucuccauguuggucagg

SEQ ID NO: 92822 - RNA, 20 nt, Human
cguugcccaggcuggagugc

SEQ ID NO: 92823 - RNA, 24 nt, Human
cucagccuuccaaguagcugggau

SEQ ID NO: 92824 - RNA, 24 nt, Human
cuccauguuggucaggcuggucuc

SEQ ID NO: 92825 - RNA, 19 nt, Human
cucccgggcccggccccgc

SEQ ID NO: 92826 - RNA, 20 nt, Human
cuccuggguucaagugauuc

SEQ ID NO: 92827 - RNA, 21 nt, Human
cuccuggguucaagugauucu

SEQ ID NO: 92828 - RNA, 24 nt, Human
cucguugcccaggcuggagugcaa

SEQ ID NO: 92829 - RNA, 18 nt, Human
cugaagccacaggcuccc

SEQ ID NO: 92830 - RNA, 23 nt, Human
cugccucagccuuccaaguagcu

SEQ ID NO: 92831 - RNA, 22 nt, Human
cuuuuuuuuuuuuuuuuuaagg

SEQ ID NO: 92832 - RNA, 20 nt, Human
gaacuuuuuuuuuuuuuuuu

SEQ ID NO: 92833 - RNA, 23 nt, Human
gaccucaggugauccgcccaccu

SEQ ID NO: 92834 - RNA, 23 nt, Human
gagacggggcuucuccauguugg

SEQ ID NO: 92835 - RNA, 19 nt, Human
gauuacaggugugaguaac

SEQ ID NO: 92836 - RNA, 22 nt, Human
gauugcaggcaugcgccgccau

SEQ ID NO: 92837 - RNA, 24 nt, Human
gauugcaggcaugcgccgccaugc

SEQ ID NO: 92838 - RNA, 19 nt, Human
gcccaggcuggagugcaau

SEQ ID NO: 92839 - RNA, 25 nt, Human
gcuaaauuuuuuuuugcauuuuuag

SEQ ID NO: 92840 - RNA, 19 nt, Human
gcuggagugcaauggcgca

SEQ ID NO: 92841 - RNA, 23 nt, Human
gcuggucucgaacucccgaccuc

SEQ ID NO: 92842 - RNA, 22 nt, Human
ggaguuucacucguugcccagg

SEQ ID NO: 92843 - RNA, 22 nt, Human
gggcuucuccauguuggucagg

SEQ ID NO: 92844 - RNA, 23 nt, Human
guagagacggggcuucuccaugu

SEQ ID NO: 92845 - RNA, 18 nt, Human
guagcugggauugcaggc

SEQ ID NO: 92846 - RNA, 24 nt, Human
gugauucuccugccucagccuucc

SEQ ID NO: 92847 - RNA, 24 nt, Human
guuucacucguugcccaggcugga

SEQ ID NO: 92848 - RNA, 24 nt, Human
uaguagagacggggcuucuccaug

SEQ ID NO: 92849 - RNA, 19 nt, Human
ucaagugauucuccugccu

SEQ ID NO: 92850 - RNA, 24 nt, Human
ucaccgcagccuccaccuccuggg

SEQ ID NO: 92851 - RNA, 27 nt, Human
ucaccgcagccuccaccuccuggguuc

SEQ ID NO: 92852 - RNA, 19 nt, Human
ucacucguugcccaggcug

SEQ ID NO: 92853 - RNA, 21 nt, Human
ucacucguugcccaggcugga

SEQ ID NO: 92854 - RNA, 23 nt, Human
uccaaguagcugggauugcaggc

SEQ ID NO: 92855 - RNA, 24 nt, Human
uccaaguagcugggauugcaggca

SEQ ID NO: 92856 - RNA, 24 nt, Human
uccauguuggucaggcuggucucg

SEQ ID NO: 92857 - RNA, 23 nt, Human
ucccaaagugcugggauuacagg

SEQ ID NO: 92858 - RNA, 20 nt, Human
ucccgggcccggccccgccc

SEQ ID NO: 92859 - RNA, 24 nt, Human
uccugaagccacaggcucccgggc

SEQ ID NO: 92860 - RNA, 21 nt, Human
uccuggguucaagugauucuc

SEQ ID NO: 92861 - RNA, 24 nt, Human
uccuggguucaagugauucuccug

SEQ ID NO: 92862 - RNA, 23 nt, Human
ucuccauaucaaacccuuucacc

SEQ ID NO: 92863 - RNA, 24 nt, Human
ucuccauaucaaacccuuucacca

SEQ ID NO: 92864 - RNA, 26 nt, Human
ucuccugccucagccuuccaaguagc

SEQ ID NO: 92865 - RNA, 18 nt, Human
ucuuuuuuuugagacgga

SEQ ID NO: 92866 - RNA, 24 nt, Human
ugauccgcccaccuuggacuccca

SEQ ID NO: 92867 - RNA, 20 nt, Human
ugauucuccugccucagccu

SEQ ID NO: 92868 - RNA, 23 nt, Human
ugcaauggcgcaaucucggcuca

SEQ ID NO: 92869 - RNA, 26 nt, Human
ugcagccaaacgcgcagccagacacc

SEQ ID NO: 92870 - RNA, 18 nt, Human
ugcccaggcuggagugca

SEQ ID NO: 92871 - RNA, 21 nt, Human
ugcccaggcuggagugcaaug

SEQ ID NO: 92872 - RNA, 21 nt, Human
ugcccaggcuggagugcaaug

SEQ ID NO: 92873 - RNA, 24 nt, Human
ugcccaggcuggagugcaauggcg

SEQ ID NO: 92874 - RNA, 24 nt, Human
ugccucagccuuccaaguagcugg

SEQ ID NO: 92875 - RNA, 20 nt, Human
ugcugggauuacagguguga

SEQ ID NO: 92876 - RNA, 23 nt, Human
uggagugcaauggcgcaaucucg

SEQ ID NO: 92877 - RNA, 24 nt, Human
uggagugcaauggcgcaaucucgg

SEQ ID NO: 92878 - RNA, 18 nt, Human
ugggauuacaggugugag

SEQ ID NO: 92879 - RNA, 18 nt, Human
ugggauuacaggugugag

SEQ ID NO: 92880 - RNA, 19 nt, Human
ugggauuacaggugugagu

SEQ ID NO: 92881 - RNA, 22 nt, Human
ugggauuacaggugugaguaac

SEQ ID NO: 92882 - RNA, 24 nt, Human
ugggauuacaggugugaguaacca

SEQ ID NO: 92883 - RNA, 18 nt, Human
ugggauugcaggcaugcg

SEQ ID NO: 92884 - RNA, 20 nt, Human
ugggauugcaggcaugcgcc

SEQ ID NO: 92885 - RNA, 21 nt, Human
ugggauugcaggcaugcgccg

SEQ ID NO: 92886 - RNA, 24 nt, Human
ugggauugcaggcaugcgccgcca

SEQ ID NO: 92887 - RNA, 23 nt, Human
uggguucaagugauucuccugcc

SEQ ID NO: 92888 - RNA, 24 nt, Human
uggguucaagugauucuccugccu

SEQ ID NO: 92889 - RNA, 23 nt, Human
uggucaggcuggucucgaacucc

SEQ ID NO: 92890 - RNA, 19 nt, Human
uggucucgaacucccgacc

SEQ ID NO: 92891 - RNA, 25 nt, Human
uguuucuccauaucaaacccuuuca

SEQ ID NO: 92892 - RNA, 18 nt, Human
uuaguagagacggggcuu

SEQ ID NO: 92893 - RNA, 24 nt, Human
uuaguagagacggggcuucuccau

SEQ ID NO: 92894 - RNA, 21 nt, Human
uucaagugauucuccugccuc

SEQ ID NO: 92895 - RNA, 23 nt, Human
uucaagugauucuccugccucag

SEQ ID NO: 92896 - RNA, 24 nt, Human
uucaagugauucuccugccucagc

SEQ ID NO: 92897 - RNA, 22 nt, Human
uucacucguugcccaggcugga

SEQ ID NO: 92898 - RNA, 24 nt, Human
uucacucguugcccaggcuggagu

SEQ ID NO: 92899 - RNA, 22 nt, Human
uuccugaagccacaggcucccg

SEQ ID NO: 92900 - RNA, 25 nt, Human
uuccugaagccacaggcucccgggc

SEQ ID NO: 92901 - RNA, 18 nt, Human
uugcccaggcuggagugc

SEQ ID NO: 92902 - RNA, 19 nt, Human
uuggacucccaaagugcug

SEQ ID NO: 92903 - RNA, 21 nt, Human
uuucacucguugcccaggcug

SEQ ID NO: 92904 - RNA, 22 nt, Human
uuucacucguugcccaggcugg

SEQ ID NO: 92905 - RNA, 23 nt, Human
uuucacucguugcccaggcugga

SEQ ID NO: 92906 - RNA, 26 nt, Human
uuucuuuuuuuugagacggaguuuca

SEQ ID NO: 92907 - RNA, 19 nt, Human
uuuuuaguagagacggggc

SEQ ID NO: 92908 - RNA, 21 nt, Human
uuuuuugcauuuuuaguagag

SEQ ID NO: 92909 - RNA, 24 nt, Human
uuuuuugcauuuuuaguagagacg

SEQ ID NO: 92910 - RNA, 20 nt, Human
aacaaaagacagcaccagaa

SEQ ID NO: 92911 - RNA, 20 nt, Human
aacaaaagacagcaccagaa

SEQ ID NO: 92912 - RNA, 22 nt, Human
aacauaagaagcacaaauccca

SEQ ID NO: 92913 - RNA, 22 nt, Human
aagaagcacaaaucccacugcu

SEQ ID NO: 92914 - RNA, 19 nt, Human
aagagcccaaagcgacccg

SEQ ID NO: 92915 - RNA, 21 nt, Human
aagagcccaaagcgacccgug

SEQ ID NO: 92916 - RNA, 19 nt, Human
aagcgacccguguccccgc

SEQ ID NO: 92917 - RNA, 21 nt, Human
aagcuggccgcgcgcucugcc

SEQ ID NO: 92918 - RNA, 22 nt, Human
aaggugcugguggaagauguga

SEQ ID NO: 92919 - RNA, 22 nt, Human
aaggugcugguggaagauguga

SEQ ID NO: 92920 - RNA, 24 nt, Human
aaguaacaaauauuuacucaaaau

SEQ ID NO: 92921 - RNA, 24 nt, Human
aaguaacaaauauuuacucaaaau

SEQ ID NO: 92922 - RNA, 27 nt, Human
aagugccaaaaaucuuugccauaaacu

SEQ ID NO: 92923 - RNA, 27 nt, Human
aagugccaaaaaucuuugccauaaacu

SEQ ID NO: 92924 - RNA, 23 nt, Human
acacaggaaaccaaaccucuucc

SEQ ID NO: 92925 - RNA, 23 nt, Human
acacaggaaaccaaaccucuucc

SEQ ID NO: 92926 - RNA, 24 nt, Human
acacucaauacccacauucugcaa

SEQ ID NO: 92927 - RNA, 24 nt, Human
acacucaauacccacauucugcaa

SEQ ID NO: 92928 - RNA, 22 nt, Human
acagucaccaaaugaauaacau

SEQ ID NO: 92929 - RNA, 18 nt, Human
accacacaggggaucugc

SEQ ID NO: 92930 - RNA, 21 nt, Human
acuacuggacacaggaaacca

SEQ ID NO: 92931 - RNA, 20 nt, Human
acuauuaggcagaaaaaaac

SEQ ID NO: 92932 - RNA, 21 nt, Human
acucccacuaggcagccccca

SEQ ID NO: 92933 - RNA, 18 nt, Human
acuggacacaggaaacca

SEQ ID NO: 92934 - RNA, 18 nt, Human
acuggacacaggaaacca

SEQ ID NO: 92935 - RNA, 20 nt, Human
agacucaaagugccuggcaa

SEQ ID NO: 92936 - RNA, 18 nt, Human
agauuuucgacauaaagc

SEQ ID NO: 92937 - RNA, 21 nt, Human
agggaggagccgcccugggua

SEQ ID NO: 92938 - RNA, 21 nt, Human
agggguggaagagcccaaagc

SEQ ID NO: 92939 - RNA, 20 nt, Human
aucgaggguacagcaggccu

SEQ ID NO: 92940 - RNA, 20 nt, Human
augaucccacuacuggacac

SEQ ID NO: 92941 - RNA, 20 nt, Human
augaucccacuacuggacac

SEQ ID NO: 92942 - RNA, 25 nt, Human
caaagugccaaaaaucuuugccaua

SEQ ID NO: 92943 - RNA, 25 nt, Human
caaagugccaaaaaucuuugccaua

SEQ ID NO: 92944 - RNA, 26 nt, Human
caaagugccaaaaaucuuugccauag

SEQ ID NO: 92945 - RNA, 22 nt, Human
caaaucccacugcuaccaccgc

SEQ ID NO: 92946 - RNA, 23 nt, Human
cacagucaccaaaugaauaacau

SEQ ID NO: 92947 - RNA, 23 nt, Human
cacagucaccaaaugaauaacau

SEQ ID NO: 92948 - RNA, 23 nt, Human
cacagucaccaaaugaauaacau

SEQ ID NO: 92949 - RNA, 23 nt, Human
caccaauugcaguggacacagcc

SEQ ID NO: 92950 - RNA, 23 nt, Human
caccaauugcaguggacacagcc

SEQ ID NO: 92951 - RNA, 23 nt, Human
caccaauugcaguggacacagcc

SEQ ID NO: 92952 - RNA, 19 nt, Human
caccagaaaguuucuuccc

SEQ ID NO: 92953 - RNA, 19 nt, Human
caccagaaaguuucuuccc

SEQ ID NO: 92954 - RNA, 18 nt, Human
cacuacuggacacaggaa

SEQ ID NO: 92955 - RNA, 18 nt, Human
cacuacuggacacaggaa

SEQ ID NO: 92956 - RNA, 23 nt, Human
cacucaauacccacauucugcaa

SEQ ID NO: 92957 - RNA, 26 nt, Human
cacucaauacccacauucugcaauaa

SEQ ID NO: 92958 - RNA, 26 nt, Human
cacucaauacccacauucugcaauaa

SEQ ID NO: 92959 - RNA, 19 nt, Human
cagucggcuuucucauguu

SEQ ID NO: 92960 - RNA, 21 nt, Human
cauaagaagcacaaaucccac

SEQ ID NO: 92961 - RNA, 18 nt, Human
caucgaggguacagcagg

SEQ ID NO: 92962 - RNA, 22 nt, Human
cauuauaaaaaaagucucugaa

SEQ ID NO: 92963 - RNA, 21 nt, Human
ccaaagcgacccguguccccg

SEQ ID NO: 92964 - RNA, 22 nt, Human
ccaaagcgacccguguccccgc

SEQ ID NO: 92965 - RNA, 19 nt, Human
ccaccaugguuccagcucc

SEQ ID NO: 92966 - RNA, 19 nt, Human
ccaccaugguuccagcucc

SEQ ID NO: 92967 - RNA, 22 nt, Human
ccaccgcagcugguguucuuuu

SEQ ID NO: 92968 - RNA, 21 nt, Human
ccagaagucacuucuguugca

SEQ ID NO: 92969 - RNA, 21 nt, Human
ccagaagucacuucuguugca

SEQ ID NO: 92970 - RNA, 21 nt, Human
ccagaagucacuucuguugca

SEQ ID NO: 92971 - RNA, 19 nt, Human
cccauuauccucauagccc

SEQ ID NO: 92972 - RNA, 19 nt, Human
cccauuauccucauagccc

SEQ ID NO: 92973 - RNA, 22 nt, Human
cccucagcuuugaaggaaguac

SEQ ID NO: 92974 - RNA, 21 nt, Human
ccuagacguugcuuugcgggg

SEQ ID NO: 92975 - RNA, 23 nt, Human
ccuccgagggugugcucugaucu

SEQ ID NO: 92976 - RNA, 20 nt, Human
ccugccguucccacggcggu

SEQ ID NO: 92977 - RNA, 23 nt, Human
cgaaacuaaaagucucggcgcug

SEQ ID NO: 92978 - RNA, 23 nt, Human
cgccccuggcucgggauagugcg

SEQ ID NO: 92979 - RNA, 24 nt, Human
cggcugggacuggcacagucucuc

SEQ ID NO: 92980 - RNA, 24 nt, Human
cuaacucccacuaggcagccccca

SEQ ID NO: 92981 - RNA, 24 nt, Human
cuaacucccacuaggcagccccca

SEQ ID NO: 92982 - RNA, 24 nt, Human
cuaagccaaugaaaaaucauucaa

SEQ ID NO: 92983 - RNA, 19 nt, Human
cucaaagugccuggcaacu

SEQ ID NO: 92984 - RNA, 19 nt, Human
cucaaagugccuggcaacu

SEQ ID NO: 92985 - RNA, 24 nt, Human
cucaauacccacauucugcaauaa

SEQ ID NO: 92986 - RNA, 24 nt, Human
cucaauacccacauucugcaauaa

SEQ ID NO: 92987 - RNA, 19 nt, Human
cucccacuaggcagccccc

SEQ ID NO: 92988 - RNA, 19 nt, Human
cucccacuaggcagccccc

SEQ ID NO: 92989 - RNA, 22 nt, Human
cucugaaaauucagagaacaaa

SEQ ID NO: 92990 - RNA, 20 nt, Human
cugccaaguuggccccucgc

SEQ ID NO: 92991 - RNA, 20 nt, Human
cuggcacagucggcuuucuc

SEQ ID NO: 92992 - RNA, 23 nt, Human
cugggacuggcacagucucucuc

SEQ ID NO: 92993 - RNA, 22 nt, Human
cuucucagcuagaauguacccc

SEQ ID NO: 92994 - RNA, 23 nt, Human
cuucuugcuguuuggcuucucuu

SEQ ID NO: 92995 - RNA, 23 nt, Human
cuucuugcuguuuggcuucucuu

SEQ ID NO: 92996 - RNA, 18 nt, Human
cuuugccauaaacucuuc

SEQ ID NO: 92997 - RNA, 18 nt, Human
cuuugccauaaacucuuc

SEQ ID NO: 92998 - RNA, 22 nt, Human
gaaacuaaaagucucggcgcug

SEQ ID NO: 92999 - RNA, 21 nt, Human
gaacaaaagacagcaccagaa

SEQ ID NO: 93000 - RNA, 18 nt, Human
gacauaaagccaaaacag

SEQ ID NO: 93001 - RNA, 19 nt, Human
gaccacacaggggaucugc

SEQ ID NO: 93002 - RNA, 22 nt, Human
gcugauccgcuucgggcccgcu

SEQ ID NO: 93003 - RNA, 19 nt, Human
gcugggacuggcacagucg

SEQ ID NO: 93004 - RNA, 18 nt, Human
ggcaguaaggugcuggug

SEQ ID NO: 93005 - RNA, 18 nt, Human
ggcaguaaggugcuggug

SEQ ID NO: 93006 - RNA, 20 nt, Human
gggcaguaaggugcuggugg

SEQ ID NO: 93007 - RNA, 20 nt, Human
gggcaguaaggugcuggugg

SEQ ID NO: 93008 - RNA, 22 nt, Human
gggcggcugggacuggcacagu

SEQ ID NO: 93009 - RNA, 22 nt, Human
gggcggcugggacuggcacagu

SEQ ID NO: 93010 - RNA, 23 nt, Human
gguaacagacauacaaagagaaa

SEQ ID NO: 93011 - RNA, 23 nt, Human
gguaacagacauacaaagagaaa

SEQ ID NO: 93012 - RNA, 23 nt, Human
gguaacagacauacaaagagaaa

SEQ ID NO: 93013 - RNA, 19 nt, Human
gguagggccgggcggggcu

SEQ ID NO: 93014 - RNA, 21 nt, Human
uaaagccaaaacagauuguuu

SEQ ID NO: 93015 - RNA, 21 nt, Human
uaaagccaaaacagauuguuu

SEQ ID NO: 93016 - RNA, 18 nt, Human
uaacaagguaacagacau

SEQ ID NO: 93017 - RNA, 23 nt, Human
uaacaccaucuugaaaacaaagu

SEQ ID NO: 93018 - RNA, 23 nt, Human
uaacaccaucuugaaaacaaagu

SEQ ID NO: 93019 - RNA, 19 nt, Human
uaacagacauacaaagaga

SEQ ID NO: 93020 - RNA, 19 nt, Human
uaacagacauacaaagaga

SEQ ID NO: 93021 - RNA, 19 nt, Human
uaacagacauacaaagaga

SEQ ID NO: 93022 - RNA, 22 nt, Human
uaagccaaugaaaaaucauuca

SEQ ID NO: 93023 - RNA, 22 nt, Human
uaagccaaugaaaaaucauuca

SEQ ID NO: 93024 - RNA, 18 nt, Human
uacacagucaccaaauga

SEQ ID NO: 93025 - RNA, 18 nt, Human
uacacagucaccaaauga

SEQ ID NO: 93026 - RNA, 18 nt, Human
uacacagucaccaaauga

SEQ ID NO: 93027 - RNA, 22 nt, Human
uacauagacuaucugacaaccc

SEQ ID NO: 93028 - RNA, 22 nt, Human
uacauagacuaucugacaaccc

SEQ ID NO: 93029 - RNA, 18 nt, Human
uaccaccgcagcuggugu

SEQ ID NO: 93030 - RNA, 20 nt, Human
uaccacuguuaccaccaauu

SEQ ID NO: 93031 - RNA, 20 nt, Human
uaccacuguuaccaccaauu

SEQ ID NO: 93032 - RNA, 21 nt, Human
uacuauuaggcagaaaaaaac

SEQ ID NO: 93033 - RNA, 21 nt, Human
uacuauuaggcagaaaaaaac

SEQ ID NO: 93034 - RNA, 19 nt, Human
uacuggacacaggaaacca

SEQ ID NO: 93035 - RNA, 19 nt, Human
uagaguuccuuggugagca

SEQ ID NO: 93036 - RNA, 23 nt, Human
uaggcagcccccaccaugguucc

SEQ ID NO: 93037 - RNA, 23 nt, Human
uaggcagcccccaccaugguucc

SEQ ID NO: 93038 - RNA, 22 nt, Human
uaggccugggcaguaaggugcu

SEQ ID NO: 93039 - RNA, 22 nt, Human
uaggccugggcaguaaggugcu

SEQ ID NO: 93040 - RNA, 23 nt, Human
uauauuuuaaagcuauaacagau

SEQ ID NO: 93041 - RNA, 23 nt, Human
uauauuuuaaagcuauaacagau

SEQ ID NO: 93042 - RNA, 19 nt, Human
uauuaacaagguaacagac

SEQ ID NO: 93043 - RNA, 19 nt, Human
uauuaacaagguaacagac

SEQ ID NO: 93044 - RNA, 19 nt, Human
uauuaacaagguaacagac

SEQ ID NO: 93045 - RNA, 21 nt, Human
uauuaacaagguaacagacau

SEQ ID NO: 93046 - RNA, 21 nt, Human
uauuaacaagguaacagacau

SEQ ID NO: 93047 - RNA, 22 nt, Human
ucaaaagauaacaccaucuuga

SEQ ID NO: 93048 - RNA, 22 nt, Human
ucaaaagauaacaccaucuuga

SEQ ID NO: 93049 - RNA, 20 nt, Human
ucaauacccacauucugcaa

SEQ ID NO: 93050 - RNA, 22 nt, Human
ucaauacccacauucugcaaaa

SEQ ID NO: 93051 - RNA, 22 nt, Human
ucaauacccacauucugcaaaa

SEQ ID NO: 93052 - RNA, 24 nt, Human
ucaauacccacauucugcaauaaa

SEQ ID NO: 93053 - RNA, 24 nt, Human
ucaauacccacauucugcaauaaa

SEQ ID NO: 93054 - RNA, 22 nt, Human
ucauucaaaucacacucaauac

SEQ ID NO: 93055 - RNA, 23 nt, Human
ucauucaaaucacacucaauacc

SEQ ID NO: 93056 - RNA, 23 nt, Human
ucauucaaaucacacucaauacc

SEQ ID NO: 93057 - RNA, 27 nt, Human
uccacaauccauuggugguccuaacuc

SEQ ID NO: 93058 - RNA, 27 nt, Human
uccacaauccauuggugguccuaacuc

SEQ ID NO: 93059 - RNA, 22 nt, Human
uccaucucagucaguggcuuug

SEQ ID NO: 93060 - RNA, 24 nt, Human
uccaucucagucaguggcuuuguu

SEQ ID NO: 93061 - RNA, 24 nt, Human
uccaucucagucaguggcuuuguu

SEQ ID NO: 93062 - RNA, 18 nt, Human
uccauuucuuguucuucu

SEQ ID NO: 93063 - RNA, 18 nt, Human
uccauuucuuguucuucu

SEQ ID NO: 93064 - RNA, 18 nt, Human
ucccacuaggcagccccc

SEQ ID NO: 93065 - RNA, 20 nt, Human
ucccauuauccucauagccc

SEQ ID NO: 93066 - RNA, 21 nt, Human
uccccgcacgcauagucccug

SEQ ID NO: 93067 - RNA, 21 nt, Human
ucccuggagggcgcucucugc

SEQ ID NO: 93068 - RNA, 21 nt, Human
uccgcagcaagggucuggggc

SEQ ID NO: 93069 - RNA, 19 nt, Human
uccugccguucccacggcg

SEQ ID NO: 93070 - RNA, 18 nt, Human
ucucagcucacuccaucu

SEQ ID NO: 93071 - RNA, 18 nt, Human
ucucagcucacuccaucu

SEQ ID NO: 93072 - RNA, 22 nt, Human
ucucauggaagugugggucauc

SEQ ID NO: 93073 - RNA, 23 nt, Human
ucucugaaaauucagagaacaaa

SEQ ID NO: 93074 - RNA, 26 nt, Human
ucucugcaaagcuggccgcgcgcucu

SEQ ID NO: 93075 - RNA, 22 nt, Human
ucugaauauuucaagagcauaa

SEQ ID NO: 93076 - RNA, 22 nt, Human
ucugaauauuucaagagcauaa

SEQ ID NO: 93077 - RNA, 21 nt, Human
ucuuguucuucuccugccuca

SEQ ID NO: 93078 - RNA, 21 nt, Human
ugacugaaguagaguuccuug

SEQ ID NO: 93079 - RNA, 18 nt, Human
ugagggcaggauagguga

SEQ ID NO: 93080 - RNA, 18 nt, Human
ugagggcaggauagguga

SEQ ID NO: 93081 - RNA, 19 nt, Human
ugcacauaaagccaaaaca

SEQ ID NO: 93082 - RNA, 19 nt, Human
ugcacauaaagccaaaaca

SEQ ID NO: 93083 - RNA, 23 nt, Human
ugcaguggacacagccaugagcu

SEQ ID NO: 93084 - RNA, 23 nt, Human
ugcaguggacacagccaugagcu

SEQ ID NO: 93085 - RNA, 23 nt, Human
ugcaguggacacagccaugagcu

SEQ ID NO: 93086 - RNA, 18 nt, Human
ugcauguauuaagucuau

SEQ ID NO: 93087 - RNA, 18 nt, Human
ugcauguauuaagucuau

SEQ ID NO: 93088 - RNA, 18 nt, Human
ugccauaaacucuuccuc

SEQ ID NO: 93089 - RNA, 18 nt, Human
ugccauaaacucuuccuc

SEQ ID NO: 93090 - RNA, 19 nt, Human
ugcgcgcgugggcguagga

SEQ ID NO: 93091 - RNA, 23 nt, Human
ugcggagggaggagccgcccugg

SEQ ID NO: 93092 - RNA, 21 nt, Human
ugcugguggaagaugugaggg

SEQ ID NO: 93093 - RNA, 21 nt, Human
ugcugguggaagaugugaggg

SEQ ID NO: 93094 - RNA, 20 nt, Human
uggagaauuucugaauauuu

SEQ ID NO: 93095 - RNA, 19 nt, Human
uggcuucucuuuuaucauc

SEQ ID NO: 93096 - RNA, 19 nt, Human
uggcuucucuuuuaucauc

SEQ ID NO: 93097 - RNA, 21 nt, Human
ugggcaguaaggugcuggugg

SEQ ID NO: 93098 - RNA, 21 nt, Human
uggguagggccgggcggggcu

SEQ ID NO: 93099 - RNA, 20 nt, Human
uggugguccuaacucccacu

SEQ ID NO: 93100 - RNA, 20 nt, Human
uggugguccuaacucccacu

SEQ ID NO: 93101 - RNA, 19 nt, Human
ugucauggcuccauuuucc

SEQ ID NO: 93102 - RNA, 19 nt, Human
ugucauggcuccauuuucc

SEQ ID NO: 93103 - RNA, 23 nt, Human
uguugacaccaauugcaguggac

SEQ ID NO: 93104 - RNA, 21 nt, Human
uguugcauguauuaagucuau

SEQ ID NO: 93105 - RNA, 21 nt, Human
uguugcauguauuaagucuau

SEQ ID NO: 93106 - RNA, 23 nt, Human
uuaaagcuauaacagauuuugca

SEQ ID NO: 93107 - RNA, 23 nt, Human
uuaaagcuauaacagauuuugca

SEQ ID NO: 93108 - RNA, 18 nt, Human
uucaagagcauaaaaaaa

SEQ ID NO: 93109 - RNA, 18 nt, Human
uucaagagcauaaaaaaa

SEQ ID NO: 93110 - RNA, 23 nt, Human
uucagagaacaaaagacagcacc

SEQ ID NO: 93111 - RNA, 23 nt, Human
uucagagaacaaaagacagcacc

SEQ ID NO: 93112 - RNA, 20 nt, Human
uuccaagguccuuggugagg

SEQ ID NO: 93113 - RNA, 20 nt, Human
uuccaagguccuuggugagg

SEQ ID NO: 93114 - RNA, 23 nt, Human
uuccugccguucccacggcgguu

SEQ ID NO: 93115 - RNA, 20 nt, Human
uucucagcuagaauguaccc

SEQ ID NO: 93116 - RNA, 20 nt, Human
uucucagcuagaauguaccc

SEQ ID NO: 93117 - RNA, 23 nt, Human
uugaauggauaaauuguugagca

SEQ ID NO: 93118 - RNA, 23 nt, Human
uugaauggauaaauuguugagca

SEQ ID NO: 93119 - RNA, 18 nt, Human
uugcggggggcgcccucc

SEQ ID NO: 93120 - RNA, 21 nt, Human
uuggugagguggcuuccagau

SEQ ID NO: 93121 - RNA, 21 nt, Human
uuggugagguggcuuccagau

SEQ ID NO: 93122 - RNA, 28 nt, Human
uuggugguccuaacucccacuaggcagc

SEQ ID NO: 93123 - RNA, 28 nt, Human
uuggugguccuaacucccacuaggcagc

SEQ ID NO: 93124 - RNA, 19 nt, Human
uugucauguaucccuuccu

SEQ ID NO: 93125 - RNA, 19 nt, Human
uuuccagacuggauccuga

SEQ ID NO: 93126 - RNA, 19 nt, Human
uuuccagacuggauccuga

SEQ ID NO: 93127 - RNA, 22 nt, Human
uuuccugaaauuaaaauccugg

SEQ ID NO: 93128 - RNA, 22 nt, Human
uuuccugaaauuaaaauccugg

SEQ ID NO: 93129 - RNA, 19 nt, Human
uuucuguuuuccagacugg

SEQ ID NO: 93130 - RNA, 19 nt, Human
uuucuguuuuccagacugg

SEQ ID NO: 93131 - RNA, 23 nt, Human
uuucuuguucuucuccugccuca

SEQ ID NO: 93132 - RNA, 25 nt, Human
aaaaaacaaaacaaaacaaaacaaa

SEQ ID NO: 93133 - RNA, 25 nt, Human
aaaaaacaaaacaaaacaaaacaaa

SEQ ID NO: 93134 - RNA, 21 nt, Human
aaaaagcaaauauaguuagcc

SEQ ID NO: 93135 - RNA, 24 nt, Human
aaaaagcaaauauaguuagccaag

SEQ ID NO: 93136 - RNA, 24 nt, Human
aaaaagcaaauauaguuagccaag

SEQ ID NO: 93137 - RNA, 25 nt, Human
aaaacaaaacaaacaaaauagcacc

SEQ ID NO: 93138 - RNA, 25 nt, Human
aaaacaaacaaaauagcaccaucaa

SEQ ID NO: 93139 - RNA, 24 nt, Human
aaaagcaauaagaaggcauaaagc

SEQ ID NO: 93140 - RNA, 24 nt, Human
aaaagcaauaagaaggcauaaagc

SEQ ID NO: 93141 - RNA, 23 nt, Human
aaaaggaggagaaccugugaaaa

SEQ ID NO: 93142 - RNA, 22 nt, Human
aaacaaaacaaaacaaaacaaa

SEQ ID NO: 93143 - RNA, 22 nt, Human
aaacaaaacaaaacaaaacaaa

SEQ ID NO: 93144 - RNA, 21 nt, Human
aaacaaaacaaaacaaacaaa

SEQ ID NO: 93145 - RNA, 21 nt, Human
aaacaaaacaaaacaaacaaa

SEQ ID NO: 93146 - RNA, 19 nt, Human
aaacaaacaaaauagcacc

SEQ ID NO: 93147 - RNA, 23 nt, Human
aaacaaacaaaauagcaccauca

SEQ ID NO: 93148 - RNA, 24 nt, Human
aaagugcugggauuauagacauga

SEQ ID NO: 93149 - RNA, 24 nt, Human
aaagugcugggauuauagacauga

SEQ ID NO: 93150 - RNA, 21 nt, Human
aaaugcauaaaaagaccccag

SEQ ID NO: 93151 - RNA, 21 nt, Human
aaaugcauaaaaagaccccag

SEQ ID NO: 93152 - RNA, 27 nt, Human
aacaaaacaaaacaaaacaaacaaaaa

SEQ ID NO: 93153 - RNA, 27 nt, Human
aacaaaacaaaacaaaacaaacaaaaa

SEQ ID NO: 93154 - RNA, 22 nt, Human
aacacaaaagauaaaaggagga

SEQ ID NO: 93155 - RNA, 19 nt, Human
aacacagugaaacccuguc

SEQ ID NO: 93156 - RNA, 19 nt, Human
aacacagugaaacccuguc

SEQ ID NO: 93157 - RNA, 20 nt, Human
aacacagugaaacccugucu

SEQ ID NO: 93158 - RNA, 20 nt, Human
aacacagugaaacccugucu

SEQ ID NO: 93159 - RNA, 21 nt, Human
aacacagugaaacccugucuc

SEQ ID NO: 93160 - RNA, 21 nt, Human
aacacagugaaacccugucuc

SEQ ID NO: 93161 - RNA, 22 nt, Human
aaccugugaaaacacuucccuc

SEQ ID NO: 93162 - RNA, 21 nt, Human
aagcaaauauaguuagccaag

SEQ ID NO: 93163 - RNA, 21 nt, Human
aagcaaauauaguuagccaag

SEQ ID NO: 93164 - RNA, 23 nt, Human
aagcaauaagaaggcauaaagca

SEQ ID NO: 93165 - RNA, 23 nt, Human
aagcaauaagaaggcauaaagca

SEQ ID NO: 93166 - RNA, 19 nt, Human
aagcagagaugaaagaggg

SEQ ID NO: 93167 - RNA, 22 nt, Human
aagcagagaugaaagaggggac

SEQ ID NO: 93168 - RNA, 22 nt, Human
aagcagagaugaaagaggggac

SEQ ID NO: 93169 - RNA, 19 nt, Human
aaggaggagaaccugugaa

SEQ ID NO: 93170 - RNA, 18 nt, Human
aagguucaagugaccaac

SEQ ID NO: 93171 - RNA, 21 nt, Human
aagugcugggauuauagacau

SEQ ID NO: 93172 - RNA, 21 nt, Human
aagugcugggauuauagacau

SEQ ID NO: 93173 - RNA, 26 nt, Human
aagugcugggauuauagacaugagcc

SEQ ID NO: 93174 - RNA, 26 nt, Human
aagugcugggauuauagacaugagcc

SEQ ID NO: 93175 - RNA, 18 nt, Human
aaucagaagggaagacaa

SEQ ID NO: 93176 - RNA, 23 nt, Human
aaugcaaaugcauaaaaagaccc

SEQ ID NO: 93177 - RNA, 23 nt, Human
aaugcaaaugcauaaaaagaccc

SEQ ID NO: 93178 - RNA, 25 nt, Human
acaaaacaaaacaaaacaaacaaaa

SEQ ID NO: 93179 - RNA, 25 nt, Human
acaaaacaaaacaaaacaaacaaaa

SEQ ID NO: 93180 - RNA, 27 nt, Human
acaaaacaaaacaaacaaaauagcacc

SEQ ID NO: 93181 - RNA, 27 nt, Human
acaaaacaaaacaaacaaaauagcacc

SEQ ID NO: 93182 - RNA, 18 nt, Human
acaaguuuuuuucuuagu

SEQ ID NO: 93183 - RNA, 23 nt, Human
acagagcgagauucugucucaaa

SEQ ID NO: 93184 - RNA, 24 nt, Human
acagagcgagauucugucucaaaa

SEQ ID NO: 93185 - RNA, 24 nt, Human
acagagcgagauucugucucaaaa

SEQ ID NO: 93186 - RNA, 22 nt, Human
accagugaacugagaugucagc

SEQ ID NO: 93187 - RNA, 18 nt, Human
acccugucucuacuaaaa

SEQ ID NO: 93188 - RNA, 18 nt, Human
acccugucucuacuaaaa

SEQ ID NO: 93189 - RNA, 23 nt, Human
accucuuggguucaagcaaaucc

SEQ ID NO: 93190 - RNA, 23 nt, Human
accucuuggguucaagcaaaucc

SEQ ID NO: 93191 - RNA, 21 nt, Human
acgccacugcacuccagccug

SEQ ID NO: 93192 - RNA, 22 nt, Human
acgccacugcacuccagccugg

SEQ ID NO: 93193 - RNA, 24 nt, Human
acgccacugcacuccagccugggc

SEQ ID NO: 93194 - RNA, 24 nt, Human
acgccacugcacuccagccugggc

SEQ ID NO: 93195 - RNA, 24 nt, Human
acugcacuccagccugggcgacag

SEQ ID NO: 93196 - RNA, 24 nt, Human
acugcacuccagccugggcgacag

SEQ ID NO: 93197 - RNA, 26 nt, Human
acugcacuccagccugggcgacagag

SEQ ID NO: 93198 - RNA, 26 nt, Human
acugcacuccagccugggcgacagag

SEQ ID NO: 93199 - RNA, 19 nt, Human
acugcagccuuggaccucu

SEQ ID NO: 93200 - RNA, 20 nt, Human
acugcagccuuggaccucuu

SEQ ID NO: 93201 - RNA, 20 nt, Human
acugcagccuuggaccucuu

SEQ ID NO: 93202 - RNA, 18 nt, Human
agaaggcauaaagcaagu

SEQ ID NO: 93203 - RNA, 18 nt, Human
agaaggcauaaagcaagu

SEQ ID NO: 93204 - RNA, 18 nt, Human
agacaagagcaaacgucu

SEQ ID NO: 93205 - RNA, 20 nt, Human
agcaaauccucccaccucaa

SEQ ID NO: 93206 - RNA, 20 nt, Human
agcaaauccucccaccucaa

SEQ ID NO: 93207 - RNA, 24 nt, Human
agcacuuugggaggccgagguggg

SEQ ID NO: 93208 - RNA, 24 nt, Human
agcacuuugggaggccgagguggg

SEQ ID NO: 93209 - RNA, 25 nt, Human
agccaagcauauauauaucauaaaa

SEQ ID NO: 93210 - RNA, 25 nt, Human
agccaagcauauauauaucauaaaa

SEQ ID NO: 93211 - RNA, 21 nt, Human
agccaggugugguggcgggcc

SEQ ID NO: 93212 - RNA, 21 nt, Human
agccaggugugguggcgggcc

SEQ ID NO: 93213 - RNA, 24 nt, Human
agccugggcgacagagcgagauuc

SEQ ID NO: 93214 - RNA, 24 nt, Human
agccugggcgacagagcgagauuc

SEQ ID NO: 93215 - RNA, 19 nt, Human
agcggugugaacauggcuc

SEQ ID NO: 93216 - RNA, 19 nt, Human
agcggugugaacauggcuc

SEQ ID NO: 93217 - RNA, 24 nt, Human
agcuuuuguucucucccuuuugau

SEQ ID NO: 93218 - RNA, 23 nt, Human
aggcaggaagcucagucugaaca

SEQ ID NO: 93219 - RNA, 19 nt, Human
aggcaggagaauauaaucc

SEQ ID NO: 93220 - RNA, 18 nt, Human
aggcaggagaauggccug

SEQ ID NO: 93221 - RNA, 24 nt, Human
aggcaggagaauggccugaacccg

SEQ ID NO: 93222 - RNA, 24 nt, Human
aggcaggagaauggcgugaacccg

SEQ ID NO: 93223 - RNA, 24 nt, Human
aggcaggagaauggcgugaacccg

SEQ ID NO: 93224 - RNA, 22 nt, Human
aggcaggcaggaagcucagucu

SEQ ID NO: 93225 - RNA, 21 nt, Human
aggccgagguggguggaucac

SEQ ID NO: 93226 - RNA, 21 nt, Human
aggccgagguggguggaucac

SEQ ID NO: 93227 - RNA, 24 nt, Human
aggcgcgguggcucacgccuguaa

SEQ ID NO: 93228 - RNA, 24 nt, Human
aggcgcgguggcucacgccuguaa

SEQ ID NO: 93229 - RNA, 24 nt, Human
aggcggagcuugcggugagccgag

SEQ ID NO: 93230 - RNA, 24 nt, Human
aggcggagcuugcggugagccgag

SEQ ID NO: 93231 - RNA, 20 nt, Human
aggcggccaaggcccaaccu

SEQ ID NO: 93232 - RNA, 18 nt, Human
aggcugaggcaggagaau

SEQ ID NO: 93233 - RNA, 19 nt, Human
aggcugaggcaggagaaug

SEQ ID NO: 93234 - RNA, 19 nt, Human
aggcugaggcaggagaaug

SEQ ID NO: 93235 - RNA, 24 nt, Human
agguggguggaucacgaggucagg

SEQ ID NO: 93236 - RNA, 24 nt, Human
agguggguggaucacgaggucagg

SEQ ID NO: 93237 - RNA, 22 nt, Human
agucucaacagguauaccuuuc

SEQ ID NO: 93238 - RNA, 21 nt, Human
agucuccgaguccccuaaccu

SEQ ID NO: 93239 - RNA, 23 nt, Human
agugcagcggugugaacauggcu

SEQ ID NO: 93240 - RNA, 23 nt, Human
agugcagcggugugaacauggcu

SEQ ID NO: 93241 - RNA, 24 nt, Human
agugcagcggugugaacauggcuc

SEQ ID NO: 93242 - RNA, 24 nt, Human
agugcagcggugugaacauggcuc

SEQ ID NO: 93243 - RNA, 24 nt, Human
agugcugggauuauagacaugagc

SEQ ID NO: 93244 - RNA, 24 nt, Human
agugcugggauuauagacaugagc

SEQ ID NO: 93245 - RNA, 21 nt, Human
auaauccaagcagagaugaaa

SEQ ID NO: 93246 - RNA, 21 nt, Human
auaauccaagcagagaugaaa

SEQ ID NO: 93247 - RNA, 24 nt, Human
aucacgccacugcacuccagccug

SEQ ID NO: 93248 - RNA, 24 nt, Human
aucacgccacugcacuccagccug

SEQ ID NO: 93249 - RNA, 21 nt, Human
auccaagcagagaugaaagag

SEQ ID NO: 93250 - RNA, 24 nt, Human
aucggccaggcgcgguggcucacg

SEQ ID NO: 93251 - RNA, 24 nt, Human
aucggccaggcgcgguggcucacg

SEQ ID NO: 93252 - RNA, 22 nt, Human
augcaaaugcauaaaaagaccc

SEQ ID NO: 93253 - RNA, 22 nt, Human
augcaaaugcauaaaaagaccc

SEQ ID NO: 93254 - RNA, 22 nt, Human
caaaaaaacaaaacaaaacaaa

SEQ ID NO: 93255 - RNA, 22 nt, Human
caaaaaaacaaaacaaaacaaa

SEQ ID NO: 93256 - RNA, 27 nt, Human
caaaaaaacaaaacaaaacaaaacaaa

SEQ ID NO: 93257 - RNA, 23 nt, Human
caaaaagcaaauauaguuagcca

SEQ ID NO: 93258 - RNA, 23 nt, Human
caaaaagcaaauauaguuagcca

SEQ ID NO: 93259 - RNA, 21 nt, Human
caaaacaaaacaaaacaaaca

SEQ ID NO: 93260 - RNA, 21 nt, Human
caaaacaaaacaaaacaaaca

SEQ ID NO: 93261 - RNA, 24 nt, Human
caaaacaaaacaaaacaaacaaaa

SEQ ID NO: 93262 - RNA, 24 nt, Human
caaaacaaaacaaaacaaacaaaa

SEQ ID NO: 93263 - RNA, 21 nt, Human
caaaacaaacaaaauagcacc

SEQ ID NO: 93264 - RNA, 21 nt, Human
caaaacaaacaaaauagcacc

SEQ ID NO: 93265 - RNA, 24 nt, Human
caaagugcugggauuauagacaug

SEQ ID NO: 93266 - RNA, 24 nt, Human
caaagugcugggauuauagacaug

SEQ ID NO: 93267 - RNA, 20 nt, Human
caacucaagggcucaggcgg

SEQ ID NO: 93268 - RNA, 22 nt, Human
caaguguguuccauuccugucc

SEQ ID NO: 93269 - RNA, 20 nt, Human
cacaguuauucacaguggcc

SEQ ID NO: 93270 - RNA, 19 nt, Human
caccagcuaaaaacauucc

SEQ ID NO: 93271 - RNA, 19 nt, Human
caccagcuaaaaacauucc

SEQ ID NO: 93272 - RNA, 24 nt, Human
caccucaaccucccaaagugcugg

SEQ ID NO: 93273 - RNA, 24 nt, Human
caccucaaccucccaaagugcugg

SEQ ID NO: 93274 - RNA, 24 nt, Human
cacgccuguaaucccagcacuuug

SEQ ID NO: 93275 - RNA, 24 nt, Human
cacgccuguaaucccagcacuuug

SEQ ID NO: 93276 - RNA, 23 nt, Human
cacuccagccugggcgacagagc

SEQ ID NO: 93277 - RNA, 23 nt, Human
cacuccagccugggcgacagagc

SEQ ID NO: 93278 - RNA, 24 nt, Human
cacuccagccugggcgacagagcg

SEQ ID NO: 93279 - RNA, 24 nt, Human
cacuccagccugggcgacagagcg

SEQ ID NO: 93280 - RNA, 19 nt, Human
cacugcacuccagccuggg

SEQ ID NO: 93281 - RNA, 19 nt, Human
cacugcacuccagccuggg

SEQ ID NO: 93282 - RNA, 20 nt, Human
cacugcacuccagccugggc

SEQ ID NO: 93283 - RNA, 20 nt, Human
cacugcacuccagccugggc

SEQ ID NO: 93284 - RNA, 20 nt, Human
cacugcacuccagccugggc

SEQ ID NO: 93285 - RNA, 21 nt, Human
cacugcacuccagccugggcg

SEQ ID NO: 93286 - RNA, 22 nt, Human
cacugcacuccagccugggcga

SEQ ID NO: 93287 - RNA, 22 nt, Human
cacugcacuccagccugggcga

SEQ ID NO: 93288 - RNA, 23 nt, Human
cacugcacuccagccugggcgac

SEQ ID NO: 93289 - RNA, 24 nt, Human
cacugcacuccagccugggcgaca

SEQ ID NO: 93290 - RNA, 24 nt, Human
cacugcacuccagccugggcgaca

SEQ ID NO: 93291 - RNA, 24 nt, Human
cagcacuuugggaggccgaggugg

SEQ ID NO: 93292 - RNA, 24 nt, Human
cagcacuuugggaggccgaggugg

SEQ ID NO: 93293 - RNA, 24 nt, Human
cagcuacucgggaggcugaggcag

SEQ ID NO: 93294 - RNA, 24 nt, Human
cagcuacucgggaggcugaggcag

SEQ ID NO: 93295 - RNA, 19 nt, Human
caggcagccaccagucacc

SEQ ID NO: 93296 - RNA, 18 nt, Human
caggccuauccacuacca

SEQ ID NO: 93297 - RNA, 22 nt, Human
cagucuccgaguccccuaaccu

SEQ ID NO: 93298 - RNA, 23 nt, Human
cauaaaagcaauaagaaggcaua

SEQ ID NO: 93299 - RNA, 23 nt, Human
cauaaaagcaauaagaaggcaua

SEQ ID NO: 93300 - RNA, 18 nt, Human
cauaagagaaaggagaca

SEQ ID NO: 93301 - RNA, 18 nt, Human
caucgcagucuccgaguc

SEQ ID NO: 93302 - RNA, 19 nt, Human
caucuaagacaagagcaaa

SEQ ID NO: 93303 - RNA, 21 nt, Human
caucuguuuccccauguuuuu

SEQ ID NO: 93304 - RNA, 18 nt, Human
cauggccucacuuccugu

SEQ ID NO: 93305 - RNA, 20 nt, Human
cauggcucacugcagccuug

SEQ ID NO: 93306 - RNA, 20 nt, Human
cauggcucacugcagccuug

SEQ ID NO: 93307 - RNA, 18 nt, Human
ccaaagugcugggauuau

SEQ ID NO: 93308 - RNA, 18 nt, Human
ccaaagugcugggauuau

SEQ ID NO: 93309 - RNA, 24 nt, Human
ccaaagugcugggauuauagacau

SEQ ID NO: 93310 - RNA, 24 nt, Human
ccaaagugcugggauuauagacau

SEQ ID NO: 93311 - RNA, 20 nt, Human
ccaagcagagaugaaagagc

SEQ ID NO: 93312 - RNA, 20 nt, Human
ccaagcagagaugaaagagc

SEQ ID NO: 93313 - RNA, 20 nt, Human
ccacugcacuccagccuggg

SEQ ID NO: 93314 - RNA, 20 nt, Human
ccacugcacuccagccuggg

SEQ ID NO: 93315 - RNA, 20 nt, Human
ccacugcacuccagccuggg

SEQ ID NO: 93316 - RNA, 20 nt, Human
ccacugcacuccagccuggg

SEQ ID NO: 93317 - RNA, 21 nt, Human
ccacugcacuccagccugggc

SEQ ID NO: 93318 - RNA, 21 nt, Human
ccacugcacuccagccugggc

SEQ ID NO: 93319 - RNA, 21 nt, Human
ccacugcacuccagccugggc

SEQ ID NO: 93320 - RNA, 21 nt, Human
ccacugcacuccagccugggc

SEQ ID NO: 93321 - RNA, 23 nt, Human
ccacugcacuccagccugggcga

SEQ ID NO: 93322 - RNA, 23 nt, Human
ccacugcacuccagccugggcga

SEQ ID NO: 93323 - RNA, 23 nt, Human
ccacugcacuccagccugggcga

SEQ ID NO: 93324 - RNA, 24 nt, Human
ccacugcacuccagccugggcgac

SEQ ID NO: 93325 - RNA, 24 nt, Human
ccacugcacuccagccugggcgac

SEQ ID NO: 93326 - RNA, 23 nt, Human
ccagcuaaaaacauucccaaagc

SEQ ID NO: 93327 - RNA, 23 nt, Human
ccagcuaaaaacauucccaaagc

SEQ ID NO: 93328 - RNA, 23 nt, Human
ccagcuaaaaacauucucaaacc

SEQ ID NO: 93329 - RNA, 27 nt, Human
ccagcuaaaaacauucucaaacccugc

SEQ ID NO: 93330 - RNA, 24 nt, Human
cccaaccucacgugcccagaaagu

SEQ ID NO: 93331 - RNA, 19 nt, Human
cccaagguucaagugacca

SEQ ID NO: 93332 - RNA, 23 nt, Human
cccauguuuuucuugucauccuu

SEQ ID NO: 93333 - RNA, 23 nt, Human
ccccuguagucccagcuacucgg

SEQ ID NO: 93334 - RNA, 23 nt, Human
ccccuguagucccagcuacucgg

SEQ ID NO: 93335 - RNA, 24 nt, Human
ccccuguagucccagcuacucggg

SEQ ID NO: 93336 - RNA, 24 nt, Human
ccccuguagucccagcuacucggg

SEQ ID NO: 93337 - RNA, 23 nt, Human
cccuggcucuucugccucccucc

SEQ ID NO: 93338 - RNA, 20 nt, Human
cccuguagucccagcuacuc

SEQ ID NO: 93339 - RNA, 20 nt, Human
cccuguagucccagcuacuc

SEQ ID NO: 93340 - RNA, 24 nt, Human
ccuauccacuaccaucugagcauc

SEQ ID NO: 93341 - RNA, 22 nt, Human
ccucccaccucaaccucccaaa

SEQ ID NO: 93342 - RNA, 22 nt, Human
ccucccaccucaaccucccaaa

SEQ ID NO: 93343 - RNA, 26 nt, Human
ccucccaccucaaccucccaaagugc

SEQ ID NO: 93344 - RNA, 22 nt, Human
ccucccuccauggccucacuuc

SEQ ID NO: 93345 - RNA, 22 nt, Human
ccuggcuaacacagugaaaccc

SEQ ID NO: 93346 - RNA, 22 nt, Human
ccuggcuaacacagugaaaccc

SEQ ID NO: 93347 - RNA, 24 nt, Human
ccuggcuaacacagugaaacccug

SEQ ID NO: 93348 - RNA, 24 nt, Human
ccuggcuaacacagugaaacccug

SEQ ID NO: 93349 - RNA, 22 nt, Human
ccugggcgacagagcgagauuc

SEQ ID NO: 93350 - RNA, 22 nt, Human
ccugggcgacagagcgagauuc

SEQ ID NO: 93351 - RNA, 22 nt, Human
ccuguaaucccagcacuuuggg

SEQ ID NO: 93352 - RNA, 19 nt, Human
ccuguagucccagcuacuc

SEQ ID NO: 93353 - RNA, 21 nt, Human
ccuguagucccagcuacucgg

SEQ ID NO: 93354 - RNA, 21 nt, Human
ccuguagucccagcuacucgg

SEQ ID NO: 93355 - RNA, 22 nt, Human
ccuguagucccagcuacucggg

SEQ ID NO: 93356 - RNA, 22 nt, Human
ccuguagucccagcuacucggg

SEQ ID NO: 93357 - RNA, 23 nt, Human
cgaaggcccaagagcaaaacccu

SEQ ID NO: 93358 - RNA, 24 nt, Human
cgagaucacgccacugcacuccag

SEQ ID NO: 93359 - RNA, 24 nt, Human
cgagaucacgccacugcacuccag

SEQ ID NO: 93360 - RNA, 24 nt, Human
cgagguggguggaucacgagguca

SEQ ID NO: 93361 - RNA, 26 nt, Human
cgccacugcacuccagccugggcgac

SEQ ID NO: 93362 - RNA, 26 nt, Human
cgccacugcacuccagccugggcgac

SEQ ID NO: 93363 - RNA, 23 nt, Human
cgccuguaaucccagcacuuugg

SEQ ID NO: 93364 - RNA, 24 nt, Human
cgccuguaaucccagcacuuuggg

SEQ ID NO: 93365 - RNA, 24 nt, Human
cgccuguaaucccagcacuuuggg

SEQ ID NO: 93366 - RNA, 27 nt, Human
cgcuccacccuuuccuggcaccaucgc

SEQ ID NO: 93367 - RNA, 24 nt, Human
cggccaggcgcgguggcucacgcc

SEQ ID NO: 93368 - RNA, 24 nt, Human
cggccaggcgcgguggcucacgcc

SEQ ID NO: 93369 - RNA, 24 nt, Human
cgucacaggccuauccacuaccau

SEQ ID NO: 93370 - RNA, 20 nt, Human
cucacgaugguagcaccuuc

SEQ ID NO: 93371 - RNA, 22 nt, Human
cucacgccuguaaucccagcac

SEQ ID NO: 93372 - RNA, 22 nt, Human
cucacgccuguaaucccagcac

SEQ ID NO: 93373 - RNA, 24 nt, Human
cucacgccuguaaucccagcacuu

SEQ ID NO: 93374 - RNA, 24 nt, Human
cucacgccuguaaucccagcacuu

SEQ ID NO: 93375 - RNA, 21 nt, Human
cucacugcagccuuggaccuc

SEQ ID NO: 93376 - RNA, 21 nt, Human
cucacugcagccuuggaccuc

SEQ ID NO: 93377 - RNA, 25 nt, Human
cucacugcagccuuggaccucuugg

SEQ ID NO: 93378 - RNA, 25 nt, Human
cucacugcagccuuggaccucuugg

SEQ ID NO: 93379 - RNA, 20 nt, Human
cucaggcggccaaggcccaa

SEQ ID NO: 93380 - RNA, 21 nt, Human
cuccagaaaugcuaauucucu

SEQ ID NO: 93381 - RNA, 21 nt, Human
cucccaccucaaccucccaaa

SEQ ID NO: 93382 - RNA, 21 nt, Human
cucccuccauggccucacuuc

SEQ ID NO: 93383 - RNA, 20 nt, Human
cucugucacccaagcuugag

SEQ ID NO: 93384 - RNA, 18 nt, Human
cugcaggguuucgguagg

SEQ ID NO: 93385 - RNA, 18 nt, Human
cuggcuaacacagugaaa

SEQ ID NO: 93386 - RNA, 18 nt, Human
cuggcuaacacagugaaa

SEQ ID NO: 93387 - RNA, 24 nt, Human
cuggcuaacacagugaaacccugu

SEQ ID NO: 93388 - RNA, 24 nt, Human
cuggcuaacacagugaaacccugu

SEQ ID NO: 93389 - RNA, 21 nt, Human
cugucucaaaaaaacaaaaca

SEQ ID NO: 93390 - RNA, 21 nt, Human
cugucucaaaaaaacaaaaca

SEQ ID NO: 93391 - RNA, 19 nt, Human
cuugcggugagccgagauc

SEQ ID NO: 93392 - RNA, 19 nt, Human
cuuguaaaaaucauuugaa

SEQ ID NO: 93393 - RNA, 19 nt, Human
cuuguaaaaaucauuugaa

SEQ ID NO: 93394 - RNA, 18 nt, Human
gaaaaaaaacacaaaaga

SEQ ID NO: 93395 - RNA, 26 nt, Human
gaaaaaaaacacaaaagauaaaagga

SEQ ID NO: 93396 - RNA, 19 nt, Human
gaaacccugucucuacuaa

SEQ ID NO: 93397 - RNA, 19 nt, Human
gaacauggcucacugcagc

SEQ ID NO: 93398 - RNA, 19 nt, Human
gaacauggcucacugcagc

SEQ ID NO: 93399 - RNA, 24 nt, Human
gacagagcgagauucugucucaaa

SEQ ID NO: 93400 - RNA, 24 nt, Human
gacagagcgagauucugucucaaa

SEQ ID NO: 93401 - RNA, 22 nt, Human
gacgcacccaggggcugcucag

SEQ ID NO: 93402 - RNA, 23 nt, Human
gagaucacgccacugcacuccag

SEQ ID NO: 93403 - RNA, 30 nt, Human
gagcaucuaagacaagagcaaacgucuaaa

SEQ ID NO: 93404 - RNA, 18 nt, Human
gagcuugcggugagccga

SEQ ID NO: 93405 - RNA, 18 nt, Human
gagcuugcggugagccga

SEQ ID NO: 93406 - RNA, 23 nt, Human
gagguggguggaucacgagguca

SEQ ID NO: 93407 - RNA, 23 nt, Human
gagguggguggaucacgagguca

SEQ ID NO: 93408 - RNA, 18 nt, Human
gauuauagacaugagcca

SEQ ID NO: 93409 - RNA, 18 nt, Human
gauuauagacaugagcca

SEQ ID NO: 93410 - RNA, 21 nt, Human
gauuauagacaugagccacca

SEQ ID NO: 93411 - RNA, 21 nt, Human
gauuauagacaugagccacca

SEQ ID NO: 93412 - RNA, 24 nt, Human
gauuauagacaugagccaccauac

SEQ ID NO: 93413 - RNA, 24 nt, Human
gauuauagacaugagccaccauac

SEQ ID NO: 93414 - RNA, 20 nt, Human
gcaaaugcauaaaaagaccc

SEQ ID NO: 93415 - RNA, 20 nt, Human
gcaaaugcauaaaaagaccc

SEQ ID NO: 93416 - RNA, 21 nt, Human
gcaagggaagggcacuucaaa

SEQ ID NO: 93417 - RNA, 24 nt, Human
gcacuccagccugggcgacagagc

SEQ ID NO: 93418 - RNA, 24 nt, Human
gcacuccagccugggcgacagagc

SEQ ID NO: 93419 - RNA, 24 nt, Human
gcagaaagucagccucauccggga

SEQ ID NO: 93420 - RNA, 22 nt, Human
gccacugcacuccagccugggc

SEQ ID NO: 93421 - RNA, 22 nt, Human
gccacugcacuccagccugggc

SEQ ID NO: 93422 - RNA, 24 nt, Human
gccacugcacuccagccugggcga

SEQ ID NO: 93423 - RNA, 24 nt, Human
gccacugcacuccagccugggcga

SEQ ID NO: 93424 - RNA, 20 nt, Human
gccgagaucacgccacugca

SEQ ID NO: 93425 - RNA, 20 nt, Human
gccgagaucacgccacugca

SEQ ID NO: 93426 - RNA, 24 nt, Human
gcgacagagcgagauucugucuca

SEQ ID NO: 93427 - RNA, 24 nt, Human
gcgacagagcgagauucugucuca

SEQ ID NO: 93428 - RNA, 19 nt, Human
gcgggguacaggcaggcag

SEQ ID NO: 93429 - RNA, 22 nt, Human
gcuaaaaacauucucaaacccu

SEQ ID NO: 93430 - RNA, 24 nt, Human
gcuaacacagugaaacccugucuc

SEQ ID NO: 93431 - RNA, 24 nt, Human
gcuaacacagugaaacccugucuc

SEQ ID NO: 93432 - RNA, 22 nt, Human
gcucacugcagccuuggaccuc

SEQ ID NO: 93433 - RNA, 22 nt, Human
gcucacugcagccuuggaccuc

SEQ ID NO: 93434 - RNA, 20 nt, Human
gcucugucacccaagcuuga

SEQ ID NO: 93435 - RNA, 20 nt, Human
gcucugucacccaagcuuga

SEQ ID NO: 93436 - RNA, 22 nt, Human
gcugaggcaggagaauggcgug

SEQ ID NO: 93437 - RNA, 22 nt, Human
gcugaggcaggagaauggcgug

SEQ ID NO: 93438 - RNA, 18 nt, Human
ggaaaaaagauacuuaaa

SEQ ID NO: 93439 - RNA, 18 nt, Human
ggaaaaaagauacuuaaa

SEQ ID NO: 93440 - RNA, 22 nt, Human
ggagagcuuauuuaaaacuugu

SEQ ID NO: 93441 - RNA, 22 nt, Human
ggagagcuuauuuaaaacuugu

SEQ ID NO: 93442 - RNA, 18 nt, Human
ggagcuugcggugagccg

SEQ ID NO: 93443 - RNA, 18 nt, Human
ggagcuugcggugagccg

SEQ ID NO: 93444 - RNA, 24 nt, Human
ggagcuugcggugagccgagauca

SEQ ID NO: 93445 - RNA, 24 nt, Human
ggagcuugcggugagccgagauca

SEQ ID NO: 93446 - RNA, 19 nt, Human
ggauuauagacaugagcca

SEQ ID NO: 93447 - RNA, 19 nt, Human
ggauuauagacaugagcca

SEQ ID NO: 93448 - RNA, 21 nt, Human
ggccaggcgcgguggcucacg

SEQ ID NO: 93449 - RNA, 23 nt, Human
ggccaggcgcgguggcucacgcc

SEQ ID NO: 93450 - RNA, 22 nt, Human
ggggacggggucuugcucuguc

SEQ ID NO: 93451 - RNA, 22 nt, Human
ggggacggggucuugcucuguc

SEQ ID NO: 93452 - RNA, 24 nt, Human
ggguggaucacgaggucaggagau

SEQ ID NO: 93453 - RNA, 21 nt, Human
gguggaucacgaggucaggag

SEQ ID NO: 93454 - RNA, 21 nt, Human
gguggaucacgaggucaggag

SEQ ID NO: 93455 - RNA, 23 nt, Human
gguggcucacgccuguaauccca

SEQ ID NO: 93456 - RNA, 23 nt, Human
gguggcucacgccuguaauccca

SEQ ID NO: 93457 - RNA, 24 nt, Human
gguggcucacgccuguaaucccag

SEQ ID NO: 93458 - RNA, 24 nt, Human
gguggcucacgccuguaaucccag

SEQ ID NO: 93459 - RNA, 18 nt, Human
gucaccuucuucugaagc

SEQ ID NO: 93460 - RNA, 21 nt, Human
gugaaacccugucucuacuaa

SEQ ID NO: 93461 - RNA, 21 nt, Human
gugaaacccugucucuacuaa

SEQ ID NO: 93462 - RNA, 18 nt, Human
uaaaaagaccccagagca

SEQ ID NO: 93463 - RNA, 18 nt, Human
uaaaaagaccccagagca

SEQ ID NO: 93464 - RNA, 24 nt, Human
uaaaaggaggagaaccugugaaaa

SEQ ID NO: 93465 - RNA, 25 nt, Human
uaaaauaauccaagcagagaugaaa

SEQ ID NO: 93466 - RNA, 21 nt, Human
uaacacagugaaacccugucu

SEQ ID NO: 93467 - RNA, 21 nt, Human
uaacacagugaaacccugucu

SEQ ID NO: 93468 - RNA, 22 nt, Human
uaacacagugaaacccugucuc

SEQ ID NO: 93469 - RNA, 22 nt, Human
uaacacagugaaacccugucuc

SEQ ID NO: 93470 - RNA, 24 nt, Human
uaacacagugaaacccugucucua

SEQ ID NO: 93471 - RNA, 24 nt, Human
uaacacagugaaacccugucucua

SEQ ID NO: 93472 - RNA, 22 nt, Human
uacugugguccaugaguuggua

SEQ ID NO: 93473 - RNA, 19 nt, Human
uagaauauuaacagugggc

SEQ ID NO: 93474 - RNA, 21 nt, Human
uaggaaacacaguuauucaca

SEQ ID NO: 93475 - RNA, 19 nt, Human
uaucaucgccucgaggaca

SEQ ID NO: 93476 - RNA, 18 nt, Human
ucacgaggucaggagauc

SEQ ID NO: 93477 - RNA, 18 nt, Human
ucacgaggucaggagauc

SEQ ID NO: 93478 - RNA, 24 nt, Human
ucacgaggucaggagaucaagacc

SEQ ID NO: 93479 - RNA, 24 nt, Human
ucacgaggucaggagaucaagacc

SEQ ID NO: 93480 - RNA, 23 nt, Human
ucacgccacugcacuccagccug

SEQ ID NO: 93481 - RNA, 23 nt, Human
ucacgccacugcacuccagccug

SEQ ID NO: 93482 - RNA, 24 nt, Human
ucacugcagccuuggaccucuugg

SEQ ID NO: 93483 - RNA, 25 nt, Human
ucacugcagccuuggaccucuuggg

SEQ ID NO: 93484 - RNA, 25 nt, Human
ucacugcagccuuggaccucuuggg

SEQ ID NO: 93485 - RNA, 20 nt, Human
ucauccgggauauaucucgu

SEQ ID NO: 93486 - RNA, 23 nt, Human
uccagccugggcgacagagcgag

SEQ ID NO: 93487 - RNA, 23 nt, Human
uccagccugggcgacagagcgag

SEQ ID NO: 93488 - RNA, 24 nt, Human
uccagccugggcgacagagcgaga

SEQ ID NO: 93489 - RNA, 24 nt, Human
uccagccugggcgacagagcgaga

SEQ ID NO: 93490 - RNA, 26 nt, Human
uccauuuucuugaaacauggcccuuu

SEQ ID NO: 93491 - RNA, 20 nt, Human
ucccaaagccuuaagcauaa

SEQ ID NO: 93492 - RNA, 18 nt, Human
ucccaaagugcugggauu

SEQ ID NO: 93493 - RNA, 18 nt, Human
ucccaaagugcugggauu

SEQ ID NO: 93494 - RNA, 24 nt, Human
ucccaaagugcugggauuauagac

SEQ ID NO: 93495 - RNA, 24 nt, Human
ucccaaagugcugggauuauagac

SEQ ID NO: 93496 - RNA, 22 nt, Human
uccccagcagaaagucagccuc

SEQ ID NO: 93497 - RNA, 19 nt, Human
uccccuaaccugccuaacu

SEQ ID NO: 93498 - RNA, 21 nt, Human
uccccuaaccugccuaacucc

SEQ ID NO: 93499 - RNA, 27 nt, Human
uccucccaccucaaccucccaaagugc

SEQ ID NO: 93500 - RNA, 27 nt, Human
uccucccaccucaaccucccaaagugc

SEQ ID NO: 93501 - RNA, 23 nt, Human
ucuaagacaagagcaaacgucua

SEQ ID NO: 93502 - RNA, 23 nt, Human
ucucacgaugguagcaccuucgu

SEQ ID NO: 93503 - RNA, 18 nt, Human
ucugaaucauaagcccuc

SEQ ID NO: 93504 - RNA, 18 nt, Human
ucugaaucauaagcccuc

SEQ ID NO: 93505 - RNA, 25 nt, Human
ucugcaggcuucuaauauuuauugc

SEQ ID NO: 93506 - RNA, 19 nt, Human
ucugcaggguuucgguagg

SEQ ID NO: 93507 - RNA, 24 nt, Human
ucugucacccaagcuugagugcag

SEQ ID NO: 93508 - RNA, 24 nt, Human
ucugucacccaagcuugagugcag

SEQ ID NO: 93509 - RNA, 18 nt, Human
ucuugcucugucacccaa

SEQ ID NO: 93510 - RNA, 18 nt, Human
ucuugcucugucacccaa

SEQ ID NO: 93511 - RNA, 24 nt, Human
ucuugcucugucacccaagcuuga

SEQ ID NO: 93512 - RNA, 24 nt, Human
ucuugcucugucacccaagcuuga

SEQ ID NO: 93513 - RNA, 24 nt, Human
ucuugcucugucacccaagcuuga

SEQ ID NO: 93514 - RNA, 25 nt, Human
ucuugcucugucacccaagcuugag

SEQ ID NO: 93515 - RNA, 25 nt, Human
ucuugcucugucacccaagcuugag

SEQ ID NO: 93516 - RNA, 27 nt, Human
ugaaaaaaaacacaaaagauaaaagga

SEQ ID NO: 93517 - RNA, 19 nt, Human
ugaaaacacuucccucccc

SEQ ID NO: 93518 - RNA, 18 nt, Human
ugaaacauggcccuuuug

SEQ ID NO: 93519 - RNA, 22 nt, Human
ugaaagagcaaaugcaaaugca

SEQ ID NO: 93520 - RNA, 22 nt, Human
ugaaagagcaaaugcaaaugca

SEQ ID NO: 93521 - RNA, 22 nt, Human
ugagccgagaucacgccacugc

SEQ ID NO: 93522 - RNA, 22 nt, Human
ugagccgagaucacgccacugc

SEQ ID NO: 93523 - RNA, 20 nt, Human
ugaggcaggagaauggccug

SEQ ID NO: 93524 - RNA, 24 nt, Human
ugaggcaggagaauggccugaacc

SEQ ID NO: 93525 - RNA, 25 nt, Human
ugaggcaggagaauggccugaaccc

SEQ ID NO: 93526 - RNA, 23 nt, Human
ugaggcaggagaauggcgugaac

SEQ ID NO: 93527 - RNA, 23 nt, Human
ugaggcaggagaauggcgugaac

SEQ ID NO: 93528 - RNA, 24 nt, Human
ugaggcaggagaauggcgugaacc

SEQ ID NO: 93529 - RNA, 24 nt, Human
ugaggcaggagaauggcgugaacc

SEQ ID NO: 93530 - RNA, 25 nt, Human
ugaggcaggagaauggcgugaaccc

SEQ ID NO: 93531 - RNA, 25 nt, Human
ugaggcaggagaauggcgugaaccc

SEQ ID NO: 93532 - RNA, 21 nt, Human
ugaggugaugauaaauccauu

SEQ ID NO: 93533 - RNA, 18 nt, Human
ugcauaaaaagaccccag

SEQ ID NO: 93534 - RNA, 28 nt, Human
ugccaccagcuaaaaacauucccaaagc

SEQ ID NO: 93535 - RNA, 28 nt, Human
ugccaccagcuaaaaacauucccaaagc

SEQ ID NO: 93536 - RNA, 21 nt, Human
ugcucagacagcagaugcucc

SEQ ID NO: 93537 - RNA, 24 nt, Human
ugcucugucacccaagcuugagug

SEQ ID NO: 93538 - RNA, 24 nt, Human
ugcucugucacccaagcuugagug

SEQ ID NO: 93539 - RNA, 20 nt, Human
uggaaaaaagauacuuaaau

SEQ ID NO: 93540 - RNA, 21 nt, Human
uggcgggguacaggcaggcag

SEQ ID NO: 93541 - RNA, 22 nt, Human
uggcucacgccuguaaucccag

SEQ ID NO: 93542 - RNA, 22 nt, Human
uggcucacgccuguaaucccag

SEQ ID NO: 93543 - RNA, 24 nt, Human
uggcucacgccuguaaucccagca

SEQ ID NO: 93544 - RNA, 24 nt, Human
uggcucacgccuguaaucccagca

SEQ ID NO: 93545 - RNA, 25 nt, Human
uggcucacugcagccuuggaccucu

SEQ ID NO: 93546 - RNA, 25 nt, Human
uggcucacugcagccuuggaccucu

SEQ ID NO: 93547 - RNA, 19 nt, Human
uggcucuucugccucccuc

SEQ ID NO: 93548 - RNA, 23 nt, Human
ugggaggccgagguggguggauc

SEQ ID NO: 93549 - RNA, 23 nt, Human
ugggaggccgagguggguggauc

SEQ ID NO: 93550 - RNA, 24 nt, Human
ugggaggccgagguggguggauca

SEQ ID NO: 93551 - RNA, 24 nt, Human
ugggaggccgagguggguggauca

SEQ ID NO: 93552 - RNA, 18 nt, Human
ugggauuauagacaugag

SEQ ID NO: 93553 - RNA, 18 nt, Human
ugggauuauagacaugag

SEQ ID NO: 93554 - RNA, 22 nt, Human
ugggauuauagacaugagccac

SEQ ID NO: 93555 - RNA, 22 nt, Human
ugggauuauagacaugagccac

SEQ ID NO: 93556 - RNA, 24 nt, Human
ugggauuauagacaugagccacca

SEQ ID NO: 93557 - RNA, 24 nt, Human
ugggauuauagacaugagccacca

SEQ ID NO: 93558 - RNA, 18 nt, Human
uggggcuugaucucaaaa

SEQ ID NO: 93559 - RNA, 21 nt, Human
ugggggccuccuguccaucag

SEQ ID NO: 93560 - RNA, 22 nt, Human
uggguucaagcaaauccuccca

SEQ ID NO: 93561 - RNA, 22 nt, Human
uggguucaagcaaauccuccca

SEQ ID NO: 93562 - RNA, 23 nt, Human
ugguaguguggaauuuagcuuug

SEQ ID NO: 93563 - RNA, 23 nt, Human
ugguaguguggaauuuagcuuug

SEQ ID NO: 93564 - RNA, 23 nt, Human
ugguggcgggccccuguaguccc

SEQ ID NO: 93565 - RNA, 23 nt, Human
ugguggcgggccccuguaguccc

SEQ ID NO: 93566 - RNA, 24 nt, Human
ugguggcgggccccuguaguccca

SEQ ID NO: 93567 - RNA, 24 nt, Human
ugguggcgggccccuguaguccca

SEQ ID NO: 93568 - RNA, 21 nt, Human
ugucacccaagcuugagugca

SEQ ID NO: 93569 - RNA, 19 nt, Human
ugugaaaacacuucccucc

SEQ ID NO: 93570 - RNA, 19 nt, Human
ugugaacauggcucacugc

SEQ ID NO: 93571 - RNA, 19 nt, Human
ugugaacauggcucacugc

SEQ ID NO: 93572 - RNA, 23 nt, Human
ugugguggcgggccccuguaguc

SEQ ID NO: 93573 - RNA, 23 nt, Human
ugugguggcgggccccuguaguc

SEQ ID NO: 93574 - RNA, 26 nt, Human
uuaaaaaauguuuuggaaaaaagaua

SEQ ID NO: 93575 - RNA, 26 nt, Human
uuaaaaaauguuuuggaaaaaagaua

SEQ ID NO: 93576 - RNA, 23 nt, Human
uuaaaaguuuucaaacaaauuug

SEQ ID NO: 93577 - RNA, 23 nt, Human
uuaaaaguuuucaaacaaauuug

SEQ ID NO: 93578 - RNA, 25 nt, Human
uucaagcaaauccucccaccucaac

SEQ ID NO: 93579 - RNA, 25 nt, Human
uucaagcaaauccucccaccucaac

SEQ ID NO: 93580 - RNA, 23 nt, Human
uucagcagggcuugaaaaaaaac

SEQ ID NO: 93581 - RNA, 21 nt, Human
uucccaagguucaagugacca

SEQ ID NO: 93582 - RNA, 21 nt, Human
uugaauuuuuaaaagauuuca

SEQ ID NO: 93583 - RNA, 24 nt, Human
uugauuuaaaaaaaaauaggcaua

SEQ ID NO: 93584 - RNA, 18 nt, Human
uugcggugagccgagauc

SEQ ID NO: 93585 - RNA, 18 nt, Human
uugcggugagccgagauc

SEQ ID NO: 93586 - RNA, 20 nt, Human
uugcggugagccgagaucac

SEQ ID NO: 93587 - RNA, 20 nt, Human
uugcggugagccgagaucac

SEQ ID NO: 93588 - RNA, 21 nt, Human
uugcggugagccgagaucacg

SEQ ID NO: 93589 - RNA, 21 nt, Human
uugcggugagccgagaucacg

SEQ ID NO: 93590 - RNA, 25 nt, Human
uugggaggccgagguggguggauca

SEQ ID NO: 93591 - RNA, 25 nt, Human
uugggaggccgagguggguggauca

SEQ ID NO: 93592 - RNA, 22 nt, Human
uugguagauuuucaaaaucuca

SEQ ID NO: 93593 - RNA, 22 nt, Human
uuugaauuuuuaaaagauuuca

SEQ ID NO: 93594 - RNA, 27 nt, Human
uuuuuggggacggggucuugcucuguc

SEQ ID NO: 93595 - RNA, 27 nt, Human
uuuuuggggacggggucuugcucuguc

SEQ ID NO: 93596 - RNA, 19 nt, Human
uuuuuuuuuuuuuuuuuaa

SEQ ID NO: 93597 - RNA, 19 nt, Human
uuuuuuuuuuuuuuuuuaa

SEQ ID NO: 93598 - RNA, 25 nt, Human
uuuuuuuuuuuuuuuuuuuuuaagg

SEQ ID NO: 93599 - RNA, 25 nt, Human
aauaaaaaauggaugaacaauugaa

SEQ ID NO: 93600 - RNA, 21 nt, Human
acacauacauacauauacaca

SEQ ID NO: 93601 - RNA, 24 nt, Human
accaaaaacagauaagcaaaucag

SEQ ID NO: 93602 - RNA, 20 nt, Human
agccucuuccuuagcagucc

SEQ ID NO: 93603 - RNA, 33 nt, Human
auacagaaacacacauacauacauauacacagu

SEQ ID NO: 93604 - RNA, 26 nt, Human
caaaaacagauaagcaaaucagaaug

SEQ ID NO: 93605 - RNA, 21 nt, Human
cacauacauacauauacacac

SEQ ID NO: 93606 - RNA, 18 nt, Human
caccaccugcggccagac

SEQ ID NO: 93607 - RNA, 22 nt, Human
caccugcggccagacgucaggc

SEQ ID NO: 93608 - RNA, 21 nt, Human
cagauggacucccuccgacuc

SEQ ID NO: 93609 - RNA, 24 nt, Human
cuaccgcgccaugcagccucuucc

SEQ ID NO: 93610 - RNA, 18 nt, Human
cucucugguuucccaggg

SEQ ID NO: 93611 - RNA, 33 nt, Human
gcauauacagaaacacacauacauacauauagu

SEQ ID NO: 93612 - RNA, 27 nt, Human
uacauacauauacacacgguauuuuac

SEQ ID NO: 93613 - RNA, 20 nt, Human
uaccaaaacaaggaggcaau

SEQ ID NO: 93614 - RNA, 21 nt, Human
uagaaagucauuucuuuaaaa

SEQ ID NO: 93615 - RNA, 22 nt, Human
uagauuaucaucugguaaccaa

SEQ ID NO: 93616 - RNA, 22 nt, Human
ucaauacaucacuguugcuuuc

SEQ ID NO: 93617 - RNA, 19 nt, Human
uccccgaccuacuuggccg

SEQ ID NO: 93618 - RNA, 22 nt, Human
ucccucacggaccgggccccua

SEQ ID NO: 93619 - RNA, 25 nt, Human
uccuuggcuaggcaaagccgggguc

SEQ ID NO: 93620 - RNA, 21 nt, Human
ugaaauuagagagucacugag

SEQ ID NO: 93621 - RNA, 20 nt, Human
ugaccaaaaacagauaagca

SEQ ID NO: 93622 - RNA, 20 nt, Human
ugcggccagacgucaggcgc

SEQ ID NO: 93623 - RNA, 21 nt, Human
ugcggccagacgucaggcgcg

SEQ ID NO: 93624 - RNA, 20 nt, Human
ugguuucccaggggcagccg

SEQ ID NO: 93625 - RNA, 22 nt, Human
ugugaaauuagagagucacuga

SEQ ID NO: 93626 - RNA, 31 nt, Human
ugugugcauauacagaaacacacauacagug

SEQ ID NO: 93627 - RNA, 24 nt, Human
ugugugugcauauacagaaacaca

SEQ ID NO: 93628 - RNA, 25 nt, Human
uguugcuuucauuuugguaaguucu

SEQ ID NO: 93629 - RNA, 26 nt, Human
uuuacaugguuuuauuauacauuacu

SEQ ID NO: 93630 - RNA, 26 nt, Human
aaacagaagucagauaagagggaccc

SEQ ID NO: 93631 - RNA, 19 nt, Human
acacaguauucucccuucc

SEQ ID NO: 93632 - RNA, 20 nt, Human
agaagagguuagcuggggua

SEQ ID NO: 93633 - RNA, 18 nt, Human
agagagcaugaaaagacc

SEQ ID NO: 93634 - RNA, 21 nt, Human
agauaagagagagcuggccug

SEQ ID NO: 93635 - RNA, 19 nt, Human
agaugucuuuauugaggcc

SEQ ID NO: 93636 - RNA, 20 nt, Human
agcaugaaaagaccaguggg

SEQ ID NO: 93637 - RNA, 23 nt, Human
aggacaagggaaggcaggagaga

SEQ ID NO: 93638 - RNA, 25 nt, Human
aggcaggagagagcaugaaaagacc

SEQ ID NO: 93639 - RNA, 19 nt, Human
agggaaggacaagggaagg

SEQ ID NO: 93640 - RNA, 21 nt, Human
agggaggggccccuggguccc

SEQ ID NO: 93641 - RNA, 23 nt, Human
aggggcucaagugggagggggga

SEQ ID NO: 93642 - RNA, 23 nt, Human
aguauggagagugauggaagaga

SEQ ID NO: 93643 - RNA, 25 nt, Human
caaacacaguauucucccuuccuuc

SEQ ID NO: 93644 - RNA, 23 nt, Human
caagaaagaguauggagagugau

SEQ ID NO: 93645 - RNA, 25 nt, Human
cagcauauagaccccaguuagcucu

SEQ ID NO: 93646 - RNA, 18 nt, Human
caugaaaagaccaguggg

SEQ ID NO: 93647 - RNA, 24 nt, Human
ccccugggucccagauucugaguu

SEQ ID NO: 93648 - RNA, 21 nt, Human
cucagggaaggacaagggaag

SEQ ID NO: 93649 - RNA, 20 nt, Human
cucccuuccuucuggccaag

SEQ ID NO: 93650 - RNA, 22 nt, Human
cugagauacagucccaaacaca

SEQ ID NO: 93651 - RNA, 24 nt, Human
gaauuccuuuuuuuuuuuuuuuuu

SEQ ID NO: 93652 - RNA, 18 nt, Human
gacaagggaaggcaggag

SEQ ID NO: 93653 - RNA, 19 nt, Human
gauucugaguuaggggcuc

SEQ ID NO: 93654 - RNA, 25 nt, Human
gcaugaaaagaccaguggggcugaa

SEQ ID NO: 93655 - RNA, 21 nt, Human
ggaaggacaagggaaggcagg

SEQ ID NO: 93656 - RNA, 20 nt, Human
ggacaagggaaggcaggaga

SEQ ID NO: 93657 - RNA, 21 nt, Human
ggauaagaaacagaagucaga

SEQ ID NO: 93658 - RNA, 20 nt, Human
ggcccagagcaguggacaga

SEQ ID NO: 93659 - RNA, 22 nt, Human
gggccccugggucccagauucu

SEQ ID NO: 93660 - RNA, 21 nt, Human
ggguagggaggggccccuggg

SEQ ID NO: 93661 - RNA, 24 nt, Human
gucagaaagauacaggauuagaga

SEQ ID NO: 93662 - RNA, 21 nt, Human
uaagagagagcuggccuggug

SEQ ID NO: 93663 - RNA, 25 nt, Human
uaagagagagcuggccuggugucua

SEQ ID NO: 93664 - RNA, 22 nt, Human
uagcucuauggcagagaauaac

SEQ ID NO: 93665 - RNA, 22 nt, Human
uaggggcucaagugggaggggg

SEQ ID NO: 93666 - RNA, 22 nt, Human
ucauuugcucaucaaaugaggg

SEQ ID NO: 93667 - RNA, 20 nt, Human
uccagaagagguuagcuggg

SEQ ID NO: 93668 - RNA, 19 nt, Human
ucccuggaggaacucaggg

SEQ ID NO: 93669 - RNA, 18 nt, Human
uccuuuuuuuuuuuuuuu

SEQ ID NO: 93670 - RNA, 18 nt, Human
uccuuuuuuuuuuuuuuu

SEQ ID NO: 93671 - RNA, 24 nt, Human
ugaaaagaccaguggggcugaaag

SEQ ID NO: 93672 - RNA, 20 nt, Human
ugaggccucucauuugaccc

SEQ ID NO: 93673 - RNA, 20 nt, Human
uggcccagagcaguggacag

SEQ ID NO: 93674 - RNA, 20 nt, Human
ugggauaagaaacagaaguc

SEQ ID NO: 93675 - RNA, 21 nt, Human
ugggaucuggguuggcucucc

SEQ ID NO: 93676 - RNA, 25 nt, Human
ugucucagcacccagcauauagacc

SEQ ID NO: 93677 - RNA, 18 nt, Human
uuaugggauaagaaacag

SEQ ID NO: 93678 - RNA, 18 nt, Human
uuuuuuucaugcugcccc

SEQ ID NO: 93679 - RNA, 25 nt, Human
aacuggagaguuaauugacugcugg

SEQ ID NO: 93680 - RNA, 22 nt, Human
aaggagcuggcugggugugggg

SEQ ID NO: 93681 - RNA, 23 nt, Human
acacuaaaucuaccaagcacaau

SEQ ID NO: 93682 - RNA, 18 nt, Human
agaauuaguuagcuagua

SEQ ID NO: 93683 - RNA, 18 nt, Human
agagagcagacaggcuga

SEQ ID NO: 93684 - RNA, 23 nt, Human
agcaaagaacaagaucuguuccg

SEQ ID NO: 93685 - RNA, 20 nt, Human
agcagcuacagagaaggggu

SEQ ID NO: 93686 - RNA, 20 nt, Human
aguuuucccccacccuccac

SEQ ID NO: 93687 - RNA, 24 nt, Human
cacucuaugccugugaguuagaaa

SEQ ID NO: 93688 - RNA, 19 nt, Human
cagaauagaggacagaaga

SEQ ID NO: 93689 - RNA, 24 nt, Human
cagcaaagaacaagaucuguuccg

SEQ ID NO: 93690 - RNA, 33 nt, Human
caugacccuugaugguccagcaaagaacaaggg

SEQ ID NO: 93691 - RNA, 18 nt, Human
cauuucaagcccucucca

SEQ ID NO: 93692 - RNA, 23 nt, Human
cauuugaaaaggcauuugcugaa

SEQ ID NO: 93693 - RNA, 18 nt, Human
ccaaggcugagccuucuc

SEQ ID NO: 93694 - RNA, 18 nt, Human
ccaaucagagacaugaac

SEQ ID NO: 93695 - RNA, 18 nt, Human
ccaaucagagacaugaac

SEQ ID NO: 93696 - RNA, 20 nt, Human
ccuuguugagcaaggagaga

SEQ ID NO: 93697 - RNA, 22 nt, Human
cuaggaagccagcugacccaau

SEQ ID NO: 93698 - RNA, 24 nt, Human
cugcauuugaaaaggcauuugcug

SEQ ID NO: 93699 - RNA, 22 nt, Human
cugcuaagugggauugcugcau

SEQ ID NO: 93700 - RNA, 22 nt, Human
cuggaggagggaucccaacuga

SEQ ID NO: 93701 - RNA, 18 nt, Human
cuugaauauccaaguuca

SEQ ID NO: 93702 - RNA, 20 nt, Human
cuugccaacuagagggaagu

SEQ ID NO: 93703 - RNA, 20 nt, Human
gaagacuguuagaggccuug

SEQ ID NO: 93704 - RNA, 23 nt, Human
gacgcaaagggagugggaaaaga

SEQ ID NO: 93705 - RNA, 18 nt, Human
gagcaaaucaaccuccca

SEQ ID NO: 93706 - RNA, 21 nt, Human
gaugauggaaaagggaaagga

SEQ ID NO: 93707 - RNA, 21 nt, Human
gccaauugugggaguacugau

SEQ ID NO: 93708 - RNA, 21 nt, Human
gcucagaaggcacuuugggau

SEQ ID NO: 93709 - RNA, 20 nt, Human
ggaaaggagcuggcugggug

SEQ ID NO: 93710 - RNA, 21 nt, Human
gggaaaggagcuggcugggug

SEQ ID NO: 93711 - RNA, 25 nt, Human
guuuucccccacccuccacuccugc

SEQ ID NO: 93712 - RNA, 18 nt, Human
uagaggccuuguugagcc

SEQ ID NO: 93713 - RNA, 26 nt, Human
ucaaccucccaucccaguuuccuaau

SEQ ID NO: 93714 - RNA, 23 nt, Human
ucagagacaugaacccaucagaa

SEQ ID NO: 93715 - RNA, 20 nt, Human
ucaucagaauuguuuggagu

SEQ ID NO: 93716 - RNA, 19 nt, Human
ucccaucccaguuuccuaa

SEQ ID NO: 93717 - RNA, 24 nt, Human
ucccccacccuccacuccugcuga

SEQ ID NO: 93718 - RNA, 21 nt, Human
ugauggaaaagggaaaggagc

SEQ ID NO: 93719 - RNA, 21 nt, Human
ugauuuauaaguuugcuucca

SEQ ID NO: 93720 - RNA, 24 nt, Human
ugccaugacccuugaugguccagc

SEQ ID NO: 93721 - RNA, 20 nt, Human
ugcccuggccaauuguggga

SEQ ID NO: 93722 - RNA, 22 nt, Human
ugcugaaugaugcugcuccuga

SEQ ID NO: 93723 - RNA, 20 nt, Human
ugcugccaccuugugcuguc

SEQ ID NO: 93724 - RNA, 20 nt, Human
ugcuugcugccaccuugugc

SEQ ID NO: 93725 - RNA, 18 nt, Human
uggaggagggaucccaac

SEQ ID NO: 93726 - RNA, 20 nt, Human
ugggaaaagagaugauggaa

SEQ ID NO: 93727 - RNA, 24 nt, Human
ugggaaaagagaugauggaaaagg

SEQ ID NO: 93728 - RNA, 19 nt, Human
ugggauuuuuuuuuuuuuc

SEQ ID NO: 93729 - RNA, 24 nt, Human
ugugauuuuguuuucaucagaauu

SEQ ID NO: 93730 - RNA, 20 nt, Human
ugugcugucuguaugguagu

SEQ ID NO: 93731 - RNA, 19 nt, Human
uucccccacccuccacucc

SEQ ID NO: 93732 - RNA, 23 nt, Human
uugaaauaaguuuaacaaagcca

SEQ ID NO: 93733 - RNA, 20 nt, Human
uugcugaaugaugcugcucc

SEQ ID NO: 93734 - RNA, 23 nt, Human
uugcugcauuugaaaaggcauuu

SEQ ID NO: 93735 - RNA, 20 nt, Human
uugcugccaccuugugcugu

SEQ ID NO: 93736 - RNA, 22 nt, Human
uugcugccaccuugugcugucu

SEQ ID NO: 93737 - RNA, 25 nt, Human
uuuagagagcaaaucaaccucccau

SEQ ID NO: 93738 - RNA, 18 nt, Human
uuucccccacccuccacu

SEQ ID NO: 93739 - RNA, 19 nt, Human
uuuguuuucaucagaauug

SEQ ID NO: 93740 - RNA, 22 nt, Human
uuuuuuuuuuuucagugccuca

SEQ ID NO: 93741 - RNA, 18 nt, Human
aaacagcucccuccuucc

SEQ ID NO: 93742 - RNA, 22 nt, Human
aaucuccauuucugccuuccuc

SEQ ID NO: 93743 - RNA, 19 nt, Human
acagcucccuccuuccacu

SEQ ID NO: 93744 - RNA, 20 nt, Human
agaggaaaggagucuggggc

SEQ ID NO: 93745 - RNA, 18 nt, Human
agcaguucacucccugca

SEQ ID NO: 93746 - RNA, 23 nt, Human
augagacagcuaggaguuuggag

SEQ ID NO: 93747 - RNA, 22 nt, Human
auucacugucauuuaagauggu

SEQ ID NO: 93748 - RNA, 19 nt, Human
cagcucccuccuuccacuc

SEQ ID NO: 93749 - RNA, 22 nt, Human
caggucaagcguugccugugcc

SEQ ID NO: 93750 - RNA, 18 nt, Human
ccccaagaaaccucucug

SEQ ID NO: 93751 - RNA, 25 nt, Human
cucccuccuuccacucuccugcgcg

SEQ ID NO: 93752 - RNA, 21 nt, Human
gagacagcuaggaguuuggag

SEQ ID NO: 93753 - RNA, 22 nt, Human
gauuccucaucccugggacccc

SEQ ID NO: 93754 - RNA, 19 nt, Human
gggcaagggaugagacagc

SEQ ID NO: 93755 - RNA, 20 nt, Human
ggucaagcguugccugugcc

SEQ ID NO: 93756 - RNA, 19 nt, Human
guggggacacaugucuaca

SEQ ID NO: 93757 - RNA, 21 nt, Human
gugguccuugagucuuuggaa

SEQ ID NO: 93758 - RNA, 19 nt, Human
ucagaggaaaggagucugg

SEQ ID NO: 93759 - RNA, 20 nt, Human
ucagaggaaaggagucuggg

SEQ ID NO: 93760 - RNA, 18 nt, Human
uccucaauccagacuugu

SEQ ID NO: 93761 - RNA, 19 nt, Human
ugcagccaggugccuguug

SEQ ID NO: 93762 - RNA, 18 nt, Human
uggagcaguucacucccu

SEQ ID NO: 93763 - RNA, 18 nt, Human
uggcugcagccaggugcc

SEQ ID NO: 93764 - RNA, 23 nt, Human
ugggaccccaagaaaccucucug

SEQ ID NO: 93765 - RNA, 19 nt, Human
uuggagcaguucacucccu

SEQ ID NO: 93766 - RNA, 20 nt, Human
aacaaaaaccauucuagaaa

SEQ ID NO: 93767 - RNA, 20 nt, Human
aagcugacaccuugguggcc

SEQ ID NO: 93768 - RNA, 21 nt, Human
accagcauagguucuggagga

SEQ ID NO: 93769 - RNA, 18 nt, Human
caaaaaaaauuaagggca

SEQ ID NO: 93770 - RNA, 20 nt, Human
caccagaggaagcugacacc

SEQ ID NO: 93771 - RNA, 23 nt, Human
cagaggaagcugacaccuuggug

SEQ ID NO: 93772 - RNA, 19 nt, Human
cagcauagguucuggagga

SEQ ID NO: 93773 - RNA, 19 nt, Human
caguacacaggugaaccag

SEQ ID NO: 93774 - RNA, 23 nt, Human
ccauccaccagcugaagauuuua

SEQ ID NO: 93775 - RNA, 19 nt, Human
ccuuuuguucuucaaaagu

SEQ ID NO: 93776 - RNA, 19 nt, Human
cuagaaaucacccagaaca

SEQ ID NO: 93777 - RNA, 25 nt, Human
cuccugguuuggaaggcgauucacu

SEQ ID NO: 93778 - RNA, 22 nt, Human
cugcugccgaggcuugcugcuu

SEQ ID NO: 93779 - RNA, 23 nt, Human
ggcggccgcucgcgaucuagaac

SEQ ID NO: 93780 - RNA, 21 nt, Human
gugcaaaaauucacuuagcuu

SEQ ID NO: 93781 - RNA, 27 nt, Human
uaaaacauuguuuucuaaacacuaaca

SEQ ID NO: 93782 - RNA, 19 nt, Human
uaagggcaaacugaaaaua

SEQ ID NO: 93783 - RNA, 23 nt, Human
uaccagauaccuuaacuuguauu

SEQ ID NO: 93784 - RNA, 24 nt, Human
uaccagauaccuuaacuuguauuu

SEQ ID NO: 93785 - RNA, 26 nt, Human
uaccagauaccuuaacuuguauuucu

SEQ ID NO: 93786 - RNA, 19 nt, Human
uagcuuuucuuuuguuuuu

SEQ ID NO: 93787 - RNA, 21 nt, Human
ucagagacucaacaaaaacca

SEQ ID NO: 93788 - RNA, 19 nt, Human
ucaguacacaggugaacca

SEQ ID NO: 93789 - RNA, 20 nt, Human
uccaccagcugaagauuuua

SEQ ID NO: 93790 - RNA, 21 nt, Human
uccuuucuuuucuccugguuu

SEQ ID NO: 93791 - RNA, 20 nt, Human
ucuggaaaagaauaacaaac

SEQ ID NO: 93792 - RNA, 22 nt, Human
ucuucaaaagucaccauccacc

SEQ ID NO: 93793 - RNA, 20 nt, Human
ugcucaugggugcggcgggc

SEQ ID NO: 93794 - RNA, 18 nt, Human
ugcugcuuuuuucucauc

SEQ ID NO: 93795 - RNA, 19 nt, Human
uggaaaagaauaacaaacc

SEQ ID NO: 93796 - RNA, 28 nt, Human
uuagcuuuucuuuuguuuuuuugguguu

SEQ ID NO: 93797 - RNA, 22 nt, Human
uucuucaaaagucaccauccac

SEQ ID NO: 93798 - RNA, 24 nt, Human
uuggaaggcgauucacugguuuuu

SEQ ID NO: 93799 - RNA, 24 nt, Human
uuucuguugccaaagccuuuuguu

SEQ ID NO: 93800 - RNA, 22 nt, Human
uuuguucuucaaaagucaccau

SEQ ID NO: 93801 - RNA, 22 nt, Human
uuuuuuuuuuuuuuuaauguuu

SEQ ID NO: 93802 - RNA, 19 nt, Human
uuuuuuuuuuuuuuuuuaa

SEQ ID NO: 93803 - RNA, 22 nt, Human
aaccuucauuuuccccugggga

SEQ ID NO: 93804 - RNA, 22 nt, Human
agauuauuuauuguaaaaaugu

SEQ ID NO: 93805 - RNA, 20 nt, Human
aucaucuuuaucuuuucuuu

SEQ ID NO: 93806 - RNA, 22 nt, Human
auccagugaugagcggguuaca

SEQ ID NO: 93807 - RNA, 18 nt, Human
cacugcaggaggccucgg

SEQ ID NO: 93808 - RNA, 21 nt, Human
caggagaaucuucauccagug

SEQ ID NO: 93809 - RNA, 18 nt, Human
cgcugcacaggugcaggg

SEQ ID NO: 93810 - RNA, 18 nt, Human
gagaaucuucauccagug

SEQ ID NO: 93811 - RNA, 22 nt, Human
gcugcacaggugcagggccccg

SEQ ID NO: 93812 - RNA, 21 nt, Human
uaacauuaauguaacuccagu

SEQ ID NO: 93813 - RNA, 24 nt, Human
uaacuccagugaaaaaaaugaauu

SEQ ID NO: 93814 - RNA, 21 nt, Human
uaucaggaauaaacauuaagc

SEQ ID NO: 93815 - RNA, 24 nt, Human
uccagugaugagcggguuacacgg

SEQ ID NO: 93816 - RNA, 21 nt, Human
ucuguugugaaaucagugcug

SEQ ID NO: 93817 - RNA, 25 nt, Human
ugaaaaaaaugaauuugaucaauua

SEQ ID NO: 93818 - RNA, 20 nt, Human
uggggaaauagcauuaaaaa

SEQ ID NO: 93819 - RNA, 20 nt, Human
uucugaguagaucaucuuua

SEQ ID NO: 93820 - RNA, 24 nt, Human
aagcuuuuggauauaccaggcagc

SEQ ID NO: 93821 - RNA, 23 nt, Human
aaggaagaucuuguauuguaugg

SEQ ID NO: 93822 - RNA, 20 nt, Human
aauaaguguaugaaaaaaaa

SEQ ID NO: 93823 - RNA, 22 nt, Human
aaucagguauacuucuauccuu

SEQ ID NO: 93824 - RNA, 20 nt, Human
acacaauguugagccacuaa

SEQ ID NO: 93825 - RNA, 21 nt, Human
acgaagcugaauagacaugcu

SEQ ID NO: 93826 - RNA, 21 nt, Human
acuccauggccauacccugga

SEQ ID NO: 93827 - RNA, 20 nt, Human
agccaauaaagcgaugguug

SEQ ID NO: 93828 - RNA, 19 nt, Human
aggcaaaaaucaagcagag

SEQ ID NO: 93829 - RNA, 25 nt, Human
aggcaaaaaucaagcagaggggacc

SEQ ID NO: 93830 - RNA, 18 nt, Human
aggcagaaucacaauaug

SEQ ID NO: 93831 - RNA, 20 nt, Human
aggcgcuggaggggggcggu

SEQ ID NO: 93832 - RNA, 21 nt, Human
aggggggcgguggcuccgggg

SEQ ID NO: 93833 - RNA, 22 nt, Human
agguuucccugggcugugcuuu

SEQ ID NO: 93834 - RNA, 22 nt, Human
aguuuggauucaggaaagcgug

SEQ ID NO: 93835 - RNA, 19 nt, Human
auucagacugccaaaaaua

SEQ ID NO: 93836 - RNA, 22 nt, Human
auucaggaaagcgugauuauuc

SEQ ID NO: 93837 - RNA, 24 nt, Human
cacagcauaacagacgguugcaag

SEQ ID NO: 93838 - RNA, 24 nt, Human
cacauccccaagguucuggcagca

SEQ ID NO: 93839 - RNA, 23 nt, Human
cagccaauaaagcgaugguugau

SEQ ID NO: 93840 - RNA, 18 nt, Human
cagcugaaaugggaacac

SEQ ID NO: 93841 - RNA, 24 nt, Human
caggacugccagcccacagagagc

SEQ ID NO: 93842 - RNA, 24 nt, Human
caggaggaauaaaaagcuuuugga

SEQ ID NO: 93843 - RNA, 19 nt, Human
caggcacagaaaauaucau

SEQ ID NO: 93844 - RNA, 19 nt, Human
cagguauacuucuauccuu

SEQ ID NO: 93845 - RNA, 26 nt, Human
cauggccauacccuggaauucuuccc

SEQ ID NO: 93846 - RNA, 22 nt, Human
ccaaaaauagaugaaauagcuc

SEQ ID NO: 93847 - RNA, 21 nt, Human
ccacaugcaaauaaaaaggua

SEQ ID NO: 93848 - RNA, 24 nt, Human
ccagaugaagcccagaagugagcu

SEQ ID NO: 93849 - RNA, 20 nt, Human
cccacagagagcucagcccu

SEQ ID NO: 93850 - RNA, 27 nt, Human
cccguggcuggaugaaaaccggggucc

SEQ ID NO: 93851 - RNA, 18 nt, Human
cccuggaauucuucccuu

SEQ ID NO: 93852 - RNA, 19 nt, Human
ccuuucaacaauauguuca

SEQ ID NO: 93853 - RNA, 24 nt, Human
cgguggcugggagggagccuccug

SEQ ID NO: 93854 - RNA, 20 nt, Human
cucaguuugaguucagaaga

SEQ ID NO: 93855 - RNA, 25 nt, Human
cucccccaucuucuuucugggcaaa

SEQ ID NO: 93856 - RNA, 26 nt, Human
cuggaggggggcgguggcuccgggug

SEQ ID NO: 93857 - RNA, 20 nt, Human
cuuccaggacugccagccca

SEQ ID NO: 93858 - RNA, 19 nt, Human
cuuggauuagguccaaagc

SEQ ID NO: 93859 - RNA, 23 nt, Human
gaguaggcaguugagguuguugg

SEQ ID NO: 93860 - RNA, 18 nt, Human
gccccuccuuggaggccc

SEQ ID NO: 93861 - RNA, 18 nt, Human
ggaggggggcgguggcug

SEQ ID NO: 93862 - RNA, 22 nt, Human
ggcgcuggaggggggcggugga

SEQ ID NO: 93863 - RNA, 21 nt, Human
ggcggggagcgcccgcagcga

SEQ ID NO: 93864 - RNA, 23 nt, Human
ggcugggagggagccuccuggcc

SEQ ID NO: 93865 - RNA, 27 nt, Human
gggaaaaaaaggcgcuggaggggggcg

SEQ ID NO: 93866 - RNA, 22 nt, Human
ggggaaaaaaaggcgcuggagg

SEQ ID NO: 93867 - RNA, 21 nt, Human
ggggaggggccaugugucaca

SEQ ID NO: 93868 - RNA, 21 nt, Human
gggggcgguggcugggaggga

SEQ ID NO: 93869 - RNA, 22 nt, Human
ggggggcgguggcugggaggga

SEQ ID NO: 93870 - RNA, 22 nt, Human
guagaacagacaugucuuggaa

SEQ ID NO: 93871 - RNA, 26 nt, Human
guugguucuuuucuuuuuuuuuuuuu

SEQ ID NO: 93872 - RNA, 28 nt, Human
uaaaaugaccaacauuuugacuaacgag

SEQ ID NO: 93873 - RNA, 19 nt, Human
uaaaauuucaagaagagua

SEQ ID NO: 93874 - RNA, 19 nt, Human
uaaagcgaguugcugaguu

SEQ ID NO: 93875 - RNA, 20 nt, Human
uaaagcgaguugcugaguua

SEQ ID NO: 93876 - RNA, 22 nt, Human
uaaagcgaguugcugaguuaga

SEQ ID NO: 93877 - RNA, 24 nt, Human
uaaagcgaguugcugaguuagacc

SEQ ID NO: 93878 - RNA, 25 nt, Human
uaaagcgaguugcugaguuagaccc

SEQ ID NO: 93879 - RNA, 18 nt, Human
uaacauaaaaugaccaac

SEQ ID NO: 93880 - RNA, 22 nt, Human
uaagaaaaguccccaaaggcag

SEQ ID NO: 93881 - RNA, 22 nt, Human
uacagauugaaucacaaagcca

SEQ ID NO: 93882 - RNA, 18 nt, Human
uaccaggcagcuuucugu

SEQ ID NO: 93883 - RNA, 22 nt, Human
uagaacagacaugucuuggaau

SEQ ID NO: 93884 - RNA, 24 nt, Human
uagugucaaccauacccacuacgg

SEQ ID NO: 93885 - RNA, 20 nt, Human
ucaagaagaguaaggcauua

SEQ ID NO: 93886 - RNA, 19 nt, Human
ucagaagagacauaauacu

SEQ ID NO: 93887 - RNA, 21 nt, Human
uccacaugcaaauaaaaaggu

SEQ ID NO: 93888 - RNA, 22 nt, Human
uccacaugcaaauaaaaagguu

SEQ ID NO: 93889 - RNA, 22 nt, Human
uccaggacugccagcccacaga

SEQ ID NO: 93890 - RNA, 18 nt, Human
uccauggccauacccugg

SEQ ID NO: 93891 - RNA, 24 nt, Human
uccccaagguucuggcagcagagg

SEQ ID NO: 93892 - RNA, 24 nt, Human
ugaaaaaaaaaucauaacugaagg

SEQ ID NO: 93893 - RNA, 23 nt, Human
ugaggaaggaagaucuugggucg

SEQ ID NO: 93894 - RNA, 19 nt, Human
ugagggacuaagcaucuau

SEQ ID NO: 93895 - RNA, 25 nt, Human
ugcucgcgguuggcccggacgugug

SEQ ID NO: 93896 - RNA, 22 nt, Human
ugcugaccucauucaguugaug

SEQ ID NO: 93897 - RNA, 21 nt, Human
uggaacuugaaauuggcacca

SEQ ID NO: 93898 - RNA, 22 nt, Human
uggaagaggcaaaaaucaagca

SEQ ID NO: 93899 - RNA, 20 nt, Human
uggaggggggcgguggcugg

SEQ ID NO: 93900 - RNA, 20 nt, Human
uggauauaccaggcagcuuu

SEQ ID NO: 93901 - RNA, 26 nt, Human
uggcaccaggaaaauuaaaaggaaaa

SEQ ID NO: 93902 - RNA, 18 nt, Human
uggcagcagagggcgggg

SEQ ID NO: 93903 - RNA, 24 nt, Human
uggcagggggaggggccauguguc

SEQ ID NO: 93904 - RNA, 18 nt, Human
uggcccggacgugugcug

SEQ ID NO: 93905 - RNA, 22 nt, Human
uggcuuccaggacugccagccc

SEQ ID NO: 93906 - RNA, 22 nt, Human
ugggaaaagaguuugcugaaaa

SEQ ID NO: 93907 - RNA, 22 nt, Human
ugggaacacaauguugagccac

SEQ ID NO: 93908 - RNA, 24 nt, Human
ugggaacacaauguugagccacua

SEQ ID NO: 93909 - RNA, 18 nt, Human
ugggagggagccuccugg

SEQ ID NO: 93910 - RNA, 25 nt, Human
ugggcaaagggaugcuuggauuagg

SEQ ID NO: 93911 - RNA, 22 nt, Human
ugguucuuuucuuuuuuuuuuu

SEQ ID NO: 93912 - RNA, 21 nt, Human
uguauggggggaaaaaaaggc

SEQ ID NO: 93913 - RNA, 20 nt, Human
ugugaggagguuucccuggg

SEQ ID NO: 93914 - RNA, 22 nt, Human
uguugagccacuaaaccacccc

SEQ ID NO: 93915 - RNA, 19 nt, Human
uuauuccagcaaaauacuu

SEQ ID NO: 93916 - RNA, 24 nt, Human
uucaaucuuuuuauuacugccucc

SEQ ID NO: 93917 - RNA, 18 nt, Human
uucuaauuuuggucuuca

SEQ ID NO: 93918 - RNA, 23 nt, Human
uucugggcaaagggaugcuugga

SEQ ID NO: 93919 - RNA, 19 nt, Human
uucuuuuuuuuuuuuuucc

SEQ ID NO: 93920 - RNA, 24 nt, Human
uugaaucacaaagccauuuccuaa

SEQ ID NO: 93921 - RNA, 20 nt, Human
uugcugaguuagacccuauu

SEQ ID NO: 93922 - RNA, 18 nt, Human
uuggaccaguaauugauu

SEQ ID NO: 93923 - RNA, 19 nt, Human
uuugcugaaaaucugccca

SEQ ID NO: 93924 - RNA, 23 nt, Human
uuuuauuacugccuccuccccca

SEQ ID NO: 93925 - RNA, 20 nt, Human
uuuuggauauaccaggcagc

SEQ ID NO: 93926 - RNA, 21 nt, Human
uuuuggauauaccaggcagcu

SEQ ID NO: 93927 - RNA, 24 nt, Human
uuuuuuuuuccuccucaguucuuc

SEQ ID NO: 93928 - RNA, 26 nt, Human
uuuuuuuuuuuuuuccuccucaguuc

SEQ ID NO: 93929 - RNA, 21 nt, Human
aaaaugcuuuuaagcaaucug

SEQ ID NO: 93930 - RNA, 26 nt, Human
aaacagacaaacaaauaagaaaucuc

SEQ ID NO: 93931 - RNA, 18 nt, Human
aaaguauuacucccagag

SEQ ID NO: 93932 - RNA, 19 nt, Human
aacagaacaguggugcuuu

SEQ ID NO: 93933 - RNA, 21 nt, Human
acugcaauuuccaggaucauu

SEQ ID NO: 93934 - RNA, 19 nt, Human
agaagauguacaaaugcuu

SEQ ID NO: 93935 - RNA, 22 nt, Human
agcgcccggccccgcccccccu

SEQ ID NO: 93936 - RNA, 24 nt, Human
aggaaaugaacagaacaguggugc

SEQ ID NO: 93937 - RNA, 18 nt, Human
aguauuuuuauagaaaug

SEQ ID NO: 93938 - RNA, 22 nt, Human
cagcucccagcccggccguccc

SEQ ID NO: 93939 - RNA, 25 nt, Human
ccagcucccagcccggccgucccga

SEQ ID NO: 93940 - RNA, 22 nt, Human
cccagaguaaaaacagacaaac

SEQ ID NO: 93941 - RNA, 21 nt, Human
cccguagcgcccggccccgcc

SEQ ID NO: 93942 - RNA, 19 nt, Human
gaaaugaacagaacagugg

SEQ ID NO: 93943 - RNA, 22 nt, Human
gcagccuuggugcgcggccgcu

SEQ ID NO: 93944 - RNA, 18 nt, Human
gccuuggugcgcggccgc

SEQ ID NO: 93945 - RNA, 20 nt, Human
gcuaggaaaugaacagaaca

SEQ ID NO: 93946 - RNA, 18 nt, Human
ggcggcggccgcuucccg

SEQ ID NO: 93947 - RNA, 20 nt, Human
uaaaaugaaacaucuuguua

SEQ ID NO: 93948 - RNA, 22 nt, Human
uagaacagcuaggaaaugaaca

SEQ ID NO: 93949 - RNA, 24 nt, Human
uaggaaaacaauauuuuaaaggaa

SEQ ID NO: 93950 - RNA, 22 nt, Human
uauaauaacaaagaaguauuac

SEQ ID NO: 93951 - RNA, 22 nt, Human
uccagcucccagcccggccguc

SEQ ID NO: 93952 - RNA, 19 nt, Human
ucccagaguaaaaacagac

SEQ ID NO: 93953 - RNA, 23 nt, Human
ucccgcugugggcuccagcuccc

SEQ ID NO: 93954 - RNA, 19 nt, Human
ugcgaggcccgggcggcgg

SEQ ID NO: 93955 - RNA, 24 nt, Human
ugcucaucuuaauaguuuucuuaa

SEQ ID NO: 93956 - RNA, 22 nt, Human
ugggcuccagcucccagcccgg

SEQ ID NO: 93957 - RNA, 22 nt, Human
uuagaaaagcauuauuugaaaa

SEQ ID NO: 93958 - RNA, 24 nt, Human
uucaugaaucuacuuucacauuua

SEQ ID NO: 93959 - RNA, 18 nt, Human
uucccgcugugggcucca

SEQ ID NO: 93960 - RNA, 22 nt, Human
aaaaugcagcauuccccaaaug

SEQ ID NO: 93961 - RNA, 24 nt, Human
aaaugcagccaaaacccuuuacug

SEQ ID NO: 93962 - RNA, 22 nt, Human
aacaauagaauccgaagaagaa

SEQ ID NO: 93963 - RNA, 20 nt, Human
aaccaacucucccugugucu

SEQ ID NO: 93964 - RNA, 23 nt, Human
acaaaaugcagcauuccccaaau

SEQ ID NO: 93965 - RNA, 21 nt, Human
acucuguucuucacuuacauu

SEQ ID NO: 93966 - RNA, 22 nt, Human
agacaaccaacucucccugugu

SEQ ID NO: 93967 - RNA, 20 nt, Human
agcagccccugugaagaagu

SEQ ID NO: 93968 - RNA, 24 nt, Human
aggcaugggggcaucauggugggg

SEQ ID NO: 93969 - RNA, 26 nt, Human
cacacgcacaaauuagacccacaagu

SEQ ID NO: 93970 - RNA, 18 nt, Human
cacccccugcccugccac

SEQ ID NO: 93971 - RNA, 26 nt, Human
cagcaaacaauagaauccgaagaaga

SEQ ID NO: 93972 - RNA, 21 nt, Human
cagcauuccccaaaugcagcc

SEQ ID NO: 93973 - RNA, 23 nt, Human
cagccccugugaagaaguccccc

SEQ ID NO: 93974 - RNA, 18 nt, Human
caggacacaaaccaaucu

SEQ ID NO: 93975 - RNA, 23 nt, Human
caggacacaaaccaaucuuacag

SEQ ID NO: 93976 - RNA, 18 nt, Human
caggcccuucccucagug

SEQ ID NO: 93977 - RNA, 19 nt, Human
cauuucaggggcucgguua

SEQ ID NO: 93978 - RNA, 25 nt, Human
cauuuuugugcucaggcaacaggag

SEQ ID NO: 93979 - RNA, 21 nt, Human
ccaccgcuguugccccaccug

SEQ ID NO: 93980 - RNA, 18 nt, Human
ccacgcccaggcaugggg

SEQ ID NO: 93981 - RNA, 21 nt, Human
ccacgcccaggcaugggggca

SEQ ID NO: 93982 - RNA, 20 nt, Human
cccauuuuugugcucaggca

SEQ ID NO: 93983 - RNA, 22 nt, Human
cccccggggaccagucuggccc

SEQ ID NO: 93984 - RNA, 22 nt, Human
ccccgggugggaaccgcgugcu

SEQ ID NO: 93985 - RNA, 18 nt, Human
ccccugcccugccaccgc

SEQ ID NO: 93986 - RNA, 19 nt, Human
ccccugugaagaagucccc

SEQ ID NO: 93987 - RNA, 19 nt, Human
cccuaaagagaaagagcuc

SEQ ID NO: 93988 - RNA, 21 nt, Human
cccugugucuguuuuucaggg

SEQ ID NO: 93989 - RNA, 20 nt, Human
ccgcuguugccccaccuggc

SEQ ID NO: 93990 - RNA, 22 nt, Human
cgaacaaaaugcagcauucccc

SEQ ID NO: 93991 - RNA, 25 nt, Human
cgaacaaaaugcagcauuccccaaa

SEQ ID NO: 93992 - RNA, 18 nt, Human
cgccaguggucacugguc

SEQ ID NO: 93993 - RNA, 22 nt, Human
cgucacaucuccugagggcgaa

SEQ ID NO: 93994 - RNA, 18 nt, Human
cuggcccaccacccccug

SEQ ID NO: 93995 - RNA, 21 nt, Human
cuggcuucccuacaccgugug

SEQ ID NO: 93996 - RNA, 23 nt, Human
cuucuguggcugggccgucuuuu

SEQ ID NO: 93997 - RNA, 24 nt, Human
cuuguuccuucgucacaucuccug

SEQ ID NO: 93998 - RNA, 19 nt, Human
gaccuuguuccuucgucac

SEQ ID NO: 93999 - RNA, 21 nt, Human
gagcuguguggccggcugggg

SEQ ID NO: 94000 - RNA, 24 nt, Human
gcccaccacccccugcccugccac

SEQ ID NO: 94001 - RNA, 19 nt, Human
gccggcuggggcugaaaau

SEQ ID NO: 94002 - RNA, 18 nt, Human
gcuccaucaugggguaug

SEQ ID NO: 94003 - RNA, 21 nt, Human
ggaggcuugaacccaggcccu

SEQ ID NO: 94004 - RNA, 22 nt, Human
ggggcaucaugguggggcuggg

SEQ ID NO: 94005 - RNA, 20 nt, Human
gucacuggucacuuuccuga

SEQ ID NO: 94006 - RNA, 18 nt, Human
gucacuuaaacaugaucu

SEQ ID NO: 94007 - RNA, 25 nt, Human
gugcccauuuuugugcucaggcaac

SEQ ID NO: 94008 - RNA, 23 nt, Human
ucaugguggggcugggggagagc

SEQ ID NO: 94009 - RNA, 24 nt, Human
uccagcaaacaauagaauccgaag

SEQ ID NO: 94010 - RNA, 24 nt, Human
uccagcaaacaauagaauccgaag

SEQ ID NO: 94011 - RNA, 21 nt, Human
uccccaaaugcagccaaaacc

SEQ ID NO: 94012 - RNA, 23 nt, Human
ucccuacaccgugugcuccauca

SEQ ID NO: 94013 - RNA, 20 nt, Human
ucccugugucuguuuuucag

SEQ ID NO: 94014 - RNA, 18 nt, Human
ucuccugagggcgaaggu

SEQ ID NO: 94015 - RNA, 18 nt, Human
ugaagagacaaccaacuc

SEQ ID NO: 94016 - RNA, 26 nt, Human
ugaagagacaaccaacucucccugug

SEQ ID NO: 94017 - RNA, 20 nt, Human
ugaaguauauuuuuggagcu

SEQ ID NO: 94018 - RNA, 21 nt, Human
ugaaguauauuuuuggagcug

SEQ ID NO: 94019 - RNA, 24 nt, Human
ugccccugccagcccaagggucau

SEQ ID NO: 94020 - RNA, 19 nt, Human
uggcaaaugaucuuccccc

SEQ ID NO: 94021 - RNA, 20 nt, Human
uggcaguacugggcauuuca

SEQ ID NO: 94022 - RNA, 21 nt, Human
uggcaguacugggcauuucag

SEQ ID NO: 94023 - RNA, 25 nt, Human
uggcaguacugggcauuucaggggc

SEQ ID NO: 94024 - RNA, 24 nt, Human
uggggcugggggagagcgaagggc

SEQ ID NO: 94025 - RNA, 20 nt, Human
uggucaggacacaaaccaau

SEQ ID NO: 94026 - RNA, 21 nt, Human
ugugcuccaucaugggguaug

SEQ ID NO: 94027 - RNA, 22 nt, Human
uuacuggagccaccuuccuaac

SEQ ID NO: 94028 - RNA, 21 nt, Human
aaaaaaaacaacuuugagcau

SEQ ID NO: 94029 - RNA, 31 nt, Human
aaaauuuuggaaaggggcuggagcugaagcc

SEQ ID NO: 94030 - RNA, 21 nt, Human
aaacaaacaaaaaaaacaacu

SEQ ID NO: 94031 - RNA, 18 nt, Human
aaacaggaaaaaaaccga

SEQ ID NO: 94032 - RNA, 19 nt, Human
aaacaggaaaaaaaccgaa

SEQ ID NO: 94033 - RNA, 25 nt, Human
aaacaggaaaaaaaccgaacaucug

SEQ ID NO: 94034 - RNA, 23 nt, Human
aaagcaaaaagugaaauucagaa

SEQ ID NO: 94035 - RNA, 22 nt, Human
aacccacggacgccauucaucu

SEQ ID NO: 94036 - RNA, 18 nt, Human
aagaaaaacaccauuggg

SEQ ID NO: 94037 - RNA, 24 nt, Human
aaugcuaauuaacugcaggcugag

SEQ ID NO: 94038 - RNA, 18 nt, Human
acaauaagucauuacgac

SEQ ID NO: 94039 - RNA, 22 nt, Human
accaaaaagagucuuuuuuucc

SEQ ID NO: 94040 - RNA, 22 nt, Human
agaaacaggaaaaaaaccgaac

SEQ ID NO: 94041 - RNA, 24 nt, Human
agaaagauacagguuucucaccaa

SEQ ID NO: 94042 - RNA, 25 nt, Human
agaaauguggaggaugaccgguacc

SEQ ID NO: 94043 - RNA, 28 nt, Human
agagaggagggccaucagaggggcuggg

SEQ ID NO: 94044 - RNA, 21 nt, Human
agagcaccaaaaagcaaaaag

SEQ ID NO: 94045 - RNA, 21 nt, Human
aggacagaaguguuuuaacac

SEQ ID NO: 94046 - RNA, 26 nt, Human
aggcagagacagauggagaggggacc

SEQ ID NO: 94047 - RNA, 21 nt, Human
aggcugagucucuuacuucug

SEQ ID NO: 94048 - RNA, 21 nt, Human
agggaggaggucaaaucuauc

SEQ ID NO: 94049 - RNA, 23 nt, Human
aguaucacaaccccuacccuccc

SEQ ID NO: 94050 - RNA, 22 nt, Human
aguggcagcagagaggagggcc

SEQ ID NO: 94051 - RNA, 20 nt, Human
auaaaagcagcauagaaaga

SEQ ID NO: 94052 - RNA, 19 nt, Human
auauauauauauauauaua

SEQ ID NO: 94053 - RNA, 19 nt, Human
auauauauauauauauaua

SEQ ID NO: 94054 - RNA, 19 nt, Human
auauauauauauauauaua

SEQ ID NO: 94055 - RNA, 19 nt, Human
auauauauauauauauaua

SEQ ID NO: 94056 - RNA, 19 nt, Human
auauauauauauauauaua

SEQ ID NO: 94057 - RNA, 19 nt, Human
auauauauauauauauaua

SEQ ID NO: 94058 - RNA, 18 nt, Human
augacaggagcacaugug

SEQ ID NO: 94059 - RNA, 23 nt, Human
augacaggagcacauguggccuu

SEQ ID NO: 94060 - RNA, 22 nt, Human
augugcgugugugugugugugu

SEQ ID NO: 94061 - RNA, 21 nt, Human
caaacaaacaaaaaaaacaac

SEQ ID NO: 94062 - RNA, 27 nt, Human
caaccccuacccuccccuuagcacucc

SEQ ID NO: 94063 - RNA, 20 nt, Human
caagaaaaacaccauuggga

SEQ ID NO: 94064 - RNA, 22 nt, Human
caagaaaaacaccauugggaaa

SEQ ID NO: 94065 - RNA, 23 nt, Human
caagaaaaacaccauugggaaac

SEQ ID NO: 94066 - RNA, 18 nt, Human
caccauugggaaaccuca

SEQ ID NO: 94067 - RNA, 18 nt, Human
cacuccaccucucucugc

SEQ ID NO: 94068 - RNA, 19 nt, Human
cauagaaagauacagguuu

SEQ ID NO: 94069 - RNA, 24 nt, Human
ccacaauaagucauuacgacccgu

SEQ ID NO: 94070 - RNA, 24 nt, Human
ccacacagaaaguggcugucuccu

SEQ ID NO: 94071 - RNA, 24 nt, Human
ccccuacccuccccuuagcacucc

SEQ ID NO: 94072 - RNA, 25 nt, Human
ccccuacccuccccuuagcacucca

SEQ ID NO: 94073 - RNA, 18 nt, Human
cccguuacuggcccucug

SEQ ID NO: 94074 - RNA, 18 nt, Human
ccuccccuuagcacucca

SEQ ID NO: 94075 - RNA, 22 nt, Human
ccuccgacaguucugaguucac

SEQ ID NO: 94076 - RNA, 22 nt, Human
ccucuguguuuuacuaccaccu

SEQ ID NO: 94077 - RNA, 24 nt, Human
cuaccaccucaagauacaguuagg

SEQ ID NO: 94078 - RNA, 18 nt, Human
cucacaggacagaagugu

SEQ ID NO: 94079 - RNA, 20 nt, Human
cugccaggcagagacagaug

SEQ ID NO: 94080 - RNA, 22 nt, Human
cuuccaaucugcugcacaucug

SEQ ID NO: 94081 - RNA, 19 nt, Human
cuugaaaauaacagggagg

SEQ ID NO: 94082 - RNA, 22 nt, Human
cuugaacccagcccugucucuu

SEQ ID NO: 94083 - RNA, 18 nt, Human
gagggccaucagaggggc

SEQ ID NO: 94084 - RNA, 24 nt, Human
gcaaguuucagagcaccaaaaagc

SEQ ID NO: 94085 - RNA, 21 nt, Human
gcaucgccggaggcagggugc

SEQ ID NO: 94086 - RNA, 23 nt, Human
gccauucaucuucuuguuaaaau

SEQ ID NO: 94087 - RNA, 23 nt, Human
gcgugcgccugccaggcagagac

SEQ ID NO: 94088 - RNA, 22 nt, Human
ggaaaaaaaccgaacaucugug

SEQ ID NO: 94089 - RNA, 19 nt, Human
ggcagaacaaugacaggga

SEQ ID NO: 94090 - RNA, 18 nt, Human
ggcaucgccggaggcagg

SEQ ID NO: 94091 - RNA, 23 nt, Human
gggccaucagaggggcuggggcg

SEQ ID NO: 94092 - RNA, 19 nt, Human
guauauauauauauauaua

SEQ ID NO: 94093 - RNA, 19 nt, Human
guauauauauauauauaua

SEQ ID NO: 94094 - RNA, 22 nt, Human
guauauaugugcgugugugugu

SEQ ID NO: 94095 - RNA, 20 nt, Human
guggcagcagagaggagggc

SEQ ID NO: 94096 - RNA, 19 nt, Human
guguauauauauauauaua

SEQ ID NO: 94097 - RNA, 20 nt, Human
guguguauauauauauauau

SEQ ID NO: 94098 - RNA, 21 nt, Human
gugugugugugugugugugug

SEQ ID NO: 94099 - RNA, 21 nt, Human
gugugugugugugugugugug

SEQ ID NO: 94100 - RNA, 21 nt, Human
gugugugugugugugugugug

SEQ ID NO: 94101 - RNA, 21 nt, Human
gugugugugugugugugugug

SEQ ID NO: 94102 - RNA, 21 nt, Human
gugugugugugugugugugug

SEQ ID NO: 94103 - RNA, 20 nt, Human
uaaaagcagcauagaaagau

SEQ ID NO: 94104 - RNA, 21 nt, Human
uaaaaucccagcuacuugaaa

SEQ ID NO: 94105 - RNA, 22 nt, Human
uaaacaaacaaacaaaaaaaac

SEQ ID NO: 94106 - RNA, 24 nt, Human
uaaacaaacaaacaaaaaaaacaa

SEQ ID NO: 94107 - RNA, 20 nt, Human
uaaagagacuaaaugugggc

SEQ ID NO: 94108 - RNA, 24 nt, Human
uaauaaacaaacaaacaaaaaaaa

SEQ ID NO: 94109 - RNA, 25 nt, Human
uacagauauaaaagcagcauagaaa

SEQ ID NO: 94110 - RNA, 19 nt, Human
uacagguuucucaccaacu

SEQ ID NO: 94111 - RNA, 20 nt, Human
uaccacacagaaaguggcug

SEQ ID NO: 94112 - RNA, 22 nt, Human
uagaaagauacagguuucucac

SEQ ID NO: 94113 - RNA, 21 nt, Human
uauaaaaugaaugagcuggaa

SEQ ID NO: 94114 - RNA, 19 nt, Human
uauauauauauauauauau

SEQ ID NO: 94115 - RNA, 19 nt, Human
uauauauauauauauauau

SEQ ID NO: 94116 - RNA, 19 nt, Human
uauauauauauauauauau

SEQ ID NO: 94117 - RNA, 19 nt, Human
uauauauauauauauauau

SEQ ID NO: 94118 - RNA, 19 nt, Human
uaugugcgugugugugugu

SEQ ID NO: 94119 - RNA, 24 nt, Human
uaugugcgugugugugugugugua

SEQ ID NO: 94120 - RNA, 25 nt, Human
ucagaaacaggaaaaaaaccgaaca

SEQ ID NO: 94121 - RNA, 20 nt, Human
ucagaggggcuggggcggca

SEQ ID NO: 94122 - RNA, 24 nt, Human
uccaacacauuuacaagaaaaaca

SEQ ID NO: 94123 - RNA, 20 nt, Human
ucccauugcaaaucaucuuu

SEQ ID NO: 94124 - RNA, 28 nt, Human
ucucuuuaggcagaacaaugacagggau

SEQ ID NO: 94125 - RNA, 21 nt, Human
ucugcucucuuuucaguucuc

SEQ ID NO: 94126 - RNA, 18 nt, Human
ucuugguuugcuguuugg

SEQ ID NO: 94127 - RNA, 24 nt, Human
ucuuuaggcagaacaaugacaggg

SEQ ID NO: 94128 - RNA, 19 nt, Human
ugcgccugccaggcagaga

SEQ ID NO: 94129 - RNA, 24 nt, Human
ugcguguguguguguguguauaua

SEQ ID NO: 94130 - RNA, 22 nt, Human
uggaaugaguggcagcagagag

SEQ ID NO: 94131 - RNA, 19 nt, Human
uguauauaaagaacauugu

SEQ ID NO: 94132 - RNA, 18 nt, Human
uguauauauauauauaua

SEQ ID NO: 94133 - RNA, 22 nt, Human
uguauauauauauauauauaua

SEQ ID NO: 94134 - RNA, 19 nt, Human
ugucaaaacugccagaaug

SEQ ID NO: 94135 - RNA, 20 nt, Human
ugugcgugugugugugugug

SEQ ID NO: 94136 - RNA, 18 nt, Human
uguguauauauauauaua

SEQ ID NO: 94137 - RNA, 20 nt, Human
uguguauauauauauauaua

SEQ ID NO: 94138 - RNA, 20 nt, Human
uguguauauauauauauaua

SEQ ID NO: 94139 - RNA, 22 nt, Human
uguguauauauauauauauaua

SEQ ID NO: 94140 - RNA, 24 nt, Human
uguguauauaugugcgugugugug

SEQ ID NO: 94141 - RNA, 19 nt, Human
uguguguauauaugugcgu

SEQ ID NO: 94142 - RNA, 18 nt, Human
uguguguguauauauaua

SEQ ID NO: 94143 - RNA, 18 nt, Human
uguguguguauauaugug

SEQ ID NO: 94144 - RNA, 23 nt, Human
uguguguguauauaugugcgugu

SEQ ID NO: 94145 - RNA, 26 nt, Human
uguguguguguauauauauauaaugu

SEQ ID NO: 94146 - RNA, 23 nt, Human
uguguguguguauauauauauau

SEQ ID NO: 94147 - RNA, 21 nt, Human
uguguguguguauauaugugc

SEQ ID NO: 94148 - RNA, 23 nt, Human
uguguguguguauauaugugcgu

SEQ ID NO: 94149 - RNA, 18 nt, Human
uguguguguguguauaua

SEQ ID NO: 94150 - RNA, 23 nt, Human
uguguguguguguauauauauau

SEQ ID NO: 94151 - RNA, 21 nt, Human
uguguguguguguauauaugu

SEQ ID NO: 94152 - RNA, 18 nt, Human
uguguguguguguguaua

SEQ ID NO: 94153 - RNA, 20 nt, Human
uguguguguguguguauaua

SEQ ID NO: 94154 - RNA, 21 nt, Human
uguguguguguguguauauaa

SEQ ID NO: 94155 - RNA, 31 nt, Human
uguguguguguguguguauauaugugcgugg

SEQ ID NO: 94156 - RNA, 18 nt, Human
ugugugugugugugugug

SEQ ID NO: 94157 - RNA, 18 nt, Human
ugugugugugugugugug

SEQ ID NO: 94158 - RNA, 18 nt, Human
ugugugugugugugugug

SEQ ID NO: 94159 - RNA, 18 nt, Human
ugugugugugugugugug

SEQ ID NO: 94160 - RNA, 18 nt, Human
ugugugugugugugugug

SEQ ID NO: 94161 - RNA, 18 nt, Human
ugugugugugugugugug

SEQ ID NO: 94162 - RNA, 18 nt, Human
ugugugugugugugugug

SEQ ID NO: 94163 - RNA, 18 nt, Human
ugugugugugugugugug

SEQ ID NO: 94164 - RNA, 18 nt, Human
ugugugugugugugugug

SEQ ID NO: 94165 - RNA, 18 nt, Human
ugugugugugugugugug

SEQ ID NO: 94166 - RNA, 18 nt, Human
ugugugugugugugugug

SEQ ID NO: 94167 - RNA, 18 nt, Human
ugugugugugugugugug

SEQ ID NO: 94168 - RNA, 18 nt, Human
ugugugugugugugugug

SEQ ID NO: 94169 - RNA, 18 nt, Human
ugugugugugugugugug

SEQ ID NO: 94170 - RNA, 18 nt, Human
ugugugugugugugugug

SEQ ID NO: 94171 - RNA, 24 nt, Human
uguguguguguguguguguauaua

SEQ ID NO: 94172 - RNA, 20 nt, Human
ugugugugugugugugugug

SEQ ID NO: 94173 - RNA, 22 nt, Human
ugugugugugugugugugugag

SEQ ID NO: 94174 - RNA, 21 nt, Human
ugugugugugugugugugugu

SEQ ID NO: 94175 - RNA, 21 nt, Human
ugugugugugugugugugugu

SEQ ID NO: 94176 - RNA, 21 nt, Human
ugugugugugugugugugugu

SEQ ID NO: 94177 - RNA, 21 nt, Human
ugugugugugugugugugugu

SEQ ID NO: 94178 - RNA, 21 nt, Human
ugugugugugugugugugugu

SEQ ID NO: 94179 - RNA, 21 nt, Human
ugugugugugugugugugugu

SEQ ID NO: 94180 - RNA, 21 nt, Human
ugugugugugugugugugugu

SEQ ID NO: 94181 - RNA, 21 nt, Human
ugugugugugugugugugugu

SEQ ID NO: 94182 - RNA, 21 nt, Human
ugugugugugugugugugugu

SEQ ID NO: 94183 - RNA, 21 nt, Human
ugugugugugugugugugugu

SEQ ID NO: 94184 - RNA, 21 nt, Human
ugugugugugugugugugugu

SEQ ID NO: 94185 - RNA, 21 nt, Human
ugugugugugugugugugugu

SEQ ID NO: 94186 - RNA, 21 nt, Human
ugugugugugugugugugugu

SEQ ID NO: 94187 - RNA, 21 nt, Human
ugugugugugugugugugugu

SEQ ID NO: 94188 - RNA, 21 nt, Human
ugugugugugugugugugugu

SEQ ID NO: 94189 - RNA, 21 nt, Human
ugugugugugugugugugugu

SEQ ID NO: 94190 - RNA, 21 nt, Human
ugugugugugugugugugugu

SEQ ID NO: 94191 - RNA, 21 nt, Human
ugugugugugugugugugugu

SEQ ID NO: 94192 - RNA, 21 nt, Human
ugugugugugugugugugugu

SEQ ID NO: 94193 - RNA, 21 nt, Human
ugugugugugugugugugugu

SEQ ID NO: 94194 - RNA, 21 nt, Human
ugugugugugugugugugugu

SEQ ID NO: 94195 - RNA, 21 nt, Human
ugugugugugugugugugugu

SEQ ID NO: 94196 - RNA, 21 nt, Human
ugugugugugugugugugugu

SEQ ID NO: 94197 - RNA, 21 nt, Human
ugugugugugugugugugugu

SEQ ID NO: 94198 - RNA, 21 nt, Human
ugugugugugugugugugugu

SEQ ID NO: 94199 - RNA, 21 nt, Human
ugugugugugugugugugugu

SEQ ID NO: 94200 - RNA, 21 nt, Human
ugugugugugugugugugugu

SEQ ID NO: 94201 - RNA, 22 nt, Human
ugugugugugugugugugugua

SEQ ID NO: 94202 - RNA, 22 nt, Human
ugugugugugugugugugugug

SEQ ID NO: 94203 - RNA, 22 nt, Human
ugugugugugugugugugugug

SEQ ID NO: 94204 - RNA, 22 nt, Human
ugugugugugugugugugugug

SEQ ID NO: 94205 - RNA, 22 nt, Human
ugugugugugugugugugugug

SEQ ID NO: 94206 - RNA, 22 nt, Human
ugugugugugugugugugugug

SEQ ID NO: 94207 - RNA, 22 nt, Human
ugugugugugugugugugugug

SEQ ID NO: 94208 - RNA, 22 nt, Human
ugugugugugugugugugugug

SEQ ID NO: 94209 - RNA, 22 nt, Human
ugugugugugugugugugugug

SEQ ID NO: 94210 - RNA, 21 nt, Human
uucagaaacaggaaaaaaacc

SEQ ID NO: 94211 - RNA, 24 nt, Human
uucuuuucagaaacaggaaaaaaa

SEQ ID NO: 94212 - RNA, 23 nt, Human
uugaaaaauuuuggaaaggggcu

SEQ ID NO: 94213 - RNA, 24 nt, Human
uuucgcguugguuguguugucuuu

SEQ ID NO: 94214 - RNA, 21 nt, Human
aaaaagacagggaagaaugug

SEQ ID NO: 94215 - RNA, 19 nt, Human
aaacaaaacccaaaaagac

SEQ ID NO: 94216 - RNA, 25 nt, Human
aaacaaacaaaauaacaauaaaaaa

SEQ ID NO: 94217 - RNA, 21 nt, Human
aaacgaaacugucacagcaac

SEQ ID NO: 94218 - RNA, 20 nt, Human
aaacugucacagcaaccaca

SEQ ID NO: 94219 - RNA, 23 nt, Human
aaagacgugaaacccagcccuca

SEQ ID NO: 94220 - RNA, 18 nt, Human
aaagcacagaaaaaccag

SEQ ID NO: 94221 - RNA, 23 nt, Human
aaagcacagaaaaaccagauucu

SEQ ID NO: 94222 - RNA, 18 nt, Human
aaaguaaagcauggguuu

SEQ ID NO: 94223 - RNA, 21 nt, Human
aacaaaaaacaaaacccaaaa

SEQ ID NO: 94224 - RNA, 23 nt, Human
aacaaaaaacaaaacccaaaaag

SEQ ID NO: 94225 - RNA, 21 nt, Human
aacaaacaaacaaacaaaaua

SEQ ID NO: 94226 - RNA, 26 nt, Human
aacaaacaaacaaacaaaauaacaau

SEQ ID NO: 94227 - RNA, 27 nt, Human
aacaacaaaaaacaaaacccaaaaagg

SEQ ID NO: 94228 - RNA, 26 nt, Human
aacaacaacaaaaaacaaaacccaaa

SEQ ID NO: 94229 - RNA, 20 nt, Human
aacaaggagaaaccccgucu

SEQ ID NO: 94230 - RNA, 21 nt, Human
aacaaggagaaaccccgucuc

SEQ ID NO: 94231 - RNA, 25 nt, Human
aaccacaacaacaacaaaaaacaaa

SEQ ID NO: 94232 - RNA, 18 nt, Human
aagcaggcugaauuucca

SEQ ID NO: 94233 - RNA, 24 nt, Human
aagcaggcugaauuuccacucccc

SEQ ID NO: 94234 - RNA, 21 nt, Human
aagcuaggaagaaaaauugau

SEQ ID NO: 94235 - RNA, 25 nt, Human
aaggaacaugauucucugcuguugu

SEQ ID NO: 94236 - RNA, 19 nt, Human
acaaaacccaaaaagacag

SEQ ID NO: 94237 - RNA, 22 nt, Human
acaacaacaaaaaacaaaaccc

SEQ ID NO: 94238 - RNA, 22 nt, Human
acaacaacaacaaaaaacaaaa

SEQ ID NO: 94239 - RNA, 26 nt, Human
acagagaggcugugggguguuauuau

SEQ ID NO: 94240 - RNA, 18 nt, Human
acaggucccaaacuaaag

SEQ ID NO: 94241 - RNA, 23 nt, Human
accaaccugcacagcacauccag

SEQ ID NO: 94242 - RNA, 26 nt, Human
accacaacaacaacaaaaaacaaaac

SEQ ID NO: 94243 - RNA, 23 nt, Human
accacagcccacaagagcaggcc

SEQ ID NO: 94244 - RNA, 24 nt, Human
accccgucuccacuaaaaauacaa

SEQ ID NO: 94245 - RNA, 22 nt, Human
accugcacagcacauccagcag

SEQ ID NO: 94246 - RNA, 21 nt, Human
acuccagccugggagacaaga

SEQ ID NO: 94247 - RNA, 28 nt, Human
acucccgucucaaaacaaacaaacaaac

SEQ ID NO: 94248 - RNA, 20 nt, Human
acugcaaauaugaacuguag

SEQ ID NO: 94249 - RNA, 18 nt, Human
acugcccagguuugcaga

SEQ ID NO: 94250 - RNA, 18 nt, Human
agaacuacagacacucca

SEQ ID NO: 94251 - RNA, 21 nt, Human
agaagaugcccacagcguucc

SEQ ID NO: 94252 - RNA, 20 nt, Human
agaauggcacacuggcuccg

SEQ ID NO: 94253 - RNA, 22 nt, Human
agagguuaccgugagccgagau

SEQ ID NO: 94254 - RNA, 24 nt, Human
agagguuaccgugagccgagauug

SEQ ID NO: 94255 - RNA, 19 nt, Human
agauggggaggggagcugg

SEQ ID NO: 94256 - RNA, 21 nt, Human
agauggggaggggagcuggug

SEQ ID NO: 94257 - RNA, 19 nt, Human
agcagccaucaggguaagc

SEQ ID NO: 94258 - RNA, 20 nt, Human
agcguuccagaugugugugg

SEQ ID NO: 94259 - RNA, 24 nt, Human
agcugcagggccccccagugugga

SEQ ID NO: 94260 - RNA, 24 nt, Human
aggagauggggaggggagcuggga

SEQ ID NO: 94261 - RNA, 19 nt, Human
aggaggcagauggggucgg

SEQ ID NO: 94262 - RNA, 21 nt, Human
aggcaaguggggacaaaaagg

SEQ ID NO: 94263 - RNA, 24 nt, Human
aggcagagguuaccgugagccgag

SEQ ID NO: 94264 - RNA, 22 nt, Human
aggcagcucaggcuggcugccc

SEQ ID NO: 94265 - RNA, 22 nt, Human
aggcaggagacucgcccgaacc

SEQ ID NO: 94266 - RNA, 24 nt, Human
aggcaggagacucgcccgaaccug

SEQ ID NO: 94267 - RNA, 22 nt, Human
aggcagguagucaacguuuugg

SEQ ID NO: 94268 - RNA, 21 nt, Human
aggccaagguggggggaucac

SEQ ID NO: 94269 - RNA, 20 nt, Human
aggcugaggcaggagacucg

SEQ ID NO: 94270 - RNA, 20 nt, Human
agggaagaaugugggaggca

SEQ ID NO: 94271 - RNA, 23 nt, Human
agguggggggaucaccugagguc

SEQ ID NO: 94272 - RNA, 21 nt, Human
aguggcucaugccuguaaucc

SEQ ID NO: 94273 - RNA, 21 nt, Human
aguggcucaugccuguaaucc

SEQ ID NO: 94274 - RNA, 24 nt, Human
aguggcucaugccuguaauccugg

SEQ ID NO: 94275 - RNA, 23 nt, Human
aguugggcgugguggcgcaugcc

SEQ ID NO: 94276 - RNA, 25 nt, Human
aucuacgcaaucggugaccccacca

SEQ ID NO: 94277 - RNA, 21 nt, Human
augcauucugugggugguguc

SEQ ID NO: 94278 - RNA, 19 nt, Human
augccuguaauccuggcac

SEQ ID NO: 94279 - RNA, 23 nt, Human
auggagcccaugggcagaagaug

SEQ ID NO: 94280 - RNA, 18 nt, Human
auugcacuccagccuggg

SEQ ID NO: 94281 - RNA, 21 nt, Human
auugcacuccagccugggaga

SEQ ID NO: 94282 - RNA, 24 nt, Human
auugcgcgauugcacuccagccug

SEQ ID NO: 94283 - RNA, 19 nt, Human
caaaaucaguugggcgugg

SEQ ID NO: 94284 - RNA, 24 nt, Human
caacaaaaaacaaaacccaaaaag

SEQ ID NO: 94285 - RNA, 23 nt, Human
caacaacaacaaaaaacaaaacc

SEQ ID NO: 94286 - RNA, 23 nt, Human
caacaacaacaaaaaacaaaacc

SEQ ID NO: 94287 - RNA, 21 nt, Human
caaccugcacagcacauccag

SEQ ID NO: 94288 - RNA, 24 nt, Human
caacugagccucauucucucucag

SEQ ID NO: 94289 - RNA, 21 nt, Human
caaggagaaaccccgucucca

SEQ ID NO: 94290 - RNA, 19 nt, Human
caagguagggauggggcug

SEQ ID NO: 94291 - RNA, 24 nt, Human
caagguggggggaucaccugaggu

SEQ ID NO: 94292 - RNA, 25 nt, Human
cacagcaaccacagcccacaagagc

SEQ ID NO: 94293 - RNA, 26 nt, Human
caccaaaccuaagccuuaaccacaga

SEQ ID NO: 94294 - RNA, 21 nt, Human
cacccuagacaugucuggcug

SEQ ID NO: 94295 - RNA, 23 nt, Human
cagaaaacgaaacugucacagca

SEQ ID NO: 94296 - RNA, 29 nt, Human
cagaaaacgaaacugucacagcaaccacu

SEQ ID NO: 94297 - RNA, 26 nt, Human
cagaagaugcccacagcguuccagau

SEQ ID NO: 94298 - RNA, 23 nt, Human
cagacuauccacaacugagccuc

SEQ ID NO: 94299 - RNA, 20 nt, Human
cagagaaaacagacuaucca

SEQ ID NO: 94300 - RNA, 24 nt, Human
cagaguuuugcucuguugcccagg

SEQ ID NO: 94301 - RNA, 21 nt, Human
cagcagaagguuugcaaacug

SEQ ID NO: 94302 - RNA, 19 nt, Human
cagccaaggccaggugugg

SEQ ID NO: 94303 - RNA, 18 nt, Human
cagccucugggcagcacg

SEQ ID NO: 94304 - RNA, 24 nt, Human
cagcuacucagaaggcugaggcag

SEQ ID NO: 94305 - RNA, 24 nt, Human
caguguggagugcccccaccuccc

SEQ ID NO: 94306 - RNA, 24 nt, Human
caguucugaagaaagccuccaaga

SEQ ID NO: 94307 - RNA, 18 nt, Human
caucccccuuuaaaaacc

SEQ ID NO: 94308 - RNA, 19 nt, Human
caugaaaaacuaguaagcu

SEQ ID NO: 94309 - RNA, 20 nt, Human
caugccuguaauccuggcac

SEQ ID NO: 94310 - RNA, 24 nt, Human
caugccuguaauccuggcacuuug

SEQ ID NO: 94311 - RNA, 18 nt, Human
ccaaaaagacagggaaga

SEQ ID NO: 94312 - RNA, 21 nt, Human
ccaaaugggcaaaggaaaucc

SEQ ID NO: 94313 - RNA, 22 nt, Human
ccaacagacaccagcgcacaug

SEQ ID NO: 94314 - RNA, 23 nt, Human
ccaaccugcacagcacauccagc

SEQ ID NO: 94315 - RNA, 24 nt, Human
ccacaacaacaacaaaaaacaaaa

SEQ ID NO: 94316 - RNA, 19 nt, Human
ccagcccuggagcugcagg

SEQ ID NO: 94317 - RNA, 22 nt, Human
ccaugccagcuccucuuugccu

SEQ ID NO: 94318 - RNA, 20 nt, Human
ccauggaggaggcagcucag

SEQ ID NO: 94319 - RNA, 19 nt, Human
cccaauggugcuccuccuc

SEQ ID NO: 94320 - RNA, 23 nt, Human
cccacggucacccaaccgugccu

SEQ ID NO: 94321 - RNA, 18 nt, Human
ccccaccgcaaucugggc

SEQ ID NO: 94322 - RNA, 22 nt, Human
ccccgccccaauggugcuccuc

SEQ ID NO: 94323 - RNA, 19 nt, Human
ccgcagacagcaagugcac

SEQ ID NO: 94324 - RNA, 21 nt, Human
ccgccccucaggccuccuaac

SEQ ID NO: 94325 - RNA, 18 nt, Human
ccgccugccgccuccagc

SEQ ID NO: 94326 - RNA, 20 nt, Human
ccgcucccugaccgaggggc

SEQ ID NO: 94327 - RNA, 23 nt, Human
ccugaccaacaaggagaaacccc

SEQ ID NO: 94328 - RNA, 24 nt, Human
ccugaccaacaaggagaaaccccg

SEQ ID NO: 94329 - RNA, 21 nt, Human
ccugcaaucccagcuacucag

SEQ ID NO: 94330 - RNA, 23 nt, Human
ccugcacagcacauccagcagga

SEQ ID NO: 94331 - RNA, 23 nt, Human
ccugcggagccgcuggcacagcc

SEQ ID NO: 94332 - RNA, 19 nt, Human
ccugcugccugccgccugc

SEQ ID NO: 94333 - RNA, 24 nt, Human
ccuggcugagcacauuggacaguc

SEQ ID NO: 94334 - RNA, 25 nt, Human
ccugggaggcagagguuaccgugag

SEQ ID NO: 94335 - RNA, 22 nt, Human
ccuguaauccuggcacuuuggg

SEQ ID NO: 94336 - RNA, 23 nt, Human
ccuuccccacuggaugagucagg

SEQ ID NO: 94337 - RNA, 19 nt, Human
ccuucuguaccaccaugcc

SEQ ID NO: 94338 - RNA, 24 nt, Human
cgauugcacuccagccugggagac

SEQ ID NO: 94339 - RNA, 18 nt, Human
cgccugccgccuccagcc

SEQ ID NO: 94340 - RNA, 23 nt, Human
cggagccgcuggcacagccccca

SEQ ID NO: 94341 - RNA, 24 nt, Human
cuaguucaguucugaagaaagccu

SEQ ID NO: 94342 - RNA, 24 nt, Human
cucaugccuguaauccuggcacuu

SEQ ID NO: 94343 - RNA, 20 nt, Human
cuccagaguuggaagggccc

SEQ ID NO: 94344 - RNA, 21 nt, Human
cucccugaccgaggggccucc

SEQ ID NO: 94345 - RNA, 19 nt, Human
cugaauuuccacuccccac

SEQ ID NO: 94346 - RNA, 19 nt, Human
cugaccaacaaggagaaac

SEQ ID NO: 94347 - RNA, 20 nt, Human
cugacucaaggagaugggga

SEQ ID NO: 94348 - RNA, 25 nt, Human
cugcagggccccccagucgaccggu

SEQ ID NO: 94349 - RNA, 18 nt, Human
cugcauuuccaagagaug

SEQ ID NO: 94350 - RNA, 21 nt, Human
cugcugccugccgccugccgc

SEQ ID NO: 94351 - RNA, 19 nt, Human
cugcuucucugccgacucc

SEQ ID NO: 94352 - RNA, 22 nt, Human
cuggcacuuugggaggccaagg

SEQ ID NO: 94353 - RNA, 19 nt, Human
cuggucucacccuagacau

SEQ ID NO: 94354 - RNA, 24 nt, Human
cuucguuuucuauuuauuuacauu

SEQ ID NO: 94355 - RNA, 19 nt, Human
gaaaaaaaacaggucccaa

SEQ ID NO: 94356 - RNA, 23 nt, Human
gaaagggauucuugaaaugugaa

SEQ ID NO: 94357 - RNA, 22 nt, Human
gaaguugguuuggucuacugac

SEQ ID NO: 94358 - RNA, 23 nt, Human
gacaagcaaagacgugaaaccca

SEQ ID NO: 94359 - RNA, 23 nt, Human
gacacaguggcucaugccuguaa

SEQ ID NO: 94360 - RNA, 18 nt, Human
gagaaaaaaaacaggucc

SEQ ID NO: 94361 - RNA, 21 nt, Human
gagaaaccccgucuccacuaa

SEQ ID NO: 94362 - RNA, 19 nt, Human
gagacagccaugucucaug

SEQ ID NO: 94363 - RNA, 21 nt, Human
gagauggggaggggagcuggu

SEQ ID NO: 94364 - RNA, 23 nt, Human
gagauugcgcgauugcacuccag

SEQ ID NO: 94365 - RNA, 19 nt, Human
gagcgggcagcagccaagg

SEQ ID NO: 94366 - RNA, 24 nt, Human
gagcucacuaccguacaauuccag

SEQ ID NO: 94367 - RNA, 24 nt, Human
gaucaccugagguccgggguuuga

SEQ ID NO: 94368 - RNA, 24 nt, Human
gauugcacuccagccugggagaca

SEQ ID NO: 94369 - RNA, 25 nt, Human
gauugcacuccagccugggagacaa

SEQ ID NO: 94370 - RNA, 20 nt, Human
gcacuuugggaggccaaggu

SEQ ID NO: 94371 - RNA, 23 nt, Human
gcacuuugggaggccaagguggg

SEQ ID NO: 94372 - RNA, 19 nt, Human
gcagaagaugcccacagcg

SEQ ID NO: 94373 - RNA, 21 nt, Human
gcagacagcaagugcacagag

SEQ ID NO: 94374 - RNA, 22 nt, Human
gcagaucagccucugggcagca

SEQ ID NO: 94375 - RNA, 22 nt, Human
gcccacaagagcaggccaggcu

SEQ ID NO: 94376 - RNA, 21 nt, Human
gcccuggagcugcagggcccc

SEQ ID NO: 94377 - RNA, 21 nt, Human
gccgccuccagccuggcugag

SEQ ID NO: 94378 - RNA, 21 nt, Human
gccucuuggcgcagcagcccu

SEQ ID NO: 94379 - RNA, 22 nt, Human
gcugcagggccccccagugugg

SEQ ID NO: 94380 - RNA, 20 nt, Human
ggacaaaaaggacaagcaaa

SEQ ID NO: 94381 - RNA, 21 nt, Human
ggagauggggaggggagcugg

SEQ ID NO: 94382 - RNA, 22 nt, Human
ggaucaccugagguccgggguu

SEQ ID NO: 94383 - RNA, 22 nt, Human
ggcaagauguguccuguuucca

SEQ ID NO: 94384 - RNA, 23 nt, Human
ggcgugguggcgcaugccugcaa

SEQ ID NO: 94385 - RNA, 20 nt, Human
gggaagaaugugggaggcag

SEQ ID NO: 94386 - RNA, 22 nt, Human
gggacaucuggcaucuuugguc

SEQ ID NO: 94387 - RNA, 24 nt, Human
gggaucaccugagguccgggguuu

SEQ ID NO: 94388 - RNA, 18 nt, Human
gggcagcacgagcagggu

SEQ ID NO: 94389 - RNA, 24 nt, Human
gggcagcagccaaggccaggugug

SEQ ID NO: 94390 - RNA, 23 nt, Human
gggcugcucucgacagcuggcca

SEQ ID NO: 94391 - RNA, 26 nt, Human
gggugcuuuuauugcaacagugacuc

SEQ ID NO: 94392 - RNA, 19 nt, Human
gguccgggguuugagacca

SEQ ID NO: 94393 - RNA, 18 nt, Human
ggugcaggcaagugggga

SEQ ID NO: 94394 - RNA, 24 nt, Human
gguggcgcaugccugcaaucccag

SEQ ID NO: 94395 - RNA, 20 nt, Human
guggagugcccccaccuccc

SEQ ID NO: 94396 - RNA, 19 nt, Human
guggggggaucaccugagg

SEQ ID NO: 94397 - RNA, 18 nt, Human
guuugguucagacacgcu

SEQ ID NO: 94398 - RNA, 21 nt, Human
uaaaaaaccacaacaacaaca

SEQ ID NO: 94399 - RNA, 23 nt, Human
uaaaaaaccacaacaacaacaaa

SEQ ID NO: 94400 - RNA, 25 nt, Human
uaaaaaaccacaacaacaacaaaaa

SEQ ID NO: 94401 - RNA, 22 nt, Human
uaaaaaccugcucaagaccgga

SEQ ID NO: 94402 - RNA, 19 nt, Human
uaaaaauacaaaaucaguu

SEQ ID NO: 94403 - RNA, 22 nt, Human
uaaaagcaugagcuacccuggc

SEQ ID NO: 94404 - RNA, 21 nt, Human
uaagccuuaaccacagaaaug

SEQ ID NO: 94405 - RNA, 19 nt, Human
uaagcuguuguaauggcuc

SEQ ID NO: 94406 - RNA, 20 nt, Human
uagaguuccccaccaaggac

SEQ ID NO: 94407 - RNA, 25 nt, Human
uagauauaaugaccuguaacuauga

SEQ ID NO: 94408 - RNA, 20 nt, Human
uagcugccuaccccgcccca

SEQ ID NO: 94409 - RNA, 20 nt, Human
uaucaagucugaacagcagg

SEQ ID NO: 94410 - RNA, 24 nt, Human
uauucaauucuacaguuuccagga

SEQ ID NO: 94411 - RNA, 18 nt, Human
ucacagcaaccacagccc

SEQ ID NO: 94412 - RNA, 18 nt, Human
ucagcagaggcugggaac

SEQ ID NO: 94413 - RNA, 23 nt, Human
ucagugauuuauucaauucuaca

SEQ ID NO: 94414 - RNA, 18 nt, Human
ucagugucaucugcugag

SEQ ID NO: 94415 - RNA, 18 nt, Human
ucaguugggcgugguggc

SEQ ID NO: 94416 - RNA, 24 nt, Human
ucaguugggcgugguggcgcaugc

SEQ ID NO: 94417 - RNA, 26 nt, Human
uccaaccaguaaaagcaugagcuacc

SEQ ID NO: 94418 - RNA, 20 nt, Human
ucccucagcccaagcacucu

SEQ ID NO: 94419 - RNA, 24 nt, Human
ucccucagcccaagcacucuguca

SEQ ID NO: 94420 - RNA, 20 nt, Human
uccgcagacagcaagugcac

SEQ ID NO: 94421 - RNA, 20 nt, Human
uccuccacagccugcugccu

SEQ ID NO: 94422 - RNA, 22 nt, Human
ucuaacccagcacugcccuaga

SEQ ID NO: 94423 - RNA, 26 nt, Human
ucugcaaacagcuuaaaaaaaaaaaa

SEQ ID NO: 94424 - RNA, 18 nt, Human
ucugccgacuccaaggua

SEQ ID NO: 94425 - RNA, 21 nt, Human
ucuggggacaucuggcaucuu

SEQ ID NO: 94426 - RNA, 19 nt, Human
ugaaaaacuaguaagcugu

SEQ ID NO: 94427 - RNA, 24 nt, Human
ugacaaagcacagaaaaaccagau

SEQ ID NO: 94428 - RNA, 21 nt, Human
ugaccagagaguuggagaauu

SEQ ID NO: 94429 - RNA, 20 nt, Human
ugacccggcagcuacaugcc

SEQ ID NO: 94430 - RNA, 23 nt, Human
ugaccgaggggccuccuccacag

SEQ ID NO: 94431 - RNA, 18 nt, Human
ugaccugggagccuggaa

SEQ ID NO: 94432 - RNA, 21 nt, Human
ugacuucuuuccuguggacuc

SEQ ID NO: 94433 - RNA, 22 nt, Human
ugagacagaguuuugcucuguu

SEQ ID NO: 94434 - RNA, 21 nt, Human
ugagaccagccugaccaacaa

SEQ ID NO: 94435 - RNA, 24 nt, Human
ugagaccagccugaccaacaagga

SEQ ID NO: 94436 - RNA, 22 nt, Human
ugagaccaggccuugacagugg

SEQ ID NO: 94437 - RNA, 20 nt, Human
ugagagauaaaaggacacag

SEQ ID NO: 94438 - RNA, 22 nt, Human
ugagccgagauugcgcgauugc

SEQ ID NO: 94439 - RNA, 24 nt, Human
ugaggcaggagacucgcccgaacc

SEQ ID NO: 94440 - RNA, 19 nt, Human
ugagguccaggagggcuuu

SEQ ID NO: 94441 - RNA, 23 nt, Human
ugcaaauguggcccuguccgggg

SEQ ID NO: 94442 - RNA, 20 nt, Human
ugcacuccagccugggagac

SEQ ID NO: 94443 - RNA, 19 nt, Human
ugcagagagcgggcagcag

SEQ ID NO: 94444 - RNA, 22 nt, Human
ugcagagagcgggcagcagcca

SEQ ID NO: 94445 - RNA, 24 nt, Human
ugccugcaaucccagcuacucaga

SEQ ID NO: 94446 - RNA, 23 nt, Human
ugccuguaauccuggcacuuugg

SEQ ID NO: 94447 - RNA, 25 nt, Human
ugcucagagaaaacagacuauccac

SEQ ID NO: 94448 - RNA, 23 nt, Human
ugcucuguugcccaggcuuugug

SEQ ID NO: 94449 - RNA, 22 nt, Human
ugcugucagcagaggcugggaa

SEQ ID NO: 94450 - RNA, 24 nt, Human
uggcacuuugggaggccaaggugg

SEQ ID NO: 94451 - RNA, 19 nt, Human
uggcucaugccuguaaucc

SEQ ID NO: 94452 - RNA, 24 nt, Human
uggcucaugccuguaauccuggca

SEQ ID NO: 94453 - RNA, 24 nt, Human
ugggaggccaagguggggggauca

SEQ ID NO: 94454 - RNA, 20 nt, Human
ugggcagaggcccucgugac

SEQ ID NO: 94455 - RNA, 19 nt, Human
uggggaggggagcuggugg

SEQ ID NO: 94456 - RNA, 24 nt, Human
ugguggcgcaugccugcaauccca

SEQ ID NO: 94457 - RNA, 21 nt, Human
ugucaaguugacacuaagcag

SEQ ID NO: 94458 - RNA, 22 nt, Human
ugucacagcaaccacagcccac

SEQ ID NO: 94459 - RNA, 22 nt, Human
uguccccaacagacaccagcgc

SEQ ID NO: 94460 - RNA, 27 nt, Human
ugugaccugugagacagccaugucuca

SEQ ID NO: 94461 - RNA, 24 nt, Human
uguggcccuguccgggguacugac

SEQ ID NO: 94462 - RNA, 22 nt, Human
ugugggggaaguuuuauuuguu

SEQ ID NO: 94463 - RNA, 20 nt, Human
uguguuaaaaaaccacaaca

SEQ ID NO: 94464 - RNA, 21 nt, Human
uuagaguaaauuagggacuug

SEQ ID NO: 94465 - RNA, 18 nt, Human
uuccaagagaugauccac

SEQ ID NO: 94466 - RNA, 18 nt, Human
uuccuuggcggguggugc

SEQ ID NO: 94467 - RNA, 24 nt, Human
uuccuuggcggguggugcugagca

SEQ ID NO: 94468 - RNA, 21 nt, Human
uugacacuaagcagugaugaa

SEQ ID NO: 94469 - RNA, 19 nt, Human
uugacagugggggcaaguc

SEQ ID NO: 94470 - RNA, 19 nt, Human
uugcucuguugcccaggcu

SEQ ID NO: 94471 - RNA, 24 nt, Human
uuuaaguagaacaaacuaaauaca

SEQ ID NO: 94472 - RNA, 20 nt, Human
uuuggucuucucuggucccu

SEQ ID NO: 94473 - RNA, 19 nt, Human
uuuugcucuguugcccagg

SEQ ID NO: 94474 - RNA, 24 nt, Human
uuuugcucuguugcccaggcuuug

SEQ ID NO: 94475 - RNA, 25 nt, Human
uuuugcucuguugcccaggcuuugu

SEQ ID NO: 94476 - RNA, 18 nt, Human
aaagaggaggggcugggc

SEQ ID NO: 94477 - RNA, 19 nt, Human
aacaaaagucgcuucuaac

SEQ ID NO: 94478 - RNA, 22 nt, Human
aagcagucgagaaucaacccaa

SEQ ID NO: 94479 - RNA, 22 nt, Human
acacaaaaccccccaaaauucu

SEQ ID NO: 94480 - RNA, 29 nt, Human
acagaagagaaaaagacccacauccaaaa

SEQ ID NO: 94481 - RNA, 22 nt, Human
acagacagagaggaaaagagag

SEQ ID NO: 94482 - RNA, 24 nt, Human
acagagggggagagacagacagag

SEQ ID NO: 94483 - RNA, 25 nt, Human
acagagggggagagacagacagaga

SEQ ID NO: 94484 - RNA, 23 nt, Human
acagcuggguucagaucuccagc

SEQ ID NO: 94485 - RNA, 21 nt, Human
acauuacaggaaaaaaaaauc

SEQ ID NO: 94486 - RNA, 22 nt, Human
acccaaaagauugucacaguuu

SEQ ID NO: 94487 - RNA, 22 nt, Human
acccaaauaucccgacacccac

SEQ ID NO: 94488 - RNA, 26 nt, Human
acccacaaacaaaaucagaggaaagc

SEQ ID NO: 94489 - RNA, 21 nt, Human
acccacauccaaacaaaccca

SEQ ID NO: 94490 - RNA, 20 nt, Human
acgggccacaccacgcacac

SEQ ID NO: 94491 - RNA, 25 nt, Human
agacagagaggaaaagagagguggg

SEQ ID NO: 94492 - RNA, 19 nt, Human
agagagagagaggauagag

SEQ ID NO: 94493 - RNA, 24 nt, Human
agcaagguaguucacaaguaugcu

SEQ ID NO: 94494 - RNA, 23 nt, Human
agcaagugaaacagugaaaaaaa

SEQ ID NO: 94495 - RNA, 20 nt, Human
agcacuuuuuuuccacaagu

SEQ ID NO: 94496 - RNA, 22 nt, Human
agcaugaauuucuuuaucccuu

SEQ ID NO: 94497 - RNA, 24 nt, Human
agcugggugggguuggcacggugc

SEQ ID NO: 94498 - RNA, 25 nt, Human
aggaaaaaaaaaucugaaaccaaaa

SEQ ID NO: 94499 - RNA, 22 nt, Human
aggccaggcaucggaggccagg

SEQ ID NO: 94500 - RNA, 18 nt, Human
agguagaggaggacgggc

SEQ ID NO: 94501 - RNA, 28 nt, Human
aucagaacagaagagaaaaagacccaca

SEQ ID NO: 94502 - RNA, 22 nt, Human
aucuugagucagaaaucgaaau

SEQ ID NO: 94503 - RNA, 18 nt, Human
augaauuucuuuaucccu

SEQ ID NO: 94504 - RNA, 21 nt, Human
augccaggcugcgggccgugc

SEQ ID NO: 94505 - RNA, 25 nt, Human
caaaaucagaacagaagagaaaaag

SEQ ID NO: 94506 - RNA, 22 nt, Human
caacacacaaaaccccccaaaa

SEQ ID NO: 94507 - RNA, 21 nt, Human
caagagcaagugaaacaguga

SEQ ID NO: 94508 - RNA, 23 nt, Human
cacacggaccacgcacacgcggc

SEQ ID NO: 94509 - RNA, 18 nt, Human
cacagcauccggugggcc

SEQ ID NO: 94510 - RNA, 18 nt, Human
cacauccaaacaaaccca

SEQ ID NO: 94511 - RNA, 22 nt, Human
cacauccaaacaaacccaagag

SEQ ID NO: 94512 - RNA, 19 nt, Human
caccacgcacacagaugcc

SEQ ID NO: 94513 - RNA, 19 nt, Human
caccgagacacaccccagg

SEQ ID NO: 94514 - RNA, 24 nt, Human
caccgagacacaccccagggccag

SEQ ID NO: 94515 - RNA, 23 nt, Human
cacgcacacagaugccaagccac

SEQ ID NO: 94516 - RNA, 19 nt, Human
cacgccacgcacacagaug

SEQ ID NO: 94517 - RNA, 22 nt, Human
cacgcucagcuucaggccucug

SEQ ID NO: 94518 - RNA, 23 nt, Human
caggggccaaccuggagcccagg

SEQ ID NO: 94519 - RNA, 24 nt, Human
caucaugaauaucauuuggaccuc

SEQ ID NO: 94520 - RNA, 19 nt, Human
ccaaacaaacccaagagca

SEQ ID NO: 94521 - RNA, 22 nt, Human
ccaacacacaaaaccccccaaa

SEQ ID NO: 94522 - RNA, 23 nt, Human
ccaagccacgggccacgccacac

SEQ ID NO: 94523 - RNA, 21 nt, Human
ccacacacacagaugccaggc

SEQ ID NO: 94524 - RNA, 19 nt, Human
ccacgcacacagaugccaa

SEQ ID NO: 94525 - RNA, 20 nt, Human
ccaggacaggccucuaccag

SEQ ID NO: 94526 - RNA, 23 nt, Human
ccaggccacgggccacaccacgc

SEQ ID NO: 94527 - RNA, 23 nt, Human
ccaggccacgggccacgccacac

SEQ ID NO: 94528 - RNA, 23 nt, Human
ccaggccacgggccacgccacgc

SEQ ID NO: 94529 - RNA, 23 nt, Human
ccaggccacgggccacgccacgc

SEQ ID NO: 94530 - RNA, 18 nt, Human
cccaaauaucccgacacc

SEQ ID NO: 94531 - RNA, 22 nt, Human
cccacaaacaaaaucagaacag

SEQ ID NO: 94532 - RNA, 19 nt, Human
ccccccguuuucuuugucc

SEQ ID NO: 94533 - RNA, 24 nt, Human
ccccugggggaggggcacagcugg

SEQ ID NO: 94534 - RNA, 22 nt, Human
ccgccgcgccugcggcaucugc

SEQ ID NO: 94535 - RNA, 24 nt, Human
ccgccgcgccugcggcaucugcuc

SEQ ID NO: 94536 - RNA, 25 nt, Human
ccgccgcgccugcggcaucugcucu

SEQ ID NO: 94537 - RNA, 19 nt, Human
ccgcgccugcggcaucugc

SEQ ID NO: 94538 - RNA, 20 nt, Human
ccggcaggccaggggccagu

SEQ ID NO: 94539 - RNA, 24 nt, Human
ccucuaccaggacugccuuucccg

SEQ ID NO: 94540 - RNA, 22 nt, Human
ccuggagcccaggacaggccuc

SEQ ID NO: 94541 - RNA, 20 nt, Human
ccuggaguugggccucuguc

SEQ ID NO: 94542 - RNA, 18 nt, Human
ccuugagggaaagaggag

SEQ ID NO: 94543 - RNA, 21 nt, Human
cgaaaagcagucgagaaucaa

SEQ ID NO: 94544 - RNA, 18 nt, Human
cgacacccacaaacaaaa

SEQ ID NO: 94545 - RNA, 25 nt, Human
cgcagaagagaacaaaagucgcuuc

SEQ ID NO: 94546 - RNA, 21 nt, Human
cgcggcggacgcaccaacgcc

SEQ ID NO: 94547 - RNA, 24 nt, Human
cggcacacggaccacgcacacgcg

SEQ ID NO: 94548 - RNA, 22 nt, Human
cggugcuguguccggcaggcca

SEQ ID NO: 94549 - RNA, 23 nt, Human
cuuuguccauuucugaguagcuc

SEQ ID NO: 94550 - RNA, 24 nt, Human
gaaaagcagucgagaaucaaccca

SEQ ID NO: 94551 - RNA, 18 nt, Human
gaagacagagggggagag

SEQ ID NO: 94552 - RNA, 21 nt, Human
gagacacaccccagggccaga

SEQ ID NO: 94553 - RNA, 21 nt, Human
gagacagacagagaggaaaag

SEQ ID NO: 94554 - RNA, 18 nt, Human
gaggaggcagagggcugc

SEQ ID NO: 94555 - RNA, 20 nt, Human
gagggaaagaggaggggcug

SEQ ID NO: 94556 - RNA, 21 nt, Human
gagggccacccucaggggcca

SEQ ID NO: 94557 - RNA, 18 nt, Human
gaguagcugcgguggggc

SEQ ID NO: 94558 - RNA, 21 nt, Human
gcaggccaggggccagugggg

SEQ ID NO: 94559 - RNA, 19 nt, Human
gcaguguuucagggaggcc

SEQ ID NO: 94560 - RNA, 18 nt, Human
gcaguugagaggagugga

SEQ ID NO: 94561 - RNA, 21 nt, Human
gccacaccacgcacacagaug

SEQ ID NO: 94562 - RNA, 18 nt, Human
gccuggagcugggugggg

SEQ ID NO: 94563 - RNA, 20 nt, Human
gcggcggacgcaccaacgcc

SEQ ID NO: 94564 - RNA, 26 nt, Human
gcucucucugggaagaaaacuuuagc

SEQ ID NO: 94565 - RNA, 21 nt, Human
gcuucugaggaugcuugaaga

SEQ ID NO: 94566 - RNA, 29 nt, Human
ggaaaaaaaaaucugaaaccaaaaaugcu

SEQ ID NO: 94567 - RNA, 19 nt, Human
ggagagagguagaggagga

SEQ ID NO: 94568 - RNA, 23 nt, Human
ggagaggggcaguagcagcagug

SEQ ID NO: 94569 - RNA, 18 nt, Human
ggagggagggugggcagg

SEQ ID NO: 94570 - RNA, 20 nt, Human
ggagggagggugggcagggc

SEQ ID NO: 94571 - RNA, 23 nt, Human
ggaguggagggagggugggcagg

SEQ ID NO: 94572 - RNA, 18 nt, Human
ggccggagcaacggcaca

SEQ ID NO: 94573 - RNA, 21 nt, Human
ggccuggagcugggugggguu

SEQ ID NO: 94574 - RNA, 18 nt, Human
ggcgauggggcugagaga

SEQ ID NO: 94575 - RNA, 20 nt, Human
gggcagggcuggaggauggg

SEQ ID NO: 94576 - RNA, 23 nt, Human
gggccagaggcgaacgcaucuga

SEQ ID NO: 94577 - RNA, 19 nt, Human
gggcugggccagcuggggc

SEQ ID NO: 94578 - RNA, 19 nt, Human
ggggcugggccagcugggg

SEQ ID NO: 94579 - RNA, 21 nt, Human
ggucggagcuggggugagggg

SEQ ID NO: 94580 - RNA, 18 nt, Human
ggugggccuggagcuggg

SEQ ID NO: 94581 - RNA, 18 nt, Human
gguuggcacggugcugug

SEQ ID NO: 94582 - RNA, 21 nt, Human
gucgcuucuaacugggcacaa

SEQ ID NO: 94583 - RNA, 27 nt, Human
uacgcagaagagaacaaaagucgcuuc

SEQ ID NO: 94584 - RNA, 25 nt, Human
uagaacuccugauagccacgcacac

SEQ ID NO: 94585 - RNA, 19 nt, Human
uagagaagacagaggggga

SEQ ID NO: 94586 - RNA, 26 nt, Human
uauauacauucacauuaacguacacg

SEQ ID NO: 94587 - RNA, 22 nt, Human
uaugcucucucugggaagaaaa

SEQ ID NO: 94588 - RNA, 21 nt, Human
ucaggcggggcgcagugucug

SEQ ID NO: 94589 - RNA, 22 nt, Human
ucagggucuucccuggggagga

SEQ ID NO: 94590 - RNA, 20 nt, Human
ucccgacacccacaaacaaa

SEQ ID NO: 94591 - RNA, 20 nt, Human
ucccuggaaagccgaggccc

SEQ ID NO: 94592 - RNA, 20 nt, Human
ucccuggggaggaggcagag

SEQ ID NO: 94593 - RNA, 22 nt, Human
uccggugggccuggagcugggu

SEQ ID NO: 94594 - RNA, 18 nt, Human
uccuggaguugggccucu

SEQ ID NO: 94595 - RNA, 18 nt, Human
ucucccuuuuuaaucagg

SEQ ID NO: 94596 - RNA, 18 nt, Human
ucugagggguggcugggc

SEQ ID NO: 94597 - RNA, 19 nt, Human
ucugauagaaaacgucacc

SEQ ID NO: 94598 - RNA, 18 nt, Human
ucugucccuggaaagccg

SEQ ID NO: 94599 - RNA, 25 nt, Human
ugaaaagucacagggggcgugagga

SEQ ID NO: 94600 - RNA, 22 nt, Human
ugagagaggucggagcuggggu

SEQ ID NO: 94601 - RNA, 20 nt, Human
ugagaggaguggagggaggg

SEQ ID NO: 94602 - RNA, 24 nt, Human
ugagaggaguggagggaggguggg

SEQ ID NO: 94603 - RNA, 23 nt, Human
ugaggcaggugcacugaaugcgg

SEQ ID NO: 94604 - RNA, 24 nt, Human
ugaggcaggugcacugaaugcggu

SEQ ID NO: 94605 - RNA, 22 nt, Human
ugagggaaagaggaggggcugg

SEQ ID NO: 94606 - RNA, 23 nt, Human
ugagggaaagaggaggggcuggg

SEQ ID NO: 94607 - RNA, 21 nt, Human
ugaguagcucuuuugccaaca

SEQ ID NO: 94608 - RNA, 22 nt, Human
ugcacccaaauaucccgacacc

SEQ ID NO: 94609 - RNA, 24 nt, Human
ugccaacacacaaaaccccccaaa

SEQ ID NO: 94610 - RNA, 21 nt, Human
ugcuuccuuugcuuuuuuaaa

SEQ ID NO: 94611 - RNA, 23 nt, Human
ugcuugaagagacguugucagga

SEQ ID NO: 94612 - RNA, 22 nt, Human
ugcuuuuuuggauuuccuuugg

SEQ ID NO: 94613 - RNA, 18 nt, Human
uggaagaaaggggaguag

SEQ ID NO: 94614 - RNA, 18 nt, Human
uggagcugggugggguug

SEQ ID NO: 94615 - RNA, 20 nt, Human
uggagggagggugggcaggg

SEQ ID NO: 94616 - RNA, 21 nt, Human
uggagggagggugggcagggc

SEQ ID NO: 94617 - RNA, 23 nt, Human
uggagggagggugggcagggcug

SEQ ID NO: 94618 - RNA, 24 nt, Human
uggagggagggugggcagggcugg

SEQ ID NO: 94619 - RNA, 21 nt, Human
uggcugggcaggagcaccagg

SEQ ID NO: 94620 - RNA, 23 nt, Human
uggcugggcaggagcaccagggc

SEQ ID NO: 94621 - RNA, 19 nt, Human
ugggagggagcacgucuga

SEQ ID NO: 94622 - RNA, 21 nt, Human
ugggcacaaacccucugcacc

SEQ ID NO: 94623 - RNA, 25 nt, Human
ugggcacaaacccucugcacccaaa

SEQ ID NO: 94624 - RNA, 22 nt, Human
ugggucacucccguauugcacu

SEQ ID NO: 94625 - RNA, 21 nt, Human
ugucacaguuuuguuucggaa

SEQ ID NO: 94626 - RNA, 21 nt, Human
uguccgguauccuuggcuggc

SEQ ID NO: 94627 - RNA, 20 nt, Human
ugucuaaagcucagucgagg

SEQ ID NO: 94628 - RNA, 24 nt, Human
uuagcacuuuuuuuccacaagugg

SEQ ID NO: 94629 - RNA, 21 nt, Human
uugagggaaagaggaggggcu

SEQ ID NO: 94630 - RNA, 24 nt, Human
uuugccaacacacaaaacccccca

SEQ ID NO: 94631 - RNA, 24 nt, Human
uuuggaagaaaggggaguagcugc

SEQ ID NO: 94632 - RNA, 21 nt, Human
aaaaaaaaaaaaaagaaagag

SEQ ID NO: 94633 - RNA, 24 nt, Human
aaaaaauagaaaaaaugauuagag

SEQ ID NO: 94634 - RNA, 24 nt, Human
aaaaaauagaaaaaaugauuagag

SEQ ID NO: 94635 - RNA, 23 nt, Human
aaaaacacaaaaggaaauggggc

SEQ ID NO: 94636 - RNA, 23 nt, Human
aaaaacacaaaaggaaauggggc

SEQ ID NO: 94637 - RNA, 19 nt, Human
aaaaagaaagagccuguaa

SEQ ID NO: 94638 - RNA, 19 nt, Human
aaaaagaaagagccuguaa

SEQ ID NO: 94639 - RNA, 18 nt, Human
aaaacagaagccagccug

SEQ ID NO: 94640 - RNA, 18 nt, Human
aaaacagaagccagccug

SEQ ID NO: 94641 - RNA, 23 nt, Human
aaaaggaaauggggcaaacaaaa

SEQ ID NO: 94642 - RNA, 23 nt, Human
aaaaggaaauggggcaaacaaaa

SEQ ID NO: 94643 - RNA, 24 nt, Human
aaaauaccauauauauaacuguga

SEQ ID NO: 94644 - RNA, 24 nt, Human
aaaauaccauauauauaacuguga

SEQ ID NO: 94645 - RNA, 23 nt, Human
aaacaaacaaacacacaguaugg

SEQ ID NO: 94646 - RNA, 23 nt, Human
aaacaaacaaacacacaguaugg

SEQ ID NO: 94647 - RNA, 24 nt, Human
aaacaaacaaacacacaguauggc

SEQ ID NO: 94648 - RNA, 24 nt, Human
aaacaaacaaacacacaguauggc

SEQ ID NO: 94649 - RNA, 22 nt, Human
aaacaucuagaaguacaaaaaa

SEQ ID NO: 94650 - RNA, 22 nt, Human
aaacaucuagaaguacaaaaaa

SEQ ID NO: 94651 - RNA, 24 nt, Human
aaacaugugagcuguacaacacca

SEQ ID NO: 94652 - RNA, 24 nt, Human
aaacaugugagcuguacaacacca

SEQ ID NO: 94653 - RNA, 20 nt, Human
aaagaugggcagcacacauc

SEQ ID NO: 94654 - RNA, 21 nt, Human
aaaucccugaauaaaacagaa

SEQ ID NO: 94655 - RNA, 21 nt, Human
aaaucccugaauaaaacagaa

SEQ ID NO: 94656 - RNA, 23 nt, Human
aaaugacuuagcacuguuuucca

SEQ ID NO: 94657 - RNA, 23 nt, Human
aaaugacuuagcacuguuuucca

SEQ ID NO: 94658 - RNA, 18 nt, Human
aaauuagggcacugagug

SEQ ID NO: 94659 - RNA, 18 nt, Human
aaauuagggcacugagug

SEQ ID NO: 94660 - RNA, 24 nt, Human
aacaaaacaaaaaauaagaaugcu

SEQ ID NO: 94661 - RNA, 24 nt, Human
aacaaaacaaaaaauaagaaugcu

SEQ ID NO: 94662 - RNA, 20 nt, Human
aacacacaguauggccaaug

SEQ ID NO: 94663 - RNA, 19 nt, Human
aagaugggcagcacacauc

SEQ ID NO: 94664 - RNA, 20 nt, Human
aauaugcuguuacauacaug

SEQ ID NO: 94665 - RNA, 20 nt, Human
aauaugcuguuacauacaug

SEQ ID NO: 94666 - RNA, 18 nt, Human
aaucccugaauaaaacag

SEQ ID NO: 94667 - RNA, 18 nt, Human
aaucccugaauaaaacag

SEQ ID NO: 94668 - RNA, 21 nt, Human
aaugaaaguaacaccucccuc

SEQ ID NO: 94669 - RNA, 18 nt, Human
acaaaaaaaaaaauagaa

SEQ ID NO: 94670 - RNA, 18 nt, Human
acaaaaaaaaaaauagaa

SEQ ID NO: 94671 - RNA, 24 nt, Human
acaaacaaacacacaguauggcca

SEQ ID NO: 94672 - RNA, 24 nt, Human
acaaacaaacacacaguauggcca

SEQ ID NO: 94673 - RNA, 24 nt, Human
acaaugaaaguaacaccucccuca

SEQ ID NO: 94674 - RNA, 24 nt, Human
acaaugaaaguaacaccucccuca

SEQ ID NO: 94675 - RNA, 25 nt, Human
acacagaaguuuauugugaaaguaa

SEQ ID NO: 94676 - RNA, 25 nt, Human
acacagaaguuuauugugaaaguaa

SEQ ID NO: 94677 - RNA, 22 nt, Human
acugcaacuuuaauaacuguaa

SEQ ID NO: 94678 - RNA, 22 nt, Human
acugcaacuuuaauaacuguaa

SEQ ID NO: 94679 - RNA, 18 nt, Human
acuuagcacuguuuucca

SEQ ID NO: 94680 - RNA, 18 nt, Human
acuuagcacuguuuucca

SEQ ID NO: 94681 - RNA, 18 nt, Human
agaaaaugcauccucugc

SEQ ID NO: 94682 - RNA, 19 nt, Human
agacagacagaagcagcau

SEQ ID NO: 94683 - RNA, 19 nt, Human
agacagacagaagcagcau

SEQ ID NO: 94684 - RNA, 23 nt, Human
agccuguaaucccaguacucugg

SEQ ID NO: 94685 - RNA, 24 nt, Human
agccuguaaucccaguacucuggg

SEQ ID NO: 94686 - RNA, 24 nt, Human
agccuguaaucccaguacucuggg

SEQ ID NO: 94687 - RNA, 20 nt, Human
agcuguacaacaccaaaacc

SEQ ID NO: 94688 - RNA, 20 nt, Human
agcuguacaacaccaaaacc

SEQ ID NO: 94689 - RNA, 23 nt, Human
aggaguucgagaccagccugggc

SEQ ID NO: 94690 - RNA, 23 nt, Human
aggaguucgagaccagccugggc

SEQ ID NO: 94691 - RNA, 22 nt, Human
aggaucacuuaaaaagcgauuc

SEQ ID NO: 94692 - RNA, 24 nt, Human
aggaucgcuugaugccaggaguuc

SEQ ID NO: 94693 - RNA, 24 nt, Human
aggaucgcuugaugccaggaguuc

SEQ ID NO: 94694 - RNA, 18 nt, Human
aggcaggaggaucgcuug

SEQ ID NO: 94695 - RNA, 18 nt, Human
aggcaggaggaucgcuug

SEQ ID NO: 94696 - RNA, 24 nt, Human
aggcuaaggcaggaggaucgcuug

SEQ ID NO: 94697 - RNA, 24 nt, Human
aggcuaaggcaggaggaucgcuug

SEQ ID NO: 94698 - RNA, 20 nt, Human
aguacucugggaggcuaagg

SEQ ID NO: 94699 - RNA, 20 nt, Human
aguacucugggaggcuaagg

SEQ ID NO: 94700 - RNA, 23 nt, Human
agugcagaaguaaaaaaccaagg

SEQ ID NO: 94701 - RNA, 23 nt, Human
agugcagaaguaaaaaaccaagg

SEQ ID NO: 94702 - RNA, 18 nt, Human
auaaugcaaacaacauca

SEQ ID NO: 94703 - RNA, 20 nt, Human
auaaugcaaacaacaucagc

SEQ ID NO: 94704 - RNA, 21 nt, Human
aucgcuugaugccaggaguuc

SEQ ID NO: 94705 - RNA, 24 nt, Human
aucgcuugaugccaggaguucgag

SEQ ID NO: 94706 - RNA, 25 nt, Human
auuaaaaaaaaaaaaaagaaagagu

SEQ ID NO: 94707 - RNA, 25 nt, Human
auuaaaaaaaaaaaaaagaaagagu

SEQ ID NO: 94708 - RNA, 21 nt, Human
auugacuuuuuaaaaaaaucc

SEQ ID NO: 94709 - RNA, 21 nt, Human
caaaacaaaaaauaagaaugc

SEQ ID NO: 94710 - RNA, 21 nt, Human
caaaacaaaaaauaagaaugc

SEQ ID NO: 94711 - RNA, 25 nt, Human
caaaacaucuagaaguacaaaaaaa

SEQ ID NO: 94712 - RNA, 25 nt, Human
caaaacaucuagaaguacaaaaaaa

SEQ ID NO: 94713 - RNA, 21 nt, Human
caaaauaccauauauauaacu

SEQ ID NO: 94714 - RNA, 21 nt, Human
caaaauaccauauauauaacu

SEQ ID NO: 94715 - RNA, 22 nt, Human
caaacacacaguauggccaaug

SEQ ID NO: 94716 - RNA, 22 nt, Human
caacacugcgagacccugucuc

SEQ ID NO: 94717 - RNA, 22 nt, Human
caacacugcgagacccugucuc

SEQ ID NO: 94718 - RNA, 19 nt, Human
caacuagaagcaaugugua

SEQ ID NO: 94719 - RNA, 19 nt, Human
caacuagaagcaaugugua

SEQ ID NO: 94720 - RNA, 18 nt, Human
cacaaaaggaaauggggc

SEQ ID NO: 94721 - RNA, 18 nt, Human
cacaaaaggaaauggggc

SEQ ID NO: 94722 - RNA, 22 nt, Human
cacagaugaacauuuucucucu

SEQ ID NO: 94723 - RNA, 22 nt, Human
cacagaugaacauuuucucucu

SEQ ID NO: 94724 - RNA, 18 nt, Human
cacaguauggccaauggu

SEQ ID NO: 94725 - RNA, 18 nt, Human
cacaguauggccaauggu

SEQ ID NO: 94726 - RNA, 20 nt, Human
cagaacagaagcuaaaacaa

SEQ ID NO: 94727 - RNA, 20 nt, Human
cagaacagaagcuaaaacaa

SEQ ID NO: 94728 - RNA, 21 nt, Human
caguacucugggaggcuaagg

SEQ ID NO: 94729 - RNA, 21 nt, Human
caguacucugggaggcuaagg

SEQ ID NO: 94730 - RNA, 24 nt, Human
caguacucugggaggcuaaggcag

SEQ ID NO: 94731 - RNA, 24 nt, Human
caguacucugggaggcuaaggcag

SEQ ID NO: 94732 - RNA, 24 nt, Human
caugcauaacuucaaauauauaac

SEQ ID NO: 94733 - RNA, 24 nt, Human
caugcauaacuucaaauauauaac

SEQ ID NO: 94734 - RNA, 25 nt, Human
ccaaaaccaaccaaauucauucaua

SEQ ID NO: 94735 - RNA, 25 nt, Human
ccaaaaccaaccaaauucauucaua

SEQ ID NO: 94736 - RNA, 18 nt, Human
ccagcauuaagacagaca

SEQ ID NO: 94737 - RNA, 18 nt, Human
ccagcauuaagacagaca

SEQ ID NO: 94738 - RNA, 25 nt, Human
ccaggaguucgagaccagccugggc

SEQ ID NO: 94739 - RNA, 25 nt, Human
ccaggaguucgagaccagccugggc

SEQ ID NO: 94740 - RNA, 24 nt, Human
ccuauauacaaugaaaguaacacc

SEQ ID NO: 94741 - RNA, 24 nt, Human
ccugggcaacacugcgagacccug

SEQ ID NO: 94742 - RNA, 24 nt, Human
ccugggcaacacugcgagacccug

SEQ ID NO: 94743 - RNA, 18 nt, Human
ccuguaaucccaguacuc

SEQ ID NO: 94744 - RNA, 23 nt, Human
ccuguacuacuggagaaaaaggg

SEQ ID NO: 94745 - RNA, 23 nt, Human
ccuguacuacuggagaaaaaggg

SEQ ID NO: 94746 - RNA, 24 nt, Human
cuuauucagacuucaguccauuuu

SEQ ID NO: 94747 - RNA, 24 nt, Human
cuuauucagacuucaguccauuuu

SEQ ID NO: 94748 - RNA, 20 nt, Human
gacaauagaggaaaauguac

SEQ ID NO: 94749 - RNA, 20 nt, Human
gacaauagaggaaaauguac

SEQ ID NO: 94750 - RNA, 24 nt, Human
gaucgcuugaugccaggaguucga

SEQ ID NO: 94751 - RNA, 24 nt, Human
gaucgcuugaugccaggaguucga

SEQ ID NO: 94752 - RNA, 20 nt, Human
gauuacagaacagaagcuaa

SEQ ID NO: 94753 - RNA, 18 nt, Human
ggaucacuuaaaaagcga

SEQ ID NO: 94754 - RNA, 23 nt, Human
ggaucgcuugaugccaggaguuc

SEQ ID NO: 94755 - RNA, 23 nt, Human
ggaucgcuugaugccaggaguuc

SEQ ID NO: 94756 - RNA, 20 nt, Human
ggucaucaccaccaccuaaa

SEQ ID NO: 94757 - RNA, 21 nt, Human
guggcagacagcucuaugcua

SEQ ID NO: 94758 - RNA, 21 nt, Human
guggcagacagcucuaugcua

SEQ ID NO: 94759 - RNA, 22 nt, Human
uaaaaaaaaaaaaaagaaagag

SEQ ID NO: 94760 - RNA, 25 nt, Human
uaaaaacacaaaaggaaauggggca

SEQ ID NO: 94761 - RNA, 25 nt, Human
uaaaaacacaaaaggaaauggggca

SEQ ID NO: 94762 - RNA, 18 nt, Human
uaaaaagcgauucccuca

SEQ ID NO: 94763 - RNA, 18 nt, Human
uaaaaagcgauucccuca

SEQ ID NO: 94764 - RNA, 21 nt, Human
uaaaacagaagccagccugug

SEQ ID NO: 94765 - RNA, 21 nt, Human
uaaaacagaagccagccugug

SEQ ID NO: 94766 - RNA, 20 nt, Human
uaaaaugcuauagacuauaa

SEQ ID NO: 94767 - RNA, 20 nt, Human
uaaaaugcuauagacuauaa

SEQ ID NO: 94768 - RNA, 24 nt, Human
uaaauaaugcaaacaacaucagca

SEQ ID NO: 94769 - RNA, 24 nt, Human
uaaauaaugcaaacaacaucagca

SEQ ID NO: 94770 - RNA, 22 nt, Human
uaacaccucccucaucagucaa

SEQ ID NO: 94771 - RNA, 22 nt, Human
uaacaccucccucaucagucaa

SEQ ID NO: 94772 - RNA, 21 nt, Human
uaaggcaggaggaucgcuuga

SEQ ID NO: 94773 - RNA, 21 nt, Human
uaaggcaggaggaucgcuuga

SEQ ID NO: 94774 - RNA, 23 nt, Human
uaagugcagaaguaaaaaaccaa

SEQ ID NO: 94775 - RNA, 23 nt, Human
uaagugcagaaguaaaaaaccaa

SEQ ID NO: 94776 - RNA, 21 nt, Human
uaaguuuuuagccuguaaaua

SEQ ID NO: 94777 - RNA, 21 nt, Human
uaaguuuuuagccuguaaaua

SEQ ID NO: 94778 - RNA, 24 nt, Human
uacaaugaaaguaacaccucccuc

SEQ ID NO: 94779 - RNA, 20 nt, Human
uacagaacagaagcuaaaac

SEQ ID NO: 94780 - RNA, 20 nt, Human
uacagaacagaagcuaaaac

SEQ ID NO: 94781 - RNA, 22 nt, Human
uacagaacagaagcuaaaacaa

SEQ ID NO: 94782 - RNA, 22 nt, Human
uacagaacagaagcuaaaacaa

SEQ ID NO: 94783 - RNA, 19 nt, Human
uacuggagaaaaagggcuc

SEQ ID NO: 94784 - RNA, 21 nt, Human
uagaaaaaaugauuagagaaa

SEQ ID NO: 94785 - RNA, 21 nt, Human
uagaaaaaaugauuagagaaa

SEQ ID NO: 94786 - RNA, 20 nt, Human
uagaaguacaaaaaaaaaaa

SEQ ID NO: 94787 - RNA, 20 nt, Human
uagaaguacaaaaaaaaaaa

SEQ ID NO: 94788 - RNA, 20 nt, Human
uagacuauaaaaacacaaaa

SEQ ID NO: 94789 - RNA, 20 nt, Human
uagacuauaaaaacacaaaa

SEQ ID NO: 94790 - RNA, 19 nt, Human
uagaggaaaauguaccauc

SEQ ID NO: 94791 - RNA, 19 nt, Human
uagaggaaaauguaccauc

SEQ ID NO: 94792 - RNA, 23 nt, Human
uaugaaauaagaccuauauacaa

SEQ ID NO: 94793 - RNA, 24 nt, Human
uaugaaauaagaccuauauacaaa

SEQ ID NO: 94794 - RNA, 22 nt, Human
uccuuuccaugcauaacuucaa

SEQ ID NO: 94795 - RNA, 22 nt, Human
uccuuuccaugcauaacuucaa

SEQ ID NO: 94796 - RNA, 20 nt, Human
ucgcuugaugccaggaguuc

SEQ ID NO: 94797 - RNA, 22 nt, Human
ucucuauuaaaaaaaaaaaaaa

SEQ ID NO: 94798 - RNA, 22 nt, Human
ucucuauuaaaaaaaaaaaaaa

SEQ ID NO: 94799 - RNA, 19 nt, Human
ugaaaaaauaucaaauugc

SEQ ID NO: 94800 - RNA, 19 nt, Human
ugaaaaaauaucaaauugc

SEQ ID NO: 94801 - RNA, 24 nt, Human
ugaaaaaauaucaaauugcaucaa

SEQ ID NO: 94802 - RNA, 24 nt, Human
ugaaaaaauaucaaauugcaucaa

SEQ ID NO: 94803 - RNA, 20 nt, Human
ugaaaaaauauuuguaagga

SEQ ID NO: 94804 - RNA, 20 nt, Human
ugaaaaaauauuuguaagga

SEQ ID NO: 94805 - RNA, 19 nt, Human
ugaaaguaacaccucccuc

SEQ ID NO: 94806 - RNA, 19 nt, Human
ugaaaguaacaccucccuc

SEQ ID NO: 94807 - RNA, 24 nt, Human
ugaauaaaacagaagccagccugu

SEQ ID NO: 94808 - RNA, 24 nt, Human
ugaauaaaacagaagccagccugu

SEQ ID NO: 94809 - RNA, 24 nt, Human
ugagaaauagaccguaguaccucc

SEQ ID NO: 94810 - RNA, 24 nt, Human
ugagaaauagaccguaguaccucc

SEQ ID NO: 94811 - RNA, 18 nt, Human
ugagcuguacaacaccaa

SEQ ID NO: 94812 - RNA, 18 nt, Human
ugagcuguacaacaccaa

SEQ ID NO: 94813 - RNA, 21 nt, Human
ugauuacagaacagaagcuaa

SEQ ID NO: 94814 - RNA, 18 nt, Human
ugcaauuugacaguaagc

SEQ ID NO: 94815 - RNA, 20 nt, Human
ugcuauagacuauaaaaaca

SEQ ID NO: 94816 - RNA, 20 nt, Human
ugcuauagacuauaaaaaca

SEQ ID NO: 94817 - RNA, 21 nt, Human
uggaagaaaaugcauccucug

SEQ ID NO: 94818 - RNA, 21 nt, Human
uggaagaaaaugcauccucug

SEQ ID NO: 94819 - RNA, 23 nt, Human
ugggaggcuaaggcaggaggauc

SEQ ID NO: 94820 - RNA, 23 nt, Human
ugggaggcuaaggcaggaggauc

SEQ ID NO: 94821 - RNA, 24 nt, Human
ugggcaacacugcgagacccuguc

SEQ ID NO: 94822 - RNA, 24 nt, Human
ugggcaacacugcgagacccuguc

SEQ ID NO: 94823 - RNA, 18 nt, Human
uguacaacaccaaaacca

SEQ ID NO: 94824 - RNA, 18 nt, Human
uguacaacaccaaaacca

SEQ ID NO: 94825 - RNA, 24 nt, Human
uguacaacaccaaaaccaaccaaa

SEQ ID NO: 94826 - RNA, 24 nt, Human
uguacaacaccaaaaccaaccaaa

SEQ ID NO: 94827 - RNA, 22 nt, Human
uuaauggaagaaaaugcauccu

SEQ ID NO: 94828 - RNA, 22 nt, Human
uuaauggaagaaaaugcauccu

SEQ ID NO: 94829 - RNA, 25 nt, Human
uuagaaaugcagguauuauaaucau

SEQ ID NO: 94830 - RNA, 25 nt, Human
uuagaaaugcagguauuauaaucau

SEQ ID NO: 94831 - RNA, 18 nt, Human
uuccagaauuaauggaag

SEQ ID NO: 94832 - RNA, 20 nt, Human
uugacuuuuuaaaaaaaucc

SEQ ID NO: 94833 - RNA, 22 nt, Human
uugaugccaggaguucgagacc

SEQ ID NO: 94834 - RNA, 22 nt, Human
uugaugccaggaguucgagacc

SEQ ID NO: 94835 - RNA, 19 nt, Human
uugcaauuugacaguaagc

SEQ ID NO: 94836 - RNA, 24 nt, Human
uuuauuugauacaggauaucuguu

SEQ ID NO: 94837 - RNA, 24 nt, Human
uuuauuugauacaggauaucuguu

SEQ ID NO: 94838 - RNA, 18 nt, Human
uuuguagcugauucauca

SEQ ID NO: 94839 - RNA, 18 nt, Human
aaaggaacuccugcccuu

SEQ ID NO: 94840 - RNA, 26 nt, Human
aaggaacuccugcccuucuaggugcc

SEQ ID NO: 94841 - RNA, 22 nt, Human
agagaagcagggcgugaaggag

SEQ ID NO: 94842 - RNA, 20 nt, Human
agggucggagcccaggcggg

SEQ ID NO: 94843 - RNA, 21 nt, Human
auaaaacauacuagcugcucc

SEQ ID NO: 94844 - RNA, 27 nt, Human
cagggucggagcccaggcggguccgcc

SEQ ID NO: 94845 - RNA, 22 nt, Human
ccacagagagggcaagacuuca

SEQ ID NO: 94846 - RNA, 18 nt, Human
ccgccgccgccgccgccg

SEQ ID NO: 94847 - RNA, 18 nt, Human
ccgccgccgccgccgccg

SEQ ID NO: 94848 - RNA, 18 nt, Human
ccgccgccgccgccgccg

SEQ ID NO: 94849 - RNA, 18 nt, Human
ccgccgccgccgccgccg

SEQ ID NO: 94850 - RNA, 24 nt, Human
ccgccgccgccgccgccgccgccg

SEQ ID NO: 94851 - RNA, 24 nt, Human
ccgccgccgccgccgccgccgccg

SEQ ID NO: 94852 - RNA, 24 nt, Human
ccgccgccgccgccgccgccgccg

SEQ ID NO: 94853 - RNA, 24 nt, Human
ccgccgccgccgccgccgccgccg

SEQ ID NO: 94854 - RNA, 25 nt, Human
ccgccgccgccgccgccgccgccgg

SEQ ID NO: 94855 - RNA, 24 nt, Human
ccgccgccgccgccgccgccggcu

SEQ ID NO: 94856 - RNA, 27 nt, Human
ccgccgccgccgccgccggcuauccgg

SEQ ID NO: 94857 - RNA, 19 nt, Human
ccucuaaaccugcagcagg

SEQ ID NO: 94858 - RNA, 18 nt, Human
cucccggccgccgccgcc

SEQ ID NO: 94859 - RNA, 21 nt, Human
cuccugcccuucuaggugcca

SEQ ID NO: 94860 - RNA, 23 nt, Human
gccgccgccgccgccgccgccgg

SEQ ID NO: 94861 - RNA, 21 nt, Human
gccgccgccgccgccggcuau

SEQ ID NO: 94862 - RNA, 23 nt, Human
gcgagcgagggagagaagcaggg

SEQ ID NO: 94863 - RNA, 19 nt, Human
gggcagggucggagcccag

SEQ ID NO: 94864 - RNA, 22 nt, Human
uaacucccaacucacugguccu

SEQ ID NO: 94865 - RNA, 21 nt, Human
uccugcccuucuaggugccac

SEQ ID NO: 94866 - RNA, 22 nt, Human
ucuaaaccugcagcagggagau

SEQ ID NO: 94867 - RNA, 19 nt, Human
ugaaggaggggccucuccc

SEQ ID NO: 94868 - RNA, 20 nt, Human
ugcgagcgagggagagaagc

SEQ ID NO: 94869 - RNA, 24 nt, Human
uggaaccacugaugugauauccca

SEQ ID NO: 94870 - RNA, 19 nt, Human
aacuugggagucaccggca

SEQ ID NO: 94871 - RNA, 20 nt, Human
aagaaaaucucaacacuuca

SEQ ID NO: 94872 - RNA, 20 nt, Human
aauccacacccgcucucccc

SEQ ID NO: 94873 - RNA, 25 nt, Human
acacgcacgcagcccagugugugug

SEQ ID NO: 94874 - RNA, 21 nt, Human
acccgcucuccccucccgccc

SEQ ID NO: 94875 - RNA, 20 nt, Human
acuagagcacaaagcucuca

SEQ ID NO: 94876 - RNA, 21 nt, Human
agaacagcucgcucccgaaga

SEQ ID NO: 94877 - RNA, 22 nt, Human
agacaaauccacacccgcucuc

SEQ ID NO: 94878 - RNA, 18 nt, Human
agaggcugaaucaaaaac

SEQ ID NO: 94879 - RNA, 22 nt, Human
aggccuccgagacguggaaacg

SEQ ID NO: 94880 - RNA, 23 nt, Human
caaaacaacuugcuuaaaaccug

SEQ ID NO: 94881 - RNA, 28 nt, Human
caaaacuacuagagcacaaagcucucau

SEQ ID NO: 94882 - RNA, 25 nt, Human
caaauuucaggcaaauucacaaccc

SEQ ID NO: 94883 - RNA, 21 nt, Human
caagacaaauccacacccgcu

SEQ ID NO: 94884 - RNA, 25 nt, Human
cacacccgcucuccccucccgcccg

SEQ ID NO: 94885 - RNA, 24 nt, Human
caccccaccccuguggcacacaca

SEQ ID NO: 94886 - RNA, 21 nt, Human
cacuccacacgcacgcagccc

SEQ ID NO: 94887 - RNA, 26 nt, Human
cagcucgcucccgaagaaggagcaac

SEQ ID NO: 94888 - RNA, 23 nt, Human
caggcaaauucacaacccaguga

SEQ ID NO: 94889 - RNA, 19 nt, Human
ccagagacacgcgugugcg

SEQ ID NO: 94890 - RNA, 24 nt, Human
cccaccccuguggcacacacagga

SEQ ID NO: 94891 - RNA, 23 nt, Human
ccccuguggcacacacaggaccc

SEQ ID NO: 94892 - RNA, 18 nt, Human
ccggcaccuggagaaccc

SEQ ID NO: 94893 - RNA, 19 nt, Human
cgacucggggaggccgcgg

SEQ ID NO: 94894 - RNA, 20 nt, Human
cgcgggacgccgcagcagca

SEQ ID NO: 94895 - RNA, 21 nt, Human
cggggaggccgcgggacgccg

SEQ ID NO: 94896 - RNA, 21 nt, Human
cguggaaacgcaacaauuacc

SEQ ID NO: 94897 - RNA, 18 nt, Human
cuaauggagggaugagaa

SEQ ID NO: 94898 - RNA, 19 nt, Human
cuggacaccccaccccugu

SEQ ID NO: 94899 - RNA, 25 nt, Human
cuguccagagacacgcgugugcgcg

SEQ ID NO: 94900 - RNA, 18 nt, Human
gacaccccaccccugugg

SEQ ID NO: 94901 - RNA, 20 nt, Human
gagaagaucauaaucagagg

SEQ ID NO: 94902 - RNA, 18 nt, Human
gcccagugugugugggga

SEQ ID NO: 94903 - RNA, 22 nt, Human
gucccacuccacacgcacgcag

SEQ ID NO: 94904 - RNA, 19 nt, Human
uaacacaaaaccuuaaugu

SEQ ID NO: 94905 - RNA, 20 nt, Human
uacuacacuacuaccuuaau

SEQ ID NO: 94906 - RNA, 25 nt, Human
uacugaacucugaauucugaaaauu

SEQ ID NO: 94907 - RNA, 28 nt, Human
uaguauggacaaaacaacuugcuuaaaa

SEQ ID NO: 94908 - RNA, 20 nt, Human
ucaaaacuacuagagcacaa

SEQ ID NO: 94909 - RNA, 22 nt, Human
ucccgaguuggaggccuggcag

SEQ ID NO: 94910 - RNA, 23 nt, Human
uccuagaggauaacacaaaaccc

SEQ ID NO: 94911 - RNA, 23 nt, Human
ucggcgccguagcuguccagaga

SEQ ID NO: 94912 - RNA, 19 nt, Human
ucugaaauuaaaagaagga

SEQ ID NO: 94913 - RNA, 18 nt, Human
ugacugaugcccaacuac

SEQ ID NO: 94914 - RNA, 20 nt, Human
ugagaagaucauaaucagag

SEQ ID NO: 94915 - RNA, 20 nt, Human
ugcaagaaaagcaaguucau

SEQ ID NO: 94916 - RNA, 24 nt, Human
ugcaagaaaagcaaguucauauuu

SEQ ID NO: 94917 - RNA, 22 nt, Human
uggacaaaacaacuugcuuaaa

SEQ ID NO: 94918 - RNA, 18 nt, Human
uggaggccuggcaggugg

SEQ ID NO: 94919 - RNA, 21 nt, Human
uguugagugaagaaccaugcu

SEQ ID NO: 94920 - RNA, 20 nt, Human
uugcuuaaaaccugacugau

SEQ ID NO: 94921 - RNA, 23 nt, Human
uuguucaaaacuuuuuuaaaggu

SEQ ID NO: 94922 - RNA, 21 nt, Human
aaaugcccuuuggaccaacuc

SEQ ID NO: 94923 - RNA, 23 nt, Human
aaauggggcccauggauggagcu

SEQ ID NO: 94924 - RNA, 20 nt, Human
aacaccugcguggagaacag

SEQ ID NO: 94925 - RNA, 18 nt, Human
aaggauauuuaugacauu

SEQ ID NO: 94926 - RNA, 23 nt, Human
augcccuuuggaccaacucagga

SEQ ID NO: 94927 - RNA, 25 nt, Human
caaaauggggcccauggauggagcu

SEQ ID NO: 94928 - RNA, 20 nt, Human
caacucaggacaagguacaa

SEQ ID NO: 94929 - RNA, 21 nt, Human
cggggcgcgcggaacaccugc

SEQ ID NO: 94930 - RNA, 21 nt, Human
gcgcggaacaccugcguggag

SEQ ID NO: 94931 - RNA, 21 nt, Human
guggagaacagaccuggcuca

SEQ ID NO: 94932 - RNA, 26 nt, Human
ugacauuguaaaugcccuuuggacca

SEQ ID NO: 94933 - RNA, 19 nt, Human
uggagaacagaccuggcuc

SEQ ID NO: 94934 - RNA, 22 nt, Human
uggagaacagaccuggcucagg

SEQ ID NO: 94935 - RNA, 19 nt, Human
aagcagcaagcuccgaagc

SEQ ID NO: 94936 - RNA, 21 nt, Human
auuaagcagcaagcuccgaag

SEQ ID NO: 94937 - RNA, 21 nt, Human
aaaaaacccaaacacgcaaac

SEQ ID NO: 94938 - RNA, 22 nt, Human
aacacgcaaacucgucccgcca

SEQ ID NO: 94939 - RNA, 24 nt, Human
aacucgucccgccagcucagcccc

SEQ ID NO: 94940 - RNA, 22 nt, Human
aagugggcaaggguggcgggcc

SEQ ID NO: 94941 - RNA, 25 nt, Human
accgcucaaacucuguaaggagacg

SEQ ID NO: 94942 - RNA, 22 nt, Human
acggaugcucugugccgugugc

SEQ ID NO: 94943 - RNA, 20 nt, Human
agaaaaucacauauuucauc

SEQ ID NO: 94944 - RNA, 20 nt, Human
agauggugcugacaguucag

SEQ ID NO: 94945 - RNA, 23 nt, Human
aggaaagcgaaggagaagugggc

SEQ ID NO: 94946 - RNA, 26 nt, Human
aggaaguuacauuagagaaaaucaca

SEQ ID NO: 94947 - RNA, 22 nt, Human
caaagucgaucagcaguugcca

SEQ ID NO: 94948 - RNA, 19 nt, Human
ccacaccgcccagcgcucc

SEQ ID NO: 94949 - RNA, 21 nt, Human
ccagaacagggaaaaccuauu

SEQ ID NO: 94950 - RNA, 18 nt, Human
ccaggggaggaggaagac

SEQ ID NO: 94951 - RNA, 23 nt, Human
cccgcuccacaccgcccagcgcu

SEQ ID NO: 94952 - RNA, 24 nt, Human
ccgacuucucucucaauauuuccu

SEQ ID NO: 94953 - RNA, 18 nt, Human
ccuggacucuucucucuu

SEQ ID NO: 94954 - RNA, 21 nt, Human
ccuggccgacuucucucucaa

SEQ ID NO: 94955 - RNA, 18 nt, Human
cucuucucucuuuugccu

SEQ ID NO: 94956 - RNA, 21 nt, Human
cugcgcagucauugccugugu

SEQ ID NO: 94957 - RNA, 25 nt, Human
cuuucuggauguacuaaaugccgcu

SEQ ID NO: 94958 - RNA, 27 nt, Human
gacaacagagacacaaaagggagggcc

SEQ ID NO: 94959 - RNA, 19 nt, Human
ggaggaggaagacgggagg

SEQ ID NO: 94960 - RNA, 19 nt, Human
gggcucaggaaagcgaagg

SEQ ID NO: 94961 - RNA, 21 nt, Human
ggggaggaggaagacgggagg

SEQ ID NO: 94962 - RNA, 23 nt, Human
ggggugaugacagaauguuccag

SEQ ID NO: 94963 - RNA, 20 nt, Human
guuuuacuugguuaacuucu

SEQ ID NO: 94964 - RNA, 23 nt, Human
guuuuacuugguuaacuucuugc

SEQ ID NO: 94965 - RNA, 19 nt, Human
uaaaaaacccaaacacgca

SEQ ID NO: 94966 - RNA, 20 nt, Human
uagacaacagagacacaaag

SEQ ID NO: 94967 - RNA, 18 nt, Human
ucaugggauccugguguu

SEQ ID NO: 94968 - RNA, 18 nt, Human
uccacaccgcccagcgcu

SEQ ID NO: 94969 - RNA, 21 nt, Human
uccagaacgugacagaggugg

SEQ ID NO: 94970 - RNA, 18 nt, Human
uccccgccccuuccugga

SEQ ID NO: 94971 - RNA, 19 nt, Human
ucccgccagcucagccccg

SEQ ID NO: 94972 - RNA, 25 nt, Human
ugacagagguggugccuacacaacu

SEQ ID NO: 94973 - RNA, 19 nt, Human
uggaggaugcugagccacc

SEQ ID NO: 94974 - RNA, 18 nt, Human
uggccgacuucucucuca

SEQ ID NO: 94975 - RNA, 18 nt, Human
uuagagaaaaucacauau

SEQ ID NO: 94976 - RNA, 21 nt, Human
uugcuucgggaauuuaaggaa

SEQ ID NO: 94977 - RNA, 21 nt, Human
uuuuuuuuuuuuuuuguguga

SEQ ID NO: 94978 - RNA, 18 nt, Human
uuuuuuuuuuuuuuuuug

SEQ ID NO: 94979 - RNA, 19 nt, Human
uuuuuuuuuuuuuuuuugu

SEQ ID NO: 94980 - RNA, 22 nt, Human
aacacaagacccuacaaaccca

SEQ ID NO: 94981 - RNA, 24 nt, Human
aagcaacacaagacccuacaaacc

SEQ ID NO: 94982 - RNA, 23 nt, Human
agaaaugucugaaaccuggacaa

SEQ ID NO: 94983 - RNA, 22 nt, Human
agaagcaacacaagacccuaca

SEQ ID NO: 94984 - RNA, 24 nt, Human
agacagacacucaaagaggaucuc

SEQ ID NO: 94985 - RNA, 24 nt, Human
agacccuacaaacccaccuaugga

SEQ ID NO: 94986 - RNA, 21 nt, Human
aggcaacuccccaaggccaag

SEQ ID NO: 94987 - RNA, 22 nt, Human
auagcaucuuccccaaccuaga

SEQ ID NO: 94988 - RNA, 23 nt, Human
auagcaucuuccccaaccuagaa

SEQ ID NO: 94989 - RNA, 23 nt, Human
caacacaagacccuacaaaccca

SEQ ID NO: 94990 - RNA, 26 nt, Human
caaccuagaaaugucugaaaccugga

SEQ ID NO: 94991 - RNA, 19 nt, Human
caagacccuacaaacccac

SEQ ID NO: 94992 - RNA, 24 nt, Human
caagccuaaaggcaacuccccaag

SEQ ID NO: 94993 - RNA, 22 nt, Human
cacuugguucucuaagaugaag

SEQ ID NO: 94994 - RNA, 19 nt, Human
caggggccaugcagagcug

SEQ ID NO: 94995 - RNA, 20 nt, Human
ccaagccuggagagaccagg

SEQ ID NO: 94996 - RNA, 19 nt, Human
ccagaacauucugugucac

SEQ ID NO: 94997 - RNA, 20 nt, Human
ccccaaccuagaaaugucug

SEQ ID NO: 94998 - RNA, 22 nt, Human
ccccaaggccaagaugagccag

SEQ ID NO: 94999 - RNA, 24 nt, Human
ccugagccuuagcaggggccaugc

SEQ ID NO: 95000 - RNA, 23 nt, Human
cuaaaggcaacuccccaaggcca

SEQ ID NO: 95001 - RNA, 22 nt, Human
cucccacccagaacauucugug

SEQ ID NO: 95002 - RNA, 24 nt, Human
cucuaagaugaagaagggcggcuc

SEQ ID NO: 95003 - RNA, 23 nt, Human
cucugcgggcauguggggauguc

SEQ ID NO: 95004 - RNA, 23 nt, Human
cuggacaaagacagacacucaaa

SEQ ID NO: 95005 - RNA, 18 nt, Human
gaaaaggagaggcuugag

SEQ ID NO: 95006 - RNA, 18 nt, Human
gaaaccuggacaaagaca

SEQ ID NO: 95007 - RNA, 21 nt, Human
gacaaagacagacacucaaag

SEQ ID NO: 95008 - RNA, 20 nt, Human
gacccuacaaacccaccuau

SEQ ID NO: 95009 - RNA, 21 nt, Human
gaggggcagggagaggcccag

SEQ ID NO: 95010 - RNA, 20 nt, Human
gcagggagaggcccagguca

SEQ ID NO: 95011 - RNA, 19 nt, Human
ggagagaccagaagcaaca

SEQ ID NO: 95012 - RNA, 21 nt, Human
ggagaggcuugaggacucaag

SEQ ID NO: 95013 - RNA, 19 nt, Human
ggcagggagaggcccaggu

SEQ ID NO: 95014 - RNA, 21 nt, Human
uagaaaugucugaaaccugga

SEQ ID NO: 95015 - RNA, 19 nt, Human
ucccaauagcaucuucccc

SEQ ID NO: 95016 - RNA, 21 nt, Human
ucucugcgggcauguggggau

SEQ ID NO: 95017 - RNA, 19 nt, Human
ugaggacucaagccuaaag

SEQ ID NO: 95018 - RNA, 20 nt, Human
uggacgaaaaggagaggcuu

SEQ ID NO: 95019 - RNA, 20 nt, Human
ugucugaaaccuggacaaag

SEQ ID NO: 95020 - RNA, 22 nt, Human
aacuuugcagagaggcagccuu

SEQ ID NO: 95021 - RNA, 18 nt, Human
accaacaggcucugccgu

SEQ ID NO: 95022 - RNA, 20 nt, Human
cccaccagaccaaaauuugg

SEQ ID NO: 95023 - RNA, 20 nt, Human
ggcuccugugugcaggucac

SEQ ID NO: 95024 - RNA, 22 nt, Human
ugccguguucaauagcagcuca

SEQ ID NO: 95025 - RNA, 20 nt, Human
caaccggagcagcccggcag

SEQ ID NO: 95026 - RNA, 22 nt, Human
gagcgugugugguugcacugga

SEQ ID NO: 95027 - RNA, 18 nt, Human
gggagguugcuuccguug

SEQ ID NO: 95028 - RNA, 18 nt, Human
gucaaacuccacagacaa

SEQ ID NO: 95029 - RNA, 18 nt, Human
uaggacggcagcuggcuu

SEQ ID NO: 95030 - RNA, 20 nt, Human
ugagcgugugugguugcacu

SEQ ID NO: 95031 - RNA, 24 nt, Human
uggcguuuccaaccggagcagccc

SEQ ID NO: 95032 - RNA, 22 nt, Human
ugucuuauucugccuccucugg

SEQ ID NO: 95033 - RNA, 18 nt, Human
uuggauuaggacggcagc

SEQ ID NO: 95034 - RNA, 21 nt, Human
aagugcuggagagcuggugaa

SEQ ID NO: 95035 - RNA, 24 nt, Human
accuugaagaguucccacuggagg

SEQ ID NO: 95036 - RNA, 19 nt, Human
agaaaccaaucauggcccc

SEQ ID NO: 95037 - RNA, 22 nt, Human
ccggcucauuccucuaaugacc

SEQ ID NO: 95038 - RNA, 18 nt, Human
ccuuccuucuccaucagc

SEQ ID NO: 95039 - RNA, 25 nt, Human
cucuucuuccguucuuucuucucug

SEQ ID NO: 95040 - RNA, 18 nt, Human
cugcugcuuuccaccaag

SEQ ID NO: 95041 - RNA, 19 nt, Human
cugcugcuuuccaccaagu

SEQ ID NO: 95042 - RNA, 18 nt, Human
cuuucuucucugccuccu

SEQ ID NO: 95043 - RNA, 23 nt, Human
gaaaccaaucauggccccacugg

SEQ ID NO: 95044 - RNA, 18 nt, Human
gaugaaggaugaaaagag

SEQ ID NO: 95045 - RNA, 19 nt, Human
gcuccuucucuuccugauc

SEQ ID NO: 95046 - RNA, 23 nt, Human
ggaugaaaagagaccuugaagag

SEQ ID NO: 95047 - RNA, 18 nt, Human
uaacauauccugcuuuga

SEQ ID NO: 95048 - RNA, 21 nt, Human
uccuucugcgguggaggguca

SEQ ID NO: 95049 - RNA, 23 nt, Human
ucucuucuuccguucuuucuucu

SEQ ID NO: 95050 - RNA, 21 nt, Human
ucugccuccucccugccuucc

SEQ ID NO: 95051 - RNA, 23 nt, Human
ucugcgguggagggucaggggac

SEQ ID NO: 95052 - RNA, 21 nt, Human
ucuuucuucucugccuccucc

SEQ ID NO: 95053 - RNA, 19 nt, Human
ugaccgaagcgucucgcag

SEQ ID NO: 95054 - RNA, 20 nt, Human
uuuccaccaagugcuggaga

SEQ ID NO: 95055 - RNA, 25 nt, Human
uuucuucucugccuccucccugccu

SEQ ID NO: 95056 - RNA, 20 nt, Human
aaggaaggagagggcagggc

SEQ ID NO: 95057 - RNA, 18 nt, Human
aggaaggagagggcaggg

SEQ ID NO: 95058 - RNA, 21 nt, Human
agucucuaaaacaaucagugc

SEQ ID NO: 95059 - RNA, 27 nt, Human
aguugugguuuguguuuucuaugucug

SEQ ID NO: 95060 - RNA, 22 nt, Human
caacccccacggccccucuacu

SEQ ID NO: 95061 - RNA, 20 nt, Human
caugccuccuuucccaugua

SEQ ID NO: 95062 - RNA, 22 nt, Human
ccucaacccccacggccccucu

SEQ ID NO: 95063 - RNA, 23 nt, Human
ccucaacccccacggccccucua

SEQ ID NO: 95064 - RNA, 20 nt, Human
ccugccucaacccccacggc

SEQ ID NO: 95065 - RNA, 21 nt, Human
ccuuaacuggaaagggaugaa

SEQ ID NO: 95066 - RNA, 20 nt, Human
gaaggagagggcagggccuc

SEQ ID NO: 95067 - RNA, 19 nt, Human
ggagcaucccagagucagu

SEQ ID NO: 95068 - RNA, 25 nt, Human
guuuguguuuucuaugucuggaagg

SEQ ID NO: 95069 - RNA, 23 nt, Human
uaugagauuaggccugaugguau

SEQ ID NO: 95070 - RNA, 20 nt, Human
ucaacccccacggccccucu

SEQ ID NO: 95071 - RNA, 24 nt, Human
ucagucccauaucagaggcaugcc

SEQ ID NO: 95072 - RNA, 19 nt, Human
ucaguccugugccaggcuc

SEQ ID NO: 95073 - RNA, 21 nt, Human
ucaguccugugccaggcucca

SEQ ID NO: 95074 - RNA, 19 nt, Human
ucagugucauguuucuaug

SEQ ID NO: 95075 - RNA, 18 nt, Human
ucauguuucuaugggcca

SEQ ID NO: 95076 - RNA, 22 nt, Human
ucauuugcccugccucaacccc

SEQ ID NO: 95077 - RNA, 21 nt, Human
ucccagagucaguccugugcc

SEQ ID NO: 95078 - RNA, 21 nt, Human
ucuaugggccaggcucagucc

SEQ ID NO: 95079 - RNA, 19 nt, Human
ugagauuaggccugauggu

SEQ ID NO: 95080 - RNA, 19 nt, Human
ugccucaacccccacggcc

SEQ ID NO: 95081 - RNA, 18 nt, Human
ugcuagggacgcuguguc

SEQ ID NO: 95082 - RNA, 20 nt, Human
ugggguuaguccaugcuuug

SEQ ID NO: 95083 - RNA, 18 nt, Human
uucccauguacugcucca

SEQ ID NO: 95084 - RNA, 24 nt, Human
uugggguuaguccaugcuuugggu

SEQ ID NO: 95085 - RNA, 23 nt, Human
uuggguguugguuuccuguguca

SEQ ID NO: 95086 - RNA, 18 nt, Human
uuucccauguacugcucc

SEQ ID NO: 95087 - RNA, 24 nt, Human
uuuggguaaggaaggagagggcag

SEQ ID NO: 95088 - RNA, 20 nt, Human
uuuucaggaggaagccaaac

SEQ ID NO: 95089 - RNA, 23 nt, Human
uuuuuuuuuuucaggaggaagcc

SEQ ID NO: 95090 - RNA, 22 nt, Human
uuuuuuuuuuuuuuuuuucagg

SEQ ID NO: 95091 - RNA, 21 nt, Human
aaaaccugccuggaccccaaa

SEQ ID NO: 95092 - RNA, 20 nt, Human
accugccuggaccccaaagc

SEQ ID NO: 95093 - RNA, 25 nt, Human
caaagcgggccccgcucuucccguc

SEQ ID NO: 95094 - RNA, 23 nt, Human
caagugacgagcagggugcuggu

SEQ ID NO: 95095 - RNA, 21 nt, Human
caccagacaggaggccccaaa

SEQ ID NO: 95096 - RNA, 20 nt, Human
caggaggccccaaaaccugc

SEQ ID NO: 95097 - RNA, 19 nt, Human
cagggugcugcgcugcggc

SEQ ID NO: 95098 - RNA, 24 nt, Human
cccaaaaccugccuggaccccaaa

SEQ ID NO: 95099 - RNA, 24 nt, Human
cccaccagacaggaggccccaaaa

SEQ ID NO: 95100 - RNA, 22 nt, Human
ccccaaaaccugccuggacccc

SEQ ID NO: 95101 - RNA, 27 nt, Human
ccucccaccagacaggaggccccaaaa

SEQ ID NO: 95102 - RNA, 21 nt, Human
ccuggaccccaaagcgggccc

SEQ ID NO: 95103 - RNA, 23 nt, Human
cucuucccgucguuaucuuucua

SEQ ID NO: 95104 - RNA, 18 nt, Human
cugcgcugcggccuccuc

SEQ ID NO: 95105 - RNA, 19 nt, Human
cugcgcugcggccuccucc

SEQ ID NO: 95106 - RNA, 19 nt, Human
cuggaagugcuuccauuca

SEQ ID NO: 95107 - RNA, 19 nt, Human
cuucugauauggaggugaa

SEQ ID NO: 95108 - RNA, 21 nt, Human
gccccaaaaccugccuggacc

SEQ ID NO: 95109 - RNA, 18 nt, Human
ugauauggaggugaaguu

SEQ ID NO: 95110 - RNA, 24 nt, Human
ugccuggaccccaaagcgggcccc

SEQ ID NO: 95111 - RNA, 20 nt, Human
ugcggccuccucccaccaga

SEQ ID NO: 95112 - RNA, 23 nt, Human
uggaagugcuuccauucagaaac

SEQ ID NO: 95113 - RNA, 20 nt, Human
uggaccccaaagcgggcccc

SEQ ID NO: 95114 - RNA, 20 nt, Human
uucccgucguuaucuuucua

SEQ ID NO: 95115 - RNA, 21 nt, Human
aagcagaacaccggaggcccg

SEQ ID NO: 95116 - RNA, 22 nt, Human
aagcagaacaccggaggcccga

SEQ ID NO: 95117 - RNA, 23 nt, Human
acaaccagcagaaaccaacagcc

SEQ ID NO: 95118 - RNA, 18 nt, Human
accaggcagcagcucagc

SEQ ID NO: 95119 - RNA, 18 nt, Human
agauggcacauggugcca

SEQ ID NO: 95120 - RNA, 20 nt, Human
agcacgccgagaagagccag

SEQ ID NO: 95121 - RNA, 19 nt, Human
agcagaacaccggaggccc

SEQ ID NO: 95122 - RNA, 19 nt, Human
aggcccgaccagccaagga

SEQ ID NO: 95123 - RNA, 28 nt, Human
caaggaccuacaaccagcagaaaccaac

SEQ ID NO: 95124 - RNA, 21 nt, Human
cagcacgccgagaagagccag

SEQ ID NO: 95125 - RNA, 20 nt, Human
ccagccaaggaccuacaacc

SEQ ID NO: 95126 - RNA, 19 nt, Human
ccccgcacugcucccuccu

SEQ ID NO: 95127 - RNA, 22 nt, Human
ccgaccagccaaggaccuacaa

SEQ ID NO: 95128 - RNA, 23 nt, Human
cgagaagagccagccuagccuca

SEQ ID NO: 95129 - RNA, 26 nt, Human
cgagaagagccagccuagccucagau

SEQ ID NO: 95130 - RNA, 24 nt, Human
cggggagaagcagaacaccggagg

SEQ ID NO: 95131 - RNA, 19 nt, Human
cugcucccuccuuauuggc

SEQ ID NO: 95132 - RNA, 22 nt, Human
cuucaccaggcagcagcucagc

SEQ ID NO: 95133 - RNA, 22 nt, Human
gaagagccagccuagccucaga

SEQ ID NO: 95134 - RNA, 19 nt, Human
gagaagcagaacaccggag

SEQ ID NO: 95135 - RNA, 25 nt, Human
gaggcccgaccagccaaggaccuac

SEQ ID NO: 95136 - RNA, 23 nt, Human
gcagaacaccggaggcccgacca

SEQ ID NO: 95137 - RNA, 22 nt, Human
uuuuuuuuuuuuuuuuuuacag

SEQ ID NO: 95138 - RNA, 22 nt, Human
aaacuuauggagggaaaaaaac

SEQ ID NO: 95139 - RNA, 22 nt, Human
aaugguuuauuuccaagugguc

SEQ ID NO: 95140 - RNA, 22 nt, Human
acuugauuaauuucccugaaau

SEQ ID NO: 95141 - RNA, 25 nt, Human
aucaacaucauuaccaaaaucuucc

SEQ ID NO: 95142 - RNA, 23 nt, Human
cccagcccguccgguaaccgcgc

SEQ ID NO: 95143 - RNA, 30 nt, Human
gaaaaaaacccucauagauugacuguaaaa

SEQ ID NO: 95144 - RNA, 22 nt, Human
guccccuuagaaccuuuccaaa

SEQ ID NO: 95145 - RNA, 20 nt, Human
guuaaacuuauggagggaaa

SEQ ID NO: 95146 - RNA, 21 nt, Human
uaaaauacacuuuuaaaucaa

SEQ ID NO: 95147 - RNA, 22 nt, Human
uaaacuuauggagggaaaaaaa

SEQ ID NO: 95148 - RNA, 24 nt, Human
uagaaucauauuaaagaaaaacua

SEQ ID NO: 95149 - RNA, 25 nt, Human
ugcaaaaauaaaaucacuuuccaau

SEQ ID NO: 95150 - RNA, 18 nt, Human
uguaagauuugauuccuu

SEQ ID NO: 95151 - RNA, 23 nt, Human
uuaagaaauauuauacuaaucaa

SEQ ID NO: 95152 - RNA, 25 nt, Human
uuugcaaaaauaaaaucacuuucca

SEQ ID NO: 95153 - RNA, 23 nt, Human
aaaaaaaacuacaaaaaaggcau

SEQ ID NO: 95154 - RNA, 18 nt, Human
aaaaaacugauccuccaa

SEQ ID NO: 95155 - RNA, 23 nt, Human
aaaacaaaaaacugauccuccaa

SEQ ID NO: 95156 - RNA, 25 nt, Human
aaaacaauaacaaacagaacacuag

SEQ ID NO: 95157 - RNA, 21 nt, Human
aaacaaaaaacugauccucca

SEQ ID NO: 95158 - RNA, 22 nt, Human
aaacaaguacauggauauuccc

SEQ ID NO: 95159 - RNA, 20 nt, Human
aaaccagcaucucauaaaca

SEQ ID NO: 95160 - RNA, 23 nt, Human
aacagagaaacaaguacauuaau

SEQ ID NO: 95161 - RNA, 24 nt, Human
aaccucugaggucccuacuuucaa

SEQ ID NO: 95162 - RNA, 24 nt, Human
aaccuuuuucuucuugacuggcac

SEQ ID NO: 95163 - RNA, 21 nt, Human
aagaacacaaaccaaguagcu

SEQ ID NO: 95164 - RNA, 19 nt, Human
aagcaaaguacagagaugc

SEQ ID NO: 95165 - RNA, 19 nt, Human
acaaaccaaguagcugugg

SEQ ID NO: 95166 - RNA, 18 nt, Human
acaaagcgucccucaagg

SEQ ID NO: 95167 - RNA, 19 nt, Human
acuauuucgucuucucuuu

SEQ ID NO: 95168 - RNA, 27 nt, Human
acugucaggggagcaccuggggccggc

SEQ ID NO: 95169 - RNA, 23 nt, Human
agaaaaccagcaucucauaaaca

SEQ ID NO: 95170 - RNA, 28 nt, Human
agaagguuugugugugugugugugugug

SEQ ID NO: 95171 - RNA, 22 nt, Human
agagaugccuagaaccccacua

SEQ ID NO: 95172 - RNA, 25 nt, Human
agccaggaugguugagguaagcgug

SEQ ID NO: 95173 - RNA, 18 nt, Human
agcgcaauaagaaaaugg

SEQ ID NO: 95174 - RNA, 22 nt, Human
aggaaaaaacaaccaacaacaa

SEQ ID NO: 95175 - RNA, 18 nt, Human
agggguggggcggggugg

SEQ ID NO: 95176 - RNA, 19 nt, Human
agggguggggcgggguggg

SEQ ID NO: 95177 - RNA, 20 nt, Human
agguaaaccucugagguccc

SEQ ID NO: 95178 - RNA, 26 nt, Human
auaaaaaaaaaaaaaacuacaaaaaa

SEQ ID NO: 95179 - RNA, 23 nt, Human
aucaucccgaaugagaguccuac

SEQ ID NO: 95180 - RNA, 21 nt, Human
aucuguagcacaacccuccuc

SEQ ID NO: 95181 - RNA, 26 nt, Human
augcuuuuuuuuaaacacguaaagga

SEQ ID NO: 95182 - RNA, 20 nt, Human
caaaacaauaacaaacagaa

SEQ ID NO: 95183 - RNA, 23 nt, Human
caaacaaguacauggauauuccc

SEQ ID NO: 95184 - RNA, 21 nt, Human
caaagcaggcagaaccugccc

SEQ ID NO: 95185 - RNA, 23 nt, Human
caaagcgucccucaaggccccuc

SEQ ID NO: 95186 - RNA, 21 nt, Human
caaaggaaaaaacaaccaaca

SEQ ID NO: 95187 - RNA, 21 nt, Human
caaaggacaugcacacggcca

SEQ ID NO: 95188 - RNA, 19 nt, Human
caacagagaaacaaguaca

SEQ ID NO: 95189 - RNA, 19 nt, Human
caaccagaaaugcacagac

SEQ ID NO: 95190 - RNA, 19 nt, Human
caagaauuacauagccaag

SEQ ID NO: 95191 - RNA, 22 nt, Human
caauagcagcaaacaaugugaa

SEQ ID NO: 95192 - RNA, 21 nt, Human
caccccaccuccacugccacc

SEQ ID NO: 95193 - RNA, 18 nt, Human
caccucccuucaacacuu

SEQ ID NO: 95194 - RNA, 18 nt, Human
cacgcagccucccaaaca

SEQ ID NO: 95195 - RNA, 21 nt, Human
cacgcagccucccaaacaccc

SEQ ID NO: 95196 - RNA, 20 nt, Human
cacugccaccacaguggccc

SEQ ID NO: 95197 - RNA, 22 nt, Human
cagcccucuggaggcuccagga

SEQ ID NO: 95198 - RNA, 22 nt, Human
cagccgcccgccgcccagaccc

SEQ ID NO: 95199 - RNA, 23 nt, Human
cagccuccacacucuugccaccu

SEQ ID NO: 95200 - RNA, 18 nt, Human
cagccucccaaacacccc

SEQ ID NO: 95201 - RNA, 23 nt, Human
caggacuugugcccuugccccau

SEQ ID NO: 95202 - RNA, 20 nt, Human
caggcgcagggaagagaaga

SEQ ID NO: 95203 - RNA, 21 nt, Human
ccaaguagcuguggguugaac

SEQ ID NO: 95204 - RNA, 23 nt, Human
ccacacucuugccaccucccuuc

SEQ ID NO: 95205 - RNA, 21 nt, Human
ccaccuccacugccaccacag

SEQ ID NO: 95206 - RNA, 20 nt, Human
ccagccgcccgccgcccaga

SEQ ID NO: 95207 - RNA, 24 nt, Human
cccaaaacuugaacaaauuccaga

SEQ ID NO: 95208 - RNA, 21 nt, Human
cccaaacaccccaccuccacu

SEQ ID NO: 95209 - RNA, 26 nt, Human
cccaaacaccccaccuccacugccac

SEQ ID NO: 95210 - RNA, 19 nt, Human
cccaaacaccccaccuccc

SEQ ID NO: 95211 - RNA, 19 nt, Human
cccagacccucagacuugc

SEQ ID NO: 95212 - RNA, 19 nt, Human
cccagcaucacaggcgcag

SEQ ID NO: 95213 - RNA, 23 nt, Human
ccccgcgcucccucgcgcucuuc

SEQ ID NO: 95214 - RNA, 20 nt, Human
ccccucgggagccuccuccu

SEQ ID NO: 95215 - RNA, 18 nt, Human
cccgaucagaugaagugc

SEQ ID NO: 95216 - RNA, 22 nt, Human
cccucgcgcucuucugccccuc

SEQ ID NO: 95217 - RNA, 19 nt, Human
ccgacccugcuacgcuggc

SEQ ID NO: 95218 - RNA, 22 nt, Human
ccgagcacaggaugacccugcc

SEQ ID NO: 95219 - RNA, 19 nt, Human
ccggcccccgccagccugu

SEQ ID NO: 95220 - RNA, 22 nt, Human
ccucacaccuccucccgccugu

SEQ ID NO: 95221 - RNA, 21 nt, Human
ccuccgagcacaggaugaccc

SEQ ID NO: 95222 - RNA, 22 nt, Human
ccuccuccucacaccuccuccc

SEQ ID NO: 95223 - RNA, 21 nt, Human
ccucucgauacacacaacauc

SEQ ID NO: 95224 - RNA, 21 nt, Human
ccugggcagcuggggagggcu

SEQ ID NO: 95225 - RNA, 20 nt, Human
ccuguccccggugugggcac

SEQ ID NO: 95226 - RNA, 20 nt, Human
ccuugccccaucacgacaga

SEQ ID NO: 95227 - RNA, 22 nt, Human
cgacagacaaagcgucccucaa

SEQ ID NO: 95228 - RNA, 19 nt, Human
cgccaaagcaggcagaacc

SEQ ID NO: 95229 - RNA, 23 nt, Human
cgccagccugugugggaucgcgc

SEQ ID NO: 95230 - RNA, 20 nt, Human
cgcccgccgcccagacccuc

SEQ ID NO: 95231 - RNA, 18 nt, Human
cgcuggguccaccauggc

SEQ ID NO: 95232 - RNA, 18 nt, Human
cggcucucgcuucugcug

SEQ ID NO: 95233 - RNA, 23 nt, Human
cuaaaacccucuucuacuuuaaa

SEQ ID NO: 95234 - RNA, 20 nt, Human
cuacaaaaaaggcaucugua

SEQ ID NO: 95235 - RNA, 21 nt, Human
cuagaaccccacuacagcugu

SEQ ID NO: 95236 - RNA, 23 nt, Human
cuagaaccccacuacagcugugc

SEQ ID NO: 95237 - RNA, 20 nt, Human
cucacaccuccucccgccug

SEQ ID NO: 95238 - RNA, 19 nt, Human
cucauaaacaggucacuac

SEQ ID NO: 95239 - RNA, 26 nt, Human
cucccccaccgcucaggguuaugcaa

SEQ ID NO: 95240 - RNA, 23 nt, Human
cuccucccgccuguccucccuca

SEQ ID NO: 95241 - RNA, 20 nt, Human
cuccuccucacaccuccucc

SEQ ID NO: 95242 - RNA, 20 nt, Human
cucgcugcuacugcgccgac

SEQ ID NO: 95243 - RNA, 20 nt, Human
cucgcuucugcugccccgcg

SEQ ID NO: 95244 - RNA, 21 nt, Human
cugcuacgcuggcuggugccc

SEQ ID NO: 95245 - RNA, 20 nt, Human
cuguagcacaacccuccucc

SEQ ID NO: 95246 - RNA, 21 nt, Human
cuuaaaaaccaccuguucucu

SEQ ID NO: 95247 - RNA, 26 nt, Human
cuugccaccucccuucaacacuuccu

SEQ ID NO: 95248 - RNA, 21 nt, Human
cuuggaaauggaaugguuuua

SEQ ID NO: 95249 - RNA, 22 nt, Human
gaagguuugugugugugugugu

SEQ ID NO: 95250 - RNA, 21 nt, Human
gagcacaggaugacccugcca

SEQ ID NO: 95251 - RNA, 20 nt, Human
gagcaccuggggccggcucc

SEQ ID NO: 95252 - RNA, 19 nt, Human
gaggcuccaggacuuugca

SEQ ID NO: 95253 - RNA, 18 nt, Human
gauuguuuuuuucucacc

SEQ ID NO: 95254 - RNA, 18 nt, Human
gcaaaguacagagaugcc

SEQ ID NO: 95255 - RNA, 21 nt, Human
gcagcuggggagggcuguggg

SEQ ID NO: 95256 - RNA, 22 nt, Human
gcccagacccucagacuugcgc

SEQ ID NO: 95257 - RNA, 19 nt, Human
gcccgacaaaccuccacug

SEQ ID NO: 95258 - RNA, 21 nt, Human
gcgucccucaaggcccccgcg

SEQ ID NO: 95259 - RNA, 22 nt, Human
gcugccccgcgcucccucgcgc

SEQ ID NO: 95260 - RNA, 23 nt, Human
gcugcggccuguccccggugugg

SEQ ID NO: 95261 - RNA, 24 nt, Human
ggagggguggggcggggugggccu

SEQ ID NO: 95262 - RNA, 19 nt, Human
ggaugguuuguuggggugg

SEQ ID NO: 95263 - RNA, 23 nt, Human
ggccacgcuacgcuacuguaacc

SEQ ID NO: 95264 - RNA, 22 nt, Human
ggccccaaccacgugggcccgc

SEQ ID NO: 95265 - RNA, 19 nt, Human
gggacagguggccuuuccc

SEQ ID NO: 95266 - RNA, 21 nt, Human
gggagggcuguggguccuggc

SEQ ID NO: 95267 - RNA, 21 nt, Human
gggccggcccccgccagccug

SEQ ID NO: 95268 - RNA, 20 nt, Human
ggggugggccugugcccgag

SEQ ID NO: 95269 - RNA, 21 nt, Human
ggugcaaccagaaaugcacag

SEQ ID NO: 95270 - RNA, 22 nt, Human
guaaaacaaaaaacugauccuc

SEQ ID NO: 95271 - RNA, 23 nt, Human
guaaaacaaaaaacugauccucc

SEQ ID NO: 95272 - RNA, 21 nt, Human
gucccuacuuucaaacaccag

SEQ ID NO: 95273 - RNA, 23 nt, Human
guguguguguguguguaucugug

SEQ ID NO: 95274 - RNA, 20 nt, Human
uaaaaacuacuaugaugcua

SEQ ID NO: 95275 - RNA, 25 nt, Human
uaaaaauaaacuguauuaaaucugu

SEQ ID NO: 95276 - RNA, 21 nt, Human
uaaaacccucuucuacuuuaa

SEQ ID NO: 95277 - RNA, 21 nt, Human
uaaacauacccaaaacuugaa

SEQ ID NO: 95278 - RNA, 20 nt, Human
uaacaaaacaauaacaaaca

SEQ ID NO: 95279 - RNA, 30 nt, Human
uaacaaaacaauaacaaacagaacacuagg

SEQ ID NO: 95280 - RNA, 23 nt, Human
uaacagauuaaacauacccaaaa

SEQ ID NO: 95281 - RNA, 23 nt, Human
uaaccaagaggugacuucagcca

SEQ ID NO: 95282 - RNA, 21 nt, Human
uacaaugacuuauaaagugac

SEQ ID NO: 95283 - RNA, 22 nt, Human
uacacacaacauccaggacuug

SEQ ID NO: 95284 - RNA, 18 nt, Human
uacagagaugccuagaac

SEQ ID NO: 95285 - RNA, 24 nt, Human
uacaugcauaugagcaagcaaagu

SEQ ID NO: 95286 - RNA, 25 nt, Human
uacggaauauaauaacauacaauga

SEQ ID NO: 95287 - RNA, 22 nt, Human
uacuaugaugcuacgcccccga

SEQ ID NO: 95288 - RNA, 19 nt, Human
uagaaaaccagcaucucau

SEQ ID NO: 95289 - RNA, 22 nt, Human
uagcauuaugguguaauuaaca

SEQ ID NO: 95290 - RNA, 23 nt, Human
uagcuacacgcaaagaauaacac

SEQ ID NO: 95291 - RNA, 24 nt, Human
uagguugaguacccuaauuuuccu

SEQ ID NO: 95292 - RNA, 23 nt, Human
uaguacauaacagauuaaacaua

SEQ ID NO: 95293 - RNA, 24 nt, Human
uaucuguguguuuaaaucaagggg

SEQ ID NO: 95294 - RNA, 27 nt, Human
uauuuuuuuuuucucucucucucuuuu

SEQ ID NO: 95295 - RNA, 18 nt, Human
ucacaggcgcaaaggaca

SEQ ID NO: 95296 - RNA, 19 nt, Human
ucacuggaugguuuguugg

SEQ ID NO: 95297 - RNA, 18 nt, Human
ucagacagacgccgcagc

SEQ ID NO: 95298 - RNA, 24 nt, Human
ucauacuggccuuaugaacauccu

SEQ ID NO: 95299 - RNA, 24 nt, Human
ucaucggaaccgaacuuagguuga

SEQ ID NO: 95300 - RNA, 22 nt, Human
uccacugccaccacaguggccc

SEQ ID NO: 95301 - RNA, 23 nt, Human
uccacugccaccacaguggccca

SEQ ID NO: 95302 - RNA, 20 nt, Human
ucccuacuuucaaacaccag

SEQ ID NO: 95303 - RNA, 22 nt, Human
ucccugcacacacaacaaaaac

SEQ ID NO: 95304 - RNA, 22 nt, Human
uccucccucacacgucagccuc

SEQ ID NO: 95305 - RNA, 18 nt, Human
uccugggcagcuggggag

SEQ ID NO: 95306 - RNA, 23 nt, Human
ucucacgcacgcggccucggggc

SEQ ID NO: 95307 - RNA, 20 nt, Human
ucucccgagacgccuccuuu

SEQ ID NO: 95308 - RNA, 24 nt, Human
ucucuagguaaaccucugaggucc

SEQ ID NO: 95309 - RNA, 22 nt, Human
ucugggaaacgccaaacaggcu

SEQ ID NO: 95310 - RNA, 23 nt, Human
ucuguaauacaauguucuaagag

SEQ ID NO: 95311 - RNA, 25 nt, Human
ucuguagcacaacccuccuccccca

SEQ ID NO: 95312 - RNA, 18 nt, Human
ugaaacaucuaagauaac

SEQ ID NO: 95313 - RNA, 21 nt, Human
ugaaacaucuaagauaacccu

SEQ ID NO: 95314 - RNA, 19 nt, Human
ugaaccuggacgugagcug

SEQ ID NO: 95315 - RNA, 21 nt, Human
ugaagugcccagcaucacagg

SEQ ID NO: 95316 - RNA, 19 nt, Human
ugacuacaugcauaugagc

SEQ ID NO: 95317 - RNA, 22 nt, Human
ugagaaugcaaaccuuuuucuu

SEQ ID NO: 95318 - RNA, 20 nt, Human
ugagcuggcugcagggccgu

SEQ ID NO: 95319 - RNA, 22 nt, Human
ugcacacacaacaaaaacagcg

SEQ ID NO: 95320 - RNA, 21 nt, Human
ugcccgccaaagcaggcagaa

SEQ ID NO: 95321 - RNA, 23 nt, Human
ugcugccccgcgcucccucgcgc

SEQ ID NO: 95322 - RNA, 21 nt, Human
uggaggcuccaggacuuugca

SEQ ID NO: 95323 - RNA, 21 nt, Human
ugggcaccgccccuuccccuc

SEQ ID NO: 95324 - RNA, 18 nt, Human
ugggcagcuggggagggc

SEQ ID NO: 95325 - RNA, 20 nt, Human
ugguggcacguaagacacac

SEQ ID NO: 95326 - RNA, 26 nt, Human
uguagcacaacccuccucccccaccg

SEQ ID NO: 95327 - RNA, 26 nt, Human
ugucacuaaguuuuuuaaaggaaggg

SEQ ID NO: 95328 - RNA, 24 nt, Human
uguccaaucagaugacucugggaa

SEQ ID NO: 95329 - RNA, 20 nt, Human
uguguguguguaucugugug

SEQ ID NO: 95330 - RNA, 21 nt, Human
uguguguguguaucugugugu

SEQ ID NO: 95331 - RNA, 21 nt, Human
uguguguguguguaucugugu

SEQ ID NO: 95332 - RNA, 23 nt, Human
uguguguguguguaucugugugu

SEQ ID NO: 95333 - RNA, 22 nt, Human
uguguguguguguguguaucug

SEQ ID NO: 95334 - RNA, 18 nt, Human
ugugugugugugugugug

SEQ ID NO: 95335 - RNA, 18 nt, Human
ugugugugugugugugug

SEQ ID NO: 95336 - RNA, 18 nt, Human
ugugugugugugugugug

SEQ ID NO: 95337 - RNA, 18 nt, Human
ugugugugugugugugug

SEQ ID NO: 95338 - RNA, 18 nt, Human
ugugugugugugugugug

SEQ ID NO: 95339 - RNA, 21 nt, Human
ugugugugugugugugugugu

SEQ ID NO: 95340 - RNA, 21 nt, Human
ugugugugugugugugugugu

SEQ ID NO: 95341 - RNA, 21 nt, Human
ugugugugugugugugugugu

SEQ ID NO: 95342 - RNA, 21 nt, Human
ugugugugugugugugugugu

SEQ ID NO: 95343 - RNA, 21 nt, Human
ugugugugugugugugugugu

SEQ ID NO: 95344 - RNA, 21 nt, Human
ugugugugugugugugugugu

SEQ ID NO: 95345 - RNA, 21 nt, Human
ugugugugugugugugugugu

SEQ ID NO: 95346 - RNA, 22 nt, Human
ugugugugugugugugugugua

SEQ ID NO: 95347 - RNA, 22 nt, Human
ugugugugugugugugugugug

SEQ ID NO: 95348 - RNA, 22 nt, Human
ugugugugugugugugugugug

SEQ ID NO: 95349 - RNA, 20 nt, Human
uuaaaggaaggggcagggga

SEQ ID NO: 95350 - RNA, 21 nt, Human
uuaacaaaacaauaacaaaca

SEQ ID NO: 95351 - RNA, 19 nt, Human
uuacaacagagaaacaagu

SEQ ID NO: 95352 - RNA, 22 nt, Human
uuacauagccaagaugugcaaa

SEQ ID NO: 95353 - RNA, 20 nt, Human
uucuggagggguggggcggg

SEQ ID NO: 95354 - RNA, 28 nt, Human
uucuggagggguggggcggggugggccu

SEQ ID NO: 95355 - RNA, 26 nt, Human
uugaucacauaaaaaaaaaaaaaacu

SEQ ID NO: 95356 - RNA, 21 nt, Human
uugccucaaaguccugcuugc

SEQ ID NO: 95357 - RNA, 20 nt, Human
uugcugaauuuuucuauguu

SEQ ID NO: 95358 - RNA, 24 nt, Human
uugcugaauuuuucuauguuuuuu

SEQ ID NO: 95359 - RNA, 18 nt, Human
uuggcaccaaaggauucc

SEQ ID NO: 95360 - RNA, 19 nt, Human
uuucauguuugucuuuuug

SEQ ID NO: 95361 - RNA, 24 nt, Human
uuugugugugugugugugugugug

SEQ ID NO: 95362 - RNA, 23 nt, Human
uuuguuggggugguggucacagg

SEQ ID NO: 95363 - RNA, 18 nt, Human
uuuuucuucuugacuggc

SEQ ID NO: 95364 - RNA, 22 nt, Human
aaaaaaaaaaaaaacggaaaag

SEQ ID NO: 95365 - RNA, 25 nt, Human
aaaaaaaaaaaaaacggaaaaggga

SEQ ID NO: 95366 - RNA, 27 nt, Human
aaaaaaaaaaaaccaaacugaacaaaa

SEQ ID NO: 95367 - RNA, 24 nt, Human
aaaaaaaaaaaccaaaaaaccaag

SEQ ID NO: 95368 - RNA, 25 nt, Human
aaaaaaaaaaagaaaaagaaaagaa

SEQ ID NO: 95369 - RNA, 22 nt, Human
aaaaaaaacaaccaugaauaug

SEQ ID NO: 95370 - RNA, 24 nt, Human
aaaaaaaacggaaaagggaacaaa

SEQ ID NO: 95371 - RNA, 20 nt, Human
aaaaaaccaaaaaaccaaaa

SEQ ID NO: 95372 - RNA, 20 nt, Human
aaaaaaccaaacugaacaaa

SEQ ID NO: 95373 - RNA, 20 nt, Human
aaaaaagucuccucuaauuu

SEQ ID NO: 95374 - RNA, 23 nt, Human
aaaaagaaaaagaaaagaaaaaa

SEQ ID NO: 95375 - RNA, 21 nt, Human
aaaaaugagagacccuuagau

SEQ ID NO: 95376 - RNA, 20 nt, Human
aaaacaaacuacggaagggc

SEQ ID NO: 95377 - RNA, 21 nt, Human
aaaacaaacuacggaagggcu

SEQ ID NO: 95378 - RNA, 20 nt, Human
aaaacacaaagaacaaaaac

SEQ ID NO: 95379 - RNA, 21 nt, Human
aaaacacaaagaacaaaaaca

SEQ ID NO: 95380 - RNA, 24 nt, Human
aaaagaaaaaaaaaaacaaccaug

SEQ ID NO: 95381 - RNA, 18 nt, Human
aaaauagcagcacacucu

SEQ ID NO: 95382 - RNA, 20 nt, Human
aaaauuccccugcccucuug

SEQ ID NO: 95383 - RNA, 21 nt, Human
aaacacaaagaacaaaaacaa

SEQ ID NO: 95384 - RNA, 21 nt, Human
aaacagacacccacaccucuu

SEQ ID NO: 95385 - RNA, 23 nt, Human
aaacugaacaaaacaaaauuaaa

SEQ ID NO: 95386 - RNA, 20 nt, Human
aaagaacaaaaacaaccaga

SEQ ID NO: 95387 - RNA, 21 nt, Human
aaauagcccuguucugauuuu

SEQ ID NO: 95388 - RNA, 24 nt, Human
aacacaaagaacaaaaacaaccag

SEQ ID NO: 95389 - RNA, 27 nt, Human
aaccaaaaaaccaaaaaagaaaaaaaa

SEQ ID NO: 95390 - RNA, 18 nt, Human
aacgugaauaaggaugga

SEQ ID NO: 95391 - RNA, 21 nt, Human
aacgugaauaaggauggauga

SEQ ID NO: 95392 - RNA, 18 nt, Human
aacuggucucgcucuccc

SEQ ID NO: 95393 - RNA, 20 nt, Human
aagaaaacaaacuacggaag

SEQ ID NO: 95394 - RNA, 21 nt, Human
aagaagaagcaggaugucaca

SEQ ID NO: 95395 - RNA, 24 nt, Human
aagaagagaaagaacaacaacaac

SEQ ID NO: 95396 - RNA, 18 nt, Human
aagcagccucuucaccuc

SEQ ID NO: 95397 - RNA, 20 nt, Human
aagggugaugaacauaaugg

SEQ ID NO: 95398 - RNA, 18 nt, Human
aagguagaaaaagaccag

SEQ ID NO: 95399 - RNA, 24 nt, Human
aaguggagaggaagaaaaauucaa

SEQ ID NO: 95400 - RNA, 21 nt, Human
aaucacuuaacacugaacaga

SEQ ID NO: 95401 - RNA, 20 nt, Human
aauccagaaucaucaaaagc

SEQ ID NO: 95402 - RNA, 23 nt, Human
acaaagaacaaaaacaaccagaa

SEQ ID NO: 95403 - RNA, 23 nt, Human
acaacaaaaagagcaaguucaaa

SEQ ID NO: 95404 - RNA, 18 nt, Human
acaacaacaacaaaaaga

SEQ ID NO: 95405 - RNA, 23 nt, Human
acacccaucaucacacaaggccc

SEQ ID NO: 95406 - RNA, 22 nt, Human
accaaaaaaccaaaaaagaaaa

SEQ ID NO: 95407 - RNA, 18 nt, Human
accagcaauaacuuuucu

SEQ ID NO: 95408 - RNA, 19 nt, Human
accagggucuaacugggag

SEQ ID NO: 95409 - RNA, 18 nt, Human
acuacaggaagaguggaa

SEQ ID NO: 95410 - RNA, 18 nt, Human
acucauucuauagcuaca

SEQ ID NO: 95411 - RNA, 18 nt, Human
acuccugacuuaguaaca

SEQ ID NO: 95412 - RNA, 19 nt, Human
acucgcaccgguccucccc

SEQ ID NO: 95413 - RNA, 19 nt, Human
acucgcaccgguccucccc

SEQ ID NO: 95414 - RNA, 19 nt, Human
acuuccuaaaaaccuuuuc

SEQ ID NO: 95415 - RNA, 21 nt, Human
agaaaaagaaaagaaaaaaaa

SEQ ID NO: 95416 - RNA, 19 nt, Human
agaaaagacuccauucugg

SEQ ID NO: 95417 - RNA, 19 nt, Human
agaaagaagaagagaccag

SEQ ID NO: 95418 - RNA, 20 nt, Human
agaacaacaacaacaaaaag

SEQ ID NO: 95419 - RNA, 24 nt, Human
agaacuaaaccaauuaaaaauaaa

SEQ ID NO: 95420 - RNA, 30 nt, Human
agaagagaaagaacaacaacaacaaaaagg

SEQ ID NO: 95421 - RNA, 23 nt, Human
agagaagcagccucuucucccgg

SEQ ID NO: 95422 - RNA, 27 nt, Human
agagagaagguggagcagaagggaccc

SEQ ID NO: 95423 - RNA, 24 nt, Human
agagucaucugauccugccuuaug

SEQ ID NO: 95424 - RNA, 23 nt, Human
agcccagccaaguuuaaaagcag

SEQ ID NO: 95425 - RNA, 18 nt, Human
aggaacaccagaacugug

SEQ ID NO: 95426 - RNA, 24 nt, Human
agggagggggcaaaagagaagagg

SEQ ID NO: 95427 - RNA, 25 nt, Human
agggagggggcaaaagagaagaggg

SEQ ID NO: 95428 - RNA, 27 nt, Human
aggugggggcagaauuuuugggagguc

SEQ ID NO: 95429 - RNA, 21 nt, Human
aguauucagcaugacuugcau

SEQ ID NO: 95430 - RNA, 23 nt, Human
aguggaaaguuacagacuguaaa

SEQ ID NO: 95431 - RNA, 21 nt, Human
auaaaauaauucuucaaauag

SEQ ID NO: 95432 - RNA, 22 nt, Human
aucagaggaaaaaaaaaaaacc

SEQ ID NO: 95433 - RNA, 22 nt, Human
caaaaagagcaaguucaaaucc

SEQ ID NO: 95434 - RNA, 21 nt, Human
caaaaaggucccugggaguga

SEQ ID NO: 95435 - RNA, 20 nt, Human
caaaaugccacacccugaug

SEQ ID NO: 95436 - RNA, 19 nt, Human
caaacagacacccacaccu

SEQ ID NO: 95437 - RNA, 25 nt, Human
caaagaacaaaaacaaccagaaaga

SEQ ID NO: 95438 - RNA, 24 nt, Human
caaagaacgccagauaccagaagc

SEQ ID NO: 95439 - RNA, 18 nt, Human
caaagagacuaagagcua

SEQ ID NO: 95440 - RNA, 18 nt, Human
caaauaggcaccaaaugc

SEQ ID NO: 95441 - RNA, 21 nt, Human
caacaacaacaaaaagagcaa

SEQ ID NO: 95442 - RNA, 30 nt, Human
caacaacaauaaaaaaaaaaaaaacggaag

SEQ ID NO: 95443 - RNA, 22 nt, Human
caaccagaaagaagaagagacc

SEQ ID NO: 95444 - RNA, 19 nt, Human
caaguuuaaaagcagacac

SEQ ID NO: 95445 - RNA, 19 nt, Human
caauugugcaaaaaaaaaa

SEQ ID NO: 95446 - RNA, 22 nt, Human
cacaaagaacaaaaacaaccag

SEQ ID NO: 95447 - RNA, 24 nt, Human
cacacccaucaucacacaaggccc

SEQ ID NO: 95448 - RNA, 23 nt, Human
cacaccucuuauagaguacacug

SEQ ID NO: 95449 - RNA, 20 nt, Human
cacauagaccaaggaugacc

SEQ ID NO: 95450 - RNA, 22 nt, Human
caccaaaaauuaguuuuuuucu

SEQ ID NO: 95451 - RNA, 19 nt, Human
caccagaacuguguaccaa

SEQ ID NO: 95452 - RNA, 24 nt, Human
caccaugaaaugaauuugcaccuc

SEQ ID NO: 95453 - RNA, 21 nt, Human
cacccuaaaacacaaagaaca

SEQ ID NO: 95454 - RNA, 26 nt, Human
cacccuaaaacacaaagaacaaaaac

SEQ ID NO: 95455 - RNA, 28 nt, Human
cacccuaaaacacaaagaacaaaaacaa

SEQ ID NO: 95456 - RNA, 22 nt, Human
cacuucccucuccaaaacuuca

SEQ ID NO: 95457 - RNA, 21 nt, Human
cagaaaagacuccauucugga

SEQ ID NO: 95458 - RNA, 20 nt, Human
cagaacagagccuccaguac

SEQ ID NO: 95459 - RNA, 18 nt, Human
cagaaucaucaaaagcca

SEQ ID NO: 95460 - RNA, 20 nt, Human
cagagcucccagggcacagu

SEQ ID NO: 95461 - RNA, 24 nt, Human
cagccaucuaucuuugcaccagca

SEQ ID NO: 95462 - RNA, 23 nt, Human
cagcccugcucacacugcuucug

SEQ ID NO: 95463 - RNA, 23 nt, Human
cagcgcaaaaaaaaaaaaaaacc

SEQ ID NO: 95464 - RNA, 23 nt, Human
caggagccaaucaccugugucca

SEQ ID NO: 95465 - RNA, 22 nt, Human
caggaugucacagaacaugaaa

SEQ ID NO: 95466 - RNA, 22 nt, Human
cauccugaccaaacagacaccc

SEQ ID NO: 95467 - RNA, 25 nt, Human
cauucaaaaccauuuucaaauccau

SEQ ID NO: 95468 - RNA, 23 nt, Human
ccaaagaacgccagauaccagaa

SEQ ID NO: 95469 - RNA, 21 nt, Human
ccaaucaccuguguccaacug

SEQ ID NO: 95470 - RNA, 18 nt, Human
ccacacccaucaucacac

SEQ ID NO: 95471 - RNA, 18 nt, Human
ccauacuuaucugaccua

SEQ ID NO: 95472 - RNA, 22 nt, Human
ccaucaucacacaaggccccaa

SEQ ID NO: 95473 - RNA, 21 nt, Human
ccauuuucaaauccaucuuua

SEQ ID NO: 95474 - RNA, 18 nt, Human
cccacacccaucaucaca

SEQ ID NO: 95475 - RNA, 27 nt, Human
cccacacccaucaucacacaaggcccc

SEQ ID NO: 95476 - RNA, 22 nt, Human
cccauagcuacauuuccccauu

SEQ ID NO: 95477 - RNA, 19 nt, Human
ccccaucaugucccuccuu

SEQ ID NO: 95478 - RNA, 18 nt, Human
cccccacugauggagaaa

SEQ ID NO: 95479 - RNA, 24 nt, Human
ccccggccuggaaaaggguuuuuc

SEQ ID NO: 95480 - RNA, 19 nt, Human
ccccucucccuccugcuuu

SEQ ID NO: 95481 - RNA, 20 nt, Human
ccccucucccuccugcuuuc

SEQ ID NO: 95482 - RNA, 21 nt, Human
ccccuuccuaccuccaauucc

SEQ ID NO: 95483 - RNA, 21 nt, Human
cccggcggccccucucccucc

SEQ ID NO: 95484 - RNA, 23 nt, Human
cccuuggucuccaucugccuccg

SEQ ID NO: 95485 - RNA, 28 nt, Human
ccggcggccccucucccuccugcuuucc

SEQ ID NO: 95486 - RNA, 25 nt, Human
ccucacucgcaccgguccuccccuu

SEQ ID NO: 95487 - RNA, 22 nt, Human
ccucucccuccugcuuuccccg

SEQ ID NO: 95488 - RNA, 22 nt, Human
ccugaccuccuuccuuuggcua

SEQ ID NO: 95489 - RNA, 25 nt, Human
ccuuggggcccaggagagugugcug

SEQ ID NO: 95490 - RNA, 19 nt, Human
ccuuuggcuaaauaggggg

SEQ ID NO: 95491 - RNA, 22 nt, Human
cgcaaaaaaaaaaaaaaaccaa

SEQ ID NO: 95492 - RNA, 24 nt, Human
cgcaaaaaaaaaaaaaaaccaaac

SEQ ID NO: 95493 - RNA, 21 nt, Human
cgcaccgguccuccccuuaaa

SEQ ID NO: 95494 - RNA, 18 nt, Human
cggcagccccacacccau

SEQ ID NO: 95495 - RNA, 21 nt, Human
cggcccccacugauggagaaa

SEQ ID NO: 95496 - RNA, 22 nt, Human
cgggacuacaggaagaguggaa

SEQ ID NO: 95497 - RNA, 25 nt, Human
cuaaaacacaaagaacaaaaacaac

SEQ ID NO: 95498 - RNA, 22 nt, Human
cuaccagaagaaaacaaacuac

SEQ ID NO: 95499 - RNA, 22 nt, Human
cuauucucaagguuggacuguc

SEQ ID NO: 95500 - RNA, 19 nt, Human
cucaagggucagucaccau

SEQ ID NO: 95501 - RNA, 23 nt, Human
cuccccuuccuaccuccaauucc

SEQ ID NO: 95502 - RNA, 20 nt, Human
cuccucuggaacaaaacucc

SEQ ID NO: 95503 - RNA, 22 nt, Human
cucggcccccacugauggagaa

SEQ ID NO: 95504 - RNA, 23 nt, Human
cugcagagaugauccuaaacaca

SEQ ID NO: 95505 - RNA, 24 nt, Human
cugccuugaaggggagggaggauc

SEQ ID NO: 95506 - RNA, 19 nt, Human
cuucucccagcccuguccc

SEQ ID NO: 95507 - RNA, 18 nt, Human
cuuggcuguuauggaccc

SEQ ID NO: 95508 - RNA, 25 nt, Human
cuuuuacauaaucaaacaauaacug

SEQ ID NO: 95509 - RNA, 18 nt, Human
gaaaaaaaaaaacaaccc

SEQ ID NO: 95510 - RNA, 21 nt, Human
gaacaacaacaacaaaaagag

SEQ ID NO: 95511 - RNA, 19 nt, Human
gaagaaaugccaaggccac

SEQ ID NO: 95512 - RNA, 18 nt, Human
gaaggggagggaggaucc

SEQ ID NO: 95513 - RNA, 22 nt, Human
gaagguggagcagaagggaggc

SEQ ID NO: 95514 - RNA, 22 nt, Human
gaaugggcucccaagcagaaac

SEQ ID NO: 95515 - RNA, 25 nt, Human
gacugggggcaggaagggagggggc

SEQ ID NO: 95516 - RNA, 18 nt, Human
gagaagaggggaggagua

SEQ ID NO: 95517 - RNA, 21 nt, Human
gagcucgccucucagcacgca

SEQ ID NO: 95518 - RNA, 22 nt, Human
gaggaucccuugguucaauguc

SEQ ID NO: 95519 - RNA, 18 nt, Human
gagggcagagagagaagg

SEQ ID NO: 95520 - RNA, 19 nt, Human
gaguccugguaggaacacc

SEQ ID NO: 95521 - RNA, 20 nt, Human
gaucuccaaacagccuggug

SEQ ID NO: 95522 - RNA, 18 nt, Human
gcaaaaaaaaaaaaaaaa

SEQ ID NO: 95523 - RNA, 23 nt, Human
gcaauaaaauuaacaacaacaau

SEQ ID NO: 95524 - RNA, 22 nt, Human
gccaauacaacauuuuugccau

SEQ ID NO: 95525 - RNA, 21 nt, Human
gccagcccggcggccccucuc

SEQ ID NO: 95526 - RNA, 23 nt, Human
gcgcaguuugagacagaggaggg

SEQ ID NO: 95527 - RNA, 28 nt, Human
ggagcagaagggaggcgaggauugggug

SEQ ID NO: 95528 - RNA, 21 nt, Human
ggagccaaucaccugugucca

SEQ ID NO: 95529 - RNA, 19 nt, Human
ggagugagaccgcccugcc

SEQ ID NO: 95530 - RNA, 24 nt, Human
ggcagaaaagccuaacaacccccg

SEQ ID NO: 95531 - RNA, 21 nt, Human
ggcagagagagaagguggagc

SEQ ID NO: 95532 - RNA, 21 nt, Human
ggcaggcugggggaacaacuc

SEQ ID NO: 95533 - RNA, 25 nt, Human
ggccccucucccuccugcuuucccc

SEQ ID NO: 95534 - RNA, 18 nt, Human
gggcaaaagagaagaggg

SEQ ID NO: 95535 - RNA, 25 nt, Human
gggcgagcagagccucggggcugau

SEQ ID NO: 95536 - RNA, 19 nt, Human
ggggagaggugagggcaga

SEQ ID NO: 95537 - RNA, 20 nt, Human
gggggagaggugagggcaga

SEQ ID NO: 95538 - RNA, 23 nt, Human
gggucuaacugggagcccgaugg

SEQ ID NO: 95539 - RNA, 20 nt, Human
gguguccaugccaggggagg

SEQ ID NO: 95540 - RNA, 24 nt, Human
guagagauccaacuacacuccuga

SEQ ID NO: 95541 - RNA, 21 nt, Human
guaggcugcaggcgaagggau

SEQ ID NO: 95542 - RNA, 23 nt, Human
uaaaaaaaugagagacccuuaga

SEQ ID NO: 95543 - RNA, 21 nt, Human
uaaaacacaaagaacaaaaac

SEQ ID NO: 95544 - RNA, 21 nt, Human
uaaaacacaaagaacaaaaac

SEQ ID NO: 95545 - RNA, 24 nt, Human
uaaaagcagacacacacgaaugua

SEQ ID NO: 95546 - RNA, 23 nt, Human
uaaacuagucagaaaacagguua

SEQ ID NO: 95547 - RNA, 21 nt, Human
uaaauaggggguuuucggggg

SEQ ID NO: 95548 - RNA, 20 nt, Human
uaacaacccccgacuuuccc

SEQ ID NO: 95549 - RNA, 25 nt, Human
uaacacugaacagauaagaccucuu

SEQ ID NO: 95550 - RNA, 24 nt, Human
uaacaugaaaaaaaaaagucuccu

SEQ ID NO: 95551 - RNA, 19 nt, Human
uaaggagagggcaaaaucc

SEQ ID NO: 95552 - RNA, 23 nt, Human
uaaggcacuuuauuuccccaaag

SEQ ID NO: 95553 - RNA, 18 nt, Human
uaggaaaccugcagagau

SEQ ID NO: 95554 - RNA, 19 nt, Human
uaggauuuggccaaaagag

SEQ ID NO: 95555 - RNA, 21 nt, Human
uagggucaugcuaacucacaa

SEQ ID NO: 95556 - RNA, 22 nt, Human
uaguaucguugugccugaaaug

SEQ ID NO: 95557 - RNA, 20 nt, Human
uauaacugagagagaggaga

SEQ ID NO: 95558 - RNA, 22 nt, Human
uauccugccaauucagugugau

SEQ ID NO: 95559 - RNA, 19 nt, Human
uaucguugugccugaaaug

SEQ ID NO: 95560 - RNA, 23 nt, Human
uaugcuuagcauauauuuuuggc

SEQ ID NO: 95561 - RNA, 19 nt, Human
ucaccucccuucaacuauc

SEQ ID NO: 95562 - RNA, 26 nt, Human
ucagcaggaaggggugucucuugagu

SEQ ID NO: 95563 - RNA, 19 nt, Human
ucagcauuaauuucccuuu

SEQ ID NO: 95564 - RNA, 24 nt, Human
ucaggguugucuucuccucuggcu

SEQ ID NO: 95565 - RNA, 23 nt, Human
ucagucccagagcucccagggca

SEQ ID NO: 95566 - RNA, 23 nt, Human
ucauuaccugucaauuacaauug

SEQ ID NO: 95567 - RNA, 23 nt, Human
ucccacuuuccccauuccguggg

SEQ ID NO: 95568 - RNA, 23 nt, Human
ucccauacuuaucugaccuauuu

SEQ ID NO: 95569 - RNA, 24 nt, Human
uccccugaccuccuuccuuuggcu

SEQ ID NO: 95570 - RNA, 19 nt, Human
uccccuguggcccauggag

SEQ ID NO: 95571 - RNA, 20 nt, Human
ucccugggagugagaccgcc

SEQ ID NO: 95572 - RNA, 22 nt, Human
ucuaaacacacuucccaagaga

SEQ ID NO: 95573 - RNA, 18 nt, Human
ucuccaaaacuucaaaau

SEQ ID NO: 95574 - RNA, 22 nt, Human
ucuccaaaacuucaaaauucac

SEQ ID NO: 95575 - RNA, 27 nt, Human
ucuggcuuugucacuuaaaggucggac

SEQ ID NO: 95576 - RNA, 20 nt, Human
ugaacuagaaaaucaauuau

SEQ ID NO: 95577 - RNA, 23 nt, Human
ugaaucuucuuacccuauuuugc

SEQ ID NO: 95578 - RNA, 21 nt, Human
ugacauaaggugcaagucuau

SEQ ID NO: 95579 - RNA, 18 nt, Human
ugaccuccuuccuuuggc

SEQ ID NO: 95580 - RNA, 18 nt, Human
ugacuauaucaugucacc

SEQ ID NO: 95581 - RNA, 21 nt, Human
ugacuuaguaacagguggcug

SEQ ID NO: 95582 - RNA, 22 nt, Human
ugagacagaggagggagaagga

SEQ ID NO: 95583 - RNA, 20 nt, Human
ugagagaauaacauggacuu

SEQ ID NO: 95584 - RNA, 22 nt, Human
ugaggauaccagggucuaacug

SEQ ID NO: 95585 - RNA, 21 nt, Human
ugagggcagagagagaaggug

SEQ ID NO: 95586 - RNA, 21 nt, Human
ugagggcagagagagaaggug

SEQ ID NO: 95587 - RNA, 18 nt, Human
ugagguaaagaauacucc

SEQ ID NO: 95588 - RNA, 21 nt, Human
ugaugcugucaggguugucuu

SEQ ID NO: 95589 - RNA, 18 nt, Human
ugcaaaaaaaaaaaaaaa

SEQ ID NO: 95590 - RNA, 23 nt, Human
ugcagaugaagccccgcuuuuga

SEQ ID NO: 95591 - RNA, 21 nt, Human
ugccacacccugauguucagc

SEQ ID NO: 95592 - RNA, 25 nt, Human
ugccuuauguucuuaaccuuucagu

SEQ ID NO: 95593 - RNA, 24 nt, Human
ugcuccaaccucuuugcuaacuga

SEQ ID NO: 95594 - RNA, 22 nt, Human
ugcuguacuucaaauaggcacc

SEQ ID NO: 95595 - RNA, 19 nt, Human
ugcugugcucuccaguggg

SEQ ID NO: 95596 - RNA, 24 nt, Human
uggaacaaaacuccuaccaaagag

SEQ ID NO: 95597 - RNA, 23 nt, Human
uggaagaagaagcaggaugucac

SEQ ID NO: 95598 - RNA, 18 nt, Human
uggagcagaagggaggcg

SEQ ID NO: 95599 - RNA, 22 nt, Human
uggcaggcugggggaacaacuc

SEQ ID NO: 95600 - RNA, 21 nt, Human
uggccaaaagaggggaaggau

SEQ ID NO: 95601 - RNA, 19 nt, Human
uggcccgaugauuugcugg

SEQ ID NO: 95602 - RNA, 20 nt, Human
uggcccgaugauuugcuggg

SEQ ID NO: 95603 - RNA, 22 nt, Human
uggcccgaugauuugcugggga

SEQ ID NO: 95604 - RNA, 24 nt, Human
ugggaaagagaaaagcuagaagga

SEQ ID NO: 95605 - RNA, 21 nt, Human
ugggggcaggaagggaggggg

SEQ ID NO: 95606 - RNA, 22 nt, Human
uggugucugcaaugaacugcau

SEQ ID NO: 95607 - RNA, 22 nt, Human
ugugagguauuaugaaaacaaa

SEQ ID NO: 95608 - RNA, 20 nt, Human
ugugcaaaaaaaaaaaaaaa

SEQ ID NO: 95609 - RNA, 22 nt, Human
ugugcucuccagugggguccug

SEQ ID NO: 95610 - RNA, 19 nt, Human
uguuuagaauccagaauca

SEQ ID NO: 95611 - RNA, 26 nt, Human
uuauaaaauagcagcacacucuguga

SEQ ID NO: 95612 - RNA, 21 nt, Human
uucaaaauaaggccuccugga

SEQ ID NO: 95613 - RNA, 22 nt, Human
uucaacccucauacuaugaaac

SEQ ID NO: 95614 - RNA, 26 nt, Human
uucacccuaaaacacaaagaacaaaa

SEQ ID NO: 95615 - RNA, 19 nt, Human
uucaccucccuucaacuau

SEQ ID NO: 95616 - RNA, 21 nt, Human
uuccuaccuccaauucccaca

SEQ ID NO: 95617 - RNA, 22 nt, Human
uugcaauaaaauuaacaacaac

SEQ ID NO: 95618 - RNA, 23 nt, Human
uugcauaaaccaucccaucuauc

SEQ ID NO: 95619 - RNA, 18 nt, Human
uuggcuguuauggacccg

SEQ ID NO: 95620 - RNA, 22 nt, Human
uuggcuguuauggacccgcaug

SEQ ID NO: 95621 - RNA, 21 nt, Human
uuguguuuaagcaggagcagg

SEQ ID NO: 95622 - RNA, 20 nt, Human
uuuccugacaccugguaccu

SEQ ID NO: 95623 - RNA, 26 nt, Human
uuugcugcuucuguuuaagcucaagg

SEQ ID NO: 95624 - RNA, 19 nt, Human
aaacaugagagcccccagg

SEQ ID NO: 95625 - RNA, 30 nt, Human
aagccaguuuuauuucacaaucaucuuuaa

SEQ ID NO: 95626 - RNA, 19 nt, Human
accagccuaaaccuugcag

SEQ ID NO: 95627 - RNA, 23 nt, Human
accgaaaugcagacauggcuggu

SEQ ID NO: 95628 - RNA, 20 nt, Human
agaaagcaaagcaaagagga

SEQ ID NO: 95629 - RNA, 22 nt, Human
agaaagcaaagcaaagaggaau

SEQ ID NO: 95630 - RNA, 18 nt, Human
agcaaagcaaagaggaau

SEQ ID NO: 95631 - RNA, 22 nt, Human
agcagcuccuuggccacaaaga

SEQ ID NO: 95632 - RNA, 18 nt, Human
aggaaaacagcaaccacc

SEQ ID NO: 95633 - RNA, 22 nt, Human
aggagaagcugagcagaaagca

SEQ ID NO: 95634 - RNA, 18 nt, Human
aggcagggaggugggugg

SEQ ID NO: 95635 - RNA, 18 nt, Human
aggcagggcgggagugcg

SEQ ID NO: 95636 - RNA, 18 nt, Human
agggacaaugggagagga

SEQ ID NO: 95637 - RNA, 18 nt, Human
agggaggaaaacagcaac

SEQ ID NO: 95638 - RNA, 18 nt, Human
caaggcaggcgacgggcc

SEQ ID NO: 95639 - RNA, 18 nt, Human
caauccaaaugcaauaac

SEQ ID NO: 95640 - RNA, 24 nt, Human
cacaaucaucuuuauuacaguagg

SEQ ID NO: 95641 - RNA, 19 nt, Human
cacaggagaagcugagcag

SEQ ID NO: 95642 - RNA, 22 nt, Human
cacccccagcuagaguugggaa

SEQ ID NO: 95643 - RNA, 24 nt, Human
cacugcgcggcggauccccagcug

SEQ ID NO: 95644 - RNA, 21 nt, Human
cagaaagcaaagcaaagagga

SEQ ID NO: 95645 - RNA, 20 nt, Human
cagcccgcccgccgcccgcg

SEQ ID NO: 95646 - RNA, 20 nt, Human
cagcggccccuccucugcuu

SEQ ID NO: 95647 - RNA, 23 nt, Human
caucuuuauuacaguaggaugau

SEQ ID NO: 95648 - RNA, 23 nt, Human
ccaauccaaaugcaauaacccua

SEQ ID NO: 95649 - RNA, 21 nt, Human
ccaccagccuaaaccuugcag

SEQ ID NO: 95650 - RNA, 22 nt, Human
ccagccuaaaccuugcagccuu

SEQ ID NO: 95651 - RNA, 19 nt, Human
ccccagggguggggggggg

SEQ ID NO: 95652 - RNA, 18 nt, Human
cccugcugcauuuucccu

SEQ ID NO: 95653 - RNA, 19 nt, Human
cccugcuggaggauggggc

SEQ ID NO: 95654 - RNA, 21 nt, Human
ccgcgcgcgcgcgccgcuucc

SEQ ID NO: 95655 - RNA, 22 nt, Human
ccuccagggcaucccugcugca

SEQ ID NO: 95656 - RNA, 23 nt, Human
ccucccucucuagacaggggcug

SEQ ID NO: 95657 - RNA, 21 nt, Human
ccucucuagacaggggcucag

SEQ ID NO: 95658 - RNA, 19 nt, Human
ccuucagcagcaaagcugu

SEQ ID NO: 95659 - RNA, 23 nt, Human
cgagucccaaggcaggcgacggg

SEQ ID NO: 95660 - RNA, 23 nt, Human
cgcccgccgcccgcgcgcgcgcg

SEQ ID NO: 95661 - RNA, 18 nt, Human
cuagacaggggcucagcc

SEQ ID NO: 95662 - RNA, 22 nt, Human
cugcggggauggguaggaccag

SEQ ID NO: 95663 - RNA, 20 nt, Human
cugcuggucagaugcaggga

SEQ ID NO: 95664 - RNA, 18 nt, Human
gacaaugggagaggaggg

SEQ ID NO: 95665 - RNA, 20 nt, Human
gacauggcuggccgggcccc

SEQ ID NO: 95666 - RNA, 23 nt, Human
gagcauuuuggcaguugaaaaca

SEQ ID NO: 95667 - RNA, 24 nt, Human
gagcccccaggggugggggggggc

SEQ ID NO: 95668 - RNA, 18 nt, Human
gauguggugugguuccug

SEQ ID NO: 95669 - RNA, 19 nt, Human
gcacuagagcauuuuggca

SEQ ID NO: 95670 - RNA, 18 nt, Human
gcccgcgcgcgcgcgccg

SEQ ID NO: 95671 - RNA, 24 nt, Human
gcgggcucgcgagucccaaggcag

SEQ ID NO: 95672 - RNA, 24 nt, Human
ggauccccagcccgcccgccgccc

SEQ ID NO: 95673 - RNA, 22 nt, Human
ggccggagagcgcggggcgcgg

SEQ ID NO: 95674 - RNA, 24 nt, Human
ggcgcugcuggucagaugcaggga

SEQ ID NO: 95675 - RNA, 26 nt, Human
gggacaaugggagaggagggcaugac

SEQ ID NO: 95676 - RNA, 24 nt, Human
gggcagcgaacaggcagggcggga

SEQ ID NO: 95677 - RNA, 20 nt, Human
gggcucagccaccuccaggg

SEQ ID NO: 95678 - RNA, 19 nt, Human
ggguggcagcggccccucc

SEQ ID NO: 95679 - RNA, 20 nt, Human
uagagcauuuuggcaguuga

SEQ ID NO: 95680 - RNA, 23 nt, Human
uaggaugaugguccugggccacc

SEQ ID NO: 95681 - RNA, 18 nt, Human
uaggccccucccucuagg

SEQ ID NO: 95682 - RNA, 18 nt, Human
uccaagaagccaaagcca

SEQ ID NO: 95683 - RNA, 20 nt, Human
uccaagaagccaaagccagu

SEQ ID NO: 95684 - RNA, 21 nt, Human
uccccagcccgcccgccgccc

SEQ ID NO: 95685 - RNA, 24 nt, Human
uccugggccaccagccuaaaccuu

SEQ ID NO: 95686 - RNA, 19 nt, Human
ucucuggcugaggccuagg

SEQ ID NO: 95687 - RNA, 23 nt, Human
ucucuggcugaggccuaggcccc

SEQ ID NO: 95688 - RNA, 19 nt, Human
ugagagcccccaggggugg

SEQ ID NO: 95689 - RNA, 23 nt, Human
ugagagcccccaggggugggggg

SEQ ID NO: 95690 - RNA, 22 nt, Human
ugagcagaaagcaaagcaaaga

SEQ ID NO: 95691 - RNA, 24 nt, Human
ugcaauaacccuagaagggacaac

SEQ ID NO: 95692 - RNA, 18 nt, Human
ugcuggucagaugcaggg

SEQ ID NO: 95693 - RNA, 18 nt, Human
uggcagcggccccuccuc

SEQ ID NO: 95694 - RNA, 23 nt, Human
ugggauggccaggcccccauuau

SEQ ID NO: 95695 - RNA, 20 nt, Human
ugguccugggccaccagccu

SEQ ID NO: 95696 - RNA, 24 nt, Human
uucaggcuuagauguggugugguu

SEQ ID NO: 95697 - RNA, 20 nt, Human
uuuggcaguugaaaacauga

SEQ ID NO: 95698 - RNA, 24 nt, Human
uuuuuuuuuuuuuuuuuuuccaag

SEQ ID NO: 95699 - RNA, 21 nt, Human
aaaagcagguaucagagccug

SEQ ID NO: 95700 - RNA, 24 nt, Human
aaaagcagguaucagagccugacc

SEQ ID NO: 95701 - RNA, 19 nt, Human
aagaggaggcaggugccaa

SEQ ID NO: 95702 - RNA, 28 nt, Human
aauaguacacugcaauaaaugccuugau

SEQ ID NO: 95703 - RNA, 22 nt, Human
accaucaacaucuuuacaauga

SEQ ID NO: 95704 - RNA, 21 nt, Human
agaguacaaaugagccugaaa

SEQ ID NO: 95705 - RNA, 23 nt, Human
aggcagcuuuccuaggaaucucu

SEQ ID NO: 95706 - RNA, 25 nt, Human
aggcagcuuuccuaggaaucucuuc

SEQ ID NO: 95707 - RNA, 24 nt, Human
aggggaagagaguacaaaugagcc

SEQ ID NO: 95708 - RNA, 18 nt, Human
agguaucagagccugacc

SEQ ID NO: 95709 - RNA, 27 nt, Human
auaguacacugcaauaaaugccuucuc

SEQ ID NO: 95710 - RNA, 18 nt, Human
auucuauuucacccucuc

SEQ ID NO: 95711 - RNA, 22 nt, Human
caagggcucguuuccgucaaca

SEQ ID NO: 95712 - RNA, 22 nt, Human
cagcgggggagagcaguccccu

SEQ ID NO: 95713 - RNA, 21 nt, Human
cagcugccucaucuggggggu

SEQ ID NO: 95714 - RNA, 23 nt, Human
ccagaggcccugcccugccuccu

SEQ ID NO: 95715 - RNA, 21 nt, Human
ccaucaacaucuuuacaauga

SEQ ID NO: 95716 - RNA, 25 nt, Human
ccaucaacaucuuuacaaugaaaac

SEQ ID NO: 95717 - RNA, 21 nt, Human
cgaccgagacuucucaaaaac

SEQ ID NO: 95718 - RNA, 18 nt, Human
cgcugccacugccggagc

SEQ ID NO: 95719 - RNA, 18 nt, Human
cugcgacagccgcuccac

SEQ ID NO: 95720 - RNA, 19 nt, Human
cuguggagacggcagugga

SEQ ID NO: 95721 - RNA, 19 nt, Human
gaagacuucccuuaccgac

SEQ ID NO: 95722 - RNA, 22 nt, Human
gaagaggaggcaggugccaaua

SEQ ID NO: 95723 - RNA, 18 nt, Human
gacgaugagaggggaaga

SEQ ID NO: 95724 - RNA, 24 nt, Human
gccuccgcugccacugccggagcc

SEQ ID NO: 95725 - RNA, 20 nt, Human
gcuccacuuccgggccacag

SEQ ID NO: 95726 - RNA, 18 nt, Human
ggaagacuucccuuaccg

SEQ ID NO: 95727 - RNA, 18 nt, Human
gggguggccgaagaggag

SEQ ID NO: 95728 - RNA, 26 nt, Human
gucacagcugccucaucugggggguu

SEQ ID NO: 95729 - RNA, 19 nt, Human
uaaaugccuugauggcagc

SEQ ID NO: 95730 - RNA, 22 nt, Human
uauauagcacagaaaaauauac

SEQ ID NO: 95731 - RNA, 19 nt, Human
ucagagucguggcuucccu

SEQ ID NO: 95732 - RNA, 21 nt, Human
ucucaaaaacacuucccgaau

SEQ ID NO: 95733 - RNA, 22 nt, Human
ucucagggugauccccugaucc

SEQ ID NO: 95734 - RNA, 19 nt, Human
ucuuugguaauagugucuc

SEQ ID NO: 95735 - RNA, 19 nt, Human
ugacgaugagaggggaaga

SEQ ID NO: 95736 - RNA, 19 nt, Human
ugacgaugagaggggaaga

SEQ ID NO: 95737 - RNA, 20 nt, Human
ugagaccaucaacaucuuua

SEQ ID NO: 95738 - RNA, 24 nt, Human
ugagagaagacuauggucagaguc

SEQ ID NO: 95739 - RNA, 21 nt, Human
ugcaaaaagagaauaaggcag

SEQ ID NO: 95740 - RNA, 18 nt, Human
ugccggagccgcacugcg

SEQ ID NO: 95741 - RNA, 19 nt, Human
uggaagacuucccuuaccg

SEQ ID NO: 95742 - RNA, 19 nt, Human
uggagacggcaguggaagc

SEQ ID NO: 95743 - RNA, 22 nt, Human
uggcagcauggacuuguucaca

SEQ ID NO: 95744 - RNA, 19 nt, Human
uggccgaagaggaggcagg

SEQ ID NO: 95745 - RNA, 21 nt, Human
uggccgaagaggaggcaggug

SEQ ID NO: 95746 - RNA, 19 nt, Human
uuggaagacuucccuuacc

SEQ ID NO: 95747 - RNA, 20 nt, Human
uuuuuaaucacuggcaaguu

SEQ ID NO: 95748 - RNA, 22 nt, Human
aaaaaaaaaaaaaaaaaagcau

SEQ ID NO: 95749 - RNA, 23 nt, Human
aaaaaaaaaaaaaaaagcaucug

SEQ ID NO: 95750 - RNA, 20 nt, Human
aaaaaaaaaaagcaucuggg

SEQ ID NO: 95751 - RNA, 24 nt, Human
aaaaagacagcugccgcggacaug

SEQ ID NO: 95752 - RNA, 18 nt, Human
aaaauuagcugggcgugg

SEQ ID NO: 95753 - RNA, 24 nt, Human
aaacagaaguggauggcagcaggg

SEQ ID NO: 95754 - RNA, 20 nt, Human
aaaccagcagaugugggcag

SEQ ID NO: 95755 - RNA, 19 nt, Human
aaagcccaggggucugccu

SEQ ID NO: 95756 - RNA, 20 nt, Human
aacauggugaaaucccgucu

SEQ ID NO: 95757 - RNA, 21 nt, Human
aacauggugaaaucccgucuc

SEQ ID NO: 95758 - RNA, 23 nt, Human
aagagcauuugggggccaggcgc

SEQ ID NO: 95759 - RNA, 19 nt, Human
aagcagcagcucagugagc

SEQ ID NO: 95760 - RNA, 19 nt, Human
aagcgugaaagcugucagc

SEQ ID NO: 95761 - RNA, 23 nt, Human
aagggacagagaggugcccucca

SEQ ID NO: 95762 - RNA, 20 nt, Human
aaucccgucucuaccgaaaa

SEQ ID NO: 95763 - RNA, 24 nt, Human
acacauagcaccagcacacauaaa

SEQ ID NO: 95764 - RNA, 22 nt, Human
accagcacacauaaaagcagca

SEQ ID NO: 95765 - RNA, 21 nt, Human
accauggaagccccacccaga

SEQ ID NO: 95766 - RNA, 18 nt, Human
acugcacuccagccgggg

SEQ ID NO: 95767 - RNA, 27 nt, Human
acugucuccaaaaaaaaaaaaaaaaaa

SEQ ID NO: 95768 - RNA, 20 nt, Human
agacaagagcaaaacugucu

SEQ ID NO: 95769 - RNA, 20 nt, Human
agacaggaaaagaauggccc

SEQ ID NO: 95770 - RNA, 24 nt, Human
agacaggaaaagaauggcccagaa

SEQ ID NO: 95771 - RNA, 21 nt, Human
agacaggaaaagaauggcccg

SEQ ID NO: 95772 - RNA, 19 nt, Human
agagacagugagacacgga

SEQ ID NO: 95773 - RNA, 23 nt, Human
agagcugcaguugggaucagcca

SEQ ID NO: 95774 - RNA, 24 nt, Human
agcacuuugggagaccgaaguggg

SEQ ID NO: 95775 - RNA, 22 nt, Human
agcaucucccaucccuggguuu

SEQ ID NO: 95776 - RNA, 24 nt, Human
agccuggccaacauggugaaaucc

SEQ ID NO: 95777 - RNA, 19 nt, Human
agcugcaguugggaucagc

SEQ ID NO: 95778 - RNA, 20 nt, Human
agcugggcgugguugggugc

SEQ ID NO: 95779 - RNA, 24 nt, Human
aggcgccguggcucaugccuguaa

SEQ ID NO: 95780 - RNA, 19 nt, Human
aggcggagguuacagugag

SEQ ID NO: 95781 - RNA, 24 nt, Human
aggcggagguuacagugaguugag

SEQ ID NO: 95782 - RNA, 21 nt, Human
aggcugaggcaggaguauccg

SEQ ID NO: 95783 - RNA, 22 nt, Human
aggggcacacagucgacaggac

SEQ ID NO: 95784 - RNA, 19 nt, Human
aggugcccuccacacagug

SEQ ID NO: 95785 - RNA, 23 nt, Human
aucaugccacugcacuccagccg

SEQ ID NO: 95786 - RNA, 19 nt, Human
augccuguaaucccagcac

SEQ ID NO: 95787 - RNA, 24 nt, Human
caacauggugaaaucccgucucua

SEQ ID NO: 95788 - RNA, 22 nt, Human
caagagcaaaacugucuccaaa

SEQ ID NO: 95789 - RNA, 21 nt, Human
cacaacccccugugagguagg

SEQ ID NO: 95790 - RNA, 25 nt, Human
cacaugggcugaagcuuccagagac

SEQ ID NO: 95791 - RNA, 24 nt, Human
caccagcacacauaaaagcagcag

SEQ ID NO: 95792 - RNA, 18 nt, Human
caccccacccaggguggc

SEQ ID NO: 95793 - RNA, 23 nt, Human
caccccgaccacaccccacccag

SEQ ID NO: 95794 - RNA, 24 nt, Human
cacuccagccggggagacaagagc

SEQ ID NO: 95795 - RNA, 18 nt, Human
cacugcacuccagccggg

SEQ ID NO: 95796 - RNA, 19 nt, Human
cacugcacuccagccgggg

SEQ ID NO: 95797 - RNA, 24 nt, Human
cacugcacuccagccggggagaca

SEQ ID NO: 95798 - RNA, 19 nt, Human
cagaaauucagcacaaaga

SEQ ID NO: 95799 - RNA, 22 nt, Human
cagaaggaagugggugccccau

SEQ ID NO: 95800 - RNA, 23 nt, Human
cagagaggugcccuccacacagu

SEQ ID NO: 95801 - RNA, 21 nt, Human
cagaguaaacagaaguggaug

SEQ ID NO: 95802 - RNA, 24 nt, Human
cagcacuuugggagaccgaagugg

SEQ ID NO: 95803 - RNA, 21 nt, Human
cagcaggaaagcccagggguc

SEQ ID NO: 95804 - RNA, 24 nt, Human
cagcuacccaggaggcugaggcag

SEQ ID NO: 95805 - RNA, 22 nt, Human
caggaaaagaauggcccagaaa

SEQ ID NO: 95806 - RNA, 24 nt, Human
caggagcagagucuccguggccag

SEQ ID NO: 95807 - RNA, 24 nt, Human
caggggucugccucccucccacgg

SEQ ID NO: 95808 - RNA, 30 nt, Human
caugaacacacauagcaccagcacacauag

SEQ ID NO: 95809 - RNA, 20 nt, Human
caugccuguaaucccagcac

SEQ ID NO: 95810 - RNA, 25 nt, Human
cauuugggggccaggcgccguggcu

SEQ ID NO: 95811 - RNA, 22 nt, Human
ccacaccccacccaggguggcc

SEQ ID NO: 95812 - RNA, 26 nt, Human
ccacaccccacccaggguggccagag

SEQ ID NO: 95813 - RNA, 25 nt, Human
ccacccagaaggaagugggugcccc

SEQ ID NO: 95814 - RNA, 19 nt, Human
ccacugcacuccagccggg

SEQ ID NO: 95815 - RNA, 24 nt, Human
ccacugcacuccagccggggagac

SEQ ID NO: 95816 - RNA, 19 nt, Human
ccagagacagugagacacg

SEQ ID NO: 95817 - RNA, 21 nt, Human
ccagcagaugugggcaggggc

SEQ ID NO: 95818 - RNA, 18 nt, Human
ccaggcgccguggcucau

SEQ ID NO: 95819 - RNA, 22 nt, Human
ccauggaagccccacccagaag

SEQ ID NO: 95820 - RNA, 19 nt, Human
cccagaaggaagugggugc

SEQ ID NO: 95821 - RNA, 19 nt, Human
cccaugcaggccgaggugg

SEQ ID NO: 95822 - RNA, 18 nt, Human
cccccacagcagagcugc

SEQ ID NO: 95823 - RNA, 20 nt, Human
ccccgacugcucugcucuuc

SEQ ID NO: 95824 - RNA, 22 nt, Human
cccgucucuaccgaaaauacaa

SEQ ID NO: 95825 - RNA, 21 nt, Human
cccuuauaguagcaaaaagac

SEQ ID NO: 95826 - RNA, 22 nt, Human
ccgaccacaccccacccagggu

SEQ ID NO: 95827 - RNA, 18 nt, Human
ccgccggagcccgccuga

SEQ ID NO: 95828 - RNA, 21 nt, Human
ccguggccagcaggaaagccc

SEQ ID NO: 95829 - RNA, 23 nt, Human
ccuaugcuaugcucccacccuuc

SEQ ID NO: 95830 - RNA, 26 nt, Human
ccuccacacaguguggccaacugcuu

SEQ ID NO: 95831 - RNA, 23 nt, Human
ccucucugcucucugcgcaaagg

SEQ ID NO: 95832 - RNA, 23 nt, Human
ccuggccaacauggugaaauccc

SEQ ID NO: 95833 - RNA, 24 nt, Human
ccuggccaacauggugaaaucccg

SEQ ID NO: 95834 - RNA, 20 nt, Human
ccuguaaucccagcacuuug

SEQ ID NO: 95835 - RNA, 24 nt, Human
cgaagugggcggaucacuugaggu

SEQ ID NO: 95836 - RNA, 18 nt, Human
cgacaggacgggucuaca

SEQ ID NO: 95837 - RNA, 18 nt, Human
cgacugcucugcucuucu

SEQ ID NO: 95838 - RNA, 24 nt, Human
cgagacuagccuggccaacauggu

SEQ ID NO: 95839 - RNA, 21 nt, Human
cgccggagcccgccugagagc

SEQ ID NO: 95840 - RNA, 23 nt, Human
cgccuccagcccccucaguacac

SEQ ID NO: 95841 - RNA, 20 nt, Human
cggagacagaaacuuggugg

SEQ ID NO: 95842 - RNA, 24 nt, Human
cggaucacuugaggucaugaguuc

SEQ ID NO: 95843 - RNA, 24 nt, Human
cguggcucaugccuguaaucccag

SEQ ID NO: 95844 - RNA, 21 nt, Human
cucacauuuaauccucacaac

SEQ ID NO: 95845 - RNA, 24 nt, Human
cucaugccuguaaucccagcacuu

SEQ ID NO: 95846 - RNA, 19 nt, Human
cucccacccuucgccucca

SEQ ID NO: 95847 - RNA, 23 nt, Human
cucccacccuucgccuccagccc

SEQ ID NO: 95848 - RNA, 20 nt, Human
cuccccacugaagccccaaa

SEQ ID NO: 95849 - RNA, 19 nt, Human
cucccgcggagacagaaac

SEQ ID NO: 95850 - RNA, 22 nt, Human
cucucugcgcaaaggccuccau

SEQ ID NO: 95851 - RNA, 21 nt, Human
cucugcucuucugccucuugg

SEQ ID NO: 95852 - RNA, 25 nt, Human
cucugguggggcugggaacaccagg

SEQ ID NO: 95853 - RNA, 19 nt, Human
cugaagccccaaaccagca

SEQ ID NO: 95854 - RNA, 26 nt, Human
cugaagccccaaaccagcagaugugg

SEQ ID NO: 95855 - RNA, 22 nt, Human
cugaagcuuccagagacaguga

SEQ ID NO: 95856 - RNA, 23 nt, Human
cugcaguugggaucagccaggac

SEQ ID NO: 95857 - RNA, 23 nt, Human
cuugcacgggacucccgcggaga

SEQ ID NO: 95858 - RNA, 21 nt, Human
cuuugggagaccgaagugggc

SEQ ID NO: 95859 - RNA, 20 nt, Human
gaaggaagugggugccccau

SEQ ID NO: 95860 - RNA, 25 nt, Human
gaagugggcggaucacuugagguca

SEQ ID NO: 95861 - RNA, 22 nt, Human
gacacuucuggccaagugguuc

SEQ ID NO: 95862 - RNA, 23 nt, Human
gagaucaugccacugcacuccag

SEQ ID NO: 95863 - RNA, 19 nt, Human
gagcaaaacugucuccaaa

SEQ ID NO: 95864 - RNA, 28 nt, Human
gagcaaaacugucuccaaaaaaaaaaaa

SEQ ID NO: 95865 - RNA, 20 nt, Human
gagguuacagugaguugaga

SEQ ID NO: 95866 - RNA, 18 nt, Human
gaucacuugaggucauga

SEQ ID NO: 95867 - RNA, 24 nt, Human
gaucacuugaggucaugaguucga

SEQ ID NO: 95868 - RNA, 24 nt, Human
gccaacauggugaaaucccgucuc

SEQ ID NO: 95869 - RNA, 23 nt, Human
gcccccgacugcucugcucuucu

SEQ ID NO: 95870 - RNA, 21 nt, Human
gcucccggcacggggcucugg

SEQ ID NO: 95871 - RNA, 18 nt, Human
gcucugcucuucugccuc

SEQ ID NO: 95872 - RNA, 21 nt, Human
gcucugcucuucugccucuug

SEQ ID NO: 95873 - RNA, 22 nt, Human
ggacaugaacacacauagcacc

SEQ ID NO: 95874 - RNA, 21 nt, Human
ggaggcggagguuacagugag

SEQ ID NO: 95875 - RNA, 18 nt, Human
ggagguuacagugaguug

SEQ ID NO: 95876 - RNA, 21 nt, Human
ggagguuacagugaguugaga

SEQ ID NO: 95877 - RNA, 25 nt, Human
ggagguuacagugaguugagaguug

SEQ ID NO: 95878 - RNA, 23 nt, Human
ggaucacuugaggucaugaguuc

SEQ ID NO: 95879 - RNA, 20 nt, Human
ggcccccgacugcucugcuc

SEQ ID NO: 95880 - RNA, 19 nt, Human
ggcuggaguaagauuuuug

SEQ ID NO: 95881 - RNA, 21 nt, Human
gggcucugguggggcugggaa

SEQ ID NO: 95882 - RNA, 24 nt, Human
gggcucugguggggcugggaacac

SEQ ID NO: 95883 - RNA, 20 nt, Human
ggggcucugguggggcuggg

SEQ ID NO: 95884 - RNA, 22 nt, Human
ggggcucugguggggcugggaa

SEQ ID NO: 95885 - RNA, 19 nt, Human
ggggcugggaacaccagga

SEQ ID NO: 95886 - RNA, 22 nt, Human
gucagcuccccacugaagcccc

SEQ ID NO: 95887 - RNA, 22 nt, Human
guggcucaugccuguaauccca

SEQ ID NO: 95888 - RNA, 19 nt, Human
gugggcggaucacuugagg

SEQ ID NO: 95889 - RNA, 24 nt, Human
gugguugggugcuuguaaucccag

SEQ ID NO: 95890 - RNA, 23 nt, Human
uaccauggaagccccacccagaa

SEQ ID NO: 95891 - RNA, 24 nt, Human
uagccuggccaacauggugaaauc

SEQ ID NO: 95892 - RNA, 18 nt, Human
uagcugggcgugguuggg

SEQ ID NO: 95893 - RNA, 22 nt, Human
uauaguagcaaaaagacagcug

SEQ ID NO: 95894 - RNA, 28 nt, Human
uaugcuaugcucccacccuucgccucca

SEQ ID NO: 95895 - RNA, 21 nt, Human
ucacauggccccaggcaggcu

SEQ ID NO: 95896 - RNA, 24 nt, Human
ucagcacaaagagagguguucaca

SEQ ID NO: 95897 - RNA, 22 nt, Human
ucaugccuguaaucccagcacu

SEQ ID NO: 95898 - RNA, 18 nt, Human
ucccacccuucgccucca

SEQ ID NO: 95899 - RNA, 19 nt, Human
ucccacccuucgccuccag

SEQ ID NO: 95900 - RNA, 19 nt, Human
uccccacugaagccccaaa

SEQ ID NO: 95901 - RNA, 18 nt, Human
uccccaggcgugggcugc

SEQ ID NO: 95902 - RNA, 21 nt, Human
uccccaggcgugggcugcugg

SEQ ID NO: 95903 - RNA, 24 nt, Human
uccccaggcgugggcugcuggcuc

SEQ ID NO: 95904 - RNA, 27 nt, Human
uccccaggcgugggcugcuggcuccca

SEQ ID NO: 95905 - RNA, 22 nt, Human
ucccggcacggggcucuggugg

SEQ ID NO: 95906 - RNA, 22 nt, Human
ucccucccacgggcccccacag

SEQ ID NO: 95907 - RNA, 19 nt, Human
uccguggccagcaggaaag

SEQ ID NO: 95908 - RNA, 20 nt, Human
ucuccaaaaaaaaaaaaaaa

SEQ ID NO: 95909 - RNA, 24 nt, Human
ucuccguggccagcaggaaagccc

SEQ ID NO: 95910 - RNA, 18 nt, Human
ucugggacagagcucuaa

SEQ ID NO: 95911 - RNA, 23 nt, Human
ugacuacccaggucacacgugcc

SEQ ID NO: 95912 - RNA, 25 nt, Human
ugagcaucucccaucccuggguuuc

SEQ ID NO: 95913 - RNA, 19 nt, Human
ugagguagguaucauugcc

SEQ ID NO: 95914 - RNA, 18 nt, Human
ugcagggacgcaggcccc

SEQ ID NO: 95915 - RNA, 18 nt, Human
ugccacuauccuccucac

SEQ ID NO: 95916 - RNA, 23 nt, Human
ugccucccucccacgggccccca

SEQ ID NO: 95917 - RNA, 23 nt, Human
ugccuguaaucccagcacuuugg

SEQ ID NO: 95918 - RNA, 24 nt, Human
ugccuguaaucccagcacuuuggg

SEQ ID NO: 95919 - RNA, 24 nt, Human
ugcuuguaaucccagcuacccagg

SEQ ID NO: 95920 - RNA, 24 nt, Human
uggccaacauggugaaaucccguc

SEQ ID NO: 95921 - RNA, 20 nt, Human
uggcccagaaauucagcaca

SEQ ID NO: 95922 - RNA, 24 nt, Human
uggcucaugccuguaaucccagca

SEQ ID NO: 95923 - RNA, 21 nt, Human
uggcucccaggcucccuuucc

SEQ ID NO: 95924 - RNA, 19 nt, Human
ugggagaccgaagugggcg

SEQ ID NO: 95925 - RNA, 24 nt, Human
ugggagaccgaagugggcggauca

SEQ ID NO: 95926 - RNA, 22 nt, Human
uggucacauggccccaggcagg

SEQ ID NO: 95927 - RNA, 22 nt, Human
ugguugggugcuuguaauccca

SEQ ID NO: 95928 - RNA, 20 nt, Human
uguaaucccagcuacccagg

SEQ ID NO: 95929 - RNA, 20 nt, Human
uuacagugaguugagaguug

SEQ ID NO: 95930 - RNA, 21 nt, Human
uuagcugggcgugguugggug

SEQ ID NO: 95931 - RNA, 22 nt, Human
uuagcugggcgugguugggugc

SEQ ID NO: 95932 - RNA, 19 nt, Human
uuccaaagagagggaucug

SEQ ID NO: 95933 - RNA, 22 nt, Human
uuugcagaguaaacagaagugg

SEQ ID NO: 95934 - RNA, 21 nt, Human
aacaagguuguggagaaaggc

SEQ ID NO: 95935 - RNA, 21 nt, Human
aagaggagagaggcccgggga

SEQ ID NO: 95936 - RNA, 23 nt, Human
aauucaaaucauaaacauaauuc

SEQ ID NO: 95937 - RNA, 23 nt, Human
acugcagcuccucagcgguaacc

SEQ ID NO: 95938 - RNA, 21 nt, Human
agagaggcccggggaggggga

SEQ ID NO: 95939 - RNA, 19 nt, Human
agcgguaaccacccucccc

SEQ ID NO: 95940 - RNA, 21 nt, Human
aggcaagaggagagaggcccg

SEQ ID NO: 95941 - RNA, 22 nt, Human
aggcaagaggagagaggcccgg

SEQ ID NO: 95942 - RNA, 20 nt, Human
aggcaguuuucccaagucug

SEQ ID NO: 95943 - RNA, 22 nt, Human
aucauaaacauaauuccacuac

SEQ ID NO: 95944 - RNA, 19 nt, Human
cauuagcauuucacauuua

SEQ ID NO: 95945 - RNA, 24 nt, Human
cauuauggaauccauagaacaagg

SEQ ID NO: 95946 - RNA, 23 nt, Human
cauuguaacauuauggaauccau

SEQ ID NO: 95947 - RNA, 21 nt, Human
cccggggagggggacuguccu

SEQ ID NO: 95948 - RNA, 21 nt, Human
cccuccccgggccugcucacc

SEQ ID NO: 95949 - RNA, 23 nt, Human
ccggggagggggacuguccuggg

SEQ ID NO: 95950 - RNA, 24 nt, Human
ccucagcgguaaccacccuccccg

SEQ ID NO: 95951 - RNA, 23 nt, Human
cggggagggggacuguccugggu

SEQ ID NO: 95952 - RNA, 24 nt, Human
cucggcagcgccgccgagacaacu

SEQ ID NO: 95953 - RNA, 21 nt, Human
gcccggggagggggacugucc

SEQ ID NO: 95954 - RNA, 18 nt, Human
gggacucguaggcaagag

SEQ ID NO: 95955 - RNA, 22 nt, Human
guuagaucaaugauagaaauga

SEQ ID NO: 95956 - RNA, 21 nt, Human
uagaacaagguuguggagaaa

SEQ ID NO: 95957 - RNA, 18 nt, Human
uagugugacuccuccaau

SEQ ID NO: 95958 - RNA, 25 nt, Human
uccgagaggccuacgaggagagggg

SEQ ID NO: 95959 - RNA, 23 nt, Human
uccucagcgguaaccacccuccc

SEQ ID NO: 95960 - RNA, 23 nt, Human
ugaaugccuucacagaugaauuc

SEQ ID NO: 95961 - RNA, 21 nt, Human
ugauagaaaugaagauucaua

SEQ ID NO: 95962 - RNA, 20 nt, Human
ugauugaagcugugggaaga

SEQ ID NO: 95963 - RNA, 22 nt, Human
ugggaagacugauaguugauag

SEQ ID NO: 95964 - RNA, 18 nt, Human
ugugaaauguugcuuucg

SEQ ID NO: 95965 - RNA, 26 nt, Human
uucaauaccaccuaaauauauugauc

SEQ ID NO: 95966 - RNA, 25 nt, Human
uugauaguauuagugugacuccucc

SEQ ID NO: 95967 - RNA, 24 nt, Human
uuugaaugccuucacagaugaauu

SEQ ID NO: 95968 - RNA, 22 nt, Human
uuugugaaauguugcuuucgac

SEQ ID NO: 95969 - RNA, 22 nt, Human
aaaacacccguacccccaccga

SEQ ID NO: 95970 - RNA, 27 nt, Human
agccggcgcuggcgcgcugucgucacg

SEQ ID NO: 95971 - RNA, 18 nt, Human
cagacgagaacccaaacg

SEQ ID NO: 95972 - RNA, 22 nt, Human
cccguacgcaguugcauuuccg

SEQ ID NO: 95973 - RNA, 19 nt, Human
ccggcgcuggcgcgcuguc

SEQ ID NO: 95974 - RNA, 19 nt, Human
ccguacccccaccgaagau

SEQ ID NO: 95975 - RNA, 19 nt, Human
cguaaaacacccguacccc

SEQ ID NO: 95976 - RNA, 23 nt, Human
cugcagacgagaacccaaacgca

SEQ ID NO: 95977 - RNA, 18 nt, Human
gagaacccaaacgcauca

SEQ ID NO: 95978 - RNA, 21 nt, Human
gagggucugcagacgagaacc

SEQ ID NO: 95979 - RNA, 20 nt, Human
ggaaagaaaacaauagaaaa

SEQ ID NO: 95980 - RNA, 23 nt, Human
guaaaacacccguacccccaccg

SEQ ID NO: 95981 - RNA, 21 nt, Human
uaaaacacccguacccccacc

SEQ ID NO: 95982 - RNA, 24 nt, Human
uaaaacacccguacccccaccgaa

SEQ ID NO: 95983 - RNA, 23 nt, Human
uacgcggccagcccguacgcagu

SEQ ID NO: 95984 - RNA, 18 nt, Human
uagcauugagaaaucaac

SEQ ID NO: 95985 - RNA, 27 nt, Human
uauucuagcucuuuugaagaugguuua

SEQ ID NO: 95986 - RNA, 20 nt, Human
uuaaacguuugauaugcuuc

SEQ ID NO: 95987 - RNA, 18 nt, Human
aaaaaaacaaagagggaa

SEQ ID NO: 95988 - RNA, 18 nt, Human
aaaaaagccauccaauga

SEQ ID NO: 95989 - RNA, 23 nt, Human
aaaaacaaagagggaaaaaaggc

SEQ ID NO: 95990 - RNA, 21 nt, Human
aaaaagccauccaaugaggca

SEQ ID NO: 95991 - RNA, 24 nt, Human
aaacaaagagggaaaaaaggcuca

SEQ ID NO: 95992 - RNA, 18 nt, Human
aaguaacccagugcagga

SEQ ID NO: 95993 - RNA, 18 nt, Human
acugcaacugucgugcau

SEQ ID NO: 95994 - RNA, 22 nt, Human
agaacugcuuuuauuuggauaa

SEQ ID NO: 95995 - RNA, 19 nt, Human
agaaugucaccgaaugaaa

SEQ ID NO: 95996 - RNA, 19 nt, Human
caagggcacugaugaggcu

SEQ ID NO: 95997 - RNA, 22 nt, Human
caagguacccugcugcuuaccc

SEQ ID NO: 95998 - RNA, 24 nt, Human
caaguacauuucuccccuucuccc

SEQ ID NO: 95999 - RNA, 23 nt, Human
cacucugauuuuaucccaggggc

SEQ ID NO: 96000 - RNA, 20 nt, Human
caggggcccgguccauucuu

SEQ ID NO: 96001 - RNA, 23 nt, Human
cauaaccuacuccgaccuccaga

SEQ ID NO: 96002 - RNA, 23 nt, Human
ccaguggauagcggcgguuggcc

SEQ ID NO: 96003 - RNA, 18 nt, Human
cccauacugcaacugucg

SEQ ID NO: 96004 - RNA, 24 nt, Human
cccucagucggugggucacucacc

SEQ ID NO: 96005 - RNA, 18 nt, Human
ccuacuccgaccuccaga

SEQ ID NO: 96006 - RNA, 18 nt, Human
cguccucuaggugugagg

SEQ ID NO: 96007 - RNA, 18 nt, Human
cuacuccgaccuccagau

SEQ ID NO: 96008 - RNA, 23 nt, Human
cuauaaaugaaaaaugugguucu

SEQ ID NO: 96009 - RNA, 20 nt, Human
cucaccccucgcuucagggg

SEQ ID NO: 96010 - RNA, 20 nt, Human
gccauccaaugaggcaaccc

SEQ ID NO: 96011 - RNA, 18 nt, Human
gcggcgguuggccauaac

SEQ ID NO: 96012 - RNA, 19 nt, Human
ggaugcaaacaucuauaaa

SEQ ID NO: 96013 - RNA, 21 nt, Human
ggcuuguucuuuccaaaaggu

SEQ ID NO: 96014 - RNA, 18 nt, Human
gggcacugaugaggcuac

SEQ ID NO: 96015 - RNA, 24 nt, Human
uaaaaaaacaaagagggaaaaaag

SEQ ID NO: 96016 - RNA, 21 nt, Human
uaaaguaacccagugcaggac

SEQ ID NO: 96017 - RNA, 20 nt, Human
uaaccaagauggaauucaca

SEQ ID NO: 96018 - RNA, 25 nt, Human
uacccugcugcuuacccacuucaac

SEQ ID NO: 96019 - RNA, 23 nt, Human
uacucugcaagucgauuagaaaa

SEQ ID NO: 96020 - RNA, 22 nt, Human
uauguuguuacauucacacuua

SEQ ID NO: 96021 - RNA, 22 nt, Human
ucucagacauuagcugaaccaa

SEQ ID NO: 96022 - RNA, 24 nt, Human
ucucagacauuagcugaaccaagu

SEQ ID NO: 96023 - RNA, 22 nt, Human
ucucccuggaggaaaaaaaaaa

SEQ ID NO: 96024 - RNA, 21 nt, Human
ugaaaauguuagaauccggag

SEQ ID NO: 96025 - RNA, 19 nt, Human
ugaaguaggcuuguucuuu

SEQ ID NO: 96026 - RNA, 20 nt, Human
ugaggcuacucugaaagcug

SEQ ID NO: 96027 - RNA, 19 nt, Human
ugaguuuccaggaaaaaua

SEQ ID NO: 96028 - RNA, 24 nt, Human
ugaguuuccaggaaaaauaggcac

SEQ ID NO: 96029 - RNA, 20 nt, Human
ugccccuucugggugucaug

SEQ ID NO: 96030 - RNA, 21 nt, Human
uggaauucacaguauguuguu

SEQ ID NO: 96031 - RNA, 19 nt, Human
uggaggaaaaaaaaaaagc

SEQ ID NO: 96032 - RNA, 25 nt, Human
ugggagagaaugucaccgaauggug

SEQ ID NO: 96033 - RNA, 22 nt, Human
ugugguucuucugccccuucug

SEQ ID NO: 96034 - RNA, 23 nt, Human
uguuguuacauucacacuuaaaa

SEQ ID NO: 96035 - RNA, 21 nt, Human
uuaaaaaaacaaagagggaaa

SEQ ID NO: 96036 - RNA, 19 nt, Human
uucccauacugcaacuguc

SEQ ID NO: 96037 - RNA, 22 nt, Human
uuuccaggaaaaauaggcacug

SEQ ID NO: 96038 - RNA, 21 nt, Human
aagcaaaagucaaaggaccua

SEQ ID NO: 96039 - RNA, 20 nt, Human
accagaaaaaaccuugaggc

SEQ ID NO: 96040 - RNA, 18 nt, Human
acuuccggaaugcaccuc

SEQ ID NO: 96041 - RNA, 18 nt, Human
agaaaaaaccuugaggcg

SEQ ID NO: 96042 - RNA, 23 nt, Human
agaaguuuuuuucuccucuucuu

SEQ ID NO: 96043 - RNA, 20 nt, Human
caaccagaaggcagcggcga

SEQ ID NO: 96044 - RNA, 24 nt, Human
caccucgcuacaccccguagccga

SEQ ID NO: 96045 - RNA, 21 nt, Human
cagcgucaccuaagaggcgac

SEQ ID NO: 96046 - RNA, 25 nt, Human
ccggaaugcaccucgcuacaccccc

SEQ ID NO: 96047 - RNA, 20 nt, Human
ccggguuguuacuugccucc

SEQ ID NO: 96048 - RNA, 19 nt, Human
ccuccguagaggaagcaaa

SEQ ID NO: 96049 - RNA, 22 nt, Human
ccuccguagaggaagcaaaagu

SEQ ID NO: 96050 - RNA, 20 nt, Human
gacccacauccgcugugcgg

SEQ ID NO: 96051 - RNA, 19 nt, Human
gcgacccacauccgcugug

SEQ ID NO: 96052 - RNA, 24 nt, Human
ggcagcggcgaagguugcaggcac

SEQ ID NO: 96053 - RNA, 23 nt, Human
guuaacagccaauaugcgaccag

SEQ ID NO: 96054 - RNA, 21 nt, Human
uaagaggcgacccacauccgc

SEQ ID NO: 96055 - RNA, 23 nt, Human
uagaggaagcaaaagucaaagga

SEQ ID NO: 96056 - RNA, 21 nt, Human
uccggaaugcaccucgcuaca

SEQ ID NO: 96057 - RNA, 19 nt, Human
uucuccucuucuuuuucuu

SEQ ID NO: 96058 - RNA, 19 nt, Human
uuucuccucuucuuuuucu

SEQ ID NO: 96059 - RNA, 19 nt, Human
uuucuccucuucuuuuucu

SEQ ID NO: 96060 - RNA, 21 nt, Human
aaagaggcuccuaaguacccc

SEQ ID NO: 96061 - RNA, 22 nt, Human
aaagugccaccuuuguuuuaga

SEQ ID NO: 96062 - RNA, 25 nt, Human
aaauacacaaaagaaaacaauuuac

SEQ ID NO: 96063 - RNA, 23 nt, Human
aagaccagaacaaauguuaggac

SEQ ID NO: 96064 - RNA, 22 nt, Human
aaucacaguaauccacauaacc

SEQ ID NO: 96065 - RNA, 24 nt, Human
acaaaagaaaacaauuuacacuca

SEQ ID NO: 96066 - RNA, 21 nt, Human
acaaaauaaugaacaauuauc

SEQ ID NO: 96067 - RNA, 23 nt, Human
acagagaaaaaauuaaguuuuca

SEQ ID NO: 96068 - RNA, 18 nt, Human
acauuuuucuccacuuuc

SEQ ID NO: 96069 - RNA, 21 nt, Human
acuuacaagcagcuccaaucc

SEQ ID NO: 96070 - RNA, 21 nt, Human
agaccagaacaaauguuagga

SEQ ID NO: 96071 - RNA, 18 nt, Human
agauuaaacucuaauauu

SEQ ID NO: 96072 - RNA, 24 nt, Human
agcauagguuuaauuucauuuuua

SEQ ID NO: 96073 - RNA, 23 nt, Human
agccaagcaacaaaaaauagcua

SEQ ID NO: 96074 - RNA, 23 nt, Human
aggaguauauuuaagaauauggu

SEQ ID NO: 96075 - RNA, 23 nt, Human
aguaaaggaaaaauugaccuaaa

SEQ ID NO: 96076 - RNA, 20 nt, Human
aguuuugcaccuuccaugcu

SEQ ID NO: 96077 - RNA, 21 nt, Human
auacagagcaacaaaguuaca

SEQ ID NO: 96078 - RNA, 20 nt, Human
auacagguacaaugcacagu

SEQ ID NO: 96079 - RNA, 19 nt, Human
augcaagaccagaacaaau

SEQ ID NO: 96080 - RNA, 23 nt, Human
auuaugccauacagagcaacaaa

SEQ ID NO: 96081 - RNA, 24 nt, Human
auucaaaagccaagcaacaaaaaa

SEQ ID NO: 96082 - RNA, 22 nt, Human
auugacaaaauaaugaacaauu

SEQ ID NO: 96083 - RNA, 25 nt, Human
caaaaaauagcuacaguauucaaau

SEQ ID NO: 96084 - RNA, 18 nt, Human
caaaagccaagcaacaaa

SEQ ID NO: 96085 - RNA, 23 nt, Human
caacaaacauuuaaaugcacuuc

SEQ ID NO: 96086 - RNA, 24 nt, Human
caagaccagaacaaauguuaggac

SEQ ID NO: 96087 - RNA, 26 nt, Human
cacaucucaaaacaauucugcaaauu

SEQ ID NO: 96088 - RNA, 21 nt, Human
cacccccaauuauacaguagc

SEQ ID NO: 96089 - RNA, 21 nt, Human
cagaaccucugaaggcaaaau

SEQ ID NO: 96090 - RNA, 19 nt, Human
cagccagccauucauccua

SEQ ID NO: 96091 - RNA, 18 nt, Human
cauacaaguauaaauaca

SEQ ID NO: 96092 - RNA, 22 nt, Human
cauacauacaaguauaaauaca

SEQ ID NO: 96093 - RNA, 18 nt, Human
cauagaacugcaacaagc

SEQ ID NO: 96094 - RNA, 23 nt, Human
ccaagaaagcccuucccucccuc

SEQ ID NO: 96095 - RNA, 24 nt, Human
ccaagcaacaaaaaauagcuacag

SEQ ID NO: 96096 - RNA, 22 nt, Human
ccaaucuggucagaaccucuga

SEQ ID NO: 96097 - RNA, 18 nt, Human
ccauaacaauauacacua

SEQ ID NO: 96098 - RNA, 18 nt, Human
cccaauuauacaguagca

SEQ ID NO: 96099 - RNA, 19 nt, Human
ccccaauuauacaguagca

SEQ ID NO: 96100 - RNA, 22 nt, Human
ccuccgcccgcuccuucauuca

SEQ ID NO: 96101 - RNA, 19 nt, Human
ccugguauuaucaccccca

SEQ ID NO: 96102 - RNA, 21 nt, Human
cuaauauuuacaacugcaaaa

SEQ ID NO: 96103 - RNA, 22 nt, Human
cuagcuaucuuuuuaacugucc

SEQ ID NO: 96104 - RNA, 20 nt, Human
cucccucaucuugcacucag

SEQ ID NO: 96105 - RNA, 18 nt, Human
cugggaggcugaccuuuu

SEQ ID NO: 96106 - RNA, 18 nt, Human
cugguuugccugggaggc

SEQ ID NO: 96107 - RNA, 18 nt, Human
gaagcaguggcagcaaca

SEQ ID NO: 96108 - RNA, 20 nt, Human
gaagucagaugacugugcaa

SEQ ID NO: 96109 - RNA, 22 nt, Human
gaccuuuucuuucuuacagagc

SEQ ID NO: 96110 - RNA, 21 nt, Human
gcaaacuuuaccucaacagaa

SEQ ID NO: 96111 - RNA, 25 nt, Human
ggcugcccuuuaauaaauaaaguca

SEQ ID NO: 96112 - RNA, 24 nt, Human
guugcacugcacacaucugguaga

SEQ ID NO: 96113 - RNA, 21 nt, Human
guuuucaguucaacaagaggu

SEQ ID NO: 96114 - RNA, 21 nt, Human
uaaaauuccugguauuaucac

SEQ ID NO: 96115 - RNA, 19 nt, Human
uaaaggaaacaacucacua

SEQ ID NO: 96116 - RNA, 21 nt, Human
uaacauaaaaaagugccaccu

SEQ ID NO: 96117 - RNA, 21 nt, Human
uacaauauuaugccauacaga

SEQ ID NO: 96118 - RNA, 20 nt, Human
uacagagugaaaagugaaua

SEQ ID NO: 96119 - RNA, 19 nt, Human
uaccacagaauaaauucaa

SEQ ID NO: 96120 - RNA, 23 nt, Human
uaccacagaauaaauucaagauu

SEQ ID NO: 96121 - RNA, 19 nt, Human
uaccccaaguucaaauaac

SEQ ID NO: 96122 - RNA, 19 nt, Human
uaccccaaguucaaauaac

SEQ ID NO: 96123 - RNA, 23 nt, Human
uacugacccauaacaauauacac

SEQ ID NO: 96124 - RNA, 26 nt, Human
uagcuacaguauucaaaucauaaaua

SEQ ID NO: 96125 - RNA, 26 nt, Human
uauaaauacacaaaagaaaacaauuu

SEQ ID NO: 96126 - RNA, 19 nt, Human
uauacaguagcacaaccac

SEQ ID NO: 96127 - RNA, 20 nt, Human
uauguggagauaaagacuug

SEQ ID NO: 96128 - RNA, 22 nt, Human
uauuuacaacugcaacauaaca

SEQ ID NO: 96129 - RNA, 20 nt, Human
uauuuuuuccucuucaagcc

SEQ ID NO: 96130 - RNA, 24 nt, Human
ucaaauucaauuuuggaaguacua

SEQ ID NO: 96131 - RNA, 21 nt, Human
ucaacaagaggucgaauccaa

SEQ ID NO: 96132 - RNA, 18 nt, Human
ucagaagucagaugacug

SEQ ID NO: 96133 - RNA, 22 nt, Human
ucauccuaauguucuuagcugc

SEQ ID NO: 96134 - RNA, 20 nt, Human
ucccuacaaagaggcuccua

SEQ ID NO: 96135 - RNA, 21 nt, Human
ucuaaauuaccaagaaagccc

SEQ ID NO: 96136 - RNA, 18 nt, Human
ugaaacaugcaaaucaua

SEQ ID NO: 96137 - RNA, 24 nt, Human
ugaagaauaaagcagcacuuacaa

SEQ ID NO: 96138 - RNA, 20 nt, Human
ugaaugcuugaggcaucuua

SEQ ID NO: 96139 - RNA, 19 nt, Human
ugacaacuggcugcccuuu

SEQ ID NO: 96140 - RNA, 19 nt, Human
ugauaaccauaaacuauaa

SEQ ID NO: 96141 - RNA, 23 nt, Human
uguaacaaaaauacagagaaaaa

SEQ ID NO: 96142 - RNA, 21 nt, Human
uuaaacucuaauauuuacaac

SEQ ID NO: 96143 - RNA, 21 nt, Human
uuaaaggaaacaacucacuaa

SEQ ID NO: 96144 - RNA, 21 nt, Human
uuacagagugaaaagugaaua

SEQ ID NO: 96145 - RNA, 24 nt, Human
uuacugaaguuaugcaagaccaga

SEQ ID NO: 96146 - RNA, 19 nt, Human
uuauguaguuuuuacauga

SEQ ID NO: 96147 - RNA, 20 nt, Human
uucauuuuuauaaggaagac

SEQ ID NO: 96148 - RNA, 20 nt, Human
uugacaaaauaaugaacaag

SEQ ID NO: 96149 - RNA, 23 nt, Human
uuuaagguuaacauaaaaaagug

SEQ ID NO: 96150 - RNA, 23 nt, Human
aaaguucugcucuguccccacuu

SEQ ID NO: 96151 - RNA, 21 nt, Human
aacacacugggcaacauaaga

SEQ ID NO: 96152 - RNA, 18 nt, Human
aacuaacucuuuaccaca

SEQ ID NO: 96153 - RNA, 23 nt, Human
aacucaaacuaacucuuuaccac

SEQ ID NO: 96154 - RNA, 20 nt, Human
aacuggaagguaguuuggaa

SEQ ID NO: 96155 - RNA, 19 nt, Human
aagaaauuaugaagacuag

SEQ ID NO: 96156 - RNA, 22 nt, Human
aaugauacaaaacaaaacacaa

SEQ ID NO: 96157 - RNA, 23 nt, Human
acaaaacacaaaaggcuuuuggc

SEQ ID NO: 96158 - RNA, 21 nt, Human
acauguuggauaugcauuggg

SEQ ID NO: 96159 - RNA, 19 nt, Human
accaguaucaucuccuggc

SEQ ID NO: 96160 - RNA, 26 nt, Human
acccuucaagguuaaauacacguggc

SEQ ID NO: 96161 - RNA, 20 nt, Human
acucuaugccuguauucaaa

SEQ ID NO: 96162 - RNA, 19 nt, Human
acugugauucaaacgacau

SEQ ID NO: 96163 - RNA, 21 nt, Human
acugugauucaaacgacauca

SEQ ID NO: 96164 - RNA, 20 nt, Human
acuuaugcaaaagagaauca

SEQ ID NO: 96165 - RNA, 19 nt, Human
agaaauuaugaagacuaga

SEQ ID NO: 96166 - RNA, 23 nt, Human
agaaauuaugaagacuagaaaaa

SEQ ID NO: 96167 - RNA, 18 nt, Human
agaagcccaguguuucuu

SEQ ID NO: 96168 - RNA, 20 nt, Human
agacagggggauguggccua

SEQ ID NO: 96169 - RNA, 18 nt, Human
agauccagcugagaugac

SEQ ID NO: 96170 - RNA, 18 nt, Human
agcaugauauuucauaga

SEQ ID NO: 96171 - RNA, 18 nt, Human
agcauugauuuauuuucc

SEQ ID NO: 96172 - RNA, 18 nt, Human
agccauguggccugaaag

SEQ ID NO: 96173 - RNA, 18 nt, Human
aggcuuuuggcagcaagc

SEQ ID NO: 96174 - RNA, 26 nt, Human
auaaagcaaaaauaugucaugcacuu

SEQ ID NO: 96175 - RNA, 20 nt, Human
augcacuuaugcaaaagaga

SEQ ID NO: 96176 - RNA, 22 nt, Human
caaaacacaaaaggcuuuuggc

SEQ ID NO: 96177 - RNA, 25 nt, Human
caccaaaacucccagguuauugcag

SEQ ID NO: 96178 - RNA, 23 nt, Human
caccuuugucuuuguccaggcuc

SEQ ID NO: 96179 - RNA, 20 nt, Human
cacugugaaucacacaucug

SEQ ID NO: 96180 - RNA, 18 nt, Human
cacuuaugcaaaagagaa

SEQ ID NO: 96181 - RNA, 19 nt, Human
cagaucagaaacacacugg

SEQ ID NO: 96182 - RNA, 20 nt, Human
cagggagcuucuccaccuuc

SEQ ID NO: 96183 - RNA, 20 nt, Human
caugcucaugucucccuccu

SEQ ID NO: 96184 - RNA, 21 nt, Human
cauugggugacauagucugua

SEQ ID NO: 96185 - RNA, 23 nt, Human
ccagcuggagucucucuccucuc

SEQ ID NO: 96186 - RNA, 20 nt, Human
ccagcuggcccuugauuuca

SEQ ID NO: 96187 - RNA, 20 nt, Human
cccacagaucacacacuucc

SEQ ID NO: 96188 - RNA, 21 nt, Human
cccuccuucuccucucagccc

SEQ ID NO: 96189 - RNA, 18 nt, Human
cccugaccuggugaaccc

SEQ ID NO: 96190 - RNA, 21 nt, Human
ccuccagcuggcccuugauuu

SEQ ID NO: 96191 - RNA, 18 nt, Human
ccucucagccuuccugcc

SEQ ID NO: 96192 - RNA, 18 nt, Human
ccuggcugaaugcgugag

SEQ ID NO: 96193 - RNA, 25 nt, Human
cgaagcacugaaacacucgaaugug

SEQ ID NO: 96194 - RNA, 21 nt, Human
cucagcccugaccccacuauc

SEQ ID NO: 96195 - RNA, 29 nt, Human
cucagcccugaccccacuauccgguuccg

SEQ ID NO: 96196 - RNA, 20 nt, Human
cuccaccaaaacucccaggu

SEQ ID NO: 96197 - RNA, 21 nt, Human
cuccaccaaaacucccagguu

SEQ ID NO: 96198 - RNA, 27 nt, Human
cucucagcccugaccccacuaucccuc

SEQ ID NO: 96199 - RNA, 21 nt, Human
cuggauuauucccugagcaca

SEQ ID NO: 96200 - RNA, 22 nt, Human
gaccccacuaucccucacuccc

SEQ ID NO: 96201 - RNA, 19 nt, Human
gagguuccugggcaccugc

SEQ ID NO: 96202 - RNA, 21 nt, Human
gagguuccugggcaccugcuu

SEQ ID NO: 96203 - RNA, 20 nt, Human
gcccugagguuccugggcac

SEQ ID NO: 96204 - RNA, 24 nt, Human
ggaaaauacuguuuuccaacccag

SEQ ID NO: 96205 - RNA, 24 nt, Human
ggaacaauaugagcaucaaggaca

SEQ ID NO: 96206 - RNA, 21 nt, Human
ggcaaauuagggaacaauaug

SEQ ID NO: 96207 - RNA, 18 nt, Human
ggggauguggccuaagaa

SEQ ID NO: 96208 - RNA, 21 nt, Human
guaauaaagcaaaaauauguc

SEQ ID NO: 96209 - RNA, 18 nt, Human
guccaggcucagccaugc

SEQ ID NO: 96210 - RNA, 19 nt, Human
guccaggcucagccaugcu

SEQ ID NO: 96211 - RNA, 21 nt, Human
gugaagaaauuaugaagacua

SEQ ID NO: 96212 - RNA, 22 nt, Human
uaaaaaaagucugaacucuaug

SEQ ID NO: 96213 - RNA, 20 nt, Human
uacaaaacaaaacacaaaag

SEQ ID NO: 96214 - RNA, 22 nt, Human
uaccaccugcucaaaauucuua

SEQ ID NO: 96215 - RNA, 23 nt, Human
uagaauuaucucugugacuaaua

SEQ ID NO: 96216 - RNA, 23 nt, Human
uaguacacacagcccugagguuc

SEQ ID NO: 96217 - RNA, 18 nt, Human
uauacagauuguuaucuc

SEQ ID NO: 96218 - RNA, 24 nt, Human
uaucucccuuuauaaacaacaauc

SEQ ID NO: 96219 - RNA, 25 nt, Human
uaugcaaaagagaaucaucggacuc

SEQ ID NO: 96220 - RNA, 20 nt, Human
ucaaaaaugaggaacuggaa

SEQ ID NO: 96221 - RNA, 18 nt, Human
ucaagacauugacagaau

SEQ ID NO: 96222 - RNA, 26 nt, Human
ucagcagucucccaaacauaccaccu

SEQ ID NO: 96223 - RNA, 21 nt, Human
ucaggagcugagaugagcuuu

SEQ ID NO: 96224 - RNA, 18 nt, Human
uccaccaaaacucccagg

SEQ ID NO: 96225 - RNA, 21 nt, Human
ucccaaacucucccugaccuu

SEQ ID NO: 96226 - RNA, 23 nt, Human
uccuggcugaaugcgugagcccu

SEQ ID NO: 96227 - RNA, 28 nt, Human
uccuggcugaaugcgugaggagcucauu

SEQ ID NO: 96228 - RNA, 19 nt, Human
ucucccuccuucuccucuc

SEQ ID NO: 96229 - RNA, 27 nt, Human
ucuuuuauaaacaaaaauuuucugaau

SEQ ID NO: 96230 - RNA, 20 nt, Human
ugaaaccuucuuuagccaug

SEQ ID NO: 96231 - RNA, 20 nt, Human
ugagguuccugggcaccugc

SEQ ID NO: 96232 - RNA, 21 nt, Human
ugagguuccugggcaccugcu

SEQ ID NO: 96233 - RNA, 21 nt, Human
ugcaaaagagaaucaucggac

SEQ ID NO: 96234 - RNA, 20 nt, Human
ugcaguucccaaacucuccc

SEQ ID NO: 96235 - RNA, 27 nt, Human
ugcauauacauauauuagcauaucaua

SEQ ID NO: 96236 - RNA, 18 nt, Human
ugcucuguccccacuucu

SEQ ID NO: 96237 - RNA, 22 nt, Human
uggagcaugauauuucauagau

SEQ ID NO: 96238 - RNA, 23 nt, Human
uggcagauggggcuaaggaccag

SEQ ID NO: 96239 - RNA, 27 nt, Human
ugugcccacagaucacaccacccaagg

SEQ ID NO: 96240 - RNA, 23 nt, Human
uucaagacauugacagaaucaga

SEQ ID NO: 96241 - RNA, 18 nt, Human
uuccaacccagcuggagu

SEQ ID NO: 96242 - RNA, 20 nt, Human
uucccugagcacauguugga

SEQ ID NO: 96243 - RNA, 21 nt, Human
uucuuuagccauguggccuga

SEQ ID NO: 96244 - RNA, 21 nt, Human
uugcaguucccaaacucuccc

SEQ ID NO: 96245 - RNA, 19 nt, Human
uugcaucagaucagaaaca

SEQ ID NO: 96246 - RNA, 21 nt, Human
agaggugaguguggaaggcuu

SEQ ID NO: 96247 - RNA, 22 nt, Human
cuucucccugugauagaagaag

SEQ ID NO: 96248 - RNA, 24 nt, Human
aaaagaaccagcccauuuucuagg

SEQ ID NO: 96249 - RNA, 25 nt, Human
aaaagaugcaaaggugaauuccauu

SEQ ID NO: 96250 - RNA, 19 nt, Human
aaagaagagggccaaaaga

SEQ ID NO: 96251 - RNA, 18 nt, Human
aaagacacaaaagaugca

SEQ ID NO: 96252 - RNA, 19 nt, Human
aaauagccuuccagcaagg

SEQ ID NO: 96253 - RNA, 20 nt, Human
aacaaggagaacagaaggaa

SEQ ID NO: 96254 - RNA, 24 nt, Human
aagaaagacacaaaagaugcaaag

SEQ ID NO: 96255 - RNA, 18 nt, Human
aagccaacagacuuugga

SEQ ID NO: 96256 - RNA, 18 nt, Human
aagccuacaacagggcca

SEQ ID NO: 96257 - RNA, 18 nt, Human
agaaagaagagggccaaa

SEQ ID NO: 96258 - RNA, 19 nt, Human
agaaagaagagggccaaaa

SEQ ID NO: 96259 - RNA, 22 nt, Human
agaacaaggagaacagaaggaa

SEQ ID NO: 96260 - RNA, 22 nt, Human
agacagacgguggacccaaagc

SEQ ID NO: 96261 - RNA, 20 nt, Human
agaucaggaaucuauaagac

SEQ ID NO: 96262 - RNA, 22 nt, Human
agcaaggccugcgcuucacccc

SEQ ID NO: 96263 - RNA, 20 nt, Human
agcuggguugcucucugccu

SEQ ID NO: 96264 - RNA, 20 nt, Human
agcuggguugcucucugccu

SEQ ID NO: 96265 - RNA, 21 nt, Human
agcuuuuaaaauguugccacu

SEQ ID NO: 96266 - RNA, 18 nt, Human
aggggcaggcuuuguggg

SEQ ID NO: 96267 - RNA, 21 nt, Human
agucaagagccaaucaacagc

SEQ ID NO: 96268 - RNA, 18 nt, Human
aguucagauucaucccuu

SEQ ID NO: 96269 - RNA, 21 nt, Human
aucuauuugaucuuuaauugc

SEQ ID NO: 96270 - RNA, 23 nt, Human
auggaaguaaauagccuuccagc

SEQ ID NO: 96271 - RNA, 26 nt, Human
caaaagaaccaugcaccucagagaag

SEQ ID NO: 96272 - RNA, 26 nt, Human
caagccuacaacagggccaaggcugg

SEQ ID NO: 96273 - RNA, 24 nt, Human
caaggaccuucacuggcccagaac

SEQ ID NO: 96274 - RNA, 18 nt, Human
caagggcuccuccagagg

SEQ ID NO: 96275 - RNA, 20 nt, Human
cacagucaagagccaaucaa

SEQ ID NO: 96276 - RNA, 18 nt, Human
cacagugcauggagaaaa

SEQ ID NO: 96277 - RNA, 20 nt, Human
caccauaccaaggaauaagc

SEQ ID NO: 96278 - RNA, 18 nt, Human
cacuguauuccucagaau

SEQ ID NO: 96279 - RNA, 25 nt, Human
cagaacaagccuacaacagggccaa

SEQ ID NO: 96280 - RNA, 22 nt, Human
cagaaggaaauuaggucugaga

SEQ ID NO: 96281 - RNA, 23 nt, Human
cagaaggaaauuaggucugagau

SEQ ID NO: 96282 - RNA, 23 nt, Human
cagacagacgguggacccaaagc

SEQ ID NO: 96283 - RNA, 19 nt, Human
cagacgguggacccaaagc

SEQ ID NO: 96284 - RNA, 22 nt, Human
caggcaccaccagcucucagug

SEQ ID NO: 96285 - RNA, 22 nt, Human
caggcaccaccagcucucagug

SEQ ID NO: 96286 - RNA, 18 nt, Human
caggccauggagagacac

SEQ ID NO: 96287 - RNA, 22 nt, Human
cagggccaaggcuggcuccugc

SEQ ID NO: 96288 - RNA, 23 nt, Human
caucacagucaagagccaaucaa

SEQ ID NO: 96289 - RNA, 20 nt, Human
ccaaaagaaccagcccauuu

SEQ ID NO: 96290 - RNA, 18 nt, Human
ccaccagcucucaguguc

SEQ ID NO: 96291 - RNA, 18 nt, Human
ccaccagcucucaguguc

SEQ ID NO: 96292 - RNA, 24 nt, Human
ccacucaacagaacaagccuacaa

SEQ ID NO: 96293 - RNA, 22 nt, Human
ccagaacagaacaaggagaaca

SEQ ID NO: 96294 - RNA, 20 nt, Human
cccuuugcccuaccuggcug

SEQ ID NO: 96295 - RNA, 21 nt, Human
ccuccagcaggacacagaaau

SEQ ID NO: 96296 - RNA, 24 nt, Human
cucccugggacagcaggcaccacc

SEQ ID NO: 96297 - RNA, 24 nt, Human
cucccugggacagcaggcaccacc

SEQ ID NO: 96298 - RNA, 23 nt, Human
cugccugggaugaggggcaggcu

SEQ ID NO: 96299 - RNA, 19 nt, Human
cugcgcuucaccccuuugc

SEQ ID NO: 96300 - RNA, 23 nt, Human
cugcucuguggagggcgaugcaa

SEQ ID NO: 96301 - RNA, 23 nt, Human
cuuccaaaagaaccaugcaccuc

SEQ ID NO: 96302 - RNA, 19 nt, Human
cuucuguguccccuuuugg

SEQ ID NO: 96303 - RNA, 18 nt, Human
cuuugcccuaccuggcug

SEQ ID NO: 96304 - RNA, 18 nt, Human
gaaguaaauagccuucca

SEQ ID NO: 96305 - RNA, 20 nt, Human
gacagcaggcaccaccagcu

SEQ ID NO: 96306 - RNA, 20 nt, Human
gacagcaggcaccaccagcu

SEQ ID NO: 96307 - RNA, 20 nt, Human
gauaagaaagacacaaaaga

SEQ ID NO: 96308 - RNA, 20 nt, Human
gaugcaaaggugaauuccau

SEQ ID NO: 96309 - RNA, 22 nt, Human
gcaagccugcucuguggagggc

SEQ ID NO: 96310 - RNA, 24 nt, Human
gcagacagacgguggacccaaagc

SEQ ID NO: 96311 - RNA, 24 nt, Human
gcaggacacagaaauggauuggaa

SEQ ID NO: 96312 - RNA, 19 nt, Human
gccuuguggguguggucag

SEQ ID NO: 96313 - RNA, 24 nt, Human
gcuuguggagggcgaugcaacucu

SEQ ID NO: 96314 - RNA, 18 nt, Human
gguaaagaaagugacaag

SEQ ID NO: 96315 - RNA, 20 nt, Human
uaaaaccuccagcaggacac

SEQ ID NO: 96316 - RNA, 24 nt, Human
uaagaaagacacaaaagaugcaaa

SEQ ID NO: 96317 - RNA, 21 nt, Human
uaguucagauucaucccuuuc

SEQ ID NO: 96318 - RNA, 23 nt, Human
uaguucagauucaucccuuucug

SEQ ID NO: 96319 - RNA, 22 nt, Human
uaucuauuugaucuuuaauugc

SEQ ID NO: 96320 - RNA, 18 nt, Human
ucagaacaaggaccuuca

SEQ ID NO: 96321 - RNA, 22 nt, Human
ucaggccauggagagacacugu

SEQ ID NO: 96322 - RNA, 18 nt, Human
uccaaaagaaccaugcaa

SEQ ID NO: 96323 - RNA, 20 nt, Human
ucccugcucaggccauggag

SEQ ID NO: 96324 - RNA, 23 nt, Human
ucuagaucaggaaucuauaagac

SEQ ID NO: 96325 - RNA, 25 nt, Human
ucuagguuaaaaccuccagcaggac

SEQ ID NO: 96326 - RNA, 22 nt, Human
ucucagugucuggggaaagagc

SEQ ID NO: 96327 - RNA, 22 nt, Human
ucucagugucuggggaaagagc

SEQ ID NO: 96328 - RNA, 20 nt, Human
ucucccugcucaggccaugg

SEQ ID NO: 96329 - RNA, 24 nt, Human
ucuuccaaaagaaccaugcaccuc

SEQ ID NO: 96330 - RNA, 21 nt, Human
ucuuuucucuuucacucucuc

SEQ ID NO: 96331 - RNA, 19 nt, Human
ugagaacugaagccacaga

SEQ ID NO: 96332 - RNA, 20 nt, Human
ugagaacugaagccacagaa

SEQ ID NO: 96333 - RNA, 19 nt, Human
ugaguuuucuuuucucuuu

SEQ ID NO: 96334 - RNA, 24 nt, Human
ugccacuauagaguaagaaaagga

SEQ ID NO: 96335 - RNA, 18 nt, Human
ugccugggaugaggggca

SEQ ID NO: 96336 - RNA, 18 nt, Human
ugccugggaugaggggca

SEQ ID NO: 96337 - RNA, 19 nt, Human
ugccugggaugaggggcag

SEQ ID NO: 96338 - RNA, 21 nt, Human
ugccugggaugaggggcaggc

SEQ ID NO: 96339 - RNA, 20 nt, Human
ugcuuuggcaaauucugacu

SEQ ID NO: 96340 - RNA, 20 nt, Human
uggacccaaagcaagugcca

SEQ ID NO: 96341 - RNA, 19 nt, Human
uggagaaaauccaagggcu

SEQ ID NO: 96342 - RNA, 19 nt, Human
uggcaaagccagggugcuc

SEQ ID NO: 96343 - RNA, 22 nt, Human
uggcccagaacagaacaaggag

SEQ ID NO: 96344 - RNA, 24 nt, Human
uggcccagaacagaacaaggagaa

SEQ ID NO: 96345 - RNA, 21 nt, Human
uggcugcugcccauaucugcu

SEQ ID NO: 96346 - RNA, 22 nt, Human
uggcugcugcccauaucugcuc

SEQ ID NO: 96347 - RNA, 20 nt, Human
ugggacagcaggcaccacca

SEQ ID NO: 96348 - RNA, 20 nt, Human
ugggacagcaggcaccacca

SEQ ID NO: 96349 - RNA, 21 nt, Human
ugggccucagaaagaagaggg

SEQ ID NO: 96350 - RNA, 18 nt, Human
uguagcagcagccagugc

SEQ ID NO: 96351 - RNA, 19 nt, Human
uguauuccucagaauaaag

SEQ ID NO: 96352 - RNA, 21 nt, Human
uucaaaaucagaacaaggacc

SEQ ID NO: 96353 - RNA, 19 nt, Human
uucacuggcaagaccugca

SEQ ID NO: 96354 - RNA, 21 nt, Human
uucacuggcaagaccugcaga

SEQ ID NO: 96355 - RNA, 21 nt, Human
uucccaaagauggacauuuuc

SEQ ID NO: 96356 - RNA, 21 nt, Human
uuggcaaauucugacuacaag

SEQ ID NO: 96357 - RNA, 22 nt, Human
uuucccaaagauggacauuuuc

SEQ ID NO: 96358 - RNA, 22 nt, Human
aaacaggaaaaaagauaguugg

SEQ ID NO: 96359 - RNA, 27 nt, Human
aaccaagauacaaaauuaucaccacaa

SEQ ID NO: 96360 - RNA, 21 nt, Human
aaccaggaaauugaaauuggu

SEQ ID NO: 96361 - RNA, 20 nt, Human
accaggaaauugaaauuggu

SEQ ID NO: 96362 - RNA, 20 nt, Human
agauaguuggaguucugcug

SEQ ID NO: 96363 - RNA, 27 nt, Human
aguucugugucauuuuaucacuugugu

SEQ ID NO: 96364 - RNA, 19 nt, Human
auaagcaccacugcaacca

SEQ ID NO: 96365 - RNA, 27 nt, Human
auuaucuuguuuccucuucuuggcuuu

SEQ ID NO: 96366 - RNA, 24 nt, Human
auuuauuaucuuguuuccucuucu

SEQ ID NO: 96367 - RNA, 24 nt, Human
caaccacggcgucugagauuugag

SEQ ID NO: 96368 - RNA, 18 nt, Human
cacaggaaguuacaaaga

SEQ ID NO: 96369 - RNA, 23 nt, Human
ccuggguacccuucacccaguuu

SEQ ID NO: 96370 - RNA, 18 nt, Human
ccuuuuaacaugaaccuc

SEQ ID NO: 96371 - RNA, 26 nt, Human
cuauauuguucauuuuaauuuucaug

SEQ ID NO: 96372 - RNA, 25 nt, Human
cuuuuauuucucccccuucccccaa

SEQ ID NO: 96373 - RNA, 22 nt, Human
ggguacccuucacccaguuuuc

SEQ ID NO: 96374 - RNA, 18 nt, Human
ggguuuuuuuuuaacuug

SEQ ID NO: 96375 - RNA, 18 nt, Human
gguacaauguguguauau

SEQ ID NO: 96376 - RNA, 28 nt, Human
guuuguuuuuuuuuuauugcuuuuuugg

SEQ ID NO: 96377 - RNA, 18 nt, Human
uaaaaaaaacaggaaaaa

SEQ ID NO: 96378 - RNA, 19 nt, Human
uacaaaauuaucaccacaa

SEQ ID NO: 96379 - RNA, 28 nt, Human
uacaaauuuaaaaaaaacaggaaaaaag

SEQ ID NO: 96380 - RNA, 25 nt, Human
uaguggguuuuuuuuuaacuuguuu

SEQ ID NO: 96381 - RNA, 23 nt, Human
uauguauccaagcaaaaggcaga

SEQ ID NO: 96382 - RNA, 25 nt, Human
uauguauccaagcaaaaggcagagc

SEQ ID NO: 96383 - RNA, 19 nt, Human
uccuggguacccuucaccc

SEQ ID NO: 96384 - RNA, 23 nt, Human
ugguacagagugguccuggguaa

SEQ ID NO: 96385 - RNA, 24 nt, Human
uguauaagcaccacugcaaccaag

SEQ ID NO: 96386 - RNA, 21 nt, Human
uguuuuauuugaggggaaagc

SEQ ID NO: 96387 - RNA, 24 nt, Human
uguuuuguacauuuauuaucuugu

SEQ ID NO: 96388 - RNA, 26 nt, Human
uguuuuuuuuuuauugcuuuuuugga

SEQ ID NO: 96389 - RNA, 24 nt, Human
uuaaaaaaaacaggaaaaaagaua

SEQ ID NO: 96390 - RNA, 28 nt, Human
uugcaaccacggcgucugagauuugagu

SEQ ID NO: 96391 - RNA, 23 nt, Human
uugcuuuuuuggaggagguggau

SEQ ID NO: 96392 - RNA, 29 nt, Human
uuuuuuuuuuuuuuuauaguuuguuuuuu

SEQ ID NO: 96393 - RNA, 18 nt, Human
caccaccccgagacgcag

SEQ ID NO: 96394 - RNA, 25 nt, Human
cagucaccaccccgagacgcagaac

SEQ ID NO: 96395 - RNA, 18 nt, Human
ccacagcagcuccugccc

SEQ ID NO: 96396 - RNA, 18 nt, Human
cccuguacugagcucucc

SEQ ID NO: 96397 - RNA, 22 nt, Human
ccuguacugagcucuccaaaga

SEQ ID NO: 96398 - RNA, 23 nt, Human
cuggaggacagcaacagagccaa

SEQ ID NO: 96399 - RNA, 23 nt, Human
gacagcaacagagccaaggugag

SEQ ID NO: 96400 - RNA, 18 nt, Human
gcccuggaggacagcaac

SEQ ID NO: 96401 - RNA, 19 nt, Human
ggaaguggaaagugcucgc

SEQ ID NO: 96402 - RNA, 21 nt, Human
ggcaaagucccucuggccccc

SEQ ID NO: 96403 - RNA, 20 nt, Human
gucccucuggcccccucugg

SEQ ID NO: 96404 - RNA, 21 nt, Human
uggaaagugcucgcccuggag

SEQ ID NO: 96405 - RNA, 18 nt, Human
uggacccagucaccaccc

SEQ ID NO: 96406 - RNA, 21 nt, Human
aagugaauccccucacagcuc

SEQ ID NO: 96407 - RNA, 18 nt, Human
auagaguaucuuucaaac

SEQ ID NO: 96408 - RNA, 19 nt, Human
caccgauaaacagauucca

SEQ ID NO: 96409 - RNA, 21 nt, Human
caccgauaaacagauuccaca

SEQ ID NO: 96410 - RNA, 25 nt, Human
cuccuuuuuuuccuuucauuguuca

SEQ ID NO: 96411 - RNA, 22 nt, Human
gaaaugaacuccuuuaaaucaa

SEQ ID NO: 96412 - RNA, 19 nt, Human
ggcaaauaaauuagaccua

SEQ ID NO: 96413 - RNA, 22 nt, Human
uaaaucaacugauuuguaugga

SEQ ID NO: 96414 - RNA, 23 nt, Human
uaaauuagaccuauguuaaagcg

SEQ ID NO: 96415 - RNA, 24 nt, Human
uaaugcccaguaugcgaaaugaac

SEQ ID NO: 96416 - RNA, 23 nt, Human
uccaaagaucgacagcacguggg

SEQ ID NO: 96417 - RNA, 22 nt, Human
uccgcacacaagugaauccccu

SEQ ID NO: 96418 - RNA, 22 nt, Human
ucuccuuuuuuuccuuucauug

SEQ ID NO: 96419 - RNA, 19 nt, Human
uuugcuagaaacuggucca

SEQ ID NO: 96420 - RNA, 24 nt, Human
uuugcuagaaacugguccaaagau

SEQ ID NO: 96421 - RNA, 24 nt, Human
uuuuuuuucuccuuuuuuuccuuu

SEQ ID NO: 96422 - RNA, 19 nt, Human
acccagagcugggggaacc

SEQ ID NO: 96423 - RNA, 21 nt, Human
agaaagggacugggggcugcc

SEQ ID NO: 96424 - RNA, 20 nt, Human
caauagagaagaauuacaug

SEQ ID NO: 96425 - RNA, 22 nt, Human
cacaguguuccuggcacucugg

SEQ ID NO: 96426 - RNA, 21 nt, Human
cacucuggcucaggaaaaggg

SEQ ID NO: 96427 - RNA, 23 nt, Human
ccagagcugggggaaccggcaga

SEQ ID NO: 96428 - RNA, 19 nt, Human
cucaggaaaaggggagacu

SEQ ID NO: 96429 - RNA, 25 nt, Human
cugagcugggacagaaagggacugg

SEQ ID NO: 96430 - RNA, 20 nt, Human
gacagaaagggacugggggc

SEQ ID NO: 96431 - RNA, 18 nt, Human
gcgaugcagagccgggua

SEQ ID NO: 96432 - RNA, 19 nt, Human
ggaaaaggggagacucugc

SEQ ID NO: 96433 - RNA, 20 nt, Human
ggaaaaggggagacucugcu

SEQ ID NO: 96434 - RNA, 19 nt, Human
ggagacucugcugguucug

SEQ ID NO: 96435 - RNA, 23 nt, Human
uaaauggaaaccuuacaauagag

SEQ ID NO: 96436 - RNA, 26 nt, Human
ucccuucugaacaaagacguccacag

SEQ ID NO: 96437 - RNA, 18 nt, Human
ucuggcucaggaaaaggg

SEQ ID NO: 96438 - RNA, 23 nt, Human
ugaacaaagacguccacaguguu

SEQ ID NO: 96439 - RNA, 21 nt, Human
uggaaaacugagcugggacag

SEQ ID NO: 96440 - RNA, 19 nt, Human
uuaaucaucggaagcaaac

SEQ ID NO: 96441 - RNA, 24 nt, Human
acacagcggcacccgccggcuucc

SEQ ID NO: 96442 - RNA, 18 nt, Human
caaaggguugaauugguc

SEQ ID NO: 96443 - RNA, 19 nt, Human
ccucugagcuccggacagg

SEQ ID NO: 96444 - RNA, 26 nt, Human
cugaagccaaggcaguuugaguccau

SEQ ID NO: 96445 - RNA, 23 nt, Human
cuggaagugcuuuagcuucuuuc

SEQ ID NO: 96446 - RNA, 21 nt, Human
cuuuccuacacagcggcaccc

SEQ ID NO: 96447 - RNA, 18 nt, Human
ucuggaagugcuuuagcu

SEQ ID NO: 96448 - RNA, 21 nt, Human
ugacgggacuccccugaagcc

SEQ ID NO: 96449 - RNA, 22 nt, Human
aaaaaaauauaaucccacagca

SEQ ID NO: 96450 - RNA, 24 nt, Human
aaaaacagcuguuaucaagcacaa

SEQ ID NO: 96451 - RNA, 31 nt, Human
aaaagaaaaagcacagucuauucauccaggg

SEQ ID NO: 96452 - RNA, 23 nt, Human
aaacaguaaaucuucaucuuaac

SEQ ID NO: 96453 - RNA, 18 nt, Human
aaacugccaagagccaug

SEQ ID NO: 96454 - RNA, 24 nt, Human
aaauaaaaaacguuaaugaccuag

SEQ ID NO: 96455 - RNA, 26 nt, Human
aaauauugaaaaucaagugcgaaacu

SEQ ID NO: 96456 - RNA, 23 nt, Human
aacgaguaacaaagaaacaguaa

SEQ ID NO: 96457 - RNA, 22 nt, Human
aagaaaaagcacagucuauuca

SEQ ID NO: 96458 - RNA, 21 nt, Human
aagcacaaaauuuuaaucuaa

SEQ ID NO: 96459 - RNA, 24 nt, Human
aauaauguauauccuucuugccuc

SEQ ID NO: 96460 - RNA, 20 nt, Human
accuagaaaagcaaaagccc

SEQ ID NO: 96461 - RNA, 19 nt, Human
agaaaaagaaaaagcacag

SEQ ID NO: 96462 - RNA, 22 nt, Human
agagcuuaccuuucacugucuu

SEQ ID NO: 96463 - RNA, 27 nt, Human
agguguugugaaauuacauuggucacu

SEQ ID NO: 96464 - RNA, 18 nt, Human
auguacaaaugugcaagu

SEQ ID NO: 96465 - RNA, 22 nt, Human
caaacagcuguaccaacgagua

SEQ ID NO: 96466 - RNA, 26 nt, Human
cacagcagcagcuauuuaaaauaaga

SEQ ID NO: 96467 - RNA, 21 nt, Human
caugcuuauuauacuauggga

SEQ ID NO: 96468 - RNA, 22 nt, Human
ccccaagaaacuuugaagccag

SEQ ID NO: 96469 - RNA, 24 nt, Human
cgaccuuuccccaagaaacuuuga

SEQ ID NO: 96470 - RNA, 22 nt, Human
cgcaacgcucagucaaccccuc

SEQ ID NO: 96471 - RNA, 20 nt, Human
cgggagaaagcuaaggcucg

SEQ ID NO: 96472 - RNA, 21 nt, Human
cuaaauacagcaguaucugcc

SEQ ID NO: 96473 - RNA, 19 nt, Human
cuagaaaagcaaaagccca

SEQ ID NO: 96474 - RNA, 18 nt, Human
cucaaugacauaagaugc

SEQ ID NO: 96475 - RNA, 20 nt, Human
cucgcaacgcucagucaacc

SEQ ID NO: 96476 - RNA, 20 nt, Human
cugcaagaacaaaucagaug

SEQ ID NO: 96477 - RNA, 26 nt, Human
gaaaaagcacagucuauucauccagg

SEQ ID NO: 96478 - RNA, 22 nt, Human
gaaaagguuucuauauaccuuc

SEQ ID NO: 96479 - RNA, 24 nt, Human
gacaaucaguaaaaaucuacagua

SEQ ID NO: 96480 - RNA, 23 nt, Human
gaguaacaaagaaacaguaaauc

SEQ ID NO: 96481 - RNA, 21 nt, Human
ggaaaaaaaauauaaucccac

SEQ ID NO: 96482 - RNA, 24 nt, Human
gggagagaaaaagaaaaagcacag

SEQ ID NO: 96483 - RNA, 19 nt, Human
gggucgacccacgcguccg

SEQ ID NO: 96484 - RNA, 23 nt, Human
guaaaccucuaaaacugaagacg

SEQ ID NO: 96485 - RNA, 18 nt, Human
gugggucgacccacgcgu

SEQ ID NO: 96486 - RNA, 21 nt, Human
gugggucgacccacgcguccg

SEQ ID NO: 96487 - RNA, 23 nt, Human
guuauauuuggcauguuaaggaa

SEQ ID NO: 96488 - RNA, 24 nt, Human
guucaagauacgaaggcuuucaau

SEQ ID NO: 96489 - RNA, 24 nt, Human
uaaaaacuaacagccauggcacca

SEQ ID NO: 96490 - RNA, 22 nt, Human
uaaaacaaacagcuguaccaac

SEQ ID NO: 96491 - RNA, 19 nt, Human
uaaaccgaccuuuccccaa

SEQ ID NO: 96492 - RNA, 19 nt, Human
uaaacuacuuaaagccucu

SEQ ID NO: 96493 - RNA, 20 nt, Human
uaaacugccaagagccauga

SEQ ID NO: 96494 - RNA, 20 nt, Human
uaaagccucugcacuagucc

SEQ ID NO: 96495 - RNA, 20 nt, Human
uacucaagacagucuggugg

SEQ ID NO: 96496 - RNA, 25 nt, Human
uacuuuuuuuuaaaguacaaaggag

SEQ ID NO: 96497 - RNA, 20 nt, Human
uagaagaacaucugcaagaa

SEQ ID NO: 96498 - RNA, 20 nt, Human
uagaagaacaucugcaagaa

SEQ ID NO: 96499 - RNA, 22 nt, Human
uagaagaacaucugcaagaaca

SEQ ID NO: 96500 - RNA, 19 nt, Human
uauuuuggcuucagugagu

SEQ ID NO: 96501 - RNA, 28 nt, Human
ucaauccggacgcgugggucgacccacg

SEQ ID NO: 96502 - RNA, 21 nt, Human
ucuacaguaaccugaucaacc

SEQ ID NO: 96503 - RNA, 23 nt, Human
ucucaaugacauaagaugcuuua

SEQ ID NO: 96504 - RNA, 19 nt, Human
ugaaaugaaacaaagcagu

SEQ ID NO: 96505 - RNA, 21 nt, Human
ugaaaugacagccaaaaaucc

SEQ ID NO: 96506 - RNA, 24 nt, Human
ugaaaugacagccaaaaauccacc

SEQ ID NO: 96507 - RNA, 22 nt, Human
ugacagccaaaaauccaccuaa

SEQ ID NO: 96508 - RNA, 22 nt, Human
ugaccaauccuuaccuuccuua

SEQ ID NO: 96509 - RNA, 23 nt, Human
ugagguaaaccgaccuuucccca

SEQ ID NO: 96510 - RNA, 22 nt, Human
ugcaacaaauaucuguaaggua

SEQ ID NO: 96511 - RNA, 23 nt, Human
ugcaugcuuauuauacuauggga

SEQ ID NO: 96512 - RNA, 24 nt, Human
uggaauagcgucuuccauguggga

SEQ ID NO: 96513 - RNA, 23 nt, Human
uggauuuuaaaaaaacccaaaaa

SEQ ID NO: 96514 - RNA, 23 nt, Human
uggcaccauaauacauuuuguga

SEQ ID NO: 96515 - RNA, 24 nt, Human
uggcaccauaauacauuuugugag

SEQ ID NO: 96516 - RNA, 22 nt, Human
uggcucaagauacuacauugcu

SEQ ID NO: 96517 - RNA, 24 nt, Human
ugggagguucaagauacgaaggcu

SEQ ID NO: 96518 - RNA, 21 nt, Human
ugguacaugauacagauuggu

SEQ ID NO: 96519 - RNA, 26 nt, Human
uguuauguuuucacaaaauuugcuac

SEQ ID NO: 96520 - RNA, 21 nt, Human
uuaaagccucugcacuagucc

SEQ ID NO: 96521 - RNA, 22 nt, Human
uuaaagccucugcacuagucca

SEQ ID NO: 96522 - RNA, 18 nt, Human
uuccaucacuuucagaaa

SEQ ID NO: 96523 - RNA, 21 nt, Human
uucuggauuuuaaaaaaaccc

SEQ ID NO: 96524 - RNA, 18 nt, Human
uucuucucaauucuguuc

SEQ ID NO: 96525 - RNA, 21 nt, Human
uuuaaaauaagacagccacag

SEQ ID NO: 96526 - RNA, 18 nt, Human
uuugauagaagaacaucu

SEQ ID NO: 96527 - RNA, 21 nt, Human
uuuuaaacuacuuaaagccuc

SEQ ID NO: 96528 - RNA, 19 nt, Human
aaaauuagaaggaaagggg

SEQ ID NO: 96529 - RNA, 18 nt, Human
aaacaagcaaaaauaaca

SEQ ID NO: 96530 - RNA, 18 nt, Human
aacuuauucaccuucccc

SEQ ID NO: 96531 - RNA, 24 nt, Human
aagcaaaaauaacaaaauuuuuac

SEQ ID NO: 96532 - RNA, 23 nt, Human
aagucccagaacccaggucagaa

SEQ ID NO: 96533 - RNA, 23 nt, Human
aauccacuccuucaaaaacccug

SEQ ID NO: 96534 - RNA, 21 nt, Human
acaaagaaaauccacuccuuc

SEQ ID NO: 96535 - RNA, 22 nt, Human
acaaagaaaauccacuccuuca

SEQ ID NO: 96536 - RNA, 21 nt, Human
accaaccuccaacuuauucac

SEQ ID NO: 96537 - RNA, 22 nt, Human
accccaaaaggagaagggugac

SEQ ID NO: 96538 - RNA, 23 nt, Human
agaaacaagcaaaaauaacaaaa

SEQ ID NO: 96539 - RNA, 19 nt, Human
agaacaacaaauccugcaa

SEQ ID NO: 96540 - RNA, 21 nt, Human
agaaggaaaggggggaucuaa

SEQ ID NO: 96541 - RNA, 18 nt, Human
agagcauaaagugaaaug

SEQ ID NO: 96542 - RNA, 18 nt, Human
aggaagagacugcuuccc

SEQ ID NO: 96543 - RNA, 19 nt, Human
aggagaagggugacgagga

SEQ ID NO: 96544 - RNA, 21 nt, Human
auuugcagauguuauuuccuu

SEQ ID NO: 96545 - RNA, 23 nt, Human
auuuuuacaaagagaguugagag

SEQ ID NO: 96546 - RNA, 19 nt, Human
caacaaagaaaauccacuc

SEQ ID NO: 96547 - RNA, 18 nt, Human
caacagacaaaccucccc

SEQ ID NO: 96548 - RNA, 19 nt, Human
cacgauguguucaggugug

SEQ ID NO: 96549 - RNA, 27 nt, Human
cacgauguguucagguguggcguagcg

SEQ ID NO: 96550 - RNA, 20 nt, Human
cacucuguccuuuucaauau

SEQ ID NO: 96551 - RNA, 25 nt, Human
cacucuguccuuuucaauauuuucc

SEQ ID NO: 96552 - RNA, 27 nt, Human
cacucuguccuuuucaauauuuuccca

SEQ ID NO: 96553 - RNA, 19 nt, Human
cagaacaacaaauccugca

SEQ ID NO: 96554 - RNA, 24 nt, Human
caggucagaacaacaaauccugca

SEQ ID NO: 96555 - RNA, 22 nt, Human
caggugugucuggagcccuugg

SEQ ID NO: 96556 - RNA, 22 nt, Human
ccaacuuauucaccuuccccua

SEQ ID NO: 96557 - RNA, 24 nt, Human
ccagaacccaggucagaacaacaa

SEQ ID NO: 96558 - RNA, 22 nt, Human
ccccauuccaucuggagauaaa

SEQ ID NO: 96559 - RNA, 19 nt, Human
ccucugguucugacucucu

SEQ ID NO: 96560 - RNA, 22 nt, Human
cugcaacaaagaaaauccacuc

SEQ ID NO: 96561 - RNA, 22 nt, Human
cugcuggucucucaccccaaaa

SEQ ID NO: 96562 - RNA, 23 nt, Human
cuuauucaccuuccccuaauuca

SEQ ID NO: 96563 - RNA, 22 nt, Human
cuucccacuuguaagucaggga

SEQ ID NO: 96564 - RNA, 21 nt, Human
gaacccaggucagaacaacaa

SEQ ID NO: 96565 - RNA, 19 nt, Human
gagcacaguuagcaaagua

SEQ ID NO: 96566 - RNA, 23 nt, Human
gagcacaguuagcaaaguacggc

SEQ ID NO: 96567 - RNA, 20 nt, Human
guugcuaggaccccauucca

SEQ ID NO: 96568 - RNA, 18 nt, Human
uaucuaaaacaggccuga

SEQ ID NO: 96569 - RNA, 23 nt, Human
uauucucuuccccugucucuuca

SEQ ID NO: 96570 - RNA, 22 nt, Human
ucauuaaucagaaacaagcaaa

SEQ ID NO: 96571 - RNA, 19 nt, Human
uccaaacaaaccuacccca

SEQ ID NO: 96572 - RNA, 22 nt, Human
uccaaacaaaccuaccccacga

SEQ ID NO: 96573 - RNA, 23 nt, Human
ucccagaacccaggucagaacaa

SEQ ID NO: 96574 - RNA, 21 nt, Human
ucccauguauucucuuccccu

SEQ ID NO: 96575 - RNA, 23 nt, Human
uccccugucucuucagccccuua

SEQ ID NO: 96576 - RNA, 24 nt, Human
uccccugucucuucagccccuuac

SEQ ID NO: 96577 - RNA, 18 nt, Human
ucccucugguucugacuc

SEQ ID NO: 96578 - RNA, 18 nt, Human
uccucucuguuccagcuu

SEQ ID NO: 96579 - RNA, 21 nt, Human
ucucuauucugacuucuuucu

SEQ ID NO: 96580 - RNA, 23 nt, Human
ucuguccuuuucaauauuuuccc

SEQ ID NO: 96581 - RNA, 21 nt, Human
ucuuugauuucuguuccaaac

SEQ ID NO: 96582 - RNA, 22 nt, Human
ugaaaagccacuuaaccacuaa

SEQ ID NO: 96583 - RNA, 21 nt, Human
ugacgaggaggcucauggugu

SEQ ID NO: 96584 - RNA, 19 nt, Human
ugagaacauguuucaugca

SEQ ID NO: 96585 - RNA, 29 nt, Human
ugcaaugaagaagaggaagugaggagcac

SEQ ID NO: 96586 - RNA, 21 nt, Human
ugcccaaugcucccauguccc

SEQ ID NO: 96587 - RNA, 19 nt, Human
ugcuauggaacaagucuga

SEQ ID NO: 96588 - RNA, 21 nt, Human
uggaacaagucugauguggca

SEQ ID NO: 96589 - RNA, 20 nt, Human
uggcucccagugugcugccc

SEQ ID NO: 96590 - RNA, 19 nt, Human
uguacuuugcauugaagga

SEQ ID NO: 96591 - RNA, 25 nt, Human
uuaaucagaaacaagcaaaaauaac

SEQ ID NO: 96592 - RNA, 23 nt, Human
uuagaaggaaaggggggaucucc

SEQ ID NO: 96593 - RNA, 24 nt, Human
uucaacacagaguuuuauugagaa

SEQ ID NO: 96594 - RNA, 23 nt, Human
uucaggugugucuggagcccuug

SEQ ID NO: 96595 - RNA, 23 nt, Human
uuccaaacaaaccuaccccacga

SEQ ID NO: 96596 - RNA, 21 nt, Human
uuccccugucucuucagcccc

SEQ ID NO: 96597 - RNA, 18 nt, Human
uugaacauguggagguug

SEQ ID NO: 96598 - RNA, 20 nt, Human
augggagaggagacaugaug

SEQ ID NO: 96599 - RNA, 20 nt, Human
gaaugggagaggagacauga

SEQ ID NO: 96600 - RNA, 20 nt, Human
uaauaaauuuacaguuuuaa

SEQ ID NO: 96601 - RNA, 23 nt, Human
ugggagaggagacaugaugaugg

SEQ ID NO: 96602 - RNA, 21 nt, Human
uuaauguguguaaaaucaggg

SEQ ID NO: 96603 - RNA, 22 nt, Human
uuugcugauguuuaaauaauaa

SEQ ID NO: 96604 - RNA, 20 nt, Human
augcagaaagagaaacaauu

SEQ ID NO: 96605 - RNA, 20 nt, Human
cuccuggguugcuggguucu

SEQ ID NO: 96606 - RNA, 21 nt, Human
uaugcagaaagagaaacaauu

SEQ ID NO: 96607 - RNA, 19 nt, Human
uugguuuuuauuaacaaau

SEQ ID NO: 96608 - RNA, 23 nt, Human
uuuuuuuuuuuuuuuugguuuuu

SEQ ID NO: 96609 - RNA, 29 nt, Human
aaccuuuuaaaaucaggcauguucgcuga

SEQ ID NO: 96610 - RNA, 23 nt, Human
aauuccuuuuucuauauuuccac

SEQ ID NO: 96611 - RNA, 22 nt, Human
accccggcagcccuccucgcug

SEQ ID NO: 96612 - RNA, 19 nt, Human
acucagaaccugggcugca

SEQ ID NO: 96613 - RNA, 24 nt, Human
agaccaggacugaagucuuaggaa

SEQ ID NO: 96614 - RNA, 21 nt, Human
agagguccuggguuccagaga

SEQ ID NO: 96615 - RNA, 19 nt, Human
agccaauucccaagcccag

SEQ ID NO: 96616 - RNA, 21 nt, Human
agcccagaccccggcagcccu

SEQ ID NO: 96617 - RNA, 18 nt, Human
caacugccaauaugacau

SEQ ID NO: 96618 - RNA, 21 nt, Human
caagguaucucuccuaucuuc

SEQ ID NO: 96619 - RNA, 22 nt, Human
caaucuaucuccaacucaucuc

SEQ ID NO: 96620 - RNA, 23 nt, Human
cacccuaaccuuuugacugaucu

SEQ ID NO: 96621 - RNA, 23 nt, Human
caccgucaccaucacccuaaccu

SEQ ID NO: 96622 - RNA, 20 nt, Human
cacucacaucagcucuuacc

SEQ ID NO: 96623 - RNA, 20 nt, Human
cacucuucucccccgccgcu

SEQ ID NO: 96624 - RNA, 23 nt, Human
cacucuucucccccgccgcucaa

SEQ ID NO: 96625 - RNA, 19 nt, Human
cagaucccaucacacacac

SEQ ID NO: 96626 - RNA, 21 nt, Human
cagccaauucccaagcccaga

SEQ ID NO: 96627 - RNA, 21 nt, Human
ccaccgucaccaucacccuaa

SEQ ID NO: 96628 - RNA, 22 nt, Human
ccagaccccggcagcccuccuc

SEQ ID NO: 96629 - RNA, 18 nt, Human
ccagagacacagaugugg

SEQ ID NO: 96630 - RNA, 18 nt, Human
cccaagcccagaccccgg

SEQ ID NO: 96631 - RNA, 24 nt, Human
cccaagcccagaccccggcagccc

SEQ ID NO: 96632 - RNA, 18 nt, Human
cccucucccucacucuuu

SEQ ID NO: 96633 - RNA, 20 nt, Human
ccgcccucugaccugcgcac

SEQ ID NO: 96634 - RNA, 18 nt, Human
ccucacucuuuuuaucca

SEQ ID NO: 96635 - RNA, 18 nt, Human
ccucccucucccucacuc

SEQ ID NO: 96636 - RNA, 20 nt, Human
ccucccucucccucacucuu

SEQ ID NO: 96637 - RNA, 23 nt, Human
ccucuugaauaaauuccuuuuuc

SEQ ID NO: 96638 - RNA, 19 nt, Human
ccugacaccucccucuccc

SEQ ID NO: 96639 - RNA, 21 nt, Human
ccuggaggaaaagacuccucu

SEQ ID NO: 96640 - RNA, 27 nt, Human
cucaucucuauuucacuucuuuuugaa

SEQ ID NO: 96641 - RNA, 25 nt, Human
cucccucucccucacucuuuuuauc

SEQ ID NO: 96642 - RNA, 20 nt, Human
cucugaccugcgcacucuuc

SEQ ID NO: 96643 - RNA, 23 nt, Human
cucuuuggcaacucagaaccugg

SEQ ID NO: 96644 - RNA, 20 nt, Human
cugaaguagcauucuugggu

SEQ ID NO: 96645 - RNA, 24 nt, Human
gaccaggacugaagucuuaggaac

SEQ ID NO: 96646 - RNA, 23 nt, Human
gaccccggcagcccuccucgcug

SEQ ID NO: 96647 - RNA, 19 nt, Human
gauacaaguuugcacaccu

SEQ ID NO: 96648 - RNA, 21 nt, Human
gcugcagccugacaccucccu

SEQ ID NO: 96649 - RNA, 22 nt, Human
gggcugcagccugacaccuccc

SEQ ID NO: 96650 - RNA, 20 nt, Human
guguaauuuuugaaaaagaa

SEQ ID NO: 96651 - RNA, 19 nt, Human
uaaaagacacacaaacucc

SEQ ID NO: 96652 - RNA, 22 nt, Human
uacagaucccaucacacacacu

SEQ ID NO: 96653 - RNA, 19 nt, Human
uauaaccuaacuuucuuuu

SEQ ID NO: 96654 - RNA, 22 nt, Human
uauccaaucuaucuccaacuca

SEQ ID NO: 96655 - RNA, 22 nt, Human
uaucuccaacucaucucuauuu

SEQ ID NO: 96656 - RNA, 27 nt, Human
uauuuccaccgucaccaucacccuaac

SEQ ID NO: 96657 - RNA, 18 nt, Human
ucagaaccugggcugcag

SEQ ID NO: 96658 - RNA, 18 nt, Human
uccaacugccaauaugac

SEQ ID NO: 96659 - RNA, 24 nt, Human
uccagggcaaacuuuuuauaaaag

SEQ ID NO: 96660 - RNA, 19 nt, Human
ucccaggaauccuggcgcc

SEQ ID NO: 96661 - RNA, 20 nt, Human
ucccuuuccgcugggugcca

SEQ ID NO: 96662 - RNA, 19 nt, Human
ugaaaaacgguuaaagcca

SEQ ID NO: 96663 - RNA, 22 nt, Human
ugaccugcgcacucuucucccc

SEQ ID NO: 96664 - RNA, 24 nt, Human
ugguaggucuucagauacaaguuu

SEQ ID NO: 96665 - RNA, 19 nt, Human
uguaguguaauuuuugaaa

SEQ ID NO: 96666 - RNA, 23 nt, Human
uucacaaccggcgugucucaauu

SEQ ID NO: 96667 - RNA, 19 nt, Human
uuccuggaggaaaagacuc

SEQ ID NO: 96668 - RNA, 23 nt, Human
uucgcugaaaauccagauuucca

SEQ ID NO: 96669 - RNA, 19 nt, Human
uucugauuucacagagcca

SEQ ID NO: 96670 - RNA, 21 nt, Human
uugaaaaacgguuaaagccaa

SEQ ID NO: 96671 - RNA, 20 nt, Human
uuugacugaucuccugaagu

SEQ ID NO: 96672 - RNA, 22 nt, Human
uuugucaucagucaguagguau

SEQ ID NO: 96673 - RNA, 19 nt, Human
aaaaacuccagauguugac

SEQ ID NO: 96674 - RNA, 21 nt, Human
agaccaaaaacuccagauguu

SEQ ID NO: 96675 - RNA, 23 nt, Human
cacaugaccugagaggggacaag

SEQ ID NO: 96676 - RNA, 21 nt, Human
caugaccugagaggggacaag

SEQ ID NO: 96677 - RNA, 23 nt, Human
cuugcaaucacacuuauauugcu

SEQ ID NO: 96678 - RNA, 20 nt, Human
gagaccaaaaacuccagaug

SEQ ID NO: 96679 - RNA, 21 nt, Human
gagggcagaaauccacagugc

SEQ ID NO: 96680 - RNA, 18 nt, Human
ggagggcagaaauccaca

SEQ ID NO: 96681 - RNA, 23 nt, Human
guggcccacagccucaggaggug

SEQ ID NO: 96682 - RNA, 25 nt, Human
ucucuaagauuucugugcucggucc

SEQ ID NO: 96683 - RNA, 22 nt, Human
ucucugaggagaccaaaaacuc

SEQ ID NO: 96684 - RNA, 24 nt, Human
ucuugcaaucacacuuauauugcu

SEQ ID NO: 96685 - RNA, 24 nt, Human
ugaggagaccaaaaacuccagaug

SEQ ID NO: 96686 - RNA, 19 nt, Human
ugcuuguagugagacccag

SEQ ID NO: 96687 - RNA, 23 nt, Human
uggcccacagccucaggagguga

SEQ ID NO: 96688 - RNA, 22 nt, Human
uguucugcacacagaaaacacc

SEQ ID NO: 96689 - RNA, 24 nt, Human
uuauauugcuucuccuuacuggug

SEQ ID NO: 96690 - RNA, 27 nt, Human
uucacuuuuacucacaggauggugggc

SEQ ID NO: 96691 - RNA, 24 nt, Human
uucuccuuacuggugugauggagc

SEQ ID NO: 96692 - RNA, 22 nt, Human
uuuacucacaggauggugggca

SEQ ID NO: 96693 - RNA, 20 nt, Human
aaggaacuguagcuuaaaag

SEQ ID NO: 96694 - RNA, 22 nt, Human
aaggauggagagaaggaacugu

SEQ ID NO: 96695 - RNA, 25 nt, Human
caccccacucucccccaguguccag

SEQ ID NO: 96696 - RNA, 22 nt, Human
cacucucccccaguguccagaa

SEQ ID NO: 96697 - RNA, 21 nt, Human
ccaguguccagaacuccugcu

SEQ ID NO: 96698 - RNA, 20 nt, Human
uaaaagggggugaaguucug

SEQ ID NO: 96699 - RNA, 21 nt, Human
aagaacacaagcucuacacca

SEQ ID NO: 96700 - RNA, 22 nt, Human
aagaacacaagcucuacaccag

SEQ ID NO: 96701 - RNA, 23 nt, Human
aagaacacaagcucuacaccagg

SEQ ID NO: 96702 - RNA, 22 nt, Human
aagcuccaaggaugggccaaga

SEQ ID NO: 96703 - RNA, 23 nt, Human
agaaggacagaauaagacccagg

SEQ ID NO: 96704 - RNA, 18 nt, Human
agcuccaaggaugggcca

SEQ ID NO: 96705 - RNA, 19 nt, Human
aggcugaggcuagcaggga

SEQ ID NO: 96706 - RNA, 23 nt, Human
auacaacauaccaagcccgcccc

SEQ ID NO: 96707 - RNA, 24 nt, Human
auggagccuccaugcccucucugg

SEQ ID NO: 96708 - RNA, 18 nt, Human
caaccagcaaguccccag

SEQ ID NO: 96709 - RNA, 20 nt, Human
cagccaaauggaagacaugu

SEQ ID NO: 96710 - RNA, 19 nt, Human
ccuaaaugcaucccacuca

SEQ ID NO: 96711 - RNA, 19 nt, Human
cgcccccuaaaugcauccc

SEQ ID NO: 96712 - RNA, 19 nt, Human
gacagggcagcuacacaug

SEQ ID NO: 96713 - RNA, 19 nt, Human
gagccuccaugcccucucu

SEQ ID NO: 96714 - RNA, 24 nt, Human
gcccgcccccuaaaugcaucccac

SEQ ID NO: 96715 - RNA, 22 nt, Human
ggacuccuggggaccacagcuu

SEQ ID NO: 96716 - RNA, 21 nt, Human
ggaugccauugguugacuggg

SEQ ID NO: 96717 - RNA, 24 nt, Human
ggauucauacaacauaccaagccc

SEQ ID NO: 96718 - RNA, 23 nt, Human
gguccaaggauggagagaagaag

SEQ ID NO: 96719 - RNA, 21 nt, Human
uaaagcuccaaggaugggcca

SEQ ID NO: 96720 - RNA, 19 nt, Human
uaaaugcaucccacucagg

SEQ ID NO: 96721 - RNA, 21 nt, Human
uacacaugaauccaaauaguc

SEQ ID NO: 96722 - RNA, 24 nt, Human
ucacuuauaaagcuccaaggauug

SEQ ID NO: 96723 - RNA, 18 nt, Human
uccuggggaccacagcuu

SEQ ID NO: 96724 - RNA, 19 nt, Human
ucucagggcauuugugaag

SEQ ID NO: 96725 - RNA, 21 nt, Human
ucuccaaaaggaacagagagu

SEQ ID NO: 96726 - RNA, 24 nt, Human
ucuccaaaaggaacagagagugga

SEQ ID NO: 96727 - RNA, 20 nt, Human
ugagcagaugguaguuugca

SEQ ID NO: 96728 - RNA, 24 nt, Human
ugagcagaugguaguuugcaugga

SEQ ID NO: 96729 - RNA, 19 nt, Human
uggaagacauguauaggac

SEQ ID NO: 96730 - RNA, 24 nt, Human
uggaaguugagcagaugguaguuu

SEQ ID NO: 96731 - RNA, 18 nt, Human
uggggguggaagagguug

SEQ ID NO: 96732 - RNA, 24 nt, Human
uggggguggaagagguuguaugga

SEQ ID NO: 96733 - RNA, 18 nt, Human
ugugaagguccaaggaug

SEQ ID NO: 96734 - RNA, 21 nt, Human
uuccagccugcaagaugagcu

SEQ ID NO: 96735 - RNA, 21 nt, Human
uuggaggcaucagaaggacag

SEQ ID NO: 96736 - RNA, 20 nt, Human
aauccacaccagugugucca

SEQ ID NO: 96737 - RNA, 19 nt, Human
acuucccuggcccccgcug

SEQ ID NO: 96738 - RNA, 19 nt, Human
agagauggagaagggaagg

SEQ ID NO: 96739 - RNA, 20 nt, Human
agauggccagugggcuggug

SEQ ID NO: 96740 - RNA, 21 nt, Human
agcaaggagaguggaagagaa

SEQ ID NO: 96741 - RNA, 28 nt, Human
aggaagccauguggcgguggugaccuca

SEQ ID NO: 96742 - RNA, 20 nt, Human
aggccaggacugggccccuu

SEQ ID NO: 96743 - RNA, 24 nt, Human
cacgcaggaggaagccauguggcg

SEQ ID NO: 96744 - RNA, 19 nt, Human
ccaaaaagacuggcucuga

SEQ ID NO: 96745 - RNA, 22 nt, Human
ccagugccucugcugcagccca

SEQ ID NO: 96746 - RNA, 22 nt, Human
ccccagugccucugcugcagcc

SEQ ID NO: 96747 - RNA, 26 nt, Human
cccccagugccucugcugcagcccau

SEQ ID NO: 96748 - RNA, 23 nt, Human
ccccgcugcccccagugccucug

SEQ ID NO: 96749 - RNA, 23 nt, Human
cucagaggcagaaacugggcaua

SEQ ID NO: 96750 - RNA, 19 nt, Human
cucugcugcagcccaucca

SEQ ID NO: 96751 - RNA, 19 nt, Human
cugcccccagugccucugc

SEQ ID NO: 96752 - RNA, 18 nt, Human
cugcugcagcccauccag

SEQ ID NO: 96753 - RNA, 18 nt, Human
cuggggaaacucggggac

SEQ ID NO: 96754 - RNA, 22 nt, Human
gagauggccagugggcuggugg

SEQ ID NO: 96755 - RNA, 18 nt, Human
gaggcagaaacugggcau

SEQ ID NO: 96756 - RNA, 23 nt, Human
gcagcuccggguggagauggcca

SEQ ID NO: 96757 - RNA, 21 nt, Human
gcaggaggaagccauguggcg

SEQ ID NO: 96758 - RNA, 19 nt, Human
gccauguggcggugucugg

SEQ ID NO: 96759 - RNA, 21 nt, Human
ggaagagaacaggggcaggag

SEQ ID NO: 96760 - RNA, 20 nt, Human
ggacugggccccuuucuacu

SEQ ID NO: 96761 - RNA, 23 nt, Human
ggagaagccaggccaggacuggg

SEQ ID NO: 96762 - RNA, 22 nt, Human
ggaggugugcaugucagggcag

SEQ ID NO: 96763 - RNA, 21 nt, Human
ggagguuugggguuacccuca

SEQ ID NO: 96764 - RNA, 20 nt, Human
ggcugguggggcaggggagg

SEQ ID NO: 96765 - RNA, 21 nt, Human
gggcaggaguuuuggagguuu

SEQ ID NO: 96766 - RNA, 23 nt, Human
gguagcaaggagaguggaagaga

SEQ ID NO: 96767 - RNA, 24 nt, Human
ggugucuggggaaacucggggacu

SEQ ID NO: 96768 - RNA, 18 nt, Human
guccuuuucugggcuuuc

SEQ ID NO: 96769 - RNA, 19 nt, Human
gugcaaugccucacuucca

SEQ ID NO: 96770 - RNA, 23 nt, Human
gugugugugugugcgugugugug

SEQ ID NO: 96771 - RNA, 21 nt, Human
gugugugugugugugugcgug

SEQ ID NO: 96772 - RNA, 19 nt, Human
gugugugugugugugugug

SEQ ID NO: 96773 - RNA, 22 nt, Human
uagcaaggagaguggaagagaa

SEQ ID NO: 96774 - RNA, 22 nt, Human
ucagaggcagaaacugggcaua

SEQ ID NO: 96775 - RNA, 22 nt, Human
ucagggguagagggccagagag

SEQ ID NO: 96776 - RNA, 22 nt, Human
uccacaccaguguguccaucuc

SEQ ID NO: 96777 - RNA, 18 nt, Human
uccccgugcaaugccuca

SEQ ID NO: 96778 - RNA, 19 nt, Human
uccccgugcaaugccucac

SEQ ID NO: 96779 - RNA, 21 nt, Human
uccccgugcaaugccucacuu

SEQ ID NO: 96780 - RNA, 23 nt, Human
ucccucagaggcagaaacugggc

SEQ ID NO: 96781 - RNA, 18 nt, Human
ucccuggcccccgcugcc

SEQ ID NO: 96782 - RNA, 23 nt, Human
ucuguccuuuucugggcuuuccc

SEQ ID NO: 96783 - RNA, 19 nt, Human
ugaguggggaugucagauc

SEQ ID NO: 96784 - RNA, 20 nt, Human
ugagugugugugugugugug

SEQ ID NO: 96785 - RNA, 18 nt, Human
ugauacguacgucucccc

SEQ ID NO: 96786 - RNA, 22 nt, Human
uggagguuugggguuacccuca

SEQ ID NO: 96787 - RNA, 25 nt, Human
uggguagcaaggagaguggaagaga

SEQ ID NO: 96788 - RNA, 23 nt, Human
ugugagcucugucucccuggcag

SEQ ID NO: 96789 - RNA, 21 nt, Human
ugugcgugugugugugugugu

SEQ ID NO: 96790 - RNA, 21 nt, Human
ugugcgugugugugugugugu

SEQ ID NO: 96791 - RNA, 19 nt, Human
ugugugcgugugugugugu

SEQ ID NO: 96792 - RNA, 21 nt, Human
ugugugcgugugugugugugu

SEQ ID NO: 96793 - RNA, 21 nt, Human
ugugugugcgugugugugugu

SEQ ID NO: 96794 - RNA, 21 nt, Human
ugugugugcgugugugugugu

SEQ ID NO: 96795 - RNA, 21 nt, Human
ugugugugcgugugugugugu

SEQ ID NO: 96796 - RNA, 25 nt, Human
ugugugugcgugugugugugugugu

SEQ ID NO: 96797 - RNA, 21 nt, Human
ugugugugugcgugugugugu

SEQ ID NO: 96798 - RNA, 25 nt, Human
ugugugugugcgugugugugugugu

SEQ ID NO: 96799 - RNA, 18 nt, Human
ugugugugugugcgcaca

SEQ ID NO: 96800 - RNA, 19 nt, Human
ugugugugugugcgcacau

SEQ ID NO: 96801 - RNA, 20 nt, Human
ugugugugugugcgugugug

SEQ ID NO: 96802 - RNA, 25 nt, Human
ugugugugugugcgugugugugugu

SEQ ID NO: 96803 - RNA, 21 nt, Human
ugugugugugugugcgcacau

SEQ ID NO: 96804 - RNA, 21 nt, Human
ugugugugugugugcgugugu

SEQ ID NO: 96805 - RNA, 21 nt, Human
ugugugugugugugcgugugu

SEQ ID NO: 96806 - RNA, 18 nt, Human
ugugugugugugugugcg

SEQ ID NO: 96807 - RNA, 23 nt, Human
ugugugugugugugugcgcacau

SEQ ID NO: 96808 - RNA, 23 nt, Human
uuccaaaggagaagccaggccag

SEQ ID NO: 96809 - RNA, 19 nt, Human
uucugggcuuucccucaga

SEQ ID NO: 96810 - RNA, 26 nt, Human
aaacaagugacagcuugaaaaucagg

SEQ ID NO: 96811 - RNA, 22 nt, Human
aacaugguuucugagaggccuc

SEQ ID NO: 96812 - RNA, 19 nt, Human
aagaagccaaauggauuuc

SEQ ID NO: 96813 - RNA, 24 nt, Human
aagccacuucuaugaagaagccaa

SEQ ID NO: 96814 - RNA, 20 nt, Human
acaaccuaaccccuccaccc

SEQ ID NO: 96815 - RNA, 18 nt, Human
acuccugugccgucaucc

SEQ ID NO: 96816 - RNA, 18 nt, Human
agagaggggagaaaagga

SEQ ID NO: 96817 - RNA, 22 nt, Human
agagaugggcuugcuuugcacc

SEQ ID NO: 96818 - RNA, 19 nt, Human
aggaaaauugaagaaccag

SEQ ID NO: 96819 - RNA, 18 nt, Human
aggcuuugugcaguauca

SEQ ID NO: 96820 - RNA, 20 nt, Human
agguaugagaugcagggaga

SEQ ID NO: 96821 - RNA, 20 nt, Human
caaccuaaccccuccaccca

SEQ ID NO: 96822 - RNA, 18 nt, Human
caagugacagcuugaaaa

SEQ ID NO: 96823 - RNA, 23 nt, Human
caaugcgucuucauaaaucaaac

SEQ ID NO: 96824 - RNA, 21 nt, Human
caccccaccagacucucugcc

SEQ ID NO: 96825 - RNA, 21 nt, Human
cacugugccaauucccaaagc

SEQ ID NO: 96826 - RNA, 22 nt, Human
cagagucacagcccugcucccc

SEQ ID NO: 96827 - RNA, 18 nt, Human
cagcugccugagcccucc

SEQ ID NO: 96828 - RNA, 18 nt, Human
cauuaucauuccuuccuc

SEQ ID NO: 96829 - RNA, 18 nt, Human
cauucaugucugaucugu

SEQ ID NO: 96830 - RNA, 22 nt, Human
ccaggcccuggcccccacccac

SEQ ID NO: 96831 - RNA, 19 nt, Human
ccccacccacgugcagaac

SEQ ID NO: 96832 - RNA, 21 nt, Human
ccccacccacgugcagaaccu

SEQ ID NO: 96833 - RNA, 22 nt, Human
ccccuccacccauucaugucug

SEQ ID NO: 96834 - RNA, 27 nt, Human
ccccuccaccccaccagacucucugcc

SEQ ID NO: 96835 - RNA, 18 nt, Human
ccccugguggccaacugg

SEQ ID NO: 96836 - RNA, 19 nt, Human
ccuccacccauucaugucu

SEQ ID NO: 96837 - RNA, 18 nt, Human
ccuccaccccaccagacu

SEQ ID NO: 96838 - RNA, 21 nt, Human
cugagucaccauuaucauucc

SEQ ID NO: 96839 - RNA, 18 nt, Human
cugccagccaguucacag

SEQ ID NO: 96840 - RNA, 20 nt, Human
cuuugcaccaucuacucucc

SEQ ID NO: 96841 - RNA, 19 nt, Human
gaacaaauuuccauauccu

SEQ ID NO: 96842 - RNA, 20 nt, Human
gaguaaagcccaggcccugg

SEQ ID NO: 96843 - RNA, 20 nt, Human
gccagccccuccaccccacc

SEQ ID NO: 96844 - RNA, 21 nt, Human
gccucuuccucugggaagcca

SEQ ID NO: 96845 - RNA, 24 nt, Human
gggaaucucgaugcuaauaacauc

SEQ ID NO: 96846 - RNA, 21 nt, Human
gguaugagaugcagggagaaa

SEQ ID NO: 96847 - RNA, 23 nt, Human
uaauaacaucacuuacauaacac

SEQ ID NO: 96848 - RNA, 23 nt, Human
uaccauggacaaagcuggucuca

SEQ ID NO: 96849 - RNA, 25 nt, Human
ucaaaacaaaauauagaacaagaac

SEQ ID NO: 96850 - RNA, 23 nt, Human
ucagcaagaggacgauggggagc

SEQ ID NO: 96851 - RNA, 19 nt, Human
ucagcaugugcucugggug

SEQ ID NO: 96852 - RNA, 19 nt, Human
ucagccagagucacagccc

SEQ ID NO: 96853 - RNA, 19 nt, Human
uccacaggacagaggggcc

SEQ ID NO: 96854 - RNA, 22 nt, Human
ucccaguucacccuugucgcuu

SEQ ID NO: 96855 - RNA, 22 nt, Human
ucuagaaaugcagucaacccag

SEQ ID NO: 96856 - RNA, 20 nt, Human
ucuauagagacuccugugcc

SEQ ID NO: 96857 - RNA, 20 nt, Human
ucugaucuguaaauuggaag

SEQ ID NO: 96858 - RNA, 20 nt, Human
ucugaucuguaaauuggaag

SEQ ID NO: 96859 - RNA, 22 nt, Human
ucugaucuguaaauuggaagau

SEQ ID NO: 96860 - RNA, 23 nt, Human
ucugaucuguaaauuggaagaua

SEQ ID NO: 96861 - RNA, 22 nt, Human
ugaagaagccaaauggauuucu

SEQ ID NO: 96862 - RNA, 18 nt, Human
ugaguaaguccucuccca

SEQ ID NO: 96863 - RNA, 22 nt, Human
ugaguaaguccucucccaguuc

SEQ ID NO: 96864 - RNA, 24 nt, Human
ugcagucaacccagagaggggaga

SEQ ID NO: 96865 - RNA, 22 nt, Human
ugccucauucucagcccucagc

SEQ ID NO: 96866 - RNA, 25 nt, Human
ugcuuugcaccaucuacucucccuu

SEQ ID NO: 96867 - RNA, 21 nt, Human
uggauuucuaacaaugcgucu

SEQ ID NO: 96868 - RNA, 22 nt, Human
ugggaagccacuucuaugaaga

SEQ ID NO: 96869 - RNA, 18 nt, Human
ugugagcugacaaggccg

SEQ ID NO: 96870 - RNA, 19 nt, Human
uguugaaaugucuggccug

SEQ ID NO: 96871 - RNA, 22 nt, Human
uucaaaacaaaauauagaacaa

SEQ ID NO: 96872 - RNA, 24 nt, Human
uuccuuccucuugcuuuggaagau

SEQ ID NO: 96873 - RNA, 25 nt, Human
uuuccugggcucagccagagucaca

SEQ ID NO: 96874 - RNA, 19 nt, Human
aaaaacucuccagcucugu

SEQ ID NO: 96875 - RNA, 21 nt, Human
aaacagcauuaaauaggaacu

SEQ ID NO: 96876 - RNA, 19 nt, Human
aaacauaugaaacaggaaa

SEQ ID NO: 96877 - RNA, 18 nt, Human
aaaggagcucucaccagg

SEQ ID NO: 96878 - RNA, 18 nt, Human
aaagugcugggauuacaa

SEQ ID NO: 96879 - RNA, 24 nt, Human
aaagugcugggauuacaagcauga

SEQ ID NO: 96880 - RNA, 24 nt, Human
aacuuaccccguuuaacccacuaa

SEQ ID NO: 96881 - RNA, 20 nt, Human
aagaaccuucuugggacuca

SEQ ID NO: 96882 - RNA, 23 nt, Human
aagaaccuucuugggacucaucc

SEQ ID NO: 96883 - RNA, 24 nt, Human
aagcgauucucaugccucagccuc

SEQ ID NO: 96884 - RNA, 19 nt, Human
aagugcugggauuacaagc

SEQ ID NO: 96885 - RNA, 21 nt, Human
aagugcugggauuacaagcau

SEQ ID NO: 96886 - RNA, 26 nt, Human
aagugcugggauuacaagcaugagcc

SEQ ID NO: 96887 - RNA, 19 nt, Human
acacugaagucucaugaca

SEQ ID NO: 96888 - RNA, 19 nt, Human
accaccgccaccauccccu

SEQ ID NO: 96889 - RNA, 27 nt, Human
acccugaaacauaugaaacaggaaagc

SEQ ID NO: 96890 - RNA, 23 nt, Human
accucggccucccaaagugcugg

SEQ ID NO: 96891 - RNA, 20 nt, Human
accuucugccugaccacuuc

SEQ ID NO: 96892 - RNA, 24 nt, Human
acggaguuucaccaucuugaccag

SEQ ID NO: 96893 - RNA, 18 nt, Human
acuccucccuuccuucuc

SEQ ID NO: 96894 - RNA, 27 nt, Human
acucugucgcccaggcuggagagcugu

SEQ ID NO: 96895 - RNA, 23 nt, Human
acugcagcauuucacacaggaua

SEQ ID NO: 96896 - RNA, 23 nt, Human
agacagacuugggccaugcccuu

SEQ ID NO: 96897 - RNA, 20 nt, Human
aggagcagcugagcccagag

SEQ ID NO: 96898 - RNA, 21 nt, Human
aggcucccagaauccacuccc

SEQ ID NO: 96899 - RNA, 27 nt, Human
aucaagucuuuccauuuaaaaaaaagu

SEQ ID NO: 96900 - RNA, 20 nt, Human
augaucaaggcacucaaacc

SEQ ID NO: 96901 - RNA, 22 nt, Human
augccucagccuccugggcagc

SEQ ID NO: 96902 - RNA, 23 nt, Human
augccucagccuccugggcagcu

SEQ ID NO: 96903 - RNA, 20 nt, Human
auucuauucguccuccuucc

SEQ ID NO: 96904 - RNA, 22 nt, Human
auuuuguauuuuuaguacagac

SEQ ID NO: 96905 - RNA, 24 nt, Human
caaagugcugggauuacaagcaug

SEQ ID NO: 96906 - RNA, 18 nt, Human
caacaccugaauuaacug

SEQ ID NO: 96907 - RNA, 25 nt, Human
cacaaucaaaaauuauaggaguacc

SEQ ID NO: 96908 - RNA, 23 nt, Human
cacaccgacauuaaagagaccaa

SEQ ID NO: 96909 - RNA, 22 nt, Human
caccaccaccgccaccaucccc

SEQ ID NO: 96910 - RNA, 19 nt, Human
caccaccgccaccaucccc

SEQ ID NO: 96911 - RNA, 20 nt, Human
caccgacauuaaagagacca

SEQ ID NO: 96912 - RNA, 23 nt, Human
caccuaaugcuggcuaucuccuc

SEQ ID NO: 96913 - RNA, 18 nt, Human
cacuaaccaaaagauuaa

SEQ ID NO: 96914 - RNA, 24 nt, Human
cacucaaaccacaaggcauccuga

SEQ ID NO: 96915 - RNA, 22 nt, Human
cacucugucgcccaggcuggag

SEQ ID NO: 96916 - RNA, 24 nt, Human
cagaguuuuggagcucugagcccu

SEQ ID NO: 96917 - RNA, 19 nt, Human
cagcacccaaguacugcug

SEQ ID NO: 96918 - RNA, 21 nt, Human
caggaaaaugauggaaguuaa

SEQ ID NO: 96919 - RNA, 19 nt, Human
caggugccugccaccaggc

SEQ ID NO: 96920 - RNA, 24 nt, Human
caggugccugccaccaggccaagc

SEQ ID NO: 96921 - RNA, 21 nt, Human
caugcuacuaaacgucaggga

SEQ ID NO: 96922 - RNA, 22 nt, Human
cauggaauggaagcccacuuaa

SEQ ID NO: 96923 - RNA, 19 nt, Human
ccaaagugcugggauuaca

SEQ ID NO: 96924 - RNA, 24 nt, Human
ccaaagugcugggauuacaagcau

SEQ ID NO: 96925 - RNA, 25 nt, Human
ccaccaccaccgccaccauccccuu

SEQ ID NO: 96926 - RNA, 18 nt, Human
ccaccaccgccaccaucc

SEQ ID NO: 96927 - RNA, 26 nt, Human
ccaccaggccaagcuaaauuuuguau

SEQ ID NO: 96928 - RNA, 20 nt, Human
ccacuaaccaaaagauuaaa

SEQ ID NO: 96929 - RNA, 20 nt, Human
ccaggguaaauccaacaguu

SEQ ID NO: 96930 - RNA, 19 nt, Human
ccagguucaagcgauucuc

SEQ ID NO: 96931 - RNA, 21 nt, Human
ccauggcacuguaagacuugg

SEQ ID NO: 96932 - RNA, 22 nt, Human
cccuaaaccacauaaagucccu

SEQ ID NO: 96933 - RNA, 18 nt, Human
cccuuuuuguuuucuacc

SEQ ID NO: 96934 - RNA, 20 nt, Human
ccuccuuccaaagaaccuuc

SEQ ID NO: 96935 - RNA, 24 nt, Human
ccugaucucaagugaucugcccac

SEQ ID NO: 96936 - RNA, 19 nt, Human
ccugggcagcugggauuac

SEQ ID NO: 96937 - RNA, 24 nt, Human
ccugggcagcugggauuacaggug

SEQ ID NO: 96938 - RNA, 21 nt, Human
cuaaaccacauaaagucccug

SEQ ID NO: 96939 - RNA, 21 nt, Human
cucaagugaucugcccaccuc

SEQ ID NO: 96940 - RNA, 24 nt, Human
cucaagugaucugcccaccucggc

SEQ ID NO: 96941 - RNA, 24 nt, Human
cucacucugucgcccaggcuggag

SEQ ID NO: 96942 - RNA, 25 nt, Human
cucucuucaaaagacacauuccaaa

SEQ ID NO: 96943 - RNA, 23 nt, Human
cugaaacuaugaaagcauugcuc

SEQ ID NO: 96944 - RNA, 20 nt, Human
cugagcccuaaaccacauaa

SEQ ID NO: 96945 - RNA, 18 nt, Human
cugaguuugaucuucuug

SEQ ID NO: 96946 - RNA, 24 nt, Human
cugcaaccuccgccugccagguuc

SEQ ID NO: 96947 - RNA, 19 nt, Human
cugccugaccacuucugga

SEQ ID NO: 96948 - RNA, 19 nt, Human
cuucucagucaagucacua

SEQ ID NO: 96949 - RNA, 18 nt, Human
gaacauuaacacugaagu

SEQ ID NO: 96950 - RNA, 21 nt, Human
gaaccuucuugggacucaucc

SEQ ID NO: 96951 - RNA, 20 nt, Human
gaagagacauuuguaaccau

SEQ ID NO: 96952 - RNA, 18 nt, Human
gaccaggcugguccugac

SEQ ID NO: 96953 - RNA, 22 nt, Human
gacgaugggcuaggguuccagc

SEQ ID NO: 96954 - RNA, 25 nt, Human
gagguggccggcuggagauggcggu

SEQ ID NO: 96955 - RNA, 18 nt, Human
gauuacaagcaugagcca

SEQ ID NO: 96956 - RNA, 19 nt, Human
gauuacaagcaugagccac

SEQ ID NO: 96957 - RNA, 22 nt, Human
gauuacaagcaugagccacugc

SEQ ID NO: 96958 - RNA, 18 nt, Human
gauuacaggugccugcca

SEQ ID NO: 96959 - RNA, 21 nt, Human
gauucucaugccucagccucc

SEQ ID NO: 96960 - RNA, 22 nt, Human
gcaaccuccgccugccagguuc

SEQ ID NO: 96961 - RNA, 18 nt, Human
gcagcugggauuacaggu

SEQ ID NO: 96962 - RNA, 20 nt, Human
gcagcugggauuacaggugc

SEQ ID NO: 96963 - RNA, 18 nt, Human
gccaggucccauaguacu

SEQ ID NO: 96964 - RNA, 23 nt, Human
gcgauucucaugccucagccucc

SEQ ID NO: 96965 - RNA, 18 nt, Human
gcugccagccggcuggcu

SEQ ID NO: 96966 - RNA, 21 nt, Human
gcugggauuacaagcaugagc

SEQ ID NO: 96967 - RNA, 21 nt, Human
ggaagcccacuuaaaaaucaa

SEQ ID NO: 96968 - RNA, 18 nt, Human
ggagacaguguuuuaaug

SEQ ID NO: 96969 - RNA, 22 nt, Human
ggauuacaagcaugagccacug

SEQ ID NO: 96970 - RNA, 21 nt, Human
ggcugccagccggcuggcuuc

SEQ ID NO: 96971 - RNA, 19 nt, Human
gggaacugaaagacgcacc

SEQ ID NO: 96972 - RNA, 24 nt, Human
gggaaucccucauuugaccaaauc

SEQ ID NO: 96973 - RNA, 22 nt, Human
ggugagcucacaaucaaaaauu

SEQ ID NO: 96974 - RNA, 24 nt, Human
gugaucugcccaccucggccuccc

SEQ ID NO: 96975 - RNA, 20 nt, Human
guuuaccugauauugcuuug

SEQ ID NO: 96976 - RNA, 19 nt, Human
uaaaccacauaaagucccu

SEQ ID NO: 96977 - RNA, 24 nt, Human
uaaagagaccaacugugcaacccu

SEQ ID NO: 96978 - RNA, 24 nt, Human
uaaaggagcucucaccagggcacc

SEQ ID NO: 96979 - RNA, 24 nt, Human
uaaauuuuguauuuuuaguacaga

SEQ ID NO: 96980 - RNA, 25 nt, Human
uaagaaacaucucaagugugauuca

SEQ ID NO: 96981 - RNA, 18 nt, Human
uacccagucccuuaagaa

SEQ ID NO: 96982 - RNA, 25 nt, Human
uaccccguuuaacccacuaaccagu

SEQ ID NO: 96983 - RNA, 20 nt, Human
uacucuaacuuaccccguuu

SEQ ID NO: 96984 - RNA, 19 nt, Human
uacucuaaugaaugcuaac

SEQ ID NO: 96985 - RNA, 22 nt, Human
uagggcacaugaucaaggcacu

SEQ ID NO: 96986 - RNA, 26 nt, Human
uaguacagacggaguuucaccaucuu

SEQ ID NO: 96987 - RNA, 21 nt, Human
uauacauaauuuaucuauaug

SEQ ID NO: 96988 - RNA, 18 nt, Human
ucaaaagacacauuccaa

SEQ ID NO: 96989 - RNA, 19 nt, Human
ucaaaagacacauuccaaa

SEQ ID NO: 96990 - RNA, 20 nt, Human
ucaaaagacacauuccaaaa

SEQ ID NO: 96991 - RNA, 18 nt, Human
ucaacaccugaauuaacu

SEQ ID NO: 96992 - RNA, 18 nt, Human
ucaccagggcaccuucug

SEQ ID NO: 96993 - RNA, 18 nt, Human
ucacugcaaccuccgccu

SEQ ID NO: 96994 - RNA, 19 nt, Human
ucacugcaaccuccgccug

SEQ ID NO: 96995 - RNA, 20 nt, Human
ucacugcaaccuccgccugc

SEQ ID NO: 96996 - RNA, 24 nt, Human
ucacugcaaccuccgccugccagg

SEQ ID NO: 96997 - RNA, 27 nt, Human
ucacugcaaccuccgccugccagguuc

SEQ ID NO: 96998 - RNA, 23 nt, Human
ucagggauaggcagagucaaaga

SEQ ID NO: 96999 - RNA, 18 nt, Human
uccaaagaaccuucuugg

SEQ ID NO: 97000 - RNA, 20 nt, Human
uccacggccaccaccaccgc

SEQ ID NO: 97001 - RNA, 18 nt, Human
ucccaaagugcugggauu

SEQ ID NO: 97002 - RNA, 24 nt, Human
ucccaaagugcugggauuacaagc

SEQ ID NO: 97003 - RNA, 22 nt, Human
ucccccuacucuaacuuacccc

SEQ ID NO: 97004 - RNA, 21 nt, Human
ucccuuccuucucacauuaaa

SEQ ID NO: 97005 - RNA, 22 nt, Human
uccucauauuauagcaccucau

SEQ ID NO: 97006 - RNA, 24 nt, Human
uccugggcagcugggauuacaggu

SEQ ID NO: 97007 - RNA, 18 nt, Human
ucgcccaggcuggagagc

SEQ ID NO: 97008 - RNA, 18 nt, Human
ucggccucccaaagugcu

SEQ ID NO: 97009 - RNA, 21 nt, Human
ucuaaacuaaaggaaaacagc

SEQ ID NO: 97010 - RNA, 23 nt, Human
ucucacucugucgcccaggcugg

SEQ ID NO: 97011 - RNA, 24 nt, Human
ucucacucugucgcccaggcugga

SEQ ID NO: 97012 - RNA, 24 nt, Human
ucucacucugucgcccaggcugga

SEQ ID NO: 97013 - RNA, 23 nt, Human
ucugaaacuaugaaagcauugcu

SEQ ID NO: 97014 - RNA, 18 nt, Human
ucugucgcccaggcugga

SEQ ID NO: 97015 - RNA, 21 nt, Human
ucuuaggcuauugcccaguuu

SEQ ID NO: 97016 - RNA, 22 nt, Human
ucuucaaaagacacauuccaaa

SEQ ID NO: 97017 - RNA, 24 nt, Human
ucuuuaaauuggcaugcuuaaccc

SEQ ID NO: 97018 - RNA, 23 nt, Human
ugaacauuaacacugaagucuca

SEQ ID NO: 97019 - RNA, 23 nt, Human
ugaagaacucugugugcccaaga

SEQ ID NO: 97020 - RNA, 24 nt, Human
ugaauggaccuccaagguacagga

SEQ ID NO: 97021 - RNA, 21 nt, Human
ugacauaaagugaccuuauuu

SEQ ID NO: 97022 - RNA, 22 nt, Human
ugaccaaaucccucauuugguc

SEQ ID NO: 97023 - RNA, 19 nt, Human
ugacugagaugugcaggug

SEQ ID NO: 97024 - RNA, 23 nt, Human
ugagaaagggaagaggcucccag

SEQ ID NO: 97025 - RNA, 22 nt, Human
ugagauggagucucacucuguc

SEQ ID NO: 97026 - RNA, 19 nt, Human
ugagcagaugggggcugcc

SEQ ID NO: 97027 - RNA, 21 nt, Human
ugagcagaugggggcugccag

SEQ ID NO: 97028 - RNA, 22 nt, Human
ugagcagaugggggcugccagc

SEQ ID NO: 97029 - RNA, 19 nt, Human
ugagccacugcgccagguc

SEQ ID NO: 97030 - RNA, 18 nt, Human
ugaggaaagcaacuuggu

SEQ ID NO: 97031 - RNA, 18 nt, Human
ugaucucaagugaucugc

SEQ ID NO: 97032 - RNA, 24 nt, Human
ugaucugcccaccucggccuccca

SEQ ID NO: 97033 - RNA, 26 nt, Human
ugcaacccugaaacauaugaaacagg

SEQ ID NO: 97034 - RNA, 21 nt, Human
ugccaaggccugagagucucc

SEQ ID NO: 97035 - RNA, 21 nt, Human
ugccaaggccugagagucucc

SEQ ID NO: 97036 - RNA, 24 nt, Human
ugccagguucaagcgauucucaug

SEQ ID NO: 97037 - RNA, 19 nt, Human
ugcccaagaagcugggcaa

SEQ ID NO: 97038 - RNA, 21 nt, Human
ugccucagccuccugggcagc

SEQ ID NO: 97039 - RNA, 24 nt, Human
ugccucagccuccugggcagcugg

SEQ ID NO: 97040 - RNA, 18 nt, Human
ugccucuaaaaccuaagc

SEQ ID NO: 97041 - RNA, 24 nt, Human
ugcugggauuacaagcaugagcca

SEQ ID NO: 97042 - RNA, 21 nt, Human
uggaagcccacuuaaaaauca

SEQ ID NO: 97043 - RNA, 22 nt, Human
uggaccuccaagguacaggagc

SEQ ID NO: 97044 - RNA, 24 nt, Human
uggagucucacucugucgcccagg

SEQ ID NO: 97045 - RNA, 19 nt, Human
uggauugaagaacucugug

SEQ ID NO: 97046 - RNA, 23 nt, Human
uggcauugguggcccaacagggg

SEQ ID NO: 97047 - RNA, 22 nt, Human
ugggauuacaagcaugagccac

SEQ ID NO: 97048 - RNA, 22 nt, Human
ugggauuacaagcaugagccac

SEQ ID NO: 97049 - RNA, 24 nt, Human
ugggauuacaagcaugagccacug

SEQ ID NO: 97050 - RNA, 26 nt, Human
ugggauuacaagcaugagccacugcg

SEQ ID NO: 97051 - RNA, 30 nt, Human
ugggauuacaagcaugagccacugcgccaa

SEQ ID NO: 97052 - RNA, 21 nt, Human
ugggauuacaggugccugcca

SEQ ID NO: 97053 - RNA, 22 nt, Human
ugggauuacaggugccugccac

SEQ ID NO: 97054 - RNA, 24 nt, Human
ugggauuacaggugccugccacca

SEQ ID NO: 97055 - RNA, 24 nt, Human
uggucaaaaugacuaaauaugauc

SEQ ID NO: 97056 - RNA, 21 nt, Human
uguauuuuuaguacagacgga

SEQ ID NO: 97057 - RNA, 21 nt, Human
ugucuuccuaucccucccccu

SEQ ID NO: 97058 - RNA, 21 nt, Human
uguuuucuacccuaacuucuc

SEQ ID NO: 97059 - RNA, 19 nt, Human
uuaacccaaauaggugagc

SEQ ID NO: 97060 - RNA, 25 nt, Human
uuaaugguuuuuaaauaugucuucc

SEQ ID NO: 97061 - RNA, 24 nt, Human
uuaguacagacggaguuucaccau

SEQ ID NO: 97062 - RNA, 23 nt, Human
uucaacuacuaacgagacuugaa

SEQ ID NO: 97063 - RNA, 18 nt, Human
uucaagaaacaggaaaau

SEQ ID NO: 97064 - RNA, 19 nt, Human
uucaagaaacaggaaaaug

SEQ ID NO: 97065 - RNA, 23 nt, Human
uucaagcgauucucaugccucag

SEQ ID NO: 97066 - RNA, 23 nt, Human
uucacaguauucucacuucuccu

SEQ ID NO: 97067 - RNA, 20 nt, Human
uuccuaucccucccccuacu

SEQ ID NO: 97068 - RNA, 27 nt, Human
uuccuaucccucccccuacucuaacuu

SEQ ID NO: 97069 - RNA, 23 nt, Human
uuguauuuuuaguacagacggag

SEQ ID NO: 97070 - RNA, 21 nt, Human
uuuauaguugaagaaccauca

SEQ ID NO: 97071 - RNA, 22 nt, Human
uuuguaaccauuaucuccauuu

SEQ ID NO: 97072 - RNA, 24 nt, Human
uuuuuaguacagacggaguuucac

SEQ ID NO: 97073 - RNA, 21 nt, Human
aaaagcuuuggguuuuguuuu

SEQ ID NO: 97074 - RNA, 22 nt, Human
aaaauauaaacagcauugcaga

SEQ ID NO: 97075 - RNA, 22 nt, Human
aaacaaaaaauaacacugaaau

SEQ ID NO: 97076 - RNA, 24 nt, Human
aaacaggcacaacaguguaaccuu

SEQ ID NO: 97077 - RNA, 22 nt, Human
aaacaugaagaacuaagugaca

SEQ ID NO: 97078 - RNA, 20 nt, Human
aaaggcauucaacuguucau

SEQ ID NO: 97079 - RNA, 26 nt, Human
aaaugaccaacaaaaacuuuaagaac

SEQ ID NO: 97080 - RNA, 19 nt, Human
aacuaaguuccuuuuauga

SEQ ID NO: 97081 - RNA, 19 nt, Human
aagcaaaaacuuuaaauac

SEQ ID NO: 97082 - RNA, 24 nt, Human
aauaaggccucuuuuucuucauau

SEQ ID NO: 97083 - RNA, 21 nt, Human
aaucugcuggaaacuucccuc

SEQ ID NO: 97084 - RNA, 23 nt, Human
acacacacacacacacacacaca

SEQ ID NO: 97085 - RNA, 23 nt, Human
acacacacacacacacacacaca

SEQ ID NO: 97086 - RNA, 23 nt, Human
acacacacacacacacacacaca

SEQ ID NO: 97087 - RNA, 23 nt, Human
acacacacacacacacacacaca

SEQ ID NO: 97088 - RNA, 23 nt, Human
acacacacacacacacacacaca

SEQ ID NO: 97089 - RNA, 28 nt, Human
acacacacacacacacacacacagaguu

SEQ ID NO: 97090 - RNA, 26 nt, Human
acacacacacacacacacagaguuua

SEQ ID NO: 97091 - RNA, 25 nt, Human
accuacagacagaacauuuuaaagg

SEQ ID NO: 97092 - RNA, 21 nt, Human
agaagcuuaguggucacaaac

SEQ ID NO: 97093 - RNA, 19 nt, Human
agacaaacaggcacaacag

SEQ ID NO: 97094 - RNA, 25 nt, Human
agacaaacaggcacaacaguguaac

SEQ ID NO: 97095 - RNA, 20 nt, Human
agccugaaaucugcuggaaa

SEQ ID NO: 97096 - RNA, 20 nt, Human
aguaaggagcauaaaaaaga

SEQ ID NO: 97097 - RNA, 20 nt, Human
agugaccucauuagaagagc

SEQ ID NO: 97098 - RNA, 20 nt, Human
auacaguucauauuucccca

SEQ ID NO: 97099 - RNA, 21 nt, Human
augaacaccagguccacacca

SEQ ID NO: 97100 - RNA, 19 nt, Human
auugcuacagcaaaacaag

SEQ ID NO: 97101 - RNA, 21 nt, Human
auuugacuagucauuuaaacc

SEQ ID NO: 97102 - RNA, 18 nt, Human
caacagaaaguaauugcu

SEQ ID NO: 97103 - RNA, 18 nt, Human
caagauaaugagaaauau

SEQ ID NO: 97104 - RNA, 25 nt, Human
caaguuuaaaugcaagcauaaaaug

SEQ ID NO: 97105 - RNA, 24 nt, Human
caauaaaaaaacuacugagcacau

SEQ ID NO: 97106 - RNA, 23 nt, Human
cacaaacaaaaaauaacacugaa

SEQ ID NO: 97107 - RNA, 20 nt, Human
cacacacacacacacacaca

SEQ ID NO: 97108 - RNA, 20 nt, Human
cacacacacacacacacaca

SEQ ID NO: 97109 - RNA, 20 nt, Human
cacacacacacacacacaca

SEQ ID NO: 97110 - RNA, 20 nt, Human
cacacacacacacacacaca

SEQ ID NO: 97111 - RNA, 20 nt, Human
cacacacacacacacacaca

SEQ ID NO: 97112 - RNA, 20 nt, Human
cacacacacacacacacaca

SEQ ID NO: 97113 - RNA, 20 nt, Human
cacacacacacacacacaca

SEQ ID NO: 97114 - RNA, 20 nt, Human
cacacacacacacacacaca

SEQ ID NO: 97115 - RNA, 20 nt, Human
cacacacacacacacacaca

SEQ ID NO: 97116 - RNA, 20 nt, Human
cacacacacacacacacaca

SEQ ID NO: 97117 - RNA, 22 nt, Human
cacacacacacacacacacaca

SEQ ID NO: 97118 - RNA, 22 nt, Human
cacacacacacacacacacaca

SEQ ID NO: 97119 - RNA, 22 nt, Human
cacacacacacacacacacaca

SEQ ID NO: 97120 - RNA, 22 nt, Human
cacacacacacacacacacaca

SEQ ID NO: 97121 - RNA, 26 nt, Human
cacacacacacacacacacacacaca

SEQ ID NO: 97122 - RNA, 26 nt, Human
cacacacacacacacacacacacaca

SEQ ID NO: 97123 - RNA, 26 nt, Human
cacacacacacacacacacacacaca

SEQ ID NO: 97124 - RNA, 26 nt, Human
cacacacacacacacacacacacaca

SEQ ID NO: 97125 - RNA, 26 nt, Human
cacacacacacacacacacacacaca

SEQ ID NO: 97126 - RNA, 28 nt, Human
cacacacacacacagaguuuauaucccu

SEQ ID NO: 97127 - RNA, 19 nt, Human
cacaguuaagaaauaaggc

SEQ ID NO: 97128 - RNA, 25 nt, Human
cacguagaaaaaaaaauucaugauu

SEQ ID NO: 97129 - RNA, 18 nt, Human
cagaagcuuaguggucac

SEQ ID NO: 97130 - RNA, 18 nt, Human
cagcauugcagacaaaca

SEQ ID NO: 97131 - RNA, 21 nt, Human
cagccugaaaucugcuggaaa

SEQ ID NO: 97132 - RNA, 24 nt, Human
cauucacuaauaauuuggcaauga

SEQ ID NO: 97133 - RNA, 25 nt, Human
cauugcacuuggucauuuuauugcc

SEQ ID NO: 97134 - RNA, 19 nt, Human
cggggagaagccgacgucc

SEQ ID NO: 97135 - RNA, 24 nt, Human
cuacuuuucuauagauauuacacu

SEQ ID NO: 97136 - RNA, 23 nt, Human
cucaaagaauaccugaacuauac

SEQ ID NO: 97137 - RNA, 19 nt, Human
cucacacguagaaaaaaaa

SEQ ID NO: 97138 - RNA, 21 nt, Human
cucacacguagaaaaaaaaau

SEQ ID NO: 97139 - RNA, 18 nt, Human
cucauucugcucauacau

SEQ ID NO: 97140 - RNA, 19 nt, Human
cugaacuauacauucacua

SEQ ID NO: 97141 - RNA, 23 nt, Human
cugaaguuugaaaagcuuugggu

SEQ ID NO: 97142 - RNA, 26 nt, Human
cugaaucccuggaacauuaugaacac

SEQ ID NO: 97143 - RNA, 19 nt, Human
cuggaacauuaugaacacc

SEQ ID NO: 97144 - RNA, 19 nt, Human
cuguucucucuuuacaucu

SEQ ID NO: 97145 - RNA, 18 nt, Human
gaaacuucccucauccca

SEQ ID NO: 97146 - RNA, 24 nt, Human
gaagguaacagcuuuguauuaaga

SEQ ID NO: 97147 - RNA, 23 nt, Human
gaauaaaggaaucauuuuuccca

SEQ ID NO: 97148 - RNA, 18 nt, Human
gauguaccuacagacaga

SEQ ID NO: 97149 - RNA, 24 nt, Human
gcaaaacaaaauauauauauaaau

SEQ ID NO: 97150 - RNA, 32 nt, Human
gcaaaacaaaauauauauauaaauucacccuu

SEQ ID NO: 97151 - RNA, 21 nt, Human
gccuguucucucuuuacaucu

SEQ ID NO: 97152 - RNA, 22 nt, Human
guaaaaauauauauauauauau

SEQ ID NO: 97153 - RNA, 25 nt, Human
uaaaauaagcagaaaaguacagcaa

SEQ ID NO: 97154 - RNA, 19 nt, Human
uaaagcauaaaacaauuuu

SEQ ID NO: 97155 - RNA, 25 nt, Human
uaaagcauaaaacaauuuuuggcaa

SEQ ID NO: 97156 - RNA, 21 nt, Human
uaaguaacuuuugaagaaaca

SEQ ID NO: 97157 - RNA, 20 nt, Human
uaaguuccuuuuaugacucc

SEQ ID NO: 97158 - RNA, 20 nt, Human
uacacacacacacacacaca

SEQ ID NO: 97159 - RNA, 25 nt, Human
uacacacacacacacacacacacac

SEQ ID NO: 97160 - RNA, 21 nt, Human
uacaucuucagacuuaaauuc

SEQ ID NO: 97161 - RNA, 25 nt, Human
uacugugugucucaaagaauaccug

SEQ ID NO: 97162 - RNA, 25 nt, Human
uauacacacacacacacacacacac

SEQ ID NO: 97163 - RNA, 24 nt, Human
uauauacacacacacacacacaca

SEQ ID NO: 97164 - RNA, 25 nt, Human
uauauacacacacacacacacacag

SEQ ID NO: 97165 - RNA, 21 nt, Human
uauaucaccauauuuauagua

SEQ ID NO: 97166 - RNA, 21 nt, Human
uauguuguuuacuggcauuuc

SEQ ID NO: 97167 - RNA, 18 nt, Human
uauugcuacagcaaaaca

SEQ ID NO: 97168 - RNA, 21 nt, Human
ucacaguaaggagcauaaaaa

SEQ ID NO: 97169 - RNA, 23 nt, Human
ucacccaaaauauaaacagcauu

SEQ ID NO: 97170 - RNA, 18 nt, Human
ucaguaguauuuucaagc

SEQ ID NO: 97171 - RNA, 23 nt, Human
ucccagcacaguuaagaaauaag

SEQ ID NO: 97172 - RNA, 22 nt, Human
ucccgcggggagaagccgacgu

SEQ ID NO: 97173 - RNA, 25 nt, Human
uccuuuuaugacuccuauagugcaa

SEQ ID NO: 97174 - RNA, 23 nt, Human
ucugcuggaaacuucccucaucc

SEQ ID NO: 97175 - RNA, 18 nt, Human
ucugugaucacaguaagg

SEQ ID NO: 97176 - RNA, 21 nt, Human
ucugugaucacaguaaggagc

SEQ ID NO: 97177 - RNA, 23 nt, Human
ugacaagauaaugagaaauauuu

SEQ ID NO: 97178 - RNA, 19 nt, Human
ugacauacuaacauucuuu

SEQ ID NO: 97179 - RNA, 20 nt, Human
uggguuuguuugguuuucuu

SEQ ID NO: 97180 - RNA, 23 nt, Human
uggucacaaacaaaaaauaacac

SEQ ID NO: 97181 - RNA, 19 nt, Human
ugucaaaauaggaaaccuc

SEQ ID NO: 97182 - RNA, 21 nt, Human
uguguuuuuagauguaccuac

SEQ ID NO: 97183 - RNA, 21 nt, Human
uguuuacauauuuuauaugug

SEQ ID NO: 97184 - RNA, 20 nt, Human
uuaagacagaagcuuagugg

SEQ ID NO: 97185 - RNA, 23 nt, Human
uuaguggucacaaacaaaaaaua

SEQ ID NO: 97186 - RNA, 19 nt, Human
uuauaugugcuguaguuuc

SEQ ID NO: 97187 - RNA, 19 nt, Human
uuaucaaggacagaaaggu

SEQ ID NO: 97188 - RNA, 21 nt, Human
uucacaauuuuuaaguaacaa

SEQ ID NO: 97189 - RNA, 25 nt, Human
uucagacuuaaauucuguagaaggu

SEQ ID NO: 97190 - RNA, 25 nt, Human
uucauauuuccccaaauguuuaaca

SEQ ID NO: 97191 - RNA, 19 nt, Human
uuccaugcuguucaacuuu

SEQ ID NO: 97192 - RNA, 23 nt, Human
uucccccaaaccccuaauguaag

SEQ ID NO: 97193 - RNA, 23 nt, Human
uugcagacaaacaggcacaacag

SEQ ID NO: 97194 - RNA, 20 nt, Human
uuggucauuaaaagaaagua

SEQ ID NO: 97195 - RNA, 18 nt, Human
uuuaacaaggagaaaaua

SEQ ID NO: 97196 - RNA, 19 nt, Human
uuuauaguauagaucucuu

SEQ ID NO: 97197 - RNA, 24 nt, Human
uuuaucaaggacagaaagguaaga

SEQ ID NO: 97198 - RNA, 21 nt, Human
uuucuaggauuacaauauuuu

SEQ ID NO: 97199 - RNA, 19 nt, Human
uuuggcaaugaagauucca

SEQ ID NO: 97200 - RNA, 18 nt, Human
accuguagaggaugugga

SEQ ID NO: 97201 - RNA, 20 nt, Human
agaagaaaauggagacaugg

SEQ ID NO: 97202 - RNA, 22 nt, Human
agacauggaagguuaaggagcu

SEQ ID NO: 97203 - RNA, 24 nt, Human
caaaugaaagagcacagauuugau

SEQ ID NO: 97204 - RNA, 22 nt, Human
cacagcaucccuaugagauagg

SEQ ID NO: 97205 - RNA, 23 nt, Human
cagccuuugguccccgaccugua

SEQ ID NO: 97206 - RNA, 23 nt, Human
cgaccuguagaggauguggaucu

SEQ ID NO: 97207 - RNA, 21 nt, Human
cuuugguccccgaccuguaga

SEQ ID NO: 97208 - RNA, 21 nt, Human
gaagaaaauggagacauggaa

SEQ ID NO: 97209 - RNA, 20 nt, Human
uaccuuuauuuaaugcucac

SEQ ID NO: 97210 - RNA, 21 nt, Human
uagcaggaaacucacauaaug

SEQ ID NO: 97211 - RNA, 26 nt, Human
ugaaagagcacagauuugauuccacg

SEQ ID NO: 97212 - RNA, 21 nt, Human
aaacaggaagugggggcaggg

SEQ ID NO: 97213 - RNA, 22 nt, Human
aaacaggaagugggggcagggg

SEQ ID NO: 97214 - RNA, 22 nt, Human
aaagaaaauacagggaagaaac

SEQ ID NO: 97215 - RNA, 19 nt, Human
aagggaggagcuggugacc

SEQ ID NO: 97216 - RNA, 22 nt, Human
acugaggcaacagcucaaccca

SEQ ID NO: 97217 - RNA, 21 nt, Human
agaaagaaaauacagggaaga

SEQ ID NO: 97218 - RNA, 26 nt, Human
agaaagaaaauacagggaagaaacgg

SEQ ID NO: 97219 - RNA, 27 nt, Human
agaaagaaaauacagggaagaaacggu

SEQ ID NO: 97220 - RNA, 24 nt, Human
agagacagaaaagcaucuguuggg

SEQ ID NO: 97221 - RNA, 23 nt, Human
agaggaggggguaggggaagggg

SEQ ID NO: 97222 - RNA, 21 nt, Human
agaggcucagcuccaagaccu

SEQ ID NO: 97223 - RNA, 18 nt, Human
agcaaggaaggggcucag

SEQ ID NO: 97224 - RNA, 23 nt, Human
agcauggggguagcacgugguca

SEQ ID NO: 97225 - RNA, 18 nt, Human
agcccuggccuccaccgu

SEQ ID NO: 97226 - RNA, 18 nt, Human
aggaggggguaggggaag

SEQ ID NO: 97227 - RNA, 19 nt, Human
aggagucggcaggagggag

SEQ ID NO: 97228 - RNA, 19 nt, Human
aggcagcuggugauaaggg

SEQ ID NO: 97229 - RNA, 18 nt, Human
agggccccaagaacagcc

SEQ ID NO: 97230 - RNA, 20 nt, Human
aggggcucagggugagggag

SEQ ID NO: 97231 - RNA, 24 nt, Human
agggggcacauggagcucaguggg

SEQ ID NO: 97232 - RNA, 19 nt, Human
aggguuaggagcugaucug

SEQ ID NO: 97233 - RNA, 25 nt, Human
aggugugugcaguggggaaggguug

SEQ ID NO: 97234 - RNA, 24 nt, Human
caaccccucuggaaagaaaucaac

SEQ ID NO: 97235 - RNA, 19 nt, Human
cacugcccagccuugcccc

SEQ ID NO: 97236 - RNA, 20 nt, Human
cacuggaugggagagggccc

SEQ ID NO: 97237 - RNA, 20 nt, Human
cacuggccuuucccugagcc

SEQ ID NO: 97238 - RNA, 21 nt, Human
cagaagaggcagcuggugaua

SEQ ID NO: 97239 - RNA, 21 nt, Human
cagccaccacguguugucuug

SEQ ID NO: 97240 - RNA, 18 nt, Human
cagccagaaaacugugca

SEQ ID NO: 97241 - RNA, 20 nt, Human
caggacucugcaaaugguaa

SEQ ID NO: 97242 - RNA, 19 nt, Human
caggaucccuguucaaccc

SEQ ID NO: 97243 - RNA, 24 nt, Human
caggggugggagaagggggagggg

SEQ ID NO: 97244 - RNA, 25 nt, Human
caggggugggagaagggggaggggg

SEQ ID NO: 97245 - RNA, 19 nt, Human
cagggugagggaggcagag

SEQ ID NO: 97246 - RNA, 21 nt, Human
cagguccugagcuauagcccu

SEQ ID NO: 97247 - RNA, 18 nt, Human
ccaucaguuguuccuggg

SEQ ID NO: 97248 - RNA, 19 nt, Human
cccaagaacagccucugag

SEQ ID NO: 97249 - RNA, 19 nt, Human
cccaugguccugccuacuu

SEQ ID NO: 97250 - RNA, 18 nt, Human
ccugagcuauagcccugg

SEQ ID NO: 97251 - RNA, 22 nt, Human
ccugccuacuuugauccagagg

SEQ ID NO: 97252 - RNA, 18 nt, Human
ccugggucacccacagaa

SEQ ID NO: 97253 - RNA, 21 nt, Human
ccugugugagugcugcaaggc

SEQ ID NO: 97254 - RNA, 24 nt, Human
cggagggagggugcagcugcaugu

SEQ ID NO: 97255 - RNA, 20 nt, Human
cucaaaguagagaaagaaaa

SEQ ID NO: 97256 - RNA, 23 nt, Human
cucaaaguagagaaagaaaauac

SEQ ID NO: 97257 - RNA, 21 nt, Human
cugaucugggcuaugaccaua

SEQ ID NO: 97258 - RNA, 24 nt, Human
cugcaaggccaucaguuguuccug

SEQ ID NO: 97259 - RNA, 27 nt, Human
gaaaauacagggaagaaaccgguaccc

SEQ ID NO: 97260 - RNA, 22 nt, Human
gaccuuggcuuucccccgucac

SEQ ID NO: 97261 - RNA, 22 nt, Human
gagaaagaaaauacagggaaga

SEQ ID NO: 97262 - RNA, 25 nt, Human
gagaaagaaaauacagggaagaaac

SEQ ID NO: 97263 - RNA, 24 nt, Human
gagaacaagggaggagcuggugac

SEQ ID NO: 97264 - RNA, 19 nt, Human
gaggaggaagccauggaga

SEQ ID NO: 97265 - RNA, 22 nt, Human
gagggaggaggaagccauggag

SEQ ID NO: 97266 - RNA, 18 nt, Human
gagggggaggugggagga

SEQ ID NO: 97267 - RNA, 20 nt, Human
gauccagagggagaaaaaag

SEQ ID NO: 97268 - RNA, 20 nt, Human
gaugggagagggcccaaaca

SEQ ID NO: 97269 - RNA, 18 nt, Human
gcaggggugggagaaggg

SEQ ID NO: 97270 - RNA, 19 nt, Human
gcaguggggaaggguuggg

SEQ ID NO: 97271 - RNA, 22 nt, Human
gccccagagagacuagaacuga

SEQ ID NO: 97272 - RNA, 22 nt, Human
gcccuggccuccaccguuuucc

SEQ ID NO: 97273 - RNA, 23 nt, Human
gcccuggccuccaccguuuuccg

SEQ ID NO: 97274 - RNA, 19 nt, Human
gcgcggcuccuagagagac

SEQ ID NO: 97275 - RNA, 20 nt, Human
ggaagugggggcaggggugg

SEQ ID NO: 97276 - RNA, 18 nt, Human
ggcaggggugggagaagg

SEQ ID NO: 97277 - RNA, 22 nt, Human
gggcaggggugggagaaggggg

SEQ ID NO: 97278 - RNA, 21 nt, Human
ggggugggagaagggggaggg

SEQ ID NO: 97279 - RNA, 21 nt, Human
ggugagggaggcagagacaga

SEQ ID NO: 97280 - RNA, 21 nt, Human
ggugcagagcaaggaaggggc

SEQ ID NO: 97281 - RNA, 20 nt, Human
ggugggagaagggggagggg

SEQ ID NO: 97282 - RNA, 24 nt, Human
guagcacguggucagaugcagaga

SEQ ID NO: 97283 - RNA, 28 nt, Human
guauugcggcagagaggaggggguaggg

SEQ ID NO: 97284 - RNA, 24 nt, Human
gugggaggaaggaucggagggaga

SEQ ID NO: 97285 - RNA, 18 nt, Human
uagagaaagaaaauacag

SEQ ID NO: 97286 - RNA, 24 nt, Human
ucaaaguagagaaagaaaauacag

SEQ ID NO: 97287 - RNA, 24 nt, Human
uccagagggagaaaaaagagccca

SEQ ID NO: 97288 - RNA, 23 nt, Human
ucccagguccugagcuauagccc

SEQ ID NO: 97289 - RNA, 18 nt, Human
ucccaugguccugccuac

SEQ ID NO: 97290 - RNA, 21 nt, Human
uccucaagguguagggcccca

SEQ ID NO: 97291 - RNA, 23 nt, Human
uccugagcuauagcccuggccuc

SEQ ID NO: 97292 - RNA, 22 nt, Human
ucggcaggagggaggaggaagc

SEQ ID NO: 97293 - RNA, 18 nt, Human
ucuaggcuccagccagaa

SEQ ID NO: 97294 - RNA, 21 nt, Human
ucucggacacugcccagccuu

SEQ ID NO: 97295 - RNA, 22 nt, Human
ucucucggacacugcccagccu

SEQ ID NO: 97296 - RNA, 27 nt, Human
ucucuggaaauuucuauuuccaaccgu

SEQ ID NO: 97297 - RNA, 19 nt, Human
ugagccccucgguucacac

SEQ ID NO: 97298 - RNA, 22 nt, Human
ugagccucaggggaggucccag

SEQ ID NO: 97299 - RNA, 19 nt, Human
ugaggcaacagcucaaccc

SEQ ID NO: 97300 - RNA, 21 nt, Human
ugaggcaacagcucaacccag

SEQ ID NO: 97301 - RNA, 20 nt, Human
ugagugcugcaaggccauca

SEQ ID NO: 97302 - RNA, 18 nt, Human
ugcaaggccaucaguugu

SEQ ID NO: 97303 - RNA, 20 nt, Human
ugccccaccuagccgaguca

SEQ ID NO: 97304 - RNA, 26 nt, Human
uggaaagaaaucaacagcaaacaagg

SEQ ID NO: 97305 - RNA, 22 nt, Human
ugggagaagggggagggggagg

SEQ ID NO: 97306 - RNA, 19 nt, Human
ugggagagggcccaaacag

SEQ ID NO: 97307 - RNA, 21 nt, Human
ugggaggccuguucuaggcuc

SEQ ID NO: 97308 - RNA, 20 nt, Human
uggugauaaggguuaggagc

SEQ ID NO: 97309 - RNA, 24 nt, Human
uguugggggacugaggcaacagcu

SEQ ID NO: 97310 - RNA, 18 nt, Human
uuccugggagaaaauugu

SEQ ID NO: 97311 - RNA, 18 nt, Human
uugcugaauggccguuuc

SEQ ID NO: 97312 - RNA, 19 nt, Human
uugcugaauggccguuucu

SEQ ID NO: 97313 - RNA, 22 nt, Human
uuuccugagccccucgguucaa

SEQ ID NO: 97314 - RNA, 20 nt, Human
uuuuuuuuuuuuuuuuuugg

SEQ ID NO: 97315 - RNA, 24 nt, Human
uuuuuuuuuuuuuuuuuuguguuu

SEQ ID NO: 97316 - RNA, 21 nt, Human
acagugcuuuauugugcuauu

SEQ ID NO: 97317 - RNA, 24 nt, Human
ccuaauauguaacuucucuuugau

SEQ ID NO: 97318 - RNA, 21 nt, Human
cugguuccucaucucucuucc

SEQ ID NO: 97319 - RNA, 18 nt, Human
cuugcaaacuccuggaua

SEQ ID NO: 97320 - RNA, 24 nt, Human
uacaagcucugguuccucaucucu

SEQ ID NO: 97321 - RNA, 21 nt, Human
ucccagaauuaaagauauacu

SEQ ID NO: 97322 - RNA, 20 nt, Human
ucucuuugauaaagugaaaa

SEQ ID NO: 97323 - RNA, 22 nt, Human
ugaauuaguguuaagcaccugu

SEQ ID NO: 97324 - RNA, 21 nt, Human
uuugauaaagugaaaacaagu

SEQ ID NO: 97325 - RNA, 20 nt, Human
acacagaagaggugcugaca

SEQ ID NO: 97326 - RNA, 20 nt, Human
acagaagaggugcugacagu

SEQ ID NO: 97327 - RNA, 19 nt, Human
accacacagaagaggugcu

SEQ ID NO: 97328 - RNA, 21 nt, Human
acgcagccacgugggucccca

SEQ ID NO: 97329 - RNA, 19 nt, Human
agaggugacagcagcaggg

SEQ ID NO: 97330 - RNA, 19 nt, Human
aggccgacagauggggaca

SEQ ID NO: 97331 - RNA, 19 nt, Human
aggugcugacaguggggga

SEQ ID NO: 97332 - RNA, 19 nt, Human
cacacagaagaggugcuga

SEQ ID NO: 97333 - RNA, 19 nt, Human
cagcagcaggggcacgcag

SEQ ID NO: 97334 - RNA, 21 nt, Human
cggagggcuccaggcgaacug

SEQ ID NO: 97335 - RNA, 22 nt, Human
cucaccacacagaagaggugcu

SEQ ID NO: 97336 - RNA, 23 nt, Human
gacagcagcaggggcacgcagcc

SEQ ID NO: 97337 - RNA, 18 nt, Human
gaggugacagcagcaggg

SEQ ID NO: 97338 - RNA, 22 nt, Human
gcggagggcuccaggcgaacug

SEQ ID NO: 97339 - RNA, 22 nt, Human
ggggcggggcgggacuuugggg

SEQ ID NO: 97340 - RNA, 18 nt, Human
ugcccagcgcacgugacg

SEQ ID NO: 97341 - RNA, 20 nt, Human
ugggagaggugacagcagca

SEQ ID NO: 97342 - RNA, 24 nt, Human
uggggacaggaagcugucgggauc

SEQ ID NO: 97343 - RNA, 18 nt, Human
aaaaaggcuuccgucucu

SEQ ID NO: 97344 - RNA, 19 nt, Human
accacaaggagucaaggag

SEQ ID NO: 97345 - RNA, 20 nt, Human
agacuuuggggaaaaaggcu

SEQ ID NO: 97346 - RNA, 30 nt, Human
aggccggcaggaggcuaggcagcaagagaa

SEQ ID NO: 97347 - RNA, 19 nt, Human
augaugacauaaaccacaa

SEQ ID NO: 97348 - RNA, 20 nt, Human
caaggagcuaaaacaaccac

SEQ ID NO: 97349 - RNA, 22 nt, Human
caauuuucauucuaaucuuaua

SEQ ID NO: 97350 - RNA, 18 nt, Human
gacuuuggggaaaaaggc

SEQ ID NO: 97351 - RNA, 20 nt, Human
gaggccggcaggaggcuagg

SEQ ID NO: 97352 - RNA, 24 nt, Human
uagaucacaauaaagguaugcuga

SEQ ID NO: 97353 - RNA, 19 nt, Human
ucuucagcucugcaccagc

SEQ ID NO: 97354 - RNA, 20 nt, Human
uggaggacccuccaaaaucu

SEQ ID NO: 97355 - RNA, 19 nt, Human
uuggggaaaaaggcuuccg

SEQ ID NO: 97356 - RNA, 23 nt, Human
uuguggaggacccuccaaaaucu

SEQ ID NO: 97357 - RNA, 20 nt, Human
aaauaaauauccuggcaaga

SEQ ID NO: 97358 - RNA, 21 nt, Human
agaaggcagggaggagggagc

SEQ ID NO: 97359 - RNA, 23 nt, Human
agaaggcagggaggagggagcgg

SEQ ID NO: 97360 - RNA, 18 nt, Human
agagaaggcagggaggag

SEQ ID NO: 97361 - RNA, 24 nt, Human
agagcacauauacggagaugccaa

SEQ ID NO: 97362 - RNA, 18 nt, Human
agauggcggaggccagca

SEQ ID NO: 97363 - RNA, 23 nt, Human
aggaaacagggagucgcaggggg

SEQ ID NO: 97364 - RNA, 22 nt, Human
aggagcacagggcuggcucagg

SEQ ID NO: 97365 - RNA, 22 nt, Human
aggcagggaggagggagcgggg

SEQ ID NO: 97366 - RNA, 23 nt, Human
aggcagggaggagggagcggggg

SEQ ID NO: 97367 - RNA, 20 nt, Human
agggaguaggggauuagggg

SEQ ID NO: 97368 - RNA, 18 nt, Human
caaaaggggacggcgaua

SEQ ID NO: 97369 - RNA, 18 nt, Human
caacauuuacccagucca

SEQ ID NO: 97370 - RNA, 22 nt, Human
caugcaagaaaaggagggaacu

SEQ ID NO: 97371 - RNA, 25 nt, Human
ccagagcacauauacggagaugcca

SEQ ID NO: 97372 - RNA, 19 nt, Human
cggagaaguuacauccaaa

SEQ ID NO: 97373 - RNA, 26 nt, Human
cggcgauagaaaaguagauggaauac

SEQ ID NO: 97374 - RNA, 23 nt, Human
cgggaggcaguguucuccagagg

SEQ ID NO: 97375 - RNA, 20 nt, Human
gaccugggccagcgggaggc

SEQ ID NO: 97376 - RNA, 28 nt, Human
gaggaacgauucucucucguggggucca

SEQ ID NO: 97377 - RNA, 18 nt, Human
gagugaauagcacaaaua

SEQ ID NO: 97378 - RNA, 22 nt, Human
ggacuggagaggagaccugggc

SEQ ID NO: 97379 - RNA, 24 nt, Human
ggacuggagaggagaccugggcca

SEQ ID NO: 97380 - RNA, 21 nt, Human
ggacuggguaccagcagagaa

SEQ ID NO: 97381 - RNA, 18 nt, Human
ggagaggagaccugggcc

SEQ ID NO: 97382 - RNA, 19 nt, Human
ggagcacagggcuggcuca

SEQ ID NO: 97383 - RNA, 18 nt, Human
ggagcgggggaucaggcu

SEQ ID NO: 97384 - RNA, 22 nt, Human
ggagggaggagcacagggcugg

SEQ ID NO: 97385 - RNA, 23 nt, Human
ggaguguugggggagggaggagc

SEQ ID NO: 97386 - RNA, 24 nt, Human
ggccaggaucugugaacggggcag

SEQ ID NO: 97387 - RNA, 22 nt, Human
gggaagggagugaauagcacaa

SEQ ID NO: 97388 - RNA, 19 nt, Human
gggacuggagaggagaccu

SEQ ID NO: 97389 - RNA, 19 nt, Human
gggaggagggagcggggga

SEQ ID NO: 97390 - RNA, 27 nt, Human
gggaguaggggauuaggggacaggggu

SEQ ID NO: 97391 - RNA, 20 nt, Human
ggggagggaggagcacaggg

SEQ ID NO: 97392 - RNA, 19 nt, Human
gggggagggaggagcacag

SEQ ID NO: 97393 - RNA, 22 nt, Human
ggggguuggagggaguagggga

SEQ ID NO: 97394 - RNA, 19 nt, Human
gucgcagggggacuggaga

SEQ ID NO: 97395 - RNA, 20 nt, Human
guuuauuuuuuucucucuca

SEQ ID NO: 97396 - RNA, 20 nt, Human
uaaauauccuggcaagaggg

SEQ ID NO: 97397 - RNA, 19 nt, Human
uaagauggcggaggccagc

SEQ ID NO: 97398 - RNA, 21 nt, Human
uacagugggaggggggguugg

SEQ ID NO: 97399 - RNA, 19 nt, Human
uacaugcaagaaaaggagg

SEQ ID NO: 97400 - RNA, 18 nt, Human
uagggaguguugggggag

SEQ ID NO: 97401 - RNA, 19 nt, Human
uagggaguguugggggagg

SEQ ID NO: 97402 - RNA, 18 nt, Human
ucgugggguccaagacua

SEQ ID NO: 97403 - RNA, 22 nt, Human
ugcaagaaaaggagggaacuga

SEQ ID NO: 97404 - RNA, 22 nt, Human
ugggaggggggguuggagggag

SEQ ID NO: 97405 - RNA, 23 nt, Human
ugggaggggggguuggagggagu

SEQ ID NO: 97406 - RNA, 22 nt, Human
ugguagggaguguugggggagg

SEQ ID NO: 97407 - RNA, 24 nt, Human
uguugggggagggaggagcacagg

SEQ ID NO: 97408 - RNA, 20 nt, Human
uugguagggaguguuggggg

SEQ ID NO: 97409 - RNA, 19 nt, Human
aguauuuguuuuuauuuuu

SEQ ID NO: 97410 - RNA, 19 nt, Human
ccuugagucuagauuuagg

SEQ ID NO: 97411 - RNA, 21 nt, Human
gaaagucucucugcuaggagc

SEQ ID NO: 97412 - RNA, 21 nt, Human
gagaaacccccaaauuugcuc

SEQ ID NO: 97413 - RNA, 21 nt, Human
gucaucucugggaaccuugag

SEQ ID NO: 97414 - RNA, 18 nt, Human
uccggcaaaagcguggag

SEQ ID NO: 97415 - RNA, 19 nt, Human
ucucugggaaccuugaguc

SEQ ID NO: 97416 - RNA, 18 nt, Human
ucugcuaggagcuuucca

SEQ ID NO: 97417 - RNA, 21 nt, Human
ugagucuagauuuagggcuga

SEQ ID NO: 97418 - RNA, 22 nt, Human
uuugagaaacccccaaauuugc

SEQ ID NO: 97419 - RNA, 21 nt, Human
uuugcucugauggccuuucuu

SEQ ID NO: 97420 - RNA, 20 nt, Human
aaaaagcagagcagagagcg

SEQ ID NO: 97421 - RNA, 25 nt, Human
aaaaagcagagcagagagcguuuuc

SEQ ID NO: 97422 - RNA, 24 nt, Human
aaaacagacucaacaacucagcug

SEQ ID NO: 97423 - RNA, 19 nt, Human
aaaacaguagaaaaaaagc

SEQ ID NO: 97424 - RNA, 18 nt, Human
aaggcagggccguaagcc

SEQ ID NO: 97425 - RNA, 22 nt, Human
acaacagaagccaaauuuacag

SEQ ID NO: 97426 - RNA, 22 nt, Human
agaaaaaaagcagagcagagag

SEQ ID NO: 97427 - RNA, 18 nt, Human
agaaauucgcacuccccc

SEQ ID NO: 97428 - RNA, 23 nt, Human
aggagaaaaggagucucugcugg

SEQ ID NO: 97429 - RNA, 22 nt, Human
auccugugucucauaaucuggg

SEQ ID NO: 97430 - RNA, 22 nt, Human
aucugggcgucugcaggucugg

SEQ ID NO: 97431 - RNA, 23 nt, Human
caacagaagccaaauuuacagca

SEQ ID NO: 97432 - RNA, 18 nt, Human
caaggcagggccguaagc

SEQ ID NO: 97433 - RNA, 18 nt, Human
cacacuguuuuuuaugcc

SEQ ID NO: 97434 - RNA, 21 nt, Human
cacacuguuuuuuaugccacu

SEQ ID NO: 97435 - RNA, 19 nt, Human
caccggcaaaccagagggc

SEQ ID NO: 97436 - RNA, 19 nt, Human
cacucccuuaaagagugca

SEQ ID NO: 97437 - RNA, 18 nt, Human
cacuguguaaccacacug

SEQ ID NO: 97438 - RNA, 19 nt, Human
cacuguguaaccacacugu

SEQ ID NO: 97439 - RNA, 24 nt, Human
cagaagccaaauuuacagcaggag

SEQ ID NO: 97440 - RNA, 22 nt, Human
cagagcagagagcguuuuccau

SEQ ID NO: 97441 - RNA, 22 nt, Human
cagcaguacccuaguacauuga

SEQ ID NO: 97442 - RNA, 18 nt, Human
cagcucaucaaggucagu

SEQ ID NO: 97443 - RNA, 19 nt, Human
cagcucccugguugcaccu

SEQ ID NO: 97444 - RNA, 20 nt, Human
caggagacaggucuaccugc

SEQ ID NO: 97445 - RNA, 25 nt, Human
cauggccugugcccuguaaugacgc

SEQ ID NO: 97446 - RNA, 22 nt, Human
ccagggaggcacaacauggccc

SEQ ID NO: 97447 - RNA, 19 nt, Human
ccauguguugcgucuuccu

SEQ ID NO: 97448 - RNA, 21 nt, Human
ccgacaggccaagaaauucgc

SEQ ID NO: 97449 - RNA, 24 nt, Human
ccugcaccaccggcaaaccagagg

SEQ ID NO: 97450 - RNA, 25 nt, Human
cgcccaccuucccaugccccugcag

SEQ ID NO: 97451 - RNA, 20 nt, Human
cucgcaggcccuggcugacc

SEQ ID NO: 97452 - RNA, 22 nt, Human
cugaggcagcgguggccgggac

SEQ ID NO: 97453 - RNA, 21 nt, Human
cugcagcuaccuccccaggaa

SEQ ID NO: 97454 - RNA, 19 nt, Human
cugccccucugcccggccc

SEQ ID NO: 97455 - RNA, 19 nt, Human
cugcccggcccucucacca

SEQ ID NO: 97456 - RNA, 25 nt, Human
cuuccugcgaggccuucacaaagau

SEQ ID NO: 97457 - RNA, 21 nt, Human
gacaggucuaccugcaccacc

SEQ ID NO: 97458 - RNA, 19 nt, Human
gaggcagaggcugaggcag

SEQ ID NO: 97459 - RNA, 24 nt, Human
gcagcaguacccuaguacauugac

SEQ ID NO: 97460 - RNA, 18 nt, Human
gccacuguccgcugggca

SEQ ID NO: 97461 - RNA, 18 nt, Human
gcccuguaaugacgcagc

SEQ ID NO: 97462 - RNA, 18 nt, Human
gccuucacaaagaugauu

SEQ ID NO: 97463 - RNA, 21 nt, Human
gcuccuuuccaucugccccuc

SEQ ID NO: 97464 - RNA, 24 nt, Human
gcugcauuuucacugaagcauuua

SEQ ID NO: 97465 - RNA, 22 nt, Human
ggaggcagaggcugaggcagcg

SEQ ID NO: 97466 - RNA, 20 nt, Human
ggccuaggcuccuuuccauc

SEQ ID NO: 97467 - RNA, 21 nt, Human
gggaggcagaggcugaggcag

SEQ ID NO: 97468 - RNA, 21 nt, Human
guuguaaaugcuucauccugu

SEQ ID NO: 97469 - RNA, 21 nt, Human
uaaccaaagcauccuguacau

SEQ ID NO: 97470 - RNA, 18 nt, Human
uacccuaguacauugacg

SEQ ID NO: 97471 - RNA, 21 nt, Human
uaggagaaaaggagucucugc

SEQ ID NO: 97472 - RNA, 26 nt, Human
uaggcuccuuuccaucugccccuccu

SEQ ID NO: 97473 - RNA, 21 nt, Human
ucaacggccuccucuugcucc

SEQ ID NO: 97474 - RNA, 21 nt, Human
ucagaaagaggcugggaggca

SEQ ID NO: 97475 - RNA, 19 nt, Human
ucaguggcugagaagagug

SEQ ID NO: 97476 - RNA, 21 nt, Human
ucaguggcugagaagagugaa

SEQ ID NO: 97477 - RNA, 24 nt, Human
uccauggccugugcccuguaauga

SEQ ID NO: 97478 - RNA, 21 nt, Human
ucccagggagaacgaggaacc

SEQ ID NO: 97479 - RNA, 21 nt, Human
uccccugcccgcccaccuucc

SEQ ID NO: 97480 - RNA, 23 nt, Human
uccccugcccgcccaccuuccca

SEQ ID NO: 97481 - RNA, 23 nt, Human
ucccgcugcccucgcaggcccug

SEQ ID NO: 97482 - RNA, 19 nt, Human
ucccugguugcaccuggcc

SEQ ID NO: 97483 - RNA, 18 nt, Human
ucccuuaaagagugcagg

SEQ ID NO: 97484 - RNA, 18 nt, Human
ucugcagcuaccucccca

SEQ ID NO: 97485 - RNA, 22 nt, Human
ucugcagcuaccuccccaggaa

SEQ ID NO: 97486 - RNA, 23 nt, Human
ugaaaggaggugaaggugacaac

SEQ ID NO: 97487 - RNA, 24 nt, Human
ugaagugaaucaacggccuccucu

SEQ ID NO: 97488 - RNA, 24 nt, Human
ugacaacagaagccaaauuuacag

SEQ ID NO: 97489 - RNA, 20 nt, Human
ugacccuccccugcccgccc

SEQ ID NO: 97490 - RNA, 18 nt, Human
ugagaagagugaaccggg

SEQ ID NO: 97491 - RNA, 21 nt, Human
ugagaagagugaaccggguug

SEQ ID NO: 97492 - RNA, 24 nt, Human
ugagaggcagugcgcccgccuccc

SEQ ID NO: 97493 - RNA, 22 nt, Human
ugaggcagggaggcucccgcug

SEQ ID NO: 97494 - RNA, 20 nt, Human
ugcacagcucaucaagguca

SEQ ID NO: 97495 - RNA, 24 nt, Human
ugccccugcagcucccugguugca

SEQ ID NO: 97496 - RNA, 25 nt, Human
ugccccugcagcucccugguugcac

SEQ ID NO: 97497 - RNA, 24 nt, Human
uggcugagaagagugaaccggguu

SEQ ID NO: 97498 - RNA, 21 nt, Human
ugggaggcagaggcugagggg

SEQ ID NO: 97499 - RNA, 19 nt, Human
ugggcgucugcaggucugg

SEQ ID NO: 97500 - RNA, 21 nt, Human
uggugcggcacagaggccuga

SEQ ID NO: 97501 - RNA, 21 nt, Human
uucaauggugcggcacagagg

SEQ ID NO: 97502 - RNA, 21 nt, Human
uucacugaagcauuuauuaug

SEQ ID NO: 97503 - RNA, 22 nt, Human
uucacugaagcauuuauuaugc

SEQ ID NO: 97504 - RNA, 24 nt, Human
uuuacaaaacagacucaacaacuc

SEQ ID NO: 97505 - RNA, 20 nt, Human
aaaccucuggaucugcaucc

SEQ ID NO: 97506 - RNA, 19 nt, Human
aaaggaaauggcguggagg

SEQ ID NO: 97507 - RNA, 23 nt, Human
aagccggggccuaacccaggaga

SEQ ID NO: 97508 - RNA, 23 nt, Human
aaggaaaaggaaauggcguggag

SEQ ID NO: 97509 - RNA, 20 nt, Human
aagggaggguguggggcagg

SEQ ID NO: 97510 - RNA, 20 nt, Human
acggugugauuaagccucug

SEQ ID NO: 97511 - RNA, 18 nt, Human
acuggcuuggcuguguga

SEQ ID NO: 97512 - RNA, 21 nt, Human
agaaggaaauagggaaaagga

SEQ ID NO: 97513 - RNA, 24 nt, Human
agacaggaggagaaggaaauaggg

SEQ ID NO: 97514 - RNA, 18 nt, Human
aggagaaggaaauaggga

SEQ ID NO: 97515 - RNA, 22 nt, Human
aggaggcgaacaggaggccaga

SEQ ID NO: 97516 - RNA, 20 nt, Human
agggaggccuucaucccugc

SEQ ID NO: 97517 - RNA, 22 nt, Human
augaucaucuuaguucugucac

SEQ ID NO: 97518 - RNA, 24 nt, Human
augccagccagggcuggcccugaa

SEQ ID NO: 97519 - RNA, 21 nt, Human
auuuuuauuucagcucagggg

SEQ ID NO: 97520 - RNA, 21 nt, Human
caaaguaagcaaauggggagc

SEQ ID NO: 97521 - RNA, 23 nt, Human
caaaguaagcaaauggggagccc

SEQ ID NO: 97522 - RNA, 24 nt, Human
cacucugauuagaagagccaaagg

SEQ ID NO: 97523 - RNA, 18 nt, Human
cagacacccagccucacc

SEQ ID NO: 97524 - RNA, 23 nt, Human
cagcaauaggggggucuuccugg

SEQ ID NO: 97525 - RNA, 20 nt, Human
cagcagcaauaggggggucu

SEQ ID NO: 97526 - RNA, 19 nt, Human
cagcaguggaacuugggac

SEQ ID NO: 97527 - RNA, 18 nt, Human
cagcauggggcaggaggu

SEQ ID NO: 97528 - RNA, 23 nt, Human
cagggguggagagugggcacaaa

SEQ ID NO: 97529 - RNA, 21 nt, Human
cauccuugacuggcuuggcug

SEQ ID NO: 97530 - RNA, 24 nt, Human
ccagacacccagccucacccucca

SEQ ID NO: 97531 - RNA, 19 nt, Human
ccagccagggcuggcccug

SEQ ID NO: 97532 - RNA, 20 nt, Human
ccagccuuguaggauuuuuc

SEQ ID NO: 97533 - RNA, 23 nt, Human
ccaggagguucugcacaggguca

SEQ ID NO: 97534 - RNA, 23 nt, Human
ccaugcuccaugcuuccagacac

SEQ ID NO: 97535 - RNA, 22 nt, Human
cccaaaaguacacauugaguac

SEQ ID NO: 97536 - RNA, 19 nt, Human
cccacagaaauggcagggc

SEQ ID NO: 97537 - RNA, 20 nt, Human
cccagcaaagcucgcuucca

SEQ ID NO: 97538 - RNA, 24 nt, Human
cccagccucacccuccaugccagc

SEQ ID NO: 97539 - RNA, 23 nt, Human
cccaugcuccaugcuuccagaca

SEQ ID NO: 97540 - RNA, 21 nt, Human
cccgcugcuucucaaacaggc

SEQ ID NO: 97541 - RNA, 24 nt, Human
cccucucaggcuagcuacccccuc

SEQ ID NO: 97542 - RNA, 19 nt, Human
cccuguguccugaaugguc

SEQ ID NO: 97543 - RNA, 20 nt, Human
ccuccaugccagccagggcu

SEQ ID NO: 97544 - RNA, 22 nt, Human
ccugaacacuccccugggaucc

SEQ ID NO: 97545 - RNA, 22 nt, Human
ccuuggaggguucccucucagg

SEQ ID NO: 97546 - RNA, 18 nt, Human
cgugcaagcuccugcccu

SEQ ID NO: 97547 - RNA, 20 nt, Human
cuacccccucucccagcaaa

SEQ ID NO: 97548 - RNA, 21 nt, Human
cuagagagcaacacucaaccg

SEQ ID NO: 97549 - RNA, 19 nt, Human
cuccagcacuugcuagucc

SEQ ID NO: 97550 - RNA, 21 nt, Human
cuccugcccucugugguccca

SEQ ID NO: 97551 - RNA, 21 nt, Human
cucucugagcucugguucugg

SEQ ID NO: 97552 - RNA, 19 nt, Human
cucuggaucugcauccauc

SEQ ID NO: 97553 - RNA, 21 nt, Human
cugcauccauccuugacuggc

SEQ ID NO: 97554 - RNA, 19 nt, Human
cugggcuugcgucuuucuu

SEQ ID NO: 97555 - RNA, 22 nt, Human
cuugcccgcugcuucucaaaca

SEQ ID NO: 97556 - RNA, 19 nt, Human
cuugcgucuuucuugcccg

SEQ ID NO: 97557 - RNA, 20 nt, Human
cuuggaggguucccucucag

SEQ ID NO: 97558 - RNA, 24 nt, Human
gaaggaaaaggaaauggcguggag

SEQ ID NO: 97559 - RNA, 24 nt, Human
gagaaauaaugagagaagggccgg

SEQ ID NO: 97560 - RNA, 22 nt, Human
gagaaggaaauagggaaaagga

SEQ ID NO: 97561 - RNA, 20 nt, Human
gagagggucagagagaaaua

SEQ ID NO: 97562 - RNA, 18 nt, Human
gaggaggguaagggaggg

SEQ ID NO: 97563 - RNA, 22 nt, Human
gaggccguguacauggggcugu

SEQ ID NO: 97564 - RNA, 21 nt, Human
gagguucugcacagggucagu

SEQ ID NO: 97565 - RNA, 20 nt, Human
gcagggccucugggcuugcg

SEQ ID NO: 97566 - RNA, 24 nt, Human
gccagaaaccucuggaucugcauc

SEQ ID NO: 97567 - RNA, 20 nt, Human
gcucccagcuugcacucuga

SEQ ID NO: 97568 - RNA, 24 nt, Human
ggaaauagggaaaaggaguuggga

SEQ ID NO: 97569 - RNA, 19 nt, Human
gggccugagccaguaggga

SEQ ID NO: 97570 - RNA, 21 nt, Human
ggguaagggaggguguggggc

SEQ ID NO: 97571 - RNA, 22 nt, Human
ggugaggaaggguaggaagaga

SEQ ID NO: 97572 - RNA, 22 nt, Human
gucaggaugugagucuguggcc

SEQ ID NO: 97573 - RNA, 24 nt, Human
guccugaauggucuggaggagggu

SEQ ID NO: 97574 - RNA, 18 nt, Human
uaacccaggagaaacaau

SEQ ID NO: 97575 - RNA, 23 nt, Human
uaacccaggagaaacaauggcaa

SEQ ID NO: 97576 - RNA, 19 nt, Human
uaagcaaauggggagcccc

SEQ ID NO: 97577 - RNA, 22 nt, Human
uacauggggcuguguccagagg

SEQ ID NO: 97578 - RNA, 18 nt, Human
uagcuacccccucuccca

SEQ ID NO: 97579 - RNA, 20 nt, Human
uaggaagagaggggauccug

SEQ ID NO: 97580 - RNA, 23 nt, Human
uccaugccagccagggcuggccc

SEQ ID NO: 97581 - RNA, 21 nt, Human
ucccuguguccugaauggucu

SEQ ID NO: 97582 - RNA, 20 nt, Human
uccgcaggcaggaaacgcgg

SEQ ID NO: 97583 - RNA, 20 nt, Human
ucuggaggaggguaagggag

SEQ ID NO: 97584 - RNA, 21 nt, Human
ucuggaggaggguaagggagg

SEQ ID NO: 97585 - RNA, 25 nt, Human
ugaaggaaaaggaaauggcguggag

SEQ ID NO: 97586 - RNA, 21 nt, Human
ugagagaagggcuaggcuuga

SEQ ID NO: 97587 - RNA, 21 nt, Human
ugagagaagggcuaggcuuga

SEQ ID NO: 97588 - RNA, 22 nt, Human
ugagcaguggggagagggucag

SEQ ID NO: 97589 - RNA, 23 nt, Human
ugagcaguggggagagggucagg

SEQ ID NO: 97590 - RNA, 20 nt, Human
ugaggccguguacauggggc

SEQ ID NO: 97591 - RNA, 23 nt, Human
ugaguacccaccacuagccacug

SEQ ID NO: 97592 - RNA, 18 nt, Human
ugauuaagccucuggaaa

SEQ ID NO: 97593 - RNA, 18 nt, Human
ugccagaaaccucuggau

SEQ ID NO: 97594 - RNA, 22 nt, Human
ugccgagggaggcaggggccug

SEQ ID NO: 97595 - RNA, 19 nt, Human
ugccugugcucccagcuug

SEQ ID NO: 97596 - RNA, 21 nt, Human
ugccugugcucccagcuugca

SEQ ID NO: 97597 - RNA, 27 nt, Human
ugccugugcucccagcuugcacucuga

SEQ ID NO: 97598 - RNA, 30 nt, Human
ugcuccaugcuuccagacacccagccucaa

SEQ ID NO: 97599 - RNA, 22 nt, Human
uggaggaggguaagggagggug

SEQ ID NO: 97600 - RNA, 21 nt, Human
uggcguggaggacggugugau

SEQ ID NO: 97601 - RNA, 20 nt, Human
uggggaggcugcaaguggga

SEQ ID NO: 97602 - RNA, 21 nt, Human
uggggcaggagguacuggcuc

SEQ ID NO: 97603 - RNA, 21 nt, Human
uguccagaggggcuguuugug

SEQ ID NO: 97604 - RNA, 19 nt, Human
uuaguucugucacugccag

SEQ ID NO: 97605 - RNA, 19 nt, Human
uucuugcccgcugcuucuc

SEQ ID NO: 97606 - RNA, 24 nt, Human
uugaaggaaaaggaaauggcgugg

SEQ ID NO: 97607 - RNA, 24 nt, Human
uugacuggcuuggcugugugauuu

SEQ ID NO: 97608 - RNA, 23 nt, Human
uuuuuuuuuuuuuuuuuaucuuu

SEQ ID NO: 97609 - RNA, 18 nt, Human
aaaauggacccauucaaa

SEQ ID NO: 97610 - RNA, 19 nt, Human
aacuaguacaccccaaccu

SEQ ID NO: 97611 - RNA, 27 nt, Human
aagaacaaaacacaaaaaacaaaaaga

SEQ ID NO: 97612 - RNA, 25 nt, Human
aaguaacuuuaaaaaauuauacuga

SEQ ID NO: 97613 - RNA, 18 nt, Human
acaaaacacaaaaaacaa

SEQ ID NO: 97614 - RNA, 21 nt, Human
acaaaacacaaaaaacaaaaa

SEQ ID NO: 97615 - RNA, 19 nt, Human
agaacaaaacacaaaaaac

SEQ ID NO: 97616 - RNA, 19 nt, Human
aggaucccugggcgcgggg

SEQ ID NO: 97617 - RNA, 21 nt, Human
aggcuauggaagggcaaaaug

SEQ ID NO: 97618 - RNA, 21 nt, Human
auuuuaugcuaaaaaagauuc

SEQ ID NO: 97619 - RNA, 18 nt, Human
caaaacacaaaaaacaaa

SEQ ID NO: 97620 - RNA, 24 nt, Human
caaauuuccucccagggaccaggc

SEQ ID NO: 97621 - RNA, 19 nt, Human
caaccucaguggaaagcaa

SEQ ID NO: 97622 - RNA, 24 nt, Human
caaugcccagggauuaggcuaugg

SEQ ID NO: 97623 - RNA, 19 nt, Human
caucugaaaaauuucuaga

SEQ ID NO: 97624 - RNA, 20 nt, Human
ccugggcgcggggcaggggc

SEQ ID NO: 97625 - RNA, 23 nt, Human
cgaaaggagcuggaggaucccug

SEQ ID NO: 97626 - RNA, 20 nt, Human
cgcgggcgaaaggagcugga

SEQ ID NO: 97627 - RNA, 21 nt, Human
cgcgggcgaaaggagcuggag

SEQ ID NO: 97628 - RNA, 26 nt, Human
cucccuguaaugguuauguuuccaac

SEQ ID NO: 97629 - RNA, 18 nt, Human
cugacuuuaaagaacaaa

SEQ ID NO: 97630 - RNA, 20 nt, Human
gaaaggagcuggaggauccc

SEQ ID NO: 97631 - RNA, 21 nt, Human
gaccaggcccuauuaacccug

SEQ ID NO: 97632 - RNA, 26 nt, Human
gaccugacuuuaaagaacaaaacaca

SEQ ID NO: 97633 - RNA, 21 nt, Human
gcuauggaagggcaaaaugga

SEQ ID NO: 97634 - RNA, 18 nt, Human
gggcaggggccggcggag

SEQ ID NO: 97635 - RNA, 18 nt, Human
gggcgcgggcgaaaggag

SEQ ID NO: 97636 - RNA, 20 nt, Human
guuguuucuuuccaagauaa

SEQ ID NO: 97637 - RNA, 28 nt, Human
uaaaaaagauucgcaaugaaacaaucag

SEQ ID NO: 97638 - RNA, 19 nt, Human
uaaaaaauuauacugauca

SEQ ID NO: 97639 - RNA, 24 nt, Human
uaaagaacaaaacacaaaaaacaa

SEQ ID NO: 97640 - RNA, 24 nt, Human
uaacuaguacaccccaaccucagu

SEQ ID NO: 97641 - RNA, 21 nt, Human
uagaagccauccauagcacac

SEQ ID NO: 97642 - RNA, 21 nt, Human
uauggaagggcaaaauggacc

SEQ ID NO: 97643 - RNA, 18 nt, Human
ucccugggcgcggggcag

SEQ ID NO: 97644 - RNA, 19 nt, Human
ucccugggcgcggggcagg

SEQ ID NO: 97645 - RNA, 22 nt, Human
ucccugggcgcggggcaggggc

SEQ ID NO: 97646 - RNA, 22 nt, Human
ucccuguaaugguuauguuucc

SEQ ID NO: 97647 - RNA, 24 nt, Human
ucccuguaaugguuauguuuccaa

SEQ ID NO: 97648 - RNA, 22 nt, Human
ucucccagaagcaucugaaaaa

SEQ ID NO: 97649 - RNA, 21 nt, Human
ucugaaaaauuucuagagggg

SEQ ID NO: 97650 - RNA, 20 nt, Human
uggaaagcaaugcccaggga

SEQ ID NO: 97651 - RNA, 23 nt, Human
uguaguuuuuguuagaagccauc

SEQ ID NO: 97652 - RNA, 19 nt, Human
uguccggagcgaacggagg

SEQ ID NO: 97653 - RNA, 21 nt, Human
uuaaaaaauuauacugaucaa

SEQ ID NO: 97654 - RNA, 20 nt, Human
uugcaucuguuaaguguccc

SEQ ID NO: 97655 - RNA, 24 nt, Human
aaucaucaaggccauggugcuuaa

SEQ ID NO: 97656 - RNA, 18 nt, Human
agugaaucaucaaggcca

SEQ ID NO: 97657 - RNA, 21 nt, Human
ccgcaggugucuggagcagca

SEQ ID NO: 97658 - RNA, 18 nt, Human
ccgccgccgccgcaggug

SEQ ID NO: 97659 - RNA, 22 nt, Human
ccgccgccgccguuacaggcag

SEQ ID NO: 97660 - RNA, 26 nt, Human
ccgccgcggggucgccgccgccgccg

SEQ ID NO: 97661 - RNA, 22 nt, Human
cuuucacgucuuacuacucucc

SEQ ID NO: 97662 - RNA, 26 nt, Human
ucgccgccgccgccgcaggugucugg

SEQ ID NO: 97663 - RNA, 24 nt, Human
ugaaucaucaaggccauggugcuu

SEQ ID NO: 97664 - RNA, 25 nt, Human
aaacaacaaagggauauaaaauuaa

SEQ ID NO: 97665 - RNA, 22 nt, Human
aauguugucacaauuuugggug

SEQ ID NO: 97666 - RNA, 23 nt, Human
agcauguguaucucuauaucucu

SEQ ID NO: 97667 - RNA, 19 nt, Human
agucucuguccuggugagg

SEQ ID NO: 97668 - RNA, 21 nt, Human
caugaucaccaacaggcaaga

SEQ ID NO: 97669 - RNA, 21 nt, Human
cucguugauaauucagcagca

SEQ ID NO: 97670 - RNA, 24 nt, Human
gagcaugaucaccaacaggccgug

SEQ ID NO: 97671 - RNA, 18 nt, Human
uaaaaguuaacuugaaaa

SEQ ID NO: 97672 - RNA, 18 nt, Human
uaucaaauguuuauuuua

SEQ ID NO: 97673 - RNA, 22 nt, Human
uguacuagaaaacaacaaaggg

SEQ ID NO: 97674 - RNA, 18 nt, Human
uucuggucagccuauacc

SEQ ID NO: 97675 - RNA, 22 nt, Human
uuuuuuuuuuuuuuuuuuucag

SEQ ID NO: 97676 - RNA, 23 nt, Human
aaaaugcacucgcccagcuguga

SEQ ID NO: 97677 - RNA, 23 nt, Human
aagaggccaaagcgcucgauuug

SEQ ID NO: 97678 - RNA, 27 nt, Human
aagaggccaaagcgcucggugggcacc

SEQ ID NO: 97679 - RNA, 23 nt, Human
aaggaaggugucuuuagaugagg

SEQ ID NO: 97680 - RNA, 20 nt, Human
accagggacagagucugagg

SEQ ID NO: 97681 - RNA, 19 nt, Human
agaugaggggguuggggag

SEQ ID NO: 97682 - RNA, 28 nt, Human
agcagcgccuguccggaaggcuucuggg

SEQ ID NO: 97683 - RNA, 19 nt, Human
agcuuccuugucacuccuu

SEQ ID NO: 97684 - RNA, 23 nt, Human
agggaaagggggcccccuucaga

SEQ ID NO: 97685 - RNA, 18 nt, Human
aggugucuuuagaugagg

SEQ ID NO: 97686 - RNA, 26 nt, Human
cacuacuuacaaaaaacuauucaaaa

SEQ ID NO: 97687 - RNA, 18 nt, Human
cagacacccccgagucuc

SEQ ID NO: 97688 - RNA, 26 nt, Human
cagcagcgccuguccggaaggcuucc

SEQ ID NO: 97689 - RNA, 22 nt, Human
cagggacagagucugaggagaa

SEQ ID NO: 97690 - RNA, 21 nt, Human
ccccagagggauccgcagggg

SEQ ID NO: 97691 - RNA, 20 nt, Human
cccccgagucucuaguugga

SEQ ID NO: 97692 - RNA, 24 nt, Human
cggggcagcagcgccuguccggaa

SEQ ID NO: 97693 - RNA, 21 nt, Human
cucaggacaaacaggucuggc

SEQ ID NO: 97694 - RNA, 18 nt, Human
cugaccaccacggcugca

SEQ ID NO: 97695 - RNA, 24 nt, Human
cugggcagcugggcaccgcaggug

SEQ ID NO: 97696 - RNA, 24 nt, Human
gaggaaaagcacuacuuacaaaaa

SEQ ID NO: 97697 - RNA, 22 nt, Human
gcagggaaagggggcccccuuc

SEQ ID NO: 97698 - RNA, 18 nt, Human
gccuucucuugccucagc

SEQ ID NO: 97699 - RNA, 22 nt, Human
gcucugcccaccacagcuucca

SEQ ID NO: 97700 - RNA, 21 nt, Human
gcugucuuugugcucagguga

SEQ ID NO: 97701 - RNA, 18 nt, Human
gcuuguuuuggggcucug

SEQ ID NO: 97702 - RNA, 22 nt, Human
ggaaggcuucuggccucugucc

SEQ ID NO: 97703 - RNA, 18 nt, Human
ggcugcagaggucuccgg

SEQ ID NO: 97704 - RNA, 23 nt, Human
gugagggugucuggccggguauc

SEQ ID NO: 97705 - RNA, 20 nt, Human
uauucaaaaugcacucgccc

SEQ ID NO: 97706 - RNA, 20 nt, Human
ucaaaaugcacucgcccagc

SEQ ID NO: 97707 - RNA, 25 nt, Human
uccccagcgggcagggaaagggggc

SEQ ID NO: 97708 - RNA, 18 nt, Human
ucucuugccucagccugg

SEQ ID NO: 97709 - RNA, 20 nt, Human
ucugcccaccacagcuucca

SEQ ID NO: 97710 - RNA, 23 nt, Human
ucuuugugcucaggugagcagcc

SEQ ID NO: 97711 - RNA, 23 nt, Human
ugaagagcggacaguuuucucag

SEQ ID NO: 97712 - RNA, 18 nt, Human
ugccucagccugggcagc

SEQ ID NO: 97713 - RNA, 21 nt, Human
ugccucagccugggcagcugg

SEQ ID NO: 97714 - RNA, 22 nt, Human
uggaaggcugcuuguuuugggg

SEQ ID NO: 97715 - RNA, 22 nt, Human
uggaggggcggccgagcuguug

SEQ ID NO: 97716 - RNA, 24 nt, Human
uggaugcugcacagaagaggccaa

SEQ ID NO: 97717 - RNA, 18 nt, Human
uggcuugacagccagugg

SEQ ID NO: 97718 - RNA, 21 nt, Human
uggggaggggagucauaagac

SEQ ID NO: 97719 - RNA, 18 nt, Human
uguuuuggggcucugccc

SEQ ID NO: 97720 - RNA, 22 nt, Human
uucacugagacgccgcucccca

SEQ ID NO: 97721 - RNA, 22 nt, Human
uugugcucaggugagcagccuc

SEQ ID NO: 97722 - RNA, 18 nt, Human
aaagaaauugaaaugaga

SEQ ID NO: 97723 - RNA, 20 nt, Human
aagacugggcauuauuuaga

SEQ ID NO: 97724 - RNA, 22 nt, Human
acauuaacaaaaucuuaucuga

SEQ ID NO: 97725 - RNA, 22 nt, Human
agacagggaccuaaaaagggaa

SEQ ID NO: 97726 - RNA, 21 nt, Human
agggaaaggaugggaggagga

SEQ ID NO: 97727 - RNA, 19 nt, Human
augguccagugagccuggc

SEQ ID NO: 97728 - RNA, 23 nt, Human
auugaaaugagaucuugcccuuu

SEQ ID NO: 97729 - RNA, 23 nt, Human
caacuagucucuugcuugacuuu

SEQ ID NO: 97730 - RNA, 28 nt, Human
cacccacuucucugguuguugucgggac

SEQ ID NO: 97731 - RNA, 18 nt, Human
ccagaagucuucuuacug

SEQ ID NO: 97732 - RNA, 19 nt, Human
ccagaagucuucuuacugu

SEQ ID NO: 97733 - RNA, 23 nt, Human
ccuaaaaagggaaaggaugggag

SEQ ID NO: 97734 - RNA, 20 nt, Human
cuggccccagaacucccuuc

SEQ ID NO: 97735 - RNA, 18 nt, Human
cuugacuuuggggagaag

SEQ ID NO: 97736 - RNA, 24 nt, Human
gaaagauugucuugcugccugaga

SEQ ID NO: 97737 - RNA, 20 nt, Human
gacagggaccuaaaaaggga

SEQ ID NO: 97738 - RNA, 29 nt, Human
gagaugaaacaagucucuucaccacagaa

SEQ ID NO: 97739 - RNA, 27 nt, Human
gccccagaacucccuucaacuagucuc

SEQ ID NO: 97740 - RNA, 24 nt, Human
ggccauuaaauccaggggggagcc

SEQ ID NO: 97741 - RNA, 18 nt, Human
ggcccucuaauaaagaaa

SEQ ID NO: 97742 - RNA, 20 nt, Human
gggcacuuagucaaagagaa

SEQ ID NO: 97743 - RNA, 23 nt, Human
gggcacuuagucaaagagaaaca

SEQ ID NO: 97744 - RNA, 23 nt, Human
uaagugacugguugaaaucagga

SEQ ID NO: 97745 - RNA, 23 nt, Human
uagaacacaucaauaaggcccuc

SEQ ID NO: 97746 - RNA, 24 nt, Human
uauuaguuucaccacuuugagaga

SEQ ID NO: 97747 - RNA, 22 nt, Human
ucacuggauaguuuuuuucugg

SEQ ID NO: 97748 - RNA, 18 nt, Human
uccuggguucacccuuug

SEQ ID NO: 97749 - RNA, 26 nt, Human
ucucugguuguauaagacagggacug

SEQ ID NO: 97750 - RNA, 20 nt, Human
ugagagacauggcugcugcc

SEQ ID NO: 97751 - RNA, 18 nt, Human
ugauagagagauaauacc

SEQ ID NO: 97752 - RNA, 23 nt, Human
uggaaagacuuagaacacaucaa

SEQ ID NO: 97753 - RNA, 22 nt, Human
ugggaggaggaucauccugcag

SEQ ID NO: 97754 - RNA, 18 nt, Human
ugggaugugccuggccaa

SEQ ID NO: 97755 - RNA, 21 nt, Human
ugguccagugagccuggcccc

SEQ ID NO: 97756 - RNA, 20 nt, Human
uuagaggcuggagacuaauu

SEQ ID NO: 97757 - RNA, 26 nt, Human
uugagauaauaaacuguuuuauuuau

SEQ ID NO: 97758 - RNA, 20 nt, Human
uugcugccugagaugggaug

SEQ ID NO: 97759 - RNA, 20 nt, Human
uuuggagaaagagaacugug

SEQ ID NO: 97760 - RNA, 23 nt, Human
aaacaauuuacugacaaaaaaag

SEQ ID NO: 97761 - RNA, 19 nt, Human
aaagcagcugcuucaaguu

SEQ ID NO: 97762 - RNA, 21 nt, Human
acaauuuacugacaaaaaaag

SEQ ID NO: 97763 - RNA, 19 nt, Human
cagccaaaacuaaugcuug

SEQ ID NO: 97764 - RNA, 19 nt, Human
cuguugucuucaucuucug

SEQ ID NO: 97765 - RNA, 21 nt, Human
cuguugucuucaucuucuguu

SEQ ID NO: 97766 - RNA, 24 nt, Human
uaaaaacaauuuacugacaaaaaa

SEQ ID NO: 97767 - RNA, 22 nt, Human
uacugacaaaaaaagcaagcac

SEQ ID NO: 97768 - RNA, 21 nt, Human
ugcuuguucuuuguuaguggg

SEQ ID NO: 97769 - RNA, 19 nt, Human
uucuucuuaaagcagcugc

SEQ ID NO: 97770 - RNA, 21 nt, Human
uuguuaguggguauuucuucu

SEQ ID NO: 97771 - RNA, 20 nt, Human
aaaauuuaaagacagaggaa

SEQ ID NO: 97772 - RNA, 23 nt, Human
aagagaaagcggacuacgcagga

SEQ ID NO: 97773 - RNA, 23 nt, Human
aagagaaagcggacuacgcagga

SEQ ID NO: 97774 - RNA, 26 nt, Human
aaggaucuuguugucccugacugaca

SEQ ID NO: 97775 - RNA, 19 nt, Human
acaccauugauguaugcua

SEQ ID NO: 97776 - RNA, 21 nt, Human
acaccuacuucacucuuagac

SEQ ID NO: 97777 - RNA, 19 nt, Human
acagaaccuggcggcgccc

SEQ ID NO: 97778 - RNA, 24 nt, Human
acaggauccauuuggaaaauauca

SEQ ID NO: 97779 - RNA, 24 nt, Human
acugcauauccuuuucggccauaa

SEQ ID NO: 97780 - RNA, 18 nt, Human
agaacccacucaagcugu

SEQ ID NO: 97781 - RNA, 22 nt, Human
agaagaaagcuggcacugcuca

SEQ ID NO: 97782 - RNA, 28 nt, Human
agaucuguuguuauuaaggaugaccuuu

SEQ ID NO: 97783 - RNA, 19 nt, Human
augguaaaacauaccccug

SEQ ID NO: 97784 - RNA, 21 nt, Human
caacacgggaucccugaaguu

SEQ ID NO: 97785 - RNA, 25 nt, Human
caagagcaaaggaggaagcaugcaa

SEQ ID NO: 97786 - RNA, 24 nt, Human
caagcuaauuuuauucuuucccaa

SEQ ID NO: 97787 - RNA, 21 nt, Human
cacucgguuuguccaacagag

SEQ ID NO: 97788 - RNA, 20 nt, Human
cacuuaauacugccagucac

SEQ ID NO: 97789 - RNA, 19 nt, Human
cagaguauaaucaaggguu

SEQ ID NO: 97790 - RNA, 23 nt, Human
cauugcacucgguuuguccaaca

SEQ ID NO: 97791 - RNA, 21 nt, Human
cauuuucagaaaagcaucauu

SEQ ID NO: 97792 - RNA, 25 nt, Human
ccagaaguccucuagcucugcauua

SEQ ID NO: 97793 - RNA, 24 nt, Human
ccagagccccucuaucuuagccag

SEQ ID NO: 97794 - RNA, 21 nt, Human
cccacauauggaacauuuggc

SEQ ID NO: 97795 - RNA, 21 nt, Human
cccacuucccugccagaaguc

SEQ ID NO: 97796 - RNA, 18 nt, Human
ccccacuucccugccaga

SEQ ID NO: 97797 - RNA, 31 nt, Human
cucaaacuguaaccacaaaggguguccccag

SEQ ID NO: 97798 - RNA, 25 nt, Human
cucauauacuccugccccacccucc

SEQ ID NO: 97799 - RNA, 25 nt, Human
cuccauggcaacacgggaucccuga

SEQ ID NO: 97800 - RNA, 23 nt, Human
cugcauauccuuuucggccauaa

SEQ ID NO: 97801 - RNA, 24 nt, Human
cuggcggcgcccaggauccucucc

SEQ ID NO: 97802 - RNA, 20 nt, Human
cuguaaccacaaaggguguc

SEQ ID NO: 97803 - RNA, 21 nt, Human
cuguguguggcaaagccaaga

SEQ ID NO: 97804 - RNA, 18 nt, Human
cuucaaguggggcuuccc

SEQ ID NO: 97805 - RNA, 19 nt, Human
cuucuuucaguugcuacca

SEQ ID NO: 97806 - RNA, 24 nt, Human
gaacacuuccccacuucccugcca

SEQ ID NO: 97807 - RNA, 22 nt, Human
gaacauuuggcaugccuccaug

SEQ ID NO: 97808 - RNA, 28 nt, Human
gaucuuguugucccugacugacacccac

SEQ ID NO: 97809 - RNA, 23 nt, Human
gccaagaucauaaaauacaaaug

SEQ ID NO: 97810 - RNA, 19 nt, Human
gccauaaccacauucaccc

SEQ ID NO: 97811 - RNA, 22 nt, Human
ggaaaaacucgauuuucagcca

SEQ ID NO: 97812 - RNA, 24 nt, Human
guggaagauaacaaagcccauaua

SEQ ID NO: 97813 - RNA, 23 nt, Human
uaaaauuuaaagacagaggaaaa

SEQ ID NO: 97814 - RNA, 19 nt, Human
uacauccaaggagccagag

SEQ ID NO: 97815 - RNA, 19 nt, Human
uacuauauacacacauacc

SEQ ID NO: 97816 - RNA, 21 nt, Human
uacuauauacacacauaccug

SEQ ID NO: 97817 - RNA, 24 nt, Human
uacuccugccccacccuccaaaga

SEQ ID NO: 97818 - RNA, 23 nt, Human
uauauacacacauaccugaacug

SEQ ID NO: 97819 - RNA, 24 nt, Human
uauuuuauacaaucuaugcugagu

SEQ ID NO: 97820 - RNA, 23 nt, Human
ucaaacuguaaccacaaagggug

SEQ ID NO: 97821 - RNA, 19 nt, Human
ucaagaaauuccuccaucu

SEQ ID NO: 97822 - RNA, 24 nt, Human
uccaauaaaaaaaaggcaaggaaa

SEQ ID NO: 97823 - RNA, 21 nt, Human
ucccaagagcaaaggaggaag

SEQ ID NO: 97824 - RNA, 19 nt, Human
ucccugcaaacaggacugg

SEQ ID NO: 97825 - RNA, 25 nt, Human
uccuaccauuccaauaaaaaaaagg

SEQ ID NO: 97826 - RNA, 21 nt, Human
ucggccauaaccacauucacc

SEQ ID NO: 97827 - RNA, 23 nt, Human
ucuggaacacuuccccacuuccc

SEQ ID NO: 97828 - RNA, 25 nt, Human
ugaaagguguguaucauuuuuuaga

SEQ ID NO: 97829 - RNA, 18 nt, Human
ugagagaggaugcucaua

SEQ ID NO: 97830 - RNA, 22 nt, Human
ugcaaacaggacuggucuucaa

SEQ ID NO: 97831 - RNA, 24 nt, Human
ugcacucgguuuguccaacagagu

SEQ ID NO: 97832 - RNA, 18 nt, Human
ugcagagaacccacucaa

SEQ ID NO: 97833 - RNA, 21 nt, Human
ugcauucauacuauauacaca

SEQ ID NO: 97834 - RNA, 19 nt, Human
ugcucauauacuccugccc

SEQ ID NO: 97835 - RNA, 19 nt, Human
uggaagauaacaaagccca

SEQ ID NO: 97836 - RNA, 18 nt, Human
ugggagaagcucuccugg

SEQ ID NO: 97837 - RNA, 20 nt, Human
ugggagaagcucuccuggug

SEQ ID NO: 97838 - RNA, 19 nt, Human
uguaguagaguguucacuc

SEQ ID NO: 97839 - RNA, 22 nt, Human
uucaaagucucccagagccccc

SEQ ID NO: 97840 - RNA, 26 nt, Human
uucacuagaauacacagggaaaagga

SEQ ID NO: 97841 - RNA, 18 nt, Human
uucauucacuagaauaca

SEQ ID NO: 97842 - RNA, 23 nt, Human
uuuucagaaaagcaucauucauu

SEQ ID NO: 97843 - RNA, 19 nt, Human
uuuucagccacuuguaccu

SEQ ID NO: 97844 - RNA, 26 nt, Human
uuuucggccauaaccacauucaccca

SEQ ID NO: 97845 - RNA, 23 nt, Human
uuuuuuuuuuuuuuuuaaguuuu

SEQ ID NO: 97846 - RNA, 19 nt, Human
uuuuuuuuuuuuuuuuuaa

SEQ ID NO: 97847 - RNA, 19 nt, Human
aaaggccagaaccaguguc

SEQ ID NO: 97848 - RNA, 23 nt, Human
aaccagugucaaagggucagggu

SEQ ID NO: 97849 - RNA, 18 nt, Human
aagauuuuuauuggggca

SEQ ID NO: 97850 - RNA, 19 nt, Human
acauggaagcucaucuucc

SEQ ID NO: 97851 - RNA, 20 nt, Human
acauggaagcucaucuuccc

SEQ ID NO: 97852 - RNA, 18 nt, Human
agaaggagguccccaagc

SEQ ID NO: 97853 - RNA, 19 nt, Human
aggagaacaagcagagggc

SEQ ID NO: 97854 - RNA, 22 nt, Human
aggagaacaagcagagggcagg

SEQ ID NO: 97855 - RNA, 23 nt, Human
aggcggggccaggggggccaggu

SEQ ID NO: 97856 - RNA, 22 nt, Human
auaagacacaacuuuagcccuc

SEQ ID NO: 97857 - RNA, 22 nt, Human
caacuuuagcccucccugaucu

SEQ ID NO: 97858 - RNA, 24 nt, Human
cagacuccugaggggaugagggag

SEQ ID NO: 97859 - RNA, 22 nt, Human
cagccuagccucagaaucuaaa

SEQ ID NO: 97860 - RNA, 23 nt, Human
cagcucacaucuacaggcagcaa

SEQ ID NO: 97861 - RNA, 23 nt, Human
caggcagcuugagaaaaggcagg

SEQ ID NO: 97862 - RNA, 23 nt, Human
cagugucaaagggucaggguuga

SEQ ID NO: 97863 - RNA, 22 nt, Human
ccagaaugaguaugaggauaau

SEQ ID NO: 97864 - RNA, 20 nt, Human
ccuacacuaagaaauaacag

SEQ ID NO: 97865 - RNA, 22 nt, Human
ccucuuucuugaccuuuuccca

SEQ ID NO: 97866 - RNA, 22 nt, Human
ccugaagcuugaggaaaaaaaa

SEQ ID NO: 97867 - RNA, 21 nt, Human
cucagccuagccucagaaucu

SEQ ID NO: 97868 - RNA, 19 nt, Human
gaaacaucauuuuuuacac

SEQ ID NO: 97869 - RNA, 21 nt, Human
gagaacaagcagagggcaggc

SEQ ID NO: 97870 - RNA, 22 nt, Human
gcaggaaaggccagaaccagug

SEQ ID NO: 97871 - RNA, 19 nt, Human
gccucaagcuuacaggccc

SEQ ID NO: 97872 - RNA, 20 nt, Human
ggaguaguggcucaagccug

SEQ ID NO: 97873 - RNA, 20 nt, Human
gggcaggcggggccaggggg

SEQ ID NO: 97874 - RNA, 22 nt, Human
gggcaggcggggccaggggggc

SEQ ID NO: 97875 - RNA, 23 nt, Human
gggcaggcggggccaggggggcc

SEQ ID NO: 97876 - RNA, 20 nt, Human
gucuacccacauuuucuuuc

SEQ ID NO: 97877 - RNA, 20 nt, Human
uaacagaauagggagguguu

SEQ ID NO: 97878 - RNA, 20 nt, Human
uaaggcauaagcccaguguu

SEQ ID NO: 97879 - RNA, 26 nt, Human
uaaguacucagccuagccucagaauc

SEQ ID NO: 97880 - RNA, 24 nt, Human
uacaaucaagucuugauucucuua

SEQ ID NO: 97881 - RNA, 20 nt, Human
uacacuaagaaauaacagaa

SEQ ID NO: 97882 - RNA, 22 nt, Human
ucagccuagccucagaaucuaa

SEQ ID NO: 97883 - RNA, 21 nt, Human
ucccugaucucuuucugccuc

SEQ ID NO: 97884 - RNA, 20 nt, Human
ucucuuauuucugucuugcc

SEQ ID NO: 97885 - RNA, 25 nt, Human
ucugccucuuucuugaccuuuuccc

SEQ ID NO: 97886 - RNA, 24 nt, Human
ucuuucuugaccuuuucccaguca

SEQ ID NO: 97887 - RNA, 20 nt, Human
ugagaaaaggcaggaaaggc

SEQ ID NO: 97888 - RNA, 21 nt, Human
ugagacugugaaaucugauuu

SEQ ID NO: 97889 - RNA, 21 nt, Human
ugagcugaaauuuaaggcuag

SEQ ID NO: 97890 - RNA, 19 nt, Human
uggaagcucaucuucccca

SEQ ID NO: 97891 - RNA, 18 nt, Human
uggcauaagacacaacuu

SEQ ID NO: 97892 - RNA, 22 nt, Human
uggcauaagacacaacuuuagc

SEQ ID NO: 97893 - RNA, 19 nt, Human
uguagccguauaauaagua

SEQ ID NO: 97894 - RNA, 22 nt, Human
ugucuaccuacacuaagaaaua

SEQ ID NO: 97895 - RNA, 22 nt, Human
uguuucauuccuuuaauguuug

SEQ ID NO: 97896 - RNA, 20 nt, Human
uguuugcagacauagaccuu

SEQ ID NO: 97897 - RNA, 19 nt, Human
uuagauaaguguaaaugug

SEQ ID NO: 97898 - RNA, 22 nt, Human
uuauuagauaaguguaaaugug

SEQ ID NO: 97899 - RNA, 20 nt, Human
uucugccucuuucuugaccu

SEQ ID NO: 97900 - RNA, 19 nt, Human
uuuacaaucaagucuugau

SEQ ID NO: 97901 - RNA, 21 nt, Human
uuuagcccucccugaucucuu

SEQ ID NO: 97902 - RNA, 18 nt, Human
uuucuuuuuuuuuuuuug

SEQ ID NO: 97903 - RNA, 18 nt, Human
uuugaggauuccaggcag

SEQ ID NO: 97904 - RNA, 20 nt, Human
uuugaggauuccaggcagcu

SEQ ID NO: 97905 - RNA, 24 nt, Human
uuuucuuuuuuuuuuuuugagacu

SEQ ID NO: 97906 - RNA, 21 nt, Human
cccagaugaggaggcugagga

SEQ ID NO: 97907 - RNA, 20 nt, Human
ccgccgcggcuccggggcuc

SEQ ID NO: 97908 - RNA, 20 nt, Human
ccggggcucucuagcugcgc

SEQ ID NO: 97909 - RNA, 21 nt, Human
ccucucccgccgcggcuccgg

SEQ ID NO: 97910 - RNA, 22 nt, Human
cuccggggcucucuagcugcgc

SEQ ID NO: 97911 - RNA, 21 nt, Human
cugcgccccccggccccucgu

SEQ ID NO: 97912 - RNA, 18 nt, Human
cuggcugcgcguuccucu

SEQ ID NO: 97913 - RNA, 26 nt, Human
cuucccaaggcuggcugcgcguuccu

SEQ ID NO: 97914 - RNA, 18 nt, Human
gccugggcuucccaaggc

SEQ ID NO: 97915 - RNA, 18 nt, Human
ggcugccgggccugggcu

SEQ ID NO: 97916 - RNA, 23 nt, Human
uagcugcgccccccggccccucg

SEQ ID NO: 97917 - RNA, 22 nt, Human
ucucccgccgcggcuccggggc

SEQ ID NO: 97918 - RNA, 22 nt, Human
ugaaaaaccuggaggauacuau

SEQ ID NO: 97919 - RNA, 22 nt, Human
uugaaaaaccuggaggauacua

SEQ ID NO: 97920 - RNA, 19 nt, Human
uuuuuuuuuuuucuuuucg

SEQ ID NO: 97921 - RNA, 21 nt, Human
uuuuuuuuuuuucuuuucggu

SEQ ID NO: 97922 - RNA, 24 nt, Human
uuuuuuuuuuuuuuuucuuuucgg

SEQ ID NO: 97923 - RNA, 24 nt, Human
uuuuuuuuuuuuuuuuuuucuuuu

SEQ ID NO: 97924 - RNA, 24 nt, Human
uuuuuuuuuuuuuuuuuuuucuuu

SEQ ID NO: 97925 - RNA, 26 nt, Human
uuuuuuuuuuuuuuuuuuuuuucuuu

SEQ ID NO: 97926 - RNA, 24 nt, Human
aaagugcugggauuacaggcauga

SEQ ID NO: 97927 - RNA, 23 nt, Human
aagaaacucauggcuuuuaaucc

SEQ ID NO: 97928 - RNA, 22 nt, Human
aagcaguucugccucagccucc

SEQ ID NO: 97929 - RNA, 24 nt, Human
aagcaguucugccucagccuccca

SEQ ID NO: 97930 - RNA, 19 nt, Human
aaguagcugggauuacagg

SEQ ID NO: 97931 - RNA, 24 nt, Human
aaguagcugggauuacaggccagc

SEQ ID NO: 97932 - RNA, 19 nt, Human
aagugcugggauuacaggc

SEQ ID NO: 97933 - RNA, 21 nt, Human
aagugcugggauuacaggcau

SEQ ID NO: 97934 - RNA, 26 nt, Human
aagugcugggauuacaggcaugagcc

SEQ ID NO: 97935 - RNA, 18 nt, Human
acaggguuucaccauguu

SEQ ID NO: 97936 - RNA, 23 nt, Human
acaggguuucaccauguuggcca

SEQ ID NO: 97937 - RNA, 24 nt, Human
acaggguuucaccauguuggccag

SEQ ID NO: 97938 - RNA, 18 nt, Human
accauguuggccaggcug

SEQ ID NO: 97939 - RNA, 22 nt, Human
accccaacccccucagugcccu

SEQ ID NO: 97940 - RNA, 21 nt, Human
acccccccaccacaccccaac

SEQ ID NO: 97941 - RNA, 25 nt, Human
aggcuggagugcaguggcgcgaucu

SEQ ID NO: 97942 - RNA, 23 nt, Human
agugauccaccugccucagccuc

SEQ ID NO: 97943 - RNA, 24 nt, Human
agugauccaccugccucagccucc

SEQ ID NO: 97944 - RNA, 23 nt, Human
agugcaguggcgcgaucuuggcu

SEQ ID NO: 97945 - RNA, 23 nt, Human
agugcaguggcgcgaucuuggcu

SEQ ID NO: 97946 - RNA, 18 nt, Human
agugcugggauuacaggc

SEQ ID NO: 97947 - RNA, 21 nt, Human
auucucucccucccuucuccc

SEQ ID NO: 97948 - RNA, 24 nt, Human
caaagugcugggauuacaggcaug

SEQ ID NO: 97949 - RNA, 20 nt, Human
caaccuccaccuccuggguu

SEQ ID NO: 97950 - RNA, 23 nt, Human
caaccuccaccuccuggguucaa

SEQ ID NO: 97951 - RNA, 19 nt, Human
caagcaguucugccucagc

SEQ ID NO: 97952 - RNA, 26 nt, Human
cacaccccaacccccucagugcccuu

SEQ ID NO: 97953 - RNA, 21 nt, Human
caccauguuggccaggcuggu

SEQ ID NO: 97954 - RNA, 24 nt, Human
caccauguuggccaggcuggucuc

SEQ ID NO: 97955 - RNA, 27 nt, Human
caccauguuggccaggcuggucucaaa

SEQ ID NO: 97956 - RNA, 25 nt, Human
caccccaacccccucagugcccugg

SEQ ID NO: 97957 - RNA, 23 nt, Human
caccugccucagccucccaaagu

SEQ ID NO: 97958 - RNA, 21 nt, Human
cacugcaaccuccaccuccug

SEQ ID NO: 97959 - RNA, 23 nt, Human
cacugcaaccuccaccuccuggg

SEQ ID NO: 97960 - RNA, 24 nt, Human
caggguuucaccauguuggccagg

SEQ ID NO: 97961 - RNA, 18 nt, Human
cagugcccugggguuuga

SEQ ID NO: 97962 - RNA, 19 nt, Human
caguggcgcgaucuuggcu

SEQ ID NO: 97963 - RNA, 19 nt, Human
cauggcuuuuaauccuggc

SEQ ID NO: 97964 - RNA, 24 nt, Human
cauguuggccaggcuggucucaaa

SEQ ID NO: 97965 - RNA, 23 nt, Human
ccaaagugcugggauuacaggca

SEQ ID NO: 97966 - RNA, 24 nt, Human
ccaaagugcugggauuacaggcau

SEQ ID NO: 97967 - RNA, 26 nt, Human
ccaccugccucagccucccaaagugc

SEQ ID NO: 97968 - RNA, 21 nt, Human
ccagugauccaccugccucag

SEQ ID NO: 97969 - RNA, 27 nt, Human
ccagugauccaccugccucagccuccc

SEQ ID NO: 97970 - RNA, 24 nt, Human
cccaaagugcugggauuacaggca

SEQ ID NO: 97971 - RNA, 23 nt, Human
cccaaguagcugggauuacaggc

SEQ ID NO: 97972 - RNA, 19 nt, Human
ccccaacccccucagugcc

SEQ ID NO: 97973 - RNA, 20 nt, Human
ccccaccacaccccaacccc

SEQ ID NO: 97974 - RNA, 23 nt, Human
ccccaccacaccccaacccccuc

SEQ ID NO: 97975 - RNA, 23 nt, Human
ccccaccacaccccaacccccuc

SEQ ID NO: 97976 - RNA, 18 nt, Human
cccccaccacaccccaac

SEQ ID NO: 97977 - RNA, 21 nt, Human
ccccccaccacaccccaaccc

SEQ ID NO: 97978 - RNA, 22 nt, Human
cccccccaccacaccccaaccc

SEQ ID NO: 97979 - RNA, 19 nt, Human
cccucagugcccugggguu

SEQ ID NO: 97980 - RNA, 21 nt, Human
ccgccacaccuggcuaauugu

SEQ ID NO: 97981 - RNA, 19 nt, Human
ccuccaccuccuggguuca

SEQ ID NO: 97982 - RNA, 24 nt, Human
ccuccaccuccuggguucaagcag

SEQ ID NO: 97983 - RNA, 21 nt, Human
ccugaccuccagugauccacc

SEQ ID NO: 97984 - RNA, 23 nt, Human
ccugaccuccagugauccaccug

SEQ ID NO: 97985 - RNA, 24 nt, Human
ccugccucagccucccaaagugcu

SEQ ID NO: 97986 - RNA, 24 nt, Human
ccuggcaggacaaggaaaaccccg

SEQ ID NO: 97987 - RNA, 24 nt, Human
cgcccaggcuggagugcaguggcg

SEQ ID NO: 97988 - RNA, 24 nt, Human
cucacugcaaccuccaccuccugg

SEQ ID NO: 97989 - RNA, 27 nt, Human
cucacugcaaccuccaccuccuggguu

SEQ ID NO: 97990 - RNA, 24 nt, Human
cucagccucccaaguagcugggau

SEQ ID NO: 97991 - RNA, 21 nt, Human
cuccuggguucaagcaguucu

SEQ ID NO: 97992 - RNA, 18 nt, Human
cugcaaccuccaccuccu

SEQ ID NO: 97993 - RNA, 24 nt, Human
cugcaaccuccaccuccuggguuc

SEQ ID NO: 97994 - RNA, 24 nt, Human
cugccucagccucccaaagugcug

SEQ ID NO: 97995 - RNA, 23 nt, Human
cugccucagccucccaaguagcu

SEQ ID NO: 97996 - RNA, 26 nt, Human
cuggcuaauuguauuuuuaguagaga

SEQ ID NO: 97997 - RNA, 28 nt, Human
cuggcuaauuguauuuuuaguagagaca

SEQ ID NO: 97998 - RNA, 24 nt, Human
gaccuccagugauccaccugccuc

SEQ ID NO: 97999 - RNA, 18 nt, Human
gagacagucuggcucugu

SEQ ID NO: 98000 - RNA, 18 nt, Human
gauuacaggcaugagccg

SEQ ID NO: 98001 - RNA, 24 nt, Human
gauuacaggcaugagccgucaugc

SEQ ID NO: 98002 - RNA, 19 nt, Human
gauuacaggccagcuggga

SEQ ID NO: 98003 - RNA, 19 nt, Human
gcccaggcuggagugcagu

SEQ ID NO: 98004 - RNA, 20 nt, Human
gcccaggcuggagugcagug

SEQ ID NO: 98005 - RNA, 20 nt, Human
gcccugggguuugaagcaaa

SEQ ID NO: 98006 - RNA, 25 nt, Human
gcucugucgcccaggcuggagugca

SEQ ID NO: 98007 - RNA, 19 nt, Human
gcugggggggggggggggc

SEQ ID NO: 98008 - RNA, 23 nt, Human
gcuggucucaaacuccugaccuc

SEQ ID NO: 98009 - RNA, 24 nt, Human
ggauuacaggcaugagccgucaug

SEQ ID NO: 98010 - RNA, 25 nt, Human
ggcgcgaugacggcucacugcaacc

SEQ ID NO: 98011 - RNA, 24 nt, Human
ggcucugucgcccaggcuggagug

SEQ ID NO: 98012 - RNA, 24 nt, Human
ggcuggucucaaacuccugaccuc

SEQ ID NO: 98013 - RNA, 22 nt, Human
ggguuucaccauguuggccagg

SEQ ID NO: 98014 - RNA, 24 nt, Human
gugauccaccugccucagccuccc

SEQ ID NO: 98015 - RNA, 24 nt, Human
uaauaaaauucucucccucccuuc

SEQ ID NO: 98016 - RNA, 23 nt, Human
uacaggcaugagccgucaugccc

SEQ ID NO: 98017 - RNA, 20 nt, Human
uacccccccaccacacccca

SEQ ID NO: 98018 - RNA, 22 nt, Human
uacccccccaccacaccccaac

SEQ ID NO: 98019 - RNA, 22 nt, Human
uagagacaggguuucaccaugu

SEQ ID NO: 98020 - RNA, 24 nt, Human
uaguagagacaggguuucaccaug

SEQ ID NO: 98021 - RNA, 26 nt, Human
uaguagagacaggguuucaccauguu

SEQ ID NO: 98022 - RNA, 23 nt, Human
ucacugcaaccuccaccuccugg

SEQ ID NO: 98023 - RNA, 24 nt, Human
ucacugcaaccuccaccuccuggg

SEQ ID NO: 98024 - RNA, 25 nt, Human
ucacugcaaccuccaccuccugggu

SEQ ID NO: 98025 - RNA, 27 nt, Human
ucacugcaaccuccaccuccuggguuc

SEQ ID NO: 98026 - RNA, 20 nt, Human
ucagccucccaaguagcugg

SEQ ID NO: 98027 - RNA, 19 nt, Human
ucagugcccugggguuuga

SEQ ID NO: 98028 - RNA, 20 nt, Human
ucagugcccugggguuugaa

SEQ ID NO: 98029 - RNA, 22 nt, Human
uccagugauccaccugccucag

SEQ ID NO: 98030 - RNA, 24 nt, Human
ucccaaagugcugggauuacaggc

SEQ ID NO: 98031 - RNA, 24 nt, Human
ucccaaguagcugggauuacaggc

SEQ ID NO: 98032 - RNA, 24 nt, Human
uccugcugggggggggggggggca

SEQ ID NO: 98033 - RNA, 19 nt, Human
uccuggguucaagcaguuc

SEQ ID NO: 98034 - RNA, 21 nt, Human
uccuggguucaagcaguucug

SEQ ID NO: 98035 - RNA, 24 nt, Human
ucgcccaggcuggagugcaguggc

SEQ ID NO: 98036 - RNA, 19 nt, Human
ucuggcucugucgcccagg

SEQ ID NO: 98037 - RNA, 23 nt, Human
ucuggcucugucgcccaggcugg

SEQ ID NO: 98038 - RNA, 24 nt, Human
ucuggcucugucgcccaggcugga

SEQ ID NO: 98039 - RNA, 24 nt, Human
ucugucgcccaggcuggagugcag

SEQ ID NO: 98040 - RNA, 21 nt, Human
ugcaguggcgcgaucuuggcu

SEQ ID NO: 98041 - RNA, 24 nt, Human
ugccucagccucccaaagugcugg

SEQ ID NO: 98042 - RNA, 24 nt, Human
ugccucagccucccaaguagcugg

SEQ ID NO: 98043 - RNA, 20 nt, Human
ugcugggauuacaggcauga

SEQ ID NO: 98044 - RNA, 22 nt, Human
ugcugggggggggggggggcag

SEQ ID NO: 98045 - RNA, 24 nt, Human
ugcugggggggggggggggcaguu

SEQ ID NO: 98046 - RNA, 23 nt, Human
uggagugcaguggcgcgaucuug

SEQ ID NO: 98047 - RNA, 24 nt, Human
uggagugcaguggcgcgaucuugg

SEQ ID NO: 98048 - RNA, 24 nt, Human
uggccaggcuggucucaaacuccu

SEQ ID NO: 98049 - RNA, 28 nt, Human
uggcgcgaugacggcucacugcaaccuc

SEQ ID NO: 98050 - RNA, 24 nt, Human
uggcucugucgcccaggcuggagu

SEQ ID NO: 98051 - RNA, 18 nt, Human
ugggauuacaggcaugag

SEQ ID NO: 98052 - RNA, 19 nt, Human
ugggauuacaggcaugagc

SEQ ID NO: 98053 - RNA, 20 nt, Human
ugggauuacaggcaugagcc

SEQ ID NO: 98054 - RNA, 20 nt, Human
ugggauuacaggcaugagcc

SEQ ID NO: 98055 - RNA, 21 nt, Human
ugggauuacaggcaugagccg

SEQ ID NO: 98056 - RNA, 22 nt, Human
ugggauuacaggcaugagccgu

SEQ ID NO: 98057 - RNA, 23 nt, Human
ugggauuacaggcaugagccguc

SEQ ID NO: 98058 - RNA, 24 nt, Human
ugggauuacaggcaugagccguca

SEQ ID NO: 98059 - RNA, 19 nt, Human
ugggauuacaggccagcug

SEQ ID NO: 98060 - RNA, 24 nt, Human
ugggauuacaggccagcugggauu

SEQ ID NO: 98061 - RNA, 21 nt, Human
uuacaggccagcugggauuac

SEQ ID NO: 98062 - RNA, 24 nt, Human
uuaguagagacaggguuucaccau

SEQ ID NO: 98063 - RNA, 22 nt, Human
uuaguggcgcgaugacggcucu

SEQ ID NO: 98064 - RNA, 21 nt, Human
uugagacagucuggcucuguc

SEQ ID NO: 98065 - RNA, 23 nt, Human
uugcugcucuccugcuggggggg

SEQ ID NO: 98066 - RNA, 18 nt, Human
uuguauuuuuaguagaga

SEQ ID NO: 98067 - RNA, 24 nt, Human
uuucaccauguuggccaggcuggu

SEQ ID NO: 98068 - RNA, 24 nt, Human
uuuuuaguagagacaggguuucac

SEQ ID NO: 98069 - RNA, 25 nt, Human
aaacaaauacauuuuauugcacaua

SEQ ID NO: 98070 - RNA, 22 nt, Human
aagauuacagaauauuuccuaa

SEQ ID NO: 98071 - RNA, 19 nt, Human
aaguauugaaguauugcac

SEQ ID NO: 98072 - RNA, 21 nt, Human
aauaaaagcccacagugcaga

SEQ ID NO: 98073 - RNA, 19 nt, Human
accaacaucuaacuccuuc

SEQ ID NO: 98074 - RNA, 22 nt, Human
acugaacacaaaauacaaacaa

SEQ ID NO: 98075 - RNA, 20 nt, Human
aggucugaagauuacagaau

SEQ ID NO: 98076 - RNA, 24 nt, Human
auucuacuuuuauuucacauauau

SEQ ID NO: 98077 - RNA, 23 nt, Human
cacuguauaaaagauuauaaagg

SEQ ID NO: 98078 - RNA, 22 nt, Human
cauggcaauaaaagcccacagu

SEQ ID NO: 98079 - RNA, 23 nt, Human
cucauagucuuugcuuaugucuu

SEQ ID NO: 98080 - RNA, 23 nt, Human
cugucuacagcugaggaaguaaa

SEQ ID NO: 98081 - RNA, 22 nt, Human
uaaaagcccacagugcagauuu

SEQ ID NO: 98082 - RNA, 22 nt, Human
uacaaaucuuaguuucauaagc

SEQ ID NO: 98083 - RNA, 24 nt, Human
uacugaacacaaaauacaaacaaa

SEQ ID NO: 98084 - RNA, 25 nt, Human
uaguuaaucucaggucaagucaagc

SEQ ID NO: 98085 - RNA, 23 nt, Human
uauaaaggcaaagaaauauguac

SEQ ID NO: 98086 - RNA, 19 nt, Human
uccaacacuauucuauguc

SEQ ID NO: 98087 - RNA, 18 nt, Human
ucggaccacagagcagcc

SEQ ID NO: 98088 - RNA, 20 nt, Human
ucuauggaagacuucggacc

SEQ ID NO: 98089 - RNA, 20 nt, Human
ugaacacaaaauacaaacaa

SEQ ID NO: 98090 - RNA, 18 nt, Human
ugcaugaagggcucucac

SEQ ID NO: 98091 - RNA, 20 nt, Human
uucccaagacacuauaaaaa

SEQ ID NO: 98092 - RNA, 25 nt, Human
uucucuguaagacacuguauaaaag

SEQ ID NO: 98093 - RNA, 21 nt, Human
uuucacaaagucucuauggaa

SEQ ID NO: 98094 - RNA, 20 nt, Human
uuucauaagcauuuguccau

SEQ ID NO: 98095 - RNA, 24 nt, Human
uuuuuuuuuuuuuuuuuuguguuu

SEQ ID NO: 98096 - RNA, 27 nt, Human
uuuuuuuuuuuuuuuuuuuuuuugggg

SEQ ID NO: 98097 - RNA, 27 nt, Human
aaggugcuggggggaccacaggcggga

SEQ ID NO: 98098 - RNA, 18 nt, Human
aggaagcacagaagccuu

SEQ ID NO: 98099 - RNA, 18 nt, Human
aggguggggggcauggug

SEQ ID NO: 98100 - RNA, 23 nt, Human
cacagaaaagcccuccuuggcca

SEQ ID NO: 98101 - RNA, 20 nt, Human
caggguggggggcauggugg

SEQ ID NO: 98102 - RNA, 20 nt, Human
cccacagaaaagcccuccuu

SEQ ID NO: 98103 - RNA, 27 nt, Human
cccaggcccaucccacagaaaagcccc

SEQ ID NO: 98104 - RNA, 22 nt, Human
ccccacacccagcucucccagc

SEQ ID NO: 98105 - RNA, 18 nt, Human
ccgguggcggcgugggcu

SEQ ID NO: 98106 - RNA, 18 nt, Human
cucccgguggcggcgugg

SEQ ID NO: 98107 - RNA, 23 nt, Human
cuccucccguccucugccgggcu

SEQ ID NO: 98108 - RNA, 29 nt, Human
cugcagccgugggaggacagcagggugaa

SEQ ID NO: 98109 - RNA, 24 nt, Human
cugccugugugucugcuuggagcu

SEQ ID NO: 98110 - RNA, 20 nt, Human
gcagggaaggugcugggggg

SEQ ID NO: 98111 - RNA, 19 nt, Human
gcuggggggaccacaggcg

SEQ ID NO: 98112 - RNA, 19 nt, Human
gggccggcacugacaggag

SEQ ID NO: 98113 - RNA, 20 nt, Human
guccacugagaagcaccgug

SEQ ID NO: 98114 - RNA, 21 nt, Human
gucuccucccguccucugccg

SEQ ID NO: 98115 - RNA, 22 nt, Human
gugagggguguggcaggguggg

SEQ ID NO: 98116 - RNA, 19 nt, Human
ucccacagaaaagcccucc

SEQ ID NO: 98117 - RNA, 22 nt, Human
uccccacacccagcucucccag

SEQ ID NO: 98118 - RNA, 19 nt, Human
ugagaagcaccguggggcc

SEQ ID NO: 98119 - RNA, 18 nt, Human
ugagggguguggcagggu

SEQ ID NO: 98120 - RNA, 19 nt, Human
ugagggguguggcagggug

SEQ ID NO: 98121 - RNA, 24 nt, Human
ugccuggggguugggggccugcug

SEQ ID NO: 98122 - RNA, 20 nt, Human
ugcuggggggaccacaggcg

SEQ ID NO: 98123 - RNA, 21 nt, Human
uggagcugggcacggcugggc

SEQ ID NO: 98124 - RNA, 19 nt, Human
uggcaggguggggggcaug

SEQ ID NO: 98125 - RNA, 21 nt, Human
uggccauggucgggagaugca

SEQ ID NO: 98126 - RNA, 22 nt, Human
uggcggcgugggcugggcaggg

SEQ ID NO: 98127 - RNA, 19 nt, Human
ugggcugggcagggaaggc

SEQ ID NO: 98128 - RNA, 24 nt, Human
uggggccuggccacugccugugug

SEQ ID NO: 98129 - RNA, 24 nt, Human
ugggugggccggcacugacaggag

SEQ ID NO: 98130 - RNA, 23 nt, Human
ugguggggcagggaaggugcugg

SEQ ID NO: 98131 - RNA, 23 nt, Human
aaagucccuucuagagguggcuu

SEQ ID NO: 98132 - RNA, 18 nt, Human
agacuggcuggaaguguc

SEQ ID NO: 98133 - RNA, 24 nt, Human
agccgguggcuggcacugcccaga

SEQ ID NO: 98134 - RNA, 23 nt, Human
agggagcaggcagcagacuggcu

SEQ ID NO: 98135 - RNA, 24 nt, Human
agugucaacucagugcaaaggacu

SEQ ID NO: 98136 - RNA, 24 nt, Human
cacucgucuucccugucauccacu

SEQ ID NO: 98137 - RNA, 26 nt, Human
ccagaaugaaggagauggucugagga

SEQ ID NO: 98138 - RNA, 20 nt, Human
ccaggccucagguuaggaag

SEQ ID NO: 98139 - RNA, 25 nt, Human
ccccacucgucuucccugucaucca

SEQ ID NO: 98140 - RNA, 21 nt, Human
cccgugcgcccuccuccccca

SEQ ID NO: 98141 - RNA, 20 nt, Human
ccucccuugccccucucguc

SEQ ID NO: 98142 - RNA, 21 nt, Human
ccucccuugccccucucgucu

SEQ ID NO: 98143 - RNA, 19 nt, Human
cgcccuccucccccacccc

SEQ ID NO: 98144 - RNA, 23 nt, Human
cuagagguggcuucacccuuuuc

SEQ ID NO: 98145 - RNA, 19 nt, Human
cucagcccgugcgcccucc

SEQ ID NO: 98146 - RNA, 18 nt, Human
gaaguucuuggggggagg

SEQ ID NO: 98147 - RNA, 19 nt, Human
gcccuccucccccacccca

SEQ ID NO: 98148 - RNA, 27 nt, Human
gcucagcccgugcgcccuccuccccca

SEQ ID NO: 98149 - RNA, 22 nt, Human
gcuccgggccgccccuauccgc

SEQ ID NO: 98150 - RNA, 24 nt, Human
ggcacugcccagaaugaaggagau

SEQ ID NO: 98151 - RNA, 22 nt, Human
ggggggaggccaaagucccuuc

SEQ ID NO: 98152 - RNA, 22 nt, Human
uagagguggcuucacccuuuuc

SEQ ID NO: 98153 - RNA, 23 nt, Human
ucccaggaacaguccaguuucag

SEQ ID NO: 98154 - RNA, 19 nt, Human
ucugaggaaccccaggccu

SEQ ID NO: 98155 - RNA, 19 nt, Human
ucuguguucccucugugac

SEQ ID NO: 98156 - RNA, 18 nt, Human
ugagcagcucugccccca

SEQ ID NO: 98157 - RNA, 18 nt, Human
ugccuggcuggcuccggg

SEQ ID NO: 98158 - RNA, 18 nt, Human
uggcuccgggccgccccu

SEQ ID NO: 98159 - RNA, 20 nt, Human
uggcuggaagugucaggugu

SEQ ID NO: 98160 - RNA, 22 nt, Human
uggcuggcuccgggccgccccu

SEQ ID NO: 98161 - RNA, 20 nt, Human
ugggaaguucuuggggggag

SEQ ID NO: 98162 - RNA, 23 nt, Human
ugggaaguucuuggggggaggcc

SEQ ID NO: 98163 - RNA, 23 nt, Human
ugggucagccgguggcuggcacu

SEQ ID NO: 98164 - RNA, 23 nt, Human
uucccugucauccacuguccucc

SEQ ID NO: 98165 - RNA, 21 nt, Human
aaacauuggcucuuccuuggg

SEQ ID NO: 98166 - RNA, 27 nt, Human
aaagccaaggccaaaggcuggagggga

SEQ ID NO: 98167 - RNA, 27 nt, Human
aaauaggcuagaaaagccaaggccaaa

SEQ ID NO: 98168 - RNA, 24 nt, Human
aagcuuggcugagcagagggaacu

SEQ ID NO: 98169 - RNA, 26 nt, Human
agccuuguguuggaggcugcugugau

SEQ ID NO: 98170 - RNA, 18 nt, Human
aggcaccaggucucaugg

SEQ ID NO: 98171 - RNA, 18 nt, Human
cagcagggccuugcugca

SEQ ID NO: 98172 - RNA, 23 nt, Human
cagggugggacaugggggagggg

SEQ ID NO: 98173 - RNA, 25 nt, Human
cauggcccugaaagcugauaacaag

SEQ ID NO: 98174 - RNA, 18 nt, Human
ccaaaggcuggaggggag

SEQ ID NO: 98175 - RNA, 21 nt, Human
ccaaggccaaaggcuggaggg

SEQ ID NO: 98176 - RNA, 18 nt, Human
cuagaaaagccaaggcca

SEQ ID NO: 98177 - RNA, 19 nt, Human
cucguccaugagccuaggu

SEQ ID NO: 98178 - RNA, 18 nt, Human
cugcagguaaauaggcua

SEQ ID NO: 98179 - RNA, 23 nt, Human
gaaaagccaaggccaaaggcugg

SEQ ID NO: 98180 - RNA, 20 nt, Human
gaaagagccaggcaccaggu

SEQ ID NO: 98181 - RNA, 20 nt, Human
gacagauggagauugggcag

SEQ ID NO: 98182 - RNA, 23 nt, Human
gagaggacagucagcauguccag

SEQ ID NO: 98183 - RNA, 22 nt, Human
gaugcuggggaaagggaagaga

SEQ ID NO: 98184 - RNA, 22 nt, Human
gauguugaagaccgccucugcu

SEQ ID NO: 98185 - RNA, 23 nt, Human
gauugggcagcagggccuugcug

SEQ ID NO: 98186 - RNA, 23 nt, Human
gcaggauguugaagaccgccucu

SEQ ID NO: 98187 - RNA, 20 nt, Human
gccuucccaucucguccaug

SEQ ID NO: 98188 - RNA, 20 nt, Human
ggagauugggcagcagggcc

SEQ ID NO: 98189 - RNA, 24 nt, Human
ggaucugucuagcuuuuggccacu

SEQ ID NO: 98190 - RNA, 20 nt, Human
ggggaggggcugggggcuga

SEQ ID NO: 98191 - RNA, 20 nt, Human
ggucuggguguaggguuauc

SEQ ID NO: 98192 - RNA, 20 nt, Human
ggugacgaaagagccaggca

SEQ ID NO: 98193 - RNA, 25 nt, Human
uagcuguguggggcuggcaggaugu

SEQ ID NO: 98194 - RNA, 19 nt, Human
uauggguccaaaacauugg

SEQ ID NO: 98195 - RNA, 24 nt, Human
ucagcauguccagccuggggucug

SEQ ID NO: 98196 - RNA, 21 nt, Human
ucaugggaugagguacagggu

SEQ ID NO: 98197 - RNA, 20 nt, Human
uccaaaacauuggcucuucc

SEQ ID NO: 98198 - RNA, 20 nt, Human
uccuuggggagugaugcugg

SEQ ID NO: 98199 - RNA, 23 nt, Human
ugaaccauggcccugaaagcuga

SEQ ID NO: 98200 - RNA, 23 nt, Human
ugacgaaagagccaggcaccagg

SEQ ID NO: 98201 - RNA, 18 nt, Human
ugagcagagggaacuagg

SEQ ID NO: 98202 - RNA, 18 nt, Human
uggcugagcagagggaac

SEQ ID NO: 98203 - RNA, 24 nt, Human
uggguccaaaacauuggcucuucc

SEQ ID NO: 98204 - RNA, 19 nt, Human
uguguggggcuggcaggau

SEQ ID NO: 98205 - RNA, 25 nt, Human
uguuggaggcugcugugaugucagg

SEQ ID NO: 98206 - RNA, 24 nt, Human
uuaucugcuguuccgacuugguuu

SEQ ID NO: 98207 - RNA, 21 nt, Human
uuccuuggggagugaugcugg

SEQ ID NO: 98208 - RNA, 28 nt, Human
uuggcucuuccuuggggagugaugcugg

SEQ ID NO: 98209 - RNA, 18 nt, Human
agcugagacacuggagcu

SEQ ID NO: 98210 - RNA, 23 nt, Human
agguuacccucccaccccccacu

SEQ ID NO: 98211 - RNA, 24 nt, Human
caaggaggccuggccuggagaaga

SEQ ID NO: 98212 - RNA, 23 nt, Human
cagaucagggaggagggggugac

SEQ ID NO: 98213 - RNA, 24 nt, Human
cagcaggcgggggcagccuggcag

SEQ ID NO: 98214 - RNA, 24 nt, Human
caguuuagagggaagaagaguggg

SEQ ID NO: 98215 - RNA, 19 nt, Human
cccaccccccacuggggga

SEQ ID NO: 98216 - RNA, 22 nt, Human
cccucccaccccccacuggggg

SEQ ID NO: 98217 - RNA, 22 nt, Human
cuggagcugggugcacagcagg

SEQ ID NO: 98218 - RNA, 20 nt, Human
gaaaggcagcggggcguggg

SEQ ID NO: 98219 - RNA, 19 nt, Human
gagcugggugcacagcagg

SEQ ID NO: 98220 - RNA, 22 nt, Human
gaggcagcgauuaagggcucau

SEQ ID NO: 98221 - RNA, 22 nt, Human
ggagcugggugcacagcaggcg

SEQ ID NO: 98222 - RNA, 18 nt, Human
ggaggagggggugacacu

SEQ ID NO: 98223 - RNA, 18 nt, Human
ggcagcggggcgugggga

SEQ ID NO: 98224 - RNA, 25 nt, Human
uccccuagaggcagcgauuaagggc

SEQ ID NO: 98225 - RNA, 18 nt, Human
ugacuaaggaagccccca

SEQ ID NO: 98226 - RNA, 19 nt, Human
ugacuaaggaagcccccag

SEQ ID NO: 98227 - RNA, 18 nt, Human
uggccuggagaagaguga

SEQ ID NO: 98228 - RNA, 19 nt, Human
ugggaaaggcagcggggcg

SEQ ID NO: 98229 - RNA, 23 nt, Human
ugggugcacagcaggcgggggca

SEQ ID NO: 98230 - RNA, 20 nt, Human
aacugcaccggcugcagccu

SEQ ID NO: 98231 - RNA, 19 nt, Human
aagcagucacugaggccag

SEQ ID NO: 98232 - RNA, 24 nt, Human
aagcagucacugaggccagggagc

SEQ ID NO: 98233 - RNA, 19 nt, Human
accccaaacccgugacaac

SEQ ID NO: 98234 - RNA, 20 nt, Human
acugcucuguccccgacccc

SEQ ID NO: 98235 - RNA, 22 nt, Human
agcuggggaccaggggcuggag

SEQ ID NO: 98236 - RNA, 24 nt, Human
aggcagcuccgaagcagucacuga

SEQ ID NO: 98237 - RNA, 18 nt, Human
caccucauagcaccccca

SEQ ID NO: 98238 - RNA, 23 nt, Human
ccagcuucagaggccagcugggg

SEQ ID NO: 98239 - RNA, 24 nt, Human
ccaguuggguccauggcccuuccc

SEQ ID NO: 98240 - RNA, 22 nt, Human
ccccaaacccgugacaacgucc

SEQ ID NO: 98241 - RNA, 18 nt, Human
ccccagagaacucccucc

SEQ ID NO: 98242 - RNA, 21 nt, Human
cccccaucccaugugugggga

SEQ ID NO: 98243 - RNA, 20 nt, Human
cccgaccccaaacccgugac

SEQ ID NO: 98244 - RNA, 21 nt, Human
cccgaccccaaacccgugacc

SEQ ID NO: 98245 - RNA, 19 nt, Human
cccgugacaacguccgagg

SEQ ID NO: 98246 - RNA, 20 nt, Human
cccucggcuccgaguccauu

SEQ ID NO: 98247 - RNA, 18 nt, Human
cccuuuggcaagagcugg

SEQ ID NO: 98248 - RNA, 19 nt, Human
ccucauagcacccccagaa

SEQ ID NO: 98249 - RNA, 19 nt, Human
ccucggcuccgaguccauu

SEQ ID NO: 98250 - RNA, 21 nt, Human
ccugcacccaggucauggggc

SEQ ID NO: 98251 - RNA, 20 nt, Human
ccuguuguccuucuacucca

SEQ ID NO: 98252 - RNA, 20 nt, Human
ccuuuggcaagagcugggga

SEQ ID NO: 98253 - RNA, 22 nt, Human
cucauagcacccccagaaggcu

SEQ ID NO: 98254 - RNA, 23 nt, Human
cucccccaucccaugugugggga

SEQ ID NO: 98255 - RNA, 21 nt, Human
cuggaccagucucugccuccc

SEQ ID NO: 98256 - RNA, 24 nt, Human
cuucuacuccaggcccuuuggcaa

SEQ ID NO: 98257 - RNA, 23 nt, Human
gaacucccuccaaguugcugccc

SEQ ID NO: 98258 - RNA, 18 nt, Human
gcacuggaggccagggcc

SEQ ID NO: 98259 - RNA, 22 nt, Human
gccagcuucagaggccagcugg

SEQ ID NO: 98260 - RNA, 23 nt, Human
gccagcuucagaggccagcuggg

SEQ ID NO: 98261 - RNA, 18 nt, Human
gccagggccucccugggg

SEQ ID NO: 98262 - RNA, 21 nt, Human
gccagggccucccuggggugg

SEQ ID NO: 98263 - RNA, 21 nt, Human
gcuggggaccaggggcuggag

SEQ ID NO: 98264 - RNA, 22 nt, Human
ggaccagucucugccuccccca

SEQ ID NO: 98265 - RNA, 21 nt, Human
ggaucaccucauagcaccccc

SEQ ID NO: 98266 - RNA, 20 nt, Human
ggccagcuucagaggccagc

SEQ ID NO: 98267 - RNA, 31 nt, Human
ggccagcuucagaggccagcugggggguccc

SEQ ID NO: 98268 - RNA, 23 nt, Human
gggaaggcacuggaggccagggc

SEQ ID NO: 98269 - RNA, 23 nt, Human
gggaggcccucggcuccgagucc

SEQ ID NO: 98270 - RNA, 26 nt, Human
ggggcuggagacaaauggcagcucug

SEQ ID NO: 98271 - RNA, 21 nt, Human
gggggguccaggaaagggguu

SEQ ID NO: 98272 - RNA, 20 nt, Human
gggguugggccaugagccag

SEQ ID NO: 98273 - RNA, 21 nt, Human
ggguccaggaaagggguuggg

SEQ ID NO: 98274 - RNA, 19 nt, Human
gggugggagugguugcggg

SEQ ID NO: 98275 - RNA, 19 nt, Human
ucacugaggccagggagcc

SEQ ID NO: 98276 - RNA, 22 nt, Human
uccaggaaagggguugggccau

SEQ ID NO: 98277 - RNA, 23 nt, Human
uccaggaaagggguugggccaug

SEQ ID NO: 98278 - RNA, 22 nt, Human
uccauggcccuucccaagcucu

SEQ ID NO: 98279 - RNA, 24 nt, Human
ucccaagcucugcugggaggcccu

SEQ ID NO: 98280 - RNA, 18 nt, Human
uccccagagaacucccuc

SEQ ID NO: 98281 - RNA, 20 nt, Human
uccccagagaacucccucca

SEQ ID NO: 98282 - RNA, 19 nt, Human
ucucugccucccccauccc

SEQ ID NO: 98283 - RNA, 23 nt, Human
ugaggccagggagccugcaccca

SEQ ID NO: 98284 - RNA, 18 nt, Human
ugcucuguccccgacccc

SEQ ID NO: 98285 - RNA, 18 nt, Human
ugcugggaggcccucggc

SEQ ID NO: 98286 - RNA, 22 nt, Human
uggaggaaaacguguaacugca

SEQ ID NO: 98287 - RNA, 24 nt, Human
uggaggccagggccucccuggggu

SEQ ID NO: 98288 - RNA, 21 nt, Human
uggcaagagcuggggaccagg

SEQ ID NO: 98289 - RNA, 22 nt, Human
uggggcccaguuggguccaugg

SEQ ID NO: 98290 - RNA, 24 nt, Human
ugggggguccaggaaagggguugg

SEQ ID NO: 98291 - RNA, 19 nt, Human
uguaacugcaccggcugca

SEQ ID NO: 98292 - RNA, 20 nt, Human
aagaaugccucaugaucccc

SEQ ID NO: 98293 - RNA, 23 nt, Human
agaauggaaacauggcaaaagaa

SEQ ID NO: 98294 - RNA, 25 nt, Human
agaauggaaacauggcaaaagaaga

SEQ ID NO: 98295 - RNA, 19 nt, Human
agcuuaaucugaaagaggu

SEQ ID NO: 98296 - RNA, 23 nt, Human
aggguguuccugggucuccaaag

SEQ ID NO: 98297 - RNA, 23 nt, Human
auuuccccuucuaacuucuguua

SEQ ID NO: 98298 - RNA, 21 nt, Human
caagauggcagaauggaaaca

SEQ ID NO: 98299 - RNA, 24 nt, Human
caauugcucacguagaagacccuc

SEQ ID NO: 98300 - RNA, 23 nt, Human
cacuuuuucuuuaaauccuuuga

SEQ ID NO: 98301 - RNA, 23 nt, Human
cagaucuuuucagccccuugcuu

SEQ ID NO: 98302 - RNA, 18 nt, Human
cagggcacuucccaggug

SEQ ID NO: 98303 - RNA, 20 nt, Human
caggugcaaaacaggcaggg

SEQ ID NO: 98304 - RNA, 20 nt, Human
ccagaagagaugacggaggc

SEQ ID NO: 98305 - RNA, 23 nt, Human
ccccacgauccauguaucccaga

SEQ ID NO: 98306 - RNA, 23 nt, Human
gauccccacgauccauguauccc

SEQ ID NO: 98307 - RNA, 22 nt, Human
gaugacggaggcuaccuucaga

SEQ ID NO: 98308 - RNA, 21 nt, Human
gcauauggggagaaaggagag

SEQ ID NO: 98309 - RNA, 18 nt, Human
gguuguggauuuaguuuc

SEQ ID NO: 98310 - RNA, 26 nt, Human
guuacauuaagcaaauugcauauggg

SEQ ID NO: 98311 - RNA, 18 nt, Human
uaagaaggugagguagug

SEQ ID NO: 98312 - RNA, 21 nt, Human
uaagaccagggcacuucccag

SEQ ID NO: 98313 - RNA, 19 nt, Human
uaaucuucagagaggcgac

SEQ ID NO: 98314 - RNA, 19 nt, Human
uacauuaagcaaauugcau

SEQ ID NO: 98315 - RNA, 23 nt, Human
uagggucaaaagugaaagccaac

SEQ ID NO: 98316 - RNA, 25 nt, Human
ucagaucuuuucagccccuugcuuc

SEQ ID NO: 98317 - RNA, 20 nt, Human
uccccacgauccauguaucc

SEQ ID NO: 98318 - RNA, 19 nt, Human
uccugggucuccaaagguu

SEQ ID NO: 98319 - RNA, 22 nt, Human
ugaaagagguuuuuaagaaggu

SEQ ID NO: 98320 - RNA, 19 nt, Human
ugaaagccaacaauuugga

SEQ ID NO: 98321 - RNA, 21 nt, Human
uggcagaauggaaacauggca

SEQ ID NO: 98322 - RNA, 24 nt, Human
uggcagaauggaaacauggcaaaa

SEQ ID NO: 98323 - RNA, 19 nt, Human
uggggagaaaggagaggga

SEQ ID NO: 98324 - RNA, 21 nt, Human
ugggucuccaaagguugugga

SEQ ID NO: 98325 - RNA, 22 nt, Human
uuacagucuauaaagcaaugac

SEQ ID NO: 98326 - RNA, 19 nt, Human
uucagaucuuuucagcccc

SEQ ID NO: 98327 - RNA, 21 nt, Human
aacaaaaacaaaaccccaaaa

SEQ ID NO: 98328 - RNA, 26 nt, Human
aacaggaaaguucagaacaaaaacaa

SEQ ID NO: 98329 - RNA, 23 nt, Human
aaggaccccugcccuccaguccc

SEQ ID NO: 98330 - RNA, 24 nt, Human
aaggaccccugcccuccagucccc

SEQ ID NO: 98331 - RNA, 21 nt, Human
aauaccggaaacguuauauac

SEQ ID NO: 98332 - RNA, 25 nt, Human
acaaaaacaaaaccccaaaaguaaa

SEQ ID NO: 98333 - RNA, 24 nt, Human
acaaaaccccaaaaguaaaaaggc

SEQ ID NO: 98334 - RNA, 18 nt, Human
accccaaaaguaaaaagg

SEQ ID NO: 98335 - RNA, 22 nt, Human
accggggcaggagggaacaagg

SEQ ID NO: 98336 - RNA, 24 nt, Human
agaaaggacaggugcaugaaggca

SEQ ID NO: 98337 - RNA, 19 nt, Human
agagcacccugggacccca

SEQ ID NO: 98338 - RNA, 20 nt, Human
agcccugaaaagguaacagg

SEQ ID NO: 98339 - RNA, 22 nt, Human
caaaaccccaaaaguaaaaagg

SEQ ID NO: 98340 - RNA, 25 nt, Human
caaaaguaaaaaggcuacguguagc

SEQ ID NO: 98341 - RNA, 21 nt, Human
caagacccaggcccgucucca

SEQ ID NO: 98342 - RNA, 20 nt, Human
cacagccccccaaguuggcc

SEQ ID NO: 98343 - RNA, 20 nt, Human
cagaaggaccccugcccucc

SEQ ID NO: 98344 - RNA, 19 nt, Human
cagagagugcccacagacu

SEQ ID NO: 98345 - RNA, 20 nt, Human
caggcggugauggcccccuc

SEQ ID NO: 98346 - RNA, 19 nt, Human
caggugcaugaaggcagag

SEQ ID NO: 98347 - RNA, 23 nt, Human
cauacacgccaccuacaugugac

SEQ ID NO: 98348 - RNA, 18 nt, Human
ccccaaaaguaaaaaggc

SEQ ID NO: 98349 - RNA, 18 nt, Human
ccccagggcagaaggacc

SEQ ID NO: 98350 - RNA, 19 nt, Human
ccccagggcagaaggaccc

SEQ ID NO: 98351 - RNA, 22 nt, Human
ccccagggcagaaggaccccug

SEQ ID NO: 98352 - RNA, 25 nt, Human
cccccaaguuggccaagcugagucu

SEQ ID NO: 98353 - RNA, 21 nt, Human
cccugggaccccagggcagag

SEQ ID NO: 98354 - RNA, 18 nt, Human
ccggggcaggagggaaca

SEQ ID NO: 98355 - RNA, 18 nt, Human
ccuccaguccccaagacc

SEQ ID NO: 98356 - RNA, 21 nt, Human
ccuccaguccccaagacccag

SEQ ID NO: 98357 - RNA, 23 nt, Human
ccuccaguccccaagacccaggc

SEQ ID NO: 98358 - RNA, 22 nt, Human
ccuguggccagagcugcggggc

SEQ ID NO: 98359 - RNA, 23 nt, Human
cucauacacgccaccuacaugug

SEQ ID NO: 98360 - RNA, 23 nt, Human
cuccaguccccaagacccaggcc

SEQ ID NO: 98361 - RNA, 19 nt, Human
cucggcucucgaaccgggg

SEQ ID NO: 98362 - RNA, 25 nt, Human
gaaaggacaggugcaugaaggcaga

SEQ ID NO: 98363 - RNA, 25 nt, Human
gaacaaggugagcugugcagcccac

SEQ ID NO: 98364 - RNA, 20 nt, Human
gaaggcagagagugcccaca

SEQ ID NO: 98365 - RNA, 18 nt, Human
gacccaggcccgucucca

SEQ ID NO: 98366 - RNA, 20 nt, Human
gaccccugcccuccaguccc

SEQ ID NO: 98367 - RNA, 20 nt, Human
gcacugcagaggucccugug

SEQ ID NO: 98368 - RNA, 18 nt, Human
gcccgucuccacucauac

SEQ ID NO: 98369 - RNA, 20 nt, Human
gccugcggggcgcgggccgg

SEQ ID NO: 98370 - RNA, 21 nt, Human
gcggcgcgggcggcgggcggc

SEQ ID NO: 98371 - RNA, 23 nt, Human
ggacgggcgggcuggguggacac

SEQ ID NO: 98372 - RNA, 23 nt, Human
ggcagaaggaccccugcccucca

SEQ ID NO: 98373 - RNA, 18 nt, Human
ggcggcgcgggcggcggg

SEQ ID NO: 98374 - RNA, 25 nt, Human
ggcggcgcgggcggcgggcggccug

SEQ ID NO: 98375 - RNA, 18 nt, Human
ggggcaggagggaacaag

SEQ ID NO: 98376 - RNA, 20 nt, Human
gguaacaggaaaguucagaa

SEQ ID NO: 98377 - RNA, 21 nt, Human
guaaaaaggcuacguguagca

SEQ ID NO: 98378 - RNA, 25 nt, Human
uagaaaggacaggugcaugaaggca

SEQ ID NO: 98379 - RNA, 18 nt, Human
ucagaacaaaaacaaaac

SEQ ID NO: 98380 - RNA, 22 nt, Human
ucagaacaaaaacaaaacccca

SEQ ID NO: 98381 - RNA, 19 nt, Human
uccccaagacccaggcccg

SEQ ID NO: 98382 - RNA, 21 nt, Human
uccccaagacccaggcccguc

SEQ ID NO: 98383 - RNA, 21 nt, Human
ucucugggcgaguggcuccca

SEQ ID NO: 98384 - RNA, 18 nt, Human
ugcagcccacaggacggg

SEQ ID NO: 98385 - RNA, 21 nt, Human
uggccaagcugagucucuggg

SEQ ID NO: 98386 - RNA, 20 nt, Human
uggcucccaggagaggccug

SEQ ID NO: 98387 - RNA, 19 nt, Human
ugggaccccagggcagaag

SEQ ID NO: 98388 - RNA, 19 nt, Human
ugggaccccagggcagaag

SEQ ID NO: 98389 - RNA, 18 nt, Human
ugggcgaguggcucccag

SEQ ID NO: 98390 - RNA, 21 nt, Human
uucagaacaaaaacaaaaccc

SEQ ID NO: 98391 - RNA, 20 nt, Human
aaaaacacuaaaucaacuug

SEQ ID NO: 98392 - RNA, 22 nt, Human
aaaacacagaaaauucaaagag

SEQ ID NO: 98393 - RNA, 26 nt, Human
aaaacaccaucaucauagcaaggaua

SEQ ID NO: 98394 - RNA, 24 nt, Human
aaacauccaugcaacacuucguga

SEQ ID NO: 98395 - RNA, 19 nt, Human
aacaauggcuaaaacaucc

SEQ ID NO: 98396 - RNA, 21 nt, Human
aaccaagaagggaagggccca

SEQ ID NO: 98397 - RNA, 25 nt, Human
aaggaacuugcucaagaaguuugua

SEQ ID NO: 98398 - RNA, 24 nt, Human
acaauggagaaagcagacaccaga

SEQ ID NO: 98399 - RNA, 28 nt, Human
acaccagaaggaacuugcuccccgaggg

SEQ ID NO: 98400 - RNA, 18 nt, Human
acccucucauccccaaaa

SEQ ID NO: 98401 - RNA, 19 nt, Human
acucauuuuuccuauccca

SEQ ID NO: 98402 - RNA, 19 nt, Human
acugcaccgucagcccagc

SEQ ID NO: 98403 - RNA, 23 nt, Human
agaaaauucaaagagaugucccc

SEQ ID NO: 98404 - RNA, 23 nt, Human
agaaagcagacaccagaaggaac

SEQ ID NO: 98405 - RNA, 21 nt, Human
agaagaaccugcagaaauccu

SEQ ID NO: 98406 - RNA, 24 nt, Human
agagguaaaaacacuaaaucaacu

SEQ ID NO: 98407 - RNA, 24 nt, Human
agcacccucucauccccaaaacac

SEQ ID NO: 98408 - RNA, 19 nt, Human
agcugcaucucaccauagc

SEQ ID NO: 98409 - RNA, 20 nt, Human
agguggccauggagaagcag

SEQ ID NO: 98410 - RNA, 25 nt, Human
agucccuucugccagcggcucccgu

SEQ ID NO: 98411 - RNA, 19 nt, Human
auaaaacagaaaaacaccc

SEQ ID NO: 98412 - RNA, 25 nt, Human
auaaaacagaaaaacacccuucuuc

SEQ ID NO: 98413 - RNA, 19 nt, Human
caaacaauggaaaacauga

SEQ ID NO: 98414 - RNA, 18 nt, Human
caagacagagguaaaaac

SEQ ID NO: 98415 - RNA, 23 nt, Human
cacccucucauccccaaaacacc

SEQ ID NO: 98416 - RNA, 19 nt, Human
cacccucucauccccaaag

SEQ ID NO: 98417 - RNA, 21 nt, Human
cagcuguccucaggagucugu

SEQ ID NO: 98418 - RNA, 19 nt, Human
caggaaaggcuucuuggua

SEQ ID NO: 98419 - RNA, 23 nt, Human
cauauaacucagcaauaaaugcc

SEQ ID NO: 98420 - RNA, 18 nt, Human
ccaacaauggcuaaaaca

SEQ ID NO: 98421 - RNA, 26 nt, Human
ccaagacagagguaaaaacacuaaau

SEQ ID NO: 98422 - RNA, 21 nt, Human
ccagcggcucccgugugucca

SEQ ID NO: 98423 - RNA, 19 nt, Human
ccccaagaugcagaagagg

SEQ ID NO: 98424 - RNA, 20 nt, Human
ccccugagccucagcuucag

SEQ ID NO: 98425 - RNA, 21 nt, Human
cccguguguccauaucuugga

SEQ ID NO: 98426 - RNA, 20 nt, Human
cccuucugccagcggcuccc

SEQ ID NO: 98427 - RNA, 19 nt, Human
ccucucauccccaaaacac

SEQ ID NO: 98428 - RNA, 24 nt, Human
cuucucccucucuauguccaggcu

SEQ ID NO: 98429 - RNA, 24 nt, Human
cuucuuuguuucaaacaauggaaa

SEQ ID NO: 98430 - RNA, 22 nt, Human
cuugcucaagaucaugcaccca

SEQ ID NO: 98431 - RNA, 20 nt, Human
cuuuguacacagauuacucc

SEQ ID NO: 98432 - RNA, 22 nt, Human
gaaagcagacaccagaaggaac

SEQ ID NO: 98433 - RNA, 18 nt, Human
gaagucccuucugccagc

SEQ ID NO: 98434 - RNA, 23 nt, Human
gaagucccuucugccagcggcuc

SEQ ID NO: 98435 - RNA, 19 nt, Human
gagaagcagcaguggccuc

SEQ ID NO: 98436 - RNA, 27 nt, Human
gaucuucauuagcccaugcaacagccu

SEQ ID NO: 98437 - RNA, 19 nt, Human
gaugccaucuucagcguag

SEQ ID NO: 98438 - RNA, 22 nt, Human
gcaaaacacagaaaauucaaag

SEQ ID NO: 98439 - RNA, 20 nt, Human
gcacccucucauccccaaaa

SEQ ID NO: 98440 - RNA, 20 nt, Human
ggagaaagcagacaccagaa

SEQ ID NO: 98441 - RNA, 18 nt, Human
ggcgagcacccagacugc

SEQ ID NO: 98442 - RNA, 19 nt, Human
uaaaaacacuaaaucaacu

SEQ ID NO: 98443 - RNA, 26 nt, Human
uaaaaacacuaaaucaacuugguauc

SEQ ID NO: 98444 - RNA, 21 nt, Human
uaaaacagaaaaacacccuuc

SEQ ID NO: 98445 - RNA, 23 nt, Human
uacaauggagaaagcagacacca

SEQ ID NO: 98446 - RNA, 23 nt, Human
uagcaggaccuucacaccaggaa

SEQ ID NO: 98447 - RNA, 19 nt, Human
uauaaaacagaaaaacacc

SEQ ID NO: 98448 - RNA, 19 nt, Human
ucaaaagcagaaaaacaca

SEQ ID NO: 98449 - RNA, 22 nt, Human
ucaaaagcagaaaaacacaaac

SEQ ID NO: 98450 - RNA, 20 nt, Human
ucaaacaauggaaaacauga

SEQ ID NO: 98451 - RNA, 19 nt, Human
ucaaagagauguccccaag

SEQ ID NO: 98452 - RNA, 25 nt, Human
ucaaagagauguccccaagaugcag

SEQ ID NO: 98453 - RNA, 21 nt, Human
ucacgggccagcugggggcau

SEQ ID NO: 98454 - RNA, 21 nt, Human
ucagugaggugaaggacuuca

SEQ ID NO: 98455 - RNA, 24 nt, Human
ucgcugaaaagguggccauggaga

SEQ ID NO: 98456 - RNA, 20 nt, Human
ucucuaucuugucacccucu

SEQ ID NO: 98457 - RNA, 23 nt, Human
ucucuaucuugucacccucucug

SEQ ID NO: 98458 - RNA, 20 nt, Human
ucugacuucuucucccucuc

SEQ ID NO: 98459 - RNA, 22 nt, Human
ugaaaagacccugcuggggaau

SEQ ID NO: 98460 - RNA, 24 nt, Human
ugacugaaaaaauguccaggaggu

SEQ ID NO: 98461 - RNA, 21 nt, Human
ugagaaauggauagcacccuc

SEQ ID NO: 98462 - RNA, 24 nt, Human
ugagaaauggauagcacccucuuc

SEQ ID NO: 98463 - RNA, 22 nt, Human
uggagaaagcagacaccagaag

SEQ ID NO: 98464 - RNA, 20 nt, Human
uggagcgcugcgccgcugcc

SEQ ID NO: 98465 - RNA, 23 nt, Human
ugggcugguacagcaaaacacag

SEQ ID NO: 98466 - RNA, 19 nt, Human
uggggugggauccccuucc

SEQ ID NO: 98467 - RNA, 22 nt, Human
ugguacagcaaaacacagaaaa

SEQ ID NO: 98468 - RNA, 21 nt, Human
uguaacagacaggcacacccc

SEQ ID NO: 98469 - RNA, 23 nt, Human
uguguuaggcuacugcuucaaga

SEQ ID NO: 98470 - RNA, 24 nt, Human
uuacauagguaaacuuacaucaug

SEQ ID NO: 98471 - RNA, 19 nt, Human
uuagcccaugcaacagccu

SEQ ID NO: 98472 - RNA, 21 nt, Human
uuagcccaugcaacagccuug

SEQ ID NO: 98473 - RNA, 21 nt, Human
uuagggggacagugaacauau

SEQ ID NO: 98474 - RNA, 22 nt, Human
uuauguaaucacccagguauua

SEQ ID NO: 98475 - RNA, 21 nt, Human
uucaaaagcagaaaaacacaa

SEQ ID NO: 98476 - RNA, 21 nt, Human
uucaaaagcagaaaaacacaa

SEQ ID NO: 98477 - RNA, 22 nt, Human
uucaaaagcagaaaaacacaaa

SEQ ID NO: 98478 - RNA, 24 nt, Human
uucaaaagcagaaaaacacaaacc

SEQ ID NO: 98479 - RNA, 24 nt, Human
uucaggaagaagaaccugcagaaa

SEQ ID NO: 98480 - RNA, 21 nt, Human
uucauggguauaagugcaggu

SEQ ID NO: 98481 - RNA, 27 nt, Human
uuccucacuuccccaaaagaauuccua

SEQ ID NO: 98482 - RNA, 20 nt, Human
uuucccaagacccuuuucca

SEQ ID NO: 98483 - RNA, 20 nt, Human
uuuuccagcugcaucucacc

SEQ ID NO: 98484 - RNA, 21 nt, Human
aaagguugcccaggaacuuac

SEQ ID NO: 98485 - RNA, 21 nt, Human
aagagaccagaugcauaagca

SEQ ID NO: 98486 - RNA, 23 nt, Human
aauaaaccaaaaggaguauuugc

SEQ ID NO: 98487 - RNA, 18 nt, Human
accagaugcauaagcaca

SEQ ID NO: 98488 - RNA, 20 nt, Human
agagcuggaguuacagggag

SEQ ID NO: 98489 - RNA, 22 nt, Human
agcaaggugguaagaauaaacc

SEQ ID NO: 98490 - RNA, 21 nt, Human
aggguagaaaaaaugaauacc

SEQ ID NO: 98491 - RNA, 18 nt, Human
aguaagagaauuaaaguc

SEQ ID NO: 98492 - RNA, 24 nt, Human
caaaugccuguccacuguagcucc

SEQ ID NO: 98493 - RNA, 25 nt, Human
caaggugguaagaauaaaccaacug

SEQ ID NO: 98494 - RNA, 19 nt, Human
cagcauucccaaggaacac

SEQ ID NO: 98495 - RNA, 26 nt, Human
ccaaaaagagaccagaugcauaagca

SEQ ID NO: 98496 - RNA, 21 nt, Human
ccuggagcccccuuauuacuc

SEQ ID NO: 98497 - RNA, 23 nt, Human
ccuguccacuguagcuccaaaaa

SEQ ID NO: 98498 - RNA, 22 nt, Human
cucaugguaaugucuuuuugcc

SEQ ID NO: 98499 - RNA, 23 nt, Human
gcuggaguuacagggaggcuagu

SEQ ID NO: 98500 - RNA, 21 nt, Human
ggaagaaaucaaaaagguugc

SEQ ID NO: 98501 - RNA, 18 nt, Human
ggagcccccuuauuacuc

SEQ ID NO: 98502 - RNA, 19 nt, Human
uaagugugcucugaaguga

SEQ ID NO: 98503 - RNA, 28 nt, Human
ucaaaaagguugcccaggaacuuacaaa

SEQ ID NO: 98504 - RNA, 23 nt, Human
ucugaagugaaaagaagcaguaa

SEQ ID NO: 98505 - RNA, 21 nt, Human
ugccuguccacuguagcucca

SEQ ID NO: 98506 - RNA, 20 nt, Human
ugcugucacaaaugccuguc

SEQ ID NO: 98507 - RNA, 18 nt, Human
uggaguuacagggaggcu

SEQ ID NO: 98508 - RNA, 22 nt, Human
uguagcuccaaaaagagaccag

SEQ ID NO: 98509 - RNA, 30 nt, Human
uugcgagcuccccguaccuccuaaggcucu

SEQ ID NO: 98510 - RNA, 23 nt, Human
uuuuuuuuuuuuuuuuuuauugg

SEQ ID NO: 98511 - RNA, 22 nt, Human
aaagaaaaaguaaucuuuccca

SEQ ID NO: 98512 - RNA, 20 nt, Human
aaagaaagaccugaauggug

SEQ ID NO: 98513 - RNA, 18 nt, Human
aacagcauaguacaaccc

SEQ ID NO: 98514 - RNA, 19 nt, Human
acauauuuuacauguaugu

SEQ ID NO: 98515 - RNA, 20 nt, Human
acauauuuuacauguaugug

SEQ ID NO: 98516 - RNA, 22 nt, Human
acccugacuugcugugugccuu

SEQ ID NO: 98517 - RNA, 21 nt, Human
acuuaaguuuuuucucuccaa

SEQ ID NO: 98518 - RNA, 19 nt, Human
agggauucauuuuccaggg

SEQ ID NO: 98519 - RNA, 21 nt, Human
aggucccuccagcuacugcuc

SEQ ID NO: 98520 - RNA, 24 nt, Human
caacccuauuuaaaaaagaaagac

SEQ ID NO: 98521 - RNA, 18 nt, Human
caagaaguacuuguuccc

SEQ ID NO: 98522 - RNA, 23 nt, Human
caagcaccucacccugagacagg

SEQ ID NO: 98523 - RNA, 22 nt, Human
cacaguaucccagguaucaagg

SEQ ID NO: 98524 - RNA, 24 nt, Human
caccauauuaacaggagauuauuc

SEQ ID NO: 98525 - RNA, 22 nt, Human
caccccgcccccacuaaaauaa

SEQ ID NO: 98526 - RNA, 18 nt, Human
cagguaucaagaaguacu

SEQ ID NO: 98527 - RNA, 28 nt, Human
cauaacagcauaguacaacccuauuuaa

SEQ ID NO: 98528 - RNA, 18 nt, Human
ccagcucucucagcauga

SEQ ID NO: 98529 - RNA, 21 nt, Human
ccccucugcaaugcaagggcu

SEQ ID NO: 98530 - RNA, 22 nt, Human
cccgucaaacacauaaagaaaa

SEQ ID NO: 98531 - RNA, 22 nt, Human
cccuaccgcgaugugcgcacaa

SEQ ID NO: 98532 - RNA, 23 nt, Human
cccugagcugggagacaaggucc

SEQ ID NO: 98533 - RNA, 19 nt, Human
ccugccccuuuccacgccc

SEQ ID NO: 98534 - RNA, 19 nt, Human
cggaaagaaagaccugaau

SEQ ID NO: 98535 - RNA, 21 nt, Human
cggggaagagguugagauggc

SEQ ID NO: 98536 - RNA, 21 nt, Human
cucaaauucuauuuguaaagg

SEQ ID NO: 98537 - RNA, 20 nt, Human
cucauaacagcauaguacaa

SEQ ID NO: 98538 - RNA, 20 nt, Human
cugcaaugcaagggcuggga

SEQ ID NO: 98539 - RNA, 22 nt, Human
gaaaauaaucaggaagaaugua

SEQ ID NO: 98540 - RNA, 22 nt, Human
gaauguacaccauauuaacagg

SEQ ID NO: 98541 - RNA, 20 nt, Human
gacaggggccucggaaagaa

SEQ ID NO: 98542 - RNA, 21 nt, Human
gcacaacaguauugugacccu

SEQ ID NO: 98543 - RNA, 23 nt, Human
gccucaucccuguaucugcuagu

SEQ ID NO: 98544 - RNA, 26 nt, Human
gcuacugcuccaacccugacuugcug

SEQ ID NO: 98545 - RNA, 21 nt, Human
gcucuggccugccccuuucca

SEQ ID NO: 98546 - RNA, 22 nt, Human
ggaggaaagagcccugagcugg

SEQ ID NO: 98547 - RNA, 23 nt, Human
ggccucggaaagaaagaccugaa

SEQ ID NO: 98548 - RNA, 18 nt, Human
gggcugggagagcaauuc

SEQ ID NO: 98549 - RNA, 19 nt, Human
ggguagcucuggccugccc

SEQ ID NO: 98550 - RNA, 20 nt, Human
guccucuuucaugggccccu

SEQ ID NO: 98551 - RNA, 24 nt, Human
guggaggaaagagcccugagcugg

SEQ ID NO: 98552 - RNA, 23 nt, Human
uaaccucacugaugcucaaauuc

SEQ ID NO: 98553 - RNA, 21 nt, Human
uacaccauauuaacaggagau

SEQ ID NO: 98554 - RNA, 24 nt, Human
uagaacucugccaaaggcaguucu

SEQ ID NO: 98555 - RNA, 23 nt, Human
ucaaacacauaaagaaaaaguaa

SEQ ID NO: 98556 - RNA, 18 nt, Human
ucacccugagacaggggc

SEQ ID NO: 98557 - RNA, 21 nt, Human
ucccaccccgcccccacuaaa

SEQ ID NO: 98558 - RNA, 21 nt, Human
ucccagguaucaagaaguacu

SEQ ID NO: 98559 - RNA, 20 nt, Human
ucccccuuuguaaaacgggc

SEQ ID NO: 98560 - RNA, 21 nt, Human
ucccuccagcuacugcuccaa

SEQ ID NO: 98561 - RNA, 23 nt, Human
ucuccaaugggcaggcauugcuu

SEQ ID NO: 98562 - RNA, 23 nt, Human
ucugcaaugcaagggcugggaga

SEQ ID NO: 98563 - RNA, 19 nt, Human
ucugcggguagcucuggcc

SEQ ID NO: 98564 - RNA, 21 nt, Human
ucugggcacaguaucccaggu

SEQ ID NO: 98565 - RNA, 21 nt, Human
ucuuuagagauagagggauuc

SEQ ID NO: 98566 - RNA, 18 nt, Human
ugagcagaggccagggcu

SEQ ID NO: 98567 - RNA, 23 nt, Human
ugagcugggagacaaggucccuc

SEQ ID NO: 98568 - RNA, 24 nt, Human
ugaggggcucuccaacaauugucu

SEQ ID NO: 98569 - RNA, 21 nt, Human
ugccaaaggcaguucucuucu

SEQ ID NO: 98570 - RNA, 26 nt, Human
ugccuccagcucucucagcaugauuc

SEQ ID NO: 98571 - RNA, 18 nt, Human
ugcuccaacccugacuug

SEQ ID NO: 98572 - RNA, 24 nt, Human
uguacaccauauuaacaggagauu

SEQ ID NO: 98573 - RNA, 21 nt, Human
ugugcgcacaacaguauugug

SEQ ID NO: 98574 - RNA, 25 nt, Human
uguuuauucauuaaagccacucaua

SEQ ID NO: 98575 - RNA, 21 nt, Human
uuucccaccccgcccccacua

SEQ ID NO: 98576 - RNA, 22 nt, Human
uuuuuuuuuuuuuuuuucggau

SEQ ID NO: 98577 - RNA, 23 nt, Human
uuuuuuuuuuuuuuuuuuuucgg

SEQ ID NO: 98578 - RNA, 24 nt, Human
aaaaaaacaaacaacaaacaacaa

SEQ ID NO: 98579 - RNA, 23 nt, Human
aaaacaaacaaacaaaaaauccc

SEQ ID NO: 98580 - RNA, 21 nt, Human
aaacaaaacaaaacaaacaaa

SEQ ID NO: 98581 - RNA, 23 nt, Human
aaacaaacaaacaaaaaauccca

SEQ ID NO: 98582 - RNA, 23 nt, Human
aaacaaacaacaaacaacaaaca

SEQ ID NO: 98583 - RNA, 21 nt, Human
aacaaacaacaaacaaaacaa

SEQ ID NO: 98584 - RNA, 22 nt, Human
aaccaaaccccccgcucaacua

SEQ ID NO: 98585 - RNA, 23 nt, Human
aaccaaagcaaaccaaacccccc

SEQ ID NO: 98586 - RNA, 20 nt, Human
aagcaaaaacaaacaacuga

SEQ ID NO: 98587 - RNA, 26 nt, Human
aagcaaaaacaaacaacugaaaaaau

SEQ ID NO: 98588 - RNA, 18 nt, Human
aagcaaaccaaacccccc

SEQ ID NO: 98589 - RNA, 25 nt, Human
acaaaacaaaacaaacaaacaaaaa

SEQ ID NO: 98590 - RNA, 24 nt, Human
acaaacaacaaacaacaaacaaaa

SEQ ID NO: 98591 - RNA, 22 nt, Human
agcaaaaacaaacaacugaaaa

SEQ ID NO: 98592 - RNA, 23 nt, Human
aucaaauugucuucaauauaagu

SEQ ID NO: 98593 - RNA, 22 nt, Human
caaaaaaauucuuuuauguaca

SEQ ID NO: 98594 - RNA, 20 nt, Human
caaaacaaaacaaacaaaca

SEQ ID NO: 98595 - RNA, 23 nt, Human
caaacaacaaacaaaacaaaaca

SEQ ID NO: 98596 - RNA, 25 nt, Human
caaacaacaaacaaaacaaaacaaa

SEQ ID NO: 98597 - RNA, 23 nt, Human
caaacaacaaacaacaaacaaaa

SEQ ID NO: 98598 - RNA, 18 nt, Human
caaaccaaaccccccgcu

SEQ ID NO: 98599 - RNA, 21 nt, Human
caaaccccccgcucaacuaca

SEQ ID NO: 98600 - RNA, 20 nt, Human
caaagcaaaccaaacccccc

SEQ ID NO: 98601 - RNA, 24 nt, Human
caacaaacaacaaacaaaacaaaa

SEQ ID NO: 98602 - RNA, 21 nt, Human
caaugcagaaugaauacuaaa

SEQ ID NO: 98603 - RNA, 20 nt, Human
cagaaugaauacuaaaauua

SEQ ID NO: 98604 - RNA, 18 nt, Human
cugaaaaaauauaaacca

SEQ ID NO: 98605 - RNA, 21 nt, Human
gaaaaaauauaaaccaaagca

SEQ ID NO: 98606 - RNA, 20 nt, Human
gcagcugggacuggcgggac

SEQ ID NO: 98607 - RNA, 20 nt, Human
ggcaaaaaaacaaacaacaa

SEQ ID NO: 98608 - RNA, 18 nt, Human
ggcgcgcgcagcugggac

SEQ ID NO: 98609 - RNA, 18 nt, Human
uaaaagacaaacauaaag

SEQ ID NO: 98610 - RNA, 21 nt, Human
uaaaagacaaacauaaaguaa

SEQ ID NO: 98611 - RNA, 22 nt, Human
uaaaccaaagcaaaccaaaccc

SEQ ID NO: 98612 - RNA, 18 nt, Human
uaacuuagccugggccga

SEQ ID NO: 98613 - RNA, 25 nt, Human
uacaauaucuugucuagagucuagc

SEQ ID NO: 98614 - RNA, 21 nt, Human
uagagucuagcaaauauagua

SEQ ID NO: 98615 - RNA, 20 nt, Human
uagcaaugcagaaugaauac

SEQ ID NO: 98616 - RNA, 24 nt, Human
uaguaccuuucauugcaggauuuc

SEQ ID NO: 98617 - RNA, 24 nt, Human
uaguggcaaaaaaacaaacaacaa

SEQ ID NO: 98618 - RNA, 21 nt, Human
uauaaaccaaagcaaaccaaa

SEQ ID NO: 98619 - RNA, 21 nt, Human
uauaacaagcaaaaacaaaca

SEQ ID NO: 98620 - RNA, 23 nt, Human
uaucuugucuagagucuagcaaa

SEQ ID NO: 98621 - RNA, 22 nt, Human
uggcaaaaaaacaaacaacaaa

SEQ ID NO: 98622 - RNA, 19 nt, Human
uggcgggaccuggcgcugg

SEQ ID NO: 98623 - RNA, 24 nt, Human
uggggggcgcgcgcagcugggacu

SEQ ID NO: 98624 - RNA, 20 nt, Human
uguaucaaauugucuucaau

SEQ ID NO: 98625 - RNA, 23 nt, Human
aaaaguccaggaugggacaagcg

SEQ ID NO: 98626 - RNA, 22 nt, Human
aagcugagccccagcgccuagu

SEQ ID NO: 98627 - RNA, 24 nt, Human
aagcugcuguggccacaggagcug

SEQ ID NO: 98628 - RNA, 19 nt, Human
acacaacgucuacaaccuu

SEQ ID NO: 98629 - RNA, 20 nt, Human
acagauaaaaacacauuaca

SEQ ID NO: 98630 - RNA, 20 nt, Human
agcaggaccaguggcuccga

SEQ ID NO: 98631 - RNA, 18 nt, Human
agcccugggccagccccu

SEQ ID NO: 98632 - RNA, 21 nt, Human
aggaccaguggcuccgacucc

SEQ ID NO: 98633 - RNA, 20 nt, Human
aggcaguggccccaaggggc

SEQ ID NO: 98634 - RNA, 19 nt, Human
agggaggauggauggucuu

SEQ ID NO: 98635 - RNA, 19 nt, Human
aguggcuccgacuccaccc

SEQ ID NO: 98636 - RNA, 25 nt, Human
agugucaacacugaaaaauuuuaac

SEQ ID NO: 98637 - RNA, 23 nt, Human
caacacugaaaaauuuuaacaga

SEQ ID NO: 98638 - RNA, 24 nt, Human
caagguggagcagagaggcagcca

SEQ ID NO: 98639 - RNA, 18 nt, Human
cagcagcaggaccagugg

SEQ ID NO: 98640 - RNA, 19 nt, Human
cagcagcaggaccaguggc

SEQ ID NO: 98641 - RNA, 22 nt, Human
cagcaggaccaguggcuccgac

SEQ ID NO: 98642 - RNA, 20 nt, Human
cagccccuguccccacccug

SEQ ID NO: 98643 - RNA, 19 nt, Human
cagcccugggccagccccu

SEQ ID NO: 98644 - RNA, 21 nt, Human
caggaugggacaagcgcccuu

SEQ ID NO: 98645 - RNA, 19 nt, Human
ccaggaugggacaagcgcc

SEQ ID NO: 98646 - RNA, 21 nt, Human
ccccagcgccuagucucuuca

SEQ ID NO: 98647 - RNA, 20 nt, Human
ccuccugguggcacacggga

SEQ ID NO: 98648 - RNA, 19 nt, Human
cggcaggagcggcagggga

SEQ ID NO: 98649 - RNA, 19 nt, Human
cucuguaccgugagccucc

SEQ ID NO: 98650 - RNA, 24 nt, Human
cugcugggccguccagaaccaugc

SEQ ID NO: 98651 - RNA, 18 nt, Human
cuguaccgugagccucag

SEQ ID NO: 98652 - RNA, 19 nt, Human
gacaugagaggaaaagucc

SEQ ID NO: 98653 - RNA, 20 nt, Human
gagcagagaggcagccagca

SEQ ID NO: 98654 - RNA, 20 nt, Human
gaggguggagggaguagagu

SEQ ID NO: 98655 - RNA, 23 nt, Human
gccagccccuguccccacccugg

SEQ ID NO: 98656 - RNA, 20 nt, Human
gcugagccccagcgccuagu

SEQ ID NO: 98657 - RNA, 21 nt, Human
ggagcagagaggcagccagca

SEQ ID NO: 98658 - RNA, 20 nt, Human
ggaggguggagggaguagag

SEQ ID NO: 98659 - RNA, 22 nt, Human
ggcacacgggaucagggaggga

SEQ ID NO: 98660 - RNA, 22 nt, Human
gggccucugacaucaggacccu

SEQ ID NO: 98661 - RNA, 18 nt, Human
guccuggacuuuggugcc

SEQ ID NO: 98662 - RNA, 18 nt, Human
guggcuccgacuccaccc

SEQ ID NO: 98663 - RNA, 25 nt, Human
uaaaaacacauuacacaacgucuac

SEQ ID NO: 98664 - RNA, 21 nt, Human
uaagagggaagcugagcccca

SEQ ID NO: 98665 - RNA, 24 nt, Human
uacacaacgucuacaaccuucaca

SEQ ID NO: 98666 - RNA, 20 nt, Human
uccaccccacuggguguccu

SEQ ID NO: 98667 - RNA, 23 nt, Human
uccaccccacuggguguccugga

SEQ ID NO: 98668 - RNA, 24 nt, Human
ucucuucaguucugcagcaaagac

SEQ ID NO: 98669 - RNA, 19 nt, Human
ugagaaccuccugcccggc

SEQ ID NO: 98670 - RNA, 22 nt, Human
ugagccucaggcaguggcccca

SEQ ID NO: 98671 - RNA, 18 nt, Human
uggacgaagggaggaugg

SEQ ID NO: 98672 - RNA, 24 nt, Human
uggccccaaggggccucgccaugg

SEQ ID NO: 98673 - RNA, 24 nt, Human
ugggacaagcgcccuuagucuguc

SEQ ID NO: 98674 - RNA, 18 nt, Human
ugguggacgaagggagga

SEQ ID NO: 98675 - RNA, 22 nt, Human
uuaacagauaaaaacacauuac

SEQ ID NO: 98676 - RNA, 21 nt, Human
uuacacaacgucuacaaccuu

SEQ ID NO: 98677 - RNA, 18 nt, Human
uuuuuuuuuuuuuuucug

SEQ ID NO: 98678 - RNA, 19 nt, Human
uuuuuuuuuuuuuuucugu

SEQ ID NO: 98679 - RNA, 25 nt, Human
accccgggcaggcagcagagcagcg

SEQ ID NO: 98680 - RNA, 23 nt, Human
agccuggcuggggccccagacac

SEQ ID NO: 98681 - RNA, 21 nt, Human
aggaaagguggggcagggggg

SEQ ID NO: 98682 - RNA, 19 nt, Human
aggcuggacuuugaaagag

SEQ ID NO: 98683 - RNA, 19 nt, Human
aggcuggggccacugggca

SEQ ID NO: 98684 - RNA, 22 nt, Human
cagcagagcagcggaaacagga

SEQ ID NO: 98685 - RNA, 19 nt, Human
cagguggcuguuacaggca

SEQ ID NO: 98686 - RNA, 20 nt, Human
ccggccagccuggcuggggc

SEQ ID NO: 98687 - RNA, 21 nt, Human
cugcauccugaaacuggcgcg

SEQ ID NO: 98688 - RNA, 21 nt, Human
gaaggaaaggaaagguggggc

SEQ ID NO: 98689 - RNA, 21 nt, Human
gcagagcagcggaaacaggag

SEQ ID NO: 98690 - RNA, 21 nt, Human
gcaggcagcagagcagcggaa

SEQ ID NO: 98691 - RNA, 22 nt, Human
ggaaggaaaggaaagguggggc

SEQ ID NO: 98692 - RNA, 19 nt, Human
ggcaggcagcagagcagcg

SEQ ID NO: 98693 - RNA, 18 nt, Human
ggcagguguccccagggc

SEQ ID NO: 98694 - RNA, 19 nt, Human
ggggggcggcgguguucua

SEQ ID NO: 98695 - RNA, 24 nt, Human
gugcugacucaggcuggaguguaa

SEQ ID NO: 98696 - RNA, 21 nt, Human
guggggcaggggggcggcggu

SEQ ID NO: 98697 - RNA, 26 nt, Human
uaagucccaaggcagguugcuaggag

SEQ ID NO: 98698 - RNA, 23 nt, Human
uaaucuggaaacaucaucuuugc

SEQ ID NO: 98699 - RNA, 21 nt, Human
uccagguggcuguuacaggca

SEQ ID NO: 98700 - RNA, 22 nt, Human
ucuccuagacccugcauccuga

SEQ ID NO: 98701 - RNA, 18 nt, Human
uggcuggggccccagaca

SEQ ID NO: 98702 - RNA, 22 nt, Human
ugguaccccgggcaggcagcag

SEQ ID NO: 98703 - RNA, 19 nt, Human
uguucuaagucccaaggca

SEQ ID NO: 98704 - RNA, 21 nt, Human
aacaaagaaauauauauaaga

SEQ ID NO: 98705 - RNA, 21 nt, Human
aagcuggccgcgcgcucugcc

SEQ ID NO: 98706 - RNA, 23 nt, Human
agaagacgaaguacagcugaagu

SEQ ID NO: 98707 - RNA, 23 nt, Human
caaaaauagacaagaguuaacaa

SEQ ID NO: 98708 - RNA, 24 nt, Human
cggccgcagcggcagcuacaacaa

SEQ ID NO: 98709 - RNA, 24 nt, Human
cucuccgcucaauuuccaagagcc

SEQ ID NO: 98710 - RNA, 20 nt, Human
cugccaaguuggccccucgc

SEQ ID NO: 98711 - RNA, 19 nt, Human
gaaauuagaagacgaagua

SEQ ID NO: 98712 - RNA, 18 nt, Human
gagccagcuuugaagcca

SEQ ID NO: 98713 - RNA, 22 nt, Human
uaacaaagaaauauauauaaga

SEQ ID NO: 98714 - RNA, 21 nt, Human
uccccgcacgcauagucccug

SEQ ID NO: 98715 - RNA, 21 nt, Human
ucccuggagggcgcucucugc

SEQ ID NO: 98716 - RNA, 26 nt, Human
ucucugcaaagcuggccgcgcgcucu

SEQ ID NO: 98717 - RNA, 20 nt, Human
uucacauuuacagaauuaua

SEQ ID NO: 98718 - RNA, 21 nt, Human
uugaagccaagugcccccccc

SEQ ID NO: 98719 - RNA, 24 nt, Human
uuuuuuuuuuuuuuuuucacauuu

SEQ ID NO: 98720 - RNA, 23 nt, Human
aaaaacaugaagggagacaugac

SEQ ID NO: 98721 - RNA, 22 nt, Human
agaaaaauaaaaaacaacugag

SEQ ID NO: 98722 - RNA, 21 nt, Human
gaaaaauaaaaaacaacugag

SEQ ID NO: 98723 - RNA, 22 nt, Human
gaccggcuuuaacacgccuggc

SEQ ID NO: 98724 - RNA, 24 nt, Human
gggagggguccuugcaguuggugc

SEQ ID NO: 98725 - RNA, 24 nt, Human
gggggagggguccuugcaguuggu

SEQ ID NO: 98726 - RNA, 21 nt, Human
uaaaaaacaacugaggugaug

SEQ ID NO: 98727 - RNA, 24 nt, Human
uauuagaaaaauaaaaaacaacug

SEQ ID NO: 98728 - RNA, 19 nt, Human
ugcaguuggugccuacgga

SEQ ID NO: 98729 - RNA, 21 nt, Human
aaaaaaaaaaagcauucaggg

SEQ ID NO: 98730 - RNA, 28 nt, Human
aaaaaaaaaaagcauucagggaagaagg

SEQ ID NO: 98731 - RNA, 21 nt, Human
aaaaaaaagcauucagggaag

SEQ ID NO: 98732 - RNA, 22 nt, Human
aacacaaaauucugggaauaag

SEQ ID NO: 98733 - RNA, 25 nt, Human
aaccuugaaaaggcauggcagugga

SEQ ID NO: 98734 - RNA, 25 nt, Human
aacuguuuuggaagauugucucccu

SEQ ID NO: 98735 - RNA, 18 nt, Human
aagaagagcugagguccu

SEQ ID NO: 98736 - RNA, 22 nt, Human
aaguuacuuccaauuugaaagc

SEQ ID NO: 98737 - RNA, 20 nt, Human
aauccuaucuccuugcuugc

SEQ ID NO: 98738 - RNA, 20 nt, Human
accagcuugaagugaguuua

SEQ ID NO: 98739 - RNA, 22 nt, Human
acgugcuguucuuuacauggag

SEQ ID NO: 98740 - RNA, 24 nt, Human
acucuuuggacauaagugagacag

SEQ ID NO: 98741 - RNA, 21 nt, Human
aggauucugucaguuggccuc

SEQ ID NO: 98742 - RNA, 22 nt, Human
agggaagaaggccaagaucuau

SEQ ID NO: 98743 - RNA, 26 nt, Human
caagagcaaggucauuuguauccauu

SEQ ID NO: 98744 - RNA, 21 nt, Human
cagcucaggguagaguggcag

SEQ ID NO: 98745 - RNA, 24 nt, Human
cagugcccuacugccagcucaggg

SEQ ID NO: 98746 - RNA, 21 nt, Human
ccaucuguagaaacaagaaga

SEQ ID NO: 98747 - RNA, 22 nt, Human
ccucaucuagauaaaggcugaa

SEQ ID NO: 98748 - RNA, 23 nt, Human
ccugugcuaaagugcuauaaaag

SEQ ID NO: 98749 - RNA, 21 nt, Human
ccuucuuuuauucaacucuag

SEQ ID NO: 98750 - RNA, 24 nt, Human
cuccugcuguacacacaugcacag

SEQ ID NO: 98751 - RNA, 20 nt, Human
cugucccuauggagcuguug

SEQ ID NO: 98752 - RNA, 19 nt, Human
cuuuagaagacccccccaa

SEQ ID NO: 98753 - RNA, 18 nt, Human
gaaacucuccaagagcac

SEQ ID NO: 98754 - RNA, 18 nt, Human
gaacaaauggauagcucu

SEQ ID NO: 98755 - RNA, 21 nt, Human
gcuuuagaagacccccccaaa

SEQ ID NO: 98756 - RNA, 21 nt, Human
ggccaaaaaaaaaaagcauuc

SEQ ID NO: 98757 - RNA, 23 nt, Human
guugaauaaaguuacuuccaauu

SEQ ID NO: 98758 - RNA, 18 nt, Human
uaaaaacguaacacaaaa

SEQ ID NO: 98759 - RNA, 20 nt, Human
uaaagugcuauaaaagggac

SEQ ID NO: 98760 - RNA, 22 nt, Human
uaacacaaaauucugggaauaa

SEQ ID NO: 98761 - RNA, 26 nt, Human
uaacacaaaauucugggaauaagaau

SEQ ID NO: 98762 - RNA, 21 nt, Human
uacucagugcccuacugccag

SEQ ID NO: 98763 - RNA, 18 nt, Human
uccuuggaacagacgugc

SEQ ID NO: 98764 - RNA, 20 nt, Human
ucuauagccacucuuuggac

SEQ ID NO: 98765 - RNA, 18 nt, Human
ucucccuagagaguaaga

SEQ ID NO: 98766 - RNA, 22 nt, Human
ucucugacaucagaauagggau

SEQ ID NO: 98767 - RNA, 19 nt, Human
ucugucaguuggccucuga

SEQ ID NO: 98768 - RNA, 20 nt, Human
ugaagugucauauguuagga

SEQ ID NO: 98769 - RNA, 23 nt, Human
ugccagcucaggguagaguggca

SEQ ID NO: 98770 - RNA, 25 nt, Human
ugcuguacacacaugcacaggccug

SEQ ID NO: 98771 - RNA, 20 nt, Human
uguagaaacaagaagagcug

SEQ ID NO: 98772 - RNA, 24 nt, Human
uguugcagaugggagggaaaaaaa

SEQ ID NO: 98773 - RNA, 23 nt, Human
uuacuuccaauuugaaagcuuua

SEQ ID NO: 98774 - RNA, 21 nt, Human
uuaggagguaaaaacguaaca

SEQ ID NO: 98775 - RNA, 24 nt, Human
uuuagaagacccccccaaaacugg

SEQ ID NO: 98776 - RNA, 20 nt, Human
uuucuugggggccaaaaaaa

SEQ ID NO: 98777 - RNA, 22 nt, Human
aaaccaagccgaccuacaccuc

SEQ ID NO: 98778 - RNA, 20 nt, Human
aacccgcuugcccagcuccg

SEQ ID NO: 98779 - RNA, 22 nt, Human
aagccgaccuacaccucuuacc

SEQ ID NO: 98780 - RNA, 18 nt, Human
acaccgcgaggccagcgg

SEQ ID NO: 98781 - RNA, 25 nt, Human
acuccgcgguucagggacgcggcug

SEQ ID NO: 98782 - RNA, 23 nt, Human
acugcauuguggcacaguucuga

SEQ ID NO: 98783 - RNA, 23 nt, Human
agaugcuggagcccgauaaggcc

SEQ ID NO: 98784 - RNA, 22 nt, Human
agccacaggcacgggugcuucc

SEQ ID NO: 98785 - RNA, 22 nt, Human
aggaaagaggguaaagggggau

SEQ ID NO: 98786 - RNA, 25 nt, Human
caagagaagccgggcgagagccucg

SEQ ID NO: 98787 - RNA, 19 nt, Human
caccggcgcccgcggguca

SEQ ID NO: 98788 - RNA, 21 nt, Human
cagagcucccgcucccucuuc

SEQ ID NO: 98789 - RNA, 22 nt, Human
cagcaagaugcccugggcucca

SEQ ID NO: 98790 - RNA, 21 nt, Human
ccaaacaaacguggcgggucg

SEQ ID NO: 98791 - RNA, 22 nt, Human
cccacuguggcucagagcagcu

SEQ ID NO: 98792 - RNA, 22 nt, Human
ccccgccgacaccggccucggc

SEQ ID NO: 98793 - RNA, 19 nt, Human
cccgccccgccgacaccgg

SEQ ID NO: 98794 - RNA, 24 nt, Human
ccgccccgccgacaccggccucgg

SEQ ID NO: 98795 - RNA, 18 nt, Human
ccgccgacaccggccucg

SEQ ID NO: 98796 - RNA, 20 nt, Human
ccgccgcgaccgccccgccc

SEQ ID NO: 98797 - RNA, 20 nt, Human
ccgcucccucuuccucugcc

SEQ ID NO: 98798 - RNA, 22 nt, Human
ccucuuacccaggcugucgcag

SEQ ID NO: 98799 - RNA, 28 nt, Human
cgaggcaacggcccaggcucacgcuguc

SEQ ID NO: 98800 - RNA, 23 nt, Human
cgcccgcgggucaaacacaaaca

SEQ ID NO: 98801 - RNA, 24 nt, Human
cgccgacaccggccucggccgcgc

SEQ ID NO: 98802 - RNA, 26 nt, Human
cgcgaccgccccgccccgccgacacc

SEQ ID NO: 98803 - RNA, 20 nt, Human
cggcccaggcucacgcuguc

SEQ ID NO: 98804 - RNA, 23 nt, Human
cgggcgggcgccggcaaccagcu

SEQ ID NO: 98805 - RNA, 23 nt, Human
cucccaacccgcuugcccagcuc

SEQ ID NO: 98806 - RNA, 20 nt, Human
cucgcagagcucccgcuccc

SEQ ID NO: 98807 - RNA, 23 nt, Human
cucggccgcgcgccaccggcgcc

SEQ ID NO: 98808 - RNA, 19 nt, Human
gagcagcuugacacggugc

SEQ ID NO: 98809 - RNA, 19 nt, Human
gaggccagcgggcgggcgg

SEQ ID NO: 98810 - RNA, 23 nt, Human
gcagaaaaccaagccgaccuaca

SEQ ID NO: 98811 - RNA, 23 nt, Human
gcccccucuccaaaugucacaca

SEQ ID NO: 98812 - RNA, 18 nt, Human
gcccggccucgcagagcu

SEQ ID NO: 98813 - RNA, 25 nt, Human
gcgaccgccccgccccgccgacacc

SEQ ID NO: 98814 - RNA, 19 nt, Human
ggccagcgggcgggcgggc

SEQ ID NO: 98815 - RNA, 23 nt, Human
ggcugccgcgggcaaagcggcgc

SEQ ID NO: 98816 - RNA, 22 nt, Human
gggcgggugugcggacccucca

SEQ ID NO: 98817 - RNA, 19 nt, Human
uacaccucuuacccaggcu

SEQ ID NO: 98818 - RNA, 22 nt, Human
uagcagaaaaccaagccgaccu

SEQ ID NO: 98819 - RNA, 19 nt, Human
ucaaacacaaacacgacuc

SEQ ID NO: 98820 - RNA, 19 nt, Human
ucccaggcccccucuccaa

SEQ ID NO: 98821 - RNA, 30 nt, Human
uccccuccgucuccucuccccucaugagaa

SEQ ID NO: 98822 - RNA, 20 nt, Human
uccucugccuccgccgcgac

SEQ ID NO: 98823 - RNA, 22 nt, Human
uccucugccuccgccgcgaccg

SEQ ID NO: 98824 - RNA, 23 nt, Human
ucgaggcaacggcccaggcucac

SEQ ID NO: 98825 - RNA, 24 nt, Human
ucucccaacccgcuugcccagcuc

SEQ ID NO: 98826 - RNA, 22 nt, Human
ugacacggugcucagaacugca

SEQ ID NO: 98827 - RNA, 19 nt, Human
ugcuuaaguuucucugcag

SEQ ID NO: 98828 - RNA, 19 nt, Human
uggagggaagcuugggcug

SEQ ID NO: 98829 - RNA, 23 nt, Human
uggcucagagcagcuugacacgg

SEQ ID NO: 98830 - RNA, 18 nt, Human
ugucuucgcuguucuccc

SEQ ID NO: 98831 - RNA, 21 nt, Human
aaacagaccaagcacacaggu

SEQ ID NO: 98832 - RNA, 22 nt, Human
aaauaggcacacauauauuccu

SEQ ID NO: 98833 - RNA, 21 nt, Human
aacagaccaagcacacaggua

SEQ ID NO: 98834 - RNA, 23 nt, Human
aacccuaaguguaaauauuuuug

SEQ ID NO: 98835 - RNA, 23 nt, Human
aagcacacagguaacacugaaau

SEQ ID NO: 98836 - RNA, 23 nt, Human
acaagacagcagcaaguucugag

SEQ ID NO: 98837 - RNA, 21 nt, Human
acacaaaauacugccuuuaag

SEQ ID NO: 98838 - RNA, 18 nt, Human
acagcaccugaggccucc

SEQ ID NO: 98839 - RNA, 23 nt, Human
acccuaacaaggaaacaagaagc

SEQ ID NO: 98840 - RNA, 22 nt, Human
agacagcagcaaguucugagca

SEQ ID NO: 98841 - RNA, 25 nt, Human
agacugggcucuuccaggggugggg

SEQ ID NO: 98842 - RNA, 18 nt, Human
agcagcaaguucugagca

SEQ ID NO: 98843 - RNA, 26 nt, Human
aggaaagaguaagagcuucuguucag

SEQ ID NO: 98844 - RNA, 19 nt, Human
aggaagagccacagggcca

SEQ ID NO: 98845 - RNA, 24 nt, Human
aggaagagccacagggccaggcgc

SEQ ID NO: 98846 - RNA, 19 nt, Human
aggaaggaguuuagcucug

SEQ ID NO: 98847 - RNA, 20 nt, Human
aggaaggaguuuagcucuga

SEQ ID NO: 98848 - RNA, 19 nt, Human
aggagggagggaggaagag

SEQ ID NO: 98849 - RNA, 18 nt, Human
aggcacacauauauuccu

SEQ ID NO: 98850 - RNA, 19 nt, Human
aggcagcgggcgaggggug

SEQ ID NO: 98851 - RNA, 21 nt, Human
aguccuugguuuagcugcuuc

SEQ ID NO: 98852 - RNA, 20 nt, Human
augcggggagggcggggggc

SEQ ID NO: 98853 - RNA, 21 nt, Human
caagaagcuccuggaggacac

SEQ ID NO: 98854 - RNA, 22 nt, Human
caagaagcuccuggaggacaca

SEQ ID NO: 98855 - RNA, 23 nt, Human
caagacagcagcaaguucugagc

SEQ ID NO: 98856 - RNA, 19 nt, Human
caaggcccuaacagaugac

SEQ ID NO: 98857 - RNA, 22 nt, Human
caaggcccuaacagaugacuca

SEQ ID NO: 98858 - RNA, 25 nt, Human
cacagcccugcccccaucuugagau

SEQ ID NO: 98859 - RNA, 21 nt, Human
cacagguaacacugaaauagg

SEQ ID NO: 98860 - RNA, 23 nt, Human
cacccauccauccaaccuuccau

SEQ ID NO: 98861 - RNA, 23 nt, Human
caccugaggccuccagcaggccc

SEQ ID NO: 98862 - RNA, 18 nt, Human
cagcagcaaguucugagc

SEQ ID NO: 98863 - RNA, 20 nt, Human
cagcagggccuucaagcaca

SEQ ID NO: 98864 - RNA, 24 nt, Human
cagcaguaggggcugggcuuccag

SEQ ID NO: 98865 - RNA, 26 nt, Human
cagcaguaggggcugggcuuccagca

SEQ ID NO: 98866 - RNA, 19 nt, Human
cagcccugcccccaucuug

SEQ ID NO: 98867 - RNA, 24 nt, Human
caggacaccacaccaucuuuccca

SEQ ID NO: 98868 - RNA, 26 nt, Human
caggcccucagcccggcaggcccaua

SEQ ID NO: 98869 - RNA, 19 nt, Human
caggcucaugauucaggcc

SEQ ID NO: 98870 - RNA, 22 nt, Human
cagggccaggcgcgagggagga

SEQ ID NO: 98871 - RNA, 22 nt, Human
cauuuccucuugaauagcucca

SEQ ID NO: 98872 - RNA, 22 nt, Human
ccaagcacacagguaacacuga

SEQ ID NO: 98873 - RNA, 23 nt, Human
ccaagcacacagguaacacugaa

SEQ ID NO: 98874 - RNA, 27 nt, Human
ccaaggcccuaacagaugacucagcag

SEQ ID NO: 98875 - RNA, 22 nt, Human
ccaccugguuuggguaugcaag

SEQ ID NO: 98876 - RNA, 23 nt, Human
ccacggcucuccccagccucagc

SEQ ID NO: 98877 - RNA, 30 nt, Human
ccagcaggcccucagcccggcaggcccauu

SEQ ID NO: 98878 - RNA, 20 nt, Human
ccauccacggccauccaccc

SEQ ID NO: 98879 - RNA, 20 nt, Human
cccauccauccaaccuucca

SEQ ID NO: 98880 - RNA, 20 nt, Human
cccaucuugagauucagaau

SEQ ID NO: 98881 - RNA, 21 nt, Human
cccauggacagcaccugaggc

SEQ ID NO: 98882 - RNA, 24 nt, Human
ccccaaggauaauaacaucccuuu

SEQ ID NO: 98883 - RNA, 24 nt, Human
ccggcacagcuggcugggccgagg

SEQ ID NO: 98884 - RNA, 22 nt, Human
ccucagcugacacacacacaaa

SEQ ID NO: 98885 - RNA, 23 nt, Human
ccucagggaccacggcucucccc

SEQ ID NO: 98886 - RNA, 25 nt, Human
ccucagggaccacggcucuccccag

SEQ ID NO: 98887 - RNA, 21 nt, Human
ccuccagcaggcccucagccc

SEQ ID NO: 98888 - RNA, 18 nt, Human
ccugagaugggcguaaag

SEQ ID NO: 98889 - RNA, 19 nt, Human
ccugaggccuccagcaggc

SEQ ID NO: 98890 - RNA, 18 nt, Human
ccuugguuuagcugcuuc

SEQ ID NO: 98891 - RNA, 20 nt, Human
cggcucuccccagccucagc

SEQ ID NO: 98892 - RNA, 18 nt, Human
cucugacccauccucagg

SEQ ID NO: 98893 - RNA, 20 nt, Human
cugacacacacacaaaggag

SEQ ID NO: 98894 - RNA, 22 nt, Human
cugcgcauccacggccauccac

SEQ ID NO: 98895 - RNA, 19 nt, Human
cuggagggccgggcgcagg

SEQ ID NO: 98896 - RNA, 21 nt, Human
cuuaacccuugcccugggagc

SEQ ID NO: 98897 - RNA, 22 nt, Human
gaaggagggagggaggaagagc

SEQ ID NO: 98898 - RNA, 22 nt, Human
gaccacggcucuccccagccuc

SEQ ID NO: 98899 - RNA, 18 nt, Human
gagcagucaggccccagg

SEQ ID NO: 98900 - RNA, 18 nt, Human
gaggcagcgggcgagggg

SEQ ID NO: 98901 - RNA, 19 nt, Human
gaggcagcgggcgaggggu

SEQ ID NO: 98902 - RNA, 27 nt, Human
gcaggcccucagcccggcaggcccauu

SEQ ID NO: 98903 - RNA, 19 nt, Human
gcccuaacagaugacucag

SEQ ID NO: 98904 - RNA, 23 nt, Human
gcccucagcccggcaggcccaua

SEQ ID NO: 98905 - RNA, 23 nt, Human
ggaggagagggaugcggggaggg

SEQ ID NO: 98906 - RNA, 20 nt, Human
ggaugacacaggggaaucug

SEQ ID NO: 98907 - RNA, 21 nt, Human
ggcagacauaccacgguuccu

SEQ ID NO: 98908 - RNA, 20 nt, Human
ggcagcccuggcccgggaag

SEQ ID NO: 98909 - RNA, 24 nt, Human
ggccggcagaaggcuggcuggagg

SEQ ID NO: 98910 - RNA, 18 nt, Human
ggcgcgagggaggagagg

SEQ ID NO: 98911 - RNA, 18 nt, Human
ggcucuuccagggguggg

SEQ ID NO: 98912 - RNA, 19 nt, Human
gggaaguacacagggcaga

SEQ ID NO: 98913 - RNA, 23 nt, Human
gggaggcagcgggcgaggggugg

SEQ ID NO: 98914 - RNA, 22 nt, Human
gggcagcuggcuucaggccucg

SEQ ID NO: 98915 - RNA, 19 nt, Human
gggccggcagaaggcuggc

SEQ ID NO: 98916 - RNA, 22 nt, Human
gggcgagggguggggggggggg

SEQ ID NO: 98917 - RNA, 21 nt, Human
ggggagggcggggggcgaggg

SEQ ID NO: 98918 - RNA, 22 nt, Human
ggggcgagggacgccgggcuca

SEQ ID NO: 98919 - RNA, 19 nt, Human
gggggaaggagggagggag

SEQ ID NO: 98920 - RNA, 19 nt, Human
ggggggaaggagggaggga

SEQ ID NO: 98921 - RNA, 23 nt, Human
ggggggaaggagggagggaggaa

SEQ ID NO: 98922 - RNA, 22 nt, Human
gggggggggaaggagggaggga

SEQ ID NO: 98923 - RNA, 23 nt, Human
ggggggggggaaggagggaggga

SEQ ID NO: 98924 - RNA, 21 nt, Human
gguggggggggggggaaggag

SEQ ID NO: 98925 - RNA, 20 nt, Human
guaaagucaaacagaccaag

SEQ ID NO: 98926 - RNA, 24 nt, Human
guaaagucaaacagaccaagcaca

SEQ ID NO: 98927 - RNA, 19 nt, Human
guaaauauuuuuguccaca

SEQ ID NO: 98928 - RNA, 20 nt, Human
guauuaacccaacuuaacua

SEQ ID NO: 98929 - RNA, 20 nt, Human
guggggggggggggaaggag

SEQ ID NO: 98930 - RNA, 18 nt, Human
uaacccuaacaaggaaac

SEQ ID NO: 98931 - RNA, 19 nt, Human
uaagagcuucuguucaggc

SEQ ID NO: 98932 - RNA, 23 nt, Human
uaagcugguauuaacccaacuua

SEQ ID NO: 98933 - RNA, 18 nt, Human
uaugcaaggcacugcgca

SEQ ID NO: 98934 - RNA, 24 nt, Human
ucagcagggccuucaagcacagcc

SEQ ID NO: 98935 - RNA, 22 nt, Human
ucaggcaccagccagggaagcc

SEQ ID NO: 98936 - RNA, 18 nt, Human
uccaaccuuccauccauc

SEQ ID NO: 98937 - RNA, 21 nt, Human
uccacacaaauaggcacacau

SEQ ID NO: 98938 - RNA, 24 nt, Human
uccacacaaauaggcacacauaua

SEQ ID NO: 98939 - RNA, 20 nt, Human
uccacggccauccacggcca

SEQ ID NO: 98940 - RNA, 22 nt, Human
ucccauggacagcaccugaggc

SEQ ID NO: 98941 - RNA, 21 nt, Human
ucuacggaaguguccugagau

SEQ ID NO: 98942 - RNA, 26 nt, Human
ucugggcuggggcagacaggcaggac

SEQ ID NO: 98943 - RNA, 21 nt, Human
ucuugaauagcuccaaacccu

SEQ ID NO: 98944 - RNA, 21 nt, Human
ugaaauaggaaagaguaagag

SEQ ID NO: 98945 - RNA, 18 nt, Human
ugacacacacacaaagga

SEQ ID NO: 98946 - RNA, 18 nt, Human
ugagaugggcguaaaguc

SEQ ID NO: 98947 - RNA, 18 nt, Human
ugagcagucaggccccag

SEQ ID NO: 98948 - RNA, 22 nt, Human
ugcucaacaaaacgcucccacc

SEQ ID NO: 98949 - RNA, 22 nt, Human
uggcugggccgagggaggcagc

SEQ ID NO: 98950 - RNA, 19 nt, Human
ugggccgagggaggcagcg

SEQ ID NO: 98951 - RNA, 22 nt, Human
ugggcguaaagucaaacagacc

SEQ ID NO: 98952 - RNA, 18 nt, Human
ugggcuggggcagacagg

SEQ ID NO: 98953 - RNA, 19 nt, Human
ugggcuggggcagacaggc

SEQ ID NO: 98954 - RNA, 19 nt, Human
uggggggggggggaaggag

SEQ ID NO: 98955 - RNA, 28 nt, Human
uguccacacaaauaggcacacauauagu

SEQ ID NO: 98956 - RNA, 22 nt, Human
uuaacccuaacaaggaaacaag

SEQ ID NO: 98957 - RNA, 25 nt, Human
uuaacccuaacaaggaaacaagaag

SEQ ID NO: 98958 - RNA, 18 nt, Human
uugaauagcuccaaaccc

SEQ ID NO: 98959 - RNA, 24 nt, Human
uuucccauggacagcaccugaggc

SEQ ID NO: 98960 - RNA, 26 nt, Human
uuuuuuuuuuuuuucucaacuugauu

SEQ ID NO: 98961 - RNA, 27 nt, Human
aaaaaagaaagagggggaaacaaagaa

SEQ ID NO: 98962 - RNA, 23 nt, Human
aaacaaaaccuagcucaagccug

SEQ ID NO: 98963 - RNA, 18 nt, Human
aaagaaagaagguagaca

SEQ ID NO: 98964 - RNA, 19 nt, Human
aacuagauugcagcucugc

SEQ ID NO: 98965 - RNA, 18 nt, Human
aacucaaggcugccuuau

SEQ ID NO: 98966 - RNA, 24 nt, Human
aagaaggaaaauacaaagaaagaa

SEQ ID NO: 98967 - RNA, 25 nt, Human
acaacgcucuugcauagcccgaagc

SEQ ID NO: 98968 - RNA, 21 nt, Human
agaaaaacaaaaccuagcuca

SEQ ID NO: 98969 - RNA, 23 nt, Human
agaaaaacaaaaccuagcucaag

SEQ ID NO: 98970 - RNA, 18 nt, Human
agaaggaaaauacaaaga

SEQ ID NO: 98971 - RNA, 18 nt, Human
agaaggccaaaguuacgg

SEQ ID NO: 98972 - RNA, 25 nt, Human
agaaggccucuuucugcucaggguu

SEQ ID NO: 98973 - RNA, 21 nt, Human
aggaaaauacaaagaaagaag

SEQ ID NO: 98974 - RNA, 26 nt, Human
augaaaggaaaucuaggggaaaggag

SEQ ID NO: 98975 - RNA, 20 nt, Human
cagaaggccucuuucugcuc

SEQ ID NO: 98976 - RNA, 18 nt, Human
cauagcccgaagcccaga

SEQ ID NO: 98977 - RNA, 18 nt, Human
cuaauccauucccaggcc

SEQ ID NO: 98978 - RNA, 19 nt, Human
cucaccaggagaaaaacaa

SEQ ID NO: 98979 - RNA, 27 nt, Human
cugcagugucuuuuuggugacuuguua

SEQ ID NO: 98980 - RNA, 23 nt, Human
cuuucagcucugcugaaaccuaa

SEQ ID NO: 98981 - RNA, 20 nt, Human
gaaaaacaaaaccuagcuca

SEQ ID NO: 98982 - RNA, 19 nt, Human
gaaggaaaauacaaagaaa

SEQ ID NO: 98983 - RNA, 25 nt, Human
gagaaaaacaaaaccuagcucaagc

SEQ ID NO: 98984 - RNA, 19 nt, Human
gagagaaaguagauaggga

SEQ ID NO: 98985 - RNA, 27 nt, Human
gagccagcuccaggacucugccaccag

SEQ ID NO: 98986 - RNA, 23 nt, Human
gcccagagagaaagaguuggcuu

SEQ ID NO: 98987 - RNA, 26 nt, Human
ggagaaaaacaaaaccuagcucaagc

SEQ ID NO: 98988 - RNA, 23 nt, Human
uacaaagaaagaagguagacaac

SEQ ID NO: 98989 - RNA, 21 nt, Human
uacaaguugguagccuguugg

SEQ ID NO: 98990 - RNA, 23 nt, Human
uagacaacgcucuugcauagccc

SEQ ID NO: 98991 - RNA, 20 nt, Human
uagagccagcuccaggacuc

SEQ ID NO: 98992 - RNA, 26 nt, Human
uaguguuuauuuuuccauuuuuaaaa

SEQ ID NO: 98993 - RNA, 21 nt, Human
ucaggguuucugcagugucuu

SEQ ID NO: 98994 - RNA, 24 nt, Human
ucccugaaccaauacaaaucucua

SEQ ID NO: 98995 - RNA, 24 nt, Human
ucucuaugcaacucaaggcugccu

SEQ ID NO: 98996 - RNA, 24 nt, Human
ucugcucaggguuucugcaguguc

SEQ ID NO: 98997 - RNA, 19 nt, Human
ucugcugaaaccuaaucca

SEQ ID NO: 98998 - RNA, 22 nt, Human
ugaaaccuaauccauucccagg

SEQ ID NO: 98999 - RNA, 21 nt, Human
ugacuuguuagcagccagugg

SEQ ID NO: 99000 - RNA, 18 nt, Human
ugagcagaaggccaaagu

SEQ ID NO: 99001 - RNA, 20 nt, Human
ugagcagaaggccaaaguua

SEQ ID NO: 99002 - RNA, 21 nt, Human
ugccaccagcuuucagcucug

SEQ ID NO: 99003 - RNA, 18 nt, Human
ugcucaggguuucugcag

SEQ ID NO: 99004 - RNA, 26 nt, Human
uggcuugugagaagacaugaggaguc

SEQ ID NO: 99005 - RNA, 22 nt, Human
uucugcucaggguuucugcagu

SEQ ID NO: 99006 - RNA, 19 nt, Human
uugcauagcccgaagccca

SEQ ID NO: 99007 - RNA, 22 nt, Human
uugcauagcccgaagcccagag

SEQ ID NO: 99008 - RNA, 21 nt, Human
aaacagaaaagaaaguucccc

SEQ ID NO: 99009 - RNA, 22 nt, Human
aaaguuccccacccuacccccc

SEQ ID NO: 99010 - RNA, 22 nt, Human
acagaaccaaauaaaaacaaau

SEQ ID NO: 99011 - RNA, 19 nt, Human
acucuguuuaucuggaaca

SEQ ID NO: 99012 - RNA, 25 nt, Human
agcauaacucuuccuucaugauacu

SEQ ID NO: 99013 - RNA, 25 nt, Human
agcggcuccggcccggccagccccu

SEQ ID NO: 99014 - RNA, 21 nt, Human
auaaagcauaacucuuccuuc

SEQ ID NO: 99015 - RNA, 20 nt, Human
cagaaaagaaaguuccccac

SEQ ID NO: 99016 - RNA, 19 nt, Human
cauuccuuggcaaucaagu

SEQ ID NO: 99017 - RNA, 18 nt, Human
cccugcucauuuaaacuc

SEQ ID NO: 99018 - RNA, 21 nt, Human
ccgccagcucaagaguaaaga

SEQ ID NO: 99019 - RNA, 18 nt, Human
ccucgaggcucaggccca

SEQ ID NO: 99020 - RNA, 18 nt, Human
cggacgaugacaccgcca

SEQ ID NO: 99021 - RNA, 19 nt, Human
cuaccccccauaaauuguc

SEQ ID NO: 99022 - RNA, 21 nt, Human
cuguagcggcuccggcccggc

SEQ ID NO: 99023 - RNA, 23 nt, Human
gagccagucuuguuagcagcuaa

SEQ ID NO: 99024 - RNA, 25 nt, Human
uaaaaacaaauuuuugaaaaagcaa

SEQ ID NO: 99025 - RNA, 21 nt, Human
uaaagaaaaacagaaaagaaa

SEQ ID NO: 99026 - RNA, 23 nt, Human
ucagcacuagucacacauccagu

SEQ ID NO: 99027 - RNA, 24 nt, Human
ucaucacuauuuuccauaucuaau

SEQ ID NO: 99028 - RNA, 21 nt, Human
uccccacccuaccccccauaa

SEQ ID NO: 99029 - RNA, 22 nt, Human
ucuguuuaucuggaacagaacc

SEQ ID NO: 99030 - RNA, 21 nt, Human
ugacggacgaugacaccgcca

SEQ ID NO: 99031 - RNA, 22 nt, Human
ugauacuuuccaacaaagggag

SEQ ID NO: 99032 - RNA, 22 nt, Human
ugccucaggcccccccuguagc

SEQ ID NO: 99033 - RNA, 22 nt, Human
uggaacagaaccaaauaaaaac

SEQ ID NO: 99034 - RNA, 23 nt, Human
uggaacagaaccaaauaaaaaca

SEQ ID NO: 99035 - RNA, 19 nt, Human
uguagcggcuccggcccgg

SEQ ID NO: 99036 - RNA, 24 nt, Human
uuaagguaauuuacauuccuuggc

SEQ ID NO: 99037 - RNA, 22 nt, Human
uuacauuuguuuaugggagauc

SEQ ID NO: 99038 - RNA, 18 nt, Human
aagaaacagcaaccgcgc

SEQ ID NO: 99039 - RNA, 20 nt, Human
agaguccuuuucaucacccu

SEQ ID NO: 99040 - RNA, 19 nt, Human
aucacccauuugaguuaaa

SEQ ID NO: 99041 - RNA, 21 nt, Human
cauuugaguuaaaacacccua

SEQ ID NO: 99042 - RNA, 18 nt, Human
cccgugccgccgccgccg

SEQ ID NO: 99043 - RNA, 21 nt, Human
cccgugccgccgccgccgccg

SEQ ID NO: 99044 - RNA, 24 nt, Human
cccuacgccgccgcccgugccgcc

SEQ ID NO: 99045 - RNA, 27 nt, Human
ccgcccgugccgccgccgccgccgccg

SEQ ID NO: 99046 - RNA, 29 nt, Human
ccgccgcccgugccgccgccgccgccggc

SEQ ID NO: 99047 - RNA, 18 nt, Human
ccgccgccgccgccgccg

SEQ ID NO: 99048 - RNA, 25 nt, Human
ccgccgccgccgccgccggucccgg

SEQ ID NO: 99049 - RNA, 24 nt, Human
ccggagccagagaagaaacagcaa

SEQ ID NO: 99050 - RNA, 23 nt, Human
cucugcuuucuccucuuguuccu

SEQ ID NO: 99051 - RNA, 24 nt, Human
cugaagaauuucaucuaaaguuuu

SEQ ID NO: 99052 - RNA, 23 nt, Human
gaaacagcaaccgcgcgcgccaa

SEQ ID NO: 99053 - RNA, 24 nt, Human
gaaguacaaaagaacuucaccgaa

SEQ ID NO: 99054 - RNA, 23 nt, Human
gaguuaaaacacccuacgccgcc

SEQ ID NO: 99055 - RNA, 20 nt, Human
uaaaacacccuacgccgccg

SEQ ID NO: 99056 - RNA, 23 nt, Human
uaaaacacccuacgccgccgccc

SEQ ID NO: 99057 - RNA, 22 nt, Human
uacaaaagaacuucaccgaaga

SEQ ID NO: 99058 - RNA, 24 nt, Human
uacaaaagaacuucaccgaagaag

SEQ ID NO: 99059 - RNA, 21 nt, Human
uccucuuguuccuuccuucgu

SEQ ID NO: 99060 - RNA, 24 nt, Human
uccuuuucaucacccauuugaguu

SEQ ID NO: 99061 - RNA, 24 nt, Human
uuaaaacacccuacgccgccgccc

SEQ ID NO: 99062 - RNA, 19 nt, Human
uuccuuccuucguuucuuu

SEQ ID NO: 99063 - RNA, 20 nt, Human
uuguuccuuccuucguuucu

SEQ ID NO: 99064 - RNA, 19 nt, Human
agaguccuuuucaucaccc

SEQ ID NO: 99065 - RNA, 21 nt, Human
agaguugcugccggucuccuc

SEQ ID NO: 99066 - RNA, 19 nt, Human
aucacccauuugaguuaaa

SEQ ID NO: 99067 - RNA, 19 nt, Human
augugcagacacuucccug

SEQ ID NO: 99068 - RNA, 24 nt, Human
caacucgaaccgcucccgcggcgg

SEQ ID NO: 99069 - RNA, 25 nt, Human
cagaaccugagccugauucugcuga

SEQ ID NO: 99070 - RNA, 18 nt, Human
cagcaggucccuuucuuc

SEQ ID NO: 99071 - RNA, 23 nt, Human
caucuucuucuccucugucuucc

SEQ ID NO: 99072 - RNA, 21 nt, Human
cauuugaguuaaaacacccua

SEQ ID NO: 99073 - RNA, 19 nt, Human
cccuacggggccgcggccg

SEQ ID NO: 99074 - RNA, 20 nt, Human
cccugcgggccucccgcucc

SEQ ID NO: 99075 - RNA, 19 nt, Human
cccuuccuccuccuccucu

SEQ ID NO: 99076 - RNA, 22 nt, Human
cccuucucuucugucuuuccca

SEQ ID NO: 99077 - RNA, 23 nt, Human
ccgagcuggucuuccucucgcug

SEQ ID NO: 99078 - RNA, 20 nt, Human
ccgaggcgggcugcgacucc

SEQ ID NO: 99079 - RNA, 20 nt, Human
ccgcccgccgcucgcgcucc

SEQ ID NO: 99080 - RNA, 18 nt, Human
ccgcuuggaaucccgguc

SEQ ID NO: 99081 - RNA, 19 nt, Human
ccggccuggccucaccugg

SEQ ID NO: 99082 - RNA, 18 nt, Human
ccucccgcuccuugcgcc

SEQ ID NO: 99083 - RNA, 18 nt, Human
ccuccucuuccuccuccu

SEQ ID NO: 99084 - RNA, 20 nt, Human
ccuccucuuccuccuccucc

SEQ ID NO: 99085 - RNA, 20 nt, Human
ccuccucuuccucuuccucc

SEQ ID NO: 99086 - RNA, 23 nt, Human
ccuggccucaccuggcuuccggc

SEQ ID NO: 99087 - RNA, 19 nt, Human
cggccgaggcgggcugcga

SEQ ID NO: 99088 - RNA, 24 nt, Human
cggucaucagaauuuuuuaagcgu

SEQ ID NO: 99089 - RNA, 24 nt, Human
cuaugaugccuacauuuuucuuuu

SEQ ID NO: 99090 - RNA, 21 nt, Human
cucaccuggcuuccggccguc

SEQ ID NO: 99091 - RNA, 21 nt, Human
cucagaaccugagccugauuc

SEQ ID NO: 99092 - RNA, 23 nt, Human
cuccuccuccucuuccuccuccu

SEQ ID NO: 99093 - RNA, 22 nt, Human
cuccuccucuuccuccuccucc

SEQ ID NO: 99094 - RNA, 19 nt, Human
cuccuccucuuccucuucc

SEQ ID NO: 99095 - RNA, 19 nt, Human
cuccucuuccucuuccucc

SEQ ID NO: 99096 - RNA, 23 nt, Human
cuccuucugcugcucccgcaucu

SEQ ID NO: 99097 - RNA, 23 nt, Human
cucugcuuucuccucuuguuccu

SEQ ID NO: 99098 - RNA, 22 nt, Human
cugagccugagaagaaacagca

SEQ ID NO: 99099 - RNA, 23 nt, Human
cugcucccgcugcuccuucugcu

SEQ ID NO: 99100 - RNA, 20 nt, Human
cuuuccucuuuucaucuuuu

SEQ ID NO: 99101 - RNA, 22 nt, Human
cuuuccucuuuucaucuuuucu

SEQ ID NO: 99102 - RNA, 21 nt, Human
cuuucuuccauuuucucuucu

SEQ ID NO: 99103 - RNA, 24 nt, Human
cuuugucgcuguaguccucucuca

SEQ ID NO: 99104 - RNA, 19 nt, Human
gcagacacuucccugcggg

SEQ ID NO: 99105 - RNA, 21 nt, Human
gcaggucccuuucuuccauuu

SEQ ID NO: 99106 - RNA, 22 nt, Human
gcuuggaaucccggucaucaga

SEQ ID NO: 99107 - RNA, 19 nt, Human
ggcgggcugcgacuccagu

SEQ ID NO: 99108 - RNA, 20 nt, Human
gugcagacacuucccugcgg

SEQ ID NO: 99109 - RNA, 24 nt, Human
guucuucucgaugucguuuccgac

SEQ ID NO: 99110 - RNA, 20 nt, Human
uaaaacacccuacggggccg

SEQ ID NO: 99111 - RNA, 23 nt, Human
uaaaacacccuacggggccgcgg

SEQ ID NO: 99112 - RNA, 25 nt, Human
ucagaaccugagccugauucugcug

SEQ ID NO: 99113 - RNA, 21 nt, Human
ucccgcugcuccuucugcugc

SEQ ID NO: 99114 - RNA, 18 nt, Human
ucccuuucucuccuggaa

SEQ ID NO: 99115 - RNA, 18 nt, Human
uccuccucuuccucuucc

SEQ ID NO: 99116 - RNA, 21 nt, Human
uccucuuguuccuuccuucgu

SEQ ID NO: 99117 - RNA, 18 nt, Human
uccuucugcucccgcugc

SEQ ID NO: 99118 - RNA, 24 nt, Human
uccuucugcucccgcugcuccuuc

SEQ ID NO: 99119 - RNA, 18 nt, Human
uccuucugcugcucccgc

SEQ ID NO: 99120 - RNA, 24 nt, Human
uccuuuucaucacccauuugaguu

SEQ ID NO: 99121 - RNA, 20 nt, Human
ucuccuccuccuccucuucc

SEQ ID NO: 99122 - RNA, 18 nt, Human
ucucucagcucccccucc

SEQ ID NO: 99123 - RNA, 19 nt, Human
ucucucagcucccccuccu

SEQ ID NO: 99124 - RNA, 24 nt, Human
ucuuccuccuccuccucuucuucc

SEQ ID NO: 99125 - RNA, 19 nt, Human
ucuuccucuuccuccucuc

SEQ ID NO: 99126 - RNA, 20 nt, Human
ucuuuccucuuuucaucuuu

SEQ ID NO: 99127 - RNA, 23 nt, Human
ugaagaauuucaucuaaaguuuu

SEQ ID NO: 99128 - RNA, 19 nt, Human
ugagaagaaacagcaaccg

SEQ ID NO: 99129 - RNA, 20 nt, Human
ugagaagaaacagcaaccgc

SEQ ID NO: 99130 - RNA, 21 nt, Human
ugagccugagaagaaacagca

SEQ ID NO: 99131 - RNA, 21 nt, Human
ugaucuccaugcagugaucuc

SEQ ID NO: 99132 - RNA, 24 nt, Human
ugaugugcagacacuucccugcgg

SEQ ID NO: 99133 - RNA, 18 nt, Human
ugcagugaucucucagcu

SEQ ID NO: 99134 - RNA, 20 nt, Human
ugcagugaucucucagcucc

SEQ ID NO: 99135 - RNA, 22 nt, Human
ugcagugaucucucagcucccc

SEQ ID NO: 99136 - RNA, 21 nt, Human
ugccauuucccuucucuucug

SEQ ID NO: 99137 - RNA, 18 nt, Human
ugcucccuugccauuucc

SEQ ID NO: 99138 - RNA, 19 nt, Human
ugcuggggugguuugaugg

SEQ ID NO: 99139 - RNA, 18 nt, Human
uggccucaccuggcuucc

SEQ ID NO: 99140 - RNA, 19 nt, Human
uggcuggcuuucacuuugu

SEQ ID NO: 99141 - RNA, 19 nt, Human
uggcuuccggccgucuccc

SEQ ID NO: 99142 - RNA, 21 nt, Human
uggggugguuugauggccaaa

SEQ ID NO: 99143 - RNA, 23 nt, Human
uucccauucccggcgagcuuuau

SEQ ID NO: 99144 - RNA, 19 nt, Human
uuccuccuccuccucuucc

SEQ ID NO: 99145 - RNA, 19 nt, Human
uuccuuccuucguuucuuu

SEQ ID NO: 99146 - RNA, 21 nt, Human
uucuucggcagacugcucuga

SEQ ID NO: 99147 - RNA, 18 nt, Human
uugcugccggucuccucc

SEQ ID NO: 99148 - RNA, 20 nt, Human
uugcugccggucuccuccuc

SEQ ID NO: 99149 - RNA, 20 nt, Human
uuguuccuuccuucguuucu

SEQ ID NO: 99150 - RNA, 23 nt, Human
uuucccauucccggcgagcuuua

SEQ ID NO: 99151 - RNA, 25 nt, Human
uuucuuccucacuuacuucuucggc

SEQ ID NO: 99152 - RNA, 20 nt, Human
uuucuuuccucuuuucaucu

SEQ ID NO: 99153 - RNA, 20 nt, Human
aaaaagccaaaacgaaacaa

SEQ ID NO: 99154 - RNA, 20 nt, Human
aaaacgaaacaaccagagga

SEQ ID NO: 99155 - RNA, 23 nt, Human
aaccaaagcagggaaaagagucg

SEQ ID NO: 99156 - RNA, 20 nt, Human
aagccaaaacgaaacaacca

SEQ ID NO: 99157 - RNA, 25 nt, Human
aagccaaaacgaaacaaccagagga

SEQ ID NO: 99158 - RNA, 18 nt, Human
aaggagccacggguccgg

SEQ ID NO: 99159 - RNA, 22 nt, Human
acccugggcccguccaccgagc

SEQ ID NO: 99160 - RNA, 18 nt, Human
accguccgggggggagcc

SEQ ID NO: 99161 - RNA, 19 nt, Human
agcgcccccguggcuccuc

SEQ ID NO: 99162 - RNA, 19 nt, Human
aggcaggaccgggccccuc

SEQ ID NO: 99163 - RNA, 22 nt, Human
aggcaggaccgggccccucgga

SEQ ID NO: 99164 - RNA, 19 nt, Human
caaaaccuccgugagguag

SEQ ID NO: 99165 - RNA, 24 nt, Human
caaacaaaccaaagcagggaaaag

SEQ ID NO: 99166 - RNA, 18 nt, Human
cagcagcgcccccguggc

SEQ ID NO: 99167 - RNA, 19 nt, Human
cagcgcccccguggcuccu

SEQ ID NO: 99168 - RNA, 18 nt, Human
cagcgcggggccgcgcga

SEQ ID NO: 99169 - RNA, 24 nt, Human
caggaccgggccccucggaccgcu

SEQ ID NO: 99170 - RNA, 19 nt, Human
ccaccgagccccgagugac

SEQ ID NO: 99171 - RNA, 19 nt, Human
ccccgguagaagucgggcu

SEQ ID NO: 99172 - RNA, 19 nt, Human
cccgagcgcuccagcagcu

SEQ ID NO: 99173 - RNA, 24 nt, Human
cccggggucggagcagcgcggggc

SEQ ID NO: 99174 - RNA, 23 nt, Human
cccugggcccguccaccgagccc

SEQ ID NO: 99175 - RNA, 24 nt, Human
cccugggcccguccaccgagcccc

SEQ ID NO: 99176 - RNA, 27 nt, Human
ccgccgcccggggaccccgagcgcucc

SEQ ID NO: 99177 - RNA, 26 nt, Human
ccgccgccgccgcccggggaccccga

SEQ ID NO: 99178 - RNA, 20 nt, Human
ccgccugccuccuccucugc

SEQ ID NO: 99179 - RNA, 25 nt, Human
ccucggaccgcuacaccugggccuc

SEQ ID NO: 99180 - RNA, 20 nt, Human
ccucugcgccgccgccgccg

SEQ ID NO: 99181 - RNA, 23 nt, Human
ccucugcgccgccgccgccgccc

SEQ ID NO: 99182 - RNA, 21 nt, Human
cgcaccguccgggggggagcc

SEQ ID NO: 99183 - RNA, 22 nt, Human
cgcccggggaccccgagcgcuc

SEQ ID NO: 99184 - RNA, 24 nt, Human
cgcucccacccugggcccguccac

SEQ ID NO: 99185 - RNA, 19 nt, Human
cggcggcggaggggcccgg

SEQ ID NO: 99186 - RNA, 20 nt, Human
cucauaaaguaguuuuauuu

SEQ ID NO: 99187 - RNA, 19 nt, Human
cuccagcagcucuggcgcc

SEQ ID NO: 99188 - RNA, 22 nt, Human
cuccagcagcucuggcgccgcc

SEQ ID NO: 99189 - RNA, 18 nt, Human
cucccgaggggacaggug

SEQ ID NO: 99190 - RNA, 18 nt, Human
cucugcgccgccgccgcc

SEQ ID NO: 99191 - RNA, 21 nt, Human
cucugugcuggacguggcucc

SEQ ID NO: 99192 - RNA, 21 nt, Human
gaccccgagcgcuccagcagc

SEQ ID NO: 99193 - RNA, 19 nt, Human
gccaaaacgaaacaaccag

SEQ ID NO: 99194 - RNA, 19 nt, Human
gcccggggaccccgagcgc

SEQ ID NO: 99195 - RNA, 24 nt, Human
gcggcggaggggcccggggucgga

SEQ ID NO: 99196 - RNA, 18 nt, Human
ggcccggggucggagcag

SEQ ID NO: 99197 - RNA, 20 nt, Human
ggcggcggcggaggggcccg

SEQ ID NO: 99198 - RNA, 18 nt, Human
gggaccagcacaaaaccu

SEQ ID NO: 99199 - RNA, 20 nt, Human
guggcuccaggaccuggagc

SEQ ID NO: 99200 - RNA, 23 nt, Human
uccaggaccuggagcugacaggc

SEQ ID NO: 99201 - RNA, 19 nt, Human
uccucugcgccgccgccgc

SEQ ID NO: 99202 - RNA, 19 nt, Human
ucggagcagcgcggggccg

SEQ ID NO: 99203 - RNA, 24 nt, Human
ucugugcuggacguggcuccagga

SEQ ID NO: 99204 - RNA, 26 nt, Human
ugacaggcaggaccgggccccuucuu

SEQ ID NO: 99205 - RNA, 21 nt, Human
ugcggccaguccggaagcugg

SEQ ID NO: 99206 - RNA, 22 nt, Human
uggcgguggggcagccccucuu

SEQ ID NO: 99207 - RNA, 20 nt, Human
uggcuccaggaccuggagcu

SEQ ID NO: 99208 - RNA, 21 nt, Human
uggggagggagaaaaagccaa

SEQ ID NO: 99209 - RNA, 27 nt, Human
aaaaaaaaaaaaaacagacacacaaaa

SEQ ID NO: 99210 - RNA, 22 nt, Human
aaaaaaaaaaacagacacacaa

SEQ ID NO: 99211 - RNA, 18 nt, Human
aaaaaaaaaacagacaca

SEQ ID NO: 99212 - RNA, 18 nt, Human
aaaaaaaacagacacaca

SEQ ID NO: 99213 - RNA, 23 nt, Human
aaaaaaacaaaacaaaacacuaa

SEQ ID NO: 99214 - RNA, 20 nt, Human
aaaaaaacagacacacaaaa

SEQ ID NO: 99215 - RNA, 26 nt, Human
aaaaacaagacuaaaaaacaaacccc

SEQ ID NO: 99216 - RNA, 23 nt, Human
aaaacaaaacaaaacacuaagau

SEQ ID NO: 99217 - RNA, 18 nt, Human
aaaacaagacuaaaaaac

SEQ ID NO: 99218 - RNA, 20 nt, Human
aaaauaguacuaaucacuuu

SEQ ID NO: 99219 - RNA, 23 nt, Human
aaacaaaccccacacacacuccc

SEQ ID NO: 99220 - RNA, 20 nt, Human
aaacagaaauaaggggauuc

SEQ ID NO: 99221 - RNA, 24 nt, Human
aacaaaaaaaaauaguacuaauca

SEQ ID NO: 99222 - RNA, 24 nt, Human
aaccaaaauaagcugaaaaaaucc

SEQ ID NO: 99223 - RNA, 22 nt, Human
aagaggagggaaaaaaacaaaa

SEQ ID NO: 99224 - RNA, 26 nt, Human
aagaggagggaaaaaaacaaaacaaa

SEQ ID NO: 99225 - RNA, 18 nt, Human
aagcugaaaaaaucccua

SEQ ID NO: 99226 - RNA, 21 nt, Human
aaguguucuccccacccccac

SEQ ID NO: 99227 - RNA, 18 nt, Human
aauaagcugaaaaaaucc

SEQ ID NO: 99228 - RNA, 19 nt, Human
aauuaaaaaaacaagacua

SEQ ID NO: 99229 - RNA, 23 nt, Human
acaaaaaaaaaaaaaaaaaaaaa

SEQ ID NO: 99230 - RNA, 21 nt, Human
acaaaacacuaagauguccca

SEQ ID NO: 99231 - RNA, 26 nt, Human
acaagacuaaaaaacaaaccccacac

SEQ ID NO: 99232 - RNA, 21 nt, Human
acucaauucauuuggugcauu

SEQ ID NO: 99233 - RNA, 19 nt, Human
agaaaagaggaggggcaag

SEQ ID NO: 99234 - RNA, 21 nt, Human
agaauugagacaugagaaagc

SEQ ID NO: 99235 - RNA, 24 nt, Human
agacuaaaaaacaaaccccacaca

SEQ ID NO: 99236 - RNA, 20 nt, Human
agaggaggggcaagaugggc

SEQ ID NO: 99237 - RNA, 20 nt, Human
aucacuuuucugacaauaca

SEQ ID NO: 99238 - RNA, 18 nt, Human
augggcuccacccacuuu

SEQ ID NO: 99239 - RNA, 25 nt, Human
auugagacaugagaaagcauugguu

SEQ ID NO: 99240 - RNA, 21 nt, Human
auuuccucuacauaacagguc

SEQ ID NO: 99241 - RNA, 22 nt, Human
caaaauaagcugaaaaaauccc

SEQ ID NO: 99242 - RNA, 19 nt, Human
caaaccccacacacacucc

SEQ ID NO: 99243 - RNA, 20 nt, Human
caagacuaaaaaacaaaccc

SEQ ID NO: 99244 - RNA, 21 nt, Human
caagacuaaaaaacaaacccc

SEQ ID NO: 99245 - RNA, 24 nt, Human
cacacacucccccccaaaaaaaag

SEQ ID NO: 99246 - RNA, 18 nt, Human
caccuggcugcucuaggg

SEQ ID NO: 99247 - RNA, 23 nt, Human
cagaaauaaggggauuccccuga

SEQ ID NO: 99248 - RNA, 21 nt, Human
cagagucauccacaagcaugc

SEQ ID NO: 99249 - RNA, 24 nt, Human
cagcaaauggcaaacaaauguccu

SEQ ID NO: 99250 - RNA, 25 nt, Human
cagcaaauggcaaacaaauguccuu

SEQ ID NO: 99251 - RNA, 24 nt, Human
ccaaaaaaaucagcaaauggcaaa

SEQ ID NO: 99252 - RNA, 20 nt, Human
cccacacacacuccccccca

SEQ ID NO: 99253 - RNA, 21 nt, Human
cccacccccacccuaccccca

SEQ ID NO: 99254 - RNA, 23 nt, Human
ccccacacacacucccccccaaa

SEQ ID NO: 99255 - RNA, 24 nt, Human
ccccacccccacccuacccccagc

SEQ ID NO: 99256 - RNA, 18 nt, Human
ccccacccuacccccagc

SEQ ID NO: 99257 - RNA, 24 nt, Human
ccccccaaaaaaaagaggagggaa

SEQ ID NO: 99258 - RNA, 23 nt, Human
ccucauaugcaaaacagaaauug

SEQ ID NO: 99259 - RNA, 21 nt, Human
cuaaaaaacaaaccccacaca

SEQ ID NO: 99260 - RNA, 22 nt, Human
cuacugagcugcaaaucuaugc

SEQ ID NO: 99261 - RNA, 22 nt, Human
cucccccccaaaaaaaagagga

SEQ ID NO: 99262 - RNA, 23 nt, Human
cugaugaugaccucagcuucucc

SEQ ID NO: 99263 - RNA, 25 nt, Human
gaaaaaaacaaaacaaaacacuaag

SEQ ID NO: 99264 - RNA, 23 nt, Human
gaaggguuuuuguuuguuuaaua

SEQ ID NO: 99265 - RNA, 21 nt, Human
gaguggaaccagggagcagcu

SEQ ID NO: 99266 - RNA, 18 nt, Human
gcguccuagaaaagagga

SEQ ID NO: 99267 - RNA, 25 nt, Human
ggaaaaaaauuuuuuuaauuacaaa

SEQ ID NO: 99268 - RNA, 24 nt, Human
gggcauuugucauuauugcaaaaa

SEQ ID NO: 99269 - RNA, 21 nt, Human
ggguggagagaaaaggcaacu

SEQ ID NO: 99270 - RNA, 19 nt, Human
gucuucagcugcauucuag

SEQ ID NO: 99271 - RNA, 19 nt, Human
guggagagaaaaggcaacu

SEQ ID NO: 99272 - RNA, 23 nt, Human
uaaaaaaacaagacuaaaaaaca

SEQ ID NO: 99273 - RNA, 18 nt, Human
uaaaaaacaaaccccaca

SEQ ID NO: 99274 - RNA, 23 nt, Human
uaaaaaacaaaccccacacacac

SEQ ID NO: 99275 - RNA, 28 nt, Human
uaaaaaacaaaccccacacacacucccc

SEQ ID NO: 99276 - RNA, 22 nt, Human
uaagagcaccagauggggaaca

SEQ ID NO: 99277 - RNA, 21 nt, Human
uaagcugaaaaaaucccuauu

SEQ ID NO: 99278 - RNA, 30 nt, Human
uaagcugaaaaaaucccuauuaacacuuaa

SEQ ID NO: 99279 - RNA, 18 nt, Human
uaccuaugggccuugucu

SEQ ID NO: 99280 - RNA, 27 nt, Human
uaccucaacauuuuuaaaaauuggaaa

SEQ ID NO: 99281 - RNA, 19 nt, Human
uauagugcguccuagaaaa

SEQ ID NO: 99282 - RNA, 18 nt, Human
ucagugaaagaaguuagg

SEQ ID NO: 99283 - RNA, 21 nt, Human
uccccacccccacccuacccc

SEQ ID NO: 99284 - RNA, 21 nt, Human
ucuaaacuagaucuaggaagu

SEQ ID NO: 99285 - RNA, 20 nt, Human
ugaaggguuuuuguuuguuc

SEQ ID NO: 99286 - RNA, 18 nt, Human
ugagacaugagaaagcau

SEQ ID NO: 99287 - RNA, 23 nt, Human
ugaugccgacaccagcugugcag

SEQ ID NO: 99288 - RNA, 21 nt, Human
ugcaaaacagaaauaagggga

SEQ ID NO: 99289 - RNA, 18 nt, Human
uggaaccagggagcagcu

SEQ ID NO: 99290 - RNA, 18 nt, Human
uggaaucaauccguccuc

SEQ ID NO: 99291 - RNA, 21 nt, Human
ugggaaagauuaccucaacau

SEQ ID NO: 99292 - RNA, 20 nt, Human
ugucuucuagcaccaccccu

SEQ ID NO: 99293 - RNA, 21 nt, Human
uguuacagagucauccacaag

SEQ ID NO: 99294 - RNA, 28 nt, Human
uguucuccccacccccacccuaccccca

SEQ ID NO: 99295 - RNA, 27 nt, Human
uuaaacaacaaaaaaaaaaaaaaaaaa

SEQ ID NO: 99296 - RNA, 24 nt, Human
uuccucuacauaacaggucuucag

SEQ ID NO: 99297 - RNA, 23 nt, Human
uucuccccacccccacccuaccc

SEQ ID NO: 99298 - RNA, 24 nt, Human
uuuucugacaauacaauuacucaa

SEQ ID NO: 99299 - RNA, 20 nt, Human
uuuuuuuuuuuugaaggguu

SEQ ID NO: 99300 - RNA, 20 nt, Human
uuuuuuuuuuuuugaagggu

SEQ ID NO: 99301 - RNA, 18 nt, Human
uuuuuuuuuuuuuuuuug

SEQ ID NO: 99302 - RNA, 23 nt, Human
uuuuuuuuuuuuuuuuugaaggg

SEQ ID NO: 99303 - RNA, 22 nt, Human
augaaagccaguuacauaaaua

SEQ ID NO: 99304 - RNA, 22 nt, Human
caagagcccggcggcacgaggc

SEQ ID NO: 99305 - RNA, 21 nt, Human
ccggacgccuggcgcucgcgc

SEQ ID NO: 99306 - RNA, 20 nt, Human
cgcugagguaccaagagccc

SEQ ID NO: 99307 - RNA, 22 nt, Human
cggcggccggacgccuggcgcu

SEQ ID NO: 99308 - RNA, 18 nt, Human
gcggccggacgccuggcg

SEQ ID NO: 99309 - RNA, 23 nt, Human
uuuuuuuuuuuuuuggggacgga

SEQ ID NO: 99310 - RNA, 18 nt, Human
aaacaacugaaaaaccac

SEQ ID NO: 99311 - RNA, 23 nt, Human
aaaccggcaauuaauuaauccug

SEQ ID NO: 99312 - RNA, 18 nt, Human
aacacaaaaccaucaaac

SEQ ID NO: 99313 - RNA, 18 nt, Human
aacugaaaaaccacagau

SEQ ID NO: 99314 - RNA, 24 nt, Human
aauaaacaacugaaaaaccacaga

SEQ ID NO: 99315 - RNA, 24 nt, Human
acaaaaccaucaaaccacucuggc

SEQ ID NO: 99316 - RNA, 19 nt, Human
acaacugaaaaaccacaga

SEQ ID NO: 99317 - RNA, 23 nt, Human
acaacugaaaaaccacagauggu

SEQ ID NO: 99318 - RNA, 18 nt, Human
acacaaaaccaucaaacc

SEQ ID NO: 99319 - RNA, 22 nt, Human
caaagccgccacuuccuccaag

SEQ ID NO: 99320 - RNA, 19 nt, Human
caacugaaaaaccacagau

SEQ ID NO: 99321 - RNA, 18 nt, Human
caagcagccgagaggagc

SEQ ID NO: 99322 - RNA, 19 nt, Human
caagguaggagggggcgca

SEQ ID NO: 99323 - RNA, 19 nt, Human
caucaaaccacucuggcca

SEQ ID NO: 99324 - RNA, 21 nt, Human
ccaccggacucaaagccgcca

SEQ ID NO: 99325 - RNA, 18 nt, Human
cggcaagcagccgagagg

SEQ ID NO: 99326 - RNA, 21 nt, Human
cuaacacaaaaccaucaaacc

SEQ ID NO: 99327 - RNA, 20 nt, Human
gaguaugaaaaccggcaauu

SEQ ID NO: 99328 - RNA, 23 nt, Human
gauaaacaucaguuucagccuuc

SEQ ID NO: 99329 - RNA, 20 nt, Human
ggaagacuaacacaaaacca

SEQ ID NO: 99330 - RNA, 27 nt, Human
uaaaauaaacaacugaaaaaccacaga

SEQ ID NO: 99331 - RNA, 19 nt, Human
uaaacaacugaaaaaccac

SEQ ID NO: 99332 - RNA, 18 nt, Human
uaaaggccaaaacuaaaa

SEQ ID NO: 99333 - RNA, 20 nt, Human
uaaggucuuuauacacagaa

SEQ ID NO: 99334 - RNA, 22 nt, Human
uaggagggggcgcagaauagca

SEQ ID NO: 99335 - RNA, 21 nt, Human
ucaaaggcagcacuuuaaaau

SEQ ID NO: 99336 - RNA, 18 nt, Human
ugaaagggaaaaaguguc

SEQ ID NO: 99337 - RNA, 21 nt, Human
ugaagauaaacaucaguuuca

SEQ ID NO: 99338 - RNA, 26 nt, Human
ugaagauaaacaucaguuucagccuu

SEQ ID NO: 99339 - RNA, 24 nt, Human
uggcggcagggugucucggcaagc

SEQ ID NO: 99340 - RNA, 18 nt, Human
uuaaauuaaaggccaaaa

SEQ ID NO: 99341 - RNA, 25 nt, Human
aaaaaacaaacaaaaaaauacccac

SEQ ID NO: 99342 - RNA, 23 nt, Human
aaaaacaacaacaacaaaaaaaa

SEQ ID NO: 99343 - RNA, 21 nt, Human
aaaacaaacaaaaaaauaccc

SEQ ID NO: 99344 - RNA, 26 nt, Human
aaaacaaacaaaaaaauacccacuca

SEQ ID NO: 99345 - RNA, 23 nt, Human
aaaauaguaagacccaaagauau

SEQ ID NO: 99346 - RNA, 22 nt, Human
aaaaugaagacuguagcucucu

SEQ ID NO: 99347 - RNA, 22 nt, Human
aaacaacaacaacaaaaaaaac

SEQ ID NO: 99348 - RNA, 23 nt, Human
aaacaacaacaacaaaaaaaaca

SEQ ID NO: 99349 - RNA, 24 nt, Human
aaacaacaacaacaaaaaaaacaa

SEQ ID NO: 99350 - RNA, 20 nt, Human
aacaacaaaaaaaacaaaca

SEQ ID NO: 99351 - RNA, 24 nt, Human
aacagggugagacgcgccucaaaa

SEQ ID NO: 99352 - RNA, 20 nt, Human
aacaugguaaaacccugucu

SEQ ID NO: 99353 - RNA, 21 nt, Human
aacaugguaaaacccugucuc

SEQ ID NO: 99354 - RNA, 24 nt, Human
aacgcgccauugcacuccagccug

SEQ ID NO: 99355 - RNA, 26 nt, Human
aaggugggcagaucacuugaggguca

SEQ ID NO: 99356 - RNA, 19 nt, Human
acaaaaaaaacaaacaaaa

SEQ ID NO: 99357 - RNA, 18 nt, Human
acaacaaaaaaaacaaac

SEQ ID NO: 99358 - RNA, 19 nt, Human
acaacaaaaaaaacaaaca

SEQ ID NO: 99359 - RNA, 20 nt, Human
acaacaaaaaaaacaaacaa

SEQ ID NO: 99360 - RNA, 26 nt, Human
acaacaacaaaaaaaacaaacaaaaa

SEQ ID NO: 99361 - RNA, 23 nt, Human
acagcggcagcagcaaacuccag

SEQ ID NO: 99362 - RNA, 22 nt, Human
acagggugagacgcgccucaaa

SEQ ID NO: 99363 - RNA, 24 nt, Human
accacaagccccugaacaaacugc

SEQ ID NO: 99364 - RNA, 24 nt, Human
accaccacaagccccugaacaaac

SEQ ID NO: 99365 - RNA, 18 nt, Human
acccagcuccgcugccuc

SEQ ID NO: 99366 - RNA, 25 nt, Human
accccaggccuccucgagcaauccu

SEQ ID NO: 99367 - RNA, 18 nt, Human
acccugucucuacuaaaa

SEQ ID NO: 99368 - RNA, 25 nt, Human
acgcgccucaaaaacaagggaacgc

SEQ ID NO: 99369 - RNA, 24 nt, Human
acuccagccugggcaacaggguga

SEQ ID NO: 99370 - RNA, 24 nt, Human
agagaacgcgccauugcacuccag

SEQ ID NO: 99371 - RNA, 24 nt, Human
agcacuuagggaggccaagguggg

SEQ ID NO: 99372 - RNA, 22 nt, Human
agccuggccaacaugguaaaac

SEQ ID NO: 99373 - RNA, 24 nt, Human
agccuggccaacaugguaaaaccc

SEQ ID NO: 99374 - RNA, 22 nt, Human
agccugggcaacagggugagac

SEQ ID NO: 99375 - RNA, 23 nt, Human
agcggcagcagcaaacuccagcc

SEQ ID NO: 99376 - RNA, 22 nt, Human
aggcaagagaaucacuucaacc

SEQ ID NO: 99377 - RNA, 25 nt, Human
aggcaagagaaucacuucaaccugg

SEQ ID NO: 99378 - RNA, 21 nt, Human
aggccaaggugggcagaucac

SEQ ID NO: 99379 - RNA, 24 nt, Human
auugcacuccagccugggcaacag

SEQ ID NO: 99380 - RNA, 20 nt, Human
caacaaaaaaaacaaacaaa

SEQ ID NO: 99381 - RNA, 21 nt, Human
caacaaaaaaaacaaacaaaa

SEQ ID NO: 99382 - RNA, 22 nt, Human
caacaacaaaaaaaacaaacaa

SEQ ID NO: 99383 - RNA, 21 nt, Human
caacaacaacaaaaaaaacaa

SEQ ID NO: 99384 - RNA, 25 nt, Human
caacaacaacaaaaaaaacaaacaa

SEQ ID NO: 99385 - RNA, 24 nt, Human
caacaugguaaaacccugucucua

SEQ ID NO: 99386 - RNA, 24 nt, Human
caagaccagccuggccaacauggu

SEQ ID NO: 99387 - RNA, 23 nt, Human
caagccccugaacaaacugcaca

SEQ ID NO: 99388 - RNA, 23 nt, Human
caaggugggcagaucacuugagg

SEQ ID NO: 99389 - RNA, 21 nt, Human
cacaagccccugaacaaacug

SEQ ID NO: 99390 - RNA, 22 nt, Human
cacagcggcagcagcaaacucc

SEQ ID NO: 99391 - RNA, 18 nt, Human
cacagcucaggccucgcc

SEQ ID NO: 99392 - RNA, 23 nt, Human
cacagcucaggccucgccggaac

SEQ ID NO: 99393 - RNA, 20 nt, Human
caccacaagccccugaacaa

SEQ ID NO: 99394 - RNA, 22 nt, Human
caccaccacaagccccugaaca

SEQ ID NO: 99395 - RNA, 23 nt, Human
caccaccacaagccccugaacaa

SEQ ID NO: 99396 - RNA, 24 nt, Human
caccaccacaagccccugaacaaa

SEQ ID NO: 99397 - RNA, 21 nt, Human
caccuguaaucccagcuacuc

SEQ ID NO: 99398 - RNA, 24 nt, Human
caccuguaaucccagcuacucggg

SEQ ID NO: 99399 - RNA, 24 nt, Human
cacgccuauaaucccagcacuuag

SEQ ID NO: 99400 - RNA, 20 nt, Human
cacuccagccugggcaacag

SEQ ID NO: 99401 - RNA, 23 nt, Human
cacuccagccugggcaacagggu

SEQ ID NO: 99402 - RNA, 24 nt, Human
cacuccagccugggcaacagggug

SEQ ID NO: 99403 - RNA, 24 nt, Human
cacuugagggucaggaguucaaga

SEQ ID NO: 99404 - RNA, 19 nt, Human
cacuugcaagcacauuggc

SEQ ID NO: 99405 - RNA, 25 nt, Human
cagaucacuugagggucaggaguuc

SEQ ID NO: 99406 - RNA, 24 nt, Human
cagcacuuagggaggccaaggugg

SEQ ID NO: 99407 - RNA, 22 nt, Human
cagcagcaaacuccagccgcgc

SEQ ID NO: 99408 - RNA, 18 nt, Human
cauugcacuccagccugg

SEQ ID NO: 99409 - RNA, 19 nt, Human
cauugcacuccagccuggg

SEQ ID NO: 99410 - RNA, 21 nt, Human
cauugcacuccagccugggca

SEQ ID NO: 99411 - RNA, 23 nt, Human
cauugcacuccagccugggcaac

SEQ ID NO: 99412 - RNA, 24 nt, Human
cauugcacuccagccugggcaaca

SEQ ID NO: 99413 - RNA, 21 nt, Human
ccaaagauauuauucugugcu

SEQ ID NO: 99414 - RNA, 22 nt, Human
ccaccuccucagugcaggaucc

SEQ ID NO: 99415 - RNA, 20 nt, Human
ccaguguccuccaaaucucc

SEQ ID NO: 99416 - RNA, 20 nt, Human
ccauugcacuccagccuggg

SEQ ID NO: 99417 - RNA, 21 nt, Human
ccauugcacuccagccugggc

SEQ ID NO: 99418 - RNA, 22 nt, Human
ccauugcacuccagccugggca

SEQ ID NO: 99419 - RNA, 23 nt, Human
ccauugcacuccagccugggcaa

SEQ ID NO: 99420 - RNA, 24 nt, Human
ccauugcacuccagccugggcaac

SEQ ID NO: 99421 - RNA, 23 nt, Human
cccagcuccgcugccucacagaa

SEQ ID NO: 99422 - RNA, 26 nt, Human
ccucaaaaacaacaacaacaaaaaaa

SEQ ID NO: 99423 - RNA, 20 nt, Human
ccuccaaaucuccaugugga

SEQ ID NO: 99424 - RNA, 21 nt, Human
ccuccaaaucuccauguggac

SEQ ID NO: 99425 - RNA, 23 nt, Human
ccuccucgagcaauccucuucuu

SEQ ID NO: 99426 - RNA, 27 nt, Human
ccucgagcaauccucuucuuuccaccu

SEQ ID NO: 99427 - RNA, 22 nt, Human
ccuggccaacaugguaaaaccc

SEQ ID NO: 99428 - RNA, 24 nt, Human
ccuggccaacaugguaaaacccug

SEQ ID NO: 99429 - RNA, 21 nt, Human
ccuguaaucccagcuacucgg

SEQ ID NO: 99430 - RNA, 20 nt, Human
cgccucaaaaacaacaacaa

SEQ ID NO: 99431 - RNA, 24 nt, Human
cgccucaaaaacaacaacaacaaa

SEQ ID NO: 99432 - RNA, 21 nt, Human
cggaacccgcagccuucaccc

SEQ ID NO: 99433 - RNA, 23 nt, Human
cucaaaaacaacaacaacaaaaa

SEQ ID NO: 99434 - RNA, 27 nt, Human
cucacagaccccaggccuccucgaggg

SEQ ID NO: 99435 - RNA, 22 nt, Human
cucacgccuauaaucccagcac

SEQ ID NO: 99436 - RNA, 24 nt, Human
cucacgccuauaaucccagcacuu

SEQ ID NO: 99437 - RNA, 24 nt, Human
cucacgucucucacacgcagccuc

SEQ ID NO: 99438 - RNA, 18 nt, Human
cucucggacucaccacca

SEQ ID NO: 99439 - RNA, 22 nt, Human
cucucuaaaugccagcugaaua

SEQ ID NO: 99440 - RNA, 21 nt, Human
cuguaaucccagcuacucggg

SEQ ID NO: 99441 - RNA, 19 nt, Human
cugugcuaauauuaaagaa

SEQ ID NO: 99442 - RNA, 24 nt, Human
cuugagggucaggaguucaagacc

SEQ ID NO: 99443 - RNA, 21 nt, Human
gagcaugguggcucacgccua

SEQ ID NO: 99444 - RNA, 25 nt, Human
gaucacuugagggucaggaguucaa

SEQ ID NO: 99445 - RNA, 21 nt, Human
gcacuccagccugggcaacag

SEQ ID NO: 99446 - RNA, 24 nt, Human
gccaacaugguaaaacccugucuc

SEQ ID NO: 99447 - RNA, 22 nt, Human
gccauugcacuccagccugggc

SEQ ID NO: 99448 - RNA, 24 nt, Human
gccauugcacuccagccugggcaa

SEQ ID NO: 99449 - RNA, 19 nt, Human
ggcaccuguaaucccagcu

SEQ ID NO: 99450 - RNA, 23 nt, Human
ggcgcgguggugggcaccuguaa

SEQ ID NO: 99451 - RNA, 21 nt, Human
ggcugagcaugguggcucacg

SEQ ID NO: 99452 - RNA, 23 nt, Human
gggaggccaaggugggcagauca

SEQ ID NO: 99453 - RNA, 19 nt, Human
gggaggcugaggcaagaga

SEQ ID NO: 99454 - RNA, 23 nt, Human
gggaggcugaggcaagagaauca

SEQ ID NO: 99455 - RNA, 27 nt, Human
gggcagaucacuugagggucaggaguu

SEQ ID NO: 99456 - RNA, 24 nt, Human
gguggcucacgccuauaaucccag

SEQ ID NO: 99457 - RNA, 23 nt, Human
gguggugggcaccuguaauccca

SEQ ID NO: 99458 - RNA, 24 nt, Human
gguggugggcaccuguaaucccag

SEQ ID NO: 99459 - RNA, 24 nt, Human
uaaaaauaguaagacccaaagaua

SEQ ID NO: 99460 - RNA, 21 nt, Human
uaaaauucauuggcuucaagu

SEQ ID NO: 99461 - RNA, 22 nt, Human
uaaagcacuaaaaugaagacug

SEQ ID NO: 99462 - RNA, 23 nt, Human
uagauuaaaauucauuggcuuca

SEQ ID NO: 99463 - RNA, 18 nt, Human
ucaaaaacaacaacaaca

SEQ ID NO: 99464 - RNA, 24 nt, Human
ucacuugagggucaggaguucaag

SEQ ID NO: 99465 - RNA, 26 nt, Human
ucaggcccgaauguguaaagcacuaa

SEQ ID NO: 99466 - RNA, 22 nt, Human
uccaccuccucagugcaggauc

SEQ ID NO: 99467 - RNA, 23 nt, Human
uccagccugggcaacagggugag

SEQ ID NO: 99468 - RNA, 24 nt, Human
uccagccugggcaacagggugaga

SEQ ID NO: 99469 - RNA, 21 nt, Human
uccucgagcaauccucuucuu

SEQ ID NO: 99470 - RNA, 28 nt, Human
ucgagcaauccucuucuuuccaccuccu

SEQ ID NO: 99471 - RNA, 25 nt, Human
ucgggaggcugaggcaagagaauca

SEQ ID NO: 99472 - RNA, 25 nt, Human
ucucggacucaccaccacaagcccc

SEQ ID NO: 99473 - RNA, 23 nt, Human
ucucuacuaaaaauuaaaaaauu

SEQ ID NO: 99474 - RNA, 21 nt, Human
ugaagacuguagcucucuaaa

SEQ ID NO: 99475 - RNA, 19 nt, Human
ugagacgcgccucaaaaac

SEQ ID NO: 99476 - RNA, 18 nt, Human
ugaggcaagagaaucacu

SEQ ID NO: 99477 - RNA, 19 nt, Human
ugaggcaagagaaucacuu

SEQ ID NO: 99478 - RNA, 24 nt, Human
ugaggcaagagaaucacuucaacc

SEQ ID NO: 99479 - RNA, 22 nt, Human
ugcacuccagccugggcaacag

SEQ ID NO: 99480 - RNA, 24 nt, Human
uggccaacaugguaaaacccuguc

SEQ ID NO: 99481 - RNA, 21 nt, Human
uggcucacgccuauaauccca

SEQ ID NO: 99482 - RNA, 22 nt, Human
uggcucacgccuauaaucccag

SEQ ID NO: 99483 - RNA, 24 nt, Human
uggcucacgccuauaaucccagca

SEQ ID NO: 99484 - RNA, 25 nt, Human
ugggcagaucacuugagggucagga

SEQ ID NO: 99485 - RNA, 24 nt, Human
ugguggcucacgccuauaauccca

SEQ ID NO: 99486 - RNA, 22 nt, Human
uggugggcaccuguaaucccag

SEQ ID NO: 99487 - RNA, 20 nt, Human
ugugcuaauauuaaagaauc

SEQ ID NO: 99488 - RNA, 22 nt, Human
ugugcuaauauuaaagaaucua

SEQ ID NO: 99489 - RNA, 20 nt, Human
uguguaaagcacuaaaauga

SEQ ID NO: 99490 - RNA, 25 nt, Human
uuacccuaaacuuaaaguucuuaac

SEQ ID NO: 99491 - RNA, 18 nt, Human
uuagcugggcgcgguggu

SEQ ID NO: 99492 - RNA, 24 nt, Human
uuagcugggcgcgguggugggcac

SEQ ID NO: 99493 - RNA, 23 nt, Human
uugagggucaggaguucaagacc

SEQ ID NO: 99494 - RNA, 23 nt, Human
aagaaaaaaauggcaauucacac

SEQ ID NO: 99495 - RNA, 22 nt, Human
aagacuuagucaaaacaggaua

SEQ ID NO: 99496 - RNA, 22 nt, Human
aagcauuuggacuaucaaucuu

SEQ ID NO: 99497 - RNA, 19 nt, Human
aaugugccaccaaacacua

SEQ ID NO: 99498 - RNA, 19 nt, Human
agaaggaagaaaauugaga

SEQ ID NO: 99499 - RNA, 22 nt, Human
agaauguuuuagguaggggcag

SEQ ID NO: 99500 - RNA, 18 nt, Human
agggguuacauccacagg

SEQ ID NO: 99501 - RNA, 21 nt, Human
agguaggggcagagaaggaag

SEQ ID NO: 99502 - RNA, 24 nt, Human
aucaaucuucaccuugguccugca

SEQ ID NO: 99503 - RNA, 21 nt, Human
auccuauacuuaccaaacaga

SEQ ID NO: 99504 - RNA, 21 nt, Human
caaaaugaauacaugucccua

SEQ ID NO: 99505 - RNA, 21 nt, Human
caccagcaccagguugagaaa

SEQ ID NO: 99506 - RNA, 28 nt, Human
caccagcaccagguugaguugguggucc

SEQ ID NO: 99507 - RNA, 21 nt, Human
caggauacagagaucuggaug

SEQ ID NO: 99508 - RNA, 22 nt, Human
cauaacucuaaaagaaucuaca

SEQ ID NO: 99509 - RNA, 26 nt, Human
cauccagaaacuuuguggucagcacc

SEQ ID NO: 99510 - RNA, 21 nt, Human
ccccaugaccaacauuuccuc

SEQ ID NO: 99511 - RNA, 21 nt, Human
ccuaaaaucuacuuagguagg

SEQ ID NO: 99512 - RNA, 21 nt, Human
ccugggucgccgucuccaaga

SEQ ID NO: 99513 - RNA, 22 nt, Human
ccugggucgccgucuccaagag

SEQ ID NO: 99514 - RNA, 24 nt, Human
cuagaaaaggaaauuaucuucuuu

SEQ ID NO: 99515 - RNA, 21 nt, Human
cuguauucacuuuuccuuuca

SEQ ID NO: 99516 - RNA, 19 nt, Human
gaacccaccuaaaaucuac

SEQ ID NO: 99517 - RNA, 19 nt, Human
gaacccaccuaaaaucuac

SEQ ID NO: 99518 - RNA, 18 nt, Human
gaugcaaaaugccagcua

SEQ ID NO: 99519 - RNA, 22 nt, Human
gcagagaaggaagaaaauugag

SEQ ID NO: 99520 - RNA, 20 nt, Human
gcuaagggguuacauccaca

SEQ ID NO: 99521 - RNA, 18 nt, Human
gcuccuuuuucuguaugu

SEQ ID NO: 99522 - RNA, 24 nt, Human
gggcagagaaggaagaaaauugag

SEQ ID NO: 99523 - RNA, 23 nt, Human
guccuuuucucuuugccuacuuc

SEQ ID NO: 99524 - RNA, 26 nt, Human
uaacaguaaacauuaaaugaagaucc

SEQ ID NO: 99525 - RNA, 21 nt, Human
uaagaaaaaaauggcaauuca

SEQ ID NO: 99526 - RNA, 20 nt, Human
uagggaagcuaaaaaucuga

SEQ ID NO: 99527 - RNA, 20 nt, Human
uauacaaauucaagagcauu

SEQ ID NO: 99528 - RNA, 18 nt, Human
ucauuguuuuaguguuca

SEQ ID NO: 99529 - RNA, 21 nt, Human
ucauuuaauccucaucacauc

SEQ ID NO: 99530 - RNA, 24 nt, Human
uccacagggggagcaaagcagggu

SEQ ID NO: 99531 - RNA, 22 nt, Human
ucccaacuguaaacacguacaa

SEQ ID NO: 99532 - RNA, 18 nt, Human
ucccaagaacuaucccag

SEQ ID NO: 99533 - RNA, 21 nt, Human
uccccaaacuauaccuagcuc

SEQ ID NO: 99534 - RNA, 20 nt, Human
ucugucagcugaccacccac

SEQ ID NO: 99535 - RNA, 22 nt, Human
ucuucccaacccaccuaagacu

SEQ ID NO: 99536 - RNA, 19 nt, Human
ugagaagccaguaagaaaa

SEQ ID NO: 99537 - RNA, 23 nt, Human
ugauacuuugccccaugguaaca

SEQ ID NO: 99538 - RNA, 19 nt, Human
uggaugaauucaauuuuaa

SEQ ID NO: 99539 - RNA, 19 nt, Human
uucaccuugguccugcagc

SEQ ID NO: 99540 - RNA, 19 nt, Human
uucaccuugguccugcagc

SEQ ID NO: 99541 - RNA, 21 nt, Human
uuuucuguaugucagugaaag

SEQ ID NO: 99542 - RNA, 22 nt, Human
aaaaaaaaaaaaaaaggcagag

SEQ ID NO: 99543 - RNA, 19 nt, Human
aaaaaaaaaaaagcuuuaa

SEQ ID NO: 99544 - RNA, 21 nt, Human
aaaaaaaaaaagcuuuaagaa

SEQ ID NO: 99545 - RNA, 20 nt, Human
aaaacuacagugacauucuc

SEQ ID NO: 99546 - RNA, 21 nt, Human
aaaaggaggcuggugggagaa

SEQ ID NO: 99547 - RNA, 18 nt, Human
aaaaucugcaaggugcug

SEQ ID NO: 99548 - RNA, 19 nt, Human
aaacacauguugagacucc

SEQ ID NO: 99549 - RNA, 20 nt, Human
aaacuuauuagagcuauaaa

SEQ ID NO: 99550 - RNA, 19 nt, Human
aaaguugaaauucacauuu

SEQ ID NO: 99551 - RNA, 24 nt, Human
aaauugccaggcucaaugacaagc

SEQ ID NO: 99552 - RNA, 23 nt, Human
aacaagucacuggauagcugccc

SEQ ID NO: 99553 - RNA, 20 nt, Human
aacacagggagaccccgucu

SEQ ID NO: 99554 - RNA, 20 nt, Human
aacauagcaagaccccaucu

SEQ ID NO: 99555 - RNA, 21 nt, Human
aagaccccaucuguacaaaaa

SEQ ID NO: 99556 - RNA, 23 nt, Human
aagauccucacuacccccuaccc

SEQ ID NO: 99557 - RNA, 18 nt, Human
aagcucuccugccaucuc

SEQ ID NO: 99558 - RNA, 24 nt, Human
aaggcagaaggauugcuugaggcc

SEQ ID NO: 99559 - RNA, 21 nt, Human
acaaacuuauuagagcuauaa

SEQ ID NO: 99560 - RNA, 22 nt, Human
acacaauuaucagcacccacac

SEQ ID NO: 99561 - RNA, 24 nt, Human
acaucacugcaucccaggccuggg

SEQ ID NO: 99562 - RNA, 25 nt, Human
acaucacugcaucccaggccugggc

SEQ ID NO: 99563 - RNA, 18 nt, Human
acauucucuacacagaac

SEQ ID NO: 99564 - RNA, 21 nt, Human
acccccaaagaaaauacacaa

SEQ ID NO: 99565 - RNA, 20 nt, Human
accucaaucauccucagcau

SEQ ID NO: 99566 - RNA, 24 nt, Human
acuaacugcaucacuaaccagucu

SEQ ID NO: 99567 - RNA, 23 nt, Human
acugcacuccagccuggccgaua

SEQ ID NO: 99568 - RNA, 20 nt, Human
acugcaucacuaaccagucu

SEQ ID NO: 99569 - RNA, 18 nt, Human
agaugggaggaucacuug

SEQ ID NO: 99570 - RNA, 23 nt, Human
agaugggaggaucacuugagccc

SEQ ID NO: 99571 - RNA, 24 nt, Human
agcagcucaugcccacaaucccag

SEQ ID NO: 99572 - RNA, 24 nt, Human
agccuggccgauagaaugagaccc

SEQ ID NO: 99573 - RNA, 24 nt, Human
agcuugggcaacauagcaagaccc

SEQ ID NO: 99574 - RNA, 20 nt, Human
aggaguuugagaccagccug

SEQ ID NO: 99575 - RNA, 24 nt, Human
aggaucacuugagcccaggaguuu

SEQ ID NO: 99576 - RNA, 24 nt, Human
aggauugcuugaggccaggaguuu

SEQ ID NO: 99577 - RNA, 18 nt, Human
aggcagaaggauugcuug

SEQ ID NO: 99578 - RNA, 22 nt, Human
aggcagaaggauugcuugaggc

SEQ ID NO: 99579 - RNA, 18 nt, Human
agggaguuggggagcugg

SEQ ID NO: 99580 - RNA, 19 nt, Human
agggccacauuuucuucuu

SEQ ID NO: 99581 - RNA, 24 nt, Human
aggugcaguggcucaugucuguaa

SEQ ID NO: 99582 - RNA, 23 nt, Human
aguggcucaugucuguaauccca

SEQ ID NO: 99583 - RNA, 22 nt, Human
auagaaugagacccugucuuaa

SEQ ID NO: 99584 - RNA, 24 nt, Human
auagaaugagacccugucuuaaaa

SEQ ID NO: 99585 - RNA, 21 nt, Human
aucaagacaauuccaaaaagu

SEQ ID NO: 99586 - RNA, 24 nt, Human
aucacuugagcccaggaguuugag

SEQ ID NO: 99587 - RNA, 19 nt, Human
augucuguaaucccaauac

SEQ ID NO: 99588 - RNA, 23 nt, Human
auuauauacacaaaacaacagaa

SEQ ID NO: 99589 - RNA, 24 nt, Human
auugcaccacugcacuccagccug

SEQ ID NO: 99590 - RNA, 21 nt, Human
caagacaauuccaaaaaguga

SEQ ID NO: 99591 - RNA, 26 nt, Human
caaggcagaaggauugcuugaggcca

SEQ ID NO: 99592 - RNA, 18 nt, Human
caaguuacauacucagga

SEQ ID NO: 99593 - RNA, 19 nt, Human
caccaccauguaaagagug

SEQ ID NO: 99594 - RNA, 18 nt, Human
cacugcacuccagccugg

SEQ ID NO: 99595 - RNA, 21 nt, Human
cacugcacuccagccuggccg

SEQ ID NO: 99596 - RNA, 23 nt, Human
cacugcacuccagccuggccgau

SEQ ID NO: 99597 - RNA, 25 nt, Human
cacugcacuccagccuggccgauag

SEQ ID NO: 99598 - RNA, 19 nt, Human
cacugcaucccaggccugg

SEQ ID NO: 99599 - RNA, 24 nt, Human
cacugcaucccaggccugggcgau

SEQ ID NO: 99600 - RNA, 24 nt, Human
cagcacuuuggggggccaaggcag

SEQ ID NO: 99601 - RNA, 25 nt, Human
cauagcaagaccccaucuguacaaa

SEQ ID NO: 99602 - RNA, 20 nt, Human
caucacugcaucccaggccu

SEQ ID NO: 99603 - RNA, 24 nt, Human
caugcccacaaucccagcacuuug

SEQ ID NO: 99604 - RNA, 23 nt, Human
caugggucuggggcccgccucuc

SEQ ID NO: 99605 - RNA, 20 nt, Human
caugucuguaaucccaauac

SEQ ID NO: 99606 - RNA, 23 nt, Human
ccaaaacacuugagaaacaguaa

SEQ ID NO: 99607 - RNA, 22 nt, Human
ccacauuuucuucuugcuccua

SEQ ID NO: 99608 - RNA, 19 nt, Human
ccacugcacuccagccugg

SEQ ID NO: 99609 - RNA, 19 nt, Human
ccacugcacuccagccugg

SEQ ID NO: 99610 - RNA, 20 nt, Human
ccacugcacuccagccuggc

SEQ ID NO: 99611 - RNA, 22 nt, Human
ccacugcacuccagccuggccg

SEQ ID NO: 99612 - RNA, 23 nt, Human
ccacugcacuccagccuggccga

SEQ ID NO: 99613 - RNA, 23 nt, Human
ccacugcacuccagccuggccga

SEQ ID NO: 99614 - RNA, 18 nt, Human
ccagacaaagacacaaac

SEQ ID NO: 99615 - RNA, 18 nt, Human
cccaaagaaaauacacaa

SEQ ID NO: 99616 - RNA, 20 nt, Human
cccaauacucugggaggcca

SEQ ID NO: 99617 - RNA, 25 nt, Human
cccagaguuugagguuacagugagc

SEQ ID NO: 99618 - RNA, 20 nt, Human
ccugccaucuccaagcccac

SEQ ID NO: 99619 - RNA, 23 nt, Human
ccugucuuaaaaaaaaaaaaaaa

SEQ ID NO: 99620 - RNA, 18 nt, Human
ccuguggucccagcuacu

SEQ ID NO: 99621 - RNA, 21 nt, Human
ccuguggucccagcuacuugg

SEQ ID NO: 99622 - RNA, 26 nt, Human
ccuuuagggccacauuuucuucuuga

SEQ ID NO: 99623 - RNA, 18 nt, Human
cgggucgggccgggcugg

SEQ ID NO: 99624 - RNA, 22 nt, Human
cuaacccccuuuagggccacau

SEQ ID NO: 99625 - RNA, 18 nt, Human
cuacccccuaccccucaa

SEQ ID NO: 99626 - RNA, 30 nt, Human
cucaagggaagggagcugaaaaaccacccc

SEQ ID NO: 99627 - RNA, 20 nt, Human
cucacuacccccuaccccuc

SEQ ID NO: 99628 - RNA, 24 nt, Human
cucaugcccacaaucccagcacuu

SEQ ID NO: 99629 - RNA, 20 nt, Human
cucaugucuguaaucccaau

SEQ ID NO: 99630 - RNA, 26 nt, Human
cugcagcacuuuaggcacuauucuaa

SEQ ID NO: 99631 - RNA, 22 nt, Human
cugcagugagcugugauugcac

SEQ ID NO: 99632 - RNA, 19 nt, Human
cugcaucccaggccugggc

SEQ ID NO: 99633 - RNA, 19 nt, Human
cugcaucccaggccugggc

SEQ ID NO: 99634 - RNA, 18 nt, Human
cugccgaaaaaucaagac

SEQ ID NO: 99635 - RNA, 20 nt, Human
cuggccgauagaaugagacc

SEQ ID NO: 99636 - RNA, 19 nt, Human
cuguaaucccaauacucug

SEQ ID NO: 99637 - RNA, 21 nt, Human
cuguaaucccaauacucuggg

SEQ ID NO: 99638 - RNA, 20 nt, Human
cuuaaaaaaaaaaaaaaagg

SEQ ID NO: 99639 - RNA, 20 nt, Human
cuuaaaaaauggcagggagu

SEQ ID NO: 99640 - RNA, 22 nt, Human
cuucuugcuccuaagaaaaaau

SEQ ID NO: 99641 - RNA, 20 nt, Human
cuugaggccaggaguuuaag

SEQ ID NO: 99642 - RNA, 19 nt, Human
cuuuuggacaucaccacca

SEQ ID NO: 99643 - RNA, 21 nt, Human
cuuuuggacaucaccaccaug

SEQ ID NO: 99644 - RNA, 22 nt, Human
gagacuccuccauuccuuccag

SEQ ID NO: 99645 - RNA, 18 nt, Human
gagccccagaguuugagg

SEQ ID NO: 99646 - RNA, 20 nt, Human
gagcgggcuggagucugaac

SEQ ID NO: 99647 - RNA, 20 nt, Human
gaggcugaggugcaaggaua

SEQ ID NO: 99648 - RNA, 20 nt, Human
gauagaaugagacccugucu

SEQ ID NO: 99649 - RNA, 18 nt, Human
gauagcuugagccuggga

SEQ ID NO: 99650 - RNA, 24 nt, Human
gaucacuugagcccaggaguuuga

SEQ ID NO: 99651 - RNA, 24 nt, Human
gauugcuugaggccaggaguuuaa

SEQ ID NO: 99652 - RNA, 22 nt, Human
gcaaagcaacugaauucaggag

SEQ ID NO: 99653 - RNA, 22 nt, Human
gcccaggaguuugagaccagcc

SEQ ID NO: 99654 - RNA, 24 nt, Human
gccgauagaaugagacccugucuu

SEQ ID NO: 99655 - RNA, 24 nt, Human
gccugggaggacaaggcugcagug

SEQ ID NO: 99656 - RNA, 19 nt, Human
gcggucgggucgggccggg

SEQ ID NO: 99657 - RNA, 21 nt, Human
gcuggagucugaacugacuuc

SEQ ID NO: 99658 - RNA, 24 nt, Human
gcugggcaggugcaguggcucaug

SEQ ID NO: 99659 - RNA, 22 nt, Human
ggaucacuugagcccaggaguu

SEQ ID NO: 99660 - RNA, 23 nt, Human
ggaucacuugagcccaggaguuu

SEQ ID NO: 99661 - RNA, 22 nt, Human
ggauugcuugaggccaggaguu

SEQ ID NO: 99662 - RNA, 23 nt, Human
ggauugcuugaggccaggaguuu

SEQ ID NO: 99663 - RNA, 18 nt, Human
ggcaggugcaguggcuca

SEQ ID NO: 99664 - RNA, 22 nt, Human
gggaguuggggagcugggcagg

SEQ ID NO: 99665 - RNA, 22 nt, Human
gggcaggugcaguggcucaugu

SEQ ID NO: 99666 - RNA, 21 nt, Human
gggcuuugaguacaaaccacg

SEQ ID NO: 99667 - RNA, 22 nt, Human
guaaagcuauuucaacaaaagu

SEQ ID NO: 99668 - RNA, 20 nt, Human
guaguggugcaugccugugg

SEQ ID NO: 99669 - RNA, 20 nt, Human
gugcacaccuggaauugggc

SEQ ID NO: 99670 - RNA, 22 nt, Human
uaaaaagagauccaaaucaaga

SEQ ID NO: 99671 - RNA, 24 nt, Human
uaaaagagcccaauaauuucugca

SEQ ID NO: 99672 - RNA, 23 nt, Human
uaaagcuauuucaacaaaagucu

SEQ ID NO: 99673 - RNA, 21 nt, Human
uaaugaacacacuuacucaga

SEQ ID NO: 99674 - RNA, 22 nt, Human
uacacaaaacaacagaacuaga

SEQ ID NO: 99675 - RNA, 23 nt, Human
uagggccacauuuucuucuugcu

SEQ ID NO: 99676 - RNA, 21 nt, Human
uaguaaugagcagaagcacac

SEQ ID NO: 99677 - RNA, 24 nt, Human
uaguggugcaugccugugguccca

SEQ ID NO: 99678 - RNA, 20 nt, Human
uauauacacaaaacaacaga

SEQ ID NO: 99679 - RNA, 21 nt, Human
uauauacacaaaacaacagaa

SEQ ID NO: 99680 - RNA, 24 nt, Human
uaucagcacccacacauguauaca

SEQ ID NO: 99681 - RNA, 21 nt, Human
uauuagagcuauaaaguggag

SEQ ID NO: 99682 - RNA, 24 nt, Human
ucacuacccccuaccccucaacua

SEQ ID NO: 99683 - RNA, 21 nt, Human
ucaggagaugaaagagggaag

SEQ ID NO: 99684 - RNA, 22 nt, Human
ucaugcccacaaucccagcacu

SEQ ID NO: 99685 - RNA, 22 nt, Human
ucaugucuguaaucccaauacu

SEQ ID NO: 99686 - RNA, 19 nt, Human
uccaaaacacuugagaaac

SEQ ID NO: 99687 - RNA, 24 nt, Human
uccgcaagcucacaggugcuuugc

SEQ ID NO: 99688 - RNA, 23 nt, Human
ucuccugccaucuccaagcccac

SEQ ID NO: 99689 - RNA, 18 nt, Human
ucuguagacaucaucaaa

SEQ ID NO: 99690 - RNA, 19 nt, Human
ucugucuuuggcugcagca

SEQ ID NO: 99691 - RNA, 26 nt, Human
ucuuuucuuugauugucaaaaguuga

SEQ ID NO: 99692 - RNA, 23 nt, Human
ugaaagagggaagccauuaaagg

SEQ ID NO: 99693 - RNA, 18 nt, Human
ugacuuccgcaagcucac

SEQ ID NO: 99694 - RNA, 19 nt, Human
ugacuucuccccuucuuuu

SEQ ID NO: 99695 - RNA, 23 nt, Human
ugagcccaggaguuugagaccag

SEQ ID NO: 99696 - RNA, 24 nt, Human
ugagccugggaggacaaggcugca

SEQ ID NO: 99697 - RNA, 20 nt, Human
ugaucacaucacugcauccc

SEQ ID NO: 99698 - RNA, 21 nt, Human
ugcaccacugcacuccagccu

SEQ ID NO: 99699 - RNA, 24 nt, Human
ugccuguggucccagcuacuuggg

SEQ ID NO: 99700 - RNA, 18 nt, Human
uggacaucaccaccaugu

SEQ ID NO: 99701 - RNA, 22 nt, Human
uggcagggaguuggggagcugg

SEQ ID NO: 99702 - RNA, 24 nt, Human
uggccgauagaaugagacccuguc

SEQ ID NO: 99703 - RNA, 21 nt, Human
uggcucaugucuguaauccca

SEQ ID NO: 99704 - RNA, 22 nt, Human
uggcucaugucuguaaucccaa

SEQ ID NO: 99705 - RNA, 24 nt, Human
uggcucaugucuguaaucccaaua

SEQ ID NO: 99706 - RNA, 21 nt, Human
uggcugcagcacuuuaggcac

SEQ ID NO: 99707 - RNA, 24 nt, Human
ugggaggccaagaugggaggauca

SEQ ID NO: 99708 - RNA, 22 nt, Human
ugggcaacauagcaagacccca

SEQ ID NO: 99709 - RNA, 18 nt, Human
uggugcaugccugugguc

SEQ ID NO: 99710 - RNA, 24 nt, Human
uggugcaugccuguggucccagcu

SEQ ID NO: 99711 - RNA, 21 nt, Human
uguacaaaaaaauaaaaagga

SEQ ID NO: 99712 - RNA, 23 nt, Human
uguacaaaaaaauaaaaaggagg

SEQ ID NO: 99713 - RNA, 24 nt, Human
uguacaaaaaaauaaaaaggaggc

SEQ ID NO: 99714 - RNA, 23 nt, Human
ugucuguaaucccaauacucugg

SEQ ID NO: 99715 - RNA, 21 nt, Human
uuaaaggucuucagaguagac

SEQ ID NO: 99716 - RNA, 18 nt, Human
uucagagaugagguagac

SEQ ID NO: 99717 - RNA, 19 nt, Human
uuccagaauuuucagagau

SEQ ID NO: 99718 - RNA, 21 nt, Human
uucuccaaaacacuugagaaa

SEQ ID NO: 99719 - RNA, 22 nt, Human
uugagcccaggaguuugagacc

SEQ ID NO: 99720 - RNA, 22 nt, Human
uugaggccaggaguuuaagacc

SEQ ID NO: 99721 - RNA, 23 nt, Human
uugcaccacugcacuccagccug

SEQ ID NO: 99722 - RNA, 21 nt, Human
uuucccagcacaugggucugg

SEQ ID NO: 99723 - RNA, 20 nt, Human
aaaagcuucauuugcaaggg

SEQ ID NO: 99724 - RNA, 20 nt, Human
acucuggacagcagggaacc

SEQ ID NO: 99725 - RNA, 21 nt, Human
agaaauugucacuaugucccc

SEQ ID NO: 99726 - RNA, 20 nt, Human
aggaaaaugcuccugaauau

SEQ ID NO: 99727 - RNA, 19 nt, Human
auagcuuuggcucuuggaa

SEQ ID NO: 99728 - RNA, 18 nt, Human
auggaaguugguuccagc

SEQ ID NO: 99729 - RNA, 23 nt, Human
cauauauauuccaugagacaucc

SEQ ID NO: 99730 - RNA, 19 nt, Human
ccuauuuuacccaguuggu

SEQ ID NO: 99731 - RNA, 21 nt, Human
cuaacucaagcucuuucucag

SEQ ID NO: 99732 - RNA, 18 nt, Human
cuucuugacaaaucccag

SEQ ID NO: 99733 - RNA, 18 nt, Human
gaaaugaaauugcacaaa

SEQ ID NO: 99734 - RNA, 25 nt, Human
gcauaucacaccuacuaacaucaca

SEQ ID NO: 99735 - RNA, 20 nt, Human
ggacagcagggaaccgaaga

SEQ ID NO: 99736 - RNA, 25 nt, Human
guaaaauuuuucuucaccuuuuuaa

SEQ ID NO: 99737 - RNA, 26 nt, Human
guaaaauuuuucuucaccuuuuuaaa

SEQ ID NO: 99738 - RNA, 19 nt, Human
gugcugacuggcaggaaaa

SEQ ID NO: 99739 - RNA, 19 nt, Human
uaaaacauuagcagauaga

SEQ ID NO: 99740 - RNA, 30 nt, Human
uaaauacaaaaauauaaauauaaaacauuu

SEQ ID NO: 99741 - RNA, 19 nt, Human
uaacccaggagaaauuguc

SEQ ID NO: 99742 - RNA, 23 nt, Human
uaacucaagcucuuucucagcau

SEQ ID NO: 99743 - RNA, 20 nt, Human
uaagaaguaaaugagaaaaa

SEQ ID NO: 99744 - RNA, 24 nt, Human
uaagauggacaacacuguauuucc

SEQ ID NO: 99745 - RNA, 22 nt, Human
uacagaacaggauauacuguaa

SEQ ID NO: 99746 - RNA, 23 nt, Human
uaucacugauucuacuucaaucu

SEQ ID NO: 99747 - RNA, 18 nt, Human
uauccuguucauguuucu

SEQ ID NO: 99748 - RNA, 19 nt, Human
uauuccaugagacauccua

SEQ ID NO: 99749 - RNA, 18 nt, Human
ucaagcucuuucucagca

SEQ ID NO: 99750 - RNA, 25 nt, Human
ucaaucuaacucaagcucuuucuca

SEQ ID NO: 99751 - RNA, 19 nt, Human
ucagcaucacuuuuaacuc

SEQ ID NO: 99752 - RNA, 21 nt, Human
ugaaaugaaauugcacaaaug

SEQ ID NO: 99753 - RNA, 23 nt, Human
ugcauaucacaccuacuaacauc

SEQ ID NO: 99754 - RNA, 22 nt, Human
uggacagcagggaaccgaagaa

SEQ ID NO: 99755 - RNA, 18 nt, Human
uggagacagcauggguag

SEQ ID NO: 99756 - RNA, 20 nt, Human
uggauaauggaaguugguuc

SEQ ID NO: 99757 - RNA, 18 nt, Human
ugugcugacuggcaggaa

SEQ ID NO: 99758 - RNA, 19 nt, Human
uguuuuguucauguuuccc

SEQ ID NO: 99759 - RNA, 28 nt, Human
uuguuugugagguugcuuaagggagaac

SEQ ID NO: 99760 - RNA, 27 nt, Human
uuucucagcaucacuuuuaacucuggg

SEQ ID NO: 99761 - RNA, 25 nt, Human
aaaagaagaaagacuuggauguuca

SEQ ID NO: 99762 - RNA, 21 nt, Human
aaaaugacauagaaauagggc

SEQ ID NO: 99763 - RNA, 28 nt, Human
aaagauuuacaagaaucagcaguaacaa

SEQ ID NO: 99764 - RNA, 21 nt, Human
aaaucugcuaguuucuuaaaa

SEQ ID NO: 99765 - RNA, 24 nt, Human
aaguagaagcaaaaagauuuacaa

SEQ ID NO: 99766 - RNA, 24 nt, Human
aauaagaacuuuaaaauuguacaa

SEQ ID NO: 99767 - RNA, 24 nt, Human
aaucauaguccaagucugaaucug

SEQ ID NO: 99768 - RNA, 20 nt, Human
acaacuuaaaaaagaagaaa

SEQ ID NO: 99769 - RNA, 18 nt, Human
acaguuauaucuggcacg

SEQ ID NO: 99770 - RNA, 18 nt, Human
acauauagaguguccaga

SEQ ID NO: 99771 - RNA, 18 nt, Human
acccggccacugagcccc

SEQ ID NO: 99772 - RNA, 20 nt, Human
accucucuugggauggaaug

SEQ ID NO: 99773 - RNA, 20 nt, Human
agcucauauuaaagcaacag

SEQ ID NO: 99774 - RNA, 28 nt, Human
agggacccggccacugagccccugccuu

SEQ ID NO: 99775 - RNA, 21 nt, Human
agugguucuuucuuuugccuu

SEQ ID NO: 99776 - RNA, 21 nt, Human
augacauagaaauagggcguc

SEQ ID NO: 99777 - RNA, 18 nt, Human
caacaaaugacaacacga

SEQ ID NO: 99778 - RNA, 19 nt, Human
caacacgaaggaaugucac

SEQ ID NO: 99779 - RNA, 20 nt, Human
caacacgaaggaaugucaca

SEQ ID NO: 99780 - RNA, 22 nt, Human
caaccuccgagccgccaguccc

SEQ ID NO: 99781 - RNA, 19 nt, Human
caagaaucagcaguaacaa

SEQ ID NO: 99782 - RNA, 24 nt, Human
cacaguauuuaccacuuugauguc

SEQ ID NO: 99783 - RNA, 18 nt, Human
cagcaguaacaagauuga

SEQ ID NO: 99784 - RNA, 23 nt, Human
cagggacccggccacugagcccc

SEQ ID NO: 99785 - RNA, 22 nt, Human
cccggccacugagccccugccu

SEQ ID NO: 99786 - RNA, 25 nt, Human
ccggagcccaggucuaggcauguac

SEQ ID NO: 99787 - RNA, 21 nt, Human
ccuccgagccgccagucccug

SEQ ID NO: 99788 - RNA, 19 nt, Human
ccuuucuaauuuuguggaa

SEQ ID NO: 99789 - RNA, 20 nt, Human
cucauauuaaagcaacagua

SEQ ID NO: 99790 - RNA, 19 nt, Human
cuccuucacuuaaauauuu

SEQ ID NO: 99791 - RNA, 20 nt, Human
cuggccggagcccaggucua

SEQ ID NO: 99792 - RNA, 22 nt, Human
gagccgccagucccuggcgcag

SEQ ID NO: 99793 - RNA, 21 nt, Human
ggagaaugcagcugucacccc

SEQ ID NO: 99794 - RNA, 19 nt, Human
ggccacugagccccugccu

SEQ ID NO: 99795 - RNA, 22 nt, Human
uaaaaaagaagaaagacuugga

SEQ ID NO: 99796 - RNA, 22 nt, Human
uaacacauaaacaauuucccuu

SEQ ID NO: 99797 - RNA, 19 nt, Human
uaaguaaugauguucucac

SEQ ID NO: 99798 - RNA, 21 nt, Human
uacagcucagaacuguugucc

SEQ ID NO: 99799 - RNA, 24 nt, Human
uacagcucagaacuguuguccuuu

SEQ ID NO: 99800 - RNA, 20 nt, Human
uagggcgucucucacugaaa

SEQ ID NO: 99801 - RNA, 21 nt, Human
uauuucacaguauuuaccacu

SEQ ID NO: 99802 - RNA, 23 nt, Human
ucacugaaacaagacaguuauau

SEQ ID NO: 99803 - RNA, 26 nt, Human
ucagcggcggcugcgagcggcccccu

SEQ ID NO: 99804 - RNA, 22 nt, Human
ucaggauucuggaggguggcaa

SEQ ID NO: 99805 - RNA, 30 nt, Human
uccacccaucugauuggucacucaacaaaa

SEQ ID NO: 99806 - RNA, 24 nt, Human
ucccggacgcgucacgcagaccuc

SEQ ID NO: 99807 - RNA, 28 nt, Human
ucgacauccacgcuguugggcgcuggcc

SEQ ID NO: 99808 - RNA, 19 nt, Human
ucucuguaaaacuuugccu

SEQ ID NO: 99809 - RNA, 24 nt, Human
ucuucuuccccacccccuucauca

SEQ ID NO: 99810 - RNA, 25 nt, Human
ucuuuugccuucucagggucacaaa

SEQ ID NO: 99811 - RNA, 25 nt, Human
ugaaaguagaagcaaaaagauuuac

SEQ ID NO: 99812 - RNA, 19 nt, Human
ugacaacuuaaaaaagaag

SEQ ID NO: 99813 - RNA, 25 nt, Human
ugacauagaaauagggcgucucuca

SEQ ID NO: 99814 - RNA, 20 nt, Human
ugagaaaagguauuucacag

SEQ ID NO: 99815 - RNA, 19 nt, Human
ugccguaacauuuucuuac

SEQ ID NO: 99816 - RNA, 18 nt, Human
uggcgcagggcaagcgcu

SEQ ID NO: 99817 - RNA, 22 nt, Human
uggcgcagggcaagcgcugcgg

SEQ ID NO: 99818 - RNA, 18 nt, Human
ugggauggaaugucucug

SEQ ID NO: 99819 - RNA, 22 nt, Human
uguacauuguauuguacauaca

SEQ ID NO: 99820 - RNA, 23 nt, Human
uguacgguggucuugcugagggu

SEQ ID NO: 99821 - RNA, 22 nt, Human
uguccagaguuuaaggcgaaau

SEQ ID NO: 99822 - RNA, 19 nt, Human
ugucuucuuccccaccccc

SEQ ID NO: 99823 - RNA, 23 nt, Human
ugucuuuggaaccauacaaaucu

SEQ ID NO: 99824 - RNA, 22 nt, Human
uucccuucauugucaguucagc

SEQ ID NO: 99825 - RNA, 21 nt, Human
uucuccuucacuuaaauauuu

SEQ ID NO: 99826 - RNA, 22 nt, Human
uucuccuucacuuaaauauuuu

SEQ ID NO: 99827 - RNA, 19 nt, Human
uucuuuugccuucucaggg

SEQ ID NO: 99828 - RNA, 19 nt, Human
uucuuuugccuucucaggg

SEQ ID NO: 99829 - RNA, 19 nt, Human
uuucacaguauuuaccacu

SEQ ID NO: 99830 - RNA, 21 nt, Human
aaaacaaaacaacaaaacaaa

SEQ ID NO: 99831 - RNA, 22 nt, Human
aaaacaaaacacagcgugccuu

SEQ ID NO: 99832 - RNA, 20 nt, Human
aaacaaaacaacaaaacaaa

SEQ ID NO: 99833 - RNA, 24 nt, Human
aaacaaaacacagcgugccuuuga

SEQ ID NO: 99834 - RNA, 23 nt, Human
aaacaacaaaacaaagcaaguac

SEQ ID NO: 99835 - RNA, 18 nt, Human
aaaccagguaaucaaagg

SEQ ID NO: 99836 - RNA, 21 nt, Human
aacaaaacaaagcaaguacac

SEQ ID NO: 99837 - RNA, 22 nt, Human
aacaacaaaacaaagcaaguac

SEQ ID NO: 99838 - RNA, 23 nt, Human
aacacucuuccaccgugaugcca

SEQ ID NO: 99839 - RNA, 21 nt, Human
aacugcagcggcgagcggcga

SEQ ID NO: 99840 - RNA, 24 nt, Human
aacugcagcggcgagcggcgagcc

SEQ ID NO: 99841 - RNA, 20 nt, Human
aagguggagaucagaaagug

SEQ ID NO: 99842 - RNA, 21 nt, Human
agaagaagguggagaucagaa

SEQ ID NO: 99843 - RNA, 23 nt, Human
agaggcaauuuauuuucuaaggc

SEQ ID NO: 99844 - RNA, 20 nt, Human
agcaccgacggccgcagcag

SEQ ID NO: 99845 - RNA, 19 nt, Human
agcagcaccgacggccgca

SEQ ID NO: 99846 - RNA, 19 nt, Human
agcucaacugcagcggcga

SEQ ID NO: 99847 - RNA, 19 nt, Human
agcuuuaaaaaggcuggca

SEQ ID NO: 99848 - RNA, 19 nt, Human
aggcagcugcaggagcagc

SEQ ID NO: 99849 - RNA, 23 nt, Human
augauaagaguuucaauaggcac

SEQ ID NO: 99850 - RNA, 20 nt, Human
caaaacugacaauaugauua

SEQ ID NO: 99851 - RNA, 19 nt, Human
caaaucacugugccaacac

SEQ ID NO: 99852 - RNA, 23 nt, Human
caacaaaacaaagcaaguacaca

SEQ ID NO: 99853 - RNA, 26 nt, Human
caacugcagcggcgagcggcgagcca

SEQ ID NO: 99854 - RNA, 24 nt, Human
caaggugagaaauccgucaaauca

SEQ ID NO: 99855 - RNA, 23 nt, Human
cagaaaaggcagcugcaggagca

SEQ ID NO: 99856 - RNA, 19 nt, Human
cagaagacucauuaaacga

SEQ ID NO: 99857 - RNA, 19 nt, Human
cagaauaaaccaaaacuga

SEQ ID NO: 99858 - RNA, 19 nt, Human
cagaauaaaccaaaacuga

SEQ ID NO: 99859 - RNA, 23 nt, Human
cagcagaguaauaaaaacuccaa

SEQ ID NO: 99860 - RNA, 22 nt, Human
cagccaguagacaccacuuucu

SEQ ID NO: 99861 - RNA, 23 nt, Human
cagcuugucuauauuucccaaaa

SEQ ID NO: 99862 - RNA, 18 nt, Human
cauaaagacggugucugu

SEQ ID NO: 99863 - RNA, 25 nt, Human
cauauuuauuucaauuuucugaaag

SEQ ID NO: 99864 - RNA, 22 nt, Human
ccaaguagcugcauccugugcu

SEQ ID NO: 99865 - RNA, 20 nt, Human
cccuccugucaucuccccgc

SEQ ID NO: 99866 - RNA, 20 nt, Human
cccucucuguggcucccucc

SEQ ID NO: 99867 - RNA, 27 nt, Human
ccuggaccccucucuguggcucccucc

SEQ ID NO: 99868 - RNA, 25 nt, Human
ccuugcgcggaaggugagacccuuc

SEQ ID NO: 99869 - RNA, 22 nt, Human
cgcaauaccaucacagcagagu

SEQ ID NO: 99870 - RNA, 18 nt, Human
cucaaaacaaaacacagc

SEQ ID NO: 99871 - RNA, 28 nt, Human
cucaaaacaaaacacagcgugccuuuga

SEQ ID NO: 99872 - RNA, 20 nt, Human
cucagaaaagccuggacccc

SEQ ID NO: 99873 - RNA, 26 nt, Human
cucccuccacauuuacccuucagauc

SEQ ID NO: 99874 - RNA, 21 nt, Human
cuccucacuguaaguuagagg

SEQ ID NO: 99875 - RNA, 20 nt, Human
cuccuggguuccagcuuguc

SEQ ID NO: 99876 - RNA, 21 nt, Human
cucuucucagaaaagccugga

SEQ ID NO: 99877 - RNA, 21 nt, Human
cugauggcagaaaaggcagcu

SEQ ID NO: 99878 - RNA, 23 nt, Human
cuucucagaaaagccuggacccc

SEQ ID NO: 99879 - RNA, 23 nt, Human
cuuuccaaaucacugugccaaca

SEQ ID NO: 99880 - RNA, 25 nt, Human
gaaagagugugugugugugugugug

SEQ ID NO: 99881 - RNA, 19 nt, Human
gaagaggcugccucucuuc

SEQ ID NO: 99882 - RNA, 25 nt, Human
gaaggugagacccuucucuucuguu

SEQ ID NO: 99883 - RNA, 21 nt, Human
gcaauaccaucacagcagagu

SEQ ID NO: 99884 - RNA, 20 nt, Human
gcagaauaaaccaaaacuga

SEQ ID NO: 99885 - RNA, 19 nt, Human
gcagaguguacuguacacc

SEQ ID NO: 99886 - RNA, 20 nt, Human
ggggcccaggauucccuccu

SEQ ID NO: 99887 - RNA, 22 nt, Human
gugaaaaaacaaaacaacaaaa

SEQ ID NO: 99888 - RNA, 24 nt, Human
guggagaucagaaaguguucuucu

SEQ ID NO: 99889 - RNA, 19 nt, Human
gugugugugugugugugug

SEQ ID NO: 99890 - RNA, 23 nt, Human
guguguuuguguguguguguguu

SEQ ID NO: 99891 - RNA, 24 nt, Human
guuuaaaaaagaaaaagaaaaccc

SEQ ID NO: 99892 - RNA, 19 nt, Human
uaaaacucccaacugcucc

SEQ ID NO: 99893 - RNA, 23 nt, Human
uaacuuacuagaaaccagguaau

SEQ ID NO: 99894 - RNA, 25 nt, Human
uaaguuagaggcaauuuauuuucua

SEQ ID NO: 99895 - RNA, 23 nt, Human
uaauaaaaacuccaacacuuaac

SEQ ID NO: 99896 - RNA, 19 nt, Human
uacacauuauaggauguau

SEQ ID NO: 99897 - RNA, 21 nt, Human
uacaccacuuuaaaugauaag

SEQ ID NO: 99898 - RNA, 23 nt, Human
uacaguuuaaaaaagaaaaagaa

SEQ ID NO: 99899 - RNA, 20 nt, Human
uagaaaccagguaaucaaag

SEQ ID NO: 99900 - RNA, 20 nt, Human
ucaaccgugaaugggguggg

SEQ ID NO: 99901 - RNA, 18 nt, Human
ucaacugcagcggcgagc

SEQ ID NO: 99902 - RNA, 24 nt, Human
ucacugugccaacacacugcuuug

SEQ ID NO: 99903 - RNA, 19 nt, Human
ucagaaaagccuggacccc

SEQ ID NO: 99904 - RNA, 26 nt, Human
ucagaagacucauuaaacgagccuag

SEQ ID NO: 99905 - RNA, 18 nt, Human
ucagccuugcgcggaagg

SEQ ID NO: 99906 - RNA, 18 nt, Human
ucccaacugcuccugggu

SEQ ID NO: 99907 - RNA, 18 nt, Human
ucccuccugucaucuccc

SEQ ID NO: 99908 - RNA, 21 nt, Human
uccuuagcucucagaagacuc

SEQ ID NO: 99909 - RNA, 21 nt, Human
ucuccccgcccucaaaacaaa

SEQ ID NO: 99910 - RNA, 22 nt, Human
ucucugugaacaaggugagaaa

SEQ ID NO: 99911 - RNA, 26 nt, Human
ucucuuguuggcagaauaaaccaaaa

SEQ ID NO: 99912 - RNA, 19 nt, Human
ucuguggccuccaccgcuu

SEQ ID NO: 99913 - RNA, 25 nt, Human
ugaaaaaacaaaacaacaaaacaaa

SEQ ID NO: 99914 - RNA, 23 nt, Human
ugacacaucauugaguagugaaa

SEQ ID NO: 99915 - RNA, 24 nt, Human
ugaccuccacaguaacuugauucu

SEQ ID NO: 99916 - RNA, 24 nt, Human
ugaugaugcaggcauuaauccuuu

SEQ ID NO: 99917 - RNA, 20 nt, Human
ugauugugaaaaaacaaaac

SEQ ID NO: 99918 - RNA, 25 nt, Human
uggaauuaagaaaaaucuaacacuc

SEQ ID NO: 99919 - RNA, 25 nt, Human
uggaccccucucuguggcucccucc

SEQ ID NO: 99920 - RNA, 22 nt, Human
uggcagaauaaaccaaaacuga

SEQ ID NO: 99921 - RNA, 25 nt, Human
ugggggcccaggauucccuccuguc

SEQ ID NO: 99922 - RNA, 23 nt, Human
ugggguggggagaucgaaguuuu

SEQ ID NO: 99923 - RNA, 23 nt, Human
ugggguggggagaucgaaguuuu

SEQ ID NO: 99924 - RNA, 23 nt, Human
ugugaaaaaacaaaacaacaaaa

SEQ ID NO: 99925 - RNA, 24 nt, Human
ugugaacaaggugagaaauccguc

SEQ ID NO: 99926 - RNA, 18 nt, Human
ugugugugugugugugug

SEQ ID NO: 99927 - RNA, 18 nt, Human
ugugugugugugugugug

SEQ ID NO: 99928 - RNA, 19 nt, Human
ugugugugugugugugugu

SEQ ID NO: 99929 - RNA, 19 nt, Human
ugugugugugugugugugu

SEQ ID NO: 99930 - RNA, 22 nt, Human
ugugugugugugugugugugag

SEQ ID NO: 99931 - RNA, 25 nt, Human
uguguguguguguguguuugugugu

SEQ ID NO: 99932 - RNA, 23 nt, Human
uguguguguguguguuugugugu

SEQ ID NO: 99933 - RNA, 21 nt, Human
uguguguguguguuugugugu

SEQ ID NO: 99934 - RNA, 26 nt, Human
uguguguguguguuugugugugugug

SEQ ID NO: 99935 - RNA, 23 nt, Human
uguguguguguuugugugugugu

SEQ ID NO: 99936 - RNA, 26 nt, Human
uguguguguguuugugugugugugug

SEQ ID NO: 99937 - RNA, 21 nt, Human
uguguguguuugugugugugu

SEQ ID NO: 99938 - RNA, 21 nt, Human
uguguguguuugugugugugu

SEQ ID NO: 99939 - RNA, 21 nt, Human
uguguguguuugugugugugu

SEQ ID NO: 99940 - RNA, 23 nt, Human
uguguguguuugugugugugugu

SEQ ID NO: 99941 - RNA, 23 nt, Human
uguguguuugugugugugugugu

SEQ ID NO: 99942 - RNA, 23 nt, Human
uguguuugugugugugugugugu

SEQ ID NO: 99943 - RNA, 20 nt, Human
uguucuuuuuccccccuagc

SEQ ID NO: 99944 - RNA, 20 nt, Human
uguuugugugugugugugug

SEQ ID NO: 99945 - RNA, 25 nt, Human
uguuugugugugugugugugugugg

SEQ ID NO: 99946 - RNA, 18 nt, Human
uuaaaaaucuccccucuc

SEQ ID NO: 99947 - RNA, 21 nt, Human
uucauuguagaaugcuuugaa

SEQ ID NO: 99948 - RNA, 21 nt, Human
uuccuggaagaggcugccucu

SEQ ID NO: 99949 - RNA, 23 nt, Human
uuucccaaaagagccaagcuguu

SEQ ID NO: 99950 - RNA, 20 nt, Human
uuuuaaaaaucuccccucuc

SEQ ID NO: 99951 - RNA, 28 nt, Human
uuuuaaaaaucuccccucucgguuguau

SEQ ID NO: 99952 - RNA, 24 nt, Human
uuuucugaaaggauaggauaaaca

SEQ ID NO: 99953 - RNA, 23 nt, Human
aaacaacgguagucaauucacac

SEQ ID NO: 99954 - RNA, 22 nt, Human
aaaccggaacaauugaggccua

SEQ ID NO: 99955 - RNA, 20 nt, Human
aaagaaaauaaaaaaccgga

SEQ ID NO: 99956 - RNA, 27 nt, Human
aaauaugcuaagacacucaccuuaccc

SEQ ID NO: 99957 - RNA, 22 nt, Human
aacaaacagcgugaaugugcau

SEQ ID NO: 99958 - RNA, 19 nt, Human
aacccacagacaaagcugg

SEQ ID NO: 99959 - RNA, 22 nt, Human
acaccaauacuaacccacagac

SEQ ID NO: 99960 - RNA, 23 nt, Human
acagaaggcuaacugaaagcaca

SEQ ID NO: 99961 - RNA, 24 nt, Human
acagacaaagcugggugccuggag

SEQ ID NO: 99962 - RNA, 25 nt, Human
acagacaaagcugggugccuggagc

SEQ ID NO: 99963 - RNA, 20 nt, Human
acaguggagaaguagcuucg

SEQ ID NO: 99964 - RNA, 19 nt, Human
agacaacauaugacuucua

SEQ ID NO: 99965 - RNA, 19 nt, Human
agauacucauacauacacc

SEQ ID NO: 99966 - RNA, 22 nt, Human
auacauacaccaauacuaaccc

SEQ ID NO: 99967 - RNA, 29 nt, Human
auauauacauacagauacucauacauaca

SEQ ID NO: 99968 - RNA, 18 nt, Human
caagcacuaacuuuccgc

SEQ ID NO: 99969 - RNA, 19 nt, Human
cacagacaaagcugggugc

SEQ ID NO: 99970 - RNA, 25 nt, Human
caccagaaaaaguagucauuguucc

SEQ ID NO: 99971 - RNA, 21 nt, Human
cagaaggcuaacugaaagcac

SEQ ID NO: 99972 - RNA, 19 nt, Human
cauacagauacucauacau

SEQ ID NO: 99973 - RNA, 21 nt, Human
cauguuaacacaccagaaaaa

SEQ ID NO: 99974 - RNA, 20 nt, Human
cauuguuccugcucccagaa

SEQ ID NO: 99975 - RNA, 21 nt, Human
cauuuaugguuuaucaacaag

SEQ ID NO: 99976 - RNA, 22 nt, Human
ccaauacuaacccacagaccgg

SEQ ID NO: 99977 - RNA, 24 nt, Human
ccacaagcugucacuaguuuuauu

SEQ ID NO: 99978 - RNA, 21 nt, Human
ccacagacaaagcugggugcc

SEQ ID NO: 99979 - RNA, 21 nt, Human
ccaugaaagaaaaugucagcc

SEQ ID NO: 99980 - RNA, 24 nt, Human
ccucaccuccuuggcucaggauca

SEQ ID NO: 99981 - RNA, 21 nt, Human
ccugcucugcuccucaccucc

SEQ ID NO: 99982 - RNA, 20 nt, Human
cucacagaauacaaaucagu

SEQ ID NO: 99983 - RNA, 18 nt, Human
gacuguggauucgggaca

SEQ ID NO: 99984 - RNA, 23 nt, Human
gcaguguaaauugguuguagucc

SEQ ID NO: 99985 - RNA, 18 nt, Human
gcccuggaggguucaggu

SEQ ID NO: 99986 - RNA, 24 nt, Human
ggagcaaaagugacagcucugugg

SEQ ID NO: 99987 - RNA, 26 nt, Human
gggacaguggagaaguagcuucggag

SEQ ID NO: 99988 - RNA, 21 nt, Human
gguaccuguacaccucuuugu

SEQ ID NO: 99989 - RNA, 24 nt, Human
guacauguggguauauauguguau

SEQ ID NO: 99990 - RNA, 23 nt, Human
guggaccugccuggcugguugug

SEQ ID NO: 99991 - RNA, 20 nt, Human
uaacugaaagcacaagugca

SEQ ID NO: 99992 - RNA, 23 nt, Human
uauaaauaccguguauauauaca

SEQ ID NO: 99993 - RNA, 19 nt, Human
uauauacauacagauacuc

SEQ ID NO: 99994 - RNA, 19 nt, Human
uauauauacauacagauac

SEQ ID NO: 99995 - RNA, 19 nt, Human
uauguguauacaagauggu

SEQ ID NO: 99996 - RNA, 24 nt, Human
uauguuccaaaaggauuuaccauu

SEQ ID NO: 99997 - RNA, 18 nt, Human
ucaaaaugaugaaguaca

SEQ ID NO: 99998 - RNA, 18 nt, Human
ucaacaagaagguaaucu

SEQ ID NO: 99999 - RNA, 18 nt, Human
ucauuguuccugcuccca

SEQ ID NO: 100000 - RNA, 22 nt, Human
uccaaaaggauuuaccauugaa

SEQ ID NO: 100001 - RNA, 22 nt, Human
ucuguacauguggguauauaug

SEQ ID NO: 100002 - RNA, 20 nt, Human
ucuuuguaugcauguaugac

SEQ ID NO: 100003 - RNA, 22 nt, Human
ugaaacaaacagcgugaaugug

SEQ ID NO: 100004 - RNA, 19 nt, Human
ugaaagcacaagugcaaac

SEQ ID NO: 100005 - RNA, 20 nt, Human
ugaaagcacaagugcaaaca

SEQ ID NO: 100006 - RNA, 21 nt, Human
ugaacgggacaguggagaagu

SEQ ID NO: 100007 - RNA, 19 nt, Human
ugaggagggagagauucuc

SEQ ID NO: 100008 - RNA, 22 nt, Human
ugcauaagaaagcgugugugug

SEQ ID NO: 100009 - RNA, 18 nt, Human
ugccugcucugcuccuca

SEQ ID NO: 100010 - RNA, 19 nt, Human
ugcugaccuugaugcggga

SEQ ID NO: 100011 - RNA, 18 nt, Human
uggaaaaaaaaaucucug

SEQ ID NO: 100012 - RNA, 21 nt, Human
uggcauuugguggugaaauug

SEQ ID NO: 100013 - RNA, 22 nt, Human
uggcgagcucuaauaaaaagcc

SEQ ID NO: 100014 - RNA, 24 nt, Human
uggugugagcuuugaugauucauu

SEQ ID NO: 100015 - RNA, 20 nt, Human
ugguuguggcagcauucaga

SEQ ID NO: 100016 - RNA, 24 nt, Human
uguaaagaaaauaaaaaaccggaa

SEQ ID NO: 100017 - RNA, 22 nt, Human
uguacaccucuuuguaugcaug

SEQ ID NO: 100018 - RNA, 21 nt, Human
uguauauauacauacagauac

SEQ ID NO: 100019 - RNA, 31 nt, Human
uguauauauacauacagauacucauacauag

SEQ ID NO: 100020 - RNA, 26 nt, Human
ugucaaaaugaugaaguacagacuaa

SEQ ID NO: 100021 - RNA, 20 nt, Human
ugucuuaguuuccacccacc

SEQ ID NO: 100022 - RNA, 19 nt, Human
ugugaaguucgauagcugu

SEQ ID NO: 100023 - RNA, 24 nt, Human
ugugcaugugcgguuaaaaccuuu

SEQ ID NO: 100024 - RNA, 18 nt, Human
uguggguauauaugugua

SEQ ID NO: 100025 - RNA, 20 nt, Human
uguggguauauauguguaua

SEQ ID NO: 100026 - RNA, 22 nt, Human
uuaaaggagggaggaagaugcu

SEQ ID NO: 100027 - RNA, 19 nt, Human
uuaacacaccagaaaaagu

SEQ ID NO: 100028 - RNA, 22 nt, Human
uucagggaaaauucagaagauu

SEQ ID NO: 100029 - RNA, 27 nt, Human
uuccacccaccuugcuuaaccuugcaa

SEQ ID NO: 100030 - RNA, 18 nt, Human
uucuacuuccuacagaag

SEQ ID NO: 100031 - RNA, 18 nt, Human
uugaugcgggaggcccug

SEQ ID NO: 100032 - RNA, 23 nt, Human
uuguuccugcucccagaagauca

SEQ ID NO: 100033 - RNA, 20 nt, Human
uuucuuggcauuugguggug

SEQ ID NO: 100034 - RNA, 23 nt, Human
uuuuaugccuguauauaugaaac

SEQ ID NO: 100035 - RNA, 22 nt, Human
uuuucggguuugcaaacaacgg

SEQ ID NO: 100036 - RNA, 19 nt, Human
agagaaacucuucccaccc

SEQ ID NO: 100037 - RNA, 24 nt, Human
aggaaggaggcugccccaggccca

SEQ ID NO: 100038 - RNA, 20 nt, Human
aggagguugcugucuuucau

SEQ ID NO: 100039 - RNA, 21 nt, Human
aggcccaggggggucgggccc

SEQ ID NO: 100040 - RNA, 18 nt, Human
aggcugccucugcagggg

SEQ ID NO: 100041 - RNA, 20 nt, Human
auggagagaaacucuuccca

SEQ ID NO: 100042 - RNA, 26 nt, Human
cacugguaggaggcaaaggugggaaa

SEQ ID NO: 100043 - RNA, 22 nt, Human
caggcccaggggggucgggccc

SEQ ID NO: 100044 - RNA, 21 nt, Human
ccacacucagguucugccccc

SEQ ID NO: 100045 - RNA, 24 nt, Human
ccccaggcccaggggggucgggcc

SEQ ID NO: 100046 - RNA, 25 nt, Human
ccccaggcccaggggggucgggccc

SEQ ID NO: 100047 - RNA, 21 nt, Human
cccgcgacccgaagaagcgcg

SEQ ID NO: 100048 - RNA, 20 nt, Human
ccggagugcacccgcgaccc

SEQ ID NO: 100049 - RNA, 22 nt, Human
ccggcaggaaggggccucuucc

SEQ ID NO: 100050 - RNA, 25 nt, Human
cgccccauccacacucagguucugc

SEQ ID NO: 100051 - RNA, 22 nt, Human
cugcaggggccaucacugccac

SEQ ID NO: 100052 - RNA, 20 nt, Human
gaaacucuucccaccccggc

SEQ ID NO: 100053 - RNA, 22 nt, Human
gaaacucuucccaccccggcag

SEQ ID NO: 100054 - RNA, 21 nt, Human
gcaaaggugggacuagggagg

SEQ ID NO: 100055 - RNA, 18 nt, Human
gcccaggggggucgggcc

SEQ ID NO: 100056 - RNA, 22 nt, Human
gccccauccacacucagguucu

SEQ ID NO: 100057 - RNA, 20 nt, Human
ggcccggugaccucaggcug

SEQ ID NO: 100058 - RNA, 21 nt, Human
ggccgaggcgggagccgggcc

SEQ ID NO: 100059 - RNA, 19 nt, Human
gggaggugacccgcauggg

SEQ ID NO: 100060 - RNA, 21 nt, Human
gggccgaggcgggagccgggc

SEQ ID NO: 100061 - RNA, 20 nt, Human
uacaaagaugagguucacug

SEQ ID NO: 100062 - RNA, 23 nt, Human
uacaggaaggaggcugccccagg

SEQ ID NO: 100063 - RNA, 18 nt, Human
uagcacguuuuucauuca

SEQ ID NO: 100064 - RNA, 21 nt, Human
uaggaggcaaaggugggacua

SEQ ID NO: 100065 - RNA, 22 nt, Human
ugcacccgcgacccgaagaagc

SEQ ID NO: 100066 - RNA, 19 nt, Human
uucagauuuacccaggagg

SEQ ID NO: 100067 - RNA, 27 nt, Human
uuuuucauucagauuuacccaggaggu

SEQ ID NO: 100068 - RNA, 18 nt, Human
uuuuuuuuuuuuuuuuug

SEQ ID NO: 100069 - RNA, 21 nt, Human
uuuuuuuuuuuuuuuuugcau

SEQ ID NO: 100070 - RNA, 23 nt, Human
uuuuuuuuuuuuuuuuugcauga

SEQ ID NO: 100071 - RNA, 22 nt, Human
aagcucccagcuagagcugccu

SEQ ID NO: 100072 - RNA, 24 nt, Human
acucccaugggcaguccauaaagu

SEQ ID NO: 100073 - RNA, 20 nt, Human
acucuguccuguccccugcu

SEQ ID NO: 100074 - RNA, 21 nt, Human
acucuguccuguccccugcug

SEQ ID NO: 100075 - RNA, 21 nt, Human
agccagaggccaagcucccag

SEQ ID NO: 100076 - RNA, 24 nt, Human
aggggacucagauggagccagagg

SEQ ID NO: 100077 - RNA, 24 nt, Human
auggagccagaggccaagcuccca

SEQ ID NO: 100078 - RNA, 23 nt, Human
caagcucccagcuagagcugccu

SEQ ID NO: 100079 - RNA, 23 nt, Human
cagauggagccagaggccaagcu

SEQ ID NO: 100080 - RNA, 21 nt, Human
cagcgcccaagacuggcuccc

SEQ ID NO: 100081 - RNA, 18 nt, Human
ccauagggcccagcccag

SEQ ID NO: 100082 - RNA, 21 nt, Human
ccauagggcccagcccaguuc

SEQ ID NO: 100083 - RNA, 24 nt, Human
ccuggugauggugauggugccucc

SEQ ID NO: 100084 - RNA, 23 nt, Human
ccuguccccugcuggaucuuggg

SEQ ID NO: 100085 - RNA, 26 nt, Human
cuggugauggugauggugccuccacc

SEQ ID NO: 100086 - RNA, 19 nt, Human
ggugauggugauggugccu

SEQ ID NO: 100087 - RNA, 23 nt, Human
ggugauggugauggugccuccac

SEQ ID NO: 100088 - RNA, 23 nt, Human
ggugcugggcucucucccagggg

SEQ ID NO: 100089 - RNA, 21 nt, Human
gugauggugauggugccucca

SEQ ID NO: 100090 - RNA, 21 nt, Human
uacucuguccuguccccugcu

SEQ ID NO: 100091 - RNA, 21 nt, Human
uagggcccagcccaguucucu

SEQ ID NO: 100092 - RNA, 21 nt, Human
uccagcugccaagcaagaaga

SEQ ID NO: 100093 - RNA, 19 nt, Human
ugccuggugauggugaugg

SEQ ID NO: 100094 - RNA, 21 nt, Human
ugcugggcucucucccagggg

SEQ ID NO: 100095 - RNA, 23 nt, Human
uggugauggugauggugccucca

SEQ ID NO: 100096 - RNA, 30 nt, Human
uucucuggggcuuuauuauugggcaaacaa

SEQ ID NO: 100097 - RNA, 19 nt, Human
uugguguccaggcucugca

SEQ ID NO: 100098 - RNA, 24 nt, Human
aaaaaagaaauauuuagcaaauau

SEQ ID NO: 100099 - RNA, 18 nt, Human
aaaauuagcugggcaugg

SEQ ID NO: 100100 - RNA, 18 nt, Human
aaagagcaacaugucaca

SEQ ID NO: 100101 - RNA, 22 nt, Human
aaauggcgaaaccccgucucua

SEQ ID NO: 100102 - RNA, 20 nt, Human
acaccacuguacuccagccu

SEQ ID NO: 100103 - RNA, 22 nt, Human
acaccacuguacuccagccugg

SEQ ID NO: 100104 - RNA, 24 nt, Human
acaccacuguacuccagccugggc

SEQ ID NO: 100105 - RNA, 24 nt, Human
acagagcaagacuccaccucaaaa

SEQ ID NO: 100106 - RNA, 20 nt, Human
acaugcgcagcauguaugca

SEQ ID NO: 100107 - RNA, 22 nt, Human
accacuguacuccagccugggc

SEQ ID NO: 100108 - RNA, 24 nt, Human
accacuguacuccagccugggcga

SEQ ID NO: 100109 - RNA, 24 nt, Human
acccaggaggcggagguugcagug

SEQ ID NO: 100110 - RNA, 24 nt, Human
accccgucucuauuaaaaauacaa

SEQ ID NO: 100111 - RNA, 24 nt, Human
acuguacuccagccugggcgacag

SEQ ID NO: 100112 - RNA, 26 nt, Human
acuguacuccagccugggcgacagag

SEQ ID NO: 100113 - RNA, 21 nt, Human
agacaacacugauauaucucc

SEQ ID NO: 100114 - RNA, 24 nt, Human
agccugggcgacagagcaagacuc

SEQ ID NO: 100115 - RNA, 23 nt, Human
agcugggcaugguggugggugcc

SEQ ID NO: 100116 - RNA, 26 nt, Human
aggcagaucacuugacgucaggaguu

SEQ ID NO: 100117 - RNA, 18 nt, Human
aggcaggagaaucaugug

SEQ ID NO: 100118 - RNA, 24 nt, Human
aggcaggagaaucaugugaaccca

SEQ ID NO: 100119 - RNA, 26 nt, Human
aggcaggcagaucacuugacgucagg

SEQ ID NO: 100120 - RNA, 20 nt, Human
aggcggagguugcagugagc

SEQ ID NO: 100121 - RNA, 24 nt, Human
aggcggagguugcagugagcuggg

SEQ ID NO: 100122 - RNA, 22 nt, Human
aguaggugggugcagugguuca

SEQ ID NO: 100123 - RNA, 21 nt, Human
agugguucaugccuguauugg

SEQ ID NO: 100124 - RNA, 24 nt, Human
aucacaccacuguacuccagccug

SEQ ID NO: 100125 - RNA, 21 nt, Human
caaacaaaacugacuacaacc

SEQ ID NO: 100126 - RNA, 21 nt, Human
caagacuccaccucaaaaaag

SEQ ID NO: 100127 - RNA, 26 nt, Human
caaggcaggcagaucacuugacguca

SEQ ID NO: 100128 - RNA, 21 nt, Human
cacaccacuguacuccagccu

SEQ ID NO: 100129 - RNA, 30 nt, Human
cacaccacuguacuccagccugggcgacaa

SEQ ID NO: 100130 - RNA, 19 nt, Human
cacuguacuccagccuggg

SEQ ID NO: 100131 - RNA, 20 nt, Human
cacuguacuccagccugggc

SEQ ID NO: 100132 - RNA, 21 nt, Human
cacuguacuccagccugggcg

SEQ ID NO: 100133 - RNA, 22 nt, Human
cacuguacuccagccugggcga

SEQ ID NO: 100134 - RNA, 23 nt, Human
cacuguacuccagccugggcgac

SEQ ID NO: 100135 - RNA, 24 nt, Human
cacuguacuccagccugggcgaca

SEQ ID NO: 100136 - RNA, 24 nt, Human
cagaaaaaacauaaauggaaucca

SEQ ID NO: 100137 - RNA, 26 nt, Human
cagaaaaaacauaaauggaauccagg

SEQ ID NO: 100138 - RNA, 24 nt, Human
cagaucacuugacgucaggaguuc

SEQ ID NO: 100139 - RNA, 21 nt, Human
caggauggaaucagaaaaaac

SEQ ID NO: 100140 - RNA, 24 nt, Human
caggcagaucacuugacgucagga

SEQ ID NO: 100141 - RNA, 21 nt, Human
caugcgcagcauguaugcaug

SEQ ID NO: 100142 - RNA, 21 nt, Human
cauuucuguuaauacuaaggg

SEQ ID NO: 100143 - RNA, 18 nt, Human
ccaaagagcaacauguca

SEQ ID NO: 100144 - RNA, 20 nt, Human
ccacuguacuccagccuggg

SEQ ID NO: 100145 - RNA, 20 nt, Human
ccacuguacuccagccuggg

SEQ ID NO: 100146 - RNA, 21 nt, Human
ccacuguacuccagccugggc

SEQ ID NO: 100147 - RNA, 21 nt, Human
ccacuguacuccagccugggc

SEQ ID NO: 100148 - RNA, 23 nt, Human
ccacuguacuccagccugggcga

SEQ ID NO: 100149 - RNA, 24 nt, Human
ccacuguacuccagccugggcgac

SEQ ID NO: 100150 - RNA, 20 nt, Human
ccccaaaagggaaaaacaca

SEQ ID NO: 100151 - RNA, 26 nt, Human
ccucaaaaaagaaauauuuagcaaau

SEQ ID NO: 100152 - RNA, 22 nt, Human
ccuggccaaauggcgaaacccc

SEQ ID NO: 100153 - RNA, 23 nt, Human
ccuggccaaauggcgaaaccccg

SEQ ID NO: 100154 - RNA, 22 nt, Human
ccugggcgacagagcaagacuc

SEQ ID NO: 100155 - RNA, 25 nt, Human
cuacaaccaguguuuauucuugauu

SEQ ID NO: 100156 - RNA, 23 nt, Human
cuugacgucaggaguucaagacc

SEQ ID NO: 100157 - RNA, 18 nt, Human
gacuggaguaucuccccc

SEQ ID NO: 100158 - RNA, 23 nt, Human
gagaaucaugugaacccaggagg

SEQ ID NO: 100159 - RNA, 21 nt, Human
gaggcggagguugcagugagc

SEQ ID NO: 100160 - RNA, 22 nt, Human
gagguugcagugagcugggauc

SEQ ID NO: 100161 - RNA, 18 nt, Human
gaucacuugacgucagga

SEQ ID NO: 100162 - RNA, 24 nt, Human
gaucacuugacgucaggaguucaa

SEQ ID NO: 100163 - RNA, 22 nt, Human
gcaggagaaucaugugaaccca

SEQ ID NO: 100164 - RNA, 24 nt, Human
gccuggccaaauggcgaaaccccg

SEQ ID NO: 100165 - RNA, 18 nt, Human
ggagguugcagugagcug

SEQ ID NO: 100166 - RNA, 22 nt, Human
ggagguugcagugagcugggau

SEQ ID NO: 100167 - RNA, 23 nt, Human
ggagguugcagugagcugggauc

SEQ ID NO: 100168 - RNA, 24 nt, Human
ggagguugcagugagcugggauca

SEQ ID NO: 100169 - RNA, 20 nt, Human
ggaugagaugguuguugcug

SEQ ID NO: 100170 - RNA, 22 nt, Human
ggaugagaugguuguugcugga

SEQ ID NO: 100171 - RNA, 23 nt, Human
ggcaugguggugggugccuguaa

SEQ ID NO: 100172 - RNA, 19 nt, Human
ggccaaauggcgaaacccc

SEQ ID NO: 100173 - RNA, 23 nt, Human
ggccagcugacugguuccuuuac

SEQ ID NO: 100174 - RNA, 23 nt, Human
gggaucacaccacuguacuccag

SEQ ID NO: 100175 - RNA, 24 nt, Human
guacuccagccugggcgacagagc

SEQ ID NO: 100176 - RNA, 25 nt, Human
uaaacccagcuacuuaggaagcuga

SEQ ID NO: 100177 - RNA, 25 nt, Human
uaagucacaaaauggugguuaaaag

SEQ ID NO: 100178 - RNA, 26 nt, Human
uaauaaccaaaacuuuacuaacauac

SEQ ID NO: 100179 - RNA, 22 nt, Human
uacuccagccugggcgacagag

SEQ ID NO: 100180 - RNA, 20 nt, Human
uaggaagcugaggcaggaga

SEQ ID NO: 100181 - RNA, 24 nt, Human
uaggaagcugaggcaggagaauca

SEQ ID NO: 100182 - RNA, 23 nt, Human
ucacaccacuguacuccagccug

SEQ ID NO: 100183 - RNA, 23 nt, Human
ucacuugacgucaggaguucaag

SEQ ID NO: 100184 - RNA, 18 nt, Human
ucagugaaauaccaaagg

SEQ ID NO: 100185 - RNA, 27 nt, Human
uccaaguugaagaauuucagccaaaga

SEQ ID NO: 100186 - RNA, 24 nt, Human
uccagccugggcgacagagcaaga

SEQ ID NO: 100187 - RNA, 19 nt, Human
ucuaaguaggugggugcag

SEQ ID NO: 100188 - RNA, 21 nt, Human
ucucuauuaaaaauacaaaaa

SEQ ID NO: 100189 - RNA, 18 nt, Human
ugaaauaccaaaggaguc

SEQ ID NO: 100190 - RNA, 23 nt, Human
ugaaauaccaaaggagucaagga

SEQ ID NO: 100191 - RNA, 23 nt, Human
ugaacccaggaggcggagguugc

SEQ ID NO: 100192 - RNA, 18 nt, Human
ugaggcaggagaaucaug

SEQ ID NO: 100193 - RNA, 22 nt, Human
ugaggcaggagaaucaugugaa

SEQ ID NO: 100194 - RNA, 24 nt, Human
ugaggcaggagaaucaugugaacc

SEQ ID NO: 100195 - RNA, 25 nt, Human
ugaggcaggagaaucaugugaaccc

SEQ ID NO: 100196 - RNA, 24 nt, Human
ugccuguaaacccagcuacuuagg

SEQ ID NO: 100197 - RNA, 18 nt, Human
uggaaucagaaaaaacau

SEQ ID NO: 100198 - RNA, 24 nt, Human
ugggagaccaaggcaggcagauca

SEQ ID NO: 100199 - RNA, 20 nt, Human
uggugggugccuguaaaccc

SEQ ID NO: 100200 - RNA, 24 nt, Human
ugguggugggugccuguaaaccca

SEQ ID NO: 100201 - RNA, 19 nt, Human
uguaagucacaaaauggug

SEQ ID NO: 100202 - RNA, 24 nt, Human
ugucauggaaaaaugaaaaaucuc

SEQ ID NO: 100203 - RNA, 27 nt, Human
uuaaaaguccuuuucuucccucucgug

SEQ ID NO: 100204 - RNA, 24 nt, Human
uuagcugggcaugguggugggugc

SEQ ID NO: 100205 - RNA, 22 nt, Human
uucaaauuccuuucuguaaguc

SEQ ID NO: 100206 - RNA, 19 nt, Human
uugcagugagcugggauca

SEQ ID NO: 100207 - RNA, 20 nt, Human
uugcagugagcugggaucac

SEQ ID NO: 100208 - RNA, 23 nt, Human
uugcagugagcugggaucacacc

SEQ ID NO: 100209 - RNA, 22 nt, Human
aaccuuuucucucaaucuccac

SEQ ID NO: 100210 - RNA, 22 nt, Human
aagcaaauuccacaagguugca

SEQ ID NO: 100211 - RNA, 22 nt, Human
agacaccaucaucucuccccag

SEQ ID NO: 100212 - RNA, 19 nt, Human
aucaucucuccccagaauu

SEQ ID NO: 100213 - RNA, 22 nt, Human
auccacuuacucaggaagcaaa

SEQ ID NO: 100214 - RNA, 20 nt, Human
cucuccccagaauucuuggg

SEQ ID NO: 100215 - RNA, 18 nt, Human
cuggcucccuguuucugu

SEQ ID NO: 100216 - RNA, 18 nt, Human
cuuggaaaaucaaagccg

SEQ ID NO: 100217 - RNA, 22 nt, Human
gagaagccagagcaucuuuagg

SEQ ID NO: 100218 - RNA, 19 nt, Human
gaucuguaacuggcucccu

SEQ ID NO: 100219 - RNA, 19 nt, Human
guccaugauuuaacugucc

SEQ ID NO: 100220 - RNA, 24 nt, Human
guuuccacacuucuuccuugucau

SEQ ID NO: 100221 - RNA, 20 nt, Human
uacauucugaaccacuugga

SEQ ID NO: 100222 - RNA, 18 nt, Human
ucacucugcugcagacac

SEQ ID NO: 100223 - RNA, 21 nt, Human
ucagcuacaaaagcuuaguga

SEQ ID NO: 100224 - RNA, 25 nt, Human
ucauugcugagguuguauauccacu

SEQ ID NO: 100225 - RNA, 18 nt, Human
uccagcuuccucaguucc

SEQ ID NO: 100226 - RNA, 25 nt, Human
ucuccacugcugucacucugcugca

SEQ ID NO: 100227 - RNA, 25 nt, Human
ucuccacugcugucacucugcugca

SEQ ID NO: 100228 - RNA, 20 nt, Human
ucuugcuccucuucagucua

SEQ ID NO: 100229 - RNA, 20 nt, Human
ugaaccacuuggaaaaucaa

SEQ ID NO: 100230 - RNA, 23 nt, Human
ugagcauucaagagagaagccag

SEQ ID NO: 100231 - RNA, 18 nt, Human
uggaaaaucaaagccgua

SEQ ID NO: 100232 - RNA, 22 nt, Human
uguaagauaacuuuccaguuca

SEQ ID NO: 100233 - RNA, 23 nt, Human
uuagugagcauucaagagagaag

SEQ ID NO: 100234 - RNA, 20 nt, Human
uuccucaguuccaaguacug

SEQ ID NO: 100235 - RNA, 21 nt, Human
uucgaucaugaaaagggcacu

SEQ ID NO: 100236 - RNA, 20 nt, Human
aauuucucugacuauacauu

SEQ ID NO: 100237 - RNA, 22 nt, Human
acauugaaaaauaguagaggaa

SEQ ID NO: 100238 - RNA, 20 nt, Human
acauuucuccccacaucucu

SEQ ID NO: 100239 - RNA, 27 nt, Human
accuagcauucuuuuuuuuuuuuuuuu

SEQ ID NO: 100240 - RNA, 18 nt, Human
agaaaacuccauagacua

SEQ ID NO: 100241 - RNA, 20 nt, Human
agcauguagguagcuuaaaa

SEQ ID NO: 100242 - RNA, 19 nt, Human
aggacgucacuaacaaaaa

SEQ ID NO: 100243 - RNA, 18 nt, Human
aggcuuuuauucauacaa

SEQ ID NO: 100244 - RNA, 20 nt, Human
aucauacuuucuaguuuucu

SEQ ID NO: 100245 - RNA, 21 nt, Human
cacaaaacucuuuaagacuac

SEQ ID NO: 100246 - RNA, 20 nt, Human
ccagggaaaucagaaaacuc

SEQ ID NO: 100247 - RNA, 23 nt, Human
ccauggaguauuuacuccaggga

SEQ ID NO: 100248 - RNA, 26 nt, Human
ccuucuauauaccuuuguaacuucaa

SEQ ID NO: 100249 - RNA, 23 nt, Human
cucaucuacuuuuaauaucuucc

SEQ ID NO: 100250 - RNA, 24 nt, Human
cuuuuuuuuuuuuuuuuuuuuuaa

SEQ ID NO: 100251 - RNA, 23 nt, Human
ggaauauuuuagucauaugccag

SEQ ID NO: 100252 - RNA, 19 nt, Human
gucacuaacaaaaaucuug

SEQ ID NO: 100253 - RNA, 24 nt, Human
uacaaaaguucugugauccccaga

SEQ ID NO: 100254 - RNA, 24 nt, Human
uagcauucuuuuuuuuuuuuuuuu

SEQ ID NO: 100255 - RNA, 20 nt, Human
uauaccuuuguaacuucaac

SEQ ID NO: 100256 - RNA, 21 nt, Human
uccagggaaaucagaaaacuc

SEQ ID NO: 100257 - RNA, 23 nt, Human
uccccagaaagccuuauuuacau

SEQ ID NO: 100258 - RNA, 25 nt, Human
uccccgccauagagccagggcacaa

SEQ ID NO: 100259 - RNA, 18 nt, Human
ucgcauaaggaucgacua

SEQ ID NO: 100260 - RNA, 24 nt, Human
ucuucagaggaaacaggacgucac

SEQ ID NO: 100261 - RNA, 27 nt, Human
ugacauugaaaaauaguagaggaauau

SEQ ID NO: 100262 - RNA, 22 nt, Human
ugacuauacauuuucaauuuuc

SEQ ID NO: 100263 - RNA, 21 nt, Human
ugauuguuuacauuucucccc

SEQ ID NO: 100264 - RNA, 21 nt, Human
uucaaaucugguuguauugau

SEQ ID NO: 100265 - RNA, 24 nt, Human
uucauggaauaauucaugaaaauu

SEQ ID NO: 100266 - RNA, 23 nt, Human
uuuacauuucuccccacaucucu

SEQ ID NO: 100267 - RNA, 26 nt, Human
uuucugauucuguguaccuucuauau

SEQ ID NO: 100268 - RNA, 21 nt, Human
uuugguauuuuuacucuuucc

SEQ ID NO: 100269 - RNA, 22 nt, Human
aaaaaaaaaaaacaaacuaaag

SEQ ID NO: 100270 - RNA, 23 nt, Human
aaaaaaacaaacuaaagucuaaa

SEQ ID NO: 100271 - RNA, 22 nt, Human
aaaaaaccugaauccauagucc

SEQ ID NO: 100272 - RNA, 25 nt, Human
aaaaaaccugaauccauaguccaaa

SEQ ID NO: 100273 - RNA, 26 nt, Human
aaacuaaagucuaaaacuagaaguaa

SEQ ID NO: 100274 - RNA, 25 nt, Human
aaagccuuaaacagaaaacuaauuc

SEQ ID NO: 100275 - RNA, 24 nt, Human
aaccugaauccauaguccaaauaa

SEQ ID NO: 100276 - RNA, 20 nt, Human
aacuuacugcucccaccacu

SEQ ID NO: 100277 - RNA, 22 nt, Human
acaaaaaggcacauaaaauccc

SEQ ID NO: 100278 - RNA, 18 nt, Human
acaauacagaggcaaagc

SEQ ID NO: 100279 - RNA, 25 nt, Human
acaauacagaggcaaagcuguuguc

SEQ ID NO: 100280 - RNA, 23 nt, Human
acccccuucccuuccccuccccu

SEQ ID NO: 100281 - RNA, 20 nt, Human
accccuuucuuuccuuuccu

SEQ ID NO: 100282 - RNA, 24 nt, Human
acuacagcucaacaauugaaucuu

SEQ ID NO: 100283 - RNA, 23 nt, Human
agaagucucuccaguuuaaaagc

SEQ ID NO: 100284 - RNA, 21 nt, Human
agcggcgcggagaaacggcuc

SEQ ID NO: 100285 - RNA, 24 nt, Human
aggaggcggcggcggcggcggcgg

SEQ ID NO: 100286 - RNA, 24 nt, Human
aggcggcggcggcggcggcggcgg

SEQ ID NO: 100287 - RNA, 19 nt, Human
aucugaaaaagguacaaaa

SEQ ID NO: 100288 - RNA, 28 nt, Human
auguaacaaaagcguguugaagcauauc

SEQ ID NO: 100289 - RNA, 18 nt, Human
auuguuuguacuugucca

SEQ ID NO: 100290 - RNA, 19 nt, Human
caaaugcaauguaacaaaa

SEQ ID NO: 100291 - RNA, 19 nt, Human
cacaauacagaggcaaagc

SEQ ID NO: 100292 - RNA, 19 nt, Human
cacauaaaaucccagugcu

SEQ ID NO: 100293 - RNA, 18 nt, Human
cacccccuucccuucccc

SEQ ID NO: 100294 - RNA, 24 nt, Human
cacugugcuaguagacuacaaagu

SEQ ID NO: 100295 - RNA, 18 nt, Human
cagcggcagcaccaacag

SEQ ID NO: 100296 - RNA, 24 nt, Human
caguuuaaaagcuuuuuuuuuucc

SEQ ID NO: 100297 - RNA, 19 nt, Human
cauuauguacacauacuau

SEQ ID NO: 100298 - RNA, 18 nt, Human
cauuugugcuaagaacuu

SEQ ID NO: 100299 - RNA, 18 nt, Human
cccaaaccaaaaagaaaa

SEQ ID NO: 100300 - RNA, 25 nt, Human
cccaaaccaaaaagaaaauaaaaaa

SEQ ID NO: 100301 - RNA, 18 nt, Human
ccccuccccacccccuuc

SEQ ID NO: 100302 - RNA, 19 nt, Human
ccccuccccuccccacccc

SEQ ID NO: 100303 - RNA, 20 nt, Human
cccuccccacccccuucuuc

SEQ ID NO: 100304 - RNA, 18 nt, Human
cccuuccccuccccuccc

SEQ ID NO: 100305 - RNA, 18 nt, Human
ccuccagcaagcacugug

SEQ ID NO: 100306 - RNA, 21 nt, Human
ccuuccccuccccuccccacc

SEQ ID NO: 100307 - RNA, 19 nt, Human
cgaaagauauaaacaugca

SEQ ID NO: 100308 - RNA, 24 nt, Human
cgaaagauauaaacaugcaaaaaa

SEQ ID NO: 100309 - RNA, 25 nt, Human
cggcagcaccaacagcggcgcggag

SEQ ID NO: 100310 - RNA, 19 nt, Human
cggcgcggagaaacggcuc

SEQ ID NO: 100311 - RNA, 23 nt, Human
cggcggcggcggcggcggcggag

SEQ ID NO: 100312 - RNA, 24 nt, Human
cggcuccaggcaguuuccaccccc

SEQ ID NO: 100313 - RNA, 25 nt, Human
cuccaggcaguuuccacccccuucc

SEQ ID NO: 100314 - RNA, 18 nt, Human
cugcucuccgcuccccgc

SEQ ID NO: 100315 - RNA, 19 nt, Human
cugguacacaauacagagg

SEQ ID NO: 100316 - RNA, 21 nt, Human
cugguacacaauacagaggca

SEQ ID NO: 100317 - RNA, 18 nt, Human
cuuaucguuucagaaauc

SEQ ID NO: 100318 - RNA, 23 nt, Human
cuucccuuccccuccccucccca

SEQ ID NO: 100319 - RNA, 21 nt, Human
cuucgcugcucuccgcucccc

SEQ ID NO: 100320 - RNA, 20 nt, Human
cuucuccauagacuaugcca

SEQ ID NO: 100321 - RNA, 23 nt, Human
gaaaaaaaaaaaacaaacuaaag

SEQ ID NO: 100322 - RNA, 21 nt, Human
gcggcggcggcggcggaggag

SEQ ID NO: 100323 - RNA, 20 nt, Human
gcggcggcggcggcggcggc

SEQ ID NO: 100324 - RNA, 20 nt, Human
gcggcggcggcggcggcggc

SEQ ID NO: 100325 - RNA, 24 nt, Human
gcggcggcggcggcggcggcggcg

SEQ ID NO: 100326 - RNA, 30 nt, Human
ggaggaggcggcggcggcggcggcggcgac

SEQ ID NO: 100327 - RNA, 18 nt, Human
ggcgcggagaaacggcuc

SEQ ID NO: 100328 - RNA, 20 nt, Human
ggcggaggaggaggaggcag

SEQ ID NO: 100329 - RNA, 23 nt, Human
ggcggcggcggcggcggcggcgg

SEQ ID NO: 100330 - RNA, 20 nt, Human
guacauggauuaagaccaaa

SEQ ID NO: 100331 - RNA, 22 nt, Human
gugauaugaaaacucccuuuau

SEQ ID NO: 100332 - RNA, 23 nt, Human
guugucagaagucucuccaguuu

SEQ ID NO: 100333 - RNA, 21 nt, Human
uaaaacauuugugcuaagaac

SEQ ID NO: 100334 - RNA, 22 nt, Human
uaaaagcuuuuuuuuuuccauu

SEQ ID NO: 100335 - RNA, 22 nt, Human
uaaacagaaaacuaauuccaau

SEQ ID NO: 100336 - RNA, 22 nt, Human
uagaaguaauguacauuuucca

SEQ ID NO: 100337 - RNA, 21 nt, Human
uagcauuuuauucagaacgcu

SEQ ID NO: 100338 - RNA, 22 nt, Human
uaguagugccaccagugucagg

SEQ ID NO: 100339 - RNA, 20 nt, Human
uccccaaaccaaaaagaaaa

SEQ ID NO: 100340 - RNA, 24 nt, Human
uccccaaaccaaaaagaaaauaaa

SEQ ID NO: 100341 - RNA, 19 nt, Human
uccccacccccuucuucgc

SEQ ID NO: 100342 - RNA, 21 nt, Human
ucccuuccccuccccucccca

SEQ ID NO: 100343 - RNA, 19 nt, Human
uccuuuuuuuuuuuuuugg

SEQ ID NO: 100344 - RNA, 18 nt, Human
ucucccuccccaaaccaa

SEQ ID NO: 100345 - RNA, 30 nt, Human
ucuuuccuuuccuuuuuuuuuuuuuugguu

SEQ ID NO: 100346 - RNA, 23 nt, Human
ugaaaaaaaaaaaacaaacuaaa

SEQ ID NO: 100347 - RNA, 18 nt, Human
ugaaguggaaaaauacag

SEQ ID NO: 100348 - RNA, 23 nt, Human
ugaaguggaaaaauacagaaaua

SEQ ID NO: 100349 - RNA, 21 nt, Human
ugauaugaaaacucccuuuau

SEQ ID NO: 100350 - RNA, 19 nt, Human
ugcagccuaugccaaagcc

SEQ ID NO: 100351 - RNA, 25 nt, Human
uggaaaaauacagaaauaaaaaagu

SEQ ID NO: 100352 - RNA, 20 nt, Human
ugucaggccaccccuuucuu

SEQ ID NO: 100353 - RNA, 21 nt, Human
uuuaagauuuuagugaaaaaa

SEQ ID NO: 100354 - RNA, 21 nt, Human
uuuccuuuccuuuuuuuuuuu

SEQ ID NO: 100355 - RNA, 18 nt, Human
uuuguauuuuaauaaaag

SEQ ID NO: 100356 - RNA, 23 nt, Human
aaagaaaaaaagguaauuaaaga

SEQ ID NO: 100357 - RNA, 18 nt, Human
aagccuucgcacacagug

SEQ ID NO: 100358 - RNA, 21 nt, Human
acccccauucucacucuccag

SEQ ID NO: 100359 - RNA, 21 nt, Human
acgcgcgccugccuccuggcu

SEQ ID NO: 100360 - RNA, 19 nt, Human
agagcucuguucgccugcu

SEQ ID NO: 100361 - RNA, 22 nt, Human
auaaaaaacagauacgagagua

SEQ ID NO: 100362 - RNA, 19 nt, Human
aucuacccaaguaaagcug

SEQ ID NO: 100363 - RNA, 22 nt, Human
cacacagugucagaaaaaucaa

SEQ ID NO: 100364 - RNA, 24 nt, Human
cacacagugucagaaaaaucaaaa

SEQ ID NO: 100365 - RNA, 23 nt, Human
cacagugucagaaaaaucaaaaa

SEQ ID NO: 100366 - RNA, 23 nt, Human
caucucuguauccaaggccagag

SEQ ID NO: 100367 - RNA, 19 nt, Human
ccccauucucacucuccag

SEQ ID NO: 100368 - RNA, 21 nt, Human
cgaauggcagagaaaagccac

SEQ ID NO: 100369 - RNA, 22 nt, Human
gcagagaaaagccacccuuguc

SEQ ID NO: 100370 - RNA, 24 nt, Human
gcagagaaaagccacccuugucag

SEQ ID NO: 100371 - RNA, 20 nt, Human
gccugcucacccccauucuc

SEQ ID NO: 100372 - RNA, 21 nt, Human
gcgaagcacccgcggagaacg

SEQ ID NO: 100373 - RNA, 19 nt, Human
ggagaacgucuggauuugg

SEQ ID NO: 100374 - RNA, 20 nt, Human
uaaaaaacagauacgagagu

SEQ ID NO: 100375 - RNA, 23 nt, Human
uaaagauucugcccucuuccuuc

SEQ ID NO: 100376 - RNA, 23 nt, Human
uaagauaaaaaacagauacgaga

SEQ ID NO: 100377 - RNA, 21 nt, Human
ucagaacaccuuggacuccaa

SEQ ID NO: 100378 - RNA, 20 nt, Human
uccgcgaagcacccgcggaa

SEQ ID NO: 100379 - RNA, 23 nt, Human
uggcagagaaaagccacccuugu

SEQ ID NO: 100380 - RNA, 18 nt, Human
ugucagaaaaaucaaaaa

SEQ ID NO: 100381 - RNA, 19 nt, Human
ugucagaaaaaucaaaaag

SEQ ID NO: 100382 - RNA, 26 nt, Human
ugucagaaaaaucaaaaagaaaagaa

SEQ ID NO: 100383 - RNA, 23 nt, Human
uguccgcgaagcacccgcggagg

SEQ ID NO: 100384 - RNA, 19 nt, Human
ugugguggaaaagugacaa

SEQ ID NO: 100385 - RNA, 19 nt, Human
uucgcacacagugucagaa

SEQ ID NO: 100386 - RNA, 19 nt, Human
aaggccuggccuuggaggg

SEQ ID NO: 100387 - RNA, 18 nt, Human
acauugacuuucuugucc

SEQ ID NO: 100388 - RNA, 24 nt, Human
accccgcgcuccaugcccaggccg

SEQ ID NO: 100389 - RNA, 19 nt, Human
accggcccugucccugccc

SEQ ID NO: 100390 - RNA, 21 nt, Human
acuagccccgaccaccucagc

SEQ ID NO: 100391 - RNA, 19 nt, Human
agccaagcugguccccaga

SEQ ID NO: 100392 - RNA, 20 nt, Human
agccugagccaagcuggucc

SEQ ID NO: 100393 - RNA, 18 nt, Human
agcgagacuuggacugga

SEQ ID NO: 100394 - RNA, 21 nt, Human
aggggauggugcuugcggggu

SEQ ID NO: 100395 - RNA, 24 nt, Human
auggugcuugcgggguggagcugg

SEQ ID NO: 100396 - RNA, 21 nt, Human
caagcaucgcgccugcagccc

SEQ ID NO: 100397 - RNA, 19 nt, Human
caagcugguccccagacuc

SEQ ID NO: 100398 - RNA, 18 nt, Human
caccccgcgcuccaugcc

SEQ ID NO: 100399 - RNA, 21 nt, Human
cacuucuguuuauaagcuggg

SEQ ID NO: 100400 - RNA, 18 nt, Human
cagcuccugggucuccgc

SEQ ID NO: 100401 - RNA, 25 nt, Human
ccagugacccuccuuaccuuguccu

SEQ ID NO: 100402 - RNA, 20 nt, Human
cccgaccaccucagcguccg

SEQ ID NO: 100403 - RNA, 26 nt, Human
cccgaccaccucagcguccggccgcc

SEQ ID NO: 100404 - RNA, 25 nt, Human
ccgaccaccucagcguccggccgcc

SEQ ID NO: 100405 - RNA, 21 nt, Human
ccgccgcgucuucccgccggc

SEQ ID NO: 100406 - RNA, 18 nt, Human
ccggcccugucccugccc

SEQ ID NO: 100407 - RNA, 19 nt, Human
ccugcagcccgcgucccuc

SEQ ID NO: 100408 - RNA, 18 nt, Human
ccugcucuggcccuggcc

SEQ ID NO: 100409 - RNA, 22 nt, Human
ccugucccugcccuugcucccu

SEQ ID NO: 100410 - RNA, 25 nt, Human
ccugucccugcccuugcucccuggg

SEQ ID NO: 100411 - RNA, 19 nt, Human
cgccgcgccucgccucgcc

SEQ ID NO: 100412 - RNA, 24 nt, Human
cgccgggggcucggacugggcgcg

SEQ ID NO: 100413 - RNA, 23 nt, Human
cgccucgccucgggcucugcucu

SEQ ID NO: 100414 - RNA, 24 nt, Human
cggccagcaggggauguccgcgcu

SEQ ID NO: 100415 - RNA, 18 nt, Human
cuccgccggaucggcccc

SEQ ID NO: 100416 - RNA, 22 nt, Human
cucgccgcucgccgcucgccgc

SEQ ID NO: 100417 - RNA, 21 nt, Human
cucuccgccggaucggccccc

SEQ ID NO: 100418 - RNA, 23 nt, Human
cucuugggccccagugacccucc

SEQ ID NO: 100419 - RNA, 21 nt, Human
cuggccaccgccgcgucuucc

SEQ ID NO: 100420 - RNA, 23 nt, Human
gacuuggacuggagucgggucga

SEQ ID NO: 100421 - RNA, 20 nt, Human
gagcagcugaugcgggcugc

SEQ ID NO: 100422 - RNA, 18 nt, Human
gcacacauuugggaagcc

SEQ ID NO: 100423 - RNA, 18 nt, Human
gcagcggcgccgcgccuc

SEQ ID NO: 100424 - RNA, 20 nt, Human
gccuuggagggucccccccg

SEQ ID NO: 100425 - RNA, 20 nt, Human
gcgccgcgccucgccucgcc

SEQ ID NO: 100426 - RNA, 18 nt, Human
gcgggguggagcugggag

SEQ ID NO: 100427 - RNA, 21 nt, Human
ggaaauguagcgagacuugga

SEQ ID NO: 100428 - RNA, 22 nt, Human
ggaugggugcugcucacaccca

SEQ ID NO: 100429 - RNA, 19 nt, Human
ggccaagccaagguugucc

SEQ ID NO: 100430 - RNA, 20 nt, Human
ggccaccgccgcgucuuccc

SEQ ID NO: 100431 - RNA, 19 nt, Human
ggccccagugacccuccuu

SEQ ID NO: 100432 - RNA, 20 nt, Human
ggccgcucgccgcucgccgc

SEQ ID NO: 100433 - RNA, 19 nt, Human
gggacgguggaugggugcu

SEQ ID NO: 100434 - RNA, 24 nt, Human
gggaggagggccuguuuggccucu

SEQ ID NO: 100435 - RNA, 23 nt, Human
gggagggaggagggccuguuugg

SEQ ID NO: 100436 - RNA, 18 nt, Human
gggauguccgcgcugggc

SEQ ID NO: 100437 - RNA, 19 nt, Human
ggggauggugcuugcgggg

SEQ ID NO: 100438 - RNA, 18 nt, Human
gggguggagcugggaggg

SEQ ID NO: 100439 - RNA, 18 nt, Human
uaacagaucuuaugaagg

SEQ ID NO: 100440 - RNA, 23 nt, Human
uauaaaaauaacagaucuuauga

SEQ ID NO: 100441 - RNA, 20 nt, Human
uccagaggcucugccacccc

SEQ ID NO: 100442 - RNA, 20 nt, Human
uccccaaggccuggccuugg

SEQ ID NO: 100443 - RNA, 19 nt, Human
ucccgagccgccgccgccg

SEQ ID NO: 100444 - RNA, 19 nt, Human
ucccugggaggggacggug

SEQ ID NO: 100445 - RNA, 23 nt, Human
ucgccgcucgccgcucgccgcuc

SEQ ID NO: 100446 - RNA, 23 nt, Human
ucuccgcgggccgcucgccgcuc

SEQ ID NO: 100447 - RNA, 19 nt, Human
ucuugggccccagugaccc

SEQ ID NO: 100448 - RNA, 19 nt, Human
ucuugggccccagugaccc

SEQ ID NO: 100449 - RNA, 22 nt, Human
ugcgggguggagcugggaggga

SEQ ID NO: 100450 - RNA, 24 nt, Human
uggagcugggagggaggagggccu

SEQ ID NO: 100451 - RNA, 19 nt, Human
uggagucggguguccggcc

SEQ ID NO: 100452 - RNA, 21 nt, Human
ugggaggggacgguggauggg

SEQ ID NO: 100453 - RNA, 23 nt, Human
ugggaggggacgguggauggguc

SEQ ID NO: 100454 - RNA, 24 nt, Human
ugggaggggacgguggaugggugc

SEQ ID NO: 100455 - RNA, 19 nt, Human
ugucccugcccuugcuccc

SEQ ID NO: 100456 - RNA, 21 nt, Human
uguccgcgcugggccucccuu

SEQ ID NO: 100457 - RNA, 18 nt, Human
uuucuuguccacgugggg

SEQ ID NO: 100458 - RNA, 20 nt, Human
uuuuuuuuuuuuaagagucc

SEQ ID NO: 100459 - RNA, 19 nt, Human
uuuuuuuuuuuuuuuuuaa

SEQ ID NO: 100460 - RNA, 21 nt, Human
aaccagaaaugcaggacggcc

SEQ ID NO: 100461 - RNA, 21 nt, Human
aggcauuggggucuggaaacc

SEQ ID NO: 100462 - RNA, 23 nt, Human
agugggcccagcagcucugggcu

SEQ ID NO: 100463 - RNA, 21 nt, Human
auaaggggcaaccuaggcaca

SEQ ID NO: 100464 - RNA, 19 nt, Human
caaacugcccacauuccuc

SEQ ID NO: 100465 - RNA, 19 nt, Human
caacgcaacagggaaaaua

SEQ ID NO: 100466 - RNA, 18 nt, Human
cacagcaggcccaggccc

SEQ ID NO: 100467 - RNA, 23 nt, Human
cacucaguauaaaaacgcagaga

SEQ ID NO: 100468 - RNA, 21 nt, Human
caggcccaggcccaggacaca

SEQ ID NO: 100469 - RNA, 20 nt, Human
ccacuuccugacaagcuccg

SEQ ID NO: 100470 - RNA, 18 nt, Human
cccacauuccuccauccu

SEQ ID NO: 100471 - RNA, 19 nt, Human
ccgcucagcucuugccccu

SEQ ID NO: 100472 - RNA, 23 nt, Human
ccgguguuccgcucagcucuugc

SEQ ID NO: 100473 - RNA, 21 nt, Human
ccucugaggcaacccuggccc

SEQ ID NO: 100474 - RNA, 21 nt, Human
cgaaugggaggcauugggguc

SEQ ID NO: 100475 - RNA, 23 nt, Human
cggccagugggcccagcagcucu

SEQ ID NO: 100476 - RNA, 21 nt, Human
cuuggccucugaggcaacccu

SEQ ID NO: 100477 - RNA, 19 nt, Human
gggcccagcagcucugggc

SEQ ID NO: 100478 - RNA, 25 nt, Human
uaaaaaauaaggggcaaccuaggca

SEQ ID NO: 100479 - RNA, 23 nt, Human
uaaggaagcaaccacucuaacgu

SEQ ID NO: 100480 - RNA, 22 nt, Human
uaggcacacucaguauaaaaac

SEQ ID NO: 100481 - RNA, 22 nt, Human
ucagcugaagggggaacugaga

SEQ ID NO: 100482 - RNA, 22 nt, Human
uccauccugaaaggcuaaggaa

SEQ ID NO: 100483 - RNA, 21 nt, Human
uccgccaaguugcuacggcca

SEQ ID NO: 100484 - RNA, 23 nt, Human
uccgccaaguugcuacggccacu

SEQ ID NO: 100485 - RNA, 21 nt, Human
ucuggaaacuuggccucugag

SEQ ID NO: 100486 - RNA, 22 nt, Human
ugaaaggcuaaggaagcaacca

SEQ ID NO: 100487 - RNA, 21 nt, Human
ugaagcagcugccgcgacggc

SEQ ID NO: 100488 - RNA, 18 nt, Human
uggccucugaggcaaccc

SEQ ID NO: 100489 - RNA, 19 nt, Human
uggccucugaggcaacccu

SEQ ID NO: 100490 - RNA, 22 nt, Human
ugggcccagcagcucugggcug

SEQ ID NO: 100491 - RNA, 18 nt, Human
uggggucuggaaaccaga

SEQ ID NO: 100492 - RNA, 22 nt, Human
uuggagaugcucuguggccuga

SEQ ID NO: 100493 - RNA, 22 nt, Human
uuggccucugaggcaacccugg

SEQ ID NO: 100494 - RNA, 24 nt, Human
uuggccucugaggcaacccuggcc

SEQ ID NO: 100495 - RNA, 22 nt, Human
acagcacuaaggacacagccgc

SEQ ID NO: 100496 - RNA, 19 nt, Human
agggcgcuguggggguggg

SEQ ID NO: 100497 - RNA, 23 nt, Human
cagggcgcugugggggugggugc

SEQ ID NO: 100498 - RNA, 22 nt, Human
ccucugcucaguccugcuccuc

SEQ ID NO: 100499 - RNA, 21 nt, Human
cggccgggugcagggcgcugu

SEQ ID NO: 100500 - RNA, 20 nt, Human
gccgcagggagucgggaaga

SEQ ID NO: 100501 - RNA, 20 nt, Human
gcgcugugggggugggugcu

SEQ ID NO: 100502 - RNA, 18 nt, Human
gggcagcggccgggugca

SEQ ID NO: 100503 - RNA, 23 nt, Human
uaacagcacuaaggacacagccg

SEQ ID NO: 100504 - RNA, 23 nt, Human
ucuuuuuuuuuuuuuuuuuuuaa

SEQ ID NO: 100505 - RNA, 19 nt, Human
ugcagggcgcugugggggu

SEQ ID NO: 100506 - RNA, 24 nt, Human
uuuuuuuuuuuuaaaaacagugcu

SEQ ID NO: 100507 - RNA, 23 nt, Human
aaaagaaagagagcauggauugg

SEQ ID NO: 100508 - RNA, 26 nt, Human
aaaauacaguacuugucaugcaccag

SEQ ID NO: 100509 - RNA, 26 nt, Human
aaagaaagagagcauggauuggcgac

SEQ ID NO: 100510 - RNA, 18 nt, Human
aaagacccugcagcaguu

SEQ ID NO: 100511 - RNA, 20 nt, Human
aagcuguccaggccuuugcc

SEQ ID NO: 100512 - RNA, 26 nt, Human
acuucaggacccaaggucaggagcug

SEQ ID NO: 100513 - RNA, 20 nt, Human
agaaagagagcauggauugg

SEQ ID NO: 100514 - RNA, 22 nt, Human
agcgagguguaaagacacaugg

SEQ ID NO: 100515 - RNA, 20 nt, Human
aggaaccuggaguuugcuau

SEQ ID NO: 100516 - RNA, 20 nt, Human
aggaaggggugcugggcugg

SEQ ID NO: 100517 - RNA, 23 nt, Human
aggaaggggugcugggcugggga

SEQ ID NO: 100518 - RNA, 18 nt, Human
aggcagagaaggggagac

SEQ ID NO: 100519 - RNA, 18 nt, Human
aggcagauaggcaccagg

SEQ ID NO: 100520 - RNA, 21 nt, Human
aggggugcugggcuggggagu

SEQ ID NO: 100521 - RNA, 21 nt, Human
aguagacagagaaaagaaaga

SEQ ID NO: 100522 - RNA, 24 nt, Human
aucuccacugccccuccagaauga

SEQ ID NO: 100523 - RNA, 24 nt, Human
caccaguuuggccaauauauagac

SEQ ID NO: 100524 - RNA, 23 nt, Human
cagaacaccagccuggauuugcc

SEQ ID NO: 100525 - RNA, 19 nt, Human
cagccuggauuugccagca

SEQ ID NO: 100526 - RNA, 25 nt, Human
cagccuggauuugccagcauuugag

SEQ ID NO: 100527 - RNA, 20 nt, Human
caggacccaaggucaggagc

SEQ ID NO: 100528 - RNA, 21 nt, Human
caggacccaaggucaggagcu

SEQ ID NO: 100529 - RNA, 18 nt, Human
caggaggaacagaucgug

SEQ ID NO: 100530 - RNA, 19 nt, Human
caggccagugaggucacuu

SEQ ID NO: 100531 - RNA, 21 nt, Human
caggccuggagagggguuggg

SEQ ID NO: 100532 - RNA, 23 nt, Human
cagugugaggggcuuugcccaga

SEQ ID NO: 100533 - RNA, 22 nt, Human
cauuuuuggaggcuguggugcc

SEQ ID NO: 100534 - RNA, 19 nt, Human
ccaaggucaggagcugcca

SEQ ID NO: 100535 - RNA, 18 nt, Human
ccaggccuucuccagagg

SEQ ID NO: 100536 - RNA, 25 nt, Human
ccagugaggucacuucaggacccaa

SEQ ID NO: 100537 - RNA, 19 nt, Human
ccaguuuugcuaaaggcca

SEQ ID NO: 100538 - RNA, 18 nt, Human
cccaaggcugaugagguc

SEQ ID NO: 100539 - RNA, 22 nt, Human
cccaggaggaacagaucgugcc

SEQ ID NO: 100540 - RNA, 21 nt, Human
ccccaggcccagagugaccuc

SEQ ID NO: 100541 - RNA, 20 nt, Human
ccguccagggccugagcgug

SEQ ID NO: 100542 - RNA, 19 nt, Human
ccugagaugugacaacagc

SEQ ID NO: 100543 - RNA, 20 nt, Human
ccugcagcaguuaaacacag

SEQ ID NO: 100544 - RNA, 22 nt, Human
cugagcccagacagaacaccag

SEQ ID NO: 100545 - RNA, 21 nt, Human
cugaucuccacugccccucca

SEQ ID NO: 100546 - RNA, 18 nt, Human
cugcaggggguuuggguc

SEQ ID NO: 100547 - RNA, 20 nt, Human
cuucccaggaggaacagauc

SEQ ID NO: 100548 - RNA, 19 nt, Human
cuuggaguggaguauggag

SEQ ID NO: 100549 - RNA, 21 nt, Human
gaggaaggggugcugggcugg

SEQ ID NO: 100550 - RNA, 24 nt, Human
gagugggaaccucgguccaugacg

SEQ ID NO: 100551 - RNA, 22 nt, Human
gcccagacagaacaccagccug

SEQ ID NO: 100552 - RNA, 20 nt, Human
gcugcaggggguuugggucc

SEQ ID NO: 100553 - RNA, 22 nt, Human
ggacugccuguccguccagggc

SEQ ID NO: 100554 - RNA, 22 nt, Human
ggaugucugagcccagacagaa

SEQ ID NO: 100555 - RNA, 20 nt, Human
gggcuuugcccagagugggg

SEQ ID NO: 100556 - RNA, 19 nt, Human
ggguuggggaguggugggg

SEQ ID NO: 100557 - RNA, 18 nt, Human
gguugggcagggcagggc

SEQ ID NO: 100558 - RNA, 18 nt, Human
gugaggcagagaagggga

SEQ ID NO: 100559 - RNA, 20 nt, Human
guggagcucuguggagccug

SEQ ID NO: 100560 - RNA, 21 nt, Human
guggagguggcccucacccug

SEQ ID NO: 100561 - RNA, 26 nt, Human
uaaaaaaauacaguacuugucaugca

SEQ ID NO: 100562 - RNA, 25 nt, Human
uaaaaaaaucauuauaagaagcuag

SEQ ID NO: 100563 - RNA, 24 nt, Human
uaaauaacaaccugcuuauuaugc

SEQ ID NO: 100564 - RNA, 22 nt, Human
uacaauuauagaaaauagaagg

SEQ ID NO: 100565 - RNA, 19 nt, Human
uagaaaaagacccugcagc

SEQ ID NO: 100566 - RNA, 19 nt, Human
uagaaaaagacccugcagc

SEQ ID NO: 100567 - RNA, 20 nt, Human
uagacagagaaaagaaagag

SEQ ID NO: 100568 - RNA, 23 nt, Human
uaucauuaguaaaaaaaucauua

SEQ ID NO: 100569 - RNA, 19 nt, Human
ucaugcagucaugaguggg

SEQ ID NO: 100570 - RNA, 19 nt, Human
uccaggcagauaggcacca

SEQ ID NO: 100571 - RNA, 18 nt, Human
uccaggccuuugccucca

SEQ ID NO: 100572 - RNA, 23 nt, Human
ucccaaggcugaugaggucucug

SEQ ID NO: 100573 - RNA, 19 nt, Human
uccccaggcccagagugac

SEQ ID NO: 100574 - RNA, 18 nt, Human
ucccgagagagggcauga

SEQ ID NO: 100575 - RNA, 18 nt, Human
ucgugccuguggggcuga

SEQ ID NO: 100576 - RNA, 18 nt, Human
ucuacaaucccuugcagu

SEQ ID NO: 100577 - RNA, 25 nt, Human
ucuccuucccugccccucucuguug

SEQ ID NO: 100578 - RNA, 22 nt, Human
ucucuguugacugaugccacuu

SEQ ID NO: 100579 - RNA, 22 nt, Human
ucuuccaggccuucuccagagg

SEQ ID NO: 100580 - RNA, 20 nt, Human
ugacaggguuauguggauga

SEQ ID NO: 100581 - RNA, 21 nt, Human
ugacgaagggugagcuuggug

SEQ ID NO: 100582 - RNA, 18 nt, Human
ugagagcuagaaacuugu

SEQ ID NO: 100583 - RNA, 20 nt, Human
ugagcccagacagaacaccg

SEQ ID NO: 100584 - RNA, 22 nt, Human
ugagggucaguucccugagaug

SEQ ID NO: 100585 - RNA, 18 nt, Human
ugccagcauuugagaaua

SEQ ID NO: 100586 - RNA, 22 nt, Human
ugccccuucucaggcaaaacug

SEQ ID NO: 100587 - RNA, 22 nt, Human
ugccugagggucaguucccuga

SEQ ID NO: 100588 - RNA, 21 nt, Human
ugccuucugcaaggugugccu

SEQ ID NO: 100589 - RNA, 18 nt, Human
ugcuccgggaacaucugc

SEQ ID NO: 100590 - RNA, 22 nt, Human
uggaagaugcaugggugaccac

SEQ ID NO: 100591 - RNA, 19 nt, Human
uggacugccuguccgucca

SEQ ID NO: 100592 - RNA, 18 nt, Human
uggagagggguuggggag

SEQ ID NO: 100593 - RNA, 23 nt, Human
uggaggcuguggugccuggcguc

SEQ ID NO: 100594 - RNA, 24 nt, Human
uggaugucugagcccagacagaac

SEQ ID NO: 100595 - RNA, 20 nt, Human
uggcaggccagugaggucac

SEQ ID NO: 100596 - RNA, 21 nt, Human
uggcucggcuccgucaugcag

SEQ ID NO: 100597 - RNA, 19 nt, Human
ugucugagcccagacagaa

SEQ ID NO: 100598 - RNA, 23 nt, Human
uucaggacccaaggucaggagcu

SEQ ID NO: 100599 - RNA, 19 nt, Human
uuggaggcuguggugccug

SEQ ID NO: 100600 - RNA, 25 nt, Human
uuggaggcuguggugccuggcgucu

SEQ ID NO: 100601 - RNA, 23 nt, Human
uuguccaguuuugcuaaaggcca

SEQ ID NO: 100602 - RNA, 22 nt, Human
uuuuuuuguugcccaggcuaaa

SEQ ID NO: 100603 - RNA, 23 nt, Human
aaaacaccaggacagcggaagcg

SEQ ID NO: 100604 - RNA, 27 nt, Human
aaaacaccaggacagcggaagcgggca

SEQ ID NO: 100605 - RNA, 23 nt, Human
aaacaacaguguguuuccaaaca

SEQ ID NO: 100606 - RNA, 20 nt, Human
aacagagaagccuucacgga

SEQ ID NO: 100607 - RNA, 23 nt, Human
aagugacccgugauacauguggu

SEQ ID NO: 100608 - RNA, 21 nt, Human
aaugacacuaaaauuauuugu

SEQ ID NO: 100609 - RNA, 26 nt, Human
acaaaggcaaacuuucgcaugucuag

SEQ ID NO: 100610 - RNA, 22 nt, Human
acccugcgacccgcccaggcug

SEQ ID NO: 100611 - RNA, 19 nt, Human
acuguucccuguccucccc

SEQ ID NO: 100612 - RNA, 20 nt, Human
agacccugcgacccgcccag

SEQ ID NO: 100613 - RNA, 19 nt, Human
agggcaggguauuagguuc

SEQ ID NO: 100614 - RNA, 20 nt, Human
auaugacaauauccccaaau

SEQ ID NO: 100615 - RNA, 28 nt, Human
augguacaaaggcaaacuuucgcauguc

SEQ ID NO: 100616 - RNA, 20 nt, Human
auggucaugaaagcaaaguu

SEQ ID NO: 100617 - RNA, 19 nt, Human
auguacaguauaguagaau

SEQ ID NO: 100618 - RNA, 23 nt, Human
caaacagaaaauaugugcugaua

SEQ ID NO: 100619 - RNA, 26 nt, Human
caauauccccaaauggaaaugacacu

SEQ ID NO: 100620 - RNA, 20 nt, Human
caccaggacagcggaagcgg

SEQ ID NO: 100621 - RNA, 19 nt, Human
cacugcaccguauccagcc

SEQ ID NO: 100622 - RNA, 23 nt, Human
cagccucauuccuccuuccuucc

SEQ ID NO: 100623 - RNA, 21 nt, Human
ccaaauggaaaugacacuaaa

SEQ ID NO: 100624 - RNA, 19 nt, Human
cccugagaacaaguggaaa

SEQ ID NO: 100625 - RNA, 18 nt, Human
cccugcgacccgcccagg

SEQ ID NO: 100626 - RNA, 18 nt, Human
ccgccgccgccgccgccg

SEQ ID NO: 100627 - RNA, 21 nt, Human
ccgccgccgccgccgccgcgg

SEQ ID NO: 100628 - RNA, 24 nt, Human
ccgccgccgccgccgcggucgccg

SEQ ID NO: 100629 - RNA, 25 nt, Human
ccgccgccgccgccgcggucgccgg

SEQ ID NO: 100630 - RNA, 18 nt, Human
ccgccgccgccgcggucg

SEQ ID NO: 100631 - RNA, 20 nt, Human
ccgcggagacccugcgaccc

SEQ ID NO: 100632 - RNA, 19 nt, Human
ccgcggucgccggcucugc

SEQ ID NO: 100633 - RNA, 28 nt, Human
ccggcaccugccuguugggcugacuugg

SEQ ID NO: 100634 - RNA, 25 nt, Human
ccggcucugccguucuuggcccccg

SEQ ID NO: 100635 - RNA, 20 nt, Human
ccuccuuccuuccuuaaugu

SEQ ID NO: 100636 - RNA, 24 nt, Human
ccugcgcccgcggagacccugcga

SEQ ID NO: 100637 - RNA, 18 nt, Human
cgccgccgccgccgccgc

SEQ ID NO: 100638 - RNA, 21 nt, Human
cuccgccgccgccgccgccgc

SEQ ID NO: 100639 - RNA, 21 nt, Human
cucuuccaagggucuuccaaa

SEQ ID NO: 100640 - RNA, 23 nt, Human
cuucacggaguaguggauaaaua

SEQ ID NO: 100641 - RNA, 18 nt, Human
cuuuaaagcacaguccuu

SEQ ID NO: 100642 - RNA, 19 nt, Human
gaagguuacgggcucggga

SEQ ID NO: 100643 - RNA, 22 nt, Human
gagaauuuuaacauaugggugg

SEQ ID NO: 100644 - RNA, 26 nt, Human
gaucauuacuuuaucauuaguucaaa

SEQ ID NO: 100645 - RNA, 19 nt, Human
gcaguuggcugaccugaca

SEQ ID NO: 100646 - RNA, 22 nt, Human
gccuccgccgccgccgccgccg

SEQ ID NO: 100647 - RNA, 18 nt, Human
gguucaaguguggcuggc

SEQ ID NO: 100648 - RNA, 22 nt, Human
guaaaacaccaggacagcggaa

SEQ ID NO: 100649 - RNA, 19 nt, Human
guagaacagagaagccuuc

SEQ ID NO: 100650 - RNA, 25 nt, Human
guagaacagagaagccuucacggag

SEQ ID NO: 100651 - RNA, 18 nt, Human
gugacacaaauaaacacc

SEQ ID NO: 100652 - RNA, 23 nt, Human
uaagauucuaaugauaagugcca

SEQ ID NO: 100653 - RNA, 18 nt, Human
uaaguauauauauauaca

SEQ ID NO: 100654 - RNA, 21 nt, Human
uaaugagaauuuuaacauaug

SEQ ID NO: 100655 - RNA, 18 nt, Human
uacaguuagggcaguugg

SEQ ID NO: 100656 - RNA, 18 nt, Human
uacaguuagggcaguugg

SEQ ID NO: 100657 - RNA, 26 nt, Human
uacgcuggaauuucugaugacugcac

SEQ ID NO: 100658 - RNA, 24 nt, Human
uacuagaaaaaagucucuaacauu

SEQ ID NO: 100659 - RNA, 26 nt, Human
uagaauaauacugacaacuauagaca

SEQ ID NO: 100660 - RNA, 18 nt, Human
uaugaugauauuuuuauc

SEQ ID NO: 100661 - RNA, 25 nt, Human
ucauaaucucaauguuguuuaucca

SEQ ID NO: 100662 - RNA, 19 nt, Human
uccacacggacugcagcca

SEQ ID NO: 100663 - RNA, 25 nt, Human
ucccucccccuuuauaugguacaaa

SEQ ID NO: 100664 - RNA, 24 nt, Human
uccuccuuccuuccuuaauguucu

SEQ ID NO: 100665 - RNA, 23 nt, Human
ucuaaccucuccacugaacuccu

SEQ ID NO: 100666 - RNA, 18 nt, Human
ucucagaggauaucucug

SEQ ID NO: 100667 - RNA, 24 nt, Human
ugaaaaaaaauuaaugcuuuugaa

SEQ ID NO: 100668 - RNA, 19 nt, Human
ugacaauauccccaaaugg

SEQ ID NO: 100669 - RNA, 18 nt, Human
ugacacaaauaaacaccc

SEQ ID NO: 100670 - RNA, 22 nt, Human
ugacacaaauaaacaccccuau

SEQ ID NO: 100671 - RNA, 21 nt, Human
ugacugcacaagguaagauuc

SEQ ID NO: 100672 - RNA, 22 nt, Human
ugagaucauuacuuuaucauuu

SEQ ID NO: 100673 - RNA, 18 nt, Human
ugauaugacaauaucccc

SEQ ID NO: 100674 - RNA, 27 nt, Human
ugauggcagagaaaguucuccccgagg

SEQ ID NO: 100675 - RNA, 21 nt, Human
ugccuccgccgccgccgccgc

SEQ ID NO: 100676 - RNA, 21 nt, Human
ugcugucgcggcugaaacugc

SEQ ID NO: 100677 - RNA, 21 nt, Human
uggaauuucugaugacugcac

SEQ ID NO: 100678 - RNA, 21 nt, Human
uggcaccgucgagucugugcg

SEQ ID NO: 100679 - RNA, 18 nt, Human
uguaagaaggauaugaag

SEQ ID NO: 100680 - RNA, 24 nt, Human
uguacaguuagggcaguuggcuga

SEQ ID NO: 100681 - RNA, 20 nt, Human
uguacuucacacugcuacuu

SEQ ID NO: 100682 - RNA, 20 nt, Human
uuaaagcacaguccuuuauc

SEQ ID NO: 100683 - RNA, 23 nt, Human
uuacuaauucaacuuagucgugu

SEQ ID NO: 100684 - RNA, 19 nt, Human
uuauccaaauguaucacgu

SEQ ID NO: 100685 - RNA, 19 nt, Human
uucaguucaguuggguccu

SEQ ID NO: 100686 - RNA, 25 nt, Human
uuccuugguuaacauuauuagcuau

SEQ ID NO: 100687 - RNA, 19 nt, Human
uugaauaguaguugauggc

SEQ ID NO: 100688 - RNA, 20 nt, Human
uuuccaucuuuacuucuugg

SEQ ID NO: 100689 - RNA, 19 nt, Human
aaccggcucgacacccgcu

SEQ ID NO: 100690 - RNA, 24 nt, Human
aagaaaaaaaccuugacaagagaa

SEQ ID NO: 100691 - RNA, 24 nt, Human
aagaaaaaaaccuugacaagagaa

SEQ ID NO: 100692 - RNA, 22 nt, Human
aagucauaaaacuaaucagaac

SEQ ID NO: 100693 - RNA, 19 nt, Human
accuggggccucgcugccc

SEQ ID NO: 100694 - RNA, 18 nt, Human
accuugacaagagaaaag

SEQ ID NO: 100695 - RNA, 18 nt, Human
accuugacaagagaaaag

SEQ ID NO: 100696 - RNA, 22 nt, Human
agccugucgugaaagccgugau

SEQ ID NO: 100697 - RNA, 21 nt, Human
aggcacaguuccaguuggcuu

SEQ ID NO: 100698 - RNA, 21 nt, Human
aggcacaguuccaguuggcuu

SEQ ID NO: 100699 - RNA, 27 nt, Human
cacgggcuccuccuccaaucacagccc

SEQ ID NO: 100700 - RNA, 23 nt, Human
caguacauuucgaauuaagguuc

SEQ ID NO: 100701 - RNA, 19 nt, Human
cccuccccacggcgucaga

SEQ ID NO: 100702 - RNA, 18 nt, Human
ccucgcugcccuccccac

SEQ ID NO: 100703 - RNA, 18 nt, Human
cgccagggacccgggcgu

SEQ ID NO: 100704 - RNA, 18 nt, Human
cgcugcccuccccacggc

SEQ ID NO: 100705 - RNA, 21 nt, Human
cuccuccuccaaucacagccc

SEQ ID NO: 100706 - RNA, 18 nt, Human
gacaagagaaaaggcaca

SEQ ID NO: 100707 - RNA, 18 nt, Human
gacaagagaaaaggcaca

SEQ ID NO: 100708 - RNA, 22 nt, Human
gauuggaagaggucaccacugc

SEQ ID NO: 100709 - RNA, 22 nt, Human
gauuggaagaggucaccacugc

SEQ ID NO: 100710 - RNA, 19 nt, Human
uaagaaaaaaaccuugaca

SEQ ID NO: 100711 - RNA, 19 nt, Human
uaagaaaaaaaccuugaca

SEQ ID NO: 100712 - RNA, 18 nt, Human
ugccuccggcaggguguc

SEQ ID NO: 100713 - RNA, 18 nt, Human
ugccuccggcaggguguc

SEQ ID NO: 100714 - RNA, 20 nt, Human
ugcgcgcagcuccgcgcgcg

SEQ ID NO: 100715 - RNA, 20 nt, Human
ugguguaguaaguaccuggg

SEQ ID NO: 100716 - RNA, 20 nt, Human
uguaagaaaaaaaccuugac

SEQ ID NO: 100717 - RNA, 20 nt, Human
uguaagaaaaaaaccuugac

SEQ ID NO: 100718 - RNA, 19 nt, Human
uguaguaaguaccuggggc

SEQ ID NO: 100719 - RNA, 18 nt, Human
uguaguaaguaccuuagc

SEQ ID NO: 100720 - RNA, 19 nt, Human
aaacaaauagccacauugg

SEQ ID NO: 100721 - RNA, 20 nt, Human
aaacagacaucaucuaagca

SEQ ID NO: 100722 - RNA, 21 nt, Human
agcauuuacuuacagcucugc

SEQ ID NO: 100723 - RNA, 19 nt, Human
auuuacuuacagcucugcc

SEQ ID NO: 100724 - RNA, 18 nt, Human
caccacgaaaaugagaca

SEQ ID NO: 100725 - RNA, 23 nt, Human
cuagacacuccacauacuuaauu

SEQ ID NO: 100726 - RNA, 25 nt, Human
uaagcaaaucaccacgaaaaugaga

SEQ ID NO: 100727 - RNA, 21 nt, Human
uauagcacgggaaacagacau

SEQ ID NO: 100728 - RNA, 25 nt, Human
ucuagacacuccacauacuuaauuc

SEQ ID NO: 100729 - RNA, 20 nt, Human
ucuccggucugcagccaucc

SEQ ID NO: 100730 - RNA, 23 nt, Human
uggggcccugcgcuggcgaaugu

SEQ ID NO: 100731 - RNA, 18 nt, Human
ugguugaguuuauagaug

SEQ ID NO: 100732 - RNA, 20 nt, Human
uugaguuuauagaugacugg

SEQ ID NO: 100733 - RNA, 22 nt, Human
uuuauaaccuccuaacauauac

SEQ ID NO: 100734 - RNA, 20 nt, Human
aaagacagcggggggacugc

SEQ ID NO: 100735 - RNA, 20 nt, Human
aaagacagcggggggacugc

SEQ ID NO: 100736 - RNA, 24 nt, Human
aaagcuuuuauccaacaagagccu

SEQ ID NO: 100737 - RNA, 24 nt, Human
aaagcuuuuauccaacaagagccu

SEQ ID NO: 100738 - RNA, 24 nt, Human
aaagcuuuuauccaacaagagccu

SEQ ID NO: 100739 - RNA, 24 nt, Human
aagcuuuuauccaacaagagccua

SEQ ID NO: 100740 - RNA, 24 nt, Human
aagcuuuuauccaacaagagccua

SEQ ID NO: 100741 - RNA, 19 nt, Human
accccauaccuugucccuc

SEQ ID NO: 100742 - RNA, 19 nt, Human
accccauaccuugucccuc

SEQ ID NO: 100743 - RNA, 19 nt, Human
accccauaccuugucccuc

SEQ ID NO: 100744 - RNA, 18 nt, Human
accugggguccccacagc

SEQ ID NO: 100745 - RNA, 18 nt, Human
accugggguccccacagc

SEQ ID NO: 100746 - RNA, 18 nt, Human
accugggguccccacagc

SEQ ID NO: 100747 - RNA, 22 nt, Human
acucaaagaaaugccaggccag

SEQ ID NO: 100748 - RNA, 23 nt, Human
acucaaagaaaugccaggccagg

SEQ ID NO: 100749 - RNA, 21 nt, Human
acuugaccugagccuccgaga

SEQ ID NO: 100750 - RNA, 21 nt, Human
agauaauggaggccccggagc

SEQ ID NO: 100751 - RNA, 18 nt, Human
agccgccagaccugcccu

SEQ ID NO: 100752 - RNA, 18 nt, Human
agccgccagaccugcccu

SEQ ID NO: 100753 - RNA, 18 nt, Human
agccgccagaccugcccu

SEQ ID NO: 100754 - RNA, 22 nt, Human
agcuccacgauguucggaugac

SEQ ID NO: 100755 - RNA, 22 nt, Human
agcuggaucccgggcgccuggu

SEQ ID NO: 100756 - RNA, 22 nt, Human
agcuggaucccgggcgccuggu

SEQ ID NO: 100757 - RNA, 23 nt, Human
agcuuuuauccaacaagagccua

SEQ ID NO: 100758 - RNA, 19 nt, Human
aggcccgggccaggccgaa

SEQ ID NO: 100759 - RNA, 20 nt, Human
aggcccgggccaggccgaaa

SEQ ID NO: 100760 - RNA, 20 nt, Human
aggccgaaauccgcugcagc

SEQ ID NO: 100761 - RNA, 19 nt, Human
agggauccagcucagccuc

SEQ ID NO: 100762 - RNA, 21 nt, Human
aguggcagcuuggaaaagccc

SEQ ID NO: 100763 - RNA, 22 nt, Human
auccaacaagagccuauagcuu

SEQ ID NO: 100764 - RNA, 22 nt, Human
auccaacaagagccuauagcuu

SEQ ID NO: 100765 - RNA, 24 nt, Human
augagaccccugcagccacggaug

SEQ ID NO: 100766 - RNA, 19 nt, Human
caccacuccucccaagaag

SEQ ID NO: 100767 - RNA, 19 nt, Human
caccacuccucccaagaag

SEQ ID NO: 100768 - RNA, 19 nt, Human
caccacuccucccaagaag

SEQ ID NO: 100769 - RNA, 23 nt, Human
caccacugaucggaagaccuggu

SEQ ID NO: 100770 - RNA, 23 nt, Human
caccacugaucggaagaccuggu

SEQ ID NO: 100771 - RNA, 19 nt, Human
cacccaccacuccucccaa

SEQ ID NO: 100772 - RNA, 19 nt, Human
cacccaccacuccucccaa

SEQ ID NO: 100773 - RNA, 19 nt, Human
cacccaccacuccucccaa

SEQ ID NO: 100774 - RNA, 22 nt, Human
cacccggccuuuuucugggggc

SEQ ID NO: 100775 - RNA, 22 nt, Human
cacccggccuuuuucugggggc

SEQ ID NO: 100776 - RNA, 22 nt, Human
cacccggccuuuuucugggggc

SEQ ID NO: 100777 - RNA, 19 nt, Human
cacccuucacagacaccac

SEQ ID NO: 100778 - RNA, 19 nt, Human
cacccuucacagacaccac

SEQ ID NO: 100779 - RNA, 19 nt, Human
caccugggguccccacagc

SEQ ID NO: 100780 - RNA, 19 nt, Human
caccugggguccccacagc

SEQ ID NO: 100781 - RNA, 19 nt, Human
caccugggguccccacagc

SEQ ID NO: 100782 - RNA, 19 nt, Human
caccugggguccccacagc

SEQ ID NO: 100783 - RNA, 19 nt, Human
caccugggguccccacagc

SEQ ID NO: 100784 - RNA, 22 nt, Human
cagcaggcgcagcccggccucc

SEQ ID NO: 100785 - RNA, 24 nt, Human
cagcaguggguucagggcagacag

SEQ ID NO: 100786 - RNA, 24 nt, Human
cagcaguggguucagggcagacag

SEQ ID NO: 100787 - RNA, 19 nt, Human
cagcgugauuucccgcaag

SEQ ID NO: 100788 - RNA, 18 nt, Human
cagcucagccuccagccc

SEQ ID NO: 100789 - RNA, 18 nt, Human
cagcucagccuccagccc

SEQ ID NO: 100790 - RNA, 23 nt, Human
cagcuccacgauguucggaugac

SEQ ID NO: 100791 - RNA, 19 nt, Human
cagcuuggaaaagcccggc

SEQ ID NO: 100792 - RNA, 25 nt, Human
caucaccaggaagaugcucuccagg

SEQ ID NO: 100793 - RNA, 24 nt, Human
caucccaggccagcgguccaccac

SEQ ID NO: 100794 - RNA, 23 nt, Human
caucccaggccagcguccaccac

SEQ ID NO: 100795 - RNA, 22 nt, Human
caucuggaguccugccaggccc

SEQ ID NO: 100796 - RNA, 22 nt, Human
caucuggaguccugccaggccc

SEQ ID NO: 100797 - RNA, 22 nt, Human
caucuggaguccugccaggccc

SEQ ID NO: 100798 - RNA, 20 nt, Human
ccaacaagagccuauagcuu

SEQ ID NO: 100799 - RNA, 22 nt, Human
ccaccacuccucccaagaagca

SEQ ID NO: 100800 - RNA, 22 nt, Human
ccaccacuccucccaagaagca

SEQ ID NO: 100801 - RNA, 22 nt, Human
ccaccacuccucccaagaagca

SEQ ID NO: 100802 - RNA, 24 nt, Human
ccacggccuccuguuggguccucc

SEQ ID NO: 100803 - RNA, 24 nt, Human
ccacggccuccuguuggguccucc

SEQ ID NO: 100804 - RNA, 25 nt, Human
ccaggcccaccuggggguccccugg

SEQ ID NO: 100805 - RNA, 25 nt, Human
ccaggcccaccuggggguccccugg

SEQ ID NO: 100806 - RNA, 25 nt, Human
ccaggcccaccuggggguccccugg

SEQ ID NO: 100807 - RNA, 21 nt, Human
cccaggccagcgguccaccac

SEQ ID NO: 100808 - RNA, 21 nt, Human
ccccccggugucacccggccu

SEQ ID NO: 100809 - RNA, 20 nt, Human
cccccggugucacccggccu

SEQ ID NO: 100810 - RNA, 20 nt, Human
cccccggugucacccggccu

SEQ ID NO: 100811 - RNA, 18 nt, Human
ccccggagcaccugcagc

SEQ ID NO: 100812 - RNA, 24 nt, Human
cccgcaagcugcugauggggaugc

SEQ ID NO: 100813 - RNA, 22 nt, Human
ccggugucacccggccuuuuuc

SEQ ID NO: 100814 - RNA, 20 nt, Human
ccuccagcccagggcucucc

SEQ ID NO: 100815 - RNA, 20 nt, Human
ccuccagcccagggcucucc

SEQ ID NO: 100816 - RNA, 20 nt, Human
ccuccagcccagggcucucc

SEQ ID NO: 100817 - RNA, 18 nt, Human
ccuccguguggggagcag

SEQ ID NO: 100818 - RNA, 18 nt, Human
ccuccguguggggagcag

SEQ ID NO: 100819 - RNA, 18 nt, Human
ccuccguguggggagcag

SEQ ID NO: 100820 - RNA, 22 nt, Human
ccuccguguggggagcagggau

SEQ ID NO: 100821 - RNA, 20 nt, Human
ccucugcuugugcucuucuc

SEQ ID NO: 100822 - RNA, 21 nt, Human
ccucugcuugugcucuucucg

SEQ ID NO: 100823 - RNA, 23 nt, Human
ccucuuguccucaucuggagucc

SEQ ID NO: 100824 - RNA, 23 nt, Human
ccucuuguccucaucuggagucc

SEQ ID NO: 100825 - RNA, 23 nt, Human
ccucuuguccucaucuggagucc

SEQ ID NO: 100826 - RNA, 19 nt, Human
ccugcagccacggauggag

SEQ ID NO: 100827 - RNA, 19 nt, Human
ccugcagccacggauggag

SEQ ID NO: 100828 - RNA, 19 nt, Human
ccugcagccacggauggag

SEQ ID NO: 100829 - RNA, 20 nt, Human
ccugcccuuccagggugcac

SEQ ID NO: 100830 - RNA, 20 nt, Human
ccugcccuuccagggugcac

SEQ ID NO: 100831 - RNA, 20 nt, Human
ccugcccuuccagggugcac

SEQ ID NO: 100832 - RNA, 21 nt, Human
ccuggcccaaguugcacccac

SEQ ID NO: 100833 - RNA, 21 nt, Human
ccugggguccccacagccaac

SEQ ID NO: 100834 - RNA, 21 nt, Human
ccugggguccccacagccaac

SEQ ID NO: 100835 - RNA, 21 nt, Human
ccugggguccccacagccaac

SEQ ID NO: 100836 - RNA, 20 nt, Human
ccuugucccucuuguccuca

SEQ ID NO: 100837 - RNA, 20 nt, Human
ccuugucccucuuguccuca

SEQ ID NO: 100838 - RNA, 20 nt, Human
ccuugucccucuuguccuca

SEQ ID NO: 100839 - RNA, 21 nt, Human
cgcagcccggccuccgacagc

SEQ ID NO: 100840 - RNA, 22 nt, Human
cgccaugccgagcgcuggcccc

SEQ ID NO: 100841 - RNA, 21 nt, Human
cggccuccuguuggguccucc

SEQ ID NO: 100842 - RNA, 21 nt, Human
cgggccaggccgaaauccgcu

SEQ ID NO: 100843 - RNA, 23 nt, Human
cgugugccaggcccaccgucagg

SEQ ID NO: 100844 - RNA, 21 nt, Human
cuagggacagggccuggccca

SEQ ID NO: 100845 - RNA, 21 nt, Human
cugcguggugguucccaacag

SEQ ID NO: 100846 - RNA, 21 nt, Human
cuggccgaccaguggcagcug

SEQ ID NO: 100847 - RNA, 23 nt, Human
cuucucgacacgcuuauuucugg

SEQ ID NO: 100848 - RNA, 23 nt, Human
gaccacaugagaccccugcagcc

SEQ ID NO: 100849 - RNA, 23 nt, Human
gaccacaugagaccccugcagcc

SEQ ID NO: 100850 - RNA, 23 nt, Human
gaccacaugagaccccugcagcc

SEQ ID NO: 100851 - RNA, 24 nt, Human
gaccacaugagaccccugcagcca

SEQ ID NO: 100852 - RNA, 24 nt, Human
gaccacaugagaccccugcagcca

SEQ ID NO: 100853 - RNA, 24 nt, Human
gaccacaugagaccccugcagcca

SEQ ID NO: 100854 - RNA, 22 nt, Human
gagaccccugcagccacggaug

SEQ ID NO: 100855 - RNA, 22 nt, Human
gagaccccugcagccacggaug

SEQ ID NO: 100856 - RNA, 19 nt, Human
gaggcuggccagguccugc

SEQ ID NO: 100857 - RNA, 18 nt, Human
gcacgggacagccccggg

SEQ ID NO: 100858 - RNA, 18 nt, Human
gcacgggacagccccggg

SEQ ID NO: 100859 - RNA, 18 nt, Human
gcacgggacagccccggg

SEQ ID NO: 100860 - RNA, 21 nt, Human
gcagcaguggguucagggcag

SEQ ID NO: 100861 - RNA, 21 nt, Human
gcagcaguggguucagggcag

SEQ ID NO: 100862 - RNA, 21 nt, Human
gcagcaguggguucagggcag

SEQ ID NO: 100863 - RNA, 25 nt, Human
gcagcaguggguucagggcagacag

SEQ ID NO: 100864 - RNA, 21 nt, Human
gcccagggcucuccugguagc

SEQ ID NO: 100865 - RNA, 21 nt, Human
gcccagggcucuccugguagc

SEQ ID NO: 100866 - RNA, 21 nt, Human
gcccagggcucuccugguagc

SEQ ID NO: 100867 - RNA, 21 nt, Human
gccugugcgccagcagcucgg

SEQ ID NO: 100868 - RNA, 22 nt, Human
gcuggccccgccucucuugcgc

SEQ ID NO: 100869 - RNA, 20 nt, Human
ggaauacaggcgugugccag

SEQ ID NO: 100870 - RNA, 20 nt, Human
ggaauacaggcgugugccag

SEQ ID NO: 100871 - RNA, 20 nt, Human
ggagaagaggccugugcgcc

SEQ ID NO: 100872 - RNA, 22 nt, Human
ggagcaccugcagcacgaugca

SEQ ID NO: 100873 - RNA, 22 nt, Human
ggagccgccagaccugcccuuc

SEQ ID NO: 100874 - RNA, 20 nt, Human
ggaggccccggagcaccugc

SEQ ID NO: 100875 - RNA, 20 nt, Human
ggaguccugccaggcccacc

SEQ ID NO: 100876 - RNA, 21 nt, Human
ggaguccugccaggcccaccu

SEQ ID NO: 100877 - RNA, 21 nt, Human
ggaguccugccaggcccaccu

SEQ ID NO: 100878 - RNA, 22 nt, Human
ggcagcaguggguucagggcag

SEQ ID NO: 100879 - RNA, 22 nt, Human
ggcagcaguggguucagggcag

SEQ ID NO: 100880 - RNA, 22 nt, Human
ggcagcaguggguucagggcag

SEQ ID NO: 100881 - RNA, 19 nt, Human
ggccccgccucucuugcgc

SEQ ID NO: 100882 - RNA, 21 nt, Human
ggccgaaauccgcugcagcag

SEQ ID NO: 100883 - RNA, 19 nt, Human
ggcuggggcggcccgcuug

SEQ ID NO: 100884 - RNA, 18 nt, Human
ggcugggggcgguggcuc

SEQ ID NO: 100885 - RNA, 18 nt, Human
gggcagacagugggagga

SEQ ID NO: 100886 - RNA, 18 nt, Human
gggcagacagugggagga

SEQ ID NO: 100887 - RNA, 18 nt, Human
gggcagacagugggagga

SEQ ID NO: 100888 - RNA, 19 nt, Human
gggcugggagcccccggug

SEQ ID NO: 100889 - RNA, 18 nt, Human
ggggagaagaggccugug

SEQ ID NO: 100890 - RNA, 25 nt, Human
gggggcagcaguggguucagggcag

SEQ ID NO: 100891 - RNA, 25 nt, Human
gggggcagcaguggguucagggcag

SEQ ID NO: 100892 - RNA, 25 nt, Human
gggggcagcaguggguucagggcag

SEQ ID NO: 100893 - RNA, 27 nt, Human
gguguuggcauauuauccaggaggcug

SEQ ID NO: 100894 - RNA, 21 nt, Human
gucccucuuguccucaucugg

SEQ ID NO: 100895 - RNA, 21 nt, Human
gucccucuuguccucaucugg

SEQ ID NO: 100896 - RNA, 21 nt, Human
gucccucuuguccucaucugg

SEQ ID NO: 100897 - RNA, 21 nt, Human
gucugcguggugguucccaac

SEQ ID NO: 100898 - RNA, 20 nt, Human
guuguuguagggcugcuucc

SEQ ID NO: 100899 - RNA, 19 nt, Human
uacaggcgugugccaggcc

SEQ ID NO: 100900 - RNA, 19 nt, Human
uacaggcgugugccaggcc

SEQ ID NO: 100901 - RNA, 20 nt, Human
uaccuugucccucuuguccu

SEQ ID NO: 100902 - RNA, 20 nt, Human
uaccuugucccucuuguccu

SEQ ID NO: 100903 - RNA, 20 nt, Human
uaccuugucccucuuguccu

SEQ ID NO: 100904 - RNA, 22 nt, Human
uaccuugucccucuuguccuca

SEQ ID NO: 100905 - RNA, 22 nt, Human
uaccuugucccucuuguccuca

SEQ ID NO: 100906 - RNA, 22 nt, Human
uaccuugucccucuuguccuca

SEQ ID NO: 100907 - RNA, 23 nt, Human
ucacaguaacccaucaccaggaa

SEQ ID NO: 100908 - RNA, 22 nt, Human
ucacccggccuuuuucuggggg

SEQ ID NO: 100909 - RNA, 22 nt, Human
ucacccggccuuuuucuggggg

SEQ ID NO: 100910 - RNA, 22 nt, Human
ucacccggccuuuuucuggggg

SEQ ID NO: 100911 - RNA, 22 nt, Human
ucacugggcgugcccagcagcu

SEQ ID NO: 100912 - RNA, 26 nt, Human
ucacugggcgugcccagcagcugcac

SEQ ID NO: 100913 - RNA, 25 nt, Human
ucagagccacggccuccuguugggu

SEQ ID NO: 100914 - RNA, 25 nt, Human
ucagagccacggccuccuguugggu

SEQ ID NO: 100915 - RNA, 25 nt, Human
ucagagccacggccuccuguugggu

SEQ ID NO: 100916 - RNA, 20 nt, Human
uccaccacaacucaaagaca

SEQ ID NO: 100917 - RNA, 20 nt, Human
uccaccacaacucaaagaca

SEQ ID NO: 100918 - RNA, 20 nt, Human
uccaccacaacucaaagaca

SEQ ID NO: 100919 - RNA, 20 nt, Human
uccagcucagccuccagccc

SEQ ID NO: 100920 - RNA, 22 nt, Human
ucccaccccauaccuugucccc

SEQ ID NO: 100921 - RNA, 22 nt, Human
ucccaccccauaccuugucccc

SEQ ID NO: 100922 - RNA, 22 nt, Human
ucccaccccauaccuugucccc

SEQ ID NO: 100923 - RNA, 19 nt, Human
ucccaggccagcgguccac

SEQ ID NO: 100924 - RNA, 19 nt, Human
ucccaggccagcgguccac

SEQ ID NO: 100925 - RNA, 18 nt, Human
ucccaggccagcguccac

SEQ ID NO: 100926 - RNA, 20 nt, Human
ucccaggccagcguccacca

SEQ ID NO: 100927 - RNA, 23 nt, Human
uccuccguguggggagcagggau

SEQ ID NO: 100928 - RNA, 24 nt, Human
uccucugcuugugcucuucucgac

SEQ ID NO: 100929 - RNA, 21 nt, Human
ucggccaguaugcagcccaca

SEQ ID NO: 100930 - RNA, 22 nt, Human
ucuccaggcaguccccggccgu

SEQ ID NO: 100931 - RNA, 21 nt, Human
ucucuugcgcgcaggcgcaga

SEQ ID NO: 100932 - RNA, 22 nt, Human
ucugcucgcacuccagaucugg

SEQ ID NO: 100933 - RNA, 19 nt, Human
ucugggggcagcagugggu

SEQ ID NO: 100934 - RNA, 19 nt, Human
ucugggggcagcagugggu

SEQ ID NO: 100935 - RNA, 19 nt, Human
ucugggggcagcagugggu

SEQ ID NO: 100936 - RNA, 20 nt, Human
ucuuagggucguacaugaac

SEQ ID NO: 100937 - RNA, 20 nt, Human
ugacgcaggcggagcagcag

SEQ ID NO: 100938 - RNA, 21 nt, Human
ugauggggaugccauccuucu

SEQ ID NO: 100939 - RNA, 19 nt, Human
ugcacgggacagccccggg

SEQ ID NO: 100940 - RNA, 19 nt, Human
ugcacgggacagccccggg

SEQ ID NO: 100941 - RNA, 19 nt, Human
ugcacgggacagccccggg

SEQ ID NO: 100942 - RNA, 19 nt, Human
ugcagcagagaggggagug

SEQ ID NO: 100943 - RNA, 18 nt, Human
ugccaggcccaccugggg

SEQ ID NO: 100944 - RNA, 18 nt, Human
ugccaggcccaccugggg

SEQ ID NO: 100945 - RNA, 18 nt, Human
ugccaggcccaccugggg

SEQ ID NO: 100946 - RNA, 21 nt, Human
ugcugguggucugcguggugg

SEQ ID NO: 100947 - RNA, 20 nt, Human
uggaaaagcccggccagaug

SEQ ID NO: 100948 - RNA, 20 nt, Human
uggaggccccggagcaccug

SEQ ID NO: 100949 - RNA, 20 nt, Human
uggcucgcggcacccuucac

SEQ ID NO: 100950 - RNA, 20 nt, Human
uggcucgcggcacccuucac

SEQ ID NO: 100951 - RNA, 18 nt, Human
ugggaauacaggcgugug

SEQ ID NO: 100952 - RNA, 21 nt, Human
ugggaauacaggcgugugcca

SEQ ID NO: 100953 - RNA, 21 nt, Human
ugggaauacaggcgugugcca

SEQ ID NO: 100954 - RNA, 21 nt, Human
ugggacaccauaggcccgggc

SEQ ID NO: 100955 - RNA, 19 nt, Human
ugggagcccccggugucac

SEQ ID NO: 100956 - RNA, 19 nt, Human
ugggagcccccggugucac

SEQ ID NO: 100957 - RNA, 18 nt, Human
ugggaggaagucagugga

SEQ ID NO: 100958 - RNA, 18 nt, Human
ugggaggaagucagugga

SEQ ID NO: 100959 - RNA, 18 nt, Human
ugggaggaagucagugga

SEQ ID NO: 100960 - RNA, 23 nt, Human
ugggggcagcaguggguucaggg

SEQ ID NO: 100961 - RNA, 23 nt, Human
ugggggcagcaguggguucaggg

SEQ ID NO: 100962 - RNA, 23 nt, Human
ugggggcagcaguggguucaggg

SEQ ID NO: 100963 - RNA, 18 nt, Human
ugucacacuuccugaacu

SEQ ID NO: 100964 - RNA, 20 nt, Human
ugugcagauaauggaggccc

SEQ ID NO: 100965 - RNA, 23 nt, Human
uguuggguccuccguguggggag

SEQ ID NO: 100966 - RNA, 23 nt, Human
uguuggguccuccguguggggag

SEQ ID NO: 100967 - RNA, 23 nt, Human
uguuggguccuccguguggggag

SEQ ID NO: 100968 - RNA, 21 nt, Human
uuccccacaaccaccuccuuc

SEQ ID NO: 100969 - RNA, 21 nt, Human
uucuggguguccaaauccuug

SEQ ID NO: 100970 - RNA, 22 nt, Human
uucuuagggucguacaugaaca

SEQ ID NO: 100971 - RNA, 18 nt, Human
uuuuuuuuuuuuuuucug

SEQ ID NO: 100972 - RNA, 18 nt, Human
uuuuuuuuuuuuuuucug

SEQ ID NO: 100973 - RNA, 18 nt, Human
uuuuuuuuuuuuuuucug

SEQ ID NO: 100974 - RNA, 22 nt, Human
uuuuuuuuuuuuuuuuucuguu

SEQ ID NO: 100975 - RNA, 22 nt, Human
uuuuuuuuuuuuuuuuucuguu

SEQ ID NO: 100976 - RNA, 21 nt, Human
aaaaaaaaaaaaaaaagccaa

SEQ ID NO: 100977 - RNA, 20 nt, Human
aaaaaaaaaagccaacucua

SEQ ID NO: 100978 - RNA, 24 nt, Human
aaaaaagccaacucuacuauugga

SEQ ID NO: 100979 - RNA, 18 nt, Human
aaaaccccaaggugcaca

SEQ ID NO: 100980 - RNA, 22 nt, Human
aaacaauguugccgccucccac

SEQ ID NO: 100981 - RNA, 20 nt, Human
aaacagggcccaguaccgug

SEQ ID NO: 100982 - RNA, 24 nt, Human
aacaacuaagaauacuaaaaggaa

SEQ ID NO: 100983 - RNA, 27 nt, Human
aaggccauggugaagcaauagauugga

SEQ ID NO: 100984 - RNA, 18 nt, Human
aagggacaaacaagggga

SEQ ID NO: 100985 - RNA, 21 nt, Human
aauagcaagagcacucaagga

SEQ ID NO: 100986 - RNA, 21 nt, Human
acuggggccaaucauuuuucu

SEQ ID NO: 100987 - RNA, 26 nt, Human
agaaaaauucaaacaucucucaccug

SEQ ID NO: 100988 - RNA, 20 nt, Human
agaaggcggacccuggcucu

SEQ ID NO: 100989 - RNA, 23 nt, Human
agaaggugaguguuuaaggcaag

SEQ ID NO: 100990 - RNA, 24 nt, Human
agccuggucaagcccacacuggag

SEQ ID NO: 100991 - RNA, 25 nt, Human
aggaagagaaaaauucaaacaucuc

SEQ ID NO: 100992 - RNA, 24 nt, Human
aggagagggugagauuagggcugg

SEQ ID NO: 100993 - RNA, 24 nt, Human
agggcccaccugaguccaaauagc

SEQ ID NO: 100994 - RNA, 19 nt, Human
agucuucagucucccagcc

SEQ ID NO: 100995 - RNA, 19 nt, Human
auggaacgcaguauaccuc

SEQ ID NO: 100996 - RNA, 20 nt, Human
caaaagcaccaacuuagccc

SEQ ID NO: 100997 - RNA, 18 nt, Human
caaaaugaugccuaaacc

SEQ ID NO: 100998 - RNA, 20 nt, Human
caaauccacccacuaugacc

SEQ ID NO: 100999 - RNA, 22 nt, Human
caacaaauccacccacuaugac

SEQ ID NO: 101000 - RNA, 27 nt, Human
caacuugaaacaauguugccgccuccc

SEQ ID NO: 101001 - RNA, 21 nt, Human
caagagcacucaaggacaagg

SEQ ID NO: 101002 - RNA, 22 nt, Human
cacagcccugaaaaagugucag

SEQ ID NO: 101003 - RNA, 18 nt, Human
cacccgggcugagucuuc

SEQ ID NO: 101004 - RNA, 20 nt, Human
cagcaggaggcuugggaucc

SEQ ID NO: 101005 - RNA, 21 nt, Human
ccaaauagcccaaggccaagc

SEQ ID NO: 101006 - RNA, 22 nt, Human
ccaacuuagcccccgcuaucau

SEQ ID NO: 101007 - RNA, 21 nt, Human
ccaagccuggucaagcccaca

SEQ ID NO: 101008 - RNA, 20 nt, Human
ccacacuggaggagagggug

SEQ ID NO: 101009 - RNA, 20 nt, Human
ccaccagaggccccgcccug

SEQ ID NO: 101010 - RNA, 22 nt, Human
cccaccgaguucccgaccgcca

SEQ ID NO: 101011 - RNA, 31 nt, Human
cccacuaugaccaaaaaaaaaaaaaaaaaaa

SEQ ID NO: 101012 - RNA, 18 nt, Human
cccaguaccguggccccg

SEQ ID NO: 101013 - RNA, 22 nt, Human
cccccuuucaccccuguauucc

SEQ ID NO: 101014 - RNA, 23 nt, Human
cccgaccgccaccagaggccccg

SEQ ID NO: 101015 - RNA, 21 nt, Human
ccucacucaaucacagcccug

SEQ ID NO: 101016 - RNA, 23 nt, Human
ccucacucaaucacagcccugaa

SEQ ID NO: 101017 - RNA, 24 nt, Human
ccugcagaaggcggacccuggcuc

SEQ ID NO: 101018 - RNA, 20 nt, Human
ccuggcucucgggggccgag

SEQ ID NO: 101019 - RNA, 22 nt, Human
cguguaggaaggcuuuuuuaaa

SEQ ID NO: 101020 - RNA, 21 nt, Human
cuaaacccuaacuucuaacuc

SEQ ID NO: 101021 - RNA, 27 nt, Human
cuaugaccaaaaaaaaaaaaaaaaaag

SEQ ID NO: 101022 - RNA, 23 nt, Human
cucucgcucuugucaauuuggcc

SEQ ID NO: 101023 - RNA, 19 nt, Human
cugccucauaaggccaugg

SEQ ID NO: 101024 - RNA, 21 nt, Human
gcaauagauuggaaugaagca

SEQ ID NO: 101025 - RNA, 20 nt, Human
gcuugggauccuggucaucc

SEQ ID NO: 101026 - RNA, 19 nt, Human
ggccgaggagggggaaaca

SEQ ID NO: 101027 - RNA, 24 nt, Human
gggccgaggagggggaaacagggc

SEQ ID NO: 101028 - RNA, 23 nt, Human
gggugguggaggcuaacuuaagu

SEQ ID NO: 101029 - RNA, 19 nt, Human
gguaggagguggacgucag

SEQ ID NO: 101030 - RNA, 18 nt, Human
uaagagaagggggaaagg

SEQ ID NO: 101031 - RNA, 22 nt, Human
uaaugagcuacaaacuaaauua

SEQ ID NO: 101032 - RNA, 24 nt, Human
uagcacugucauuacaaaaccccu

SEQ ID NO: 101033 - RNA, 24 nt, Human
uagcccaaggccaagccuggucaa

SEQ ID NO: 101034 - RNA, 25 nt, Human
uauaaaacuaggcacauuuuuuuaa

SEQ ID NO: 101035 - RNA, 21 nt, Human
uauuggauauaaccugaaaua

SEQ ID NO: 101036 - RNA, 22 nt, Human
uauuggauauaaccugaaauau

SEQ ID NO: 101037 - RNA, 19 nt, Human
ucaagcccacacuggagga

SEQ ID NO: 101038 - RNA, 19 nt, Human
ucagggccucccagauucc

SEQ ID NO: 101039 - RNA, 23 nt, Human
ucccgaccgccaccagaggcccc

SEQ ID NO: 101040 - RNA, 20 nt, Human
ucgggucagcccggcccugg

SEQ ID NO: 101041 - RNA, 23 nt, Human
ugaacaacuaagaauacuaaaag

SEQ ID NO: 101042 - RNA, 21 nt, Human
ugaagcacaaucccugucuca

SEQ ID NO: 101043 - RNA, 18 nt, Human
ugacagagacaaaucaua

SEQ ID NO: 101044 - RNA, 26 nt, Human
ugacagagacaaaucauaaaaaaaaa

SEQ ID NO: 101045 - RNA, 27 nt, Human
ugacagagacaaaucauaaaaaaaaaa

SEQ ID NO: 101046 - RNA, 18 nt, Human
ugcagaaggcggacccug

SEQ ID NO: 101047 - RNA, 22 nt, Human
ugcccucacucaaucacagccc

SEQ ID NO: 101048 - RNA, 23 nt, Human
uggaaugaagcacaaucccuguc

SEQ ID NO: 101049 - RNA, 20 nt, Human
uggccaacuugaaacaaugu

SEQ ID NO: 101050 - RNA, 19 nt, Human
ugggaacccugcagaaggc

SEQ ID NO: 101051 - RNA, 18 nt, Human
ugggguaggagguggacg

SEQ ID NO: 101052 - RNA, 18 nt, Human
uuaaaauagacuccuccc

SEQ ID NO: 101053 - RNA, 21 nt, Human
uuaaggcaaguucagagggcc

SEQ ID NO: 101054 - RNA, 22 nt, Human
uuauaccaacccucuucagcaa

SEQ ID NO: 101055 - RNA, 23 nt, Human
uucccgaccgccaccagaggccc

SEQ ID NO: 101056 - RNA, 21 nt, Human
uuucacugguuccccccuuuc

SEQ ID NO: 101057 - RNA, 22 nt, Human
uuucacugguuccccccuuuca

SEQ ID NO: 101058 - RNA, 19 nt, Human
uuuuauaccaacccucuuc

SEQ ID NO: 101059 - RNA, 21 nt, Human
aaaaaacaaaaaaaaccuggg

SEQ ID NO: 101060 - RNA, 23 nt, Human
aaaaaacaaaaaaaaccugggca

SEQ ID NO: 101061 - RNA, 21 nt, Human
aaaacaaaaaaaaccugggca

SEQ ID NO: 101062 - RNA, 22 nt, Human
aaaacaaggguuucaucugaac

SEQ ID NO: 101063 - RNA, 20 nt, Human
aaacaguuuuagucauuuuc

SEQ ID NO: 101064 - RNA, 31 nt, Human
aaccaugggaggaaaaacgaaacuguaaccc

SEQ ID NO: 101065 - RNA, 19 nt, Human
aagcagaaccuacauugua

SEQ ID NO: 101066 - RNA, 19 nt, Human
aaugcuuaagcaaaaaaga

SEQ ID NO: 101067 - RNA, 24 nt, Human
aauggugucuuggaggcaaacuac

SEQ ID NO: 101068 - RNA, 22 nt, Human
aauuaacugcaaaaucuuuucu

SEQ ID NO: 101069 - RNA, 19 nt, Human
acaaggguuucaucugaac

SEQ ID NO: 101070 - RNA, 21 nt, Human
agagccaagugaaccauggga

SEQ ID NO: 101071 - RNA, 18 nt, Human
aggccagggcgaaccgga

SEQ ID NO: 101072 - RNA, 22 nt, Human
aucaaguaauaaauacauacaa

SEQ ID NO: 101073 - RNA, 24 nt, Human
augaaaaggaacaaagaacaccau

SEQ ID NO: 101074 - RNA, 24 nt, Human
caaaaaaaaccugggcaguuccua

SEQ ID NO: 101075 - RNA, 19 nt, Human
caaaacaaaaucccuacag

SEQ ID NO: 101076 - RNA, 25 nt, Human
caaagaacaccauggguaacaaagg

SEQ ID NO: 101077 - RNA, 18 nt, Human
caaaguuuggggggcugg

SEQ ID NO: 101078 - RNA, 20 nt, Human
caaauauggccguccgcgcc

SEQ ID NO: 101079 - RNA, 19 nt, Human
caaguaauaaauacauaca

SEQ ID NO: 101080 - RNA, 18 nt, Human
caaugcuuaaaaaacaaa

SEQ ID NO: 101081 - RNA, 23 nt, Human
caauggugucuuggaggcaaacu

SEQ ID NO: 101082 - RNA, 24 nt, Human
caggccccgggugcggcgcagggg

SEQ ID NO: 101083 - RNA, 22 nt, Human
caucaaguaauaaauacauaca

SEQ ID NO: 101084 - RNA, 24 nt, Human
caucuuguaaaaagauggaaaucc

SEQ ID NO: 101085 - RNA, 24 nt, Human
ccauuuugaaaacaaggguuucau

SEQ ID NO: 101086 - RNA, 18 nt, Human
ccccgcgcccggcgcccc

SEQ ID NO: 101087 - RNA, 18 nt, Human
ccccgcgccuccgggugc

SEQ ID NO: 101088 - RNA, 22 nt, Human
ccccgcgccuccgggugcgcuc

SEQ ID NO: 101089 - RNA, 18 nt, Human
ccccgggggugugcuggg

SEQ ID NO: 101090 - RNA, 18 nt, Human
ccccgggggugugcuggg

SEQ ID NO: 101091 - RNA, 25 nt, Human
cccgcgccuccgggugcgcucggcg

SEQ ID NO: 101092 - RNA, 20 nt, Human
ccgcagucucacccaggccc

SEQ ID NO: 101093 - RNA, 18 nt, Human
ccgcgagggcggcggcgg

SEQ ID NO: 101094 - RNA, 23 nt, Human
ccgcgcccguccgagcgcccgcc

SEQ ID NO: 101095 - RNA, 18 nt, Human
ccgcgcccugccgccgcc

SEQ ID NO: 101096 - RNA, 18 nt, Human
ccgcggcggcugcgggag

SEQ ID NO: 101097 - RNA, 19 nt, Human
ccuccgggugcgcucggcg

SEQ ID NO: 101098 - RNA, 19 nt, Human
ccuucaaaaccaacaaggc

SEQ ID NO: 101099 - RNA, 22 nt, Human
cgcaaacuuuccgcggagccgg

SEQ ID NO: 101100 - RNA, 20 nt, Human
cgcccugccgccgccgcagu

SEQ ID NO: 101101 - RNA, 24 nt, Human
cgcccugccgccgccgcagucuca

SEQ ID NO: 101102 - RNA, 22 nt, Human
cgccugaggcccgcgcgcgucc

SEQ ID NO: 101103 - RNA, 26 nt, Human
cgcgagggcggcggcggcggcggcga

SEQ ID NO: 101104 - RNA, 18 nt, Human
cgcggagccggcggggcg

SEQ ID NO: 101105 - RNA, 21 nt, Human
cggcucgggccgcgccggcaa

SEQ ID NO: 101106 - RNA, 18 nt, Human
cgggagggggcggcccgg

SEQ ID NO: 101107 - RNA, 19 nt, Human
cgggagggggcggcccggc

SEQ ID NO: 101108 - RNA, 20 nt, Human
cuguagguucagagccaagu

SEQ ID NO: 101109 - RNA, 19 nt, Human
gaaauccuucaaaaccaac

SEQ ID NO: 101110 - RNA, 20 nt, Human
gagggcggcggcggcggcgg

SEQ ID NO: 101111 - RNA, 27 nt, Human
gcggcggcggcgaggccgggcgguagc

SEQ ID NO: 101112 - RNA, 27 nt, Human
gcggcggcggcggcgaggccgggcggu

SEQ ID NO: 101113 - RNA, 23 nt, Human
gcggcggcggcggcggcgaggcc

SEQ ID NO: 101114 - RNA, 20 nt, Human
ggaaaaacgaaacuguaacc

SEQ ID NO: 101115 - RNA, 22 nt, Human
ggaggcaaacuacaguuugcug

SEQ ID NO: 101116 - RNA, 18 nt, Human
ggccgggagggggcggcc

SEQ ID NO: 101117 - RNA, 23 nt, Human
ggccgggcgguagcgcugcagcc

SEQ ID NO: 101118 - RNA, 18 nt, Human
ggcgcggcggggccaggc

SEQ ID NO: 101119 - RNA, 18 nt, Human
ggcuggggucccggcggc

SEQ ID NO: 101120 - RNA, 19 nt, Human
gggcgcggcggggccaggc

SEQ ID NO: 101121 - RNA, 24 nt, Human
gggcggccggggccgggagggggc

SEQ ID NO: 101122 - RNA, 24 nt, Human
gguaacaaauguauacaaaagaga

SEQ ID NO: 101123 - RNA, 25 nt, Human
uaaaaaacaaaaaaaaccugggcag

SEQ ID NO: 101124 - RNA, 20 nt, Human
uaaagggagacaaugguguc

SEQ ID NO: 101125 - RNA, 23 nt, Human
uaacugcaaaaucuuuucucaau

SEQ ID NO: 101126 - RNA, 21 nt, Human
ucaaaacaaaaucccuacagu

SEQ ID NO: 101127 - RNA, 23 nt, Human
ucaucuuguaaaaagauggaaau

SEQ ID NO: 101128 - RNA, 18 nt, Human
uccccuugaugguggggg

SEQ ID NO: 101129 - RNA, 21 nt, Human
ucccggcggcgccugaggccc

SEQ ID NO: 101130 - RNA, 18 nt, Human
uccgaagagcacuuucuu

SEQ ID NO: 101131 - RNA, 19 nt, Human
ucugaacaggggagaugaa

SEQ ID NO: 101132 - RNA, 22 nt, Human
ugcaaauccuaauuaacugcaa

SEQ ID NO: 101133 - RNA, 24 nt, Human
ugccaaaguuuggggggcuggggu

SEQ ID NO: 101134 - RNA, 18 nt, Human
uggcaaaugggaaccggc

SEQ ID NO: 101135 - RNA, 19 nt, Human
uggggggcuggggucccgg

SEQ ID NO: 101136 - RNA, 18 nt, Human
uggggucccggcggcgcc

SEQ ID NO: 101137 - RNA, 24 nt, Human
uggguaacaaauguauacaaaaga

SEQ ID NO: 101138 - RNA, 22 nt, Human
ugguggguugcucuuucuucug

SEQ ID NO: 101139 - RNA, 24 nt, Human
uguauacaaaagagaagauuaaag

SEQ ID NO: 101140 - RNA, 18 nt, Human
agcuggggcagcagcugc

SEQ ID NO: 101141 - RNA, 21 nt, Human
cagcgcucccgguugcuccuc

SEQ ID NO: 101142 - RNA, 22 nt, Human
ccagcccagcgcucccgguugc

SEQ ID NO: 101143 - RNA, 23 nt, Human
cccagcgcucccgguugcuccuc

SEQ ID NO: 101144 - RNA, 19 nt, Human
ccccagaugcauccucucu

SEQ ID NO: 101145 - RNA, 22 nt, Human
cccgguugcuccuccagcuucc

SEQ ID NO: 101146 - RNA, 18 nt, Human
ccgguugcuccuccagcu

SEQ ID NO: 101147 - RNA, 22 nt, Human
ccuuagugcuuugcucucccca

SEQ ID NO: 101148 - RNA, 18 nt, Human
cgagaaaggaucugagug

SEQ ID NO: 101149 - RNA, 18 nt, Human
cuaacccagacucagccc

SEQ ID NO: 101150 - RNA, 19 nt, Human
cugaugcugaauuccuuag

SEQ ID NO: 101151 - RNA, 18 nt, Human
cuuagugcuuugcucucc

SEQ ID NO: 101152 - RNA, 19 nt, Human
gacucagcccucugcaggc

SEQ ID NO: 101153 - RNA, 21 nt, Human
gcacugggcaauuugcacccc

SEQ ID NO: 101154 - RNA, 18 nt, Human
uaggaggcagcuggggca

SEQ ID NO: 101155 - RNA, 18 nt, Human
ucugcaggcugaugcuga

SEQ ID NO: 101156 - RNA, 19 nt, Human
ugccugggaaacagaaggc

SEQ ID NO: 101157 - RNA, 22 nt, Human
ugcuuugcucuccccagaugca

SEQ ID NO: 101158 - RNA, 21 nt, Human
uggcaauggguaggaggcagc

SEQ ID NO: 101159 - RNA, 23 nt, Human
ugggcaauuugcaccccagccca

SEQ ID NO: 101160 - RNA, 21 nt, Human
aaaaaggaccccaaauauaaa

SEQ ID NO: 101161 - RNA, 21 nt, Human
aaaaaggaccccaaauauaaa

SEQ ID NO: 101162 - RNA, 21 nt, Human
aaggaccccaaauauaaaggu

SEQ ID NO: 101163 - RNA, 21 nt, Human
aaggaccccaaauauaaaggu

SEQ ID NO: 101164 - RNA, 23 nt, Human
aaggaccccaaauauaaagguag

SEQ ID NO: 101165 - RNA, 23 nt, Human
aaggaccccaaauauaaagguag

SEQ ID NO: 101166 - RNA, 18 nt, Human
aaggcaaagauugcccuc

SEQ ID NO: 101167 - RNA, 18 nt, Human
aaggcaaagauugcccuc

SEQ ID NO: 101168 - RNA, 21 nt, Human
aagggaaauggcagcuuuucu

SEQ ID NO: 101169 - RNA, 21 nt, Human
aagggaaauggcagcuuuucu

SEQ ID NO: 101170 - RNA, 22 nt, Human
aauauaaagguagggaaaggga

SEQ ID NO: 101171 - RNA, 22 nt, Human
aauauaaagguagggaaaggga

SEQ ID NO: 101172 - RNA, 20 nt, Human
accccaaauauaaagguagg

SEQ ID NO: 101173 - RNA, 20 nt, Human
accccaaauauaaagguagg

SEQ ID NO: 101174 - RNA, 19 nt, Human
agaaaugggaaggagaagg

SEQ ID NO: 101175 - RNA, 19 nt, Human
agaaaugggaaggagaagg

SEQ ID NO: 101176 - RNA, 20 nt, Human
agagaggcccccucaccccc

SEQ ID NO: 101177 - RNA, 22 nt, Human
agaggcccccucacccccaccc

SEQ ID NO: 101178 - RNA, 21 nt, Human
agagugcugcagagcucgaaa

SEQ ID NO: 101179 - RNA, 19 nt, Human
agcuggacgcagagggccc

SEQ ID NO: 101180 - RNA, 20 nt, Human
aggagaaggagaagccucaa

SEQ ID NO: 101181 - RNA, 22 nt, Human
aggagaaggagaagccucaaaa

SEQ ID NO: 101182 - RNA, 28 nt, Human
aggcagagauucgcuuguguggguuaga

SEQ ID NO: 101183 - RNA, 22 nt, Human
aggcagcaaaguaaucucugua

SEQ ID NO: 101184 - RNA, 22 nt, Human
aggcagcaaaguaaucucugua

SEQ ID NO: 101185 - RNA, 18 nt, Human
aggcccccucacccccac

SEQ ID NO: 101186 - RNA, 24 nt, Human
aggcgcgcggaaacugggagggcu

SEQ ID NO: 101187 - RNA, 21 nt, Human
aguguagagaaaugggaagga

SEQ ID NO: 101188 - RNA, 21 nt, Human
aguguagagaaaugggaagga

SEQ ID NO: 101189 - RNA, 18 nt, Human
caccaugugaccagcugc

SEQ ID NO: 101190 - RNA, 19 nt, Human
caccaugugaccagcugcc

SEQ ID NO: 101191 - RNA, 20 nt, Human
cacugggcggggcccucugg

SEQ ID NO: 101192 - RNA, 22 nt, Human
cagagggcccgaccauagacac

SEQ ID NO: 101193 - RNA, 21 nt, Human
cagcagcagcugugcucccga

SEQ ID NO: 101194 - RNA, 21 nt, Human
cccacccucaccaugugacca

SEQ ID NO: 101195 - RNA, 25 nt, Human
ccccauacacccgagcucgguccgg

SEQ ID NO: 101196 - RNA, 22 nt, Human
ccggagcagcuggacgcagagg

SEQ ID NO: 101197 - RNA, 19 nt, Human
ccucaaaaggagagguggg

SEQ ID NO: 101198 - RNA, 19 nt, Human
ccucaaaaggagagguggg

SEQ ID NO: 101199 - RNA, 19 nt, Human
ccucagagauaaaggcaaa

SEQ ID NO: 101200 - RNA, 19 nt, Human
ccucagagauaaaggcaaa

SEQ ID NO: 101201 - RNA, 22 nt, Human
ccuccauagccucagagauaaa

SEQ ID NO: 101202 - RNA, 22 nt, Human
ccuccauagccucagagauaaa

SEQ ID NO: 101203 - RNA, 18 nt, Human
ccucuggaggcagcccaa

SEQ ID NO: 101204 - RNA, 19 nt, Human
ccucuggggggaaaggcuc

SEQ ID NO: 101205 - RNA, 23 nt, Human
cugugcucccgacuccuccaucu

SEQ ID NO: 101206 - RNA, 19 nt, Human
gagaaggagaagccucaaa

SEQ ID NO: 101207 - RNA, 21 nt, Human
gagaaggagaagccucaaaag

SEQ ID NO: 101208 - RNA, 19 nt, Human
gagcagcuggacgcagagg

SEQ ID NO: 101209 - RNA, 21 nt, Human
gagcagcuggacgcagagggc

SEQ ID NO: 101210 - RNA, 20 nt, Human
gaggugggaggggaauguca

SEQ ID NO: 101211 - RNA, 20 nt, Human
gaggugggaggggaauguca

SEQ ID NO: 101212 - RNA, 22 nt, Human
gcccccucacccccacccucac

SEQ ID NO: 101213 - RNA, 19 nt, Human
gcuggacgcagagggcccg

SEQ ID NO: 101214 - RNA, 19 nt, Human
ggaaggagaaggagaagcc

SEQ ID NO: 101215 - RNA, 22 nt, Human
ggacaagagggaacauaccccu

SEQ ID NO: 101216 - RNA, 22 nt, Human
ggacaagagggaacauaccccu

SEQ ID NO: 101217 - RNA, 18 nt, Human
ggcaaagauugcccucuc

SEQ ID NO: 101218 - RNA, 18 nt, Human
ggcaaagauugcccucuc

SEQ ID NO: 101219 - RNA, 23 nt, Human
gggacaagagggaacauaccccu

SEQ ID NO: 101220 - RNA, 23 nt, Human
gggacaagagggaacauaccccu

SEQ ID NO: 101221 - RNA, 21 nt, Human
gggagacccucacgccagccc

SEQ ID NO: 101222 - RNA, 21 nt, Human
gggugcugugggggcggcccg

SEQ ID NO: 101223 - RNA, 19 nt, Human
uaaaaaaaaaaaaaagacc

SEQ ID NO: 101224 - RNA, 20 nt, Human
uaaaaaaaaaaaaaagacca

SEQ ID NO: 101225 - RNA, 27 nt, Human
uaaaaaaggaccccaaauauaaaggua

SEQ ID NO: 101226 - RNA, 27 nt, Human
uaaaaaaggaccccaaauauaaaggua

SEQ ID NO: 101227 - RNA, 19 nt, Human
uagagaaaugggaaggaga

SEQ ID NO: 101228 - RNA, 19 nt, Human
uagagaaaugggaaggaga

SEQ ID NO: 101229 - RNA, 19 nt, Human
uauaaagguagggaaaggg

SEQ ID NO: 101230 - RNA, 19 nt, Human
uauaaagguagggaaaggg

SEQ ID NO: 101231 - RNA, 24 nt, Human
ucaaaaggagaggugggaggggaa

SEQ ID NO: 101232 - RNA, 24 nt, Human
ucaaaaggagaggugggaggggaa

SEQ ID NO: 101233 - RNA, 21 nt, Human
ucagguaccaccgacugcacu

SEQ ID NO: 101234 - RNA, 19 nt, Human
uccagaagggaaauggcag

SEQ ID NO: 101235 - RNA, 19 nt, Human
uccagaagggaaauggcag

SEQ ID NO: 101236 - RNA, 24 nt, Human
uccauggcagccacuccauugcuc

SEQ ID NO: 101237 - RNA, 25 nt, Human
uccuacggccccauacacccgagcu

SEQ ID NO: 101238 - RNA, 20 nt, Human
uccuguauaaaaaaggaccc

SEQ ID NO: 101239 - RNA, 18 nt, Human
uggaggaggacccuccau

SEQ ID NO: 101240 - RNA, 18 nt, Human
uggaggaggacccuccau

SEQ ID NO: 101241 - RNA, 21 nt, Human
ugggaaggagaaggagaagcc

SEQ ID NO: 101242 - RNA, 20 nt, Human
uggggggaaaggcuccacgg

SEQ ID NO: 101243 - RNA, 21 nt, Human
uguccagaagggaaauggcag

SEQ ID NO: 101244 - RNA, 21 nt, Human
uguccagaagggaaauggcag

SEQ ID NO: 101245 - RNA, 24 nt, Human
uuccauggcagccacuccauugcu

SEQ ID NO: 101246 - RNA, 21 nt, Human
uuccuguauaaaaaaggaccc

SEQ ID NO: 101247 - RNA, 23 nt, Human
uuuaaaaaaaaaaaaaagaccau

SEQ ID NO: 101248 - RNA, 23 nt, Human
uuuaaaaaaaaaaaaaagaccau

SEQ ID NO: 101249 - RNA, 23 nt, Human
caggcacccccacugucucaccc

SEQ ID NO: 101250 - RNA, 22 nt, Human
ccaggcacccccacugucucac

SEQ ID NO: 101251 - RNA, 21 nt, Human
ccccacugucucaccccucuc

SEQ ID NO: 101252 - RNA, 20 nt, Human
uggaggccgggggucccggg

SEQ ID NO: 101253 - RNA, 21 nt, Human
aaauccaaacaccgcggccuc

SEQ ID NO: 101254 - RNA, 18 nt, Human
acaggagggaagauggug

SEQ ID NO: 101255 - RNA, 21 nt, Human
acaugacaggagcaacaagaa

SEQ ID NO: 101256 - RNA, 23 nt, Human
acuccacgcccagcaaauccaaa

SEQ ID NO: 101257 - RNA, 22 nt, Human
agacacacaaacccaaggaacg

SEQ ID NO: 101258 - RNA, 29 nt, Human
agacaggaggaaaaaugaagagggacccc

SEQ ID NO: 101259 - RNA, 18 nt, Human
agacaggagggaagaugg

SEQ ID NO: 101260 - RNA, 19 nt, Human
agaugcagacacacaaacc

SEQ ID NO: 101261 - RNA, 19 nt, Human
aggaacaggagagagaggg

SEQ ID NO: 101262 - RNA, 18 nt, Human
aggaagaaggcagacagg

SEQ ID NO: 101263 - RNA, 22 nt, Human
aggaggaaaaaugaagacacaa

SEQ ID NO: 101264 - RNA, 23 nt, Human
aggagggaagauggugacacaug

SEQ ID NO: 101265 - RNA, 26 nt, Human
aggcaaggaaauggauaaaagggacc

SEQ ID NO: 101266 - RNA, 23 nt, Human
aggcagacaggagggaagauggu

SEQ ID NO: 101267 - RNA, 20 nt, Human
agggagagggaggaagaaag

SEQ ID NO: 101268 - RNA, 20 nt, Human
agggcagauggggacacagg

SEQ ID NO: 101269 - RNA, 19 nt, Human
aggggcuggggcgggggau

SEQ ID NO: 101270 - RNA, 22 nt, Human
aggggcuggggcgggggauggg

SEQ ID NO: 101271 - RNA, 22 nt, Human
agucaggaauaaaaaaaugcaa

SEQ ID NO: 101272 - RNA, 19 nt, Human
caagaagggcagaugggga

SEQ ID NO: 101273 - RNA, 21 nt, Human
caagaagggcagauggggaca

SEQ ID NO: 101274 - RNA, 23 nt, Human
cacaaacccaaggaacggaaaau

SEQ ID NO: 101275 - RNA, 22 nt, Human
cagacacacaaacccaaggaac

SEQ ID NO: 101276 - RNA, 18 nt, Human
cagacgggaagagugagg

SEQ ID NO: 101277 - RNA, 22 nt, Human
cagccggggcgcugagcggcgg

SEQ ID NO: 101278 - RNA, 24 nt, Human
ccacgcccagcaaauccaaacacc

SEQ ID NO: 101279 - RNA, 18 nt, Human
cccaaggaacggaaaaug

SEQ ID NO: 101280 - RNA, 24 nt, Human
ccccacuccacgcccagcaaaucc

SEQ ID NO: 101281 - RNA, 18 nt, Human
cccgggcgcgcggacugg

SEQ ID NO: 101282 - RNA, 21 nt, Human
ccgcccagccggggcgcugag

SEQ ID NO: 101283 - RNA, 26 nt, Human
ccuagccccggcccgggcgcgcggac

SEQ ID NO: 101284 - RNA, 18 nt, Human
cggcgccgcugcuacugc

SEQ ID NO: 101285 - RNA, 22 nt, Human
cgggaagagugagguuggagug

SEQ ID NO: 101286 - RNA, 21 nt, Human
cuagccccggcccgggcgcgc

SEQ ID NO: 101287 - RNA, 25 nt, Human
gaaaauggaaaggcagggagaggga

SEQ ID NO: 101288 - RNA, 19 nt, Human
gagaugcagacacacaaac

SEQ ID NO: 101289 - RNA, 24 nt, Human
gagcggcgguaacagcggcggugu

SEQ ID NO: 101290 - RNA, 26 nt, Human
gaggaagaaagagaggaacaggagag

SEQ ID NO: 101291 - RNA, 20 nt, Human
gagugagguuggagugccuu

SEQ ID NO: 101292 - RNA, 24 nt, Human
gagugugugucaggggcuggggcg

SEQ ID NO: 101293 - RNA, 19 nt, Human
gaucaggggagaggggugu

SEQ ID NO: 101294 - RNA, 18 nt, Human
gcaaauccaaacaccgcg

SEQ ID NO: 101295 - RNA, 20 nt, Human
gcaaggaaauggauaaaacc

SEQ ID NO: 101296 - RNA, 25 nt, Human
gcaaggaaauggauaaaaccgaggg

SEQ ID NO: 101297 - RNA, 20 nt, Human
gcagacagacgggaagagug

SEQ ID NO: 101298 - RNA, 19 nt, Human
gcagacaggaggaaaaaug

SEQ ID NO: 101299 - RNA, 22 nt, Human
gcagauggggacacaggugcag

SEQ ID NO: 101300 - RNA, 20 nt, Human
gcagccccgggggacccggc

SEQ ID NO: 101301 - RNA, 20 nt, Human
gccggggcgcugagcggcgg

SEQ ID NO: 101302 - RNA, 24 nt, Human
gcggcgguggcuuuguggucccgg

SEQ ID NO: 101303 - RNA, 19 nt, Human
gcgggggaugggcgcggcc

SEQ ID NO: 101304 - RNA, 20 nt, Human
gcgguggcuuuguggucccg

SEQ ID NO: 101305 - RNA, 19 nt, Human
ggagagagagagagaggaa

SEQ ID NO: 101306 - RNA, 21 nt, Human
ggagagggaggaagaaagaga

SEQ ID NO: 101307 - RNA, 22 nt, Human
ggaggaagaaggcagacaggag

SEQ ID NO: 101308 - RNA, 25 nt, Human
ggaggagaaacaggggucuacgggg

SEQ ID NO: 101309 - RNA, 23 nt, Human
ggcccgggcgcgcggacuggcgg

SEQ ID NO: 101310 - RNA, 23 nt, Human
ggcgguggcuuuguggucccggg

SEQ ID NO: 101311 - RNA, 23 nt, Human
ggcugaagggaagggggagaccc

SEQ ID NO: 101312 - RNA, 18 nt, Human
ggcuggggcgggggaugg

SEQ ID NO: 101313 - RNA, 18 nt, Human
gggaaugggcugaaggga

SEQ ID NO: 101314 - RNA, 21 nt, Human
gggacccggcgguggggggcc

SEQ ID NO: 101315 - RNA, 19 nt, Human
gggcagauggggacacagg

SEQ ID NO: 101316 - RNA, 19 nt, Human
gggccggcgcccaggcccc

SEQ ID NO: 101317 - RNA, 20 nt, Human
ggggaaugggcugaagggaa

SEQ ID NO: 101318 - RNA, 18 nt, Human
ggggacccggcggugggg

SEQ ID NO: 101319 - RNA, 18 nt, Human
ggggagagggguguggug

SEQ ID NO: 101320 - RNA, 21 nt, Human
ggggggccuagccccggcccg

SEQ ID NO: 101321 - RNA, 21 nt, Human
ggggggccuagccccggcccg

SEQ ID NO: 101322 - RNA, 20 nt, Human
ggucuacgggguacagucag

SEQ ID NO: 101323 - RNA, 21 nt, Human
gugagguuggagugccuuucc

SEQ ID NO: 101324 - RNA, 20 nt, Human
uccaaacaccgcggccucug

SEQ ID NO: 101325 - RNA, 23 nt, Human
uccacgcccagcaaauccaaaca

SEQ ID NO: 101326 - RNA, 20 nt, Human
uccccugaggggcaugggcg

SEQ ID NO: 101327 - RNA, 21 nt, Human
uccuggcaccucagucgaucc

SEQ ID NO: 101328 - RNA, 26 nt, Human
ucuacgggguacagucaggcaagggg

SEQ ID NO: 101329 - RNA, 19 nt, Human
ugacaggagcaacaagaag

SEQ ID NO: 101330 - RNA, 21 nt, Human
ugaucaggggagaggggugug

SEQ ID NO: 101331 - RNA, 22 nt, Human
ugcagacacacaaacccaagga

SEQ ID NO: 101332 - RNA, 19 nt, Human
ugcuacugcagccccgggg

SEQ ID NO: 101333 - RNA, 22 nt, Human
uggggcugcaguuucuccuggc

SEQ ID NO: 101334 - RNA, 18 nt, Human
uuuuuuuuuuuuuuuuug

SEQ ID NO: 101335 - RNA, 20 nt, Human
uuuuuuuuuuuuuuuuugcu

SEQ ID NO: 101336 - RNA, 23 nt, Human
uuuuuuuuuuuuuuuuugcuggg

SEQ ID NO: 101337 - RNA, 20 nt, Human
aggccuccagauagcaaucc

SEQ ID NO: 101338 - RNA, 21 nt, Human
aggccuccagauagcaauccu

SEQ ID NO: 101339 - RNA, 21 nt, Human
cagcagcuggaaggccuccag

SEQ ID NO: 101340 - RNA, 27 nt, Human
ccuccagauagcaauccuccacagcuc

SEQ ID NO: 101341 - RNA, 23 nt, Human
cgccuggacgccgcccgccgcgg

SEQ ID NO: 101342 - RNA, 24 nt, Human
cuccacagcucuguagggcuugcu

SEQ ID NO: 101343 - RNA, 21 nt, Human
cuccagauagcaauccuccac

SEQ ID NO: 101344 - RNA, 22 nt, Human
gccgccgcucgccuacuccggg

SEQ ID NO: 101345 - RNA, 21 nt, Human
gccuccagauagcaauccucc

SEQ ID NO: 101346 - RNA, 21 nt, Human
gcggcgccgcuggggcgggcg

SEQ ID NO: 101347 - RNA, 23 nt, Human
ggaaggccuccagauagcaaucc

SEQ ID NO: 101348 - RNA, 20 nt, Human
ggcgggcggggggugcgcuc

SEQ ID NO: 101349 - RNA, 19 nt, Human
uacuccggggcuccccgga

SEQ ID NO: 101350 - RNA, 20 nt, Human
acauuuaauaaaaauaaccc

SEQ ID NO: 101351 - RNA, 26 nt, Human
aguauugaacuuuucucacuuuggga

SEQ ID NO: 101352 - RNA, 20 nt, Human
auuauuugccuuuuuggcua

SEQ ID NO: 101353 - RNA, 21 nt, Human
ccggcgccguaaagcccgacu

SEQ ID NO: 101354 - RNA, 19 nt, Human
cuuaaagccuccaacaccc

SEQ ID NO: 101355 - RNA, 20 nt, Human
gacaacacgaauuuaaagcu

SEQ ID NO: 101356 - RNA, 23 nt, Human
uaaagcccgacuccagccgaaaa

SEQ ID NO: 101357 - RNA, 22 nt, Human
uaauuuuuauuaaguuuucccu

SEQ ID NO: 101358 - RNA, 20 nt, Human
uaccuuaaagccuccaacac

SEQ ID NO: 101359 - RNA, 23 nt, Human
uaccuuaaagccuccaacaccca

SEQ ID NO: 101360 - RNA, 25 nt, Human
ucccaggacaacacgaauuuaaagc

SEQ ID NO: 101361 - RNA, 21 nt, Human
ucuaaucagaaaaaccagaau

SEQ ID NO: 101362 - RNA, 18 nt, Human
uuaaagccuccaacaccc

SEQ ID NO: 101363 - RNA, 19 nt, Human
uuggcuauuucccucagua

SEQ ID NO: 101364 - RNA, 24 nt, Human
uuuacauguguagaauauuuacaa

SEQ ID NO: 101365 - RNA, 24 nt, Human
aaaauagguacaacuuggaagcca

SEQ ID NO: 101366 - RNA, 21 nt, Human
aacacaaacugugcuagcacu

SEQ ID NO: 101367 - RNA, 18 nt, Human
aacugugcuagcacuuuc

SEQ ID NO: 101368 - RNA, 20 nt, Human
aacugugcuagcacuuucuu

SEQ ID NO: 101369 - RNA, 18 nt, Human
acagucagcccugcagca

SEQ ID NO: 101370 - RNA, 18 nt, Human
agcaaauccacaacacaa

SEQ ID NO: 101371 - RNA, 25 nt, Human
caacagugcauggacaagauuccga

SEQ ID NO: 101372 - RNA, 22 nt, Human
cacaacacaaacugugcuagca

SEQ ID NO: 101373 - RNA, 18 nt, Human
cagacugucacugaaaaa

SEQ ID NO: 101374 - RNA, 18 nt, Human
cagugcauggacaagauu

SEQ ID NO: 101375 - RNA, 22 nt, Human
cauacaaagacaaaugcuugcc

SEQ ID NO: 101376 - RNA, 18 nt, Human
ccucugaggccggagccc

SEQ ID NO: 101377 - RNA, 19 nt, Human
ccugcagcauucgcaacag

SEQ ID NO: 101378 - RNA, 22 nt, Human
uaacuccaaaauagguacaacu

SEQ ID NO: 101379 - RNA, 18 nt, Human
uagcacauucacagcuuc

SEQ ID NO: 101380 - RNA, 24 nt, Human
uauggaaguagcaaauccacaaca

SEQ ID NO: 101381 - RNA, 22 nt, Human
ucacagcuucaacugcuacaga

SEQ ID NO: 101382 - RNA, 21 nt, Human
ugaaaagugguggaacuuggc

SEQ ID NO: 101383 - RNA, 21 nt, Human
ugaaccaugucaaguaaacua

SEQ ID NO: 101384 - RNA, 23 nt, Human
ugccccuagcacauucacagcuu

SEQ ID NO: 101385 - RNA, 21 nt, Human
ugugaaaagugguggaacuug

SEQ ID NO: 101386 - RNA, 19 nt, Human
aaaaaaaaaaauucaacuu

SEQ ID NO: 101387 - RNA, 21 nt, Human
aaacaauggaaccaaaagaaa

SEQ ID NO: 101388 - RNA, 19 nt, Human
aacacaguaaaauucuccu

SEQ ID NO: 101389 - RNA, 19 nt, Human
aagaaaaaaaacacaagag

SEQ ID NO: 101390 - RNA, 25 nt, Human
aagaaaaaaaacacaagagcccuag

SEQ ID NO: 101391 - RNA, 19 nt, Human
aagacagcuccagugcccu

SEQ ID NO: 101392 - RNA, 22 nt, Human
aaugucuccaaacaauggaacc

SEQ ID NO: 101393 - RNA, 21 nt, Human
acauagcagaagaaaaaaaac

SEQ ID NO: 101394 - RNA, 18 nt, Human
accagcaaggacaagaca

SEQ ID NO: 101395 - RNA, 19 nt, Human
agaaaaaaaacacaagagc

SEQ ID NO: 101396 - RNA, 20 nt, Human
agaaaaaaaacacaagagcc

SEQ ID NO: 101397 - RNA, 23 nt, Human
agaaaaaaaacacaagagcccua

SEQ ID NO: 101398 - RNA, 25 nt, Human
agaaaaccagcaaggacaagacagc

SEQ ID NO: 101399 - RNA, 21 nt, Human
agaagaaaaaaaacacaagag

SEQ ID NO: 101400 - RNA, 24 nt, Human
agcagaagaaaaaaaacacaagag

SEQ ID NO: 101401 - RNA, 21 nt, Human
augcuccacuccaguccacuc

SEQ ID NO: 101402 - RNA, 21 nt, Human
caagacagcuccagugcccuc

SEQ ID NO: 101403 - RNA, 26 nt, Human
caagucacauagcagaagaaaaaaaa

SEQ ID NO: 101404 - RNA, 24 nt, Human
cacaagagcccuaguggcaagcgc

SEQ ID NO: 101405 - RNA, 24 nt, Human
cacauagcagaagaaaaaaaacac

SEQ ID NO: 101406 - RNA, 22 nt, Human
cacuccaguccacucagcgggc

SEQ ID NO: 101407 - RNA, 18 nt, Human
cagaagaaaaaaaacaca

SEQ ID NO: 101408 - RNA, 24 nt, Human
cagaagaaaaaaaacacaagagcc

SEQ ID NO: 101409 - RNA, 22 nt, Human
cagcgggcugcucccagagccc

SEQ ID NO: 101410 - RNA, 24 nt, Human
cagucgcugcugccgccgcuccug

SEQ ID NO: 101411 - RNA, 20 nt, Human
cagugcccuccuggucucuc

SEQ ID NO: 101412 - RNA, 19 nt, Human
ccaaacaauggaaccaaaa

SEQ ID NO: 101413 - RNA, 22 nt, Human
ccaaacaauggaaccaaaagaa

SEQ ID NO: 101414 - RNA, 20 nt, Human
ccaaugcuccacuccagucc

SEQ ID NO: 101415 - RNA, 20 nt, Human
ccagaaaaccagcaaggaca

SEQ ID NO: 101416 - RNA, 22 nt, Human
ccauggaaacccucugggaacc

SEQ ID NO: 101417 - RNA, 21 nt, Human
ccccauggaaacccucuggga

SEQ ID NO: 101418 - RNA, 20 nt, Human
cccccagucgcugcugccgc

SEQ ID NO: 101419 - RNA, 28 nt, Human
ccgccgcccccagucgcugcugccgccg

SEQ ID NO: 101420 - RNA, 20 nt, Human
ccgccgccgcccccagucgc

SEQ ID NO: 101421 - RNA, 28 nt, Human
ccgccgccgcccccagucgcugcugccg

SEQ ID NO: 101422 - RNA, 19 nt, Human
ccgcuccugcuccgggucc

SEQ ID NO: 101423 - RNA, 19 nt, Human
ccuguccccucuuccacca

SEQ ID NO: 101424 - RNA, 22 nt, Human
cgccgccgccgcccccagucgc

SEQ ID NO: 101425 - RNA, 21 nt, Human
cucaaaugcccugucuccacc

SEQ ID NO: 101426 - RNA, 21 nt, Human
cuccacuccaguccacucagc

SEQ ID NO: 101427 - RNA, 21 nt, Human
cugcugccgccgcuccugcuc

SEQ ID NO: 101428 - RNA, 24 nt, Human
gaaaaccagcaaggacaagacagc

SEQ ID NO: 101429 - RNA, 19 nt, Human
gacagcuccagugcccucc

SEQ ID NO: 101430 - RNA, 21 nt, Human
gcagaagaaaaaaaacacaag

SEQ ID NO: 101431 - RNA, 18 nt, Human
gcgccgccgccgccccca

SEQ ID NO: 101432 - RNA, 24 nt, Human
gcuccacuccaguccacucagcgg

SEQ ID NO: 101433 - RNA, 19 nt, Human
ggcugcucccagagcccag

SEQ ID NO: 101434 - RNA, 18 nt, Human
uccaacgcgccgccgccg

SEQ ID NO: 101435 - RNA, 22 nt, Human
uccaacgcgccgccgccgcccc

SEQ ID NO: 101436 - RNA, 18 nt, Human
ucgcugcugccgccgcuc

SEQ ID NO: 101437 - RNA, 19 nt, Human
ucgcugcugccgccgcucc

SEQ ID NO: 101438 - RNA, 22 nt, Human
ucgcugcugccgccgcuccugc

SEQ ID NO: 101439 - RNA, 25 nt, Human
ucucucagccaaugcuccacuccag

SEQ ID NO: 101440 - RNA, 22 nt, Human
ugaagaaaccaagaguuugugc

SEQ ID NO: 101441 - RNA, 23 nt, Human
ugccagccccaguguuucugagg

SEQ ID NO: 101442 - RNA, 22 nt, Human
ugcccaggaaugucuccaaaca

SEQ ID NO: 101443 - RNA, 18 nt, Human
uggaaccaaaagaaacac

SEQ ID NO: 101444 - RNA, 19 nt, Human
uggaaccaaaagaaacaca

SEQ ID NO: 101445 - RNA, 22 nt, Human
ugggaaccauccagaaaaccag

SEQ ID NO: 101446 - RNA, 22 nt, Human
uggugggcgagcccauccuccu

SEQ ID NO: 101447 - RNA, 24 nt, Human
aaaacacaaauaauaauuaagaca

SEQ ID NO: 101448 - RNA, 22 nt, Human
aaaaggagaacacgggaugagg

SEQ ID NO: 101449 - RNA, 25 nt, Human
aaacgggaaccaggacacaugggga

SEQ ID NO: 101450 - RNA, 19 nt, Human
aacguuagugccaggaaag

SEQ ID NO: 101451 - RNA, 18 nt, Human
aaggaacugacuucggca

SEQ ID NO: 101452 - RNA, 20 nt, Human
aaggacaagggggagggaca

SEQ ID NO: 101453 - RNA, 21 nt, Human
aaguagcuggcaugaagccgg

SEQ ID NO: 101454 - RNA, 22 nt, Human
acacaaacugagacuaaggcag

SEQ ID NO: 101455 - RNA, 25 nt, Human
accccaccuucccccugccuucaca

SEQ ID NO: 101456 - RNA, 20 nt, Human
acccgcgaacacgcauccuc

SEQ ID NO: 101457 - RNA, 23 nt, Human
acccucacccccacagcuagagg

SEQ ID NO: 101458 - RNA, 24 nt, Human
acucccagccccauaugagcccac

SEQ ID NO: 101459 - RNA, 21 nt, Human
agagaaaacaguccaggccag

SEQ ID NO: 101460 - RNA, 20 nt, Human
agcacacacccgcgaacacg

SEQ ID NO: 101461 - RNA, 19 nt, Human
agcuagaggagggggcggu

SEQ ID NO: 101462 - RNA, 22 nt, Human
aggaaccucucauucaaccgcc

SEQ ID NO: 101463 - RNA, 20 nt, Human
aggagggggcggucgcugcu

SEQ ID NO: 101464 - RNA, 18 nt, Human
aggcagaagauguagagc

SEQ ID NO: 101465 - RNA, 18 nt, Human
aggcuggggggcaggggg

SEQ ID NO: 101466 - RNA, 22 nt, Human
agggggccugugccaccacaug

SEQ ID NO: 101467 - RNA, 21 nt, Human
aggguguggucccugcccucg

SEQ ID NO: 101468 - RNA, 23 nt, Human
agguagaacuagggugcccuucu

SEQ ID NO: 101469 - RNA, 24 nt, Human
auaccccuaacacagagauaaccc

SEQ ID NO: 101470 - RNA, 18 nt, Human
auggggagccgagagaaa

SEQ ID NO: 101471 - RNA, 22 nt, Human
caaauaauaauuaagacacaca

SEQ ID NO: 101472 - RNA, 22 nt, Human
cacaaacugagacuaaggcaga

SEQ ID NO: 101473 - RNA, 23 nt, Human
cacacacccgcgaacacgcaucc

SEQ ID NO: 101474 - RNA, 24 nt, Human
cacacacccgcgaacacgcauccu

SEQ ID NO: 101475 - RNA, 26 nt, Human
cacaccccuccagaggguaccacccc

SEQ ID NO: 101476 - RNA, 22 nt, Human
caccucagagccaccuggagcu

SEQ ID NO: 101477 - RNA, 22 nt, Human
cacuaagcacuucagugccucc

SEQ ID NO: 101478 - RNA, 21 nt, Human
cagagauaaccccacucaagg

SEQ ID NO: 101479 - RNA, 19 nt, Human
cagagccaccuggagcuga

SEQ ID NO: 101480 - RNA, 18 nt, Human
cagaggcuggggggcagg

SEQ ID NO: 101481 - RNA, 18 nt, Human
cagcccuaggcugugcuc

SEQ ID NO: 101482 - RNA, 24 nt, Human
cagcuccggcuccacaaggaacug

SEQ ID NO: 101483 - RNA, 18 nt, Human
caggaccccaccuucccc

SEQ ID NO: 101484 - RNA, 25 nt, Human
caggaccccaccuucccccugccuu

SEQ ID NO: 101485 - RNA, 21 nt, Human
caggggagccaaagagggaaa

SEQ ID NO: 101486 - RNA, 18 nt, Human
caugaagccggcccaccc

SEQ ID NO: 101487 - RNA, 24 nt, Human
ccaaaguuuuugaugaugccccca

SEQ ID NO: 101488 - RNA, 24 nt, Human
ccaaccuuagaggaggugagggga

SEQ ID NO: 101489 - RNA, 19 nt, Human
ccacaugggacccucaccc

SEQ ID NO: 101490 - RNA, 23 nt, Human
ccaccacaugggacccucacccc

SEQ ID NO: 101491 - RNA, 23 nt, Human
ccacccaaccuccgggagggccc

SEQ ID NO: 101492 - RNA, 20 nt, Human
ccacccagcggacaaguggg

SEQ ID NO: 101493 - RNA, 23 nt, Human
ccacucggugaggccccuucaaa

SEQ ID NO: 101494 - RNA, 23 nt, Human
ccagaggcuggggggcagggggc

SEQ ID NO: 101495 - RNA, 19 nt, Human
ccaggaccccaccuucccc

SEQ ID NO: 101496 - RNA, 20 nt, Human
ccaguccauugagcuggggg

SEQ ID NO: 101497 - RNA, 21 nt, Human
cccacagcuagaggagggggc

SEQ ID NO: 101498 - RNA, 18 nt, Human
cccacccaaccuccggga

SEQ ID NO: 101499 - RNA, 21 nt, Human
cccaccuucccccugccuuca

SEQ ID NO: 101500 - RNA, 21 nt, Human
cccagccccauaugagcccac

SEQ ID NO: 101501 - RNA, 20 nt, Human
cccccugccuucacaagaca

SEQ ID NO: 101502 - RNA, 22 nt, Human
ccccuguugucugccgccgcuc

SEQ ID NO: 101503 - RNA, 23 nt, Human
ccgcagaaacaccugugaacgca

SEQ ID NO: 101504 - RNA, 23 nt, Human
ccgcgcccagcuccggcuccaca

SEQ ID NO: 101505 - RNA, 23 nt, Human
ccgggagagaggaaaaggagaac

SEQ ID NO: 101506 - RNA, 18 nt, Human
ccucacccccacagcuag

SEQ ID NO: 101507 - RNA, 21 nt, Human
ccugugacagcgaugggaagg

SEQ ID NO: 101508 - RNA, 24 nt, Human
cgcagcacacacccgcgaacacgc

SEQ ID NO: 101509 - RNA, 20 nt, Human
cgccgcucucucaccuccuc

SEQ ID NO: 101510 - RNA, 20 nt, Human
cggcucugggccgccggccc

SEQ ID NO: 101511 - RNA, 23 nt, Human
cucaacacugagacgggcucccc

SEQ ID NO: 101512 - RNA, 21 nt, Human
cucacccccacagcuagagga

SEQ ID NO: 101513 - RNA, 18 nt, Human
cuccagaggguaccaccc

SEQ ID NO: 101514 - RNA, 18 nt, Human
cugacuucggcagcugcu

SEQ ID NO: 101515 - RNA, 19 nt, Human
cugacuucggcagcugcuc

SEQ ID NO: 101516 - RNA, 23 nt, Human
cugggggugggggugggacaggc

SEQ ID NO: 101517 - RNA, 18 nt, Human
gaaacaccugugaacgca

SEQ ID NO: 101518 - RNA, 21 nt, Human
gaaacaccugugaacgcagca

SEQ ID NO: 101519 - RNA, 20 nt, Human
gaacacgcauccucgcggac

SEQ ID NO: 101520 - RNA, 22 nt, Human
gagaagaaggguagcuggggcu

SEQ ID NO: 101521 - RNA, 24 nt, Human
gagccaccuggagcugagagggua

SEQ ID NO: 101522 - RNA, 19 nt, Human
gagcugggggugggggugg

SEQ ID NO: 101523 - RNA, 23 nt, Human
gcccagcuccggcuccacaagga

SEQ ID NO: 101524 - RNA, 24 nt, Human
gccgccgcucucucaccuccucug

SEQ ID NO: 101525 - RNA, 19 nt, Human
gccggcccacccaaccucc

SEQ ID NO: 101526 - RNA, 23 nt, Human
gcggacacgcagggacacacgcg

SEQ ID NO: 101527 - RNA, 21 nt, Human
gcucugggccgccggcccggg

SEQ ID NO: 101528 - RNA, 23 nt, Human
gcucugggccgccggcccggggu

SEQ ID NO: 101529 - RNA, 22 nt, Human
ggaaccucucauucaaccgccu

SEQ ID NO: 101530 - RNA, 23 nt, Human
ggacaagggggagggacagcagc

SEQ ID NO: 101531 - RNA, 23 nt, Human
ggaggagcugugaaagacacaga

SEQ ID NO: 101532 - RNA, 18 nt, Human
ggaggugaggggacucca

SEQ ID NO: 101533 - RNA, 20 nt, Human
ggcacgcuuggcucggcucu

SEQ ID NO: 101534 - RNA, 18 nt, Human
gggacccucacccccaca

SEQ ID NO: 101535 - RNA, 20 nt, Human
gggcagggggcggccagggu

SEQ ID NO: 101536 - RNA, 22 nt, Human
ggggguaucaagagccaggagg

SEQ ID NO: 101537 - RNA, 20 nt, Human
gggggugggggugggacagg

SEQ ID NO: 101538 - RNA, 20 nt, Human
ggguauguacaugaggaggu

SEQ ID NO: 101539 - RNA, 23 nt, Human
gguacaggggagccaaagaggga

SEQ ID NO: 101540 - RNA, 18 nt, Human
gguaucaagagccaggag

SEQ ID NO: 101541 - RNA, 22 nt, Human
gguuuacagucuagguggagaa

SEQ ID NO: 101542 - RNA, 19 nt, Human
gugcaggucagaggggcca

SEQ ID NO: 101543 - RNA, 31 nt, Human
uaaaacacaaauaauaauuaagacacacaaa

SEQ ID NO: 101544 - RNA, 22 nt, Human
uaaaauaaaaaugcccagcacu

SEQ ID NO: 101545 - RNA, 18 nt, Human
uaaauaauucuaaugcca

SEQ ID NO: 101546 - RNA, 20 nt, Human
uaagacacacaaacugagac

SEQ ID NO: 101547 - RNA, 27 nt, Human
uaauaauuaagacacacaaacugagac

SEQ ID NO: 101548 - RNA, 23 nt, Human
uaccagguccccagcucagcccu

SEQ ID NO: 101549 - RNA, 19 nt, Human
uagcuggcaugaagccggc

SEQ ID NO: 101550 - RNA, 28 nt, Human
uaggaaccucucauucaaccgccuaguu

SEQ ID NO: 101551 - RNA, 18 nt, Human
uauaccccuaacacagag

SEQ ID NO: 101552 - RNA, 25 nt, Human
ucaacacugagacgggcuccccagu

SEQ ID NO: 101553 - RNA, 25 nt, Human
uccaaaguuuuugaugaugccccca

SEQ ID NO: 101554 - RNA, 22 nt, Human
uccaggaaagggggugaauuuc

SEQ ID NO: 101555 - RNA, 22 nt, Human
uccaggaaagggggugaauuuc

SEQ ID NO: 101556 - RNA, 18 nt, Human
ucccagccccauaugagc

SEQ ID NO: 101557 - RNA, 19 nt, Human
uccccuguugucugccgcc

SEQ ID NO: 101558 - RNA, 20 nt, Human
uccucgcggacacgcaggga

SEQ ID NO: 101559 - RNA, 20 nt, Human
ucgcgcuuccaggacugcag

SEQ ID NO: 101560 - RNA, 22 nt, Human
ucuuaggaaccucucauucaac

SEQ ID NO: 101561 - RNA, 24 nt, Human
ucuugugugucccuuccccuucca

SEQ ID NO: 101562 - RNA, 21 nt, Human
ugaaaaagaauucaggucuga

SEQ ID NO: 101563 - RNA, 19 nt, Human
ugaaagacacagaacagua

SEQ ID NO: 101564 - RNA, 19 nt, Human
ugaaagacacagaacagua

SEQ ID NO: 101565 - RNA, 20 nt, Human
ugaagccggcccacccaacc

SEQ ID NO: 101566 - RNA, 29 nt, Human
ugaagggaaaggacaagggggagggaaag

SEQ ID NO: 101567 - RNA, 23 nt, Human
ugagcaccugcuguauauucagc

SEQ ID NO: 101568 - RNA, 18 nt, Human
ugagcugggggugggggu

SEQ ID NO: 101569 - RNA, 22 nt, Human
ugccaggaaagacaacuacucc

SEQ ID NO: 101570 - RNA, 19 nt, Human
ugcccagcacucuuaggaa

SEQ ID NO: 101571 - RNA, 19 nt, Human
ugccucggugccucggcga

SEQ ID NO: 101572 - RNA, 24 nt, Human
uggaagguguuuggggucagaccc

SEQ ID NO: 101573 - RNA, 22 nt, Human
ugggaaggagccacaccccucc

SEQ ID NO: 101574 - RNA, 20 nt, Human
uggggaggaggaaguagcug

SEQ ID NO: 101575 - RNA, 21 nt, Human
uggggaggaggaaguagcugg

SEQ ID NO: 101576 - RNA, 21 nt, Human
ugggggugggacaggcaccuc

SEQ ID NO: 101577 - RNA, 22 nt, Human
ugggggugggggugggacaggc

SEQ ID NO: 101578 - RNA, 19 nt, Human
uguccaggaaaggggguga

SEQ ID NO: 101579 - RNA, 20 nt, Human
uuaaaacacaaauaauaauu

SEQ ID NO: 101580 - RNA, 20 nt, Human
uuaggaaccucucauucaac

SEQ ID NO: 101581 - RNA, 18 nt, Human
uuagugccaggaaagaca

SEQ ID NO: 101582 - RNA, 19 nt, Human
uuuaaagucacuaagaauc

SEQ ID NO: 101583 - RNA, 24 nt, Human
uuuuuuuuuuuuuuuuuuuuaaag

SEQ ID NO: 101584 - RNA, 22 nt, Human
aaaaaaacaaaaccgaacaaaa

SEQ ID NO: 101585 - RNA, 23 nt, Human
aaaaaccuaauugcauaaugcua

SEQ ID NO: 101586 - RNA, 20 nt, Human
aaaacaaaaccgaacaaaac

SEQ ID NO: 101587 - RNA, 19 nt, Human
aaaaccgaacaaaacaaag

SEQ ID NO: 101588 - RNA, 20 nt, Human
aaacaaggaaacauauucuu

SEQ ID NO: 101589 - RNA, 20 nt, Human
aaacaauucaaacccuuccc

SEQ ID NO: 101590 - RNA, 20 nt, Human
aaaccgaacaaaacaaagcg

SEQ ID NO: 101591 - RNA, 23 nt, Human
aaagacacagaccccgacgagcc

SEQ ID NO: 101592 - RNA, 20 nt, Human
aaagcgccccuacgcggccc

SEQ ID NO: 101593 - RNA, 27 nt, Human
aaagcgccccuacgcggcccgaacccc

SEQ ID NO: 101594 - RNA, 19 nt, Human
aacaaagcgccccuacgcg

SEQ ID NO: 101595 - RNA, 22 nt, Human
aagcauagccauauuauuuaac

SEQ ID NO: 101596 - RNA, 24 nt, Human
aaggaaaaaccuaauugcauaaug

SEQ ID NO: 101597 - RNA, 20 nt, Human
acagaccccgacgagccacg

SEQ ID NO: 101598 - RNA, 26 nt, Human
acagcauuuacaaaugcacaaaacaa

SEQ ID NO: 101599 - RNA, 19 nt, Human
acccugcccucccuucccc

SEQ ID NO: 101600 - RNA, 24 nt, Human
agaauaaacuucuuguaaaaauaa

SEQ ID NO: 101601 - RNA, 21 nt, Human
agcaaauaaggaaaaaccuaa

SEQ ID NO: 101602 - RNA, 22 nt, Human
agcaagcggggacaggggaggg

SEQ ID NO: 101603 - RNA, 27 nt, Human
agccccacccugcccucccuuccccaa

SEQ ID NO: 101604 - RNA, 21 nt, Human
agcccguccgagucugggcgg

SEQ ID NO: 101605 - RNA, 21 nt, Human
caaaacaaagcgccccuacgc

SEQ ID NO: 101606 - RNA, 19 nt, Human
caaaaccgaacaaaacaaa

SEQ ID NO: 101607 - RNA, 21 nt, Human
caaaacucccaagcaccucgg

SEQ ID NO: 101608 - RNA, 23 nt, Human
caaggaaacauauucuuaauucg

SEQ ID NO: 101609 - RNA, 24 nt, Human
caauaauuggcaucuuuuucacac

SEQ ID NO: 101610 - RNA, 19 nt, Human
caaugaaauacuguuuaaa

SEQ ID NO: 101611 - RNA, 22 nt, Human
cacagcccgaagugaaaagaaa

SEQ ID NO: 101612 - RNA, 20 nt, Human
caccccgaaaagacgagccc

SEQ ID NO: 101613 - RNA, 18 nt, Human
cacgucaguuccucagcc

SEQ ID NO: 101614 - RNA, 21 nt, Human
cagaucucccaaaugagaaua

SEQ ID NO: 101615 - RNA, 19 nt, Human
cauucaaaacucccaagca

SEQ ID NO: 101616 - RNA, 21 nt, Human
cauuccaugaagucagcgaua

SEQ ID NO: 101617 - RNA, 24 nt, Human
ccaagcaccucggauuuuugcccc

SEQ ID NO: 101618 - RNA, 22 nt, Human
cccacccugcccucccuucccc

SEQ ID NO: 101619 - RNA, 20 nt, Human
ccccuacgcggcccgaaccc

SEQ ID NO: 101620 - RNA, 22 nt, Human
cccuacgcggcccgaaccccuc

SEQ ID NO: 101621 - RNA, 18 nt, Human
cccugcccucccuucccc

SEQ ID NO: 101622 - RNA, 19 nt, Human
ccgcgggucccgcgaaccc

SEQ ID NO: 101623 - RNA, 19 nt, Human
ccuauucuacccaacacag

SEQ ID NO: 101624 - RNA, 22 nt, Human
ccucagccccacccugcccucc

SEQ ID NO: 101625 - RNA, 18 nt, Human
ccucggagccaaaagaca

SEQ ID NO: 101626 - RNA, 25 nt, Human
ccuuuuuuuaguggcccaauauggc

SEQ ID NO: 101627 - RNA, 23 nt, Human
cgaacaaaacaaagcgccccuac

SEQ ID NO: 101628 - RNA, 21 nt, Human
cgaacccagccgcucuccaaa

SEQ ID NO: 101629 - RNA, 24 nt, Human
cggcccgaaccccucucggaagcc

SEQ ID NO: 101630 - RNA, 18 nt, Human
cggcccgagcucuaggag

SEQ ID NO: 101631 - RNA, 18 nt, Human
cggggacaggggaggggg

SEQ ID NO: 101632 - RNA, 21 nt, Human
cucagccccacccugcccucc

SEQ ID NO: 101633 - RNA, 20 nt, Human
cucccgggucugcacgaccg

SEQ ID NO: 101634 - RNA, 26 nt, Human
cucgcacucucaaaaaaacaaaaccc

SEQ ID NO: 101635 - RNA, 18 nt, Human
cucucaaaaaaacaaaac

SEQ ID NO: 101636 - RNA, 21 nt, Human
gaaccccucucggaagcccag

SEQ ID NO: 101637 - RNA, 20 nt, Human
gacacagaccccgacgagcc

SEQ ID NO: 101638 - RNA, 20 nt, Human
gaccgccucucucgcacucu

SEQ ID NO: 101639 - RNA, 23 nt, Human
gagcaagcggggacaggggaggg

SEQ ID NO: 101640 - RNA, 21 nt, Human
gagccacggcccgagcucuag

SEQ ID NO: 101641 - RNA, 22 nt, Human
gaguaagcuuuaaauuaaaaaa

SEQ ID NO: 101642 - RNA, 19 nt, Human
gaucauuuaagagugccua

SEQ ID NO: 101643 - RNA, 21 nt, Human
gcccgaaccccucucggaagc

SEQ ID NO: 101644 - RNA, 23 nt, Human
gcccgaaccccucucggaagccc

SEQ ID NO: 101645 - RNA, 19 nt, Human
ggagggcagugaggauagg

SEQ ID NO: 101646 - RNA, 19 nt, Human
ggagggcggagaggagagg

SEQ ID NO: 101647 - RNA, 21 nt, Human
gggaagccccggcccggccgc

SEQ ID NO: 101648 - RNA, 24 nt, Human
gggaagccccggcccggccgccga

SEQ ID NO: 101649 - RNA, 19 nt, Human
guguuguuguuuuucagug

SEQ ID NO: 101650 - RNA, 21 nt, Human
uaaacaaggaaacauauucuu

SEQ ID NO: 101651 - RNA, 21 nt, Human
uaaagaaaacaauucaaaccc

SEQ ID NO: 101652 - RNA, 24 nt, Human
uaagagagacuggggagggcagug

SEQ ID NO: 101653 - RNA, 21 nt, Human
uauggcgguggaagggaggcu

SEQ ID NO: 101654 - RNA, 21 nt, Human
ucacuuauccuacaagugugc

SEQ ID NO: 101655 - RNA, 23 nt, Human
uccaacgcuuuuagaggcagauc

SEQ ID NO: 101656 - RNA, 23 nt, Human
uccccaaaauugcuucucuucau

SEQ ID NO: 101657 - RNA, 25 nt, Human
ucucucgcacucucaaaaaaacaaa

SEQ ID NO: 101658 - RNA, 19 nt, Human
ugaaaagaaaaugagaaaa

SEQ ID NO: 101659 - RNA, 23 nt, Human
ugaaguaucagcugucucugaaa

SEQ ID NO: 101660 - RNA, 20 nt, Human
ugccacuuuggcuuguauau

SEQ ID NO: 101661 - RNA, 18 nt, Human
ugcugaguaauuaacugg

SEQ ID NO: 101662 - RNA, 22 nt, Human
uggggagggcagugaggauagg

SEQ ID NO: 101663 - RNA, 22 nt, Human
uguaacaauaauuggcaucuuu

SEQ ID NO: 101664 - RNA, 24 nt, Human
uuacacagcccgaagugaaaagaa

SEQ ID NO: 101665 - RNA, 23 nt, Human
uuacaucuuuaaagaaaacaauu

SEQ ID NO: 101666 - RNA, 19 nt, Human
uuaguauaauuuuucagug

SEQ ID NO: 101667 - RNA, 27 nt, Human
uucaaaacucccaagcaccucggauuu

SEQ ID NO: 101668 - RNA, 20 nt, Human
uucaaaugguuuuuccauac

SEQ ID NO: 101669 - RNA, 20 nt, Human
uucauguauaucuuccuugc

SEQ ID NO: 101670 - RNA, 23 nt, Human
uuccucagccccacccugcccuc

SEQ ID NO: 101671 - RNA, 21 nt, Human
uuuaaugugaaguuacuuaau

SEQ ID NO: 101672 - RNA, 18 nt, Human
uuucauguauaucuuccu

SEQ ID NO: 101673 - RNA, 23 nt, Human
uuuuuuuuuuuuuuagcuaugga

SEQ ID NO: 101674 - RNA, 19 nt, Human
aagaaggggaaaggagagg

SEQ ID NO: 101675 - RNA, 19 nt, Human
agaggaggagagggcggag

SEQ ID NO: 101676 - RNA, 22 nt, Human
agaggaggagagggcggaggcc

SEQ ID NO: 101677 - RNA, 21 nt, Human
agcgagaagaaggggaaagga

SEQ ID NO: 101678 - RNA, 23 nt, Human
caaaauuuaaaaacaaaaccgaa

SEQ ID NO: 101679 - RNA, 19 nt, Human
cagccgccgccgguugcug

SEQ ID NO: 101680 - RNA, 22 nt, Human
cagccgcgcccccucgaugccu

SEQ ID NO: 101681 - RNA, 25 nt, Human
ccagcgcccuuccaacguccgcugc

SEQ ID NO: 101682 - RNA, 19 nt, Human
ccgcgccgcccgacucugc

SEQ ID NO: 101683 - RNA, 23 nt, Human
ccgcgccgcccgacucugcgugu

SEQ ID NO: 101684 - RNA, 20 nt, Human
ccgcugccccggcagguucc

SEQ ID NO: 101685 - RNA, 23 nt, Human
ccggacggcagccgcgcccccuc

SEQ ID NO: 101686 - RNA, 19 nt, Human
cggacggcagccgcgcccc

SEQ ID NO: 101687 - RNA, 18 nt, Human
cguccggacggcagccgc

SEQ ID NO: 101688 - RNA, 20 nt, Human
cgugcagaauacauuuagau

SEQ ID NO: 101689 - RNA, 21 nt, Human
cucgcucgaggggugcccgga

SEQ ID NO: 101690 - RNA, 23 nt, Human
cuguccggugguggacucuucug

SEQ ID NO: 101691 - RNA, 19 nt, Human
gaaaggagaggaggagagg

SEQ ID NO: 101692 - RNA, 19 nt, Human
gaaaggagaggaggagagg

SEQ ID NO: 101693 - RNA, 18 nt, Human
gaggagagggcggaggcc

SEQ ID NO: 101694 - RNA, 18 nt, Human
gaggggugcccggaauuc

SEQ ID NO: 101695 - RNA, 19 nt, Human
gcagguucccucggggcuc

SEQ ID NO: 101696 - RNA, 19 nt, Human
gccgcgcccccucgaugcc

SEQ ID NO: 101697 - RNA, 22 nt, Human
gccgggcgcaagggagaccccg

SEQ ID NO: 101698 - RNA, 19 nt, Human
gcgugugcgagggacgcgg

SEQ ID NO: 101699 - RNA, 21 nt, Human
gggaaaggagaggaggagagg

SEQ ID NO: 101700 - RNA, 18 nt, Human
ggggaaaggagaggagga

SEQ ID NO: 101701 - RNA, 23 nt, Human
ggggaaaggagaggaggagaggg

SEQ ID NO: 101702 - RNA, 21 nt, Human
ucguccggacggcagccgcgc

SEQ ID NO: 101703 - RNA, 23 nt, Human
ugaacggucccagccgaggccca

SEQ ID NO: 101704 - RNA, 21 nt, Human
uucaaaauuuaaaaacaaaac

SEQ ID NO: 101705 - RNA, 20 nt, Human
uuuuauauaaaugacucuua

SEQ ID NO: 101706 - RNA, 19 nt, Human
aaacuacgaaagcggggug

SEQ ID NO: 101707 - RNA, 19 nt, Human
aaacuacgaaagcggggug

SEQ ID NO: 101708 - RNA, 19 nt, Human
aaacuacgaaagcggggug

SEQ ID NO: 101709 - RNA, 20 nt, Human
accaccagcguguccaggaa

SEQ ID NO: 101710 - RNA, 18 nt, Human
acccccacccccacccca

SEQ ID NO: 101711 - RNA, 25 nt, Human
acccccacccccaccccacccccac

SEQ ID NO: 101712 - RNA, 22 nt, Human
acccugucccucaaauccucug

SEQ ID NO: 101713 - RNA, 25 nt, Human
accuucacccccacccccaccccac

SEQ ID NO: 101714 - RNA, 18 nt, Human
acggaaaggaagcuugug

SEQ ID NO: 101715 - RNA, 18 nt, Human
acggccccaggcaucgcg

SEQ ID NO: 101716 - RNA, 24 nt, Human
agagaagccaguaaccccccugag

SEQ ID NO: 101717 - RNA, 24 nt, Human
agagaagccaguaaccccccugag

SEQ ID NO: 101718 - RNA, 24 nt, Human
agagaagccaguaaccccccugag

SEQ ID NO: 101719 - RNA, 25 nt, Human
agagcccccucaccgccaagcagac

SEQ ID NO: 101720 - RNA, 19 nt, Human
agccaguaaccccccugag

SEQ ID NO: 101721 - RNA, 19 nt, Human
agccaguaaccccccugag

SEQ ID NO: 101722 - RNA, 19 nt, Human
agccaguaaccccccugag

SEQ ID NO: 101723 - RNA, 22 nt, Human
agccccuccucuuucuuccucc

SEQ ID NO: 101724 - RNA, 20 nt, Human
agcccugcgcacgcgggaag

SEQ ID NO: 101725 - RNA, 24 nt, Human
agugcucacuccagaaaacuccaa

SEQ ID NO: 101726 - RNA, 24 nt, Human
agugcucacuccagaaaacuccaa

SEQ ID NO: 101727 - RNA, 24 nt, Human
agugcucacuccagaaaacuccaa

SEQ ID NO: 101728 - RNA, 21 nt, Human
auggacauuuacgguaguggg

SEQ ID NO: 101729 - RNA, 21 nt, Human
auggacauuuacgguaguggg

SEQ ID NO: 101730 - RNA, 21 nt, Human
auggacauuuacgguaguggg

SEQ ID NO: 101731 - RNA, 20 nt, Human
caagaaaugcccacaugaau

SEQ ID NO: 101732 - RNA, 20 nt, Human
caagaaaugcccacaugaau

SEQ ID NO: 101733 - RNA, 20 nt, Human
caagaaaugcccacaugaau

SEQ ID NO: 101734 - RNA, 22 nt, Human
caagagaagccaguaacccccc

SEQ ID NO: 101735 - RNA, 22 nt, Human
caagagaagccaguaacccccc

SEQ ID NO: 101736 - RNA, 22 nt, Human
caagagaagccaguaacccccc

SEQ ID NO: 101737 - RNA, 18 nt, Human
cacaccugaagucgcccc

SEQ ID NO: 101738 - RNA, 19 nt, Human
caccccacccccacuccca

SEQ ID NO: 101739 - RNA, 19 nt, Human
caccccacccccacuccca

SEQ ID NO: 101740 - RNA, 20 nt, Human
caccccacccccacucccac

SEQ ID NO: 101741 - RNA, 26 nt, Human
cacccccaccccacccccacucccac

SEQ ID NO: 101742 - RNA, 21 nt, Human
cacccccacccccaccccacc

SEQ ID NO: 101743 - RNA, 30 nt, Human
cacccggaccuccaagaucucggaacgggg

SEQ ID NO: 101744 - RNA, 20 nt, Human
caccgccaagcagaccccca

SEQ ID NO: 101745 - RNA, 21 nt, Human
caccuucacccccacccccac

SEQ ID NO: 101746 - RNA, 22 nt, Human
cagaaaacuccaacacagugaa

SEQ ID NO: 101747 - RNA, 22 nt, Human
cagaauggucagagccagggug

SEQ ID NO: 101748 - RNA, 20 nt, Human
cagccagccccuccucuuuc

SEQ ID NO: 101749 - RNA, 21 nt, Human
cagccccuccucuuucuuccu

SEQ ID NO: 101750 - RNA, 23 nt, Human
cagccgcgcgcagguaccgugcg

SEQ ID NO: 101751 - RNA, 23 nt, Human
cagccgcgcgcagguaccgugcg

SEQ ID NO: 101752 - RNA, 25 nt, Human
cauuuuuaaaagcucuauuuucuaa

SEQ ID NO: 101753 - RNA, 26 nt, Human
cauuuuuaaaagcucuauuuucuaaa

SEQ ID NO: 101754 - RNA, 26 nt, Human
cauuuuuaaaagcucuauuuucuaaa

SEQ ID NO: 101755 - RNA, 19 nt, Human
ccaccccacccccacuccc

SEQ ID NO: 101756 - RNA, 23 nt, Human
ccaguaaccccccugagcuuccc

SEQ ID NO: 101757 - RNA, 23 nt, Human
ccaguaaccccccugagcuuccc

SEQ ID NO: 101758 - RNA, 23 nt, Human
ccaguaaccccccugagcuuccc

SEQ ID NO: 101759 - RNA, 22 nt, Human
cccaccccacccccacucccac

SEQ ID NO: 101760 - RNA, 21 nt, Human
cccacccccaccccaccccca

SEQ ID NO: 101761 - RNA, 23 nt, Human
cccacccccacucccacccggac

SEQ ID NO: 101762 - RNA, 20 nt, Human
ccccaccccacccccacucc

SEQ ID NO: 101763 - RNA, 23 nt, Human
ccccacccccaccccacccccac

SEQ ID NO: 101764 - RNA, 23 nt, Human
ccccaccuucacccccaccccca

SEQ ID NO: 101765 - RNA, 21 nt, Human
cccccaccccacccccacucc

SEQ ID NO: 101766 - RNA, 24 nt, Human
cccccaccccacccccacucccac

SEQ ID NO: 101767 - RNA, 27 nt, Human
cccccacccccaccccacccccacucc

SEQ ID NO: 101768 - RNA, 22 nt, Human
cccccaccuucacccccacccc

SEQ ID NO: 101769 - RNA, 20 nt, Human
cccccacucccacccggacc

SEQ ID NO: 101770 - RNA, 23 nt, Human
cccccacucccacccggaccucc

SEQ ID NO: 101771 - RNA, 20 nt, Human
ccccccaccuucacccccac

SEQ ID NO: 101772 - RNA, 24 nt, Human
cccccuccgacccugucccucaaa

SEQ ID NO: 101773 - RNA, 26 nt, Human
ccccgccgcccgcugccugcucuccc

SEQ ID NO: 101774 - RNA, 21 nt, Human
ccccugagcuucccuaguuca

SEQ ID NO: 101775 - RNA, 22 nt, Human
ccccugagcuucccuaguucac

SEQ ID NO: 101776 - RNA, 22 nt, Human
ccccugagcuucccuaguucac

SEQ ID NO: 101777 - RNA, 22 nt, Human
ccccugagcuucccuaguucac

SEQ ID NO: 101778 - RNA, 22 nt, Human
cccgccuucccugagcgcgccc

SEQ ID NO: 101779 - RNA, 19 nt, Human
cccuccucuuucuuccucc

SEQ ID NO: 101780 - RNA, 21 nt, Human
cccugagcgcgcccgcccccc

SEQ ID NO: 101781 - RNA, 19 nt, Human
cccugcgcacgcgggaagg

SEQ ID NO: 101782 - RNA, 18 nt, Human
ccgcagccgcgcgcaggu

SEQ ID NO: 101783 - RNA, 18 nt, Human
ccgcagccgcgcgcaggu

SEQ ID NO: 101784 - RNA, 23 nt, Human
ccgcaggcgcgcacccgccuucc

SEQ ID NO: 101785 - RNA, 23 nt, Human
ccgccccccaccuucacccccac

SEQ ID NO: 101786 - RNA, 20 nt, Human
ccgccgcccgcugccugcuc

SEQ ID NO: 101787 - RNA, 21 nt, Human
ccgccgcccgcugccugcucu

SEQ ID NO: 101788 - RNA, 24 nt, Human
ccgccgccggcuccaugcugcucc

SEQ ID NO: 101789 - RNA, 22 nt, Human
ccgcugccugcucucccccucu

SEQ ID NO: 101790 - RNA, 24 nt, Human
ccuccaagaucucggaacggcucu

SEQ ID NO: 101791 - RNA, 22 nt, Human
ccuucacccccacccccacccc

SEQ ID NO: 101792 - RNA, 18 nt, Human
cgccccccaccuucaccc

SEQ ID NO: 101793 - RNA, 23 nt, Human
cgccccccaccuucacccccacc

SEQ ID NO: 101794 - RNA, 19 nt, Human
cgccccggcccggugcagc

SEQ ID NO: 101795 - RNA, 22 nt, Human
cgccgcccgcugccugcucucc

SEQ ID NO: 101796 - RNA, 19 nt, Human
cggaacggcucugagcccu

SEQ ID NO: 101797 - RNA, 18 nt, Human
cgggaagggcugccggag

SEQ ID NO: 101798 - RNA, 21 nt, Human
cgggaagggcugccggaggcg

SEQ ID NO: 101799 - RNA, 25 nt, Human
cgguagugggggaaggcauauaucu

SEQ ID NO: 101800 - RNA, 25 nt, Human
cgguagugggggaaggcauauaucu

SEQ ID NO: 101801 - RNA, 25 nt, Human
cgguagugggggaaggcauauaucu

SEQ ID NO: 101802 - RNA, 23 nt, Human
cgguagugggggaaggcuuauau

SEQ ID NO: 101803 - RNA, 19 nt, Human
cuaaaugaaaacuacgaaa

SEQ ID NO: 101804 - RNA, 19 nt, Human
cuaaaugaaaacuacgaaa

SEQ ID NO: 101805 - RNA, 19 nt, Human
cuaaaugaaaacuacgaaa

SEQ ID NO: 101806 - RNA, 21 nt, Human
cucaagagaagccaguaaccc

SEQ ID NO: 101807 - RNA, 21 nt, Human
cucaagagaagccaguaaccc

SEQ ID NO: 101808 - RNA, 21 nt, Human
cucaagagaagccaguaaccc

SEQ ID NO: 101809 - RNA, 22 nt, Human
cucaccgccaagcagaccccca

SEQ ID NO: 101810 - RNA, 22 nt, Human
cuccaugcugcuccccgccgcc

SEQ ID NO: 101811 - RNA, 22 nt, Human
cuccccgccgcccgcugccugc

SEQ ID NO: 101812 - RNA, 18 nt, Human
cuccccgccgccggcucc

SEQ ID NO: 101813 - RNA, 25 nt, Human
cuccggugcuggcggaagagccccc

SEQ ID NO: 101814 - RNA, 21 nt, Human
cugcucucccccucuccgcag

SEQ ID NO: 101815 - RNA, 19 nt, Human
cuggcggaagagcccccuc

SEQ ID NO: 101816 - RNA, 23 nt, Human
cuggugaccagccagccccuccu

SEQ ID NO: 101817 - RNA, 21 nt, Human
cuucucagcauucgagagauc

SEQ ID NO: 101818 - RNA, 22 nt, Human
gaaaacuccaacacagugaaaa

SEQ ID NO: 101819 - RNA, 22 nt, Human
gaaaacuccaacacagugaaaa

SEQ ID NO: 101820 - RNA, 22 nt, Human
gaaaacuccaacacagugaaaa

SEQ ID NO: 101821 - RNA, 21 nt, Human
gaauggucagagccagggugg

SEQ ID NO: 101822 - RNA, 20 nt, Human
gacccugucccucaaauccu

SEQ ID NO: 101823 - RNA, 19 nt, Human
gcagccgccgagcgcacgc

SEQ ID NO: 101824 - RNA, 22 nt, Human
gccccacccucuggugaccagc

SEQ ID NO: 101825 - RNA, 23 nt, Human
gccccaggcaucgcgcacgucca

SEQ ID NO: 101826 - RNA, 22 nt, Human
gcccccucaccgccaagcagac

SEQ ID NO: 101827 - RNA, 24 nt, Human
gcccccucaccgccaagcagaccc

SEQ ID NO: 101828 - RNA, 20 nt, Human
gcccgccccccaccuucacc

SEQ ID NO: 101829 - RNA, 25 nt, Human
gcccgccccccaccuucacccccac

SEQ ID NO: 101830 - RNA, 23 nt, Human
gccgagcgcacgcgguccgcccc

SEQ ID NO: 101831 - RNA, 20 nt, Human
ggaacggcucugagcccugc

SEQ ID NO: 101832 - RNA, 23 nt, Human
ggaggcugcgaggcucgcaagaa

SEQ ID NO: 101833 - RNA, 23 nt, Human
ggaggcugcgaggcucgcaagaa

SEQ ID NO: 101834 - RNA, 23 nt, Human
ggaggcugcgaggcucgcaagaa

SEQ ID NO: 101835 - RNA, 19 nt, Human
ggcagacggccccaggcau

SEQ ID NO: 101836 - RNA, 21 nt, Human
gggcuccgcgccguggagcag

SEQ ID NO: 101837 - RNA, 18 nt, Human
gggucgggugagaguggc

SEQ ID NO: 101838 - RNA, 21 nt, Human
gggucgggugagaguggcggg

SEQ ID NO: 101839 - RNA, 23 nt, Human
ggucagagccagggugggggccg

SEQ ID NO: 101840 - RNA, 20 nt, Human
gguccacgggcagacggccc

SEQ ID NO: 101841 - RNA, 22 nt, Human
guccacgggcagacggccccag

SEQ ID NO: 101842 - RNA, 26 nt, Human
gugcagcaccaccagcguguccagga

SEQ ID NO: 101843 - RNA, 19 nt, Human
guggagcagcagcagcucc

SEQ ID NO: 101844 - RNA, 20 nt, Human
guggagcagcagcagcuccg

SEQ ID NO: 101845 - RNA, 25 nt, Human
ucacccccacccccaccccaccccc

SEQ ID NO: 101846 - RNA, 24 nt, Human
ucacuccagaaaacuccaacacag

SEQ ID NO: 101847 - RNA, 24 nt, Human
ucacuccagaaaacuccaacacag

SEQ ID NO: 101848 - RNA, 24 nt, Human
ucacuccagaaaacuccaacacag

SEQ ID NO: 101849 - RNA, 18 nt, Human
uccaggaagcccucccgg

SEQ ID NO: 101850 - RNA, 20 nt, Human
ucccacccggaccuccaaga

SEQ ID NO: 101851 - RNA, 18 nt, Human
uccccgccgccggcucca

SEQ ID NO: 101852 - RNA, 22 nt, Human
ucccugagcgcgcccgcccccc

SEQ ID NO: 101853 - RNA, 20 nt, Human
uccucuggagggaccgcggu

SEQ ID NO: 101854 - RNA, 28 nt, Human
ucggugacugaugaucuaaguucccgag

SEQ ID NO: 101855 - RNA, 26 nt, Human
ucggugacugaugaucuaaguuuccc

SEQ ID NO: 101856 - RNA, 22 nt, Human
ucucggaacggcucugagcccu

SEQ ID NO: 101857 - RNA, 24 nt, Human
ucuggugaccagccagccccuccu

SEQ ID NO: 101858 - RNA, 19 nt, Human
ugaaaaggcagaagcggug

SEQ ID NO: 101859 - RNA, 19 nt, Human
ugaaaaggcagaagcggug

SEQ ID NO: 101860 - RNA, 19 nt, Human
ugaaaaggcagaagcggug

SEQ ID NO: 101861 - RNA, 24 nt, Human
ugaccagccagccccuccucuuuc

SEQ ID NO: 101862 - RNA, 18 nt, Human
ugcugcuccccgccgccc

SEQ ID NO: 101863 - RNA, 20 nt, Human
ugcugcuccccgccgcccgc

SEQ ID NO: 101864 - RNA, 20 nt, Human
ugcugcuccccgccgcccgc

SEQ ID NO: 101865 - RNA, 19 nt, Human
ugcuggcggaagagccccc

SEQ ID NO: 101866 - RNA, 22 nt, Human
ugcuggcggaagagcccccucc

SEQ ID NO: 101867 - RNA, 18 nt, Human
uggcccagcuccucagcc

SEQ ID NO: 101868 - RNA, 22 nt, Human
uggucagagccagggugggggc

SEQ ID NO: 101869 - RNA, 18 nt, Human
ugugacucaagagaagcc

SEQ ID NO: 101870 - RNA, 18 nt, Human
ugugacucaagagaagcc

SEQ ID NO: 101871 - RNA, 18 nt, Human
ugugacucaagagaagcc

SEQ ID NO: 101872 - RNA, 19 nt, Human
ugugacucaagagaagcca

SEQ ID NO: 101873 - RNA, 19 nt, Human
ugugacucaagagaagcca

SEQ ID NO: 101874 - RNA, 19 nt, Human
ugugacucaagagaagcca

SEQ ID NO: 101875 - RNA, 24 nt, Human
uguuccccccuucagaucuucuca

SEQ ID NO: 101876 - RNA, 27 nt, Human
uucacccccacccccaccccaccccca

SEQ ID NO: 101877 - RNA, 23 nt, Human
uucuuuuuuacauuuuuauaaga

SEQ ID NO: 101878 - RNA, 23 nt, Human
uucuuuuuuacauuuuuauaaga

SEQ ID NO: 101879 - RNA, 20 nt, Human
aaaauaucacaaaaucaaaa

SEQ ID NO: 101880 - RNA, 19 nt, Human
aaaggaaacaaucagaaaa

SEQ ID NO: 101881 - RNA, 22 nt, Human
aaauccgcuucucuguguuuca

SEQ ID NO: 101882 - RNA, 18 nt, Human
aacauuucucaggaguua

SEQ ID NO: 101883 - RNA, 21 nt, Human
aacccgcgggaaucucuccuc

SEQ ID NO: 101884 - RNA, 18 nt, Human
aagaaaaaaauguaugga

SEQ ID NO: 101885 - RNA, 23 nt, Human
aagaaauaaauagguuaagaaga

SEQ ID NO: 101886 - RNA, 21 nt, Human
aagcaacccuggaaauuaaau

SEQ ID NO: 101887 - RNA, 24 nt, Human
aauugcugguauugcuuaugagca

SEQ ID NO: 101888 - RNA, 21 nt, Human
acacucuucccuucuuuccca

SEQ ID NO: 101889 - RNA, 21 nt, Human
acugagagccacuaguuaugu

SEQ ID NO: 101890 - RNA, 18 nt, Human
agaaaaauuuaacaaaga

SEQ ID NO: 101891 - RNA, 18 nt, Human
agaagaaagcaaucuagg

SEQ ID NO: 101892 - RNA, 21 nt, Human
agacaaagaaaaaaauguaug

SEQ ID NO: 101893 - RNA, 24 nt, Human
agacaggcuugcaggcuuacaggc

SEQ ID NO: 101894 - RNA, 20 nt, Human
agauaagacaaagaaaaaaa

SEQ ID NO: 101895 - RNA, 22 nt, Human
aggcuuuccgccgcuccccguu

SEQ ID NO: 101896 - RNA, 22 nt, Human
agggcuuccagagagugucguu

SEQ ID NO: 101897 - RNA, 24 nt, Human
aguacaaaauaucacaaaaucaaa

SEQ ID NO: 101898 - RNA, 21 nt, Human
agugggagauucauccaucgg

SEQ ID NO: 101899 - RNA, 21 nt, Human
auaaaggaaacaaucagaaaa

SEQ ID NO: 101900 - RNA, 21 nt, Human
aucacugccuucucccacuuc

SEQ ID NO: 101901 - RNA, 22 nt, Human
augugugugugugugugugugu

SEQ ID NO: 101902 - RNA, 22 nt, Human
augugugugugugugugugugu

SEQ ID NO: 101903 - RNA, 20 nt, Human
caaguuuuuauacucaaucu

SEQ ID NO: 101904 - RNA, 21 nt, Human
caccaccagcguguccaggaa

SEQ ID NO: 101905 - RNA, 18 nt, Human
cacccugagacacucuau

SEQ ID NO: 101906 - RNA, 30 nt, Human
cacccugagacacucuauaaaggaaacaag

SEQ ID NO: 101907 - RNA, 22 nt, Human
cauccucucuuaccccucugcu

SEQ ID NO: 101908 - RNA, 25 nt, Human
caugugugugugugugugugugugu

SEQ ID NO: 101909 - RNA, 21 nt, Human
ccaccucuuggaguucaaucu

SEQ ID NO: 101910 - RNA, 22 nt, Human
ccccaggcaucgcgcacgucca

SEQ ID NO: 101911 - RNA, 22 nt, Human
cccccagacgcgcagcggcccg

SEQ ID NO: 101912 - RNA, 25 nt, Human
cccccguggcugugcgcagguaccc

SEQ ID NO: 101913 - RNA, 23 nt, Human
cccgugcaguggccgagcggccg

SEQ ID NO: 101914 - RNA, 18 nt, Human
cccuccuccacuuugucc

SEQ ID NO: 101915 - RNA, 22 nt, Human
cccuuaggcuccgcccccuguc

SEQ ID NO: 101916 - RNA, 20 nt, Human
ccgccacgcgggcgcugccc

SEQ ID NO: 101917 - RNA, 27 nt, Human
ccggcgucucccacccccuuaggcucc

SEQ ID NO: 101918 - RNA, 22 nt, Human
ccucacauuuuaacugagagcc

SEQ ID NO: 101919 - RNA, 23 nt, Human
ccuggaaugucacacacuccuaa

SEQ ID NO: 101920 - RNA, 27 nt, Human
cgaccccuggaaugucacacacuccuu

SEQ ID NO: 101921 - RNA, 21 nt, Human
cgacugccgucacccaagugc

SEQ ID NO: 101922 - RNA, 18 nt, Human
cgcagccgagcucaaagc

SEQ ID NO: 101923 - RNA, 19 nt, Human
cgccccggcccggugcagc

SEQ ID NO: 101924 - RNA, 19 nt, Human
cgccuagcgcggacgcagc

SEQ ID NO: 101925 - RNA, 21 nt, Human
cgccuggauugcuucugggaa

SEQ ID NO: 101926 - RNA, 27 nt, Human
cgcucaaacuaaagcgccgccggggac

SEQ ID NO: 101927 - RNA, 21 nt, Human
cggaacccgcgggaaucucuc

SEQ ID NO: 101928 - RNA, 23 nt, Human
cucacuccacuccaccaccucau

SEQ ID NO: 101929 - RNA, 20 nt, Human
cucagcuucauuacccuccc

SEQ ID NO: 101930 - RNA, 18 nt, Human
cucuucccuucuuuccca

SEQ ID NO: 101931 - RNA, 23 nt, Human
cucuucccuucuuucccacgcug

SEQ ID NO: 101932 - RNA, 18 nt, Human
cuucccuucuuucccacg

SEQ ID NO: 101933 - RNA, 19 nt, Human
gaagaaagcaaucuaggcg

SEQ ID NO: 101934 - RNA, 18 nt, Human
gacacucuauaaaggaaa

SEQ ID NO: 101935 - RNA, 19 nt, Human
gcaacgucgcgguggcccc

SEQ ID NO: 101936 - RNA, 22 nt, Human
gcacucucuccuuccuaggaga

SEQ ID NO: 101937 - RNA, 24 nt, Human
gcacuuucccucagaaaacccuga

SEQ ID NO: 101938 - RNA, 23 nt, Human
gcgcagguacccugcaacgucgc

SEQ ID NO: 101939 - RNA, 18 nt, Human
gcgccuggauugcuucug

SEQ ID NO: 101940 - RNA, 20 nt, Human
gcucagcuucauuacccucc

SEQ ID NO: 101941 - RNA, 21 nt, Human
gcuggagugggagauucaucc

SEQ ID NO: 101942 - RNA, 21 nt, Human
gcuuggggccccgugcagugg

SEQ ID NO: 101943 - RNA, 19 nt, Human
ggaaccuggcgucaguccc

SEQ ID NO: 101944 - RNA, 22 nt, Human
ggaguugggcgagggucuccag

SEQ ID NO: 101945 - RNA, 19 nt, Human
ggcagacgaccccaggcau

SEQ ID NO: 101946 - RNA, 19 nt, Human
gggccagauaagacaaaga

SEQ ID NO: 101947 - RNA, 23 nt, Human
gggccagauaagacaaagaaaaa

SEQ ID NO: 101948 - RNA, 19 nt, Human
gggcgagggucuccagggc

SEQ ID NO: 101949 - RNA, 21 nt, Human
gggcuccgcgccguggagcag

SEQ ID NO: 101950 - RNA, 20 nt, Human
ggugggugggggugggaaau

SEQ ID NO: 101951 - RNA, 22 nt, Human
guccacgggcagacgaccccag

SEQ ID NO: 101952 - RNA, 25 nt, Human
gugcagcaccaccagcguguccagg

SEQ ID NO: 101953 - RNA, 19 nt, Human
guggagcagcagcagcucc

SEQ ID NO: 101954 - RNA, 20 nt, Human
guggagcagcagcagcuccg

SEQ ID NO: 101955 - RNA, 19 nt, Human
guggccccgcuccucggcc

SEQ ID NO: 101956 - RNA, 21 nt, Human
gugugugugugugugugugug

SEQ ID NO: 101957 - RNA, 21 nt, Human
gugugugugugugugugugug

SEQ ID NO: 101958 - RNA, 23 nt, Human
uaaaccaaauuacccaccucuug

SEQ ID NO: 101959 - RNA, 22 nt, Human
uaaagucguugugggcggcugg

SEQ ID NO: 101960 - RNA, 25 nt, Human
uaaaucccaaagcagugcaccuuua

SEQ ID NO: 101961 - RNA, 28 nt, Human
uaacaaagaaauaaauagguuaagaaga

SEQ ID NO: 101962 - RNA, 23 nt, Human
uaagacaguugcugaacaacuaa

SEQ ID NO: 101963 - RNA, 25 nt, Human
uagcaugugugugugugugugugug

SEQ ID NO: 101964 - RNA, 18 nt, Human
uagcuccgggcuuuuccu

SEQ ID NO: 101965 - RNA, 22 nt, Human
ucagaaaaauuuaacaaagaaa

SEQ ID NO: 101966 - RNA, 20 nt, Human
ucagaaaacccugaaaagca

SEQ ID NO: 101967 - RNA, 21 nt, Human
ucagaaaacccugaaaagcaa

SEQ ID NO: 101968 - RNA, 21 nt, Human
ucagcagacauuggagugaac

SEQ ID NO: 101969 - RNA, 28 nt, Human
ucauaugcacuuucccucagaaaacccu

SEQ ID NO: 101970 - RNA, 18 nt, Human
uccaggaagcccucccgg

SEQ ID NO: 101971 - RNA, 24 nt, Human
ucccacccccuuaggcuccgcccc

SEQ ID NO: 101972 - RNA, 20 nt, Human
ucccacccccuuaggcuccu

SEQ ID NO: 101973 - RNA, 24 nt, Human
uccuaaauaucccuggaaauccgc

SEQ ID NO: 101974 - RNA, 23 nt, Human
uccucagucuucagguuuuccuu

SEQ ID NO: 101975 - RNA, 20 nt, Human
ucucuguguuucgcuucaug

SEQ ID NO: 101976 - RNA, 22 nt, Human
ucugguggaguugggcgagggu

SEQ ID NO: 101977 - RNA, 23 nt, Human
ugaaaagcaaacgaccccuggaa

SEQ ID NO: 101978 - RNA, 20 nt, Human
ugaaguaucaguuguuccaa

SEQ ID NO: 101979 - RNA, 23 nt, Human
ugaccucugcacccugagacacu

SEQ ID NO: 101980 - RNA, 24 nt, Human
ugaccucugcacccugagacacuc

SEQ ID NO: 101981 - RNA, 18 nt, Human
ugagagaagggaacccug

SEQ ID NO: 101982 - RNA, 22 nt, Human
ugaucaagcaacccuggaaauu

SEQ ID NO: 101983 - RNA, 20 nt, Human
ugcgcagguacccugcaacu

SEQ ID NO: 101984 - RNA, 19 nt, Human
ugcugaacaacuaaaaagu

SEQ ID NO: 101985 - RNA, 20 nt, Human
ugggccaaggggccggcguc

SEQ ID NO: 101986 - RNA, 23 nt, Human
ugggugggggugggaaauugggu

SEQ ID NO: 101987 - RNA, 23 nt, Human
ugucacacacuccuaaauauccc

SEQ ID NO: 101988 - RNA, 20 nt, Human
ugugggcggcuggggaaccu

SEQ ID NO: 101989 - RNA, 18 nt, Human
ugugugugugugugugug

SEQ ID NO: 101990 - RNA, 18 nt, Human
ugugugugugugugugug

SEQ ID NO: 101991 - RNA, 18 nt, Human
ugugugugugugugugug

SEQ ID NO: 101992 - RNA, 18 nt, Human
ugugugugugugugugug

SEQ ID NO: 101993 - RNA, 18 nt, Human
ugugugugugugugugug

SEQ ID NO: 101994 - RNA, 18 nt, Human
ugugugugugugugugug

SEQ ID NO: 101995 - RNA, 18 nt, Human
ugugugugugugugugug

SEQ ID NO: 101996 - RNA, 21 nt, Human
ugugugugugugugugugugu

SEQ ID NO: 101997 - RNA, 21 nt, Human
ugugugugugugugugugugu

SEQ ID NO: 101998 - RNA, 21 nt, Human
ugugugugugugugugugugu

SEQ ID NO: 101999 - RNA, 21 nt, Human
ugugugugugugugugugugu

SEQ ID NO: 102000 - RNA, 21 nt, Human
ugugugugugugugugugugu

SEQ ID NO: 102001 - RNA, 21 nt, Human
ugugugugugugugugugugu

SEQ ID NO: 102002 - RNA, 21 nt, Human
ugugugugugugugugugugu

SEQ ID NO: 102003 - RNA, 21 nt, Human
ugugugugugugugugugugu

SEQ ID NO: 102004 - RNA, 21 nt, Human
ugugugugugugugugugugu

SEQ ID NO: 102005 - RNA, 22 nt, Human
ugugugugugugugugugugug

SEQ ID NO: 102006 - RNA, 22 nt, Human
ugugugugugugugugugugug

SEQ ID NO: 102007 - RNA, 22 nt, Human
ugugugugugugugugugugug

SEQ ID NO: 102008 - RNA, 22 nt, Human
ugugugugugugugugugugug

SEQ ID NO: 102009 - RNA, 26 nt, Human
uuucccucagaaaacccugaaaagca

SEQ ID NO: 102010 - RNA, 19 nt, Human
uuucuuagucugaccucug

SEQ ID NO: 102011 - RNA, 23 nt, Human
uuuuaugaauugcugguauugcu

SEQ ID NO: 102012 - RNA, 21 nt, Human
uuuuuuuuuuuuuuuuuuaca

SEQ ID NO: 102013 - RNA, 21 nt, Human
aaaaacaaagucuucaacuug

SEQ ID NO: 102014 - RNA, 25 nt, Human
aaaaacaaagucuucaacuugggug

SEQ ID NO: 102015 - RNA, 23 nt, Human
aacaaaugacauuaaaagucagg

SEQ ID NO: 102016 - RNA, 23 nt, Human
agacaaaagcaucaggacaaacc

SEQ ID NO: 102017 - RNA, 31 nt, Human
agagagacacacagacacacauacauuccuu

SEQ ID NO: 102018 - RNA, 24 nt, Human
agcaagggaaaagccaaggaaaga

SEQ ID NO: 102019 - RNA, 18 nt, Human
agccauuggagaggggcu

SEQ ID NO: 102020 - RNA, 18 nt, Human
agccucagaggccguggg

SEQ ID NO: 102021 - RNA, 22 nt, Human
aggcgaacgggaguagcaguuc

SEQ ID NO: 102022 - RNA, 24 nt, Human
aggggcagguccuccagggggcuc

SEQ ID NO: 102023 - RNA, 26 nt, Human
aguccuggguccuccgcugcugggag

SEQ ID NO: 102024 - RNA, 22 nt, Human
caaaugacauuaaaagucagga

SEQ ID NO: 102025 - RNA, 19 nt, Human
caccgcucccagugacagu

SEQ ID NO: 102026 - RNA, 21 nt, Human
caccgcucccagugacaguuu

SEQ ID NO: 102027 - RNA, 26 nt, Human
cacucccucccuugcugcuuuuuucg

SEQ ID NO: 102028 - RNA, 23 nt, Human
cacugggcagcccccccgggaac

SEQ ID NO: 102029 - RNA, 18 nt, Human
cagagagacacacagaca

SEQ ID NO: 102030 - RNA, 19 nt, Human
cagcugugcccuggagcag

SEQ ID NO: 102031 - RNA, 22 nt, Human
caggacaaaccauuuuaaaaac

SEQ ID NO: 102032 - RNA, 23 nt, Human
cagguuaaaaagauguugcuuaa

SEQ ID NO: 102033 - RNA, 19 nt, Human
ccccccuagaucgccgguc

SEQ ID NO: 102034 - RNA, 19 nt, Human
cccccgggaacuucccgcc

SEQ ID NO: 102035 - RNA, 19 nt, Human
cccccuagaucgccggucc

SEQ ID NO: 102036 - RNA, 19 nt, Human
ccccgccgagccucagagg

SEQ ID NO: 102037 - RNA, 21 nt, Human
ccccuagaucgccggucccug

SEQ ID NO: 102038 - RNA, 23 nt, Human
cccgccaggucccgggacucccg

SEQ ID NO: 102039 - RNA, 21 nt, Human
cccgcccgccaggcagccgca

SEQ ID NO: 102040 - RNA, 23 nt, Human
cccgggacucccggcagcccgag

SEQ ID NO: 102041 - RNA, 24 nt, Human
cccuacaggcacuugcgugucgcc

SEQ ID NO: 102042 - RNA, 23 nt, Human
cccuagaucgccggucccugcuc

SEQ ID NO: 102043 - RNA, 19 nt, Human
ccgcuguccuuuccuuccu

SEQ ID NO: 102044 - RNA, 19 nt, Human
ccggccugugccccuuugc

SEQ ID NO: 102045 - RNA, 20 nt, Human
ccuagaucgccggucccugc

SEQ ID NO: 102046 - RNA, 19 nt, Human
ccuccuuggccgcaccgcu

SEQ ID NO: 102047 - RNA, 23 nt, Human
cgccgcgguggcuggaugcugac

SEQ ID NO: 102048 - RNA, 22 nt, Human
cgccggucccugcuccuuucac

SEQ ID NO: 102049 - RNA, 26 nt, Human
cgccucgcuuuuuuagcuuaaccccu

SEQ ID NO: 102050 - RNA, 19 nt, Human
cgcuacagaucucugugag

SEQ ID NO: 102051 - RNA, 22 nt, Human
cggacagggcagccgccagcca

SEQ ID NO: 102052 - RNA, 18 nt, Human
cggagcccggacugcugg

SEQ ID NO: 102053 - RNA, 23 nt, Human
cggcagcccgaggaaggagagug

SEQ ID NO: 102054 - RNA, 24 nt, Human
cgggaacuucccgccuacgaccga

SEQ ID NO: 102055 - RNA, 23 nt, Human
cgggacucccggcagcccgagga

SEQ ID NO: 102056 - RNA, 24 nt, Human
cgggccaagccgugggcuaaugcc

SEQ ID NO: 102057 - RNA, 23 nt, Human
cguccgggccaagccgugggcua

SEQ ID NO: 102058 - RNA, 19 nt, Human
cugagccauuggagagggg

SEQ ID NO: 102059 - RNA, 27 nt, Human
cuucacucccucccuugcugcuuuuuu

SEQ ID NO: 102060 - RNA, 22 nt, Human
cuuuccuuccuuucccgguuuu

SEQ ID NO: 102061 - RNA, 22 nt, Human
gacauuaaaagucaggagagcu

SEQ ID NO: 102062 - RNA, 22 nt, Human
gacuccacagagagacacacag

SEQ ID NO: 102063 - RNA, 25 nt, Human
gagccucagaggccgugggagccgg

SEQ ID NO: 102064 - RNA, 18 nt, Human
gcaagggaaaagccaagg

SEQ ID NO: 102065 - RNA, 19 nt, Human
gccaaggaaagauaaaaua

SEQ ID NO: 102066 - RNA, 20 nt, Human
gccgcagccccgccgagccu

SEQ ID NO: 102067 - RNA, 23 nt, Human
gcggacagggcagccgccagcca

SEQ ID NO: 102068 - RNA, 22 nt, Human
gcugccgggcgugcggcgggcc

SEQ ID NO: 102069 - RNA, 23 nt, Human
ggaaagcgucuacggagcccgga

SEQ ID NO: 102070 - RNA, 18 nt, Human
ggcagcacugcuuccucc

SEQ ID NO: 102071 - RNA, 23 nt, Human
ggcaucggagacugacagaagga

SEQ ID NO: 102072 - RNA, 18 nt, Human
ggcgggcccccgagaagc

SEQ ID NO: 102073 - RNA, 19 nt, Human
gggcagguccuccaggggg

SEQ ID NO: 102074 - RNA, 25 nt, Human
gggcagguccuccagggggcucggu

SEQ ID NO: 102075 - RNA, 22 nt, Human
gggcgugcggcgggcccccgag

SEQ ID NO: 102076 - RNA, 26 nt, Human
gugccgguuucuucucccuuuuuucc

SEQ ID NO: 102077 - RNA, 21 nt, Human
guuuuaaggaggcucggcaga

SEQ ID NO: 102078 - RNA, 19 nt, Human
uaaaaacaaagucuucaac

SEQ ID NO: 102079 - RNA, 19 nt, Human
uaaaguagaggcaacgugg

SEQ ID NO: 102080 - RNA, 25 nt, Human
uaacaaaugacauuaaaagucagga

SEQ ID NO: 102081 - RNA, 21 nt, Human
uaagaucugccugccaaaagc

SEQ ID NO: 102082 - RNA, 19 nt, Human
uacaggucguaacgauugc

SEQ ID NO: 102083 - RNA, 21 nt, Human
uaccuacgcuacagaucucug

SEQ ID NO: 102084 - RNA, 23 nt, Human
uacggagcccggacugcuggggc

SEQ ID NO: 102085 - RNA, 26 nt, Human
uacggagcccggacugcuggggcagc

SEQ ID NO: 102086 - RNA, 23 nt, Human
uagcuuaaccccuaugaagaauu

SEQ ID NO: 102087 - RNA, 21 nt, Human
uaggcacucauugagcugcug

SEQ ID NO: 102088 - RNA, 19 nt, Human
uaucugcaauuacauguua

SEQ ID NO: 102089 - RNA, 20 nt, Human
ucagagagggugccgguuuc

SEQ ID NO: 102090 - RNA, 20 nt, Human
ucagcagccucggcgcccgg

SEQ ID NO: 102091 - RNA, 21 nt, Human
ucaggaaagcuccggagcccg

SEQ ID NO: 102092 - RNA, 20 nt, Human
uccagaagagccuuuggucg

SEQ ID NO: 102093 - RNA, 18 nt, Human
uccuggguccuccgcugc

SEQ ID NO: 102094 - RNA, 24 nt, Human
ucgccggucccugcuccuuucacc

SEQ ID NO: 102095 - RNA, 19 nt, Human
ucguuuuucuuuuuccccu

SEQ ID NO: 102096 - RNA, 19 nt, Human
ucuccagaagagccuuugg

SEQ ID NO: 102097 - RNA, 23 nt, Human
ucuccagaagagccuuuggucgc

SEQ ID NO: 102098 - RNA, 21 nt, Human
ucugcaauuacauguuagaac

SEQ ID NO: 102099 - RNA, 23 nt, Human
ugaauuagucguuuuucuuuuuc

SEQ ID NO: 102100 - RNA, 27 nt, Human
ugacagaaggacugggaugguuaaucu

SEQ ID NO: 102101 - RNA, 23 nt, Human
ugacauuaaaagucaggagagcu

SEQ ID NO: 102102 - RNA, 18 nt, Human
ugagauuggcaaaagggg

SEQ ID NO: 102103 - RNA, 25 nt, Human
ugagcugcugccgccgcuguccuuu

SEQ ID NO: 102104 - RNA, 18 nt, Human
ugaggcagaacugcaggg

SEQ ID NO: 102105 - RNA, 19 nt, Human
ugccaaaagcccgccccuc

SEQ ID NO: 102106 - RNA, 21 nt, Human
ugcccagugcucugggcuucu

SEQ ID NO: 102107 - RNA, 19 nt, Human
ugcugcuuuuuucgcugaa

SEQ ID NO: 102108 - RNA, 18 nt, Human
uggcaaaaggggaagcaa

SEQ ID NO: 102109 - RNA, 18 nt, Human
ugggagagcgccgcggug

SEQ ID NO: 102110 - RNA, 23 nt, Human
ugggagagcgccgcgguggcugg

SEQ ID NO: 102111 - RNA, 18 nt, Human
ugggaugguuaaucugga

SEQ ID NO: 102112 - RNA, 24 nt, Human
uuacauguuagaacagauuuugca

SEQ ID NO: 102113 - RNA, 20 nt, Human
uuagcugcuuaacauaugac

SEQ ID NO: 102114 - RNA, 19 nt, Human
uuccccuuuccuuugcucc

SEQ ID NO: 102115 - RNA, 22 nt, Human
uuccuccuuggccgcaccgcuc

SEQ ID NO: 102116 - RNA, 18 nt, Human
uuccugguuaaugacucc

SEQ ID NO: 102117 - RNA, 21 nt, Human
uuccuuucccgguuuuguggg

SEQ ID NO: 102118 - RNA, 22 nt, Human
uucuguugccucucagagaggg

SEQ ID NO: 102119 - RNA, 21 nt, Human
uugaaaaacccgcccccauuu

SEQ ID NO: 102120 - RNA, 22 nt, Human
uugcggcugcacugggcagccc

SEQ ID NO: 102121 - RNA, 24 nt, Human
uugcgugucgcccccuuuuuugcu

SEQ ID NO: 102122 - RNA, 19 nt, Human
uugcuuuuuuccuucacuc

SEQ ID NO: 102123 - RNA, 19 nt, Human
uuggcaaaaggggaagcaa

SEQ ID NO: 102124 - RNA, 19 nt, Human
uuuucuuuuuccccuuucc

SEQ ID NO: 102125 - RNA, 24 nt, Human
uuuugcuuuuuuccuucacucccu

SEQ ID NO: 102126 - RNA, 18 nt, Human
uuuuuuuuccuguuuuga

SEQ ID NO: 102127 - RNA, 18 nt, Human
uuuuuuuuuuuuuuccug

SEQ ID NO: 102128 - RNA, 23 nt, Human
uuuuuuuuuuuuuuuccuguuuu

SEQ ID NO: 102129 - RNA, 25 nt, Human
uuuuuuuuuuuuuuuuuccuguuuu

SEQ ID NO: 102130 - RNA, 24 nt, Human
uuuuuuuuuuuuuuuuuuccuggg

SEQ ID NO: 102131 - RNA, 21 nt, Human
aaaacaaaugagaaacguccc

SEQ ID NO: 102132 - RNA, 21 nt, Human
aaacaaaugagaaacgucccc

SEQ ID NO: 102133 - RNA, 21 nt, Human
aaagccccccgccccgcccca

SEQ ID NO: 102134 - RNA, 18 nt, Human
aacaccuauaagccacaa

SEQ ID NO: 102135 - RNA, 21 nt, Human
aacacucacacccccaaaacc

SEQ ID NO: 102136 - RNA, 22 nt, Human
aacgugcucccggccacgcccc

SEQ ID NO: 102137 - RNA, 27 nt, Human
acacaccaaaaggagugagaaaaacaa

SEQ ID NO: 102138 - RNA, 22 nt, Human
acacccccaaaaccaacaccua

SEQ ID NO: 102139 - RNA, 23 nt, Human
acacucacacccccaaaaccaac

SEQ ID NO: 102140 - RNA, 19 nt, Human
acacuggcggcccucccuc

SEQ ID NO: 102141 - RNA, 22 nt, Human
acagccggccaaggccaccagc

SEQ ID NO: 102142 - RNA, 25 nt, Human
acccccaaaaccaacaccuauaagc

SEQ ID NO: 102143 - RNA, 21 nt, Human
accguuuagguggcuguggcc

SEQ ID NO: 102144 - RNA, 18 nt, Human
agaaaaacaaaugagaaa

SEQ ID NO: 102145 - RNA, 19 nt, Human
agaaaaacaaaugagaaac

SEQ ID NO: 102146 - RNA, 20 nt, Human
agagacuggaaaacaagcuu

SEQ ID NO: 102147 - RNA, 23 nt, Human
agccaacgugcucccggccacgc

SEQ ID NO: 102148 - RNA, 19 nt, Human
agcccggcgcugucagcgc

SEQ ID NO: 102149 - RNA, 18 nt, Human
agcccucccggggcgcgg

SEQ ID NO: 102150 - RNA, 21 nt, Human
aggcgcagaagaaacugaacc

SEQ ID NO: 102151 - RNA, 22 nt, Human
agugagaaaaacaaaugagaaa

SEQ ID NO: 102152 - RNA, 22 nt, Human
augagaaacgucccccaaacac

SEQ ID NO: 102153 - RNA, 24 nt, Human
caaaaccaacaccuauaagccaca

SEQ ID NO: 102154 - RNA, 25 nt, Human
caaaugagaaacgucccccaaacac

SEQ ID NO: 102155 - RNA, 24 nt, Human
caacacaccaaaaggagugagaaa

SEQ ID NO: 102156 - RNA, 25 nt, Human
caacacaccaaaaggagugagaaaa

SEQ ID NO: 102157 - RNA, 22 nt, Human
cacaccaaaaggagugagaaaa

SEQ ID NO: 102158 - RNA, 20 nt, Human
cacacccccaaaaccaacac

SEQ ID NO: 102159 - RNA, 24 nt, Human
cacccccaaaaccaacaccuauaa

SEQ ID NO: 102160 - RNA, 26 nt, Human
cacccccaaaaccaacaccuauaagc

SEQ ID NO: 102161 - RNA, 21 nt, Human
caccccccaugccugaagcaa

SEQ ID NO: 102162 - RNA, 23 nt, Human
cacucacacccccaaaaccaaca

SEQ ID NO: 102163 - RNA, 23 nt, Human
cacuggcggccugcaaagccccc

SEQ ID NO: 102164 - RNA, 25 nt, Human
cagaagaaacugaaccguuuaggug

SEQ ID NO: 102165 - RNA, 20 nt, Human
cagcgcggagcagccggcgg

SEQ ID NO: 102166 - RNA, 21 nt, Human
cagcuucuaggcucccuggag

SEQ ID NO: 102167 - RNA, 22 nt, Human
cagcuucuaggcucccuggagg

SEQ ID NO: 102168 - RNA, 19 nt, Human
caggagaaacaagaagaga

SEQ ID NO: 102169 - RNA, 19 nt, Human
caggucucugagcacagcc

SEQ ID NO: 102170 - RNA, 22 nt, Human
cauaaccccacgggguucucuu

SEQ ID NO: 102171 - RNA, 21 nt, Human
ccaaaaccaacaccuauaagc

SEQ ID NO: 102172 - RNA, 26 nt, Human
ccaaacacucacacccccaaaaccaa

SEQ ID NO: 102173 - RNA, 23 nt, Human
cccaaaaccaacaccuauaagcc

SEQ ID NO: 102174 - RNA, 23 nt, Human
cccaaacacucacacccccaaaa

SEQ ID NO: 102175 - RNA, 25 nt, Human
cccaaacacucacacccccaaaacc

SEQ ID NO: 102176 - RNA, 20 nt, Human
cccagcccgagaccccggcc

SEQ ID NO: 102177 - RNA, 20 nt, Human
cccaugccugaagcaacgug

SEQ ID NO: 102178 - RNA, 19 nt, Human
ccccaaaaccaacaccuau

SEQ ID NO: 102179 - RNA, 25 nt, Human
ccccaaaaccaacaccuauaagcca

SEQ ID NO: 102180 - RNA, 19 nt, Human
ccccaccccccaugccuga

SEQ ID NO: 102181 - RNA, 19 nt, Human
cccccaaaaccaacaccua

SEQ ID NO: 102182 - RNA, 25 nt, Human
cccccaaaaccaacaccuauaagcc

SEQ ID NO: 102183 - RNA, 22 nt, Human
cccccaaacacucacaccccca

SEQ ID NO: 102184 - RNA, 21 nt, Human
ccccccaccccccaugccuga

SEQ ID NO: 102185 - RNA, 24 nt, Human
ccccccaccccccaugccugaagc

SEQ ID NO: 102186 - RNA, 18 nt, Human
ccccccgccccgccccag

SEQ ID NO: 102187 - RNA, 20 nt, Human
cccccgccccgccccagccc

SEQ ID NO: 102188 - RNA, 20 nt, Human
cccccugucagccggaggac

SEQ ID NO: 102189 - RNA, 25 nt, Human
ccccuacugcagcagugggcaggag

SEQ ID NO: 102190 - RNA, 23 nt, Human
cccgagaccccggcccucccggc

SEQ ID NO: 102191 - RNA, 19 nt, Human
cccgcgugcgcugcucucc

SEQ ID NO: 102192 - RNA, 19 nt, Human
cccgcgugcgcugcucucc

SEQ ID NO: 102193 - RNA, 23 nt, Human
cccgcgugcgcugcucucccguc

SEQ ID NO: 102194 - RNA, 19 nt, Human
cccggcccucccggcgggc

SEQ ID NO: 102195 - RNA, 24 nt, Human
ccgccgccgccgcugaggcagccg

SEQ ID NO: 102196 - RNA, 20 nt, Human
ccgcugaggcagccgccagg

SEQ ID NO: 102197 - RNA, 20 nt, Human
ccucccggcgggcuccuccc

SEQ ID NO: 102198 - RNA, 20 nt, Human
ccugcaaagccccccgcccc

SEQ ID NO: 102199 - RNA, 22 nt, Human
ccugcaaagccccccgccccgc

SEQ ID NO: 102200 - RNA, 19 nt, Human
ccugcccggcgcccgcccc

SEQ ID NO: 102201 - RNA, 21 nt, Human
ccuugggucucgucugaggcc

SEQ ID NO: 102202 - RNA, 20 nt, Human
cgacacuggcggcccucccu

SEQ ID NO: 102203 - RNA, 18 nt, Human
cgaggggcugggagccgg

SEQ ID NO: 102204 - RNA, 24 nt, Human
cgccccgccccagcccggcgcugu

SEQ ID NO: 102205 - RNA, 18 nt, Human
cgccgccgccgccgcuga

SEQ ID NO: 102206 - RNA, 24 nt, Human
cgcuccccccaccccccaugccug

SEQ ID NO: 102207 - RNA, 25 nt, Human
cgcuccccccaccccccaugccuga

SEQ ID NO: 102208 - RNA, 22 nt, Human
cggccugcaaagccccccgccc

SEQ ID NO: 102209 - RNA, 22 nt, Human
cggcuccccagcccgagacccc

SEQ ID NO: 102210 - RNA, 24 nt, Human
cgucccccaaacacucacaccccc

SEQ ID NO: 102211 - RNA, 21 nt, Human
cuccccagcccgagaccccgg

SEQ ID NO: 102212 - RNA, 21 nt, Human
cuccccccaccccccaugccu

SEQ ID NO: 102213 - RNA, 21 nt, Human
cucccccuaacucacccuccc

SEQ ID NO: 102214 - RNA, 24 nt, Human
cucccggggcgcggccgcggugca

SEQ ID NO: 102215 - RNA, 18 nt, Human
cucucccgucccggcucc

SEQ ID NO: 102216 - RNA, 21 nt, Human
cucuguccaacacaccaaaag

SEQ ID NO: 102217 - RNA, 18 nt, Human
cugagccugcgccgccgc

SEQ ID NO: 102218 - RNA, 18 nt, Human
cugcaggagcccuucucu

SEQ ID NO: 102219 - RNA, 19 nt, Human
gacacuggcggcccucccu

SEQ ID NO: 102220 - RNA, 18 nt, Human
gagaaaaacaaaugagaa

SEQ ID NO: 102221 - RNA, 19 nt, Human
gagcacagccggccaaggc

SEQ ID NO: 102222 - RNA, 20 nt, Human
gccugcaggagcccuucucu

SEQ ID NO: 102223 - RNA, 18 nt, Human
gcuccccccaccccccau

SEQ ID NO: 102224 - RNA, 22 nt, Human
ggaaaacaagcuuccaacagaa

SEQ ID NO: 102225 - RNA, 18 nt, Human
gggacgcuccccccaccc

SEQ ID NO: 102226 - RNA, 24 nt, Human
gggucucccccuaacucacccucc

SEQ ID NO: 102227 - RNA, 18 nt, Human
uacaacauuuuuuccaau

SEQ ID NO: 102228 - RNA, 20 nt, Human
uacugcagcagugggcagga

SEQ ID NO: 102229 - RNA, 21 nt, Human
uacugcagcagugggcaggag

SEQ ID NO: 102230 - RNA, 22 nt, Human
ucacacccccaaaaccaacacc

SEQ ID NO: 102231 - RNA, 23 nt, Human
uccccagcccgagaccccggccc

SEQ ID NO: 102232 - RNA, 21 nt, Human
ucccccaaacacucacacccc

SEQ ID NO: 102233 - RNA, 20 nt, Human
ucccccuaacucacccuccc

SEQ ID NO: 102234 - RNA, 22 nt, Human
ucccggcuccccagcccgagac

SEQ ID NO: 102235 - RNA, 26 nt, Human
ucugagccugcgccgccgccgccgcu

SEQ ID NO: 102236 - RNA, 24 nt, Human
ucugaggccccagcagccugaggc

SEQ ID NO: 102237 - RNA, 20 nt, Human
ugagaaaaacaaaugagaaa

SEQ ID NO: 102238 - RNA, 21 nt, Human
ugagaaaaacaaaugagaaac

SEQ ID NO: 102239 - RNA, 30 nt, Human
ugagaaaaacaaaugagaaacgucccccaa

SEQ ID NO: 102240 - RNA, 31 nt, Human
ugagaaaaacaaaugagaaacgucccccaaa

SEQ ID NO: 102241 - RNA, 19 nt, Human
ugaggcgcagaagaaacug

SEQ ID NO: 102242 - RNA, 20 nt, Human
ugauuugggacgcucccccc

SEQ ID NO: 102243 - RNA, 23 nt, Human
ugauuugggacgcuccccccacc

SEQ ID NO: 102244 - RNA, 22 nt, Human
ugcagcagugggcaggagaaac

SEQ ID NO: 102245 - RNA, 26 nt, Human
ugcagcagugggcaggagaaacaaga

SEQ ID NO: 102246 - RNA, 19 nt, Human
ugccugaagcaacgugcac

SEQ ID NO: 102247 - RNA, 21 nt, Human
ugcuccuccccuacugcagca

SEQ ID NO: 102248 - RNA, 22 nt, Human
ugggacgcuccccccacccccc

SEQ ID NO: 102249 - RNA, 20 nt, Human
uggguaaaaacauuaaauua

SEQ ID NO: 102250 - RNA, 21 nt, Human
uucacucuuaaaugcucugcc

SEQ ID NO: 102251 - RNA, 19 nt, Human
uucucuugcuggagagggu

SEQ ID NO: 102252 - RNA, 22 nt, Human
uuuuuugaucaugcacaagucu

SEQ ID NO: 102253 - RNA, 20 nt, Human
uuuuuuuuuuuuuuuuuugg

SEQ ID NO: 102254 - RNA, 21 nt, Human
acacuggugguuucauuucaa

SEQ ID NO: 102255 - RNA, 23 nt, Human
gccgccccacgucgagaccagug

SEQ ID NO: 102256 - RNA, 25 nt, Human
uaaaacuuuaggaauaucugcacau

SEQ ID NO: 102257 - RNA, 19 nt, Human
uaugcuagagaacugacau

SEQ ID NO: 102258 - RNA, 22 nt, Human
ucagacauggucauauauaugc

SEQ ID NO: 102259 - RNA, 20 nt, Human
ugacauuucagacaugguca

SEQ ID NO: 102260 - RNA, 25 nt, Human
uugauaacacuggugguuucauuuc

SEQ ID NO: 102261 - RNA, 24 nt, Human
aagaacauacaaaguauacuaaag

SEQ ID NO: 102262 - RNA, 23 nt, Human
aagcagacacacacgcacaaacc

SEQ ID NO: 102263 - RNA, 18 nt, Human
aaggagcugggggcgagg

SEQ ID NO: 102264 - RNA, 20 nt, Human
accaaaguauuuccaaaagc

SEQ ID NO: 102265 - RNA, 21 nt, Human
acccccaggccccuggcagcg

SEQ ID NO: 102266 - RNA, 23 nt, Human
agacacacacgcacaaacccagc

SEQ ID NO: 102267 - RNA, 19 nt, Human
agagacagcaagagaccca

SEQ ID NO: 102268 - RNA, 21 nt, Human
agagacccacccccaggcccc

SEQ ID NO: 102269 - RNA, 21 nt, Human
agcugggggcgagggagccua

SEQ ID NO: 102270 - RNA, 22 nt, Human
aggcaaacauacagcgaaccuu

SEQ ID NO: 102271 - RNA, 18 nt, Human
aggccccuggcagcgcag

SEQ ID NO: 102272 - RNA, 21 nt, Human
aggccccuggcagcgcagugg

SEQ ID NO: 102273 - RNA, 19 nt, Human
caagagacccacccccagg

SEQ ID NO: 102274 - RNA, 19 nt, Human
caauauuuaagaacauaca

SEQ ID NO: 102275 - RNA, 21 nt, Human
cacacacgcacaaacccagca

SEQ ID NO: 102276 - RNA, 18 nt, Human
cacacgcacaaacccagc

SEQ ID NO: 102277 - RNA, 30 nt, Human
cacuuuauuuaaauuauuugguaauuuuaa

SEQ ID NO: 102278 - RNA, 19 nt, Human
cagcaagagacccaccccc

SEQ ID NO: 102279 - RNA, 21 nt, Human
cagcaagagacccacccccag

SEQ ID NO: 102280 - RNA, 19 nt, Human
cagcgcaguggauccggga

SEQ ID NO: 102281 - RNA, 19 nt, Human
cagugggacuuuucuucug

SEQ ID NO: 102282 - RNA, 18 nt, Human
ccccaggccccuggcagc

SEQ ID NO: 102283 - RNA, 19 nt, Human
cccccaggccccuggcagc

SEQ ID NO: 102284 - RNA, 21 nt, Human
cccccaggccccuggcagcgc

SEQ ID NO: 102285 - RNA, 20 nt, Human
ccgcuaagcagacacacacg

SEQ ID NO: 102286 - RNA, 21 nt, Human
ccgugaguuccucuauuauuc

SEQ ID NO: 102287 - RNA, 20 nt, Human
ccuuauaauuagcaucugcc

SEQ ID NO: 102288 - RNA, 23 nt, Human
cgcuaagcagacacacacgcaca

SEQ ID NO: 102289 - RNA, 19 nt, Human
gaaaaaauaaaaucuacag

SEQ ID NO: 102290 - RNA, 19 nt, Human
gagcgagccaaggagcugg

SEQ ID NO: 102291 - RNA, 21 nt, Human
gagcugggggcgagggagccu

SEQ ID NO: 102292 - RNA, 21 nt, Human
gauccgggaucgcuggagacg

SEQ ID NO: 102293 - RNA, 20 nt, Human
gcgagccaaggagcuggggg

SEQ ID NO: 102294 - RNA, 21 nt, Human
ggcaaacauacagcgaaccuu

SEQ ID NO: 102295 - RNA, 23 nt, Human
gggcugcgguggaggagcugagc

SEQ ID NO: 102296 - RNA, 19 nt, Human
guggauccgggaucgcugg

SEQ ID NO: 102297 - RNA, 23 nt, Human
guucagagaccaaaguauuucca

SEQ ID NO: 102298 - RNA, 22 nt, Human
uaagcagacacacacgcacaaa

SEQ ID NO: 102299 - RNA, 25 nt, Human
uaagcagacacacacgcacaaaccc

SEQ ID NO: 102300 - RNA, 24 nt, Human
uagcaguacaaaaucuuugacuau

SEQ ID NO: 102301 - RNA, 24 nt, Human
uagguagccuuuuuguccaaggca

SEQ ID NO: 102302 - RNA, 24 nt, Human
ucacaagacuuucuuuuccucagu

SEQ ID NO: 102303 - RNA, 22 nt, Human
ucacugcugggcugcgguggag

SEQ ID NO: 102304 - RNA, 23 nt, Human
uccaaggcaaacauacagcgaac

SEQ ID NO: 102305 - RNA, 23 nt, Human
uccuccagguaacaaagcaaaca

SEQ ID NO: 102306 - RNA, 19 nt, Human
ucuguuuuuacuucuugcu

SEQ ID NO: 102307 - RNA, 22 nt, Human
ucuucugcaguagcugagggca

SEQ ID NO: 102308 - RNA, 23 nt, Human
ugaaaacccucacugacgcuccu

SEQ ID NO: 102309 - RNA, 21 nt, Human
ugaccaugggacacagacaug

SEQ ID NO: 102310 - RNA, 21 nt, Human
ugagcgagccaaggagcuggg

SEQ ID NO: 102311 - RNA, 21 nt, Human
ugagcgagccaaggagcuggg

SEQ ID NO: 102312 - RNA, 22 nt, Human
uguuguggucuggggaucaugu

SEQ ID NO: 102313 - RNA, 22 nt, Human
uuguuguggucuggggaucaug

SEQ ID NO: 102314 - RNA, 26 nt, Human
uuucuuuuccucagugggacuuuucu

SEQ ID NO: 102315 - RNA, 24 nt, Human
uuuguuguggucuggggaucaugu

SEQ ID NO: 102316 - RNA, 21 nt, Human
uuuuacuucuugcuaauuaca

SEQ ID NO: 102317 - RNA, 21 nt, Human
aaaauauaugucuuccaacua

SEQ ID NO: 102318 - RNA, 20 nt, Human
aaagaaauccaggucuucca

SEQ ID NO: 102319 - RNA, 23 nt, Human
aagucuuccagcaaauccagucu

SEQ ID NO: 102320 - RNA, 24 nt, Human
aauccaugucuuccaauaauuuca

SEQ ID NO: 102321 - RNA, 23 nt, Human
agaaagaaauccaggucuuccag

SEQ ID NO: 102322 - RNA, 22 nt, Human
aguucuuccagaaaaaucuaga

SEQ ID NO: 102323 - RNA, 26 nt, Human
caguaaaucaagucuuccagcaaauc

SEQ ID NO: 102324 - RNA, 22 nt, Human
uccacaucuuccagacaaucca

SEQ ID NO: 102325 - RNA, 25 nt, Human
uccagaaaaaucugugucuuccacc

SEQ ID NO: 102326 - RNA, 18 nt, Human
ucuuccagaaaauccacg

SEQ ID NO: 102327 - RNA, 22 nt, Human
ucuuccagcuaauccaugucuc

SEQ ID NO: 102328 - RNA, 21 nt, Human
uggucuuccaccaaauccaga

SEQ ID NO: 102329 - RNA, 24 nt, Human
uucaaggucuuccaucaaauacag

SEQ ID NO: 102330 - RNA, 18 nt, Human
aaaacucaaggacuugga

SEQ ID NO: 102331 - RNA, 20 nt, Human
aaauuugccaucucaauuug

SEQ ID NO: 102332 - RNA, 21 nt, Human
aacaaagaaggcggggaaaga

SEQ ID NO: 102333 - RNA, 23 nt, Human
aagcccguccccugaucugcgcu

SEQ ID NO: 102334 - RNA, 23 nt, Human
aaguauagcucuucccuccacug

SEQ ID NO: 102335 - RNA, 26 nt, Human
acaaaacucaaggacuuggaguauug

SEQ ID NO: 102336 - RNA, 19 nt, Human
acccuccccggccggggau

SEQ ID NO: 102337 - RNA, 18 nt, Human
agcucuucccuccacugg

SEQ ID NO: 102338 - RNA, 18 nt, Human
aggaacugaagucuaauc

SEQ ID NO: 102339 - RNA, 18 nt, Human
aguaacauuaggcuucag

SEQ ID NO: 102340 - RNA, 20 nt, Human
agugaaggggugcggccgaa

SEQ ID NO: 102341 - RNA, 19 nt, Human
ccagaaguauagcucuucc

SEQ ID NO: 102342 - RNA, 18 nt, Human
ccagagccgcccucgggc

SEQ ID NO: 102343 - RNA, 24 nt, Human
ccagaggccaguuugucaugggau

SEQ ID NO: 102344 - RNA, 22 nt, Human
ccccgggcucuuccccggcccc

SEQ ID NO: 102345 - RNA, 21 nt, Human
ccgucccgccucagccgcugc

SEQ ID NO: 102346 - RNA, 28 nt, Human
ccgucccgccucagccgcugccccgggc

SEQ ID NO: 102347 - RNA, 20 nt, Human
ccucagccagagccgcccuc

SEQ ID NO: 102348 - RNA, 19 nt, Human
ccucgacucgccucgcgcc

SEQ ID NO: 102349 - RNA, 20 nt, Human
ccugaucugcgcugugaggc

SEQ ID NO: 102350 - RNA, 22 nt, Human
cgccgccgucccgccucagccg

SEQ ID NO: 102351 - RNA, 23 nt, Human
cgccucagccgcugccccgggcu

SEQ ID NO: 102352 - RNA, 20 nt, Human
cggaauaaacaaagaaggcg

SEQ ID NO: 102353 - RNA, 22 nt, Human
cgguaucgagggcaagcagcca

SEQ ID NO: 102354 - RNA, 20 nt, Human
cggugcgaacgccuggagcc

SEQ ID NO: 102355 - RNA, 24 nt, Human
cucgcgccuaccgacggccccaac

SEQ ID NO: 102356 - RNA, 23 nt, Human
cucucgaacauucuucguaauga

SEQ ID NO: 102357 - RNA, 18 nt, Human
cugcuggccgagcggcag

SEQ ID NO: 102358 - RNA, 18 nt, Human
cuggggagcuggcagagg

SEQ ID NO: 102359 - RNA, 25 nt, Human
gcaagugagaggauguuuccacagu

SEQ ID NO: 102360 - RNA, 18 nt, Human
gcagaacccuccccggcc

SEQ ID NO: 102361 - RNA, 19 nt, Human
gcagaacccuccccggccg

SEQ ID NO: 102362 - RNA, 23 nt, Human
gcagaggcgcgucuuaccccugu

SEQ ID NO: 102363 - RNA, 22 nt, Human
gcagcggcccccgccgccgucc

SEQ ID NO: 102364 - RNA, 19 nt, Human
gccuaccgacggccccaac

SEQ ID NO: 102365 - RNA, 22 nt, Human
gccucagccccguucccgccgg

SEQ ID NO: 102366 - RNA, 24 nt, Human
gccuggagccggagucucacgcag

SEQ ID NO: 102367 - RNA, 19 nt, Human
gcgggacgcgccgccgccc

SEQ ID NO: 102368 - RNA, 22 nt, Human
ggaaagagugaaggggugcggc

SEQ ID NO: 102369 - RNA, 24 nt, Human
ggaauaaacaaagaaggcggggaa

SEQ ID NO: 102370 - RNA, 20 nt, Human
ggcaagucagccagcucaga

SEQ ID NO: 102371 - RNA, 21 nt, Human
gggcucuuccccggccccucc

SEQ ID NO: 102372 - RNA, 25 nt, Human
gggcucuuccccggccccuccgccc

SEQ ID NO: 102373 - RNA, 20 nt, Human
ggggagcuuaaauggaagug

SEQ ID NO: 102374 - RNA, 21 nt, Human
ggguccggaauaaacaaagaa

SEQ ID NO: 102375 - RNA, 19 nt, Human
ggugcgaacgccuggagcc

SEQ ID NO: 102376 - RNA, 21 nt, Human
uaaauaagcaaagcaaugagg

SEQ ID NO: 102377 - RNA, 25 nt, Human
uaacaagcuaacuuauaucaaacaa

SEQ ID NO: 102378 - RNA, 23 nt, Human
uaacuccaggccuacuucuccag

SEQ ID NO: 102379 - RNA, 20 nt, Human
uaagcaaagcaaugaggcaa

SEQ ID NO: 102380 - RNA, 18 nt, Human
uaaguuaaaagaaugcaa

SEQ ID NO: 102381 - RNA, 22 nt, Human
uagcucuucccuccacuggucc

SEQ ID NO: 102382 - RNA, 24 nt, Human
uaucaaacaaaaauuugccaucuc

SEQ ID NO: 102383 - RNA, 24 nt, Human
uauucaguuggauuuggauauauu

SEQ ID NO: 102384 - RNA, 20 nt, Human
ucaggaacugaagucuaauc

SEQ ID NO: 102385 - RNA, 26 nt, Human
ucccgccucagccgcugccccgggcu

SEQ ID NO: 102386 - RNA, 22 nt, Human
uccucuaccagguuuuccgcca

SEQ ID NO: 102387 - RNA, 19 nt, Human
ucuacaaacacuugucuga

SEQ ID NO: 102388 - RNA, 21 nt, Human
ucucaauuugguauucaguug

SEQ ID NO: 102389 - RNA, 19 nt, Human
ucuccaaagaccggcggcu

SEQ ID NO: 102390 - RNA, 24 nt, Human
ucugcaacaagucaaaaccggggc

SEQ ID NO: 102391 - RNA, 25 nt, Human
ucuucacgccgccgccgggcccaac

SEQ ID NO: 102392 - RNA, 18 nt, Human
ugaggcuccuaggagggc

SEQ ID NO: 102393 - RNA, 22 nt, Human
ugcaagagcagcuuguggcugg

SEQ ID NO: 102394 - RNA, 21 nt, Human
ugccccgggcucuuccccggc

SEQ ID NO: 102395 - RNA, 23 nt, Human
ugccccgggcucuuccccggccc

SEQ ID NO: 102396 - RNA, 22 nt, Human
ugccuuagcuuuguucuaacuc

SEQ ID NO: 102397 - RNA, 18 nt, Human
ugcggccgaaagcccguc

SEQ ID NO: 102398 - RNA, 19 nt, Human
uggaucagagaacugauac

SEQ ID NO: 102399 - RNA, 22 nt, Human
uggcagaggcgcgucuuacccc

SEQ ID NO: 102400 - RNA, 18 nt, Human
ugggagagagaggcgaua

SEQ ID NO: 102401 - RNA, 24 nt, Human
uucccccauacuguaguaacuccc

SEQ ID NO: 102402 - RNA, 21 nt, Human
uuuaguuugaauuugagaaag

SEQ ID NO: 102403 - RNA, 22 nt, Human
uuucauagguagcuuuauuugg

SEQ ID NO: 102404 - RNA, 18 nt, Human
uuugacagccuucugacu

SEQ ID NO: 102405 - RNA, 24 nt, Human
uuugaucuuuccccuuuaguuuga

SEQ ID NO: 102406 - RNA, 19 nt, Human
uuuggcagaacccuccccg

SEQ ID NO: 102407 - RNA, 19 nt, Human
aaaauuaaaagcagcucca

SEQ ID NO: 102408 - RNA, 21 nt, Human
aagcagcuccaagugcaaaag

SEQ ID NO: 102409 - RNA, 22 nt, Human
aagcaggguucugcaggcgggg

SEQ ID NO: 102410 - RNA, 18 nt, Human
aaggcacacugccaggug

SEQ ID NO: 102411 - RNA, 23 nt, Human
acauaucuccaaaacuucaaccc

SEQ ID NO: 102412 - RNA, 22 nt, Human
agaaacauaucuccaaaacuuc

SEQ ID NO: 102413 - RNA, 19 nt, Human
agcgcggcucugggcuccc

SEQ ID NO: 102414 - RNA, 19 nt, Human
aggaggaggagaaggggcg

SEQ ID NO: 102415 - RNA, 23 nt, Human
aggggcggggagaaaaggaggac

SEQ ID NO: 102416 - RNA, 22 nt, Human
agguaggaggaggagaaggggc

SEQ ID NO: 102417 - RNA, 19 nt, Human
auagagcggccgccgcgcc

SEQ ID NO: 102418 - RNA, 23 nt, Human
caccucgcagccgcgcccuggag

SEQ ID NO: 102419 - RNA, 19 nt, Human
cacuucucccugcccgggc

SEQ ID NO: 102420 - RNA, 24 nt, Human
cagguaggaggaggagaaggggcg

SEQ ID NO: 102421 - RNA, 21 nt, Human
ccaggcgcgagcagagaaggc

SEQ ID NO: 102422 - RNA, 20 nt, Human
ccccgcacacuucucccugc

SEQ ID NO: 102423 - RNA, 18 nt, Human
ccccgccaccucgcagcc

SEQ ID NO: 102424 - RNA, 19 nt, Human
cccgccaccucgcagccgc

SEQ ID NO: 102425 - RNA, 22 nt, Human
cccgccgccgcgcaggccccuc

SEQ ID NO: 102426 - RNA, 24 nt, Human
ccgccgccgcgcaggccccucccg

SEQ ID NO: 102427 - RNA, 22 nt, Human
ccuucuugucaguccuucccuc

SEQ ID NO: 102428 - RNA, 19 nt, Human
cgcccuggagucccgcgga

SEQ ID NO: 102429 - RNA, 22 nt, Human
cgcucgaggccgccugcagcga

SEQ ID NO: 102430 - RNA, 18 nt, Human
cggcucugggcucccgcc

SEQ ID NO: 102431 - RNA, 22 nt, Human
cuccucaagcaccccgaaaccc

SEQ ID NO: 102432 - RNA, 18 nt, Human
cucggagccggcuugucc

SEQ ID NO: 102433 - RNA, 18 nt, Human
gagcagagaaggcggaga

SEQ ID NO: 102434 - RNA, 23 nt, Human
gcagaggcccagguaggaggagg

SEQ ID NO: 102435 - RNA, 18 nt, Human
gccccgccaccucgcagc

SEQ ID NO: 102436 - RNA, 23 nt, Human
gcgagcgcggcuccggcggaggu

SEQ ID NO: 102437 - RNA, 19 nt, Human
gcgcggcucugggcucccg

SEQ ID NO: 102438 - RNA, 19 nt, Human
ggaaggaaguucacaucag

SEQ ID NO: 102439 - RNA, 18 nt, Human
ggcggagacgcggccucc

SEQ ID NO: 102440 - RNA, 18 nt, Human
uaggaggaggagaagggg

SEQ ID NO: 102441 - RNA, 25 nt, Human
uaucuccaaaacuucaaccuauugc

SEQ ID NO: 102442 - RNA, 19 nt, Human
ucccgcggagccgcagcca

SEQ ID NO: 102443 - RNA, 20 nt, Human
uccuucccucucuggaucca

SEQ ID NO: 102444 - RNA, 20 nt, Human
ucgcagccgcgcccuggagu

SEQ ID NO: 102445 - RNA, 22 nt, Human
ucucccugcccgggccucccgc

SEQ ID NO: 102446 - RNA, 28 nt, Human
ucugaauaauuccuucuugucaguccuu

SEQ ID NO: 102447 - RNA, 19 nt, Human
ucugucaguguuuuucuga

SEQ ID NO: 102448 - RNA, 22 nt, Human
ucuugucaguccuucccucucu

SEQ ID NO: 102449 - RNA, 19 nt, Human
ugcaagcaggguucugcag

SEQ ID NO: 102450 - RNA, 21 nt, Human
ugccguggcggccuccucaag

SEQ ID NO: 102451 - RNA, 23 nt, Human
ugcuaaaauuaaaagcagcucca

SEQ ID NO: 102452 - RNA, 25 nt, Human
uuuguuaaauauucacaguaauuuc

SEQ ID NO: 102453 - RNA, 25 nt, Human
uuuuuuaaauccaacuaagcccuuu

SEQ ID NO: 102454 - RNA, 24 nt, Human
aaaaaaaaaaaaaaagacagugag

SEQ ID NO: 102455 - RNA, 23 nt, Human
aaaaaaaaaagacagugaguuga

SEQ ID NO: 102456 - RNA, 24 nt, Human
aaaaaaaaaagacagugaguugaa

SEQ ID NO: 102457 - RNA, 27 nt, Human
aaaacaaacacagacacacacacuccu

SEQ ID NO: 102458 - RNA, 22 nt, Human
aaaagaccagguguacaaaaca

SEQ ID NO: 102459 - RNA, 21 nt, Human
aaacaaacacagacacacaca

SEQ ID NO: 102460 - RNA, 26 nt, Human
aaacaaacacagacacacacacuccu

SEQ ID NO: 102461 - RNA, 26 nt, Human
aaagggcucaguuacaguacauucua

SEQ ID NO: 102462 - RNA, 24 nt, Human
acaaaacaucuaagcugugccucc

SEQ ID NO: 102463 - RNA, 22 nt, Human
acaaacacagacacacacacuc

SEQ ID NO: 102464 - RNA, 21 nt, Human
acaaauaaaaaauacccucca

SEQ ID NO: 102465 - RNA, 19 nt, Human
acacaacacagcagcuaca

SEQ ID NO: 102466 - RNA, 21 nt, Human
acagaaggcaacccuucugca

SEQ ID NO: 102467 - RNA, 21 nt, Human
acagcagcuacauggguguuc

SEQ ID NO: 102468 - RNA, 20 nt, Human
accaagaaaacacuccugac

SEQ ID NO: 102469 - RNA, 22 nt, Human
agaaaagaccagguguacaaaa

SEQ ID NO: 102470 - RNA, 23 nt, Human
agaaacaguucaauugauggggg

SEQ ID NO: 102471 - RNA, 19 nt, Human
agaaaggauucagcagcag

SEQ ID NO: 102472 - RNA, 18 nt, Human
agcagccagcccuggagc

SEQ ID NO: 102473 - RNA, 23 nt, Human
agccagcccuggagcucggcccc

SEQ ID NO: 102474 - RNA, 23 nt, Human
agccccgacccgagagcucccuc

SEQ ID NO: 102475 - RNA, 24 nt, Human
agcugggcuugccuuggagaccug

SEQ ID NO: 102476 - RNA, 22 nt, Human
agguguacaaaacaucuaagcu

SEQ ID NO: 102477 - RNA, 18 nt, Human
agugaagaagucauggug

SEQ ID NO: 102478 - RNA, 24 nt, Human
auaaaaaauacccuccaaaaaaaa

SEQ ID NO: 102479 - RNA, 21 nt, Human
augaaggugaacccaucuuau

SEQ ID NO: 102480 - RNA, 23 nt, Human
caaaaaaaaaaaaaaaagacagu

SEQ ID NO: 102481 - RNA, 24 nt, Human
caaaauagucaaggcucuaaucag

SEQ ID NO: 102482 - RNA, 21 nt, Human
cacaaauucuaaacacauaga

SEQ ID NO: 102483 - RNA, 20 nt, Human
cacaacacagcagcuacaug

SEQ ID NO: 102484 - RNA, 22 nt, Human
caccaagaaaacacuccugacu

SEQ ID NO: 102485 - RNA, 25 nt, Human
cacccagugccgucaccgcccuuuc

SEQ ID NO: 102486 - RNA, 19 nt, Human
cacuccugaccugggcaac

SEQ ID NO: 102487 - RNA, 23 nt, Human
cagcagcaagucuacagcacaaa

SEQ ID NO: 102488 - RNA, 25 nt, Human
cagcagcaagucuacagcacaaaca

SEQ ID NO: 102489 - RNA, 19 nt, Human
cagcagcagcaagucuaca

SEQ ID NO: 102490 - RNA, 22 nt, Human
cagccuucccuagccccgaccc

SEQ ID NO: 102491 - RNA, 22 nt, Human
cagcugggcuugccuuggagac

SEQ ID NO: 102492 - RNA, 22 nt, Human
caguguguuuuuucuccagacu

SEQ ID NO: 102493 - RNA, 22 nt, Human
caucuuauaaagcagagcuuac

SEQ ID NO: 102494 - RNA, 20 nt, Human
ccaagaaaacacuccugacc

SEQ ID NO: 102495 - RNA, 21 nt, Human
ccacggccggccccgccccgc

SEQ ID NO: 102496 - RNA, 20 nt, Human
ccccugcucaguucuguucc

SEQ ID NO: 102497 - RNA, 22 nt, Human
cccuccaaaaaaaaaaaaaaaa

SEQ ID NO: 102498 - RNA, 22 nt, Human
ccgagcggggucagccuucccu

SEQ ID NO: 102499 - RNA, 20 nt, Human
ccuagccccgacccgagagc

SEQ ID NO: 102500 - RNA, 20 nt, Human
ccuccaaaaaaaaaaaaaaa

SEQ ID NO: 102501 - RNA, 21 nt, Human
ccuguucuccuggcccugggu

SEQ ID NO: 102502 - RNA, 18 nt, Human
ccuuagcagcccagcagc

SEQ ID NO: 102503 - RNA, 24 nt, Human
ccuucugcagcuccaagcagggau

SEQ ID NO: 102504 - RNA, 20 nt, Human
cggcucugagcggcucacag

SEQ ID NO: 102505 - RNA, 24 nt, Human
cuagaaaagaccagguguacaaaa

SEQ ID NO: 102506 - RNA, 21 nt, Human
cucacaguucccuuagcagcc

SEQ ID NO: 102507 - RNA, 18 nt, Human
cuccaaaaaaaaaaaaaa

SEQ ID NO: 102508 - RNA, 20 nt, Human
cucugagcggcucacaguuc

SEQ ID NO: 102509 - RNA, 25 nt, Human
cugccccugcucaguucuguuccug

SEQ ID NO: 102510 - RNA, 19 nt, Human
cugugccucccaccacagg

SEQ ID NO: 102511 - RNA, 23 nt, Human
cuguucuccuggcccuggguggc

SEQ ID NO: 102512 - RNA, 28 nt, Human
gaacccacaaauaaaaaauacccuccaa

SEQ ID NO: 102513 - RNA, 21 nt, Human
gaagcccucugcucccugccc

SEQ ID NO: 102514 - RNA, 21 nt, Human
gaccuacagaaggcaacccuu

SEQ ID NO: 102515 - RNA, 23 nt, Human
gaugagaaaguccccagaaagga

SEQ ID NO: 102516 - RNA, 24 nt, Human
gcagcagcaagucuacagcacaaa

SEQ ID NO: 102517 - RNA, 20 nt, Human
gcugugccucccaccacagg

SEQ ID NO: 102518 - RNA, 20 nt, Human
ggacucccacggccggcccc

SEQ ID NO: 102519 - RNA, 18 nt, Human
ggagacauuggagccuag

SEQ ID NO: 102520 - RNA, 21 nt, Human
uaccugguuaguaagccucca

SEQ ID NO: 102521 - RNA, 25 nt, Human
uacuuuuguuuuaaaaaaauccaaa

SEQ ID NO: 102522 - RNA, 23 nt, Human
uagcagcccagcagccagcccug

SEQ ID NO: 102523 - RNA, 24 nt, Human
uagcagcgaagccgccggagcagg

SEQ ID NO: 102524 - RNA, 21 nt, Human
uaguaagccuccauuccuccg

SEQ ID NO: 102525 - RNA, 25 nt, Human
uaguaagccuccauuccuccgaccu

SEQ ID NO: 102526 - RNA, 26 nt, Human
uauauacacaacacagcagcuacaug

SEQ ID NO: 102527 - RNA, 21 nt, Human
ucagccuucccuagccccgac

SEQ ID NO: 102528 - RNA, 21 nt, Human
ucaggcaaagggugcaugaac

SEQ ID NO: 102529 - RNA, 21 nt, Human
uccagacuauuauaaauaauu

SEQ ID NO: 102530 - RNA, 18 nt, Human
ucccacggccggccccgc

SEQ ID NO: 102531 - RNA, 24 nt, Human
ucccuagccccgacccgagagcuc

SEQ ID NO: 102532 - RNA, 20 nt, Human
ucggccccacccagugccgu

SEQ ID NO: 102533 - RNA, 24 nt, Human
ucugugucugacugagcccagaaa

SEQ ID NO: 102534 - RNA, 24 nt, Human
ugaaaacacacaguuagguggacc

SEQ ID NO: 102535 - RNA, 22 nt, Human
ugaaauauuacaguguguuuuu

SEQ ID NO: 102536 - RNA, 22 nt, Human
ugacugagcccagaaacaguuc

SEQ ID NO: 102537 - RNA, 23 nt, Human
ugagaaaguccccagaaaggauu

SEQ ID NO: 102538 - RNA, 23 nt, Human
ugaugggggcuggaaccaccaag

SEQ ID NO: 102539 - RNA, 24 nt, Human
ugccgucaccgcccuuucacccgg

SEQ ID NO: 102540 - RNA, 21 nt, Human
ugcgaugaaggugaacccauc

SEQ ID NO: 102541 - RNA, 23 nt, Human
uggaaccaccaagaaaacacucc

SEQ ID NO: 102542 - RNA, 21 nt, Human
uggagcucggccccacccagg

SEQ ID NO: 102543 - RNA, 23 nt, Human
ugggaaagggcucaguuacagua

SEQ ID NO: 102544 - RNA, 21 nt, Human
uggugcaauugaaaucacugu

SEQ ID NO: 102545 - RNA, 21 nt, Human
ugguguggaugcauagaaggc

SEQ ID NO: 102546 - RNA, 23 nt, Human
ugguguggaugcauagaaggcuc

SEQ ID NO: 102547 - RNA, 21 nt, Human
ugguuuuacaacccgugacuu

SEQ ID NO: 102548 - RNA, 18 nt, Human
ugucccugaaaacacacu

SEQ ID NO: 102549 - RNA, 20 nt, Human
uuagugaagaagucauggug

SEQ ID NO: 102550 - RNA, 18 nt, Human
uucaaaauagucaaggcu

SEQ ID NO: 102551 - RNA, 18 nt, Human
uugaacccacaaauaaaa

SEQ ID NO: 102552 - RNA, 18 nt, Human
uuggagaccugccccugc

SEQ ID NO: 102553 - RNA, 19 nt, Human
uuucuagaaaagaccaggu

SEQ ID NO: 102554 - RNA, 23 nt, Human
uuuuuugaacccacaaauaaaaa

SEQ ID NO: 102555 - RNA, 23 nt, Human
acucuuuugggaaggagggaaac

SEQ ID NO: 102556 - RNA, 21 nt, Human
caugcacacacacaacaguug

SEQ ID NO: 102557 - RNA, 24 nt, Human
cccuaugccugggcacuggccuuc

SEQ ID NO: 102558 - RNA, 18 nt, Human
cuuguuugugcccaaggc

SEQ ID NO: 102559 - RNA, 19 nt, Human
ugggaaggagggaaacuga

SEQ ID NO: 102560 - RNA, 25 nt, Human
ugugcccaaggcaugcacacacaca

SEQ ID NO: 102561 - RNA, 25 nt, Human
aagagaagaaaaauuuauucuugaa

SEQ ID NO: 102562 - RNA, 18 nt, Human
acaggccuccagcugcac

SEQ ID NO: 102563 - RNA, 18 nt, Human
accagaccuccugggccc

SEQ ID NO: 102564 - RNA, 18 nt, Human
accugguagggaagacuc

SEQ ID NO: 102565 - RNA, 21 nt, Human
agagcccagugcuaugggcuu

SEQ ID NO: 102566 - RNA, 19 nt, Human
agccacacucccagcaccc

SEQ ID NO: 102567 - RNA, 21 nt, Human
aggagcuggaaggucuuuauc

SEQ ID NO: 102568 - RNA, 21 nt, Human
aggcaggugugaguugaccac

SEQ ID NO: 102569 - RNA, 23 nt, Human
aggcugcagaagaggcaggugug

SEQ ID NO: 102570 - RNA, 23 nt, Human
auggaggaggagguggggccugg

SEQ ID NO: 102571 - RNA, 20 nt, Human
caccaugucccagaagguca

SEQ ID NO: 102572 - RNA, 22 nt, Human
cagaaggucagggcugagacuc

SEQ ID NO: 102573 - RNA, 18 nt, Human
caggagccacacucccag

SEQ ID NO: 102574 - RNA, 22 nt, Human
cagggcugagacucggaccaga

SEQ ID NO: 102575 - RNA, 22 nt, Human
ccacacaggccuccagcugcac

SEQ ID NO: 102576 - RNA, 18 nt, Human
ccagaggucuagaacaca

SEQ ID NO: 102577 - RNA, 19 nt, Human
ccagcacccgaguccccag

SEQ ID NO: 102578 - RNA, 23 nt, Human
ccagcacccgaguccccaggucc

SEQ ID NO: 102579 - RNA, 25 nt, Human
cccacacaggccuccagcugcaccc

SEQ ID NO: 102580 - RNA, 23 nt, Human
cccacaggagccacacucccagc

SEQ ID NO: 102581 - RNA, 18 nt, Human
ccccacacaggccuccag

SEQ ID NO: 102582 - RNA, 25 nt, Human
ccccacacaggccuccagcugcacc

SEQ ID NO: 102583 - RNA, 22 nt, Human
cccucccccaaccauuuggggc

SEQ ID NO: 102584 - RNA, 18 nt, Human
ccgccgcugccggccgcc

SEQ ID NO: 102585 - RNA, 19 nt, Human
ccucccagggccucccucu

SEQ ID NO: 102586 - RNA, 22 nt, Human
cggcgcacaggcugggcauggg

SEQ ID NO: 102587 - RNA, 21 nt, Human
cucccagcacccgagucccca

SEQ ID NO: 102588 - RNA, 23 nt, Human
cucccugggcccugaugggcagc

SEQ ID NO: 102589 - RNA, 23 nt, Human
cuccugggcccacaggagccaca

SEQ ID NO: 102590 - RNA, 19 nt, Human
cucggaccagaccuccugg

SEQ ID NO: 102591 - RNA, 23 nt, Human
cugggcccacaggagccacacuc

SEQ ID NO: 102592 - RNA, 22 nt, Human
cugggggcucccugggcccuga

SEQ ID NO: 102593 - RNA, 25 nt, Human
cugggggcucccugggcccugaugg

SEQ ID NO: 102594 - RNA, 18 nt, Human
cuguaacccaguggagca

SEQ ID NO: 102595 - RNA, 24 nt, Human
gagcagccaucagagcccagugcu

SEQ ID NO: 102596 - RNA, 19 nt, Human
gagcccagugcuaugggcu

SEQ ID NO: 102597 - RNA, 19 nt, Human
gccacacucccagcacccg

SEQ ID NO: 102598 - RNA, 23 nt, Human
gcccacaggagccacacucccag

SEQ ID NO: 102599 - RNA, 19 nt, Human
gccuggcggggguguagaa

SEQ ID NO: 102600 - RNA, 23 nt, Human
gccuugucuaggccccuccccca

SEQ ID NO: 102601 - RNA, 20 nt, Human
ggagcagccaucagagcccu

SEQ ID NO: 102602 - RNA, 22 nt, Human
ggaggaggagguggggccugga

SEQ ID NO: 102603 - RNA, 22 nt, Human
ggcagguagaggugaggcugca

SEQ ID NO: 102604 - RNA, 21 nt, Human
ggcccugaugggcagccuggc

SEQ ID NO: 102605 - RNA, 19 nt, Human
gggaagggcucagugcccu

SEQ ID NO: 102606 - RNA, 19 nt, Human
ggggcagguagaggugagg

SEQ ID NO: 102607 - RNA, 19 nt, Human
guauccagccugggaaggg

SEQ ID NO: 102608 - RNA, 18 nt, Human
guccccacacaggccucc

SEQ ID NO: 102609 - RNA, 18 nt, Human
uauccagccugggaaggg

SEQ ID NO: 102610 - RNA, 18 nt, Human
uccacccuggacucccuu

SEQ ID NO: 102611 - RNA, 19 nt, Human
uccagccugggaagggcuc

SEQ ID NO: 102612 - RNA, 23 nt, Human
ucccagaaggucagggcugagac

SEQ ID NO: 102613 - RNA, 21 nt, Human
ucccagcacccgaguccccag

SEQ ID NO: 102614 - RNA, 18 nt, Human
ucccugggcccugauggg

SEQ ID NO: 102615 - RNA, 23 nt, Human
ucccugggcccugaugggcagcc

SEQ ID NO: 102616 - RNA, 24 nt, Human
ucccugggcccugaugggcagccu

SEQ ID NO: 102617 - RNA, 25 nt, Human
uccugggcccacaggagccacacuc

SEQ ID NO: 102618 - RNA, 21 nt, Human
ucggaccagaccuccugggcc

SEQ ID NO: 102619 - RNA, 19 nt, Human
ucugcccccuucucuccuc

SEQ ID NO: 102620 - RNA, 23 nt, Human
ucuguaacccaguggagcagcca

SEQ ID NO: 102621 - RNA, 23 nt, Human
ugaccacguuccucccuccucag

SEQ ID NO: 102622 - RNA, 23 nt, Human
ugaugggcagccuggcgggggug

SEQ ID NO: 102623 - RNA, 19 nt, Human
ugaugggggcagguagagg

SEQ ID NO: 102624 - RNA, 21 nt, Human
ugcagaagaggcaggugugag

SEQ ID NO: 102625 - RNA, 18 nt, Human
ugggcccugaugggcagc

SEQ ID NO: 102626 - RNA, 22 nt, Human
ugggcccugaugggcagccugg

SEQ ID NO: 102627 - RNA, 19 nt, Human
uggggccuggagccuuguc

SEQ ID NO: 102628 - RNA, 23 nt, Human
ugguccccacacaggccuccagc

SEQ ID NO: 102629 - RNA, 23 nt, Human
uugaaaagagaagaaaaauuuau

SEQ ID NO: 102630 - RNA, 23 nt, Human
uugugcuuaguauccagccuggg

SEQ ID NO: 102631 - RNA, 21 nt, Human
aauugcucugccgcugcagaa

SEQ ID NO: 102632 - RNA, 26 nt, Human
acaggcuggcgugcggagccccaggc

SEQ ID NO: 102633 - RNA, 19 nt, Human
agacccgcacaggcuggcg

SEQ ID NO: 102634 - RNA, 22 nt, Human
aggcuggcgugcggagccccag

SEQ ID NO: 102635 - RNA, 24 nt, Human
augcugccuggggaccgacgcugg

SEQ ID NO: 102636 - RNA, 20 nt, Human
ccgcuggcuccucgcggcuc

SEQ ID NO: 102637 - RNA, 21 nt, Human
ccucccaccuccuucccacua

SEQ ID NO: 102638 - RNA, 22 nt, Human
ccucccucccucccuuucuucc

SEQ ID NO: 102639 - RNA, 20 nt, Human
ccucccuuucuuccuucuuc

SEQ ID NO: 102640 - RNA, 22 nt, Human
ccuccgaggcggucccucccuc

SEQ ID NO: 102641 - RNA, 20 nt, Human
ccucuggccugccuccuccc

SEQ ID NO: 102642 - RNA, 28 nt, Human
ccugccuccucccucccucccuuucuuc

SEQ ID NO: 102643 - RNA, 22 nt, Human
cgaggggacucgaggagcggcg

SEQ ID NO: 102644 - RNA, 23 nt, Human
cggucccucccucuggccugccu

SEQ ID NO: 102645 - RNA, 20 nt, Human
cucccaccuccuucccacua

SEQ ID NO: 102646 - RNA, 24 nt, Human
cuccucccucccucccuuucuucc

SEQ ID NO: 102647 - RNA, 23 nt, Human
cugaggagucuagcagaguccac

SEQ ID NO: 102648 - RNA, 18 nt, Human
cugcgccccagcccgcgg

SEQ ID NO: 102649 - RNA, 25 nt, Human
cuuucuuccuucuuuccucccaccu

SEQ ID NO: 102650 - RNA, 23 nt, Human
gacgcuggaggcugccggggggc

SEQ ID NO: 102651 - RNA, 28 nt, Human
gcacaggcuggcgugcggagccccaggc

SEQ ID NO: 102652 - RNA, 21 nt, Human
gcacgaagggaaaggggcgag

SEQ ID NO: 102653 - RNA, 20 nt, Human
gcagaguccacgcuccucau

SEQ ID NO: 102654 - RNA, 21 nt, Human
gccccaggccggcggcuuccg

SEQ ID NO: 102655 - RNA, 18 nt, Human
gcuggcuccucgcggcuc

SEQ ID NO: 102656 - RNA, 19 nt, Human
ggaagacccgcacaggcug

SEQ ID NO: 102657 - RNA, 18 nt, Human
ggcgugcggagccccagg

SEQ ID NO: 102658 - RNA, 18 nt, Human
gggaaaggggcgagggga

SEQ ID NO: 102659 - RNA, 18 nt, Human
gggcacgaagggaaaggg

SEQ ID NO: 102660 - RNA, 23 nt, Human
gggcacgaagggaaaggggcgag

SEQ ID NO: 102661 - RNA, 22 nt, Human
uccucccaccuccuucccacua

SEQ ID NO: 102662 - RNA, 19 nt, Human
ucuuccuucuuuccuccca

SEQ ID NO: 102663 - RNA, 24 nt, Human
ugcagaggcggggaagacccgcac

SEQ ID NO: 102664 - RNA, 18 nt, Human
ugccuccucccucccucc

SEQ ID NO: 102665 - RNA, 23 nt, Human
aaaggaaaagaaaaucaagcgau

SEQ ID NO: 102666 - RNA, 20 nt, Human
acacuucuuucugccuccag

SEQ ID NO: 102667 - RNA, 24 nt, Human
acauagacacuucuuucugccucc

SEQ ID NO: 102668 - RNA, 19 nt, Human
accuuuguuucaguugcgu

SEQ ID NO: 102669 - RNA, 18 nt, Human
aguagccucaggugagag

SEQ ID NO: 102670 - RNA, 21 nt, Human
auaaaguuuucuuuuguuaac

SEQ ID NO: 102671 - RNA, 21 nt, Human
augugguguaacaaguuuuac

SEQ ID NO: 102672 - RNA, 19 nt, Human
cagcucuucaccagguucu

SEQ ID NO: 102673 - RNA, 23 nt, Human
ccaccaaaaucauuccauaauuc

SEQ ID NO: 102674 - RNA, 21 nt, Human
ccagaauuuuaacuuauuaac

SEQ ID NO: 102675 - RNA, 21 nt, Human
ccagcucuucaccagguucug

SEQ ID NO: 102676 - RNA, 20 nt, Human
ccucuccauacuuacugccu

SEQ ID NO: 102677 - RNA, 20 nt, Human
cuagaacauacacuaaagua

SEQ ID NO: 102678 - RNA, 23 nt, Human
cucauggugcaugacaacuugcu

SEQ ID NO: 102679 - RNA, 22 nt, Human
cuggugggacagcuugggcuuu

SEQ ID NO: 102680 - RNA, 21 nt, Human
cuuacugccuggugggacagc

SEQ ID NO: 102681 - RNA, 23 nt, Human
gguaagaacuagacauuuauaaa

SEQ ID NO: 102682 - RNA, 18 nt, Human
uauaaaggaaaagaaaau

SEQ ID NO: 102683 - RNA, 19 nt, Human
uauaaaggaaaagaaaauc

SEQ ID NO: 102684 - RNA, 22 nt, Human
ucaccaccaauucuagucaugu

SEQ ID NO: 102685 - RNA, 22 nt, Human
ucaguagccucaggugagagua

SEQ ID NO: 102686 - RNA, 21 nt, Human
uccacacauuagaaccuggau

SEQ ID NO: 102687 - RNA, 19 nt, Human
uccauacuuacugccuggu

SEQ ID NO: 102688 - RNA, 24 nt, Human
ucucauggugcaugacaacuugcu

SEQ ID NO: 102689 - RNA, 31 nt, Human
ugcgaaauagcagcuaugccaugugccugaa

SEQ ID NO: 102690 - RNA, 22 nt, Human
uggaacaguugcugugccaccu

SEQ ID NO: 102691 - RNA, 20 nt, Human
uuacugccuggugggacagc

SEQ ID NO: 102692 - RNA, 20 nt, Human
uuacugccuggugggacagc

SEQ ID NO: 102693 - RNA, 19 nt, Human
uuggaacaguugcugugcc

SEQ ID NO: 102694 - RNA, 24 nt, Human
aaauccacagccccaacccucugg

SEQ ID NO: 102695 - RNA, 20 nt, Human
acacuucuuucugccuccag

SEQ ID NO: 102696 - RNA, 24 nt, Human
acauagacacuucuuucugccucc

SEQ ID NO: 102697 - RNA, 19 nt, Human
accuuuguuucaguugcgu

SEQ ID NO: 102698 - RNA, 19 nt, Human
agcuaaauccacagcccca

SEQ ID NO: 102699 - RNA, 18 nt, Human
aguagccucaggugagag

SEQ ID NO: 102700 - RNA, 21 nt, Human
cagaaagcuuucuuccugccu

SEQ ID NO: 102701 - RNA, 19 nt, Human
cagcucuucaccagguucu

SEQ ID NO: 102702 - RNA, 21 nt, Human
ccagcucuucaccagguucug

SEQ ID NO: 102703 - RNA, 20 nt, Human
ccucuccacacuuacugccu

SEQ ID NO: 102704 - RNA, 23 nt, Human
cucauggugcaugacagcuugcu

SEQ ID NO: 102705 - RNA, 22 nt, Human
cuggugggacagcuugggcuuu

SEQ ID NO: 102706 - RNA, 20 nt, Human
guagcuaaauccacagcccc

SEQ ID NO: 102707 - RNA, 25 nt, Human
uaaauccacagccccaacccucugg

SEQ ID NO: 102708 - RNA, 22 nt, Human
ucaguagccucaggugagagua

SEQ ID NO: 102709 - RNA, 24 nt, Human
ucucauggugcaugacagcuugcu

SEQ ID NO: 102710 - RNA, 18 nt, Human
ucuccacacuuacugccu

SEQ ID NO: 102711 - RNA, 22 nt, Human
ucuccacacuuacugccuggug

SEQ ID NO: 102712 - RNA, 31 nt, Human; identical to SEQ ID NO: 102689

SEQ ID NO: 102713 - RNA, 22 nt, Human
uggaacaguugcugugccaccu

SEQ ID NO: 102714 - RNA, 20 nt, Human
uuacugccuggugggacagc

SEQ ID NO: 102715 - RNA, 20 nt, Human
uuacugccuggugggacagc

SEQ ID NO: 102716 - RNA, 19 nt, Human
uuggaacaguugcugugcc

SEQ ID NO: 102717 - RNA, 24 nt, Human
aaccaauaaaacacaauucuguuu

SEQ ID NO: 102718 - RNA, 21 nt, Human
aagugaaccuaaaaauuacac

SEQ ID NO: 102719 - RNA, 19 nt, Human
acagaaaaccaaaacuguc

SEQ ID NO: 102720 - RNA, 18 nt, Human
agaaaaccaaaacugucu

SEQ ID NO: 102721 - RNA, 24 nt, Human
agaaaaccaaaacugucuauaaag

SEQ ID NO: 102722 - RNA, 21 nt, Human
agaaggaagaaaugaggaaaa

SEQ ID NO: 102723 - RNA, 27 nt, Human
agcuaagucuuuugauuuugaguuucc

SEQ ID NO: 102724 - RNA, 19 nt, Human
agcuacgggugagcuuguu

SEQ ID NO: 102725 - RNA, 20 nt, Human
aucaggggaacuggagccgg

SEQ ID NO: 102726 - RNA, 22 nt, Human
auccaaaaccaauaaaacacaa

SEQ ID NO: 102727 - RNA, 18 nt, Human
caaaaccaauaaaacaca

SEQ ID NO: 102728 - RNA, 23 nt, Human
caggauauuguuugaaacccauu

SEQ ID NO: 102729 - RNA, 20 nt, Human
caguacuagccaaagaaaac

SEQ ID NO: 102730 - RNA, 25 nt, Human
caguacuagccaaagaaaacaaaaa

SEQ ID NO: 102731 - RNA, 23 nt, Human
ccaaaaccaauaaaacacaauuc

SEQ ID NO: 102732 - RNA, 23 nt, Human
ccccuuagauucuguguucuaga

SEQ ID NO: 102733 - RNA, 19 nt, Human
cccgagaugagucucuuca

SEQ ID NO: 102734 - RNA, 21 nt, Human
ccugcuuaguuccccgagaug

SEQ ID NO: 102735 - RNA, 24 nt, Human
cuaagucuuuugauuuugaguuuc

SEQ ID NO: 102736 - RNA, 25 nt, Human
cuaagucuuuugauuuugaguuucc

SEQ ID NO: 102737 - RNA, 20 nt, Human
cugcaaacagaaaaccaaaa

SEQ ID NO: 102738 - RNA, 21 nt, Human
gaaaaacuauuuaaaacccac

SEQ ID NO: 102739 - RNA, 19 nt, Human
gagcuucuaagagcagucu

SEQ ID NO: 102740 - RNA, 23 nt, Human
gaguuuuugcauuuaauagugug

SEQ ID NO: 102741 - RNA, 20 nt, Human
gaucccggugucaccagugg

SEQ ID NO: 102742 - RNA, 18 nt, Human
gcucagcccgaucccggu

SEQ ID NO: 102743 - RNA, 21 nt, Human
ggagaaaaagccaacgccuca

SEQ ID NO: 102744 - RNA, 27 nt, Human
ggaucaggggaacuggagccggugaug

SEQ ID NO: 102745 - RNA, 22 nt, Human
uaaaacccacuaaagacuaacu

SEQ ID NO: 102746 - RNA, 26 nt, Human
uacaguacuagccaaagaaaacaaaa

SEQ ID NO: 102747 - RNA, 19 nt, Human
uagaaauagguccucucuc

SEQ ID NO: 102748 - RNA, 23 nt, Human
uagagacagugguuucuucaugu

SEQ ID NO: 102749 - RNA, 24 nt, Human
uagagacagugguuucuucauguu

SEQ ID NO: 102750 - RNA, 24 nt, Human
uagccaaagaaaacaaaaauuaga

SEQ ID NO: 102751 - RNA, 21 nt, Human
uaguuauuuauuuuaaaguua

SEQ ID NO: 102752 - RNA, 20 nt, Human
uauacaguacuagccaaaga

SEQ ID NO: 102753 - RNA, 20 nt, Human
uaucucagcaugaauccuaa

SEQ ID NO: 102754 - RNA, 19 nt, Human
uauucagugauucacuaau

SEQ ID NO: 102755 - RNA, 23 nt, Human
ucuagaaggaagaaaugaggaaa

SEQ ID NO: 102756 - RNA, 19 nt, Human
ucugcaaacagaaaaccaa

SEQ ID NO: 102757 - RNA, 24 nt, Human
ucuucauguuaacuggguaagaac

SEQ ID NO: 102758 - RNA, 22 nt, Human
ugauucacuaauacugcaaaac

SEQ ID NO: 102759 - RNA, 23 nt, Human
ugcaaacagaaaaccaaaacugu

SEQ ID NO: 102760 - RNA, 22 nt, Human
uggacguauuuuaaaaagaagg

SEQ ID NO: 102761 - RNA, 23 nt, Human
uggagaaaaagccaacgccucac

SEQ ID NO: 102762 - RNA, 22 nt, Human
uggggcagggaggcgaggcugg

SEQ ID NO: 102763 - RNA, 21 nt, Human
uucccgaaucugagguaucug

SEQ ID NO: 102764 - RNA, 23 nt, Human
uucuaagugaaccuaaaaauuac

SEQ ID NO: 102765 - RNA, 22 nt, Human
uugaaaggaguuuuugcauuua

SEQ ID NO: 102766 - RNA, 22 nt, Human
uugcauuuaauagugugccaaa

SEQ ID NO: 102767 - RNA, 19 nt, Human
uuuacaccugcguguauau

SEQ ID NO: 102768 - RNA, 22 nt, Human
uuucagaagggucagaaaaacu

SEQ ID NO: 102769 - RNA, 19 nt, Human
aaaaggagaaaaaucccaa

SEQ ID NO: 102770 - RNA, 22 nt, Human
aaaguuguuucuguccccaccc

SEQ ID NO: 102771 - RNA, 22 nt, Human
aagcuauaaccccucccucuca

SEQ ID NO: 102772 - RNA, 24 nt, Human
aaguaugcacaguccgugucaggg

SEQ ID NO: 102773 - RNA, 26 nt, Human
aaguuguuucuguccccaccccucua

SEQ ID NO: 102774 - RNA, 23 nt, Human
acagcacagcauggaugagggaa

SEQ ID NO: 102775 - RNA, 19 nt, Human
acccugaaagagguaccug

SEQ ID NO: 102776 - RNA, 19 nt, Human
acugcagugagcaggacag

SEQ ID NO: 102777 - RNA, 19 nt, Human
acuuucucucucucgcugu

SEQ ID NO: 102778 - RNA, 25 nt, Human
agaaaacccugaaagagguaccuga

SEQ ID NO: 102779 - RNA, 19 nt, Human
aggcuuuggagaaauagga

SEQ ID NO: 102780 - RNA, 18 nt, Human
aggggaagggaggggaag

SEQ ID NO: 102781 - RNA, 18 nt, Human
agggugagagacuugaaa

SEQ ID NO: 102782 - RNA, 22 nt, Human
agugaaugggggcaaacagaaa

SEQ ID NO: 102783 - RNA, 26 nt, Human
auaaaaccuuucucuuagccccaaag

SEQ ID NO: 102784 - RNA, 20 nt, Human
augaucuuagccaggaaaaa

SEQ ID NO: 102785 - RNA, 19 nt, Human
auuguguuuaucagaagcu

SEQ ID NO: 102786 - RNA, 23 nt, Human
caaagagauuccaucuguguaga

SEQ ID NO: 102787 - RNA, 21 nt, Human
caaggggcauuagcaccagug

SEQ ID NO: 102788 - RNA, 21 nt, Human
cccaccccucuacccuagagg

SEQ ID NO: 102789 - RNA, 20 nt, Human
ccccaccccucuacccuaga

SEQ ID NO: 102790 - RNA, 23 nt, Human
ccugaagcuauaaccccucccuc

SEQ ID NO: 102791 - RNA, 21 nt, Human
ccugacaaagugaaugggggc

SEQ ID NO: 102792 - RNA, 18 nt, Human
ccugaguauagagaacuc

SEQ ID NO: 102793 - RNA, 22 nt, Human
cuacagguagacaacccugaca

SEQ ID NO: 102794 - RNA, 19 nt, Human
cuauaaccccucccucuca

SEQ ID NO: 102795 - RNA, 19 nt, Human
cucaaggaccaaauacacc

SEQ ID NO: 102796 - RNA, 21 nt, Human
cucagcacugccuugaacaga

SEQ ID NO: 102797 - RNA, 22 nt, Human
cuccugaagcuauaaccccucc

SEQ ID NO: 102798 - RNA, 23 nt, Human
cugagggauuucggugguuucuu

SEQ ID NO: 102799 - RNA, 25 nt, Human
cuuucuagcuguaaacaaugccacc

SEQ ID NO: 102800 - RNA, 22 nt, Human
gaagaaaaccuuuucuuauuuu

SEQ ID NO: 102801 - RNA, 20 nt, Human
gaaugucucagagaaaagga

SEQ ID NO: 102802 - RNA, 22 nt, Human
gacaacccugacaguggacaaa

SEQ ID NO: 102803 - RNA, 27 nt, Human
gacaggacugggggugggaaggaauga

SEQ ID NO: 102804 - RNA, 18 nt, Human
gacugggggugggaagga

SEQ ID NO: 102805 - RNA, 19 nt, Human
gagagcuugggcuccagga

SEQ ID NO: 102806 - RNA, 26 nt, Human
gauaggacaggacuggggguggagua

SEQ ID NO: 102807 - RNA, 19 nt, Human
gcaagugauuuuuccuagu

SEQ ID NO: 102808 - RNA, 19 nt, Human
gcacugccuugaacagagc

SEQ ID NO: 102809 - RNA, 22 nt, Human
gcagugaccaggcagccuggag

SEQ ID NO: 102810 - RNA, 20 nt, Human
ggcaaacagaaaaugcacag

SEQ ID NO: 102811 - RNA, 20 nt, Human
ggcauuagcaccagugcagc

SEQ ID NO: 102812 - RNA, 19 nt, Human
gggaaaguaugcacagucc

SEQ ID NO: 102813 - RNA, 22 nt, Human
gggaagggaggggaaguucugg

SEQ ID NO: 102814 - RNA, 23 nt, Human
ggggaagggaggggaaguucugg

SEQ ID NO: 102815 - RNA, 25 nt, Human
uaaaaccuuucucuuagccccaaag

SEQ ID NO: 102816 - RNA, 25 nt, Human
uaauucagacaugaucuuagccagg

SEQ ID NO: 102817 - RNA, 22 nt, Human
uagaagacugggugagaaguac

SEQ ID NO: 102818 - RNA, 23 nt, Human
uagaauaaaaccuuucucuuagc

SEQ ID NO: 102819 - RNA, 24 nt, Human
uaggccuaacaugagaucagguaa

SEQ ID NO: 102820 - RNA, 20 nt, Human
uauaaccccucccucucagc

SEQ ID NO: 102821 - RNA, 19 nt, Human
uauaauccuccuccucaca

SEQ ID NO: 102822 - RNA, 21 nt, Human
uauuuggagccucugacaaaa

SEQ ID NO: 102823 - RNA, 21 nt, Human
ucagcacugcagugagcagga

SEQ ID NO: 102824 - RNA, 23 nt, Human
uccagguugggaaaaggggaagg

SEQ ID NO: 102825 - RNA, 18 nt, Human
ucccaaagucagcuuugc

SEQ ID NO: 102826 - RNA, 21 nt, Human
uccgaauuagagugauaggac

SEQ ID NO: 102827 - RNA, 26 nt, Human
ucgaugucugauauauuauuuuuauu

SEQ ID NO: 102828 - RNA, 24 nt, Human
ucggugguuucuuucaccuaaggc

SEQ ID NO: 102829 - RNA, 21 nt, Human
ugaacagagcccauaaagaua

SEQ ID NO: 102830 - RNA, 19 nt, Human
ugaagggcagcucucugau

SEQ ID NO: 102831 - RNA, 23 nt, Human
ugaaugaagaaaaccuuuucuua

SEQ ID NO: 102832 - RNA, 19 nt, Human
ugacaagaagguuggguuu

SEQ ID NO: 102833 - RNA, 18 nt, Human
ugacaguggacaaaccug

SEQ ID NO: 102834 - RNA, 22 nt, Human
ugaccaggcagccuggagaugc

SEQ ID NO: 102835 - RNA, 21 nt, Human
ugagagacuugaaauacaucg

SEQ ID NO: 102836 - RNA, 22 nt, Human
ugagggauuucggugguuucuu

SEQ ID NO: 102837 - RNA, 24 nt, Human
ugccuuggauuuuggcaagugauu

SEQ ID NO: 102838 - RNA, 18 nt, Human
uggaaugucucagagaaa

SEQ ID NO: 102839 - RNA, 21 nt, Human
uggucugaggugccuagaaac

SEQ ID NO: 102840 - RNA, 20 nt, Human
uguuucuguccccaccccuc

SEQ ID NO: 102841 - RNA, 22 nt, Human
uuagaaaacccugaaagaggua

SEQ ID NO: 102842 - RNA, 22 nt, Human
uuggagccucugacaaaaaaaa

SEQ ID NO: 102843 - RNA, 23 nt, Human
uuuggagaaauaggagaagcauu

SEQ ID NO: 102844 - RNA, 23 nt, Human
uuuucacauaaauaagcaguuac

SEQ ID NO: 102845 - RNA, 19 nt, Human
aagaagcaaaacaacuggu

SEQ ID NO: 102846 - RNA, 19 nt, Human
aagaagcaaaacaacuguc

SEQ ID NO: 102847 - RNA, 22 nt, Human
aauaguuucccaagucuggagc

SEQ ID NO: 102848 - RNA, 19 nt, Human
acuacaggugcgcgccacc

SEQ ID NO: 102849 - RNA, 22 nt, Human
acuacaggugcgcgccaccaag

SEQ ID NO: 102850 - RNA, 18 nt, Human
acuauauuaccauacaau

SEQ ID NO: 102851 - RNA, 24 nt, Human
acuggagugcaguggugcgaucug

SEQ ID NO: 102852 - RNA, 24 nt, Human
agagucuuuucuguaaauauccuu

SEQ ID NO: 102853 - RNA, 18 nt, Human
agaguggauagcuuaaaa

SEQ ID NO: 102854 - RNA, 22 nt, Human
agugcagugguaucagaaacuu

SEQ ID NO: 102855 - RNA, 19 nt, Human
agugcaguggugcgaucug

SEQ ID NO: 102856 - RNA, 24 nt, Human
agugcaguggugcgaucugggcuc

SEQ ID NO: 102857 - RNA, 27 nt, Human
augaaauuaauuauuuucucugcuuga

SEQ ID NO: 102858 - RNA, 18 nt, Human
augggguuucacgauguu

SEQ ID NO: 102859 - RNA, 20 nt, Human
augggguuucacgauguugg

SEQ ID NO: 102860 - RNA, 22 nt, Human
auuuuuguauuuuuaguagaga

SEQ ID NO: 102861 - RNA, 24 nt, Human
auuuuuguauuuuuaguagagaug

SEQ ID NO: 102862 - RNA, 20 nt, Human
caagcgauucuccugccuca

SEQ ID NO: 102863 - RNA, 22 nt, Human
caagcgauucuccugccucagc

SEQ ID NO: 102864 - RNA, 24 nt, Human
caccaagcccagcucauuuuugua

SEQ ID NO: 102865 - RNA, 24 nt, Human
cacgauguuggcuaggauggucuc

SEQ ID NO: 102866 - RNA, 23 nt, Human
cacugcaaucuccaccucccggg

SEQ ID NO: 102867 - RNA, 24 nt, Human
ccaccucccggguucaagcgauuc

SEQ ID NO: 102868 - RNA, 18 nt, Human
ccagacuggagugcagug

SEQ ID NO: 102869 - RNA, 24 nt, Human
cccgaguaacugggacuacaggug

SEQ ID NO: 102870 - RNA, 23 nt, Human
cccggguucaagcgauucuccug

SEQ ID NO: 102871 - RNA, 24 nt, Human
ccucccggguucaagcgauucucc

SEQ ID NO: 102872 - RNA, 19 nt, Human
ccugaaaugaagaaacuac

SEQ ID NO: 102873 - RNA, 24 nt, Human
ccugccucagccucccgaguaacu

SEQ ID NO: 102874 - RNA, 24 nt, Human
cucacugcaaucuccaccucccgg

SEQ ID NO: 102875 - RNA, 24 nt, Human
cugcaaucuccaccucccggguuc

SEQ ID NO: 102876 - RNA, 20 nt, Human
cuugcucuguugccagacug

SEQ ID NO: 102877 - RNA, 20 nt, Human
gagaaaauguaaaugucuca

SEQ ID NO: 102878 - RNA, 24 nt, Human
gaguaacugggacuacaggugcgc

SEQ ID NO: 102879 - RNA, 21 nt, Human
gauucuccugccucagccucc

SEQ ID NO: 102880 - RNA, 24 nt, Human
gcgauucuccugccucagccuccc

SEQ ID NO: 102881 - RNA, 23 nt, Human
gggaaacaagacauuuaaagaau

SEQ ID NO: 102882 - RNA, 19 nt, Human
gggguuucacgauguuggc

SEQ ID NO: 102883 - RNA, 22 nt, Human
ggguuucacgauguuggcuagg

SEQ ID NO: 102884 - RNA, 22 nt, Human
gguaucagaaacuuguauucaa

SEQ ID NO: 102885 - RNA, 18 nt, Human
gucccaugaaauuaauua

SEQ ID NO: 102886 - RNA, 24 nt, Human
gucuugcucuguugccagacugga

SEQ ID NO: 102887 - RNA, 22 nt, Human
uaguagagaugggguuucacga

SEQ ID NO: 102888 - RNA, 24 nt, Human
uaguagagaugggguuucacgaug

SEQ ID NO: 102889 - RNA, 23 nt, Human
uauuuucucugcuugaucuuggu

SEQ ID NO: 102890 - RNA, 23 nt, Human
ucacugcaaucuccaccucccgg

SEQ ID NO: 102891 - RNA, 24 nt, Human
ucacugcaaucuccaccucccggg

SEQ ID NO: 102892 - RNA, 25 nt, Human
ucacugcaaucuccaccucccgggu

SEQ ID NO: 102893 - RNA, 22 nt, Human
ucagagucuucuuuucuuuucu

SEQ ID NO: 102894 - RNA, 24 nt, Human
ucauuuuuguauuuuuaguagaga

SEQ ID NO: 102895 - RNA, 24 nt, Human
ucccgaguaacugggacuacaggu

SEQ ID NO: 102896 - RNA, 21 nt, Human
ucccggguucaagcgauucuc

SEQ ID NO: 102897 - RNA, 24 nt, Human
ucccggguucaagcgauucuccug

SEQ ID NO: 102898 - RNA, 24 nt, Human
ucuccugccucagccucccgagua

SEQ ID NO: 102899 - RNA, 19 nt, Human
ucucugcugucugcucugu

SEQ ID NO: 102900 - RNA, 19 nt, Human
ucugcucuguccuccucug

SEQ ID NO: 102901 - RNA, 24 nt, Human
ucuggucagagucuuuucuguaaa

SEQ ID NO: 102902 - RNA, 23 nt, Human
ucuguugccagacuggagugcag

SEQ ID NO: 102903 - RNA, 21 nt, Human
ucuugcucuguugccagacug

SEQ ID NO: 102904 - RNA, 22 nt, Human
ucuugcucuguugccagacugg

SEQ ID NO: 102905 - RNA, 23 nt, Human
ucuugcucuguugccagacugga

SEQ ID NO: 102906 - RNA, 24 nt, Human
ucuuuucuuuucuuuuugagaugg

SEQ ID NO: 102907 - RNA, 22 nt, Human
ugagauggagucuugcucuguu

SEQ ID NO: 102908 - RNA, 23 nt, Human
ugccagacuggagugcaguggug

SEQ ID NO: 102909 - RNA, 24 nt, Human
ugccucagccucccgaguaacugg

SEQ ID NO: 102910 - RNA, 24 nt, Human
ugcuguaagaguggauagcuuaaa

SEQ ID NO: 102911 - RNA, 20 nt, Human
ugcuuuaaggaagaagcaaa

SEQ ID NO: 102912 - RNA, 23 nt, Human
uggagugcaguggugcgaucugg

SEQ ID NO: 102913 - RNA, 22 nt, Human
uggauagcuuaaaagaaaaaaa

SEQ ID NO: 102914 - RNA, 21 nt, Human
uggcuaggauggucucgaucu

SEQ ID NO: 102915 - RNA, 26 nt, Human
ugggaaacaagacauuuaaagaauca

SEQ ID NO: 102916 - RNA, 22 nt, Human
ugggacuacaggugcgcgccac

SEQ ID NO: 102917 - RNA, 24 nt, Human
ugggacuacaggugcgcgccacca

SEQ ID NO: 102918 - RNA, 24 nt, Human
ugggguuucacgauguuggcuagg

SEQ ID NO: 102919 - RNA, 21 nt, Human
uguauuuuuaguagagauggg

SEQ ID NO: 102920 - RNA, 21 nt, Human
ugucaguuaguucauuaaagu

SEQ ID NO: 102921 - RNA, 19 nt, Human
ugucugcucuguccuccuc

SEQ ID NO: 102922 - RNA, 21 nt, Human
uuaaaguuuuggaaauucuca

SEQ ID NO: 102923 - RNA, 18 nt, Human
uuaguagagaugggguuu

SEQ ID NO: 102924 - RNA, 21 nt, Human
uuaguagagaugggguuucac

SEQ ID NO: 102925 - RNA, 24 nt, Human
uuaguagagaugggguuucacgau

SEQ ID NO: 102926 - RNA, 21 nt, Human
uucaagcgauucuccugccuc

SEQ ID NO: 102927 - RNA, 23 nt, Human
uucaagcgauucuccugccucag

SEQ ID NO: 102928 - RNA, 24 nt, Human
uucaagcgauucuccugccucagc

SEQ ID NO: 102929 - RNA, 21 nt, Human
uugagauggagucuugcucug

SEQ ID NO: 102930 - RNA, 24 nt, Human
uugguggacaguuucaugaagcug

SEQ ID NO: 102931 - RNA, 23 nt, Human
uuguauuuuuaguagagaugggg

SEQ ID NO: 102932 - RNA, 19 nt, Human
uuucacgauguuggcuagg

SEQ ID NO: 102933 - RNA, 24 nt, Human
uuuuuaguagagaugggguuucac

SEQ ID NO: 102934 - RNA, 20 nt, Human
uuuuuguauuuuuaguagag

SEQ ID NO: 102935 - RNA, 24 nt, Human
aaauaucgaaaauacaccagggcu

SEQ ID NO: 102936 - RNA, 19 nt, Human
aagaggcaggcauaagcaa

SEQ ID NO: 102937 - RNA, 23 nt, Human
aagugucagaaacugcacagacu

SEQ ID NO: 102938 - RNA, 18 nt, Human
accaacuaaaauagaaua

SEQ ID NO: 102939 - RNA, 18 nt, Human
acugucucuaguuaggug

SEQ ID NO: 102940 - RNA, 19 nt, Human
agcagaccuuguuuuuagu

SEQ ID NO: 102941 - RNA, 23 nt, Human
agcauuuagcaccacuggcucaa

SEQ ID NO: 102942 - RNA, 19 nt, Human
aggccugaggguuuucccu

SEQ ID NO: 102943 - RNA, 18 nt, Human
aguaugacuauuaggagg

SEQ ID NO: 102944 - RNA, 18 nt, Human
aucuaucuucuuccuuaa

SEQ ID NO: 102945 - RNA, 21 nt, Human
cacuacaccagggaguaugac

SEQ ID NO: 102946 - RNA, 19 nt, Human
caucuugggaaaagcuguc

SEQ ID NO: 102947 - RNA, 20 nt, Human
gaaauaucgaaaauacaccg

SEQ ID NO: 102948 - RNA, 18 nt, Human
gacacauuucucugaguu

SEQ ID NO: 102949 - RNA, 22 nt, Human
gacuacgcaccuuaggcaagau

SEQ ID NO: 102950 - RNA, 20 nt, Human
gaggagcuagaagaauucag

SEQ ID NO: 102951 - RNA, 22 nt, Human
gaggagcuagaagaauucaggg

SEQ ID NO: 102952 - RNA, 26 nt, Human
gauacaaaccaacuaaaauagaauaa

SEQ ID NO: 102953 - RNA, 21 nt, Human
gaugacacauuucucugaguu

SEQ ID NO: 102954 - RNA, 20 nt, Human
gugguuccaugggauaaaau

SEQ ID NO: 102955 - RNA, 19 nt, Human
uaaaacagggagugagaac

SEQ ID NO: 102956 - RNA, 18 nt, Human
uaaaaggggguaagagcc

SEQ ID NO: 102957 - RNA, 18 nt, Human
uacgcaccuuaggcaaga

SEQ ID NO: 102958 - RNA, 19 nt, Human
ucaacaacaagugucagaa

SEQ ID NO: 102959 - RNA, 21 nt, Human
ucauugaguuguccaucucca

SEQ ID NO: 102960 - RNA, 19 nt, Human
uccaccucuuuguagagga

SEQ ID NO: 102961 - RNA, 27 nt, Human
ucucugaguggcacacaccucaggccu

SEQ ID NO: 102962 - RNA, 19 nt, Human
ucucugcugucuucucugu

SEQ ID NO: 102963 - RNA, 21 nt, Human
ugaagucucugaguggcacac

SEQ ID NO: 102964 - RNA, 19 nt, Human
ugaauuaaaacagggagug

SEQ ID NO: 102965 - RNA, 21 nt, Human
ugagagugugaccaaaucuua

SEQ ID NO: 102966 - RNA, 20 nt, Human
ugaguguagccauuuuaacc

SEQ ID NO: 102967 - RNA, 19 nt, Human
ugaugacacauuucucuga

SEQ ID NO: 102968 - RNA, 23 nt, Human
ugcaugcagacauuuaaagcuuu

SEQ ID NO: 102969 - RNA, 21 nt, Human
ugggaaaagcuguccauagug

SEQ ID NO: 102970 - RNA, 21 nt, Human
ugggaaaagcuguccauagug

SEQ ID NO: 102971 - RNA, 23 nt, Human
ugguuccaugggauaaaauggga

SEQ ID NO: 102972 - RNA, 22 nt, Human
ugucagaaacugcacagacucc

SEQ ID NO: 102973 - RNA, 19 nt, Human
ugugaccaaaucuuaaagc

SEQ ID NO: 102974 - RNA, 18 nt, Human
uguguuaaagaugcugcu

SEQ ID NO: 102975 - RNA, 18 nt, Human
uuccaugggauaaaaugg

SEQ ID NO: 102976 - RNA, 18 nt, Human
uuccugaaauaucgaaaa

SEQ ID NO: 102977 - RNA, 19 nt, Human
uuuggaucuaucuucuucc

SEQ ID NO: 102978 - RNA, 21 nt, Human
uuuuuuuuuuuuuuuuuggau

SEQ ID NO: 102979 - RNA, 20 nt, Human
uuuuuuuuuuuuuuuuuugg

SEQ ID NO: 102980 - RNA, 19 nt, Human
aaaacaaaaccaaauaaaa

SEQ ID NO: 102981 - RNA, 18 nt, Human
aaacaaaacaaaaccaaa

SEQ ID NO: 102982 - RNA, 26 nt, Human
aaaccaaacaaaacaaaaccaaauaa

SEQ ID NO: 102983 - RNA, 18 nt, Human
aaagccagccuauagcag

SEQ ID NO: 102984 - RNA, 21 nt, Human
aaauacuagaguugccgggcu

SEQ ID NO: 102985 - RNA, 18 nt, Human
aacuagagaccuccaccu

SEQ ID NO: 102986 - RNA, 22 nt, Human
aagccagccuauagcaggcugg

SEQ ID NO: 102987 - RNA, 22 nt, Human
aaggagaaccccccucaccuca

SEQ ID NO: 102988 - RNA, 20 nt, Human
acaaggcacugcugggcaca

SEQ ID NO: 102989 - RNA, 22 nt, Human
acagccagaucucuaggucucc

SEQ ID NO: 102990 - RNA, 22 nt, Human
accacucccuggguccccgccg

SEQ ID NO: 102991 - RNA, 25 nt, Human
accccccucaccucauugguccccc

SEQ ID NO: 102992 - RNA, 19 nt, Human
agaagccuugugggcagcc

SEQ ID NO: 102993 - RNA, 26 nt, Human
agaggaagggaggggacacgcggagc

SEQ ID NO: 102994 - RNA, 21 nt, Human
agcucccugagccccccuccu

SEQ ID NO: 102995 - RNA, 22 nt, Human
aggaaaccuccaaauaaaauga

SEQ ID NO: 102996 - RNA, 22 nt, Human
aggcaccucccuucccgaccag

SEQ ID NO: 102997 - RNA, 23 nt, Human
aggcaccucccuucccgaccagg

SEQ ID NO: 102998 - RNA, 23 nt, Human
agggaggggacacgcggagcagg

SEQ ID NO: 102999 - RNA, 22 nt, Human
agggcaaaggagaaccccccuc

SEQ ID NO: 103000 - RNA, 21 nt, Human
aguggcccuucaccccccaug

SEQ ID NO: 103001 - RNA, 20 nt, Human
auacauccucagagcugacc

SEQ ID NO: 103002 - RNA, 24 nt, Human
caaaaggaaagagagucucagacc

SEQ ID NO: 103003 - RNA, 23 nt, Human
caaaaguaaucccaaaaccaaaa

SEQ ID NO: 103004 - RNA, 22 nt, Human
caaaggagaaccccccucaccu

SEQ ID NO: 103005 - RNA, 21 nt, Human
caaccuuagguuccaagcccc

SEQ ID NO: 103006 - RNA, 23 nt, Human
caagucccuauguuuccaccccu

SEQ ID NO: 103007 - RNA, 23 nt, Human
cacaaggcacugcugggcacaga

SEQ ID NO: 103008 - RNA, 21 nt, Human
cacagccagaucucuaggucu

SEQ ID NO: 103009 - RNA, 23 nt, Human
cacagccagaucucuaggucucc

SEQ ID NO: 103010 - RNA, 29 nt, Human
cacagccagaucucuaggucucccucucc

SEQ ID NO: 103011 - RNA, 22 nt, Human
cacccggagacccugcucgccc

SEQ ID NO: 103012 - RNA, 22 nt, Human
caccucccuucccgaccaggag

SEQ ID NO: 103013 - RNA, 23 nt, Human
caccuccgggucgcgaauggccc

SEQ ID NO: 103014 - RNA, 22 nt, Human
caccuucauguagaacuaggga

SEQ ID NO: 103015 - RNA, 23 nt, Human
cagacccuucccccagcugccga

SEQ ID NO: 103016 - RNA, 24 nt, Human
cagcugccgacggagagucucauc

SEQ ID NO: 103017 - RNA, 21 nt, Human
caggcguggaggagcggcugg

SEQ ID NO: 103018 - RNA, 22 nt, Human
caucuuagacgcaccaaguccg

SEQ ID NO: 103019 - RNA, 21 nt, Human
ccacccggagacccugcucgc

SEQ ID NO: 103020 - RNA, 23 nt, Human
ccacccggagacccugcucgccc

SEQ ID NO: 103021 - RNA, 21 nt, Human
cccaagaauucuccccuccuc

SEQ ID NO: 103022 - RNA, 23 nt, Human
cccacccggagacccugcucgcc

SEQ ID NO: 103023 - RNA, 21 nt, Human
cccaguggcccuucacccccc

SEQ ID NO: 103024 - RNA, 21 nt, Human
cccaugcccgccccacagcca

SEQ ID NO: 103025 - RNA, 18 nt, Human
ccccaagaauucuccccu

SEQ ID NO: 103026 - RNA, 19 nt, Human
ccccaagaauucuccccuc

SEQ ID NO: 103027 - RNA, 20 nt, Human
ccccaagaauucuccccucc

SEQ ID NO: 103028 - RNA, 18 nt, Human
ccccacagccagaucucu

SEQ ID NO: 103029 - RNA, 18 nt, Human
ccccuuucuaaggacagg

SEQ ID NO: 103030 - RNA, 22 nt, Human
cccuauguuuccaccccuuucu

SEQ ID NO: 103031 - RNA, 23 nt, Human
ccgcgcccgcgcaccuccggguc

SEQ ID NO: 103032 - RNA, 21 nt, Human
ccuaguccuggcucgcacggu

SEQ ID NO: 103033 - RNA, 26 nt, Human
ccuccgggucgcgaauggcccggccc

SEQ ID NO: 103034 - RNA, 22 nt, Human
ccucugggggagaagccuugug

SEQ ID NO: 103035 - RNA, 24 nt, Human
ccucugggggagaagccuuguggg

SEQ ID NO: 103036 - RNA, 21 nt, Human
ccuucccgaccaggagccagg

SEQ ID NO: 103037 - RNA, 22 nt, Human
ccuucccugcucccagccccag

SEQ ID NO: 103038 - RNA, 25 nt, Human
cgagaaaaccaaacaaaacaaaacc

SEQ ID NO: 103039 - RNA, 24 nt, Human
cgucgcgccgcccacccggagacc

SEQ ID NO: 103040 - RNA, 20 nt, Human
cguggaacuagagaccucca

SEQ ID NO: 103041 - RNA, 19 nt, Human
cucaccucauugguccccc

SEQ ID NO: 103042 - RNA, 19 nt, Human
cuccacgggccugcucccc

SEQ ID NO: 103043 - RNA, 25 nt, Human
cuccagccugcgcggggcgucgcgc

SEQ ID NO: 103044 - RNA, 20 nt, Human
cuccuccacgggccugcucc

SEQ ID NO: 103045 - RNA, 21 nt, Human
cucgcagggagaagccaccgc

SEQ ID NO: 103046 - RNA, 20 nt, Human
cuggcccccucaucuuagac

SEQ ID NO: 103047 - RNA, 18 nt, Human
cuggggcuggcgggcuug

SEQ ID NO: 103048 - RNA, 20 nt, Human
gaccuagcuuucuggucuga

SEQ ID NO: 103049 - RNA, 21 nt, Human
gagaaaaccaaacaaaacaaa

SEQ ID NO: 103050 - RNA, 21 nt, Human
gagaagccuugugggcagccc

SEQ ID NO: 103051 - RNA, 19 nt, Human
gagccucggcggccuccag

SEQ ID NO: 103052 - RNA, 22 nt, Human
gcaaugcugaaggcauacagua

SEQ ID NO: 103053 - RNA, 18 nt, Human
gcaccggaaucuccuagu

SEQ ID NO: 103054 - RNA, 18 nt, Human
gcccgccccacagccaga

SEQ ID NO: 103055 - RNA, 23 nt, Human
ggccaggcuuucaggaggcaccg

SEQ ID NO: 103056 - RNA, 22 nt, Human
gggaaagccagccuauagcagg

SEQ ID NO: 103057 - RNA, 19 nt, Human
ggggagaagccuugugggc

SEQ ID NO: 103058 - RNA, 21 nt, Human
gggggucugcuguagccucgg

SEQ ID NO: 103059 - RNA, 19 nt, Human
gucaccuggugaccccauc

SEQ ID NO: 103060 - RNA, 22 nt, Human
gugcggagggaggugggagagg

SEQ ID NO: 103061 - RNA, 21 nt, Human
uagcagagacgguacauucac

SEQ ID NO: 103062 - RNA, 18 nt, Human
uagcuuucuggucugacu

SEQ ID NO: 103063 - RNA, 22 nt, Human
uagguuccaagccccaaguccc

SEQ ID NO: 103064 - RNA, 21 nt, Human
ucaaaaguaaucccaaaacca

SEQ ID NO: 103065 - RNA, 20 nt, Human
ucagcucccugagccccccu

SEQ ID NO: 103066 - RNA, 22 nt, Human
ucccagcucagccccaagaauu

SEQ ID NO: 103067 - RNA, 18 nt, Human
ucccccaggaucaaaagu

SEQ ID NO: 103068 - RNA, 22 nt, Human
uccccgccggaggcuggcccag

SEQ ID NO: 103069 - RNA, 19 nt, Human
ucucagacccuucccccag

SEQ ID NO: 103070 - RNA, 19 nt, Human
ucucccucucccaccaggg

SEQ ID NO: 103071 - RNA, 18 nt, Human
ucucuaggucucccucuc

SEQ ID NO: 103072 - RNA, 22 nt, Human
ugaaggcauacaguacaaacaa

SEQ ID NO: 103073 - RNA, 18 nt, Human
ugccgacggagagucuca

SEQ ID NO: 103074 - RNA, 18 nt, Human
ugccgggcucccagcuca

SEQ ID NO: 103075 - RNA, 23 nt, Human
uggcaaguauccgagaaaaccaa

SEQ ID NO: 103076 - RNA, 21 nt, Human
uggcccagggcggucccacag

SEQ ID NO: 103077 - RNA, 27 nt, Human
uggcccuucaccccccaugcccgcccc

SEQ ID NO: 103078 - RNA, 21 nt, Human
ugggaaagcugagggcaaagg

SEQ ID NO: 103079 - RNA, 25 nt, Human
ugugugcggagggaggugggagagg

SEQ ID NO: 103080 - RNA, 21 nt, Human
uucccuucccugcucccagcc

SEQ ID NO: 103081 - RNA, 27 nt, Human
uucuggucugacucggggaggaaaacc

SEQ ID NO: 103082 - RNA, 25 nt, Human
aaaauaaacacguuuagcuucucuc

SEQ ID NO: 103083 - RNA, 21 nt, Human
acugcagcgggcacccggcgg

SEQ ID NO: 103084 - RNA, 25 nt, Human
agaaaaagcuaccauuacaaaaaua

SEQ ID NO: 103085 - RNA, 19 nt, Human
agucucucccgccccggcc

SEQ ID NO: 103086 - RNA, 24 nt, Human
auaauuuaagggaaaauaaacacc

SEQ ID NO: 103087 - RNA, 19 nt, Human
caagaaacugcagcgggca

SEQ ID NO: 103088 - RNA, 21 nt, Human
caagaaacugcagcgggcacc

SEQ ID NO: 103089 - RNA, 20 nt, Human
caccucgcugggcccagccc

SEQ ID NO: 103090 - RNA, 24 nt, Human
cacguuuagcuucucucgcaguuu

SEQ ID NO: 103091 - RNA, 18 nt, Human
cccaagaaacugcagcgg

SEQ ID NO: 103092 - RNA, 24 nt, Human
cccggcggcucuggcugcgccagg

SEQ ID NO: 103093 - RNA, 27 nt, Human
cuccgggccgucgggucugagguaugg

SEQ ID NO: 103094 - RNA, 18 nt, Human
cucgcugggcccagcccc

SEQ ID NO: 103095 - RNA, 21 nt, Human
gcacccggcggcucuggcugc

SEQ ID NO: 103096 - RNA, 22 nt, Human
guccaggcuguagcuucuuugc

SEQ ID NO: 103097 - RNA, 18 nt, Human
uaaguccaggcuguagcu

SEQ ID NO: 103098 - RNA, 22 nt, Human
uacaauacaaaggguuugucug

SEQ ID NO: 103099 - RNA, 23 nt, Human
uagaaaaagcuaccauuacaaaa

SEQ ID NO: 103100 - RNA, 24 nt, Human
uagaaaaagcuaccauuacaaaaa

SEQ ID NO: 103101 - RNA, 18 nt, Human
uccuaugucccaagaaac

SEQ ID NO: 103102 - RNA, 19 nt, Human
uccuaugucccaagaaacu

SEQ ID NO: 103103 - RNA, 24 nt, Human
uguaaaaauuaauauaaaaaagug

SEQ ID NO: 103104 - RNA, 23 nt, Human
uuuaagggaaaauaaacacguuu

SEQ ID NO: 103105 - RNA, 24 nt, Human
agagcucaagaugggaggggagcc

SEQ ID NO: 103106 - RNA, 20 nt, Human
agcucaagaugggaggggag

SEQ ID NO: 103107 - RNA, 22 nt, Human
aggaagagcucaagaugggagg

SEQ ID NO: 103108 - RNA, 20 nt, Human
gacugcuguuccuuccaucu

SEQ ID NO: 103109 - RNA, 20 nt, Human
ggaugaauaaacucuuugca

SEQ ID NO: 103110 - RNA, 19 nt, Human
uaccaaggcucaugggacg

SEQ ID NO: 103111 - RNA, 20 nt, Human
ugaggcuuuauucaggaaga

SEQ ID NO: 103112 - RNA, 19 nt, Human
ugggaggggagccccuggg

SEQ ID NO: 103113 - RNA, 21 nt, Human
ugggaggggagccccuggggu

SEQ ID NO: 103114 - RNA, 21 nt, Human
ugggaggggagccccuggggu

SEQ ID NO: 103115 - RNA, 23 nt, Human
uuuuagggguaugaggcuuuauu

SEQ ID NO: 103116 - RNA, 20 nt, Human
uuuuuuuuuuagggguauga

SEQ ID NO: 103117 - RNA, 18 nt, Human
uuuuuuuuuuuuaggggu

SEQ ID NO: 103118 - RNA, 21 nt, Human
acaggggcagccucaguguca

SEQ ID NO: 103119 - RNA, 25 nt, Human
agacaucaaaggucgucuuggcgcc

SEQ ID NO: 103120 - RNA, 24 nt, Human
agagcucaagaugggaggggagcc

SEQ ID NO: 103121 - RNA, 19 nt, Human
agaugggaguggccucaga

SEQ ID NO: 103122 - RNA, 20 nt, Human
agcucaagaugggaggggag

SEQ ID NO: 103123 - RNA, 22 nt, Human
aggaagagcucaagaugggagg

SEQ ID NO: 103124 - RNA, 19 nt, Human
aggggcacaggggcauccu

SEQ ID NO: 103125 - RNA, 24 nt, Human
auggagcugcugcccaucuucuug

SEQ ID NO: 103126 - RNA, 20 nt, Human
caaaguccaccacagucuuc

SEQ ID NO: 103127 - RNA, 25 nt, Human
caaaguccaccacagucuucuucuu

SEQ ID NO: 103128 - RNA, 24 nt, Human
caccaggaagaggacaucggucuc

SEQ ID NO: 103129 - RNA, 25 nt, Human
caccaggaagaggacaucggucuca

SEQ ID NO: 103130 - RNA, 20 nt, Human
cacuagaaacuaaugacugc

SEQ ID NO: 103131 - RNA, 18 nt, Human
caggaagagcucaagaug

SEQ ID NO: 103132 - RNA, 20 nt, Human
caggcaugucgaugcuggcg

SEQ ID NO: 103133 - RNA, 21 nt, Human
cauggaacuggccuccugguc

SEQ ID NO: 103134 - RNA, 23 nt, Human
ccacagucuucuucuuauucucc

SEQ ID NO: 103135 - RNA, 18 nt, Human
cccauguugggguccccu

SEQ ID NO: 103136 - RNA, 18 nt, Human
ccccaaagauguacugga

SEQ ID NO: 103137 - RNA, 23 nt, Human
cccggagugggguggcaaagggc

SEQ ID NO: 103138 - RNA, 22 nt, Human
ccucagagucacccguagggua

SEQ ID NO: 103139 - RNA, 24 nt, Human
ccucagagucacuugugaggggca

SEQ ID NO: 103140 - RNA, 23 nt, Human
ccuccgugacuuucuuguugccc

SEQ ID NO: 103141 - RNA, 21 nt, Human
ccugucgggggagaugggagu

SEQ ID NO: 103142 - RNA, 22 nt, Human
cuccagguagccgcuguuuucc

SEQ ID NO: 103143 - RNA, 20 nt, Human
cuccuggucggucacugugg

SEQ ID NO: 103144 - RNA, 19 nt, Human
cucuauggucggcccccac

SEQ ID NO: 103145 - RNA, 23 nt, Human
cucugugcugggcuagggcaauc

SEQ ID NO: 103146 - RNA, 20 nt, Human
cugcagcaucugagcuuccc

SEQ ID NO: 103147 - RNA, 19 nt, Human
cugucuuggggccgguagc

SEQ ID NO: 103148 - RNA, 25 nt, Human
cuuggcauuggcucugugccgguuc

SEQ ID NO: 103149 - RNA, 18 nt, Human
cuuguagaaguccuccuc

SEQ ID NO: 103150 - RNA, 24 nt, Human
gacucggaguugccugucggggga

SEQ ID NO: 103151 - RNA, 25 nt, Human
gagcuuccucggagucaucuguggg

SEQ ID NO: 103152 - RNA, 21 nt, Human
gagugggguggcaaagggcuc

SEQ ID NO: 103153 - RNA, 19 nt, Human
ggagaugggaguggccuca

SEQ ID NO: 103154 - RNA, 21 nt, Human
ggaucucaucucuauggucgg

SEQ ID NO: 103155 - RNA, 23 nt, Human
gggcacgggccucagagucaccc

SEQ ID NO: 103156 - RNA, 20 nt, Human
ggggcauccugagagucacc

SEQ ID NO: 103157 - RNA, 23 nt, Human
gguagacgggcauccgagaggga

SEQ ID NO: 103158 - RNA, 24 nt, Human
gucacccguugcagggacgggggc

SEQ ID NO: 103159 - RNA, 21 nt, Human
gucuucuucuuauucuccucc

SEQ ID NO: 103160 - RNA, 21 nt, Human
uagcccggagugggguggcaa

SEQ ID NO: 103161 - RNA, 21 nt, Human
uagggcaaucucggugggcac

SEQ ID NO: 103162 - RNA, 23 nt, Human
ucacccguugcagggacgggggc

SEQ ID NO: 103163 - RNA, 23 nt, Human
ucacuugugaggggcacaggggc

SEQ ID NO: 103164 - RNA, 23 nt, Human
ucagagucacccguaggguacgg

SEQ ID NO: 103165 - RNA, 25 nt, Human
ucagagucacuugugaggggcacag

SEQ ID NO: 103166 - RNA, 19 nt, Human
uccucggagucaucugugg

SEQ ID NO: 103167 - RNA, 23 nt, Human
ucuauggucggcccccacccauu

SEQ ID NO: 103168 - RNA, 20 nt, Human
ucuccugggauggguccugg

SEQ ID NO: 103169 - RNA, 18 nt, Human
ugacugcagcaucugagc

SEQ ID NO: 103170 - RNA, 20 nt, Human
uggccguccauguuguuggu

SEQ ID NO: 103171 - RNA, 19 nt, Human
ugggaggggagccccuggg

SEQ ID NO: 103172 - RNA, 21 nt, Human
ugggaggggagccccuggggu

SEQ ID NO: 103173 - RNA, 21 nt, Human
ugggaggggagccccuggggu

SEQ ID NO: 103174 - RNA, 23 nt, Human
ugggaggggagccccugggguug

SEQ ID NO: 103175 - RNA, 24 nt, Human
ugggcccaggacucgggaccaaag

SEQ ID NO: 103176 - RNA, 23 nt, Human
ugggguggcaaagggcuccccaa

SEQ ID NO: 103177 - RNA, 20 nt, Human
uggucggcccccacccauuu

SEQ ID NO: 103178 - RNA, 18 nt, Human
ugucuuggggccgguagc

SEQ ID NO: 103179 - RNA, 26 nt, Human
ugucuuggggccgguagcccggagug

SEQ ID NO: 103180 - RNA, 25 nt, Human
uguggccguccauguuguuggugcc

SEQ ID NO: 103181 - RNA, 20 nt, Human
ugugggcagcgccagauagg

SEQ ID NO: 103182 - RNA, 18 nt, Human
ugugggggacacaggggc

SEQ ID NO: 103183 - RNA, 20 nt, Human
ugugggggacacaggggcag

SEQ ID NO: 103184 - RNA, 27 nt, Human
uuagagacuguccugucuuggggccgg

SEQ ID NO: 103185 - RNA, 18 nt, Human
uucuuguugcccuuguug

SEQ ID NO: 103186 - RNA, 20 nt, Human
uugagaccaaggcugauggg

SEQ ID NO: 103187 - RNA, 21 nt, Human
uuucuuguugcccuuguugau

SEQ ID NO: 103188 - RNA, 18 nt, Human
aaaagaaaacugaagaaa

SEQ ID NO: 103189 - RNA, 22 nt, Human
aaccagcaccgcagaaguacaa

SEQ ID NO: 103190 - RNA, 27 nt, Human
aacgccaggggcaaacguuuaaaggga

SEQ ID NO: 103191 - RNA, 21 nt, Human
aagaaaagaaaacugaagaaa

SEQ ID NO: 103192 - RNA, 21 nt, Human
aagaccuuugugucuggauga

SEQ ID NO: 103193 - RNA, 23 nt, Human
aauuuggugaaagacaaaaacug

SEQ ID NO: 103194 - RNA, 18 nt, Human
acaaacgcacacacagcg

SEQ ID NO: 103195 - RNA, 25 nt, Human
acagagccucagggaccagugggaa

SEQ ID NO: 103196 - RNA, 23 nt, Human
acggggagcaggagcaaaggaca

SEQ ID NO: 103197 - RNA, 20 nt, Human
acuccacuucaagggcagug

SEQ ID NO: 103198 - RNA, 19 nt, Human
agaaaaaccagcaccgcag

SEQ ID NO: 103199 - RNA, 18 nt, Human
agaaaagaaaacugaaga

SEQ ID NO: 103200 - RNA, 25 nt, Human
agccggggcagauggcagcagagga

SEQ ID NO: 103201 - RNA, 24 nt, Human
aggagaaagaucagugcaagaaaa

SEQ ID NO: 103202 - RNA, 22 nt, Human
agucacagaaggagaggagaaa

SEQ ID NO: 103203 - RNA, 21 nt, Human
agugcaagaaaagaaaacuga

SEQ ID NO: 103204 - RNA, 24 nt, Human
auagaacaaaaaaauuacaccucu

SEQ ID NO: 103205 - RNA, 21 nt, Human
auggcaaaaaaaaaaaguccu

SEQ ID NO: 103206 - RNA, 22 nt, Human
caaacgcacacacagcgaacac

SEQ ID NO: 103207 - RNA, 18 nt, Human
caaaggacaaagccaucc

SEQ ID NO: 103208 - RNA, 19 nt, Human
caagaaaagaaaacugaag

SEQ ID NO: 103209 - RNA, 19 nt, Human
caagaaaagaaaacugaag

SEQ ID NO: 103210 - RNA, 20 nt, Human
cacagugaccucagcagggc

SEQ ID NO: 103211 - RNA, 22 nt, Human
cacguccguaaaccgucccuuc

SEQ ID NO: 103212 - RNA, 25 nt, Human
cagaggacaaacgcacacacagcga

SEQ ID NO: 103213 - RNA, 22 nt, Human
cagcaagagaucauugcaugga

SEQ ID NO: 103214 - RNA, 22 nt, Human
cagccggggcagauggcagcag

SEQ ID NO: 103215 - RNA, 21 nt, Human
cagcucccgggccaccuggga

SEQ ID NO: 103216 - RNA, 25 nt, Human
cauccccaccugcagcucccgggcc

SEQ ID NO: 103217 - RNA, 21 nt, Human
ccacaccauccucacuuccug

SEQ ID NO: 103218 - RNA, 18 nt, Human
ccaccugcagcucccggg

SEQ ID NO: 103219 - RNA, 27 nt, Human
ccaccugggaggcggugaggggagggg

SEQ ID NO: 103220 - RNA, 19 nt, Human
ccacuccacuucaagggca

SEQ ID NO: 103221 - RNA, 20 nt, Human
ccagccucugggcccagucu

SEQ ID NO: 103222 - RNA, 20 nt, Human
cccacagugaccucagcagg

SEQ ID NO: 103223 - RNA, 19 nt, Human
cccacuccacuucaagggc

SEQ ID NO: 103224 - RNA, 18 nt, Human
cccagggggccggcgggg

SEQ ID NO: 103225 - RNA, 18 nt, Human
cccagucugggguccccu

SEQ ID NO: 103226 - RNA, 21 nt, Human
cccagugguccacgccucccu

SEQ ID NO: 103227 - RNA, 21 nt, Human
ccccacaccucuguccaaauc

SEQ ID NO: 103228 - RNA, 21 nt, Human
cccucugcacaauuggccauu

SEQ ID NO: 103229 - RNA, 20 nt, Human
ccgccacacucugggcccac

SEQ ID NO: 103230 - RNA, 18 nt, Human
ccucgugauguuggcugu

SEQ ID NO: 103231 - RNA, 18 nt, Human
ccugggcauggggagggg

SEQ ID NO: 103232 - RNA, 21 nt, Human
ccuuccacggccacccugggc

SEQ ID NO: 103233 - RNA, 19 nt, Human
cguccguaaaccgucccuu

SEQ ID NO: 103234 - RNA, 25 nt, Human
cucaugccuguggccuuuggcacuu

SEQ ID NO: 103235 - RNA, 18 nt, Human
cuccagaggggagaaccc

SEQ ID NO: 103236 - RNA, 22 nt, Human
cugcagugggcccgaccuuggu

SEQ ID NO: 103237 - RNA, 22 nt, Human
cuggcccagugguccacgccuc

SEQ ID NO: 103238 - RNA, 24 nt, Human
cugguaaggcacauguauaauuca

SEQ ID NO: 103239 - RNA, 19 nt, Human
gaagaguguggcuguggcu

SEQ ID NO: 103240 - RNA, 27 nt, Human
gaccuuggugugaauuuccaaaaacag

SEQ ID NO: 103241 - RNA, 18 nt, Human
gagcaggagcaaaggaca

SEQ ID NO: 103242 - RNA, 20 nt, Human
gaggcggugaggggaggggg

SEQ ID NO: 103243 - RNA, 23 nt, Human
gaggcggugaggggagggggugg

SEQ ID NO: 103244 - RNA, 20 nt, Human
gauaacaaagucagcacgaa

SEQ ID NO: 103245 - RNA, 22 nt, Human
gaucacuuauuugggcaccuga

SEQ ID NO: 103246 - RNA, 22 nt, Human
gcaccugauuugaagaacaaag

SEQ ID NO: 103247 - RNA, 23 nt, Human
gcuaaaaucaaacaugucugaca

SEQ ID NO: 103248 - RNA, 22 nt, Human
ggaaaaaaauagaacaaaaaaa

SEQ ID NO: 103249 - RNA, 22 nt, Human
ggaaggccccacaccucugucc

SEQ ID NO: 103250 - RNA, 19 nt, Human
ggacaaagccauccccacc

SEQ ID NO: 103251 - RNA, 19 nt, Human
ggacccagggggccggcgg

SEQ ID NO: 103252 - RNA, 24 nt, Human
ggaccgcggucuuuggucugugcc

SEQ ID NO: 103253 - RNA, 20 nt, Human
ggcauggggaggggcggggg

SEQ ID NO: 103254 - RNA, 21 nt, Human
ggccccacaccucuguccaaa

SEQ ID NO: 103255 - RNA, 18 nt, Human
gggcaguggccccuuggg

SEQ ID NO: 103256 - RNA, 18 nt, Human
gggcauggggaggggcgg

SEQ ID NO: 103257 - RNA, 19 nt, Human
gggcauggggaggggcggg

SEQ ID NO: 103258 - RNA, 22 nt, Human
gggcauggggaggggcgggggu

SEQ ID NO: 103259 - RNA, 18 nt, Human
gggcccagucuggggucc

SEQ ID NO: 103260 - RNA, 20 nt, Human
gggcccagucuggggucccc

SEQ ID NO: 103261 - RNA, 19 nt, Human
ggggagggcccacaccauc

SEQ ID NO: 103262 - RNA, 21 nt, Human
gggguccccucucaguucugg

SEQ ID NO: 103263 - RNA, 19 nt, Human
gggugccuuugcaaaggac

SEQ ID NO: 103264 - RNA, 21 nt, Human
gguccccucucaguucuggcu

SEQ ID NO: 103265 - RNA, 21 nt, Human
gguggucacagaaugaccagg

SEQ ID NO: 103266 - RNA, 21 nt, Human
gugaauuuccaaaaacaguuu

SEQ ID NO: 103267 - RNA, 18 nt, Human
gugguccacgccucccuc

SEQ ID NO: 103268 - RNA, 18 nt, Human
gugugaauuuccaaaaac

SEQ ID NO: 103269 - RNA, 21 nt, Human
uaacagugcucacauuuucau

SEQ ID NO: 103270 - RNA, 24 nt, Human
uaauaaauacacguucuguuaaaa

SEQ ID NO: 103271 - RNA, 19 nt, Human
uacacguucuguuaaaaac

SEQ ID NO: 103272 - RNA, 20 nt, Human
uacuugauuuucauccuauu

SEQ ID NO: 103273 - RNA, 23 nt, Human
uauacagguugcaccuccucaga

SEQ ID NO: 103274 - RNA, 18 nt, Human
ucacuggagucacagaag

SEQ ID NO: 103275 - RNA, 18 nt, Human
ucagacuccagaggggag

SEQ ID NO: 103276 - RNA, 19 nt, Human
ucauuucauccuccugucc

SEQ ID NO: 103277 - RNA, 23 nt, Human
uccccaccugcagcucccgggcc

SEQ ID NO: 103278 - RNA, 21 nt, Human
ucgggccacgcugugccagcu

SEQ ID NO: 103279 - RNA, 22 nt, Human
ucucauuucauccuccuguccu

SEQ ID NO: 103280 - RNA, 20 nt, Human
ucugggaucucauuucaucc

SEQ ID NO: 103281 - RNA, 18 nt, Human
ucugggcccacuccacuu

SEQ ID NO: 103282 - RNA, 18 nt, Human
ucuucgaaagaccacuca

SEQ ID NO: 103283 - RNA, 21 nt, Human
ugaagaaauaauggcaaaaaa

SEQ ID NO: 103284 - RNA, 23 nt, Human
ugaagaaauaauggcaaaaaaaa

SEQ ID NO: 103285 - RNA, 24 nt, Human
ugaggacucugggaucucauuuca

SEQ ID NO: 103286 - RNA, 18 nt, Human
ugaggggaggggguggug

SEQ ID NO: 103287 - RNA, 19 nt, Human
ugccgcagccugugugggg

SEQ ID NO: 103288 - RNA, 26 nt, Human
ugccuagugcugcacugcccugucuu

SEQ ID NO: 103289 - RNA, 21 nt, Human
ugcuggcccagugguccacgc

SEQ ID NO: 103290 - RNA, 19 nt, Human
uggaaggccccacaccucu

SEQ ID NO: 103291 - RNA, 21 nt, Human
uggcaaaaaaaaaaaguccuc

SEQ ID NO: 103292 - RNA, 18 nt, Human
uggcccagugguccacgc

SEQ ID NO: 103293 - RNA, 19 nt, Human
uggcugagggagcauggga

SEQ ID NO: 103294 - RNA, 20 nt, Human
ugggagaaccaagaccuuug

SEQ ID NO: 103295 - RNA, 19 nt, Human
ugggaggcggugaggggag

SEQ ID NO: 103296 - RNA, 19 nt, Human
ugggcccagucuggggucc

SEQ ID NO: 103297 - RNA, 25 nt, Human
ugguggucacagaaugaccaggugg

SEQ ID NO: 103298 - RNA, 23 nt, Human
uguauaauucauucaggugugag

SEQ ID NO: 103299 - RNA, 25 nt, Human
uguccuggaccauuuucagauacgc

SEQ ID NO: 103300 - RNA, 18 nt, Human
ugucugacaguuccggga

SEQ ID NO: 103301 - RNA, 21 nt, Human
ugucuggaugaucagucgggg

SEQ ID NO: 103302 - RNA, 24 nt, Human
uuaauuuauuguagacucuucuca

SEQ ID NO: 103303 - RNA, 23 nt, Human
uucuagccgcuugguuuuagccc

SEQ ID NO: 103304 - RNA, 22 nt, Human
uugaagaguguggcuguggcuu

SEQ ID NO: 103305 - RNA, 21 nt, Human
uugguuuuagccccacugcug

SEQ ID NO: 103306 - RNA, 26 nt, Human
uuuuagccccacugcugacguauuuc

SEQ ID NO: 103307 - RNA, 20 nt, Human
aaaaagcaaauaaauaaaac

SEQ ID NO: 103308 - RNA, 21 nt, Human
aaaacgcuaccauauuuacag

SEQ ID NO: 103309 - RNA, 24 nt, Human
aaacaacaacaacaaaacgcuacc

SEQ ID NO: 103310 - RNA, 23 nt, Human
aaaggagaggggcuggggcugcc

SEQ ID NO: 103311 - RNA, 23 nt, Human
aacaacaacaacaaaacgcuacc

SEQ ID NO: 103312 - RNA, 22 nt, Human
aagccagggcugcugggaacac

SEQ ID NO: 103313 - RNA, 23 nt, Human
aauugcugaggggagaagacagg

SEQ ID NO: 103314 - RNA, 24 nt, Human
accagaacccagacuugaaaccug

SEQ ID NO: 103315 - RNA, 21 nt, Human
accaguuaaauuuuuaacccu

SEQ ID NO: 103316 - RNA, 19 nt, Human
acccacaucacagcaaaga

SEQ ID NO: 103317 - RNA, 18 nt, Human
acggcagaaaagccagag

SEQ ID NO: 103318 - RNA, 18 nt, Human
agaggggaggagaggugg

SEQ ID NO: 103319 - RNA, 28 nt, Human
agauccuuuuuuaaauucuuuuuuuccu

SEQ ID NO: 103320 - RNA, 21 nt, Human
agcaacaaccaaacuguacaa

SEQ ID NO: 103321 - RNA, 23 nt, Human
agcguauaaaaaaaaugaauccc

SEQ ID NO: 103322 - RNA, 21 nt, Human
aguggacaccagaacccagac

SEQ ID NO: 103323 - RNA, 18 nt, Human
auaaagcacaagacagga

SEQ ID NO: 103324 - RNA, 18 nt, Human
auagaacaugucucagag

SEQ ID NO: 103325 - RNA, 23 nt, Human
augaaaaaacaacaacaacaaaa

SEQ ID NO: 103326 - RNA, 20 nt, Human
augacuggccugcccggggc

SEQ ID NO: 103327 - RNA, 23 nt, Human
caaaaagcaaauaaauaaaacaa

SEQ ID NO: 103328 - RNA, 18 nt, Human
caacaacaaaacgcuacc

SEQ ID NO: 103329 - RNA, 21 nt, Human
caacaacaacaaaacgcuacc

SEQ ID NO: 103330 - RNA, 22 nt, Human
cacaucacagcaaagaagcgca

SEQ ID NO: 103331 - RNA, 19 nt, Human
cacccuuugcccuggcccc

SEQ ID NO: 103332 - RNA, 21 nt, Human
caccggacagggcuuuuccag

SEQ ID NO: 103333 - RNA, 23 nt, Human
cagaacccagacuugaaaccugu

SEQ ID NO: 103334 - RNA, 25 nt, Human
cagcaaagaagcgcaacuuaacaca

SEQ ID NO: 103335 - RNA, 19 nt, Human
cagccgagccagcacugug

SEQ ID NO: 103336 - RNA, 28 nt, Human
caggagcagggcaugaguggcgaacacg

SEQ ID NO: 103337 - RNA, 19 nt, Human
caggccccccaggaguccc

SEQ ID NO: 103338 - RNA, 21 nt, Human
cagugaggggaaugguggggg

SEQ ID NO: 103339 - RNA, 22 nt, Human
cauccugggagguccuauccuc

SEQ ID NO: 103340 - RNA, 21 nt, Human
ccacccacaucacagcaaaga

SEQ ID NO: 103341 - RNA, 25 nt, Human
ccacccacaucacagcaaagaagcg

SEQ ID NO: 103342 - RNA, 26 nt, Human
ccagaacccagacuugaaaccugugc

SEQ ID NO: 103343 - RNA, 20 nt, Human
ccagaggcuggccucacaaa

SEQ ID NO: 103344 - RNA, 20 nt, Human
ccagaggcuggccucacaaa

SEQ ID NO: 103345 - RNA, 23 nt, Human
ccagcucccggccggcggccggg

SEQ ID NO: 103346 - RNA, 21 nt, Human
ccaggagucccucuccuccca

SEQ ID NO: 103347 - RNA, 22 nt, Human
cccaagccagggcugcugggaa

SEQ ID NO: 103348 - RNA, 24 nt, Human
cccacaucacagcaaagaagcgca

SEQ ID NO: 103349 - RNA, 18 nt, Human
ccccacccacaucacagc

SEQ ID NO: 103350 - RNA, 21 nt, Human
ccccacccacaucacagcaaa

SEQ ID NO: 103351 - RNA, 18 nt, Human
ccccaggagucccucucc

SEQ ID NO: 103352 - RNA, 21 nt, Human
cccccaagccagggcugcugg

SEQ ID NO: 103353 - RNA, 19 nt, Human
ccccccaggagucccucuc

SEQ ID NO: 103354 - RNA, 19 nt, Human
cccccgggacuggacacga

SEQ ID NO: 103355 - RNA, 21 nt, Human
cccccgggacuggacacgaag

SEQ ID NO: 103356 - RNA, 19 nt, Human
ccccgccugggggcacagg

SEQ ID NO: 103357 - RNA, 19 nt, Human
cccgcacagaacuaguuua

SEQ ID NO: 103358 - RNA, 19 nt, Human
ccucccccacccacaucac

SEQ ID NO: 103359 - RNA, 19 nt, Human
ccuggggcaaggggaaggg

SEQ ID NO: 103360 - RNA, 20 nt, Human
ccuucugcccccucaccgga

SEQ ID NO: 103361 - RNA, 19 nt, Human
cgccugggggcacaggcuc

SEQ ID NO: 103362 - RNA, 21 nt, Human
cggcagaaaagccagaggcug

SEQ ID NO: 103363 - RNA, 19 nt, Human
cggcuccuccuccggcucc

SEQ ID NO: 103364 - RNA, 22 nt, Human
cgggacuggacacgaacccauc

SEQ ID NO: 103365 - RNA, 23 nt, Human
cggggagaaagaggaacaggacc

SEQ ID NO: 103366 - RNA, 22 nt, Human
cuaccauauuuacagcaacaac

SEQ ID NO: 103367 - RNA, 23 nt, Human
cucacaaaugagaaacaggagcc

SEQ ID NO: 103368 - RNA, 21 nt, Human
cucccccacccacaucacagc

SEQ ID NO: 103369 - RNA, 23 nt, Human
cugauuuuggggggugggguggg

SEQ ID NO: 103370 - RNA, 20 nt, Human
cugcccggggcgcggggcgg

SEQ ID NO: 103371 - RNA, 18 nt, Human
cugcguguggcuuugucc

SEQ ID NO: 103372 - RNA, 24 nt, Human
cuggccucacaaaugagaaacagg

SEQ ID NO: 103373 - RNA, 26 nt, Human
cuuuugggucagcaacugagcaaaca

SEQ ID NO: 103374 - RNA, 21 nt, Human
gaaugguggggggggaguugg

SEQ ID NO: 103375 - RNA, 20 nt, Human
gacagggcuuuuccaguucc

SEQ ID NO: 103376 - RNA, 20 nt, Human
gacccccgggacuggacacg

SEQ ID NO: 103377 - RNA, 19 nt, Human
gacguuucgucgcugcugc

SEQ ID NO: 103378 - RNA, 20 nt, Human
gagcugggguggagucgggg

SEQ ID NO: 103379 - RNA, 22 nt, Human
gauuuugggggguggggugggu

SEQ ID NO: 103380 - RNA, 19 nt, Human
gcaugagugcggcugggga

SEQ ID NO: 103381 - RNA, 20 nt, Human
gccagaguccaggaaaagga

SEQ ID NO: 103382 - RNA, 18 nt, Human
gcccggggcgcggggcgg

SEQ ID NO: 103383 - RNA, 31 nt, Human
gccgggucaacggcggcggcggcuccuccuu

SEQ ID NO: 103384 - RNA, 19 nt, Human
gccugcccggggcgcgggg

SEQ ID NO: 103385 - RNA, 18 nt, Human
gcguguggcuuuguccuu

SEQ ID NO: 103386 - RNA, 19 nt, Human
gcugaggggagaagacagg

SEQ ID NO: 103387 - RNA, 20 nt, Human
gcugaguccuucugcccccu

SEQ ID NO: 103388 - RNA, 21 nt, Human
ggcaggacgagacacacccuu

SEQ ID NO: 103389 - RNA, 22 nt, Human
ggccuggggcaaggggaagggc

SEQ ID NO: 103390 - RNA, 19 nt, Human
ggcgauggggagcggggca

SEQ ID NO: 103391 - RNA, 21 nt, Human
ggcuggggcugcccgaccccc

SEQ ID NO: 103392 - RNA, 24 nt, Human
gggaaugguggggggggaguuggc

SEQ ID NO: 103393 - RNA, 21 nt, Human
gggcaggacgagacacacccu

SEQ ID NO: 103394 - RNA, 22 nt, Human
gggcaggacgagacacacccuu

SEQ ID NO: 103395 - RNA, 18 nt, Human
ggggaauggugggggggg

SEQ ID NO: 103396 - RNA, 23 nt, Human
gggggaguuggcacuagauggcc

SEQ ID NO: 103397 - RNA, 18 nt, Human
gugacucagaugaaaagc

SEQ ID NO: 103398 - RNA, 21 nt, Human
gugcagccugaagggugugaa

SEQ ID NO: 103399 - RNA, 25 nt, Human
uaaaaaaaaugaaucccugaaguca

SEQ ID NO: 103400 - RNA, 24 nt, Human
uagguggggugaguaccccucccg

SEQ ID NO: 103401 - RNA, 21 nt, Human
uauuaacucucucuucacagg

SEQ ID NO: 103402 - RNA, 27 nt, Human
ucaacggcggcggcggcuccuccuccg

SEQ ID NO: 103403 - RNA, 19 nt, Human
ucaagcccccaagccaggg

SEQ ID NO: 103404 - RNA, 18 nt, Human
ucacaaaugagaaacagg

SEQ ID NO: 103405 - RNA, 23 nt, Human
ucagacccccgggacuggacacg

SEQ ID NO: 103406 - RNA, 25 nt, Human
uccaaagugcagugaggggaauggu

SEQ ID NO: 103407 - RNA, 26 nt, Human
uccaggaaaaggagaggggcuggggc

SEQ ID NO: 103408 - RNA, 23 nt, Human
ucccccacccacaucacagcaaa

SEQ ID NO: 103409 - RNA, 21 nt, Human
ucuagccaccugcuccagaag

SEQ ID NO: 103410 - RNA, 19 nt, Human
ugaaaaaacaacaacaaca

SEQ ID NO: 103411 - RNA, 23 nt, Human
ugaaaagcagucggcaaaacuga

SEQ ID NO: 103412 - RNA, 19 nt, Human
ugacucagaugaaaagcag

SEQ ID NO: 103413 - RNA, 23 nt, Human
ugagcaaacaccugggcugcugu

SEQ ID NO: 103414 - RNA, 19 nt, Human
ugaggagaggggaggagag

SEQ ID NO: 103415 - RNA, 18 nt, Human
ugaggggaaugguggggg

SEQ ID NO: 103416 - RNA, 21 nt, Human
ugauggcguaugaggggcagg

SEQ ID NO: 103417 - RNA, 20 nt, Human
ugcagccugaagggugugaa

SEQ ID NO: 103418 - RNA, 24 nt, Human
ugcagugaggggaauggugggggg

SEQ ID NO: 103419 - RNA, 22 nt, Human
ugcccgacccccgccugggggc

SEQ ID NO: 103420 - RNA, 21 nt, Human
ugcccuggccccucaccguuc

SEQ ID NO: 103421 - RNA, 23 nt, Human
uggaguaaauggugacucagaug

SEQ ID NO: 103422 - RNA, 22 nt, Human
ugggaagggaaaggggagucaa

SEQ ID NO: 103423 - RNA, 19 nt, Human
ugggagaggcagugcgggc

SEQ ID NO: 103424 - RNA, 20 nt, Human
ugggggguggggugggugag

SEQ ID NO: 103425 - RNA, 18 nt, Human
ugggguggagucggggag

SEQ ID NO: 103426 - RNA, 25 nt, Human
ugggguggagucggggagaaagagg

SEQ ID NO: 103427 - RNA, 19 nt, Human
uggggugggugaguggaca

SEQ ID NO: 103428 - RNA, 18 nt, Human
ugguggggggggaguugg

SEQ ID NO: 103429 - RNA, 23 nt, Human
ugucucagaggccacagcagguu

SEQ ID NO: 103430 - RNA, 18 nt, Human
uguuggccccaggggucc

SEQ ID NO: 103431 - RNA, 20 nt, Human
uguuuacucuuccuccccca

SEQ ID NO: 103432 - RNA, 26 nt, Human
uuaacacaugacuggccugcccgggg

SEQ ID NO: 103433 - RNA, 20 nt, Human
uuuccugcccacagccucuu

SEQ ID NO: 103434 - RNA, 20 nt, Human
uuucuuuccugcccacagcc

SEQ ID NO: 103435 - RNA, 19 nt, Human
aaaauagcaaaaguaagag

SEQ ID NO: 103436 - RNA, 30 nt, Human
aaacaaaguaaaaacauuuuuugaaucugg

SEQ ID NO: 103437 - RNA, 18 nt, Human
aaagagggccgcugggcu

SEQ ID NO: 103438 - RNA, 22 nt, Human
aaagagggccgcugggcuggag

SEQ ID NO: 103439 - RNA, 22 nt, Human
aaccccagagaggggcaucuac

SEQ ID NO: 103440 - RNA, 21 nt, Human
aaccccccaggagacagaaaa

SEQ ID NO: 103441 - RNA, 21 nt, Human
aagaccaacccccagccccag

SEQ ID NO: 103442 - RNA, 24 nt, Human
aagcccccaugaggaagucagagg

SEQ ID NO: 103443 - RNA, 23 nt, Human
aaugaccccuccaccgacccucu

SEQ ID NO: 103444 - RNA, 21 nt, Human
acauaauaaacacacacaucc

SEQ ID NO: 103445 - RNA, 25 nt, Human
accagcaccccacagcaucaguccu

SEQ ID NO: 103446 - RNA, 25 nt, Human
acccccagccccagaaguuuggccu

SEQ ID NO: 103447 - RNA, 20 nt, Human
accuggggguuagaaaaccc

SEQ ID NO: 103448 - RNA, 18 nt, Human
acgcugcugccgccuccc

SEQ ID NO: 103449 - RNA, 24 nt, Human
agacacccucccacccccagcagg

SEQ ID NO: 103450 - RNA, 23 nt, Human
agacagaaaagcugaaaaauaac

SEQ ID NO: 103451 - RNA, 22 nt, Human
agacaggaaagagggccgcugg

SEQ ID NO: 103452 - RNA, 18 nt, Human
agaccaacccccagcccc

SEQ ID NO: 103453 - RNA, 18 nt, Human
agcaggaggcugccuugg

SEQ ID NO: 103454 - RNA, 22 nt, Human
aggaagucagaggaccccuguu

SEQ ID NO: 103455 - RNA, 22 nt, Human
agggacuccacauaauaaacac

SEQ ID NO: 103456 - RNA, 21 nt, Human
aguggcaccuacauucugggu

SEQ ID NO: 103457 - RNA, 22 nt, Human
auaggaggcaguggcaccuaca

SEQ ID NO: 103458 - RNA, 24 nt, Human
auggagccucagcccugccacacc

SEQ ID NO: 103459 - RNA, 23 nt, Human
caaaguguaaaacucaaaguuuu

SEQ ID NO: 103460 - RNA, 24 nt, Human
caacauggcucccggccgccccga

SEQ ID NO: 103461 - RNA, 19 nt, Human
caagaccaacccccagccc

SEQ ID NO: 103462 - RNA, 20 nt, Human
caagucccucucccacuuuc

SEQ ID NO: 103463 - RNA, 23 nt, Human
caccaggaggggcgguaugagca

SEQ ID NO: 103464 - RNA, 22 nt, Human
caccccccagcccugcacagcc

SEQ ID NO: 103465 - RNA, 23 nt, Human
caccccccagcccugcacagcca

SEQ ID NO: 103466 - RNA, 19 nt, Human
caccgccccccgccccggu

SEQ ID NO: 103467 - RNA, 21 nt, Human
caccgccccccgccccggucc

SEQ ID NO: 103468 - RNA, 20 nt, Human
cacggccuccaccgcccccc

SEQ ID NO: 103469 - RNA, 22 nt, Human
cacucucccccgugguuagagg

SEQ ID NO: 103470 - RNA, 19 nt, Human
cacuuggaaacaaaggaaa

SEQ ID NO: 103471 - RNA, 21 nt, Human
cagcccaggugccuagggcca

SEQ ID NO: 103472 - RNA, 23 nt, Human
cagccucaaaccccccaggagac

SEQ ID NO: 103473 - RNA, 25 nt, Human
cagccucaaaccccccaggagacag

SEQ ID NO: 103474 - RNA, 19 nt, Human
cagcugcuccaccagcacc

SEQ ID NO: 103475 - RNA, 20 nt, Human
cauaguaaagacacccuccc

SEQ ID NO: 103476 - RNA, 21 nt, Human
cauaguaaagacacccuccca

SEQ ID NO: 103477 - RNA, 18 nt, Human
ccaacccccagccccaga

SEQ ID NO: 103478 - RNA, 21 nt, Human
ccaccacuggggagcaggagg

SEQ ID NO: 103479 - RNA, 18 nt, Human
ccaccgccccccgccccg

SEQ ID NO: 103480 - RNA, 20 nt, Human
ccaccgccccccgccccggg

SEQ ID NO: 103481 - RNA, 20 nt, Human
ccacuccuggagucucuccu

SEQ ID NO: 103482 - RNA, 21 nt, Human
ccacuccuggagucucuccug

SEQ ID NO: 103483 - RNA, 18 nt, Human
ccagcccagccucaaacc

SEQ ID NO: 103484 - RNA, 19 nt, Human
cccaccacagcauccccga

SEQ ID NO: 103485 - RNA, 23 nt, Human
cccaccacuggggagcaggaggc

SEQ ID NO: 103486 - RNA, 22 nt, Human
cccacccaucugaguccacccc

SEQ ID NO: 103487 - RNA, 23 nt, Human
cccagcccagccucaaacccccc

SEQ ID NO: 103488 - RNA, 23 nt, Human
cccagccucaaaccccccaggag

SEQ ID NO: 103489 - RNA, 23 nt, Human
cccaugaggaagucagaggaccc

SEQ ID NO: 103490 - RNA, 23 nt, Human
ccccagagaggggcaucuacgaa

SEQ ID NO: 103491 - RNA, 19 nt, Human
ccccagcaggccacucagc

SEQ ID NO: 103492 - RNA, 21 nt, Human
ccccagcccugcacagccacu

SEQ ID NO: 103493 - RNA, 22 nt, Human
cccccagcaggccacucagccc

SEQ ID NO: 103494 - RNA, 22 nt, Human
cccccagccccagaaguuuggc

SEQ ID NO: 103495 - RNA, 23 nt, Human
cccccagccccagaaguuuggcc

SEQ ID NO: 103496 - RNA, 19 nt, Human
ccccccgccccgguccggg

SEQ ID NO: 103497 - RNA, 19 nt, Human
ccccgacgcugcugccgcc

SEQ ID NO: 103498 - RNA, 24 nt, Human
ccccgccccuccgccugucucucc

SEQ ID NO: 103499 - RNA, 26 nt, Human
ccccgccgcccucugggcaccaucua

SEQ ID NO: 103500 - RNA, 19 nt, Human
ccccgggcccccgccccuc

SEQ ID NO: 103501 - RNA, 20 nt, Human
cccucagcuguuccucgucc

SEQ ID NO: 103502 - RNA, 22 nt, Human
cccucccacccccagcaggcca

SEQ ID NO: 103503 - RNA, 21 nt, Human
cccuccggcgugcggcccugg

SEQ ID NO: 103504 - RNA, 23 nt, Human
cccucuaucucccucccccuccc

SEQ ID NO: 103505 - RNA, 25 nt, Human
cccugcacggccuccaccgcccccc

SEQ ID NO: 103506 - RNA, 24 nt, Human
ccgcccccaccacagcauccccga

SEQ ID NO: 103507 - RNA, 20 nt, Human
ccgccccgggcccccgcccc

SEQ ID NO: 103508 - RNA, 18 nt, Human
ccgccucccugcacggcc

SEQ ID NO: 103509 - RNA, 21 nt, Human
ccgccugucucuccgcacccc

SEQ ID NO: 103510 - RNA, 25 nt, Human
ccggcgugcggcccuggcuuuuucc

SEQ ID NO: 103511 - RNA, 20 nt, Human
ccgggccccugccgccgccc

SEQ ID NO: 103512 - RNA, 23 nt, Human
ccgggccccugccgccgccccgg

SEQ ID NO: 103513 - RNA, 18 nt, Human
ccuaccuuucacuuggaa

SEQ ID NO: 103514 - RNA, 22 nt, Human
ccuacucucaaggucuucugga

SEQ ID NO: 103515 - RNA, 21 nt, Human
ccuaggacauaguaaagacac

SEQ ID NO: 103516 - RNA, 20 nt, Human
ccucugggcaccaucuacuc

SEQ ID NO: 103517 - RNA, 24 nt, Human
ccucugggcaccaucuacuccgcg

SEQ ID NO: 103518 - RNA, 23 nt, Human
ccugcagcccaggugccuagggc

SEQ ID NO: 103519 - RNA, 24 nt, Human
ccugcagcccaggugccuagggcc
